United States Patent 9,675,668 (MODIFIED POLYNUCLEOTIDES ENCODING HEPATITIS A VIRUS CELLULAR RECEPTOR 2) - sequence listing, part 14

SEQ ID NO: 27576 - DNA, 822 bp, Artificial Sequence
  Description of Artificial Sequence: Synthetic coding sequence
atgggctctggctgggtcccttgggtggtcgccctactggtgaatctgactaggctggatagctctatgacacaaggcacggactcccctgaggattttgttatccaagctaaggcggattgctatttcacaaacggcacagagaaggtgcagtttgttgtacggttcatattcaatctcgaggagtacgtcagattcgacagtgatgtcgggatgtttgtcgccttgactaaactgggccagcccgacgctgagcagtggaattctaggttagaccttctcgagcgaagtcggcaggccgtggatggtgtatgccggcacaactatagactcggggccccattcacagtcggccggaaagtccagcccgaggtcacagtctaccccgagagaacacctctcctacaccaacataacctcctgcactgtagtgtgacaggcttttatccgggcgacatcaagatcaagtggttcctgaacggccaggaggaacgtgccggcgtaatgtccacggggccaatacgcaatggtgattggacttttcagaccgtcgtgatgctggagatgacccccgagctcggccacgtctacacatgccttgttgaccactcatcattgctgtctcccatcagcgtcgaatggagagcgcagtctgagtatagctggcggaagatgctgagcgggatcgcagcgtttctgctggggttaatctttcttttggtcggcattgtcattcaattaagggctcagaaggggtacgttaggacccagatgagcggcaacgaggtgtctcgcgccgtgttgttgcctcaatcttgttag

SEQ ID NO: 27577 - DNA, 822 bp, Artificial Sequence
  Description of Artificial Sequence: Synthetic coding sequence
atggggtctgggtgggtcccttgggtggtcgctcttcttgtgaatttgacacgcctggatagcagtatgacacaagggaccgatagtcccgaggacttcgtaatccaggccaaagccgactgctacttcactaacgggaccgaaaaggtgcagttcgtagtcaggttcatattcaacctcgaggagtacgtccgttttgacagtgacgtcggcatgttcgttgcccttacaaaacttggccagcctgacgctgaacagtggaactcacgcttggacctgctggagcggtcacgccaggcggtagatggagtgtgcagacacaactatagactcggagccccattcactgtgggcagaaaagttcagcctgaggtgactgtctaccccgaaagaacaccgcttttgcaccagcataatctgctccactgttctgtcacaggcttctaccctggagacatcaagataaagtggtttttgaatggccaggaagaacgcgccggcgtgatgagtaccggcccaattcggaatggagattggacattccagacagtggtaatgctggagatgacaccagaacttggacacgtgtacacctgcttagtggaccacagcagccttcttagcccagtgagcgttgagtggcgcgcccagtctgaatactcttggcgaaagatgctctctggcattgcagcgttcctgctggggctaatctttttattggttggcatagtcattcaattacgggctcaaaaaggttatgttagaactcagatgagcggtaatgaggtgtcccgtgccgtcctcctgcctcaaagttgttag

SEQ ID NO: 27578 - DNA, 549 bp, Artificial Sequence
  Description of Artificial Sequence: Synthetic coding sequence
tgaaacctcactaggctcgattctagtatgacccagggaacagatagccctgaagatttcgtcatccaagccaaagcagattgttactttacaaatggcactgaaaaggttcagttcgtcgtacggtttattttcaacctagaagagtatgtgagattcgattccgatgtggggatgttcgtcgccttaacaaagttaggccaacccgatgcggagcagtggaactcccgcctggatctgctggagcgaagtcggcaggccgttgatggggtctgccgacacaactacagactgggcgccccatttaccgttgggagaaaagaagtgaccgtttaccctgagaggacgccactgctgcaccagcacaaccttctccactgcagtgtgaccggattttatcctggggacataaagattaagtggtttctgaacggacaggaagagcgcgcgggcgtcatgagtaccggacctattagaaacggtgactggacttttcagaccgtggtaatgttggaaatgactcccgagcttgggcatgtctacacttag

SEQ ID NO: 27579 - DNA, 822 bp, Artificial Sequence
  Description of Artificial Sequence: Synthetic coding sequence
atggggtctggatgggtaccctgggtcgttgcgctcctggtgaacctcactcgcctggacagttcgatgacccaaggcacggattcccccgaggatttcgtgatccaagccaaggccgattgttatttcactaatggaacagagaaagtacagtttgttgtgcggttcatctttaatctggaggagtacgtgaggtttgactccgacgtaggcatgttcgtcgcgctgacgaagctcgggcagcccgatgcggaacaatggaattccaggctggacctgcttgaacgctcacgtcaggccgtggatggtgtgtgccggcataactacaggctgggcgctcccttcaccgtcggtaggaaagtccagcccgaagtgaccgtgtacccggaacgtaccccccttctccaccagcacaatctgctgcattgctctgtgaccgggttctacccgggggatatcaaaatcaagtggtttcttaacggccaggaggagagggccggggttatgagtacggggccgatccgaaatggagactggaccttccaaacagtagtgatgctggagatgacaccagagcttggacacgtctacacatgcctggtcgaccacagcagccttttgtcccccgttagcgtggaatggagggcacagtctgaatattcttggagaaagatgctgtcaggaattgccgcttttcttttgggcctaatattcctgctagtggggatcgtcatacagcttcgggctcagaaggggtacgttagaacccagatgagtgggaacgaggtgtccagagctgtgctgctcccacaaagctgctag

SEQ ID NO: 27580 - DNA, 411 bp, Artificial Sequence
  Description of Artificial Sequence: Synthetic coding sequence
atgagctggaaaaaagctctgaggattcccggaggcctgcgagtagctacagtgacacttatgctggctatgcttagtacacccgttgctgaaggccgagacagtccagaggatttcgtgtaccagttcaaaggcatgtgttattttaccaatggcaccgagagagtccgattagtcacacgttatatctataatagagaggaatacgctagattcgattcagacgtgggcgtttaccgggcagttacaccactgggccctcctgacgcagaatattggaattctcagaaagaagtgctcgagaggactagagcagaactggataccgtgtgtagacacaactaccagctggaactgaggactacccttcagcgccgcgggacagtaaccggtccatcgcgaagttggtag

SEQ ID NO: 27581 - DNA, 840 bp, Artificial Sequence
  Description of Artificial Sequence: Synthetic coding sequence
atgtcatggaagatggcactgcagatacccggcggcttttgggctgcagcggtgaccgtcatgctggttatgctgagcacccccgttgcggaggcccgcgattttcccaaggattttctcgtccagttcaagggaatgtgctactttaccaatggaacggagcgggtgcggggcgtggctcggtacatttacaatcgggaggaatacggtcgcttcgactccgatgtgggtgagttccaggccgtcactgaacttggtcgttcaattgaagactggaataactataaggacttcttggaacaagaaagagccgctgttgataaggtgtgtcgacacaactacgaagctgagctgcggaccacattgcagcgtcaagtggagcccaccgttacaatctcaccttcgcgtacagaggccctgaaccatcataacctcctggtgtgctccgtgactgatttctatcctgcccaaatcaaagtgcagtggtttcggaacgaccaggaagagactgctggagttgtatctaccagccttatccgaaatggtgattggacattccagatactggtgatgctcgagatcactccacagaggggagatatttacacttgccaagtggagcaccccagcctgcaatcccccatcacagtcgagtggcgggcccagtcagaaagtgcacagtcgaaaatgctgggtggggttggcgggttcgtgctaggtctgatttttctgggattgggcttaatcattaggcaccggggacagaaggggccgagggggccgcctccagccggaaatatcagtgcaatgatacagagcggcgagcgagctcaagcgtag

SEQ ID NO: 27582 - DNA, 696 bp, Artificial Sequence
  Description of Artificial Sequence: Synthetic coding sequence
atgagttggaagatggcactccagatccctggcggcttttgggccgccgccgttactgttatgctggtcatgctgtccaccccagtggcagaggctagagactttcctaaggactttctggtgcagtttaagggaatgtgttatttcaccaatgggaccgagcgcgtccgaggagtggcacgatacatctacaatagggaagagtatggccgtttcgacagtgatgtgggggagtttcaggccgtaactgaactcggccgcagcatagaggattggaataattacaaggactttctggagcaagagcgagccgccgtggacaaagtgtgtcgccataactacgaagcggaactccgaacaaccctgcagagacaggtagagccaacggtgacgatttccccaagtcggaccgaggccctaaaccatcataacttactagtttgcagcgtcacagacttttacccagcccaaatcaaagtacaatggtttcggaacgatcaggaggagaccgccggagtcgtgagtacgagcctaatccgtaatggcgactggactttccaaatactggtgatgttggagattacgccccagaggggagatatctacacatgccaagtagaacatccctccttacagtccccaattacagtggaatggcgacctcgggggcctcctcctgccggcctgctgcactag

SEQ ID NO: 27583 - DNA, 807 bp, Artificial Sequence
  Description of Artificial Sequence: Synthetic coding sequence
atgagctggaagatggctcttcagattcctggaggcttctgggcagctgcagtcacagtgatgctagttatgctgagcacccccgtcgccgaggcccgtgacttccccaaggattttttggtccagttcaaaggcatgtgctattttactaacggaacagaacgtgtgagaggggtcgctagatacatatacaatagagaggagtatgggcgcttcgactcggacgtgggcgagtttcaggctgtgacagagctggggcggtccatcgaggactggaataattacaaggactttctcgaacaggagcgggccgctgttgacaaagtctgcagacacaactacgaggccgagctgcgtacaaccctccagaggcaggtagaaccgactgtgactattagcccttcacgaactgaggctttgaaccaccacaacctgctggtgtgttccgttacagatttttatcctgcccagataaaggtgcagtggtttcggaatgatcaggaagaaactgccggagttgtgagtacttccctgattagaaatggtgactggacattccaaatcttggtgatgctcgaaataactccccaacgcggcgatatttacacctgccaggtcgagcacccttccctccaaagcccgattactgttgaatggcgcgctcagagcgaatccgcccagagcaaaatgctgggcggcgtgggagggtttgttcttggtctcatctttcttggtttaggactaataatccgccatcgcggccaaaagggaccccgtggaccacctcccgccgggctcctgcactag

SEQ ID NO: 27584 - DNA, 684 bp, Artificial Sequence
  Description of Artificial Sequence: Synthetic coding sequence
atggccctgcaaatccccggtggcttctgggctgcggctgttacagtgatgcttgtgatgttgtcgacgccagtcgccgaggcaagggactttcctaaagacttccttgtacagttcaagggcatgtgctatttcacaaatggtacagagagggtgagaggagtggcacgctatatttacaatcgggaagaatacggacgctttgactctgatgtcggagaatttcaggccgtcacagagttgggcagatccattgaggattggaacaactacaaagattttcttgaacaagagagagctgccgttgacaaagtgtgtcggcataattatgaagccgaactccgaaccaccctgcagcgccaggtcgagccaaccgtgactatttccccctcaaggacagaagctctaaatcaccacaacctcctggtatgttcagtgactgatttttaccccgcccaaatcaaagtcagatggttcagaaatgaccaggaggagaccgccggcgtcgtgtccacctctctaattaggaacggtgactggacttttcagatactagtgatgctggagattactcctcagcgaggggacatttacacatgccaagtggagcatccctctctgcagagccctatcaccgtcgagtggcgtcctaggggaccgccccccgcaggcctgctgcactag

SEQ ID NO: 27585 - DNA, 828 bp, Artificial Sequence
  Description of Artificial Sequence: Synthetic coding sequence
atggcactgcaaattcccggaggattttgggctgccgcagtaacagtcatgctcgtgatgctgtcgacccctgttgcagaggcccgcgattttcctaaggacttcctggttcagttcaaaggaatgtgttacttcaccaacggtacagagcgtgtgcgcggcgttgcccgctacatctataaccgggaagagtacggtagattcgactctgatgtaggtgaattccaggccgttacagagctcggacgctctattgaagattggaataattacaaagattttcttgagcaggaacgggcagccgtggacaaggtctgcagacacaactacgaggccgagctgagaacaacactgcagcgccaggtcgaaccgactgtgacaatctctcccagccgcactgaggctcttaaccatcacaacctcctggtctgctctgtgacagacttttatcccgctcagattaaggtacgttggtttaggaacgaccaggaggaaaccgcaggagtggtgagcacctccctcattcgcaatggtgattggacgttccagatcttggtcatgctggaaatcaccccccaaaggggtgacatctatacgtgtcaagtcgaacatccctccctacagagcccaattaccgttgaatggagagcacagagcgaatcagcgcagtcaaaaatgctttcaggaataggcggtttcgtgcttggcctgatatttctgggactgggcctgattataagacatcgtggtcagaagggtccgaggggcccacccccagcgggaaatattagtgccatgattcagagcggggaacgtgcccaagcatag

SEQ ID NO: 27586 - DNA, 657 bp, Artificial Sequence
  Description of Artificial Sequence: Synthetic coding sequence
tagctccagattcctggcgggttttgggccgccgctgtgactgttatgctggtgatgttgtctacacccgtggcagaggctagagatttcccaaaggatttcctcgtacagttcaaggggatgtgttacttcacaaacggaactgaacgcgtgcgtggggtggcacgctatatctataacagggaagagtatggtcgttttgacagcgacgtgggcgagtttcaggcagtgacagagctgggcagatcgatcgaagattggaataactataaggattttttggagcaggagagagccgcggtggacaaagtatgtaggcataactacgaggccgagctgaggacgacactgcagcggcaagtggaaccaaccgtaactatctccccctcccgaacagaagccctgaaccaccataaccttctggtatgcagcgttacagatttctaccctgcccagattaaagttcagtggttcagaaacgaccaagaggagacagctggggtcgtttccacctcactcatcagaaatggcgattggaccttccagattttggtgatgctcgagatcacacctcagcgcggtgacatctatacttgccaagttgaacatccctcactgcagagtccaataacagttgaatggcgactgttacactag

SEQ ID NO: 27587 - DNA, 696 bp, Artificial Sequence
  Description of Artificial Sequence: Synthetic coding sequence
atgtcttggaaaatggccctgcagatccctgggggcttttgggccgcagctgttacagtgatgctcgtaatgctgagcacacctgtggccgaggctcgcgacttccctaaggacttcctggttcaatttaaaggaatgtgttacttcaccaatggcacagagcgcgttcggggcgtcgctcgatacatttataatcgggaagagtatggccggtttgattcagatgtgggcgagtttcaggccgtcacggaactgggtagaagtatcgaggactggaataattacaaggacttcctcgagcaggagcgcgccgctgtagataaagtatgtaggcacaattacgaagcagagctgcgtactaccctgcagcggcaggtggagcccacagttaccatcagtcctagtcgaactgaggctttaaaccaccataatctgctggtctgctcagtcacagatttttaccctgcgcagattaaggtgcagtggttccggaatgatcaggaagagaccgccggcgtcgtgagcacaagcctgatcaggaatggagattggacctttcagatcctggtcatgttagagattaccccacagcgtggggacatctacacctgccaagtagagcatcccagtttgcagtcaccgatcactgtggagtggaggcctaggggaccaccaccagctggtctcctgcattag

SEQ ID NO: 27588 - DNA, 657 bp, Artificial Sequence
  Description of Artificial Sequence: Synthetic coding sequence
taattacaaattcctggcgggttctgggcagccgctgtgaccgtaatgttagttatgctgagtacccccgttgccgaggctcgcgactttccgaaggacttccttgttcaattcaaggggatgtgttactttacaaacgggacggagcgagttcggggtgtggcccgatacatctacaacagagaggaatacggccgcttcgactcggatgtgggggagtttcaggcggtgaccgagctgggacgttcgatcgaggattggaacaattacaaagatttcctggaacaggaaagagccgcagtggacaaagtgtgtcgtcataactatgaggctgaacttaggactacccttcagagacaggtggaacccactgtgacaatcagcccctcaagaaccgaggcacttaaccaccacaacctcctcgtttgtagtgtgaccgacttctaccccgctcagatcaaggtccgatggttccgtaacgaccaggaggagacagcgggggtggtgagcacctcactcataagaaatggggactggaccttccagatcctagtgatgctggagatcactcctcagaggggagacatctatacctgtcaggtggaacaccctagtttgcagtcgcccatcaccgttgaatggcggttgttacactag

SEQ ID NO: 27589 - DNA, 657 bp, Artificial Sequence
  Description of Artificial Sequence: Synthetic coding sequence
taactgcagattcccgggggcttttgggcagcagccgttaccgtgatgcttgttatgctgtctacccctgtggcggaggcccgagacttccccaaagatttcctcgtccaattcaagggcatgtgctattttacaaatgggacagaacgtgtcagaggggtagcccgatatatttacaacagggaagaatatgggaggtttgattctgatgtaggcgagttccaggccgtgaccgaattgggacggtctattgaagactggaacaactacaaggatttcctcgaacaggaaagggcagccgtggataaagtgtgcagacataactatgaggccgagctgcgaacaactctccagcgacaggtggagccgaccgttaccatttccccatctaggacagaggccttgaatcaccataacctcctagtgtgctctgttaccgacttctacccagcccaaatcaaggtgcagtggttcaggaatgaccaggaggagaccgcaggcgtcgtgtccacatcactcataaggaacggggattggacttttcagatcttagtgatgctcgagatcacccctcagcggggagatatctatacctgtcaggtcgagcacccctcactccagtccccaatcaccgttgagtggcgcctgcttcactag

SEQ ID NO: 27590 - DNA, 840 bp, Artificial Sequence
  Description of Artificial Sequence: Synthetic coding sequence
atgtcttggaagatggccttgcagatccctggcggtttctgggccgccgccgtgacggtgatgctggttatgcttagtacacctgttgcagaagccagggacttccctaaagactttcttgtacagttcaagggtatgtgttacttcaccaacggaactgaacgcgtgcgtggcgtggccaggtatatttacaatcgagaagaatatgggcgcttcgacagcgacgtgggcgagttccaggccgtgaccgaactgggccgctcaattgaggactggaataattacaaggattttttggagcaggagcgggctgccgtggataaggtttgccggcacaattacgaggccgagttaagaaccaccctacagaggcaggtggagcccactgtcaccatttctcctagccggacggaagccctcaatcatcataacctgctggtgtgttcagtgaccgacttctacccagcccagatcaaagtacagtggttccggaatgatcaggaggagacggccggagttgtaagtacaagtctgattagaaacggagactggacattccaaattctggtcatgctggagataacaccccaacggggagatatctacacatgccaggtggaacatcctagcttacagtcccctattaccgtcgagtggcgagcacagagcgaatctgcacagagcaagatgctgggcggcgtgggcggttttgtgctcggtcttatctttctgggcttgggactcattatcagacaccggggccagaaaggtccgcgcgggccacctcctgccggcaatattagcgccatgatacaatctggcgaaagagctcaggcctag

SEQ ID NO: 27591 - DNA, 795 bp, Artificial Sequence
  Description of Artificial Sequence: Synthetic coding sequence
atggcccttcagattcctggaggcttttgggctgccgcggtcacagtgatgctagtcatgctttccaccccagtcgcagaagcgcgcgactttcctaaggactttttggttcaatttaaggggatgtgttattttaccaacggaaccgagcgagtgagaggggttgccaggtatatatacaatcgagaggagtacgggaggtttgacagtgacgttggtgagttccaggctgtgacagagctgggccgttccattgaagattggaacaattacaaagactttctggagcaggaacgtgcagccgtggataaggtgtgtagacacaattacgaggcagaattaaggaccactctgcaaagacaggtggagccgactgtgacgatcagcccttcaagaacggaggccttgaatcatcacaatttgctggtgtgtagtgtcaccgacttctacccagctcaaattaaggtgcgctggttccgtaacgaccaggaggagactgcaggcgttgtgtcaacttctctcattcggaatggagactggacctttcagatcctcgtcatgctggaaatcactccgcaacggggtgacatctatacatgccaggtggagcatccatctctacagtctccgatcacggtggagtggagagcacagtctgagagcgcgcagtccaagatgctctccggcatagggggatttgtgcttggtctgatttttctgggcctaggattgatcattagacacaggggacaaaaagggcccagaggacctcccccagcaggcctactgcattag

SEQ ID NO: 27592 - DNA, 657 bp, Artificial Sequence
  Description of Artificial Sequence: Synthetic coding sequence
tgactacagatcccagggggcttttgggccgccgccgtcacagtcatgctggtgatgctctcaacccctgtggcagaagctcgcgatttccctaaagatttccttgtccagttcaaaggcatgtgctattttaccaatggtacagaacgggtgcgcggagtggccagatatatctacaacagggaagaatatggccgctttgacagcgacgtgggagagttccaggccgtaaccgaactaggaaggtcgattgaggactggaacaattacaaagatttcctggagcaggagagggctgctgtcgacaaagtctgcagacacaattatgaggcagaactgaggacgactctccagagacaagtggaacccaccgtcactatcagtccatcacggactgaagcgctgaatcaccacaaccttcttgtatgttctgtgaccgacttctatccggcacagattaaggtcaggtggttccggaacgaccaggaggagacagccggagtggtgagtacctcgctaatcaggaatggggactggaccttccaaattctggtgatgctcgagatcacaccgcagcggggtgacatctatacctgccaagtcgagcaccccagcctccaatccccaattacagttgaatggcgtcttctccactag

SEQ ID NO: 27593 - DNA, 657 bp, Artificial Sequence
  Description of Artificial Sequence: Synthetic coding sequence
tgactgcagataccgggcggcttttgggcggccgcagtgacagtgatgctcgtcatgctgagcacccccgtggcggaagctcgagatttcccaaaggattttcttgtccagtttaagggaatgtgttattttactaatggaacagaaagggtgcggggtgttgcgagatacatctataatagagaagagtacgggcgcttcgactcagatgtaggcgaattccaggccgtgaccgagctgggtcgctctattgaggactggaacaactataaggactttttagaacaagaacgggccgctgtcgataaggtctgcagacacaactatgaagcagagctcaggaccactctgcaaaggcaggtagagcctaccgtcactatttcaccctcgaggacggaagcgttaaaccaccacaatctcctggtctgttccgtaaccgatttttatcctgcgcaaatcaaggtgcagtggttcagaaacgatcaggaggagacagcaggggtggttagcaccagtctgatccggaatggggactggacattccaaattctcgttatgctcgagatcaccccacagagaggagatatctacacatgtcaggtggaacacccgtctctgcagtcaccgataacggtggaatggaggctcctgcattag

SEQ ID NO: 27594 - DNA, 684 bp, Artificial Sequence
  Description of Artificial Sequence: Synthetic coding sequence
atggccttgcagattccaggcggcttttgggctgcggcggtcaccgtcatgctagtcatgctgagcaccccggtcgcggaagctcgagactttccgaaagactttctggtgcagttcaaaggcatgtgttattttactaacggcacagaacgggttcgcggtgtggcgaggtacatttacaaccgtgaggaatacggacggtttgattccgatgtcggtgagtttcaagccgtgaccgaactgggcaggagcatcgaagactggaataactataaagacttcctggagcaagagagagccgctgttgataaagtgtgcaggcataattacgaggccgagcttaggaccactctgcagaggcaggtggagccaacggttacaatctccccgagcagaacggaggctttgaaccaccacaatctgctagtctgcagtgtcacagatttttaccctgcccaaatcaaggtgcgatggttccgcaacgaccaggaagaaactgcaggcgtcgtgagtacaagtctgattcggaacggtgactggaccttccagatcctggtcatgctcgagatcacgcctcagcgcggggacatttacacctgccaggttgagcatccgagcctgcagtctcccattaccgttgaatggcgcccaagaggcccaccaccggccgggctgttacactag

SEQ ID NO: 27595 - DNA, 657 bp, Artificial Sequence
  Description of Artificial Sequence: Synthetic coding sequence
taacttcagatccccggcgggttttgggccgccgccgtcactgtgatgttagtgatgctaagcacccctgtggcggaggctcgcgattttcctaaggactttttggtgcagttcaaaggcatgtgctacttcactaacggcacggagagagtcaggggggtggcaagatatatttataatcgggaagagtacggacggttcgacagtgatgtaggtgaattccaggcggtaactgaactgggaagatcgatcgaggattggaataattataaagacttcctggagcaagaacgtgcagcagtcgacaaggtatgcaggcacaactacgaggctgagcttcggaccaccctacagcgacaagttgagcccaccgtgactatcagtccatctcggacggaggcactcaaccatcataatttactggtgtgctccgtgactgatttctaccccgctcagatcaaggtgcgctggttcaggaatgatcaggaggagacagcaggcgtcgtctccacctcactcatccgaaacggggactggacatttcagatcctcgtgatgttagagattacccctcagagaggggacatttacacgtgtcaagttgagcacccatctttgcagagtcccatcactgtcgagtggcggctgctgcactag

SEQ ID NO: 27596 - DNA, 696 bp, Artificial Sequence
  Description of Artificial Sequence: Synthetic coding sequence
atgtcttggaagatggccctccagattccaggaggattttgggcagcggctgtcacagttatgctggtcatgctgtccaccccggtagctgaggcgagagactttcctaaggactttctggttcagtttaaaggcatgtgttattttaccaacggcactgaacgggtacggggggtcgcccggtacatatacaatcgggaggagtatggcagattcgacagcgatgtgggcgaatttcaggccgtaaccgaacttgggcggtccattgaagattggaacaattacaaagacttcctggagcaggagagagccgccgtagataaagtgtgccggcacaattatgaagccgagttgagaaccaccctccaaagacaagtggagcccactgtcacaatctcaccaagccggacggaggccttgaatcaccataatctattagtttgctccgtgacagacttctacccagcgcaaatcaaggtgcagtggttcagaaacgaccaggaggagaccgcaggtgttgtcagcaccagtttaatccgcaacggcgattggactttccaaattctggtaatgctcgaaatcacccctcagcgaggcgacatctacacatgtcaagtagaacacccgtcactccagagccccataaccgtggaatggcggccacgaggtccaccgcctgcaggcctgctacattag

SEQ ID NO: 27597 - DNA, 795 bp, Artificial Sequence
  Description of Artificial Sequence: Synthetic coding sequence
atggcgctccagattccgggcggcttttgggccgcggctgtaaccgtcatgctagttatgctatctactccggtcgcagaggcaagagacttccctaaggacttcctggtacagttcaaaggcatgtgctatttcactaacgggacagaaagagtgcggggggtggcccgctatatttataacagggaggagtatggaagatttgactcagatgtgggtgagttccaggcagtcacagagctaggccgttcaatcgaggattggaataactacaaggatttcctcgagcaggaacgggctgctgttgataaagtttgtcgccacaactacgaagccgaattacgcacaaccctgcagcgacaggttgaacccacagtgacgatatctccttcccgcacggaggctctgaaccaccacaatctgttggtttgttcagttaccgacttttacccagcccaaatcaaagttaggtggtttagaaatgatcaggaagagacggccggagtggtgtctaccagcttgattcgaaatggcgactggacttttcagattctcgtcatgctcgaaatcactcctcagagaggtgatatctacacctgtcaggttgagcatccttccctgcagtcgccaatcacggtggagtggcgtgcccagagtgagtctgcccagtcaaaaatgctgtctggcatcgggggctttgtcctcggcctcatctttcttggcctcggcctgatcattagacacagaggccaaaaaggcccaaggggtccaccacccgccggacttctccactag

SEQ ID NO: 27598 - DNA, 795 bp, Artificial Sequence
  Description of Artificial Sequence: Synthetic coding sequence
atggctctgcagataccaggcggattctgggccgcggctgttacggttatgctggtaatgcttagcactcccgttgccgaggcacgtgattttcccaaggactttctggtacagtttaaggggatgtgctattttacaaatggcacagagagagtgcgcggggttgcacggtacatttataaccgcgaggagtacggccgctttgactccgatgtcggagagtttcaagcagtaactgaattaggccgctcaatcgaagactggaataactataaagattttctggaacaggagcgggccgctgttgacaaagtctgccgtcataactacgaggccgagctgcgaacaacgctgcaaaggcaggtcgagccaacggtgaccatttcgccctcccgtacagaggcgctcaatcatcataacctgctcgtatgttctgtaacagatttctatccagcccaaattaaggtgcgatggttccgaaacgaccaagaggaaacagctggtgtcgtgagcacatcacttataaggaacggggactggacattccaaattttagtcatgctggagataactccgcagaggggggatatttacacatgtcaggtggaacacccatccctccagtcccctattaccgtagaatggcgggctcagtctgaatctgctcaaagtaagatgctgtccggtatcggtggcttcgttctcgggttaatttttctgggcctcggcctcattatcaggcaccgcggccagaaaggccctcgagggccaccgcccgcgggtctgctccattag

SEQ ID NO: 27599 - DNA, 807 bp, Artificial Sequence
  Description of Artificial Sequence: Synthetic coding sequence
atgagctggaagatggcactccagattccgggaggattctgggcagccgctgtgactgtcatgctggttatgctgtccactcccgtggcagaggcccgcgattttcccaaagactttctcgtgcagttcaagggtatgtgttacttcaccaacggaacagaacgagttaggggtgttgctaggtacatatacaatcgagaagaatacgggcgtttcgactccgatgtcggggaattccaggctgtaacggagctggggaggtctattgaagattggaataactacaaagatttcctagaacaagagcgtgcagctgtcgataaggtgtgtcgtcataactatgaagccgagctgcgaaccaccctccagcgacaggtagaacccacggttactatctcaccctcaagaaccgaggctttgaaccaccacaacttacttgtatgctcagtcacggatttctatcccgcccagatcaaagtgcagtggtttcggaatgaccaagaggagacagcaggtgtcgtgtccacctcattgattcggaatggcgattggacgtttcaaatactggtgatgttggaaatcactccacagcggggagacatatacacttgtcaggtcgagcatccgagtctgcagagccccatcactgtcgaatggcgcgcgcaatccgagtcagcgcagagtaaaatgctgggcggcgtgggcggcttcgtgctgggtcttatctttctgggattgggcctgattatccgacaccgtgggcaaaagggaccacggggaccccccccggctggtctcctgcactag

SEQ ID NO: 27600 - DNA, 807 bp, Artificial Sequence
  Description of Artificial Sequence: Synthetic coding sequence
atgagctggaagatggcattacagatccctggcgggttttgggctgcggccgtgaccgttatgctggttatgcttagtaccccggtcgcggaggctagagatttccctaaagactttctggtccagtttaaggggatgtgttattttacaaacggcactgaacgggtgcgtggcgtcgcccgctatatttacaaccgagaagagtatggaagatttgatagtgatgtaggagagtttcaggccgtgactgaactggggcgcagcatagaagattggaataactacaaagatttcttagagcaggagagggccgcggtagataaggtatgccggcacaattatgaggccgagcttcggacaaccctccagcgccaggtggaacccactgtgacaattagcccatctaggactgaggcccttaatcatcataatctgctcgtatgttcagtgactgatttttatccagctcagatcaaagtgcagtggttcaggaatgaccaagaggaaaccgccggggtagtgtccacatcactcatccgtaatggcgactggacattccagatcctggtaatgctggagatcacacctcagcgaggggacatctacacatgtcaggtcgaacacccttctctgcagtctccaattacggtagaatggagagctcagtctgagtctgctcagtcgaagatgctgggcggcgtaggggggttcgttctgggccttatcttcctggggctgggcctcattataagacaccgcgggcaaaaaggtcctcgaggcccacctcccgccggactactccattag

SEQ ID NO: 27601 - DNA, 696 bp, Artificial Sequence
  Description of Artificial Sequence: Synthetic coding sequence
atgtcttggaagatggccctccaaatacctggcggtttctgggccgccgcagtcactgtcatgctagttatgctctccactccagtagcggaggctcgggactttccgaaagacttcctggtccagttcaagggaatgtgctactttaccaatgggacagaacgcgtgaggggcgtggcccgctatatttacaaccgagaggagtacgggcgtttcgacagcgatgtgggagaattccaggccgtcacagagctgggacggtcaatcgaggactggaacaactacaaagactttctggaacaagagagagcagctgtagataaggtatgcagacataactatgaggctgaactgaggacaactctgcaaagacaggtggagcccaccgtcaccatctcaccaagccgcaccgaagctctaaatcaccataatctgctggtgtgttccgttactgacttttatcccgcgcagataaaagttcagtggtttagaaacgaccaggaagaaaccgccggggtagtgagcaccagcctcatccggaatggggattggacctttcaaatccttgtaatgcttgagatcacaccccagaggggcgatatctacacttgccaggtggagcacccctccttgcagagtcccatcaccgtggagtggagacccagaggccctcctcctgccgggctgctccattag

SEQ ID NO: 27602 - DNA, 840 bp, Artificial Sequence
  Description of Artificial Sequence: Synthetic coding sequence
atgagctggaagatggccttacaaattcctggaggcttttgggccgccgctgtgaccgtgatgttggtcatgctcagcacacccgttgctgaggcacgggatttccccaaggactttctcgtgcagttcaaggggatgtgctattttacgaatgggacggagcgggttcgcggtgtggcacggtatatatacaaccgtgaagagtacggacgattcgactccgatgtcggcgagtttcaggctgtcactgaactggggcgcagcattgaggattggaacaactacaaagactttctggaacaggagagggcagccgttgataaggtgtgccgacataactatgaggccgagctgagaactacactgcagagacaagtcgagccgacagtgaccatctctcccagcagaactgaagcgctgaaccaccataatctgcttgtgtgcagcgtcacagacttttatcctgcccagatcaaggtccaatggtttcgtaatgatcaggaagagacggccggcgtggtcagcacaagtcttattagaaatggagattggaccttccagatcctggtcatgctagaaatcacaccacagcggggggacatttacacttgtcaggttgagcacccaagtctccagtcgccgattaccgttgaatggcgcgcccagtctgagtctgcccagtctaagatgttagggggcgtgggcggattcgtgcttggcctcatcttcctcggcttgggcctcatcatcaggcaccggggacagaagggcccccggggaccaccacctgccggtaacatctcagccatgatccagtctggggaacgggcccaggcttag

SEQ ID NO: 27603 - DNA, 657 bp, Artificial Sequence
  Description of Artificial Sequence: Synthetic coding sequence
taactgcaaatcccgggcggattctgggccgcagcagtgaccgtcatgctggtgatgttaagtacccccgttgccgaggcccgggattttccgaaagactttctggtgcagttcaaaggcatgtgttactttacaaacgggaccgaacgggtccggggcgtggcaaggtacatatacaatcgcgaggagtatggccggttcgattccgacgtaggcgaatttcaggccgtaaccgaactgggccggtccatagaggactggaacaactataaggacttcttagaacaggagcgcgccgccgttgataaggtatgtagacataactatgaagctgagttgagaacgacactacaaaggcaagtggaacctaccgttactattagcccctccaggaccgaagctttgaaccaccataatctcttagtttgctccgtgactgatttttacccggctcagatcaaggtgcgatggttcagaaatgaccaggaggagacagctggagtggtgtccacctcactgatccgaaacggtgactggaccttccagattctcgtgatgctagaaataacccctcaacgtggggacatctatacctgtcaggttgagcatccgagcctgcagtcgcccataaccgtggagtggcgactattgcactag

SEQ ID NO: 27604 - DNA, 828 bp, Artificial Sequence
  Description of Artificial Sequence: Synthetic coding sequence
atggctttacagatccccggcgggttctgggccgccgcagtaacagtgatgctcgtaatgctaagtactcctgttgccgaggctcgcgatttccccaaggattttcttgttcagtttaaagggatgtgctatttcacaaatggaacagagcgggtaagaggcgtcgctcgttacatttataatagggaggagtacgggaggtttgacagcgacgttggcgagtttcaagccgtcaccgagttgggacgtagcatcgaggattggaataattacaaggactttctcgaacaggaaagagccgcggtcgataaagtgtgccgtcacaattacgaggcggaactgagaacaacactgcagcgtcaggttgaaccaacagtcacaatatccccttctagaaccgaagccctcaatcatcataacctgctcgtgtgctccgtgactgacttttatccggcacagattaaagtgaggtggtttaggaacgatcaggaggaaaccgccggcgtggtgtcaacctctctgatcaggaacggcgattggaccttccagatattagtgatgctggagatcactccacagcgcggggatatttacacctgtcaggtggaacatccttctcttcagtccccgatcaccgtcgaatggagggcacagtctgagagcgcacagtcaaagatgctgtctggcattggagggttcgttctgggcctgatttttcttgggctgggtctgattatcaggcaccgaggccagaaaggacctagggggcccccccctgcgggtaacatctccgccatgattcagtcgggggagagggcccaggcatag

SEQ ID NO: 27605 - DNA, 795 bp, Artificial Sequence
  Description of Artificial Sequence: Synthetic coding sequence
atggctctccagatccctgggggtttttgggccgcggcagtcaccgtgatgctggtcatgctatccacacccgtcgctgaggcccgcgatttccctaaggactttctggtacagtttaagggaatgtgttactttacgaacggaacggaacgggtgcgaggagtcgcccggtatatttataaccgcgaggaatatggtcgatttgacagcgatgttggcgagttccaggccgtaaccgaactcggtcgcagcattgaggattggaacaactataaagacttcctcgaacaagaacgggccgctgttgataaggtctgcagacataactacgaggctgaactgcgcaccactctccagcgccaggtggaacccactgttacgatcagccctagtcgcaccgaagctttgaatcaccacaacctactggtgtgctctgtgaccgatttttaccctgcacaaatcaaggtccggtggtttcggaatgaccaggaagagactgccggcgtggtaagcacatctcttataagaaacggggactggacctttcaaatcctcgtaatgctggagataaccccacagcggggggatatctacacgtgccaagtcgagcacccctccctgcagagccctataaccgtggaatggcgggcccaaagcgaatctgcgcagagcaagatgctctccggcatcgggggattcgttctcggactaatcttccttggattgggcctcataatacggcaccgtggtcagaaggggcctcggggaccaccccctgctggcctcctccattag

SEQ ID NO: 27606 - DNA, 684 bp, Artificial Sequence
  Description of Artificial Sequence: Synthetic coding sequence
atggctctgcaaatcccaggcggattttgggcagcggcagtgacagtgatgctggttatgctgagcacacctgtggccgaggctcgcgattttccgaaggacttcctcgtacagttcaaagggatgtgttactttacaaatggcactgaaagagtcaggggcgtggcccgctatatatacaatcgggaagagtatggaaggttcgactcagatgtgggcgagtttcaagccgtgacagagctgggccggtctattgaggattggaacaactataaagattttcttgaacaggaaagagcagccgtggataaggtgtgccggcacaattatgaagcggagctacgtacaactctgcagagacaggtagaacctacagtgaccatatctccttcgagaaccgaggctctcaaccaccataatctcctggtgtgtagcgttacagacttctatcccgcgcagattaaggtccgttggttcaggaacgatcaggaagagacagctggtgtggtgtccaccagcctcatcagaaatggcgattggacttttcaaatcctcgtgatgctcgaaattactcctcagagaggagatatttatacatgccaggtggaacacccttcactccaaagcccaatcacagtggaatggcgccctcgcggccctcccccggccggactgctacattag

SEQ ID NO: 27607 - DNA, 840 bp, Artificial Sequence
  Description of Artificial Sequence: Synthetic coding sequence
atgtcctggaagatggccctgcagatacccggaggcttttgggcagcggccgtgactgtgatgctcgtgatgctatctacccccgtggccgaggcgcgcgacttcccgaaggactttctcgtccagttcaagggcatgtgttatttcaccaatggcactgaacgagtgagaggcgtggctaggtatatctacaatcgggaagagtacggccggtttgacagtgacgtaggggagttccaggcagtgaccgagctcggccgttccatagaggactggaataattataaggattttctggaacaagaaagggctgctgtcgacaaagtttgcaggcacaactacgaggctgagctgcgaactaccctgcaaagacaggtcgagcctactgtcactataagccctagtcgcactgaggccttgaatcatcacaatttgctagtgtgtagcgtgactgacttttaccctgcccagatcaaagtgcaatggttccgaaacgatcaagaggagacggcaggggtagtcagcacaagcctcattaggaatggggactggacatttcagatcttggtcatgctggagattaccccacagcggggcgatatatacacctgccaggtagagcatccttccttgcaatctccgatcaccgttgagtggagagcccagagcgagtctgcacagtcaaaaatgctgggaggcgtgggcggcttcgtattaggactgatcttcctggggctgggactgatcatccgccaccgcgggcaaaagggtccacgggggcctcccccagcaggaaatatctccgctatgatccaatctggtgagcgggctcaagcctag

SEQ ID NO: 27608 - DNA, 828 bp, Artificial Sequence
  Description of Artificial Sequence: Synthetic coding sequence
atggctctccaaatccccggaggcttctgggccgccgccgtgactgtgatgctggtcatgttgtccacccccgtggctgaagctcgggactttccaaaagacttcttggttcagttcaagggcatgtgctacttcactaacgggaccgagagagttaggggcgtcgccaggtacatctacaatcgggaggaatacggccgattcgattctgacgttggcgaatttcaggcagtaacagagcttgggagaagcattgaagactggaacaattacaaagactttctggagcaagagcgagcagctgtcgacaaggtgtgtcggcacaactatgaggccgagctgagaacaacattacagagacaggtcgaaccgactgtgaccataagccccagtagaaccgaggcactgaaccaccacaatctgctggtgtgctcagtcaccgacttctaccctgcccagattaaggtgagatggtttcgtaacgaccaggaagagactgctggggtcgtttcaacttcgttgatccgaaatggggattggacattccagatccttgtgatgctcgaaattacgcctcagagaggggatatctacacatgccaggttgaacatccgagtctgcagagtcctatcacagtcgagtggcgggcacagtccgaaagtgcacaatctaaaatgctctctggaataggggggttcgtactggggttgatcttcctgggtctaggcttaatcatccgccatcgtggacagaagggcccccgcggaccccctcctgccggcaacatcagtgctatgatacagagcggtgagcgggctcaggcatag

SEQ ID NO: 27609 - DNA, 657 bp, Artificial Sequence
  Description of Artificial Sequence: Synthetic coding sequence
tgactgcagatccctgggggcttctgggctgcagccgtgactgtaatgcttgtgatgctcagcacccccgtagcggaagcccgcgacttcccgaaggactttctggtacagtttaaggggatgtgttacttcaccaatggaactgagagggtgcggggtgttgcaagatatatctacaacagagaagagtacggacgctttgattccgatgtgggagagttccaggcagtgacagaattggggcgctctatcgaggattggaacaattataaagactttctagagcaggaacgcgccgccgtggataaagtctgcaggcataactatgaagccgagctcaggactactttacaacgtcaagtagagcccaccgtcaccatctcacctagcaggaccgaggctctgaaccaccacaacttactggtctgtagcgttaccgatttttatccagcccagataaaggtccagtggttccgtaacgaccaggaggagaccgcgggcgtggtctcaacatctctgatccgtaatggtgattggacattccagatactggtgatgctggagattactccacaacgaggggacatctatacctgtcaagtggaacacccttctcttcagtctccaattacggtagagtggcggctgttgcactag

SEQ ID NO: 27610 - DNA, 828 bp, Artificial Sequence
  Description of Artificial Sequence: Synthetic coding sequence
atggcccttcagatacccggcgggttctgggctgcagccgttaccgtgatgctagtaatgctgagcactcccgtggcagaagctcgagacttccccaaagatttcctcgtccagtttaagggaatgtgttactttacaaacggcacagagagggtgagaggcgttgcacgctatatatacaatagggaggaatatggtcgcttcgactccgatgtgggcgagtttcaggcggttacggaactcggcaggtccatagaggattggaataactacaaagacttcctggaacaggaaagagcagcagtggacaaggtttgcagacacaactatgaggctgagctgaggaccactctgcagcgacaggttgagcccactgtaaccatttctccttcacgaaccgaagcactcaaccatcacaaccttctggtgtgctcagtgacggatttctaccccgcccagatcaaggtaaggtggttccggaatgaccaggaggagacagcgggagtagtgtcaacctccctcatccgcaatggagattggacattccagatcttggtaatgctagagattactcctcagaggggggacatctatacttgccaagtggagcaccccagcctccagtctcccatcaccgttgaatggcgagctcagagtgaatccgcccagagcaagatgctgtccggaatcggtggctttgtgcttgggctgatcttcctgggcctcggcctgattattcgacacaggggccaaaaggggccacgggggcctccccctgccggcaatatatccgctatgatccaaagcggggaacgagcacaagcctag

SEQ ID NO: 27611 - DNA, 684 bp, Artificial Sequence
  Description of Artificial Sequence: Synthetic coding sequence
atggctctccagatacctggtggattctgggctgcagccgtcacagttatgctggttatgttaagcaccccagttgctgaagcaagggactttccaaaagactttctcgtccagttcaaaggcatgtgctactttacaaatggaaccgagagagttcgtggggttgctcgctatatctataacagagaagagtacggtagatttgacagtgatgtaggcgaatttcaggccgtaacagagctcggcaggagcatcgaggattggaacaactataaagatttccttgaacaggagcgcgcagccgtcgataaggtctgcaggcacaactatgaagcggaattgcgcacgacccttcagcgccaggtggagcccacggtcacaatcagtccttcacgcacagaggcgttaaatcaccataacctcttggtgtgttctgtgacagacttctatcctgctcagataaaggtaagatggtttaggaacgatcaggaagaaacagcgggtgtcgtcagcacatccctgatcagaaacggagattggaccttccaaatccttgtcatgctggaaatcacgccacagcgcggcgacatttacacatgtcaggtggagcaccctagcttgcagtctcccatcaccgtcgagtggaggcctcgggggccccctccagccggcctgctgcactag

SEQ ID NO: 27612 - DNA, 807 bp, Artificial Sequence
  Description of Artificial Sequence: Synthetic coding sequence
atgtcatggaaaatggcgctgcaaattccgggcggtttctgggctgctgctgtgactgtgatgcttgtgatgctctccaccccagtcgccgaagcaagagatttccccaaggactttctcgttcaattcaagggaatgtgctatttcacaaacggaaccgagagagttaggggcgtggccaggtacatctacaaccgggaggagtacggaagattcgatagtgatgtgggagagttccaggcagtgaccgagctgggccgatctatagaagactggaacaactacaaggacttcctcgagcaggagcgcgcagccgtggataaggtctgcagacataattacgaggccgaactgagaacgactctgcagagacaggtggagccgactgtgactattagtccatctaggaccgaggctttgaaccatcataatctgctggtgtgttcagtgacagacttttaccctgcccagatcaaggttcagtggtttcgtaacgaccaagaggagactgctggtgttgttagtacttccctgattaggaatggcgactggacctttcagatccttgtgatgctggagattactcctcagcgtggcgacatatatacctgtcaggtcgaacacccaagcttacagtctcccattacagtcgaatggcgagcgcaatcagagtctgcccagtcaaagatgttgggaggtgttggaggatttgtgctgggtctaatcttcctcgggttgggcttaattattcgtcacagaggtcaaaaaggtccaagaggtccaccccccgccggactactgcattag

SEQ ID NO: 27613 - DNA, 627 bp, Artificial Sequence
  Description of Artificial Sequence: Synthetic coding sequence
atgctgtctacccctgtagctgaggcccgggattttcctaaggactttctggtgcagtttaaaggcatgtgctattttaccaatgggactgagagggtccgcggggtagccagatatatctataacagggaagaatatggaaggttcgactctgacgtgggcgagttccaggctgtgaccgagctaggacgctcaatcgaggattggaataactataaagattttttggagcaggagcgcgccgccgtggacaaggtctgccgccataactacgaggctgaactccggactacccttcagcgacaagtggagcctactgttacaatcagcccgagccgtaccgaagccctgaatcaccacaatctgttagtgtgttccgttacagacttttatcccgcccagataaaagtgcaatggtttcgcaacgatcaagaggagacagccggcgtggtcagcacttcacttattagaaacggggattggacctttcagattctggtgatgctggagattacaccgcagcgcggcgacatatatacttgccaagttgaacaccccagcttacagtccccgattactgttgaatggcggcctaggggacctcccccagccggactgctgcactag

SEQ ID NO: 27614 - DNA, 828 bp, Artificial Sequence
  Description of Artificial Sequence: Synthetic coding sequence
atggccctacagattcccggaggattctgggccgcagctgtgacagtgatgctagtcatgctgtctaccccagtagccgaggccagggacttccctaaagattttctggtgcagtttaagggaatgtgctactttaccaacggcactgaacgagtgcggggtgtggcccggtatatctataatcgcgaggaatacggcagatttgattccgacgtgggagagtttcaggctgtgacagaactcgggcggtccatcgaagattggaataactacaaggattttcttgagcaggaacgagctgccgtcgataaggtgtgccggcataattatgaagccgaactgcgaaccactctgcagcgacaggttgaacccactgtgaccatctctccaagtaggaccgaagcgctgaatcaccacaatctactagtttgttcagtcacagacttctatccagctcagatcaaggtccagtggttccgcaacgaccaagaggaaacagcaggagttgtgtcaacgtccctgatccggaacggtgactggacctttcagatattagttatgctggaaatcacaccgcagagaggagacatttatacttgtcaggtggaacatccctcgctgcaaagccccatcacagtggagtggcgtgctcagtccgaaagcgcgcagtctaagatgctgggaggtgtgggaggtttcgtcttgggcttgatcttccttggcctgggtctcatcattcgccatcggggccagaaaggtcctcgtgggcctccccctgccggcaacatatcagcaatgattcagagcggagagcgagctcaggcttag

SEQ ID NO: 27615 - DNA, 627 bp, Artificial Sequence
  Description of Artificial Sequence: Synthetic coding sequence
atgttatctaccccagtggccgaagctcgggattttcccaaggatttcctggtgcagtttaaaggcatgtgctatttcaccaatgggaccgaacgggtgagaggagtggccaggtatatttataaccgggaggagtatggccggttcgatagtgacgtgggagagttccaggccgttactgagcttggtcgatcaatcgaagactggaacaactataaagactttttagaacaggagagggcagcagtggacaaggtgtgtcggcataattatgaagcagaacttaggactactctgcaacggcaagtggaaccaacagtcactatttctccgtcaaggacagaagcacttaatcatcacaatctcctcgtttgctctgtgaccgacttctaccctgctcagataaaagtgagatggttccggaatgatcaggaggaaaccgccggagttgtgtccacaagcctcattagaaacggcgattggacttttcagatcctggtaatgctcgagatcacaccacagcgtggcgatatttatacttgccaggtcgaacacccctcgttgcaatcccccatcacagtggagtggaggccccgcggcccacctccggccgggctgttgcactag

SEQ ID NO: 27616 - DNA, 627 bp, Artificial Sequence
  Description of Artificial Sequence: Synthetic coding sequence
atgctgtccacgcccgtagcagaggcccgcgattttcccaaagacttcctagtgcagtttaaggggatgtgctatttcacaaatggtacagagagagtccggggggtggctagatatatatacaaccgcgaggaatatggcaggtttgatagcgacgtcggcgagtttcaggccgttacggagctaggaaggagcattgaggattggaacaactacaaagacttcctggaacaggagagagcagccgtcgataaggtgtgccgacataactacgaggccgaattaaggactaccctgcagcgccaagtggagccgactgttaccatttctccatccagaaccgaagctctgaatcatcataatttgctcgtgtgctcagtgacagatttctatccagcacaaatcaaagtccagtggtttaggaatgatcaggaagaaacagcgggtgtggtgagcactagcttgatcagaaacggggactggactttccagatccttgtgatgcttgagatcacacctcagcgtggtgacatctacacatgccaggtagagcatccaagcctccagtcaccaattacagtggaatggcgtccccgagggcctcccccagctgggcttctgcactag

SEQ ID NO: 27617 - DNA, 627 bp, Artificial Sequence
  Description of Artificial Sequence: Synthetic coding sequence
atgctgtcaactcccgtggccgaggccagagattttcccaaggatttcctggtgcagttcaaaggtatgtgttactttactaacgggacggagcgggtaagaggggtggctagatatatttacaatcgtgaggaatatggaagattcgattcagatgttggtgagttccaggccgtgaccgagcttggccggtctatcgaagattggaacaattacaaagactttctcgagcaagagagagcggccgtcgataaagtctgccggcataactatgaggccgaactacgcactacactgcaacggcaggtggaacccaccgtgaccattagtccaagtcggacagaggcccttaatcaccacaatcttctggtttgttctgtgacggacttttatccagcccagatcaaggtgcagtggtttagaaatgaccaagaggagactgcgggagtggtgtcgacttctctcattaggaacggggattggacttttcagattctggtgatgctggaaatcactcctcaaagaggcgatatctatacctgtcaggtcgagcatccgtctctacagagcccaatcaccgtggagtggcgtccccggggacccccgcctgctggtctgcttcactag

SEQ ID NO: 27618 - DNA, 627 bp, Artificial Sequence
  Description of Artificial Sequence: Synthetic coding sequence
atgttgagtactcccgtggccgaggccagagacttccccaaggattttctggttcagtttaaggggatgtgttatttcacaaatggcacagagagggtgaggggcgtggccagatacatctataatcgggaggagtatggcagattcgactccgacgtgggcgagtttcaggctgttaccgagctcggtaggtcaattgaagactggaataactataaggacttccttgagcaggaaagggcggcggtggataaggtatgcaggcacaattatgaggccgagctgagaaccaccctgcagcggcaagttgagcccaccgtgacaatctcgcccagccgcacagaagcactcaatcatcacaatctattagtgtgctccgtaactgatttctaccctgcccagattaaggtgcggtggtttcggaacgaccaggaggagacagccggggtggtttcaactagtctgattaggaatggggactggacattccagatcctagtgatgctggagatcaccccccagcgaggggatatctacacctgtcaggtcgagcaccccagtttgcagtcgccgataacagtcgaatggaggccccgggggccaccccccgccggcctgctgcactag

SEQ ID NO: 27619 - DNA, 627 bp, Artificial Sequence
  Description of Artificial Sequence: Synthetic coding sequence
atgctgagcactcctgtcgccgaggccagagactttcctaaggacttcctggtccagttcaagggtatgtgttatttcaccaacggtacagaacgcgtccgaggcgttgcacgatacatttacaatagagaagagtacggcaggttcgacagtgacgtgggcgaattccaagccgtcaccgaactgggacggtctattgaggattggaacaattacaaagatttcctggaacaggagcgcgccgccgtggacaaggtctgcaggcacaattacgaagctgagctgaggacgaccctccagaggcaggtcgaacccacagtaacaattagcccctctaggaccgaggctcttaatcaccacaatttgctggtttgttcagtcactgatttctaccctgcccagattaaagtgcagtggtttcgcaacgatcaagaggagaccgcgggggtggtcagcacttctttaattcgcaacggtgattggacctttcaaatattagtcatgctggaaataacaccacagagaggcgatatctatacctgccaggtggagcacccatctctgcaatcacccatcaccgtcgaatggcgaccaaggggacccccgcccgccggcttgctgcactag

SEQ ID NO: 27620 - DNA, 828 bp, Artificial Sequence
  Description of Artificial Sequence: Synthetic coding sequence
atggccttgcagatacccggagggttctgggcagctgctgtaaccgttatgctggttatgctcagtacaccagttgctgaggcacgcgatttcccgaaggatttcctggtgcagttcaaaggaatgtgttattttacgaacgggactgagcgtgtgcggggcgtggccaggtacatttacaatagagaggaatacgggaggttcgacagtgatgttggggaattccaggcagtgaccgagttgggacgctcgatcgaggactggaataactataaggacttcttagagcaggagcgcgcagcggtagataaggtctgtcgacataactatgaggcggagctcagaacgaccctgcagcgacaagtcgagccaacagtgaccatctccccatcccgcactgaggcgctgaatcaccacaatctgcttgtttgcagcgtcactgacttttaccccgcacaaatcaaagtccaatggtttcgaaatgaccaggaggagacagccggcgtagtaagcacatctctgattcggaacggggattggacgttccagatactggtgatgctagaaataactccccagaggggagacatctatacctgccaagtggagcacccttctctgcagagcccgattaccgtggagtggcgcgctcagtctgagagcgcgcagagcaagatgctgggcggggttggtggttttgtcctgggtctcatttttctaggtttaggccttatcatacgacatcgcggccagaaggggcctagaggaccgcctcccgccggcaatatctccgcgatgattcagagcggcgagcgcgctcaagcctag

SEQ ID NO: 27621 - DNA, 627 bp, Artificial Sequence
  Description of Artificial Sequence: Synthetic coding sequence
atgctctccactccagtagctgaagctcgtgactttccaaaagattttttagtccaattcaagggaatgtgctatttcacaaacggtaccgaaagagtgcgcggagtggcccgctacatttacaaccgcgaggaatatggcaggttcgattcagacgtaggcgagttccaggcagtgaccgagttgggtcggtcaattgaagattggaataattacaaagattttttagaacaagagcgcgcagctgtcgataaggtgtgtagacacaactatgaggccgagcttaggaccaccttacagcggcaggtggagcctactgttacaatctccccatcaagaacggaagctctcaatcatcacaatctgctagtatgctccgttaccgacttttaccctgctcaaattaaagtgagatggtttcgtaacgaccaagaggaaacagctggtgtagtgagtacttcactaattcggaatggggattggacatttcaaattcttgttatgctggaaatcacgcctcagaggggtgacatatacacctgtcaagtcgagcatccatctttacagtcaccaattactgtcgaatggcggcctagaggccccccccccgcagggctgttgcactag

SEQ ID NO: 27622 - DNA, 828 bp, Artificial Sequence
  Description of Artificial Sequence: Synthetic coding sequence
atggccttgcagattcccggtggattttgggccgcggctgtgacagtgatgttggtcatgctgtccacacccgtagccgaggccagagacttcccaaaggattttttggtgcagttcaagggtatgtgttacttcactaatgggactgagcgggtgcgaggtgtcgccagatatatctacaaccgggaagagtacggccgctttgatagtgatgtgggagagttccaggccgttactgaactgggacgaagcatagaggattggaataattataaggatttcttggagcaggagcgggccgcagttgacaaggtatgcaggcacaattatgaggccgagctcagaacgaccctccagaggcaggttgaaccgactgtaacaatctctccgagtcggactgaagcactgaaccatcacaatctgcttgtgtgcagtgtgaccgacttttacccagcccagatcaaggttcagtggtttagaaatgaccaggaagagacggctggagtcgtctctactagcctgatccgcaatggggactggacatttcagatattagttatgctggaaatcacccctcaacgtggcgacatttacacctgccaagtcgaacacccctccctgcagtcaccgataacagtggaatggagggcacagtccgaatccgcacagtcgaagatgttagggggggttgggggcttcgttcttggtctcatatttctcggtctaggtctgataatacgtcacaggggccaaaaggggccccgaggccctccacccgcgggtaatatatccgccatgattcaatctggcgaacgggctcaggcatag

SEQ ID NO: 27623 - DNA, 828 bp, Artificial Sequence
  Description of Artificial Sequence: Synthetic coding sequence
atggccttacagattcctggaggcttttgggcagccgcagttactgtgatgctcgtaatgctctctacgcctgtcgctgaggccagagatttcccaaaggactttctagttcagttcaaaggcatgtgctatttcacaaacgggaccgagagggtgagaggggttgccagatacatttacaatagggaggagtacggtagattcgatagtgatgttggcgagttccaggccgtgaccgagctcgggagatcaatagaagattggaataactacaaagactttctggagcaggaaagggcagcagtcgacaaagtttgtaggcacaattatgaagccgagctcaggaccactctgcagaggcaggtggagcccacggtaactatcagtccctcccggactgaagcgctgaatcaccataatttgttagtgtgttcagtaactgatttctaccccgctcaaatcaaagtgcagtggttccgaaatgatcaggaagagaccgccggggttgtcagcactagcttaatcaggaacggggattggacctttcaaatactggtgatgctagaaattaccccacagagaggggatatctacacatgccaggtggagcacccatcactgcaatcaccgatcactgtggagtggcgcgcccagtctgagagcgcacaatccaagatgcttggcggtgtgggagggttcgttctcggtctgatatttctcggactggggctcataatacgccatcgcggtcaaaagggtcctcggggcccccccccagccgggaatatctctgctatgattcaaagcggtgaacgagcccaggcttag

SEQ ID NO: 27624 - DNA, 690 bp, Artificial Sequence
  Description of Artificial Sequence: Synthetic coding sequence
atggctatcagcggcgtgccagtcctgggcttcttcatcattgccgtgttaatgagcgcccaggagagctgggcgatcaaggaggagcatgtgattattcaggcagagttctacttgaatccagatcagtcaggcgagttcatgtttgacttcgacggagacgagattttccacgtcgacatggcaaaaaaggaaacagtgtggaggttggaggagtttggtcggtttgcctcttttgaggcccagggggcactggccaacatcgccgtggacaaagccaaccttgagatcatgaccaaacggtctaactatacccccataactaacgataagtttacccctccagttgttaacgtgacctggctgagaaatggcaagcccgtgaccaccggggtcagcgagacggtgtttctgccaagagaggaccacctttttaggaagttccactacttgccttttcttccgagcacagaagacgtgtacgactgcagagtggaacactggggcttggatgagcctctgctgaagcattgggagttcgatgccccgtccccattgcccgagactaccgaaaacgtggtatgtgctctcggcctgactgttggtctagtgggtattattatcggtactattttcatcattaaagggcttagaaagtctaatgccgccgagcgccgaggcccattgtag

SEQ ID NO: 27625 - DNA, 765 bp, Artificial Sequence
  Description of Artificial Sequence: Synthetic coding sequence
atggccatcagtggcgtgcccgttttaggattttttataatagcagtgctgatgtcagcccaagaatcttgggccatcaaagaggagcacgtgatcatccaagctgaattttatctcaacccagaccagtccggtgagttcatgtttgatttcgatggcgatgaaatctttcacgtggacatggcaaagaaggaaacagtgtggcggcttgaggagtttggaagattcgcctctttcgaagcccagggcgctttggctaatattgccgtagataaggcaaacctggaaataatgactaagcgctccaactataccccaatcaccaacgttcctccagaggtgacggtgctcaccaattcaccggtggaactgcgagaacccaatgtgctgatttgttttatcgataaattcacaccccctgtggtgaatgtgacctggttacgtaatggaaagcctgtcactactggcgtgagtgaaaccgtgttcctgcctcgtgaggaccacctgttccggaagtttcactacttgcctttcctgccaagcacggaggacgtttacgactgccgcgtggagcactgggggcttgatgagcccttgctcaaacactgggagtttgacgcacctagtcccctcccagaaacaactgaaaatgtggtttgtgccctgggactaactgtagggctcgttggcataatcatcggcacaatttttatcatcaaaggcctcagaaaaagtaatgctgccgaaaggcgcggccctctttag

SEQ ID NO: 27626 - DNA, 690 bp, Artificial Sequence
  Description of Artificial Sequence: Synthetic coding sequence
atggcgatcagcggagtcccagtgctcggatttttcatcattgccgtgttgatgagtgctcaggaaagttgggcgatcaaggaagagcacgtcataatccaggctgagttctatctgaacccagatcagagcggggaattcatgtttgactttgatggcgatgagatctttcatgtggatatggccaagaaagagaccgtgtggcgcctggaggagtttggccgatttgccagcttcgaagctcagggagcattggcaaacatcgccgtggacaaggccaacctggagatcatgactaaaagatctaactatacacctattaccaacgacaagtttacacctcccgtcgtgaacgtgacatggctgcgcaacggaaaacctgtgacgaccggggtgtccgagacagtgtttctcccaagagaggatcacctctttagaaagttccactacctgcctttccttccatctaccgaggacgtttacgattgccgggtagagcactgggggctggatgagccgctattgaaacactgggagttcgacgctccgagccccctgccagagaccaccgagaatgtggtttgtgccctcgggctgaccgttggcctggtggggatcataatcggcaccatcttcattattaagggcgttaggaaaagcaatgcggccgagcggagaggtccattgtag

SEQ ID NO: 27627 - DNA, 765 bp, Artificial Sequence
  Description of Artificial Sequence: Synthetic coding sequence
atggcgatttcaggagtcccagtgctcggctttttcataatcgctgtattgatgtctgcccaggagtcatgggctatcaaggaagagcatgtcattatccaggccgaattttatcttaaccccgaccagtccggcgagttcatgtttgactttgacggagacgaaatatttcatgttgacatggctaagaaggagactgtttggcgactcgaagagttcggtaggttcgccagctttgaagcccaaggagccttggcaaacatcgcagtggacaaggctaacctggagatcatgaccaagcgctcaaattacacgcccattactaacgtgcctccggaagttacagtacttactaattcacctgtggaattacgtgagcctaacgtgctgatctgctttatagacaagtttacaccaccagtggtgaacgtgacctggctgagaaatgggaagcccgtcaccaccggagtgagcgagacggtgttcctgccccgcgaggaccacctctttcgtaaatttcactacctgcctttcttaccaagcacggaggacgtgtacgattgccgcgtggagcattggggactggatgagccgctgctgaagcattgggaatttgacgctccttcgcccttgccggaaaccacggagaacgtcgtctgcgccctggggctgacagtcggcctggtgggcattatcattggcaccatattcattatcaaaggcgttagaaagtccaatgctgctgaacgccgtggacccctgtag

SEQ ID NO: 27628 - DNA, 765 bp, Artificial Sequence
  Description of Artificial Sequence: Synthetic coding sequence
atggctatcagcggagtgcccgtcctcggatttttcatcatagctgttctgatgtcggcacaagagtcttgggcaattaaggaggaacatgtcattattcaggcagaattttacttaaaccccgaccagtccggggagttcatgttcgatttcgacggagacgaaatcttccatgtagacatggcgaagaaggaaacagtgtggcgcctagaagaatttggtcgcttcgctagcttcgaggcccagggtgcactggcaaacatcgcggtcgacaaagcgaacctggagattatgacgaagcgaagtaactacacccccataactaacgtgcctcccgaggttactgtcctcaccaattccccagtggagttacgtgaaccaaacgtcctgatatgcttcatcgacaaatttacaccaccagtggtcaatgttacatggctccgaaacggcaagcccgtgactaccggagtttctgagacggtgtttttaccaagagaggatcacttattccgcaaatttcactacctgccctttcttccgagcactgaggatgtgtacgactgtagagttgaacactgggggctggatgagccacttctaaagcattgggagttcgatgctccttcgcccctccccgagaccacggaaaacgtagtgtgtgccctggggttgactgtagggctggtgggtatcattattggaaccatttttatcatcaaagggctgagaaagtctaacgcagcagagcgccggggtcccctatag

SEQ ID NO: 27629 - DNA, 690 bp, Artificial Sequence
  Description of Artificial Sequence: Synthetic coding sequence
atggcaatctctggtgttccagtgctgggtttttttatcattgccgtgctgatgtccgcgcaggaaagctgggccatcaaagaagaacatgtgattattcaagccgaattttatctgaaccccgaccagtccggggagttcatgttcgattttgacggcgacgagatcttccatgtcgatatggcaaagaaggagaccgtctggcgcctcgaagagtttggacgatttgcgagcttcgaggcccagggcgctcttgctaacatcgccgtcgacaaagcaaacctcgagattatgactaaaagaagtaactacacacctatcaccaatgataagttcactccacctgtggtcaacgtgacatggctgcggaacggcaaacctgttacaactggtgtgagtgaaactgtgttcttacctagggaggaccacttatttcggaaattccactacctgccttttcttccctccaccgaggatgtttatgactgcagggtcgaacattgggggctcgacgagcctttgctgaaacattgggagttcgacgcacctagccccctccccgaaaccactgaaaatgtcgtttgtgcccttgggctcactgttgggctcgtggggattattattggtaccatcttcatcataaaaggcgtaaggaagtccaacgcagcagagagacggggacctctgtag

SEQ ID NO: 27630 - DNA, 765 bp, Artificial Sequence
  Description of Artificial Sequence: Synthetic coding sequence
atggccatctctggggtcccagtccttggctttttcatcattgccgtcttgatgagcgctcaggagagctgggccatcaaagaggaacacgtcatcatccaggctgaattttatcttaacccagaccagtccggagagtttatgttcgattttgatggagatgaaatcttccatgtggatatggctaaaaaagagacagtctggagacttgaggagttcggccgttttgcatctttcgaagcgcagggcgcactggccaatatcgcagtagataaggcgaacctggagataatgacgaaaagaagcaactatactcccattacaaacgtgccccctgaggtgaccgtcctaactaattcaccagtggagctgcgggaacctaacgtcctcatatgcttcattgacaaattcaccccaccagttgtgaacgtgacctggctccggaatgggaaacccgtcactaccggcgtgtcagagacagtcttcttacctcgggaagatcacctgttccgcaagttccattatctgcctttcctgccatctactgaggacgtctacgactgcagggtggaacactggggactggacgagccattgctaaaacactgggaattcgacgccccgagccctctccctgaaacaacggagaatgtcgtgtgcgctctcgggctaaccgtgggtctcgtgggaatcattattggaacgatctttatcatcaaaggtgtgcggaagtctaacgccgctgagaggcgagggcccctgtag

SEQ ID NO: 27631 - DNA, 765 bp, Artificial Sequence
  Description of Artificial Sequence: Synthetic coding sequence
atggctatctctggcgttccagtgttgggctttttcattattgcggtgctgatgtcagcccaggaatcatgggccataaaggaagaacatgtcatcatccaagcagaattttacctgaacccagaccagtcgggagagtttatgtttgacttcgatggggatgagatttttcatgtggatatggctaagaaggaaacagtctggcgcctggaagagttcggacggttcgcctcatttgaggctcaaggtgccctggctaatattgcagtagataaagctaatttggaaattatgactaagagaagcaactacactcccattaccaacgtccccccagaggtcaccgtgctcactaacagccccgtcgagctgagggaacccaacgtgcttatttgttttatcgataagtttacacctccggtggtgaatgtcacatggcttagaaatggcaagcccgttactaccggcgtatccgaaaccgtgtttttgcctcgtgaggatcacctctttaggaaatttcactacctgccttttcttcccagcaccgaggatgtatatgactgccgcgtggaacattggggcttagacgagcctctattaaagcactgggagttcgacgccccgtcccccttgccggagactactgagaatgtggtgtgtgccctgggactcacagtcgggctggtgggtatcattataggcactatctttattatcaagggagttcgcaagtcaaacgccgctgagagaagggggcctctctag

SEQ ID NO: 27632 - DNA, 690 bp, Artificial Sequence
  Description of Artificial Sequence: Synthetic coding sequence
atggccatcagcggtgtacccgtgctgggtttttttattatcgccgtgctcatgtctgctcaggagtcttgggcgatcaaagaagaacacgtgattatccaggccgagttttatctcaatccagaccagtccggggaatttatgttcgactttgatggagatgagattttccacgttgatatggcaaaaaaagagactgtgtggcgactcgaggaattcggtaggttcgctagcttcgaggcccagggggctttggccaacattgcagtggataaagcaaacctggagattatgactaagcgctctaattacactccaattacaaacgacaaattcacaccaccagtggtcaatgtaacctggctccgcaacggtaaacctgtaaccacgggtgtcagtgaaacagtttttctgccccgtgaagatcatctgttccggaagttccactatctcccctttctgccctccaccgaagatgtgtatgactgccgagtggagcattggggattagacgaacccctgctaaagcactgggagtttgatgcgccctcccccctgcccgagacgaccgagaacgtggtttgtgcccttggtttgactgtgggtctagtgggtataattatagggactattttcatcattaagggtgttaggaaatctaacgcggccgagcgccggggccccctgtag

SEQ ID NO: 27633 - DNA, 765 bp, Artificial Sequence
  Description of Artificial Sequence: Synthetic coding sequence
atggccatctcaggtgtgccagtgcttgggttcttcatcattgcagtgttaatgtcagctcaggaatcctgggcaattaaagaggaacacgtgatcatccaggcagaattttatctcaatccagaccagagtggtgaattcatgtttgacttcgacggtgatgaaatcttccatgtggatatggccaagaaagagacagtctggaggcttgaagaattcgggaggtttgcatccttcgaggctcagggcgccctagccaacattgccgtggataaggcaaatctggaaataatgaccaagcggtctaattacacccccatcaccaacgtcccacctgaggttacagtgctcaccaactcacctgttgagttacgagaaccgaatgtcctcatatgctttatcgacaagtttactccccccgtggtcaacgttacctggctcagaaatggcaagccagtgactaccggcgtgtccgagactgtgtttctcccccgagaggaccacttgttcagaaagtttcattatctccccttcctccctagtacggaggacgtctatgactgcagggttgagcactgggggctggatgaacctctcttaaaacactgggaattcgacgcaccttcgccactacccgaaacaacggaaaatgtcgtctgtgctttaggtttgaccgtgggactggtgggcattataatagggacaatctttatcattaaaggagttagaaagagtaacgcggccgaacgaaggggcccactctag

SEQ ID NO: 27634 - DNA, 690 bp, Artificial Sequence
  Description of Artificial Sequence: Synthetic coding sequence
atggccatctccggagtgcctgtattgggcttcttcatcatcgccgtcctcatgagcgctcaggaatcctgggctattaaggaggaacacgtgatcatccaggctgagttctacttgaaccctgaccagagtggggaattcatgttcgatttcgacggtgatgagatatttcacgtcgatatggctaagaaagagaccgtctggcggttggaggaatttggcagatttgctagtttcgaggcacagggggcacttgccaatattgcggtggacaaagcgaacctggagattatgacaaagcgcagcaattatacccctatcactaacgataagttcacgccgcccgttgttaatgtgacctggctgaggaatggcaagccagttacaaccggcgtatctgaaacagtgtttcttcctagagaggatcatctgttccggaaatttcattacctgcctttcctgccttctaccgaggatgtgtacgattgtcgagttgagcactgggggttggacgaacccctcttgaagcactgggagtttgacgctccgtcccctcttcccgagactactgaaaatgtcgtctgcgcactcggtctgacagtgggcttagtgggcataatcatcggcaccattttcatcatcaaaggtgtgaggaagtccaacgcagcagagcgccgtgggcccctctag

SEQ ID NO: 27635 - DNA, 690 bp, Artificial Sequence
  Description of Artificial Sequence: Synthetic coding sequence
atggccatcagtggtgtgcctgttctggggttcttcattattgcagtgctgatgtcagcacaggagagttgggccattaaggaggagcacgtaattatccaggctgagttttacctgaaccctgatcagagtggtgaattcatgttcgattttgatggcgacgagatatttcatgttgacatggcgaagaaggaaaccgtttggcgcctggaggagtttgggcgctttgccagtttcgaagcccaaggagctttagccaacatagcagtagacaaagcaaatctggagatcatgactaaacgcagcaattatacgccaattacaaatgacaagttcaccccaccggtggtcaatgtcacctggcttcgaaatggcaagcccgtgacaactggggtctcagaaacagtattcctgccccgcgaggatcacctattcaggaagttccactatttacctttcttacccagcaccgaggatgtgtacgattgccgggtagagcactgggggttagacgaaccactcctgaagcattgggaattcgatgcacccagccccctgccagagaccacagaaaatgtcgtgtgtgcccttggcctcactgtcggacttgtgggcattataattggcactatcttcattatcaaaggcgttcgtaagtcgaacgctgcggaacgaagaggccccctgtag

SEQ ID NO: 27636 - DNA, 690 bp, Artificial Sequence
  Description of Artificial Sequence: Synthetic coding sequence
atggctatatccggagtgcctgtcctggggtttttcattattgccgttctgatgtctgcccaagaatcctgggcaatcaaagaggagcacgtaattattcaggctgaattctatttaaaccctgaccagtctggagaattcatgttcgacttcgatggcgatgaaattttccacgtcgatatggctaagaaggagactgtgtggcgactcgaggagtttggtcggttcgcaagttttgaagcgcaaggcgccctcgcgaacattgccgtcgacaaagccaatctggaaatcatgacgaaaagaagcaattatacacctatcacaaacgacaagtttactccaccggtcgttaacgtgacctggctccgcaatggcaaaccggtgacaactggtgtgtccgaaaccgtgtttctgccaagagaagatcacctgtttaggaagttccattatttgcctttcctgcctagcactgaagacgtctacgactgcagggtcgagcactggggcctcgacgaaccacttttgaagcactgggagttcgatgctccatctcctctccctgaaactaccgaaaatgtcgtgtgcgcccttggcctaacggtgggccttgtcggtataataatcggcactatctttattatcaaggggttgaggaagtctaacgccgcggaaagaagaggccccttgtag

SEQ ID NO: 27637 - DNA, 765 bp, Artificial Sequence
  Description of Artificial Sequence: Synthetic coding sequence
atggcgatcagtggcgtgcccgtgctgggattttttatcattgctgtcctcatgagcgcacaggagtcctgggctattaaggaggagcacgtcatcatccaggccgaattttatctgaaccccgaccagtctggagaattcatgtttgacttcgatggggatgaaatcttccatgtcgatatggcgaagaaggaaaccgtttggcgactggaggagtttgggagattcgcatccttcgaggcccagggggcactggccaatatcgctgtggataaagccaatttggaaatcatgaccaaaagatccaactacacaccgatcaccaatgtgccaccagaggtgactgtcctaaccaattctcctgtggaactgagagaacccaatgtgcttatctgcttcatcgacaagttcaccccccctgttgtcaatgtgacatggttgcggaacggcaaacccgtgactacaggggtttccgaaacagtgtttctgccgcgcgaggaccatcttttcaggaaattccattacctgccattcctgccgagcacagaagatgtgtacgattgtagggtcgaacactgggggttggacgagccattactgaagcactgggaattcgatgctccgagtcccctaccagaaacaacagaaaacgttgtatgcgcactcggtctgaccgttggccttgtgggcattataattggaactatcttcatcatcaaaggagtaagaaaatccaacgcggcggagcgacgggggccactttag

SEQ ID NO: 27638 - DNA, 543 bp, Artificial Sequence
  Description of Artificial Sequence: Synthetic coding sequence
atggcaatttcgggtgtccccgtcctgggtttttttattattgcagtgctgatgtctgcacaggaatcatgggccattaaggaagaacatgtgataatccaagctgaattttatctaaacccagatcagagtggtgagttcatgtttgactttgacggcgacgagatttttcacgtcgatatggcaaaaaaggagacggtgtggcgcttggaggagttcgggcggtttgcttcatttgaggcccagggcgccctagctaatatagcagtggataaggctaaccttgagattatgacgaagcgcagtaaaccaagtcccagagactatcgggagagaggagtttgccccggcccagactgtggtagtggcgggcatcattattgggatcatctgcaccaccagggaatagctcaaaagcagtgctctcgcactcaaggggccagtgtccgccacatggaggttatggtgttcctgcgtgagaaaattacagaggagacaagtgcccttatggcactgcagagttggcagtattataacccatag

SEQ ID NO: 27639 - DNA, 714 bp, Artificial Sequence
  Description of Artificial Sequence: Synthetic coding sequence
atgtccgcccaggagtcctgggccatcaaagaggagcacgtgattatccaggcggaattttacctcaacccagatcaaagcggcgaattcatgttcgatttcgatggggacgagatctttcacgtggacatggcaaaaaaggagaccgtgtggcgactggaagaattcggacgcttcgcctccttcgaagcccaaggtgccctggcaaacatagccgtggataaggcaaacttggagatcatgacaaaacgatcaaactacacacctatcacaaacgtgccccccgaggttacagtgttaaccaactcccctgtggaattgcgcgaacctaacgtcctcatttgtttcatagacaagttcaccccccccgttgtaaacgtgacctggctgcggaacggaaagcccgtcaccactggcgtgagcgagactgtttttctgccaagggaggatcatctctttagaaagtttcactatttaccattcctccccagcactgaggatgtgtacgactgtcgcgtggagcactggggtctggacgagccacttctgaagcactgggagttcgatgcgcctagccccctccctgagaccaccgaaaatgtcgtgtgtgcccttggcctgactgtgggtctggttgggattatcatcggcaccattttcattataaaaggtgtacggaagtcaaacgccgccgaaagacggggccccctgtag

SEQ ID NO: 27640 - DNA, 498 bp, Artificial Sequence
  Description of Artificial Sequence: Synthetic coding sequence
atggccaagaaagaaacagtgtggcgcttggaagaattcggcagattcgcttcctttgaagcgcaaggcgcactcgcgaacattgcagtggacaaagctaatctggaaattatgaccaagcgttccaactacactcccatcacaaacgttcccccagaagtcacagtgttaactaacagccccgtggagttgagagaacccaatgtgctaatttgttttatcgataagtttacacctccggtggtcaatgtgacctggctccgtaacgggaagccggtgactacaggtgtgagcgagacagtgtttctgagcatcgccttctcttgtatctatttcccgttattccccataatcctcctgtcaccttgtaatgcctcagggatcaagcataccggcgtatgtctctgttatgggatgcctcacggcgcctctctggtttacctactgtttaaggtgagcagtaattgtgattttagcgaacacaataaactgttctag

SEQ ID NO: 27641 - DNA, 453 bp, Artificial Sequence
  Description of Artificial Sequence: Synthetic coding sequence
atggccatctccggagtccccgtgctcggcttcttcattattgctgttctcatgagcgctcaggagagctgggctatcaaagaagaacacgtgattatacaggccgagttttatcttaatccagaccaatccggagagtttatgttcgatttcgatggggacgaaatcttccatgtggatatggctaaaaaagagaccgtttggaggctcgaagagtttggcaggttcgccagcttcgaggcgcagggtgcgttggctaatatagctgtcgataaagctaatttggaaatcatgaccaaacgcagtaactacacccccattactaatgtccctcccgaagtcactgtactgacaaattccccagtcgaattaagagagccgaatgttctgatttgtttcatcataaaaggtgtgcggaagtccaacgcggccgaacgccgtggtccgctctag

SEQ ID NO: 27642 - DNA, 543 bp, Artificial Sequence
  Description of Artificial Sequence: Synthetic coding sequence
atggctatatcaggggtccctgtgctgggcttttttattatcgccgtcctgatgtccgcccaggaatcttgggccatcaaagaagagcatgtcatcatccaggctgaattctacctgaatcctgatcagagcggcgagtttatgttcgattttgatggagatgagattttccacgtagacatggcaaagaaggagaccgtctggagactggaagagttcggcaggttcgctagttttgaagcacagggggcactcgccaacattgcagtggacaaggccaatttggaaattatgaccaaaaggagtaaaccttctcctcgagattatcgcgaacgaggagtatgtcccggtcccgattgtgggtccggggggcatcactattgggatcacctccaccatcaaggatcggcccagaaacagtgcagcaggactcagggagctagtgtccggcatatggaggtcatggtgtttcttcgggagaaaatcacagaagaaacttccgccctgatgactctgcagtcttggcagtattataatccgtag

SEQ ID NO: 27643 - DNA, 543 bp, Artificial Sequence
  Description of Artificial Sequence: Synthetic coding sequence
atggctatcagcggagtccccgtgctaggattttttattatagccgtcctaatgtcagcccaggaatcttgggcaatcaaggaggaacatgtaattatccaggctgaattctaccttaacccagatcagagcggggagtttatgtttgactttgacggggacgagattttccacgttgacatggcaaaaaaggaaacagtctggagactggaagagttcggccgcttcgcctcctttgaagcccagggagccctggcgaatatcgcggtggacaaagccaacttagagatcatgaccaaacgcagcaagccttctcccagggattatagagagcggggcgtctgtcccggtcccgattgcgggtccggtggccaccactattgggaccatctgcaccatcagggctctgctcaaaagcagtgtagccgaacccaaggagcatccgttcgacatatggaggtgatggtttttctgcgcgaaaagatcacagaggaaacaagcgccctaatgacactgcagagctggcagtactataacccctag

SEQ ID NO: 27644 - DNA, 498 bp, Artificial Sequence
  Description of Artificial Sequence: Synthetic coding sequence
atggcaaaaaaggaaactgtttggaggctcgaagagttcggtcgctttgcatcgttcgaggcacaaggggccctggccaacatcgcagtcgacaaggcaaatctggagataatgactaagcggagtaactatacgccaatcacgaatgttccccctgaagttactgtgctcactaatagccccgtagaactgcgcgagccaaacgtccttatttgcttcatagataagtttacccctcctgtggtcaatgtaacatggttgagaaatggtaagcctgttaccaccggagtctccgaaacagtgttcctcagcattgcctttagctgtatatattttcccctgtttcccataatcctgctctccccttgcaatgcgtcaggaatcaaacatacaggtgtttgtttgtgctacgggatgccgcacggggccagcctcgtgtacctgctgttcaaggtaagctcaaattgtgatttctccgaacacaacaaactgttttag

SEQ ID NO: 27645 - DNA, 543 bp, Artificial Sequence
  Description of Artificial Sequence: Synthetic coding sequence
atggcgatcagcggcgtgcccgtgttggggttttttatcattgccgtgttaatgagtgcccaggagtcctgggcaatcaaggaagagcatgttatcatccaggccgagttctatctgaatcccgaccagagcggagagtttatgtttgacttcgacggggacgagatcttccacgtggacatggctaagaaagaaaccgtttggcggcttgaagagttcggccgctttgcttccttcgaagcccagggcgcactcgccaatatcgccgtagataaggcaaatcttgaaattatgacgaaacgctcaaagccgtcgcctagagactatcgagagcgtggcgtatgccccggtcccgactgcggctccggaggacatcattattgggatcacctgcaccaccagggaagcgcacaaaaacagtgttcaaggacccagggagcttctgtgcggcacatggaggtaatggtcttccttagggagaagatcaccgaggaaaccagcgcactgatgacgctccagagctggcaatactataatccttag

SEQ ID NO: 27646 - DNA, 498 bp, Artificial Sequence
  Description of Artificial Sequence: Synthetic coding sequence
atggcaaagaaggagactgtatggcgactcgaggagtttgggagattcgcaagtttcgaagctcagggggctctcgctaatatagccgtggacaaggcaaacctggagataatgacaaaacgcagtaattatacacccatcacgaacgtgccacctgaggtcaccgtattaacaaactctccggtggagctcagggaaccaaacgtcctgatctgctttatagacaaattcaccccccccgtagtgaatgtgacgtggctgcgcaatgggaaaccagtgacaaccggcgtaagcgagacggtgttcttatcaatcgcttttagctgcatttacttcccgctctttcctatcatcctgctgagcccctgcaacgctagcgggattaagcacactggggtctgcttgtgctatggaatgccgcacggggcctccttggtgtatctactcttcaaagtgagctcaaattgcgacttttcagagcataacaagctgttctag

SEQ ID NO: 27647 - DNA, 714 bp, Artificial Sequence
  Description of Artificial Sequence: Synthetic coding sequence
atgagcgcccaggagtcatgggcaatcaaggaagagcacgttatcatccaagcagaattctacctcaatcccgaccagagtggagagttcatgttcgacttcgatggagacgaaattttccacgtggatatggctaagaaggagactgtctggcgtctcgaagaatttggaaggttcgcctcctttgaggcccagggagcactggcaaacatcgctgttgacaaggccaatctcgaaatcatgactaaacgctccaattacaccccaatcacaaatgtgcctcccgaggtgaccgtgctgacaaatagtccagtggaactcagggagccaaatgttttaatttgcttcatcgacaagttcacaccccccgtcgtgaatgttacctggctccgtaacggcaagcctgtgaccaccggggtgtccgaaaccgtgttcctgccaagggaagatcacctgttccgcaaattccattatctgccatttctccccagcaccgaggacgtctatgattgcagggtggaacactggggcttggacgagcccctgcttaaacactgggaatttgacgctccgtcccctctccccgagacaacagagaacgttgtttgtgccctcggacttaccgtcggtctcgtaggcattataattggtaccattttcatcattaagggcgttcggaaatcaaatgccgctgagcggcgaggaccgctctag

SEQ ID NO: 27648 - DNA, 543 bp, Artificial Sequence
  Description of Artificial Sequence: Synthetic coding sequence
atggcgatttccggcgttcccgtactgggttttttcatcatcgcggtattgatgtccgctcaagagagttgggccatcaaggaagagcacgtgattatccaggctgagttctacttgaaccccgatcagtctggagagttcatgtttgattttgacggtgatgaaatctttcatgtggacatggccaagaaggaaactgtttggaggctggaagagttcggcagatttgctagttttgaggcacagggagctttggcaaatattgcggtggacaaggcgaatctcgagattatgactaaacgctcgaaaccttctccccgggattacagagagcggggcgtgtgtccagggcctgattgcgggtctgggggacaccactattgggatcaccttcaccaccaggggagtgcacagaagcagtgttctcgcacacagggcgcttctgtgcggcacatggaagtgatggtcttcttgcgagagaaaataacagaggagacctctgcgctgatgaccctgcagtcatggcaatattacaacccatag

SEQ ID NO: 27649 - DNA, 498 bp, Artificial Sequence
  Description of Artificial Sequence: Synthetic coding sequence
atggctaaaaaggagacagtgtggcgactagaagagttcgggagatttgccagctttgaagcccaaggcgccctggccaacattgccgtggataaggccaacctggagataatgaccaagagatcaaactacacaccgataacgaatgtgccaccggaggtcaccgtgttgaccaactctccggtggagctgagagagcccaacgtactgatttgttttattgacaaattcacaccccccgtggtcaatgttacctggctgcgaaacggtaagcccgttaccaccggggtgagcgaaacggtttttctgtcgattgccttttcatgcatctactttcccttgttccctatcatcctcttatcaccatgcaacgcctctggtattaagcatacaggcgtttgcctttgttatgggatgcctcacggtgcttccctggtctatctgctgtttaaggtcagttcaaattgcgattttagtgaacacaataagttgttctag

SEQ ID NO: 27650 - DNA, 498 bp, Artificial Sequence
  Description of Artificial Sequence: Synthetic coding sequence
atggctaaaaaagagacagtctggaggttggaggagttcggccggtttgcatcattcgaagcccaaggagctctcgcaaatatcgctgttgataaggcgaatctggaaatcatgacgaaacggtctaactacacgccaatcactaacgttccaccggaagttaccgtcctgacaaacagccccgtggagctgcgagaaccaaacgttctgatctgcttcattgacaaattcaccccgcctgtggtcaacgtgacatggctccggaacgggaaaccagtgactactggggtgtccgaaacagtttttctgagcatagctttctcctgcatctacttcccattgtttcccatcattctcctatctccatgtaacgcaagtggcatcaagcatacaggtgtttgtctctgttacggcatgcctcacggggcttccctcgtgtacctgcttttcaaagtatcatctaactgcgattttagcgaacacaacaagctattttag

SEQ ID NO: 27651 - DNA, 714 bp, Artificial Sequence
  Description of Artificial Sequence: Synthetic coding sequence
atgagcgcccaagaatcctgggccatcaaagaggaacacgtcattattcaggccgagttctatttaaatccagaccagtctggcgaattcatgttcgacttcgatggagacgagatcttccacgtggacatggctaagaaggagacggtgtggagactcgaagaattcggtcgctttgcgagtttcgaggcccagggtgcactagctaacattgccgtagacaaagctaacctggagatcatgaccaaacgaagcaactacactccaattaccaatgttccgccagaggtgacggtcctgacgaactcccccgtggagctccgcgagccaaatgtgttgatttgcttcattgacaagttcactcccccggtcgtgaatgtcacttggctgcgtaacgggaaacccgtcacaaccggagtatccgaaactgtgttcttaccgcgcgaggatcacctcttcagaaaattccattacctgccatttttacccagcacggaggatgtgtatgattgtcgtgtcgagcattggggattggatgagcctctcctgaaacattgggagtttgacgctccatctccccttcctgagaccacggaaaatgtggtgtgtgcgctggggctgaccgtaggactggtcggaattataattggaaccatttttataatcaagggggtacggaagtccaacgccgcggaacgcaggggtcccctttag

SEQ ID NO: 27652 - DNA, 543 bp, Artificial Sequence
  Description of Artificial Sequence: Synthetic coding sequence
atggccatcagtggtgtgcctgtcctcggtttctttatcattgcggttctgatgtctgcacaagaatcatgggctatcaaagaggaacacgtgatcatccaggctgaattctacttgaaccccgaccagtccggagagttcatgtttgactttgatggcgatgagattttccatgtggacatggctaagaaggaaacagtgtggaggctcgaggagtttggcaggttcgctagcttcgaagcgcagggcgccctcgccaacatcgcagtggacaaggcaaaccttgagattatgacaaaaaggtcaaaaccttctccaagagattatagggaatgtggggtctgtcctggccctgactgcggttctggcggacaccattattgggaccacctgcatcaccaggggtctgcacagaaacagtgttctcgcactcagggtgcttccgtgcggcacatggaggtaatgatgttcctgcgggaaaaaatcactgaagaaacaagcgccctcatgacactccaatcctggcagtattacaacccttag

SEQ ID NO: 27653 - DNA, 498 bp, Artificial Sequence
  Description of Artificial Sequence: Synthetic coding sequence
atggccaagaaggaaacagtttggaggttggaggagtttggccgcttcgcttctttcgaggcccagggtgccctcgcaaacattgccgtggataaggccaatttggaaattatgaccaaaaggtctaactataccccaattactaacgtacctcccgaagtcacagtccttacaaacagtcccgtcgaactgagggaaccaaacgtcctaatctgctttatcgataaatttactccacccgtggtgaacgttacttggcttaggaatggtaaaccagttaccaccggagtgtcggagactgtgttcctgtccatagccttctcctgtatctactttccactctttcccatcattctgttatctccgtgtaacgctagcggaattaaacacaccggtgtctgcctgtgctacggcatgccacacggggcctctctggtatatcttctctttaaggtttccagcaattgcgatttctctgaacataacaagctgttttag

SEQ ID NO: 27654 - DNA, 714 bp, Artificial Sequence
  Description of Artificial Sequence: Synthetic coding sequence
atgagcgctcaagagtcctgggcgattaaggaagagcacgtgattattcaggccgagttttatctgaatccagatcagagtggagagttcatgtttgatttcgacggggatgaaatttttcacgtcgacatggccaaaaaagagacagtgtggagacttgaagaattcggccgatttgcttcctttgaggctcagggagctctggccaatattgcggtggacaaggctaacctggagattatgacaaaacgatcaaactacacccccatcacaaacgtccctcctgaggttacggttctgacaaactcccccgtggagctgagagagccaaacgtgctgatctgcttcatagacaaatttacgccaccggtggtgaacgttacctggctaagaaatggaaagcccgtgaccacaggggtgagcgagacggttttcttgccccgggaggaccacctgttcaggaaatttcattacctacctttcttacccagtacagaggacgtgtacgactgtcgggtcgagcattggggactggatgaaccgcttcttaaacactgggaatttgatgctccctcccccttgcctgagacaacagagaatgtcgtatgcgcgcttggcctcaccgtagggctcgtcggaataatcatagggaccatctttatcatcaagggcgtacggaagagtaacgcagcggagcgtagaggtcctctctag

SEQ ID NO: 27655 - DNA, 801 bp, Artificial Sequence
  Description of Artificial Sequence: Synthetic coding sequence
atggtgtgtctgaagttacccggtggcagttgcatggccgccctcactgtcactctgaccgttctgagctccccactggccctcgccggtgatactcagcctcgctttctggaacaagcgaagtgcgaatgtcactttctcaacggaacagagcgggtgtggaatttgataaggtatatctataatcaggaggagtatgctaggtacaactcagatctcggagagtatcaagctgttaccgaactcggcagacccgacgctgagtattggaattctcagaaggatttactggaaaggaggcgggcagaagtcgatacttattgccggtacaactacggcgtggtggagagttttacagttcagaggcgggttcagccgaaagtgacagtgtatccttccaaaacccaaccactgcagcatcataacctcctggtctgctccgtcaacggcttctaccccggttccatagaggtacgctggtttcgcaatggacaggaagagaaggctggggttgtgtctaccggacttattcagaatggggattggactttccagactttggttatgttagagaccgtgcccaggtccggagaggtatatacatgccaggtggagcacccaagcatgatgagccctctcaccgtgcagtggtccgcccgctcagaatcagctcagtccaagatgctgagcggagtgggaggcttcgtcctgggcttgctgttcctcggaaccggcctgttcatttacttcaggaatcaaaaagggcacagcggtctgcaacccactggcctgctgagctag

SEQ ID NO: 27656 - DNA, 801 bp, Artificial Sequence
  Description of Artificial Sequence: Synthetic coding sequence
atggtttgtctaaaactgccgggcggttcctgtatggcagcactgacagtgacgcttacagtgctctcctcaccactggctctggcaggagacacccagccacgattcctcgaacaggccaagtgtgagtgccactttcttaatggcaccgagcgggtctggaatctcattaggtatatatataatcaagaagagtacgcacgctacaacagcgacttaggggagtatcaggccgtaacagaactggggaggcccgatgccgaatattggaattctcagaaggacctcctcgagcgccgaagagcagaagttgatacctattgtaggtataattacggcgtggtggagagcttcactgtgcagcgacgggtgcaacctaaggtgactgtctaccctagcaaaacccagcctctacagcaccacaatctgctcgtgtgcagcgtcaatggcttctaccccggctctatagaagtccggtggttccggaacagccaggaggagaaagcgggggtggtatctactggacttatccaaaacggcgactggacattccaaaccctcgtgatgttagagaccgtgcctcgaagcggcgaggtttacacatgccaagtcgaacatccttcaatgatgagcccactgacagtacagtggtccgccaggagtgaatctgcccaatccaagatgctctccggggtggggggattcgtcctaggacttctgtttctgggtactgggctttttatctacttccgcaaccaaaagggccacagcggactgcagccaacaggcctgctgtcatag

SEQ ID NO: 27657 - DNA, 801 bp, Artificial Sequence
  Description of Artificial Sequence: Synthetic coding sequence
atggtgtgtttgaagctccccggagggagttgcatggctgcactgacagtgactctgaccgtgctgtcttctcctcttgccctggctggcgatacccagcccaggttcttggaacaggccaagtgcgagtgtcatttcctgaatggcactgagcgggtgtggaatctcattaggtacatatataaccaggaagagtatgcgaggtacaattctgatctcggtgagtaccaggctgttactgaacttggcaggcccgatgccgaatactggaattcacaaaaggacttgctggagcggcggagggcggaggtggacacgtactgtcgatacaactacggggtcgtggagagctttacagttcaaaggcgagtacagcctaaggtgactgtctatccgagtaaaactcagcccctccaacatcacaatctgttggtgtgttctgttaatgggttctatccgggatccatcgaggtccggtggtttcggaatggacaggaggagaaggccggtgtcgtctccacaggtctgattcagaacggggactggacgtttcaaacgttggtcatgctggagaccgtgccaagatccggcgaggtatatacctgccaagtggaacacccctccatgatgagccccctgacagtgcaatggtccgctcgcagtgagagcgcgcagtccaaaatgctctctggggttggcgggttcgtcttaggactgctgttccttggtaccggcctttttatctattttagaaatcaaaagggccattctggacttcaacctactggtctactgagctag

SEQ ID NO: 27658 - DNA, 1173 bp, Artificial Sequence
  Description of Artificial Sequence: Synthetic coding sequence
atgagtgtacgcgtggcgcgagtggcttgggtaaggggtctgggcgcctcctatcgcagaggcgcatcttccttcccagtccccccaccaggggctcagggggttgccgagctgttgcgggacgcgaccggagcagaagaggaggcgccatgggctgccacggagaggcgaatgcctggccaatgtagtgtactcttgttccctggccagggatctcaagtggtgggcatgggaaggggcttattgaattaccctcgcgtacgggaactgtatgctgctgccagacgcgtactggggtacgacctgcttgaactctctctccacggcccccaggagactctcgatcgcaccgttcactgccaaccagccatctttgtggccagcctggctgcagtggaaaaactccaccacctgcagcccagcgtaatcgaaaactgcgtggccgcggccggattctctgtaggcgaattcgctgccctcgtgtttgccggagcgatggaattcgcagagggtctgtatgcagtcaaaatccgtgccgaagcgatgcaggaagcctccgaggcggtgccctcaggtatgcttagcgtcctaggccagccacagtccaagtttaattttgcttgtctggaggctagggagcactgtaaatctctgggcattgaaaatcctgtgtgcgaagtatccaactacctcttccccgactgccgtgtcatctctggccaccaagaggctctccgatttctccagaaaaactctagtaaatttcactttaggcggacaagaatgctcccagttagtggtgcatttcatactcgcctgatggaaccagccgtagagcctctcacacaggcattgaaggccgtcgatataaagaagcctcttgtctccgtgtattccaacgttcacgcacaccgatatcgccaccctgggcatattcataaactgcttgcccagcagctggttagtcccgtgaagtgggaacagaccatgcatgcaatttacgagaggaagaaagggagagggtttccacaaaccttcgaggtagggcccgggaggcagctgggggccatcctgaaatcttgtaacatgcaggcttggaagtcttatagcgctgtggacgttttgcaaactctggaacatgtagacctggatccccaggaacctccacggtag

SEQ ID NO: 27659 - DNA, 543 bp, Artificial Sequence
  Description of Artificial Sequence: Synthetic coding sequence
atgtcagttcgcgttgctagagtggcctgggtcaggggcctgggggcaagctaccgcagaggagccagtagcttccctgtcccccctccgggcgcacaaggcgtggccgagctgctgcgtgacgcaacaggggccgaagaggaggcaccttgggctgcaacggaaaggcgtatgccaggtcagtgcagcgtactgctgtttcccgggcagggatcccaagtcgtcggcatgggaaggggcctgcttaattatcccagagtacgcgagctttatgccgctgccaggcgggtgttgggctacgacttactggagctcagtcttcacggaccccaggagactttggatcggacagtccactgtcagccagcgatcttcgtcgcaagtctggctgcagtcgagaaattgcaccacctccagccatctgttatcgaaaactgcgtcgccgccgccggattttccgtcggggaattcgctgcattggtcttcgccggagccatggagtttgctgagggttctacggtgagtcctgaagaatttctgtag

SEQ ID NO: 27660 - DNA, 3414 bp, Artificial Sequence
  Description of Artificial Sequence: Synthetic coding sequence
atgcccctgtcgagtcaccttctcccagccttggtactgttcctggctggctcaagcggctgggcgtgggttcctaatcactgccggtcccctggacaggctgtgtgcaactttgtgtgcgattgtcgagattgttccgatgaggcacagtgcgggtatcacggcgcctctccgacgctgggcgctccgtttgcctgcgattttgaacaggacccctgcggatggcgggacatcagcacttcaggctactcctggctgcgggatagagctggtgctgcgctggagggccccggtccgcactcagaccatacactagggaccgatcttggatggtacatggccgtaggaacacatcggggtaaagaagccagtactgccgctttgagaagccctacattgcgagaagcagcgtcatcttgtaaattgcgtctgtggtaccacgccgcaagtggtgacgtcgccgagttacgcgtggaactaacgcacggcgccgagacactgactctgtggcaaagcacgggcccctggggccccggttggcaggagctggctgtgaccactggaagaattcggggagatttccgcgtcaccttctctgccacgcggaatgctacccatcggggggctgtggccttggacgatcttgagttttgggactgtggactgccgacacctcaagccaactgcccccccggtcaccatcattgtcagaataaagtttgcgtagagccacagcagctgtgcgacggcgaggacaactgcggagatctgagtgacgaaaatccccttacgtgcggcaggcatatagcaacagactttgaaactggtctgggcccttggaacaggagtgaaggctggtccagaaatcacagagccggggggcccgagcggccctcctggccaagacgcgatcattcaagaaactcggcacagggcagcttcttggtcagcgtggccgagccaggtacacctgctatcctcagcagtcctgagtttcaggcttccggcaccagcaattgtagtttggtgttttatcagtacctcagtggctcagaggctggatgtctccagctctttttgcagaccctaggcccgggcgctccaagagcaccagtgctcctaaggaggaggcggggtgagttgggcaccgcctgggtaagggacagggtcgatatacaaagtgcctatcctttccaaatattgctagcaggacagaccggccctgggggggtggtcgggcttgatgacctgattctgagtgaccactgccgccccgtcagcgaggtgtccacgcttcagcctctgcctccagggcctcgggctcctgcaccccagcctctccccccttctagccggctccaagacagctgtaagcagggtcacctggcttgtggcgatctgtgcgtgcccccagagcagctgtgcgacttcgaggagcaatgcgcgggcggggaggatgagcaagcatgcggaaccactgatttcgagagtcctgaagcgggggggtgggaggacgccagtgttggcaggcttcaatggcgcagggtgtccgcccaagaaagccaaggaagttccgccgccgccgccggccacttcctgagcttgcagagggcctggggacagctcggcgctgaggcccgcgttttgacccctctgctcgggccgtccggcccctcatgcgaactgcacttagcctactacctgcaaagccaacccagggaagtgtcttgtaattttgagcgggacacctgctcctggtacccaggacacctgtccgacacccactggcggtgggttgagtcccgcggtcccgatcacgaccataccaccggccaaggacacttcgtgctcttagatccaaccgaccccctggcctgggggcactcagctcatcttctgtccagaccgcaagttcctgctgctcccacagaatgtctcagcttctggtatcacttgcatggccctcaaataggtacgctgaggctggcgatgcgacgggagggagaggagacacacttatggtcccgatctggaactcagggaaaccgctggcatgaggcctgggctacactgagccatcagccagggtcgcatgctcagtatcaactcttatttgagggactgagggacggctaccacggaaccatggcgctggatgacgtagctgtgagaccgggcccctgttgggcccctaattattgttccttcgaggactccgactgtggttttagtccgggggggcaaggcctgtggagaagacaggcaaacgctagcgggcacgctgcttggggaccgcccaccgaccacacgaccgaaaccgcacagggccactatatggttgttgatacttcccccgatgccttacccagagggcagactgcctcccttacgtctaaggagcataggcctctggcgcagcccgcatgcttaacattttggtatcatggcagtctccgtagccccggcactctgcgggtgtatctggaggagagaggtcggcaccaggttctaagcctgtccgctcatggaggtcttgcctggagactcggttccatggacgtgcaggccgaacgtgcctggcgcgtggttttcgaggcagtagccgcaggagtggcgcattcctacgttgcgctcgatgacctcctgctacaggatgggccatgccctcagcctgggtcctgtgacttcgagtctgggctgtgtggttggtcccacctagcctggcctggactgggtggatactcctgggattggggaggaggagccactccctctcggtacccccagccacctgttgatcacacgctcggtaccgaagcgggacattttgccttcttcgaaacgggggtgctgggacccggggggagagccgcatggctgcgttcagagcctcttcccgctactccggcttcttgtctccggttctggtaccacatgggattccccgagcacttttataagggagaactgaaagtgttgcttcactcagctcaggggcagctcgccgtgtggggcgccggtggccatcggagacatcagtggctagaagctcaggttgaggttgccagcgctaaagaattccagattgtgtttgaggcgacactcggcgggcagccagcgctcggccccatagctctcgatgacgtggaatatcttgcaggacaacattgccagcagcccgcacccagccccggcaacacggctgccccaggatcagttccagccgtggtcggctcagcactcctgctgctgatgttactcgttctgctggggcttggcggcaggcgctggcttcagaagaaagggtcttgtccattccaatccaacactgaggctacggcacctggatttgacaacatactgttcaatgcggatggagtcaccttaccagccagcgtgacctcagacccctag

SEQ ID NO: 27661 - DNA, 3609 bp, Artificial Sequence
  Description of Artificial Sequence: Synthetic coding sequence
tgaggctgggcttgggtcccaaatcattgtcgtagccctggacaggccgtatgtaacttcgtttgtgactgtcgcgactgctccgatgaagcccaatgtgggtatcacggcgctagccctaccctaggcgcccctttcgcttgcgactttgagcaggacccctgcggatggcgggatatctccaccagtggctattcttggcttagagaccgagcgggggcggcgctggagggccccggtccacactcagatcataccttgggcactgacctggggtggtatatggccgtcggaacgcaccgcggaaaagaggcctcaaccgcggccttaaggagccctacccttagggaagccgctagttcgtgtaagctgcgactgtggtaccacgccgccagtggggatgtcgctgagctgcgagttgagttaactcatggggctgagacgcttaccctctggcagtccacagggccatggggccctggatggcaggagctggcagtgacaactggccggatcagaggcgattttcgtgttacctttagcgcgacacgcaacgccacacacaggggagctgttgcgctggatgatctcgaattttgggactgcgggctccccacgccccaggcaaactgcccaccgggtcaccaccactgtcaaaacaaggtgtgtgtggaaccgcaacagctgtgcgacggtgaagataactgtggcgacctgtccgatgagaatccactcacatgtggtagacatatcgccacagacttcgagacaggcctcggcccctggaataggtcggagggatggtcccgcaatcacagggcaggcggcccggagcgtcccagctggcctaggcgggaccacagccgcaatagcgcccaggggtcatttctggtgtccgtcgcagagcccgggacgcctgctattctgtcttcgcctgaatttcaggcttccgggaccagcaactgttcacttgtgttttaccagtatctgtccggctctgaagcaggctgcctgcagctgtttctccagaccctggggccaggtgccccccgcgcccccgtacttctgcgtaggcgaagaggtgaactgggcacggcatgggttcgggatcgggttgatattcaaagcgcctatcccttccagattttattggctgggcagactggccctgggggggtagtagggcttgacgatctgatcttgtctgatcactgccgtccggtgtcagaagtgagtactctacagccattaccaccaggcccacgcgctcctgctcctcagccactgccaccatctagccgactgcaggactcctgcaaacagggccacctggcctgcggagacctgtgcgtaccgcctgaacagttgtgtgatttcgaggagcagtgtgctggaggcgaagatgagcaagcgtgtggcaccacagatttcgaaagccccgaggcaggcgggtgggaagacgccagtgtggggaggttgcagtggcgtcgggtgtcagcccaagaaagtcaaggctcttccgccgcagcggcaggcgaagcacaaggccacttcttaagcctgcaaagggcttggggacagctgggggccgaagccagagtgctcacccctctgctcggcccttcgggcccctcatgtgagttacacctggcttactacctacagagccaacctcgaggcttccttgctcttgtggtcgtggacaacgggagccgggagctggcatggcaggcattgtccagcagtgcaggaatttggaaggtagacaaggtgcttttgggggctcggagacgacctttccgcctggagtttgtaggactggttgatctggatggaccggaccagcagggagcaggagtcgataacgtaaccctaagggattgcagcccaacagtcaccaccgagagggatcgtgaggtctcttgcaacttcgaaagggatacatgctcctggtacccagggcatctgagcgacacgcattggcgctgggtagagtcccgaggccctgaccacgatcacaccaccgggcagggacactttgtactcctcgacccgaccgatcccctggcatggggacactcggcacatttgttgtcaaggccacaggtgccggcggctccaactgaatgcctgtccttttggtatcacttgcacgggcctcaaattgggacccttagactggcaatgaggcgcgagggggaagagacccatctttggtctagatccgggacccaaggcaatcgatggcacgaggcctgggcgacgctgtctcaccagccgggttctcacgcccagtatcaattgctgttcgaaggtctgcgcgacggctaccatggtacgatggctttagacgatgtggctgtcagaccaggcccttgttgggcacctaactactgctcattcgaggactcagattgtggcttcagccctggaggccaggggttgtggcgtcgccaggccaacgccagtggtcatgcggcttggggtccgcctaccgatcacacgaccgagaccgctcagggccattacatggtcgtagatacctcaccagacgcactacccagaggccagacggccagcctgacgtctaaggagcaccgcccactggctcaaccagcatgtctcacattctggtaccacgggagtctgcgcagcccaggcactttgagggtctatctcgaggaacggggccggcatcaggtcctgagtctgtccgctcatggaggtctggcttggcgactcgggtctatggacgtgcaagcagagcgggcgtggcgggtggtattcgaggccgtggccgcaggagtggctcattcatatgtggccttggacgatctccttttgcaggacggcccgtgccctcaacctggatcgtgcgactttgagagcgggctgtgcgggtggagccatctggcttggcccgggttgggcgggtattcctgggattggggaggaggtgccactccttccagatatccacagcccccggttgaccataccctagggactgaggcggggcattttgctttcttcgagaccggggttctgggccccggaggccgagcggcctggcttcgttcggagccactgccggcaactcccgccagttgcctacgcttttggtaccacatgggcttccctgaacatttttacaaaggagaacttaaggtgcttctgcactcagcccagggccagcttgctgtctggggcgctggcggccaccgtaggcaccagtggcttgaggcccaagttgaggtggctagcgctaaggagtttcagatagtctttgaggccaccctcggaggccagccagccttaggaccaatcgccctggacgacgtagagtatctggctggtcaacattgccagcaaccggcacctagtccaggcaacaccgccgcccccggctcagttccagccgtcgtcggcagcgccctcctccttctgatgctcctggtcctcctgggcctaggagggcgccgttggctccagaagaagggttcatgcccattccaatcgaacacagaagcaactgctcccggcttcgataacattttattcaacgctgatggtgtgaccctgccagcctcagtcaccagcgacccatag

SEQ ID NO: 27662 - DNA, 3651 bp, Artificial Sequence
  Description of Artificial Sequence: Synthetic coding sequence
atgcctctttccagccaccttctccctgcgctggtcctttttttggccgggagttccggctgggcctgggtgccgaaccattgtaggtcgcctggtcaggctgtgtgtaactttgtgtgcgattgccgggactgtagtgatgaggcgcaatgcggttaccacggtgcctccccaacgctgggcgcacctttcgcctgtgactttgagcaggacccgtgcggctggcgcgatatttccaccagcggttattcttggctgcgcgacagagctggagcagcgctggaggggccgggtccacactccgatcacaccctgggaaccgatctgggatggtatatggccgtgggtacccatcgtggcaaggaggccagcacagcagccctgaggagtcctacccttcgggaagctgcttccagttgtaagctgcgactgtggtaccacgctgcaagtggtgacgtggctgaacttagggtcgagctgacacacggtgctgaaactctgaccctgtggcaatcgactgggccctggggccctggttggcaggaactagccgtgacgacgggaaggattcggggggactttcgtgtcacattcagcgcgaccagaaacgcgacacatagaggtgcagtagccttggatgatttagagttttgggactgtggcctgcccacgccccaagcaaattgtccacccggacatcatcattgtcagaacaaagtatgtgtggaacctcagcagctttgtgacggtgaggacaactgcggcgacctgtccgatgagaatcccttgacttgcggcagacacatcgctaccgacttcgagacagggctgggaccttggaaccgaagtgagggatggagtcgtaatcatcgagccggcggcccagaacgaccctcctggcctcgtcgtgaccatagtagaaatagcgcccagggtagctttctggtgtctgtggcagaaccagggacaccggctatactctcctctcccgagtttcaagcgtcaggcacatctaactgtagcctcgtgttctatcagtacctttcaggatcagaagccggttgcctgcagctgtttctgcagactctgggccctggcgcaccacgggctcctgtgctactacggcgccggaggggtgaactgggcacagcttgggtccgcgacagagttgacatacaaagcgcttacccttttcagatcctgctggccgggcagacgggcccaggaggcgtcgtgggactcgacgacctgatcctctccgatcactgtcgtcctgtatcagaagtgagtacattacagccactccctccagggccaagagctcccgcgcctcagccgctcccgccgtctagcagactgcaggatagctgtaaacaggggcacctggcctgtggggatttatgcgtaccccccgaacagctttgtgatttcgaagagcaatgtgctgggggggaagatgagcaagcgtgtggaacaaccgactttgaatccccagaagcaggcgggtgggaggatgcctcagtgggtcggctccagtggaggcgggtgagtgctcaggaatcccaaggatcgtccgctgcggcagccggacactttctgtcacttcagcgagcctggggtcagttgggcgctgaggctcgggtcctgacacccttgctgggcccttctggccctagctgcgagctgcacctcgcctactatttacagagccaaccgcgtggatttttggccctggtggtggtggataacgggtcaagggagctggcttggcaggccctttcctcctcagcaggtatttggaaagtggacaaagtgctgcttggcgcacggagacgcccttttagacttgaattcgttggacttgtggacctggatggccccgaccagcagggtgccggcgtcgacaatgtgactctcagagattgctcccccacggtgaccacggagcgcgaccgcgaggtatcctgcaacttcgagagagacacttgttcctggtaccctgggcacctgagcgacacacactggagatgggtggagtcccgggggccggaccatgaccataccaccggtcaaggacactttgtgctcctcgatcccactgatccgctggcatgggggcatagtgcacatctgctcagtcggccccaggtgcctgctgctcccaccgagtgtctcagtttctggtaccacctgcatggcccacaaatcggtacattaagactcgctatgcgccgcgagggtgaggagacccatctgtggtcaagaagcgggacacaggggaatcgttggcatgaagcctgggccaccctgagccatcagccgggctctcatgcacagtaccagctgctgttcgaaggactgcgcgatggctatcacgggacaatggcattagacgacgtggccgtgaggcccggtccttgctgggcgcctaattactgcagctttgaagatagtgactgtggattctctccggggggacaggggctctggagaagacaggcaaatgcttcaggtcacgctgcctgggggccacccaccgaccataccaccgagacggcacagggtcactatatggttgtggatactagtccagacgcactccctcgaggacaaaccgcttctctgacaagtaaggagcaccggcccctggctcagccagcctgcctgactttttggtaccatggatctcttagatcccccggaacactcagagtttatctggaggaaagggggcgccaccaggtcctctccctgtccgcccatggcgggctcgcctggaggcttgggagtatggatgtccaggcggagcgcgcatggcgggtggtgtttgaggccgtcgcagctggtgtggcccactcatacgtcgctcttgatgacttgctactgcaggatggaccctgcccacagccaggatcctgcgacttcgagagcggcctttgcgggtggtcccatctggcttggcccggtttaggcggttacagttgggactggggaggaggcgctacgccatccagataccctcagcctcccgtggaccatactctgggaaccgaggccggccattttgctttcttcgaaacaggcgtactgggaccaggcggaagggctgcgtggctaagatcggagccactaccagccacaccagctagttgtttgcgcttctggtatcatatgggttttccagagcatttctataaaggagaactgaaagtactcctgcattccgcacaggggcagctggcggtgtggggtgccggaggtcatagaaggcatcagtggctcgaagctcaggtggaggtggcaagtgcaaaggagtttcagatcgtatttgaagctacacttgggggtcagcccgcactgggccctatcgccctggacgacgtggagtacctggccggtcagcactgtcagcagcccgccccttcacctgggaatacagcagctcccggaagcgtcccggccgtcgtgggatcagctctcctgctactgatgctgctggtgctgctgggactgggtggcaggaggtggctgcagaagaagggcagctgccctttccagtctaatactgaggctacggccccgggcttcgacaacatactgtttaacgcagatggggtcacattacccgcctccgtcacgtccgacccatag

SEQ ID NO: 27663 - DNA, 1353 bp, Artificial Sequence
  Description of Artificial Sequence: Synthetic coding sequence
atgatgcagtttgcttggcagtcctacaagcgctatgccatgggcaaaaacgagttgcgacctttaaccaaagatggctatgaagggaatatgtttggcggactgagtggtgctacagtgatagacagtctggacaccctatatctgatggaactcaaggaagagtttcaggaagctaaagcgtgggtgggagaatcattccaccttaacgtcagcggagaagcttccctgtttgaggttaatatccgttacattggaggcttgttgagcgcattttacttaacaggggaagaagtgttccggattaaagccattcggcttggagaaaaactgctgcctgccttcaatacccccaccggcattcccaaaggtgtcgtgagctttaagagtggaaactggggatgggcaacagccggttcctcaagtatcctggctgaattcggaagcctacatttggaatttctccacctgaccgagctgtctggcaaccaggtttttgccgagaaggtcaggaatatacggaaggtgctcagaaagatagagaaaccgtttgggctctatcctaattttctgagtcctgtgagtggcaattgggttcaacatcacgttagtgtcggtggattgggggacagtttttatgaatatctcatcaagtcttggctgatgtcagggaagacagatatggaagcaaaaaatatgtactacgaggcccttgaagcgatcgagacatacctccttaatgtaagtcctgggggactcacatatattgctgaatggcgcggagggatcctggatcataaaatgggacacctggcttgtttctctggaggcatgattgccctcggggcggaggacgctaaagaggagaagcgcgcccactaccgcgagctggccgctcaaattaccaaaacctgccatgagtcatacgctaggagcgacaccaaattgggccccgaggccttctggtttaatagtggaagagaggcggtggctacacagttaagtgagtcttactacatcctccgccctgaagtagttgaaagttatatgtacctatggaggcagacccataaccccatctaccgggagtggggctgggaggtggtgctagcccttgaaaagtactgccgtacggaggcaggctttagcggcattcaggatgtatattcttcaacgccaaatcacgataataaacaacagtccttttttcttgcagaaacactgaagtacctgtatttgctgttttcagaggatgatttgttgtccctcgaggactgggtgtttaacaccgaagcccatcccctgccagtgaaccattccgattcctctggacgcgcttgggggcgacactag

SEQ ID NO: 27664 - DNA, 1206 bp, Artificial Sequence
  Description of Artificial Sequence: Synthetic coding sequence
atggaactaaaagaagaattccaagaggccaaggcatgggtgggggagagtttccatctgaatgtgtctggcgaagcatctctgtttgaggtgaatattagatatatcggggggttactgtccgcattctatctgacaggcgaggaagtatttaggataaaggcgatccgcctgggtgaaaagctgttgccggcgtttaacacacccacagggataccaaagggcgtggtgtcctttaaaagtggcaactggggttgggctaccgccggaagctcttcaatcttggcagagtttgggagcctgcatctggagtttttgcaccttacagagctttccggaaatcaggtcttcgctgagaaagtgaggaacataagaaaggtgcttcgcaaaattgagaagcccttcgggctctaccctaacttcctgtcccctgtgtcaggaaactgggttcagcaccatgtaagcgttgggggactgggagacagcttttatgaatatctgatcaaatcctggttgatgtcaggtaaaaccgacatggaggcgaagaacatgtactacgaggccctggaagctatcgagacgtatctacttaacgtctcccccggcggcttgacgtatatcgccgaatggagggggggcatcctcgaccacaaaatgggtcacctcgcctgcttctctggcggaatgatcgcactgggagctgaggacgctaaagaagagaagagagctcattatcgggagctcgcagcccagataactaagacttgccacgaatcctatgctcgcagcgataccaagcttggccctgaagcgttttggttcaatagcggccgggaagccgtcgccacccagctttcggaaagctactacatcctgcgccctgaggttgtggaatcctacatgtacctttggcgccaaacccacaatcctatctatcgcgagtggggctgggaggtcgtcctggcactcgaaaagtattgccggacagaggccggattctctgggattcaggatgtctactcatccaccccgaatcatgacaacaaacagcagtccttcttcctcgccgagaccctgaagtatctatatttactgttttctgaggatgacctcctgagtctagaagattgggtgttcaatacagaagctcaccccctcccagtgaaccatagcgactcctccggtcgtgcatgggggcgacactag

SEQ ID NO: 27665 - DNA, 1170 bp, Artificial Sequence
  Description of Artificial Sequence: Synthetic coding sequence
atgatgcaattcgcttggcagtcttataagcgctatgctatgggcaagaatgaactgcggcccctcactaaggatggatacgaggggaatatgttcggagggctgagtggcgctactgtgattgacagcctggacacactgtaccttatggagctgaaggaggaattccaggaagcgaaagcctgggtgggggaatcgttccacttaaacgtgtctggcgaggcttccttatttgaggtcaacatccgctatattggcggactgctgagtgccttttatctgaccggggaagaggtgttcaggataaaggctattagactgggggagaagcttctgccggccttcaatacacccactggtatcccaaaaggtgtcgtgtctttcaagtctgggaactggggctgggcaacggctgggagttcaagcattctggcagaattcggcagcctccatcttgagttccttcatctgacagaactgagcggtaaccaggtgttcgctgaaaaagtgaggaatattcgaaaagtcctcaggaagatcgagaagccattcgggctctatcctaattttctttctcccgtgtctggaaattgggtacagcaccacgtgagcgttgggggcctcggggattcattctacgaatacctgatcaagtcgtggttaatgtccggtaagacagatatggaggccaaaaatatgtactacgaagccctagaggctattgaaacgtatttgctcaatgtgtccccaggggggctgacgtacattgcagagtggcgcggcggaatactagatcataaaatgggccatctggcttgctttagtggcggaatgatcgccttgggggcagaggatgcaaaagaggaaaagcgagcccattaccgggaacttgcggctcagattacgaagacatgtcatgagagctacgcccgatctgatactaaactgggaccagaagcgttctggtttaactctggtcgcgaagctgtggcgacccagctcagtgaaagctactacattctacgccctgaggtcgtggagagttacatgtatctttggcggcagacacacaatccaatttacagagaatggggttgggaaggtgccggcttaggcgagatattgtctgatagaagccggttcctgtgggaccctcgacgggtccaatag

SEQ ID NO: 27666 - DNA, 1893 bp, Artificial Sequence
  Description of Artificial Sequence: Synthetic coding sequence
atgctgatgaggaaggtacctggctttgtacctgcaagcccatggggtctgcgccttccacagaagttcttatttcttctttttttgagcggactagtgaccctgtgtttcggtgctctcttcctgctgcctcactctagtaggctgaaacgactttttcttgcaccaagaacccagcaacctggtcttgaggtcgtggccgaaatcgcaggccacgccccggcccgggaacaggagcccccaccgaacccagcacctgcggccccggctcccggggaggacgacccaagttcatgggcctcacctcggagacggaaggggggattacgccgcactcgcccaacgggaccacgggaggaggctactgcagcccgcggaaacagtatacctgcgagtcggccaggggatgagggtgtcccgtttcggttcgattttaatgcctttcggtccaggttaaggcaccccgtgcttggaaccagggctgacgaaagccaggaacctcaatcccaggttcgcgcacagagagaaaagatcaaggaaatgatgcagtttgcgtggcagtcatacaagagatacgctatgggtaagaatgaactcaggccacttacaaaggacggttacgaaggcaacatgttcgggggcctttcgggggccaccgtcattgattccctggatactctgtacctgatggagctgaaggaggagttccaggaagctaaggcctgggtgggagaaagcttccacctcaacgtcagcggagaagcgtctctgtttgaggtgaacattaggtatatcggtggactgcttagcgcattctacctgacaggggaggaagtcttccgaatcaaagccatccgactgggggaaaagctgttgcctgcgttcaacacccccaccggaatccctaagggcgtggtctctttcaaaagcggaaattggggctgggccactgcgggatccagcagcatactggccgagttcggctcactgcatctggaattcctgcatctcactgaactctccggaaaccaggtcttcgccgagaaagtgagaaacattagaaaggtcctccggaaaattgagaagccctttggcttataccctaattttctcagccctgtgtccgggaactgggtgcagcaccacgtatcagtgggcggactgggagattccttctatgagtacctgattaagtcctggcttatgtccgggaagaccgacatggaagccaagaacatgtactatgaggccttagaggcaattgagacgtacctgctcaatgtcagcccagggggactgacctacattgcagagtggcggggcggtatcctggaccacaagatggggcatctcgcgtgcttctctgggggcatgattgctctaggagcggaagatgcaaaagaggagaaacgagcccactaccgggagctggcggcacaaataacaaaaacatgccacgaaagttacgctcgttcagacaccaaactcggacctgaggctttctggttcaatagtggtagggaagctgttgcgactcagctgagcgagtcctactacatcctgagacctgaggtagtcgagagctatatgtatctgtggcggcagacgcacaatccaatctaccgagagtggggatgggaggttgttctggccctcgaaaaatactgccggaccgaagctggctttagtggcattcaggacgtgtactcttctactcctaaccatgataacaagcaacagagtttttttctagccgaaacactcaagtacctgtacctgctattctccgaagacgacttactaagcctagaggactgggtgttcaacactgaagcacacccactcccggttaaccacagcgactctagtggacgagcctggggaaggcactag

SEQ ID NO: 27667 - DNA, 258 bp, Artificial Sequence
  Description of Artificial Sequence: Synthetic coding sequence
atggcaagcgatctcgatttttctccgccagaggtaccagaaccaactttcctggaaaaccttttacgctatgggttgttcctgggtgccatttttcagctgatctgtgtcctagccatcatcgtgccaatccccaagtcacatgaggcagaggcagagcctagtgaacccaggagtgctgaagtgaccagaaagcctaaagctgcagttccctctgtcaataagcggcccaagaaggaaacgaaaaaaaagcgctag

SEQ ID NO: 27668 - DNA, 258 bp, Artificial Sequence
  Description of Artificial Sequence: Synthetic coding sequence
atggcctctgacttggacttttctcctccagaagttcctgaacctacattcttagaaaacttgctgagatatggcttgttcctgggcgccatctttcagctgatctgtgtgctggctatcatagttcccattcccaaatcccatgaggccgaggcagagccaagcgagcctaggagcgcagaggttactcgtaaacccaaggcagccgtcccctcagttaacaagcgccccaaaaaagagaccaagaagaaacggtag

SEQ ID NO: 27669 - DNA, 171 bp, Artificial Sequence
  Description of Artificial Sequence: Synthetic coding sequence
atggcatccgacctggacttcagtcctcctgaggtgcccgagcctaccttcctcgaaaacctgctgcggtacgggctttttttaggcgctatcttccagctaatatgtgtcttagccatcatcgtgccgattcctaaatctcacgaagccgaattccacgtggaggcttag

SEQ ID NO: 27670 - DNA, 258 bp, Artificial Sequence
  Description of Artificial Sequence: Synthetic coding sequence
atggcctctgaccttgattttagcccacccgaggtgcccgagccgacattccttgagaatctccttcggtatggactctttttgggggcgattttccagctcatttgcgtgctggctattattgtgcccatccctaaatcccatgaggctgaagccgagccaagcgaacctcggtcagccgaagttactagaaaacctaaggccgccgtgccatctgtcaacaaacgacccaaaaaagaaaccaaaaagaaaagatag

SEQ ID NO: 27671 - DNA, 258 bp, Artificial Sequence
  Description of Artificial Sequence: Synthetic coding sequence
atggcatccgacctcgatttctccccacctgaagtcccagagccaacttttctggagaacttgctgcgatatggcctatttcttggagccatcttccagctgatttgtgtgctagcaatcattgtcccaattcccaagtctcatgaggccgaggccgaaccttctgagcctcgttcggccgaggtgacaagaaagccaaaagcagcggtccctagtgtgaacaaacggcctaaaaaagagacaaagaaaaaaagatag

SEQ ID NO: 27672 - DNA, 258 bp, Artificial Sequence
  Description of Artificial Sequence: Synthetic coding sequence
atggccagtgatctggattttagcccacccgaggtgcctgaacctacatttctagaaaatctccttcgctacggcctgtttctgggtgccattttccaacttatctgcgtcttggccataattgtgccaattcccaagagtcacgaggcagaagctgagccaagcgaaccccggtctgccgaggtcacacgcaagccaaaggccgcagtaccgtcagttaataagaggcccaaaaaagagacgaaaaaaaagcgttag

SEQ ID NO: 27673 - DNA, 708 bp, Artificial Sequence
  Description of Artificial Sequence: Synthetic coding sequence
atgattacaggcagtcctcaaatgacgtggtgccctccgttttggacccctcccatttccaccgccagcaggtatggaagccacggcgctttttacagatataagaattccatgggtaaatctttgcctttattctacatttacgatagctacctgacgtctccggaggcctgggcccatctgcttactcctaacgggcctcatagcattagaaacaccccatatgatggcgtgttcattgctctgctggttgaagagggacacacccacgatattctggcggccggattcgacggtatgtacacctactttgcatctaacggcttcagcttcgggtcttcacaccagaactggaaggcagttaagaacttttgcgacgctaataatctcatgttcataccgtctgtgggtcctggatacattgacacctcgatccgcccttggaacaatcataatactcggaaccgggtgaatggaaagtattatgagacagcactgcaagctgccctgacagtgaggcccgaaattgtcagcataacatcctttaatgaatggcacgaaggcacgcagattgagaaagcaatcccaaagaagacaccaacgaggctgtatttggactacctgccacaccaaccttctctatatctggaattaacccgacgctgggcagagcattttattaaagagaaggaacaatggttaatgtag

SEQ ID NO: 27674 - DNA, 1374 bp, Artificial Sequence
  Description of Artificial Sequence: Synthetic coding sequence
atggcccgacgacggcgaagagcgtgtatcgcactgttcctggttctactgtttgccttcggaaccctgatgggattgcgtacactcaaggcaccagacggactacctgccctcggtcctgggttagaattggcccccttcgaacgaaggcccgaaggggcacctgcgcctgccgctcgcgcaccagcggcgcccgccgccccccctccgccacccccaccgcctagaaccgcagaccccggcggatccccaggccccgctccggccgaggctgagcctgctcccgtgcaaagtcttcgggtctactctgacctacacgcattctattactcatggtatggatccccacgaagagagggccattacatccactgggaccacgttatggtacctcactgggaccccaagatatctgctagttacccaagaggcaggcattcgccacccgatgacctcggctcaagcttttaccctgaacttggcccgtatagctcccgtgaccctgaagtactccgcgagcacatgacacaactgaaggaagccgcaatcggggtgctagtcctcagttggtacccacccggcatggctgatgacaacggcgaaccctctgacgacttggtccccgcgatcctcgacaccgctcaccagtattctatacaggtcgcctttcatatccagccttataaaggtagagacgacattactgtgcacgataacatcaagtacatcatagatacatatggctcgcatggagccttctacagatacaagaactcaatgggtaagtccctgcccctcttttacatctacgatagctatttgacctccccagaagcttgggcacacctgctgaccccaaatgggccacactccattagaaatactccgtatgacggtgtgttcattgcccttctggtcgaggaggggcacacccatgacattctggctgcaggcttcgatgggatgtacacctactttgccagcaacggttttagctttggctcttcacatcagaattggaaggctgtgaaaaacttctgcgacgcgaataaccttatgtttatccccagcgttgggcctgggtatatagatacatctatcagaccctggaacaaccataacactaggaacagggtgaatggcaagtattacgaaactgccctccaggcagcgctgacagtcaggcccgagattgtttcgattacaagttttaatgagtggcacgaaggcacgcagatcgaaaaagctatacctaaaaagactccaacacgtctgtacctggattacctcccgcatcagccatccttgtacttggaactgacacgcaggtgggcagaacatttcataaaagagaaggagcaatggctgatgtag

SEQ ID NO: 27675 - DNA, 753 bp, Artificial Sequence
  Description of Artificial Sequence: Synthetic coding sequence
atggccagacggcgtagacgtgcatgcatcgccctcttcctcgtgcttctgtttgccttcggaacccttatgggcctgagaacattaaaggcgccagatgggctgcccgctctgggccccggcctcgaactagcgccctttgaaagacggccggagggagccccagcacccgctgccagagcacctgccgccccagctgcccctcccccacccccccctccaccaaggaccgccgatcccggaggatcacctgggcctgcaccggcagaagccgaacccgcccccgtacagtccctcagagtctattctgatttacatgcattttattactcctggtacggaagccccaggagggaagggcattatatccactgggatcatgtaatggttcctcactgggaccctaagatatccgcatcatacccccggggtaggcactcccctcctgacgacctgggatcttcattctatcccgaactcggtccctattcctcccgcgacccggaggtacttcgcgagcacatgactcagcttaaggaagcggccattggtgtgctagtcctgagctggtaccccccaggaatggccgatgacaacggggagccgtctgatgacctcgtgcctgctatcttagatactgcccatcagtactctatacaggtggcctttcatatccagccatataagggtcgggatgatattacagttcatgacaacatcaagtatataatagacactactggcaaactatag

SEQ ID NO: 27676 - DNA, 1437 bp, Artificial Sequence
  Description of Artificial Sequence: Synthetic coding sequence
atgtttaagtttcaccagatgaagcacatttttgaaattctagataagatgagatgtttgagaaaacggtcgactgtatcatttttaggagtgctggtgatcttcctcttgtttatgaatttatacattgaggattcctatgttttggaaggggacaaacagctgatccgcgagacctcaacccaccagttaaactcagagaggtacgtccatacatttaaggatctgtcaaattttagtggcgcgattaatgtaacataccggtacctcgctgccacacctctccagcgaaagaggtacttgacaatcggcctgtcttctgtaaagagaaagaagggcaattacttgctggagacaatcaaatcgatttttgagcagagttcttacgaagagctgaaggagattagtgtggtcgttcacttggccgattttaactccagttggcgagacgccatggtccaggatattacccagaagttcgcccatcacatcattgccggtcggctgatggtgattcacgcccctgaagagtattatcccatcttagacggtcttaagcggaattacaatgatcctgaggaccgggttaagttccgatctaaacaaaacgtggattacgctttcctgttgaatttttgcgccaacacatccgactactatgtgatgctcgaggatgatgtgaggtgcagcaagaactttctgacagctataaaaaaagtcatcgccagcctggaagggacttactgggtgaccctagagttcagtaaattgggatacattggcaaattgtaccattcgcacgatctgccccgactcgcccacttcctcctcatgttttatcaggagatgccttgcgactggctgctcactcattttcgggggcttctggcccaaaaaaatgtcatccggtttaagccaagcctttttcaacatatgggctactacagttcttacaaaggcaccgaaaataaactcaaagacgacgattttgaggaggagagcttcgatatacctgacaaccctccagccagcctgtatacaaatatgaatgtgttcgagaattacgaagcctccaaagcttatagctccgtggatgagtatttctggggcaaaccccctagtactggggatgtcttcgtgatagttttcgagaatcctattatcattaagaagattaaagtcaacaccggcaccgaagatcgtcagaacgacattcttcaccatggcgccctcgacgtaggagaaaacgtgatgcccagcaaacagcgtagacagtgcagtacatacttacgtctgggcgagttcaaaaatggcaatttcgagatgagtggagtgaatcaaaagataccttttgacattcactgcatgcggatctacgttaccaagacacagaaggagtggctcattataaggagcatatccatctggaccagttag

SEQ ID NO: 27677 - DNA, 1524 bp, Artificial Sequence
  Description of Artificial Sequence: Synthetic coding sequence
atgcttggaaaggacatggttagattcgtcgtgcggaagacggtgcagcgcagtgttgctaagggaagtcgaagatgtaagaagcgcatgtttaagttccatcagatgaaacatatctttgagattttggataagatgcgctgcctgagaaaacgaagtaccgtctccttccttggcgtcctcgtgatctttcttcttttcatgaatttgtacattgaagactcatatgtcctggagggggataagcagttaataagagaaactagtacacaccagctgaattcagagaggtacgttcacaccttcaaggacctgtcgaatttctctggggcgatcaacgtaacttatcgatatctagccgccactccattgcaacggaagagatacctcaccatcggcctctcttccgtgaagcggaagaagggtaactacctgttagagaccataaagagtatctttgagcagtcgagttatgaagaattgaaagagatatccgtggtcgtgcacctggcagattttaattcctcttggcgggacgcaatggttcaggacatcacacagaagtttgcgcatcacataattgctgggaggctcatggtgattcatgccccggaggagtactatccaattctggacggactgaagagaaattacaacgatcctgaggatcgcgtcaagtttcgaagtaaacaaaacgtcgactatgcctttctgctgaacttctgcgccaatactagcgattactatgtgatgctcgaggatgatgtcaggtgctccaaaaatttcctgaccgctatcaagaaggtgattgccagtttggaggggacttactgggtgacgctcgaattttcaaagctgggatacatcggaaaattataccattcccatgacctacctcggctcgcacactttctattgatgttctaccaggaaatgccttgtgactggttgctgacgcatttccgagggctgctggctcagaaaaacgtaatccggttcaagccaagcctgttccagcacatggggtactactcctcatataagggaaccgagaacaaactcaaggacgacgacttcgaagaagaatcattcgatatccctgataatccgcccgcaagtctgtacacaaacatgaacgtattcgaaaattatgaagcctccaaagcttattctagcgttgacgagtatttctggggcaaaccgcccagcactggcgacgtgttcgtaattgtgttcgagaatcccattatcatcaagaaaatcaaggtaaataccggtacagaggacaggcagaatgacatccttcaccatggggctctcgacgttggtgagaatgtgatgccctccaaacagcggcggcagtgctccacttatctgaggcttggtgagtttaaaaacgggaatttcgaaatgtccggcgtaaaccagaaaatccccttcgacatccactgtatgaggatctatgttacaaagacccaaaaagagtggctgataatccgcagtatcagcatctggacgtcttag

SEQ ID NO: 27678 - DNA, 1197 bp, Artificial Sequence
  Description of Artificial Sequence: Synthetic coding sequence
atgttcaagtttcatcaaatgaagcatatattcgagatcctggataaaatgaggtgtctgcgaaaacggagtaccgtgagctttctgggtgtgctggtgatctttcttctgtttatgaacttgtacattgaggactcatatgtcttggaaggagataagcagctgatcagggagacctccacgcatcagctgaatagcgagagatatgttcatacctttaaagacctttctaacttttctggcgcaatcaacgtcacttaccgctaccttgcggcgaccccactgcagagaaagcgttatttaactatcggattgtccagcgtgaagcgaaaaaaggggaactatctgctggaaaccattaaatctatcttcgaacagtcgtcgtatgaggagttaaaagagatcagtgtcgttgtccacctggcagatttcaattcctcttggagagatgctatggtccaggatatcacccagaaatttgcacatcatattatcgccgggcgacttatggttattcatgcccctgaagaatactaccccattctggatggcctgaaaagaaactacaatgaccctgaagacagagtcaagtttagaagcaaacagaacgtcgattatgccttcttgcttaatttctgcgccaatacctctgattactatgtaatgctggaggatgacgttagatgttctaaaaattttctgacggccataaaaaaagtgatcgcaagtctcgaaggaacctactgggtgacattagagttcagcaagctggggtacatcggaaagctgtaccactcacatgacttgccccgcctggcacactttctgttgatgttctatcaggaaatgccttgcgattggctactcactcacttccgcggactgctcgcccaaaagaacgtaatacgttttaagccttctttatttcagcacatgggttactacagcagctacaagggtacggaaaacaagctgaaagacgacgattttgaggaggagtcatttgatattcctgataaccctcccgcatcgctgtatacgaatatgaatgttttcgagaattatgaggcatcaaaggcctattcgagtgtggacgagtatttttggggcaagcctccgagtacaggagacgtattcgtaattgtgtttgaaaacccgattattatcaagaagataaaagtgaacacaggaacttag

SEQ ID NO: 27679 - DNA, 1437 bp, Artificial Sequence
  Description of Artificial Sequence: Synthetic coding sequence
atgttcaagttccaccaaatgaagcatatttttgagatactcgataagatgcgatgtctcagaaaaaggtccacagtctcattcctcggagtgttggtgatctttctgctcttcatgaacctatatattgaagattcttacgtgctggaaggggacaaacagctgatacgagaaacctccacccaccagctaaattcagaaagatatgtacatacctttaaagatctcagcaacttcagcggcgccatcaatgtgacataccggtatctcgctgctacgccgctccaacggaagagatatctcacaatcggtttgagctcagtgaagcggaaaaaggggaactaccttttggaaactattaagtcaatattcgagcaatcaagctatgaagagctcaaagagatttccgtggtggtgcaccttgcggacttcaattcctcttggcgcgatgcaatggtgcaggacatcactcagaagttcgctcaccatattatcgccgggcggctgatggtcattcatgcgcctgaggagtactacccgattcttgatggtctaaaaagaaactacaacgatcctgaagaccgcgttaaatttcgtagcaagcaaaatgtggattacgcctttctcctgaacttctgcgctaacacatctgattactacgttatgctggaagatgacgtgaggtgttccaaaaactttcttactgccattaaaaaagtgatcgcgtcacttgaggggacatattgggtaaccctcgagtttagtaagttgggatacattgggaagctgtaccactctcatgatctcccccggctcgcccactttctgcttatgttctaccaagaaatgccctgcgactggttattgacccatttccgcggccttttggcgcagaagaacgtaattaggtttaagccttccctttttcaacacatgggatactattccagttacaaaggcacggaaaataaactgaaagacgacgactttgaggaggaatcttttgacatccccgataaccccccggccagtctgtacacaaatatgaatgtgttcgagaattatgaagcctcaaaggcttattcaagcgtggacgaatatttctggggtaaacccccttcaacaggcgatgtgttcgtgatagtcttcgagaatccaataattataaaaaagatcaaagtgaataccggcactgaggaccgacagaacgatatcttgcaccatggcgccctcgatgtcggtgagaacgtgatgccgtcaaagcagcggaggcagtgctctacatacctgagattgggggaatttaagaacggcaactttgaaatgagcggagtgaaccagaagataccttttgacatccactgtatgcggatttatgtgacgaagacgcagaaggagtggctcattattcggtccatcagtatttggacttcctag

SEQ ID NO: 27680 - DNA, 1437 bp, Artificial Sequence
  Description of Artificial Sequence: Synthetic coding sequence
atgttcaaatttcatcagatgaaacacatcttcgaaatcctcgacaaaatgcggtgcctgaggaagagatctaccgtaagttttctgggagttctggtgattttcctgttgtttatgaatctctatattgaggatagctatgtcttggaaggtgacaagcagctcatccgcgagactagcactcaccagctgaacagcgagcggtacgtgcacactttcaaggacctctcgaattttagcggcgccatcaacgtgacttatcgctatctggcggccacccctttgcaacgcaagcggtatctcacaattgggctctcaagcgtcaaaaggaagaagggaaattatctcctggagaccattaaatcaatctttgagcagtcatcatatgaggagctgaaagagatctctgtagtggtgcacctggccgacttcaacagctcttggagagacgccatggtccaggacatcacacaaaaattcgcccaccacatcattgctggtagactaatggtgatccatgctccagaggagtattacccaattctagatgggctaaagcgaaattacaatgatccagaagatcgggtgaaattccggtccaaacagaacgtagattatgctttcctgctgaatttctgcgcgaacacgtcagactactacgtgatgctagaagacgatgtacgctgtagcaaaaactttttaaccgccatcaagaaggtcatcgccagcctggaagggacttattgggtcacattagagttcagtaagctcggttacatcggcaagctgtatcatagccacgatctgccgcgcctggcgcatttcctgttgatgttttatcaggaaatgccctgtgattggctgctcacccatttcaggggtctgttggctcagaaaaacgtcatcagattcaaacccagcttgttccagcatatgggctactatagctcatataaaggcaccgaaaacaaattgaaggatgacgacttcgaggaagaatcctttgacatcccggataaccccccggcctccttatacacaaatatgaacgtgttcgagaactacgaggcctcaaaggcatacagctcagtcgatgaatatttctgggggaagcccccatccacaggtgatgtgttcgtgatcgtctttgagaatccgatcatcatcaagaaaataaaggtcaatacggggactgaggatcggcagaatgacatcctgcatcatggtgcactggatgtcggcgagaacgtgatgccatccaaacagaggcgccagtgtagcacttacttgcgattgggggaattcaagaacggaaattttgagatgtccggagtgaatcagaaaatcccttttgacatacactgtatgaggatatacgtaacaaagacgcagaaagaatggttaattattcgcagcatcagcatctggacctcctag

SEQ ID NO: 27681 - DNA, 1437 bp, Artificial Sequence
  Description of Artificial Sequence: Synthetic coding sequence
atgtttaagtttcatcagatgaagcatatcttcgagatcttagataaaatgcgatgtcttcgaaagagatcaaccgtaagctttctcggcgtccttgtgatcttcctgctgttcatgaacctttacatcgaggacagctacgtgctggagggcgataagcagctgatccgcgagaccagtactcatcagctgaacagcgagcggtatgtgcacacattcaaagacctttcaaattttagtggggccatcaacgtgacatacaggtacctggccgccacccctctccagaggaagaggtatctcaccattgggctgagtagcgttaagcggaaaaagggaaactatctgctggaaacaatcaaatcaatttttgagcaaagctcttatgaggaactgaaggaaatctcagtcgttgttcacctggctgatttcaactccagctggagagacgcgatggtgcaggatatcacgcaaaaattcgcccaccacattatcgcagggcggctcatggtgatacacgcacctgaggagtattatcctatcctggacgggcttaagcgcaactacaatgaccctgaagacagggtcaagttcaggtcgaagcagaatgtcgactatgctttcttactgaacttttgcgctaatacgtctgattactatgtcatgttggaggatgatgtgcggtgcagcaagaactttctgactgcaatcaaaaaggtcattgcaagccttgaaggtacgtactgggtgacgttggagtttagtaagctggggtatattggtaagctataccattcccacgacctcccacgcctagcgcacttcctgctgatgttctaccaggaaatgccgtgtgattggttactgactcactttagagggctgctcgcccagaaaaatgtgatccgatttaagccatctctttttcaacatatggggtattacagctcctataagggaacagagaacaagctgaaagacgacgatttcgaggaagaatcttttgacatccctgacaatccaccggctagtctttacaccaacatgaatgtgtttgagaactacgaggccagtaaggcttactcaagtgtagatgaatatttctggggcaaaccgcccagcaccggggatgtcttcgttattgtgttcgaaaaccccatcatcataaagaagattaaggtcaacacagggactgaggaccgccagaatgacattctgcaccacggcgcgctcgatgtcggtgaaaacgtgatgccatccaagcagagacgacagtgttctacctatctccggttgggtgaattcaaaaatggaaatttcgaaatgagcggcgtcaaccagaaaatcccgttcgatatccactgcatgaggatttatgtcacaaagacacaaaaggagtggctaattatccggtccatttctatctggacctcgtag

SEQ ID NO: 27682 - DNA, 1437 bp, Artificial Sequence
  Description of Artificial Sequence: Synthetic coding sequence
atgttcaagttccatcagatgaagcacatctttgaaattctcgataagatgaggtgcttgcgaaagcgaagcacagtgtcattcttgggcgttcttgtgatcttcctccttttcatgaatctttacatcgaagatagctatgtgctcgagggcgacaagcaattaatccgcgaaaccagtacgcaccagctgaactcggagaggtacgtgcatacttttaaagatttatctaatttttccggggccattaatgtgacttacaggtacctggcagcaacaccccttcagcgtaagagatacctgaccattgggctgtcatcagtgaagagaaaaaaggggaactacctgctcgaaacaatcaagagtatctttgagcagtcaagctacgaagagttgaaagagatcagcgtggtagttcacctggcggacttcaattccagctggcgggatgctatggtgcaggacattactcagaaattcgctcaccacattattgcaggccggctaatggtgatccatgcgcccgaagagtactatcccatcctggacggccttaagaggaactataacgatcccgaggaccgtgtcaaattcaggtctaagcagaacgtagactacgcatttctcttgaacttttgcgccaataccagcgattattacgtgatgctggaggatgatgtgagatgctccaaaaatttcctgaccgctattaagaaagtcatagcttcactggagggcacttactgggtcactctggaattctccaagctagggtacatcggcaagttgtaccattcacatgacctgccacggctcgcccattttctgctgatgttctatcaggaaatgccatgcgattggttgttaacccacttccgcggactgctggcccagaagaacgtcattagattcaagcctagcctgttccagcatatgggttactattcttcttacaagggaaccgagaacaagctgaaagacgatgacttcgaagaggagtccttcgatatcccagataatcctccagcctccttatacaccaatatgaatgtgtttgagaattacgaagctagcaaggcctacagttctgtggatgaatacttttgggggaaaccacctagtaccggcgatgtctttgtcattgtctttgaaaaccctatcattatcaaaaagatcaaagtcaatacagggacggaagatcgtcagaacgacattctgcaccacggggctttggatgtcggagaaaacgttatgccgtctaagcagcgcaggcagtgctctacgtatctgagacttggtgagtttaaaaatggcaattttgaaatgagcggtgtcaaccagaaaattcctttcgatatccactgcatgcgcatctacgtcacgaaaacccagaaagagtggctaatcatcaggagtatcagcatttggacctcgtag

SEQ ID NO: 27683 - DNA, 810 bp, Artificial Sequence
  Description of Artificial Sequence: Synthetic coding sequence
atggcaagagcctcctctggcaatggatcagaggaggcttggggtgcactgagggcgcctcagcaacagttgcgggagctgtgccccggcgtgaacaaccagccttatctctgcgagtctggccactgctgtggcgagaccggatgctgtacttactattatgaattatggtggttttggttactgtggacagtcttgatactgttctcatgctgctgtgcctttaggcaccgtagggctaagttgcggctgcagcagcaacaaagacagagggagatcaacctcctggcctatcatggggcctgtcatggcgctggtccttttccaacaggatcactgctagatttgagatttctgagtacgtttaaaccacccgcatacgaagatgtagtccatcggcctggcacaccaccccctccctacactgtcgcacccgggcgaccgctcacggctagttccgaacagacgtgttgctcctcttcctcatcgtgtcccgcccacttcgaaggtacaaatgtggagggggtgtccagccatcaatccgcgccccctcatcaggagggtgaaccgggagccggggtgaccccagcgagcaccccaccatcttgccgctaccggcggctgacaggagactccggaattgagctatgcccctgtcctgcaagtggcgagggagagccggtcaaagaggtgagagtgagcgcaacactgcctgatttggaggactactcaccctgtgcccttcctcctgaatccgtgcctcagatcttcccaatgggcctctcgtcatccgagggcgacatcccctag

SEQ ID NO: 27684 - DNA, 2196 bp, Artificial Sequence
  Description of Artificial Sequence: Synthetic coding sequence
atgaagactcggagtcctaagccactactgacaggcctaatgtgggctcaacagggcaccaccccaggcacccccaagctgcgtcacacttgcgagcagggtgacggagtgggcccctatgggtgggaatttcacgacggactgtcattcggccgtcagcacattcaagatggtgccctgcgcctgacaaccgagttcgtgaagaggccaggaggacagcatggcggggactggagctggagggtcaccgtggaaccacaggactccgggacttcagccctccccctcgtaagcttattcttctatgttgtcacggatggcaaagaggtactcctaccggaagtgggagccaaaggacagttaaaattcattagcgggcacacttccgagctcggggacttccgcttcacactgctgccacccacctcccctggcgacacggcccccaagtacggctcttacaacgttttttggacctcaaacccaggcctgcctttacttacggagatggtgaagtcaaggctcaactcctggttccagcatagaccccctggggcgccacctgagaggtacctgggactcccagggtctctcaagtgggaggaccgaggcccttccggccagggtcagggccaattcctgattcagcaagtgacacttaaaatccccatcagcatcgagtttgtgttcgagtccgggagcgcacaggcaggcggaaaccaagctctgccaagattggccggctccctgctaacccaggccctcgaaagccacgctgaagggttcagagagcgattcgaaaaaaccttccagctcaaagaaaaggggctgtcttccggtgaacaagttctcgggcaggcagctctcagtggcctgcttgggggaatcggttatttctatgggcagggactcgtgctgccagacatcggtgtcgagggctccgagcagaaggtggaccctgctctgtttcctcccgtgcccctgtttaccgctgttccctcaaggtctttcttccctcgcggctttctttgggacgagggattccaccaacttgtggtacagagatgggacccctccttgacccgagaagcgctgggacactggctcggcctgctgaacgcagacgggtggattggtcgggaacagatcctgggggatgaagctcgcgcgcgcgttccccccgagtttctggtgcagcgcgccgtgcacgccaatccccctaccctgttgttgccagttgctcatatgctggaggtgggcgatcctgatgatctcgctttcctgcgtaaagccctgccccgcttacatgcttggttcagctggcttcaccagtcacaggctggtcctctaccactgtcctaccgctggaggggacgggatcctgctctgcctacactcctgaatccaaaaacgctgccttcagggttagatgattacccccgcgcttcccatccatccgtgaccgagaggcatcttgatttacggtgttgggtggctctgggcgcaagagtgctcactaggctggccgaacatctaggcgaggctgaagtggccgctgaactgggcccacttgcagccagtctcgaggccgcggagtcactggacgagttacattgggccccggaactgggggtcttcgctgatttcggcaatcatacgaaagccgtgcaactgaagcccagaccaccacagggcctggtgcgcgtggttggaaggccccaaccacaactgcagtatgtagatgccttaggctatgtctctctattcccactactgcttagattgctggatccaacctcaagtcgcttgggtccactactggacatactggccgattcacggcacctctggtcaccattcggactgcgatccctggccgcttcttcatcgttctacgggcaaagaaacagcgagcatgacccaccttattggcggggagcggtctggctgaacgtgaattacctcgccttgggggccttgcatcactacgggcatctggagggccctcatcaggcgcgcgctgccaaactacacggagagctgagagctaatgttgtcggcaacgtttggcgacagtatcaggccaccgggtttctgtgggagcaatactccgacagagatggccggggaatgggttgtcgaccatttcacgggtggacatccttagtgttgcttgcgatggcggaggactactag

SEQ ID NO: 27685 - DNA, 480 bp, Artificial Sequence
  Description of Artificial Sequence: Synthetic coding sequence
atggcaagaggcgaacgaagaagaagggcagtccctgccgaaggggtgagaaccgcagaaagggctgcccgagggggcccaggccgtcgagatggacgtggcggcggtccccgctcaacagccggcggtgtggccttagccgtagtggttttatccctagcactgggcatgtccggaagatgggtcttggcgtggtatcgcgccagacgggcagtaacgctgcacagcgccccgcccgtcctccccgcagactcctcttctcccgctgttgcacccgacctcttttgggggacctataggccccatgtgtacttcggcatgaagactagaagtccgaagcctcttcttacgggtctgcggtatttctgtccaccttttgggctaccagtgctactgtgcggagacaggtggcaggggagccctaccactaggggatggggacagggcgcggtcgaagtgtaccaatgggcccatcaatag

SEQ ID NO: 27686 - DNA, 1296 bp, Artificial Sequence
  Description of Artificial Sequence: Synthetic coding sequence
atgttctttgggggggaaggatctctaacctacactctggttatcatttgttttttaacgctgagactgagtgcctcgcaaaactgcttaaagaagtcgctggaggacgtcgtgatcgacattcagagctccttaagcaaaggcattcgggggaacgagccagtatatacaagcacacaggaagactgcatcaatagctgttgttccaccaagaacatcagcggcgataaggcttgcaacctgatgatattcgacacccggaaaactgccagacagccaaattgttacctcttcttttgtcccaacgaggaggcatgccctttgaaacctgccaaagggcttatgagctaccgcatcattacagatttcccttctctaactcgtaacttaccatcccaggagctgccgcaggaggactccctgctgcacgggcaattcagccaggctgtgactcctctcgctcatcaccacactgactactctaaacctaccgatatctcgtggcgggataccctatctcagaagtttggctcgagcgaccaccttgaaaaactttttaagatggatgaagcctctgcacagctacttgcatataaggagaaagggcacagccagtcttctcagttcagctcagatcaggaaattgcccatctgcttcccgagaacgtgagtgcactgcccgcgacggtggccgttgcgtccccccatacaacctctgctacccccaaaccagctacacttttgccaactaatgctagtgttactccaagcgggactagccaaccccaactggccactactgctccgcctgtcacaactgttacttcccaaccacccacaaccttaatttctactgtgtttacccgcgctgccgccaccctgcaagcaatggccacgacagctgtgttgacaaccacatttcaggcccctactgactcaaagggctctctggaaacgatcccctttacggagatttcaaacctgacattgaatacagggaatgtctacaacccaactgctctcagtatgagtaacgttgaaagctcgacaatgaacaaaaccgcgtcctgggagggacgagaggcttctcccggaagctcctcacagggcagcgtgccagagaaccagtacgggctgcccttcgagaagtggctcctgatcggatccttactgttcggcgtcctgtttttggtgattgggctcgtacttctggggaggattctgtctgagtcactacgccgaaagagatactcacggctagattacctgatcaatgggatctacgtggacatatag

SEQ ID NO: 27687 - DNA, 174 bp, Artificial Sequence
  Description of Artificial Sequence: Synthetic coding sequence
atgttcttcggcggagagggctctctgacgtacacgctggtgatcatttgctttttgacgctcaggctgtctgccagccaaaactgtctgaaaaagagcctcgaggacgtagtaatcgacatccagtcctcgctctccaagggaattagggggaacgaaccggtgtatacatag

SEQ ID NO: 27688 - DNA, 615 bp, Artificial Sequence
  Description of Artificial Sequence: Synthetic coding sequence
atggaggcccccgcagagctcctcgcagccctccctgcattggccacagcccttgcccttctgctggcttggctgctcgtgcgccggggtgccgccgcctcacccgagcccgcccgagctcctcccgaaccagcacccccagctgaagcaactggtgccccagcaccttcccgcccatgtgccccagagcccgcagcatcgccagccggcccagaagagcccggggaaccagccggcctgggggaattgggtgagcccgccggaccaggggagcctgaaggaccgggcgatcctgctgcagcaccagcggaggctgaggaacaggctgttgaggctaggcaagaggaggaacaggaccttgatggcgagaaaggccctagttctgaaggaccagaagaggaggacggcgaagggtttagttttaagtatagccccgggaagctgaggggaaaccagtacaaaaaaatgatgacaaaggaggagctggaggaggaacagagggtccaaaaggaacagcttgctgcaattttcaagttaatgaaggataacaaggagacctttggcgagatgagcgatggcgacgttcaagaacagctgagactgtatgacatgtag

SEQ ID NO: 27689 - DNA, 534 bp, Artificial Sequence
  Description of Artificial Sequence: Synthetic coding sequence
atggaggcccctgctgagttattggctgctctgcccgccctcgctacagctctggccctgctgctggcatggctcctcgtgagacggggagcggctgcttcaccagagcccgctagggccccccccgagccggccccacctgccgaagccactggggcaccggcaccttctcgaccctgcgctcctgaacctgcagcttccccagcaggacctgaggaacctggggagcccgccggcctcggcgagctgggcgaacccgccggtcctggcgaacctgagggccccggcgacccagccgcggcacctgcagaagccgaagagcaggcagtggaagctagacaggaagaagagcaggacctagacggagaaaagggaccctcttccgagggaccagaggaggaggatggcgagggtttcagctttaaatatagtccaggaaagctgaggggtaatcagtacaaaaaaatgatgacaaaagaggagttggaggaggaacaacgcatcgagctgacatccgacctgacgagcctatag

SEQ ID NO: 27690 - DNA, 513 bp, Artificial Sequence
  Description of Artificial Sequence: Synthetic coding sequence
atggaggcgccagcggagctactcgccgctttgccagcgcttgctacggctctggccttactgttagcgtggcttctggtgcgccggggcgcggcagctagtcccgagcccgcacgggctcccccagaacccgccccccctgcggaggcaaccggcgcgcccgctccatcaaggccttgtgcacccgaaccagccgcaagtccagcaggaccagaggagcccggcgaacctgctgggctaggtgagttgggggagcctgccgggccaggcgagcccgagggcccaggcgaccccgccgcagcacctgccgaggcggaagaacaggccgtggaggcccgccaggaggaagagcaagacctcgacggtgaaaaaggacccagttctgagggtcctgaggaggaagacggcgaaggatttagtttcaagtattcccccggcaaattgcgcggtaatcagtataagaaaatgatgacaaaggaagaactcgaggaggaacagcggacccagagatag

SEQ ID NO: 27691 - DNA, 513 bp, Artificial Sequence
  Description of Artificial Sequence: Synthetic coding sequence
atggaagcccccgctgaactgctagcagcccttcctgccttggccaccgctctagctctacttctggcctggctgttggtgaggagaggggccgccgcctcacccgaaccggcacgtgcccctcccgagccggcgccccccgcagaggcaaccggagctcctgccccctcccgcccttgtgcccctgagcccgctgctagccccgccggacctgaggagccaggagagcccgccgggttaggagaactaggtgaacctgcaggtcccggggagccagagggtcccggagaccccgccgccgcacccgcggaagcagaggagcaggccgtggaggcccgccaagaggaggaacaggatctcgatggcgagaaagggccttcttccgaaggccctgaggaggaggacggcgagggctttagcttcaaatatagcccaggcaagctccgggggaaccagtataagaaaatgatgacaaaagaggaactggaggaggagcaacgaacagaggaatag

SEQ ID NO: 27692 - DNA, 1329 bp, Artificial Sequence
  Description of Artificial Sequence: Synthetic coding sequence
atggccctgccttctcgcatactgctttggaaattagtgctcctgcagagcagtgcagtcttgttgcattccggctctagcgtcccagcggcagctggctcatctgtcgtctccgagagcgcagtttcatgggaagccggtgcccgtgctgtgctgcggtgtcagtcaccccgaatggtatggacgcaggatagactgcacgaccgtcagcgggtgttgcactgggaccttcgcggtcccggaggaggccctgcacgaaggcttttagacttgtactctgcaggggaacagcgagtgtacgaggccagggatcgcggtagacttgagctgagtgcgtccgcttttgatgatggcaacttcagcctgctgatcagggcagtggaagagactgacgcaggcttgtacacttgtaatctgcatcatcattactgtcacctgtatgagagtctggccgtccgtcttgaagtcacagatgggccacccgccactcctgcgtattgggatggagaaaaggaagttctggcagtggctcgtggcgctcccgcattgctgacttgtgtcaacagaggtcacgtgtggaccgatcggcatgtcgaggaggcacagcaagttgtgcactgggatcgccagcctcctggagtgccacacgatcgggccgacagattgctggatctgtatgcttctggcgaacgaagggcttatggacctttgtttttgcgcgatagggtcgcagtcggggctgacgcctttgagagaggcgacttttccctgagaattgaacccctggaggtagccgatgagggcacatattcttgtcacctccaccaccattactgcggtctgcacgaaaggcgcgtgttccatcttacagttgctgaacctcacgcagaaccccctccacgcggaagtcccgggaacgggtccagccactcaggcgcccctggccctgatccaacgttagcacgcggacacaatgtaattaacgtgatcgtcccagaatcacgtgcccattttttccagcaactgggttacgtgctggctacactgctgctgtttatactcctgctcgtaacggtgttattggccgcacgaaggagacgaggcggctacgagtatagcgaccaaaaaagtggaaaatctaagggcaaggatgtgaacctcgcggagtttgcggtggctgctggggatcagatgctttacaggagcgaggatatccagctcgactataaaaacaatatcctcaaagaacgggcggagctggctcacagcccgctgccagcaaagtatattgatcttgacaagggctttcgcaaggaaaactgcaagtag

SEQ ID NO: 27693 - DNA, 1026 bp, Artificial Sequence
  Description of Artificial Sequence: Synthetic coding sequence
atggcattgccttcgagaattttactgtggaaattggttcttctccagagttccgctgtcctgctgcatagcgcggtagaggagacggatgccggactgtatacatgcaacctgcatcaccactactgccacctgtacgaatctctcgctgtacgactggaggtgacagatggccccccagctacaccagcatattgggacggcgaaaaggaagtgctggcagtagctcgaggagcaccagccctcctcacttgcgttaatcggggtcatgtgtggactgatcgccatgtagaggaagcccagcaggtcgtccactgggaccgtcagccgccaggagtgccccatgacagggcagaccgtttgctggacctgtatgccagtggagaaaggagagcttacggaccacttttcttgcgtgatcgggttgccgtcggtgccgatgctttcgagcgcggggatttctcactccggatcgaaccactcgaagtagccgatgagggcacttactcctgccacctgcatcaccattattgcggccttcacgagcggagagtgtttcatctgacagttgccgagccacacgccgagcctcccccacgaggaagcccaggcaatggctccagtcattccggagctcccggacctgatcccactcttgctcgaggccataatgtaattaatgtgatcgtaccagagagtcgcgcacatttttttcaacagttgggttatgtgcttgcgaccctgttgttgtttatactgttattggtgacagttttgctggcagccagacgccgtcgaggagggtacgaatacagcgaccagaagtcgggcaagtcaaaagggaaagacgtcaacctggccgagttcgctgtggccgcaggcgatcagatgctgtatcggagcgaggacattcagttggactataagaacaacatcctgaaggagcgggccgaactggcccacagcccacttccagcgaagtacatcgatctggacaaggggttccggaaggaaaactgtaagtag

SEQ ID NO: 27694 - DNA, 1302 bp, Artificial Sequence
  Description of Artificial Sequence: Synthetic coding sequence
atgattagatgcgccgctacaggttctgccgttctgctccactcgggctcttccgttcctgcggccgctgggagctcagttgtgagcgaaagcgccgtgtcctgggaggccggggcccgggccgtcttgagatgtcagtcccccaggatggtttggacccaggaccggttacatgataggcagcgtgttctccattgggatcttcggggccccggcggcggcccagcccggcggctactcgatctttattcagcaggagagcaacgcgtttacgaggcaagggatcgagggcgcctggagctgagcgcaagcgctttcgacgatggtaacttctcgctcctcattagagcagtcgaggagacagatgcgggtctttacacatgcaacttacaccatcactactgccacctgtacgagagcctggctgtgagactcgaggtgacagacggcccaccagctacccccgcttattgggacggtgaaaaagaggtattggcagtcgctcggggcgcccctgcattactgacgtgtgtcaatcggggacacgtgtggacggatagacatgtcgaggaagctcagcaggtcgttcactgggatcggcagccccccggcgtcccgcacgatagagcagatagactgctcgatctgtatgcaagcggcgagagacgggcatatggtccactctttcttagagaccgtgtggccgtgggcgcggatgcctttgagcgtggcgacttttccctgaggattgagcctctggaggtggccgacgaaggaacatacagctgccacctccaccaccattactgtggccttcacgaacgacgcgtgtttcatcttaccgtggctgagccacacgccgaacccccccctaggggctcccccggcaacggcagttctcactccggggccccaggtcccgacccaacactggccagaggccacaatgtcatcaatgtgatcgtgccggaatcaagagcccacttcttccaacagctgggttacgtgttagctaccctcctgctctttattctcttgctggtgaccgtgcttctggctgctcgccgtcggcggggcgggtatgaatacagcgaccagaagtctggcaagtctaagggaaaggatgtgaacctggccgaatttgccgtggcagcaggagatcagatgctgtaccgcagtgaggacatccagttagactataaaaacaacatactgaaggaacgtgctgaactggctcactctccactaccagctaaatatatcgatttagacaaaggcttccgtaaagaaaattgcaaatag

SEQ ID NO: 27695 - DNA, 1353 bp, Artificial Sequence
  Description of Artificial Sequence: Synthetic coding sequence
atggcattacctagccgtattctactttggaagctggtgttactgcaatcatccgcggtattgctacactccggctctagcgtccctgccgccgctggctccagcgttgtttctgagagtgcagtctcttgggaggctggcgccagggccgtcctgaggtgccagtccccgaggatggtttggacccaggacagactacacgatcggcagcgagttttgcattgggaccttcgaggccctggaggcggtccggccaggagattgctcgacctctatagcgctggcgagcaacgcgtctatgaggcgagggatcggggaaggttggagctgtctgctagcgccttcgacgatggtaatttctcactgctcatccgggcagtggaggagaccgacgctggcctgtacacctgtaacctgcaccatcactactgccatctgtatgaatccttggccgtccgtttggaagtcacagatgggccaccagcgacacccgcatattgggatggtgagaaggaggtgctggccgtcgctaggggtgcgccagcgctgctgacatgtgtgaacaggggccatgtgtggaccgaccgacatgtagaggaggcgcagcaggtggtgcactgggaccgccaaccaccaggcgttcctcacgatagagccgatcggttattagatctctacgcctccggcgagagacgcgcttacggcccactattcctgagggaccgggttgccgtgggcgcagatgcattcgaaagaggggatttttcgttgagaatcgagcctctggaggtggcggacgaaggtacttactcttgtcacctgcaccatcactactgcggtctccatgaacggcgggtttttcaccttactgtcgccgagcctcacgctgagccacctccgagaggtagcccaggcaatgggtcatcccatagcggtgcgccagggcccgaccccacactggcacgcggtcacaatgttattaatgtgatcgtccctgaaagccgtgcacacttttttcagcagctggggtatgtcttggcaacccttctgctttttatcctcctgctggtgactgtgttgctggccgcacggcgacgacgtggtggttatgaatattcagaccagaagtcaggcaagtctaagggcaaggacgtcaacttggcagaattcgccgtggctgctggggatcagatgttgtacaggtctgaagacatccaattggcaagctctccccctacagactataagaataacattctcaaggaaagagcagaactggcgcattctcccctgcccgctaaatacattgacctagacaaggatccctcgggactgtgcccccttggtgcttag

SEQ ID NO: 27696 - DNA, 207 bp, Artificial Sequence
  Description of Artificial Sequence: Synthetic coding sequence
atgcctcaaaaggacccctgtcagaaacaagcctgtgaaatccagaaatgtctgcaagccaacagctatatggagagcaagtgccaagccgttattcaggaactgcggaaatgctgcgctcagtatcccaaagggcgctcagtggtgtgtagcggctttgagaaagaggaggaggagaatctcacaagaaaaagcgcctctaagtag

SEQ ID NO: 27697 - DNA, 207 bp, Artificial Sequence
  Description of Artificial Sequence: Synthetic coding sequence
atgccccaaaaagacccctgtcagaaacaggcatgtgagattcagaaatgcctgcaggccaacagctacatggaaagtaaatgtcaggcagtcatccaggagttgagaaaatgttgtgcccaatatccaaaaggccgttctgtggtatgtagcggtttcgagaaggaggaagaagagaatctcactcggaaatctgcctctaaatag

SEQ ID NO: 27698 - DNA, 618 bp, Artificial Sequence
  Description of Artificial Sequence: Synthetic coding sequence
atgagcgcccagcgtctgatctccaacaggacaagccagcagtctgccagcaacagcgactacacttgggagtatgagtattacgagatcgggccagtctcattcgaaggactgaaagcccataaatactccattgtcattggattttgggttggcttagctgtgttcgtcatattcatgtttttcgtcttgaccctgctgacaaaaactggcgctccacaccaggacaacgcagaaagctctgaaaaacgctttaggatgaattctttcgtgagcgattttggtcgtccactcgagcccgataaagtgttctcgagacaaggtaatgaagagtcaagatctctgtttcattgctacattaacgaagtggaacgccttgaccgcgcaaaagcttgccaccagaccacggcattagactctgacgtgcagcttcaagaggccattaggtcgagcggccaacctgaggaagagctgaaccgcctgatgaaattcgacatcccaaacttcgtcaacactgatcagaattattttggcgaggacgacttgctgatttctgagccgcctatagtactcgaaactaaacctttgtctcagactagccataaggacttggactag

SEQ ID NO: 27699 - DNA, 930 bp, Artificial Sequence
  Description of Artificial Sequence: Synthetic coding sequence
atgtccctggaacaaagaagcctacactgtaaacctgaagaagcactggaagcacagcaggaagctctcggcttggtctgcgtccaggccgctacatcctcctctagtccccttgtactgggcactctggaagaggttcctacagcagggtctactgatcccccccagtctccgcagggcgcgagtgctttccccacaacaattaactttacgaggcagagacagccatcagagggttcgtccagcagagaagaagaggggccttccacctcttgcatcctggagtctctattccgcgcagttattacaaagaaagtggccgatctggtcggattcctcctcctaaagtatcgcgcccgcgaacccgtcacgaaggcagaaatgctggagagcgtgatcaaaaactataaacattgtttccctgagattttcggaaaagcatcagagtcactgcagttggttttcggaattgacgtgaaggaagcggatccaaccggccactcatacgtccttgtcacgtgtctggggctgagttatgatggcctcctgggcgacaatcaaatcatgcctaaaactgggtttctgattatagtgctcgtaatgatcgccatggaaggagggcacgctcctgaggaagagatatgggaggagctttcagtgatggaggtctacgatggtcgcgagcattccgcctacggagagccccggaagcttttaacacaggatctggttcaagaaaagtatttggagtataggcaagtgcccgactctgatcctgcccggtatgaatttctgtggggccctcgggcgttagctgaaacctcttatgtcaaagtgctggagtatgtgattaaggtttccgcaagggtccgattcttttttcccagcctccgagaggctgctctgagagaggaggaggaaggcgtatag

SEQ ID NO: 27700 - DNA, 4368 bp, Artificial Sequence
  Description of Artificial Sequence: Synthetic coding sequence
atgagtaaaagtcttaagaagaagtcccactggaccagtaaggtccacgagagcgtgatcggtcgtaatcccgaggggcagttgggctttgagctgaaaggcggggcggagaacggacagtttccatacctgggcgaggtaaagccaggtaaggttgcatatgaatcaggctctaagctggtctcagaagaactgttgcttgaggtcaacgaaacgcccgtggccggtctcaccattagggatgtgctggctgtaataaagcactgcaaggatcctctcaggctgaaatgcgtgaaacagggtggaatagtggataaagatttgaggcactaccttaatctcagattccagaagggctcagtggaccacgagctgcagcagattattcgcgacaatctatacctgcgcacagtaccttgcactacccgtccccacaaagagggagaggtcccaggagtggactacatttttattaccgtagaagactttatggagctggagaagtcaggcgcgctgctggagagtggcacctatgaagacaactactatggaacccctaaacctcctgctgagcccgccccactgttgctcaatgtgactgatcagatactacctggcgccaccccctccgccgagggcaaaagaaaaaggaataaaagcgtaagcaacatggagaaggcatctattgaacctccggaggaggaagaagaagaaaggccagtggtgaacggaaatggagtcgttgtcacgcccgagtcttctgaacatgaggacaaatctgcaggggcctcaggcgagatgcccagccagccttaccccgctcctgtctattcacaaccggaagagctgaaggaacagatggacgacactaaacccacgaagcctgaagacaatgaagagcccgaccccctccctgacaactgggaaatggcatataccgaaaagggggaggtgtattttatcgaccataacaccaagaccacttcttggctcgacccacgcctggccaaaaaggcaaagccccctgaggagtgtaaagaaaatgaacttccttacggatgggagaaaatcgacgaccccatttatgggacttattatgtcgatcatatcaaccgacgcacccagtttgaaaacccggtcctagaagctaaacgaaaactacagcagcacaatatgccacatacagagttgggtaccaagccattgcaggcgcctggctttcgcgaaaaacccctgttcactcgggacgctagtcaactaaagggcacatttttgtccaccaccctgaaaaagagcaacatgggattcgggtttactattatcggaggggacgaaccagatgagttccttcaggtgaagtccgtgatacctgatgggcctgcagcacaagatggtaagatggagaccggcgatgtgatcgtgtacatcaatgaagtttgtgtgctcggccacacccacgccgacgtagtgaagttattccaatccgtccccataggccaatcagtaaacctggtgctgtgccgaggatatcctcttccattcgaccctgaggaccccgcaaactccatggtcccacctttggcgatcatggagcgtcctccccctgtgatggttaatggcagacataactacgaaacatacctagagtacatctcacgcacttctcagtccgttccggacatcaccgacaggccgccccactcccttcactcgatgcccacagacggccagcttgacggtacatacccaccccctgtgcatgacgataacgtttccatggcttcttctggtgcaactcaagcagaactgatgacactgactattgtcaaaggcgcacagggtttcgggtttacaattgccgatagccctaccgggcagcgcgtaaaacagatccttgacatccagggatgccctgggctttgtgaaggtgaccttatcgttgaaatcaatcaacagaacgtgcagaatctctctcataccgaagtagttgatatcctgaaggattgccccattggttctgagacttcactcataattcaccgtggaggtttcttcagtccttggaagacccctaaacccataatggacaggtgggagaaccaggggtcaccacagactagtctgtccgctccagcaatcccccagaatctgccttttccacccgctcttcaccgatctagtttcccagattccacagaggccttcgaccccaggaaaccagatccgtatgagctgtatgagaagtcccgagcaatttacgaaagtcgccagcaggtcccaccacggaccagttttagaatggacagctcaggccccgactataaagaattagacgtgcatctgcggagaatggagtccggctttggttttcggatcttaggaggagacgagccggggcagccgatccttattggtgctgttattgccatgggcagcgccgatagagacggcagattgcatcccggcgacgagctcgtctacgtcgatggcatccctgtcgcaggcaagacacacagatacgtgattgacctgatgcatcatgctgcccgaaacgggcaagtcaacctaaccgtcagaaggaaagtgctctgcggcggtgaaccctgccccgaaaacggcagatctccaggtagtgttagcacccaccattcatcgccacgcagtgactatgcaacgtacacaaatagtaaccatgccgccccaagcagcaacgccagcccgccggagggatttgccagccatagcctgcagacctcagacgttgtgatccacagaaaggagaatgaaggcttcggctttgtaatcattagctctctgaataggccagagtctggcagtaccatcacagtacctcacaaaattggtaggatcattgacgggtctccggctgaccgctgcgccaaactcaaagtcggcgataggatcctggcagtgaacgggcagtctatcattaacatgccacacgctgacatcgtaaagctgataaaggacgcaggcctcagtgtcaccttgcgcattatccctcaggaggagttgaattctcctacttctgctccaagttctgagaagcaatctcccatggcccagcaatctccccttgcgcagcagtctccacttgcccagcccagccctgctacccccaactcccctattgcacagccggcacccccgcagcccctacagctgcagggacacgagaattcatatagatccgaagtgaaggccagacaggatgtgaaaccagatataaggcagcccccatttacggattacaggcagccgccactggattaccgccagccacccggtggtgactaccaacagccaccccctcttgattaccggcagccacccctgctggactaccggcagcactcacctgacacacgccagtatccattaagtgattaccggcagcctcaagactttgactattttacagttgacatggaaaaaggcgcaaaaggcttcgggttttccatccggggaggccgggagtacaaaatggatctctacgttctccgactcgcggaagacggtcctgctattaggaatggcaggatgcgcgtgggcgaccagatcattgaaattaatggtgagtctactagagacatgacacatgcacgggccattgagctgatcaagtccgggggcagaagagttcggttactgttgaagcgaggcaccggtcaggtgccagaatatgatgaaccggctccatggtcttcacccgctgccgcagcccctgggctacccgaagtcggtgtcagccttgatgacggactggccccattcagtccatcacatcccgccccaccctctgatccttcacaccagatttccccaggccctacctgggacatcaaacgcgaacacgatgttcgcaagcccaaagaactgagcgcttgcgggcagaaaaaacagagactgggcgaacagcgggaacgctccgccagccctcagcgcgccgcccgcccgcggctcgaagaggctcctggaggccaggggcgcccggaggctggacggcctgccagtgaggccagggctccaggactggccgccgctgacgccgcagacgcagcacgggctggcggaaaggaggcccctcgtgcagctgcagggtccgagctgtgtcggagggagggcccaggcgctgccccagcctttgcgggcccaggcggaggaggcagcggcgcccttgaagctgagggcagagcgggagcacgcgccggacctagacctggtccccgtccccccggcggtgcacccgccaggaaggcagccgttgcacctgggccttggaaggtccctgggagtgacaaattaccatccgtgctgaagcctggggccagtgccgcatccaggtag

SEQ ID NO: 27701 - DNA, 4326 bp, Artificial Sequence
  Description of Artificial Sequence: Synthetic coding sequence
atgtcaaagagtttgaagaagaagagtcattggacttccaaggtccatgagtcggtgattggaagaaatccggaaggccaactgggttttgaactgaaaggcggggctgagaatggccagtttccctaccttggggaggtgaaaccaggaaaggttgcttatgagtctggttctaaactggtgagtgaggaactccttctcgaagtcaacgaaacccccgtagccggcctcaccattcgagacgtgttagccgtaatcaagcactgcaaggatccgctgagacttaagtgtgtcaagcagggaggtattgtggacaaagacttgcggcactaccttaacttacgatttcaaaagggctcagttgaccacgaactgcaacaaattatcagagataacttatatttgagaacagttccttgcactacacggcctcataaagaaggcgaggtgccaggcgtggactacatcttcataacagtggaggatttcatggagttggagaagtccggcgccctgctggagagcggaacttatgaggataattattacggaacccccaagcctcccgcggagccagctcccctcctgctgaacgttaccgaccaaatccttccgggggctaccccatctgctgagggcaagcgtaaacggaataaatctgtctccaacatggagaaagcctcgatagaacctccagaagaggaggaggaggaaaggccggtggtgaacggtaacggggtggtcgtcacccccgagagctctgagcatgaggacaaaagcgccggcgcatctggagagatgccgagccagccctacccagcaccagtctactctcagccggaggaactcaaggagcagatggacgataccaagccgactaaaccagaggataacgaagagccagatcccttacccgacaattgggaaatggcttatactgaaaagggcgaggtctatttcatcgaccacaacaccaaaacgacatcttggctggaccccagactcgcaaagaaggccaaacctcctgaagagtgtaaggagaacgagctgccctacggatgggaaaagatcgatgacccgatctacggaacctactatgtggaccacattaatagacgcacccagttcgagaacccagtgcttgaagctaagcgaaaactgcaacagcacaacatgccacacacagaactgggcacgaaacccttacaggctcctggattccgcgagaaacctctgttcacccgcgacgcctcacaacttaaggggacatttctatcgacgacactgaaaaagagcaatatgggattcggattcacgattattggtggagatgagcccgacgagttcctacaggtgaaatccgttatacctgacggtcccgccgcacaagacggtaagatggagactggagatgttatcgtttacattaatgaagtgtgcgttctcgggcacacccatgccgatgtcgtgaagctgtttcagtcagtgccaataggccagagtgtaaaccttgttttatgtcgagggtatccccttccattcgacccagaagatcccgccaactctatggtgccaccactggcgatcatggagcgtccacctcccgtcatggtgaacggaagacacaactatgagacataccttgagtacatctccagaacatctcagagcgtgcctgacattacggacagacccccgcatagcttgcatagtatgcctactgatggacaacttgacggtacctatcccccccctgtccatgacgacaacgtgagcatggctagctctggcgccactcaggccgagttgatgacccttactatagtcaaaggtgctcaggggttcggcttcacaattgctgattcaccaactggacaacgagtcaagcaaatccttgatatccagggttgtccaggcctatgcgagggggacctgatcgtcgaaatcaaccagcaaaacgtgcagaacctcagtcacacagaagtggtcgatatcctgaaggattgccccataggaagcgaaactagtctaattattcacaggggtggctttttcagtccgtggaagacgcctaaacccatcatggatagatgggagaatcaaggcagtccacaaacctctctgagcgcacccgcaataccgcagaatctaccatttccacccgcactacatcgctcctccttcccagattccacagaggcttttgacccacggaaaccagatccttacgaactttacgagaagtcaagggcgatatatgaaagcagaaggcctgattacaaggaactggatgtgcacctgaggcggatggagtcaggctttggatttaggatcttggggggggatgagccgggccagccaatcttaattggagcagtcattgcaatgggcagcgcagaccgggatggtagattgcatcccggcgatgagttagtttacgtggacgggattccagtagccggaaagacacacagatatgttatcgacctgatgcaccacgcagcaagaaacgggcaagtgaatctaaccgtgagacgcaaggtgctgtgtggtggggaaccctgccctgagaacggccgttctcccgggtctgtgtccacacaccactcttcaccgcgttcagactacgccacttacaccaattccaatcatgccgccccatcctccaatgcaagtccccctgaaggcttcgccagccacagcttgcagacaagcgatgtcgtgatacatcgaaaagaaaacgaagggttcggctttgtgataatttcctctcttaatagacccgagtccgggagcacaataaccgtgccacacaagatcgggaggatcatagacggaagccctgccgaccggtgcgccaagcttaaagtgggcgaccgcatccttgcagtgaatggccagtctataattaatatgccacacgcagacatcgtgaagctcatcaaggacgcaggcctgtcagtgaccttgcgaatcattccacaagaggaactgaactccccaacctccgccccgagttctgagaaacaatcccccatggcccaacagtctcccctcgctcagcagtcgccactggcccaaccatctcccgccacacctaactcccccatcgctcaaccagctcccccgcagcctcttcaactgcagggccacgaaaattcctacaggtctgaagtgaaagcgcgccaggacgttaaacccgacattcgtcagccgccttttaccgattacaggcagccaccactggattaccggcagccccccggaggagattatcagcagcccccgcctctggactacagacagcctcccttactggattataggcagcacagtccagacacacgacagtaccccctctctgactacaggcagcctcaagacttcgactacttcacggtcgatatggagaagggagccaaaggattcggtttttctatcagggggggccgcgagtacaagatggatttgtacgtgttgcggctcgccgaggacggacctgccatccgcaatggcagaatgcgagtgggcgaccagattattgaaatcaacggcgagagtacacgcgatatgactcacgccagagcgattgagctgattaaatctgggggaaggcgggtccgcctgctactgaagcgagggaccggtcaggtgcccgaatatgacgaacccgccccttggagctctcctgctgccgcggctccaggactccctgaagttggcgtttctctcgatgatggcctggcaccctttagcccctcccatcctgctccaccctccgatccatcccaccagatatcccctggcccaacctgggatattaaacgtgagcacgacgtgcgcaaaccaaaagagttatcagcgtgcgggcagaaaaagcagcggttgggagaacagagagagcgaagcgcctctccgcagcgggcagctagaccgcgcctagaagaggctccaggcggtcagggtcgtcctgaggccggacgccctgcaagcgaggcccgggctcctgggctcgccgcagccgacgccgcggacgccgctagagctggcggcaaagaagcccctcgagcggcggctggatctgagctgtgccgtcgagagggtcctggggctgcccctgccttcgcgggcccaggagggggggggtcgggggccctggaagccgaggggcgggccggcgcacgggcgggccccagacctgggcctcgccctcctggcggcgctcccgctcggaaggccgcagtggctcccggaccctggaaggtgcctggaagcgacaaactgccaagtgtgctcaaaccaggggcaagtgcagccagccgctag

SEQ ID NO: 27702 - DNA, 1668 bp, Artificial Sequence
  Description of Artificial Sequence: Synthetic coding sequence
atggagctcgagaagtctggagcactgctcgagtccggaacctacgaggataactactatggcacccctaaaccgccggctgagcctgctcctctactgcttaacgtgaccgatcagattctccctggcgcgacaccatccgccgaaggtaaaagaaagagaaataagtctgtttctaacatggagaaggccagtatagagccacctgaagaagaggaggaggaacgtcccgtcgtcaacggaaatggcgtagtggttacgcccgagagtagtgagcatgaggacaagtccgccggggccagcggtgaaatgccgtcacagccgtacccagcgccagtctattcacaaccagaagagcttaaagagcagatggatgacactaagccaactaaacctgaagataatgaggaacctgatccgctccctgacaactgggaaatggcctatacagagaaaggcgaggtgtacttcattgatcataataccaaaaccacaagttggctcgaccccagacttgcgaagaaagcgaaaccgcccgaagagtgcaaagaaaatgaactgccctacgggtgggagaagatcgacgaccccatatatggaacatattatgtggaccacatcaatagaaggacacaatttgagaaccctgtgctggaggccaaacggaagctgcagcaacataatatgcctcataccgagctagggaccaagccattacaggccccagggttccgcgaaaaacccttgtttacgcgagacgcctcacagctgaagggcacgttcctttcaaccactctgaagaaaagcaacatgggattcggattcacgatcatcggaggtgatgagccagatgaatttttgcaggtcaaaagcgtgatccctgatggcccagcagcacaggacgggaaaatggagactggtgatgtgattgtctatattaacgaggtgtgtgtcctgggacacacccacgccgatgtcgtcaagctgttccagagtgtgcccattgggcaaagcgtgaacctggtgctctgtcgtggttatccgctcccattcgatccggaagatcctgctaatagtatggttccgcctctcgccattatggaacgacctccccccgtcatggtcaacggacggcacaactatgagacttatctagaatacatcagtcggacgtcacaatccgtgccggatataacagaccgaccaccacactcacttcactcaatgcccacagacggccaattggatgggacatatccccccccagtgcacgacgataacgttagcatggccagctcaggcgcgactcaggctgagctcatgaccctgactatagtgaagggggcgcagggcttcgggtttaccatcgccgactctcccactggacagagagtgaaacagattctcgatatccagggatgtcctggactgtgcgagggtgacctgatcgtggagatcaaccaacaaaacgtgcaaaatctatcccacacggaagtcgtggatatcctgaaagactgtcccattgggtccgaaacctcgctgataatccatagaggggggaaaaccaatacgggaagtgccatcaaatatgtggggaaaattgttggtagctttaataatattgtgaagatgcagatctccctggagctaaacgaaatcattctctag

SEQ ID NO: 27703 - DNA, 3762 bp, Artificial Sequence
  Description of Artificial Sequence: Synthetic coding sequence
atgtccaagtccctgaaaaaaaagtcgcactggaccagtaaagtccacgagtcagtaattggccggaatccggaaggtcagcttgggttcgaactgaaaggtggcgccgagaacggccagttcccttatctcggagaagtgaaacccgggaaggtagcctatgaaagtggcagtaaactggtgagcgaggagctgttgctagaggtaaacgaaacaccagtggctggactgaccattcgagacgtgctggctgttataaaacactgtaaggacccactgcggttaaaatgtgttaaacaaggtggtattgtggacaaagaccttaggcactaccttaacctgcgcttccagaagggctcagtggaccatgagctacagcagattataagagataacctgtacttacgaactgtgccgtgcacgactcggccacacaaggagggagaagtgccaggcgtcgattacatttttatcaccgttgaggacttcatggagttggaaaaatctggcgctttattggaaagtggcacatacgaggacaattactacggaacacctaaacccccagcagaacccgcccctctactcctgaatgtgacggaccagatcttacctggggcaacacccagtgctgaaggcaagaggaagaggaataaaagcgtgagcaacatggagaaggctagcatcgagccacctgaagaagaggaggaggagcggccagttgtgaatggcaacggcgtggtcgtcacaccggaatcttcggagcatgaagacaaatctgctggcgcaagtggggagatgcctagtcagccgtatcccgcgccggtgtactcccagccagaagagctcaaagagcagatggacgacaccaagcccactaagcctgaggataacgaagagcccgaccccctgccagacaattgggaaatggcctatactgagaagggggaggtttacttcatcgatcacaacacaaaaacaacatcgtggctggacccccgcttggccaagaaagccaagcccccagaggagtgtaaagagaatgagttgccctatggatgggagaaaattgatgacccaatatacggcacctattacgtggatcacatcaaccgacgcacgcaatttgaaaaccctgtgctggaggcaaaacggaaactgcagcagcataatatgccccacacagagctgggtactaagccactccaagctcctggttttagggaaaagccgctgttcacgcgggatgcctcgcaactcaagggcaccttcttatcaacaaccctgaaaaagtcaaatatggggtttggatttaccatcatcggcggcgatgagcccgatgaatttctgcaggtgaaatccgtgatccctgacggacctgccgcccaagacggtaagatggaaaccggtgatgttatagtttatattaatgaggtctgcgttctggggcacacgcacgccgatgttgtcaaattatttcaatccgtccccattggccagagtgtgaacctggtattatgcagaggctatcccctgcccttcgatccggaagacccagctaattcaatggtgccacctttagccatcatggagcgaccgccccctgtcatggtcaacggcaggcacaactacgagacttaccttgagtatatcagcaggacaagtcagtcggtgcctgatattactgacaggccaccccactctcttcactctatgccaaccgacggccagctggacggaacctacccgccacccgtgcatgatgataatgtgtccatggcttcgtcaggggcgacgcaggctgaattgatgactctgactattgtaaagggtgcccaaggcttcggtttcacaatagcggacagccccactggtcaacgggtgaagcagatcttggacatccagggatgcccagggctgtgtgagggcgatctcattgtggaaatcaaccagcagaatgttcagaatctgtcacataccgaagttgtcgacatcttaaaggactgtcccataggaagtgaaacaagtctaatcatacaccggggagggttttttagtccttggaagacccccaaaccaatcatggacaggtgggagaatcaagggtcacctcagacctccctctctgcacctgccatcccccagaatttgccttttccaccggctctgcataggtcaagctttccagactctacagaggctttcgatccacgaaaacctgacccatatgagctgtacgagaaaagtagggcaatttacgagagcagacagcaggttccacctaggacctcgtttcgtatggacagcagcggacccgactataaggagctggacgttcacctgcgtcgcatggaatctgggtttggcttccgcattcttggcggggatgagcctggacaacccatacttattggagccgtgatcgccatgggttctgccgatcgagatgggcgtctgcatcctggggacgagttggtgtacgtggacggcattcccgtggccggcaaaactcaccggtacgtcattgacctaatgcaccacgccgcccgaaacggccaagtgaatttgactgtaaggaggaaagttttatgcgggggagaaccctgcccagaaaatggcagaagccctggatcggtctcaacacatcactcatcaccaaggtcagattacgctacttacaccaattctaaccacgcggccccaagtagcaacgcctccccacccgagggtttcgcctctcacagcctccaaacttctgatgtggtgattcatcggaaggagaacgaaggattcggtttcgtgatcatttcttcattaaatcgccctgaatcaggctccacaatcaccgtgccacataaaatcgggcgaattattgatggatcgccggccgatcgctgcgcaaagctgaaagtgggcgatcggatactggctgtaaatgggcaatccatcatcaacatgccacacgctgacattgtgaaactgatcaaagatgcagggctgtctgtgacgctcaggataatcccccaagaggagttaaacagtcctacaagtgccccgtctagcgagaaacagtcaccaatggcccaacagtcgcctctcgcccagcagtcccctctcgctcagccgagccccgctacccctaacagccccattgcccagccggctcctccacagcccctccagctgcagggccatgagaatagctatcgcagtgaagtaaaggcccgacaagacgtgaaacccgacatccgacagccaccttttaccgattatcgccagccgccgctggattatcgccaaccccccggaggtgattatcagcagcctccacccctggactatcgccagccccccctgcttgactaccggcagcactctccagacacccggcaatacccactgagcgactaccgccaaccccaggacttcgactacttcacagtggatatggaaaagggggccaagggattcggcttctctatacgcggcgggagggaatacaagatggatctgtatgtgctgcgtctcgctgaagacggcccagccattcggaacggtaggatgcgggtcggcgatcaaattattgaaattaacggcgagtcgaccagagatatgactcacgcgcgcgctatcgagctgatcaaatccggcggccgaagagttcggttactccttaaaagaggtaccggccaggtacccgaatacgacccgcccgctcctgcacaggccgtcctgttgcggttccgtctgaccgcgttctag

SEQ ID NO: 27704 - DNA, 1653 bp, Artificial Sequence
  Description of Artificial Sequence: Synthetic coding sequence
atgatttctgcacacaggaatctgtgcctgccagacaattactatgggaccccaaaaccacctgccgagccagcccccttgctgctgaatgtgactgatcagattctgcccggtgccactccctcagctgaaggtaagcgaaagagaaataaaagcgtgtccaatatggagaaggcctccatcgaacctccggaggaagaggaagaggagcgacccgtcgtgaatggtaacggggtcgtggtcaccccagaaagcagtgaacacgaggataagtccgctggcgcaagtggagagatgccctcccaaccctatccagcgcctgtctattcccagccagaggaactcaaggagcagatggacgataccaaaccgacgaagcccgaggataatgaggagcctgaccccctgcccgacaattgggagatggcatatacggagaaaggcgaggtctattttatcgatcataatactaaaaccacttcctggctagaccccaggctggctaaaaaggccaagccacccgaggagtgtaaagaaaatgagcttccctatggctgggagaagatagacgatcccatttacggaacttactatgtcgaccacatcaacaggagaacgcagttcgagaaccccgttctagaggccaaacggaagctgcagcagcacaacatgccgcacaccgaactgggcacgaagcccctccaggcacccggcttccgcgagaagccattatttacccgcgatgccagccagcttaaagggacctttctgagcacaaccttgaagaaatccaacatgggcttcgggttcaccatcatcggcggggatgaacccgatgagtttctgcaggtaaagagtgtcatcccagatggcccagcggcacaggatggtaagatggagacaggcgatgtgatcgtgtacattaatgaagtttgtgtgttgggccatactcacgccgacgtggtcaaactgttccagtcggtgccgatcgggcagagcgtcaatttagtgttgtgccgggggtatcctctgccatttgaccccgaggaccccgctaactccatggtaccacctctcgctatcatggagagaccaccgccggttatggtcaacggtcgccacaattatgaaacctacctcgagtatatctctagaacttcccagtccgtgccggacattaccgacagaccgccacactcactccactcaatgccaacagacggccagctggacggcacatacccccctcccgtgcacgacgacaacgtgtccatggcaagcagtggcgccacacaggccgaactgatgactctgacgatcgtgaagggcgctcaaggtttcggattcacaatcgcggactcccccaccggccaaagggtgaaacagatacttgatattcaaggatgccccggcctgtgcgaaggcgacttgattgtcgagattaatcagcagaacgtacaaaatttaagccacaccgaggttgtcgacatcctgaaagattgtcccataggttctgagaccagtctaattatccacaggggcgggaagaccaacaccggcagtgcgattaagtatgtgggcaaaattgttggcagcttcaacaacatcgttaagatgcagatatccctggagctgaatgagattatcctgtag

SEQ ID NO: 27705 - DNA, 1419 bp, Artificial Sequence
  Description of Artificial Sequence: Synthetic coding sequence
atgagccccgaggagtggacatacctggtggtgcttctgatcagtatcccgattggctttctctttaagaaagcaggcccaggtctgaagcgctggggcgccgcagcagtcggcttgggcctgaccctcttcacctgtggaccccacactctgcacagccttgttaccatccttggtacatgggctttgatccaggcgcagccttgttcctgtcacgcactggcgctggcatggacattctcctatcttctgtttttccgcgccctgagcctccttgggctgccaacgcccaccccttttacgaatgcagttcagcttttattaaccctgaaacttgttagtctggcctccgaagtgcaagacttacacctggcccagcggaaagaaatggcttctggtttctccaaaggaccaacattggggttgctacctgacgtcccctccttgatggagactctgtcatacagctattgttacgtggggattatgaccggcccattttttcggtatcgcacctacctggactggcttgagcagcccttcccaggagctgtgccctccctccgcccgcttctgaggcgggcctggccagctcctctgtttggcctgctctttttgttgagctctcatctttttccgctagaggccgtgcgtgaggatgctttctacgctcggccactgcccgctaggctgttttatatgatacccgtgtttttcgccttcaggatgcgattctatgtggcctggatagccgccgagtgtggatgtattgccgccggctttggcgcctacccagtcgctgctaaggcacgcgctggaggcggaccaactctgcagtgtccccctccgtccagcccagaaaaagctgccagtctcgaatacgactatgagaccataagaaatattgactgctactctacggatttctgtgtgcgggtccgcgatgggatgcggtactggaatatgacggtccaatggtggttggctcagtatatttataagtctgcccctgcgagatcttatgtgctgcgctcagcttggaccatgctgttgtcagcctactggcacggactgcaccctggctactacttgtcgttcctgacgattccgctgtgcctagcagcggagggccgcctggaaagtgcattaaggggccggctctcaccaggcggtcaaaaggcatgggattgggtgcactggtttttaaagatgagagcgtacgactatatgtgtatgggtttcgtccttctctcactggcagatactctaaggtattgggcttccatttatttctgcatccactttctggccctcgcggccctggggctggggctggcactcggcggcggatcaccatctaggcgcaaggcggcctcacaacctacctcccttgcacccgagaagctgcgggaggaatag

SEQ ID NO: 27706 - DNA, 1200 bp, Artificial Sequence
  Description of Artificial Sequence: Synthetic coding sequence
atgggctctagtagatgcggtcccggtgctcatcctgttcatctctggcctccccatttcgctttcagcggccaccatcccagagacctggggccacatagtggacccgcgctgctggtcagcctggcgtcggaggtgcaggacctgcacttagcccagaggaaggaaatggccagcggcttttccaagggcccaacccttggcctgctgcctgacgtcccctcccttatggagaccctgagttactcctattgctacgtgggtatcatgaccgggcctttcttccgctacagaacatacctagattggctggagcaaccctttcccggtgccgtaccctccctgcggccgcttctgagaagggcatggcctgcccccctgtttgggctgctttttttgctctcgtctcatcttttcccgctggaggctgtgcgggaggatgcgttctacgcgcgtcccctccctgccagactgttctatatgattcctgttttctttgccttccgaatgcgcttttacgttgcttggatcgccgctgagtgcggctgcattgccgctggatttggagcttatccggtagctgcaaaggctcgcgcaggcggtggaccgactctacagtgccctcccccgtcctctcccgaaaaggctgcttcactcgaatatgactacgagaccatccgaaatatcgattgctactctaccgatttctgtgtaagggtgcgggatggaatgaggtactggaatatgactgttcagtggtggctcgcccagtatatttacaagtctgcccccgcccggtcctatgtacttcgaagcgcgtggaccatgctgctgtcagcctactggcacggcctgcatcccgggtattatctcagcttcctgaccatccccttatgcctggccgccgaggggcgcctcgagtctgcattgagggggagactcagccccggaggtcagaaagcctgggactgggtgcattggttcttgaagatgagggcatacgactacatgtgcatgggatttgtgttactgtccctggctgatactttgcgctactgggcctctatctatttctgcatccatttcctcgccctcgccgctctgggcctggggcttgctctcggaggaggcagcccaagccggaggaaggccgcctcacagcctacctccttggcccccgaaaaactgcgagaggagtag

SEQ ID NO: 27707 - DNA, 1035 bp, Artificial Sequence
  Description of Artificial Sequence: Synthetic coding sequence
atgagccccgaagagtggacgtacctggtcgttctgctgatctccattccaattggattcctgttcaaaaaagcagggcccgggctgaaacggtggggcgccgctgccgttggtctcggactaaccctttttacatgcggtccgcataccctccactccctggtaactatcctcggcacttgggctctgatacaggcccaaccctgctcctgtcatgccttggccctggcctggacctttagctacctgctgttctttagagccctgtcgctcctaggtcttcctaccccaacaccctttactaacgccgttcagctcttactgacgctcaaactcgttagtctggcgtctgaggtccaggatcttcatctggcccagaggaaggaaatggctagtgggttttcaaagggcccaacccttggactgctgcccgatgtacctagcctgatggaaaccttaagttactcctattgctatgtgggaattatgacaggtcctttcttcagatatagaacctacctggactggctggagcagccctttccgggtgccgttccctccctgcgtccgctgctgagaagggcttggcccgctccactgttcggcctgcttttcttattatcttctcacttattcccactggaagccgtccgggaagacgcattttatgctcgccccctgcctgctcgcctcttctatatgatacccgtcttttttgcttttagaatgcgattctacgtcgcctggatagccgcggagtgtggctgtatagctgccggcttcggagcttatcctgtcgccgccaaagccagggccggcggggggccaacactccagtgccctccgcctagcagcccagaaaaggcagcttctctggagtacgactacgagaccattagaaatatagattgctattcgactgatttttgtgtgcgagtgagagacggcatgcgctactggaatatgactgttcagtggtggctcgctcagtatatatacaagtctgccccagcacgctcctatgtacttaggtag

SEQ ID NO: 27708 - DNA, 771 bp, Artificial Sequence
  Description of Artificial Sequence: Synthetic coding sequence
atgtccccagaagagtggacttatttggtcgtgttactgatttccatccccattggcttcctctttaagaaggccgggcccggtctgaagcggtggggcgccgccgcagtcgggctgggtctgacattgtttacgtgtggtccccataccctgcacagtttggttactatacttggcacgtgggcgctgattcaggcgcagccatgcagctgccacgcactcgcattggcatggacgttcagctatctcctcttttttcgtgcactgtcactgcttggccttcctacgccgacccccttcactaacgcagtgcagctcctcctgacattgaagctggtctctctggccagtgaggtgcaggacctgcatcttgcccaaagaaaggagatggcctcagggttttctaaaggcccaactcttgggctgctcccagatgttccatcactgatggagactcttagttatagctattgttatgtggggatcatgacaggaccattcttcagatataggacatacctggactggttagagcaaccctttcccggggctgttcccagcctgaggcctctcctgcggcgcgcctggcctgcgccattgttcggcttgctgtttctgttaagcagtcacttgttcccactagaggccgtccgcgaggacgcattttatgctcgcccgctgccagcacggctgttttacatgataccagtgtttttcgccttccgcatgcggttttacgtggcctggatcgccgccgaatgtggatgctag

SEQ ID NO: 27709 - DNA, 1200 bp, Artificial Sequence
  Description of Artificial Sequence: Synthetic coding sequence
atgggctcttcacggtgcggaccaggagcccacccagtgcacctgtggcccccacatttcgctttctccggacaccacccaagagaccttggcccacactccggaccagccctactcgtgtccctcgcttccgaggttcaggatcttcacttggctcagcggaaggagatggccagcgggttctccaaaggccccaccctgggacttctcccagacgtccccagcctgatggagacgctgtcttactcatactgctacgtcggtatcatgaccggaccgttctttcggtaccgcacctacctggactggctggagcagccgttccctggcgcagtgcccagcctcagaccattgctgagacgggcgtggcctgctcctctgttcggattactctttctgctgtcatcacacctttttcctttagaagccgtccgcgaggacgccttttatgccaggcctctgcctgcccgtttgttctacatgattcctgtgttctttgcttttaggatgcgtttctacgtcgcttggatcgccgcggagtgcggatgcattgcagccggcttcggggcctatccagtagccgccaaagcaagagccgggggcgggcccacgctgcagtgtcctccaccttcttctccagaaaaagcggccagtctggaatacgattacgaaactatccgcaacattgactgctacagcactgacttttgcgtgcgtgtgcgggacggcatgcgttactggaatatgactgtgcagtggtggctcgcgcagtatatctataaaagcgcccctgccagatcatatgtgctgagaagcgcctggacaatgctgctctcagcatattggcatgggctccatcctggctactatctctcttttctgactattccactttgtttagccgctgagggccgcttggagagtgcccttcgtggccgcttgtcaccagggggtcagaaggcctgggattgggtccactggttcctgaaaatgagagcctacgattacatgtgcatggggttcgtactactgagtttagccgatactttgcggtactgggcatcaatctatttttgtatccatttcctggcgctggccgccctggggcttggcctcgctttggggggtggcagcccaagtcgcaggaaagctgccagccagccaacaagtctcgccccggaaaagttacgagaggaatag

SEQ ID NO: 27710 - DNA, 513 bp, Artificial Sequence
  Description of Artificial Sequence: Synthetic coding sequence
atgagcccagaggaatggacgtatctggtcgtgcttctaatttctattcctatcggatttctgttcaaaaaagctgggccaggacttaagagatggggcgccgcggctgtgggattgggcctgacccttttcacctgtggccctcatacccttcactcactggtaactattttaggaacatgggctctcatacaagctcagccttgcagctgccatgcattggccctggcctggaccttctcctacctgctcttcttccgggctctgtcactgctgggtctgcctaccccaacaccattcaccaatgccgtccagcttctgctcactctgaagcttgtgagtctggcctccgaggtgcaggacctgcacctcgctcaaagaaaggagatggctagtggcttcagtaaaggacccaccttgggcctgcttcctgacgtgccaagtctgatggagaccctgagctattcttactgttatgtcggaataatgacaggccctttcttcaggtattag

SEQ ID NO: 27711 - DNA, 1740 bp, Artificial Sequence
  Description of Artificial Sequence: Synthetic coding sequence
atgaaggacttttcggacgtcatcctgtgtatggaagctaccgaaagtagcaagaccgaattttgcaaccctgcctttgaacccgagtcagggcccccttgcccgcctcctgtcttcccagaggacgccagctattccgtgcccgcgccttggcatggccgaaggcccagaggcttacgtccagactgtaggttctcctggctgtgcgttctcctgctctccagcctcctcctgttgctgctgggcctgctggtggcgataattctggcacaactgcaggcagcacctcccagcggagcaagccactccccactacctgctgggggcttgaccactaccacaaccacacctacaatcactacgtcacaggcagctggaacccctaagggacagcaggaatctggggttagtccctctcctcaaagcacatgtggtggtctcctgtccggtcctcgcggtttcttttctagccctaactaccccgacccgtacccaccaaacacacactgcgtgtggcacattcaggtggccacagaccacgcgatccaactaaagatcgaagcactctctatcgagagcgtcgccagttgtctgttcgatagattagagctgagccccgagccagagggcccgttgctgcgtgtttgcggtcgtgtgccccctcctacgctgaatacaaacgcatctcatttactggttgtgtttgtttctgactcctccgttgagggctttggtttccacgcatggtatcaggccatggcgcccggtcggggctcctgtgcccacgatgagttccggtgtgaccagctcatctgcttgctgccagactccgtttgcgatgggttcgctaattgcgccgatggaagtgatgaaaccaactgttctgcaaagttcagcggctgcggaggcaacctaacaggcttgcagggaaccttttccacaccctcctatctgcagcagtatcctcaccagctgctctgtacatggcacataagcgtgcccgcggggcactctatagaacttcagtttcacaatttcagcctagaggcacaggatgaatgcaagtttgactatgtggaagtctacgagaccagctccagtggagcattcagcttactggggcgcttttgcggggctgagcccccgccccatctcgtgtcgtcccatcatgagctcgccgtccttttccgcactgaccacggaatctcgtccggaggattctctgccacctacttggcctttaacgcaaccgagaacccatgtggtccttctgagctgtcttgtcaggctgggggctgtaaaggagtccaatggatgtgcgatatgtggcgggactgcactgacggaagtgacgacaactgctctggtcccttgtttcctccccctgagctcgcttgtgagcctgtgcaggtggagatgtgtttgggcctcagctataataccacggctttcccaaacatctgggtggggatgattacacaggaggaagtagtagaagtgctctcagggtacaagagcctgacttcccttccttgctaccagcacttccgtcgcctcctgtgcggactgctcgtccccaggtgcacaccacttggaagcgtcttacctccctgcaggagtgtatgtcaggaggctgagcaccaatgtcaatccgggctagccctcctcggtaccccttggcctttcaattgcaatcgactacccgaggccgccgacctggaagcttgcgcccagccctag

SEQ ID NO: 27712 - DNA, 1740 bp, Artificial Sequence
  Description of Artificial Sequence: Synthetic coding sequence
atgaaagatttcagcgacgttattctgtgcatggaggcgaccgagtcatccaagactgaattttgcaaccccgctttcgagcctgaaagcgggcccccctgcccgccccctgttttccccgaggatgcctcttacagcgtccccgccccatggcacgggaggagaccacgcggcttacgtccagactgccggttttcttggctctgtgttcttttgctctcctcactgcttttgctgcttctgggattgctggttgccatcatcctggcccagctgcaagctgcacccccgtcaggggccagccatagcccgcttccagctggcggtctgactacaacaacaacgacaccaacgatcaccacctctcaggcggccgggacgccgaagggccagcaggaatcaggggtgagcccatcaccgcaaagtacctgtggtggactcctcagtggtccaagaggttttttctcctctccgaactatccagatccatatccacccaatacccattgcgtctggcacattcaggtggcaacagaccacgcaatacagctgaaaatcgaggcactctctattgaaagcgtcgcttcgtgcctgtttgatcggctggaactgtctccagaaccagaggggccactgctgagagtgtgcggccgagtccccccccctacactcaatacaaatgccagccacctcttagtagtgtttgtctccgactcctcagtggagggcttcggctttcatgcatggtatcaggctatggcccccgggcggggttcgtgtgcacacgacgaattcagatgtgaccagctcatttgccttctgcccgatagcgtgtgtgacgggtttgcaaactgcgccgatgggtcagatgagactaattgtagtgctaagttctcagggtgcggcgggaatttaaccggcctccaagggactttctccacgccaagctatctccagcagtaccctcatcaactgctttgcacttggcacatcagcgtcccagctgggcattcaattgagctccagtttcacaatttctctctggaagcacaagatgagtgcaaatttgactacgttgaagtctatgaaacaagtagctctggggccttctccctgttgggaaggttttgcggagccgagccccctccacacctggtttcaagtcatcacgagcttgcagttttgttcaggaccgaccacggaattagctctggagggttctcagctacttacctggcatttaacgctaccgaaaatccctgtggtcccagtgaactttcatgccaggcaggggggtgtaaaggcgtgcaatggatgtgcgacatgtggcgagattgcaccgatggaagtgatgacaattgttcgggacccttgtttcctcctcctgagctggcctgtgagccagttcaggtggaaatgtgcctgggcctatcttacaacaccaccgccttccctaatatctgggtggggatgatcacgcaggaagaagtggtagaagtcctgtctggctataaatccctcacctccttaccctgttaccagcactttcgcagactgctctgcgggctgttagtacctcgttgcactccgcttgggagcgtgcttcctccttgccgatcggtgtgccaagaggccgaacaccagtgtcagtcagggttagccctgttgggaacaccctggccattcaactgcaataggctgcctgaagcagcagacttggaggcctgtgctcagccctag

SEQ ID NO: 27713 - DNA, 396 bp, Artificial Sequence
  Description of Artificial Sequence: Synthetic coding sequence
atggcgccgagcttatggaaagggcttgtcggtatcggactgttcgcactcgcacatgctgcatttagcgcagcccaacatcggagttacatgaggctgaccgagaaggaggatgaatcacttccaatcgatatagtcctgcagactctgctggcattcgcagtcacatgttacgggatagttcacattgcgggagagttcaaggacatggacgccacctccgaactcaagaataagacgttcgataccctccggaatcacccttccttttacgtctttaatcaccggggcagggtgctcttccgtccttcagataccgccaactcttcaaatcaagatgcactctcctctaatacttcccttaaactcaggaagctggagtcgttgaggaggtag

SEQ ID NO: 27714 - DNA, 591 bp, Artificial Sequence
  Description of Artificial Sequence: Synthetic coding sequence
atgacaccccttgggtcgggaccgccgagagaagcaagtatcgcccaacccagtggcttctcaactacagagaccctatgcgcccaagacttcagcgatgtaatcttccttagacgagccgatacgaggcggtggaagaagaagcagctcaggcggccttcacttctgcttttgggttgttgctctttcggtattatggctcccagtctttggaagggattggttgggattggcctgtttgctttagcccacgcggccttttcagccgcccagcaccgatcttatatgaggcttacagagaaggaagacgagtcccttccaattgacatcgtcttgcagactctgctggcatttgccgttacctgctacggaattgttcacatcgcaggagaattcaaagacatggacgctacctctgagctgaagaacaagactttcgacactctgcgtaaccatccatctttttacgtgtttaaccatcgggggcgggttttgtttagacctagcgacactgctaattcatctaatcaggacgctctgtcatccaacacctcactgaaattgcggaaactggagtccctgcgccggtag

SEQ ID NO: 27715 - DNA, 2139 bp, Artificial Sequence
  Description of Artificial Sequence: Synthetic coding sequence
atggagagcactagccaggatagacgcgccacacacgttatcactatcaagcccaacgagacggtgctgacggcgttcccctaccgaccacactcgagtcttctggatttcctgaagggggaaccgcgggtgctgggtgccacccaaattctcctggctctgattattgtcggcttcggaacaatctttgcactaaattatatcggcttctcacagcgtctgccactcgttgtcctcacgggctacccgttttggggcgccctgattttcatcttgaccggatacttgaccgtcacagacaaaaagagtaaactgctcggacagggagtgaccggcatgaatgtgatctcgagtctggtcgcaattactggcatcacgttcactatactgtcctaccggcatcaggacaagtactgtcagatgccaagtttcgaagagatctgcgtgttttctagaactctctttattgggatcctcctgatcctgctaatcatcagcatcgccgaactcagtattagcgtaacgattgcgtctttccgctccaagtgttggacccagtctgacgaagtgttattctttctgccaagtgatgttacacaaaattccgagcagcctgcccccgaggagaacgatcagctccagtttgttctgcaagaggaattctcctccgacgacagcacaaccaacgcccaaagcgtcatttttggtgggtacgccttctttaaactcaccctgtctcgatctcccctagttagccagcccggcaacaagggccgagagttcgtgcctgatgagcaaaaacagtctattctcccttcgcctaaattttccgaagaggaaattgaaccactcccgcctacactcgaaaagaagccatccgaaaacatgtctatccagctggactccacatttaagcaaatgaaagatgaagatctgcagtctgcgatcgtccagccaagccagatgcaaacaaaattattacaagatcaagcagcctcactgcaggtcttcccctctcacagcgccctcaagctcgaagacataagccccgaagatcttccatcccaggcgttgccggtggaggggttaagcgaacagactatgccatccaagtctacaagtagccacgtcaaacaaagctccaatcttacggccaatgatctacctccacaggggattttaagccaggacacttcatcacaggatatgctctttcacgatatgacttcccaggacatgcagtccctggatatgctgagtcaggatactccatcacacgctatgccccctcaggacatccctagccaggatatgctcagccaggctcttagtgcccatgcaattttacctgaggcatccaccagccacatcgtccagtttcccgagattcagcatctgctgcaacaacccccggacttgcagcccgagaatactgagcctcaaaaccagcaaatccttcaaatgtcctatcaggacattaggtctgaagtgatggaggaaactaaagagtggaagtccgaagaggagctgcacagacggaagtcctcccggcggcacagtctgaatcagcaaaccaaagccttgcagtacctaaggcggcactcactggacgttcaggcgaaaggtcagaagagttcaaaaaggcactcactcgaccagcaaagcaaaggatggcaatcaccaaagcagaaatcactggaccaacagattaaggattggttgtctcccaaacgtcactctgtggataaacaggcccagctcaatcaaacgaaggaacagcttccagatcaacaagcagaggaccagcaggctaaaggcgaacagtatcctgaaggccagtccaaagacgggcaggtcaaggaccagcagaccgacaaagagcaaaacagcaagaagcagacacaagatcagcagacagaagatcagcccgctcaggagaagaagagcccaaaagggcagttccagaacgtccaggcggaaggacagcaggcccaggtcgaaaaggtgcccaagctgctctgccaagattctgaaagccagattcagcagtatcaattctggcaattccacaagggcaacctccaggcgggccagccccgaaccgttaatctcttggccaagaatccccttaccggctag

SEQ ID NO: 27716 - DNA, 339 bp, Artificial Sequence
  Description of Artificial Sequence: Synthetic coding sequence
atgattggcatctttcatatcttcatgtggtacttcctcctagttctgtacatgggtcagattaagggagcctttggaacttatgaaccagtaacctacaaaaccggatgcactctgtggggcattttttttattattgccggtgtattcctgatcagggtgacaaagtaccctaccagatcaggaaaacttggcagggaggtgagccgtatcctcttgttcttctacgggctggagttctccatcgccctgacccattccatctatagctgcagcaaccttttccgaagacagaatgacttgacctccgtcacagaggaagctgaatctacaccgtag

SEQ ID NO: 27717 - DNA, 459 bp, Artificial Sequence
  Description of Artificial Sequence: Synthetic coding sequence
atgatcgggatcttccacatattcatgtggtactttctccttgtactgtacatgggtcagatcaaaggcgcgttcggaacatacgagcccgtcacatacaagacaggctgcactctgtggggcatattttttattatcgcaggcgtgttcctcatccgcgtgaccaagtaccccactaggagcggcattattagcaccttaatcattaatattatttgcatcatcaccaccatcacagcggtgacactaacaattatcgagctgtctcattttaacagtgtaagctaccgtaactacggacaggctaagctgggtagggaggtgagtagaatcctcctgttcttctatggacttgagttctctattgcgctgacacactcaatttactcctgttctaacctgttccgtcgacagaacgaccttacctccgttactgaagaagcagagtctaccccatag

SEQ ID NO: 27718 - DNA, 282 bp, Artificial Sequence
  Description of Artificial Sequence: Synthetic coding sequence
atgatcggcattttccacatcttcatgtggtattttctgttggtgctctatatggggcaaatcaaaggagccttcggcacatacgaacccgtaacgtataagacaggctgtacactgtggggcatttttaagttgggtcgggaggtaagtcggattcttctgttcttctacggcctcgaattcagcatagcccttacccacagtatttattcctgctctaatctgttcaggcggcaaaatgatctgacctcagtcactgaggaagccgagtctacaccttag

SEQ ID NO: 27719 - DNA, 2040 bp, Artificial Sequence
  Description of Artificial Sequence: Synthetic coding sequence
atggaatcaacctcacaggatagaagagccacacacgtaatcaccattaagcctaatgagacagtcctgacagcttttccataccgccctcactccagcctcctggacttcctgaagggggaacctagggtcctcggcgcaactcagatactcctggcccttataattgtgggcttcggtacaatcttcgcactcaactatatcggcttttcgcagcgtctgcccctagtcgtccttactggttacccattttggggggctctgatctttattcttaccgggtacttaacagtaacagacaagaagagcaagttactggggcagggcgtgacaggaatgaacgtcattagctccctggtcgcaatcaccgggattacttttacaatcctgtcctatagacaccaggacaaatattgccaaatgcctagctttgaggagatctgcgtgtttagcaggacgctttttatagtactcttctttctgccttccgatgtcacacagaatagcgagcaacccgccccagaggagaatgaccagcttcagtttgtcttgcaggaggaatttagctccgatgacagcaccaccaatgcacagtccgtgatatttgggggttatgcattctttaaattaaccctcagtcgaagcccactggtgtcccaacctggcaacaaaggacgtgagttcgtacctgatgagcaaaagcaatctatacttcccagcccaaaatttagcgaggaggaaatcgagccactgccgcctaccctagaaaaaaagccctcggagaacatgtctattcagctggactcgaccttcaaacagatgaaggatgaggacttgcagagcgctatcgttcaaccatcacaaatgcaaaccaaactgctgcaagaccaggcagcatctctgcaagtgttcccatcacactcagccttaaagctggaagatatcagtcccgaggacctcccatcacaggcccttccggtggaagggttatccgagcagacaatgcctagcaaaagcactagctctcacgtgaagcagtcatcgaacctaaccgcgaacgaccttcctccccaggggatcttgtctcaggatacatcttcccaggacatgctgtttcatgacatgacgagtcaggatatgcagtccctggatatgctctcgcaagataccccaagccacgccatgcctcctcaggatatcccgagccaggacatgctcagtcaggccctctcagcacacgccatcctccccgaagcaagtactagtcacatcgtgcagttccccgagattcagcatctccttcagcaaccgcccgacctgcagcctgaaaatacagaacctcagaatcagcagatcctccaaatgagctatcaagacatacgctcagaagtgatggaggaaaccaaggaatggaaatctgaagaagaactacatcggagaaagtcgtcgaggagacactcacttaaccaacagactaaagccctgcaatacttaaggaggcattcccttgatgttcaggcgaagggccagaagtcatctaaacgacacagcctggaccagcagtctaaaggctggcagagccccaagcaaaaaagtcttgaccagcaaattaaggactggctgtccccaaagcgacatagcgtggacaaacaggcacagctgaatcagactaaggagcagctaccagatcagcaggccgaggatcagcaggctaaaggagaacagtaccccgagggccagtcaaaggatggccaggtgaaggatcagcagaccgacaaagaacagaatagcaaaaaacagacccaggaccaacagacagaggatcagccagcccaggaaaaaaagtctccaaaggggcagtttcagaatgtacaggcagagggccagcaggcccaggttgaaaaagttccgaagctcctgtgccaggactccgaaagccagattcaacagtatcagttctggcaatttcataagggaaatcttcaggcagggcagcctaggacagtgaacctcttggctaagaatcctctgacaggctag

SEQ ID NO: 27720 - DNA, 177 bp, Artificial Sequence
  Description of Artificial Sequence: Synthetic coding sequence
atgaatgtaatttctagccttgtggccattacaggaatcaccttcacaatcctgagctatcggcaccaagataaatattgtcaaatgcctagcttcgaggagatttgcgtgttttcacggaccctatttatcgactttatactactgacaccaccgcattcttctcacttcttgtag

SEQ ID NO: 27721 - DNA, 1989 bp, Artificial Sequence
  Description of Artificial Sequence: Synthetic coding sequence
atggaatctacatcccaagatagaagagcgacacacgttatcaccatcaaacctaacgaaactgtgttaacagcgtttccataccgaccacactcttcactgctcgatttcttaaaaggtgagccccgggtgctgggcgctacccagattctcctggccttaatcattgtgggattcggcaccatctttgctctcaattatataggctttagtcagcgcttacccctcgtggtcctgactggttaccccttctggggcgcgctgataggacagggcgtgacaggcatgaacgtgatttctagcctcgtggccattactggtattacgttcaccatcttatcttaccgacaccaagataaatactgtcaaatgccatcatttgaggaaatctgcgtcttctcgaggacccttttcatcgtactgtttttcctaccttccgatgtgacacagaatagtgagcagccagccccagaggagaacgatcagctgcagttcgtgttacaggaggagttttctagtgatgattctaccacaaacgctcagagtgtaatatttggagggtatgctttttttaaactcactctgagccggtccccactggtgtcgcaacccggaaataaaggacgtgagtttgtgccagacgagcaaaagcagagcattctgccgagcccgaaattttctgaagaagaaattgaaccgctccctccaacccttgagaaaaaaccatccgagaatatgagcattcagctggatagtacgttcaaacagatgaaagacgaggacttgcaatcagccattgtgcagccatcccaaatgcagacaaagctgctacaagatcaggctgcgtccctccaggtctttccatcccattccgcattaaagttggaggatatttcgcccgaggacctccctagccaagctttgccagtggagggtctttccgagcagacaatgcccagcaagagtacaagttcccatgttaagcagtcgtcaaatctaacagccaacgatctgcccccccaggggatacttagtcaagacacctcaagccaggatatgcttttccacgacatgacttcccaggacatgcagtccttggacatgctgtcccaagatacgccctcccatgccatgccgccgcaagacatccccagccaagacatgttgtcccaagctctctcggctcacgcaatcctgcccgaagcctcaacatcacatattgttcagtttccggagatacagcacttgctgcaacaacctcccgacctccagcccgagaacacagagccacagaaccagcagattctgcaaatgagttaccaggacattcgttccgaggtgatggaagagactaaagagtggaagagcgaagaggagctacatagacgcaaaagttccagaagacattcactgaatcagcaaactaaggcacttcaataccttaggcggcacagcttggacgtgcaagcaaagggacagaaaagttcgaagagacacagtcttgatcagcaatctaaaggatggcagtcacccaagcagaaatcactcgaccaacagataaaagattggctgtcgcccaagcgtcattcagtggataaacaagcccagctgaatcagacaaaggagcagctgcccgaccagcaggcagaagatcaacaggccaagggagagcaatatcccgaaggacagagcaaggatggacaggtgaaggaccagcagacagacaaagaacaaaactccaaaaagcagactcaggatcagcagacagaagaccagccagcccaggagaaaaaatcccccaagggacagttccagaatgtccaggcagaaggtcagcaggctcaggtcgagaaggttccgaagcttttatgtcaagatagcgagagccagatccaacaataccaattctggcagttccataaaggaaatctacaggccggccagcccaggaccgttaacctgctggcaaagaaccctctgacaggctag

SEQ ID NO: 27722 - DNA, 1704 bp, Artificial Sequence
  Description of Artificial Sequence: Synthetic coding sequence
atgaacgtgatatcgtccttagtagcaatcaccggaattaccttcacaatcctgagttataggcaccaggacaagtattgccagatgccctcattcgaggaaatctgtgtgttttccaggaccctgtttattgtgctgttcttcctgccctcggatgtgacgcagaatagcgaacagcctgctccagaagaaaacgatcagctgcagtttgttctgcaagaagagttctcaagcgacgattcaacgaccaatgcccagtcagttatcttcggaggttatgcttttttcaagctgactttgagtcggtcccctttagtgtcccagccaggaaacaagggtagggagtttgtgccggacgagcagaaacagtcaattctcccttcacccaaattctccgaggaggagatagaacccctgcctccaacactagagaaaaaaccatctgagaatatgagtattcagctggactccaccttcaaacagatgaaagatgaagacctccagtcagccatagtgcaaccatcgcaaatgcagactaagctgctgcaggaccaggccgcgtcactgcaggtttttccgagtcattcggcgttaaagctcgaggacatctcacccgaagatcttccgtcccaggctttaccggtggagggactgtcggaacagacgatgcccagtaagagcactagttcccacgtgaagcagtcaagcaatctaacagctaacgatctgcctccccaggggatactcagtcaggatacttccagccaggatatgctgtttcacgacatgacgtcccaagatatgcagtcactggatatgctatcgcaggacacaccgtcccatgcaatgccaccacaggatataccttcacaagacatgctgtcccaggccctcagtgcgcacgcaatcctgcctgaagcctccaccagtcatatcgtacagtttcccgagattcagcacttgttgcagcagccccccgacctccagcctgagaatactgaaccacagaatcagcagatcttgcagatgtcttatcaggacattagaagcgaggtaatggaggagactaaggagtggaaatccgaggaagaacttcaccggagaaagtcttctaggagacacagcctaaatcagcaaacaaaggcacttcagtatctgcgacgacactctttagatgttcaggccaaaggccaaaaatcaagcaagcgccactcgctggaccagcaatcaaagggctggcagtcaccaaaacagaaatctcttgaccagcagataaaagattggctctctcctaagaggcattccgttgataagcaggcccagttgaatcagactaaagagcagttgccagatcagcaggcagaggaccagcaagctaaaggtgaacagtaccctgagggacagagcaaagacgggcaggttaaagaccagcagacggataaagagcagaactctaagaagcaaacacaggaccaacagaccgaggaccaacctgcccaggagaagaagagccccaagggacagtttcagaatgtgcaagctgagggacagcaggctcaggtggagaaagttccgaaactgctctgtcaggatagcgagtcacagatccagcaataccagttttggcagttccacaaaggcaatttacaagcaggacaacctcggacagtgaacctgttggcaaagaaccctcttacaggctag

SEQ ID NO: 27723 - DNA, 444 bp, Artificial Sequence
  Description of Artificial Sequence: Synthetic coding sequence
atggttaggagaggccatgttggaattttcttcatagaaggcggcgtgcctttctggggcggagcctgtttcatcatctccggctcccttagcgtggccgccgagaaaaaccacacatcatgtctcgtgcggtcaagtcttggaactaacattctgagcgtgatggcagcctttgcggggaccgccatcttgctcatggactttggtgtaaccaatcgggatgttgatagggggtatctcgctgtgctcacgatcttcacagtcctggaattttttactgctgtgattgctatgcatttcggctgtcaagccatacatgcgcaggcaagtgcccccgtgatttttctccccaacgccttttccgcagatttcaatattccttccccagctgcaagcgccccaccagcttatgataatgttgcatatgcccagggagtcgtctag

SEQ ID NO: 27724 - DNA, 723 bp, Artificial Sequence
  Description of Artificial Sequence: Synthetic coding sequence
atgtctgccgctccagcctcaaatggcgttttcgtggtgatcccgccgaataatgcttctggattatgtccacccccggcaattctgccaacgtctatgtgccagcctcccggcattatgcaatttgaagaaccacccctgggagcacagacccctcgcgccacccagcctcccgatcttaggccggttgagaccttcctcacaggagagccaaaagttctggggaccgtccagatcttaatagggttgatccatctcggatttgggagcgttctccttatggttagacgtggccatgtgggaatctttttcatcgagggcggagtccctttttggggaggtgcctgctttattatctctggaagcctatctgtggcagctgaaaagaaccacacaagttgcctcgttagatcgagcctgggtaccaacattctgtctgtaatggctgcttttgcaggcactgccatcctgttaatggatttcggagttacaaaccgagatgtggaccgaggatatcttgctgtgttgacaatcttcactgtactggagttcttcacagccgttatcgccatgcactttggttgtcaggcgattcacgcacaggcttcagcaccggtcatctttcttccgaatgcgtttagcgctgattttaacatcccttcccctgccgccagtgccccgcccgcatatgataacgtcgcttatgcccagggcgtagtgtag

SEQ ID NO: 27725 - DNA, 3162 bp, Artificial Sequence
  Description of Artificial Sequence: Synthetic coding sequence
atggaagttagtggggatcctgggatccctgctctgcaccgcctgtgtacaagagccctgagcgcaagccccggccccacagccctcgggccgagtacattcttaccctgggatgtgtcggcccgcatgacgtccgcaagacgtaggacagacgtcgggcccagggttgcctttacttatccctgcactcagctgtctccaacgagagcccatcgccatctccccgtccacactgtcacttacccttgtacccaacttagccctacacgggctcatagttgccaccttcctatgcatactgtgacctacccttgtacccccagtcccacccgggcccatagctgccacttaccagtgcataccgtcacttatacatgtacgctgtcaccgactcatgcttgtctccacgcaagtacagtgagctgcctgtgctgcattccagtgcacacagtcacatatccttgtaccttgagtcccacgtgtgcccattgccatctgcatatgcgagcccggacgcaccctcaaccacatgcatgcgccgtgtatctgtgcattctctcaccgactagggcgcattgccatctgcacgttcataccgtgacttacatgtgcgtgccagcctgtacccactctattaccccagtgcatgcaccccccgatactagctgcgcctgggctcaggccgtgcatcgctggcccgtcctctggggttcccggtcttcttctatgtcttccggcctcaagcagacgcccatggtgggcgtcactggtcctccttgggatcccgacgcccctgcgccagcccctgcggggaccctcaccgcacacctcatccctggggcactacagtcttctggcctgacactgctgttgagtctggcggcacactgcagcggccctcaagcaaaagtgctgtccccaggggggctggatgccagcggggctaacctctgggctagtgccaactgttcactcctgcaggggttttggtgccaacctgcctcccagcttccgcgcgatcaactgtcagctctgattcagcggctggctcttcttcaggtacctttgcaggcgtggcaggtatcagggaaggagtgtcggggcgctggtactgggggccgaggcgatgaccctacctgcggaaagagggggagggaagtgggcggggattgggggttacggcccccacaaagaggtcgcgccccaactggttgccatggggagtccagagtgacccgcgagagaagaagcgcccagctctcttgtttagctaatctagcgtcgcgctgtggcctgcaagatgatttcacactgcaccccccaaacctgttgttgttctacaatttaagtcaggtgcgagaagcagactgcagggccttcattcggagggctgcccagggtgacgttgagctgttatcccacctgcccgatcagagggtcgcactgtggcgcgcagctgtagcatgcctggtaggcgctgggtggggatgggctcgttgcatcggtggtagtctcccgctaggcgctgaccttttggcgctgcagggtgtggcccgcctgaggttgagcgcatcggaccaacagctgctgggcgctttagtgtgcgatatggacgcatcaagcattggcgcagcagacccacacatgcttgaaaacttgaggcgctgcccaaggctgaccgcagcccagcggattgccttaaattcactactggcaggcgggaagacgtccctgggcccccccggttcttggacactggagggcctgcaagctcttggaccgttggcaacatatatctcaccgcatttgtgggcccaagtgcaagaggccgtggggctgggtttctttcgcagtgtcgtggctagctgccaggtcgggcggcttgggcagcgggaagcccgatgctttgtcacatccttccttgaatccaaaacaaaacctgtgagcagccgccctaggcttagcaccggcaatatcacagctgcaacattacgggacgatctgttccttgttcattatgattgcgccgaactggaatcctgccttgatggatgcattctccgcaccaatctggacacactgcttcagcacctgctccccaccgagtgccaacacgttgtgaaggccaaactagcccagatctatccacaagggctgcccgaggatcaactccggctcatcaccagcttagtttacctgtattctcggaccgaaattggccagtggtctatcaccagccaagacacagtgatggccctgctggcctccgacgtggctctggagaatcagactgaggcggtgctacagaagttcttagagcataacggcactgtgagtggcgcgctgctcctcgccattgggggcacaagattatgctggatgtccccccatcagattcagacgatccatccgcaggaactgaggctcgccggagcactggatctgtcctcatgcccccaatcaaggaaagacgtcctctacacaaaggctcacgaaacatttggatctagcggtactctcgccgcttattatagattaatgaggccgtatctaggcgggtccccagggggggcacagcctccgagcccagtgccccccggcggtgcacccgtagaggagctgaggcaccttgcccacgcaaacatttccatggatatcgatacatttacatctctgaaccctctggagctgcagagcctcgacgttggaaatgtgacagctctgttgggacacaacgtgggcgacctccagaaggctcgatcccatcccacggtccgagcctggctacggagtctcaattcctctaccctggggcagttaggtctggatgcatctcctacctcgcccaccggccccgcccacgggacacgcggtccaccatccaccacccaccaggtgttgcacttggtccatactagtggtctccccaccaatgatgctcaagcaagtacgtcaggttccctgtgggctccgcttggctacctgcctttggccatggccctcccatgctccctgctgtgtctgcttcattggggaacctgtattttagtgtcggtcgattccgtcgcttctgggtggctagggagtcagggctccggcgcaggaaagaccgaggtgctggactctgccggcagacctctgggtctgactggtcaactgtag

SEQ ID NO: 27726 - DNA, 2109 bp, Artificial Sequence
  Description of Artificial Sequence: Synthetic coding sequence
atggcggcggctgtgacaattcctggtccacgcatcggggccctgcagtcttctggcctcaccttgctgctttccctggctgcccattgcagcggcccgcaagctaaggtgctctccccaggtgggttggatgcctccggcgcaaatctgtgggcatccgcaaactgctccctgctccaaggcttttggtgccagcccgctagtcagctcccacgagatcagcttagcgctctgatacaacgactggctttgcttcaggtgcctctgcaagcatggcagttaagctgtctggctaatctggcctcacgatgtgggctgcaggacgactttactctgcaccctcctaatctcctgctgttctataacttgagccaggtccgcgaggccgactgcagggcctttattcgaagagccgctcagggtgacgtcgagctactcagccatcttcctgatcagcgggtcgctctttggagggctgccgtagcgtgcctggtcggggcgggtctccgcctgtctgcttctgaccagcaactgctgggtgccttagtgtgcgatatggatgctagctctattggggctgcggacccccacatgctagaaaaccttcgcaggtgcccaaggctgacggccgctcagcggatagcccttaacagtctactcgctgggggcaagacatcattggggccaccgggttcctggactctggagggcctgcaagccctcggcccgctggccacttacattagcccacatctgtgggctcaagtgcaggaagctgtcggcctgggcttcttccgatctgtggtagcatcatgtcaggttggtcggttgggccagagagaagcccgttgctttgtgaccagtttcctggaaagcaaaactaaacccgtcagcagtagacctagactgtctactggtaacataacagccgccaccctacgcgacgatctgttcctggtccattacgactgtgccgaacttgagtcatgccttgatggatgcattttgcgaaccaatctggacactctcctgcagcatctgctgccaacagaatgccaacatgtcgtgaaggcaaagctggcgcagatttaccctcagggactgcctgaggatcagctcaggttaatcacatcgctggtctatctatactctcggactgaaattgggcagtggagcataacatcccaggatacagtgatggcactattagctagcgacgtggctctggagaaccagaccgaggccgtcctacaaaaatttctcgagcataacgggactgtaagtggggctctgctcctggccatcgggggcactcggctctgctggatgtctccacaccagatccagactatccatccgcaggagctgcgattggctggcgcactggatctatctagctgcccccagtcgcgaaaagacgtgctgtacactaaggcccatgaaacgttcggatcatcaggaacactcgcagcctactaccgcctgatgaggccatacctcggaggaagccccggcggcgctcagcctcctagccccgtccctccaggcggtgccccagtcgaggaactgagacatctcgctcacgcaaatattagcatggatatcgacactttcacttcccttaatccactggagctgcagtctctggacgtgggaaacgtgactgccctactgggccacaatgtcggagacttgcagaaagcgcgtagccatccaacggttcgggcctggctcaggtcactcaattcatccaccctcgggcagctcgggctcgacgcctcaccaacatcccccacaggcccagcccacggcacaagaggtcctcctagcacaacccatcaggttctccatctggtccacactagcgggctcccaactaacgatgcgcaagctagcacttctggatctctatgggctccactcggttacctgcctttggcaatggcattgccttgcagcctgctgtgtttacttcattggggaacttgcatccttgtgtctgttgacagcgtggcctctgggtggctggggagccaaggatctggcgcaggaaaaactgaagtcctcgactcagcaggacggccgctgggactgaccggccaactctag

SEQ ID NO: 27727 - DNA, 792 bp, Artificial Sequence
  Description of Artificial Sequence: Synthetic coding sequence
atgtctttagtggctgaggcctttgtctcccaaattgctgcagctgaaccatggccagagaacgctacactgtaccaacagcttaaaggagagcagatactcctgtccgacaacgccgcgagtctcgctgtgcaggcatttctgcagatgtgcaatttaccaatcaaggtggtgtgcagagccaacgccgaatacatgagtccctccggtaaagtgcctttcatccatgttggcaaccaggtggtctctgagcttgggccgattgtgcagttcgtgaaagccaaggggcacagcctctcagacggactagaagaggtacagaaggctgagatgaaagcatacatggaactggtgaataacatgttgttaaccgctgagctgtatctccagtggtgcgatgaggcaacagttggggagattacccacgcaaggtatggatctccatacccctggcccctcaaccatattctcgcttaccagaagcaatgggaagtgaaaaggaaaatgaaggccatcggttgggggaaaaaaactctggaccaagtgctcgaagatgtggaccagtgctgtcaggcccttagccaacggctaggaacacaaccctatttttttaataaacagcctacggaattagacgcattggttttcgggcacctgtatactatacttaccacacagcttacaaatgacgagctgtcagaaaaagttaaaaattacagcaacttactggctttttgccgccggattgaacagcactactttgaggatagaggcaaggggaggttatcatag

SEQ ID NO: 27728 - DNA, 762 bp, Artificial Sequence
  Description of Artificial Sequence: Synthetic coding sequence
atgtacatcgctgctgaaccgtggcccgaaaacgctacactgtatcagcagctgaagggtgagcaaatcctgctgtctgataacgcagcctctttggccgttcaggcatttctacaaatgtgtaatttaccaataaaagtggtatgccgggccaatgccgaatatatgagtccctcgggcaaggtacctttcatacatgtaggcaatcaagtagtctcagagctggggcctatcgtgcaatttgtgaaagccaagggccacagcttgagcgatggcctggaggaggtccagaaagcagagatgaaagcgtacatggagctggtgaacaatatgctcctcaccgccgagctctacctgcagtggtgtgacgaggcgactgtaggcgagattactcatgctcggtacggatccccttatccctggcccctgaaccacatactggcgtaccaaaagcaatgggaggtgaagagaaagatgaaagccattggatggggcaaaaaaactttggaccaggtgcttgaagatgttgaccagtgctgtcaggctctgtcacagcgccttggaacacagccatatttttttaacaaacaacctactgagttagacgctctggtgtttggccacctctacactatcttaacaacccagctcactaatgatgagctgtccgaaaaagtgaagaattactccaacctcctcgccttctgtcgcagaatcgagcagcactattttgaggatcgaggaaagggccgactgtcttag

SEQ ID NO: 27729 - DNA, 477 bp, Artificial Sequence
  Description of Artificial Sequence: Synthetic coding sequence
atggcagcccccttggaactgagttgctggggcggaggttgggggctcccctctgtgcactctgagagccttgtcgtcatggcttatgcaaagttttctggcgctccactgaaggtgaacgtcatcgacaatacctggcgcggtagtcgtggcgacgtccctattttgaccactgaagacgatatggtgagtcaacccgctaaaatcctcaacttcctgagaaagcagaaatataatgccgactacgaactatccgcgaagcaaggcgctgatacgttagcatatatcgccttactggaggagaagctgctgcccgccgtgctgcacacattttgggtggaaagcgataactactttacagtgacgaagccctggttcgcttctcagataccatttccactgtcccttattcttcctggacggatgagcaaacagatcttgagctcccgtgcagggacacacatgctgcgcaaatag

SEQ ID NO: 27730 - DNA, 747 bp, Artificial Sequence
  Description of Artificial Sequence: Synthetic coding sequence
atggctgctcctctcgaactttcatgctggggcggaggttggggcctccccagcgtgcatagcgaaagcctggttgtcatggcttacgcaaaattttcgggcgccccattgaaggttaatgtcatcgataatacttggcgagggagtcgcggcgacgtccccattctgactaccgaagacgatatggttagtcagccagctaagatcctgaacttcctcagaaaacaaaagtataacgctgactatgaattgtctgcgaagcagggagccgacactctcgcctacattgcgctcctggaggaaaaattgcttcccgcggtgctacatacattctgggtggagagcgataactattttaccgtgacaaagccgtggtttgcaagtcagatcccctttccactgagcctcattctgccagggcgtatgtcaaaaggcgctctgaatcggatcctgttgactcgcggccagcctccactatatcacctgagggaagtcgaagcccagatttatagggacgcgaaagagtgtctcaatctgctttctaacaggctgggcacctcacaattcttctttggtgacaccccaagcaccctggacgcttacgtcttcgggttcctggcccccttgtacaaggtcaggtttccaaaagtgcagttgcaggaacacctgaaacagctttccaatctgtgccggttctgtgacgacatattatcctcctatttccgtctctccctcggagaagggtag

SEQ ID NO: 27731 - DNA, 747 bp, Artificial Sequence
  Description of Artificial Sequence: Synthetic coding sequence
atggcggccccactggaactgagctgttggggcggcggttggggactgccgtctgttcatagtgagtccttggttgtgatggcctatgctaaattttctggcgcacccctgaaggtcaatgtcatcgataacacctggcgtggctctcgtggggacgttcctatcctgaccacagaagacgacatggtgtctcagccagctaagattctaaattttttacgaaaacagaaatataacgccgattacgaactgagcgccaagcagggtgcggacaccttggcctacatcgccttgctggaggaaaaactgcttcccgcagtgcttcatacattctgggttgagtccgataattacttcaccgtgaccaagccttggtttgcaagtcagattccatttcctttatcgctgatccttccgggacgcatgtcaaagggggcactcaaccgaattctcctgactcgcgggcagcctcccctgtatcacctgcgggaagtcgaggcccagatctatagggatgccaaggagtgccttaatctgctctccaacagactcggtacatctcaattttttttcggcgacactccttctacgctggatgcctatgtctttggctttttggccccgttgtataaagtccggtttccaaaggtccaactccaggaacatcttaaacaattgagcaatctgtgtagattttgcgatgacattctctcctcttactttaggctttctctgggggatgggtag

SEQ ID NO: 27732 - DNA, 939 bp, Artificial Sequence
  Description of Artificial Sequence: Synthetic coding sequence
atggccgctcctctggagttatcttgttggggtggaggctggggtcttccgagtgtacacagcgaatccctcgtagttatggcctatgcaaaattttccggggctcccctgaaggtgaacgtaatagataacacctggaggggttctcggggcgacgtgccaattctaactactgaggatgatatggtatcccaacctgcgaagatactgaatttcctacggaagcagaaatacaatgctgattatgagctttccgcaaagcaaggcgcggatacccttgcctatatagcgctcctagaggagaagctgctccccgcagtcctgcatactttctgggtagagtctgataactacttcaccgtcactaagccgtggtttgcgtcccagattcccttccccctgagcttaatccttccgggacggatgtccaagggagctctgaatcggatactgcttaccaggggccagccacccctttatcacttaagggaggtggaggcacagatttatagggatgcgaaagagtgcctcaacctcctgtctaataggctgggtacctctcaattttttttcggggataccccgtctacactggatgcctacgttttcggatttctcgcgccattgtacaaggtccgatttccgaaggtccagcttcaagagcacttgaagcagctgagcaacctatgtcgattctgcgacgatattctgtctagctacttccggctgagcctgggcgggattagccctgccggccaggagacggtggatgctaatctccagaaactcactcagttggtaaataaggagtcaaatctcatcgagaaaatggatgacaatttgcggcaatcaccacagcttcccccaaggaagctgccgactcttaaactcacacctgccgaagaagaaaacaattccttccaacggctctccccctag

SEQ ID NO: 27733 - DNA, 756 bp, Artificial Sequence
  Description of Artificial Sequence: Synthetic coding sequence
atggtgtcccaacctgcaaaaattttaaatttcctgagaaaacagaagtacaacgccgattatgagctgtccgcaaagcagggtgctgacaccctggcatacatcgccctcttggaggagaagctcctgcctgccgtcttgcacactttttgggttgaatctgacaactacttcaccgtcacaaaaccttggttcgcaagccagatcccttttcctctaagcctcatactcccaggtaggatgtccaagggtgctctgaataggatcctgctgacaaggggtcagccacctttgtaccacctgcgcgaggtcgaggcacagatttaccgtgatgcgaaggagtgcctgaacctcctttctaaccgtctcggaaccagccagtttttctttggcgacaccccatccacactggatgcttatgtgtttgggtttctggccccactgtacaaagtgaggtttcctaaagtgcaattacaggaacacctcaagcaactgtccaacctgtgccggttctgcgacgacattctgtcttcctactttcgactgtccttgggcgggattagtccggctgggcaggagaccgtggatgctaatctgcagaagcttacccaactggtgaataaggaatctaatcttattgaaaagatggatgacaatctgcggcagtcccctcaactcccaccccgcaaactgcctaccctgaagctgacacctgccgaagaagagaataactcctttcaaaggctcagtccatag

SEQ ID NO: 27734 - DNA, 1008 bp, Artificial Sequence
  Description of Artificial Sequence: Synthetic coding sequence
atggcggcaccctctggggtccacctcctggtgcggcggggctcccaccgtattttcagcagccctctgaaccatatctacttacataaacaaagttcttcacagcagcggaggaattttttttttcgtcggcagagagatatcagtcacagcattgtcttaccagccgccgtgagtagcgcacacccggtgccaaagcatatcaaaaagcctgattacgtgactactggcatcgtgccagactggggggacagcatcgaagtgaagaacgaggatcaaattcagggtctacaccaagcttgtcaacttgcacggcacgtgcttttactcgcaggcaagtctttgaaagtggacatgaccactgaggagatagatgctctggttcaccgcgaaataatatcacacaatgcgtaccccagccccctaggttatggaggattcccaaagtctgtgtgcacttccgttaataacgtgctgtgccacgggattccagacagcaggcccctgcaagatggggacatcattaacatagatgtcacggtgtattataacgggtaccacggtgatacatctgaaacatttctcgttgggaacgtagacgaatgcggaaagaaactggtcgaagtggctagaagatgtcgggatgaggccattgcggcatgtagagcaggagcccccttctctgtaattgggaatacgatctcgcacatcacacatcagaacgggttccaggtgtgtccccactttgtaggtcacgggataggaagctatttccacggccaccctgagatctggcaccacgccaacgatagcgatttacctatggaggaaggcatggcatttaccatcgagcccatcattacagagggttcccccgagttcaaggtccttgaagatgcatggactgtcgtgagcttagacaatcaacggtcagcccagttcgagcatactgtcctaataacaagcaggggtgcccagatacttacaaaactgccacacgaggcttag

SEQ ID NO: 27735 - DNA, 747 bp, Artificial Sequence
  Description of Artificial Sequence: Synthetic coding sequence
atgaaacctgcttctatatcagaggaagagctcctgaatctgattaataagcttaataacgacgataacgtcgatggccttttagtacagctccccctccctgaacatatcgacgaaaggagaatctgtaatgctgtttctcccgacaaggacgtggacggattccacgtgatcaacgtcggccggatgtgtttagatcagtattccatgttacctgccacaccctggggcgtgtgggagataataaaacgcactggcataccaaccctgggcaagaatgtggttgtagctggaaggagcaagaatgtaggaatgcctatcgcaatgctgctgcataccgacggcgcccatgagagaccaggaggggatgcaacagtgaccatcagccatcggtacacacccaaagaacaactgaaaaagcataccatactggccgatattgtgatcagcgccgccggcattcccaacctgattacagccgatatgatcaaagagggagccgctgtgatcgatgtgggcattaacagggttcacgatcccgtcaccgctaagccaaagctggtcggcgacgtggacttcgagggagtgcgtcagaaggctggctatataacccccgtcccggggggagtgggccccatgaccgtggccatgctaatgaagaataccattattgcagccaagaaggtgctgaggctggaggagagagaagtcttaaagagtaaggagctcggggtggcaactaactag

SEQ ID NO: 27736 - DNA, 561 bp, Artificial Sequence
  Description of Artificial Sequence: Synthetic coding sequence
atgtgcctggatcagtactctatgctgccagcaacaccttggggcgtgtgggaaatcattaagcgcactggaatccctactctgggcaaaaacgtggtcgtggcaggtagatccaagaacgtgggaatgcccatcgcaatgctgctccataccgacggggcgcacgaaaggccaggtggcgacgccaccgtgacaatctcacaccggtataccccaaaagaacaactcaaaaagcataccatactcgccgatatcgttatctcagccgcggggatccctaacctgatcacagctgacatgatcaaggaaggtgctgcagttatcgacgtgggaattaatcgagtacatgatcctgtgaccgcaaagcccaaactcgtgggtgacgtggattttgaaggcgtccggcagaaggcggggtatatcacccccgttcccggcggtgttggccccatgaccgtggctatgctgatgaagaataccatcatcgcagccaaaaaggtgctgcgcctagaggagcgggaagtgctgaagagtaaagaactgggagttgcaaccaactag

SEQ ID NO: 27737 - DNA, 1053 bp, Artificial Sequence
  Description of Artificial Sequence: Synthetic coding sequence
atggccgctacctcactgatgagcgcacttgctgcgaggttgttgcagcctgcacactcctgctcccttaggttaaggccattccatctagctgccgtccgcaacgaggctgtggtcataagtggcaggaaactggctcagcagattaaacaggaggtccgtcaggaggtcgaagagtgggtggcctcaggtaacaagaggcctcatttgtctgtcattcttgtcggagagaaccccgcaagccactcttacgtccttaacaaaactagggcagccgcggtggtcggaattaactccgagacaatcatgaagcccgcctccatttcagaggaagagctcctcaatttgatcaataagcttaacaatgacgacaacgtggacggactcctggtgcagctgcctctccccgagcatattgacgaacggagaatttgcaacgcagtgtcgccagataaggatgttgacgggttccacgtgattaacgtcggccggatgtgtctggaccagtactcaatgctgcccgctaccccatggggagtgtgggaaatcattaagcgcactggtatcccaacactgggaaagaacgtagtggtagcaggccgcagcaaaaacgttgggatgccgattgccatgttacttcacactgatggtgcccacgaacggccaggcggggatgcgacggtgacaatatcacaccgctacacacctaaagaacagctcaagaagcataccattctcgcagacatcgtgatctccgccgccgggatacccaatcttattaccgccgatatgatcaaggaaggtgccgcagtcattgatgtggggataaatcgcgtgcacgaccctgtgaccgctaaacctaagctggtgggcgatgtcgacttcgagggggttcgccagaaggccggctatatcactccagtgcccggtggggtaggccccatgacagttgccatgctaatgaaaaacacaattattgctgctaaaaaggttttaagactcgaggaacgggaggtcctgaaatctaaggaactgggcgtagctacaaactag

SEQ ID NO: 27738 - DNA, 882 bp, Artificial Sequence
  Description of Artificial Sequence: Synthetic coding sequence
atggctacaaacgagtctgtgtcaatcttctcctcggccagtctggccgtggagtacgtggattccctactccccgaaaaccccctgcaggaaccgttcaagaatgcctggaattatatgctgaataactatactaaattccagatcgccacttggggctctctcatcgtgcacgaagccctgtactttctgttttgcctaccgggattcctctttcagtttatcccttacatgaagaaatataagatccagaaggacaaaccagaaacctgggagaaccagtggaagtgcttcaaggtcctactttttaatcatttctgtattcagcttcccttaatctgtggcacgtattacttcaccgagtattttaatataccatacgactgggagaggatgcctcgatggtactttttgctggctcggtgctttggatgtgccgtcatcgaggatacctggcactatttccttcacagacttctgcatcataaaagaatctacaaatacatccataaggttcaccacgagtttcaggcaccgtttgggatggaggccgaatacgcgcacccattagaaactttgattttgggaacagggtttttcataggcattgtgctactttgcgaccatgtgatccttttgtgggcttgggtgactatcaggttactggagaccatcgacgttcattccggatacgatatccctttgaacccattgaacctaattcctttttatgccggaagtaggcaccacgactttcaccatatgaattttataggtaattacgccagcacattcacatggtgggaccgcattttcgggacagactcacagtataatgcttataacgaaaaaagaaagaaattcgaaaagaagaccgagtag

SEQ ID NO: 27739 - DNA, 489 bp, Artificial Sequence
  Description of Artificial Sequence: Synthetic coding sequence
atgccacgctggtactttctattggcccggtgtttcgggtgtgccgtaatagaggacacctggcactacttcctgcaccgactccttcatcataaacgcatatataagtacatccataaggttcaccacgagttccaagcaccctttggcatggaagcagaatacgcccacccgctggagacactgatcctcggcacaggatttttcatcgggatcgtgttgctgtgcgaccacgtaattttactgtgggcatgggtgaccattcgactgctagaaaccatcgacgtgcacagcggttacgatatccctctgaaccctcttaatctcatccccttttacgctggttccaggcaccacgattttcatcacatgaatttcatcggcaactatgcttccaccttcacatggtgggaccggatctttggcacagactcacagtacaatgcttataatgaaaaaaggaagaaattcgaaaaaaagaccgagtag

SEQ ID NO: 27740 - DNA, 258 bp, Artificial Sequence
  Description of Artificial Sequence: Synthetic coding sequence
atggcaactaatgaatcagtttccatcttcagctctgcttctctggcagttgaatacgtggactccctgcttcccgagaacccattgcaggagccattcaagaatgcctggaactacatgctaaacaactacaccaaattccagattgctacatggggctcacttatcgtgcacgaggctctctactttctgttctgtctaccagggttcctatttcaattcatcccatatatgaagaaatataagattcagaagtag

SEQ ID NO: 27741 - DNA, 663 bp, Artificial Sequence
  Description of Artificial Sequence: Synthetic coding sequence
atggctacaaatgaatctgtctcaatcttttcctctgcgagcttggctgtggagtacgtagattccctactcccagagaatccattacaggaaccattcaaaaacgcctggaactacatgctgaacaattatacaaaatttcaaatcgcgacttgggggagcctgatcgtgcacgaggctctttattttctgttttgtctgcctggcttcctgttccagtttatcccttacatgaaaaagtataagatccagaaagacaaaccagaaacttgggagaaccagtggaaatgctttaaggtcctgctgttcaaccacttctgcattcaattgccactcatctgcggaacctattattttacggagtactttaatattccctatgactgggagagaatgcctaggtggtatttcctgctcgccagatgtttcggctgtgctgtcattgaagacacttggcactactttctacatcggctgctgcaccacaagaggatctacaaatatattcacaaggtccaccatgagtttcaggccccttttgggatggaggccgaatatgctcacccactcgaaacactgatcctcggtactgggttcttcatcgggatcgtcctactttgcgaccatgtgatattgttgtgggcttgggtgacaatccgatag

SEQ ID NO: 27742 - DNA, 723 bp, Artificial Sequence
  Description of Artificial Sequence: Synthetic coding sequence
atggccgccctacgtagaatgttgcacctgccctcactgatgatgggaacatgcagacccttcgctggctccctggcagacagctgcctcgccgaccggtgcctttgggatcggctacacgcgcagcccagactgggcacagtcccgacctttgattggttcttcgggtatgacgaggtacagggcctcctcctacccctgttacaggaagcccaggctgcctcaccactgcgcgtgctggatgtggggtgcggaacctccagcttatgtaccggtttatatacaaaaagcccccatccggtggatgttctgggagttgatttctcccctgtggcagtggcgcatatgaacagtctactggaaggcggccccgggcagacaccactgtgccctggccaccctgcctccagcttgcactttatgcatgctgatgcccagaatctgggtgccgtagcatcgtctggttcattccagctgttattggacaaaggtacctgggacgcagttgcacggggcggcctgccccgcgcctaccaactgctatcggagtgcctgcgcgttctcaacccacagggcactcttatccagttctccgatgaagaccctgatgtaaggttaccatgcctcgaacagggatcttacggctggactgtcactgtgcaggagcttgggccctttcggggaatcacttattttgcatatcttattcaggggagccattag

SEQ ID NO: 27743 - DNA, 657 bp, Artificial Sequence
  Description of Artificial Sequence: Synthetic coding sequence
atggccctagttccttacgaagagactacggagttcgggctgcagaaatttcacaagcctctggctacatttagctttgccaaccacaccattcagataagacaggattggcgacacctgggcgtggccgccgtcgtttgggacgcagcaattgtactgtcaacgtacctggaaatgggagcagtggagttgcgaggtcggtccgcagtggaactcggtgcagggactgggttggtggggatcgtcgccgctctgcttggagcccatgtcacgatcacagatagaaaagtggccctagagtttctcaaaagcaacgtgcaagccaatcttccccctcacattcaaacaaagacggtggtgaaagaactgacttggggccagaatcttggttctttctccccaggtgaattcgatctgatcctcggggccgatatcatttatttggaagagacctttacagatctcctccagacattggagcacctttgttcgaatcactcagtcatacttctcgcctgccgaatccgatatgaaagggacaataactttctggctatgctcgagagacagttcaccgttcggaaagtgcactacgatccagagaaggacgtccacatctacgaggctcagaagaggaaccagaaggaggacctctag

SEQ ID NO: 27744 - DNA, 657 bp, Artificial Sequence
  Description of Artificial Sequence: Synthetic coding sequence
atggcgttggtgccgtacgaggaaacaacagagttcggattgcagaaattccataagcccttggccacattctcctttgctaatcatacaatacagattcggcaggattggagacatttgggtgtagcggccgtcgtttgggacgccgcgatcgtcctgtccacatatcttgaaatgggcgctgtagagctgcggggcaggtccgctgtggagctgggcgccggcactgggctggtggggatagtcgccgccctgttgggagcgcacgtaacgattacagatcggaaggtggcactcgagtttctgaagagtaacgtacaagcgaatctgccacctcatattcagaccaagacagttgtgaaagaactcacttgggggcagaaccttggttccttctcccctggagagttcgatttaatcctaggcgccgacataatttatctggaggagacttttacggaccttcttcagacactcgagcacttatgctctaatcattctgtcatcctcctggcctgtagaatccgatacgagagagataacaatttcctggctatgctcgagagacagttcaccgtccgcaaggttcattacgaccccgaaaaggatgtccatatttacgaggctcagaagaggaaccagaaggaggatctttag

SEQ ID NO: 27745 - DNA, 273 bp, Artificial Sequence
  Description of Artificial Sequence: Synthetic coding sequence
atggctctggtcccatatgaggaaaccacggagttcggacttcagaagttccataaacccctggctactttctctttcgcgaatcacacgatccagatcaggcaggattggcgacacctaggagtggctgcagtggtatgggacgccgcaatagtgctgagtacctacctggagatgggggctgtcgagctgagaggtaggtcggccgtggaacttggggccggtacgggactggtgggcattgttgccgcgctcctgggcggaggcatatag

SEQ ID NO: 27746 - DNA, 657 bp, Artificial Sequence
  Description of Artificial Sequence: Synthetic coding sequence
atggctctggtcccatatgaagagacaacagaatttggtctgcagaaattccacaaacctcttgccactttctcttttgccaaccacactattcaaattcgacaagattggcggcatcttggcgtcgccgccgtggtgtgggacgcagcaatcgtcctctccacataccttgaaatgggtgcagttgaactgaggggccgctccgctgtagagttgggggctggaacgggcctggttgggattgtagccgcgctactcggcgcgcatgtgactatcactgacaggaaggttgccctggagtttctgaaatcgaatgtccaggccaatctcccacctcacattcaaacaaagaccgtcgtgaaggagcttacatggggccagaacttaggaagtttttctcctggggagtttgacctaattcttggggccgacattatatatctggaagaaactttcacagatctgttacaaacgctggagcacctgtgcagtaaccattctgttattctcctcgcctgcagaatccgctacgagcgcgataataatttcctcgcaatgctcgagaggcagtttacagttcgaaaggtgcattatgatccagaaaaagacgtgcacatatacgaggctcaaaagcgcaatcagaaagaggacctctag

SEQ ID NO: 27747 - DNA, 657 bp, Artificial Sequence
  Description of Artificial Sequence: Synthetic coding sequence
atggctctggttccttatgaggaaacgacggaattcggtcttcagaaattccataagcccctggctacattcagcttcgctaaccacacgatccaaattcgccaagactggcgccatctcggtgtggctgcagttgtgtgggacgccgccatagttttgtctacgtatctagagatgggcgcggtagaactcagagggcggtcggctgtggagcttggtgcaggtacgggactagtgggcatcgtggcagctttattgggggcccatgtgacaattaccgacaggaaagtggcattggagttcttaaagagcaacgtgcaggcaaacctcccccctcacatccagaccaaaacagttgtcaaggagttgacctgggggcagaaccttggatccttctctccgggggagttcgacttgatcctgggcgcggacattatctatctagaggaaactttcaccgacctcttgcagacgttggagcacctttgtagtaaccactctgtcatcctcctagcctgcaggattcgctatgagcgtgacaacaactttctggctatgctggaaagacagtttactgttcgaaaggtccattacgaccctgagaaagacgtacatatctatgaggcccagaaacgaaaccagaaagaggatctgtag

SEQ ID NO: 27748 - DNA, 657 bp, Artificial Sequence
  Description of Artificial Sequence: Synthetic coding sequence
atggccctagtgccatatgaagaaaccaccgagttcgggctacagaaatttcacaaaccgctggcgacattctcgttcgccaatcatacgatccagatacgacaggactggaggcatctgggcgtcgctgccgtagtctgggatgcagccattgtgctgagcacatatttagaaatgggagcagtcgaactacgcggcaggagtgcagttgagctaggggctggtaccgggttggtgggtattgtcgctgccctgttgggagcacacgtaacgatcacggataggaaggtggcattggaatttcttaaatccaatgtccaggctaacctccccccacacattcagacaaaaaccgtggtgaaagagctgacatggggccagaacctgggttctttctccccgggcgagttcgacttaattctgggcgccgatattatatatttggaggagacattcacagatcttttgcagacattggaacacctgtgttctaaccactccgtcatccttttggcatgtcgtatcaggtacgagagggataataactttttagccatgctggagaggcagttcacagtaaggaaagtccactatgatcccgaaaaggatgtgcatatctatgaagcacagaaacgaaatcaaaaagaagatctgtag

SEQ ID NO: 27749 - DNA, 273 bp, Artificial Sequence
  Description of Artificial Sequence: Synthetic coding sequence
atggcactagtcccttatgaagaaaccaccgaattcggacttcagaaattccataaaccgctggcgacattttcattcgccaatcacaccattcagattaggcaggactggcgccacttgggagtcgccgccgtggtctgggatgcggccatcgtcctctctacctatctggagatgggggccgtggaactccgcggacgatccgctgtagaactaggtgcaggtacaggcctggttgggatcgttgctgcccttttgggaggggggatctag

SEQ ID NO: 27750 - DNA, 681 bp, Artificial Sequence
  Description of Artificial Sequence: Synthetic coding sequence
atggccgaccctggcccggaccccgaatccgagtcggagtccgttttcccgcgtgaggtcgggctttttgcagactcctattcagagaaaagtcagttctgtttctgtggccatgtattgacaattactcaaaatttcgggtcccgcctgggagttgccgcccgggtctgggatgctgccctgtccctgtgtaactacttcgaatcccagaatgtggatttcaggggaaaaaaggtgattgaactaggagcgggcacaggcatcgttggaatccttgcagcgcttcagggtggagacgtaactattacagacttgcctctcgccctggaacagatacaggggaatgtgcaggccaacgtgcctgccggcggccaggcccaggtacgcgccctgagctggggtattgatcaccacgtctttccggccaactatgatctggtgctcggggctgatatcgtgtaccttgaacctactttcccattgctcctgggtaccttgcaacacctatgtagaccgcacggaaccatttatctggcatcgaagatgagaaaagaacatggtactgaaagtttctttcaacacctgctcccccaacattttcagcttgaattggctcagcgagacgaggacgagaatgtgaatatttacagagcacggcatcgggagccacgtccagcatag

SEQ ID NO: 27751 - DNA, 450 bp, Artificial Sequence
  Description of Artificial Sequence: Synthetic coding sequence
atggctgatcccgggccagatccagaatcggagagcgagtctgtgttcccccgggaggttggccttttcgccgacagctacagcgaaaagtctcagttttgcttctgcggccatgtgctcaccatcacgcagaactttgggtcgcgactgggtgtagccgcaagggtgtgggatgcggctctgagcttatgtaattacttcgaatctcagaacgtagacttccggggcaagaaggttatcgaacttggagcaggcacgggcatagtaggcatattagccgctctgcagggtgcctacggcctggtgcgagagaccgaggatgatgtgattgagcaggagctgtggcgcggaatgcgaggtgcctgtgggcacgccctttctatgtccactatgacaccctgggagagcataaagggttcgagcgtgagggggggctgctatcatcactag

SEQ ID NO: 27752 - DNA, 810 bp, Artificial Sequence
  Description of Artificial Sequence: Synthetic coding sequence
gcacgctgccaattctgtgcctgcgaatccctgagcccctgtagcgggctctctagtttggcagccaggcaaggataccaccagatttgggcttttccctttctccccagtggcgccaccgccacctggcccgcggcctcgcgcagtaggtccctggccgcccgtagtttgccacggagccccgcaagacccggccctaatgacgctctactcggggagcacgacttcagggggcaaggggttcgagcccaaaggttccgttttagcgaggagcccggacccggggccgacggggctgtgctagaggtgcacgtcccacaaatcggagcaggtgtgtcactgccaggaatcctggccgctaagtgtggggccgaggtgatcctgtccgactcttccgaactgcctcattgcctggaagtgtgcaggcagtcgtgccagatgaataatctcccccacttacaggtcgtggggttaacgtggggccacatcagctgggacctgctagcactgcccccacaggacattatcttggcttctgacgttttcttcgaacctgaagattttgaggacatattggctacaatctatttcctgatgcacaagaacccaaaagtgcagctttggtctacttaccaggtgcgaagtgcggattggtcactcgaggcactcttgtataagtgggacatgaagtgtgtgcacattcctctggagtctttcgatgcagataaagaggacatcgctgaatcaacactacccggcaggcataccgtggaaatgctggtcatctcattcgctaaggattcactatag

SEQ ID NO: 27753 - DNA, 573 bp, Artificial Sequence
  Description of Artificial Sequence: Synthetic coding sequence
atgtatgtgtggccttgcgcagtcgtgcttgctcagtacctatggtttcacaggagatcgctgccgggcaaggcaattcttgagattggggccggcgtcagcctgcccgggattctggcagcaaaatgtggggctgaagtaatcttgtccgattcctccgaactgcctcattgcctggaagtgtgccggcagagctgtcaaatgaacaacttaccccatctacaggttgttggcctgacgtggggccacattagctgggacctcctggctctcccaccccaagatatcatactggcctctgatgttttttttgaaccagaagatttcgaggatatactggcgactatctacttcctcatgcataagaatccgaaggtgcagttgtggagtacgtaccaggtgcggagtgcggactggtctctggaggcgctactttataagtgggacatgaaatgtgttcacattccgttggaaagctttgacgcagataaggaggacattgcagaaagcacgctgccaggtaggcacacggtcgagatgctggtgatatccttcgcgaaggatagcttgtag

SEQ ID NO: 27754 - DNA, 372 bp, Artificial Sequence
  Description of Artificial Sequence: Synthetic coding sequence
atgaataatcttccccacctgcaggtggtgggcctaacctggggtcacatttcctgggacctcttggccctgcccccccaggacattatcttggcgtctgacgtcttttttgagccagaagacttcgaagatattttggccactatttacttcttaatgcacaagaacccaaaggtgcaactgtggagcacttaccaggtccgttccgccgactggtctctcgaagctctgctgtataaatgggacatgaaatgcgttcatataccgctcgagtctttcgacgcagataaggaggacatcgctgaaagcacactcccgggcaggcatacggtagagatgttggtgatttccttcgccaaggacagtctttag

SEQ ID NO: 27755 - DNA, 372 bp, Artificial Sequence
  Description of Artificial Sequence: Synthetic coding sequence
atgaataacttaccccacctccaagtagtgggcttaacatggggtcatatctcatgggacctgctggcactccccccccaggacatcattcttgcatccgacgtgttcttcgaacccgaagacttcgaagatattctcgccaccatatattttctgatgcacaaaaatcctaaggtccagttgtggagcacataccaagttagatcagcggactggtcgctcgaggctctgctgtataaatgggacatgaaatgtgtgcatattcccctggagagttttgacgccgataaggaagatatagctgagtccacgctgccggggcgccacacggtggaaatgctcgttatttcatttgccaaagattccctgtag

SEQ ID NO: 27756 - DNA, 372 bp, Artificial Sequence
  Description of Artificial Sequence: Synthetic coding sequence
atgaataatctgccacatctgcaggttgtcggtctgacatggggtcacatttcttgggatctgttggccttgccaccccaagatattatactcgcatctgacgtattctttgagcccgaggactttgaagacatcctagccacaatttatttcctgatgcacaagaatcccaaagtgcagctgtggtccacctatcaagtccggagcgctgactggtcactggaggcactgctctacaagtgggacatgaagtgcgtgcacatccctttagaaagcttcgatgcagataaagaggatattgccgaatctacactgcctgggcggcacacggtagagatgcttgtaattagcttcgcaaaagactccctgtag

SEQ ID NO: 27757 - DNA, 2715 bp, Artificial Sequence
  Description of Artificial Sequence: Synthetic coding sequence
atggccgccattagagccctgcagcagtggtgtaggcagcaatgcgaggggtacagagacgtgaatatatgcaacatgactaccagctttcgtgatggcctggcgttctgcgcaatcctgcaccgtcacagacctgacctgatcaatttttcagcattgaaaaaggagaacatttatgagaataataaacttgcatttagggtcgcagaagaacacttagggatccctgctctcctcgatgccgaggatatggttgctctgaaagttcccgacaggctttctatcctcacatatgtgagccagtactataactatttccatggacgttccccaattgggggaatggcgggtgtcaagagagctagcgaggattctgaagaagagccttcagggaagaaggctccggtgcaggctgccaaattaccgtctcctgcgccagcacgtaagccacccctgagccctgctcagactaacccggtggtccagcgacgcaacgaaggcgccggcggtccgccacccaaaacggaccaggcactggctgggtctctggtatcctcgacctgtggcgtgtgcgggaaacatgtgcatcttgtacagcgtcacctggccgatgggcggctctaccaccggagttgtttccgctgtaagcagtgctcttgcactctgcactccggggcatataaggctaccggtgagcccggcactttcgtctgcaccagtcatctccctgcagcggcctccgctagccccaagctgactggtttggtcccccggcagcccggtgctatgggagttgattcacggacttcctgctctccccaaaaggcccaggaagcaaacaaggcacggccctctgcctgggaacctgccgccgggaactcccctgcccgcgcctcagtcccagctgctccaaatcctgctgccacatctgctacatccgtgcacgtgaggtcgccagctaggccttccgaatctcgactcgcccctacacccactgagggcaaggtccgccctagagtaacgaattcgtcccctatgggatggtcttccgcagccccatgtaccgctgccgctgcatcgcatcctgcagtgccgccctcagctccagatccccgccccgcgactcctcagggcgggggggcccccagggtcgccgcccctcagacaaccctgagttctagctcaacctcggccgccacagtggatccccctgcctggacaccctccgcatcacgcacccagcaagccaggaataaatttttccagacttccgccgttccgccaggaaccagcctatcaggtaggggaccaaccccgtctttagtgttgtctaaagattctagtaaagaacaggctcgcaatttcctaaagcaggcgctgtcagccttagaagaagcaggggcccctgcgccaggcagaccttcacctgcaacagctgcggtgcctagcagtcaacccaaaaccgaagcgccacaagcatctcctctggctaagcccctgcagtcaagttccccaagagttctgggtttacccagccggatggagcctcccgcaccactcagcacgtccagcacatcccaagcctccgcgctgcccccggctggccgccggaatctggcagagagttccggggtaggacgcgttggggctggtagcagacccaagcctgaggctccgatggccaagggcaagagcacgaccctgactcaggatatgtctacatcacttcaggaaggccaggaggacgggccagccggctggcgcgccaatctgaagcccgtggatcgacgctccccagccgaaaggaccttgaagcccaaggaacctcgggcgcttgccgagcctcgggcaggagaggcccctagaaaggtgagtggaagctttgcgggttctgttcacatcactctgacacctgtgcgacctgataggacacctcggccagcatctccggggccgtcactgccagcccgctctccttctcctcctaggcggcgccggctagcagtcccggcttcccttgacgtgtgcgacaattggctgagaccagagcctcccggccaggaggcccgtgtgcagtcttggaaggaggaagaaaaaaagccccacctgcagggcaagcctgggcgcccactgtcacctgcaaacgtccccgcgcttcctggagagaccgttaccagtccggtgaggctccatccggattacctttcccccgaggaaatccaacgtcagctgcaggacattgagcggcgactggatgccctcgagctcaggggtgtggagctggagaagaggctgagggccgctgaaggtgacgatgcggaggattcattgatggtggattggttttggctcatccacgaaaaacagctgctcctccgccaggagagtgaactcatgtataagtcaaaagcccagaggcttgaggagcagcagctcgatattgagggagagctcaggagacttatggccaagccagaggcgctgaagagtttgcaagaacggcgacgtgagcaggagctcctcgagcaatatgttagcacagtgaacgatcgctcggacattgtggactcactcgatgaggatcggttgagggagcaggaggaagatcagatgttgcgcgacatgatagaaaaactgggactgcagaggaaaaaatcaaagtttaggctgtcgaagatttggtcgccgaagtccaaatcctcgccaagccaatag

SEQ ID NO: 27758 - DNA, 2079 bp, Artificial Sequence
  Description of Artificial Sequence: Synthetic coding sequence
atggcggcaatccgggcactgcaacagtggtgtcggcagcaatgtgagggctacagggacgtgaacatatgcaatatgactacacatctccccgctgctgcttccgctagcccaaaactgacaggtttggttccccgccagcccggagcgatgggtgtggacagccggacctcctgctcaccccaaaaagcccaagaagctaataaagcacgcccgtcagcttgggaaccagccgccggaaattcccccgctcgagctagcgtgcctgccgccccaaaccctgccgccacctcggcaacatctgtacacgtccgtagtccagcgcggccctccgagtccagattggcacctacgcccacagagggtaaggtccgcccgcgtgttacaaactcctcaccaatgggttggtctagtgctgccccatgcaccgcagcagctgcaagccaccccgccgtgcctccatccgcccccgacccccgtcccgcaacaccgcagggagggggggcaccgcgagtcgccgccccccagactaccctatcttcctctagtactagcgccgccactgttgacccaccagcttggacgccatccgcaagcaggacccagcaggcccgaaacaagttttttcagaccagcgcagttccccctgggacctcattgagcggaagggggcctacaccatctctggtattgagtaaagatagtagcaaagaacaggcccggaattttctgaaacaagccctctcagctttggaggaggcgggtgcaccagcacctgggcggccctctcccgctactgccgctgtgccaagcagtcagccgaaaactgaagctcctcaggcctcgcctctggccaagcctttacaatcatcatcgccgagagtgctgggcctcccatccagaatggagcctccagcccctctctcaacctcttctacaagccaggcttctgcactcccccctgccggtagacgcaacctcgcagaaagctccggcgtaggccgcgtgggcgcaggttcaaggccaaagcccgaagcccctatggctaaaggaaagtctaccacacttactcaggacatgtctacctccctgcaagagggtcaggaggatggccccgctggatggcgcgccaaccttaaaccggttgaccgccgaagtcctgcagaacgaacgttaaagcctaaggagccccgggctttggctgaaccccgtgcgggtgaggccccgagaaaggtaagcggaagtttcgcgggctcagtacacataactcttaccccagtgaggcctgacaggactccgcggcccgcctccccggggcccagtctccccgctagaagtcctagccccccccgcaggcgccggctagcagtcccagcatctctcgatgtgtgcgacaactggcttcgacctgagccccccgggcaggaagcaagagtgcagtcctggaaggaggaggagaagaagccacatttacagggcaagcctgggcgcccactttctcctgccaacgtccctgctctccccggtgagacagtgaccagtcctgttcgcctgcatcctgattatctctccccggaagaaatccagcggcaacttcaggacattgagcgcaggctggacgccctggaactgcggggtgtcgagctagaaaagcggctccgggccgccgagggggacgatgctgaagatagtctgatggtggactggttttggctcatccatgaaaagcagctgcttctgaggcaggagagtgagctcatgtacaaatccaaggcccaaagattagaggaacagcagttggacatcgagggtgaactacgacgcctgatggctaagcccgaagccttgaagtcattgcaggagcgacggcgggaacaggaacttttggaacaatatgtgagtactgtgaatgaccgctcagatatcgtggattcactagacgaagaccgcctcagagagcaggaagaagatcagatgctgcgcgatatgatcgaaaaactgggactccagaggaagaagagcaaattccggctgagcaaaatttggtctccaaagtcaaaatcgtcacccagccagtag

SEQ ID NO: 27759 - DNA, 1230 bp, Artificial Sequence
  Description of Artificial Sequence: Synthetic coding sequence
atggaccgcctgaaaagccacttaaccgtctgcttcttacctagcgtgccttttctgatcctcgtgtcgacattagccacggcaaagagcgtcactaattctaccttgaatggtactaacgtggtgctaggatccgtccccgtaatcattgctaggacagaccatattattgtgaaagaggggaatagtgcgctgattaattgctctgtgtacggaatccccgaccctcagttcaaatggtacaattctattggtaagctcctcaaggaggaggaggatgaaaaggagcgcggtgggggcaaatggcagatgcacgatagcgggctgttgaacattacaaaggtgagtttttctgaccgcgggaagtacacctgcgttgcctccaatatctacggtaccgttaataacacagtaaccctaagggtgattttcacatcaggggacatgggggtgtactacatggtggtgtgtttggtggccttcacaattgtgatggtgctcaacattactcgactgtgtatgatgagtagtcaccttaaaaagacagagaaggccattaatgagttcttcagaacggaaggtgctgagaaactgcaaaaagcctttgagatcgccaaaaggatccccattattacctctgcaaagacactagagctggctaaggtgactcaatttaagactatggagtttgcccggtacatagaggaactcgctcgttccgtgccacttcccccgttaatcatgaactgtcggaccataatggaggaaattatggaagttgtcggccttgaggaacaggggcagaactttgttagacatacaccagagggtcaagaggctgctgaccgcgacgaagtctacaccatacctaacagcctcaagcgctctgactcccccgctgcggattccgacgcctcttccttgcacgagcaaccacagcaaatcgcgattaaagttagtgtgcatccccaaagcaagaaagagcacgcagatgatcaggagggcggacaatttgaggtcaaggatgtggaagagactgaactctccgctgagcattccccagagacagctgaaccctccaccgacgtgactagcactgagttgaccagcgaggagcccacacctgtagaagtacccgataaggtccttccaccagcctatctggaagctactgaaccagctgtgacccacgataagaacacttgcatcatctatgagtcgcatgtctag

SEQ ID NO: 27760 - DNA, 921 bp, Artificial Sequence
  Description of Artificial Sequence: Synthetic coding sequence
atgcatgactcaggtttactaaacatcaccaaggtaagcttctcggacagaggaaagtacacctgcgtggccagcaatatttatggcacagtcaataatacagttactctgcgggtcatatttacttccggggatatgggagtctactacatggttgtgtgcttggtcgcttttacaatcgtcatggtccttaacataaccaggctctgcatgatgtcttcccacttgaagaaaacggagaaggccatcaacgagttcttccgcaccgagggggcagagaaactccaaaaggcattcgaaatcgctaagcggatccctattataacgtcggccaagacactggagttggcaaaggtgacccagtttaagacaatggaatttgcccgctacatcgaagaactcgcaagaagcgtgccactaccgccactgattatgaactgtcggacgatcatggaagagattatggaagttgtgggactggaggagcaggggcagaatttcgtgcgtcatacccccgagggtcaggaggccgccgaccgggacgaagtttacacaattccaaattcactcaagcgcagcgacagtcctgctgctgattctgatgcctcatctctgcacgagcagccccagcagatcgcgatcaaagtgtctgtgcatcctcagtccaaaaaagaacacgcggatgaccaggaaggcggacagtttgaggtaaaagatgtggaagagaccgagctgtctgcggaacattctccagaaacggctgaaccgtcgacagatgttacctccactgagctaaccagcgaagagccaacacccgtcgaagtgccggacaaggtgctcccgcctgcttatctggaagcaactgaacccgctgtgactcatgacaagaatacttgcatcatatatgaatcgcacgtgtag

SEQ ID NO: 27761 - DNA, 195 bp, Artificial Sequence
  Description of Artificial Sequence: Synthetic coding sequence
atgcacgacagtggcctcttaaacattacgaaagtgtcctttagcgaccgcggcaaatatacatgcgtggctagcaacatctacggcaccgtgaataatactgtgaccttacgtgtgatcttcactagtggagacatgggcgtgtattacatggtcgtctgtctggtcgcttttactatcgtcatggtgctctag

SEQ ID NO: 27762 - DNA, 297 bp, Artificial Sequence
  Description of Artificial Sequence: Synthetic coding sequence
atggatagactcaagagtcatctgacggtgtgcttcctacccagcgtaccattcctcatcctcgtttctacgttggctaccgcaaaatccgtgactaatagtacgctcaatgggacgaatgtggttctgggcagcgtgcctgtgatcatagcccgcacagatcatattatagtgaaagaggggaatagcgcactaatcaattgctccgtgtatgggattcccgatccccaattcaagtggtataattctatcggaaagcttctgaaagaagaggaggatgagaaggagcgcggttag

SEQ ID NO: 27763 - DNA, 273 bp, Artificial Sequence
  Description of Artificial Sequence: Synthetic coding sequence
atggatcgcttgaagtctcacttgaccgtgtgtttcctgccttctgtgccatttctcattctcgtatctacccttgctaccgcaaaatccgtgaccaattcaacgttaaatggaactaacgtagtcttgggcagcgtccccgtcatcatagcacgcacggatcacattatcgtcaaagagggaaacagcgccctgattaactgctccgtttatggaatccccgatccacagtttaagtggtacaacagcatcgggaaactgctgaaagagtag

SEQ ID NO: 27764 - DNA, 222 bp, Artificial Sequence
  Description of Artificial Sequence: Synthetic coding sequence
atggatagattaaagagccacctgacagtgtgctttctgccctctgttcctttcctaattctcgtgtcaacactcgccacagctaaaagcgtgactaattcaaccctgaacggaacaaacgtcgtcctgggcagtgtacccgtcattatcgcccggacagaccatataatcgtaaaggagggaaacagcgccctcataaattgctctgtgtatggcatctag

SEQ ID NO: 27765 - DNA, 474 bp, Artificial Sequence
  Description of Artificial Sequence: Synthetic coding sequence
atgcatgactccggtctgctgaatatcacaaaggtgtccttctccgacaggggtaagtacacctgtgtggcctctaacatctacggtaccgtcaacaacaccgtcaccctgagggtgatttttacatctggtgatatgggtgtgtactatatggttgtatgcctggtggcatttacaatcgtcatggtgctgaatataacaaggctttgcatgatgagctcgcatcttaagaaaacagaaaaggccattaacgagttcttccggaccgagggtgctgagaaattacagaaggcgtttgagatcgcgaagcgcatccctatcattacctcagctaaaaccctggaactggcaaaagtgactcagttcaagactatggagttcgcacggtacattgaagagctggccaggtctgtccctctgcctccgctaattatgaactgcagaacaatcatggaagagatcatggaagtgtag

SEQ ID NO: 27766 - DNA, 366 bp, Artificial Sequence
  Description of Artificial Sequence: Synthetic coding sequence
atgcctagtgacagaccgtttaaacagcgccgaagcttcgccgatcggtgtaaggaggtccagcagataagagatcaacatccaagtaaaataccagttataatagagcgctacaagggcgagaagcaactccccgtactggataaaactaaattcctagttcctgaccacgttaatatgagcgaactcgtaaaaataattcgaagaaggctccaacttaaccccacccaagcattctttttgctggttaaccagcactctatggtgagcgtgtctacacctatcgctgatatttatgagcaggagaaagacgaggacgggtttctttacatggtctacgcctctcaggaaaccttcgggttctag

SEQ ID NO: 27767 - DNA, 366 bp, Artificial Sequence
  Description of Artificial Sequence: Synthetic coding sequence
atgcccagtgaccggcccttcaagcagaggcgatctttcgcagataggtgtaaagaggtgcagcaaatcagggatcaacatccgagtaagattcctgtcatcattgaaaggtacaaaggggaaaaacaactgcctgtgctcgacaaaacgaagttcctggtgcctgatcacgtgaacatgtccgagctggtgaagattatccgcaggcgactacagctgaatcccacacaggccttttttctgttggtgaatcagcacagcatggtttctgtcagcacaccaatcgctgatatatacgagcaagaaaaggacgaggacggattcttatacatggtctacgcctcacaggagactttcggtttttag

SEQ ID NO: 27768 - DNA, 378 bp, Artificial Sequence
  Description of Artificial Sequence: Synthetic coding sequence
atgaagatgcgtttcttcagttctccgtgcggaaaagctgctgtggatccggcggatcgttgtaaggaggtacagcagatccgcgaccagcacccgagtaagatccccgtgatcatcgagcggtacaaaggtgagaaacagctgcctgtgctggacaaaacaaagttcttggtgcccgaccatgtcaacatgagtgaactggttaaaatcatcaggaggcgcctccagctgaatccaacccaagccttctttcttctggtgaaccaacatagtatggtctcggtgtcgactcctattgcggatatctacgagcaggaaaaggatgaggacgggttcctctacatggtgtacgctagccaggaaacttttggcttttag

SEQ ID NO: 27769 - DNA, 378 bp, Artificial Sequence
  Description of Artificial Sequence: Synthetic coding sequence
atgccgtcagaaaagacttttaaacagcgccggacatttgagcagagagtggaagatgtcaggttgatccgggaacagcatcccactaaaattcctgtgatcatcgaacggtacaagggggaaaaacagttgcccgtgctcgacaaaactaaattcctggtgccagatcatgtgaacatgtctgagctgattaagattatccgcagacgccttcaacttaacgccaatcaggctttttttctcttggtaaatggccatagcatggtaagtgtttccacccccattagcgaggtgtacgaatccgaaaaagatgaggatggtttcttgtatatggtgtatgcctcgcaggaaacttttggaatgaagctatcagtctag

SEQ ID NO: 27770 - DNA, 201 bp, Artificial Sequence
  Description of Artificial Sequence: Synthetic coding sequence
atgtccgaactgataaagataatccggagacggcttcagctcaacgcaaatcaagcattttttcttctcgtgaacggacactcgatggtctcggtcagtacaccgataagcgaggtgtacgaatcagagaaagacgaggatggcttcctgtatatggtttacgcgtcacaagagaccttcggcatgaaactgagtgtgtag

SEQ ID NO: 27771 - DNA, 444 bp, Artificial Sequence
  Description of Artificial Sequence: Synthetic coding sequence
atgcccccaccccaaaaaatccctagtgtgcggccatttaagcagcgcaagtctttggctatcaggcaggaggaggtggccgggattcgcgcaaagttcccaaacaagatccccgtagttgttgaacggtacccaagagagacctttctgccacccttagacaaaaccaagtttctggtgcctcaggagctgactatgacacagtttctctcgataatcaggagcagaatggtcctcagggccactgaagccttctatttgcttgtgaataataagtccctcgtgagtatgagtgccacaatggctgagatttaccgtgactataaagatgaagatggctttgtttatatgacctacgcatctcaggagaccttcgggtgtcttgagtccgcggctccaagagacggtagctcgctcgaagaccgaccttgcaaccctttatag

SEQ ID NO: 27772 - DNA, 1968 bp, Artificial Sequence
  Description of Artificial Sequence: Synthetic coding sequence
atggcggagttgggcgcaggtggtgatggccaccgaggtggagacggagcggtcagatccgaaactgctcccgattcctataaagtccaggacaaaaaaaacgcttcctcaagacctgcctcggccattagcggtcaaaataataatcatagcggcaataagccagacccgcccccagtcctgagagtggatgaccgccagagattggctagagagaggcgcgaggagcgggagaagcaactcgacccggatcggcgaagtgtatctaccatgaatctgtccaagtacgtcgatcccgtgatctccaagcggctgagctcttcttcagccactcttctgaactcaccggatcgggctagacgcctgcagctcagcccatgggagtccagtgtcgtgaataggctacttacccctacacacagtttcttagctaggtccaaaagcacagccgccctgagcggtgaagcagcttcctgttccccaattatcatgccctacaaggctgcacactccagaaatagcatggaccggcccaaactttttgtgactcctcccgagggtagctcccggaggagaatcattcacggcacagcctcctacaagaaagagagggagcgagagaacgtcctcttcctgacctcaggcacacggagagctgtaagtcccagtaacccaaaggctcggcagcctgcaagatcaaggctgtggctgcccagtaagtctcttccccacctgccgggcacacctagacccacttcaagcctcccccccggaagcgtgaaagcggcacctgcccaggtaaggccccccagcccggggaatatccgccccgtaaagagggaggttaaggtggagcccgaaaagaaagatcccgagaaggagccgcaaaaggtggctaacgaaccttccctgaaagggagagcccccctggtcaaggttgaggaagcaactgtagaagagcggactccagccgagcctgaagttggacccgcggctcccgctatggcacccgcacctgcctccgcaccagcccccgcgagcgctccagcccccgctcctgtccctactcccgccatggtgagcgcaccctcttcaaccgttaacgcctctgccagtgtcaaaacctcagccggaaccacagatcctgaagaggcaacccgtctcctcgcggagaagcgcagactagccagagagcaaagggagaaggaggagcgagaacgtcgagagcaggaggagttagagcgacagaaacgggaggagctagcccagcgcgttgcagaggagcgcaccactcggagagaggaagaatctaggcgtctggaagcagagcaggccagagagaaggaggagcagctgcagagacaggcagaggagagagccctgcgggaaagagaggaggcggaaagagctcagcgccagaaagaggaagaggcccgcgtgagggaggaagcagagagagttaggcaagaacgggagaagcactttcagcgggaagagcaggaaagattggagcgtaagaaacgcctggaagagatcatgaagcgcacgcggcgaactgaggcaactgacaaaaagacatcagatcagaggaatggcgacatagcaaagggcgccctgacaggcgggactgaggtctcagctctaccatgcactaccaacgctccaggtaatggcaaaccagtgggcagcccccacgtggtgacatctcatcagtccaaggtgacagtggagtccacacccgatctcgagaagcagcctaacgaaaacggcgtgtcagttcagaatgaaaacttcgaggaaatcatcaatctgcccatcggctcaaagccgagtcgcttagatgtgacaaacagcgagtcgccagaaattcctctgaacccgatactggccttcgatgatgaagggaccctgggcccgctgcctcaagtggacggagtccagacgcagcagacagcggtcgttatttag

SEQ ID NO: 27773 - DNA, 2250 bp, Artificial Sequence
  Description of Artificial Sequence: Synthetic coding sequence
atggcagaactgggcgccggaggggacggtcacagagggggcgacggcgccgtaagatctgagacggcacctgactcatacaaagtgcaggataaaaaaaatgctagcagccgccctgccagtgcgataagtggccagaacaacaatcacagcgggaacaaaccggacccccccccggtgctcagagtcgatgataggcagcgactggcacgcgagcggagggaagagcgcgagaaacagttagcggctagggagattgtctggttagagcgggaggaacgagcccgccagcactatgaaaagcacctggaagaaagaaagaagagattggaggaacagcgtcagaaagaagaacgaagacgggccgccgttgaggaaaagcgccgtcagcggctggaggaagataaggagcgccacgaggcagttgtccgccggacgatggaacgaagccagaaaccgaaacaaaaacacaaccgctggagctggggcggcagcctacatgggtctccgagtatccactcggcagaccctgaccgacgctcagtgtcaaccatgaatctgtctaaatatgtggaccccgtgatttcaaaaagactgtcgtctagctcggccactttgctgaattcaccagatagggcacgccggttacagctgtccccctgggagtcctcagtagtgaaccgcctgctgactcctacccatagcttcctggcccggtcaaagtctaccgccgccttgtccggggaggcagccagttgttctcccatcattatgccttataaggccgctcacagcaggaacagtatggaccgaccaaaactgtttgtgacaccacctgaagggagcagtaggcgccgaatcatccatggcactgccagctacaagaaagagcgagaaagagaaaatgtgctcttcctgacctctggcaccaggagggctgtgagcccatccaatcccaaggctcggcagcccgcacgcagcaggctttggctccctagcaaatccctgccgcacctaccaggcaccccacggcctactagttcgttgccacctgggagcgtgaaggccgcgccagctcaggttaggccccccagccccggtaatatcaggccagtaaaacgggaagtcaaggtcgaaccagaaaagaaggaccctgagaaggagccgcaaaaagtggccaatgagccatctctgaaaggtcgagctcccctggtgaaggtcgaggaagctactgttgaagaaagaactcccgccgagccagaagttggccccgctgctcctgccatggcgccggcccccgcttccgccccagcccctgccagtgcacctgccccagctcccgtgcccactccagccatggtgtccgcgccatcatctactgtaaatgcatctgccagtgttaaaacaagtgcagggacaacagacccggaagaggccacaagactgttggctgagaaaaggaggctcgcccgggaacagagagaaaaggaagagagggagagaagagaacaggaggaattggaacggcagaagcgggaggagttggcccagagggtggccgaagaacgtactacaaggcgcgaggaagagtcaagaagattggaagcggaacaggcgcgggaaaaagaggaacagcttcaacggcaagcagaggaacgagctctccgggaacgggaagaagcagagcgggcacaaagacagaaagaagaggaggcacgagtccgggaagaggcggagcgagtgaggcaggagcgggagaaacattttcagcgagaggagcaggaacggctcgagcgaaagaaacggctggaagagattatgaaaaggacacgaaggaccgaagctaccgacaaaaagacttcagatcagagaaatggtgacattgccaagggggctctcacaggcggaactgaagtcagcgcgctgccatgcacaaccaacgccccaggcaacggaaagccagttggttctccccatgtggtaactagccatcagagtaaagtgacagtggaatctactccagacctggaaaagcagcccaacgagaatggcgtgtccgtacagaacgaaaattttgaagagattataaaccttcccatcggttcaaagcccagcagactagatgtgacaaattcagagtccccagaaatccctctgaatcctattttggcctttgatgacgagggcacgttggggccactgccacaagtggacggggtccaaacacaacaaaccgccgaagtgatatag

SEQ ID NO: 27774 - DNA, 1812 bp, Artificial Sequence
  Description of Artificial Sequence: Synthetic coding sequence
atggaacgctcccagaaacccaagcagaaacataatcgctggagctggggcggctccctgcacgggtctccctccattcattccgcagatcctgatcgtcgatccgtatcaactatgaatctgtctaaatatgtagatccagtgatcagtaaacggttaagctcgagcagcgccacactgttgaatagccccgacagagcgcgcaggcttcagctgtcgccttgggagagttcagttgtaaaccgccttctaactccaacacatagcttcctggcccgtagcaagagcactgccgccctgtcaggcgaggctgcttcttgttcaccgatcattatgccctacaaggccgctcacagccgcaattccatggataggcccaagcttttcgtaaccccccctgagggtagtagccggagacggatcattcacgggacagcctcctataagaaggaacgagaaagagaaaacgtgctgttcctgacatccgggacccgaagagccgtgagccctagcaatcccaaggcacggcagcccgcgcggagccgcttatggttaccttctaagtccctgccgcacctgcccggcaccccccgcccaacctctagcctgcctccaggatcagtgaaagccgcccccgcgcaggtcagacccccttcgccaggaaacatacgacccgtaaagagagaagtgaaagtggagccggaaaaaaaggaccccgagaaagagccccagaaggtggctaacgagccctcccttaaaggcagagccccactcgtgaaggtggaggaggcaactgtcgaagaacggactcccgctgagccagaggttgggcctgccgcgcccgctatggcccctgcaccggcttctgcacccgctccagcgagcgcccctgccccggccccagtgccaacccctgcaatggtgtccgccccttcttctacagttaacgctagtgcctctgtgaaaaccagtgcggggacaaccgaccccgaagaggccacacgcctactggctgagaaacgccggttggctcgcgaacagcgtgagaaagaggagcgcgagaggagggagcaagaagagctggagcgtcaaaagcgcgaagaactggcccaacgcgtggctgaggagcggacaaccagacgggaggaagagagccggcggttagaagccgagcaggctcgagagaaggaagaacaactgcagagacaggccgaagagagagctctgcgcgaacgggaagaggcagagagggctcagcgacagaaagaggaagaggcgcgagtgagggaggaagctgaacgggtaagacaggagagagaaaagcattttcagcgggaggagcaagagagattagaacggaagaagcgcctcgaggaaatcatgaaacgcacacgcaggacagaggcgactgacaaaaagacaagcgatcaaagaaacggagatatcgctaagggagccctgaccggtggaacagaggtgagcgcacttccttgtacgacaaacgcgcccgggaacggcaagccggtcggatctcctcacgttgttaccagccaccaatcaaaggtcactgttgagagcactccagatctggagaaacaacccaacgagaatggtgtaagtgtccagaacgaaaactttgaagagatcataaatctgcccattggatcaaagccctcacgcctggatgtgactaacagtgaatcacctgaaatcccactgaaccccatactggctttcgatgacgaaggtacactaggtcctctcccccaggtcgatggagttcagactcagcagacagctgaagttatctag

SEQ ID NO: 27775 - DNA, 2205 bp, Artificial Sequence
  Description of Artificial Sequence: Synthetic coding sequence
atgcccgggagcgctaccgctcttcgtcatgagcggttaaaaaagactaacgctcggcccattcccttagggctgtttacgattaatgaggaggatgagcaacaaaagaacggcaacagcagaagaccaaaggcaccggactcatacaaagtgcaagacaagaagaacgcttctagccgtccagcttcggctatctccggccaaaataacaatcattcaggcaacaaacccgacccaccccccgttctgagagtggatgatcgtcagcgccttgcacgcgaacgccgagaagagcgagaaaagcagctggcagcaagggagattgtgtggctggagcgagaagagcgggctaggcagcactatgaaaaacacctcgaagagcggaagaagaggctagaggagcagagacagaaggaagaacgcagaagagcagcagttgaggagaagagacgccagcgcctggaagaagataaggagcggcatgaagccgtggtgcggaggacaatggagcggagccagaagcccaagcaaaaacataaccgttggtcttggggcggatccctgcacggatccccctccattcactcagctgcgcgcagactgcagctgagtccgtgggaatcatctgtagtgaatcgcttactgactcccacacattctttcctggctaggtcaaaatctacggccgcccttagtggcgaggccgcgtcatgtagcccaatcattatgccatacaaggccgctcactctcgcaattctatggaccggccaaaacttttcgtgactccacccgagggatcgtcccgaagaagaatcattcacggaactgcctcttataaaaaggaaagggagagagagaatgtgctatttcttacatccggaacaagacgagctgtgtccccttccaatcccaaagcccgccaaccagccaggtccaggctatggctgccatcaaaatcgctgccccacctgcctggcaccccgcggcccacctcatcgctcccaccaggcagcgttaaggcggccccggctcaggtgcgcccaccaagtccaggcaatataaggcccgtgaaacgggaagtcaaagtagagccggaaaagaaggatccagagaaagagcctcagaaagtagccaacgagccttccctgaaagggcgcgctcccctggtcaaggtggaggaggcaactgttgaagagcggactccagccgagcctgaggtgggaccagctgccccggctatggcccctgccccagcctcagctccagcccctgcttcagcccccgcaccagctcccgtgcccactccagctatggtcagtgcccccagctccacagtcaatgccagtgcgtccgtgaaaacatctgccggcacaactgaccccgaagaggcgacacggctgttggctgagaaacggaggctggccagggaacagcgagaaaaggaggagcgcgaacgcagagaacaggaagaactggagaggcagaagagagaagagcttgcccagagagtagctgaagagagaacaactagacgggaagaagagtcaagaaggcttgaagccgagcaagctcgggaaaaggaagaacaactacagaggcaagccgaggagcgtgcccttcgagagagagaagaagcagaaagagctcagcggcagaaagaggaggaagcaagggtacgagaagaagctgagagggtgagacaagagagggaaaagcatttccagcgggaagagcaggaacgacttgagaggaaaaaacggcttgaggaaattatgaagagaactcggaggaccgaagccaccgacaagaagacttctgatcagcgtaatggtgatatcgcaaaaggcgccttgaccggtggaacggaggtgtccgcgctcccctgcaccacaaacgcccccggcaacggcaagccagtgggttctcctcacgtcgttacgtcccaccagtcaaaagtaacggtcgaatcaacgcccgatctcgagaagcagccgaatgagaatggcgtgtctgtgcagaacgaaaatttcgaggagattattaaccttccaattggaagcaagcccagccgcctggatgttaccaactcagaatctccagaaatccccctgaaccctatcctggccttcgacgacgaagggactttaggcccgcttccacaagtcgacggggtgcagactcaacaaactgctgaagtgatctag

SEQ ID NO: 27776 - DNA, 2316 bp, Artificial Sequence
  Description of Artificial Sequence: Synthetic coding sequence
atgccaggctccgcaactgctcttcggcacgagcgcctgaaaaagacaaacgctagaccaatccctctgggactgtttacaatcaatgaggaggatgaacagcaaaaaaacggcaactcccgcagaccaaaggcgcccgacagttataaggtccaggacaaaaagaatgcttcatccaggcctgcctccgccatcagtggtcagaacaataatcattcaggcaataagcctgaccccccccccgtgctgcgcgtggatgaccgtcagcggctagctcgtgaacgaagggaagaacgggaaaaacagttggcggcaagagagatcgtgtggctggaacgcgaagaaagggccaggcagcactacgaaaaacacttggaggaacggaagaaacgcctcgaagaacaacgacagaaggaagagcgcagacgcgcagccgttgaagagaagaggcggcagagactggaagaagacaaggagcggcacgaggccgtggttcgtagaactatggagcggagccagaagcctaagcaaaaacacaataggtggtcttggggagggtctctgcacggttcgccctctattcactcagctgatcctgatagacggagtgtctcaaccatgaacctgagcaaatatgtggaccctgtgatcagcaagcgcttgtcttcctcatccgccacattgctcaattcacctgatcgcgcaaggcgactgcagctgtctccgtgggagtcatctgtagtgaaccggttgcttactcccactcactctttcctggcaagaagcaagtcgaccgctgccttgtctggagaggccgctagctgtagtccaatcattatgccttataaggcagcgcatagtagaaatagcatggaccggccaaagctatttgtgactccccccgaaggctcctcacggcgacggatcatccacggtaccgcctcctacaaaaaagagcgcgagcgggagaatgtgctgttcctgacttctggtactcgaagagctgtgtccccatctaacccaaaggccaggcagcccgccaggtccagactttggctcccttcaaagtccctaccgcatctcccaggaacccccaggcctacttctagcttgccacctgggagcgtaaaggctgcacccgctcaggtgcgccctcccagtcctgggaacatccgcccagtgaaacgtgaggtgaaagtggagcctgagaagaaagacccggaaaaagaaccccaaaaggtagccaacgaacctagcctcaagggtagggcccctttggtgaaggttgaggaagcaactgtggaagagcgaacacctgcagaaccggaggtgggcccagctgctcccgcaatggcccccgctcccgcttccgctcccgcaccagcctccgcacccgcccctgcacccgtaccgacacctgctatggtgtctgcaccttcttctacagtgaacgcttcagctagcgttaagacaagcgctgggaccacagaccccgaggaagccactcgactgctggcagagaagcggcgcctagcccgggagcagcgggagaaggaagagcgggaacggcgtgagcaagaagaactggagaggcagaaacgggaagagctggctcagcgagtggcagaggaaagaactactaggagggaggaagagtcacggaggttagaggccgagcaagcgagagaaaaggaggaacagttacagagacaagcggaggaacgcgcactgagagagcgggaggaggcagaaagggcccagcggcaaaaggaggaagaagccagagtgcgcgaggaggccgagcgggtccgtcaggaaagagaaaaacattttcagcgagaagagcaggagcgccttgaacggaaaaagcggcttgaagaaattatgaagcggaccagacgcacagaggctacagacaaaaagaccagcgaccagcggaatggcgatatcgcaaagggagcgctgaccggcggtaccgaggtgtctgccttaccttgcacgacaaatgcgcctggtaatggaaagcccgtcgggagtcctcacgtggtgacatcgcaccagagtaaagtcacggtagagtctacgcccgaccttgagaagcagcctaacgaaaatggcgtttctgtacaaaacgagaacttcgaagaaattatcaatttgccaatcggttctaagccatcccgcctcgacgttactaacagcgagtctcctgaaatccctctgaatcccatcctggcttttgacgacgagggtacgctgggaccgctgccgcaggtggatggtgtgcaaactcagcaaaccgctgaggtgatctag

SEQ ID NO: 27777 - DNA, 2205 bp, Artificial Sequence
  Description of Artificial Sequence: Synthetic coding sequence
atggaagatactaagctgtatagcccagactcgtacaaggttcaggacaagaagaacgcatcttccagacctgcttcggccatctcaggacagaataacaaccactctggtaataaacccgatcctccccctgtgcttcgggtcgatgacaggcagaggttggcacgggagcggagggaggaacgcgagaaacaactcgcagccagggaaatcgtgtggttagagcgcgaggaacgagctcggcagcattatgagaagcacctggaggagcggaagaagcgcctcgaagaacagagacagaaggaggaacggcgcagggcggcagtcgaggaaaagcgtcggcagaggttagaagaggacaaggagcggcacgaagcggtcgttaggagaacaatggagaggtctcagaagccaaaacaaaaacacaaccgctggtcctggggtggatccctgcatgggtctccatcgattcactccgcagaccctgatagaaggtctgtatcaaccatgaatttatcaaagtacgttgatccggtcattagtaaaagactgtctagcagttccgccactctgctgaattcccctgaccgggcaagaaggctgcagctgtctccatgggagagctccgttgtaaacagattgttgacgcccacacacagcttcttagccaggagcaagagcaccgcagctctatccggggaagccgctagctgctccccaattatcatgccatacaaggccgcccacagcaggaacagcatggaccggcctaagctatttgtaactcctcctgaaggcagctcccggaggcgaatcatccacgggacagcttcctacaagaaggagagggagcgagaaaacgtgttgtttctgactagcggcacccgccgggcagtgtcaccctccaacccgaaggcgcggcagccagcaagatcacgcctgtggctgccatccaagtccctcccgcatctgcctggaactccgcgcccaactagttcactaccccctggatcggtgaaggcagccccggcgcaagttaggcctccctccccgggcaatatcaggccagtcaaacgggaggtcaaggttgagccagagaagaaagatccggaaaaagagccccagaaagttgctaatgagccgagcctcaaggggcgtgcaccattggtgaaagtcgaagaggcaacagtcgaggaacggacgccagccgagccggaagtcggccccgccgccccagcaatggccccagcccccgcgagtgcccctgcacctgcctccgccccagcccccgccccagtgccaacaccggccatggtgtctgctcccagctcaaccgtaaatgcctcagcctctgtaaagacatccgccggtactactgatccagaggaggccaccaggctgctcgcagaaaagcgcaggctcgctcgcgaacagcgggagaaggaggagcgagagaggcgcgagcaggaggagcttgaacgacaaaaaagggaagagctggcacaaagggtggctgaggaaaggacaacccggcgagaggaggagtcccggaggctcgaagcggagcaggcccgcgagaaagaggagcagctacaacggcaagctgaggaaagggctttgagggagagggaggaagcagaacgtgcccagagacaaaaagaagaggaagcccgggtccgcgaagaagctgaaagagttcggcaggagagggaaaagcattttcagcgcgaggagcaggaacgtctggaacggaagaagcgcctcgaagaaattatgaaaaggacacggagaactgaagctactgataagaagacgtcagaccagcgcaatggtgatatagctaaaggagctttaacgggtgggactgaagtgagtgcactaccatgcactacaaatgccccgggcaacgggaagcccgtgggctccccccatgtagtcacttcccatcagagtaaggtgactgtcgagtcgacacccgatctggaaaagcagccaaacgagaatggtgtttccgtgcagaacgagaactttgaagagatcatcaatctccctataggatcgaaaccttcgagactggatgtgaccaatagtgaatcccccgagatcccactcaacccaattcttgcctttgatgacgaaggcaccctcgggccattaccacaggtggatggggtgcagacccagcaaaccgctgaggtgatttag

SEQ ID NO: 27778 - DNA, 3021 bp, Artificial Sequence
  Description of Artificial Sequence: Synthetic coding sequence
atgtcaaattcaagaaataatcgagtcatggttgaaggagtaggggcccgcgttgttaggggccctgactggaagtgggggaaacaggacggaggggaaggacacgtgggcactgtgagaagctttgagtcacctgaggaggtcgtggtggtttgggataacggaactgccgcaaattatcgctgctctggggcctatgatctgcggattctggactccgctccaacagggattaaacatgacggcaccatgtgtgatacttgtagacaacagccaatcattggcatacgatggaaatgtgccgagtgcacaaattatgatttgtgtacagtctgctatcatggcgacaagcaccacctcagacataggttttacagaatcaccactccagggtcggagcgggtgctgctcgaatccaggaggaagagtaaaaaaattaccgcccggggcatcttcgcaggcgcccgggtggtacgaggagttgattggcagtgggaggaccaggatggcggtaatggtcgcagaggcaaagttaccgaaattcaggattggtctgcttcctcgccacacagcgcagcctacgtcttatgggacaatggagcaaagaatttgtatcgggtgggcttcgaagggatgagcgacctcaagtgcgtccaagatgcaaagggcggctccttctatagggaccactgtccggtactgggcgaacaaaacggcaatcggaatcccggtggcctccagattggcgatctggtcaatatcgatctggatctggaaattgttcagagtctccagcacggtcacgggggctggacggacggtatgttcgaaactctcactaccactggaaccgtctgcggaatcgatgaggaccacgacatcgtcgtgcagtatcctagcggcaatagatggactttcaacccagccgtccttacgaaagcaaatatagtgcgtagtggcgacgccgcgcaaggcgccgagggcggtacgagtcagttccaggtgggagacctcgtgcaagtctgctacgacctcgagaggattaagctcctgcagagaggccacggggaatgggccgaggctatgctgcccacccttggcaaggttggccgggtgcagcaaatttattccgactcagatctgaaggtggaggtctgtggaacctcctggacttataaccccgccgccgtgagtaaggtcgcttcggccgggtccgcaatatcaaatgcatccggggaacgattgtcacagcttcttaaaaaactgtttgagactcaggaatcaggggatctgaacgaggaactggtgaaggcagccgcgaatggggatgtggccaaagtggaagacctgttaaagaggcccgacgtggatgtgaacggacaatgtgccgggcacactgctatgcaggccgctagccagaacggccatgtggacatcctgaagctgctacttaaacagaatgtagacgtagaggcagaagacaaggacggtgatcgtgcagtgcatcatgctgcatttggcgatgagggagccgtgatagaagttctacataggggctccgccgatctcaatgcccgcaataagaggagacagacgccactgcacatagccgtcaacaagggccatctgcaggtggtaaagacattgctggacttcgggtgccatccttccctccaggactctgagggagacacacctctgcatgacgccatcagtaaaaagcgagatgacattctggccgtgctgctagaagccggtgccgacgtaactatcacgaacaataatgggtttaatgctctgcaccacgccgccctaagaggaaaccccagtgcaatgagagttctcttgtcaaaactacctaggccttggatcgttgacgagaagaaggacgacgggtacactgcattgcacctagcggcactgaacaaccatgtcgaggtcgctgagttgctcgttcaccaaggcaacgcaaatctggacatacagaatgtcaaccaacaaacagctctccaccttgcagtggagcgtcagcacacccaaattgtgaggctgctcgtgcgcgctggggccaagcttgacatccaggataaagacggggatacccccctccacgaggctcttcggcaccacacccttagccagctgagacaacttcaggacatgcaagatgtaggcaaggtagacgccgcctgggaaccaagtaaaaacacactgataatggggttaggaacacaaggggcggagaagaagtcagccgccagcatcgcatgcttcctcgctgccaacggtgctgacctgtccatcagaaacaagaagggtcagagccctctggatttgtgccccgatcccaacctgtgtaaagcactagccaagtgtcataaggaaaaggtttctgggcaagtggggtcacgatcgcccagtatgatttcaaatgactccgagactttagaggagtgtatggtttgttctgacatgaaaagagacaccctctttggcccgtgcgggcacattgctacatgttctttatgctccccccgggtcaagaaatgtttgatctgcaaggaacaagtgcaaagcaggactaaaatagaagagtgtgttgtctgttcagacaagaaagccgccgttttatttcagccatgcggccacatgtgcgcctgcgagaattgcgctaatttgatgaagaaatgtgtccagtgccgcgcagttgtggaacgccgggttccattcattatgtgttgtggcggaaaaagttctgaagacgccacagacgatataagctccggtaatattcctgttcttcagaaagataaagacaacacaaacgtgaatgcagatgtgcagaagcttcagcagcaactgcaggacattaaggaacagactatgtgcccggtgtgcctggatcgtctgaaaaacatgatcttcctctgtggacacggcacctgtcagctgtgtggtgataggatgagtgagtgccctatctgcaggaaggccatcgaacgcaggatactgctgtattag

SEQ ID NO: 27779 - DNA, 750 bp, Artificial Sequence
  Description of Artificial Sequence: Synthetic coding sequence
atggcaaagagcggcctccggcaggatccccagagcacagctgcagctactgtcctaaaaagggctgtggaactcgatagcgaatccaggtacccccaggcgctcgtttgctatcaagagggcatcgacctgctgctccaagtgcttaagggtactaaggacaatacaaaacgatgcaatcttcgcgaaaagatttcgaagtatatggaccgggctgagaatataaagaagtacctcgaccaggaaaaggaggacggtaaatatcacaaacagatcaagatagaggagaatgctacaggatttagctacgagtcgctttttcgcgaatacttgaacgaaaccgtaactgaagtgtggattgaagatccttatatccggcatacacaccagttgtacaactttctccgattctgcgaaatgcttatcaagcgcccctgtaaggtgaaaacaattcatttactgaccagcctcgatgaaggcatagaacaggtacagcaaagtcgaggcctccaagaaatagaagagagcctacgttcccatggtgtcctactcgaggtgcagtattccagcagcatccacgatagagaaatccgctttaataacgggtggatgatcaaaattggacggggtcttgattatttcaagaagccccagtctcggttttccttaggttattgtgatttcgacctaaggccatgtcatgaaaccaccgttgacatctttcacaagaagcatacaaaaaatatctag

SEQ ID NO: 27780 - DNA, 696 bp, Artificial Sequence
  Description of Artificial Sequence: Synthetic coding sequence
ctgaagcgggctgtcgaactggatagtgaatccagatacccccaagctctggtgtgttatcaggagggcatcgatctgctgcttcaggtgcttaaaggcacaaaggacaataccaagaggtgcaatttgcgtgagaaaatatccaagtacatggaccgggcggagaatatcaaaaagtacctggaccaagaaaaagaggatggaaaatatcataaacagatcaagatagaggagaatgccacagggttttcctacgagtccctctttcgagagtacctcaatgaaacagtcaccgaagtatggatagaggatccatacatacggcacacccatcagctctacaactttctccgtttttgcgagatgctcatcaagaggccgtgcaaggtgaaaactatacacctgctcacctctctagacgagggcattgagcaggtacagcagagtcgaggccttcaggagatcgaagagtccctccgcagccatggggtccttctagaggtgcagtactcatcaagcatccacgaccgagaaatacgctttaataacggctggatgattaaaatcggacgcggattagattacttcaaaaagcctcagagccgcttctctctggggtattgcgattttgatctgcggccctgtcacgaaacgactgtagatatcttccataagaaacacaccaaaaacatatag

SEQ ID NO: 27781 - DNA, 1431 bp, Artificial Sequence
  Description of Artificial Sequence: Synthetic coding sequence
atgttccgtctgaacagcctgtctgccctggccgagctggcagtgggctctcggtggtatcatggaggaagccagcctatacaaatccggagacggttaatgatggtcgcttttctcggggcctcagccgtgactgcttcgacgggactgctgtggaaacgagcccacgctgagagccccccatgtgtagataatctaaaatctgacatcggcgataaaggcaaaaacaaagatgagggcgacgtttgcaaccatgaaaagaaaaccgccgatcttgcccctcaccccgaggagaagaaaaaaaaacggagtgggtttcgagatagaaaagtaatggagtatgaaaaccgcattagagcttattccactccagacaaaatttttaggtatttcgccaccctaaaggtcatcagcgagccaggtgaggctgaagtttttatgaccccagaagactttgttcgcagtatcactcccaacgagaagcagcctgagcatttgggactcgaccagtacatcataaagaggttcgacgggaagaagatcagccaggaacgggagaaatttgcagacgaaggaagcatcttctacactttgggggagtgcggactcatcagtttcagcgactatatttttcttacaactgtgctatccacaccccagcggaattttgaaatcgctttcaaaatgttcgatttaaacggagacggcgaagtagacatggaggagtttgagcaggtgcagagtatcatccggtcgcagacatccatgggaatgaggcaccgggaccggcctacaacaggcaacaccctgaagtcgggattgtgtagtgccctcactacctatttcttcggcgctgacctgaagggaaaactgactattaagaacttcttggaatttcagcgaaaactgcagcatgacgtgctgaagttagagttcgagcgccacgatcccgtcgacgggcggattaccgaacgccagtttggtggaatgctgctggcttactcaggagtgcagtccaaaaaattgactgccatgcaacgtcagctgaaaaagcacttcaaagaagggaagggtctgaccttccaggaagtagagaacttcttcacattcctcaagaacattaatgacgtcgacacagcccttagcttttatcacatggccggtgccagcctcgataaggtgaccatgcagcaggtggccaggactgtcgccaaagtggagcttagcgaccacgtctgtgatgtggtgttcgcactctttgattgtgatggaaacggcgagcttagcaacaaagagtttgtctctattatgaagcagagactgatgcgggggttagaaaagcccaaagacatgggtttcacacgactcatgcaggctatgtggaagtgcgcccaagagactgcatgggacttcgccctgcccaaacaatag

SEQ ID NO: 27782 - DNA, 1437 bp, Artificial Sequence
  Description of Artificial Sequence: Synthetic coding sequence
atgtttaggctgaactctctttcggcactcgccgagctcgccgttggctctcgttggtaccatggaggcagccaaccgattcagatcagaagacggcttatgatggtggccttcctgggggccagtgccgtgaccgctagtactggtcttctgtggaagagagctcacgcggaaagccctccttgcgtcgataatctcaaatccgacattggagataagggcaagaataaggacgagggggatgtgtgcaatcacgagaagaagaccgctgacctagctccccacccagaggagaaaaagaagaagcggagcggatttagagacagaaaagttatggaatacgagaacagaataagggcctactcaacacccgacaagattttccgttatttcgccactctgaaagtgatttctgagcccggtgaggccgaggtgtttatgaccccagaggattttgtacgctctataacccccaatgagaaacagcctgaacaccttggcctggaccagtatatcattaaaaggttcgacggaaagaacaaaaaaataagccaggagagagaaaaattcgctgatgaaggttcaatcttttataccctcggagaatgcggcctaatctctttcagcgactacatttttctgaccacagtcctttccactccccagaggaacttcgaaatcgccttcaagatgttcgatctgaatggggacggggaggtggatatggaagagttcgagcaggccatttcaataattcggagccaaactagtatgggcatgcgacaccgagaccggcctacgaccggcaacaccctgaagtccggactctgctcggccctgacaacatacttttttggggcagaccttaaagggaagctgacgatcaaaaacttcttagagttccagcgcaagctgcagcacgacgtgcttaagctggaattcgaaaggcacgatcccgttgacggccgcattacagagcgccagttcggggggatgctgctcgcttactcgggagtgcagagcaaaaagctgactgcaatgcagaggcagctaaaaaaacatttcaaggagggtaagggtttgacattccaagaggtcgagaatttctttacctttctgaaaaacatcaatgatgtggacaccgccctgtcattttaccatatggcgggcgcctcactggataaggtcacaatgcagcaagtcgcaagaaccgtcgcaaaggttgaacttagcgaccacgtgtgcgatgtggtgttcgctctctttgactgtgatggcaacggggagctatctaataaggagttcgttagtatcatgaagcagaggctgatgcgaggcctagaaaagcctaaagacatgggtttcactaggctgatgcaggctatgtggaagtgtgcccaagagaccgcttgggatttcgcgctgccgaaacagtag

SEQ ID NO: 27783 - DNA, 837 bp, Artificial Sequence
  Description of Artificial Sequence: Synthetic coding sequence
atggtctccttgaaggcgaaattaaatcatcttcgccagagcatgctgaagcagaaagccccccagcgtaattttgaaatcgctttcaagatgtttgatttaaacggggatggcgaagtcgatatggaggaatttgaacaggtccagtctattattcggagtcagaccagtatgggtatgaggcacagagacaggccgaccaccgggaataccctgaagagcggattatgctcagcgcttaccacttattttttcggtgccgacctaaaagggaaattaaccataaaaaatttcctggagttccaaaggaagctgcagcacgacgtcctaaagctggagtttgaacggcacgaccccgtcgatggaagaatcactgaaagacagtttggtggcatgcttcttgcttactccggtgtacagtccaaaaagctgaccgcaatgcagaggcagctgaaaaagcacttcaaggaggggaaggggttaacgttccaggaagtggaaaatttcttcacatttctcaagaacataaatgatgtggataccgctctctccttttatcatatggccggagcctctctcgacaaagtaacgatgcagcaagtagcgcggaccgtggccaaggtagaattgtccgaccacgtctgtgatgtggtattcgcattgttcgactgcgacggaaacggcgaactttccaacaaggagttcgtcagcataatgaaacagaggcttatgaggggcctggagaagccaaaagatatgggctttacacgcctcatgcaggccatgtggaaatgcgcacaagagactgcttgggacttcgccttaccaaagcaatag

SEQ ID NO: 27784 - DNA, 1431 bp, Artificial Sequence
  Description of Artificial Sequence: Synthetic coding sequence
atgttccgtctaaatagtttgagcgcactagctgagctggcggttggaagccggtggtaccatggtggctctcagccaatccagattagaagaaggcttatgatggtggcatttttgggtgcatcagccgttaccgccagtacgggtcttctatggaaacgcgcccacgccgagtcccccccatgtgtcgataatctgaagagtgatattggagataagggaaagaacaaggacgaaggggatgtgtgtaatcatgaaaaaaaaacagccgatctcgccccgcatccagaggagaaaaagaaaaagaggagcggcttccgcgaccgcaaggtgatggaatatgagaatcgcattagggcctatagtacaccagataaaattttccgttactttgcaacactgaaggtgataagcgagcccggtgaggccgaggtgtttatgacccctgaggactttgtgcggtccattactcctaacgagaaacagccggagcacctcggacttgaccagtacattatcaagcgcttcgacggcaagaaaatctctcaggaacgtgagaaatttgccgatgagggctccatcttttataccctgggagagtgcggcttgatctccttttccgattacatctttctcacgactgttctaagcactccgcagcgaaacttcgagattgcctttaaaatgtttgatctgaatggtgatggcgaagtggatatggaggaatttgaacaagccatatctataatcagatcgcagacctctatgggcatgaggcaccgtgaccggccaacaaccggcaataccctcaagtcaggcctctgttcagcgctgactacctacttttttggagccgacctgaagggaaaactcacgatcaagaacttcctggaattccagagaaagctgcagcacgatgtgctgaagttagagttcgaaaggcatgaccctgtggatggacgcattaccgagcggcagttcggtggtatgctgctggcatattccggagtgcagtcaaagaagctgaccgctatgcagaggcagctcaaaaagcactttaaggaaggaaaagggctgacctttcaggaagtcgagaatttctttaccttcctgaaaaacatcaacgacgtcgataccgccctctcattctatcacatggccggcgccagtctcgacaaggtcaccatgcaacaggtggcccggaccgtggccaaggttgaactgagtgaccacgtatgtgacgtggtgtttgccctctttgactgcgacggaaatggagaactttctaataaggagttcgtgtctattatgaagcagcgactgatgagggggctcgagaagccgaaggacatgggattcacacgcttaatgcaagctatgtggaagtgcgcacaagagactgcctgggacttcgcgttgcctaaacagtag

SEQ ID NO: 27785 - DNA, 837 bp, Artificial Sequence
  Description of Artificial Sequence: Synthetic coding sequence
atgaagcgtatctacacctatcggcgcgccaaagaaatttttaaggacacccccaaagcaccacagaggaacttcgagatcgctttcaagatgtttgatttgaatggggacggggaggtcgatatggaggagttcgagcaagttcagagcatcatccggtctcaaacatctatggggatgaggcatcgcgatagaccaacaacaggaaataccttgaagagcggcctgtgttcggctcttactacttactttttcggagctgacctcaagggcaagcttaccatcaaaaacttcttggagttccagcgcaagctccagcatgacgttcttaagctcgaattcgagagacacgatcctgtggacgggcgtataacggaaaggcagtttgggggaatgcttctggcgtattctggggtccagagtaaaaagctcactgcgatgcagcgacagctaaagaaacatttcaaggaaggcaagggactgaccttccaagaggtggagaactttttcacattcttgaaaaatatcaatgacgtggataccgccttaagcttttaccatatggccggagcgagcttagataaggttacaatgcagcaggttgcacgcaccgtagcgaaagtggaactatcagaccacgtttgcgacgtcgtgttcgctttgttcgactgtgacggaaacggcgaactgtcgaacaaggagtttgttagcatcatgaagcaaagactaatgcggggcctggaaaagcctaaggatatgggcttcacacgcttaatgcaggccatgtggaaatgtgctcaagaaacagcctgggactttgccctgccaaaacagtag

SEQ ID NO: 27786 - DNA, 1092 bp, Artificial Sequence
  Description of Artificial Sequence: Synthetic coding sequence
atggacggggggtccggcggactaggcagcggtgataatgcaccaaccacagaggccttgtttgtcgccttgggtgccggagtgactgccttgagccaccctctgctatacgtcaaactgttaattcaggttggccacgaaccgatgcccccaactttgggcacgaatgttctaggaagaaaggttttgtacctgccatctttttttacatacgccaaatatatagtccaggtggacggaaagataggattgtttcgcggactctcacctaggctgatgagcaacgcactgtcaaccgtgaccagaggaagtatgaagaaagtgttcccccctgacgagattgaacaagttagcaacaaggatgacatgaagaccagcctcaagaaagtggttaaggaaacttcctatgagatgatgatgcagtgtgtctcccgcatgttggctcatcccctgcacgtgatttcaatgcgctgcatggttcagttcgtgggtcgcgaggcgaagtatagtggtgtcctctcttctatcgggaaaatctttaaggaggagggacttcttggattctttgttgggctgattcctcatctcctcggcgatgttgtatttttgtggggatgtaatctcctcgctcacttcatcaacgcttacttggtagatgattccttcagccaggcgttagctatcaggagctacacgaagtttgtcatggggatcgctgtgtctatgctcacttaccccttccttttggttggcgatctgatggccgtcaataattgtggattacaagccgggctgccgccttatagcccagtttttaagtcttggatccactgttggaaatatttgtccgtgcaagggcagctctttagaggcagctcctgcttctccgcaggttgccatcaggaccacgcactgccatggagcaatcttaatcacctaaaaaacactgtatccacttggcccccctgggtcagacctgaccaccttggcaccccggcccgccggctccaacctaataacaaccagatgtgtagcagccctgctggtctgcagttccacatctgccatgtctctgttcagatgtgggggtag

SEQ ID NO: 27787 - DNA, 1074 bp, Artificial Sequence
  Description of Artificial Sequence: Synthetic coding sequence
atggacggaggctcggggggactcggatccggtgacaatgcccctacaactgaggccttattcgtggcgttgggagcaggagttaccgctctgagtcatccactgctctacgtaaaactgctcatacaggtggggcatgagcccatgcctccaaccttagggactaatgtcctggggaggaaagtgctttatctgccatcctttttcacctacgcaaaatacatcgtgcaggttgatggcaagatcggcctttttcgaggactcagtccccggttgatgagtaacgctctttctactgtcacgcgtggcagcatgaagaaggtcttccctcccgacgagattgaacaggtgtccaacaaggacgacatgaaaacttccctgaaaaaagtcgtgaaagagaccagctacgagatgatgatgcagtgtgtatcccgtatgctggctcaccccttgcatgtgatctcaatgcgctgtatggtgcaatttgttggcagagaggctaaatactccggggtcttgtctagtataggcaagatcttcaaagaggaaggtctgctcgggttttttgtgggcttgatcccacacctgcttggtgacgtggtgttcctctgggggtgcaatcttctggcccattttattaacgcttacctggtggacgactccgttatccagccaggccccggccatccagaattgtaccaggtgagggacggtgactgttcagaacacgccgacctgcctttgcctgcatcttggagaccccatgggtgcgagcagctgcgggccgctagctgggccccaccactgttacccagcgtacagattctggatagtctgctcgaagtccctgagtgtgcggcctgcttcagcgccggctgccatcaagaccacgcgttgccctggtccaacttgaaccacctcaagaatacagtgtcaacttggcccccctgggttcggcctgatcacttgggcactcccgctcggaggctgcagcctaacaacaatcagatgtgttcctcccccgcaggactccaatttcacatttgtcatgtgtcggtgcagatgtgggggtag

SEQ ID NO: 27788 - DNA, 561 bp, Artificial Sequence
  Description of Artificial Sequence: Synthetic coding sequence
gcggtctgcgttccacatgtcggtcccccaccggcctgccatctgaacgctttacacggacccgtttgtggaacgggtggccaggtgcagttatcttgtggtgcgacaattccaggttcgtcagctgctatggtacctcatttcggagtcatcaatggcaaactcgcccatagtccccgtctgatcatgtccggagtgctgtcctccatcggaaaaatattcaaggaggagggactgctgggctttttcgtggggctcatcccgcacttactgggggacgtagtttttctgtggggatgcaacttgctcgcacatttcattaatgcttacctggtagacgattctttcagtcaggcattggccatccggtcatacaccaagttcgtcatgggtattgcagtgtctatgctcacttatcccttcctgctggttggagacctcatggctgtgaacaactgtggactgcaggccgggctcccaccttattccccagtcgccagctcttcagaagccccagcatgtttctcagccggctgtcatcaggatcacgcactgccctag

SEQ ID NO: 27789 - DNA, 1119 bp, Artificial Sequence
  Description of Artificial Sequence: Synthetic coding sequence
atgggcgcctcggatccagaggtcgcgccatgggcccgtggtggcgctgctgggatggcgggggcgggagcaggcgctggggcaagggggggagccgctgctggagtcgaggctagagctcgtgacccgcctccagcccatcgtgctcaccccaggcacccacgacccgccgcgcaacccagcgcaaggaggatggatggaggctcaggaggactgggcagcggggacaacgcccccacaaccgaggctctgtttgtggcccttggagcaggagtgactgccctgtcccacccgctgctgtatgtgaaactgctgatccaggtcgggcatgaacccatgccaccgacactaggtaccaatgtgttgggcagaaaagtgttgtatctaccttcattcttcacatatgccaaatacatagtgcaggtggacggcaagatcggtttgtttagaggattgtccccaaggctgatgtcaaacgccctcagcacagtgacacggggctccatgaagaaagtatttccacctgatgagattgagcaggttagcaataaggacgacatgaaaactagtcttaagaaagttgtgaaagagacctcatacgaaatgatgatgcagtgtgtttctcgcatgcttgcacatcccttgcatgtgataagtatgaggtgcatggtccagtttgttggtcgggaggctaaatacagcggagtcctctcttcgatcggcaaaatctttaaggaagagggcctgctcgggttttttgtgggccttataccccacctactgggcgacgtggtgtttctgtggggttgtaatctgctggcccatttcatcaatgcatatctggtcgatgactcatttagtcaggcactggctattcggtcttatacaaaatttgtgatggggatagcagtgtccatgctgacctatccattcctgcttgtcggcgacctcatggccgtaaataattgcgggctgcaggctggattacccccgtactcccccgtctttaaaagctggatccattgctggaagtacctgtctgttcagggccaactgtttagaggaagttcccttttgttccgccgcgtgtcttcagggtcctgcttcgcgttagagtag

SEQ ID NO: 27790 - DNA, 1170 bp, Artificial Sequence
  Description of Artificial Sequence: Synthetic coding sequence
atgggggctagtgaccccgaggtggcaccttgggcacgcgggggggctgccggtatggctggagccggagcaggagcaggcgccagaggcggggcggccgccggcgtggaggcacgggctcgggaccccccgcccgctcacagggcccatccccggcaccctcgtccagccgcacaaccaagtgctcgccgaatggatggcggaagcggcggtctcgggagcggcgataacgcacctactactgaagctctctttgtcgccctcggagcgggggtcactgctttgtctcaccccctcctctatgtgaagctactgatacaggtcggtcacgagcccatgccacccactctgggcactaatgtgcttggacgtaaagtgctgtacttacccagcttcttcacatacgctaagtatatagtgcaggtcgacggcaagatcgggctgtttagagggttgagtccccgactgatgtcgaatgcgctctccaccgtgacccgaggatctatgaaaaaagtgttcccgccggacgaaatagaacaggtaagcaataaggatgatatgaagaccagcctcaagaaagtcgtgaaagaaacaagctacgagatgatgatgcagtgcgtctccagaatgcttgctcacccactgcacgtgatttccatgcgctgtatggtgcagtttgtcggtagggaggcgaagtatagcggagtgctctcatcaataggtaagatttttaaggaggagggcctgttagggttcttcgtggggctgatccctcatctgctcggggatgtggttttcctgtggggatgtaatctactggcacacttcataaacgcatatttagtcgatgactcagtgtctgacaccccaggcgggcttggcaacgatcagaatcccggcagccagttttcgcaggctctggccatacggtcctataccaagttcgtgatgggcatagcagtgtcgatgctaacatatccttttctcttggtcggtgatctcatggcagtgaacaactgcggcctgcaagccggcctcccaccttactctcccgtcttcaaatcctggattcactgctggaaatacctgtcagtgcaagggcagctgttccgggggtcctcactcctcttccgcagggtatcgtctggctcctgctttgccttggagtag

SEQ ID NO: 27791 - DNA, 606 bp, Artificial Sequence
  Description of Artificial Sequence: Synthetic coding sequence
tgagcggtttgtgtgccgcacgtgggccctcctcctgcttgccacctcaatgcacttcacggacctgtttgcggcaccggtggacaggttcagctgagctgtggggctaccatacctggctcatctgcggcaatggtcccccatttcggggtcataaacggcaagttggctcactcgcctcggctgattatgagcggcgtattgagcagcattgggaagatctttaaagaggaaggcttactgggcttcttcgtgggcctgatcccacacctgctgggggatgtagtcttcctgtggggctgcaatctccttgcccatttcatcaacgcctatttggttgatgatagtttttctcaagcgcttgccatacgctcctacactaaattcgttatgggtattgctgtgagtatgctcacatacccctttctgctggtcggggatttaatggctgttaacaattgcgggctccaggccggcctgcccccttactcgcccgtcttcaagtcctggattcattgttggaagtacctttctgtgcagggccagctgttcaggggatcatcgttgctgtttcgtagagtgagtagtggctcttgcttcgcttag

SEQ ID NO: 27792 - DNA, 1185 bp, Artificial Sequence
  Description of Artificial Sequence: Synthetic coding sequence
gcaggtatggcgggagctggtgctggcgcaggggctcggggcggagccgccgccggcgtggaggcccgggctagagaccctccccctgcccaccgagcccatccacggcatccccgcccagctgcccagcctagcgccagacgaatggatggagggtccggaggattaggttctggcgacaacgcacctacaaccgaggccctcttcgtcgccctgggggccggagtcactgccctatcccaccctctgctatacgtgaagcttctcatccaagtgggacacgaacctatgccccctaccctcggcacaaacgtgctgggaaggaaggtcctgtacttgcccagcttcttcacctatgctaaatatatcgtccaggtggacgggaagataggccttttcagggggctgagtccacgattaatgagcaatgcactgtccaccgtgacacgggggagcatgaaaaaggtgttccctcccgatgaaattgagcaggtgagcaacaaagatgatatgaagacaagtctaaagaaggtcgtcaaggagacttcttacgagatgatgatgcagtgcgtcagtcgaatgctcgcccaccctctgcacgtgatcagcatgagatgtatggtgcagtttgtcggcagggaagcgaaatattccggtgtgctgtcatcgatcggtaagatcttcaaggaagagggcctgttaggtttcttcgtcgggctcatcccacatctgctgggggatgtggtttttctttggggctgcaacctgctggcacatttcatcaacgcctatctggtagacgacagtttctcccaggccctggccattcgcagctacacaaagttcgtaatgggcattgcagtgtccatgctcacctatccattccttcttgtgggcgatctcatggctgttaataactgtggtctgcaagctggtctacccccctactcgcctgttttcaagagctggatccactgctggaagtatctgtcagtacaagtttccaagcattggactgctgaagccttcccagtgctttgctacatcctgcagttaaagtggttctgcggctgcttcatcgcctgcaaggacaaatggttccacggtatacaatactgtgaggaaattttgggcatctacaaggccttcaaattctccagctatattatcagtgagcgcatctag

SEQ ID NO: 27793 - DNA, 765 bp, Artificial Sequence
  Description of Artificial Sequence: Synthetic coding sequence
atgtctaacgctctcagcacagtcacccgggggtctatgaaaaaggtgttcccacctgacgaaatcgagcaggtgtccaataaggacgacatgaagacaagtcttaaaaaagtcgtgaaggagacatcctacgaaatgatgatgcaatgcgtttccaggatgctcgctcaccctctacacgtgatcagcatgaggtgcatggtccagttcgttggaagggaagcgaagtatagtggagttctgtcgtccatcggaaagatcttcaaggaggaagggcttctcgggttctttgtggggttgatcccacatctcctcggcgatgtggtcttcctttggggctgcaacctgttggcccacttcatcaacgcatacctcgtggacgactctttttcacaggcgctggcaattcgctcttacacaaagttcgtcatgggcattgccgtgtcaatgttaacgtacccctttttgctggtgggggatctgatggcggtcaacaactgtggcctgcaggctgggttaccaccttactctccagtctttaagtcctggatccattgttggaagtacctttctgtgcaagtgagtaaacactggacagcagaagctttccccgtcctctgttatatattgcaactcaagtggttctgtgggtgctttatcgcgtgcaaggataaatggttccatggcatccaatactgtgaagagattctgggcatttataaggcatttaagtttagcagctacataatctccgagcgaatctag

SEQ ID NO: 27794 - DNA, 894 bp, Artificial Sequence
  Description of Artificial Sequence: Synthetic coding sequence
atgatggactctgaggcccacgagaagcgccctccaatcctaacgtcaagcaaacaggatatatcgccgcatatcaccaatgtaggtgagatgaaacattatctgtgcggctgttgcgccgccttcaataatgtcgccattacatttccgatccagaaagttctgttccgccaacagctctatggcatcaagaccagggatgccatattacagctgagacgagacgggttccgcaatctttacagaggtatactgcctcctctgatgcaaaagaccactacactggcgcttatgtttggcctgtatgaggacttgagctgcttgctccacaagcacgtctccgcccccgaattcgccacttctggggttgcagccgtgctggccggcacaacagaggcaatctttacaccactggagagagtgcagacactgctccaggatcacaagcaccatgacaagttcacgaatacctatcaggcctttaaggcacttaaatgccacggcatcggggaatactatcgaggtctggtgcctatcttgtttagaaatggcctcagtaatgtgttgtttttcggccttcgaggtcccatcaaagagcatctacccaccgcaacgacacactccgcccatctcgtcaacgacttcatttgtggtggactattgggtgcgatgctcggattcctgttctttccaataaatgtggtgaaaacgcggatccagtcacagataggcggcgaatttcaaagcttccctaaagtattccagaagatctggctggaacgcgatagaaagttgattaatcttttccgcggagcacacctcaactatcaccgatctctgatttcatgggggatcattaacgctacgtacgaattcctgctgaaagtgatctag

SEQ ID NO: 27795 - DNA, 894 bp, Artificial Sequence
  Description of Artificial Sequence: Synthetic coding sequence
atgatggattcagaggctcatgagaaacgaccacccatactcacatcttccaagcaggacatctcccctcatatcaccaatgtcggggagatgaagcactacctttgtggctgctgcgccgccttcaataatgttgcgattacattccctatccagaaagtcttattcaggcaacagctgtatggaatcaaaactcgcgacgctattctccaactacgcagggatggcttcagaaatttatatcggggcatcctcccacctctgatgcaaaagacgacaaccctggccctgatgtttggactgtatgaggacctctcgtgcttgctacataaacacgtgagcgcacctgagtttgctacatctggagtagccgcagtgctcgctggaacaacagaggccatctttacacctctcgaacgcgtgcagacgttattacaagatcataaacatcacgacaagtttacaaatacctaccaggcatttaaagcactgaagtgtcatggcatcggcgaatactaccgcggtctcgtaccaatactcttccggaacggattgtcgaatgtgctcttcttcggactccgcggtcctattaaagagcacctacccacggccacaactcatagtgcacatcttgttaatgacttcatatgcggagggttgcttggcgccatgctggggttcctgttctttcctataaacgtggttaaaaccagaatccagtcacaaattggcggcgaattccagagttttccaaaggtgttccaaaaaatatggttggagcgcgacagaaaacttataaatctcttccgaggtgcacaccttaactaccacaggagtcttatttcatggggaatcatcaacgccacttatgagtttctcctgaaggtcatatag

SEQ ID NO: 27796 - DNA, 894 bp, Artificial Sequence
  Description of Artificial Sequence: Synthetic coding sequence
atgatggatagtgaagctcatgagaagcgtccaccaattttaacaagctctaagcaggatatttccccacatattacaaacgtgggcgaaatgaaacactatctgtgtggttgttgtgcggccttcaacaatgtggccattaccttcccgatccagaaggttcttttccggcaacagttatatggaattaagactcgagacgctatcctgcaactacggagggatggcttccgtaatttgtataggggcatcctgcctcccctcatgcagaaaaccaccacccttgcgctgatgttcggtctgtatgaggatctgtcatgtcttctgcacaaacacgtgtcagcgccagaatttgcaacatcaggggtcgcggccgttctggcaggaacaacggaagccattttcaccccattggaacgtgtgcagactctacttcaggaccataaacaccacgataagtttactaacacttatcaggcttttaaggccctgaagtgtcacggaatcggcgagtattatcgcgggctcgtccctatccttttcagaaatgggttaagcaatgtgttgttttttgggctgcgcggccccatcaaggagcatttacctactgccaccacacacagtgcacacctggtcaacgattttatctgcggaggccttctgggcgccatgctcggatttctgttttttcccatcaacgtggtcaagacgaggatccagtcacagatcggaggcgagttccagagttttccgaaagtctttcagaagatctggctggagcgtgacaggaagctgatcaatctttttcgtggtgcccatctgaactaccaccgcagtcttatcagttggggtatcataaacgcgacctacgaattcctgctgaaagttatctag

SEQ ID NO: 27797 - DNA, 924 bp, Artificial Sequence
  Description of Artificial Sequence: Synthetic coding sequence
atgcccttcatgcgcaagatcctgtctaacatgatagactctgaggcacacgagaagcgacccccaattttgacctctagcaagcaggatattagcccacatatcacaaatgtgggcgaaatgaaacactacctctgcgggtgctgcgccgcattcaacaacgtcgcaatcacgtatccaattcagaaggtgctgttccggcagcagttgtacgggattaagacgcgggatgctgtcctccaacttagaagggacgggttcaggaacctgtataggggtattctgccacctctaatgcaaaagacaacaactctggctttgatgttcgggttgtacgaggacctgagttgtctcctgagaaagcacgttcgggccccagagttcgctacacacggtgtggcagcggtcctggccgggacagcagaagccatattcactcccctcgaaagagtgcagactttgctgcagaatcataagcaccacgacaaatttaccaacacgtaccaggcctttaaagccttaaaatgtcatggcattggagagtattaccgcgggctcgtgccgattctattccgcaatgggctcagcaacgttctgtttttcgggcttaggggtcctattaaggagcatcttccgactgccactacccacagtgctcacctggtaaatgattttatcggcgggggtttattaggcgcaatgttgggctttctctgctttccaatcaatgtcgtgaaaacgagactgcagagtcaaatagggggtgagtttcaaagctttccaaaagtgtttcaaaagatttggctggaacgcgatagaaaattgatcaatttgttcaggggcgcccacttgaactatcacagatcactgatatcttggggcatcattaacgccacgtatgagtttctgctgaagttcatttag

SEQ ID NO: 27798 - DNA, 894 bp, Artificial Sequence
  Description of Artificial Sequence: Synthetic coding sequence
atgatagacagtgaagcccacgaaaagcgccctcctattctcaccagcagcaaacaagacatttcgccacatattaccaatgtgggcgaaatgaaacactacttatgtggttgttgtgctgccttcaacaatgtcgccattacgtatcccatccagaaggtgttgttccggcaacagctgtatggcatcaagacaagagacgcagttcttcagttgcgaagggatggctttagaaacctctacagagggattctccctccccttatgcagaagacaactaccttagcactgatgtttggactgtatgaggacttatcatgtctcctgcgcaaacatgtccgcgcgccagagttcgctacccatggcgtggcagccgttttagccggcactgccgaagcaattttcactcctctagaaagagtgcagaccctcctacagaaccacaagcatcacgacaagttcaccaatacttaccaggctttcaaagccctaaagtgtcacggcatcggtgaatactataggggcctggtacctatcctctttcgcaatgggctgtccaacgtcttatttttcggcctgcggggcccaatcaaggaacatcttccaacggcgactacgcattcggctcatcttgtgaatgactttataggtggcggtctgttgggagccatgctgggttttctctgctttcccatcaacgtggttaagacacgccttcagtcgcagatcggtggcgagttccagtcgtttcctaaggtatttcagaaaatttggctggaaagagacaggaagctcatcaatttattccgaggcgcacaccttaattatcaccgctcactgatctcctgggggatcatcaatgccacctatgaatttcttctgaagttcatctag

SEQ ID NO: 27799 - DNA, 924 bp, Artificial Sequence
  Description of Artificial Sequence: Synthetic coding sequence
atgggagagcagaaccactcaccaggcaaggagttgcagcaccggacgagagctgaggcacctgggaagaaaagttggcactcacaggcctacgcactcggggcagtcagtaattttatgtccacattcctgaccttcccgatttataaggtggtgttccgccaacagatacatgcaatggccgtgagcgaggcagtgaggcaattgtggcatgagggcccacagtatttctacaggggcatttaccccccactcctctcaaagacccttcagggaaccctgctgtttggcacctacgactccttgctgtgcttcctaagtcccgtgggccctcatacactcgggcatagatgggcagcagggctaatgtctggggttgtagaagccgtggctctctcaccgtttgaacgggttcagaacgtgcttcaagatggccgtaaacaggcacgcttcccttcaaccttcagcatcctgaaagaattcaattcctacggactctggggcaggctgagtctgggatactaccgagggttctggcctgtgctggcacggaacagcctaggttccgctctgtatttttcgtttaaagatccaatacaagatggtttggctgagcagggcctaccccactgggtacccgcactggtgtctggcagtgtgaacggtaccatcacatgtttagtgctttaccccctcatcgtgttggtggctaatatgcagtcccacatcggctggcagaatatgcccagtttgtgggcttccgctcaagacgtttggaacacacgcggacggaaactgttgcttatttatcgggggggttctctggtcatactccggagcagcgtcacttggggcttaacaactgccatccatgacttccttcagaggaaatcccactctcgcaaagaattgaagactgattag

SEQ ID NO: 27800 - DNA, 876 bp, Artificial Sequence
  Description of Artificial Sequence: Synthetic coding sequence
atggctgagattagcaggattcaatacgagatggaatataccgaagggatctcacagaggatgagagtacctgagaagcttaaggtggcacctcctaatgctgatctggagcagggtttccaggagggagtaccaaatgccagcgtgattatgcaggttcctgagcggattgtcgtagccggcaataatgaggacgtgagtttctctcgccctgctgacctggacctgatacagtccaccccgtttaaacccctggcactcaaaacgcctccccgggtgcttaccctttctgagaggcctctggatttcttggaccttgagagacctcctaccaccccccagaatgaagagatcagggctgtcggacgcttaaaacgcgaacgatccatgtcagagaatgcggtgaggcagaatggacaactcgttaggaatgatagcttggtgacgcccagcccccagcaggcccgcgtgtgcccaccccatatgcttccagaggatggcgcgaatctttcatcagcaagaggcattctgtccttgatacagtcttccactagacgcgcataccagcagatcctggacgtcctggatgagaacaggagacccgtccttagggggggctcagccgccgctacatccaacccgcaccacgacaacgttagatatggaatttccaatattgatacaaccattgaaggcacctcagacgatctgactgtggtcgatgctgcatcactgcgccggcagatcattaagctgaaccgcagactgcaattattggaggaggagaacaaggaacgtgccaagagggagatggtgatgtactctataactgtagcgttttggctcctgaattcctggctttggttccgcagatag

SEQ ID NO: 27801 - DNA, 732 bp, Artificial Sequence
  Description of Artificial Sequence: Synthetic coding sequence
atggctgagatctcaagaattcagtatgaaatggagtacaccgaaggtatcagtcagcgaatgcgagtgcctgagaaattaaaagtggcccctcccaacgctgatctcgagcaaggctttcaagaaggggtgccaaacgccagtgtgatcatgcaggtgcctgagaggatcgtggtggccggaaacaacgaggacgtgtcattcagcagacctgcagacctggacctaatccagagtaccccattcaagccattggctctgaaaaccccaccgagagtgctcacactgtccgaacgtccactggatttccttgacttagaacgccctccaacaactccccagaatgaagaaatcagagcggttggccgattgaagcgggagcggagcatgtcagaaaatgccgtcagacagaacggccagctggtgaggaatgatagtctgtggcaccgctctgacagcgcaccacggaacaaaatttcacgattccaggctcccataagtgcccccgagtacacctacggtatcagtaacattgacacaacgatagagggaacgagcgacgatctgaccgtggtggatgccgctagcctaaggcgacaaattatcaagcttaatcggcggctgcagctactggaagaggagaataaggagcgggcaaagcgggaaatggttatgtattccatcacagtagccttctggctattgaatagctggctatggttcagaaggtag

SEQ ID NO: 27802 - DNA, 717 bp, Artificial Sequence
  Description of Artificial Sequence: Synthetic coding sequence
atggccgagatctcacggatccagtatgaaatggagtataccgagggtatctcccagcgtatgagagttcctgaaaagctgaaggtcgctcctccgaatgccgatctggagcaagggttccaggagggggtgcctaatgcaagcgtcatcatgcaggtcccagaaagaatcgtcgtggcgggcaacaacgaggatgtgtcatttagcaggccggccgatctcgatcttatccaatcaactccattcaaacccctggccctaaaaacaccgcctcgggtgctgaccctgagcgaacgtccactggacttcctagatctggaaaggcctcccaccactccacaaaatgaggagattcgagccgtgggcaggcttaagcgcgaacggtcaatgagcgagaatgccgttagacaaaatggacagctggtgcgcaatgatagcctccctgtgcttcggggtggttccgcggccgcaacttctaatcctcatcacgataatgtccggtatggcatcagtaacatcgataccaccattgagggcacatctgatgacctgacggtggttgacgcggcttctctgcgtcgacaaattataaagctgaaccgccgattacagcttcttgaagaagagaataaggaaagggcaaagagagaaatggtcatgtatagtatcactgttgccttctggctgcttaattcttggctctggttccgaagatag

SEQ ID NO: 27803 - DNA, 1029 bp, Artificial Sequence
  Description of Artificial Sequence: Synthetic coding sequence
atgagcaaggggacaagctccgacacctccttaggaagagtttcccgagctgctttcccctccccgactgccgcggagatggcggaaatttcgcgtatacagtacgagatggagtacacggagggaatctcccagaggatgagagtgcctgagaaacttaaagtagcgccccccaacgccgatctcgaacaaggattccaagaaggcgtccccaacgcttccgtgatcatgcaggtgcccgagcgaatcgtcgttgccggtaataatgaagacgtcagcttttcccgtcccgccgacctggaccttattcagtctacgccttttaaaccactagctctgaagacccctccacgagttctgaccctgtccgagcgccctctcgactttttggatcttgagaggccaccaacaacaccacagaacgaggagattcgcgccgtgggccgcctaaagcgcgaacggtcgatgtcggaaaacgctgttcggcaaaacggtcaactagtgcgtaatgactccttgtggcatcgcagtgattctgctccaaggaacaagatcagtcgatttcaggcgcctattagcgcccctgagtacacagtgactccatccccccagcaggcgagagtttgtcccccgcatatgctgcccgaggatggcgccaatctctcctccgctcgcggtattctgagtctcattcagtcgtccacccgtcgggcttatcagcagattctggacgttttagatgaaaatcgacgccccgtcctccggggtggcagcgccgcagctactagcaaccctcaccacgacaatgtgcgttatggtatctcaaacatagataccaccatcgagggtacaagcgacgatctcaccgtcgtcgacgccgcctcactccggagacaaatcatcaaactaaaccggagactgcagctgctggaggaggaaaacaaagaacgcgctaaaagagagatggtaatgtatagcatcactgttgcattctggctgctgaactcctggttgtggtttcggcggtag

SEQ ID NO: 27804 - DNA, 657 bp, Artificial Sequence
  Description of Artificial Sequence: Synthetic coding sequence
atggcagaaatctccaggattcagtacgaaatggaatataccgaaggtatcagccagaggatgagggtaccagaaaagttgaaggttgcaccccccaacgccgacctcgaacagggcttccaggagggagtgcctaatgcttctgtgatcatgcaggtgccagaacgaattgttgtggccggcaacaacgaggacgtatccttctctcgacccgctgatttggacctgattcagagcacaccctttaagccactggcactcaagacaccgcctagggtgctgacgctgtccgaaaggcccttagactttcttgacctcgaacggccccccactacaccccagaatgaggagatccgagccgtgggcagactaaagcgcgagcgcagtatgagcgaaaatgctgtcagacaaaacggccagttggttcgcaatgactctctttacggcatcagcaacatagacacaaccatcgaggggacatccgatgatcttaccgtggtggatgctgcaagtctgcggagacagatcataaaactgaaccgtaggctccagctcctggaagaagagaacaaagagagagcgaaacgcgagatggtgatgtattccatcacagtggctttttggcttctgaacagctggctctggttccgtcgatag

SEQ ID NO: 27805 - DNA, 1029 bp, Artificial Sequence
  Description of Artificial Sequence: Synthetic coding sequence
atgtccaagggaacttcatcagatacatccctagggcgggtgtcccgcgcggctttccctagtccaaccgctgctgaaatggccgaaatctcaaggatccaatatgagatggagtataccgagggcatttcccaaaggatgagggtccctgagaaactgaaggtggcacctcctaatgcagatctcgagcaggggttccaggaaggcgtgccgaacgcctccgtcatcatgcaggtccccgaaagaatcgtggttgcaggaaacaatgaggatgtgtccttcagtcggcccgcagatctggacctaatccaaagtactccctttaagcccctcgctctgaaaacgcccccaagggtgttaacactgtcagagcggccactcgatttcttagacctggagagacccccaacaacgccacagaatgaagagatccgggctgtcggccggcttaagcgagaaagaagcatgtccgaaaacgcagttcgtcagaacggacagctcgtccggaacgacagtctttggcatcggagcgatagcgcccccagaaacaaaatcagtcgattccaagctcctattagtgctccagaatataccgtgactccttctccccaacaagcacgggtctgtcccccacacatgctcccagaggacggtgccaacctatcctcagcccgcgggatactttccctgattcagagctcaactcggcgcgcataccagcaaattttggatgtgctggatgaaaaccgacgccctgtcctgagaggaggctccgcggccgcgacaagcaacccacatcacgataatgtgagatacggcattagcaacattgatactaccatagagggcacatccgatgatctgactgtggtggacgcggctagtttgaggagacaaatcatcaagttgaaccggcggctccagctcctggaggaagaaaataaggagagggcaaagcgcgagatggtgatgtactccattactgtggcattttggctgttaaattcctggttatggtttcgccgctag

SEQ ID NO: 27806 - DNA, 657 bp, Artificial Sequence
  Description of Artificial Sequence: Synthetic coding sequence
atggccgaaatctcacggattcagtatgagatggagtacacggaagggatctctcagcggatgagagtgcccgagaagctgaaggtggctccacctaacgcggatcttgaacaggggttccaggaaggtgtcccgaacgcctcagtaataatgcaggtgcccgagcgaattgtcgtcgctggcaacaatgaggacgtaagctttagccggcctgctgacctagatctaatccaatcaactccgtttaaaccgttggcgcttaaaacacctccccgggtgctcacccttagcgagagacctctggacttcctagatctggagcggccgccgactaccccacagaacgaggaaataagggcagtgggaaggttaaagagggagagatccatgagcgagaacgctgttcggcagaatgggcaactggttcgcaacgactcactgtacggcatttcgaatatcgacacaaccatagaggggaccagcgacgacctcaccgtggtggatgcagcatcgctgcgcaggcaaattatcaaactcaaccggcgactgcagcttctggaggaggagaataaggaacgagctaaacgtgaaatggtaatgtacagcataaccgtagcattctggctgctgaattcatggttgtggttccgccggtag

SEQ ID NO: 27807 - DNA, 717 bp, Artificial Sequence
  Description of Artificial Sequence: Synthetic coding sequence
atggccgaaatttctcggatccagtatgagatggagtatacggaggggataagccagcgcatgcgcgtcccggagaaactgaaagtggcacctcccaatgctgatttggagcaggggttccaggaaggggtcccaaatgcctctgttatcatgcaagtgcctgaacgaatcgttgtggcaggtaataatgaggacgtaagtttctctcgaccggcagatttggacctgattcaatccacaccatttaaaccactcgccctgaaaacgcctccacgtgtgcttacactctccgagcggccattggactttttggacctcgaaagaccacctacaacaccacagaatgaggaaatccgggccgtcgggcggctgaaacgcgaaagaagtatgtccgagaacgctgtccgccagaatggacagcttgttaggaatgacagtctgcccgtgctgagggggggatcagcggccgcgacctctaaccctcaccatgacaatgttaggtacggaatttcaaatattgatactaccattgaaggaacgtctgacgatcttaccgtggtggatgccgcatcgctgagaaggcagattataaagttaaatcgcagactgcagcttttggaagaggaaaacaaagaacgcgcgaagagggagatggtcatgtactcaatcactgtggctttctggttattgaatagctggttgtggttccgacgatag

SEQ ID NO: 27808 - DNA, 183 bp, Artificial Sequence
  Description of Artificial Sequence: Synthetic coding sequence
atggccgagatatctcgtattcagtacgaaatggagtatacagagggaatcagtcagcgcatgcgtgtccctgaaaaattaaaggttgcaccccctaacgctgacctcgaacaaggttttcaggaaggggtacctaacgcctcagtgattatgcaagtgcccgagcgaatcgtggtagcctag

SEQ ID NO: 27809 - DNA, 99 bp, Artificial Sequence
  Description of Artificial Sequence: Synthetic coding sequence
atggctgagatcagcaggatccagtatgagatggaatatacagaagggatcagccagaggatgcgggttcctgaaaagctcaaagtcgcccctccctag

SEQ ID NO: 27810 - DNA, 105 bp, Artificial Sequence
  Description of Artificial Sequence: Synthetic coding sequence
atgtctaagggaacaagtagcgatacctcacttgggagagtgagtcgagcagcgttccctagtccgacggcagctgagatggcagaaattagcaggatccaatag

SEQ ID NO: 27811 - DNA, 216 bp, Artificial Sequence
  Description of Artificial Sequence: Synthetic coding sequence
atgtctaaggggaccagcagcgacacctcgctcggtcgagtgtcgagagcagccttcccctccccaaccgccgccgaaatggccgagattagccgcatccaatacgaaatggaatatacagaaggcatcagccagcgcatgagagtgccagagaagctcaaggtagcccctccaaacgccgatctcgagcagggcttccaggaaggagtgccctag

SEQ ID NO: 27812 - DNA, 417 bp, Artificial Sequence
  Description of Artificial Sequence: Synthetic coding sequence
atggcggaaataagtcgcatccagtacgaaatggaatacacagaagggatctcccagcgaatgcgcgttccggaaaaattgaaagtcgctccaccaaacgctgatctcgagcagggctttcaagagggcgtcccaaacgctagcgtgatcatgcaggtgccagagcggatagtggttgccggcaacaatgaggacgtgtctttctcacgcccggccgatctggacctcattcagtccacccccttcaaacccctggccctaaaaactcctccccgcgtgctgacactctctgaaaggccgctcgacttcctggacctggagcgcccgcccaccactccgcagaatgaggagataagagccgtggggagactgaagcgggagcggtctatgtctgagaatgcagttaggcagaactag

SEQ ID NO: 27813 - DNA, 159 bp, Artificial Sequence
  Description of Artificial Sequence: Synthetic coding sequence
atggccgagatctcccgcatacagtatgagatggaatacaccgaagggatttcccaaaggatgcgcgtaccggagaagctaaaggtggctccaccaaacgctgatttggagcagggctttcaggaaggagtgccaaatgccagtgtcataatgcaatag

SEQ ID NO: 27814 - DNA, 501 bp, Artificial Sequence
  Description of Artificial Sequence: Synthetic coding sequence
atgtctgagccgcagcctagaggagcggagcgcgacctgtatcgcgacacgtgggtgcgctacctgggatatgcgaatgaggtgggagaggcattccgaagtctcgtaccagctgccgtagtgtggctttcctatggtgttgcttcctcctacgttctggcagacgctatcgacaagggtaagaaagcaggagaagtaccctcccccgaggctggccggtccgctagggtgacagtggctgtggttgacactttcgtctggcaagcgctggccagcgtggctataccaggctttaccataaaccgtgtgtgtgctgccagtctgtacgtgctcggcaccgcaacccggtggccgctggcagtgcggaagtggacaactaccgccctgggcctgctaaccattcccatcatcattcaccctattgataggagcgtagacttcctcctagatagctctttgaggaagctataccccaccgtggggaagccctcaagctcctag

SEQ ID NO: 27815 - DNA, 408 bp, Artificial Sequence
  Description of Artificial Sequence: Synthetic coding sequence
atgagcgagccccaaccaagaggggctgaaagggacctgtatcgggatacatgggtgcgctatttgggctatgctaatgaagtgggtgaagcttttaggtccctcgtgcccgccgccgtggtgtggctgtcttatggtgttgcatcttcctacgttctagccgacgccatcgataaaggtaagaaagcgggtgaggtgggagggttcccaccaggcctgcaaccagcgcaggccctccccaacagcggtgaggcccaattgctcctcataatcctttggtacctggcttgcgctagcgcctcttgcttcatgtctacttcgtatagttgccagggtatgtggacaccaggaagtttagtgagcaaggacccagggacatgggtcggcctctcatggacggaagcctag

SEQ ID NO: 27816 - DNA, 1002 bp, Artificial Sequence
  Description of Artificial Sequence: Synthetic coding sequence
atgctgggttggatcaagcgtttgatacgtatggtgtttcagcaggtcggcgtatccatgcagtctgtactgtggtccaggaagccatatggaagtagtcgctccattgtgcgcaagatcggtaccaatctgtcacttatccagtgtcctagggtgcagtttcagatcaatagccatgcaaccgagtggtcacctagccaccccggcgaggacgccgtagctagttttgctgacgtgggatgggtggcaaaagaagaaggggagtgcagtgcacgcctacgcactgaagtgcgcagtcgcccccccctgcaggacgacctgctcttttttgagaaggcaccatcaaggcagatctcacttccggacctcagtcaggaagagccccagcttaaaacacccgctttggctaacgaggaggcactccaaaaaatttgcgcccttgaaaatgagctagccgctttacgcgcacagatagcaaaaatcgtcacccagcaagagcaacaaaatcttacagcaggggatctggactcaaccacctttgggaccattccaccacaccctccacctcctcctcctccgctgccccctcccgctcttgggcttcaccagtccacaagtgccgtggaccttatcaaggaacggcgcgaaaagagagccaacgccgggaagacactggtgaagaataacccaaagaagcctgagatgcctaatatgctggaaatcttgaaagagatgaattcggtaaagttgcgcagtgtcaagagaagtgagcaggacgttaaaccaaaacccgttgacgccacggatccagcagctctgattgctgaagccctgaagaagaaatttgcctacagataccggtctgattcccaagatgaggtagagaagggtatccctaaatcagagtctgaggccacaagtgagagagtgcttttcgggcctcacatgttgaagccaactggaaaaatgaaagcactcatcgagaatgtttcagacagctag

SEQ ID NO: 27817 - DNA, 903 bp, Artificial Sequence
  Description of Artificial Sequence: Synthetic coding sequence
atgctggggtggatcaagcgcctgatacggatggtctttcagcaggtgggagtttccatgcaatccatcaatagccacgcgacagaatggagcccctcccatccaggcgaggacgcagtggctagcttcgcggatgttgggtgggtcgctaaagaggagggagagtgcagcgccaggctacgtaccgaagtacggagtagaccccctttgcaagacgacctgctgttctttgaaaaggcaccatctcgccagattagcctccctgacctttctcaagaggaaccacagttaaagacgccggctctggcaaacgaggaagcactgcagaaaatatgtgcactggagaatgagctggccgctctacgagcgcagattgctaaaatcgtgactcagcaggaacagcagaatttaacagcaggggatctggattccactacatttggcacaattccacctcatccacccccaccacctccccccctcccaccacccgcccttgggctgcatcagagtaccagtgcggtcgacttgatcaaagagcggagggagaagagagcaaacgccggaaagactctcgtgaagaacaatccaaagaagcctgaaatgcctaacatgctggagatcctaaaggagatgaacagcgtcaaactgagatccgtgaagcgctctgagcaggatgttaagcccaaaccggtcgacgcgacagatccggccgcccttatcgccgaagcgctcaaaaaaaaatttgcctaccgctacaggtcggacagccaggacgaggtagaaaaggggattccaaagtccgaaagcgaagccactagtgagcgggtcctctttggccctcacatgttgaagcccactggcaaaatgaaagccctgattgagaacgtgtccgacagctag

SEQ ID NO: 27818 - DNA, 1005 bp, Artificial Sequence
  Description of Artificial Sequence: Synthetic coding sequence
atgaggctaacaccacgcgccttatgctctgccgcgcaggccgcatggagagaaaactttcccctgtgtggacgggatgttgctcgctggtttcctggacacatggccaagggcctgaagaaaatgcagtcgagcttaaagctcgtggactgtatcattgaggttcacgatgcccgcatcccattgagcgggaggaatcctctgtttcaggaaacactcgggctgaagccgcacttgctagtcctgaacaagatggacctggccgacctcacagaacagcagaagatcatgcagcacctggaaggggagggcttaaagaacgtgatttttacaaattgtgttaaggacgaaaatgtgaagcaaatcatccccatggtgaccgagctcattggccgctctcacaggtaccacaggaaggagaatctggaatactgcataatggttataggtgtgcctaatgtggggaaatcctctctgatcaacagcctgagaaggcagcatctgaggaaaggcaaagctacacgcgttggcggcgagcctgggatcaccagggccgttatgtccaaaattcaggtgtccgagcgacccctgatgttcctccttgacaccccaggggtgctggccccacggatcgagtccgtggagactgggctgaaactcgccctgtgcggcaccgtgctcgaccaccttgtgggggaagagaccatggctgactaccttctgtacactctgaataaacaccagaggttcggatatgtgcagcattacgggcttggttcggcatgcgataacgtcgagagagtcctgaaaagcgtcgctgtcaaactcgggaaaacccagaaggtcaaagtcctgacaggaacgggcaatgtcaatattatccagccaaattaccctgctgccgccagagatttccttcaaacctttcggcgcggactactaggctcagtgatgctggatttggacgtccttcgtgggcatcccccggctgaaaccctgccatag

SEQ ID NO: 27819 - DNA, 852 bp, Artificial Sequence
  Description of Artificial Sequence: Synthetic coding sequence
atgcggctgacgccaagggccctatgctccgctgcccaagcggcctggagggagaatttcccgctgtgcggacgggacgtcgcaagatggtttcctggccatatggccaaaggattaaagaaaatgcagagctcactcaagctcgtggactgtatcatcgaggtgcacgatgcgcggatcccactgagcggtcgaaatccactattccaagaaacactcggcctgaagccccatcttttagtgttgaacaagatggaccttgcagacctgacggaacaacagaaaataatgcagcacttggagggcgaaggccttaagaacgtgatctttacaaattgtgtgaaagacgagaacgtcaaacaaattattccaatggtcacggagttgatcggacgttcccacagatatcataggaaggaggtttcagagcggcctcttatgttcctgctggatacgccgggcgttctcgcccctcgaatagagagtgtggagactggactgaagctcgctctatgtggtacagtgttagaccacctggtgggtgaagagactatggctgattacttgttatacactctgaacaagcatcagcgctttggatatgtacagcactatggactggggtctgcctgcgacaacgttgaacgagtgctgaaatccgtcgcagtcaaacttgggaagacacaaaaagtgaaggtgctgaccggcaccggcaacgtcaatataatacagcctaactatccagccgccgcaagagactttttacagacattcaggcgcgggctgctgggaagcgtaatgctcgaccttgacgtcttgcgagggcaccctcccgcagagacactcccatag

SEQ ID NO: 27820 - DNA, 681 bp, Artificial Sequence
  Description of Artificial Sequence: Synthetic coding sequence
atgcagtcaagcctcaaattggtcgactgtattattgaagtgcatgacgcacgaattcctctctctggacgcaaccctctgttccaggagactctgggcctgaagccacacctactggtgctgaataagatggacctggctgacctgacagagcagcagaagataatgcagcacctggagggcgaagggttaaagaacgtcatatttactaactgtgtcaaagacgagaatgtgaaacagattatccccatggtaactgagcttattggtaggtcccatagataccaccggaaagagaacttagagtactgcattatggtcataggagtcccgaacgtgggaaagtccagtcttatcaacagcctcagaaggcagcatctcaggaaggggaaggccacacgggtcgggggcgagcccggaatcacaagagccgtgatgtccaagattcaggtggaaagctctggggcccggccctccactctcagccgtgccctccaggcatctggcacctgccgcccattgtgcggtttcagactgctgacgactctcccatcaccgcccctgagcgtgcctgccgaacatccccgaggtagacattgtccctgcccctattctaccgtcgtgatcgttttcgcgcccaatttgtggggacgccatgcagtttttcctatcagcagatag

SEQ ID NO: 27821 - DNA, 237 bp, Artificial Sequence
  Description of Artificial Sequence: Synthetic coding sequence
atgtctgaatcggagctgggccgtaaatgggacaggtgccttgccgacgccgttgtgaagattggaacagggttcggcctgggcatagtgtttagtctgacattttttaaaagaagaatgtggcctctcgcattcggcagtggaatgggtttgggcatggcctattctaactgtcagcatgatttccaggccccttacctgcttcacgggaagtatgtaaaagagcaggaacagtag

SEQ ID NO: 27822 - DNA, 1467 bp, Artificial Sequence
  Description of Artificial Sequence: Synthetic coding sequence
atgaactcccagacggaggatcatgccctggcgcccgttcggaacactattcagttaccgactcagccactgaacagcgaagagtgggacaagctgaaagaggatctgaaggaaaacacgggtaaaacctctttcgaatcgtggataatttcccagatggccggctgccattcgagcatcgacgtggccaagagtttgttggcgtgggtggcggctaaaaataatggaatcgttagttatgacctcctcgtgaagtacttgtatctgtgcgtttttcacatgcagacttcagaggtcatcgatgtcttcgagattatgaaagccaggtacaaaactctggagcccagaggatattccctgcttattcggggactgatccattcagatagatggagagaggccctgttgctgttggaggacattaaaaaggtaatcacacctagtaaaaaaaactacaacgattgcattcagggggctctgttgcaccaggacgtcaatactgcttggaacctttatcaggagctgctggggcatgacatagtgccaatgcttgagaccctgaaagcctttttcgatttcggaaaagacatcaaggatgataattactcaaacaaactcctggatatcttgtcatacttacgaaacaatcagttgtaccctggcgagtcgtttgcccactcaatcaagacctggttcgagtctgtacccgggaagcagtggaaaggacaattcaccacagtgcgaaaatctggtcagtgttcaggatgcgggaaaaccatcgagagtatacagctttctccagaggagtacgagtgtttaaagggtaagatcatgagagacgttattgatggtggggaccagtaccggaaaacaacaccacaggaactgaagcgttttgaaaatttcatcaagtccaggcccccttttgacgtcgtgatcgatggcctgaatgtggcaaagatgtttccaaaggttcgggagagccagcttctcctcaatgttgtctcccagctggctaagagaaatcttaggctcttggtgctcggccggaagcacatgttacgcagaagctcccagtggagccgcgacgagatggaagaggtccagaagcaagcttcctgcttcttcgcggacgatatcagcgaagacgatccattcctattatatgcaactctgcacagtgggaatcattgccgcttcatcacccgcgatttgatgcgggatcataaagcttgtttacccgacgctaaaacccaaaggcttttttttaaatggcagcaggggcaccagctagctatcgtcaacaggtttccaggctccaaactaaccttccagcgtatcttgagttatgacacagtggtgcagaccaccggggatagttggcacattccctacgacgaagacctggtcgagaggtgctcttgcgaggtgcccaccaagtggttatgtctgcatcagaagacttag

SEQ ID NO: 27823 - DNA, 1704 bp, Artificial Sequence
  Description of Artificial Sequence: Synthetic coding sequence
atgacattttacctcttcgggattagaagcttccctaagctctggaagagcccctacttgggattgggacctggacattcttatgtatccttgttcttggctgacaggtgtggcatacgcaatcagcaacgtttgttcagcttaaaaacaatgtcacctcagaatactaaggccaccaacctgatcgccaaagctcgttatctcaggaaggacgaaggcagtaacaagcaagtgtactcagtcccccactttttcctggccggcgctgccaaggaaaggtctcagatgaacagtcaaacggaggaccacgcacttgcccccgtgcgcaacacgatacagctccctacccagcccttaaattccgaagagtgggataagctgaaagaggaccttaaggagaacacgggtaaaacgtcttttgagagctggattatcagccagatggccggttgccacagcagtattgacgtggccaagtccttgctggcttgggtggccgcgaaaaacaacggcatcgtttcttacgacttgctggtcaagtatctctatttgtgcgtgtttcacatgcaaaccagtgaagtgatcgatgtgtttgaaatcatgaaggctagatacaaaaccctcgaaccacggggttacagtttgttaatcagaggattgatacatagcgaccgctggagagaagctctgcttcttcttgaggatattaaaaaggtgattacccctagcaaaaaaaattataatgactgtatacagggcgcactgctgcaccaagacgttaacacagcatggaatctctatcaagagcttttggggcatgacattgtacctatgctcgaaaccctgaaagcattctttgactttggcaaggacatcaaagacgataactattctaataagcttcttgatatactgtcgtatctgaggaataaccaactgtaccccggggagtccttcgcacactcaatcaaaacctggtttgaatcgggacagtgttcaggttgtggcaagacaatcgaatcaatccaactcagtcctgaggaatatgagtgcctaaagggaaagatcatgagagacgtcatcgatggcggcgatcagtatcgcaagacaaccccccaagaactgaaacgctttgaaaactttatcaaatcacgccccccttttgacgtcgtgattgacggtctgaatgttgctaaaatgttccccaaggttcgcgagtctcaactcctgctcaatgtggtctcacagttggctaagcgcaaccttagacttctggtgctgggacggaaacacatgttgcgccggagctcccaatggagccgcgatgagatggaggaggttcaaaagcaggcaagttgtttcttcgcggatgatatctcagaagatgatcctttccttctgtacgctacgctccatagcggtaaccattgccggtttatcacacgggatttgatgcgcgaccacaaggcttgcctgcctgatgctaagactcagagactgttcttcaaatggcagcaaggccatcaacttgccatcgttaatagattcccaggtagtaagctaacatttcagcgcatcctgagctacgacacagtggtccaaactacgggtgacagctggcatattccctatgatgaagacctggtggaacgttgctcatgcgaagtgccaactaaatggctttgtcttcaccaaaagacttag

SEQ ID NO: 27824 - DNA, 1752 bp, Artificial Sequence
  Description of Artificial Sequence: Synthetic coding sequence
atgacattctatttgttcggtatcaggagttttcccaagctgtggaagagtccttacttgggccttggtcctggccattcttacgtctcactttttctggccgatcgatgcggcattcgtaaccaacagcggctgttcagcctcaagacaatgtcaccccaaaatactaaggcgaccaacctcattgctaaagcgaggtacctgaggaaggatgagggttccaacaaacaggtgtactctgtgcctcatttctttctggccggggctgccaaggaaaggtcccagatgaactcacagactgaggatcatgctctcgctcccgttcgcaacactatacagctgcctacccagccgctgaattctgaggaatgggacaagttgaaggaagatctgaaggaaaacacaggaaaaactagttttgagagctggattatatcacagatggctggctgccacagctcaatcgatgtggctaaatctcttttggcctgggtggctgcaaaaaataatggtatcgtaagttacgacctactggtcaagtacctctacctctgtgtctttcacatgcagactagcgaggtgatcgacgttttcgagatcatgaaagcaaggtataaaaccctggaaccaagaggctattcattgctcattcgaggactcattcatagcgacagatggagggaggcactgctcctgctggaagacataaaaaaggtcatcactcccagcaagaaaaattataatgattgcatccagggggccctcctacaccaggacgtgaacaccgcttggaacctttatcaagaactacttggccacgatatcgtccccatgctcgagactctgaaggcattctttgatttcggcaaggatatcaaagacgacaactattcgaacaagctgcttgatatcctgagctatctccgcaacaatcaactctacccaggagagtcttttgctcactccatcaagacatggttcgaatctgttcccggcaaacaatggaagggacagtttacgaccgttagaaagtccggacagtgttcgggatgtggcaaaacaattgaatctattcagctttctcctgaagagtacgagtgtttgaagggcaaaatcatgagagacgtgatcgatgggggggaccagtataggaaaactacaccccaggagctgaagaggtttgagaacttcattaaaagtcggccacccttcgacgttgttatcgatggccttaacgttgcaaagatgtttccgaaagtccgtgaaagccaactgcttctaaatgttgtgtcacagttggccaaacggaacctgcgcctgctggtgctagggaggaaacacatgctccgaagatcttcccagtggagcagggatgagatggaagaggttcagaagcaggcatcttgcttttttgctgatgacatttctgaagatgacccctttttactgtacgctaccctccattctggtaatcattgccgcttcattactcgcgatctgatgcgcgaccataaggcgtgtctgcctgatgccaaaactcagcgcctgtttttcaagtggcagcaggggcaccagcttgctatcgtgaacaggttccccggcagcaagctcacgttccagcggattctttcatatgatacggtggttcagacaactggggattcgtggcacattccctatgacgaggatttggtggaaagatgttcatgcgaggtccccaccaaatggctgtgtctccaccagaagacgtag

SEQ ID NO: 27825 - DNA, 105 bp, Artificial Sequence
  Description of Artificial Sequence: Synthetic coding sequence
atgaccttctatctatttggcattagaagtttcccaaaactctggaagtctccatatttgggcctgggccctgggcattcttacgtgagcttgttcctagcatag

SEQ ID NO: 27826 - DNA, 63 bp, Artificial Sequence
  Description of Artificial Sequence: Synthetic coding sequence
atgaccttttatctattcggcataaggtcgttccccaagctgtggaagagtccatacctttag

SEQ ID NO: 27827 - DNA, 1467 bp, Artificial Sequence
  Description of Artificial Sequence: Synthetic coding sequence
atgaactctcagacagaagatcacgcccttgcgcccgttagaaatactatccagctgcccactcagcccttaaattccgaggagtgggacaagttaaaggaagacctgaaagagaacactggcaaaacctcttttgagagttggattatatcccaaatggcgggatgtcacagcagcatagacgtagctaaatcacttttagcttgggttgccgctaaaaataatggcattgtttcttatgatttacttgtgaaatatttgtacctgtgcgtttttcacatgcaaacctcagaggtgatcgatgtctttgaaattatgaaagctaggtacaagaccttggagccaaggggctacagtctgcttatccgcgggctaatccattctgatcggtggcgtgaagccctgcttttgttggaggacattaagaaagtaataacccccagcaagaagaactataatgattgcatacagggcgccctcctccatcaggacgtgaataccgcttggaatctgtatcaggaactgctggggcatgatatcgtaccaatgttggagacacttaaagcctttttcgacttcggcaaggacatcaaagacgataattatagtaacaaattgctcgacatcttgagctatctcaggaataaccagctgtaccctggcgagtccttcgcccacagcatcaaaacctggttcgagagcgtgcccgggaagcagtggaaaggtcaatttacaactgtgagaaaatctggccagtgttcaggttgcggcaagacaatcgaatccatccagctgagtccggaggagtacgaatgcctgaagggaaagattatgcgcgacgtaatcgacgggggagatcagtatcgcaagactactccccaggaactgaaacgcttcgaaaactttatcaaatccaggcctccttttgatgtagttatcgatgggttaaatgtcgccaagatgtttcccaaggtgcgcgaaagtcaactgctcctgaacgtagtgtctcagctggcaaaaagaaaccttcgtctgctcgtccttgggagaaagcacatgctgcgccggagttcccagtggagccgcgatgaaatggaagaggtacaaaagcaggctagctgcttttttgcagacgacatcagtgaagatgacccatttctactgtatgccaccctccactcaggaaatcactgcaggttcatcactcgagatctcatgcgggatcacaaggcctgtctgcctgacgctaaaacccagaggctgttcttcaagtggcagcaggggcatcagttggctatcgtgaataggtttcccggatcaaagctgacgttccagagaattttatcgtacgacaccgtcgtacagacaactggagacagttggcacataccctatgacgaggacctggtggaaagatgctcatgtgaagtgccaaccaagtggctttgtctccaccaaaagacatag

SEQ ID NO: 27828 - DNA, 72 bp, Artificial Sequence
  Description of Artificial Sequence: Synthetic coding sequence
atgacattttacctcttcggtataagaagctttccaaagctgtggaagtcaccctacctcggcctgggttag

SEQ ID NO: 27829 - DNA, 1704 bp, Artificial Sequence
  Description of Artificial Sequence: Synthetic coding sequence
atgacgttctacctgtttggcatacggagcttccctaagctgtggaaatccccttatctcggccttggaccggggcatagctatgtttccttattcctagccgacaggtgcggaattcgaaatcagcagcggctgttttctctcaaaaccatgtcgcctcaaaataccaaagccacaaacctaattgctaaggcaaggtacctacgaaaagacgaggggagcaacaaacaggtctactccgtgccccacttttttctagccggcgctgcgaaggagaggtcacagatgaacagccaaactgaggatcacgcgctggctcctgtacggaataccatccagcttcctactcagcccctgaactccgaggagtgggacaaactgaaggaagatttgaaagagaacactggcaagacatccttcgaaagctggataatttcccagatggcaggctgtcattcatccatagatgttgcgaagagtctactggcctgggtggcggctaaaaataacgggatcgttagctatgatttgcttgtgaagtacctgtatctctgtgttttccacatgcagacctcagaagtgatcgacgttttcgagattatgaaggcaagatacaaaactttggaaccccgggggtacagtctcctgatacgcggactcatacattctgataggtggagggaagccctgctcttactggaggacatcaaaaaagtgattacacctagtaagaagaactacaatgattgtatccagggggctctacttcatcaggacgtgaacactgcatggaacctttaccaggagctgttggggcacgatatagtcccaatgctcgagactctgaaggctttcttcgatttcggtaaggacatcaaagacgataactacagcaataagctgcttgacatcctctcctatctgaggaataaccagctttaccccggcgagtcgttcgcccacagcattaaaacttggtttgagtctgggcagtgctccgggtgcggcaagactatcgagagtattcaactcagtcccgaagagtacgaatgtctaaaaggcaaaatcatgagagatgtgatcgacggaggagaccagtacagaaagaccacaccacaggagcttaagcgtttcgagaacttcatcaagagtagaccaccctttgacgttgttatagacggccttaatgtggcaaagatgtttcccaaggtgagagagtcccagctgcttttgaacgtcgtatcgcaattagccaagcggaatctgagactcttagtgctgggaagaaagcatatgcttcgaaggtcttctcagtggtccagagacgaaatggaggaggttcaaaaacaggcttcctgtttctttgctgatgacatttctgaagatgatccctttctgctgtatgcaaccctgcattccgggaaccattgcagatttataacacgggatctaatgcgcgatcataaagcatgccttcccgatgccaaaacccagcgcctgtttttcaagtggcaacagggacatcagctcgccatagttaatcggtttccaggaagcaaattgacattccagagaattctgtcctatgacacagtggtgcagacaacgggcgatagctggcatatcccatatgatgaggatctcgtcgaacgctgctcatgtgaggtgcccacaaagtggctatgtctgcaccagaagacttag

SEQ ID NO: 27830 - DNA, 636 bp, Artificial Sequence
  Description of Artificial Sequence: Synthetic coding sequence
atgcgtgatgtgattgacggcggggaccagtatcgcaagactacaccccaggagcttaagagatttgaaaacttcataaagagcaggcctccttttgatgtggtgatcgatggcctcaatgtggccaaaatgttccctaaagtaagggagagtcagctgctgttgaatgtggtgtcacaactcgccaagagaaacctgagactcctggttctcggcagaaaacatatgctccggagaagcagccagtggtctagagatgagatggaggaggttcaaaaacaggcttcctgttttttcgctgacgacattagcgaagatgatccctttttgctttacgctactctacacagcggcaaccactgtcgcttcatcacacgggacctgatgcgggaccataaggcatgcctccccgacgcgaagacccagagactgttctttaagtggcaacagggacatcagttggcaatcgtaaaccgcttccccgggagcaaacttacattccagagaattttatcttacgatactgtggtgcaaactactggcgatagctggcacatcccatatgacgaggacctggtagagcgctgttcctgtgaggtcccaaccaagtggttgtgtctgcaccagaagacgtag

SEQ ID NO: 27831 - DNA, 633 bp, Artificial Sequence
  Description of Artificial Sequence: Synthetic coding sequence
atggcgctgggccttaaatgcttcaggatggtacacccaacattccgcaattacctagccgcttcaattcggcctgtgtccgaggtgacactgaagactgtgcacgaacggcagcacggccaccggcagtatatggcatacagcgccgtccccgtgaggcacttcgcaactaaaaaagccaagggcagccttgacaagatcgccgttgtcacggccgacgggaaactggcattaaaccagatttctcagatatcaatgaagtccccccagctgatcttagtgaacatggccagcttcccggaatgtactgccgctgcaattaaagccatccgcgaatccgggatgaacctgaatccagaggtcgagggcactctgatcagagtccctattccacaggtgacccgggagcaccgcgaaatgctcgtcaagttggctaagcagaacacgaataaggccaaggatagtctgaggaaggtgcgcaccaactccatgaacaaactcaaaaaatccaaagataccgtgagtgaggacacaattcgtcttatagagaaacaaatcagccagatggcagacgacacagtggccgaattagacaggcacctcgccgtgaagaccaaagagctactgggctag

SEQ ID NO: 27832 - DNA, 789 bp, Artificial Sequence
  Description of Artificial Sequence: Synthetic coding sequence
atggcgttgggacttaaatgttttagaatggtgcaccctactttccgaaactatctggccgctagcatacgtccagtgtctgaggtcacactcaaaaccgtgcacgaaagacaacatggccataggcagtatatggcttactccgctgttccggtccgtcatttcgcaaccaagaaagctaaagcaaagggcaagggacagtcgcagacaagagtgaacataaatgctgcactggttgaggatattatcaacctcgaggaggtgaacgaagagatgaagagcgtgattgaggccctgaaggacaattttaacaagaccctgaatattagaacaagtccaggatctctggacaaaatcgccgtggtgacggcagacggtaaactggccttgaaccaaatctctcaaatttctatgaagtcgccccagctcatactagtcaacatggcgtcctttccagaatgcacagctgcagctattaaagccatacgggagtctggtatgaatttaaaccctgaagtggaaggtacactgatcagagtgcctatcccccaggtgacaagggagcaccgggaaatgttggtgaagttggctaaacagaatacgaacaaggctaaggatagccttaggaaagtcagaactaactcaatgaataaactgaaaaagtctaaagacaccgtttctgaggataccattagactaatcgaaaagcagatcagccaaatggccgacgatacagtggcagagcttgatcgccatttggccgtgaaaactaaagaactcctgggctag

SEQ ID NO: 27833 - DNA, 606 bp, Artificial Sequence
  Description of Artificial Sequence: Synthetic coding sequence
atggctctaggacttaagtgtttcaggatggtccaccccaccttcagaaattacttagcggcctctattagaccagtatctgaggtcaccctgaagactgtacacgagagacagcacgggcatcgacaatacatggcctattccgcagtgccagtgcgacactttgctacaaaaaaagcaaaggccaagggcaaaggccaatcccagacccgggtcaatataaacgcagcgcttgttgaagatatcattaatcttgaggaggtcaatgaagagatgaagtcagtgatagaagctctgaaggataatttcaataaaaccctcaacataagaacatctccaggcagcctagataagatagccgttgtaaccgccgatggcaaactcgctctcaatcagatcagccagatctccatgaaatctccccagctgatccttgtgaatatggcatcctttcccgagtgtacagcagccgcaattaaagccattcgcgagtccggcatgaacttgaacccagaagtcgaagggacacttatccgtgttcccatccctcaaagcgccaaatggcctatgacgcaatggcagaactggactggaatatggcaatag

SEQ ID NO: 27834 - DNA, 375 bp, Artificial Sequence
  Description of Artificial Sequence: Synthetic coding sequence
atggcatactcagccgtgccagttagacactttgccacaaagaaggcgaaagccaagggcaaaggccagtcccagaccagggtcaacatcaatgccgcactggtcgaagacatcattaacttggaggaggtgaacgaggagatgaagtcagttattgaggccctgaaggataatttcaacaaaacgctcaacattcgcacatcacctggaagcttggacaaaattgcagtcgttacagccgatggcaagctcgcgctgaatcagatcagccagatcagcatgaagagtccccagctcattctcgttaatatggcttcctttcctgaaaccatgaagcagatcaaacaatatttcaatggccctaacgtggcgtag

SEQ ID NO: 27835 - DNA, 477 bp, Artificial Sequence
  Description of Artificial Sequence: Synthetic coding sequence
atggctctcggccttaaatgtttccgaatggttcacccgacttttagaaattacctggctgcaagtatacgtcccgtttccgaagtgaccctcaagacagtgcatgagagacagcacggccataggcaatacatggcttactctgctgtgcccgtgcgacacttcgcaacaaagaaggctaaagctaaggggaaaggtcagtcccaaactcgagtgaacatcaacgcagcgctcgtggaggatatcattaatctcgaggaagtgaatgaggaaatgaaaagtgtgatcgaggcactaaaagataacttcaacaagacactcaatattcgcacatcccctggatccttggacaagattgccgtggtgactgcagatggtaagctcgccctgaaccagatatcacaaatttccatgaagtctccacagctgattctggtgaacatggcctcttttcccgaagtgcgctggccctgctag

SEQ ID NO: 27836 - DNA, 477 bp, Artificial Sequence
  Description of Artificial Sequence: Synthetic coding sequence
atggccctaggcctgaaatgttttcggatggtgcaccctacattccggaactatctggccgctagtatcaggcctgtctccgaagtgacacttaagaccgtccacgaaaggcagcatgggcacaggcagtacatggcctactccgctgtgccagtgcgccattttgcaacaaagaaagcgaaagccaagggaaagggtcaaagtcagacccgggtgaacattaacgcagccttagtggaggatattattaacctcgaggaggtaaatgaggaaatgaagtctgttattgaagctctgaaggataattttaataagacccttaatatcaggacgagtccagggagcctggacaagattgccgtggtcactgcagatggtaagctcgccttaaaccagatcagccaaatatctatgaaatcaccgcagctcatcctggtgaatatggcgtcattcccagaagtgcggtggccctgctag

SEQ ID NO: 27837 - DNA, 657 bp, Artificial Sequence
  Description of Artificial Sequence: Synthetic coding sequence
atggcctattctgcagtccccgtgcggcatttcgccactaaaaaagcaaaagccaagggtaagggccagtcccagacccgggtcaacatcaacgctgctctggtggaggatattataaatctcgaagaagttaacgaggagatgaaatcggtgattgaagctttgaaggataattttaacaaaacgttaaacattcgcaccagccctggctctctggacaaaattgccgtggtcaccgcagatggcaaattggcccttaaccagattagtcagatttcgatgaagagcccacagttgatcttggtgaatatggcttcctttccggagtgcacagccgctgctatcaaagccattcgcgagagcggtatgaatctgaaccctgaggttgaaggaacgctcattcgagtgcccatcccacaggtgacccgcgagcacagggagatgttggttaagctggccaaacaaaacaccaacaaggcaaaagattctttacgaaaggtaagaacaaacagcatgaacaagctgaaaaagagcaaggacactgtatctgaagatactatcagactgatagaaaagcaaatctcgcagatggccgatgacacagtagcagagctggaccggcatttggctgtgaaaaccaaagaactccttggatag

SEQ ID NO: 27838 - DNA, 531 bp, Artificial Sequence
  Description of Artificial Sequence: Synthetic coding sequence
atggcgctcggactcaagtgttttcggatggtacatcccacatttcggaattatctcgccgcaagtattaggcccgttagcgaggtgacgctcaagaccgtgcatgaacgacagcatgggcatagacagtatatggcttactccgcggtgcccgtacgccattttgccaccaagaaagccaaagcaaagggcaaaggccagtcccaaacccgggtgaatataaacgcggccttagtcgaagacatcataaacctggaagaagtcaatgaggagatgaaaagtgtcatcgaggcgctgaaggataattttaataagactctcaacatacggacctcaccagggtccctcgacaagattgcagtggtgaccgcagatggcaagctggccctcaatcaaatctctcaaatctcaatgaagagtccacaactcatcctggttaatatggcgtccttcccagaggagcttgcctggatcagatccctgcgcgtgcctgggatcagaagtcatttgtatcaccagctggccgtttag

SEQ ID NO: 27839 - DNA, 606 bp, Artificial Sequence
  Description of Artificial Sequence: Synthetic coding sequence
atggccctaggcttgaagtgttttcgcatggtccaccccactttcagaaactatctggccgccagcattaggccggtctctgaggtgactcttaagaccgtgcatgagcgccagcacggtcacaggcaatacatggcatattcggctgtgccagtaaggcacttcgcgaccaagaaggcaaaagccaaggggaaggggcagtcccaaacaagagtcaatatcaacgccgctttggtcgaagacattataaatctggaagaagtgaatgaagagatgaagtctgtgatagaagccctaaaagataacttcaataaaacactaaatattcgtacaagtcccggctccttggacaagatagcagttgtgactgcagacggcaaactggctttgaaccaaatttcccaaatttccatgaaaagccctcagctgattctggtgaacatggcctcattccctgagtgcactgccgctgccataaaagctatcagggaatcaggaatgaacctgaatcctgaggtcgagggcactttaatcagagtcccaatccctcagagcgccaagtggccaatgacccagtggcagaactggaccggaatttggcagtag

SEQ ID NO: 27840 - DNA, 462 bp, Artificial Sequence
  Description of Artificial Sequence: Synthetic coding sequence
atggccctggggttaaagtgctttcgcatggtgcaccccacgtttcgcaactatcttgccgcttccatcaggccagtaagtgaggtgactctaaaaaccgtccatgagcgtcagcatgggcaccgacagtatatggcatattctgcagtgcctgtgagacattttgctacaaaaaaagctaaagctaaaggaaagggacaatcccaaacgcgcgtgaatattaacgccgctctggtggaggacattatcaatttggaggaagttaatgaggagatgaagtcggtcatcgaggcactaaaggacaacttcaacaagactcttaacatcaggacatcacccgggtcactagataaaatcgcagtggtgacagcagacggcaagttggctctgaaccaaatctcccagatcagtatgaagtcccctcaactgatcctggtgaatatggcctccttccccgaatag

SEQ ID NO: 27841 - DNA, 507 bp, Artificial Sequence
  Description of Artificial Sequence: Synthetic coding sequence
atggctctaggactgaagtgcttcaggatggttcatcctacgtttagaaattacctcgccgcctccattaggccggtcagtgaagtaactctgaagactgttcacgagcgacagcacgggcatcgacagtacatggcatattctgccgtacccgttagacacttcgccaccaaaaaagctaaagctaagggtaaagggcagtctcaaaccagggtgaacatcaacgcagccctcgttgaagacatcatcaaccttgaggaagtgaacgaggaaatgaagagcgtgattgaagcccttaaagataacttcaataagaccttaaacatcaggacgtcccctggcagtctcgacaagatcgccgtggtgaccgccgatggaaaactcgcactgaaccagattagccagatttctatgaagtccccacagttaattctagttaacatggcatcctttcctgaaacaatgaaacagattaagcagtattttaacggtccaaacgtagcctag

SEQ ID NO: 27842 - DNA, 1062 bp, Artificial Sequence
  Description of Artificial Sequence: Synthetic coding sequence
atggcgcttctcagcactgtccggggtgccacctggggccgacttgtgactcgtcatttctcccatgccgcgaggcatggagaacgccccggcggggaggagctgtcaaggctgcttctggacgacctggtgcctaccagccgtctcgaacttcttttcggtatgaccccttgtctgctggcccttcaagctgctagacgtagcgttgcccggcttctactgcaagcaggcaaggcagggctgcagggtaaaagagctgagctcctgaggatggctgaggccagagacattcccgtactgcgcccgcgtcggcagaagctggacaccatgtgcagataccaggtccatcagggagtgtgtatggaggtgagccctctccgacccagaccttggcgagaggctggggaggcctcacccggggacgatcctcagcagctgtggctcgtgcttgacggcatccaggacccaaggaatttcggggccgtcctgcgcagcgcacactttctcggggtggacaaagtaatcacgtccaggcgcaactcttgcccactgacacccgttgtgagcaaaagctccgccggtgctatggaggtcatggacgttttttctactgacgatctgaccggtttcctccagaccaaggcccaacaaggctggctcgtggcaggcacagtcggctgcccatctacagaggatccccagagttctgagattcctattatgagttgcctggagttcctctgggaacgaccgacattgctagtcttgggcaatgaaggctcaggactgtcacaggaggttcaggcgtcctgccaactgctgctgacaattctgcccagacgccagttgcctcctggactagagagcctgaacgtcagtgtggcggctggtatcctgctccattccatctgctcccaaaggaagggcttccctaccgagggcgagcggcgacagttgctgcaggatccccaggagccaagcgctaggagcgaaggcctgtccatggcacagcatcccggcctctcttctggccctgaaaaggagcggcagaatgaaggctag

SEQ ID NO: 27843 - DNA, 837 bp, Artificial Sequence
  Description of Artificial Sequence: Synthetic coding sequence
atggccgctttattcttgaagaggctcacgcttcagaccgtcaaaagtgaaaactcttgtatccgctgcttcggtaaacatatccttcagaagactgcccctgctcaactgtcacccatcgcttctgctccccgactgtcctttctgatccatgccaaggccttttcgaccgcagaagacacccagaatgaaggaaagaaaaccaaaaagaacaagacagcattttctaatgttggcaggaagatttcacaaagagtcatccacctattcgacgagaaagggaatgacttaggcaatatgcacagagctaacgtgatacggctaatggacgagagagacctgcgcctggtgcagagaaacacaagtacagagcccgcggagtaccagttaatgacgggtctgcaaattctgcaggagaggcagcgtctccgtgagatggagaaagccaaccccaaaaccggccccacccttagaaaagaactaatattaagtagcaatataggccagcacgacttagatacaaaaacgaagcagatccagcagtggatcaagaagaagcacttggtgcagatcaccattaagaagggtaagaacgtggatgtgtcagaaaacgaaatggaagaaatttttcaccaaatcttgcagacgatgcccggtattgcgacattctccagccggccgcaggccgtgcagggtgggaaggctttgatgtgcgtcctaagagcttttagtaagaacgaggagaaggcttataaggagacccaggagacacaggagagggacacactcaataaagaccacggtaacgataaagaaagcaatgtgttgcaccaatag

SEQ ID NO: 27844 - DNA, 837 bp, Artificial Sequence
  Description of Artificial Sequence: Synthetic coding sequence
atggctgctctctttctcaaacgactgacgctccagaccgttaagagtgagaacagttgcattagatgttttggtaaacacattcttcaaaaaacggcccctgcccagctctctcccatcgccagcgctccccggttaagttttctgatccacgccaaggcgtttagcaccgctgaagacacccagaacgagggcaagaaaactaagaaaaacaagacagccttcagcaatgtgggccggaaaatttcccaaagggtcatacacctgtttgatgagaaggggaacgatctcggcaatatgcacagggccaacgtgattcgactcatggatgagagggacctcagattggtgcagcgaaatacaagtacagagccagccgagtaccaactgatgaccgggctgcagatactgcaggaacgtcagcgactgagggagatggagaaagccaaccctaaaaccggccctaccttgcgaaaagaattgatcctctcaagcaacatcggacagcacgacttggacaccaagaccaagcagatccaacagtggatcaaaaagaagcacttagttcaaataacaatcaagaagggtaagaatgtggacgtgtcagagaacgaaatggaggaaatctttcatcaaatcttgcagactatgccaggtattgccacatttagttctcggccacaggccgtgcagggtggaaaggccctgatgtgcgtcttaagggccttcagcaagaacgaagagaaagcctacaaggagactcaggagacccaagagcgggacacacttaacaaagatcacggcaatgacaaggaaagtaacgtcctccatcagtag

SEQ ID NO: 27845 - DNA, 837 bp, Artificial Sequence
  Description of Artificial Sequence: Synthetic coding sequence
atggcggccctgttcttgaagaggttgacattgcagaccgtgaagtccgaaaactcttgcattcgctgtttcgggaagcacattttacaaaagaccgcgcctgcccaactgtctcccattgctagcgccccacgcttgagttttctcattcacgctaaagccttcagcacggctgaggacacccagaacgagggcaagaagaccaaaaaaaataaaacagcttttagcaacgtgggacgcaaaatcagtcaacgcgtcattcacctgtttgatgagaagggtaacgaccttggaaatatgcaccgtgctaacgtcatccgactaatggacgagagggatctgcgcttagtgcagcgcaatacctcaactgagccggccgaatatcagttgatgactggactgcagatactccaggagcggcagcggcttagggaaatggaaaaagctaaccccaaaaccggccccaccctaagaaaagagctcattctgtcaagcaacatcgggcaacatgacctcgatactaagacgaaacagatccagcagtggatcaagaagaagcatctggtgcaaataaccatcaaaaaagggaagaacgtagatgtcagcgagaacgaaatggaagagatattccatcaaattttgcagactatgccaggcatagccacattcagctctaggccgcaggccgtccaggggggtaaagctctcatgtgtgtgctgcgcgccttctccaagaacgaggaaaaggcatacaaagaaacccaggaaacccaggagagggatactctcaacaaggaccacggaaatgacaaagaaagtaacgttctgcaccagtag

SEQ ID NO: 27846 - DNA, 837 bp, Artificial Sequence
  Description of Artificial Sequence: Synthetic coding sequence
atggcagctttattcctcaaacgcttaactctgcagaccgtgaagtccgagaatagctgtattcggtgttttgggaaacatatactgcagaaaacagctccagctcagttatcccctatagcaagcgccccacgattgtcgttcctgattcatgccaaagcttttagtaccgctgaagacactcagaatgaagggaagaagacaaagaagaataagactgctttctctaacgtcgggcgcaagatttcccaacgtgtgatccatctgtttgacgaaaaaggtaatgaccttggcaacatgcatcgcgccaatgttatccggctgatggacgaacgcgacctcagattggtacaacggaacacgtctactgaacccgcagaataccaactgatgacaggtcttcagattcttcaggagcggcagcggctacgtgagatggaaaaggccaacccaaagaccggaccaactctcagaaaggaactgatcctcagtagcaacattggacaacacgacctcgacacaaagacaaagcaaatccagcagtggatcaagaaaaagcaccttgtacagattaccattaagaagggcaagaacgtggacgtaagcgagaatgaaatggaagagatctttcatcagatactgcagacaatgcccgggatcgcgacattttcttctagaccccaggcggtgcagggcgggaaagctctgatgtgcgtgctcagagccttttccaaaaatgaagaaaaggcatataaggagacacaggaaacacaggaaagagacacattaaataaagatcacggcaacgataaggaatcaaatgtgctgcatcagtag

SEQ ID NO: 27847 - DNA, 681 bp, Artificial Sequence
  Description of Artificial Sequence: Synthetic coding sequence
atgaacgagaacctttttgcctcgtttatcgcacctacgatccttggcctgcccgctgcagtgctcattattttattccctccactcctgatacctacaagcaagtacctcatcaataaccggctcattacaacccaacagtggctcatcaagctgacatcaaagcagatgatgacaatgcacaataccaaaggtcgtacgtggtcgctgatgctcgtaagcttgatcatcttcattgcaacgacaaatcttctgggccttttaccacattcttttacacccacgacccagctgagcatgaacttggcaatggccatcccattatgggcaggtacggtcattatggggtttcgatcaaagataaaaaacgctttagcacactttctgccgcagggcaccccgacacctctgattcctatgctggtgattattgagaccataagcctcttgatacagccaatggctctggctgtccgtcttacagccaacattaccgcaggacacctgttgatgcacctgatcggtagcgccactctcgctatgtctaccataaatctcccttctactttaattatattcactatattaatcctgctgacaattttagagatagctgtcgcgctgatacaagcctacgtttttaccttgctggttagcctatatcttcatgataacacttag

SEQ ID NO: 27848 - DNA, 1143 bp, Artificial Sequence
  Description of Artificial Sequence: Synthetic coding sequence
atgacccctatgagaaagaccaatcccctgatgaaactaatcaaccacagctttatcgatttgcctactcccagtaacatttccgcatggtggaattttggctctctgctaggcgcatgcctgatcctgcaaattaccacaggcttatttctggccatgcactactcacctgatgcatctacagccttcagctccatcgctcacatcactcgcgacgtgaattacggttggattatcagatacttacatgccaatggggcctcaatgttttttatatgcttattcctgcatattggcagaggcctttactatgggtccttcctgtactctgagacctggaatatagggattattctactgctggccaccatggccaccgcatttatggggtacgtcctgccctggggacagatgagcttctggggtgctactgtcattactaacttactgagcgccatcccgtacataggaactgacctggttcaatggatctgggggggctattcagtggatagcccaactctcactcggttttttacatttcattttatcctgccattcattatcgcagctcttgcgaccctgcacctgttattcctgcacgagactggaagtaacaacccgttgggcattacttcacactctgacaagatcactttccacccttattatacaatcaaagatgctttgggtctgcttctgttcttattatctctgatgactctgaccctgttctcacctgacctcctaggtgacccagacaattacaccctcgccaaccccctgaacaccccccctcacattaaacccgagtggtattttctgttcgcctataccatccttcggtcagtgccaaataaattaggtggagtcttggctctgctcctgtccatccttatcctagcaatgattcccatcttacacatgtcaaagcaacagagcatgatgttccggcccctgagccagagtttatattggctgctggcggccgatctcttgattctgacatggatcggcgggcagcctgttagctatcctttcaccatcattggtcaggtggccagcgtattatatttcacaacaatcctcatcctgatgcctaccatttctcttatagaaaacaagatgctgaagtgggcatag

SEQ ID NO: 27849 - DNA, 1542 bp, Artificial Sequence
  Description of Artificial Sequence: Synthetic coding sequence
atgtttgcagacaggtggcttttttccactaatcacaaggacattgggacactgtacttactgttcggcgcttgggcaggcgtcctcggcacggcactgtcactgctgatcagggcagaactggggcagccaggcaacctactaggcaacgaccatatatacaatgtgattgtcaccgcccacgcattcgtgatgatattctttatggtcatgcccatcatgatcggaggctttggaaactggctggtacctttgatgatcggcgcaccagatatggcatttccaagaatgaacaatatgagcttttggcttctgccaccatcgcttttgcttctgctggcatctgcaatggtggaggctggagcgggaaccgggtggaccgtatatccccccctagccggtaactactctcatcctggcgcgagcgtcgatctgacaatcttctccttacacctcgccggcgtttctagtatacttggcgctataaacttcatcacaactatcattaacatgaagccacctgccatgacccagtaccagacgcccctgttcgtctggtccgtcctgatcacagcggtccttctacttctttcactgcctgttttggccgccggcatcactatgctcctgacagatcggaatttaaatactacgttctttgaccctgctggcggaggcgatcccatactatatcagcacctcttttggttctttggtcaccccgaggtgtacattctgattctacctggtttcggtatgatctcccatatcgtcacgtactacagcggcaagaaagagcccttcggttacatgggcatggtgtgggccatgatgtccatcggatttctcggctttatcgtgtgggcccaccatatgtttactgttggcatggatgtagatacgcgtgcttatttcacctcggcgacaatgattattgctatacctacgggagtgaaagttttcagctggctggccactctgcacggaagtaacatgaagtggtccgctgcagtactgtgggcgctggggttcatcttcctgtttactgttggagggctgacgggcattgtattggcaaatagcagcttggacatcgtgctgcatgatacctattacgtcgtggcccacttccactatgtgttgtctatgggcgctgtctttgctattatgggcggattcatccattggtttcccctgttcagtggctacacactggaccagacctatgctaagatccatttcacgatcatgttcataggcgtcaatctcaccttcttcccgcagcacttcctcggcctgtctggtatgccccgccgatactcagattaccccgacgcatacacaacgtggaacattctgagttctgtcggctcatttatctctctcaccgccgtgatgctgatgattttcatgatctgggaggcctttgcttcgaagcggaaggtgctaatggtagaagaacccagtatgaatttggaatggttgtacggatgtccacccccctaccacacttttgaggaaccagtatacatgaagagctag

SEQ ID NO: 27850 - DNA, 684 bp, Artificial Sequence
  Description of Artificial Sequence: Synthetic coding sequence
atggctcatgcggcccaggtgggcttgcaagacgcaacatctccaatcatggaggagctgatcacctttcacgaccacgcccttatgattatttttcttatttgctttctggtgctctacgccctgtttctgaccctcacgacaaagctgactaataccaacattagtgacgcacaggaaatggaaactgtatggactattttgccagccattattttggttctgatagccctgccctctttgagaatcctgtatatgacagatgaggttaacgaccctagcctcacaatcaagtcgattggacaccaatggtactggacctatgagtacacagattacggtggcctaatattcaattcctacatgctgcctcctctatttttagaaccgggagacctgagactcctcgatgttgataaccgcgtggtgctgcctatcgaggcccctatccggatgatgattacttctcaggacgtcctgcactcttgggcagtccccacgttgggactgaagaccgacgctattcctgggcggctgaaccaaacaacttttaccgctacacgtcctggagtgtactatgggcagtgctcggagatttgcggcgctaaccacagcttcatgccgatagtcttggagctgatccccctaaaaatatttgagatggggcccgtcttcactctatag

SEQ ID NO: 27851 - DNA, 786 bp, Artificial Sequence
  Description of Artificial Sequence: Synthetic coding sequence
atgacacaccaaagccatgcctatcacatggtcaagccatctccatggccacttactggggcgcttagcgctttactgatgaccagcggcctcgccatgtggtttcacttccatagtatgaccctgctgatgctgggactactgacaaacaccctgactatgtatcagtggtggagggatgtcacgcgggagtctacctaccagggccatcacacgccacctgtgcaaaagggactgcgctacgggatgatccttttcattaccagcgaggtgttttttttcgctggatttttttgggcattttatcacagctctctagcccctacaccccaacttggggggcattggcccccgacgggtatcactccgttaaacccactagaagtccctctgctgaatacatcagtactgctggccagcggcgtctctatcacttgggcccatcactctctgatggaaaacaacagaaaccagatgatccaagccctgctgatcaccatcctgttgggactttactttactttgttgcaggcttccgagtattttgaatccccatttaccatttcggacgggatatatgggagtacttttttcgtcgctacgggattccatgggctacatgttatcatcgggagcaccttcttgacaatttgttttattcgacagttgatgttccatttcacctctaagcatcattttggatttgaggcagccgcttggtattggcatttcgttgatgtcgtgtggttgttcctctacgtatcaatttattggtggggctcttag

SEQ ID NO: 27852 - DNA, 957 bp, Artificial Sequence
  Description of Artificial Sequence: Synthetic coding sequence
atgccaatggccaacctactcttgttgatcgtgccaatcctgatcgccatggcatttttaatgctcactgagagaaagatactaggctatatgcagctgcggaaaggtcccaatgtagtgggcccctatggcctgctccagccatttgcggatgcgatgaaattgtttacgaaagagcctctgaaaccagcaaccagcacaattacgctttacatcacagcccccactctggctttgaccatcgcccttctgctgtggacccccctccctatgccaaacccattagtcaaccttaaccttggcttactgttcatcctcgcgactagctcactggccgtttattcaatcttgtggtccggctgggctagcaatagcaactatgcgctaatcggagcgctgagagctgtcgctcagactatctcgtatgaggtcacattagccatcatcctcctctccaccctgttgatgtctggcagctttaacctcagtactctaataactacgcaggaacatctgtggctgctcctcccgtcctggcccctggctatgatgtggttcatatccacactggcagaaacaaacaggaccccgtttgaccttgcagagggagaatcagagctggtgagcggtttcaatattgaatatgcagccggcccgttcgccctcttctttatggccgagtacaccaacatcatcatgatgaacacccttacgaccacaattttcctgggaactacatatgatgcattatctcccgagttgtataccacttactttgtgacaaaaacacttctcctaaccagtctgtttctgtggatccgaacggcgtacccaaggtttaggtacgatcaactcatgcatctgctgtggaaaaactttttgccactgacacttgccctgctcatgtggtacgtgtctatgccgatcacaatttcctccattccccctcagacctag

SEQ ID NO: 27853 - DNA, 1044 bp, Artificial Sequence
  Description of Artificial Sequence: Synthetic coding sequence
attaacccacttgctcagccagtgatatattccactatcttcgctgggaccttaattacagcactatcatctcactggtttttcacatgggttgggctagagatgaacatgctcgcttttattcccgttctgactaaaaagatgaatccacgctccaccgaggctgccattaaatacttcctgacccaggcaaccgccagcatgatcttgcttatggcaattctgtttaataatatgctgtctgggcaatggactatgaccaataccacaaaccagtacagtagtttgatgattatgatggcgatggctatgaaactcggtatggcacctttccatttctgggtccctgaggtgacacaagggacccctctcacaagcgggcttcttttactaacatggcaaaaacttgcccccatctccataatgtatcaaattagcccgagtctgaatgtgtcactgttgctgaccctgagtattctgtccattatggctggcagctggggcggcctcaatcagacccagttgcgaaaaattctcgcctattcgagtatcacccacatgggttggatgatggctgtcctgccttataatccaaatatgacaatcttgaaccttacaatctatataatcctgaccacaacagcgtttctactgcttaacctcaatagttccacgaccaccctcctgctttcgcggacctggaataagctaacttggctgaccccactcattccttccaccttattgtctctcggaggcctgcccccactcactgggttcctcccaaagtgggcaatcatagaagagttcactaaaaacaactcccttatcatcccaacaataatggcgaccattacccttctgaatctctacttctacctcagacttatatattccacctcgatcactctgctgcctatgagcaacaatgtcaagatgaagtggcagttcgagcacaccaaacctacccccttcttacccacactgatagcgcttactacgctgctcctgcccatatctcctttcatgctcatgatcctctag

SEQ ID NO: 27854 - DNA, 348 bp, Artificial Sequence
  Description of Artificial Sequence: Synthetic coding sequence
atgaatttcgctctgatcctgatgattaacacactgctggccttgctcctaatgatcatcactttttggctccctcagctgaatggatatatggaaaaatcgaccccttacgaatgtggattcgaccctatgagtccagccagggttcccttttctatgaaattctttcttgtggccatcacgttcctcctgttcgatcttgaaatcgcgctccttcttcccctcccatgggcccttcagactaccaacctgcctctcatggttatgagttccctgcttctgattatcatattggccctctctctggcgtacgagtggcttcagaaaggcctggattggaccgagtag

SEQ ID NO: 27855 - DNA, 1380 bp, Artificial Sequence
  Description of Artificial Sequence: Synthetic coding sequence
atgctgaagctgatcgtgccaacaatcatgctgttgccactgacctggcttagtaaaaaacatatgatctggatcaacactacaactcacagcctgatcatctctataatccccttattgttcttcaaccagattaataacaatttattctcctgttcacccaccttttcctccgacccgctgacaacaccactgctgatgctcaccacttggctgctcccgctcaccattatggcctcgcaacgccatctgagcagcgagccattgtcccggaagaaactctacctatcaatgttgatttccctccagatatctctgatcatgactttcaccgctaccgaactgatcatgttctacattttttttgagactaccctgatccccacattggccataattacaagatgggggaaccagccagagcggctgaatgcagggacttactttctcttttacactcttgtgggatccttgccgctgctaatcgccttgatctacacacacaacaccctgggatcccttaatatcctgctcctcactctgactgcccaggagttgtccaactcatgggcgaacaatcttatgtggctggcttacacaatggctttcatggtcaaaatgccactttacggcttgcacctctggcttcctaaggcacacgtggaggctcctattgctggcagtatggtgctggcagccgttttgttgaaattgggtgggtatgggatgatgagactcacccttatcctgaatcccttaacgaagcatatggcctacccattcctcgtgctctccttatgggggatgatcatgacctcctctatttgcttgcggcagaccgatctgaagagtctcattgcctattcttcaatttctcacatggcactggttgtgactgctattcttatccagaccccatggtccttcaccggagccgtgatcctgatgatcgcccatgggctgaccagtagtttactgttctgcctcgccaatagcaattatgagcgaactcactcacgcattatgattctgtcccagggccttcagactctgctgcctcttatggcattttggtggttgctggccagcctggctaatctggccttgcctccaaccatcaacctcctgggggagttatcggtgttagtgacgacttttagttggagcaacatcactctgctgctgaccggcctcaacatgctagttactgccctgtacagcctatatatgttcacaacgacacagtggggatcacttacccaccatatcaacaatatgaaaccctcttttacgcgggaaaacactctgatgttcatgcatctttccccaatcctattactaagcctgaaccctgacattatcacaggcttcagctcttag

SEQ ID NO: 27856 - DNA, 297 bp, Artificial Sequence
  Description of Artificial Sequence: Synthetic coding sequence
atgcctcttatttacatgaacattatgttagccttcactatttctttactcggcatgctggtttatagatcccacctcatgtcttccctcttgtgtctagagggtatgatgctgtccctcttcattatggcaaccctgatgaccctgaatactcacagtttgttagccaatatagtcccaatcgccatgctagtattcgcagcttgcgaagcagctgtgggactcgctctgttagtgtcgatttccaatacctacgggctcgactacgtgcacaatctgaacctcctgcagtgctag

SEQ ID NO: 27857 - DNA, 1812 bp, Artificial Sequence
  Description of Artificial Sequence: Synthetic coding sequence
atgacaatgcataccactatgacaactctgacactgacgtcccttattccacccattctgacaactttagttaatcccaataagaaaaattcgtacccacactatgtcaagtccatcgttgcttccacctttattatttcactctttccgaccactatgtttatgtgtctagaccaggaggtcattatcagcaactggcactgggcaaccacccagacaacccagctatcactgtcatttaaacttgactacttctctatgatgtttatccctgtggcgttgttcgtgacttggtccatcatggagttttcactgtggtacatgaactccgatccgaacatcaatcagttctttaagtacttgttgatttttttaataaccatgcttattctagtgactgccaataacctttttcagctgttcattggttgggaaggcgtcggaatcatgtcttttttgctcatctcctggtggtacgcccgagccgacgctaacactgccgcaattcaggctatcctgtacaacaggatcggagacattgggtttatcctagccctggcctggtttatcctgcattccaacagttgggacccccagcagatggctctgttgaacgcaaacccctccttgacaccactgctggggttattgctggccgctgctggaaagtccgcccagttgggattgcatccttggctcccatcggctatggaaggaccaacgccagtgtcagccttgcttcattctagcacaatggttgtagctggcatctttctcctgatccgctttcaccccctcgccgagaacagcccattgattcagaccttaacattatgcctgggcgctatcactactctctttgctgcagtctgtgcattaacgcagaatgacattaagaagatcgtggcgtttagcacttccagccaacttggtctcatgatggtgacaatcggtatcaaccaaccccacctggcattccttcacatctgtacacatgccttctttaaagcaatgctatttatgtgcagcgggtccatcattcacaatctgaataatgagcaggatatccggaaaatggggggactattgaagaccatgccccttaccagtacaagtctaactatcggcagcttggctttagccggaatgcccttcctcactggcttttactctaaagatcacattatcgagactgccaatatgtcgtataccaatgcctgggcactgagtataaccctcatcgctactagcctgactagtgcgtatagtactcgcatgattctgttaacactaaccggccagcccaggtttcctaccctgaccaatatcaacgagaataacccaactcttctgaacccaattaaacgtctcgcggccggatccctcttcgccggtttcctaattaccaataatatcagtcccgcatctccctttcagaccaccatacctttatacctgaagctcacagcattagctgttacctttttgggcctactgactgctctagacctgaattatctaaccaacaagcttaaaatgaaaagtcctctctgcaccttttatttcagtaacatgttaggtttctatccttccatcactcaccggacgataccatacctggggctcctcacatcacagaatctgcccctgctacttcttgatctgacatggctggaaaagctgctcccaaaaacgatctctcagcaccagataagcacctcaattatcacaagtacccagaagggaatgatcaaactctactttctctctttcttttttcccctgatcctcaccttgctgttgatcacatag

SEQ ID NO: 27858 - DNA, 525 bp, Artificial Sequence
  Description of Artificial Sequence: Synthetic coding sequence
atgatgtatgcactgttcctgctaagtgtggggctggttatgggatttgtaggattcagctcaaaaccctcacccatctatggtggattagtcttaattgtatctggggtggtcgggtgcgttataatcttaaattttggaggcggatatatggggctgatggtgtttctcatctacctcggaggcatgatggtagtatttggctacaccacagcaatggctattgaggaatatccggaagcatgggggtcgggggtagaagtacttgtaagcgtattggtcggcctggccatggaggtaggactggtcctgtgggtaaaagaatacgacggggtcgttgtcgttgtaaactttaatagcgtagggtcctggatgatctatgagggagaaggctccggattgattcgggaggacccaataggggccggcgctctgtatgattatggacggtggttagtggtcgtgacaggatggactctctttgtcggagtttacatcgtgatcgagatcgcaagagggaactag

SEQ ID NO: 27859 - DNA, 2226 bp, Artificial Sequence
  Description of Artificial Sequence: Synthetic coding sequence
atggctgaaccagtcagcccactgaaacatttcgtgctggcgaagaaggctattacagccattttcgatcaactcttggaattcgtgaccgagggttcccattttgtggaagctacatacaagaaccctgagctggaccggatcgccactgaggacgacctggtggaaatgcagggatataaggataagctcagtataatcggggaggtgctgagccgtaggcacatgaaagtcgccttctttggtaggactagcagtgggaagagcagcgtgatcaatgccatgctgtgggataaagtactgcccagcggtattgggcacatcacaaattgttttctgagtgtcgaaggtacagatggagataaagcctatctgatgactgagggcagcgacgagaagaaatcagttaaaactgtcaatcaactggcacacgccctgcacatggataaggacctgaaagctgggtgcctcgtgcgcgtcttttggcccaaggcaaaatgtgcgctcctgcgcgatgatctcgtgttagtggatagccctggcaccgatgtcactactgaattggacagctggatcgacaaattttgtctcgatgcggatgttttcgtgttggtcgccaactctgagtctaccctaatgaacaccgaaaaacacttctttcataaagttaacgaaagactgtccaaaccaaacatcttcatcctgaacaacagatgggatgccagcgcttccgaacccgaatacatggaggatgtgaggagacagcacatggaacgatgcctccattttctcgtggaagaactgaaggttgttaacgcgttagaggcacagaaccgaatcttcttcgtcagtgccaaagaggtgttgtcagcccggaagcaaaaggcccaagggatgccggaaagtggcgtcgcgctcgccgaggggttccatgcaaggctgcaggagttccaaaactttgagcaaatctttgaggagtgcatcagccaatcagcagtgaaaactaagttcgaacagcacacaatacgcgccaagcaaattctggcaactgtaaagaacatcatggatagcgtaaatctggccgcagaggacaaaagacactacagtgtggaagagcgcgaagatcagatcgatcgcctggactttatcaggaaccagatgaatttgctaacgctggatgtgaaaaagaagatcaaggaggttactgaagaagtcgctaacaaggtgagctgtgccatgaccgacgagatttgccgactgtccgtgctggtcgacgaattttgtagtgaatttcatccaaatccagatgtccttaaaatttacaagagcgagctgaataagcatattgaggatggtatgggccgcaaccttgccgaccgctgcaccgatgaggtgaacgcactcgtcctgcagacacagcaagaaatcatcgaaaacttgaaacccttgttgcctgcaggtattcaagataaactgcacacactgatcccttgcaagaaatttgatctctcttacaatctaaactaccataaactttgcagtgacttccaggaggacatcgtgtttccattcagtcttgggtggtcatctctggtccatcgttttctgggtccccgcaacgcccagagagtgctgctggggctgtcggagccgatctttcaacttcctagatctctggccagtacaccaaccgctcctaccacgccggctaccccagataatgcttcacaagaggagttgatgatcaccctggtgactggtctagcttccgtgacatcacggacttccatggggataattatcgtgggtggtgtaatctggaagactattggctggaagctgttgtccgtatcacttaccatgtacggggccctgtatctttacgaaagactttcatggacaacccacgcaaaagagagggccttcaagcagcagtttgtgaattacgccaccgaaaagctaagaatgatcgtgtcttccacaagcgccaattgttcccaccaggtaaagcagcagattgccactaccttcgcccgcttgtgtcagcaggtggacattacccagaaacagctcgaagaagaaattgcccggctgcccaaagagatcgatcaacttgaaaagatccagaataactccaaactgctcaggaacaaagctgtgcagctagaaaatgagttagaaaattttaccaagcaattcctgccttccagtaacgaagaatcctag

SEQ ID NO: 27860 - DNA, 1893 bp, Artificial Sequence
  Description of Artificial Sequence: Synthetic coding sequence
atggccgagccagtctcaccacttaagcattttgtgctggcgaaaaaagcaatcaccgccattttcgaccagctccttgagttcgtcacagagggatcccactttgtcgaggcgacctacaaaaatcctgaactcgaccggatagccaccgaggacgacctagttgagatgcaagggtataaagataaactttcaatcattggggaagtgttgtctcgtcgtcacatgaaagtcgctttcttcggtagaacctcatccggcaagtcatccgtaattaacgcgatgttatgggataaagtgcttccatctggcatcggacacatcaccaattgctttctgtccgttgaagggaccgatggtgacaaagcctatctgatgaccgagggaagtgatgagaaaaagtctgtgaagaccgtgaatcaactggcgcatgccctccatatggataaggatctgaaggcagggtgtctggtgagggttttttggccgaaggccaagtgcgccctcctgcgggatgacctggtgcttgtggatagtcctggcaccgacgtgacaactgaactcgactcatggatcgacaaattctgcctcgatgcagatgtgttcgtgctggtggcgaactccgagtcgacacttatgaatactgaaaaacatttcttccacaaggttaacgagcgtctgtccaaaccaaatattttcatactgaacaaccgctgggacgcatcggccagcgaaccagagtacatggaggacgtacgtagacagcatatggaacgctgccttcattttctggtggaggaactgaaggtggtgaatgcacttgaggctcaaaatagaatctttttcgtcagcgccaaagaggtactgtctgcgaggaaacagaaggcgcaaggtatgcccgagtctggagttgctctggcggagggattccacgccagacttcaggagttccaaaacttcgagcagatctttgaggaatgcatcagccagtcagcggtgaagaccaagtttgaacagcacactattagagcaaagcagatcttggccactgtcaagaatataatggacagcgtgaatttggccgccgaggacaaacgtcactactccgtggaagagcgggaagatcagatcgacaggctggacttcattcggaatcagatgaacctgctgactttagacgtaaagaagaagatcaaagaggtcaccgaagaggtcgcgaataaggttagctgcgccatgaccgatgaaatctgtaggctgagcgttctcgtggacgagttttgtagtgagttccatccaaatcctgatgtgctgaaaatatacaagagcctccccagatctctggcctcaactccgacagctcctaccactcctgctacccccgacaatgcctctcaggaagaactcatgattacccttgtgaccggtctagctagcgttacttctcgcaccagtatgggaattatcatcgtgggaggcgttatctggaaaacgatcggatggaaacttttgagtgtatcactgacaatgtacggcgctctgtacctgtacgagaggctgagctggaccacccacgccaaagagcgtgcttttaagcagcagtttgtgaattacgccaccgaaaagcttaggatgattgtgtcatccactagtgcaaactgttcacaccaggttaaacagcaaatcgcaaccacatttgcgcgcctgtgtcagcaggtcgacattactcagaagcagcttgaggaggaaatagctaggctgccaaaggagattgatcagctggagaagatccagaataactcgaaactcctaagaaataaggccgtgcaactggaaaatgaattggaaaattttactaaacagttcctcccttcttctaatgaggagtcctag

SEQ ID NO: 27861 - DNA, 468 bp, Artificial Sequence
  Description of Artificial Sequence: Synthetic coding sequence
atggctgaaccagtgagtcccttgaaacatttcgtgctggctaaaaaggctattaccgcaatcttcgatcaactattggaattcgttactgaaggatcacattttgttgaagccacctataagaaccccgaactggatcgcatcgccaccgaggacgatttggttgagatgcagggctacaaggacaaattatcaatcatcggggaagttttatctcgacgccacatgaaagtggccttttttgggagaacctccagtggaaaatcttccgtcatcaacgccatgctctgggacaaagttttacctagcgggattgggcatatcacaaactgctttctgagcgtcgagggcacggacggtgataaagcgtacctgatgacagaggggtccgacgaaaaaaaatctgtcaagaccgttaatcaactggcgcatgccctacacatggacaaagatttaaaagcgggctag

SEQ ID NO: 27862 - DNA, 2226 bp, Artificial Sequence
  Description of Artificial Sequence: Synthetic coding sequence
atggcagaacccgtgtcaccactgaaacattttgtgctggccaagaaagccataacagccatctttgatcagctcctggagtttgtgactgaagggtcacacttcgtggaagccacctataaaaaccccgagctcgatagaatcgcaactgaagacgacctggtggaaatgcaggggtataaagataagctcagtattatcggagaggtgctgagtagaagacacatgaaggtggctttcttcggaaggacctcaagcgggaagtcctctgtaataaatgccatgctctgggataaagtcttaccgtctgggatcggccatattacaaattgttttctcagcgtggaagggaccgatggggacaaagcatatctaatgactgagggatctgacgagaaaaagtctgtaaagacagttaaccagctggcgcacgctctgcatatggataaagacctgaaggctggatgtctcgtgagagtgttctggcctaaggctaaatgcgcactcttaagggatgatctcgtgctcgtcgattctcctgggaccgatgtcactaccgagctggactcgtggattgataaattttgcctcgacgccgatgtgttcgtacttgtggctaattcagaatcaacgttgatgaacacagagaagcactttttccataaggtcaacgagcggttgagcaagcctaacatctttattttgaataatagatgggatgcttctgcctctgagccagagtatatggaggacgtgcgacgtcagcatatggagcgctgtttacatttcctggtggaggaactgaaggtcgtcaacgctttagaagcccagaaccgtatatttttcgtgtccgccaaagaggtgttgtcggcccgtaagcaaaaggcccaggggatgccagagtcgggagtggcgctggcagaaggttttcatgcacgactgcaagaattccaaaacttcgaacagatatttgaagaatgtatcagccaatcggctgtcaagacaaaatttgagcagcacactattcgtgctaaacagattctcgcgacggtgaagaacattatggactcagtcaatttggcggccgaagacaagcgccactatagcgtcgaagagcgggaggatcaaatagatcgtctcgattttatacgaaaccagatgaacctgctgacactagacgtaaagaagaaaatcaaggaggtgactgaagaggtggctaacaaggtgagctgtgccatgacagacgaaatttgtcggctgtcggtcctagtggatgagttttgctccgaattccaccccaatccagatgtgctaaaaatttacaagagcgagttgaacaagcacatcgaagatggaatgggcaggaatctggctgacagatgcacagatgaagttaacgccttagtgctccagacacagcaggagattatcgaaaacctcaagccgcttctgcctgcaggtatacaggacaagctgcacacactgataccgtgtaagaagttcgacttgagctacaatctcaactaccacaagctgtgctctgatttccaggaggatatcgtattcccattctctctggggtggagctctctggtgcatcggttcttaggaccccggaacgctcaacgcgtccttttaggtctgtccgagcctatctttcagctgccacggagcctggcctcaacccccactgctccaacgacccctgctactcccgataacgcctctcaggaagagcttatgattacactggtgaccggcctggctagcgtaacatcccggaccagcatggggatcataattgtggggggcgtgatctggaagactattggatggaagctgctgagcgtgtccctgacaatgtatggtgctctctacctgtacgagaggttgtcttggacgacccacgctaaggaaagagcgttcaagcagcagttcgttaactatgccaccgaaaagctgcgtatgatcgtgtcaagcacttccgcaaactgcagccaccaggttaaacagcagatcgcaaccacctttgcccggctttgccagcaggtcgatatcacgcagaagcagttggaggaagaaatcgcacgactgccaaaggaaatcgaccagctggagaaaatccagaacaactccaaacttctgcgcaataaggccgtgcaactggagaacgagctggaaaacttcaccaaacagtttctgccctcgagcaatgaggagtcatag

SEQ ID NO: 27863 - DNA, 1344 bp, Artificial Sequence
  Description of Artificial Sequence: Synthetic coding sequence
atggctgagcccgtgtctccccttaaacattttgtgctggccaaaaaagctataacggccatcttcgaccagctgcttgagttcgtgacagagggttcccattttgtggaggccacttacaaaaatcctgagctcgacagaattgcaaccgaagacgatctcgtagaaatgcagggctacaaggacaagttatcaatcataggcgaggttctgtcacggcggcacatgaaggtggcgttttttggcagaacttctagcggaaagtcctctgttatcaacgccatgctttgggataaggtgctcccttctggcatcgggcatataaccaactgcttcttgtccgtggagggaacagacggagacaaagcgtaccttatgaccgagggttccgacgaaaagaagtcagttaaaactgtaaatcagctcgctcacgcccttcatatggacaaggacctgaaggcagggtgcctggtgcgggtcttctggccaaaagccaagtgcgctctgctcagggacgatctagtcttagtcgattccccaggcacagacgtcactacagaacttgactcttggatagataaattctgtctggacgccgacgttttcgtgctcgtggctaactccgagagcactttgatgaacacggagaagcatttttttcataaagtgaacgagcggctttccaagcctaacatcttcatcctaaataacagatgggacgcaagtgcctccgaaccggaatacatggaagatgtccggcgccaacatatggagaggtgtctgcactttctggttgaagagctaaaggtagtcaatgctttggaggcccaaaataggatctttttcgtgtccgccaaggaagtccttagcgcaaggaagcagaaggcccaggggatgcccgagtcaggtgtcgccctggcggaaggcttccacgccagactccaggagttccagaacttcgagcagatatttgaggagtgcattagccagtccgctgttaaaacgaaattcgaacagcacaccatcagggctaaacaaattctcgccaccgtgaagaacatcatggacagcgtgaatttggcagctgaggataaaaggcattattctgtcgaggagcgggaagatcaaattgatcgcctggacttcataaggaatcagatgaacctgctcaccctagatgtcaagaaaaaaatcaaggaagtgaccgaggaagtagcgaacaaagttagctgtgccatgacggatgaaatctgtaggctgtccgtgctggtggatgagttctgctctgagttccacccaaatcctgacgtgcttaagatatacaagtccaaaaagaaaaagtag

SEQ ID NO: 27864 - DNA, 4011 bp, Artificial Sequence
  Description of Artificial Sequence: Synthetic coding sequence
atgatggaaatacagatggatgagggcggtggcgtggtggtttatcaggacgactattgttctggctcagttatgtctgagagggtgtcaggccttgccgggtctatatatagggagttcgagcggctgatccactgctatgatgaggaagtggtcaaggagctgatgccactcgtcgtgaatgtactggaaaacctggacagcgtgctcagcgaaaatcaggaacacgaagtggaactcgagttgctccgagaggacaacgaacaactgctaactcaatacgaaagggagaaagccctgcgtcgccaggccgaggagaaattcatcgagttcgaagatgcactagaacaggagaagaaggagttgcagatacaggtcgaacactacgagttccagaccagacagttggaattaaaggctaaaaactatgcagaccaaatctcacgcctggaagaaagggagtctgaaatgaaaaaagaatacaacgcactgcaccagaggcatactgagatgatccagacttacgtcgagcatatcgaacgctcaaaaatgcagcaggttggaggtaactctcagaccgaaagtagtcttccggggcggcgcaaagagagacccacatccctgaatgtgtttccccttgctgatggtactgtcagagcccagatcggcggtaagctcgtccctgccggtgaccattggcacttaagcgatctaggtcaactgcagtcctcttcaagttatcaatgtccgcaagatgagatgagtgaatctgggcagagcagtgccgcagcaaccccatcgacgaccggcactaaaagcaacactcctacgagcagcgtgcctagcgcagccgtgacaccactgaatgagagtctgcaacctctgggagattacggagtgggttctaagaacagcaagagagcaagagagaagcgggatagtcgaaacatggaggtgcaggtgactcaagaaatgcgcaacgtgtccatcggcatggggtcctctgacgaatggagcgacgtccaggatattatcgactccacccccgaattagacatgtgcccagagacacgtctggatagaaccggcagcagcccaacacagggaatcgtgaacaaggcctttggcataaataccgatagtctctaccacgaattgtccacagccggctcagaggtgattggggacgtggacgagggagccgatttgctgggggaattcagcgttagggacgatttttttggaatgggcaaggaggtgggaaacctgctcctcgaaaattcccaattgctagaaactaaaaatgcgttaaacgtcgttaaaaatgacctgatcgccaaggtggaccaactctccggcgaacaggaagttttaagaggagagctcgaggctgctaagcaggccaaagtgaaactagagaaccgaattaaagaactcgaggaagagctcaaaagagtgaagagcgaagcgatcatagctcggcgggaaccaaaggaggaagccgaggatgtcagcagttatctgtgtaccgagagtgacaagatccctatggcccagcggcgtcggttcaccagagtggaaatggcccgggtgctgatggagcgcaatcaatacaaggaacggttgatggaactccaggaggccgttagatggacagaaatgatccgcgcctctagggagcatcctagcgtgcaggaaaaaaaaaaatcaacaatctggcagttcttctcccggctcttctctagcagtagcagccccccgccggcgaaacggccgtaccctagcgtgaacattcattacaagtctccgactactgcaggtttctcacagcgccgtaaccacgccatgtgtcccatttccgctggttctcgcccattggagtttttccctgacgatgattgtactagttcagcacggagagaacagaaacgggagcaataccgccaggtgagggaacatgtgagaaatgatgacggccggttacaagcctgcgggtggagtctacccgcgaagtacaaacagctgtcccccaatggcggacaggaggacacaagaatgaagaatgtccctgttccggtgtattgtaggcccttggtggagaaggatcccactatgaaactctggtgtgccgcgggagtcaatctctccggttggaggccaaatgaggatgatgctggtaatggtgtcaagcccgccccaggccgggatcctctgacttgcgaccgggaaggggatggcgagcccaaatccgcacataccagtcccgagaagaagaaggcaaaggagcttcccgagatggatgccacttcatcacgggtctggatccttacaagcaccctgacaacaagtaaagtggtaattattgatgccaatcagcccgggaccgtcgtggaccagtttactgtgtgcaatgcacacgtgctgtgtatctcttcaatcccagctgcgtccgattccgactatccccccggggagatgtttctcgatagtgatgtaaaccctgaagaccctggcgctgacggagtgcttgccggaatcacattagtagggtgtgcgacgagatgcaacgtccccagatctaattgttcttctcggggcgacacccccgtcctcgataaagggcagggcgaggtggctacaattgcgaacggcaaggtcaatccaagtcaatccaccgaagaagcaacggaggccaccgaggttccagatcctggcccaagcgagcccgagacggccacactccggcctggacctctgacagagcacgttttcacagaccccgccccaacaccttctagtgggcctcagcctggcagcgagaacggtccagaaccagacagttcctcaacacgccccgagcccgaacccagtggggacccaactggcgcgggctcctcagccgcacctacgatgtggctgggagcccaaaacggctggctgtatgtccacagtgcagtggccaattggaaaaagtgcctgcacagcattaaactgaaggatagtgtgctgtctcttgtccatgtaaagggccgtgtgctcgtcgccttagccgacggcactttggccatattccaccgcggcgaggatggtcagtgggacctgagcaactatcacctgatggacctgggccatccccaccacagtatcagatgcatggctgtggtgtatgacagagtgtggtgtggatataaaaacaaagtccatgtcatccaacctaaaacaatgcagattgaaaaatcttttgacgcccatcccaggagggagtcacaagttcgtcagctggcctggatcggcgacggggtgtgggttagcatacggcttgactcgactctgcgtttgtatcacgcccacacccaccaacatctgcaggacgttgatatcgagccctatgtcagcaagatgctcggcactggtaaactgggattttcattcgtgcgcatcactgcattgctcgtcgcgggaagtaggctgtgggttgggacggggaatggggtcgtgattagtattccattgaccgagaccgtcgttctgcaccgtggccagctgctgggacttagagcaaacaagacttcaccgaccagcggcgaaggagcacgccctggaggaataattcacgtttatggcgacgattcttcagacagagctgcatcctcttttataccctattgcagtatggctcaagcccagctgtgttttcacggccaccgcgacgcggttaagttcttcgtctccgtgccaggcaacgtgttggccactctaaacggaagcgttctggactcacctgcggaagggcccgggcctgccgccccagcatctgaagtggagggccagaaattgcggaatgtgttggtactgagcggcggtgaaggctatatagatttcagaatcggtgatggtgaggacgacgaaacggaggagggcgcaggagacatgagccaggtcaaaccagtcctctcgaaggcagaaagaagccatattattgtgtggcaggtgagctacacgcctgaatag

SEQ ID NO: 27865 - DNA, 3993 bp, Artificial Sequence
  Description of Artificial Sequence: Synthetic coding sequence
atgatggagatccaaatggatgaaggcggcggcgtggtagtatatcaggatgattactgctccggctctgtgatgagcgagagagtgtccgggctggcaggaagtatctatcgcgaatttgagcgactgattcactgttacgacgaagaagttgtcaaagagttaatgccgcttgttgtgaacgtgctagagaacttggatagcgtactcagcgagaaccaagagcatgaagtcgaacttgaactcctacgggaggacaacgagcaactgctcacacagtatgagagggaaaaggcactgaggcgccaagccgaggagaagtttatcgaatttgaggatgccctggaacaagagaaaaaggaacttcagattcaagtcgaacactacgaattccagactagacagttggagctgaaggctaaaaactacgccgatcagattagccgcctcgaggagagggaaagtgagatgaagaaagaatacaacgctctgcaccagcggcataccgaaatgatccagacatatgttgaacacatcgaaaggagcaagatgcagcaggttgggggcaactcccagaccgagtcttctctgccaggccgccgcaaggagagaccaactagcctaaatgtcttccctttggccgatggtaccgtgagggcccagattggaggtaaacttgtccctgctggggatcactggcacttgagtgacctgggccagctgcaatcttcgtccagctaccagtgcccccaggatgagatgtcagagtcagggcagtcctccgcagcggccacaccatccaccacaggaacaaaaagtaatacacctacatcaagtgtgccgtccgcagccgtgactccccttaacgagtcacttcaaccccttggcgattatggtgtggggtccaaaaatagcaagcgcgcgagggagaagcgggatagtcgcaatatggaggtccaagttacacaggaaatgaggaacgtgtccatcggcatgggaagctcagatgagtggtctgatgtccaagacataattgattccactcccgagctggatatgtgcccagaaacacgcctggatcggacaggctcgtcaccaacccaggggatcgtgaataaggcctttggcattaacactgattccctgtatcatgagctcagcaccgctggatcggaggtcatcggcgacgtcgatgaaggcgctgaccttctcggtgaatttagcggtatgggaaaagaagtcggcaacctccttctggaaaactcccagctgttagaaaccaaaaacgccctgaacgttgtgaagaatgacctgattgcaaaggtcgaccagctgtccggggagcaggaagtcctgcgcggggaactggaggccgccaagcaggctaaagtaaaactcgagaatcggatcaaagagctcgaagaggaactcaaacgagtaaaatccgaagctatcatcgccaggcgcgagcctaaagaggaagccgaggacgtgagtagctatctttgtaccgaaagtgacaaaattcccatggcccagcgccgaagattcacacgagtggaaatggcccgggttctgatggaacgaaatcaatacaaggaaagacttatggagttgcaagaggccgtgcggtggacggagatgatccgtgcatcgcgggaacacccaagcgtgcaggagaaaaaaaagtcaacgatatggcagttcttctctaggttgttttcatcctcctcgagccctccaccggccaaacggccttatccatccgtgaacattcattacaagagccctaccaccgcaggtttctcacaaaggcgcaaccacgctatgtgtcccatcagcgccggctcccggcccttggagttcttccccgacgatgattgcacgtcaagcgcgcggcgcgaacaaaagcgcgaacaatacaggcaggtgagggagcacgtccggaacgatgatggtcggctgcaagcttgtgggtggtctctgcccgccaaatacaagcagctgagtcctaatggagggcaggaagataccagaatgaaaaacgtgccggtgcccgtgtattgtaggcccctcgtcgagaaagaccctacgatgaagctctggtgtgccgccggtgtgaatctgagcggctggcgtcctaacgaggatgatgcaggtaatggagtgaaacccgctcctggtagggacccgctgacatgcgacagagagggggatggggagcctaagagtgcacatactagccccgagaaaaagaaggcgaaagagctcccagaaatggacgcaacaagctcacgggtgtggattctgacatccacgctcacgacatctaaggtcgtgattattgatgccaatcagcccgggacggttgtggaccagttcactgtttgtaatgctcatgttctctgcattagctccattcctgcagccagcgacagcgattacccccccggggaaatgttcctagattctgacgttaaccctgaggaccccggcgccgacggtgttctggccgggatcaccctagtaggttgtgcgacgaggtgcaacgttccccgaagcaattgtagtagccgcggcgacacccctgtgcttgataagggtcagggcgaggtcgctactattgccaacggcaaagtaaaccctagtcaatcaaccgaggaagccacagaggccacagaggtccccgaccctgggcctagcgagccagagacagcaaccctgagaccaggtcctttaacagagcatgtattcacagatcctgctcctacaccctccagcggaccacagcccgggtcagagaacggcccggagcctgactctagctcaaccaggccggagccggagccaagcggagatccaacgggcgcgggaagctctgctgctcccaccatgtggctgggagcccagaacggttggctctacgttcactccgcggtggctaactggaaaaaatgtctccatagtatcaaactaaaagactccgtcctgtctctggtgcatgtgaaagggcgggtcctggtcgccctcgccgatggcactctggcaattttccatcgcggagaagacggtcagtgggacctgtctaattaccacctaatggatctgggccatcctcatcacagtatacgctgcatggccgtggtgtatgaccgtgtctggtgtggctataagaataaagtccatgttatccagcccaagactatgcaaatcgaaaaaagcttcgacgctcatccacggcgtgaatctcaggtgcgccagcttgcatggataggggatggggtgtgggtgagcataaggctggattcaacactcaggctgtaccacgcacacacacaccagcacttacaggatgtggatattgagccttatgtttccaagatgcttggcacgggtaaactgggctttagcttcgtgcgcattactgctctgttggttgcagggtcaaggttatgggtcggcacaggaaatggtgtggtcatctcgatcccacttacggagactgtggtgctccacagggggcaactgctcggcctacgggcaaataagacaagtcccacctctggggaaggggcaaggccagggggaataatccatgtgtatggcgacgattcgtcggatcgggctgccagcagcttcattccatactgctccatggcccaggctcagctttgcttccacggccacagggatgccgtgaaattcttcgtttcagtgcccggcaatgtgctagcgacactgaatggcagcgtgctggattcccctgctgaaggccctggcccagccgcccctgcctccgaagtggaaggacaaaagctgaggaacgttctggtgctttcgggaggggaggggtatatcgacttcaggatcggagacggagaggacgatgaaaccgaagagggtgcaggggatatgtcccaggtgaaacctgttctcagcaaggctgaaaggtcgcatatcatagtttggcaggtgtcatacacgcctgagtag

SEQ ID NO: 27866 - DNA, 1569 bp, Artificial Sequence
  Description of Artificial Sequence: Synthetic coding sequence
atggcatttttggataatcctacgattattcttgcccatataagacagagccatgtgacctcggacgacacaggcatgtgcgaaatggttctgatagatcatgatgtagacctggagaagatccatcctcctagcatgccaggtgactcaggctcagaaattcaggggtccaatggcgaaactcagggctacgtgtacgcgcaaagcgtggatatcacctcctcatgggacttcggcattagaagacgttctaacacagcgcagcgactcgaacgactaaggaaggagagacaaaatcagataaaatgcaagaatatccagtggaaagaaagaaattccaaacagtcagcccaggaactgaagtcactgttcgagaaaaaatcactcaaagagaagcctccaatttcagggaagcaatccattctgtcagtgaggctggaacagtgccccctgcaacttaataacccattcaatgagtattccaaatttgatggcaaaggtcacgtgggcacgacagccacgaagaagatcgacgtctatctgccactacatagctcccaggacaggctgctcccaatgactgtggtgactatggcaagcgctagagtgcaagatctgattggactgatttgttggcaatacacttccgaggggcgggaaccgaagctaaatgacaacgtatcggcctactgcttgcacatcgcggaggacgatggcgaagtggacacagattttccacccctggatagtaacgagccgatacacaagtttgggttcagtaccctcgcacttgtggagaagtacagcagcccagggctgaccagcaaggaaagtttgttcgttaggattaatgcagcccacggcttctcattgatccaggtggataacactaaggttactatgaaggagatcctgctgaaggctgtgaaaaggagaaagggctctcaaaaagtcagcggaccacaatacaggctcgagaaacagtcagaaccaaacgtggcggtggatctcgattccacactggaatcacagtcagcttgggaattttgtctggtgcgagagaactctagtcgtgccgacggggtttttgaggaagattctcagatcgacattgccacagtgcaggacatgctgtcttctcatcattacaaatcttttaaggtatccatgatccatagactgcgcttcacaactgatgtccagctgggcatcagcggcgacaaagtggaaattgaccccgttactaaccagaaggccagcacaaaattctggattaagcagaagcccataagtatcgattctgatttgctctgtgcttgtgatcttgccgaagaaaaatccccctcccacgctatttttaagttaacctacctgtccaaccatgattataaacacctgtatttcgagtctgatgcggccaccgtgaacgaaatagttctcaaggtaaactatattctagaaagtcgcgcgtccaccgccagggccgactacttcgcacagaagcagaggaagttgaacagaagaacctcctttagtttccagaaagaaaagaagtctggacaacagtag

SEQ ID NO: 27867 - DNA, 1461 bp, Artificial Sequence
  Description of Artificial Sequence: Synthetic coding sequence
atggccttcctggataatcccactattatcttggcgcatattcgccagtctcacgtaacttccgatgacacaggcatgtgcgaaatggtgttaatagaccacgacgtggaccttgagaagattcacccccccagcatgccaggagattccggttctgaaattcagggatccaatggtgaaacacagggatatgtatatgcgcaatccgtcgacattacttctagttgggattttggtatacgcaggcggagtaatacagcccaaaggctcgagaggctacgcaaggaaaggcagaatcagatcaagtgcaaaaatatacaatggaaggaacgcaactctaagcagtccgcccaggagctcaagtccctgtttgagaaaaaaagtctgaaagaaaaacccccgatttccggtaaacaatcaattctgtcagtgagactcgagcaatgtcctctgcaactgaataacccgtttaacgaatatagcaaatttgatggcaaaggacatgtcggaacaacagctacaaagaaaattgatgtatatctccctttgcacagctcgcaggataggctgctccctatgactgtcgtgactatggcatcagccagagtccaggatctgattgggctcatatgctggcagtacacctctgagggtagagagcccaaacttaatgacaatgttagcgcatattgtctgcacatcgcagaagacgatggtgaagtcgacactgatttccctcctctcgacagtaacgaacccatccataagttcgggttcagcactctggctctggtagagaagtattcttcacccgggctcacatcaaaggagagtctgtttgtccgtatcaacgccgctcatgggtttagcctgatccaggtagacaataccaaggtgacaatgaaggaaatcctcctaaaggccgtgaaaaggcgaaaaggctcacagaaagtgagcggctcgagggcagatggcgtgttcgaggaggactcccagatcgatatagccaccgtgcaggacatgctttccagccaccactacaagtctttcaaggtgtccatgattcaccgactgcggtttacgacggatgtccagctcgggatttctggggataaagtcgagattgatcccgtcacaaaccagaaggcttcaactaagttctggatcaagcagaagcccatcagtatagatagtgacctgctttgtgcttgcgacctcgctgaggaaaaaagcccttcccacgccatctttaagctgacctacctctctaatcatgattataagcacctatactttgaaagcgacgccgctactgtgaatgagatcgtgcttaaagtcaactatatcttggaatcacgcgcaagtacggcgcgtgccgattacttcgcacagaaacagcgtaaacttaacagacggacctcgttcagtttccagaaagagaagaagtcaggtcagcagtag

SEQ ID NO: 27868 - DNA, 399 bp, Artificial Sequence
  Description of Artificial Sequence: Synthetic coding sequence
atggctttcctagataaccctaccattattctggcacacatccgccaatcccacgtgacatccgatgatacgggcatgtgtgagatggtgctcatcgatcatgatgtggatctggaaaagattcacccgccaagcatgcctggcgattcaggcagcgagatccaaggtagcaatgcacaacgcttagaaagacttcgaaaggaacggcagaatcaaattaagtgtaagaatatccagtggaaagagagaaacagcaagcagagtgcacaggaactgaagtctctgttcgaaaagaaatcattgaaggagaagcctcccattagtggcaagcagagcatcttgtccgtacggctggagcagtgtcctctgcagctgaacaacccattcaatgagtactag

SEQ ID NO: 27869 - DNA, 708 bp, Artificial Sequence
  Description of Artificial Sequence: Synthetic coding sequence
atgaccgtggtgacaatggcttccgcccgggtgcaagacctgatcggccttatatgttggcagtacacatccgaaggaagagaacctaaactcaagaatgctgcccacggcttttctctcatccaggtggacaacactaaggttaccatgaaggagattttgttgaaggcagtgaagaggagaaaaggctcccaaaaggtcagcgggagccgcgcagacggagtattcgaggaggacagccaaatagacattgctacggtccaggatatgttatccagccatcactataagtccttcaaagtgagcatgattcacaggctccgctttacaacagatgtgcaactcggaatcagtggagataaggtcgagattgaccccgtcactaaccaaaaagcaagcacaaagttctggatcaaacagaagccaatcagcattgactccgatttgctgtgtgcttgtgatctggcagaggaaaaatcaccaagtcatgccattttcaagctgacttacctgagcaaccacgactacaagcatctgtactttgagtccgacgctgccactgtgaacgagatcgtacttaaagtcaactatattttagagtcaagggcttctactgcccgggcagactatttcgcgcagaagcagcggaaattaaaccgccgcacctccttctcatttcaaaaagagaaaaagagcgggcaacagtag

SEQ ID NO: 27870 - DNA, 1569 bp, Artificial Sequence
  Description of Artificial Sequence: Synthetic coding sequence
atggcttttttggacaaccctacaattatcttggctcacattaggcagtctcatgtgacatccgacgatacgggaatgtgcgaaatggtcctgatcgatcacgatgtcgatctcgaaaagatccacccgccctccatgccaggagactccggtagcgagatccagggatccaatggagagactcagggttacgtttatgctcagtccgtcgacatcacatcttcctgggattttggaatcagacgtcggtccaacacagcccagcgcctcgaaaggctgcgtaaagaacggcagaatcaaatcaagtgcaagaatattcaatggaaagagagaaattctaagcagagtgcgcaggagctcaaaagcctttttgagaagaagagcctgaaggagaaacctcccatttccgggaagcagagtatcctcagtgttaggcttgaacagtgtccccttcaacttaataacccattcaacgaatacagtaagttcgacggtaaaggacacgtcggaactactgcaacaaaaaaaatcgacgtatacctgcccctacacagttctcaggacaggcttctgcctatgaccgtggtgacgatggctagtgctcgcgtacaggacctcataggcttgatatgttggcaatatacatctgagggccgggagccaaagctgaatgacaacgttagcgcttactgccttcacattgctgaggatgatggcgaagttgataccgattttccccccttggacagcaacgaaccaatccataagtttggattcagtacgctggccctcgtggagaagtattctagccccggactaacatccaaggagtcgctctttgttcgcatcaacgctgcccacggctttagcctgatccaggtagacaatactaaagttacgatgaaggaaatcttgcttaaagccgtgaaacgacgtaagggcagccagaaggtctctggaccccagtatcggctggagaaacaaagcgagcctaacgtggcggtggatttggacagtaccctcgaatctcagagtgcctgggaattttgcctcgtcagggagaattcctctcgagctgatggcgtgttcgaagaggactcccagattgacattgcaaccgttcaggacatgctcagttcccaccactataaatctttcaaggtgtcaatgattcacaggctccggtttaccaccgatgttcagctcggcatttcaggagataaggtggagatcgatcccgtgactaaccagaaggcgtccacaaaattctggattaaacagaagcccatatccatcgattctgacttgttgtgtgcttgtgacttagccgaagagaagtctccttctcacgccatcttcaagcttacttatctgtccaaccatgattataaacatctgtacttcgaatccgacgctgcgacggtaaatgagatcgtattgaaagttaattacatacttgagtcgagagcttccactgcgcgagcagattatttcgctcagaagcaacgtaagcttaatcgtcgcacttccttctctttccaaaaggaaaaaaagagcggccaacagtag

SEQ ID NO: 27871 - DNA, 993 bp, Artificial Sequence
  Description of Artificial Sequence: Synthetic coding sequence
atgacagttgtgacgatggcaagtgccagggttcaggacctcatcggcctgatatgctggcagtacactagtgaaggccgcgagcccaagttgaacgataatgtgtccgcatactgcctgcacattgccgaagatgacggtgaggtagacaccgatttcccacctttagatagtaacgagcccatccacaagtttggattcagcacgctggccctggtagaaaagtactcttctccaggcctgacctcgaaggaatcgctatttgtcagaatcaacgctgcacatggcttcagcctcatacaggtggataataccaaggttaccatgaaggagatactgctcaaggctgtgaagagaagaaaaggaagtcagaaggttagcgggccgcagtacagacttgagaaacaatctgaaccaaacgtagccgttgatcttgatagcacactggagtcccagagcgcctgggagttctgccttgtgcgcgaaaattcaagcagggccgatggggtcttcgaggaggactcccagattgatatcgctaccgtccaggacatgttgtccagccaccactataaatccttcaaagtttctatgattcatcgcctcaggtttaccacagatgtgcagctgggcatcagcggcgataaggtcgagatcgacccggtgacgaaccagaaagctagtacgaaattctggatcaaacaaaaacctatttctattgacagtgacttactttgtgcgtgtgatctggcagaagagaaatccccctcacatgctatttttaaattgacatacctctccaatcacgactataagcacttgtacttcgagagtgacgctgccaccgttaacgaaattgtgctgaaggtgaactacattctagaatccagagcaagcactgcgcgagccgattacttcgcacagaaacaacgcaagctcaatagaaggacgtctttcagctttcagaaggagaagaaatcaggtcagcaatag

SEQ ID NO: 27872 - DNA, 678 bp, Artificial Sequence
  Description of Artificial Sequence: Synthetic coding sequence
atgcctggtgactctggtagcgaaattcaggggagcaacggtgagacacagggatatgtgtacgcccagtccgtggatatcacaagctcctgggatttcggtatcagaagacgaagcaataccgcccagcggttagaacgcttgcgaaaagagagacagaatcagataaaatgcaagaacatccagtggaaggagaggaacagtaaacaaagcgcgcaggagctgaagagcctgtttgagaaaaagagtctgaaagaaaagccccctattagcggaaagcagagtattctaagtgtccggctggagcagtgtcccctgcagctgaataatcccttcaacgagtattccaagttcgacggcaagcactgttcgtctctgtgtaggatcatcatgaataaatgtttcctgcagtctcttgctctgaatagtagcctacagaggaagtcccttaagaccttgcaaaaatccatgaagccccctcgtaacgtggcgaatagcgagaaaggacacgtgggaaccacggcgacaaagaaaatcgacgtgtatttgccactgcactccagtcaagaccgactgctcccaatgacggttgtgacgatggcatccgcccgggtccaggacctgattggtctgatatgctggcagtacacatcagagggcagagagcccaaattgtag

SEQ ID NO: 27873 - DNA, 1428 bp, Artificial Sequence
  Description of Artificial Sequence: Synthetic coding sequence
atggcatttctggacaatcctaccatcatcctggcgcatataagacaaagccatgtgacaagcgacgacaccgggatgtgtgagatggtcctgatcgatcacgacgtggacttggagaaaatccaccccccttcaatgcctggtgacagtggctccgaaattcagggtagcaacggcgaaacacaaggctatgtatacgcccaaagcgtggacataacttccagctgggatttcggtatccgacgcaggtctaatacagcccagcgtctggaaagacttcgcaaggaaaggcagaaccagatcaagtgcaagaacattcagtggaaagagcgtaattcgaagcaaagcgcccaggagctgaagtcactctttgaaaaaaagtcccttaaagagaagccccctatcagcggaaagcaaagcattttgtctgtgcggctcgagcagtgccccctgcagctaaataatccattcaacgaatattccaagtttgatgggaagggacacgtcgggacaacagcaactaagaaaattgacgtttatctgcccctgcactccagccaggatagactgctcccaatgaccgtggtaacgatggcctcagcgagggtgcaggatctgatcgggttgatctgctggcagtacactagcgaagggcgggagccaaagctgaacgacaacgtgagcgcatactgtctgcacatagcagaggatgacggggaggttgatactgattttccaccgctggacagtaatgagccgatacacaagtttggtttttcgacactcgccctggtggagaaatattcaagtcccggtctgactagtaaggaatctttgttcgtgcgcataaacgcagcccacgggttttcacttatacaagttgacaacacaaaagtgaccatgaaagaaattctgttgaaggcagtaaagcgacgaaaaggcagtcagaaagtgtccggaccccagtacaggctcgagaaacaatccgagccaaatgtagccgtggacctggattcaacattagaatcgcaatcagcttgggagttttgtctggtcagagagaatagtatatcaggcgataaggtcgagatagaccccgtgactaatcagaaagcatcaacaaaattttggataaagcaaaaacccatttccatagactctgacctgctgtgcgcctgcgacctcgcagaagagaagtctccttcacacgcaatttttaagttgacttacctttccaaccacgactataaacatctgtactttgagagcgacgctgctaccgtgaacgagatcgtgttgaaagttaattacatccttgaatcccgggcttctactgctcgcgccgattactttgcccagaagcagcggaagctgaaccggaggaccagcttttccttccagaaggagaagaaaagcggacagcaatag

SEQ ID NO: 27874 - DNA, 993 bp, Artificial Sequence
  Description of Artificial Sequence: Synthetic coding sequence
atgaccgtcgtgaccatggcttctgctcgcgttcaggacttgattggacttatttgttggcagtacacctcggaagggcgcgagccaaagctgaatgacaacgtgagtgcctattgcctgcatatcgctgaggatgacggcgaggtggatactgacttccctcctctggacagtaatgagcccattcacaagttcgggttcagcacgctggctttggtggagaagtactcgtctccaggcctcacgtccaaggaaagcctttttgttcgaatcaacgcggctcatgggttttccttgattcaggttgacaatacgaaggtgaccatgaaagaaattttgctcaaggctgtgaaacgcaggaaaggctcccaaaaagtatccggtccccagtatcgccttgagaagcagagcgagccaaacgttgctgtggacttggacagcactctcgagagtcagtctgcctgggagttttgtctggtaagagagaactctagccgcgccgacggggtctttgaggaggacagccagatcgacattgcgacagtgcaggacatgttgtcgagccatcactataaatcctttaaagtgagtatgatccaccggctgcgctttaccacagatgtacagcttggcatatcaggcgacaaagtcgagatcgacccagttacaaaccaaaaagcttctactaagttttggatcaaacaaaaacctataagcatcgactccgatttgctctgtgcatgtgatctggctgaagagaagtctccgagccacgccatattcaaacttacgtacctctcaaaccatgattacaaacacttgtactttgagtctgatgcagcaactgtcaatgagatcgtgttgaaggtgaattacatactggagtcccgcgccagcactgctcgagccgactatttcgcccaaaagcagcggaagctcaataggagaacgtctttctctttccaaaaggagaaaaaatcaggtcagcagtag

SEQ ID NO: 27875 - DNA, 282 bp, Artificial Sequence
  Description of Artificial Sequence: Synthetic coding sequence
atggcttttctcgataaccctactattatactggctcacattcgtcagagccacgttacaagtgacgacaccgggatgtgtgagatggttctgatcgaccatgacgtggatctggagaagatccacccccctagcatgcctggcgacagtggatcagagatccaaggctcgaatggtgagacccagggttatgtctatgcgcagtctgtcgatataactagtagttgggatttcggaatcagacggcgctccaacaccgcacagagactggaacgactctag

SEQ ID NO: 27876 - DNA, 285 bp, Artificial Sequence
  Description of Artificial Sequence: Synthetic coding sequence
tgaaagagtttcaaggtgtctatgatccaccggctgcggttcactacagatgtgcagctcggccacgcaatctttaagcttacatatctgtctaaccacgactacaaacacctgtacttcgaaagcgatgccgccactgtgaatgagatagtgctgaaggtgaactacatcctggagtcaagggcaagcacagcccgtgccgactactttgcacagaagcagcgtaagctaaaccgacgcacgagcttctcctttcaaaaggaaaagaaaagcggccagcagtag

SEQ ID NO: 27877 - DNA, 972 bp, Artificial Sequence
  Description of Artificial Sequence: Synthetic coding sequence
atggcttttctggacaacccgactattattctggcgcacatcaggcagagccatgttacctcagatgacacagggatgtgcgaaatggtcttaatcgaccacgatgttgatctcgaaaagatccacccgccctcaatgccgggtgactctgggtcggagatacaggggtctaacggtgagacccagggctatgtgtacgcgcagtcagtggacatcactagctcatgggattttggaatacgacgacggagtaataccgcgcagagactcgagagactcaggaaggagcggcagaatcagatcaaatgcaaaaatattcagtggaaagagcgaaattcaaaacaatctgctcaggagctgaagagtttgttcgagaaaaaaagcctgaaagaaaaaccgcccatcagtggaaagcagtcaatccttagtgtcaggctggaacagtgccccttacagttgaacaatccctttaatgagtattccaaattcgatggtaagggacacgttggtacaactgcaacgaaaaagattgacgtctatctgcccctgcattcctcccaggataggctgcttcccatgactgtcgtgactatggcaagtgctagagtgcaagacctgataggattgatttgctggcagtacacttcagagggaagagagcctaaactgaacgataatgtgagcgcatactgcttgcacattgccgaggacgacggtgaggtggacaccgattttcctcccctagattcgaacgaacccatacacaaatttggcttctctacgctcgctctggtggagaaatattcgtcacccggcttaacatcaaaggagagcctctttgtccggataaacgctgctcacgggttctcactgatccaagtcgataacacaaaggtcacgatgaaagagatccttttaaaagcagtgaagcgcagaaagggaagtcagaaggtatccggcgcttgtgactag

SEQ ID NO: 27878 - DNA, 1008 bp, Artificial Sequence
  Description of Artificial Sequence: Synthetic coding sequence
atgaaggtcgagtttgcacctttaaatatccagctagctcgccgactacaaaccgtggccgtgcttcagtgggttctgaaataccttctgctgggacctatgtctattgggatcacagtgatgctgattatacataactatctctttctgtacataccttatctgatgtggctatacttcgattggcacaccccagagcgcggcgggaggcggagtagctggattaaaaactggaccttgtggaagcacttcaaagactacttccccatccatctgattaaaacacaagatctagatcccagccacaactatatcttcgggttccatcctcatggcattatggccgttggggcatttggcaactttagcgtgaactacagcgacttcaaagatcttttcccaggttttacttcttacctgcatgtgttacctctgtggttttggtgtcccgtgtttagggaatacgtcatgagtgtggggctggtcagtgttagcaaaaaaagcgtgagttatatggttagtaaggaaggcggaggcaacatctccgtcattgtcttggggggcgcaaaggagagtttagacgcgcaccccggaaaatttacattattcatcagacaaaggaaaggctttgttaagatcgccttgacacacggcgcaagcctcgttccggtggtttctttcggggaaaacgagctctttaaacagactgacaatccggagggttcttggatcagaactgtgcagaataagctacagaaaatcatgggttttgctctgccactgttccacgccagaggcgtgtttcagtataattttggacttatgacctatcgcaaggccattcatactgtggtgggcagaccaatccccgtcagacagacactgaaccccacacaggaacagatcgaagagcttcaccagacatatatggaggaactgaggaagctgttcgaagagcacaagggaaaatacggaattcctgagcacgaaaccttagtcctgaaatag

SEQ ID NO: 27879 - DNA, 1005 bp, Artificial Sequence
  Description of Artificial Sequence: Synthetic coding sequence
atggttgagtttgccccactctttatgccatgggagaggcggctccagactctggctgtacttcagtttgtgtttagtttcctggccctggctgagatctgtacggttggcttcatcgcactgctgttcacccgtttttggctgctcacagtcttatacgcggcgtggtggtatctcgaccgcgacaaaccacggcagggcgggcggcacatacaggcgatccggtgctggactatctggaaatatatgaaggattacttccccatctctctggtgaagacagcggagctggatcccagcagaaactacatcgccgggttccacccacacggagtccttgccgtgggggccttcgctaatctttgcaccgaatctactggctttagcagcatttttccgggcattagaccccatctcatgatgctaacactctggttccgagccccatttttccgggattacattatgtctgccggtctagtgacatcagagaaagaaagtgccgcacacattcttaatcggaaaggaggcggcaatctgttgggcataatagtgggtggagcacaggaagctctagatgctaggcctggtagcttcaccttgctcctgagaaatcggaagggcttcgtccgactcgctctcacacacggggctcctttagtcccaatcttcagctttggtgaaaatgacctcttcgatcaaattcccaattcctcgggtagctggctcagatatatccaaaatagattgcaaaagatcatgggcatctcactgccgctatttcacggcaggggcgtattccagtacagcttcggtttgataccctatagaagacctataacgactgtcgtaggtaagcccatcgaggtgcagaaaacactgcatcctagcgaagaagaagtcaaccagctccaccaacggtacattaaggagctgtgtaacctctttgaagcgcacaagctgaaatttaatatcccggccgatcagcaccttgagttctgttag

SEQ ID NO: 27880 - DNA, 759 bp, Artificial Sequence
  Description of Artificial Sequence: Synthetic coding sequence
atgaaagactattttcctatttctctcgtgaaaaccgcagaactggacccttctcgaaattacatcgcggggttccacccacacggcgtgctagcagtgggagcctttgccaacctatgcacagagagtaccggcttttcaagcatctttccgggtattcggccacatctgatgatgctcactttgtggtttagagccccgtttttccgcgattatataatgtcagccgggttggtgaccagcgaaaaagagagtgctgcccacattcttaacagaaagggtggcggcaacttgttaggtattatcgtaggtggagctcaagaggccctggacgcgcgccctggctccttcactttgctgctccgcaacaggaaggggttcgtccgactggcactgacacacggggccccccttgtcccaatcttctccttcggcgaaaacgatctttttgaccagatcccgaattcctcaggatcatggcttcgatacattcaaaaccgcctccagaaaattatgggaatctctcttccactgttccacgggcggggggtgttccagtatagcttcggactaatcccataccgccgcccgattacaacagttgttggtaagcctatagaggtccagaagaccctgcaccccagtgaagaggaagtgaaccaacttcaccaacggtacattaaagagctatgtaacttgttcgaggcacataaactgaagttcaacattccagccgatcagcatttggagttttgttag

SEQ ID NO: 27881 - DNA, 1209 bp, Artificial Sequence
  Description of Artificial Sequence: Synthetic coding sequence
atgcagatgtctccagctctcacatgcctggttctcgggctcgctctcgtgttcggagagggaagcgctgtccaccacccgcctagctatgtcgcacatctggccagtgactttggagtgcgggtctttcagcaggtggcacaggcctcaaaggataggaatgtggtgttttccccatatggcgtcgccagtgtcctggctatgctgcagctaacaaccgggggggaaacccagcagcagatccaggctgccatgggtttcaaaattgacgataaaggtatggctccagcactcagacacttgtacaaagaactaatgggaccctggaacaaggatgaaatctctacgaccgatgcaatattcgtccaacgggatctgaaactcgtccagggtttcatgccacacttcttcaggctgttcaggtccaccgtgaagcaagttgatttctccgaagtggagagggctcggttcatcataaatgattgggttaagacacacactaagggcatgattagtaatctccttgggaagggcgccgtagatcaactgacacgccttgtactagtgaatgccctgtatttcaacggccagtggaagacccccttcccagatagctctacgcacaggagacttttccacaagtctgatggttcaacagtgtccgtccctatgatggcacagaccaataagttcaattacaccgaatttacaactcctgacgggcactactacgatatcctagaactgccttaccatggggacacactatctatgtttatcgccgcaccatatgaaaaggaggtgcccctctccgctctgaccaacattctgagtgcgcagctcatttcacactggaagggaaatatgacaagattgcctcggctgctggttcttcctaaattcagcctggagaccgaggtggacctgcggaagccacttgagaaccttggaatgacggacatgttccgccagttccaggcagattttactagcctaagcgatcaggaacctctgcatgttgctcaagccctacagaaggtgaagatcgaagttaatgagagtggcaccgtcgcaagcagctcaacggctgttattgtgtccgctaggatggcacctgaggagatcatcatggacagacccttcctgtttgtggttaggcataaccctacaggcacagtccttttcatgggacaagtgatggagccctag

SEQ ID NO: 27882 - DNA, 846 bp, Artificial Sequence
  Description of Artificial Sequence: Synthetic coding sequence
atgggcgtcgcaaccaccctgcagcctccaactaccagcaagacacttcaaaagcagcacctggaggctgtgggcgcatatcagtacgtgctcacctttcttttcatggggccctttttttccctcctcgtgttcgtcctattatttacaagcctctggccattttcagttttctatctggtgtggctgtacgtggactgggacactccaaatcaaggcggtagacggagcgaatggatcagaaatagggccatctggcgacagcttagggactactaccccgtaaagcttgtcaagacagctgagctgcccccagatcgcaattatgtcttaggggctcatcctcacggcattatgtgcacaggtttcctgtgcaacttctctacagagtccaatggcttcagccagcttttccctgggctgagaccctggctagcggtgctggccgggcttttttatcttcctgtgtatcgtgattacatcatgagtttcgggctctgtcccgtgtctcggcagagtctggatttcatcttgtcacagccacagctgggccaggctgtcgtcatcatggtcggtggcgcgcacgaggccctttacagtgtccccggagaacactgtctgaccctccagaaaaggaaggggttcgtcaggcttgctctccgccatggggggccaccacacccccggcctcctgccccacccccacatcggggcggaagccaatccctatcacgtcccctgcacgatggcccaggggctgctctccgaggggcccagggtaaactatggggaccacgctttcatctgccccaccttcatctgggcctggcagccgcctttagatag

SEQ ID NO: 27883 - DNA, 1035 bp, Artificial Sequence
  Description of Artificial Sequence: Synthetic coding sequence
atgggagtggctaccactcttcagcctccaactactagcaaaaccctgcagaagcaacatctcgaggccgtgggcgcttaccagtatgtcctcacgttcctcttcatgggacctttcttctcattgcttgtcttcgtgctgctgttcacttccttgtggccgttttcggtcttctacctcgtgtggctgtatgtcgattgggatactccaaatcagggagggcgtcgttccgaatggatccgcaacagggcaatctggagacaactcagggattattatcctgtgaaacttgtaaaaactgccgaactcccccccgatagaaactatgtgctcggagctcatcctcacggaattatgtgcaccggtttcctgtgtaattttagcacagaaagcaacggctttagtcaactgttcccgggattgcgcccctggttggccgtcctggccggcctgttttacctgcctgtgtacagagattacatcatgtcatttggcctgtgcccagtctctaggcagtcactggattttatcttgtcgcaaccccaactcgggcaggccgtagttatcatggtgggcggcgcccacgaggccctctactctgtgcctggcgaacactgtctcactctgcagaaaagaaaaggcttcgtgcgcttggccctccgccatggagcctccctggtgccagtctattctttcggcgagaacgatatcttccgactgaaggcttttgctaccggctcttggcaacactggtgccaactgacattcaagaagctcatggggtttagtccctgcatcttttggggcagaggattgttcagtgccacctcctgggggttactgccctttgccgtccccatcacaactgttggggagtgtccacctcctggtggacggccgcctgctgcagcctgggcttctggaattcctaggcctccggtgagtctcagcctgcagtgggcagcaccatccccaagcccatccgcttcaacccccccacgacgaaaatctatcaccatcaccccatcaacatag

SEQ ID NO: 27884 - DNA, 645 bp, Artificial Sequence
  Description of Artificial Sequence: Synthetic coding sequence
atgcatcagcagaagaggcagccagagctcgtagagggcaacttaccagtgttcgtattcccaactgaactcatcttttacgcagatgatcaatccacgcacaagcaggtcctcactctctacaacccatatgaattcgcacttaaattcaaggtgctctgcaccaccccaaacaaatacgtggtcgtcgatgcggctggagcggtcaaaccccagtgctgtgtcgacatcgtcatacgacacagggacgtacgttcttgtcactacggggtcattgacaagtttcggttacaggtgtctgaacaatcccagaggaaagccctaggccgaaaagaagtcgtcgcgaccctcctaccctcagcaaaggagcaacagaaggaagaggaagagaagaggctgaaagaacatctaacagagagcctttttttcgaacagtcttttcagcccggcaagaaccgtgcggtctcttccggcccttctttgctgaccgttttcctgggggtagtgtgcatcgccgccctgatgctccccaccctcggggatgtcgagtccctcgtgcccctctacctgcaccttagcgtgaatcagaagctcgtagccgcctacatcctcggactgatcaccatggctattttgcggacctag

SEQ ID NO: 27885 - DNA, 480 bp, Artificial Sequence
  Description of Artificial Sequence: Synthetic coding sequence
atgcaccagcagaagcgccaaccagagctggtcgaagggaatctgccagtttttgtgttccccacagagcttattttttacgcagatgaccaatccacccataagcaggtccttactctgtataatccatacgagttcgcacttaaatttaaggtgctgtgtacaacacccaacaagtacgtcgtggttgatgccgcaggagcagtaaagccacagtgttgtgtggatatcgtgattcgccacagggacgtgagatcttgtcattatggtgtgatcgacaaatttcgactccaggttagtgaacagagccagagaaaggccttgggccggaaggaagtggtcgctaccctgctccccagcgcaaaggaacagcagaaagaggaagaggaaaaaaggctgaaggaacatctgacggaatccctgttttttgaacagtcctttcagcccggtcttattaccatggcaatcctacggacgtag

SEQ ID NO: 27886 - DNA, 642 bp, Artificial Sequence
  Description of Artificial Sequence: Synthetic coding sequence
atgcatcaacagaagaggcagcctgagttagttgaaggaaacctgccggtgtttgttttcccaaccgagcttatcttttatgcagatgatcagtcgacacacaaacaggtgctgactctgtataatccttatgagtttgccttgaaattcaaggtcctttgtaccacgcccaataagtatgttgtcgtggatgccgccggagccgtgaagccccagtgctgcgtggacatcgtcattcgccatagggatgttagaagctgccactacggggtcatagacaagttccggcttcaggtgagtgaacagagtcagagaaaggccctgggccggaaggaagtggtggcaaccctgctcccaagtgcaaaggagcaacagaaggaggaagaagagaagcgcttgaaagagcacttaacggaatcactgttcttcgaacagtcattccaacctgaaaatcgcgcggtgtcttcgggtcccagtctccttactgtgtttctaggcgtggtatgcatcgctgcccttatgctgccgactctgggggatgttgaatctctggtcccgttgtacctgcaccttagtgtcaatcaaaagctagtggctgcctatatcttgggtctcatcactatggctattctaagaacctag

SEQ ID NO: 27887 - DNA, 1557 bp, Artificial Sequence
  Description of Artificial Sequence: Synthetic coding sequence
atggctgaaaaccacgcccagaacaaggccaagctgatctcggagaccagacggcggtttgaagcagagtatgtgaccgataaaagtgacaagtatgatgccagggacgtagagaggctccagcaagatgacaactgggtggaatcgtacctcagttggaggcataatatcgttgatgagaccttgaagatgctagacgaatcattccaatggaggaaagagatttctgtgaacgatcttaacgagtcttctatccctaggtggctcctggagattggggttatatacctgcacggctacgacaaagagggaaataagctgttttggatcagggttaaatatcacgtcaaggatcagaaaaccattctggataaaaaaaaactgattgctttctggctggagcgatatgcaaagagggaaaacggaaaaccagtgacagtgatgtttgacctatctgagacggggataaattcaatcgacatggactttgtacgctttattatcaactgctttaaggtatattacccaaagtatctgagcaaaatcgtgatatttgacatgccctggctaatgaacgctgcattcaaaatcgtgaagacttggctgggacccgaagccgttagcttactgaaattcactagtaagaatgaggttcaggactacgtcagtgtggagtatctcccgccccatatgggcggaaccgacccattcaaatatagctatcctcccctcgttgacgacgactttcaaacacccctgtgtgaaaatggtccaattacttcagaggacgagactagctccaaggaggacatcgagtcagatgggaaggaaaccctagagactatctccaatgaggagcagacacccctgttaaaaaaaatcaatcccacagagagcaccagtaaagctgaggaaaacgagaaagtagactccaaggtgaaagcttttaaaaagcccctgtctgttttcaagggccccttgcttcacatttctcctgccgaagagctctacttcggaagcaccgaatctggggaaaagaaaacgctcattgtgctgactaatgtgaccaagaacatcgttgcctttaaagtccggacgactgctcctgaaaagtaccgcgttaaaccatccaatagttcctgtgatccaggcgcttctgttgacatcgttgttagcccccatggagggctgacagtatccgcacaggaccgttttctgatcatggctgccgagatggagcagtcaagcgggaccggaccagcagaacttacacagttctggaaggaagtgcccaggaataaagtaatggagcatcggctgagatgccacacggtggagtcatctaagcccaacacactgacgttaaaagacaatgctttcaacatgagcgataagacctctgaggatatttgtctgcagctctcaagactgttagaatcaaacagaaagctcgaagatcaggtgcaacggtgtatctggtttcagcaattgctgttgagtctgaccatgttgctgctagcatttgtgacctctttcttttacttgctatactcatag

SEQ ID NO: 27888 - DNA, 2406 bp, Artificial Sequence
  Description of Artificial Sequence: Synthetic coding sequence
atggaaagattgtgggggcttttccaaagagctcagcagctgtcacctcgcagctctcagaccgtataccaacgtgtggaaggacctcggaagggacatctggaggaggaagaggaggatggggaagagggggccgagacattggctcatttttgtccaatggaacttaggggaccagagcccctgggcagtcgccccagacagcccaacttgattccatgggcagcagcagggcggagggccgccccatacttggttcttactgccctgttaatctttacgggagcgtttctcctggggtatgttgctttccgaggcagctgccaagcgtgcggggactctgtcctcgtcgttagcgaggacgtgaactatgagcccgacctggacttccaccaaggccgactatattggagcgatttacaggctatgttcctccagttcttgggtgaggggcggctggaggatactattcggcagacctctctgagggaaagggtggctgggtccgcaggtatggcagccctgacccaggacataagagccgcgctcagccgccaaaagctcgatcacgtctggaccgacactcattacgtaggcctccagtttcccgatcctgctcatcctaatactctacactgggttgatgaggcaggcaaagtcggagagcagctccctctcgaagatcccgacgtgtattgtccctactcagctattggtaatgtgaccggtgagttagtgtatgcacattatggacgacctgaggatctacaggacctccgcgcacgaggcgtggatccagtgggcaggcttttgttggttagagtgggtgttatttctttcgctcaaaaagtgaccaacgcccaagactttggggcccagggcgtcttaatctatcccgagccggctgattttagccaggaccctcctaagccctctctgtcctctcaacaggcggtttacgggcatgtgcacctgggaaccggggatccttatacaccaggatttcctagtttcaaccagacacagttccccccggtggcaagctctggtctcccatccataccagcgcaaccaatttctgccgacatcgcatcgcggctgctgcgcaaactgaaagggcctgtggccccgcaggaatggcagggctctcttttgggttctccctatcaccttggccccggcccccgactgcgcctggtggtgaataaccatagaacgtctacacctatcaacaatatcttcggctgcatcgaaggtagatctgaacctgatcactatgtggtgattggcgctcagagagacgcttggggcccaggagccgcaaagtcagcagtgggcacggccatactgctggagcttgtgcgtaccttcagctctatggtgtctaatgggttcaggccaagacggagcctattatttatttcttgggatggaggagacttcggcagcgtgggctctaccgaatggctcgaggggtacctttctgtgttgcatctgaaggccgtcgtttatgtgagtcttgacaatgcggtcctgggtgacgataaattccacgcaaaaacatccccacttctaactagcctcatagaatcggttttgaagcaggtggattcccccaaccattctgggcagacactctacgaacaggtggtatttactaacccgtcctgggatgctgaggtgattcgtcccttgccaatggacagctctgcctactcctttaccgcattcgtaggcgtacctgctgtggaattctcttttatggaagacgaccaggcctaccccttcctgcacactaaagaggatacgtatgagaatttgcataaggtgttgcagggacgcctgccagctgttgctcaggccgtggcccagctggccggccaactcttaatcagactgtctcatgaccgtttgcttcccttagactttggaaggtatggagatgtggtccttcgccacatcggcaatttgaacgaattttctggcgacctgaaagctcggggtttaacgctgcagtgggtctacagtgcacgcggggactacatccgcgctgctgaaaagctcaggcaggaaatctactccagcgaagaacgtgatgaacggttgacgcgtatgtataatgtgcggattatgagagtggagttttactttctatctcagtatgtgagccccgcagactccccatttcgacatatctttatgggccgaggggaccatacactaggtgccctgctggaccatctcagattgctcagatccaattcctcaggcacacccggagctacctcctccactggctttcaggagtctcgattccgccgtcaactagccttgctcacatggacccttcaaggagccgcgaatgcactgtccggggacgtgtggaacatcgataacaatttctag

SEQ ID NO: 27889 - DNA, 708 bp, Artificial Sequence
  Description of Artificial Sequence: Synthetic coding sequence
atgcggcgcggtgcgccccaggatcaagagcttgtgggccctggcccacctggcagagggtcccggggggctccgcccccgctaggcccggtagtgccagtactcgtttttccaccggatctggtgttccgcgctgatcagcgctctggccctcgacagctcttgaccctgtataaccccaccggcaccgcattaaggtttcgtgtgctgtgcacagcaccggccaaatatactgtgtttgatgccgagggctatgtcaagccacagagttgtattgatattgtgatacggcatgtggccccaatcccttcacactacgacgtgcaggaccgtttccgcattgaactgtccgaggaaggcgccgaagggcgtgttgtgggacggaaggatatcacatctattttgcgggcccccgcgtacccgctcgagctccagggtcaaccagatcctgcacccaggcccggccctccagctgggactccaccaccaactgcccgtcactttcaggagcaccctaggcaacagttagccacctcttcattcctcctctttctgctgaccggcatcgtgtctgtggcattcctgctgctcccactcccagacgagctcggctcccagctcccacaggtgctgcatgtaagccttggtcagaaactcgtggcagcctatgtgttaggcttgttgacaatggtgtttcttagaacttag

SEQ ID NO: 27890 - DNA, 708 bp, Artificial Sequence
  Description of Artificial Sequence: Synthetic coding sequence
atgcgacggggggctccccaggaccaggaactggtcggtccagggccacccggccgggggtcccgaggggccccacctccattgggcccagtggtgcctgtcctggtgttcccccctgatctggtgttccgcgccgatcaacggtcgggcccaagacaactcctgacattgtataaccctacgggcacagccctccgattcagagttttatgtaccgctccagcaaaatatacagttttcgatgccgaagggtatgtgaagccccagagctgcatcgacatcgttatccggcacgtagcacccattccaagtcactacgacgtccaggaccgattcagaatcgagcttagcgaggagggcgccgagggtcgcgtggttggcaggaaagatataacatcgattcttcgggcccctgcctaccccctggaattgcaggggcagcctgatcccgccccgagacctgggcctccagccggcaccccaccacccaccgcaaggcactttcaggaacacccacgccagcagctggccaccagtagcttccttctgttccttctgacaggcatcgtgagcgtggccttcctgctgcttcctttaccggacgagctgggtagtcagctccctcaggtgcttcacgtcagcttggggcaaaagctagttgccgcctacgtgttgggcctcctgaccatggtgttcctgaggacctag

SEQ ID NO: 27891 - DNA, 666 bp, Artificial Sequence
  Description of Artificial Sequence: Synthetic coding sequence
atgtctgatcgccctgaacctgcctgtgccccaccacctttagggccagtagtgcccgtgcttgtgtttcctccagacctggtgttcagggccgatcagcggtccgggccccggcaattgctgactctttacaatccaaccggtacggccctgaggtttagagtgctgtgcacagcccctgcgaaatatacagtctttgacgcggaaggttacgtcaagccacagagctgcatagacatcgtgattaggcacgtggccccgatccccagccattacgatgtgcaggatcggttcagaatcgaactgtctgaggagggtgccgagggtagagtggtcgggcgcaaggatattactagcatcctgcgcgctcctgcttatcccctggagctgcaggggcaacccgacccagctccacggcccgggcccccggccggcacaccaccacccaccgcaagacattttcaggaacacccccgccagcagctagccacaagctcctttttactgttcttattaaccggtatagtcagtgttgcctttctgttactcccccttcctgatgagctgggatcacagttgccccaggtgctccacgtgagccttgggcagaaacttgtcgctgcttacgttctgggtctgctcacgatggtgtttcttcgaacctag

SEQ ID NO: 27892 - DNA, 678 bp, Artificial Sequence
  Description of Artificial Sequence: Synthetic coding sequence
atgcggcgcggtgcccctcaggatcaagagctggttgggcctggcccgcccggacgcgggagtcggggggctcctccgcccctggggccagtggttccagtgctggttttccctccagaccttgtatttcgggccgatcagcgatccggaccaaggcagctgctcactctgtataacccaaccggaacagcccttcgattccgcgtgttgtgtacagctcccgcaaagtataccgttttcgacgcagaggggtacgtgaaaccgcagtcctgtattgatattcattacgatgtgcaggatcggtttcgtatcgagctgtctgaggagggtgcagaggggcgggtggtcggccgtaaagacatcacctcaattctgcgggctcccgcctaccctcttgagttgcagggacaacctgaccccgcacccaggcccggccctccggctggcacaccgccacccactgccaggcacttccaggagcacccccgacagcagctagctacatccagttttctgttgtttcttctcactgggattgtgtctgtggccttcctgctgctgcccctgccagacgaactgggctcacagttgccccaggtgctgcacgtgtcacttggccaaaaattggtggccgcatacgtgctgggcttgctgacaatggtttttctccggacttag

SEQ ID NO: 27893 - DNA, 444 bp, Artificial Sequence
  Description of Artificial Sequence: Synthetic coding sequence
atggcgggttggtggccggctttaagccgtgctgctcgccggcatccttggccgacaaacgtgctgctgtacgggagtctggtcagcgctggggatgcattacaacagagacttcaggggcgggaggctaactggcgccaaacgcgtcgggtcgccaccttggtggttacattccacgctaattttaattatgtttggctgagactattagaaagagccttacccggccgagctccacacgcactgttagcgaagctgttatgcgaccaagtcgtgggcgctcctatcgcggtcagcgctttctatgtggagtggacagatgttttagccttatgtaccgccgatcagctgcagccgtgcagttgcagcatggaaaactcccttaggtggtccttatggttttcacttggacatctccacctttttttccctgccgaatggtag

SEQ ID NO: 27894 - DNA, 591 bp, Artificial Sequence
  Description of Artificial Sequence: Synthetic coding sequence
atggccggttggtggcctgctttgtcgcgcgctgcaaggcgccacccctggccgacaaacgtgctgttgtacgggtccttggtgagcgcgggcgacgcactccagcagaggctccaggggagagaggccaactggcggcagaccaggcgagtggctacattggtggtgacttttcacgcaaactttaactacgtctggctacggctgcttgagcgcgccttaccaggccgggccccccacgccctgctcgctaaattgctgtgtgaccaggtggtgggagccccaatcgctgtttctgctttctatgtgggaatgagcattcttcaaggcaaagatgatattttcctggatctcaagcagaagttttggaacacctatttaagcgggctgatgtactggcccttcgtacaactgactaatttcagtctggtgccagttcagtggaggacagcttacgcaggcgtgtgtggatttctgtgggcaaccttcatatgcttctcgcaacaatccggagatggcacctttaaatcggcttttaccatcctatatactaaaggaacctccgccaccgaggggtacccgaaaaaatag

SEQ ID NO: 27895 - DNA, 621 bp, Artificial Sequence
  Description of Artificial Sequence: Synthetic coding sequence
atggctcggggaggctggaggaggctgaggaggttgttgagcgctgggcagctattgtttcagggccgggctttattggtaaccaacacgctcggatgcggagccctcatggcagcgggcgatggggtgaggcaaagttgggagatcagagcccgcccaggccaggtctttgatcctaggcggtccgccagtatgttcgccgtcggttgtagtatgggtccctttctccactattggtacctgagcttggacagactttttcccgccagcggcctgcgaggctttcccaatgttctgaagaaagtgctggtggatcaacttgtcgcatctccccttctgggggtctggtattttctcgggctgggttgcttggaagggcaaactgtcggcgagtcctgccaagaacttagagaaaaattttgggagttctataaagcagactggtgcgtatggcctgctgcacaatttgtaaactttttgttcgtccctccccagtttagggtgacctacatcaatgggctgacacttggctgggacacatatttatcttatctcaaataccgaagcccagtcccgcttacccctcccgggtgtgttgctttggacacccgcgctgactag

SEQ ID NO: 27896 - DNA, 354 bp, Artificial Sequence
  Description of Artificial Sequence: Synthetic coding sequence
atggagtgcttaaggagccttccatgtctgctaccccgcgcgatgaggttgccaagacggacattgtgcgcccttgccctcgacgtgacttccgttggaccacccgtggcggcctgtggccgtcgtgcgaacctgattggtaggagccgagccgcgcagctgtgtggacccgaccgactgcgtgtggctggtgaggtgcaccggtttaggactagtgatgtttcccaggccactctggctagcgtagcgcctgtttttaccgttactaaattcgataaacaaggtaatgttactagctttgtctttgagtcctgcgataactcccgtgtctcctccgatatcagactctcatag

SEQ ID NO: 27897 - DNA, 1227 bp, Artificial Sequence
  Description of Artificial Sequence: Synthetic coding sequence
atggagtgtttgagatcccttccctgtctgctgccacgtgcaatgagactaccacgccgaaccttgtgcgccttggcgctggacgttacctccgtggggccacctgtagccgcctgcggacggagggccaatcttattggaaggtctagagcagcccagttgtgtggacctgatcgcctcagggtcgctggcgaagtgcaccgcttccgtacctccgacgtgtcccaagctactctggcctctgtagcacccgtattcacagtgactaaattcgataaacaaggcaatgtcacaagctttgaacgcaaaaagactgagctgtaccaggagctgggattgcaggctagggacctgcggtttcagcatgtcatgtccataactgtccgcaataatcgaatcataatgaggatggagtaccttaaggctgtgatcactcctgaatgcctccttattctggactacagaaaccttaaccttgagcagtggctgttccgagaactgccttcccaactgtcaggagagggccagctagtgacctacccgttgccttttgaattcagagccattgaagctttactgcagtattggattaatactctccagggcaagctgtccattctgcagcccctgatactcgaaaccctggacgctctggtcgacccgaaacactcgagcgtggaccgaagtaaactccacatcttgctgcagaacggaaagtctctctcagaactggaaaccgacattaaaatctttaaggaaagcatcttggaaatcctggacgaggaggagcttctggaagaactatgcgtatcaaaatggtctgaccctcaggtctttgaaaaaagttccgctgggattgaccacgcggaagaaatggagttacttttagaaaattactatagactcgcggacgatctctctaacgccgccagagaactcagagtcctgatcgacgacagccagagcatcattttcataaacttagactcgcaccggaatgtgatgatgcgtctgaacttgcagctcactatggggactttctcattatccctatttggtttgatgggggtggcttttggcatgaacctggaatcaagtctggaagaggaccataggattttttggttgattaccggaataatgtttatgggaagtgggttaatctggagaagactgctgagtttcttgggcagacagctggaggctcctttgccccccatggtctag

SEQ ID NO: 27898 - DNA, 1332 bp, Artificial Sequence
  Description of Artificial Sequence: Synthetic coding sequence
atggaatgtttgcgttcactcccttgtcttcttcctcgggccatgcgcttaccgaggaggacactctgcgccctggcactggatgttacatccgtcggtccgcctgtggctgcttgcgggagacgggccaacctgattgggcgttcccgggctgctcagctgtgcggcccggatagactcagagttgccggagaggtccataggttccggaccagcgatgtctcccaggccacactggcttctgtcgccccagtgttcaccgtcacgaaatttgataagcaggggaacgtaacttctttcgaacggaagaaaaccgagttgtatcaggaactgggcctgcaggcccgcgatctaagattccagcacgttatgagtatcaccgtgaggaacaaccgcatcatcatgcggatggaatacctcaaggctgtgataactccagagtgcctcctgatcctggattaccggaatttgaatctagaacaatggctgtttcgcgaactcccaagccagctaagtggcgagggccaattggtgacctatccgctcccgtttgaattcagggctatagaggcccttctccagtactggatcaatacactgcagggtaagctgtccatcctccagccactgatactggaaaccctggatgcgctagtcgacccaaagcactcgtctgtcgatcgatcgaagttgcatatactcctgcagaacggcaagtccttgtcagagctggaaacagatattaagatcttcaaggaatcaatcctggagatactagacgaggaagagcttctagaagaattgtgcgtaagtaaatggagcgatcctcaggtttttgaaaaatcctctgctggcatcgatcacgcggaagagatggaacttttgttggagaactactataggttagctgatgacctttctaatgcagccagggagctgcgcgtgctgatcgacgatagccagagtataattttcataaatctcgattcccatcggaacgttatgatgagacttaacctccaattaactatggggactttcagcctatctctgttcggcctcatgggagtggctttcggcatgaacctagagtcttcgctggaagaggaccacagaattttttggctgattaccggtatcatgttcatgggatctgggctgatctggagaagactcttgagctttctaggccgccagctagaagcgccgttaccaccaatgatggccagcctgcccaagaaaacactcttggctgatcgctccatggagctgaaaaattcacttcggctggacggcctcggctcagggagatcgattcttactaatagatag

SEQ ID NO: 27899 - DNA, 1341 bp, Artificial Sequence
  Description of Artificial Sequence: Synthetic coding sequence
atggagtgtctgagaagcttgccgtgcctcctaccacgggctatgaggctgcctcgcagaacactttgtgcccttgcactcgacgtgaccagcgtcggaccccctgtcgccgcctgtggacggcgcgccaatctgattggtaggtctcgcgcagcacagctgtgcggacctgaccgcttacgcgtggcaggcgaagttcatcggtttcggaccagcgatgtctcacaagcgaccctagctagcgtggcaccagtgttcacagtgacaaaattcgataaacaggggaacgtcaccagctttgaaagaaagaagactgagttgtaccaggaattgggactgcaagcacgtgatctgaggttccaacacgttatgagcattactgtaaggaataacagaatcattatgcgcatggaaaaatactccctcttgttggagagcgttgctagcatccttcagaactctgtttccttcatggagcggcagacggagcagtggctgtttagggagctaccaagccaattgtctggagagggccagctcgtcacttaccccctgcctttcgaatttagggctatcgaggccctgcttcaatactggataaacaccctgcagggcaaactcagcatcctgcagcctctgatcctggagaccctggatgccctcgtggaccctaaacacagttcagtggatcggtctaaactgcacatacttcttcagaatggcaagagtctgtctgagttagaaacagacatcaagatattcaaggagtcaatccttgaaatcctggatgaagaagagctgttggaagagctctgcgtgagtaaatggagcgatccccaggtgtttgagaagagctctgctggcatcgaccacgcagaggagatggagctcctcctggaaaattactataggctcgcggatgacctgagcaatgccgcacgcgaattgagagttctgattgacgatagccagtctatcatcttcataaacctggattcccacaggaacgttatgatgcgcctcaacctgcaactgacaatgggcaccttttccctctctctatttggcctaatgggcgtggcattcgggatgaacctcgaaagctcactggaggaggaccatcggatcttctggctgattactggtatcatgttcatgggctcaggattgatctggaggagactgctcagttttttgggcaggcagctcgaagctcctctcccccccatgatggcttctctacctaaaaaaaccctgttagccgacaggtctatggagttaaaaaacagcctgagactggatggcctcggaagtggacggagcatcttaacaaaccggtag

SEQ ID NO: 27900 - DNA, 549 bp, Artificial Sequence
  Description of Artificial Sequence: Synthetic coding sequence
taacgggcagcccaactgtgcgggcccgacagactacgtgtggccggcgaagtacacaggtttcggacatctgacgtgtctcaggccacactggctagtgtggcccccgttttcaccgtgaccaaatttgataagcagggtaacgttaccagtttcgagaggaagaagaccgaactgtaccaggagctggagacagatattaaaatcttcaaggagagcatccttgagattctcgatgaagaggagctcctggaagaattatgcgttagtaaatggagcgacccccaagttttcgaaaagagttccgcaggtatcgatcatgctgaagagatggagcttctcctggagaactattaccggctcgcagatgacctctccaatgcggctagagaattgcgtgttttaattgacgattcacaaagcatcatcttcatcaatctggactcccatcgcaacgtcatgatgcgtctgaacctgcaactaacgatggggaccttctcactaagcctctttggcctcatgggcgtcgcatttgggatgaacctgtag

SEQ ID NO: 27901 - DNA, 1182 bp, Artificial Sequence
  Description of Artificial Sequence: Synthetic coding sequence
atggagtgcctgcgatcccttccatgcctgcttcctcgtgcaatgagactgccaagacgcacactctgcgcattggcacttgatgtgacctccgtcgggcctcctgtggccgcatgcgggcggagggccaatctcattggcagatctcgtgccgcccagctgtgcggccccgaccggttgagggtggctggcgaggtgcatcgcttccgcacatcagatgtctctcaggccactctcgcgtctgtggccccagtttttaccgtctacttaaaagccgtgataactcccgagtgcctactaattctagactacaggaacctaaatttagaacagtggctctttagggaactgccaagtcagctgtctggggaagggcaattggtgacataccctctgcccttcgaatttagggctattgaagccctgctccagtattggataaacaccttgcagggtaaattgtccatcctgcagccattgattctcgagacacttgatgctctggtggacccaaaacactcatccgtagataggtcaaagctgcacatcctgttgcagaatggcaagagcctgtctgaactcgaaaccgatattaaaatttttaaagagagcatcctggagattctagatgaagaagaactgctcgaggagctctgtgtgtcaaagtggagtgacccacaggtcttcgagaagtccagcgccggcatagatcatgcggaagaaatggagttattgctggaaaattattatcgccttgccgacgacctctctaatgccgcccgcgagctgcgcgtgctgatcgacgactcccagtcaatcatattcatcaatctggatagccacaggaatgtcatgatgagactcaacctccagctgacaatggggacatttagcctttctctctttggtctgatgggggtagccttcgggatgaacttggagagctctctagaggaggaccatcgaattttctggctcatcactggaatcatgttcatggggtcaggccttatttggcgcagactcctgtcatttttgggaaggcagctagaggcacctctcccccccatgatggccagcctgcccaaaaaaacactgctagctgatagatccatggagttaaagaacagccttagattggatggactgggctctggccgtagtatcttgaccaaccggtag

SEQ ID NO: 27902 - DNA, 459 bp, Artificial Sequence
  Description of Artificial Sequence: Synthetic coding sequence
atggagttgctgttggaaaactactaccgactggccgacgacctctccaacgccgcacgcgagttgagggtgctaattgacgattcccagtctataatatttatcaatctggactcacatcgcaacgtgatgatgcgcctgaacctgcaattaacaatggggacctttagcctctctctgttcggtctgatgggagtggcttttggcatgaatttagagtctagtttagaggaggaccacagaatcttctggcttattacaggcattatgttcatggggagtggcctgatctggaggagactactatcattcctcggacggcagttggaggcaccgttaccaccaatgatggcatcactgcccaaaaaaacattgctggccgatagatccatggagcttaaaaactcacttcgcctcgacgggctagggagtggtaggtctatacttaccaatcgatag

SEQ ID NO: 27903 - DNA, 1254 bp, Artificial Sequence
  Description of Artificial Sequence: Synthetic coding sequence
atggccttaagcgctcagcagattcctcgatggtttaacagtgtgaagctgcggagtctgattaatgccgctcagctgaccaaacggtttacacggcccgcccggactctgctccatgggttctcggcgcagccccagatctcctctgacaactgtttcttacagtggggattcaagacctacaggacttcttctctttggaacagctcacagagcacttcaagtagttctcaggagaataacagcgcacaatcatctctcctccctagtatgaacgaacaatcccagaagacacagaatatctcatccttcgactccgagcttttcctagaggagttagacgagctgccccccctcagtccgatgcagcctatatccgaagaagaggcaatccagatcattgcagaccccccattaccgcctgccagcttcacactgagagactatgtggatcactctgaaactctgcagaaactcgtgctattgggcgtcgaccttagtaagatcgagaagcaccccgaggctgctaacctcctgcttcgccttgactttgagaaggacatcaaacagatgctgctcttcctgaaagacgttggtatcgaggacaaccaattaggggcatttctgaccaagaaccacgccatcttcagcgaagatctcgagaacctcaagacgcgtgtagcgtacctccactccaaaaatttcagtaaagccgacgtggcccagatggtccgcaaagctccattcctgctgaacttctctgtcgaaagactggataacaggctgggattttttcagaaggaactggaactctctgtaaaaaaaacgcgcgatctcgtggtccgcttgccgcggctgctcaccggttcactagagccggttaaggagaacatgaaagtctacagactggagctcggcttcaagcataacgaaatccaacatatgattacgcggatccctaaaatgttgacagccaacaagatgaaactgacagagacctttgattttgtacacaacgtcatgtcaatcccacaccacataattgtgaaatttcctcaagtgttcaatacacggctttttaaggtgaaggagcgacacctgttccttacctatttagggagggcacagtatgatccagcaaagccaaattatatctccctcgataaattggtttctatacccgatgagattttctgcgaggagatcgccaaggcctctgtgcaggatttcgaaaagtttctgaagacactctag

SEQ ID NO: 27904 - DNA, 1158 bp, Artificial Sequence
  Description of Artificial Sequence: Synthetic coding sequence
atgctgtggaaactacttctgcgctcacagtcctgtcgactgtgtagcttccgcaagatgcggtccccccctaagtaccgaccttttctcgcctgtttcacctatacaactgacaagcagtcatccaaagagaacacccgaactgttgagaagctctataaatgcagtgttgatattaggaagattcgaagacttaagggatgggtgctactggaagacgagacctacgtggaggagatcgccaacattctccaggagctaggagcagatgagaccgccgtcgcatccattctggagaggtgccccgaggcaatcgtttgtagtcccaccgcggtcaacacgcagcgaaagctttggcaactggtgtgtaagaacgaggaagagctgataaagctgattgaacaattccctgagagcttcttcactataaaggatcaggagaaccagaagctaaacgtgcagttttttcaagagctgggactgaaaaatgtggttattagtaggctgctgacggctgccccgaatgtgttccacaatcctgtagagaaaaataagcaaatggtgagaatcctgcaggaatcttatttggatgtgggcggttccgaggctaacatgaaggtgtggctgctcaagctcttatctcaaaacccattcattctactgaacagccctacagccattaaagaaaccttggaattccttcaagaacaggggttcacctcctttgaaatcttgcagctcctgagcaaactcaaaggtttcttgttccaattatgtcctaggtctatccagaacagtatatcattcagcaagaacgcatttaagtgtaccgaccacgaccttaaacagcttgtgttaaagtgccccgcgttgctgtattacagtgttcccgttcttgaggaacgtatgcagggattgcttcgggaaggaatctcaattgcccagatccgggagacgcctatggtgcttgagctgacaccccagattgtgcagtaccgcattcgaaagttgaactcaagcgggtatcggatcaaagacgggcatctcgcaaacctaaacgggtcaaagaaagagttcgaggcaaacttcgggaaaatacaggcaaagaaggtgcggcctctctttaaccctgtggcccctcttaacgtggaggaatag

SEQ ID NO: 27905 - DNA, 1158 bp, Artificial Sequence
  Description of Artificial Sequence: Synthetic coding sequence
atgctctggaagctgttgcttcggtcccaatcctgtcggctgtgtagttttcgcaaaatgaggtcgccgcccaagtaccggccctttctcgcatgttttacctatactacagacaagcaaagcagcaaggagaatacccgcaccgtggaaaagctctataagtgctcggtggatattcgtaagatcaggagactaaaaggctgggtgcttctggaggatgagacctacgtcgaagagattgccaatatcctacaggaacttggcgctgacgagaccgcagtggcatccatactggagaggtgccctgaagcgatcgtatgtagccctaccgccgtgaatactcagcgtaaattgtggcaactagtctgtaagaatgaagaagaattgatcaaactgattgagcaatttcccgagtccttcttcaccattaaggaccaagagaaccagaaactgaacgtccagttcttccaagaactgggcctgaagaacgttgttatctcccgtttgctgaccgccgccccgaatgtgttccataacccagtggagaaaaacaagcagatggtacgaatattacaggagtcttacttagatgtcgggggaagcgaggcgaatatgaaagtgtggcttcttaagctgctaagtcagaatcccttcattctgctgaactcccctactgccattaaagagacattggagtttttgcaggagcaaggattcacctcgttcgaaattttacaacttctgtccaagctgaaggggtttttgttccagttatgcccgaggtcaatccaaaattccatcagtttcagcaaaaatgcctttaagtgcactgaccatgatctcaaacagttggtactgaagtgtcctgcactcttgtattatagcgtacctgtgctagaagaacggatgcagggactactgagggaaggaatctccattgcgcagatacgcgagacacctatggttctggagcttaccccgcagatagtgcaatatagaattcgcaagctgaactcctctggctacagaatcaaagatggtcatctggccaacttaaatgggtcgaagaaagaattcgaagctaatttcggaaaaattcaggccaagaaagtgaggcccctgtttaaccccgtggcacccctgaacgtcgaggagtag

SEQ ID NO: 27906 - DNA, 537 bp, Artificial Sequence
  Description of Artificial Sequence: Synthetic coding sequence
atgttgtggaagctgcttctgaggagccaatcgtgccggttgtgttcattcaggaaaatgcggtcaccgcccaagtataggccatttctcgcatgttttacatatactacggataaacagagctccaaagagaatacaaggactgtagagaaattgtataaatgtagtgtggatatccgcaagataagaagactgaaaggctgggtgctgctggaagatgagacttatgtcgaagagatcgctaatatactacaagagctaggagcagacgagaccgcagtagcaagcatcttggagcgttgcccggaagcgattgtttgctcgccgacggctgtgaacacacagcggaagctctggcagctggtgtgtaagaatgaagaggaattaatcaaactcatcgagcagttcccagagtccttctttaccattaaggaccaggagaaccagaagctcaacgtgcaattctttcaggagcttggactcaaaaatgtggttatctcccgtctgcttacagccgcccctaacgtgttccattag

SEQ ID NO: 27907 - DNA, 102 bp, Artificial Sequence
  Description of Artificial Sequence: Synthetic coding sequence
atgctttggaagctgctgcttcggagtcagtcctgtcggctatgtagtttcagaaagatgcgctctcccccaaagtacaggccatttttggcatgtttttag

SEQ ID NO: 27908 - DNA, 261 bp, Artificial Sequence
  Description of Artificial Sequence: Synthetic coding sequence
atgctgtggaagctgctgctgagaagtcagtcctgcagactgtgttcctttcggaaaatgaggtctccacccaaatataggcctttcttagcctgttttacctacaccaccgataagcaatcctcgaaagaaaacactcgtactgtggagaaactttacaaatgctcggtagacattcggaagattcggcgtttgaaaggatgggtattactggaggacgagacatatgttgaagagatcgcaaatatcctgcaggaatag

SEQ ID NO: 27909 - DNA, 1158 bp, Artificial Sequence
  Description of Artificial Sequence: Synthetic coding sequence
atgttatggaagttattactgcgctcccagtcctgccggttgtgtagcttcaggaagatgcgctccccccccaaatacaggcctttcctcgcatgttttacatacaccaccgataaacagtcttccaaagagaatactaggactgtggaaaagttgtacaagtgttccgtcgacatcagaaaaatccgccgtcttaaggggtgggtacttctggaagacgagacgtatgtcgaggaaattgctaacattttacaggagctgggggcagacgaaactgccgtggcctccattttagaaagatgtcccgaagctatcgtgtgctcccctacagccgttaacacgcagcggaaactgtggcagctggtttgcaagaacgaggaggaattgattaaattgatagagcagtttcctgagagtttcttcacaatcaaggatcaggagaatcaaaaactgaatgtgcagttcttccaggaactcggcctcaagaacgtcgtgatttcgcggctgctcaccgccgcccctaatgtgtttcataacccagtggaaaagaacaagcagatggtccgaatcctccaagaaagttacctcgatgtgggtggatctgaagcaaatatgaaagtttggctgcttaaacttctgagtcagaaccctttcattctgctgaactctccaacagcgatcaaggagacacttgaatttctacaggaacagggcttcacatcttttgagattttacagctcctgagcaagctcaaaggcttcctgtttcaactttgtcctcggagcattcagaattccatctcattttccaagaatgcttttaaatgtactgatcacgacctgaaacagcttgtgcttaaatgtcctgcgttactgtattattcagtgcctgtcctcgaggaaaggatgcaaggcctgctaagggaggggatttctatagcacagatcagggagacccccatggtgcttgagctgacacctcagatcgtccagtaccgtataagaaaactgaatagcagtggctacaggattaaggacgggcacctggctaacctaaatggctcaaagaaggagttcgaagctaatttcggtaagattcaggccaagaaagtgcgtccactcttcaatccggtcgctcctttgaacgtagaagagtag

SEQ ID NO: 27910 - DNA, 1701 bp, Artificial Sequence
  Description of Artificial Sequence: Synthetic coding sequence
atgaaaatgcagaaagggaacgtattgctcatgttcggccttctgctgcaccttgaggctgctacaaacagtaacgaaacttcaacttccgccaatactggctcgagtgtgatcagctcaggggcttccactgccaccaattctggctccagcgtgaccagctccggtgtatctacagctaccattagtggctccagcgttacttctaatggtgtaagcatcgttacgaactccgagttccatactacctcaagcgggatctccacggctacaaattctgaattctcaacagtgagcagtggcatctctatcgcgacaaactctgaaagctctacaacctcaagtggcgctagtactgccactaatagcgaatcctcaacccctagctcgggagccagtacagccaccaattcggattcttcaacgaccagttcgggggcttctactgctacgaattcggattcctcgaccacttccagcgaagcctccaccgcaaccaatagtgagtcttcaaccacaagtagtggagcatctacggcgacgaactccgagtcctccacggtgtcatccagagcttctaccgccactaacagcgagagttccactacatcgtcaggtgcctctactgctactaacagtgagagcagaactacatctaacggggcaggcacggctacaaatagcgagtcgagtactacaagtagtggagcaagcactgctactaacagtgaaagttcaactccatcatccggggccgggacagctaccaatagtgaatctagcacaacatcgtccggcgcaggtaccgccacgaacagcgaaagttccaccgtatccagtggaatttctactgttacaaatagtgagagtagtacacccagttccggggccaacacagctaccaattcggaatcgtccactacgtcatctggtgcaaataccgcaaccaattctgactccagcacgacatctagcggggcaagcacagcaacaaattctgaatcttcaacaaccagtagcggcgcctctaccgcaaccaactcagaatcttctacaacctcttcaggggcttctacggctactaacagcggctcgtctacaaccagcagcgggaccagtaccgccacaaatagtgagtctagtacagtgagcagtggcgcgtccaccgctactaccagtgaaagttccactacatcttcaggggcgagcaccgctaccaattctgaatcatctaccgtctccagcggggcttccacagccaccaattcagagagttctacaaccagtagcggtgctaatacagccaccaactctggaagtagcgtgacctcggctggatcgggtacggcagccctaacgggaatgcatacgacttcccattccgccagtacagccgtgagcgaagccaaacctggtgggtcccttgtaccttgggagatctttctgattaccctggttagcgtggtggcggctgtgggactctttgccggcctattcttttgtgtgcggaattctctgagtctgagaaatacttttaatacagcggtctaccatccacacggccttaatcacgggctgggacccggacctggcggcaaccatggcgcccctcatcggccgcggtggtcaccaaactggttctggagacggcccgtttcctcgatcgccatggagatgagtgggcgtaactccggcccgtag

SEQ ID NO: 27911 - DNA, 1251 bp, Artificial Sequence
  Description of Artificial Sequence: Synthetic coding sequence
atgaagatgcagaaagggaatgtgctgctcatgttcggcctcttgctccatctcgaagctgctaccaattcaaacgagacttctacttcggctaacacaggttcctctgtgatttcaagcggggctagcacagcaactaactcagggtcttccgtgactagctcaggagtcagcactgcaacgatcagtggaagctcagttacttcaaacggtgtttccattgtcacgaatagtgagtttcataccactagtagcggcatctctactgctacaaactccgaatttagcactgtgtcctctggaatctctatcgcgaccaattctgagagctcgacaacgtcatcgggcgccagcactgccacaaacagtgaatcttcaacgccttcctctggtgcctccaccgccactaacagtgactcatcaacaacatcctcaggcgcatccactgccacgaattccgatagttccacaacgtcgtcagaggcttctacagccaccaatagcgagtcatcgaccacgtccagcggtgcttcaactgcaactaattcagagtcgtctaccaccagctccggtgcatcgactgccaccaacagcgaatcatccactacgagttcaggcgcctccaccgctacgaacagtggatcaagtacaacttcctctgggaccagcacggccacaaactccgagtctagcacggtgagctccggggccagcacagctacaacaagcgaatcttccacaacttctagtggcgcttctactgccacgaatagtgagagttccacagtctctagcggtgcatccacggccaccaatagtgaatcctcaacaacatcctcaggtgctaacactgcaacaaattcagggtccagcgtaacttccgcgggttcaggcacggctgcccttaccggcatgcacaccacaagtcactccgcgagcacagccgtcagcgaggcaaagcccgggggaagcctagtgccgtgggaaatctttcttatcacactggtctctgtggtggccgcggtgggactgttcgctgggttgtttttctgcgtccggaactccctctcgctcagaaacacttttaataccgccgtttaccatcctcacggccttaaccacggcctcgggcccggtcccggcggtaatcatggagctccccaccgacctcggtggagtcctaattggttttggagacgacctgtgtcgtcaatagcgatggagatgtccgggcggaactcaggcccatag

SEQ ID NO: 27912 - DNA, 483 bp, Artificial Sequence
  Description of Artificial Sequence: Synthetic coding sequence
atgaccttggaggaacttgtcgcatgcgacaatgccgcccaaaagatgcagacggtgacagcggccgttgaagagctgctagtggcagcccaacggcaagaccgactgactgttggcgtttacgagagtgccaagctaatgaacgtagatcccgacagcgtggtcttgtgcttattagccatagacgaagaggaggaggacgacattgctctccaaatacattttacactgattcagtccttttgttgtgataatgacatcaatatcgtacgggtaagcggtatgcaacggttggcccagctactcggggagcctgctgaaacccagggtacaaccgaggcccgagatctccactgtttactcgtgactaatccacacaccgatgcttggaaaagtcacgggttagtggaggtagcttcatattgcgaagagagccgaggtaacaatcagtgggtaccttacatatccctgcaggagcggtag

SEQ ID NO: 27913 - DNA, 888 bp, Artificial Sequence
  Description of Artificial Sequence: Synthetic coding sequence
atggatttcggtctggctctgctgctagctggtcttctagggctcttgcttggccaatctctccaagtgaagccactgcaagtagaacctcccgagcccgtcgtcgctgtcgcactgggggcgtccagacagttgacctgccggttggcctgcgcagaccggggcgcaagcgtgcagtggcgagggctcgatacttccctgggtgccgtacagagtgacaccgggcggtcggtcctgacggtgcggaacgcctccctctctgctgcaggcactagagtgtgtgtcggaagctgcggcgggcgaacattccaacatacagtgcagctattggtgtacgcatttccagatcagctaacggttagtcccgctgccttggtccccggagatccagaggtagcttgtacggcccacaaagtcactcccgtggaccccaacgcacttagtttcagcctgctggttggaggccaggaactggaaggagcacaggccctcggtcctgaagtgcaagaggaggaagaagagccacagggcgacgaggacgtgctctttagagtcaccgaaaggtggcgcctgccgcctttaggaactcctgtgcctcctgctctgtactgtcaggccacaatgcgcttaccagggttggagctttctcaccgtcaggcgatacctgcaagtaaacctgccggtgatcagctgcccgcagctctttggacctcgtcagccgtcctaggccttcttctgctggccctccctacctatcacttgtggaaacggtgccgccacctcgccgaagatgacacgcacccccccgcgtctctgcggcttctgcctcaggtgtctgcgtgggcagggttgcgcggcaccggccaggttggaatctccccatcttag

SEQ ID NO: 27914 - DNA, 603 bp, Artificial Sequence
  Description of Artificial Sequence: Synthetic coding sequence
atggatttcgggttggccctgctgctggccgggcttctggggctgctgcttgcctttcctgatcagctgacagtgtcaccagcagcactggtgccaggcgaccctgaagtggcttgcaccgcacataaagtgacccctgtagatcctaatgccctatcttttagcctgttagtgggcggtcaggagttagagggcgcccaggcactcggtcccgaggtgcaggaggaggaagaagaaccacagggagacgaagacgtgctgttccgtgtgactgaacgctggcgattaccccctcttggaacacccgtcccccctgcactatactgtcaagccaccatgagactgcccggcttggagcttagtcatcgccaagccatacctgctagcaagcccgctggcgatcagctgcccgcggccttatggacatctagcgctgtcctgggcctgctccttctcgctttgcccacctatcatctgtggaagcggtgcagacacctcgctgaggacgacacccaccctccagcctcgttgcgcctgctgcctcaagtgtccgcatgggcaggcctgcggggaaccggacaggttggcatctcccctagttag

SEQ ID NO: 27915 - DNA, 1221 bp, Artificial Sequence
  Description of Artificial Sequence: Synthetic coding sequence
atggatttcggcctcgcgctgctgctggccggacttttaggactactgctcggacagagcctacaggtgaaacccctccaggtggagccccccgagccggtggtggcagtcgccctgggtgccagccggcagctgacctgccgattggcatgcgctgacaggggtgcgagtgtgcaatggagaggccttgatacgagtctcggagccgttcagagcgacacaggaaggagcgtgctcaccgtgcgcaatgcctccctctcggctgccgggactagggtctgtgttggctcctgtggcggcagaacctttcaacacaccgtgcagctgctggtgtacgcgttccccgatcagcttacggttagccctgccgcactagtgcccggtgaccccgaggtggcctgtacagctcacaaggtaactccagtggaccctaacgccctgagcttcagccttctggtgggaggccaggaattggaaggggctcaggccctcgggcctgaggtgcaggaagaggaggaagagccacagggagatgaagacgtgttattccgcgttactgaaaggtggagactccctcctcttgggacccctgtgcctccggccctgtattgccaggcaaccatgagacttcctggactggagctgtctcaccgacaagcaatccccgcgctgcacgctctgtccaaccccgaggcaccggccgctgagtccccccaagcaccctccttatccactccagcctctagccatccaacctcaccagagccacctgatacgacgtctcccgagtccccagatacaacctcgcccgagtcccccgatactacgagtcaggagcctccggatacaacttcccccgagccgccggataagacctctcctgaaccggcaccacagcaagggagcacacatacacccagatcacctgggagtaccagaacaagaagaccagaaatatctcaggcgggtcccacacagggcgaagtcatccctaccgggagctcgaaacctgcgggagatcagttgcctgccgccctgtggacctcaagcgccgtgctgggcttgctgttattggcactgcctacctaccacctgtggaaacgctgcaggcacctggcagaggatgatacacacccacctgccagcctgcgactcctcccgcaagtgagcgcctgggccggtctgcggggaaccggccaagtggggatcagcccatcttag

SEQ ID NO: 27916 - DNA, 1197 bp, Artificial Sequence
  Description of Artificial Sequence: Synthetic coding sequence
atggactttggcctggcattgctattggctggcctcttgggcctgctcctcggccagagcctgcaggtgaaaccattgcaagtcgaaccgcccgagcccgtggtcgccgtcgccctgggcgcgagccggcaactgacatgccgcctggcatgcgccgatcgaggcgcttctgtgcagtggcgtggtttggacacatctctgggtgctgtgcagagcgatactggcaggagtgtactgactgtgcgtaatgccagcctgagcgccgcggggacccgggtgtgcgtaggaagctgtggcggcagaactttccagcacacagtgcagctcttagtgtacgcctttcccgaccaattgaccgtttcaccagccgctctcgtgcctggcgatcccgaggtggcgtgtactgctcacaaagttacccctgtggacccaaacgccctgagcttttctctgcttgtgggggggcaggagctagaaggggcacaggcgttagggccagaggtgcaggaggaggaggaggagcctcaaggggacgaggatgtgttgttccgcgtcaccgagcggtggcgacttcccccgctggggacacctgtcccacctgccctgtattgccaagccaccatgcgactcccggggcttgaactgtcgcaccgacaggcaatccccgcccttcatggatggctctcacccccccctccacagaataccgggccccacggccctcaccccacaagccccgaacctcctgataccacgtcccctgagagcccagacaccacctctcctgagtctcctgacacaaccagtcaggagccccctgacaccacttcgcccgagcctccagacaaaacttcccctgagcccgcacctcagcaggggtctactcatacgccccggagccctggatccacgcgtacacgaaggccagagatctctcaggcgggacccacccagggcgaggtaatccccactggtagtagtaaacctgccggagatcagcttccagccgcactctggactagttctgccgtgctagggttactgctcttggccctgcccacctatcacttgtggaaacgctgtcgccatctggctgaagacgacacacatccccctgcctctctgcgcctgttaccacaggtctccgcatgggcgggcttacgcggaacggggcaggtcggtattagtccatcctag

SEQ ID NO: 27917 - DNA, 1173 bp, Artificial Sequence
  Description of Artificial Sequence: Synthetic coding sequence
atggattttgggctggctctcctgcttgcggggctgctgggtctgcttctgggtcagagcctgcaggtcaaacctcttcaggtcgaaccacccgagcccgttgtagcagttgcactgggagcttcacgccagctgacctgtcggcttgcgtgtgccgatcgcggcgctagcgttcagtggcggggactggacacctctctcggggccgtacagagcgatacaggtcgctcggtcctgacagtgcgaaacgctagtctgagcgctgcaggcactagggtgtgcgtggggagttgcggaggaaggactttccagcatactgtccagctgttagtctatgcttttccagaccagctgacggtgagcccggctgccctcgtgcccggtgatccagaggtggcatgcacagcacacaaggtgactcctgtggatccgaatgccctcagcttttctctcctggtgggaggccaggaactcgaaggtgctcaggctctcgggcctgaagtgcaagaggaagaagaagaaccacagggggatgaagatgtgctcttccgggtaaccgagcggtggcgcctcccacccctaggcacacctgtccctccggccctctattgccaggcaactatgcgcttacctggtttggaactctctcacagacaagccattccagctttacacgctctgtccaatccagaggccccagcccccacgtccccagagccaccagatactaccagccctgagagccccgacacaaccagcccagagtccccggataccaccagccaggagccccctgataccacctccccagaacctccagacaaaactagccctgagcctgccccacagcaaggatctacgcacaccccgagatctccaggttctactcgaacccgaagacccgagatttcccaggccggacccacccaaggggaggtgattcccacggggagctctaaaccggccggggatcagctccccgccgcactttggacttcttctgctgtcctgggcttgttactgctggcgttgccaacttaccacctttggaagcgttgcagacatttagccgaagatgacacccatccacctgcgtccctgagactgctgcctcaggtgtccgcatgggctggattaagaggcaccggacaagtcggaatctccccgtcctag

SEQ ID NO: 27918 - DNA, 921 bp, Artificial Sequence
  Description of Artificial Sequence: Synthetic coding sequence
atgggaatcttggacatagaagtttggggaaaggataacaaaaaacacgaggagcggctggggacttgtaaggtggacatttcagccctgcctctgaaacaggcgaattgtttggaactgccactcgatagctgcttgggtgccctgctaatgttagtgactctcacaccttgcgccggcgtatcggtgagcgacctttgtgtgtgtccattagctgacctctccgagcggaaacagataacgcaaagatattgtctccaaaactctttaaaagatgtgaaggacgtgggcatattacaggtcaaagtgttgaaagctgcagatcttctggccgcagacttcagtggtaaaagtgacccgttctgtttactggaattagggaatgatcggctacaaacacatactgtgtataagaacctcaaccctgaatggaataaggtctttacttttcccatcaaggacatccatgatgtgctggaggtgaccgtcttcgatgaagacggcgataagccgccggatttcctgggcaaagtcgctataccccttctgtctataagagatggccagccaaactgttatgttctcaagaataaagacctcgagcaggccttcaagggtgtgatatacctggagatggatctgatctacaatccagtaaaagcaagtattaggacctttacccctagagaaaagcgtttcgtggaagattctcgcaaactaagtaaaaaaattctgagtcgggatgtggatagagtgaagcgcatcacaatggctatttggaatacaatgcaattcctgaaatcctgtttccagtgggagtcgaccctgaggagtacaatagcttttgcacatcgaaaagaggagcctcctctgtccatgaaatgtacactgttttcaggtgacatcggtccctccctgtag

SEQ ID NO: 27919 - DNA, 2337 bp, Artificial Sequence
  Description of Artificial Sequence: Synthetic coding sequence
atgctggattcctgtaaactgaagtccgcatgcaacctgccctttatctgtaacaagaaaatcatcaatacagcgggcacttcaaatgcagaggtgcctctcgcggatccaggtatgtatcagcttgatattacgcttcgtaggggacagtctcttgctgcacgagaccgtggcggaactagcgatccctacgtgaaattcaagattggtggaaaggaagtgtttaggagtaagatcatccacaaaaatctcaaccctgtgtgggaagagaaggcatgcatactggttgatcacctccgagaacctctgtacatcaaagtgtttgattacgatttcggactgcaagatgattttatggggtccgcgttccttgaccttacccagttagagcttaaccgccctactgacgtgacgcttacactgaaagaccctcattatccagaccacgatcttggcatcattctgctatccgtgattttgacgccaaaggagggcgagtccagggatgtgaccatgctcatgcggaagagttggaaaaggtcttctaaagaactttcagaaaacgaggtggtcggatcctatttcagtgtgaaatcccttttttggcggacctgcgggcggcccgcgcttcctgtgctcggcttttgcagggccgagttacaaaatccctattgtaaaaatgtccagtttcagacgcagtcactccggctctccgacctgcaccgcaaaagtcatctgtggcgaggaattgtgagcatcacactcatcgaagggcgggatctgaaggccatggacagcaatggtctctccgatccatacgtaaagtttagacttggacatcagaagtataagtccaagatcatgcccaagacactcaacccacagtggagagaacagttcgatttccatctctatgaagaacgaggaggggtgatcgacataactgcttgggataaggacgctggcaaacgcgacgatttcataggacgttgccaggtggacctaagtgcacttagtcgggagcagacacataagctcgagttacaacttgaggagggagagggacatttggtgctcctcgtgactctgacggcctccgcgacagtgagtatctctgacctgtccgtgaatagcttagaggatcagaaggagcgagaggagatcctcaagcggtactcacctctcaggatattccacaatttaaaagatgtcggcttcctgcaagttaaagtgatcagagccgaggggctcatggctgctgatgttacaggaaaatctgatcccttctgcgtcgttgagttaaacaatgacagactattgactcacaccgtgtacaagaatctgaatccggagtggaataaagtttttacttttaacattaaagacattcactccgtgctcgaggtcacagtatacgatgaggaccgcgacagatccgccgatttccttggcaaggtcgcaatccccctactttctattcagaacggtgagcagaaggcttacgtcctgaagaataagcaactaaccggacccaccaaaggggtgatctaccttgagattgatgtgatctttaacgctgtgaaagcttctctgaggaccctgataccaaaggaacagaaatacatagaggaggaaaacagactgtccaaacagctcctgctcagaaattttattagaatgaagcgatgcgtcatggtcctggtcaatgctgcttactatgtgaactcgtgctttgactgggattcccccccgcggagcctcgctgcctttgtgctgtttctgttcgttgtttggaattttgaactctacatgatccctctcgtgttactgcttctgctgacgtggaattattttttgattatctccggcaaagataacagacagagagacaccgtggtggaggacatgctcgaggacgaggaagaagaggacgataaagacgacaaggatagtgagaaaaaaggctttatcaacaaaatctacgcaatccaggaggtgtgcgtgtcagtccaaaacatcttagacgaagtcgcctctttcggcgagcgcatcaagaatacttttaactggacagtacctttcctcagttggctggctatcgtggctctgtgcgttttcacagctatactctattgtatacccctgcgctatatagtattggtttggggcatcaacaaattcaccaaaaaactgagatctccctatgccattgataataatgaacttttggacttcctgtcaagggtgccaagtgatgtgcaggtggtccagtaccaggagttgaaaccagacccaagccactctccatataagagaaaaaagaacaatctgggctag

SEQ ID NO: 27920 - DNA, 738 bp, Artificial Sequence
  Description of Artificial Sequence: Synthetic coding sequence
atgtatcagctggatattactcttcgaagggggcaatccctcgccgcacgcgatcgcggcgggacttcggacccttatgtcaaatttaaaatcggcggtaaggaagtgttcaggtcaaaaataatacataagaacctcaatccagtgtgggaagaaaaggcctgcatcctcgttgatcatctcagggaacctttatatattaaggtgtttgactacgacttcggtctgcaggacgacttcatgggctctgctttccttgacttgactcagcttgagctcaaccgcccaaccgacgttacactgacacttaaagacccacattacccagaccacgacctgggaattatcctgctgagtgtgattttaacaccaaaagagggggagtcccgagatgtgacgatgttgatgcggaaatcttggaaaagaagcagtaaatttcagacgcagtcgcttcggctgtcggatttgcaccgcaagtctcacctatggcgggggatcgttagcattaccctaatcgaaggcagagatctcaaggccatggacagtaacgggctttcggacccttatgtgaagttccgcctgggacaccaaaaatacaaaagtaagataatgccaaaaactctgaaccctcaatggcgggaacagtttgatttccacctttatgaggaaagatgtggtatcagtcctggggaatcgcaccagtctggtcgagtaaacggatgtaggaggcactggtag

SEQ ID NO: 27921 - DNA, 2079 bp, Artificial Sequence
  Description of Artificial Sequence: Synthetic coding sequence
atgctcgactcttgcaagcttaaatccgcctgcaatctgcctttcatttgcaataagaagatcattaatacggctgggacctccaatgctgaagtgcctttggctgaccccggcatgtatcaactggacataacactccgcagggggcagagtcttgccgcacgtgacagagggggcacatcagatccatatgtaaagtttaagataggtggtaaggaggtgttcaggtccaaaatcatacataagaatctgaatcctgtgtgggaagagaaggcatgcatcctggtagaccacttacgagagcccctgtacatcaaggtttttgactatgattttggactgcaggacgatttcatgggcagcgcgttcctggaccttacacagctggagctgaacaggcccacagacgtgaccctgacgctcaaagatccccactacccggatcacgatctcggtatcatactactcagtgtaattctcactccaaaagagggcgagagtcgggacgttacaatgctcatgagaaagtcgtggaagaggagcagtaagtttcagactcagtccctgagactgagtgatctccacaggaaatcacacttatggagggggatcgtaagcattacactgatcgaaggtagagacctaaaggccatggacagcaatggacttagcgacccctacgtgaaatttaggctgggccatcagaaatataagagtaaaatcatgcccaaaacacttaacccccaatggcgcgagcaattcgactttcatctgtatgaggaacgaggcggggttatcgacattactgcgtgggataaagacgcgggaaaaagagatgactttatcggccggtgccaggttgacttgtcagccttgagccgcgaacaaacgcacaagttggaactacagttagaagaaggcgaaggtcaccttgtcctactggtaaccctgaccgcctcagccacagtcagcatctccgatctgtccgttaattccctggaggaccagaaagagcgagaggagatcctcaaacgatatagtcccctgagaatcttccacaatctcaaggacgtgggctttctgcaagtcaaggtcatccgggctgaaggcttaatggcggccgatgtcacaggcaagagcgaccccttctgtgttgtcgaactaaataacgatcgcctgttgactcatactgtttataaaaatttgaatccagaatggaacaaggtttttaccttcaatataaaggatatccactctgtgctggaggttactgtgtatgacgaagacagggacaggtctgccgactttctgggcaaggttgccattccactgctctctattcagaacggcgagcaaaaggcctacgtgttgaagaataagcagctcacaggtcccacaaaaggcgttatctacctcgaaatcgacgtcatcttcaacgccgtgaaagcctccctgcggaccctaatccccaaggagcaaaaatatattgaggaggagaatcggctgagcaaacagttgctgttgcggaactttatccgcatgaagagatgtgtgatggtcctcgtaaacgcagcatattatgtgaacagttgttttgactgggactcacctcccagaagcctggccgcgttcgttgtggtggaggacatgcttgaggacgaagaagaggaagatgataaagatgacaaggactccgaaaagaaaggctttatcaacaagatctatgcgattcaagaagtctgtgtttccgtgcagaatatccttgacgaggttgcatcctttggagagagaatcaaaaacactttcaactggacagtaccattcctgagttggcttgccattgtcgcactttgtgtcttcacagctattctgtattgcattccactgcgctacatcgtgctggtgtggggtatcaataagttcactaagaagctgagaagtccttatgccatcgataataatgagctactggattttctttcacgggtaccatccgatgtccaggtggtgcaataccaggaactcaagccggacccgtctcactctccttataaacgaaagaagaataatctcgggtag

SEQ ID NO: 27922 - DNA, 1548 bp, Artificial Sequence
  Description of Artificial Sequence: Synthetic coding sequence
atggacagtaacggtttgtcagacccatatgtaaagttcagactgggacaccagaagtataagagcaagatcatgccaaagaccctaaaccctcagtggagggagcagtttgacttccacctgtatgaagagcgtgggggggtgattgatattacagcgtgggataaggatgccggtaagagggacgattttattgggcgctgccaggtggacctatccgccttatcgagagaacagacccacaagctagagttgcagttggaggaaggagaaggacatttggtactcttggtaacacttaccgcgagtgcaaccgtgagcatctccgatctgagtgttaactctctggaagaccaaaaagagagggaggaaattctgaagcggtactctcctttaaggattttccacaacctgaaggatgtcggatttttgcaagtgaaggttatcagggccgagggactcatggccgccgacgtgacaggaaaaagtgaccccttttgtgtggtggagcttaacaatgaccggctgctgacacatacagtgtacaagaacttgaacccagagtggaacaaggtgttcacatttaacattaaggacatccatagcgtccttgaagtcacagtgtacgacgaagatcgcgacagaagtgccgatttcctggggaaagtcgccatcccattgctctctatacagaatggcgaacagaaagcgtacgtcctcaaaaacaaacagctgaccgggccgaccaaaggcgtgatctaccttgaaattgacgtaattttcaacgcagttaaagcaagcttgaggactctgattcctaaagagcaaaaatatatcgaggaagagaataggctgtccaaacagctgctgctgagaaattttatcagaatgaagcggtgtgtgatggtcctcgtcaatgccgcctattacgtgaattcctgctttgactgggatagtcctccccgatctctggcagcatttgtgctgttcttgtttgtggtttggaactttgaactgtacatgatccccttagttctcttactcctgctgacgtggaactatttcctgatcatttccgggaaagacaataggcagagagacacagtggttgaagacatgctggaagacgaggaagaggaggacgacaaagacgataaggacagcgaaaagaagggctttattaataagatctatgcaattcaggaggtctgtgtctccgtgcagaacatcctcgacgaggtggcgtctttcggagaacggataaagaacactttcaattggaccgttccctttcttagttggcttgccattgtagcgttgtgcgtgtttacagccatcctttattgtattcccctcaggtacatagtgctcgtgtgggggatcaacaagtttactaaaaagctgaggtcaccttacgcgatcgataacaacgagctcctggactttctctcacgcgttccatccgatgtccaggtggtccagtatcaagagctcaagcccgacccaagccattccccctataagagaaaaaagaacaacctcggatag

SEQ ID NO: 27923 - DNA, 1803 bp, Artificial Sequence
  Description of Artificial Sequence: Synthetic coding sequence
atgctcgactcttgcaagttgaaaagtgcctgcaaccttccttttatctgtaataagaaaatcatcaacactgcaggcactagcaatgccgaagtgcctttggccgaccctggtatgtaccagctggacattactctgcgtcgtgggcagtcccttgccgcccgcgaccgtggaggcactagtgatccttacgtaaaatttaagatcggagggaaggaggtattccggagcaaaataatccacaaaaacctcaatcccgtgtgggaagagaaagcatgtatccttgtcgaccacctccgcgagcctctctatatcaaggtgttcgattacgactttgggttgcaggacgatttcatgggaagcgcatttctagatctcactcaactggaacttaataggcccacagatgtgactctaactctcaaggatccacattaccctgatcacgatctcggtataattctgctgagcgtgatcttaaccccgaaagaaggcgaaagcagagacgtgactatgctcatgaggaagagctggaaacgatcatcaaaagaactgagtgagaatgaggtcgtagggagctatttctccgtgaaatctctgttctggcgtacatgtggccgccccgccttgccagtccttggcttctgtcgcgccgagcttcagaacccatactgtaagaacgtgcagttccaaacacaaagtttgaggctttccgaccttcaccggaaatcacatttgtggcgcggcattgtgagcataactttgatagagggaagagaccttaaagcaatggattccaatggtttaagcgatccttacgtgaaatttcgcctcggtcaccagaaatataagtctaaaatcatgccaaagactctgaatccacagtggcgggagcagtttgattttcacctgtatgaagaaagaggtggagtgatcgatattactgcctgggataaggacgctgggaagcgggacgactttatcggtcgctgccaagtggacctgtccgccctttcccgggaacaaacccacaagctggagctgcagctcgaagagggcgaagggcacttggtcctcctcgttacactcactgcttccgctacggtaagtatttccgatttgtcggtgaatagcctggaggaccaaaaagaacgtgaggaaattcttaaacgttattcccctctcaggattttccacaatctcaaggacgtcgggttcctccaggttaaggttatccgggcagagggcctcatggctgctgacgttactggcaagagcgatcctttctgtgtagtggagctcaataatgaccgcctgctgacacacaccgtgtataagaacctgaaccccgaatggaacaaagtgtttaccttcaacatcaaggatattcatagcgtgctcgaggtaacggtatacgatgaagacagggatagatccgcggacttcctggggaaagtggccatacccctgttatctatacagaatggtgaacagaaggcttatgtccttaaaaataagcaactcacaggccccactaaaggagtcatatatcttgagatcgacgtgatcttcaacgccgtgaaggcaagcctgagaacacttattccgaaggaacagaaatacatagaagaagaaaacagactcagtaaacaattgcttctgcgaaatttcattcgcatgaagaggtgcgtgatggtgttggtcaacgcagcttactacgtgaactcatgctttgactgggactcccctcctaggagtctggccgcatttgtcgctttgtatggcaccttcattaacgtgtag

SEQ ID NO: 27924 - DNA, 246 bp, Artificial Sequence
  Description of Artificial Sequence: Synthetic coding sequence
atgctggacagttgtaagttgaaaagtgcctgtaacctcccgtttatttgcaataaaaaaatcatcaacacagcaggaactagcaatgccgaagtgccattagccgaccccggcatgtaccagttggatatcacattgcgcaggggacagagcttagccgcccgagacaggggcgggacatccgatccatacgtgaaatttaaaattgggggcaaagaagtgtttcgcagcaagatcatacattag

SEQ ID NO: 27925 - DNA, 3000 bp, Artificial Sequence
  Description of Artificial Sequence: Synthetic coding sequence
atggagcctcgcgcagccgccgccggggagcccgaaccgcccgcagcctcctcatcgtttcaggcacgcctgtggaaaaatctgcagctcggcgtggggcggtcgaaaggcggagggggcggccgggccggcggccccgagcgccggaccgctgacactccctcccccagccccccccctccagttggaaccggcaacgcccccgcgcggggtagcggcgcaggctctcggtggagtggattcaagaaacggaaacaggttctggaccgggtgttttctagtagtcaacctaatctgtgctgttcatcccccgaacctttggagccgggaggggcaggacgcgcagaacaaggctctacgttacgcagacggattcgtgaacatctgctgcccgctgtcaaagggccagcagcagcaagcggcgccgctgggggcactccaccaggcggccggtcgccggattcggctccttcatcaagctctgcttcctcatctctgtctagctcacctcaacctccacctaggggggaccgggcgcgcgacgaaggggcacgacgacagggtcccggcgctcatctgtgtcaccagaagagttcatctctgccaggtaccgcttgccttgagcagcttctcgaaccccctccgccacccgctgagcccgctcgttcacctgccgagtctcgcgctccagaaacaggggaggagcacggctccagccagaagataatcaatacagccggcaccagcaacgctgaagtgcctctggcagaccctggtatgtatcagttagacatcaccctcagacgaggccagtctctggccgccagggataggggcgggacaagcgatccatatgttaagtttaaaatcggtggtaaagaggtgttcaggtctaaaatcatccacaaaaatctgaaccctgtgtgggaggagaaagcttgtatcctggtggaccacctccgggaaccgttatatattaaggttttcgattatgacttcggtctacaagatgactttatgggatcagcctttcttgacctgacacaattggagctgaatagacccactgatgtaaccttgaccctgaaagacccccactaccccgaccatgatcttgggatcattttacttagcgtgatcctaactccaaaagaaggagagtcccgggacgttacaatgctcatgcggaagtcatggaagcgaagcagcaaggaactgagcgagaacgaagtcgtaggcagttacttcagcgtgaagtcacttttctggcgcacctgcgggagacccgcgctccctgttctggggttctgtcgggcggagcttcaaaacccgtactgcaagaacgttcaatttcaaacccagtccctccgtctatccgacctgcatcgaaagtcacacttgtggcggggcatcgtcagcattaccttgattgaaggaagagatctgaaagctatggatagcaatggtctgtccgatccctatgttaagttccgcctcgggcatcagaaatacaaaagtaagattatgccaaagactcttaacccacagtggcgcgagcagttcgatttccacctgtacgaggagcgtgggggcgtaatcgatattacagcttgggataaggacgcaggtaagagagatgatttcattggtcgttgtcaggttgatcttagcgccctgtcccgggaacagacacacaaactagagctacagcttgaggagggcgagggtcacttagttcttctggtgacccttaccgccagcgccacagtgagtatttcagacctgtctgtaaatagcctggaggaccagaaagaaagagaagaaatcctcaaacggtacagcccactgcgtatcttccacaacttaaaggatgttgggtttctccaggtcaaggtcatccgcgctgagggccttatggccgccgatgtaaccggaaagtccgaccctttttgtgtggtggagctaaacaacgatcgacttctcacacatacagtttacaaaaaccttaaccctgagtggaacaaggtctttacgtttaatataaaagatattcattctgttctggaggtgaccgtttatgatgaggaccgggacaggtccgctgatttcctgggcaaggtggccatccctctgctgtctattcaaaatggagaacagaaagcgtacgtccttaagaataagcagctgactggtccaacgaagggtgtcatatatctggagattgacgtgatcttcaatgctgtgaaggcgtcgctgagaaccctaatcccgaaagagcagaagtacatcgaggaagaaaacagactatccaagcagttgttactgagaaacttcatccgaatgaagcggtgtgtaatggtccttgtcaacgccgcatactatgtgaattcctgctttgactgggattcaccccctcggagcctggccgcatttgtactgtttctattcgttgtttggaattttgagctgtacatgataccactggtgctactgctccttctgacttggaattattttttaatcattagcggtaaagacaacaggcaacgggatacagtcgtcgaagacatgttagaagacgaggaagaagaggatgataaagatgataaggacagcgagaaaaaggggtttatcaacaaaatctacgcaatccaggaggtatgcgtatccgttcagaatatcctagatgaagtcgctagtttcggcgagaggataaagaacaccttcaattggactgtacccttcctctcttggctcgccatcgtggcattgtgtgtgttcaccgctatcctgtattgcatccccctgaggtacattgtccttgtctggggaataaacaaatttactaagaagttacgcagcccatacgccatcgataataatgaactgctggactttctctcccgggtgccttcagacgtgcaagtagtgcaatatcaggaactaaagcctgatccgtcacactctccttacaaacggaagaaaaacaatctgggctag

SEQ ID NO: 27926 - DNA, 921 bp, Artificial Sequence
  Description of Artificial Sequence: Synthetic coding sequence
atggggattttggatatcgaggtctgggggaaggacaacaaaaagcatgaagagaggttggggacttgtaaagtcgacatctccgcacttcctctaaagcaggccaattgtcttgaattgccactggacagctgtctgggagctttactcatgctagtgaccctcacgccttgcgccggcgtgagcgtgtccgacctctgcgtctgtcctctcgcagatctgtccgagagaaaacagatcacccagcgctactgcctccagaactctctcaaggacgtgaaggatgtgggaatcctccaggttaaagtgctgaaggccgcggacctcttggctgccgatttctcgggcaaaagcgaccctttctgtctgttagagttgggaaatgatcgcctccagactcataccgtctacaagaacttgaatccagaatggaacaaagtcttcacattccctatcaaagatattcatgatgttctcgaggtgaccgtattcgacgaggacggtgataagccccctgattttctcggcaaggtagccatccccctgctcagtataagagatggtcagccgaactgttatgttctgaaaaataaagatctcgagcaggcttttaaaggcgtgatttatttagagatggatctcatctataaccccgtgaaggccagcattcggacttttaccccgagagagaaaagattcgtcgaggattctaggaagctgagtaagaaaatcctgagccgcgacgttgatcgcgtcaaacggattacaatggcaatttggaacacgatgcaattcctaaagtcatgtttccagtgggagagcacgctgcgctcgacaattgcctttgcacatcgcaaggaggagccccccttgagtatgaaatgcacactgttttcaggcgacatcgggcctagcttgtag

SEQ ID NO: 27927 - DNA, 2637 bp, Artificial Sequence
  Description of Artificial Sequence: Synthetic coding sequence
atggatctggataagccatccgtgtggggttcacttaaacaacgcactcgccccttactgatcaatctctcgaagaagaaggtgaagaaaaatcccagcaaaccaccggacctgcgagcccgtcaccatctggatcgcagattgtctttatctgtgccagacctgctggaggccgaagcgctcgcacccgaaggtcggccctactcaggcccacaatcctcatataccagcgtcccatcctcactctccacagccggaatctttccaaaaagcagcagcagctctttaaagcagagtgaggaggagttggattggagtcaggaggaggcctcacacttacatgtcgttgaaacggacagcgaagaagcttatgcctcacctgcggaaagacggagagttagcagcaacggcatctttgatctccaaaaaacatctcttggtggtgatgcccccgaggaacccgagaaactgtgtggcagctcagatctaaatgcatcgatgaccagccagcacttcgaggagcaatcagtgccaggggaggccagtgatggactctctaacttgccttccccctttgcatatttacttactattcaccttaaggagggccggaatcttgtagtcagggatcggtgtggaacgagtgacccctacgtcaaatttaagctgaacgggaaaaccttatacaagtccaaggttatctacaaaaatctgaacccagtgtgggacgagatcgtggttttgcctattcagtcgctcgatcaaaagctcagggttaaagtttacgatagagacctgaccacgagcgattttatggggtctgcattcgtcattctgagcgatcttgaattaaaccgtactaccgagcacatcttaaagctggaagacccgaatagtctcgaagatgacatgggagtgattgtgttaaatttgaatctggtggtgaagcagggcgacttcaagcgacaccgttggtccaatcgaaagcgcctgagtgcgagcaaatcctctctgattagaaaccttcgcttgtcagagtcacttaagaagaaccagctgtggaacgggatcatctcaataactctacttgaagggaagaatgtgtctggaggctcgatgacggagatgttcgtgcaactcaagctgggagaccagagatacaaatccaagaccctctgcaaaagcgcaaatccacagtggcaggaacagttcgattttcactacttttcagaccggatgggtatcttggatatagaagtgtggggaaaagacaacaagaaacacgaggagagactcggaacctgtaaggtcgacatctcagctttgcccctgaaacaggcaaactgtctggagttgccactcgattcctgtctaggggccctactaatgctcgtgactctcaccccctgcgcaggggtgtccgtctccgatctgtgcgtttgtcctttggccgacctgagcgagagaaagcagatcactcagagatattgtctgcagaactctctcaaggatgtaaaagacgtgggcattctgcaggtgaaggtgttaaaagcagccgatctgttggccgcagatttctccggcaaatccgaccccttctgcttgctggagttgggaaatgatcggttacagacacacaccgtgtataagaatttgaatccagagtggaataaggtctttactttccctattaaggacatccatgacgtgctcgaggtgacagtctttgatgaggatggcgacaagccaccggatttcttgggaaaagtggcaatcccactgctgagcataagggatggccagcccaattgctacgttcttaagaataaggatctggagcaagcgtttaagggagtgatctatctggagatggatctcatctacaatccggtgaaagcctcaattcgcaccttcaccccaagagagaagcgcttcgtggaagacagtcggaaactgagcaagaagatcctctccagggacgtcgaccgagtgaagagaataaccatggctatttggaacaccatgcagttcctgaaatcatgttttcagtgggagtcgacattgcggtctactatagcattcgccgttttcctgatcacggtgtggaacttcgaattgtatatgattccactcgccctccttctgattttcgtgtacaactttatccgccccgtgaagggtaaggtctcatccattcaggatagccaagaatccacagacattgacgatgaggaagatgaggatgataaagaaagcgagaagaagggactgatcgaacgcatttacatggtgcaggatattgttagtacagttcagaacgtgctggaagaaatagcgtccttcggtgagcggatcaagaacacattcaactggaccgtgccatttctctcatccctggcatgcttgatcctcgcagccgctaccataatactgtattttataccattgcggtatatcattctgatttgggggattaacaaattcaccaagaagctgaggaacccttactccatagataacaatgagctgctcgatttcctcagccgggttcctagcgatgttcagaaggtacaatatgctgaactgaagctctgttccagtcattctccactgcggaagaaacggtcggcactgtag

SEQ ID NO: 27928 - DNA, 2472 bp, Artificial Sequence
  Description of Artificial Sequence: Synthetic coding sequence
atggacttggacaaaccaagtgtctgggggtcactgaagcagcgcacacggcccttgctgataaatctctccaagaagaaagtgaaaaaaaatccctccaaacccccggaccttcgggccaggcaccacctggaccggagactgagcctgagtgtgccagacttactagaagctgaggccctggctcccgaggggcgcccctattccggacctcagtctagctacacgtccgtgcccagctctttatctacagcgggcatttttccaaagtcttcctcctcttctctcaagcagtcagaggaagagctggactggagccaagaggaagcatcccatctgcatgtggtcgagacagattccgaagaagcctatgccagccccgcggagcgccgccgtgtttcaagtaacggaatattcgatctgcagaagaccagtctaggaggcgacgcccccgaggaaccagaaaagctgtgcggttcaagtgacctgaatgccagcatgacctcacagcactttgaggagcagtctgtacccggcgaggcgagcgacggactgtccaacttgcccagcccattcgcctacctactgaccatccaccttaaagagggcagaaatctggtggttagagatcgctgcggcacgagcgacccctacgttaagttcaaactcaacggaaagactttatacaaatcgaaggtgatttacaagaacttaaatcctgtgtgggacgaaatagtcgtgctccctattcaaagcttggatcagaagctgcgcgtcaaggtctacgacagagacctcactacctccgacttcatggggtccgctttcgtgatactttccgatcttgagctcaaccgcactactgaacatatcctcaaactggaggaccctaacagtctggaggacgatatgggcgtcattgtgcttaacctaaacctggtagtgaaacagggggattttaagaggcaccggtggtctaacagaaagcgccttagcgctagtaaaagctccctcatccggaatctgaggttatctgagtcactcaaaaaaaaccagctgtggaatggtataatttcaatcactctcttggaggggaaaaacgtgagtggtggctcaatgacagagatgttcgtgcagttaaagctgggcgaccagcgatacaagagtaagacactttgcaagtctgcaaatccccagtggcaagaacagttcgacttccactatttttccgatcgaatgggaattttagacatagaagtctggggaaaagataacaagaagcacgaagaaaggctcggtacatgtaaggttgatattagcgctctgcccctcaagcaggccaattgcctggagctaccgttggactcgtgtcttggcgctctattaatgctggtgacactcacaccctgcgctggggtctcagtaagtgatctatgtgtgtgtcctctcgccgacctgagcgagaggaagcagatcactcagaggtattgcctgcaaaactcactgaaggacgtgaaggacgtaggaattcttcaagtgaaagtgctgaaagcggccgacctgctggccgcagatttctcaggtaaatcagatcccttttgtctcctggaactgggaaacgaccggctgcaaacgcatactgtgtacaagaacctgaacccagagtggaacaaagtgtttacgttcccgatcaaagacatccatgatgtactggaggtcacggtcttcgacgaggatggagacaagcctcccgactttctgggaaaggtagccatccccctcctgagcattagggatggtcagccaaactgctatgtgttaaaaaataaggaccttgagcaagcctttaagggggtcatctatctcgaaatggaccttatatacaaccctgtgaaggcaagtattcggacttttactcccagagaaaaacgcttcgtggaggactctagaaagctgtcaaagaaaatcttgtcacgagacgtcgatcgcgtgaaaagaattacaatggccatctggaatacaatgcagtttttgaaatcatgcttccagtgggaaagcactttgagaagtaccatagcctttgctgagtctgaaaaaaagggattaatcgagagaatatatatggtgcaagacatagtgtccacggttcagaatgtcttagaggagattgcaagttttggcgaacgcatcaaaaatacgtttaattggactgtgcctttcctaagcagcttggcctgtctaatccttgccgctgcaaccattatactttattttatcccacttcgatacatcattctgatatggggaataaataagtttacgaagaagctgaggaacccttattcgatagataataatgagctcttggactttttatcacgggtcccaagcgatgtgcagaaagtgcagtacgctgaactcaaactctgctcgagccacagcccattaagaaagaagcgatccgctctgtag

SEQ ID NO: 27929 - DNA, 1191 bp, Artificial Sequence
  Description of Artificial Sequence: Synthetic coding sequence
atggatcttgataagccgagcgtctggggtagcctgaaacagcgcaccaggcccctgcttatcaacctaagcaaaaaaaaggtaaaaaagaatccctcaaaacctcccgatctgagagcacgacaccatctggataggcgattgagcctctcggtgccagatcttttggaagctgaggcactagctcccgagggcaggccctactctggacctcagtcttcctacaccagcgtccccagctctcttagcacggcaggcatttttccaaaatccagctccagttctctgaagcagtctgaagaggagctcgattggtcacaagaggaggcttcccaccttcatgtggtggaaaccgattcagaggaagcctacgccagtccagccgagcggagacgagtgtcatccaatggcattttcgacttacagaaaaccagcctgggtggagacgcccccgaagagcccgagaagctatgcggcagcagcgacctgaacgccagtatgacctcccagcacttcgaagagcagtccgtgcccggtgaggccagtgacggtctgtcaaatctgccctccccattcgcctacttacttacaatccaccttaaggaaggccgcaatctggtagtgagggaccgttgcgggaccagcgatccttacgtgaaattcaaacttaacgggaaaactctctacaagagcaaagtgatatacaagaaccttaaccccgtctgggatgaaatcgtcgtgcttccaatccaaagtcttgatcagaaactacgagtcaaggtatatgatagagacctgactacctctgatttcatgggaagtgctttcgtcatcctgtcggacctggaactcaatcggaccacagagcacattttgaaactggaagacccaaatagccttgaggatgacatgggagtcattgtgctgaacttaaacctggtggtgaaacagggcgattttaaaagacatcgctggtctaaccgtaaaaggctttcagcatctaagagttccttaatccggaatctgcgcttgtctgagtcccttaagaaaaatcagctgtggaacggaattataagtattactctgttggagggaaaaaatgtctccggagggtctatgactgaaatgttcgttcaattgaagctgggagatcaaagatacaagtcaaaggacgggcactttgggcattag

SEQ ID NO: 27930 - DNA, 2661 bp, Artificial Sequence
  Description of Artificial Sequence: Synthetic coding sequence
atggggatggatctcacgtgcccgttcggcatctctcctgcctgcggggctcaagcgtcctggagcattttcggcgcagatgctgccgaagtgcccgggactagaggccactcccagcaggaagcagcaatgcctcacatccccgaagatgaggagcccccgggagaacctcaggcagcccagagccccgctggacagcaaggccctcccgccgcaggcgtgagttgtagccctacgcccaccatcgtgctgaccggcgatgctactagcccagaaggggagaccgataagaatttggctaaccgagtgcattcgccgcataagagactctcgcacagacacttaaaagtatcaactgcttcactcacttctgtcgatcccgccggtcacataattgacctggttaacgaccagcttccagatatctccatatctgaggaggacaaaaaaaagaatctcgcactgcttgaagaggccaaacttgtgagtgagagatttctgacacggcgcgggcgcaagagcagaagctccccaggagattcccctagtgcggttagtcctaatctgagcccttcagcttcacccactagtagtagaagtaacagcctgaccgtacctaccccacccgagggggacgaagccgatgtttcgtcacctcatccgggcgagcccaacgtcccgaaaggattggcagatcggaaacagaatgatcagcggaaggtgtcacaaggacggctcgctccccggccaccccccgttgagaaaagcaaggagattgcgatcgagcagaaagaaaattttgatccactgcagtaccccgagaccaccccaaagggtctggcccccgtgacgaatagtagcggtaagatggcgctcaattcacctcagccaggacctgtcgaaagtgagttaggcaaacagctgttaaagactgggtgggagggctctcctctcccgcgttctcccacgcaggacgcagccggcgtcggacctcccgcctcacaaggaagagggcctgccggggagccaatgggccctgaagccggctccaaggccgaactgcccccaacggtgtctagaccccccttgctgcgcggcctctcttgggattcaggcccagaagagcccggaccccggcttcagaaggtcttggccaaactgccgcttgccgaagaggagaagcggttcgcaggcaaagcaggtggcaagttagctaaggcgccggggctgaaggattttcaaatacaggtgcagccagtaagaatgcaaaagctgactaaactgcgtgaagagcacattcttatgaggaaccagaatttagtcggattaaaattgcccgacctgtccgaagcggccgagcaggagaaggggctgccctccgagctgtcaccagcaattgaagaggaagaatctaaaagcgggcttgacgtaatgccaaacatctccgatgtacttttgcgcaaattaagagtgcaccggtcgctgcctgggtcagcccccccattgactgaaaaagaggttgagaatgtgttcgtccagttgtctctcgcattccggaatgacagttatacgctggagtccagaatcaatcaggccgaacgggaaaggaatcttactgaggagaatacagagaaagaacttgaaaactttaaggcgtccattacatcttctgcttctttgtggcaccattgcgaacacagggaaacttaccagaaactgctggaggacatagccgtgctgcaccgcctagcagcacgcctctcttcacgagccgaggtggttggcgcagtgaggcaagagaagcgcatgtcgaaggcaaccgaagtcatgatgcagtacgtggagaatctcaaacggacctacgagaaagaccacgcagagctgatggagtttaagaaactcgccaaccagaattcgagccgatcctgcggcccatcagaggacggcgtaccgaggactgcacgcagcatgtcgttgactctgggcaagaacatgcctcgccgaagggtaagcgtcgccgttgtccccaagttcaatgcgctcaatcttcctggccaaacgccctcatcaagctccataccaagcttgcctgcactaagcgagtcacccaatgggaaaggcagcctccccgttacctcagccctccctgcactcctggagaatggcaagacaaatggcgaccctgactgtgaggcctccgctcctgccttgaccctgtcatgcttggaggaactgtctcaggaaacaaaggcacgcatggaagaggaggcttacagcaaagggttccaggagggtctgaaaaagaccaaagaactgcaggacctgaaagaggaagaggaggagcagaagagtgagtcccctgaagaaccagaggaagtggaagaaactgaagaggaagaaaaaggcccacgttcatccaagctggaggaactggtgcacttcctgcaggtgatgtatccgaagctttgccagcactggcaggtgatctggatgatggccgccgtcatgctggtattgactgtcgtgttagggttgtacaatagctataattcctgtgctgaacaggccgacggtcccctcggccgttcaacatgctccgcggcccagcgagatagctggtggtcttcgggtctgcagcatgagcagcctacagaacagtag

SEQ ID NO: 27931 - DNA, 2712 bp, Artificial Sequence
  Description of Artificial Sequence: Synthetic coding sequence
atgggcatggacctgacatgtccttttggcataagtcccgcctgtggagcacaggcttcctggtccatatttggggcagatgcggctgaagtacccggcacacggggacattcacagcaagaagccgctatgccgcacatccccgaagatgaagagccaccgggtgagccccaggccgcccaaagccccgctggccagggaccaccggccgctggcgtgtcttgcagtcccacacccaccattgtactgactggtgacgccaccagtccggagggagaaaccgataagaacctggctaacagagtgcacagtccccacaaacgtctcagccaccgccatttgaaagtttctacggcgtcgctgacaagcgttgatcccgcaggccacatcattgatttggtcaacgatcagctcccagacatatccattagcgaggaggataaaaagaaaaatctggccttactggaggaagctaaactcgtgagcgaacggtttctgactcggcgcgggcgcaagagtcgatcctctcccggcgatagtccaagtgctgtgagccctaacctgagccctagcgcctctcctacaagcagcaggtctaatagcctcactgttccaaccccccccgggctagatgtgtgctctggtcctccttcaccactgcccggggcaccaccacagaagggtgatgaagctgacgtctcttctccacatccaggcgagcctaacgtgccaaaaggtctggccgacaggaagcagaatgatcagcgcaaagttagccagggtagactggcccctcggcctcctccagttgaaaagtctaaagaaatcgcaatcgagcagaaggagaacttcgatcctctgcagtaccctgagactacgccgaaaggtcttgcaccagtgactaactctagcgggaagatggctctgaatagcccccaacccgggcctgtggaatccgaactcggaaagcagttgctcaaaacaggctgggaggggtctcccttgcctagatcgcccacccaggatgccgccggagtgggccccccagcaagccagggccgggggcccgccggcgagccgatgggacctgaggcgggtagcaaagcagagttacctccaacagtgtcacggccgcctcttctgcgcggtctgagctgggattctgggccggaagaacccggaccacgcctccaaaaggtgctggccaaactgccactcgctgaagaagaaaagaggtttgcgggtaaggccggcggtaaactggcaaaagcccctgggctcaaggactttcagatccaggtacagcctgtacgcatgcagaagctgaccaaactgcgggaagagcacattctaatgaggaatcagaacctggtcggtctcaaactgccagatttgagcgaagccgcggagcaggagaaaggtttaccttcagaactttcccctgccatcgaggaagaggaatctaaatcaggcttggatgttatgccaaacatcagcgacgtgctgctccggaagctaagagtgcatcggtcattaccggggtcagcacctcctctcacagagaaagaggttgagaatgtattcgtgcagctgtctctggcgttccgaaacgattcctatacgctcgagagtcgaattaatcaggctgaacgtgaaaggaatctcacagaagaaaacacagagaaggagctcgaaaactttaaggccagcataacttcttctgcttcgctctggcatcattgtgagcatagggagacatatcagaagctgctggaagacatcgcagtgctgcaccgtctggccgcacggctgagttctcgtgctgaagtcgtcggcgctgttagacaggagaaaagaatgtctaaggctaccgaggtcatgatgcagtatgtcgaaaatttaaagagaacctacgaaaaagaccatgctgagcttatggaattcaagaaattagccaatcagaactcatctcgatcgtgcggaccttctgaagatggagttcccaggactgctcggagcatgtccctgaccttgggcaaaaacatgcctcgacgccgggtgagtgtcgccgtcgttccaaaattcaatgccctcaacctcccaggacagacgccctcctctagtagtatccctagcttacctgcactgtctgagagccctaacgggaagggatcattgccagtgacttctgcgcttcccgcgctcctcgaaaatggaaaaactaatggcgaccccgattgtgaggcctccgctcctgctctgactttgagttgcctggaagagttgtcacaagagaccaaggccagaatggaggaggaggcttactctaaaggatttcaagaaggccttaaaaaaacgaaagagttgcaggatttgaaggaggaagaggaggagcagaagtctgagagtcctgaggaaccagaggaggtggaggagacggaagaagaagagaagggaccgaggtcttccaaacttgaggagctggtccatttcctccaagtcatgtatcccaagttgtgccagcactggcaggtgatttggatgatggccgcagtgatgctggtgctgacagtggtgctgggtctgtataatagttataactcctgtgccgagcaggctgacgggcctctcggccggagcacctgcagcgccgctcagcgggacagctggtggagctcaggcctgcagcatgagcaacccacagagcagtag

SEQ ID NO: 27932 - DNA, 1794 bp, Artificial Sequence
  Description of Artificial Sequence: Synthetic coding sequence
atggctctcaactcacctcagccgggcccagttgaatccgagttaggtaagcaacttctgaaaaccgggtgggagggttctcccctgccacgaagtcctacccaggatgctgccggcgtgggacccccggcgtctcaagggcgtggccccgcaggcgaaccaatgggtcctgaagctggctcgaaggctgaactccctcccacggtgtctcggccaccccttttgcggggtctaagttgggactccggacccgaggaaccaggaccaaggctgcaaaaagtactcgccaagctcccactggcggaggaggagaaacgctttgcaggaaaggcaggagggaaattagcaaaggctccggggttaaaagattttcagattcaagtgcagcctgtacgcatgcaaaagctgacgaagctgcgggaggaacacatccttatgcgcaaccagaaccttgttggccttaagctcccagacctgagtgaggcagccgagcaagagaagggactacccagcgagttgtcccctgctatcgaagaagaggaaagcaaatcagggctcgacgttatgcccaacatcagtgatgtgctactgaggaagcttagggtgcaccgatcgctgcccggtagtgcccctcccctgacggagaaggaggtggagaacgtcttcgtgcagctcagtttggcgtttcggaatgattcttatacactggagtctcgcatcaaccaggctgagcgggaacggaacctgactgaagaaaatacagagaaagagcttgaaaatttcaaagcgtctattactagttcagcctccctgtggcatcactgcgaacatagggagacataccagaagctactggaggatatcgctgttctgcatcggctagcagcacggctgtcctctcgcgcagaggttgtgggcgctgtcagacaggaaaagcgaatgtctaaggctacagaggttatgatgcagtacgttgagaacctgaaaaggacttatgagaaagaccatgctgaattaatggaattcaagaaattagccaatcagaactcctcgaggtcatgcgggccctctgaggacggagtgcccaggacagcgcggagtatgtccttgaccctggggaagaacatgccacgcaggcgtgtctccgtcgctgtggtgccaaaattcaatgcactaaacttacccggtcaaactccaagtagttcctccatcccttccctgccagccctgagtgagtcacctaatgggaaagggtctcttccagtcaccagtgccctgcctgcccttctggagaatggcaagactaacggtgacccggattgtgaggcttcagctccagccctcaccctttcttgcctcgaggaactgagccaggagacaaaggctcggatggaagaagaagcatactctaagggcttccaagagggactcaagaaaactaaggagctgcaagatctcaaagaagaagaggaagaacagaaaagtgaatcccccgaggagccagaggaagttgaggaaaccgaggaagaagagaaggggcctcggtcgtctaagctagaggaattggtccacttcctgcaggtgatgtaccctaagctttgtcaacactggcaggtgatttggatgatggcagctgtgatgttagtgttaactgttgtgctggggctatataactcttacaactcctgcgccgagcaagctgatgggcccttgggccgatcgacctgttctgccgcccagagagatagctggtggtcatccgggttacagcatgagcaacccaccgagcagtag

SEQ ID NO: 27933 - DNA, 2658 bp, Artificial Sequence
  Description of Artificial Sequence: Synthetic coding sequence
atgggcatggacctcacctgtccgttcggaataagccctgcttgcggagcgcaggccagttggtcaatcttcggtgccgacgctgccgaggtcccaggcacccgtgggcactctcagcaggaggctgctatgccccatatccctgaagacgaggaacctcccggggagcctcaggctgcccaatctcccgccggacaaggaccacccgccgcgggcgtgtcttgcagccctacccctacgatcgtgctgacaggggatgctacgagccccgaaggggaaactgataagaacttggccaatagagtgcatagccctcataagagattatcgcatcgccatcttaaagtgtccactgcttcactcacgtctgttgacccagccgggcatatcattgacttggtaaacgaccaacttcccgacattagtatttccgaggaagacaagaagaaaaatctcgcacttttggaagaagccaaactggtctccgagcgttttttgaccaggcggggaagaaaaagtcgaagctcacccggagactcacctagcgctgtctcccccaatttgtctcctagtgcctccccaacaagcagtcgttccaatagcctcaccgtcccaacgccacccgacggggatgaagcagatgtaagtagtcctcatcccggagagccaaacgtgcccaaaggcctggccgatagaaagcagaacgatcagcggaaggtatcacagggtaggctggctccccgaccacctcccgtcgagaaatccaaggagattgccatcgagcagaaggagaactttgacccactccagtaccctgaaacgacacctaaggggctcgcgcccgtaaccaatagttccgggaaaatggctctcaactccccacagcctggcccggtggaatccgaattgggcaagcaactgctgaaaaccggttgggaggggtcaccattgcctcgatcccccacccaggacgctgcaggcgtcggcccccctgcatcacagggcaggggccccgccggagagcccatgggcccagaggccggctccaaagctgaactcccacctacggtgagccggccaccactgctgcgcgggctcagttgggattccggtcccgaagaaccagggccgaggcttcaaaaggtgctggcaaagctgcctctggcggaggaagagaagcgttttgctggcaaggcaggcgggaaactggccaaagcccccggcttgaaagattttcaaatccaggtacagcccgtgagaatgcagaagctgactaagcttagggaagagcacatcctcatgcgtaatcagaatctggtgggtctgaagttacccgatctctccgaagctgctgaacaggagaaaggtctacccagcgaactgtcaccagccattgaagaggaagagagcaaaagtggattggacgtgatgccgaacatctccgacgtgttattacggaaacttagagttcaccggagcctgccaggaagcgcaccacctctcaccgaaaaagaggttgagaatgtctttgtacagctgtccctggcatttaggaacgatagttataccctagagagcaggatcaaccaggccgaaagggaacgcaatctgactgaagaaaacacagaaaaagaactggaaaactttaaagcctcgataacttcaagcgcttcattatggcaccattgcgagcaccgcgagacatatcaaaagctgctcgaagatattgccgtgctgcatagactcgcagcgaggctgtctagtagggcagaagttgtaggcgccgtccggcaggagaagcggatgtctaaggcaacagaagtgatgatgcagtacgttgaaaacctcaaaagaacctatgagaaggaccatgcggaactgatggagttcaaaaagcttgctaatcagaattctagcaggagctgcggccccagtgaggacggtgtgcctaggaccgcccgcagcatgtccctgactctgggaaaaaacatgccccgtagaagagtgagcgtggctgtggttcccaaattcaacgccttgaaccttccaggccaaaccccctcgagcagttccatcccgagtctcccggcattgagcgaatcccctaacggtaagggatctcttccagtgaccagcgccctccctgccctactcgaaaacgggaaaaccaacggtgacccagactgcgaggcgtctgctccagcccttacattatcatgcttggaggaactatcacaagaaacgaaagcacggatggaagaagaagcttatagtaagggcttccaggagggcctcaaaaaaacaaaggagctgcaagacctgaaggaagaagaggaagagcaaaagagcgagtctccagaggagccagaggaagtcgaggaaaccgaagaggaggagaaaggcccacggtcatctaaactggaggagctcgtgcactttctccaggttatgtacccaaagctgtgccaacattggcaagtgatctggatgatggcagccgtaatgctggtgctcacagtcgttctcgggctctacaacagctataactcctgcgccgagcaggctgacggtccgctgggacggagtacctgtagtgccgcacagagagactcatggtggagttcagggcttcagcatgaacaacccacagaacagtag

SEQ ID NO: 27934 - DNA, 2466 bp, Artificial Sequence
  Description of Artificial Sequence: Synthetic coding sequence
ctaacaggagatgctaccagccccgagggcgaaaccgataagaatctcgcaaatcgtgtgcactccccgcacaaacggctcagccaccggcacctgaaggtgagcacagctagcctaacctcagtggatcccgccgggcatatcatcgatctcgttaacgatcagctcccagacattagcattagcgaggaggacaaaaaaaagaacctcgccttgctggaggaggccaagctcgtgtctgaaagattcctaaccaggagaggccgaaagtctcgtagttcaccaggggactctccaagcgctgtgtctcctaatctgtctcccagtgcctccccaactagttcccgttcaaattctctcacagtgcctactcccccaggcctggatgtctgcagcggcccaccgtccccattgccgggagctccaccccagaaaggggatgaagcagacgtgagctctccgcaccccggggaacccaatgttcctaagggtctcgctgaccgtaaacagaacgatcagaggaaggtgagtcagggacggctcgcccctagacctcccccagttgagaagtccaaagagatcgcgatagaacagaaggagaacttcgatcctctacagtacccagaaacaacgcccaagggtcttgcccccgtgacgaacagtagtggaaagatggcactaaattcaccacagcctgggcctgttgagagcgagctgggaaaacaattgcttaagactgggtgggaaggatctccccttcccaggagtccaacacaagacgcagctggcgttggccctcccgcctcccagggtagggggcctgcaggtgaacctatggggccagaagccgggtcaaaagctgagcttccgcccacggtgtcacgcccaccactgctcagaggcctcagctgggattctgggcccgaggaaccaggacctcgactgcagaaggtgctggccaagcttcccctggcagaggaggaaaagagattcgccggaaaagccgggggaaagctggctaaggcacctggacttaaggatttccagattcaggtgcagccagtgcggatgcagaagcttaccaaattgagggaagagcacatacttatgcgaaaccagaacttggtgggcctcaagcttcccgatttatctgaggccgccgaacaggagaaaggtcttccatccgaactttcacccgccatagaggaggaagagtctaagtccggtctggacgtgatgcctaacattagtgacgtgctcctcaggaaattacgcgtgcaccggtcattacctggctctgcaccgcccctaaccgaaaaggaagtagagaatgtgttcgtacagctgtccctggcgttcaggaatgatagctacacacttgagtctcggatcaaccaggccgagagggagagaaacctgaccgaggagaatacagaaaaagaactggaaaatttcaaagctagcattaccagcagcgccagtctttggcaccattgtgaacaccgggagacgtaccaaaagcttctggaagacatcgccgtgctgcatagactcgccgcccgattgtcttctcgcgccgaggttgtgggcgctgttcggcaggagaaacgtatgagtaaggccaccgaagtgatgatgcagtatgtggagaacctgaagcggacatatgaaaaggatcatgcagagttgatggagttcaaaaaacttgcaaaccagaacagcagtcgcagctgtgggccaagtgaagacggggtgccccgaactgcccgctccatgtcactgacgctgggtaaaaatatgccccgacgaagagtgtcggtcgcagtcgtgcctaaatttaatgcactgaatttgcccggccagaccccgtcatctagttcgattccctctctgcccgcgttaagcgaaagccccaacggtaagggatccttacccgtcacctctgcccttccagcacttctggaaaatggaaaaaccaacggtgacccggactgtgaagcctcggctccggccctaaccctgagctgcctcgaagagttatcacaggaaaccaaagccagaatggaagaggaggcttactccaagggattccaagagggcctgaagaaaaccaaagagctgcaggaccttaaggaggaagaagaagagcagaaatcggagtcacccgaagaaccggaggaggttgaagagactgaggaggaagaaaagggcccgcggagctctaaactggaggaactggtccacttcctccaggtgatgtatcctaaactatgccaacattggcaagtcatttggatgatggctgctgttatgttggtgctgaccgtggtacttgggctgtacaacagttacaattcctgcgccgagcaggctgacggcccactgggtcggtccacttgtagtgcggcacaacgtgactcatggtggagctcaggcctacaacacgagcagccgaccgagcaatag

SEQ ID NO: 27935 - DNA, 1794 bp, Artificial Sequence
  Description of Artificial Sequence: Synthetic coding sequence
atggccctgaatagcccacagcctggccctgtggaatctgaactgggaaagcagctcctcaaaactggctgggaagggagtcccctccccagatcacctacacaggatgccgccggagtcggccccccagccagtcaaggaaggggacctgccggtgagcctatgggccctgaagccggatccaaggcggagttaccgccgaccgtctcccgaccacctctcctgcgaggcctgtcctgggattcaggacccgaagagcctggaccaaggcttcagaaggtgttggccaagctccccctcgcagaggaagaaaagaggtttgccgggaaagccggcggtaagctggccaaagcaccaggactgaaggatttccaaattcaggtgcagcccgtgcgcatgcaaaaactgactaagcttagagaagagcacattctgatgcgaaatcagaatttagtcggattaaaactacccgacctttcagaagccgccgaacaagaaaagggcctgccaagcgaactcagtcctgctatcgaagaggaggaaagcaagtccggcctggatgttatgccaaacatttctgatgtgctactgcggaaactgcgagtgcaccggagtctcccagggtctgcaccaccactgaccgaaaaagaggttgagaatgtgttcgtgcaactatccctcgcctttaggaatgatagctacaccctcgagtcccggatcaaccaagccgagagagagcgtaacctgaccgaggaaaacaccgagaaggaactggaaaacttcaaggcatccattacctcatcagcgtccctgtggcaccattgtgagcatagggaaacctaccagaaattattagaagacatagcggtattgcatcggctcgcagcacgcctgagttccagggctgaagtggttggggccgttcgccaggaaaagcgtatgtcaaaagctacagaagtgatgatgcaatacgtcgagaatctgaagcgcacgtatgagaaggatcatgctgagctgatggagtttaagaagcttgccaatcagaacagcagtcggagctgtggtcccagcgaggacggcgtgccgaggaccgcccgatctatgagcctgacactcggcaaaaacatgccccgtcgccgggtgtcagtagccgtcgtgcccaagttcaatgctctcaacctccccgggcagaccccctcatcatcttcaataccctcactccccgctctcagcgagtcaccgaatgggaaaggctcgctgcccgtgacctctgccctgcccgccctgctggaaaacggcaaaacgaatggggacccagactgtgaggcctctgctccagccctaaccctctcctgcctcgaggagttgagccaagagactaaagcgcgcatggaggaggaggcttacagcaaagggtttcaagaaggcctgaagaaaaccaaggaactgcaggatttgaaagaggaagaggaagagcagaagagtgaatccccagaggagcccgaggaggtggaggagactgaagaagaagagaaaggccctagatcttcaaagctcgaggaactggtccatttcttgcaggtgatgtaccctaaactttgtcaacattggcaagtgatttggatgatggccgctgtgatgcttgtgctgaccgtggtgctgggattatacaatagctataactcctgtgctgagcaggcagatgggcccttgggccgatcaacctgctctgctgcccaaagagattcttggtggtcttctgggttacagcatgagcagcccacagagcagtag

SEQ ID NO: 27936 - DNA, 2466 bp, Artificial Sequence
  Description of Artificial Sequence: Synthetic coding sequence
cttacgggggatgccactagcccagagggcgaaacggataaaaatctagcaaacagggtgcattcgcctcacaagaggttgtcacaccggcacctgaaggtttctactgccagtcttacctctgtagatcccgcgggacacatcatcgaccttgtgaacgaccaactgcctgatatcagcataagtgaggaagacaaaaaaaagaatctcgccctgcttgaggaggccaagctggtgagcgagcgatttttaactcggagggggaggaagtctcgttcaagcccgggcgatagcccatctgccgtgtctcctaatctctccccatccgcgtctcccacgtcctcgcggagcaactcgctcacggtaccaaccccgccaggcctggacgtgtgttccgggccccccagtccacttcccggcgctccgccccagaagggggacgaagccgatgtgtctagccctcaccctggtgagcctaatgttcctaagggactggctgacagaaaacagaatgatcagcgaaaagtgagtcagggcaggcttgccccacggcctcctcccgtggagaaatccaaggagattgctattgagcagaaagaaaactttgaccccctccagtaccctgagaccacccctaaaggtcttgcaccagtgactaatagttccggtaaaatggccctaaattctccccagccaggtccagtggaatccgagctgggaaagcaactgcttaagactgggtgggagggctcaccacttccgagatcccccactcaggacgcagctggcgttggaccaccggcctcccaaggtagggggccagctggcgagcctatgggcccagaagccggctcaaaggcagaactcccgccaacggtgtcgcggccccccttgcttagaggcctctcttgggatagtggaccagaggaacctggccctaggctccagaaggtccttgccaaactgcccctggcagaggaagagaaacgttttgctggtaaagccggaggcaaacttgcaaaggcccccggcctgaaggattttcagatccaggttcaacctgttcgcatgcagaagcttaccaagctacgggaggaacacatactcatgcggaaccagaatttagtcggactgaagctgcccgatctttcggaggccgccgaacaggaaaaggggctcccctcagaactcagtcctgcgattgaagaggaggagagcaagtcgggcctggacgtgatgcccaatatctccgacgtgctgctcaggaagcttagggtgcataggtctctgcctggctctgcaccccccctgaccgaaaaagaagttgagaacgtctttgtacagctctcgttagcattccggaacgactcatacactcttgaaagcaggattaatcaggcagagcgcgagaggaatctgaccgaagaaaacaccgagaaggaactggaaaattttaaagcctctattacttcctccgcatctctctggcatcactgtgagcatagagagacataccagaaactactggaggacatcgcggtcctgcatcgacttgccgcaagactgtcctccagagccgaagtagttggagctgtgaggcaagaaaagcgtatgtccaaggccaccgaagtgatgatgcagtacgtcgagaatctcaaacgcacatacgaaaaggatcacgctgaactgatggagtttaagaagctagccaaccagaactctagccggtcttgcggtccttcagaagatggcgtgcccaggactgcgagatctatgagcctgacactgggcaagaacatgccgcgcaggagagtttcagtggctgttgtccccaagttcaatgcgctgaacctgccaggccaaactccttcctcgtccagtattccttctctcccagcgctgagcgaatcaccaaatgggaagggctcgctgcccgtgacttcagccctgcccgcattgctggagaacgggaaaacaaacggcgacccagattgtgaagcctccgcgccagcgttaaccctttcgtgtctggaggaactcagtcaggagacaaaggcccgcatggaagaagaggcttattcaaaaggctttcaggaagggctaaagaaaaccaaagaactgcaggatctcaaggaagaagaagaagaacagaagtccgagtctccagaggaacccgaagaagttgaagaaacagaagaggaggaaaagggcccccggtcgagcaagctcgaggagctcgtgcatttcttgcaagttatgtatccaaagttgtgtcagcactggcaagtaatttggatgatggccgccgtcatgctggtcctgaccgttgtcttgggcctctataactcttataactcctgcgctgaacaggcggatggtcctttaggtcgttctacctgctcggccgcccagagagactcttggtggagttctggtttgcagcacgagcagcctaccgagcagtag

SEQ ID NO: 27937 - DNA, 2466 bp, Artificial Sequence
  Description of Artificial Sequence: Synthetic coding sequence
atgaccggcgacgctacgagtcccgagggcgaaacagataaaaacctggcaaacagagttcattcaccacataaacgtctttctcatcgtcatctcaaggtgtcaacagctagcctgacctccgtggatcccgcggggcatattatcgatctggtgaacgatcagctacctgatatctctatcagcgaagaggacaaaaaaaaaaacctcgcactgcttgaggaagcaaagcttgtctcagagcgttttttaactagacggggaagaaaatcacgttcttcacctggcgacagtccttctgctgtctcccctaatctctctccatccgccagccctaccagtagtaggagtaactctctgacggtgcccacccctcccggtctcgacgtctgttccggtccaccatctcccctgcctggagcccccccacagaagggggatgaagccgatgtcagctctcctcatccaggtgaacctaacgtgccaaaaggactggccgacaggaagcagaacgatcagaggaaggtctcccagggacggctggcacccagacctccccctgtggaaaaaagtaaagaaatcgcaatcgagcagaaggaaaacttcgatccactgcagtaccccgaaacaactccaaagggcctggcaccagtgactaattccagtggtaagatggcactcaattctccacagccagggcccgtggaaagtgagcttggaaagcaacttctgaagaccggttgggagggctctcctttgcctcgatcaccgacacaggatgcagctggtgtcggcccccctgcatcacagggaagaggcccggctggcgagcccatgggacctgaagccggatctaaagccgaactcccccctacagtgagccgacccccactcttgaggggcctctcctgggattccggcccagaggagccgggtcctcgtctgcagaaagtacttgcgaagctcccactcgcagaggaagagaagcggttcgctggaaaggccggtggcaaattggctaaagcaccgggattgaaggactttcagatccaggtccagcccgtccgcatgcaaaaactgacaaaactccgggaagagcacattttgatgagaaatcaaaacctggtgggtctcaagctgcccgacctctcagaggcagccgagcaggagaagggactacccagtgagttgagcccggccatcgaagaagaagagagtaagtccggattagatgtgatgcctaacatctctgacgtgctgttacggaaactacgcgtgcaccggtcactgccaggctcagcacctccattaaccgagaaggaagttgagaacgtgttcgtacaactctccctggcatttcgcaacgatagctacacattggagagtagaattaaccaagccgaaagggaaagaaaccttaccgaggagaacactgagaaggaactcgagaatttcaaggcctctatcacttcaagcgcttcactgtggcatcactgtgaacacagggagacttaccagaaactgctcgaggatattgcagtacttcatagattggctgcacgcctgagctctagggccgaagtggtgggtgctgtgcgccaggagaagagaatgtccaaagccacggaggtaatgatgcagtatgtggagaacctgaaaaggacgtatgagaaagaccatgctgaactgatggagttcaagaaactggctaatcaaaattcttccagatcatgtgggccttcagaggatggggtgccgcgtacagctaggtctatgagtttgacgttaggaaagaacatgccgagaaggcgcgtgtcagtcgctgtagtgcccaaattcaatgctctgaacttgcctggacaaacaccaagcagttcttctatcccctctttgccagccctgtcagagagcccaaatggaaagggctctctccccgtgacatcggcgctcccagccctcctcgagaatggtaagaccaatggcgaccccgattgcgaagccagcgctccggcactcactctgagctgtctcgaagaactaagccaggagacaaaagcaaggatggaagaagaagcttactccaaaggcttccaggagggcctgaagaaaaccaaagagttgcaggatttgaaggaggaagaagaagaacagaaatctgaatccccagaggaaccagaagaggtggaggagaccgaggaagaggagaaggggccccgctcttccaaactcgaagagctagtgcacttcctgcaggtcatgtatcctaaactctgtcagcattggcaggtcatttggatgatggcagccgtcatgctagtcctcactgtagtgttgggcctgtacaactcttacaatagctgtgcagagcaggccgatggaccactgggaagatctacatgctctgccgcacagcgcgattcatggtggtcatcaggcttacagcatgaacagcccacagagcaatag

SEQ ID NO: 27938 - DNA, 1794 bp, Artificial Sequence
  Description of Artificial Sequence: Synthetic coding sequence
atggcgttgaactctcctcagcccggcccagtggaatctgaactggggaagcagctgctcaaaaccggttgggaaggctctcctctgccgaggagtcctactcaggacgccgccggcgtcgggccacccgccagccagggacgcggcccagctggcgagccaatgggcccggaagccggaagcaaggctgaattgcctccaaccgtgtccagaccgccacttctccgcgggctgagctgggattccggtccagaggagccagggcctcgcctgcaaaaggtacttgctaagctgccgctagctgaggaagaaaagagattcgcaggaaaagcaggtggcaagctggcgaaggctcccggcttaaaagattttcaaattcaggtacaacctgttagaatgcaaaagctgactaaattgcgcgaggaacacatcttaatgcggaatcagaacctggtcggtctgaaactgcccgatctttctgaggctgctgagcaggagaagggtctgccaagcgagcttagcccagcgatcgaagaagaggagagcaagtccggcctcgacgtaatgcccaacatctctgatgtgcttttgcgcaaactccgcgtgcatcgatctctaccaggttcagcccccccattgactgagaaggaagtagagaacgtgttcgtgcaactttctttagcctttcggaacgattcatataccctggagtcccgcattaatcaggctgagagggagagaaatctcacagaggagaatactgagaaagaacttgagaacttcaaagccagcattacttcctccgcctcactgtggcatcactgcgagcacagagagacctaccaaaaactcctagaggatatcgccgtgctgcatcgtctcgcggctcgcctgtcatcacgcgctgaggtggtcggtgctgtgcgtcaagaaaagaggatgagtaaagcaacagaagtcatgatgcagtacgtggagaatctcaaacgtacctatgaaaaggaccatgcagaactaatggagtttaagaagctggccaaccaaaactcgtccagatcctgcgggccatctgaggacggagtgcctcggacagctcgttccatgagcctgacacttggcaagaatatgcctagacggagggtttctgtggccgtggttcctaagttcaatgccctgaacttgccaggccagacgccctcctcctccagcatacccagcctgcctgccctctctgagtcccctaacggcaagggaagcctgccagttacatcagcgctcccagccttactagagaacgggaagaccaacggggacccagattgcgaggcgtcagcccccgccttgacactcagctgtctggaagagctatcgcaggaaactaaggcccggatggaggaagaagcttattccaaaggcttccaagagggactgaagaagactaaggaattacaagacctgaaagaggaggaagaggaacaaaagtcagagagcccagaggaaccagaggaggtggaggagaccgaagaggaggagaagggaccgaggtcaagcaagttggaggaactggttcattttctgcaggttatgtacccaaaactctgtcagcattggcaggtcatttggatgatggcggctgttatgcttgtcctaactgttgtcctagggctttacaactcgtataactcctgtgccgagcaggccgacggcccgcttggaagatcaacctgtagtgcagcgcagagggattcctggtggagttccggcctgcagcatgaacaacccacggagcagtag

SEQ ID NO: 27939 - DNA, 2739 bp, Artificial Sequence
  Description of Artificial Sequence: Synthetic coding sequence
atggtgaaggcacctcaatctgaagaacggctggcccggggagggaaagagaacaattccgtgcttgcgtgtggggctcaagcttcttggagtatcttcggcgcagacgccgccgaagtgcctgggactcggggtcattcacagcaggaagcagctatgccccacattcccgaagatgaagagcccccaggcgagccgcaggccgcccagtctcctgcaggccagggccctccagctgctggagtgtcctgttcaccaacacccacaattgtgctgaccggagacgctacgtcgcctgagggagagacagacaaaaacttggccaaccgggtccattcaccccacaaacgcctaagtcaccggcacttaaaggtatcaacagcctcactaaccagcgttgaccctgcaggccacattatagacctggtcaatgatcagctcccagacatctctataagtgaagaggacaaaaaaaagaacctggctctgttagaggaggccaagctcgtgtccgaaaggtttttaacacgtcgcgggcgcaagtcccggtctagtcccggcgacagcccttccgccgtgtcacctaacctctctcccagcgccagcccaacatcctcgagatctaactcacttaccgtgcccaccccccccgggcttgatgtctgttccgggcccccatctcctttaccaggcgcgcccccccagaaaggcgacgaagcggatgtgagctctccacacccaggggaacctaatgtgccaaaagggctcgcggatcgaaagcagaacgaccaacgaaaagtttctcaaggacgactggctcccaggccgccaccagtcgaaaagtccaaagaaatcgctatagagcagaaagagaattttgacccgctgcaatatcccgaaactaccccaaaggggttggctccagtcaccaatagcagtggcaagatggcgctcaattcacctcagccagggcccgtggagagcgaattgggaaaacaactgctgaagaccgggtgggagggctcacctctcccgcggtctccaacacaggatgcagcgggcgttgggccgccagccagtcagggccgagggcccgccggcgaacctatgggaccggaggccgggagcaaagccgagctgccaccaactgtatcacgaccccccctcctacgcggcctaagttgggactcaggtccagaagagcctggtcctcggctgcagaaagttctggccaagctgcctctggcagaagaggaaaagcgcttcgctgggaaggccggcggaaagctggcaaaggcgccggggctcaaggattttcagattcaggtgcaacccgtgagaatgcagaagctgaccaagctgagagaagagcacatcctgatgagaaatcagaatctagtcggccttaaactgcctgacttatctgaggcagctgaacaagagaagggcttaccctctgagctgtccccagctattgaagaggaggaatccaagtcagggctagacgtgatgcccaatatatcagatgtgctcttacgcaagttaagagtacatcggtctctaccaggatcagcgcctccattgacggaaaaagaagtggagaatgtattcgtccagctgagcttggcattcagaaatgattcttacacccttgaatcaaggataaaccaggctgagcgcgagcggaacctgaccgaggagaacacagagaaggaactcgagaactttaaggcctcaatcacttccagcgcctcactgtggcaccactgtgagcacagagaaacctatcaaaagcttctggaggatatagcggtgcttcaccgtttggccgctcgcctgtctagtcgagcagaggttgtcggcgccgtgagacaggagaagaggatgtcaaaagctaccgaggtcatgatgcagtatgtagagaatttgaaaaggacttatgaaaaggaccacgcagaactaatggagtttaagaaactggccaaccagaattcctcccgttcgtgcggaccgtccgaggacggagttcccaggactgcccggagcatgagtctgacgctggggaaaaatatgcctcgcaggcgggtatccgtcgctgtagtaccaaaattcaacgctctcaacctgccaggtcagacaccgtcaagctctagtatcccttccttgcccgccctctccgaatctccaaacggtaagggcagcctacccgtgacctcagcgcttccggcactgctggagaatggaaaaaccaatggggatccagactgcgaggccagtgccccagctttgaccctctcctgcctagaggagctctcacaagagactaaagcgcgaatggaagaggaagcctattccaagggctttcaagaagggttgaaaaaaacaaaggaattgcaggatttgaaagaagaggaagaggaacagaagtctgagtcaccagaggagcctgaggaggttgaagaaactgaggaggaagagaaggggcctcggtcatctaaacttgaggagctggtacatttcctgcaggtgatgtatcccaaactgtgccaacactggcaggtgatttggatgatggcggcagtaatgctcgttctcactgtagtgcttggactctacaactcctacaactcctgcgccgagcaagcagatggacccctcggtagatctacatgcagcgccgctcagagagacagttggtggtcctcgggactgcaacatgagcagcccaccgagcagtag

SEQ ID NO: 27940 - DNA, 2715 bp, Artificial Sequence
  Description of Artificial Sequence: Synthetic coding sequence
atggggatggatttgacatgcccgtttggcatcagtccagcttgcggcgctcaggcctcatggagcattttcggcgcagatgctgctgaggtgccaggtacccgtgggcacagccagcaagaggcagctatgccccatatccctgaagacgaagagcctccaggcgagccccaggccgctcaatcacccgccggccagggtccaccagccgcaggcgtctcctgttctcccacaccaaccattgtcctgacaggtgatgccacaagcccagaaggggaaacagacaaaaacctcgcaaatagagtgcactctccacacaaacggctcagccatcgccacctgaaggtgtcgaccgcttctctgaccagcgtcgatcccgcaggtcacatcatagacttagtaaatgaccagctccctgatatctctatttcggaggaggacaagaagaagaatcttgccctcctcgaggaagcaaagttagtaagcgaacgcttcctgacccgccgcgggcggaaatctaggtcttctcctggagacagccctagcgccgtttcacctaatcttagtccctctgcaagcccaacttctagtcggagcaattcacttaccgtgccaacaccgccaggcctcgatgtctgttccgggccacctagcccccttcccggagcacccccccaacagaagggggatgaggcagacgtcagcagtccacatccaggagagccaaatgtacccaaggggttagcagaccgaaaacagaacgaccaacgcaaggtgagtcagggcagactggcgccaagaccgccccctgttgaaaagtcaaaggagatagccatcgagcagaaggaaaatttcgatccactacagtacccagaaactacccctaagggcctggctcccgttaccaattcttcaggcaaaatggctctcaattcccctcagccaggtcctgttgagtcagaactgggaaaacagctgctgaaaacgggctgggaaggctccccactgcccaggtcgcctactcaggatgccgcaggtgtgggtcccccagcatcccagggcagaggtcccgctggcgagcccatgggacccgaggctggttcaaaggccgagctgccacccaccgtgtctcgtccaccactcctgcgagggctctcttgggattctgggccagaggagccaggtccgcgcctccagaaggtcttggccaaattaccactggctgaagaagaaaagaggttcgccggaaaagctggtggtaaactagcaaaggctcctgggctgaaggatttccagatccaggtacagccagtgaggatgcagaagctgacgaaactacgggaggaacacatcctgatgaggaatcaaaaccttgttggcctgaagctccctgacctatcagaagccgccgagcaggagaaagggctaccctcagaattatctcccgcgatcgaggaagaagagagcaaatcgggcctggatgtgatgcccaatattagtgacgttttgttgaggaagctacgcgtacacagatcccttccgggttcggctcctcctctcaccgagaaagaggtcgaaaatgtgtttgttcagctatctctagcatttcgcaatgatagttatacgcttgagagtcgcatcaatcaggccgagcgggagaggaatttgaccgaggagaataccgagaaggagctggaaaacttcaaggccagtattacctcctcggcctccctttggcaccactgtgagcacagagagacctatcagaagctgctcgaggatattgctgtgcttcatcggctggccgcgcgtctcagttctagggcagaggtggtaggcgcagtgcggcaggaaaagaggatgtcaaaggctactgaggtgatgatgcagtatgtcgagaacttaaaaaggacatacgagaaggaccacgctgaactgatggaattcaaaaaacttgcaaaccagaactcctccaggtcgtgcggcccaagcgaggacggcgtcccacgcaccgcccgttcaatgtccctgacactaggtaaaaacatgcctcggcggcgcgtgagcgtggcagtagtgccgaagtttaacgctctcaatctgcccggacagactcctagcagttcatccataccaagcctgccagccctaagcgaaagcccaaatggcaagggctccctgcctgttaccagtgctctgccagccctccttgaaaacggaaaaacaaacggagacccagactgtgaggcgtcagcgcctgctctgactttgagctgcctagaggaactgtcacaggagactaaagcacgtatggaggaggaggcttactccaaagggttccaggagggcctcaaaaaaacaaaagagttacaggacctgaaagaagaagaagaagaacaaaaatcagagagccccgaggagccagaagaagtggaggagaccgaagaggaagaaaagggaccgcgcagcagcaagctggaagaactggttcattttctgcaggtgatgtaccctaagttgtgtcaacactggcaagtcatctggatgatggcggccgttatgcttgtgctgacggtagtccttggcctgtacaactcatataacagctgcgcagagcaggctgacggtcccctgggcaggtcaacctgcagcgcagcccaaagagacagctggtggtcttccgggttgcaacatgagcagccaacagagcagtag

SEQ ID NO: 27941 - DNA, 2121 bp, Artificial Sequence
  Description of Artificial Sequence: Synthetic coding sequence
atggtgaaggccccacagtccgaggaaagattggctagaggcggcaaggaaaataattctgtgctggcttgtggagctcaggcctcctggagcatttttggagcagatgccgcggaggtccctggcacccggggacactcccagcaagaagcggctatgccgcatattccagaagacgaagaaccgcctggcgagccccaggctgcccagagccccgccgggcagggccctcccgccgccggggtgtcttgcagccccacgcccaccatcgtgctaaccggggatgctacaagtccagagggcgaaactgataaaaatctggctaaccgcgtgcacagcccacataaaaggttgagccacaggcaccttaaagtgagcacggcttccctgacctccgtcgatccagccggacatatcattgacctggtgaatgaccaactacccgacatttcaatatctgaggaggacaaaaaaaaaaatctcgctcttctcgaagaagctaagctggtatctgaaagattcttgactagacggggcaggaagtcacgatcttcacccggtgacagtccctcagctgtgtcaccaaatctgagcccatccgcgtccccgaccagctcacgaagcaattcattgactgtgcctacaccacccgggctggatgtgtgcagcggacctcccagccctcttcccggggcacctccccagaaaggagatgaggcagatgtctcatctccacatccaggcgaacctgagcacatcttgatgagaaaccagaacctcgtggggctaaaactgccagatctaagcgaggccgctgaacaagaaaagggccttcccagtgagctgtcccccgccatcgaagaggaggaatcaaaatccggactcgacgtcatgcctaatatcagcgacgtgcttctgcgaaagctgcgcgtgcacagaagcttacctgggagtgctccacccctgaccgagaaggaagtagaaaacgtctttgtgcagttaagcctggcctttaggaatgatagttacacactggaatcccgaattaatcaggctgagagggagcgaaatttgaccgaagagaacaccgagaaagaactcgaaaactttaaggcaagcattaccagcagcgccagcctctggcaccactgcgaacacagggagacttaccagaagttgctggaagatatcgcagtattacaccgtctcgctgcacggctgagctcacgagctgaagtcgtgggggccgtgagacaggaaaagcggatgtccaaggctactgaggtgatgatgcagtacgtggagaaccttaagcgcacatacgaaaaggatcacgccgagcttatggaattcaaaaagctcgccaaccaaaatagctcacgctcctgcggcccatcagaggacggcgtcccccggacagccagatctatgagcttgactctggggaagaacatgccaaggcgccgggtgtcagtcgcggtggtgcccaagtttaacgcacttaatctccccggacagacacccagctccagttccataccctcacttccagccctgagtgagtcacccaacgggaaaggttcattgccagttacaagcgccctgcccgctcttctcgaaaacggcaaaacaaatggggatccagattgcgaggcaagcgcccccgccctgacactgtcctgtttggaggagctctcccaggagactaaagcccggatggaggaggaggcttacagcaagggcttccaggaaggactgaaaaagacaaaagaacttcaggacttgaaagaggaagaggaagagcaaaaatcagaaagcccagaggaacctgaggaagtcgaggagacagaggaagaggagaagggaccccgctcgtccaaactagaggaactggtgcactttcttcaggtcatgtatccgaaactgtgccaacattggcaggtgatctggatgatggccgccgtgatgcttgtgctgactgttgttcttggactgtacaacagttacaactcatgtgccgagcaggccgatgggcctctgggccgcagtacgtgctctgccgcccagagagacagttggtggagcagtggcctgcagcacgagcagcccacggagcaatag

SEQ ID NO: 27942 - DNA, 1731 bp, Artificial Sequence
  Description of Artificial Sequence: Synthetic coding sequence
atggcggacgccaacaaggcagaggtccctggagccactggaggtgacagtccacacctgcaacccgccgaacctccgggagagccccggcgcgagccacatcccgccgaagcagaaaagcagcagccccagcatagcagctcctctaacggcgtaaaaatggaaaacgatgaatctgccaaagaggagaagtccgatttaaaagaaaagagcacaggctctaagaaggccaatcgcttccatccctatagtaaggacaagaactccggagccggcgagaaaaagggccccaaccgcaatcgggtgtttatcagtaacattccttatgacatgaaatggcaggctatcaaggacctgatgcgggaaaaagtcggcgaggttacctacgtggaactctttaaggacgctgagggcaagtctcggggctgtggagtggtcgagtttaaagacgaagaattcgttaaaaaggcgcttgagacgatgaacaaatacgatctttctgggcgacccctgaatattaaggaagatcctgatggtgagaacgctcggagagccctgcagcgaactggaggatccttccccggcggccatgtgccagacatgggatctggcctgatgaatctgccaccttctatacttaacaatcctaacattcctccagaggtgatttctaatcttcaggccggtcgcctggggtctacaatctttgtcgccaatctcgactttaaggttggctggaaaaagctgaaggaagtcttttctatagctggcacggtgaaaagagctgacattaaagaggacaaggacggcaagtcccgggggatgggtacagtcacctttgagcaagccattgaagccgttcaggcaatatcgatgtttaacggccaatttctgttcgatcggcccatgcacgtcaaaatggatgataagtcagtcccccatgaggaatatagatctcacgacgggaaaactccccagctaccaaggggcctgggaggcatcgggatggggctaggacccggtggtcagcccatatcagctagccagttgaatatcggtggcgtgatgggtaatttagggccaggcggaatggggatggatggcccgggttttggcggcatgaacagaatcgggggggggattggcttcggcgggttagaagctatgaatagtatgggagggttcgggggcgtcggacgtatgggcgaactttataggggtgcaatgaccagtagcatggaaagagatttcggacgtggtgacattggaataaatcaggggtttggcgacagtttcggacggctcggcggaggcatgggctccatgaactctgtcaccggcggcatgggaatgggccttgacagaatgtcctctagctttgatcgcatgggccccggaatcggcgcaatcctagagagatctattgacatggaccgcgggttcctctccggacccatgggcagtgggatgcgggagcgaattggatcaaaagggaatcagattttcgtgaggaacctgccatttgacctgacctggcagaaactcaaagagaaattctcccaatgcggccatgtaatgtttgccgaaataaaaatggaaaatggaaagtctaagggctgcgggacggtgcgttttgactctcccgagtcagcggaaaaggcctgccggatcatgaacggaatcaaaatatcaggacgcgaaatcgacgtgcgactagaccggaatgcctag

SEQ ID NO: 27943 - DNA, 1803 bp, Artificial Sequence
  Description of Artificial Sequence: Synthetic coding sequence
atggcagacgctaacaaggctgaggtacctggagcaacgggcggagactcaccgcacctgcagcccgcggagcctccaggcgagcctcgcagagagccccaccccgctgaggctgaaaagcagcagccccagcattcttccagtagtaatggcgtgaagatggaaaacgacgaatcagctaaggaagaaaagagcgacctaaaggaaaaatctacaggtagcaagaaggcaaataggtttcatccctactccaaggacaaaaactccggcgccggtgagaaaaagggacccaatcgaaatcgagtgttcatcagtaacatcccttacgacatgaaatggcaggcaatcaaggatttgatgagggagaaggtgggtgaagtgacgtatgtcgaattgtttaaggatgccgagggaaaatcacgcggttgtggtgttgtggaatttaaggacgaagagtttgtcaaaaaagctctggagactatgaacaaatacgacctgagcgggcgacctctgaatatcaaggaagaccccgacggtgagaacgctcgacgcgctctgcagagaaccggcggctcattcccgggtggacacgttccagacatggggtctgggcttatgaacctgccaccctctatactcaataacccaaatatcccgcccgaggtcatcagtaacctccaggccggcaggttgggctcaactatcttcgtggcaaatctcgatttcaaggtgggctggaagaaattgaaggaagtgttttccatagctggtaccgtgaaaagggcggacattaaggaggacaaggacgggaagtcccgcgggatgggtacagttacttttgagcaggctattgaagcagtccaagctatatccatgttcaatgggcagttcctgttcgaccgccctatgcacgtgaaaatggacgacaaaagtgtcccacacgaagaatacaggagccatgatggaaaaacaccccagttgcctagaggtctgggcgggatcggcatggggttaggaccgggcggacagccgatatcagcctcccagttgaacatcggaggggtgatgggcaatctgggccctggaggtatgggcatggatggtcctggctttggtgggatgaaccgaataggcggaggcatcggctttggagggttagaagcaatgaactccatgggagggttcgggggcgttggccgcatgggcgaactctatagaggggcaatgaccagctccatggaacgagacttcggcaggggcgatatcggtatcaaccagggcttcggcgacagttttgggcgattagggtcagctatgatcggcggctttgcgggccggatcggatcatctaacatgggtccggtgggatccggaatctcgggcggtatggggtccatgaacagcgtaactggcggaatgggtatggggctcgatagaatgagctcatcattcgataggatgggtcccggcatcggggccatactggagcgcagcatcgacatggaccgcgggtttttatcagggccaatgggatccggcatgagagagcgcataggatcaaaaggaaaccagatctttgtcagaaacctgccgtttgatttgacatggcagaaactcaaggagaaattcagtcagtgtggacacgttatgttcgcagagattaaaatggaaaatggaaaatccaaagggtgtggaactgtcaggttcgactcgccagaatccgccgagaaagcctgcaggattatgaatggaattaaaatctctggacgcgaaatcgacgtgaggctggaccgtaacgcgtag

SEQ ID NO: 27944 - DNA, 567 bp, Artificial Sequence
  Description of Artificial Sequence: Synthetic coding sequence
atgaattccatggggggctttggaggcgtaggaagaatgggtgaattgtataggggtgcaatgacctcaagcatggaaagagactttggacgtggggacattggtatcaatcaaggattcggcgatagttttggcagattgggaggtggtatgggcagtatgaactctgtcactgggggtatgggaatgggtctggaccggatgtcctcatcgttcgatagaatggggcctggtatcggcgccattttggagcggtcaattgacatggatcgcggttttctgtctgggcccatggggtcagggatgagggaacggatagggtcaaaaggaaaccagatcttcgtgagaaatctgccattcgacttgacctggcaaaaacttaaagagaaattttctcagtgcgggcatgtgatgtttgccgagatcaagatggagaatgggaaaagcaaaggatgtgggacggtgcgattcgatagcccggaatcagccgagaaagcatgtagaattatgaacggcatcaaaatcagtggaagggaaatcgacgtgcggctggacaggaacgcgtag

SEQ ID NO: 27945 - DNA, 381 bp, Artificial Sequence
  Description of Artificial Sequence: Synthetic coding sequence
tagggacttgaccgcatgagctccagctttgaccgaatggggccaggaatcggcgcaatcctggagagatctattgacatggacagaggttttttgtcaggacctatgggaagcggtatgcgggagaggataggttccaaaggaaatcagatcttcgtgaggaatcttccattcgaccttacgtggcagaagctaaaagagaaatttagccagtgcggacacgttatgtttgccgagatcaaaatggagaacggaaaaagcaaaggatgtgggacagtcaggttcgactcccctgaaagtgccgagaaagcctgtcgcatcatgaacggaatcaaaatttccggcagagagatcgatgttaggctcgatcggaacgcgtag

SEQ ID NO: 27946 - DNA, 810 bp, Artificial Sequence
  Description of Artificial Sequence: Synthetic coding sequence
atggccgctagtgccggagctggcgccgttatcgcggcacccgatagcaggagatggctgtggagcgtgcttgccgcggcactcgggctacttactgctggagtgagcgcccttgaagtctacaccccaaaggagattttcgtagccaacggtacgcaaggcaaacttacatgcaagttcaagtccacatccaccactggaggattaacctctgtgtcgtggtccttccagcccgagggtgctgacacaaccgtaagcttctttcattactcccaggggcaggtgtacctgggtaactaccccccatttaaagacagaatctcatgggctggcgatctcgacaaaaaggacgcctcaatcaacatagagaatatgcaatttatacacaacggtacatatatttgcgacgtgaaaaatccgccggacatcgtggtccaacccgggcatatcaggctatacgtcgtggagaaagaaaaccttccagtgtttccagtgtgggtagtggtcggtatagtaacggccgtcgtcctgggattgaccttgctgatttccatgattctcgcggtgctgtacaggcgcaaaaatagcaagagagattataccggatgttccacttcagaatctctgtctccagttaagcaggcgcctcgaaagagccctagcgatacggagggccttgtgaaaagtctgccctccgggtcccaccagggtccagtcatctacgcgcagctcgaccattcaggcggtcaccacagcgataaaattaacaagtcagagtccgtcgtttacgccgatattaggaaaaattag

SEQ ID NO: 27947 - DNA, 630 bp, Artificial Sequence
  Description of Artificial Sequence: Synthetic coding sequence
atggcggcaagcgccggggcaggtgccgtaattgctgccccggacagtcggcggtggctatggtccgtacttgccgctgccctgggactcttaacagccggtgtgtctgctctggaagtgtatacgcctaaagagatctttgtggcaaatggcacacagggcaagcttacctgcaagtttaagtcaacctctactaccggcggccttacatctgtctcctggagttttcaacctgagggcgccgatacaactgtttcattttttcactacagccaaggacaggtgtatttagggaattatcctccgtttaaagaccgcatcagttgggctggcgatctcgacaagaaagacgcttctattaacatagaaaacatgcagttcatccataacggaacatacatttgtgatgtaaagaacccgcctgacatcgtcgtccagcccgggcacattcgactctatgtggtggaaaaagagaaccttcctgttttcccggtatgggttgtagtcgggatcgtcacggctgtggttctgggcctaactctgttgatttccatgatcctggcggtcctgtatcgacggaaaaattccaagagagattacaccggtgctcaatcatacatgcactcctag

SEQ ID NO: 27948 - DNA, 360 bp, Artificial Sequence
  Description of Artificial Sequence: Synthetic coding sequence
atggccgccagcgcaggagccggcgcagtgatagcggcgccagactccaggcggtggttgtggagtgtgctagctgcggcccttggactattaacggccggagtcagcgcgctagaggtgtacaccccaaaggagattttcgtcgccaatggaacccaggggaagttgacctgtaagtttaaatccaccagcacaactggaggcctcacgagcgttagttggtcgttccagcccgagggcgctgataccactgtctctggacccgtgatctacgctcaactggaccatagcgggggtcaccacagcgataagatcaataagtccgaaagtgtggtctatgctgacattagaaagaactag

SEQ ID NO: 27949 - DNA, 6147 bp, Artificial Sequence
  Description of Artificial Sequence: Synthetic coding sequence
atgctgcgcgttatcgttgaatctgccagcaatataccaaagactaagtttggcaagcccgatcctatcgtgagcgttattttcaaggacgagaaaaagaagaccaaaaaggtagataatgagttgaaccctgtgtggaacgaaatcctggaatttgacttgcgtggaataccactggatttcagttcctccctggggatcatagtgaaggatttcgaaacgatcggacaaaataaactgatcgggactgcaactgtggcactgaaagatcttaccggagatcaatctaggtccctcccttataaactaatttcattattgaatgaaaaaggacaggataccggggccaccattgatctggtcatcgggtacgatcctcccagcgcccctcatcctaacgacctcagtggtccaagcgtgcctggtatgggaggagatggtgaagaggacgagggcgatgaagaccggctcgataatgccgtccgaggccctggtccaaagggccccgttgggactgtgagcgaagcccaactggcccgacgcctcaccaaggtcaaaaatagtaggagaatgttgagcaataagccccaggactttcagattagagttagagtgatcgaaggacgccagctctccggtaacaacattcggcctgtggtaaaggtgcacgtgtgtgggcagactcaccgcactcgcatcaagagaggtaacaaccccttttttgatgagctattcttctataacgtgaacatgaccccgtccgagttaatggacgagataatttctatacgcgtctacaactcgcactctctccgagcggactgtctgatgggggagttcaagattgacgtaggcttcgtttacgatgagccagggcacgcagtcatgcggaaatggcttctcctcaacgatccagaggatacatcatcaggttccaaaggctacatgaaagttagtatgtttgtactggggacaggcgacgagccacctccggaacggagggatcgtgataatgatagcgatgacgtcgaatcaaatctgctgcttccagccggcatagcactccgctgggtgactttcttgttgaaaatctaccgagcagaggatatcccacaaatggatgatgccttctcacagactgttaaagaaatcttcggcgggaatgctgacaaaaagaatctggtggaccctttcgtcgaagtgtcattcgccggtaaaaaagtatgcaccaacattatcgagaaaaacgccaacccagaatggaaccaggttgttaacctgcagatcaagtttccgagtgtgtgtgagaaaataaaactcaccatatacgactgggacaggttaactaagaacgacgttgttggtactacttacttgcatctcagcaaaatcgccgcgtcaggcggggaggtggaagtcaatacgggggagacggaggtgggatttgtacccacgtttggaccgtgttacttgaatctatacggcagtcctagggaatacacaggattccccgatccttacgacgagcttaacacaggcaaaggagagggtgttgcttacagaggccgtattctcgttgagttggcaacattcctggaaaaaacaccgcccgataagaaactcgagcccatatctaacgatgacctcctcgttgtggagaaatatcaaaggagaaggaagtactcactgtcagccgtatttcatagcgcgacaatgctgcaagatgtcggagaggccattcagtttgaagtgtccatagggaattatggtaataagttcgacaccacctgcaagcctttggcttccaccactcagtactcacgggccgtgtttgatggcaattattactattacctcccatgggcgcatacaaagccagtggttaccctcactagttactgggaagacatatcccatagactggatgcagtaaacacgctcctggccatggccgagcgcctccagactaatatagaggccttgaagagcgggattcaaggcaagatccctgcaaatcagctcgccgaactgtggctcaagcttattgatgaggtgattgaggacacccgctacactcttccactgacggagggcaaggccaatgtcactgtactcgacacccaaattcgcaaactgagaagtcgatcgctgagccaaatccacgaggccgccgtcagaatgaggtcagaagctaccgacgtcaagtctaccctggcggagatagaagattggttggataaactgatgcagttgactgaggaaccccagaatagcatgcccgacatcattatttggatgatcagaggcgagaagcgtctggcctacgccagaattcccgcccatcaggtcctctacagtacctctggagagaacgcctccgggaagtactgcggtaaaacccagactatatttctgaagtatcctcaggagaagaacaatggcccaaaagtccctgtggaactgagagtcaacatttggctcggactgtccgccgtcgaaaagaagtttaattcatttgccgaaggaactttcacagtgtttgccgagatgtacgaaaaccaagcgctgatgttcgggaaatggggcacctctgggttggtcggaagacacaagttctccgatgtaactggcaaaatcaaactcaagagggagttttttctcccgcccaaagggtgggaatgggaaggcgaatggatagtcgatccggagcgctccctcctgaccgaagccgatgccggacataccgagtttactgacgaagtttatcagaatgaatcccggtatccagggggagactggaaaccagccgaagacacttacaccgatgccaatggcgacaaggcagccagcccgtcagagctcacttgtccacccggctgggagtgggaagacgacgcttggagctatgacatcaaccgtgccgtggatgaaaaggggtgggagtacggcattaccatccctccagatcacaagcccaaatcatgggtggcagccgagaagatgtatcacactcaccggagacgacgtcttgttcgtaaaagaaaaaaagacttgacacagacggcatcaagcactgccagggccatggaggaactccaggatcaggaggggtgggagtacgcctctctgatcgggtggaaattccattggaagcaaaggtcctcagatactttccggcgacggcggtggaggagaaagatggcacctagtgagacccacggcgctgccgccatttttaagctcgagggagctctcggagctgataccacggaagacggggatgaaaaatctctggagaagcagaagcatagtgctaccacagtctttggagccaacacacctatcgtgagctgtaattttgaccgcgtttacatctaccaccttaggtgctatgtgtatcaggcccggaacttactggcattggacaaagacagcttctccgacccttacgcacatatctgcttcttgcacaggtcaaagactaccgaaataatccactctacactcaacccaacttgggaccaaaccatcatctttgacgaggtggagatatacggcgagccccagacagtacttcagaatccacctaaggttatcatggagttatttgacaacgatcaggtgggtaaagacgaatttcttggacgtagtatcttttcccctgtggtgaaactcaactccgagatggacataaccccaaaactactgtggcatccagtgatgaatggagataaggcctgcggggacgttctcgtgactgctgagcttattttaaggggcaaggatggctcaaatctcccgatcctccctccacagcgagcccccaacctatatatggtgcctcaaggaatccgcccggtggtgcagttgacagctattgaaattctcgcgtgggggttacggaatatgaagaattttcagatggccagtattacatcaccctcactcgtcgtcgagtgcggcggcgagagggttgagtcagttgtgattaagaacctcaagaaaacgccaaactttccctcatctgtgctttttatgaaggtatttctccccaaagaagagctgtatatgccccccctggtaattaaggtgatcgatcatcgccagttcggcaggaagcccgtggtaggacagtgtacaatcgaacggctagatagattcaggtgtgacccctatgcgggaaaggaggatattgtcccccaactgaaggcctctctgctgtcagctcccccatgcagagatatagtcatcgaaatggaggacaccaaaccactccttgcctcaaagttgactgagaaagaggaggagattgtggattggtggtctaagttttatgcatcttctggggaacacgaaaaatgtgggcagtatattcagaaggggtatagtaagttgaagatctacaattgcgagcttgagaacgtcgccgagtttgagggtctgacagacttcagtgacacattcaagctctacaggggtaagtcggatgagaacgaagacccttccgtggtcggagagttcaaaggcagcttccgaatctaccctctccctgacgatcccagtgtgccagcgcctcccaggcagttccgcgaactccccgattcagtgcctcaggagtgcactgtaagaatttacattgtacgcgggcttgaactccagcctcaggataataatgggttgtgtgacccttatattaaaatcaccctgggcaagaaggtgattgaggatagggaccactacatccctaataccctgaacccagttttcggtcgaatgtacgaactttcctgctacctccctcaggagaaggacctgaagatatctgtctatgattacgatactttcactcgagacgaaaaagtcggcgaaactatcatcgacttagaaaaccgattcctgtctaggttcggaagccactgcggaattccagaggagtattgcgtgtctggagtcaatacctggcgggatcaactgaggcccacccagctccttcagaacgtcgcccgctttaagggctttccccagcccattctgagtgaggatggttccagaattcggtatggtggaagagattacagcttggacgaattcgaggccaataaaatcctacatcagcatctgggagctcccgaggaaaggcttgcactgcacatcttgagaacccaggggttggtcccggagcatgtcgagactagaacgctgcactctacttttcagcccaacatctcccaggggaagttacagatgtgggtggatgtgtttccaaagtctctggggcctcctggcccgcccttcaacattacccccaggaaggcaaagaagtattacctgcgcgtgatcatttggaacacaaaggatgtcatcctggacgagaaatccatcactggggaagagatgtctgacatatacgttaagggttggattcctggtaacgaggaaaataagcagaaaaccgacgtgcactatcgcagtctggatggcgagggtaacttcaactggcgctttgtatttcctttcgactaccttcctgcagagcagctctgcatcgttgcgaagaaggagcacttctggtctatagaccagacagaatttagaattccgccaaggcttatcatccagatctgggacaatgataaattttccctggatgattacctgggcttcctagaattggatctccgccacaccattatccccgccaaaagccccgagaagtgtcgtctggacatgattcctgacctgaaggcaatgaaccctttaaaggcaaagaccgcatcactgtttgagcagaagtctatgaaggggtggtggccatgttatgccgagaaagacggcgcgcgcgttatggcagggaaagttgaaatgaccttggagattctgaacgaaaaggaggcagatgagagaccagccggaaaaggtcgtgatgaacctaacatgaacccaaagctcgacctgccaaatcgccccgagactagcttcctgtggttcacaaatccgtgtaagactatgaaattcatcgtatggcgccggtttaaatgggtgatcattggcctgctttttttgctcatcctgctcctctttgtggctgtcctgctttactctcttcctaactacctgtctatgaagatcgtgaaacctaacgtgtag

SEQ ID NO: 27950 - DNA, 6186 bp, Artificial Sequence
  Description of Artificial Sequence: Synthetic coding sequence
atgttacgagtgatagtcgagtccgcatccaacattcctaagacaaagtttggaaagcctgatccgatcgttagtgttatcttcaaagacgagaaaaagaagacgaagaaggtggataacgaactaaaccccgtgtggaatgaaattctggagtttgatctccgtggcattcctttagacttctcctctagcctcgggatcatcgttaaggatttcgaaacaatcggacagaataaactgattggcacagctacagtcgccctgaaagatttgacaggagatcaatcccggtcactgccctacaagctgataagtctccttaacgagaagggtcaagacactggcgccactattgatctggtcatcggctatgaccccccttccgcccctcaccctaatgatctctcgggaccgtcagtcccaggcatgggaggggacggggaggaggacgagggtgatgaggaccggctcgacaatgcagtcagagggcccggacccaaaggacctgtggggaccgttagcgaggcccaattggccaggagactcaccaaggtcaagaatagccggaggatgttgtctaacaagccccaggattttcagatccgagtgagagtcatagaggggagacaattgtctgggaataatattagacctgtcgtgaaagtgcatgtgtgcgggcagacccataggacaagaataaagagagggaataatccctttttcgacgagctgttcttctataacgttaacatgaccccctctgaactgatggatgaaattatttctattagggtctataattctcattctctccgcgccgactgcctgatgggcgagttcaaaatcgatgtcgggttcgtctatgacgaacctggacatgccgtcatgcggaagtggctactgctgaatgacccggaggacacatcttcgggcagtaagggctatatgaaggtaagcatgtttgtcctcgggaccggggatgaacctcctcctgaaaggagggatcgcgacaatgattccgatgatgtggaatcaaatctcctgctgccggctggtatcgctttacgttgggtgacctttctcttaaaaatatacagggctgaagacattccacagatggacgacgcatttagtcagacagtgaaggagatttttgggggtaacgcagataagaagaatctcgtagacccattcgtagaagtctctttcgcaggcaagaaggtctgcacaaatattattgagaagaatgctaatccggagtggaaccaggtcgtgaacctgcaaatcaaattccccagcgtttgcgagaagatcaaactgaccatttacgactgggacaggctcacaaaaaatgacgtcgtggggaccacatatcttcatctctcaaagatcgctgcatccgggggggaggttgaggacttctcctctagcggaacgggagccgccagctacacggtgaatacaggagaaacggaagttggattcgtcccaacctttggtccatgttatctgaacctgtacggtagtccccgcgaatatacagggtttccagacccttatgacgagctgaatacaggaaaaggcgagggggtcgcctacagagggcgtattctggtcgagttggccaccttcctcgagaagacccctcctgacaaaaaattagaacccatttccaacgatgacctactcgttgtggagaagtaccagcggagacggaaatactcactgagcgccgtgtttcattctgcaactatgcttcaggatgtgggagaagccatccagttcgaagtcagcatcggcaattacgggaacaaattcgacacaacctgcaagccgctcgcgtccaccacgcaatactcacgagcagtctttgacgggaattactattactacctcccctgggcccacacaaagcccgtggtcacattgacatcctactgggaggacattagtcacaggcttgatgcagtgaatacattgttagccatggctgagcggctccagacgaatatcgaagctcttaagtccggaatccagggcaagatcccagccaatcagttagccgagctgtggctgaagctgatagatgaagtgatagaagataccagatatactttacccctgacagaagggaaggccaatgtaaccgtgctcgatacccagattcgtaagctccggagtaggtccctgagccagattcacgaggcagctgtaaggatgagatcagaagctactgatgtgaagtccacactggctgaaatcgaagactggctggataagctgatgcagcttaccgaagaaccccagaattccatgcccgatatcattatctggatgatccgaggagaaaaacgcttggcctacgctagaattcccgcccatcaagtgctttacagcacaagcggagagaacgcctctgggaaatattgcgggaaaactcagactatatttctgaagtatccacaggaaaaaaataacggcccgaaagtgcccgtcgaattaagggttaatatctggctcggccttagcgcagtggagaaaaagtttaatagcttcgcggaaggaacgttcactgtattcgcagagatgtacgaaaaccaggcactgatgtttggaaagtggggtaccagcggtctagtggggcggcataagtttagcgatgtgactggaaagattaaactgaaaagagagtttttcctgccccccaaggggtgggagtgggaaggcgagtggatcgtcgatcccgaaagaagcctgcttactgaagcggatgccggccacaccgaattcactgacgaggtctatcaaaatgagtctagatatcctggcggcgactggaagcccgctgaggatacgtatactgacgccaatggagacaaggctgcatcacccagcgaactcacatgtccccccggatgggaatgggaggacgacgcatggagctatgatataaatagggcagtggatgagaagggctgggagtacggaattacaattccaccagaccacaagcccaagagctgggtggccgccgagaagatgtatcacactcaccgcagacgacggctcgtaaggaaaagaaaaaaagacctgacgcagaccgccagctcgaccgcacgggcaatggaggaattgcaggatcaggagggatgggagtatgctagccttattggttggaagtttcattggaaacagcgaagctctgacactttccggcggagaagatggagacgaaaaatggcaccgagtgaaacccatggcgctgctgctatattcaagcttgagggcgccttgggtgctgacactacagaagacggtgacgaaaaatccctcgaaaagcagaagcacagtgccaccacagtgttcggtgctaacacccccatcgtgagttgcaattttgacagggtatatatctatcacctgcgatgctatgtgtaccaggctcgcaatcttctcgccctggataaagactctttcagcgacccatacgcgcacatctgttttttacatagatcgaagacaaccgaaatcatccacagtacattgaaccccacatgggatcagaccatcatatttgacgaggttgaaatctatggcgagcctcagaccgtgctccagaacccccctaaggtgattatggaactgtttgataacgaccaggttggcaaagatgagtttttaggaagatcgatcttctctcctgtggttaaactcaactccgagatggatatcaccccaaaactgttgtggcatccggtgatgaacggcgacaaagcctgcggagatgttctggtgaccgccgagttaatccttagaggcaaggacggaagcaatctgccgatattgcctccccagagggctccaaatttgtatatggtacctcagggaatccgccccgttgtgcaactgaccgccattgaaattttggcatggggccttaggaacatgaaaaattttcagatggccagtattacctcccctagcctcgtggtagagtgtggcggcgaaagagtggagtctgttgtgattaaaaatttgaagaagactcccaattttccgtcatctgtgctgttcatgaaggtcttcctaccgaaagaagaactttacatgccacccctcgtcatcaaggtgatagaccaccggcaattcggtcgaaaacctgtagtcggccaatgtacaatcgaacgattagatcggtttcggtgtgatccctacgctggaaaggaggacattgtgccacaactgaaagcatcccttttgtcggctccgccttgccgcgatatcgtaatcgagatggaagacacaaagccactcctggcatctaaactgaccgaaaaggaagaggaaatcgtagattggtggtcaaaattttatgcctcaagcggcgagcacgaaaagtgtggacagtatattcagaagggctattctaagctaaagatttacaactgtgagctcgagaatgttgccgagttcgaaggactaacagatttcagcgatacctttaaactgtatcgcgggaaatctgatgaaaatgaggatcccagtgtggtgggcgaattcaagggctcatttcggatctatcctctgcctgatgatccatccgtgcccgccccccctcgtcagtttcgcgaactacctgactcagttccacaagagtgcactgtacggatatacatcgtgcgaggcctggagttgcagccacaggacaacaatggactctgcgacccctacataaaaatcacgctcggcaagaaagtgatcgaggatagagatcactacattccaaacactctgaaccccgtcttcggacgaatgtatgaactgagctgctatttgccccaggaaaaagacctcaagatcagcgtgtatgactatgatacgttcaccagagacgaaaaggtgggggagactatcattgatctggaaaataggtttctaagccgttttggttctcactgtggaatcccggaggagtattgtgtaagtggagtcaacacttggcgagaccagcttcggcctactcaacttttgcagaacgttgctaggttcaagggcttcccccaacccatcctgagcgaggatggttcacgcatcaggtacggtggacgggattatagcctggacgaatttgaagctaacaaaatcctacaccaacatctcggggccccagaggaacggctggctctgcacatcctccggacccagggcctggtgcctgagcacgtcgagacccggaccctgcatagcaccttccagcccaacatttctcaaggaaagctgcagatgtgggtggacgtcttcccgaagtctttgggcccacctgggccacctttcaatattacgccccgcaaagctaaaaagtactacctgcgggtgattatctggaatactaaggacgttatcctcgatgaaaaaagcatcacaggtgaggagatgtccgacatctacgttaaaggctggatccccggtaatgaggaaaataagcagaagacggacgttcactacagaagccttgatggagagggcaattttaactggcggtttgtatttcctttcgattacctgcctgccgagcagctctgtattgtggcgaagaaagaacatttctggagtatagatcagacagagttccggatcccccctcgtctgatcatacagatctgggacaacgacaagttttcccttgatgattacctagggtttttggaactggatctacgtcataccatcataccagccaagtcgcctgagaaatgcagactagacatgatcccagatctgaaggcaatgaaccctctaaaggccaagaccgcttcgcttttcgagcagaagtctatgaagggttggtggccgtgctatgcggaaaaggacggggcgagagtgatggctggcaaggttgaaatgactcttgagattttaaatgaaaaggaggctgatgagcgacccgccggaaagggccgagatgaacccaacatgaaccctaagctggatctgcccaaccgcccggaaactagctttctgtggttcactaatccatgtaagaccatgaaattcatagtttggcggcgcttcaaatgggttatcatcgggttgttgtttctactcatcctactgctctttgtggccgtgctactttactcgctccctaactacctctccatgaagatcgtaaaacccaatgtgtag

SEQ ID NO: 27951 - DNA, 483 bp, Artificial Sequence
  Description of Artificial Sequence: Synthetic coding sequence
atgctgagggtaatcgtggaaagtgccagcaatatccccaaaaccaagttcggaaagcctgacccaattgtatcagtaatcttcaaggatgagaagaaaaaaacaaaaaaggtggataatgaattgaatcccgtgtggaacgagattctggagtttgacctcagaggtatcccactggatttcagttcctccttgggcattatcgtcaaggactttgagaccattggacagaataaactgattggaacagcaaccgtggcacttaaggacctgacgggagatcagtctcgcagtttgccgtataagctcatttccctgctgaatgagaagggccaggataccggcgccacgatcgacctggtaattggctacgatcctccatccgccccacatccaaacgatctgagtggaccaagtgtgcccggaatggggggtaagctgacccttctcaaggcacagcccccaccaggaggggggtgctag

SEQ ID NO: 27952 - DNA, 1338 bp, Artificial Sequence
  Description of Artificial Sequence: Synthetic coding sequence
atgttgcgggtgattgttgagtccgctagcaatatccccaagaccaagttcggcaagcctgatccaatcgttagtgtgatcttcaaagacgagaagaaaaagacgaaaaaggtggacaacgaattgaacccagtttggaatgagatcctagaattcgacctgagaggtatacccctcgattttagctctagtctgggcattatcgtgaaggacttcgaaaccatcgggcagaacaagttgatagggaccgcgacagtggctttaaaagaccttaccggagaccagtccaggtccttaccctacaagcttatttcactgcttaacgagaaggggcaggatacaggagcaacaatcgatctcgtgataggatatgaccccccttccgctccgcatcccaacgatttaagcggcccgtccgtgccaggtatgggtggtgacggcgaggaggatgaaggagatgaggaccgtttggacaacgccgtgcgaggacccgggcctaagggtcctgtaggcactgtttccgaagctcagctggcacgcaggctaaccaaggtgaagaactcccgccgtatgttgtctaataagccccaggatttccagatcagggtgcgcgtcatcgaggggagacagctgtcaggaaataacattcgaccggtcgtgaaagtgcacgtatgcgggcaaacgcatcggacacgtatcaagcgggggaataacccattcttcgacgaactgtttttttataacgtcaatatgactcccagcgagttaatggacgaaataatttcaattagggtttataacagccactccctgcgtgcagattgtcttatgggtgaattcaagatcgacgttggcttcgtttacgacgaaccgggtcatgctgttatgcggaaatggctcttactgaatgatcccgaagacaccagttctgggtccaagggctacatgaaggtgtcaatgttcgtgctgggcactggcgacgagcctcctcctgaaaggagggaccgagacaacgattctgacgacgttgaatctaaccttcttctgcctgcagggattgccttgcgctgggtgacatttttgcttaagatctacagggctgaggacatacctcaaatggacgacgccttctctcaaacagtcaaggaaatttttggcgggaatgctgataaaaaaaacttggtggacccgttcgtcgaggtgagcttcgctggcaagaaagtgtgcaccaacattatcgaaaagaatgctaaccccgagtggaaccaggttgtaaacctgcagatcaaatttccaagcgtgtgcgagaagattaagctgactatctatgactggtag

SEQ ID NO: 27953 - DNA, 6186 bp, Artificial Sequence
  Description of Artificial Sequence: Synthetic coding sequence
atgttgagagtgattgtggagagcgcttctaatatccctaagacgaaatttgggaagccagaccccattgtgagtgtaatctttaaggatgagaagaaaaagaccaagaaggtagacaacgagctgaaccccgtttggaacgagatcctggagtttgacctacgggggatccctcttgatttcagttcatctctgggaattatagtgaaggattttgagacgattggtcagaataaactcataggtactgctactgtggctctgaaggacctgacaggagatcagtcccggtcactgccgtataaactgatctccctcctgaacgaaaagggccaggacacaggtgcgacaatagacctggtaatcggctatgacccgcccagtgcaccccaccccaacgacctgagcggtcccagcgtaccgggcatgggcggcgacggggaggaagatgagggtgatgaggaccgcctggacaatgccgttcgagggcccggacctaagggacccgttggaactgttagcgaggctcagctggcaagacggctgacgaaagtcaagaactcacggcggatgctttccaataagccccaggacttccagatcagagtgcgcgtcatagaagggagacaattgtccgggaacaatattcgccccgtggttaaagtgcacgtgtgtggtcagacgcacagaacaagaattaaacggggcaacaacccgttctttgatgaattgttcttctataatgtgaacatgaccccatctgagctgatggatgaaataatctctatcagggtctacaattcccatagtttgcgtgcagactgtctcatgggagaatttaaaatcgacgttgggtttgtgtacgacgagcctggacacgcagtgatgagaaaatggctgctgcttaatgatcctgaagacaccagctctggttctaagggatatatgaaggtgtctatgtttgtcctgggaaccggcgacgaaccgcccccagagaggcgtgatcgtgacaacgactccgatgacgtagaatctaatctgctgctgcccgctggaattgccctgcggtgggtcacttttctgctgaagatctatagagctgaggacatcccccagatggatgacgcattcagccaaactgtgaaggagatttttgggggcaatgctgacaagaagaatttagtggatcctttcgtggaagtctccttcgctggtaagaaagtgtgtaccaatatcatcgagaaaaacgcaaacccagaatggaaccaagtagtaaatctccaaatcaagttcccgtcagtgtgcgaaaagatcaagctgaccatctacgattgggatcgcctgaccaaaaacgacgtggtgggaacaacatatctgcacctttctaagattgcagcctcgggcggtgaagtggaggatttctcatcctcaggaaccggcgccgcttcctacactgtgaataccggggaaacagaggtaggcttcgttccaacgttcgggccttgctacttgaacttgtatggttcaccaagggaatatacaggattcccagatccttatgatgagctcaacactggcaaaggggaaggtgtggcctaccggggtagaattttggtggagctggcaacctttctggaaaagaccccccctgataagaagctggaacctatttccaacgatgatctgcttgtagtggagaagtaccagcgaaggagaaagtacagtttatcagctgtctttcatagcgcaaccatgttgcaggatgtgggtgaagcgattcagttcgaagtgtccatcggcaattatggaaataagttcgacaccacctgcaaacccctggccagcactacccaatactcccgcgcagtgtttgatggcaactactactactaccttccctgggcccacactaaaccagtagtcacccttaccagttactgggaggacatcagtcataggcttgatgcagtgaataccctgctggccatggcagagcgccttcaaactaatatagaagcattaaagtctgggatccagggaaaaattcccgcaaatcagcttgctgaactgtggctaaagctaatcgatgaggtgattgaggatactagatacactctccctttaactgagggcaaggccaatgtcactgtgctcgacactcaaattcgcaaactacgctccaggtctctgtcacagattcatgaggctgcagtgcggatgagaagtgaggccacagatgtaaaatcaaccctggcagagatcgaggattggctggacaagctaatgcaattaaccgaggaacctcaaaatagtatgcctgacatcattatctggatgattcgaggggagaaacgcctggcctatgctcgcatacctgcccaccaagttttgtacagcacttctggcgagaacgcctctggaaaatactgcggtaagactcagacaatttttctgaagtacccccaggaaaagaacaacggtccaaaagtgcccgttgaattacgcgtgaacatttggctgggcctgtctgccgttgagaaaaaattcaattccttcgctgaaggcacatttaccgttttcgcagagatgtacgagaaccaagcattaatgttcgggaaatggggtacatccgggttggtggggaggcataagttctcagatgtcactggcaagattaagttaaagagggaattcttcctgcccccaaagggatgggaatgggaaggagagtggatcgttgatccagagcgcagtctcctcactgaagctgatgccggtcacaccgaattcactgatgaagtgtatcagaacgagtcccggtatcctggcggagattggaaaccagccgaggacacgtataccgacgccaatggcgacaaagcggcatcaccttccgaactcacctgtccccccggttgggagtgggaggacgatgcatggtcctatgatataaatagggcagtcgacgagaaaggctgggaatatgggattaccattccaccagatcacaagcccaagagctgggtggcagctgaaaaaatgtaccatacacaccgtcggcgacgactggtcagaaaacggaagaaagacctcactcaaacagcaagcagtacggctagagccatggaggagctgcaggatcaggagggatgggagtacgctagcctcattggttggaaattccactggaaacaaagatcatctgacactttccggcgccggcgttggcgaaggaagatggcgccctcagagactcatggggccgctgcaattttcaaactggagggagcccttggagccgacaccaccgaagacggcgacgaaaaaagcttagagaaacaaaagcatagcgcaacaactgtgtttggagcgaacacacctattgtttcgtgtaattttgatcgcgtttatatttatcatctgcggtgctatgtgtaccaggctcgcaatcttctggctttggataaggatagttttagcgacccctacgcccatatctgctttctgcaccgctctaagactacagagataattcactctaccctcaaccccacttgggaccagactattatcttcgacgaggtcgagatctacggtgaaccccagacggtgcttcagaacccaccaaaagtaatcatggagctgttcgataacgatcaggtgggcaaggacgagtttctcggtcgatctatcttttcccccgtcgtaaaactgaatagtgagatggatattacacccaagctgctatggcatcccgtgatgaatggcgataaagcctgtggagacgtactcgttacagctgaactgatcctccgcggaaaggacggcagtaacctccccatcctgccaccccagcgggcccctaacttgtatatggtgcctcaaggaatccggcctgttgtgcagcttacggcaattgagattttagcttggggtcttagaaacatgaagaactttcagatggcatctattacttctccgtctttggtggtggagtgcggaggcgaacgggtagaatccgtagtgatcaaaaacctcaagaagacacctaatttcccatcaagcgtgttatttatgaaggttttcctgccgaaggaggaactttatatgcctcctttagtgatcaaggtgattgaccataggcagtttggtaggaaacccgtagtagggcagtgcacaatcgaacggctggatagattccgctgtgacccttatgctggaaaagaggatatcgtgccacagttaaaagcctccctgctgtccgctcctccttgcagggacatcgtgatcgaaatggaggataccaaacccttgctggcctctaagctcgtaagcatagaggaagagatagtggactggtggagcaaattttatgcaagctccggagagcatgagaaatgcggccagtatatacaaaaaggatacagcaagctcaaaatttacaattgcgaactggagaatgtggccgagtttgaaggcctgacagacttctctgatacttttaaactctatcgaggcaaatccgatgagaacgaggacccctcagtggtgggtgaatttaaaggatcttttcgtatctacccactgcccgacgatccatccgtccccgcccccccacggcagtttagggagctgccagatagtgtcccccaggagtgcactgtgcggatttacatcgtgcgcggactggaactccaacctcaggacaataatggactgtgtgacccttatatcaagattaccctcggcaaaaaagtgattgaagatcgcgaccattacatacctaacaccctgaaccccgtgttcggtcgcatgtacgaactgagctgctatctgccccaagagaaagatctgaaaatctctgtgtacgattatgacacctttaccagggatgagaaggttggagagaccatcatcgacttggagaatcgatttctgtcgagattcggtagccactgcgggattccggaggagtactgcgtaagcggtgtgaatacctggcgcgatcagctcagacccacccaacttttgcagaatgtcgccagattcaagggctttccgcaacctatcctctccgaagatgggagcaggattcgctatggcggacgggattatagcctcgatgagtttgaggccaataagatcctgcaccagcacctgggcgcccccgaggaaaggctagcattacacattctgcggacccaagggctggtgcctgagcacgtcgaaacacgcactttgcactcaactttccagcccaacatctcccagggtaagctgcagatgtgggtggacgtgtttcccaaatccctggggccccccggacctcctttcaacatcacgccccgtaaagcaaaaaagtattacctcagggttattatttggaacactaaagacgtcatcttagacgagaagtcaattaccggggaggagatgtccgacatttatgttaaagggtggattccgggaaatgaggagaacaaacagaaaaccgacgtgcactatcgctctttagacggagagggcaacttcaattggagatttgtttttcctttcgactatctacccgccgagcagctatgcattgtcgccaagaaggagcacttctggagtatagatcagacagagtttcgaattccccccaggctgatcatccaaatctgggataacgacaagttttctctcgacgattatctgggatttctcgaattagacttaaggcatactattattcctgctaagagtccagaaaagtgtcgtttagatatgatcccagacctgaaggcgatgaaccctctgaaggctaaaacggccagtttattcgagcagaagagtatgaagggctggtggccctgctatgcagaaaaagatggagcccgagttatggctggaaaggtggagatgaccttggagattctgaatgagaaagaggcagatgaaagaccagcagggaaaggcagggacgagcctaatatgaatccaaagctggacctgccaaacaggcccgaaaccagcttcctgtggtttactaacccttgtaaaaccatgaaatttattgtctggcgaagattcaaatgggttattatcgggctacttttccttctaattcttctcctcttcgtggccgtactactgtactcccttcccaattacttgtccatgaaaatcgtcaagcctaatgtatag

SEQ ID NO: 27954 - DNA, 6156 bp, Artificial Sequence
  Description of Artificial Sequence: Synthetic coding sequence
atgctccgagtgatcgtggaatcagcctctaacattcccaaaactaagttcggaaaaccagatccaattgtgagtgtcatattcaaagacgaaaagaagaaaactaagaaggtggataacgaactgaatcccgtatggaacgagattctcgagtttgacctacgaggtatcccactcgacttctctagctccctgggcatcattgttaaagactttgagacaataggacagaacaaactgatcgggacggccaccgtggcactgaaggacctgaccggtgaccagtcccgatcactgccttataaacttatcagtctcctgaatgaaaaagggcaggatacaggcgctactattgatctggttatcgggtatgaccctccatccgctccacatcccaacgatctgtccggtccatccgtcccagggatgggtggcgatggggaagaggatgagggggacgaagacagacttgacaacgccgtgcgagggcctggcccaaaaggacccgtgggtaccgtttcagaggctcaattagctcgccgcctgaccaaagtgaagaattctcgccgaatgctctcaaataaacctcaagatttccaaatcagggtgcgggtaattgagggccgacagttgagtggcaataacatccggcccgttgtcaaggtgcacgtgtgtgggcagacccataggacacgcatcaaacggggaaataatcctttctttgatgaactgttcttctacaacgtgaatatgactccaagcgaattaatggacgaaatcatttccattagagtgtacaacagccacagcctgcgcgccgattgcctgatgggcgaatttaagatcgatgttggctttgtgtacgacgagcctggacacgcagtgatgaggaagtggttgctgctcaacgaccctgaggatacaagcagcggctccaaaggttacatgaaagttagtatgttcgttctcggtactggagacgaaccccccccagagaggcgtgatcgtgacaacgatagcgacgacgtagaatctaatcttcttctgcctgcgggcattgcgctcagatgggttacattccttcttaaaatctacagagctgaagacatcccacagatggatgatgcttttagccagactgtaaaggagatctttggtggcaacgccgataagaaaaacctagtggatccttttgtcgaagtaagctttgccggaaaaaaggtctgtaccaacatcattgagaagaatgcaaacccggagtggaaccaagtcgtcaatctgcagatcaagttcccaagcgtctgtgagaagataaaactgaccatatacgactgggaccgcttaaccaagaatgatgttgtcggtacaacataccttcacctgtccaaaatcgccgcaagtggaggcgaagtggaagatttctctagttcgggcactggcgccgcatcatacacagtaaatactggggagacagaggtaggattcgtgccaaccttcggaccatgttacctcaacctttacggtagccccagggaatatacgggattccccgacccatacgatgagctgaacaccggtaaaggggaaggggtcgcctatcggggcaggatcctagttgaattggctacctttctggagaagactccacccgacaaaaaattagaaccaatctctaacgatgatctcctcgttgtcgaaaagtatcaacgtcggagaaagtattctctctctgcagtcttccactccgccactatgcttcaagacgtcggagaagccatccagtttgaagtgtctatcggcaattatgggaataaattcgacacgacctgcaaacctttggcttccactactcagtatagtcgcgcggtgtttgatggaaactattactattacctcccgtgggcgcacaccaagcctgtagtgaccctgactagctattgggaggatatttcccatcgattggacgcagttaacaccctgctggccatggccgagcgtttacagacaaacattgaagcattgaagagcggcattcaaggaaagatccccgcaaaccagctggccgagctgtggctgaaacttatagacgaggtaatcgaggatacccgatatacactgcctttaactgagggaaaagccaatgtgaccgtcttggatacccaaatccggaagcttaggagtaggtccttgagccaaattcatgaagccgctgtgcgcatgagatcagaggcgaccgatgtgaagtccacattggccgagatcgaagattggctcgataagctgatgcagctgaccgaagagccccagaactccatgccagacatcatcatctggatgatacgcggtgagaagcgcttggcctatgcacggattcctgctcaccaagtcctttattctacctcaggagagaacgcttcggggaaatattgtggcaaaacgcaaacaatttttctcaagtatccccaggagaaaaataacggcccaaaagttcctgtggagctaagagttaacatttggctcgggcttagcgcggttgagaagaagtttaattcttttgccgaagggacctttactgtttttgccgagatgtatgagaaccaagccttgatgttcggaaagtggggcactagtggcctggtcggccggcacaaattttcagacgttacaggcaaaatcaagctcaaaagagagttcttcctacctccaaaggggtgggaatgggagggtgagtggatcgtggatccggagcggtctctactgacagaggccgacgccggccatacagagttcaccgacgaagtgtaccaaaatgaatcgcgctacccaggtggcgactggaaaccggcggaagatacttataccgacgctaacggggataaagcagcttcgccgtccgaactcacctgcccaccagggtgggagtgggaggacgatgcttggtcatacgatattaacagagctgttgacgaaaaaggttgggagtatgggatcactatcccccccgatcacaagcccaagtcctgggttgcagcagaaaaaatgtaccatactcatagacggcggagactggttaggaagcggaagaaggatctgacacagactgcatccagtactgcgcgcgccatggaagagctccaggaccaggagggatgggagtatgcgtctctgattggctggaagtttcactggaagcaacgcagttcggataccttccgtagacggaggtggaggcggaagatggccccgagcgagacgcacggcgcagccgcgatctttaagctggaaggcgcgttgggcgccgatactacagaagacggcgatgagaagagtctagaaaagcagaagcattcggccacaacagtgttcggggcaaataccccaatagtctcatgtaactttgatcgggtttatatctaccatctgcgttgttacgtctatcaagcaaggaatctgcttgcattagataaggactccttttctgatccctatgcgcacatctgctttctgcacaggtccaagacgactgaaatcattcactctaccctaaatccaacttgggaccagaccatcatcttcgacgaggtcgagatttacggggagccccagactgtgctccagaacccccccaaagtgattatggagctgtttgataatgaccaggtcggcaaggacgagttcttaggacgcagtatattctcccctgtagtgaagctaaattcggagatggatatcactcctaagctgctgtggcatcccgttatgaacggtgataaggcctgcggcgatgtccttgtgactgccgaactgattttgcgcggaaaagatgggtccaaccttccaattctaccgccccagagggcccctaacttatacatggtaccacaggggatccggcccgtggttcaactgaccgccatagagatcctggcttgggggctcagaaacatgaagaatttccagatggcaagcataacatcaccatctttggtggttgagtgtggaggggagcgggtggagtcagttgtgataaagaatctcaaaaaaacacccaactttccaagctctgttctgtttatgaaagtgtttctgccaaaagaagagctgtatatgccccccttggtcatcaaggtgatcgatcatcgacagttcgggagaaagcccgtggtcggccagtgcaccattgagcggctagaccgatttcgttgcgacccatatgcgggaaaggaggacattgttcctcagttgaaagcgagcctgttgagtgcacctccttgtagggacatagtgatcgaaatggaagacacgaagcccctgctagcaagtaagtgcctttcatcaatgtccacggcgctgtctaagatggcctctcccgctacagtacacgtgctggacgaggaagaggagatcgtggattggtggagcaagttctacgccagttccggggaacatgaaaaatgtggccagtacatccagaaagggtactccaagttgaagatctacaattgcgagctggaaaacgttgctgaatttgagggactgaccgattttagtgacacctttaagctgtacaggggaaagagtgacgagaatgaggatccctccgtggtaggggaatttaaagggagcttccgcatttatcccctccccgatgatccttccgtgcctgctccaccccgccagtttcgcgagctgccggactctgtaccacaggaatgcactgtacggatttatatcgtgcgcggcctcgagctgcagccacaggacaataatgggctctgcgatccttatattaaaatcacccttggaaagaaagtcatcgaggatagggatcattatattcccaatacgcttaatccagttttcggccgcatgtacgagcttagctgttacctgcctcaggagaaagacttgaagatctccgtgtatgactatgacacctttacacgggacgagaaagtcggcgaaactattattgatttggaaaacaggtttctctcacggttcggtagtcactgtggaattcccgaagagtactgcgtgagcggagtgaacacctggcgggaccagctgagacccacccaactgttacaaaacgtggcaagattcaagggcttcccgcaacctatcttgagtgaggatggatcccggatccggtatggcggtcgggactactccttggacgagtttgaggctaataagatcctgcaccagcacttaggcgctcccgaggaacgtctggctctgcatatcctgagaactcagggcctggttcctgaacacgtggagacccgaacccttcacagtacatttcaacccaacatctcccagcgttattacctccgcgtaattatctggaataccaaagatgtgatcctcgatgagaagtcgattaccggagaggagatgtctgacatctacgtgaagggctggatacctggaaacgaagaaaacaaacagaagactgatgtacactatcgttctctagatggtgaaggcaattttaactggagatttgtattcccttttgattaccttcccgccgaacagctgtgtatagttgccaaaaaggagcatttctggtccatcgaccagacagagttcagaataccaccacggctaatcatccaaatatgggacaatgacaagttctccctcgacgactatcttggattcttagaactggatttaagacatacgatcatccctgcgaagtccccggaaaagtgcagactggacatgatccctgacctgaaggccatgaatcccctaaaagcaaaaaccgcgagcctgtttgaacagaagtccatgaaggggtggtggccttgctatgcggagaaagatggagcgcgcgtgatggccggcaaagtggaaatgaccctggaaattttgaatgagaaggaagcagatgagcgaccggccggcaaaggacgggacgagccaaacatgaatccgaaactggacctgcccaatagaccagagacttctttcctctggttcaccaatccatgtaagaccatgaagttcattgtgtggcgtcgtttcaagtgggtgataataggacttctgtttctcctgattttgttgctgttcgtcgctgtgctcctgtacagcctgccaaactaccttagtatgaaaattgtgaagcctaacgtttag

SEQ ID NO: 27955 - DNA, 873 bp, Artificial Sequence
  Description of Artificial Sequence: Synthetic coding sequence
atgcaccctatcaatgtgcgacgagaccctagtatccctatttatggcctaaggcaaagcattttactcaataccaggctgcaggactgctacgtggactcacctgcactgaccaatatttggatggcccgaacctgtgctaagcagaatatcaatgccccagctcccgctacaacctcctcatgggaagtggtccggaaccctttgatcgcctcttccttctccctggtgaagctcgtgcttaggcggcagctgaaaaacaaatgctgtccacccccctgcaaatttggcgaagggaaactgtcaaagagactgaaacataaagatgattcagtgatgaaggcgacccagcaggcgcgcaagagaaattttatctccagtaaaagcaagcaacctgccggccacaggcgcccagccggcgggattcgcgagtctaaagagtctagcaaagagaaaaaactgacagttcgccaagatctagaagaccgctacgcagaacacgtagccgccacccaggcacttccacaggatagcggaacagccgcctggaagggcagggtcctcctgcctgagactcagaaaaggcaacagttgtcagaagataccctgactattcacggcttgcctacagagggatatcaagccctttatcatgcagttgtagaaccaatgctttggaatccctccgggacgccgaagcggtattcacttgagctcggaaaggctattaagcagaagttgtgggaggccctgtgcagtcagggtgccattagcgaaggggcccagcgtgataggtttcccggccggaaacagcccggagttcacgaggaaccggtcctgaagaaatggcccaagttaaagagcaagaagtag

SEQ ID NO: 27956 - DNA, 813 bp, Artificial Sequence
  Description of Artificial Sequence: Synthetic coding sequence
atgaaggtgactgtaggtcccgacccttccttagtgtaccggcccgatgttgaccccgaggtggccaaagataaagccagcttcaggaactacacttccgggcccctgctggaccgcgtgtttacgacgtacaaactgatgcatacccatcagaccgttgactttgtgcgcagtaagcatgcccaatttggtggatttagctataagaaaatgaccgttatggaggccgtggacttgttagacggactcgtagacgagagcgatcccgacgtggacttccctaactcctttcatgcattccaaaccgccgagggaattcgcaaggcacacccggataaagattggtttcatctggtggggttactccatgatctgggcaaagtgctggcgctttttggcgagccacagtgggctgtggtcggagatactttcccagttggttgcaggccccaggctagcgtggtgttttgcgatagtacttttcaggacaacccggatcttcaggaccctaggtactctactgagttggggatgtaccagcctcactgcggcctggatagagtcttgatgtcctggggacatgatgagtatatgtatcaggtgatgaagttcaacaagttttccttacctcctgaagccttctatatgattcgctttcatagtttctacccatggcacaccgggagggactaccagcagctgtgtagtcagcaagatttggctatgttgccgtggcaggtgagaccattgcatcaggttcctggtccagctggacggggacaagccgccgccctcttacccggtgctcactag

SEQ ID NO: 27957 - DNA, 696 bp, Artificial Sequence
  Description of Artificial Sequence: Synthetic coding sequence
atgaaagtgaccgtgggtccagatccgtccctggtgtatcgacccgatgttgatcctgaagtggccaaggataaggctagtttccgtaattacaccagtggcccgctgctggacagggttttcactacttataaactcatgcatacccatcagaccgtagactttgttcggtcgaagcatgcacagtttggcggcttctcctacaagaaaatgaccgttatggaagccgtggacctgctggacggactggtcgacgaaagcgaccccgatgtggatttcccaaactcattccacgccttccaaacagccgagggaatccggaaggcacacccggataaggttcccaatcttccgtgtccatctccaagccagactgggagcacatcaagcgggtcttgcactacctggggacgctcctggccatgcagcggaagcccctctggactctcttctgccaccccctctccaagtgatgcagtgaggcgccctccgtggttttccgccacacccccgtcccgcacaacactgacctccagaattctggacaccgcgcagtccagcgggtgtatctcaccaacagtgggttccactggcagctcttgccccggagctatgatgcaagtgcgaccactccatcaagtaccggggcctgccggtcggggtcaagcagcagccctgcttccgggcgcacattag

SEQ ID NO: 27958 - DNA, 798 bp, Artificial Sequence
  Description of Artificial Sequence: Synthetic coding sequence
ggtccagacccttcactggtgtacaggcctgacgtggatccggaggtggcgaaggataaggcttcctttaggaattacacctcaggtccgcttttagaccgggtattcaccacgtacaaactaatgcatacccatcagaccgtggattttgtccgatcaaaacacgcccaattcggaggcttttcttacaagaaaatgactgtaatggaggcagtggacctgctggatggtctggtagatgagtctgatcccgacgtcgactttccaaactctttccatgccttccagaccgctgaaggaatcagaaaagctcatccagacaaagactggttccatctcgtaggtctgcttcatgatctgggtaaggtactggctttgttcggggagccccaagcttccgtggtcttctgtgattccaccttccaagacaacccagacctgcaggaccctcgatattccactgaactgggcatgtatcaaccacactgtggcctcgatagggtgctcatgtcctgggggcacgatgaatacatgtaccaagttatgaagttcaacaagttctcccttccaccagaggccttttacatgatcaggtttcatagcttttatccttggcacactggcagggattaccagcaactgtgtagccagcaagacttggcgatgctgccatgggtgcgagaatttaacaagttcgacctctatacgaagtgtcctgatctgcccgacgtcgataaactgcgcccatactaccaggggctcatcgacaagtactgccccggaatcctgtcctggtag

SEQ ID NO: 27959 - DNA, 2823 bp, Artificial Sequence
  Description of Artificial Sequence: Synthetic coding sequence
atggagatcgatcagtgtttactggaatctctgccgctgggtcagcgacagagactggtcaaacgaatgcgatgcgaacagatcaaggcttactacgaacgtgaaaaggccttccagaaacaggaagggtttctgaaacgtctgaaacacgccaaaaaccctaaagtgcatttcaatcttacagacatgctgcaggacgcgattatccatcataatgacaaggaagttttaagacttctcaaggagggagcagacccccacacactggtttcatccggtggtagcctgcttcatctgtgtgccaggtatgacaatgccttcattgcggagattcttattgatcgtggggtaaacgtaaaccaccaggacgaagatttctggacccccatgcatattgcctgtgcctgtgacaatcccgatatagtcctcctcctcgtcctggccggtgcaaacgtcctgttgcaggatgtgaacgggaatatccctctggactatgcagtcgaaggcaccgagagttcttctattcttttaacgtatttggacgaaaatggagttgaccttacctctctgagacagatgaaactccagcgcccgatgagcatgttgactgatgtgaagcacttcctttcctcaggagggaatgttaacgaaaaaaacgatgagggggtaaccctgctgcatatggcttgtgcttctggctataaggaggttgtgagtctaattctcgagcacggcggggatctgaacatcgtggacgatcagtactggactcctttgcaccttgctgcaaagtacggccaaacaaatctcgttaagttgctcctgatgcaccaggccaatccacatcttgtcaactgtaatgaagaaaaggcctcagatatcgcagccagcgagttcatcgaggagatgctcctcaaagcagagatcgcctgggaggaaaagatgaaagaacccctgtccgcctctacactggcacaagaggaaccgtacgaagagattatccatgacctgcccgtgctgtctagcaagttgtctcctctagtcttgccaatagcgaaacaggatagtcttctggagaaggatataatgttcaaggatgctacgaagggcctatgtaagcagcagagccaggactcaattcccgaaaatccaatgatgtccgggtccaccaagcccgaacaagtgaaactgatgcccccggctcctaacgacgacttagctaccctgtctgaactgaacgatggtagcctcctgtacgaaatacagaagcggttcgggaataaccagatttatacattcattggagatatcctcctcctggtcaatccctacaaagaactgccaatatattcttccatggtgtcccagctgtacttttcttctagtggcaaactatgtagctcgctgcccccccacctgttcagttgcgtggaaagagctttccaccagttgtttcgcgagcaacgcccccagtgtttcatcttgtcaggagaaaggggtagtggtaagagtgaggcatcaaagcagattatccgccacttgacctgtcgggccggcgcatccagagctactctggactccagattcaagcacgtcgtttgtattctggaagccttcggccatgctaaaactacactcaacgacttgagttcgtgttttatcaaatatttcgagctgcagttctgtgagcgtaagcagcagctgacgggtgccagaatatacacctatctcctggagaaaagtcggctagtcagtcagccacttgggcaatccaatttcctgatcttctaccttctgatggacggactgtcggcagaggaaaagtacggactgcatctgaataacctttgtgcacaccgctacctcaatcagaccatacaggacgacgcatccacaggcgaaagaagcctgaatcgcgaaaaactcgcagtcctcaaacgtgcattgaatgtggtgggctttagttcactggaggtggagaatctcttcgtcatcttagcagcgatcctgcacctgggcgacatccgatttacagccttgaatgagggtaattccgcttttgtgagcgatctgcaactgctcgagcaggtcgccggcatgcttcaggttagcaccgacgagctcgcctccgcattaaccaccgacattcaatacttcaagggcgacatgatcattcgaaggcatactatccagattgctgagttcttcagagacttactcgccaagagcctttattcccggctgttttcgtttctggtcaataccatgaatagctgcctgcacagccaggacgaacaaaaatcgatgcagactcttgacatcggtattttggatatattcggcttcgaggagttccagaagaatgaattcgaacagctgtgcgtcaacatgaccaacgagaagatgcaccactacattaacgaggtattgtttcttcatgaacaggtggaatgtgtgcaggaaggggtcaccatggagactgcctactctcctggaaatcaaaacggggtcctggactttttctttcaaaaaccttccggttttttgactcttctcgacgaggagagtcaaatgatatggtccgtggaatccaactttcctaaaaagctgcagagtctgctcgagagctcgaatacaaacgccgtatattcacctatgaaggatggcaatggcaacgtggcactgaaggaccacggcactgcgttcactattatgcactacgcaggtagggtgatgtatgatgtggtaggggcaatcgaaaagaacaaagactctctttctcagaatcttctgtttgtaatgaaacggggacgctgcttctag

SEQ ID NO: 27960 - DNA, 5577 bp, Artificial Sequence
  Description of Artificial Sequence: Synthetic coding sequence
atggagatcgatcagtgtcttttggaatcattgcccctgggccagaggcagaggcttgtcaaacgaatgcggtgcgagcaaatcaaagcctattacgaacgggaaaaggcctttcaaaaacaggaaggctttctgaaacgactcaaacatgcaaagaacccaaaggttcattttaatctaacagatatgttgcaggacgccatcattcaccacaatgacaaggaagtgctacgcctgctgaaggaaggtgctgatccgcacactctggtaagctcaggcggatccctgctccacctatgcgccaggtacgacaatgcttttatagccgagatcctgattgaccgcggagttaacgttaaccaccaagatgaagatttttggacgccgatgcacatcgcatgcgcatgtgataatcccgacattgttctactgctggtgctggccggagccaatgtgctcttgcaggatgtgaacgggaacattcctttagactatgccgtggaaggaaccgagtcatcatcaattctgttgacctatctggacgagaacggtgtggatctgacatcactccggcagatgaaacttcagcggccaatgtctatgctgactgacgtgaagcactttttgtcgtcaggcggtaatgtgaatgagaaaaacgatgagggcgtgaccttgctgcacatggcctgtgccagcggatacaaagaggtggtgagcctcatcctggagcacgggggtgacttgaatattgtggatgaccagtactggacacccttgcatttggccgctaagtacgggcagaccaacctggtgaagctcctgctgatgcaccaggccaatcctcatctggtaaattgcaacgaagagaaggcttccgacattgctgcctcagagttcatagaggagatgctcttaaaagctgagattgcctgggaagagaaaatgaaggagcctctctcagcgtctaccttggcacaagaggagccttatgaggagattattcatgacctaccagttctgtcttcaaaacttagcccactggtcctgcctattgcgaagcaggatagcctgctggaaaaggatatcatgtttaaagatgctacgaagggactgtgcaagcagcagtcacaggacagtatccccgaaaatcccatgatgtcagggagtactaaaccggagcaggtgaaactgatgccacctgcgccgaatgatgatctcgctacactatccgaattaaatgacggatccctgctctacgaaattcagaagcggtttgggaataaccagatctacacatttatcggggacatactgctcctggtgaatccatacaaagagttgcctatttacagctcaatggttagccaattatactttagcagctcgggtaagctgtgttcttccctcccgccacacttgttttcttgtgtggaacgggcttttcaccagttgtttcgggagcaacggccccagtgctttattctcagcggcgaacgggggtccggcaaatcagaagcttctaagcaaattattcgccatctaacatgtcgcgccggtgcgagcagggcgaccttggattcacgattcaagcacgtcgtatgtattttagaggcgttcggccatgctaaaacaacattaaacgatctgtcaagttgctttataaagtatttcgagctacagttttgtgagcgtaagcaacagctcaccggggcccggatttacacataccttctggagaagtcgcgacttgtcagccaaccactgggccagtccaatttcctgatcttctacttactgatggatgggctttccgcagaagagaagtacggcctgcacttaaataacctttgtgcccatagatacctaaaccaaaccatccaggatgatgccagcaccggtgagaggagcctcaatcgcgaaaaattggccgtcctgaagagagcgttgaatgtggtggggtttagctcactcgaagtcgaaaatcttttcgtgatcctggcagctatattgcacctcggggatatccgcttcaccgccttgaatgaggggaatagtgcctttgtgtcggacctgcaactgctggaacaggtggcaggtatgttgcaggtgtcaacggatgagttagcctctgcacttacgacggatatccagtattttaaaggcgacatgataatcaggagacatacaatccagatcgctgaattctttcgagacctgcttgctaaaagcttatattctagattatttagttttcttgtcaacactatgaacagttgcttacacagtcaggacgaacagaagtcaatgcagaccctcgatataggcatcctggacattttcggatttgaggaatttcagaaaaacgagtttgagcagttatgcgtgaacatgaccaacgaaaaaatgcatcactatattaacgaagtgctgttcttacacgagcaagtggagtgtgtgcaagaaggagtgactatggagactgcctactccccaggaaatcaaaacggcgtgctggacttctttttccagaagccatccggattcctgaccctgctcgacgaagagtcccagatgatttggtccgtcgaaagcaactttccgaagaagcttcagagcctccttgagtcctccaacacaaacgccgtctactcacctatgaaggacgggaacggcaacgttgcactcaaggatcatggaacagcattcaccattatgcactacgctggaagagttatgtacgatgtggtgggcgccatcgagaaaaataaagatagtttgtctcagaacctgttgtttgtaatgaagacatcggaaaacgtggttataaatcatctatttcagagcaagctttcccagaccggcagtctggtatccgcctatccatcctttaagtttcgggggcataaaagtgcccttttgtcaaaaaaaatgactgcttcgtctatcatcggggagaataaaaattatctggaattgagcaagctgctgaagaagaagggtaccagtaccttcctccagcgcctcgaacgaggagatcctgtgaccatagcttcccagctgcgcaagtctctcatggatatcattggaaaacttcagaagtgcacaccccatttcatccactgtatcagaccaaacaattcgaagcttcctgatacctttgataacttttacgtttcagctcagcttcagtatatcggggtgctggaaatggtgaagatttttcgctacggatatcccgttcgcctgagcttcagcgattttctgtcccgttataagcctctcgcagacacctttcttcgggagaaaaaggagcaaagcgccgccgagaggtgtagattggttcttcagcaatgcaagctccagggttggcagatgggagtgcgcaaagtgttcctgaaatattggcacgcggatcagctcaacgatttgtgcttgcaattgcagaggaaaattatcacctgccagaaggtgatacggggtttcctggccagacagcatttgctccaaagaattagtattaggcagcaagaggtaactagcatcaatagctttcttcagaacactgaggatatgggacttaaaacatacgacgcactggtgatccagaatgctagcgatatagcacgggagaatgatagattgagatccgaaatgaatgccccctaccataaggaaaaactggaagtgcggaacatgcaggaagaaggttccaagagaaccgacgataagagcggaccccgccacttccatccttcgtccatgagtgtgtgcgccgccgtggatgggctcggacagtgcctggtcggcccaagcatttggagcccaagcttacacagcgtgtttagcatggacgacagtagttcattgccaagtcctcgtaagcaaccacctcctaaacccaaaagagatccaaatacgcgcctgtctgcaagctatgaggctgtgtctgcgtgccttagcgcagccagagaggcagctaacgaagccctcgcacgccctagaccccattctgacgattactctacaatgaagaagattcctccacggaaacctaagcggtcacccaatactaaactgagtggaagctatgaagaaatctccgggagccggccaggcgacgccagacccgctggcgcccctggtgccgctgctagggttttaaccccaggtacaccacagtgcgccctcccgcctgcagcacctcccggcgacgaggacgactcagagcctgtttacattgagatgctgggacacgccgcccggcctgattcaccagaccctggcgagagtgtgtacgaggagatgaagtgctgcctgccggacgacgggggcccgggtgctgggtcctttttgctgcatggagctagtccccccttactgcaccgggcacccgaagatgaggcggccggccccccaggcgatgcttgcgacattccgcctccttttccgaacctgctgccacaccggcccccgctcttggtctttcctcccactccagtgacttgttctcccgcctctgacgaatcgccgttgactcccttggaagtgaaaaaactcccagtgctggaaactaacctgaagtatcccgtgcagcccgagggctcctcacctctgtctccacagtattccaagagtcagaagggcgacggcgatcggcctgcttccccaggcctggctctgttcaatggcagcgggcgcgcctcgcccccctctaccccaccacccccgccaccaccacccggcccccctcccgctccctaccgcccgtgcgcccatctcgccttccctcccgagcccgcccctgtgaacgctgggaaagctggcccttctgctgaagcccctaaagtccatcctaagcctaatagtgcaccagtcgctggaccgtgctctagcttcccaaagatcccttactcacctgtcaaggccacccgggcggatgccaggaaggccggctcaagtgcttcgcccccagcaccatattctcctccatcttccaggcctctgtcctccccactggacgaattagcctccctgttcaattctggaaggtcggtccttagaaagagcgcagctgggcgaaagatcagagaggccgaaggattcgaaacaaatatgaatatctctagcagggatgatcccagcaccagtgagatcacttccgagacccaggatcggaatgcgaataaccacggcatacagctgagtaactcattgtcatccgcgatcacagctgagaacggtaattcaatttcaaacgggttgccggaagaggacgggtactcccgcctgtccatcagtgggacaggcacgtccacttttcaacggcacagggattcgcatacgacacaggttatccatcaactccgcctgtcagagaacgaatccgtggccttgcaggagctgctggactggcgcagaaaactttgtgaggagggccaggactggcagcagattctccaccatgctgaacctcgagtaccgccaccacccccttgcaaaaaaccctccctgctgaagaagcctgaaggcgcaagctgcaacaggctaccctccgagctgtgggacacaactatctag

SEQ ID NO: 27961 - DNA, 5577 bp, Artificial Sequence
  Description of Artificial Sequence: Synthetic coding sequence
atggaaatcgatcagtgcctcttggaatctctgcccctgggccagcgtcagaggcttgttaaacggatgcgatgtgagcagattaaggcatactacgagcgcgagaaagcttttcagaagcaggagggattcctgaagcgcctaaaacacgccaaaaatcctaaggtgcacttcaacctaactgatatgcttcaggacgcaataatacaccacaatgataaagaagtcctcagactcctgaaggagggcgctgatccacacactttagtgtcatcaggcggctccctactgcatctatgtgcccgttacgataacgcttttatagccgagattttgattgaccgcggggtgaatgtaaatcaccaggatgaagacttttggaccccaatgcacatcgcctgcgcctgcgataatcccgacattgtgctgctgctcgtgctggccggcgctaacgttttgttacaggacgtcaacggaaatataccccttgattatgcggtcgaggggactgaaagctcttcaatcctcctgacctacctggacgaaaatggagtggatctgaccagtctgcggcaaatgaagctgcagcgtccaatgagcatgctgaccgacgtgaagcattttctttcctctggcggcaacgtgaacgaaaagaatgacgaaggtgtgacattactccacatggcttgtgcctctggatataaggaagtggtgtctttgattctggaacacggcggggacttgaatatcgtagatgatcagtattggacaccacttcacctggctgctaaatacggacaaactaacctcgtgaagctgctgctgatgcatcaggcgaacccccatctggtcaattgcaacgaagaaaaggcttcagatatcgctgcgtccgagttcattgaggagatgctgttaaaggctgaaatagcttgggaggagaagatgaaggagccactttctgccagcactctggcgcaagaagagccatacgaggaaatcatccatgaccttccagtgctatcctcaaaactaagcccccttgttttgccaatcgcaaaacaagattctctgcttgaaaaggatattatgtttaaagacgctactaaaggtttgtgcaagcagcagtcccaggattccataccagagaacccaatgatgtccggctccactaagcccgaacaggtgaagctgatgccccctgcacctaacgatgaccttgccacactgtccgaattgaatgacggctcactcctgtacgagattcagaaaagattcgggaacaatcagatctacaccttcataggggatatcctgctccttgtgaacccatacaaagaattgccaatttattcaagcatggtctcccaactctactttagtagcagcggaaaactttgttccagcttgccaccccacctgttcagctgcgttgagagagctttccatcaactgttccgggaacagcggccacaatgcttcattctttcaggggagcggggctccggtaaatcagaggcatctaaacagatcatccgccaccttacgtgcagagccggcgcctcacgtgcaaccctggatagtcgattcaagcacgtggtatgcatcctggaagctttcggacacgctaagaccactctgaatgacctgtcttcttgctttataaagtactttgagctacagttctgtgagcgcaagcaacagctgacaggagctaggatttacacctatctgttagaaaaaagcaggctggtttctcagccattaggccaaagcaacttcctcattttttatcttcttatggatggcctgtcagctgaagagaaatacggactgcacctgaacaacctgtgcgcccaccgctatcttaaccagaccattcaggacgatgcgagtaccggagagcgtagcctgaatcgggaaaagttggccgtgttaaagcgggccctcaatgtggtcggcttcagcagtttagaagtggaaaatctcttcgttattctggctgccatcttgcacttgggggatatcagatttaccgctctaaatgaaggcaattcagcttttgttagtgatttgcagctgttagagcaggtggcggggatgcttcaggtctccaccgatgagttagcctccgccctgaccaccgacatccaatattttaagggggatatgatcattaggcgtcatacgatacaaatcgctgagttttttcgggacctgctggcgaaatccctatatagtcggcttttctccttcctggtgaataccatgaactcatgccttcattctcaagatgagcagaaatccatgcaaacacttgacattgggattctggacatttttggctttgaagaatttcagaagaacgaatttgagcagctatgtgtcaatatgaccaacgagaaaatgcatcactacataaacgaagtcctatttcttcatgaacaagtggaatgtgtccaggagggggtgacaatggagaccgcatacagtccaggaaaccagaatggtgtcctggatttttttttccagaaacctagtggattccttacgcttctggatgaggaatcccagatgatttggtcggtggaatccaattttccgaaaaaacttcagtctctgttagagagctccaacactaatgccgtatatagtcccatgaaagatggtaacggcaacgtggcgctgaaggatcatggcacagctttcactataatgcattacgcaggtagagtaatgtacgatgtggttggagcaatcgaaaagaataaggattctctgagccagaacctcctgtttgtgatgaaaacttctgagaacgtggtgataaaccatctcttccagagcaaactgtctcagaccggctcgctcgtttctgcatatccttcatttaaattcagaggtcataaaagtgctttactgagcaagaagatgacagcgtccagcattataggcgaaaataagaattatctagaactgtccaagttgctgaagaagaaggggacttctacattcctccagaggctcgaacggggggacccagtgaccattgccagccagctccggaaaagcttgatggatatcatcggcaagcttcagaaatgcacccctcatttcatccactgcataagacctaataactccaagctgccagataccttcgataacttttacgtctctgcacagctccagtacatcggtgtgctggaaatggttaagatctttaggtacgggtaccctgtgcgactctcgttcagtgatttcctgagccggtacaagccactggcagatactttcctccgcgagaagaaggagcagtcagccgcagagcgctgtaggcttgtcctgcagcagtgtaaactccaaggctggcagatgggtgtccggaaagtttttctaaagtattggcatgctgatcagttgaatgacctgtgcctccagttgcagcgcaaaataattacttgtcagaaggttatcaggggcttcctagcaaggcaacacctcctgcagcgcatcagcattagacagcaagaggtcacttcgatcaacagcttcttgcagaacactgaggatatgggtttgaagacttatgacgccctcgttatccaaaatgcctcagacatcgcccgtgagaatgacaggcttcgctctgaaatgaacgctccctaccataaggagaagctggaggtgcggaacatgcaagaggaaggctcaaagagaacagatgataaatccggacctcggcacttccacccctcaagcatgagcgtgtgcgcagccgttgatggcctgggtcaatgcttagtgggcccatccatatggagcccatccctgcactccgttttttccatggacgattctagttcactcccctcacccagaaagcaacctcccccaaagccaaaaagggaccctaatacacgcctctctgctagctacgaagcagtttcagcctgcctgtccgcggctcgcgaagccgccaacgaagctctcgcccggccccgaccacacagtgacgactatagcacaatgaaaaagatccccccccgtaagccaaagaggtcccctaacaccaagctcagcggatcatatgaggagatttcagggtctaggcctggagacgcacggcctgccggggcccccggcgctgctgcccgcgtcttgactccaggaaccccccagtgtgctcttcccccggctgcgccccctggagatgaggatgactcagaacctgtgtacatagagatgctcggacatgctgctcggccagactcccccgatccaggggaatcagtctatgaagaaatgaaatgctgccttcccgatgacggagggccaggggccgggtcatttctgctgcatggcgccagcccaccactgcttcatagagcccccgaggatgaggccgctggacctccgggggatgcctgcgacatccctccaccttttcctaacctgttgccccaccggcccccactcctggtatttccgccaaccccagttacttgttcaccggcctctgacgaaagccccttaaccccattggaggtgaagaagttgcctgtgcttgaaaccaacttgaaatacccagtacagccagaaggctcctctccgttgagcccgcaatattctaaatcccagaaaggagatggagaccgccctgcctcaccaggcttggcactctttaatggaagcggcagggcgagtccccccagcacacctccacctcctccccctcctcccgggcctcctcctgcaccatatcggccttgcgctcatcttgccttcccacccgagccagcaccagttaacgccggcaaagcagggccttcagccgaagcccccaaggtccatcccaagccaaacagtgcaccagttgctggcccctgtagctctttcccaaagattccatatagccctgttaaggcaactagggccgacgctagaaaggcgggtagctcggcatcccctccagctccttattcccctccatctagccggccgctgtcaagccccttggatgagttggcttcactcttcaattcgggccgttcagtgctgagaaagtcagctgcaggccggaaaattagggaagctgagggcttcgaaacaaacatgaacattagctcccgtgacgacccatctacctctgagataacatcagaaacacaggatcggaatgccaacaaccatgggattcagctttccaattcattgagttccgccatcacggcagagaacggtaattctatatccaacggcctccctgaagaggatggatattctagactgtccatttctggtacgggaacctcgaccttccagagacaccgcgactcgcacacaacacaggtgatccaccagctgcgcctcagtgagaatgagagcgtggctttgcaggaacttctggattggagacggaaactgtgcgaggagggccaggactggcagcagatactccatcatgctgagcccagagtgccccctcctccaccatgcaaaaagccatctctcctgaaaaaacctgagggtgcctcgtgcaataggctcccaagtgagctgtgggacacaacaatctag

SEQ ID NO: 27962 - DNA, 2637 bp, Artificial Sequence
  Description of Artificial Sequence: Synthetic coding sequence
atgaagctgcaaagacctatgagtatgctgactgatgtgctgcacatggcatgtgcctcaggctacaaggaagtggttagcctgattctagagcatggaggcgacctgaatatcgtcgacgatcagtattggaccccattgcatctggctgccaagtatgggcagacaaatctagtcaaactcctgctaatgcaccaggccaaccctcacttagtcaactgcaacgaagagaaagctagtgatatcgcggcatccgaattcattgaagaaatgctgttaaaagccgaaatcgcctgggaagagaaaatgaaggagcccctgagtgccagtaccttggcgcaggaagagccatatgaggagattatacacgacttgcccgtgctatcgagcaagctctcgccccttgtgttgccaatcgccaaacaggactccctgttagagaaagacataatgtttaaggacgccaccaaagggctctgcaaacagcaaagccaggacagcattccagagaaccccatgatgtccgggtccaccaagcctgagcaggtgaagcttatgccccctgcccctaatgacgaccttgctactctgtctgagctgaacgatggttccctgctctacgagattcagaaacgattcgggaacaaccagatttacactttcatcggagatatcttgcttctcgttaatccttacaaggaactcccaatttattccagtatggtttcccagctatattttagctcatctgggaagctgtgtagctccctacctccacatcttttttcatgcgtcgagcgggcattccatcagctatttcgtgaacagagaccacaatgctttatcctctccggcgagaggggctcgggcaagtccgaggcaagcaaacagattattcggcaccttacatgcagagcaggggcttccagagccacgcttgatagccggtttaagcacgtggtgtgcattctggaagcttttggacatgctaagactacgcttaacgatctctcttcttgctttatcaagtactttgagctgcagttctgcgagcggaaacagcaactaactggggcacggatctacacttatctcctggagaaatctaggttggtttcacagccacttgggcagtccaactttttaatattctacctccttatggatggactgtccgccgaggagaaatatggactgcatctcaataacctatgcgcgcataggtatctaaaccagactatccaggacgacgcttctaccggcgagaggagcctgaaccgagagaagctcgcagtgctgaaaagggcactcaatgtcgtgggatttagcagcctggaagtggagaacctgtttgtgatccttgcagctattctgcacttaggtgatatccgcttcaccgcacttaacgaggggaactctgcttttgtgtctgatttgcagctgttggagcaggtcgcaggcatgcttcaggtgtccactgatgagctggcgtccgcattgaccactgacatccagtacttcaagggcgacatgataatcagacggcacacgatccagattgcggaatttttccgggacctgttagcaaagtctctctatagccgcttgttctcattcttggtcaacacaatgaacagttgtttgcacagccaggatgagcagaaatccatgcagactttggacattggtattctggatatcttcggttttgaggaattccaaaaaaatgaattcgagcagctgtgtgtgaatatgaccaatgagaaaatgcaccactatattaacgaggttctatttttgcacgagcaagtcgagtgcgtgcaggagggtgtgacaatggaaactgcgtattccccgggaaatcaaaacggagtcctggattttttttttcagaaaccctcagggtttctaacgttgctcgacgaggaaagccagatgatctggtcggtggagtcaaatttccctaagaaactgcagtcgctcttggagtcatctaatacaaatgccgtttactctccaatgaaagacggaaacggcaacgtcgctttaaaagatcacggtaccgccttcactattatgcattatgccgggagggtcatgtatgacgtggtgggcgcaatcgaaaagaataaagattccctctcgcagaacctattgttcgttatgaagactagtgagaacgttgtcatcaaccaccttttccagtccaagctttcgcagaccggctccttggtgtccgcttacccatctttcaagtttcgcggccacaaatcagccctcctatcaaaaaagatgacagcctcttcaattatcggagaaaataagaactatctggagttgtccaaattgctcaagaagaagggtacctccacgtttcttcaaagacttgagcgcggcgatcccgtaaccatcgcttcccagttgcgcaaatcactgatggacattattggcaagctgcagaagtgtacaccacattttatccactgcatcagaccaaacaatagtaagctgcctgatacctttgataatttttacgtgagcgcgcaacttcagtatataggcgtgctggagatggttaagatctttagatacggatatcccgtccgcctgagtttcagcgatttccttagtaggtag

SEQ ID NO: 27963 - DNA, 2823 bp, Artificial Sequence
  Description of Artificial Sequence: Synthetic coding sequence
atggaaattgaccagtgcctgctggagtcactaccactgggtcagcggcagaggttggtgaagagaatgaggtgtgaacagatcaaggcttattatgaaagggagaaagccttccagaagcaggagggatttctgaagcgcctgaaacacgccaagaatcctaaggtgcattttaacctcactgacatgttgcaggacgccattatccatcataatgataaggaggtactgaggctgctcaaagagggcgcagaccctcacaccctagtgtcctccggcggaagcctcctgcacttgtgtgcccgctacgacaacgccttcatcgccgagatcctcatagatcgaggcgttaacgtgaaccaccaagacgaggatttttggactccaatgcacatcgcctgtgcatgtgataaccctgatatcgtccttctgctggtactcgccggggccaatgtattactgcaggacgttaacggcaacattcctttggattatgccgtggaaggcacagaatctagctcaattctcctgacttatctggacgagaacggtgtcgatctcacttccttgaggcagatgaaactgcagaggccgatgtcgatgctgacagacgtcaagcattttttgtcctctggaggcaatgtgaatgaaaagaacgatgaaggcgttactctactgcatatggcttgcgccagtggatataaagaagtggtgtctctgatcctggagcacggcggcgacctgaacattgtcgacgaccagtactggacccccctgcacctggccgcaaaatatggccagaccaatctggtgaagctactgctgatgcatcaggctaacccacacctagtgaattgcaacgaagagaaggctagcgatattgctgcctccgaattcattgaagagatgctgctgaaggcagaaattgcctgggaggagaaaatgaaagaaccactctcagctagcacgctggctcaagaggaaccctatgaggaaatcatccatgacctgcccgtgctgtcaagcaagctaagtccattggtgctgcctattgctaaacaggattccctgctcgaaaaggatattatgttcaaggatgcaacgaaaggcctatgcaagcagcagtcacaggatagcatccctgagaatccgatgatgtccgggtctacgaagccggagcaggtaaaactgatgccccctgccccaaacgacgatctcgctacgctgagcgagctgaatgatgggagtctcctctatgaaattcagaagcgtttcggtaataaccagatttatacatttataggggatattctgctcttggtgaacccatacaaagagctgcccatctattcatccatggtgtcacaactgtatttttcctcctcagggaagctctgttcaagtctccctccccacctcttcagctgcgttgagagagcgttccaccaactgttccgtgaacaacgtcctcaatgttttattctttctggagaacgggggtcagggaagtctgaggcctcaaaacaaatcatccgtcacctgacatgccgagcaggcgcctcaagagctacgctcgactctcgattcaaacacgtggtgtgcatattggaggcattcggacatgctaaaacgaccctcaacgatctgagtagctgttttatcaagtacttcgaactgcagttctgtgaacgaaagcagcagctgacaggagcgaggatttatacctatcttctcgaaaaatctcggcttgtaagtcaaccgctgggacaaagtaacttcctcatcttctatctactgatggatggtctaagtgccgaagagaagtatgggctgcatctgaataatctgtgcgcgcaccgatatctgaatcagacaatacaggacgacgccagtacaggggaaaggagcctgaatcgtgaaaagctggccgtgctcaagcgtgccctgaacgtcgtcggcttttcgtctctggaggtagaaaatctgttcgtcatcctggccgcgatccttcatctaggggacattaggttcaccgccttgaacgagggaaatagtgctttcgtgtctgacctgcaactgcttgagcaagtagccggaatgctgcaggtatccacagatgagctggccagtgcacttacaactgacatccaatactttaagggtgacatgattatcagacgacatacaatccagatcgccgagttttttcgtgacttactggctaagtctctgtactccagactgttctcctttttagtgaatacaatgaacagctgtctgcacagccaggatgagcagaaaagcatgcagaccctggatatcggaatcttggacatcttcggatttgaagaattccagaagaatgaatttgaacagctgtgcgtgaacatgaccaacgaaaagatgcatcattacattaatgaggttcttttcttgcatgagcaggtcgagtgtgtgcaggaaggtgttactatggaaacagcgtactctccgggtaatcaaaatggagttcttgattttttttttcagaagccttctggcttcctcacactgttggacgaagaatcccagatgatttggtccgtagagagcaattttccaaagaaactccagtccctcctggaaagttccaatacaaacgcggtgtacagcccgatgaaggacggaaacggaaatgtggccctgaaagatcacggcacagcttttacaattatgcattacgctgggagagtaatgtatgatgttgttggagccatcgagaaaaacaaggattccctgagccagaatctgttatttgtgatgaagaataggaggtgcttctag

SEQ ID NO: 27964 - DNA, 2574 bp, Artificial Sequence
  Description of Artificial Sequence: Synthetic coding sequence
atgcggagggccgatacgagggacggagagcgcggcagtggcaagtctgaagcctcaaagcagattattaggcacctgacatgtagggctggggcttccagggcaacactagactcccgttttaaacacgtagtatgcattctagaagcctttgggcacgcgaagactacattgaacgacctctcgtcctgtttcatcaagtattttgagctgcaattttgtgagcggaagcagcagctaactggggctcggatctacacttacctcttagagaaatctaggttggtgtcccagcccctcggccagtcaaattttctcattttttatcttttaatggatgggctctctgccgaagaaaagtacggtctgcacttaaacaatctttgtgcccatagatatctgaatcaaactattcaggatgacgcctccacaggggagcgatcactgaatcgggagaagctggcggtcctgaagcgcgcgctgaatgtggtgggcttttcttcactggaagtcgagaacctctttgtgatactggctgctatcctccacttgggcgatattaggtttaccgctcttaacgagggtaattccgctttcgtttctgacctacagcttctcgaacaagttgcgggaatgctgcaggtatcgacagacgagctcgcttcagctcttacgacggacatccaatatttcaagggcgacatgatcatcagaagacatactatacagattgctgagttcttccgtgacctgctggctaagagcctctatagtcgcctgtttagcttcctagtcaacacgatgaacagctgcctgcattcacaagacgaacagaagtctatgcaaaccttagacatcgggatcctggacatctttgggttcgaggaatttcagaaaaacgaattcgaacagctgtgtgttaatatgaccaacgaaaaaatgcaccactacattaacgaggtgctattcctacacgagcaagtggaatgcgtgcaggaaggcgttaccatggaaacagcctattcacctggcaatcagaacggcgttctcgatttcttttttcagaaaccgagtggatttcttaccctcctagacgaagagagtcagatgatttggagcgtggagagcaacttccctaaaaagctccagtcgctactggagtccagtaacacgaatgccgtttattctccaatgaaggatggaaatgggaacgtggccttgaaagatcacgggaccgccttcactattatgcactacgctggacgtgtgatgtacgatgtcgtgggagccatcgagaaaaacaaagactctttgagccagaatctcctgtttgtcatgaagaccagtgagaatgtcgtcattaaccacctattccagagcaaactatcacaaacagggtctctcgtgagcgcatacccaagttttaagtttagaggtcacaaatccgccctcctaagcaagaagatgacagcctcatccatcataggcgagaacaagaactacttggagctgagcaaattactcaaaaagaagggaacctccacctttctccagaggcttgaacggggagaccccgttaccattgcttctcagctacgcaaaagcctcatggacattattgggaagctgcagaagtgtacccctcacttcattcactgtatccgtcccaataacagtaaactccctgacaccttcgataacttttacgtgagtgctcagctgcaatacattggcgttctagagatggtgaaaatctttagatacggctacccagttcgactgtctttttctgatttccttagtcggtataaacccctggcagacacattcctgcgagagaagaaagagcagagcgccgcagaaaggtgccggctggttctgcagcaatgtaagctccagggctggcagatgggagtgagaaaggtgtttctcaaatactggcatgcagatcagctgaatgacttatgcctgcaactgcagaggaagatcataacttgtcagaaggtaatcaggggtttcttggctaggcagcatcttctgcagagaatctctatccggcagcaggaggtgacctcaattaattccttcctgcagaacaccgaggacatgggtctgaaaacttatgatgccttagtgatccagaatgcatcggatatcgctcgggagaatgatcgacttcggtctgaaatgaacgctccatatcacaaggaaaaactggaggtgcggaacatgcaggaagagggaagtaagcgaactgatgataagagtgggcctagacatttccatccctcaagcatgagtgtttgtgcagctgtcgacggcctcgggcagtgccttgtgggtccttcaatttggtcaccctcactccattctgtcttcagtatggacgactcctcaagcttacctagccctcggaagcaaccccccccaaaacccaaacgggaccccaacactcggctgtccgccagctacgaggccgtctcggcctgtctctccgccgctagagaggcagcaaatgaagggcagccttgggggggcactcagcccagggtgcccggcagcagaatgctgtag

SEQ ID NO: 27965 - DNA, 1644 bp, Artificial Sequence
  Description of Artificial Sequence: Synthetic coding sequence
atgagcacggcctcttcaagtagtagctctagcagttcccaaaccccacacccccccagtcagcgcatgcggcggtctgccgctggcagccctcccgccgtcgccgccgcaggatccggtaatggtgctgggggcggagggggagtcgggtgtgcacctgccgccggcgccggccggctactgcaaccaatcagggcaacagtcccatatcagctactgcggggctctcagcactccccaaccagaccccccgttgccgcagcagccgcctcactgggttcgttacccggtcccggggcagcccgcgggccatccccaagtagccctactcctcctgctgccgccgcccccgccgaacaggcccctagagccaagggaagacccagacgctccccagagtcgcaccgccggtcctcatcacccgagcggaggtcacccggctcccctgtatgcagagctgataaggccaagtctcagcaggtacgcacctcctctacgatcaggaggacttcttctctggacactatcacgggtccgtatcttaccggtcaatggccacgggacccacatgtacattacccatcctgtatgaaggataaagccacccagacaccgtcttgttgggctgaagagggagcagaaaaaagaagtcaccagcgtagtgccagttggggttctgctgatcagctgaaagaacaaatcgcgaagctgaggcagcagctgcagcggtcgaaacaatcttcaaggcattccaaggaaaaggaccgacaaagtcctttgcatggcaatcacattacaataagtcacacccaagcaactggctctagatccgttcctatgcccctttctaatatctctgtgcccaaatccagcgtctctcgagtcccgtgcaatgtggagggtataagccctgaacttgagaaagtgttcatcaaggagaataacggaaaggaagaagtgagtaaaccattggacatcccagatgggaggcgggcgccccttcccgctcactacaggtcatcaagtactcgttctattgatactcagactccctccgtgcaggagagatcctcatcctgctccagccactcaccttgtgtttcaccattctgccctcctgaaagccaggacggcagtccctgttccacagaggacctactgtacgacagagacaaagatagtggaagctctagtcctctgcccaagtatgcttcttcacccaagcccaataactcctacatgtttaaaagggagccacctgagggttgcgagagggttaaagtttttgaagaaatggcttcgaggcagcccatttcagcccccctgttttcgtgtccagacaaaaataaggttaattttattccaaccggatcagctttttgtcccgtgaagctgcttggcccactcttgccagcaagcgaccttatgctgaaaaatagcccaaactctggacagtcctccgcgcttgcaaccctaacggttgaacaactgtcctctagagtgagcttcacaagtttatctgatgatacctcaacagcgggctccatggaggctagtgtgcaacagccttctcagcagcagcagcttcttcaggaactccaaggcgaagaccacatttctgcgcagaattatgttattatttag

SEQ ID NO: 27966 - DNA, 999 bp, Artificial Sequence
  Description of Artificial Sequence: Synthetic coding sequence
atgggggcccagttctctaagacggcagctaaaggcgaggccgccgctgaaagacctggtgaggcagccgtggcatcatcgccatccaaagccaacggacaggaaaacgggcatgtgaaggtgaacggagacgcctcacccgccgccgcagagtctggcgcaaaggaggaactgcaggcaaacggaagtgccccggccgctgataaggaggagccagcagctgcaggatcgggagccgccagcccgtccgccgcggagaagggtgaaccagcagccgcagctgcgcctgaggcaggcgcttcccccgtagagaaagaagccccagccgagggggaagccgccgaacctggcagccccacagcagctgagggagaagccgcctctgctgcttcttctaccagttcgccaaaagctgaagatggcgccacccctagtcctagtaacgaaacacctaaaaaaaaaaagaagcgattctccttcaagaaatccttcaaattgtccggcttctcgtttaagaaaaacaagaaagaagcaggcgagggcggggaggccgaggcccccgctgccgagggggggaaggatgaagctgcaggaggagctgctgctgctgcagctgaagctggcgccgcctctggcgagcaggctgccgcccctggagaagaagcagctgctggcgaagagggcgctgcaggtggagacccccaggaggccaaaccccaagaggccgccgtggcccccgaaaagccgcccgcttctgacgaaacgaaagctgctgaagagccatcaaaggtcgaagaaaagaaggctgaagaagccggggcgtctgctgccgcgtgtgaggctccgagcgcggccggcccaggggccccaccggaacaggaagcagcccctgcagaagaaccagctgctgctgccgccagtagtgcctgcgccgcgccctcccaggaagcacagccagaatgctcacctgaggcccctcctgctgaggctgctgagtag

SEQ ID NO: 27967 - DNA, 978 bp, Artificial Sequence
  Description of Artificial Sequence: Synthetic coding sequence
atggccgaggtccccccaggcccaagcagtctattgccgccccccgctcctccagccccagcagcggttgagccccgctgtccctttccagccggggccgccttagcctgttgttctgaggatgaagagcagcagcagctaaacgggctcatcagcccggagttgcggcaccttagagccgctgctagcttgaaatccaaagtgttgtctgtcgccgaggtggccgccaccacagcaacgccagacggaggtcctagggctacagcaacaaaaggggcaggagttcactccggcgagcgacctccgcacagtctcagttccaatgcccgtaccgcggtgccttctcccgtggaggccgctgctgcgtcagacccagctgccgcccgcaacggcctcgcagagggcaccgagcaggaggaggaagaggaggacgagcaggtccgcctgctgtccagtagtctgactgccgattgctcgctgcgcagcccctcaggacgggaagttgaacctggggaggacaggacaattcgatatgtgaggtatgagtctgagctgcagatgcctgacatcatgcgcctgatcacgaaggacttgtccgaaccctattcaatttatacctataggtatttcatacacaactggccgcagttgtgcttcctggcaatggtcggggaggagtgcgtcggcgcaatcgtttgtaaactggatatgcacaagaaaatgttccggagagggtatatcgccatgctggcagttgacagtaagtatcgcagaaatggcatcgggactaatcttgtgaaaaaggctatttatgctatggtggagggagactgtgacgaagtggttctcgagaccgaaatcactaataaaagcgccctgaagctgtatgagaacctaggctttgtccgggacaagcgattgtttcgatattacctgaatggcgtggatgccctgaggctgaagctgtggcttcgatag

SEQ ID NO: 27968 - DNA, 1089 bp, Artificial Sequence
  Description of Artificial Sequence: Synthetic coding sequence
atggcagaggtgcccccgggacccagctccttactgccccctcccgctccacccgcacccgccgctgttgagcctcgatgccctttccccgcaggggccgcactcgcctgttgtagcgaggacgaggaagatgacgaagaacatgaagggggtggtagtcgctccccagccggtggcgagtctgctactgtggcagctaaaggtcacccctgtcttcgctgtccccagccaccccaggagcagcagcagttaaacggactgatcagcccagaattacggcaccttcgcgccgctgctagcctgaaaagtaaagtactctcggttgctgaagtggccgcaacgacggcaacacccgacgggggtcccagagctaccgcgactaagggagccggcgtgcactctggtgagcgcccaccacactcactgagttccaacgcccggacagcggtgccttcacctgttgaagcagccgctgccagtgatccggccgccgcccgcaatgggctggcagaaggcacggagcaggaagaggaggaggaagacgaacaggtgcgcttactatctagctcgttgaccgccgattgctctttgaggtcaccctctgggagagaagtcgaacctggggaggacaggactatcaggtatgtgagatatgaaagtgaattgcagatgcccgatatcatgcgtcttattaccaaggacctaagcgagccctacagcatctacacctatcgttatttcatccataattggccccagctgtgtttcctggccatggtcggagaagaatgcgttggagccattgtatgtaaactggacatgcacaaaaaaatgtttcgcagaggatatattgcaatgctagccgtcgattcgaagtacagaaggaacggcatcggcaccaatttagtgaagaaggcaatctatgctatggtggagggggactgtgatgaggtggtgttggagaccgagatcacgaataaatctgccctgaaattatacgaaaatctaggcttcgttagagataaacgtctcttcagatactaccttaacggggtggatgcccttcggcttaagctctggctccgctag

SEQ ID NO: 27969 - DNA, 2178 bp, Artificial Sequence
  Description of Artificial Sequence: Synthetic coding sequence
atggtgatgaaggcaagcgtggacgacgacgacagcggatgggaattgtcgatgcccgagaagatggagaagtcaaatacaaattgggtggatattactcaagactttgaggaagcttgtagagagcttaaactgggagagctgttgcacgataagctctttggcctgttcgaagccatgtccgctatcgagatgatggaccctaagatggacgcaggcatgatagggaaccaggtcaaccggaaagtccttaacttcgaacaagcaatcaaggatggcacgattaagattaaggacttgaccctgccagagctaatcggaatcatggacacttgcttttgttgcctcattacatggcttgaagggcacagcttagcacagaccgttttcacatgtctgtacatacataatcccgacttcatagaggatcctgccatgaaggcatttgcccttggcatcctgaagatctgtgatatcgccagggagaaggtcaacaaggctgccgtgtttgaagaggaggattttcaatcaatgacttacggctttaaaatggctaactccgtaacagatctgagagtcactggcatgcttaaggatgtagaagacgatatgcaaagacgggtgaagtcaacacgatcacgccagggagaggaacgggacccggaggttgaactcgagcatcagcaatgtctcgccgtattctctcgcgtaaagtttacacgagtactgctgacggtgctgatcgcctttacgaagaaggagacttcagcagttgccgaggcgcagaaattaatggtgcaggccgcggacctgctgtcagctatacacaactctctgcatcatggaatccaggcccaaaacgacacaacgaaaggggaccatcccatcatgatgggcttcgagccactggtgaaccagcgcctattgccccctacgttccctcgatacgcaaagattattaagcgtgaggaaatggtcaactactttgcacgactgatcgatcgcatcaagacggtctgtgaggttgtgaacctgactaacctccattgcatcctggactttttctgcgaattttccgaacaatctccctgcgtgctcagtcgtagtctgttgcaaactacttttctggtggacaataagaaagtgtttggcacccatttgatgcaggatatggtcaaggatgctttgagaagctttgtgagtccacctgtgttgagcccaaagtgctacctgtacaacaatcatcaagcaaaggattgtatcgattcatttgtgacccactgcgtcaggcccttctgctcactcatccagatccacggccataatagggcacgacagcgagataagctcggccatattctcgaggagttcgctacactgcaggacgaggctgagaaggttgatgcagcactgcacacaatgttactgaagcaagaaccacagcgccaacacttggcctgtctgggaacgtgggtactgtaccacaaccttcgcattatgatccaatacctgctgagtgggttcgagttagaactgtactctatgcacgaatattactacatttactggtacctctcagaattcttgtatgcctggttgatgtcaaccctatcccgggccgacgggtcacaaatggctgaggagcgcattatggaggaacagcaaaaggggagatcctcaaagaaaaccaagaaaaaaaaaaaggtccgcccactgtctcgcgaaatcacaatgtctcaagcctatcagaatatgtgcgctggtatgttcaaaaccatggttgccttcgatatggacgggaaagttaggaaaccaaagtttgaactggactctgagcaggtgcgctacgagcaccgctttgccccgtttaatagtgtgatgactcctcctcctgtgcactatttgcagtttaaggagatgagtgatctgaataagtattctcccccaccacagtccccagaactctacgtggctgcctctaaacactttcaacaggccaaaatgatattagagaatatccctaatccagatcacgaggtgaatcggatactgaaggtggctaagcccaatttcgttgtgatgaaactcctggcgggaggacataagaaagagtctaaagtgccccctgagtttgatttctctgcacataagtatttccccgtggtgaaactggtgtag

SEQ ID NO: 27970 - DNA, 885 bp, Artificial Sequence
  Description of Artificial Sequence: Synthetic coding sequence
atggtaatgaaagcttccgttgacgatgacgatagcggctgggaattgtctatgccggagaagatggaaaaaagcaatactaattgggtggacattacgcaggactttgaggaggcctgtcgagagctgaaattaggggaacttctgcacgacaagctgttcggcttatttgaggccatgtccgccatagagatgatggacccaaagatggacgctggaatgatcgggaatcaagtgaatcggaaagtgctcaattttgagcaggcaatcaaagacggcaccataaagatcaaagacctgactctgcctgagctgatcgggattatggacacttgcttctgttgtctgataacttggttggagggacactcccttgcccagacggtgttcacgtgtctctatatccacaatcctgatttcatcgaggaccccgccatgaaagctttcgctctaggaatcctgaaaatttgcgacatcgcccgggaaaaagtgaacaaagcggccgtgttcgaggaagaggatttccagagcatgacatatgggttcaagatggccaacagcgtgaccgatctcagggtcacaggtatgcttaaagatgttgaggacgatatgcagcgaagagtcaaatcgactcgcagccgccagggcgaagaacgtgacccagaggtggaattggagcaccaacaatgtctcgccgtattcagtcgggtgaagtttactcgggtgctgctgacagttttgattgcgttcaccaaaaaggaaaccagcgccgttgccgaagcccagaagttaatggtgcaggccgctgatctgctgagcgctatccacaattccctccatcacggcatccaggctcagaatgacaccactaagggcggcctgtag

SEQ ID NO: 27971 - DNA, 594 bp, Artificial Sequence
  Description of Artificial Sequence: Synthetic coding sequence
atggtgatgaaggccagcgtggacgatgatgacagtggctgggagttgagcatgcctgagaagatggagaagagtaacacaaattgggtcgacataacccaggatttcgaagaggcttgtagagaattgaagctcggtgaactgctgcacgacaagctctttggtcttttcgaagcaatgtccgcaattgaaatgatggaccctaagatggacgcagggatgatcggaaatcaagtaaacaggaaagtactgaatttcgaacaggccatcaaagacggaaccatcaagattaaggacctcacactcccagaactcattggcataatggatacatgcttctgctgcctcattacgtggctggaagggcattctttggcacagacagtgtttacgtgtctttatatccacaaccctgactttatcgaagaccccgccatgaaggcattcgcacttggtatactgaaaatctgcgatattgctcgcgagaaagtgaataaggccgccgtctttgaggagataagtcggcttttggaattgatcgacttccacgagtacaacttcaagaatgaaaacgtgcagtgctggaaagagtag

SEQ ID NO: 27972 - DNA, 1857 bp, Artificial Sequence
  Description of Artificial Sequence: Synthetic coding sequence
atggttagccctaggatgtccggtttgctgagtcaaactgtaattttggctctcatcttcctgcctcagactcggcctgccggcgtgtttgaattgcaaattcatagctttggccccggacccggacccggcgcaccacggtccccatgctctgctcggctgccctgtagattgttcttcagggtgtgcctcaaacccgggttgagcgaggaagctgcagagagtccgtgtgcgctcggcgcagcactgagcgctcggggccctgtgtacactgaacagcctggagctccagccccagacttgccattgcccgacggtttgttgcaggttccctttcgcgatgcgtggccaggcactttttcttttatcattgaaacctggcgcgaggagcttggggaccagatcggcgggcccgcttggtcacttctggcccgggtggcaggcagaaggcgcttggcagctggtgggccttgggctcgcgacatccagcgagcaggggcatgggagctaagattttcctaccgcgcacggtgcgaacctccagccgtgggaactgcctgcactcgattatgtcggccccgaagcgccccctccaggtgtggccctggtcttcgcccatgtgccccactggaagatgagtgtgaggcccccctggtttgtcgtgccggctgctctcctgagcacggattttgcgagcaacctggcgagtgccggtgcctcgagggctggacagggcctctctgtacagtgcccgtaagcaccagctcatgcctctctccccgaggaccatcctcagcaactaccggctgcctcgttcctggccctgggccctgcgatggaaacccctgcgccaacggcggaagttgctctgagacaccccgcagcttcgaatgcacgtgccctaggggattctacggactcagatgcgaggttagtggagtaacatgcgctgacggcccctgtttcaacggcggattatgcgtcgggggggccgacccggatagcgcctacatctgtcactgtcctccaggctttcagggatcaaattgcgagaagagagttgatcgctgctcgcttcagccttgccggaatggaggattgtgtcttgatctgggccacgccctcaggtgcagatgtcgggccggattcgccggtccccggtgcgagcatgacctggacgactgcgccgggcgagcatgtgcgaatggaggcacctgtgtggagggcggcggtgcgcaccgctgttcgtgcgccctgggctttggtggccgggactgtagggagcgcgcagatccatgtgccgctcggccctgtgcgcatggcgggcggtgctacgcccacttcagcggcctggtatgcgcatgtgcccccggatacatgggagctcggtgtgagtttccagtccaccctgacggagcatccgcgctgccagctgctcccccaggactacgtccaggcgacccacagaggtacctgctgccacctgctcttggactgctggtggctgctggcgtagcgggcgctgcactcttgctggtgcacgttcgccgtaggggccacagccaggacgctgggagccgcctgctcgcagggaccccagagcctagcgtgcatgctctgccagacgcactgaataacctgcgtacacaggagggcagcggggatgggccctcaagttccgtggactggaatcgcccagaggatgtggacccccagggtatttacgtcattagcgctccaagtatttacgccagggaggttgcaactcctctcttccccccactgcacactggccgagcaggccagcggcagcacctgctgtttccctatccttcatctatcctaagcgtcaaatag

SEQ ID NO: 27973 - DNA, 2181 bp, Artificial Sequence
  Description of Artificial Sequence: Synthetic coding sequence
atgagcgctattaccgtcgccctcttatctctgttattcatcacatctggtaccattgagaatcacaaagatcttggcggccactttttctccaccactcagtcaccacctgctactcagggctcgaccgctgcccagagaagcactgccacccagcacagtactgcaacccagtccagcacagcgactcaaacttctcccgtgccattgaccccagaatcccccctgtttcagaatttcagtggctaccacattggagtcggacgggccgattgtacgggccaggtggctgatattaacctcatggggtacggtaaatcaggccaaaatgcccaggggattctgacgcgcctatacagccgtgcctttatcatggcagaacccgacggaagcaatcgcacagtatttgtgagcatcgatatcggcatggtgtcccagcgtctccgtctggaggtgcttaaccggctgcaatccaagtatggcagcctttaccgtcgggataacgtgatcctctccgggacccatacacacagcgggccagcaggctactttcaatacactgtgttcgttatcgcttcagagggtttttccaaccagacctttcaacacatggtgactggcatcctgaaatctattgatattgcacataccaatatgaagccagggaaaatttttatcaataaaggcaacgtcgatggcgttcaaataaatagatcaccctactcctatctgcagaaccctcagtctgaaagagcccggtactcttccaacacagacaaggagatgattgtgctgaagatggtggacctcaacggcgacgatctcggactcatctcatggtttgccatccacccagtgagcatgaacaacagcaatcatctcgttaattcggacaacgtcggatacgctagttatcttctggagcaggagaagaacaaagggtatctccctgggcaggggccattcgtggctgcttttgcatctagtaacctgggagatgtctcacccaatattttgggacctcgttgtatcaacacaggtgaaagttgcgacaatgccaacagcacatgccccatcgggggcccctccatgtgtatcgcaaaaggccccggccaggacatgttcgattcgacccagatcattggacgtgcgatgtaccagagagctaaaagtaaaacatgcaaaccagctctcggatattcgttcgctgctgggactatcgacggcgtgggcggtctgaacttcactcaggggaaaacagagggtgatccattctgggatactatccgggatcaaatcctcgggaagcctagcgaagagattaaagaatgccataagcccaaacccattctcctgcacacgggtgaactgtccaagccccacccttggcaccctgacatcgttgatgtgcagatcatcacgctcggtagtctggccattaccgcaatcccaggtgaattcactacgatgagtgggaggagattgcgtgaggccgtacaggcagagttcgcctcgcatgggatgcagaatatgacggtggtgatcagtggcctgtgtaacgtgtatacacactacatcacgacgtacgaggagtaccaggctcaaagatatgaggcagctagtactatctacggtcctcacactttatcagcttatatccaactgtttcggaatttagccaaagccattgcgactgacactgtggccaacctgtcaaggggtccagaaccaccatttttcaagcagctgatcgtcccgctgatccccagtatcgtggatagggctcctaagggaaggacgtttggtgacgttttacagccagctaagcccgagtaccgagtgggcgaagtagccgaggtcatctttgttggagcgaaccctaagaattcggtgcagaatcagacacatcagacgtttctcaccgtagagaaatacgaggccaccagcacttcctggcagattgtttgcaacgatgcatcatgggaaacccgcttttactggcataaggggctgttgggcttgagcaacgcaacagtggaatggcatatccccgacacagctcagccgggcatctacaggattaggtatttcggacacaaccgtaagcaggacatattgaagcccgcggtgatcctcagctttgaggggactagtcccgcgttcgaggtagtgaccatttag

SEQ ID NO: 27974 - DNA, 723 bp, Artificial Sequence
  Description of Artificial Sequence: Synthetic coding sequence
atgtccggtcggcggttacgtgaggcggtccaagccgagtttgcctcacacgggatgcagaatatgacagtcgtgatatctggactgtgcaacgtttacacccattatatcaccacctacgaggagtaccaagcccagcgctatgaagccgcttctacaatctatgggccgcatacactcagtgcctatatccagctcttccggaacttagcgaaggccatcgccacggatacagtagccaatctctcccgcggcccagaacctcccttcttcaagcagttgatcgttccccttatcccgagcatcgttgacagagctccaaaggggagaaccttcggagatgtgcttcagccggcaaaacctgagtaccgtgttggagaagtagccgaagttatctttgtcggcgcaaaccccaaaaactccgtacagaatcagacacatcaaacatttctgacggtggagaagtacgaggcaacgagcacatcctggcagatcgtgtgtaacgacgcatcctgggaaacacgattctactggcacaagggattgttgggacttagcaatgctaccgttgagtggcacatccctgatacagctcagcctgggatttatagaatccggtatttcggacataatagaaaacaggacatcctgaaaccagccgtcattttaagctttgaaggcactagcccagcattcgaagtccctaactctgggctccactag

SEQ ID NO: 27975 - DNA, 2343 bp, Artificial Sequence
  Description of Artificial Sequence: Synthetic coding sequence
atggcaaagcgcaccttttccaatctggaaaccttcctgatttttctgctcgtgatgatgagcgccatcaccgtggcacttctcagcttactcttcataacctccggtaccatcgagaatcataaagatctaggggggcattttttctccactacacagtcaccccctgctactcagggatctactgcagcccagagatccacggccacgcagcatagtaccgcaacccagtcctcaaccgctacccaaacgtctccagtccccctgacgccggaatctcccctcttccagaacttctccggctatcacatcggtgtgggaagggccgactgcacagggcaggtggcggacataaacttgatgggctatggtaagagcggccaaaatgcacagggaatcctaacacggctttacagcagagcattcatcatggctgaacccgacggatcaaacagaactgtctttgtctcaatagacattgggatggtatcacagagactgcggctagaagttctcaataggctgcagtccaagtacggaagcctttatcgcagagacaatgtgattctctcaggcacacacacacattctgggcccgccggctatttccaatacaccgtattcgtgatcgcctccgaaggattctcgaaccaaacatttcagcacatggttacaggcatcctcaaatcaatcgatattgcacacactaatatgaagccagggaagatctttattaacaaagggaacgtggacggcgtgcagatcaataggtctccgtatagctacctgcagaacccccagtctgagagggctagatactcaagtaacacagataaggaaatgattgttctgaagatggtagatcttaacggcgatgacctgggactgatcagctggttcgccatccaccctgtgtccatgaataattcaaaccacctggtgaatagcgacaatgttgggtacgcgtcataccttctcgagcaggagaaaaacaagggctatcttccaggacaggggccatttgtggcggctttcgcctcatccaacctgggggacgtctcacccaacatactgggtcctaggtgcataaacaccggcgaatcctgtgataatgctaacagcacctgccccatcggaggtccttctatgtgcatcgccaaagggccgggacaggatatgtttgacagcactcaaataatcggtcgtgccatgtaccagcgtgccaaagagttgtacgcttccgcctcacaagaagtgacaggcccgctggcaagtgctcaccagtgggtcgacatgaccgacgtgactgtgtggctaaactccacacacgcctctaaaacatgcaagccagccctagggtattctttcgcagcaggtacaattgacggagtgggaggtctgaatttcacccaaggcaagaccgaaggcgatcctttctgggacaccatccgggaccagatcctgggaaagcctagcgaggaaattaaagagtgtcacaagccgaagcctattctgcttcacactggcgagctttcaaaacctcatccctggcaccctgatatcgtggacgtccaaataattaccctcggctccttagcaattacagcaattccaggcgagtttacgacaatgtctgggaggcgtcttcgcgaggccgtgcaggctgagtttgcaagtcatggaatgcagaacatgacagttgtcatcagcggtctctgtaacgtgtatactcattacatcaccacgtacgaggagtaccaggcgcaaaggtacgaagctgcctcaacaatctacggcccccataccttgtcagcttacatacagttatttcggaatctggctaaggccattgctaccgacaccgtggctaatctttcacggggccccgaaccacctttctttaagcaactgatcgtccccctgatcccaagcatcgtggatcgagctcctaagggcagaacctttggagacgtgctccagcctgctaagccagaataccgggtgggcgaagtagctgaggtgatatttgtgggcgctaatccgaaaaattccgtgcagaatcaaacacatcaaaccttcttaaccgtcgagaagtatgaggctacgtccacaagttggcagatcgtgtgtaacgatgctagttgggaaacaagattctattggcacaagggactgttgggccttagcaatgctactgttgaatggcacatccccgatacagcacagcccgggatataccgtatcagatactttggacataaccgcaagcaggatattctcaagcctgcggtgatcctttcttttgaaggcaccagtccggccttcgaggtagtgaccatctag

SEQ ID NO: 27976 - DNA, 1869 bp, Artificial Sequence
  Description of Artificial Sequence: Synthetic coding sequence
atggattccgaaaagtcgagcgaatggagatcagatgtgcttaaccgcctccaaagcaaatacgggagcctgtatagaagagataatgtgatcttgtctggcacacatacccacagtggaccagctggatacttccaatacacagtgttcgtaattgcctcagaagggttctcaaaccagacgtttcagcacatggtgaccggaattttgaagtcaatcgatattgcgcacacaaacatgaaacctggaaaaatctttatcaacaaaggaaacgtcgatggcgtgcagatcaacaggagtccttacagctacctccaaaatccacagagcgaaagggcccgctattccagtaacactgataaagaaatgatagtgttgaagatggtggacctgaatggggacgatctgggcttaatatcctggttcgcgatccacccagtgagcatgaacaacagcaatcatctagtgaatagcgacaacgtgggctacgcatcctatctcctcgaacaggagaagaacaaggggtaccttcccgggcaaggccctttcgtggcggctttcgcctcgtccaatcttggcgatgtatctcccaacattctcggccctcggtgcatcaacaccggggaatcatgcgataatgcaaactcgacatgccccattggagggccctccatgtgcattgctaagggtcccgggcaggacatgtttgatagcacccaaattattgggcgagcaatgtaccagagggctaaagaactatatgcctctgcctcgcaagaagtgacaggccctctagccagcgcacatcaatgggttgatatgactgatgtaaccgtctggcttaacagcacccatgccagtaaaacatgtaagcccgctcttgggtactcattcgccgccgggactatcgatggcgttggcggtctgaatttcactcaaggaaagacggaaggggatccgttctgggataccataagggatcagatattagggaaaccatccgaggagataaaggaatgccacaagccaaagcccatcctgcttcacacaggtgagctgtcaaagcctcacccctggcatccagacattgtggatgtccagattatcacgctggggagcctcgcaatcaccgcaattccgggcgaattcacaaccatgtctggacgtaggctgcgcgaagcagtgcaggcggaatttgcgtctcatgggatgcagaatatgacggtagttattagtgggctgtgtaatgtctatacccactacataaccacatacgaggaatatcaggcccaaaggtacgaagccgcttcaacaatttacgggccgcacactctgtccgcctacatccagttattccgcaacctggccaaagcaatcgccaccgatacagtagccaacctctcgaggggccctgaaccaccgtttttcaagcagctgattgtgcctctgatcccttccatagtggatcgtgcccccaagggtaggacattcggagatgttctgcagccagccaaaccggaatatcgagtgggagaggtcgccgaagtaatctttgtgggcgccaacccaaagaactccgtgcagaatcagactcaccagacttttctgacggtagagaagtacgaggccacttccacgtcatggcagattgtgtgtaatgatgcttcctgggaaacccgcttttactggcacaaggggctgctgggtctgagcaatgccaccgtagaatggcatatccctgataccgcccaacccgggatctataggatcaggtattttgggcacaatcgaaagcaggatatactgaaacccgctgtcatcctgagctttgagggaaccagccctgccttcgaagtcgtgacaatttag

SEQ ID NO: 27977 - DNA, 2238 bp, Artificial Sequence
  Description of Artificial Sequence: Synthetic coding sequence
atggccaagcggaccttctccaacttagagacatttctcatattcttgcttgtaatgatgagcgctatcaccgtggccttgctttccctgctgtttattacttctggcaccatcgaaaatcacaaggacttgggcggccatttcttcagtaccacccagtcgccgcccgccacccagggctctactgccgcccagaggagtactgccacacagcactctaccgctactcagtcatcgacagccacgcagacgtcccctgtgcctctcactcctgagagtccactctttcagaatttttcaggttaccacatcggagtggggcgagcagactgcacaggccaggttgcagacataaatctaatgggatacggcaagtcgggacagaatgcccagggcatcctgactcgtctgtattcaagggcgtttattatggcagagcctgatgggtcaaacaggaccgtcttcgtctcaatagacattgggatggtcagccaaagattacgcctggaggttctcaacagattacaaagcaagtacggatctctgtaccggcgggataacgtgattctgtcagggacccacacacacagtggacctgccggatattttcagtacaccgtctttgtcatcgcgtccgaaggattctccaaccagaccttccagcacatggtgacaggcatccttaagagtatagatatcgcacacactaacatgaaaccggggaaaatcttcatcaacaagggcaatgtggatggagttcagattaacaggtcaccctatagttacctgcaaaacccccagtcagaaagagctcgatactcaagtaataccgataaagagatgatcgtgttaaagatggttgatctcaatggcgacgaccttggactgattagctggtttgccatccaccccgtcagcatgaacaatagtaaccacctggtgaatagtgacaacgtgggatacgcttcttatttgcttgagcaggagaagaataaaggctatctgccgggacaaggaccttttgtggctgcttttgcaagttctaatctaggtgacgtgtcccctaacatcttgggtcctagatgcattaatactggcgaatcctgtgacaatgccaatagcacctgcccaatcggggggccatccatgtgtatagcgaaaggccccggacaggacatgtttgattccacacagatcattggccgagccatgtaccagcgggccaaatcaaagacttgcaaacctgcactcggctactcattcgcggccgggacaatcgatggcgtcggcggcctgaatttcacccagggaaaaaccgagggggatcccttctgggacaccatcagagaccagatcctaggaaaaccatctgaggagatcaaagagtgtcacaagccaaaacccattctgctacacaccggggaactgtctaaacctcatccatggcaccctgacattgtagacgtgcagataataacactgggctcactggccatcaccgccatccccggagaatttacaaccatgagcggccgccggctgagggaggcagtgcaagcggaatttgcttcccatgggatgcagaatatgacagtcgtcattagcggactgtgcaacgtttacacacattacatcacgacttacgaggagtaccaggcccaaagatacgaagcagcttccaccatttatggcccgcatacgctgtcggcctacatccagctgttccgtaacctggcaaaagccattgcaacggacacagttgccaacctgtcacgggggccagaacctccattcttcaagcagctcattgttcctttgattccaagtattgtcgacagggcccccaaaggccgaacattcggcgacgtcctccaacccgcgaagccagaatatcgtgtgggagaggtggccgaggttatctttgtgggggcgaaccctaagaattccgtccaaaaccaaactcatcaaacatttttgaccgtcgagaaatatgaggccacctctacctcctggcagatagtttgcaacgacgcctcctgggagacgcgtttttactggcacaagggcctgttgggcttgtccaatgccacggtggagtggcacatcccagatacagcgcaacctgggatctaccgcatccgctatttcggacataaccgaaagcaagatatcttgaagccggccgttatactctctttcgaagggacatccccagcctttgaggtggttacaatttag

SEQ ID NO: 27978 - DNA, 840 bp, Artificial Sequence
  Description of Artificial Sequence: Synthetic coding sequence
atgctcctggccgcatcaaaagtcctagacaggttgaaacctgtcataggtgtcaatacagatccggagcggtccgaaggccacctttgcttacccgtgcgatacacacattcttttccggaagccctgcagaagttttaccggggcgagtttagatggctgtggagacagcgcatccgtctgtacttggagggcactggaatcaaccctgtaccagtcgatctacacgaacagcagctctcgcttaaccaacacaacagagccttgaacatagagagggcccacgatgaacggtcagaagcgagtggtccgcagcttctccctgtgagagccctgaacgaggtgttcatcggagagtccctcagtagtagggcatcatactatgaaatttctgtggatgatggaccctgggagaaacagaagtcatccggcctcaacctttgcaccggcacagggtcgaaggcctggagctttaacatcaaccgtgttgccacacaagctgtggaagacgttctgaacatagccaagaggcaagggaatctctccttaccactcaacagagagctcgtggaaaaggtgactaacgagtataatgaatcccttttatatagtccagaagagcctaagattctgtttagcatccgagagccaatagccaaccgcgtgttttcctccagccgccagcggtgcttctcctcaaaggtgtgcgttaggtcccggtgctgggacgcttgtatggttgtggacggaggtacctctttcgaattcaatgatggggccatcgcctcaatgatgataaataaagaagacgagctgagaaccgtgctgcttgagcagtag

SEQ ID NO: 27979 - DNA, 1329 bp, Artificial Sequence
  Description of Artificial Sequence: Synthetic coding sequence
atgacatgttatagggggtttctgctgggtagctgttgcagagtcgccggcggtcgggccgcagcactgcggggacctggcgccggtgggccagctgctcgtcctaggctcggtggtgacggtggtgggcgacggcatctgggccaaggacagccccgcgagctggcagggtgcgggtccagggctgacggaggcttccgacccagccgtgttgtagtggtcgcaaaaaccacgcggtacgaatttgaacagcagaggtacagatacgccgaactcagtgaggaggacttgaaacaactgctggccctgaaaggttcttcctattcaggcctactggaaagacaccatattcacaccaagaacgtagaacacatcattgactctctgcgcaacgagggtattgaggtgcggcttgtgaagagacgtgaatacgatgaggaaacagtgaggtgggccgacgccgtcatcgctgcgggaggggatggaaccatgctgctggcagcctccaaggtgcttgatagactcaagcccgtcataggagtgaacacggatccagaaagaagtgaggggcatctctgccttcccgtgaggtacacgcactcttttccagaggctttacagaagttttacaggggcgagtttcgttggttgtggcgccagagaatccgactctatctcgaaggcactggcattaatcctgtgccggtcgatctccatgagcagcagctgtcactgaaccaacacaatagggctctgaacatcgaacgcgcgcacgatgagagatcggaagcgagcggaccccaactgctccccgttagagccctaaacgaagttttcatcggagaatccctgtccagcagggccagttactatgagatcagtgtggacgacgggccatgggagaagcagaagtcctccggactgaatctttgcacgggaacggggtcgaaagcctggtcattcaatattaatagggtcgccacgcaggccgtagaggatgtcctcaacattgccaaaaggcaagggaacctcagcttaccattgaaccgcgagcttgtagaaaaagtcacaaatgaatataacgagtcccttctttattctccagaagagccaaagatcctgttttctatccgcgaacccatagccaatagggtcttctcttcttccaggcagagatgtttttcctctaaggtatgcgtccggagccgttgctgggacgcctgtatggtggtggacggtgggacatcgttcgagttcaatgatggggcgatcgcaagtatgatgatcaataaagaggacgagttacggaccgtgttgctggagcagtag

SEQ ID NO: 27980 - DNA, 840 bp, Artificial Sequence
  Description of Artificial Sequence: Synthetic coding sequence
atgcttttggctgccagcaaagtgcttgatcggcttaagcctgtgataggggtcaatactgaccctgagcggtcagaagggcatctttgtttacctgtgcgctatactcattcttttcctgaagcgctgcagaaattctatcgcggggagttcagatggctctggcggcaaaggattaggctctaccttgaggggaccggcatcaacccggtacccgtagatctccatgagcagcagctgagcctaaaccagcacaatagagccctgaatattgagcgagctcacgatgagcgatccgaagcctccggaccacagctgctgccagtgcgggcactcaacgaggtattcatcggcgaatcactctcctcgagggctagttactacgaaataagtgtggatgatggcccgtgggaaaagcaaaagtctagcggcctgaatctgtgcacaggtacgggaagcaaagcatggagcttcaacatcaacagggtggcaactcaggctgttgaggatgtcctgaacattgcaaagagacaggggaatctgtcgctgcccttgaaccgtgagctggtggagaaagttaccaatgagtataacgaaagcctcttatacagtcccgaggaaccgaagattctgtttagtattagagagcctattgcaaatcgtgtgttctcctccagtcggcagcgatgtttctcaagtaaagtatgcgtgagatccagatgctgggacgcttgtatggtggtagatggcggcactagttttgaattcaatgacggtgccattgcttccatgatgatcaacaaagaagacgagctcaggaccgtgcttctcgagcaatag

SEQ ID NO: 27981 - DNA, 906 bp, Artificial Sequence
  Description of Artificial Sequence: Synthetic coding sequence
atgttattggccgccagcaaggtgctcgacagactcaagccagttataggggttaatacagaccctgagagaagcgaaggccacctgtgtttgcctgtgcgctacacccactcgttccctgaggctctccagaagttttaccgcggagagttccggtggctgtggagacaacgtattcgcctgtaccttgaggggactggcatcaatcccgttcctgttgatcttcacgagcagcaactgtcgttgaaccagcacaaccgtgccctcaatattgagagagctcatgacgagaggtcagaagcgtccgggccacagttattgcctgttcgcgcactcaatgaagtgttcattggcgaatctctgtccagcaggatgagttattcctgggccgtggccgtggataatctaaggagaagcatccctacactgaaaggcctagcatcgtattacgaaatatctgttgacgacggaccatgggaaaagcaaaaatccagcggcttgaatctgtgtaccgggacgggcagtaaggcctggtcctttaatatcaaccgcgtcgccacccaggccgtagaggacgtgctgaacatcgctaagcggcaaggaaacctctccctccccctgaatcgcgagcttgtcgagaaggtaaccaatgaatataatgagagtctcctttactccccagaagagcccaagattttattttcaatccgggagccaattgccaacagggttttctcctcatcgagacagcgttgcttctccagcaaagtatgcgttagatcacgttgttgggatgcctgcatggtcgtggatgggggcacgagttttgagtttaacgatggtgcgatagcttccatgatgataaacaaagaagacgaattaaggaccgtattgttggagcagtag

SEQ ID NO: 27982 - DNA, 1233 bp, Artificial Sequence
  Description of Artificial Sequence: Synthetic coding sequence
atgacttgttatcgcggcttcctgttaggtagctgctgccgagtggctggcggtcgcgccgcagcactcagggggcctggggccggaggacctgccgccagacccagactcggaggggatggcggcggacgccgtcatcttgggcaggggcagccacgggaactggctggctgcgggtccagagcagatggcggctttagaccaagccgagtcgtggtcgtagccaaaaccacgaggtacgaatttgagcaacagaggtacaggtacgcagagcttagtgaagaggatctcaagcagctgctggcactaaagggctcctcttacagcggccttctcgaacggcatcacatccacacgaagaacgtggagcacatcatcgacagtcttcgtaacgaaggcatcgaagtccgtttggtgaagagaagggaatatgatgaagaaactgtgcgatgggctgacgctgtgatcgccgccggcggagatggtacaatgctattggccgcgtccaaggttctagataggctgaaaccagtcatcggagtgaatacagacccagagcggtcggaaggacatctgtgtctgccagtccgttacactcacagttttccggaggcgctgcaaaagttctataggggcgagtttaggtggctatggagacagagaatcagactgtatctggaggggaccggcatcaatcctgtaccagtcgacctgcacgagcagcagctttccctgaatcagcacaacagagcgctcaacatcgagcgggcccacgacgagaggagcgaagcgagcggtccccagcttctgcctgtgagagccctgaatgaggtgtttataggggaatctttgtccagtcgcagcttcaatattaaccgcgttgcaactcaggcagttgaagacgtgctgaacatcgctaaaagacaaggcaatctgtcgctgcctcttaaccgggagctcgtcgaaaaagtgacaaacgagtataacgagtctctcctgtacagtccagaggaacccaaaatcctgttctccatccgagaacccatcgccaacagggtattcagctcctccaggcagcggtgtttcagcagtaaagtgtgcgtcaggtctagatgttgggacgcctgcatggtcgtggacggaggcacaagtttcgaattcaatgacggggccatcgcctccatgatgataaacaaagaggacgagctgcggaccgtcctcctcgagcagtag

SEQ ID NO: 27983 - DNA, 192 bp, Artificial Sequence
  Description of Artificial Sequence: Synthetic coding sequence
atggagctggtacaggtactgaaacggggcctgcagcagatcaccggacatggcggtctaagaggttacctccgggttttctttcgcaccaacgacgccaaagtgggtactctggttggcgaagacaagtacgggaataagtactacgaggataacaagcaattttttggtatagttggattcactgtatag

SEQ ID NO: 27984 - DNA, 438 bp, Artificial Sequence
  Description of Artificial Sequence: Synthetic coding sequence
atggagcttgtccaagtgttgaaaaggggtctccaacagatcaccggccacggcggcttgcggggctacctgcgtgttttttttcggacaaatgacgccaaagtcggaacccttgtaggggaagacaagtacggcaacaagtattatgaagataacaagcagttttttggccggcacagatgggttgtatacacaaccgaaatgaatgggaagaatacattctgggacgtggacgggtccatggtccctcctgaatggcacaggtggttgcacagcatgacagacgatcctcctaccaccaagccattgacggcacggaaatttatatggaccaaccacaaatttaatgttaccggaacgcccgaacagtacgtgccttacagcaccacaaggaaaaagattcaggagtggattccaccatctaccccttacaagtag

SEQ ID NO: 27985 - DNA, 255 bp, Artificial Sequence
  Description of Artificial Sequence: Synthetic coding sequence
atggccgcccgcgtcggtgccttcctgaagaacgcatgggacaaagagcctgtgctcgtagtaagcttcgtcgtgggtggcctcgccgtgattctgcccccattgtcaccatacttcaaatatagtgtcatgataaataaggccaccccatacaattatcccgttccagtgcgagacgacgggaacatgcccgacgtacccagccacccacaggacccccaaggccctagcctggaatggcttaagaaactctag

SEQ ID NO: 27986 - DNA, 255 bp, Artificial Sequence
  Description of Artificial Sequence: Synthetic coding sequence
atggccgccagagtgggtgccttcctcaaaaatgcctgggacaaggagccagtgctggtagtcagtttcgttgtgggaggtctggccgtgatattgcctcccctgagtccttattttaaatactccgtcatgataaacaaggcgaccccttataactaccccgtcccagtccgagatgacggcaacatgccggatgtgcccagccaccctcaagaccctcagggcccttccctcgaatggctcaagaagctctag

SEQ ID NO: 27987 - DNA, 255 bp, Artificial Sequence
  Description of Artificial Sequence: Synthetic coding sequence
atggccgcccgggtaggggcgttcctgaagaacgcttgggacaaagagccggtacttgtcgttagttttgtggtgggcggcttagcagtcatcctgccgccccttagcccttactttaaatattcggtcatgataaataaagcaaccccttataattaccccgttcccgtgagggatgatggtaatatgcctgatgtgccctcacatcctcaggacccacagggcccgagccttgaatggctcaagaaactctag

SEQ ID NO: 27988 - DNA, 246 bp, Artificial Sequence
  Description of Artificial Sequence: Synthetic coding sequence
atgctgcggcaaattatcggacaggccaaaaaacaccctagcctcataccactgtttgtgtttattggcacgggcgcaacaggggccaccttatacctcttaagacttgccctgttcaatccagacgtctgctgggataggaataaccccgaaccttggaataagttgggaccgaacgatcagtacaaattctattccgtgaatgtggattattccaagctgaagaaggagagacctgatttctag

SEQ ID NO: 27989 - DNA, 171 bp, Artificial Sequence
  Description of Artificial Sequence: Synthetic coding sequence
ataccagtcgccatttttataacattggttaatgtgtttattggacaggccgagctggccgagatccctgagggttatgttcctgagcattgggaatattataaggggaagggtgccggaagcgcaaaaattgacgcttgcgagaggaggtggacactggtgttactatag

SEQ ID NO: 27990 - DNA, 318 bp, Artificial Sequence
  Description of Artificial Sequence: Synthetic coding sequence
atgatatgctggagacatccaagtgccccgtgtggccgaggcgagtggcaggtgccccgctctcagctgccgttagctcgcgtggagttccctgtggcactgggtctcggcgtcgccgttggcgctgaggcagccgctattatggtgaacttgctacagatcgtgcgggatcactgggtgcatgtcttagtgccaatggggtttgtgattggatgttatctagatagaaagtctgacgagcgactgactgcgttccgtaacaagtcaatgctgttcaagagggagttacaaccaagcgaggaggtgacatggaaatag

SEQ ID NO: 27991 - DNA, 177 bp, Artificial Sequence
  Description of Artificial Sequence: Synthetic coding sequence
atggtgaacctgttgcaaatcgtgagagatcactgggtgcacgtcctcgtgcccatgggctttgtcatcgggtgttatttggacagaaagagcgacgagaggctgactgcctttaggaataagtccatgctgttcaagagggagttgcaaccaagcgaagaggttacctggaagtag

SEQ ID NO: 27992 - DNA, 177 bp, Artificial Sequence
  Description of Artificial Sequence: Synthetic coding sequence
atggtcaatctgctgcagattgtacgagatcattgggtccacgttcttgtacccatgggatttgtaatcggatgttatctggacaggaaaagcgacgaacgacttaccgcctttcgaaataaatccatgctctttaagcgggaattacaaccttctgaggaggtcacctggaaatag

SEQ ID NO: 27993 - DNA, 288 bp, Artificial Sequence
  Description of Artificial Sequence: Synthetic coding sequence
atggagtctcatgagcgccaacccctcgtgctgcatgaagaaatgggagagtgcagatcgagcctttccgctgggggaggggtacacatagagcctaggtaccgacagttcccccagctgactagatcccaagtgtttcagagcgagtttttttcggggctgatgtggttttggatcttgtggaggttttggcacgactctgaagaggtcttgggccacttcccataccccgatcctagccaatggaccgatgaggaattaggaatcccgccagatgacgaggattag

SEQ ID NO: 27994 - DNA, 318 bp, Artificial Sequence
  Description of Artificial Sequence: Synthetic coding sequence
atgagtgctctcaccagactcgcttctttcgctcgagtaggggggagactatttaggagtggctgcgctcgtaccgcgggcgacggtggcgtcagacatgccgggggaggagtgcacatagagcccaggtatcggcagttcccccaactcacccgcagccaggtgttccagagtgaattcttctctggtctcatgtggttttggatattgtggagattctggcatgactccgaggaagtgctgggccacttcccctatccagacccatctcaatggaccgatgaagaactggggatccctcctgatgacgaagactag

SEQ ID NO: 27995 - DNA, 315 bp, Artificial Sequence
  Description of Artificial Sequence: Synthetic coding sequence
agtgctctgaccaggctcgcttcttttgcccgcgtgggaggtaggctcttccgatctggctgcgccaggaccgcgggcgatggcggggtgcggcacgctggtgggggagtgcacatagagccccgatacaggcaattccctcagttgaccagatcccaggtgttccagtcagaattcttttccggtctcatgtggttttggatactttggcgattttggcacgactctgaggaagtgcttggacacttcccttatccagaccctagccaatggactgacgaagagctcggcattcctcccgacgatgaggattag

SEQ ID NO: 27996 - DNA, 318 bp, Artificial Sequence
  Description of Artificial Sequence: Synthetic coding sequence
atgtccgccctcactcgcttggcttcttttgccagagtgggtggtcgcctctttcgcagcggatgcgctcggaccgcaggagacggcggtgtgagacacgctggtggaggtgttcatatagagccacgttacagacagtttcctcaattgaccagatcacaagtgtttcagagcgagtttttctctgggctgatgtggttttggatcctctggagattctggcacgattccgaggaagtcctgggacatttcccttatcccgacccaagtcaatggacagatgaagagctcggaatacctcctgatgacgaggactag

SEQ ID NO: 27997 - DNA, 318 bp, Artificial Sequence
  Description of Artificial Sequence: Synthetic coding sequence
atgagcgcgctgactcggctggcaagtttcgcccgggtaggcgggcggctatttcggtctggatgcgcacgcacagcaggtgacggtggcgtgcgccatgcggggggtggagtacatatagagcctaggtatagacagtttccgcagctgacaagaagtcaggtattccagagcgaatttttctctggattgatgtggttttggattttgtggaggttctggcacgacagtgaagaggtccttgggcacttcccctatcctgacccatcacagtggaccgatgaggaactgggaataccacccgacgacgaggattag

SEQ ID NO: 27998 - DNA, 390 bp, Artificial Sequence
  Description of Artificial Sequence: Synthetic coding sequence
atgagttttcccaaatacaagccctcttctttaaggaccctgcctgaaacattagatcccgcggagtataacataagcccagaaacccgccgggcccaggcggagaggctcgcaatccgagcacaactgaagagagaatacttgttgcagtataacgatcctaatcgccgaggtctgatagaaaatccggcccttctccggtgggcttatgcccgaacaattaacgtttatccgaatttcagacccactcccaaaaactccctgatgggcgcattatgtggctttgggccattgatctttatttactacattatcaaaaccgaaagagaccgaaaagagaagctcatacaggagggaaagcttgaccgtacctttcatttgtcatattag

SEQ ID NO: 27999 - DNA, 363 bp, Artificial Sequence
  Description of Artificial Sequence: Synthetic coding sequence
atgagcttccccaaatacaagccatcttcactgcgcaccctcccggagacattggacccagcggaatataatataagccccgagactcggagagcccaggcggagcggctggcaatcagagcacagctgaagagagagtacttactgcagtacaacgaccctaaccgacgcggtctgattgagaacccggctcttctgcggtgggcctacgccaggaccatcaatgtgtaccccaactttcgccccacacctaagaactctctgatgggggccctctgtggttttgggccattgatttttatttactacattattaagacggagcgagtgagtatacagacccgctgtctcgtattcgaatag

SEQ ID NO: 28000 - DNA, 570 bp, Artificial Sequence
  Description of Artificial Sequence: Synthetic coding sequence
atggctgcaatgagcctgctgaggagagtaagcgtgactgccgtggcagccctgtccggccgcccgctgggtacgagactgggattcggcggatttctgaccagaggtttccctaaggccgccgcgcctgtaaggcactctggcgatcacggcaagaggttgttcgtgatcagaccaagccggttttatgatagaagattcctcaaactactgaggttttacatcgctctgaccgggattccagtcgctatttttataaccctcgtgaatgttttcataggccaggccgagctggccgaaattcccgagggctacgtccccgaacactgggaatattataaacaccccatatccagatggatagctcggaacttttacgactctcccgagaagatctatgaacggaccatggccgtgctccaaatcgaggcagagaaggccgaattgcgagtgaaggagctggaagttcgcaaactaatgcacgtccggggcgatggcccatggtattactacgagacgatagataaagaattaatcgatcatagtcccaaggccacaccagataactag

SEQ ID NO: 28001 - DNA, 414 bp, Artificial Sequence
  Description of Artificial Sequence: Synthetic coding sequence
atggctgcaatgagcctgttacggagagtgagcgtgaccgctgtggccgccctaagcggtaggcccctggggacgagactgggcttcggaggatttcttacaagaggcttcccgaaggcagccggccaagccgagttggctgagatccccgaaggctatgtgcctgagcactgggaatattataaacatcctatatcccggtggatcgctcggaacttttacgactcgcccgaaaaaatctacgagagaacaatggccgtgctgcaaattgaagcagaaaaggctgaactgcgggtgaaagagctggaggtgcgcaagctgatgcatgtgcgaggagacggtccttggtactactatgaaacaatcgacaaggagctgatcgatcatagccccaaggcaactcctgacaactag

SEQ ID NO: 28002 - DNA, 342 bp, Artificial Sequence
  Description of Artificial Sequence: Synthetic coding sequence
atgacaggttacacaccggatgaaaagcttagattgcagcagctgcgggagcttcgccggcgctggctcaaagaccaggagctttccccccgggagccagtgttgccgccccagaagatgggccctatggagaaattctggaacaagttcctagaaaacaaatccccctggcgaaagatggttcacggagtctacaagaaaagcatttttgtatttacccatgttttagtaccggtgtggattatacactattatatgaagtatcatgtgagcggggacaccatcttggaaacgggcgaggtgattcctcctatgaaagagttccctgaccagcaccactag

SEQ ID NO: 28003 - DNA, 291 bp, Artificial Sequence
  Description of Artificial Sequence: Synthetic coding sequence
atgatagcccggcggaaccccgaacctctacgttttcttcctgatgaggccaggagcttgcctcccccaaagttaacagaccctaggctcttatacattgggttcctgggctattgcagtggtctgatagataatctgataagacgccgtccaatcgctaccgctgattatttatacgcagtgagggatagggagatgttcggatatatgaagttgcacccagaggattttcccgaagaggacaaaaaaacctacggggaaatcttcgagaaattccaccctatccgatag

SEQ ID NO: 28004 - DNA, 267 bp, Artificial Sequence
  Description of Artificial Sequence: Synthetic coding sequence
atgatcgcccgccggaacccggaacctctgagatttctgcccgacgaggcccggtctcttccccctcctaagctgaccgatccaagactgctatacatcggtttcctgggctactgttctgggcttatcgacaatctgattagacgcaggccgattgccacagccggcttacacaggcagttgttgtacatcacagcattctttttcgccggttactatctggtcaaacttgaagcatacgcgaatctgtatgtcgatactctgtag

SEQ ID NO: 28005 - DNA, 360 bp, Artificial Sequence
  Description of Artificial Sequence: Synthetic coding sequence
atgatcgcaagacgaaatccagagccacttaggttcttgccagatgaagcccgatccctgcccccccccaagctgacagaccccaggctgctttacatcggatttcttggttactgtagtgggctgattgataatctcattagacgtagacccattgcaacggcaggccttcaccggcaacttctctacatcaccgcgtttttctttgctggatactacctggtgaaacgtgaggattacctttatgcagtcagggatagagaaatgttcggttatatgaagcttcaccctgaggactttccagaagaggacaaaaagacttacggcgagatttttgaaaagtttcatcccatccgctag

SEQ ID NO: 28006 - DNA, 231 bp, Artificial Sequence
  Description of Artificial Sequence: Synthetic coding sequence
atgatcgcgcgcaggaaccctgaaccacttagattccttccagacgaggcccgaagcctgcccccacccaaattgacagaccctaggctcctgtatatagggttcctcggttattgctcaggcttaattgacaatcttatccgcagaaggccaatagccactgctggactacaccgacaactgctgtacattacggcattcttttgttggatcctatcatgtaagacttag

SEQ ID NO: 28007 - DNA, 1032 bp, Artificial Sequence
  Description of Artificial Sequence: Synthetic coding sequence
atgtccgtcctcctgagatctgggcttgggcctttatgcgctgttgctagggccgctatccccttcatctggcgaggcaagtacttttcaagtggcaacgagccagccgaaaatcccgtgaccccgatgcttcggcatttgatgtacaagatcaagtccacaggtcctatcacagttgcggaatacatgaaagaggtccttacaaaccctgccaagctgctcgggatatggttcataagcgaatggatggcaacggggaaatcgaccgcatttcagctcgtggagctagggccaggccgaggaactttggtgggcgatatcttacgggttttcacacagttgggttccgtattgaagaattgcgatattagtgtacacctcgtggagaaaacgcctcaaggctggagagaagtattcgtggatatcgatccacaagtttcagacaagcttcgatttgtgctggctccaagtgctactcctgccgaagcgttcatccagcacgacgagacacgcgatcacgtcgaggtgtgtccagatgctggggtcattatagaagagctgtcccagcgaattgccctcacaggcggtgccgcattggtggccgactacggacatgatggaacaaagacagacacatttaggggcttttgtgaccacaaactgcatgacgtactcatcgcccccgggaccgccgatctgacagccgacgtcgattttagctatctcagacgcatggcacaggggaaagttgcatcactcgggcccattaaacagcatacctttctgaagaacatggggattgacgtgagactcaaggtccttttggacaaatccaacgagccatccgtgcggcagcagcttctgcaaggctatgatatgttaatgaatccaaaaaagatgggggagaggtttaacttttttgccctcctcccccatcagcggcttcagggggggcgataccagcgtaacgccagacagtcaaaaccgttcgcaagcgtggttgccgggttctcagaactggcctggcagtag

SEQ ID NO: 28008 - DNA, 1452 bp, Artificial Sequence
  Description of Artificial Sequence: Synthetic coding sequence
atggcctcccttggcgatctcgtgcgggcatggcacttgggcgcacaggccgtcgaccgcggagactgggccagagctttacatctcttttcgggagtaccggccccacccgcaagattgtgtttcaacgcaggatgcgtccatttgctggctggggaccccgaggccgcccttcgcgctttcgaccaggccgtcaccaaggacacatgtatggcagtaggatttttccagagaggtgtcgcaaattttcaacttgccaggtttcaagaagccctttcagatttttggctggcactcgaacagctaaggggacacgctgctatagattacacgcagctcggcctgcggtttaaactgcaggcttgggaagtgctgcacaacgtagcatctgctcagtgccagctgggtttatggacagaggccgcaagctcactgcgggaagcaatgagtaagtggcctgaggggagcctcaacggcctagattccgctcttgatcaggttcagcgcagaggcagtctgccgccacgccaggtacctagaggcgaagtatttcggccgcacaggtggcacctcaaacacctggagccggttgacttcctcggcaaagcaaaggtcgttgcctcagccatccccgatgatcagggctggggggtgagacctcaacaacctcagggccctggggcaaaccacgacgcccgttcactgatcatggattcccctagagcgggcacacatcaaggaccactcgacgctgaaacagaagtgggcgcagataggtgcactagcacagcatatcaggaacagagacctcaggtggaacaagttggaaagcaagcccccttgtccccggggctgcctgccatgggaggccctggccctggaccctgtgaggatcctgcaggagctgggggagccggcgctggcggatctgaacccctggtgaccgtgaccgtgcagtgtgccttcactgtggctctccgggcccggagaggagccgacctatcttccctgcgagcactactcggtcaggctttgccccatcaagcccaactgggacagttgtcctatctagcccccggcgaagatggacattgggttcccattcctgaagaagaaagcttgcagcgagcgtggcaggacgctgcggcatgccccaggggactacagttgcaatgcagaggggccggcggacgccccgtgctgtaccaggtggtcgcacagcactcatacagtgcacaagggccagaggatcttggttttcgccagggcgacacagtagatgtcttgtgtgaagaacccgacgtgcccctcgcagttgaccaggcttggctggaggggcattgtgacggtcggatcggcattttccccaagtgcttcgtcgtgcctgccggccccaggatgtctggtgccccagggaggctcccccgctcacagcaaggggatcagccgtag

SEQ ID NO: 28009 - DNA, 1284 bp, Artificial Sequence
  Description of Artificial Sequence: Synthetic coding sequence
atggcgagcctaggcgatctcgtacgggcctggcacttaggcgctcaagccgtcgaccgcggggattgggcccgggctctgcatctattcagtggggttcctgcaccgcctgcacgcttatgtttcaacgccggatgcgtgcaccttttggccggcgatccagaggccgctttgcgggccttcgatcaagctgtgaccaaggacacctgcatggccgttggcttttttcagcggggggttgcgaactttcagctggccagattccaggaggcactcagcgatttctggctggccctggagcaactccgcgggcacgccgcgatcgattacacacagcttggactgaggttcaaacttcaagcttgggaagtgcttcacaatgtcgcctcagcccagtgtcagttgggcctatggacagaagccgcctcttctctgcgtgaagccatgagtaaatggccggagggtagcctgaatggcctggacagcgccttggaccaggtccaggggccaggggcaaaccacgatgcaagatccctgattatggattctcctcgcgctggaactcatcaaggcccccttgatgcagagaccgaagtaggtgctgaccggtgcacctctactgcataccaagagcagcgtcctcaggtcgaacaggtcggaaaacaggctccactcagtccaggtctgcctgcaatgggcggccccggaccaggcccatgtgaggaccccgctggcgcgggaggggccggagccggcggctcagagcccttggtgacagtaacagttcagtgcgcattcaccgtcgcccttagggcaagaaggggtgcagacttaagtagcctgagggcattattgggacaggccctgccacaccaagcccagttaggtcagctgtcatacctggcccccggggaagacgggcattgggttccaattccagaagaggagtcattacaacgggcctggcaggacgctgcagcctgccctagggggctgcagctgcagtgtcgcggagcaggggggagaccagtactgtaccaggtggtggcccagcatagctacagtgcacagggaccagaggatctgggcttccggcagggcgatacagtggacgtcctttgtgaagagccggatgtgccgttagctgtggatcaggcatggctggagggacattgcgatggcagaatcggcattttccctaagtgcttcgtggtcccggctgggcctagaatgtctggggcacctggcaggctcccacgatcacaacagggggaccagccttag

SEQ ID NO: 28010 - DNA, 1113 bp, Artificial Sequence
  Description of Artificial Sequence: Synthetic coding sequence
atggcgggcccccgatacccagtttccgtgcagggagccgcgcttgtgcagataaaacgattacagactttcgccttttccgttcgctggagtgacgggagcgatacgttcgtcagacgttcttgggacgaattccgacagctgaaaacattgaaagagacattccccgtggaggcagggctgcttaggagatcggatcgcgtgctgcctaaacttctcgacgcaccattgttggggcgcgtcgggagaacctccaggggcctggccagactgcaactcttggagacgtactcacgtagattgctggccacagccgagagagttgctagatccccaacaattactgggttttttgcaccacaacccttggatctcgaacccgctctcccacctggtagccgagtcattttgcctacaccagaagaacaaccgctcagtcgtgccgcgggccgattaagcattcactctctcgaagcccagtccctcaggtgtcttcagccgttctgcacacaggacacccgcgatcggcccttccaagcacaggcacaggaaagtctagacgttctgctgcggcacccctccggctggtggctggtggagaacgaggatcggcagactgcatggtttcccgctccctacctcgaggaggcagctccaggacagggaagggagggaggaccgtctcttggctctagcggtcctcaattctgtgcctcacgtgcatacgaatcatcaagggcggatgagctgagtgtcccggctggggcacgggtgcgtgtactcgagacttctgaccgcggctggtggctctgtcgatatggagaccgtgcgggcctgctcccagctgtattgttgagaccggaaggcctcggagcattgctgagcggtactggtttcagggggggcgacgaccccgcaggagaggcccggggtttcccagaaccctctcaggctactgcgccaccaccgactgtaccaactaggccctcccctggagccatccagtcccgctgctgtacagttacccgtcgtgcgctcgagcggcgccctcggagacaaggaaggcccaggggatgtgtggacagtgtccctcaccctacaactgaacagtag

SEQ ID NO: 28011 - DNA, 1116 bp, Artificial Sequence
  Description of Artificial Sequence: Synthetic coding sequence
atggctggcccaagatatccggtgtctgtgcaaggtgctgccctggtccagataaagaggctgcaaaccttcgcctttagcgttcgctggtctgacggatctgatacttttgtgaggagatcctgggacgagtttaggcaactgaagaaaaccctgaaggagacatttcccgtggaggctggtcttctccggcgctccgacagggtactgccgaaactgctggacgcgcccctgctcggaagagttgggcggacttcaagaggcctagcccgccttcagctgctcgaaacctactcacgccgtttgttggccaccgcagaacgcgtggcacggtctccaacaatcacaggattcttcgctcctcagccgctggacttggagcctgctctgccccccggcagtcgagtgattctgccaactcccgaagagcagcccctgtctcgggccgctggtagactgtccattcactcgttagaggctcaaagtctgcggtgcctgcagccattctgcacccaggacacccgagaccgaccgtttcaagctcaagcgcaagagagtctggacgtgctcctgcgtcatccaagtggctggtggctggtcgagaatgaggacaggcagactgcctggttccctgccccttacctcgaggaagcagcccccggccagggacgagagggagggcccagtttgggatcgtcaggccctcaattttgcgccagccgggcatatgaatcttccagagctgatgaattgtctgtgcctgcaggcgccagagtcagagtactagagaccagcgacaggggctggtggctttgccgatatggtgaccgagctgggctactgccagcagtactactgagacccgagggactgggggcgcttctgagtggaactggtttccgcgggggggatgatccagcaggggaggctaggggtttcccggagccaagccaggctactgctccgcccccaaccgtgccaacaaggccgagtcctggcgcaatacagtcccgttgttgtacagtcacaagaagggcgctggaacgccggccccggcgccagggaaggcctcgtgggtgcgtggatagtgttccacaccccaccacagaacagtag

SEQ ID NO: 28012 - DNA, 1131 bp, Artificial Sequence
  Description of Artificial Sequence: Synthetic coding sequence
atggccggaccgagataccccgtgtccgtacagggggccgccctagttcagattaaaagactccagacatttgcttttagtgtgaggtggtctgatggttcagacacattcgttagacgctcctgggacgaatttcgacagcttaagaagacactcaaggagacctttcccgtagaagctggcctcctaagaagaagcgaccgtgtcctccccaagctgctgggtcaggcaagcctggacgcccccctactcgggagagtggggaggacaagccggggcctggccaggcttcagctgttggagacctacagtagacgtctgctggctaccgcagagcgggtcgccaggtctcctacaattacagggttcttcgccccccagccgctggacctggagccagccctgccccctggtagtcgcgtcatcctacccacaccggaagagcagcccctttctcgcgccgctggcagattgtctatccatagtcttgaagcccagagtctgcgttgcctgcagccattttgcactcaggacactagggaccggccatttcaggctcaggcacaggaaagcctggatgtgttgctgcggcatccttccggatggtggcttgtggaaaatgaggatcggcagaccgcttggttccctgctccctacctggaggaggctgctccaggacaaggaagggagggcgggccatctttgggctcttctggacctcagttttgtgccagccgcgcctacgagtcatcccgcgccgacgagttgagcgtcccggccggtgcccgggtgagggtgctggagacttctgatagggggtggtggttatgtcgctacggcgatcgagccgggctgttgccagcagtgctcttgcgcccggagggattaggggccctgctgtctggaaccggttttcgggggggcgatgatccagcaggggaggccagggggttcccggagccatcccaggctaccgctcctcctcccactgttcccacccggccatctcctggcgcaattcagtctcggtgctgtacggtcactcgtagggcactggaaaggcgtccacggagacagggccgaccgcgcggttgtgtggacagtgtgcctcacccgacaactgagcagtag

SEQ ID NO: 28013 - DNA, 1413 bp, Artificial Sequence
  Description of Artificial Sequence: Synthetic coding sequence
atgggcaaactgcatagtaaaccggcagcagtctgcaagcgcagagagtctcccgagggggattccttcgccgtgagcgcggcatgggcaagaaaaggtatcgaagagtggattggaagacagcgctgtccaggtggcgtttctgggcccagacagctacgcctcgccggcacaattgggcgttccacacgagaactagtgggggacgttcttagagataccttatctgaagaagaagaggatgactttcgtctggaagtggccctgcccccagaaaagacagacggcctggggagcggtgacgaaaagaagatggaaagggtgagcgagccttgtcctggctccaagaaacagttaaaatttgaagagctacagtgtgatgtgtctatggaagaggattctcgtcaggagtggacctttacactttatgattttgataacaatgggaaggtgactagagaggacataacttcgctgctccacaccatttatgaagtagtggatagttcagtgaaccactcacctacaagttccaaaatgcttcgagtcaagctcactgtcgcacccgatggctctcagtcaaaacgcagcgtcttggtgaatcaggcagacctgcagtcagcacgcccacgggctgagacaaaacccacggaagatctgagatcctgggaaaagaagcagcgggctcccctgagatttcaaggtgattcccgcctcgagcagtccggctgttaccaccactgcgtggatgagaacattgagcgccgaaaccactacctagacttagcaggcatagagaattacacctctcagttcggcccaggcagccccagcgtggctcagaaatccgaactgccgccccgcacatctaatccgaccagaagcaggagccacgagcctgaagctatccacatcccacaccggaagcctcagggggtggacccagcttctttccactttctcgacacccccattgctaaggtttctgagctccagcagagactccgcgggacccaggatggatccaaacacttcgtgagatcacccaaagcacagggcaaatcggtcggggtgggccacgtggcacgcggggcgcgcaacaaaccaccccttggtcccgccatcccagcggtttcccctagcgctcatctggccgcctcgcccgccctcttacctagtctagcacccctgggccataaaaagcacaagcacagggcaaaggaatctcaacaggggtgcaggggccttcaggcacctctcgctagtggaggccccgttctagggcgggagcacctgcgtgagctgcccgccctggtcgtgtacgagagtcaggcaggacagcccgtgcaaagacacgaacaccaccatcatcacgaacatcaccatcactatcaccacttttaccagacatag

SEQ ID NO: 28014 - DNA, 1356 bp, Artificial Sequence
  Description of Artificial Sequence: Synthetic coding sequence
atgggtaagctgcagagtaagcatgcagcggctgcccgaaaacggcgggaaagccctgagggggattcatttgtggctagcgcgtacgcctcaggcagaaagggtgctgaggaggcagagagaagagcgcgcgacaaacaggagctccctaatggagatccgaaagaaggccctttccgcgaggatcagtgccctcttcaggtcgccctgccggccgaaaaagccgagggcagagagcatccagggcagctgctttctgctgacgatggtgagcgagcagctaatcgggaaggaccccgggggcccgggggtcagcggctcaatattgacgctttacaatgcgatgtgagcgttgaagaggacgatcgccaagagtggacgtttactctgtacgactttgacaactgcggaaaagttacccgcgaggacatgtcctcactgatgcatacaatttatgaagttgtggatgcgtcagtcaatcatagtagtggctcttcaaaaactctacgagtaaaactgacagtgagccctgagccttctagcaagcgcaaagagggaccgcctgcgggccaagaccgtgaaccgaccaggtgtagaatggagggggaactggccgaggaacctagggtggccgatcggcgcttgagtgcacatgtcagacgcccgagcacagacccccaaccttgttcggagcgcggaccgtactgcgtcgatgaaaacacagagcgacggaaccactacctcgacctcgcaggcattgaaaattatacttctaggttcggacccggatcaccgcctgttcaggctaagcaggagccccagggccgcgcgtcgcaccttcaggcccggtccagaagtcaggaacctgacactcacgccgttcatcaccgacgcagccaggttcttgttgagcacgtagttccagccagcgagccagctgcgagagcgctcgatacccaaccccggccgaaaggaccagagaagcagtttcttaaaagcccaaaaggcagcggtaaaccaccgggagtaccagcatcctcaaagtccggcaaggccttcagttattaccttcccgccgtgttacctccacaggcccctcaggatggacaccatttgccacagcctcccccccctccctatggccacaaacgttaccggcaaaagggccgggaaggccattcacccctgaaggccccccatgcccaacctgcaaccgttgagcatgaggtagtgcgagacctcccacccactcccgccggcgaaggatatgctgtgcccgtgatacagagacatgaacatcatcatcaccatgagcaccaccaccatcatcaccatcatcatttccacccctcctag

SEQ ID NO: 28015 - DNA, 507 bp, Artificial Sequence
  Description of Artificial Sequence: Synthetic coding sequence
atggccggcagcgtcgataacaggcagtgcggacgccagggcagacagtgcggacaacagacagtaagtactgcagggtccgtggatggcaggcaagccgtgtggatggctgggagtgtggacgcttgccatagcggcgctcgcggcggagcgggtcccgctgcacacgcaagtaggcgaggcttgcgtggcgctagcgacccagccgcgagggcacctccccccccaagagcccctcccccccctcctccaccaccactgcccccagtgcttgcaccattaccaagcaccccgaggtcacagcataccaccgctcgcgacctaagagccggcagccgcgcagctgctggatgcgtgcctatgggctcccctgcaccaactccccatcttaggcaacagacagcaacggattgccgctgctggcatgatggcggaggggcaccgtggaccagaggccaaggccccggggccctctgttctagtgcgctggacgcaacttggaggtag

SEQ ID NO: 28016 - DNA, 936 bp, Artificial Sequence
  Description of Artificial Sequence: Synthetic coding sequence
atgggcaagttgcagtccaagcacgcagcagccgcaagaaagcggcgtgagtcccccgaaggcgacagctttgtcgcctcagcctacgcctccggtagaaagggagccgaggaagcagagcgaagggctagagataaacaagaactccccaacggcgacccaaaagagggcccgtttcgcgaggaccaatgtccactgcaggtcgccttgcccgccgaaaaagccgagggccgcgagcatccaggccagttactttccgctgatgacggcgagagggctgctaaccgagaggggccgcgaggtcctgggggccaaaggctgaacatcgacgccttgcagtgcgacgttagcgtggaagaagacgaccgccaggaatggacttttactctgtacgattttgataactgtggcaaagtgacaagggaggacatgagtagcctcatgcatactatctacgaagtcgtcgacgccagcgtcaatcattcaagcggaagcagcaaaacattgagggtgaaactgacagtgtctcccgaaccctcaagcaaacggaaggagggtcctccagccggtcaggacagggagccaacccgttgccgaatggagggagagctcgcggaggagccacgggtcgcggaccgaaggctaagtgctcacgtgcgaaggcctagtaccgacccacaaccatgttctgagagaggaccctactgcgtggatgagaacaccgaaagaagaaaccactacctggatctagctggcatcgagaattacacatccagatttggccccggcagccagctgtgtgagaaacgaagttctgccccccgcacacattcaggggacaaggccaggggcgtgggactgtgtcgggaactctggagccaggctggccatccgcagtggccagggcctttccccagcgggctggtggcagtttag

SEQ ID NO: 28017 - DNA, 936 bp, Artificial Sequence
  Description of Artificial Sequence: Synthetic coding sequence
atgggtaagctccagtccaagcacgctgccgccgccaggaagcgccgtgaatctccagagggcgatagtttcgtggcatctgcctacgcctccggacgaaagggtgcagaagaagcagagcgaagagccagggataagcaggagctgccaaatggggaccccaaggagggcccttttcgcgaggaccaatgtccactccaggtggctctgccagccgagaaggctgagggaagagaacaccccgggcagcttctttccgctgacgatggagagcgagcggcgaatagggagggaccacgcggtccagggggacagcggctgaatatcgacgcgttgcagtgcgatgtgtccgttgaagaagatgatcgccaggaatggacattcacattatacgacttcgacaactgtgggaaggtcacacgggaagacatgtccagcttgatgcacacaatctatgaagtggtggacgcctccgtgaatcacagctccggtagttcaaagacactgcgggtcaagcttaccgtttctcctgaaccttcctccaaaagaaaggaagggccccctgctggacaggacagggaacccacaagatgtaggatggaaggcgagcttgcagaggagccgcgtgtggctgatcgtcgactatccgcacatgttcgccggccgtctactgatccacagccctgttctgagcgcggaccatactgcgtggacgagaatacagagagaaggaaccactatctggatctggccggtattgaaaactacacgtctcggtttggtcctggctctcagctgtgcgagaagcggtcctcagctccccgaacacattccggcgataaagcacggggcgtgggactatgccgggaactctggagtcaggccggccatccacagtggcctggaccttttcccagtggattggtggccgtttag

SEQ ID NO: 28018 - DNA, 438 bp, Artificial Sequence
  Description of Artificial Sequence: Synthetic coding sequence
atgcctggtgtgacggttaaagatgtgaaccagcaagaattcgtgcgcgccttggcagcattcctgaaaaagagtggcaaactcaaagtgcccgaatgggtcgacacagtcaagctggcaaaacacaaggaactcgccccttatgatgaaaattggttttatacacgtgccgctagtacggcacgacacctgtacttgcggggaggcgctggagtgggtagtatgactaagatctacggaggacgccagagaaacggggtgatgcctagtcatttcagtagaggaagtaagtctgtggccagacgggtgcttcaggccctggaaggactgaagatggttgagaaggaccaagatggaggtagaaaactgacccctcagggccaacgcgatctggacagaattgccggccaggtggctgccgctaacaagaagcattag

SEQ ID NO: 28019 - DNA, 1134 bp, Artificial Sequence
  Description of Artificial Sequence: Synthetic coding sequence
atggccgaagaagtcgtagtggtagcaaagttcgactacgtcgcgcagcaggagcaggaacttgacattaagaaaaacgaacgtctgtggctgctggatgattcgaaatcttggtggcgcgtgcgaaacagcatgaataagaccggatttgtgccgagcaactacgttgagaggaaaaatagcgcccggaaagcgagtatagtcaagaaccttaaagacactttagggataggcaaagtgaagaggaagccttcagttccagattcagccagccctgccgacgactcattcgtcgatccaggtgagaggttgtacgacttaaatatgccagcttacgtgaaattcaactatatggccgaaagggaggacgagctctctctaatcaaagggacaaaagtcattgtgatggagaagtgttcagacggttggtggaggggctcctacaacggtcaagtaggatggttcccctccaactatgtaacagaggaaggggatagcccactgggagatcacgtggggtctctgtccgaaaagctggccgccgttgtgaataatctgaataccgggcaggtactccatgtagtgcaggctttatacccattcagctctagtaatgatgaggaattgaatttcgagaagggagatgtgatggacgtgattgaaaagcccgaaaacgacccggaatggtggaaatgcagaaagataaatggaatggttgggctggtgcctaagaactacgttaccgtgatgcaaaataacccacttaccagcggccttgagccttctcctccacagtgcgattatataagaccctcgcttactggtaagttcgctgggaacccctggtattacgggaaggtgacaagacatcaggccgagatggcactcaacgaacgcggtcatgagggagatttccttataagggattcggaatcttcacccaacgatttcagcgtgagtctgaaagcacagggaaagaataaacattttaaagtgcagctcaaagaaactgtatactgcattggccagaggaaattcagtactatggaggaactggtagaacactataaaaaggctcccatattcacatccgaacagggtgaaaagctgtacctggttaaacatctgtcctag

SEQ ID NO: 28020 - DNA, 228 bp, Artificial Sequence
  Description of Artificial Sequence: Synthetic coding sequence
atggccgaggaagttgttgtggtggccaagttcgactatgttgcccaacaagagcaagagctcgacatcaagaagaatgagcgcctctggctgctcgatgactccaagagctggtggcgggtaaggaatagtatgaataagaccggtttcgtcccatccaactatgtcgagcgcaagaactctgcgaggaaggcttcaatagttaaaaaccttaaggacaccctgtag

SEQ ID NO: 28021 - DNA, 1134 bp, Artificial Sequence
  Description of Artificial Sequence: Synthetic coding sequence
atggccgaagaggttgtcgtcgtggccaagttcgattacgtggctcagcaggaacaggaactcgacattaagaaaaatgagcgcctttggctgctggacgacagcaaaagctggtggagagtgaggaactccatgaacaaaaccggattcgttccttcgaactatgtggaacgtaagaatagcgctagaaaggccagtatcgttaaaaacctgaaggacactctgggaattggcaaagtcaagaggaaaccgagcgtgcccgatagtgccagcccagcagacgactcctttgtcgatccgggagaacgattgtacgatctgaacatgcctgcctacgtgaagtttaactacatggctgagcgagaggacgagctctctttgatcaaggggaccaaagttatcgtgatggagaaatgttcagacgggtggtggaggggcagttacaacggacaggtcggatggttcccttccaactacgtgacggaagaaggagacagcccactcggtgatcacgtcggtagcctgagcgagaagctggctgccgtggttaataacctgaatacaggtcaagtcctccacgtggtccaggctctttacccattttcatcctcaaacgacgaggagctgaatttcgaaaaaggcgatgtgatggacgtgattgagaaaccagagaacgatccggagtggtggaaatgtaggaaaattaacggtatggtcggactcgttcccaaaaactatgtgacggttatgcagaacaacccattgactagtggtctcgaaccaagccctccgcagtgcgactacattagaccctcccttacgggaaagttcgccggaaatccttggtactacggaaaggtcactcgccatcaggccgagatggccctgaatgagcggggacacgaaggggacttcctgatcagagacagtgagtcaagcccaaatgatttctctgtgtcacttaaggcacaagggaaaaacaaacacttcaaggtccagctgaaggagacggtatactgtattggacagcggaagttttcaaccatggaggagctggtggaacattataaaaaggcacctatcttcacgtccgagcagggcgagaaactttacctggttaaacatctcagctag

SEQ ID NO: 28022 - DNA, 348 bp, Artificial Sequence
  Description of Artificial Sequence: Synthetic coding sequence
atggccgaggaggtagtggttgtggcgaaatttgattacgtcgcccaacaagagcaggaattggatatcaagaagaatgaacgcctgtggttgttggatgacagcaaatcctggtggagagtgagaaactccatgaataagaccggtttcgtgccttctaattacgtcgaaagaaaaaattctgccagaaaagcctccattgtgaagaatctcaaggatactctgggtatcggtaaagtgaaacggaagccctcagtgcctgacagtgcatcccctgctgatgattctttcgtggatccaggggagagattatacgatctcaatatgccggcgtacgtgaagttttag

SEQ ID NO: 28023 - DNA, 390 bp, Artificial Sequence
  Description of Artificial Sequence: Synthetic coding sequence
atggcagaggaggtggtggtggtggcaaagtttgactacgtggctcagcaagaacaggagctggatatcaagaagaacgaacgcctttggcttctcgacgactcaaaatcatggtggagagtccgaaattctatgaataaaaccgggtttgtcccgtcaaactacgtggaacgaaagaactctgctcgtaaggcgtctattgtcaagaatctgaaggacacccttggcattggaaaagtcaagcgcaagccatccgtccccgactcagcctcccctgccgacgactcctttgtggatcctggagagcgcttatacgatctcaacatgccagcctacgtaaaatttaactacatggcggagcgcgaagatgagctctcattgattaaatag

SEQ ID NO: 28024 - DNA, 942 bp, Artificial Sequence
  Description of Artificial Sequence: Synthetic coding sequence
atggactggttgaatgtcttcaaggatttcttttccataggtaaagtgaagcgcaaaccatcagtgcctgacagcgccagtccggccgatgatagcttcgtagatccaggtgagcgcttatatgatctgaatatgccggcctacgtgaagtttaattatatggctgagcgagaggatgaactcagcttgataaaaggcacgaaagtgatcgtaatggaaaagtgtagcgatggatggtggcgtggtagttacaatggacaagttggctggtttccctctaactatgtgacagaggaaggcgacagcccactcggagaccacgtaggctctctgtcggagaagctggctgctgtggtgaacaacctgaatacaggccaggtgctccacgtagtgcaggcactgtaccccttctcaagtagtaatgacgaagaactgaactttgagaaaggggacgtgatggatgttatcgaaaaacctgagaatgatccagagtggtggaagtgtagaaagataaacggcatggtgggactggtacctaagaattatgtgacggtcatgcagaataacccattgacatccgggctggaacctagcccccctcaatgcgattacattcgtcctagcctaacagggaagttcgccggcaacccatggtactacggcaaagtaactaggcatcaggcggagatggccttgaacgaacggggtcatgaaggagatttccttatcagagatagcgagtcgagtccgaatgacttcagcgtttcactgaaggcacaaggaaaaaataagcactttaaggtgcaactgaaagagacagtgtactgcatcgggcagcggaaattctcgacaatggaggagctcgtggaacattataaaaaggccccaatatttacctccgagcaaggagaaaagctgtacctggtgaagcatctcagctag

SEQ ID NO: 28025 - DNA, 3384 bp, Artificial Sequence
  Description of Artificial Sequence: Synthetic coding sequence
atgtccttgacaagcgcataccaacataagcttgctgagaagctgaccatcttgaatgacaggggacagggtgtcctcatacggatgtacaacatcaaaaagacctgctccgacccaaaaagtaagccaccgtttctgctggagaaaagcatggagcctagcctaaagtacattaacaagaaattccctaacattgacgtgcgcaactctacccagcacttgggacccgtccaccgggagaaagctgagattattagatttcttaccaactactatcaaagcttcgtcgacgtcatggagtttagagatcacgtgtacgaacttctgaataccatcgatgcctgtcaatgtcattttgatatcaatttaaatttcgactttacacgatcatatctggacctgatagtcacatataccagcgtgattttgcttctgagcaggatcgaggaccgacggattttaataggcatgtacaattgtgctcacgagatgctccacggacacggcgatcctagtttcgctcgccttggtcagatggtcctggagtacgatcaccccctgaagaagctcactgaagagtttggacctcacacaaaggcagtaagtggagccctcctgagcctgcactttctattcgtccgtcgcaaccagggagctgaacagtggaggtcagcacagctcctgtccctgatttccaacccgcctgcgatgatcaaccctgccaattcggacactatggcatgtgaatatttgtctgtggaggtcatggagcgctggatcatcattggcttcctgttgtgtcatgggtgtctcaattcaaatagccagtgccagaagctgtggaaactatgtctccaggggtctctgtatatcactctgatccgtgaagacgtgctccaggtgcacaaggtgaccgaagatcttttctcatcactgaaaggctatggcaaaagagtagctgacatcaaggagagcaaagagcatgtgatagccaactctgggcagttccactgccagaggaggcagttcctgcgcatggccgttaaggagctggagaccgtcttggccgacgagccaggtttgctgggccctaaggccctgtttgcttttatggccctgagcttcattcgagatgaagtcacctggttggtgagacacacagaaaatgtaacaaaaactaagactcccgaggattatgcggactcatctattgccgagctgctgtttctgctggaaggcattaggagcctagtccggagacacatcaaggtcattcaacagtatcatctgcaatacctggcccgctttgatgccctcgtgctaagtgatatcatccagaacctatccgtgtgcccagaggaagaatctatcatcatgtctagctttgtctccattctgtccagccttaacctaaagcaggtcgacaacggagaaaagtttgagttttcaggactgagactagattggtttcgactgcaagcttacacttccgtcgcaaaggcccccctgcacttacatgaaaatcctgatctggcgaaagtgatgaacttaatcgtttttcacagcaggatgttggacagtgttgagaagctactggtggagacatctgatttgagcactttctgtttccatctgagaatctttgagaagatgtttgccatgaccttggaggaatcagcgatgttgaggtatgccatagctttccccctaatctgcgctcactttgtccattgtacacacgaaatgtgtccagaggagtacccgcacctaaagaaccatggcctccaccactgcaactccttcctcgaggagctcgccaagcaaacctcaaactgtgtgctggagatttgtgccgaacagaggaatctatcagagcagcttctcccaaagcactgcgcgacgactatttccaaggctaagaataagaaaactcggaagcagcggcaaacccccagaaaaggggagcccgagagggataaaccgggggcagaaagccaccgcaagaatcgcagtatcgtgactaacatggataagctgcatctgaatctgactgagctggcactcacgatgaaccacgtctattctttttctgtgttcgaacacaccatttttccatccgagtatcttagttctcacttggaggcccggcttaatagagctatcgtatggctagccggctataatgctactactcaagaaatcgtgcggccatccgagctactagctggagtaaaggcttatataggctttatccaatctctggcccaattcctcggtgctgatgcatcccgtgtgattagaaacgctcttcttcagcaaacgcagcccctggacagctgtggggaacaaacaatcaccaccctgtacactaactggtacctggaatcactgctacgccaagcatcctccggaactatcatcctcagtccagctatgcaggcctttgtgagtctgccaagagagggagagcaaaatttttctgctgaagaattcagcgacatatccgagatgcgtgctctcgccgaactgttgggcccatacgggatgaaattcctgtccgaaaacctgatgtggcatgttactagccagattgtggaactcaaaaagttagtggtggaaaacatggatatactggtgcagatccgcagcaatttcagcaagcctgatcttatggctagtctgcttccgcaactcactggcgccgaaaatgttctgaaaaggatgaccatcatcggcgtgatcctgtcctttagggcgatggcacaagaaggccttagggaggtctttagcagccactgcccctttcttatggggcctatcgagtgcctgaaggaattcgtgacccccgatactgacatcaaggtcacactaagcatcttcgagctggcgtccgccgccggtgtggggtgcgatattgaccccgcattagtggctgcaattgccaatcttaaagccgatacttcctcccctgaggaggaatataaagtggcttgcttgctgctgatctttctggcggtcagcctgcccctcctggccaccgacccatccagcttctactccattgaaaaagatgggtacaataataacattcattgcttgacgaaggccatcatccaggtcagcgccgcattatttaccctctataataagaatattgaaacccacctaaaagagtttctggtggtggcctctgttagcttattacaactcggacaggagacagacaaattaaaaaccagaaaccgagaatcaatcagtctgcttatgagacttgttgtggaggagtcaagctttctgacattggacatgctagagtcatgcttcccgtacgtcctgcttaggaatgcctaccgagaggtctcccgggccttccatctgaattag

SEQ ID NO: 28026 - DNA, 3234 bp, Artificial Sequence
  Description of Artificial Sequence: Synthetic coding sequence
atggagccctctctgaaatatatcaataagaaatttcctaacattgacgtgaggaattctacacagcacttagggccagtccaccgagaaaaggccgagatcatccgcttcctcacaaattactatcagagctttgtcgacgtcatggagtttcgcgaccatgtatatgagctgctgaacaccatcgatgcctgccagtgccatttcgatatcaatctcaatttcgattttacacgatcataccttgacctgatcgtcacatatacaagtgtcatcctcttgttatctcgcatagaagaccggagaatattgatagggatgtataactgtgcccacgagatgttgcacggtcatggagatcccagcttcgcacgcctgggtcagatggtgctggaatatgatcacccactgaaaaaactcactgaggagttcggccctcacaccaaagccgtcagcggtgcactgctctcgctgcatttcctgtttgtgagacggaaccagggcgcagagcagtggaggtctgctcagctcctttccctgattagcaacccaccagctatgattaatccggctaacagcgacacaatggcgtgcgagtatctgagtgtggaagtcatggaacgatggatcataatcggatttctcctgtgtcatggctgtctgaacagcaattctcagtgtcagaagttgtggaaattgtgcctgcagggatcactttatatcacactgatcagggaagatgtgctgcaggtacataaggtcacggaggatcttttcagttctctgaagggatacggcaaaagggtggccgacattaaggagtctaaagaacatgttatagcaaactccggccagtttcactgtcagcggaggcagtttttaagaatggcagtgaaagagctggaaacagtgctggccgatgaacctgggctattgggcccaaaggcacttttcgcgtttatggccctctctttcatcagggatgaagttacatggctagtccgacatacagaaaacgttacaaagacgaagactcctgaggactacgcagactcgagcattgccgaattgctgtttctcctcgagggaatccgctccctggttagaaggcatattaaggtcatccagcaatatcaccttcagtacctggctcgcttcgacgcactggtcctgtccgacatcatccagaacttatctgtctgtcctgaggaagagtcaatcataatgagctccttcgtatcaatcctgtcttctctaaacttgaagcaagtggataacggcgaaaagtttgaattctccggattgcgtctggactggttcaggttgcaggcttacacaagcgttgcgaaggcacctctgcatctgcatgagaaccctgacttagcaaaggttatgaacctgatagtattccactcgcgaatgctcgacagtgtcgaaaagctcctcgtagagacatccgaccttagcaccttttgctttcacctgaggatctttgagaagatgtttgcaatgaccctggaggaatcagccatgctgaggtacgccattgcatttcccctaatctgtgcacattttgtacattgcacccatgagatgtgtcctgaggaatacccacacctgaaaaaccacgggctgcatcactgtaactcatttttggaggaactggccaagcaaactagcaactgtgtgttggagatttgtgccgagcagagaaatctgagcgaacaacttcttcccaaacattgcgctactaccataagtaaagccaagaataagaagacacggaagcagaggcagaccccccgcaagggagaaccggaaagggataagcccggcgctgaatcccatcgcaaaaacaggtcgattgtgacaaacatggacaaactccacctgaatttgactgagctggcccttacaatgaaccacgtgtactctttctccgtgtttgagcacacaatatttccatccgaatatctcagctctcacctggaggctaggctgaatcgggctatagtttggctagccggttacaacgccaccactcaagagatcgtgaggccatccgagctgctggcgggggtgaaagcctacatcggattcatccagtccctggcccagttccttggagccgatgcctcccgcgtcatcagaaatgcgctgctccagcagactcagcccttagacagttgtggggaacagacgattaccacactctacacaaactggtatctggaatcgttactcaggcaagccagctccggaaccatcatactgtctcccgcaatgcaggcttttgtctcgctcccgcgcgaaggtgaacagaattttagcgctgaagagttctcagacattagcgaaatgagagctctggctgagctcctgggcccctatggcatgaagttcctctccgagaaccttatgtggcacgtaacaagtcagatcgtagagcttaagaaactagttgtggaaaacatggatatcttggtgcagattcggagcaatttttccaaacccgatttgatggcctcactgctgccacagctgacaggcgctgagaacgtactgaaacgcatgacaattattggggtgatattgtcctttagagccatggcccaagagggattgcgggaagttttcagctcccattgccctttcttgatggggccgatcgagtgtttgaaggagttcgtcaccccagataccgatattaaagtcacgctctccattttcgaattggccagtgctgccggggtcggctgtgatatcgatcctgccctggtagctgccatcgcaaacctgaaggctgacacgtcctcccccgaggaagaatacaaagtcgcctgccttctgctgatttttctcgccgtttcactcccccttctggcaaccgatccaagctctttttattcaatagagaaggatggatataacaataacattcattgcctcacaaaggctattatccaggtgtctgctgcactttttaccctctataacaaaaacatcgagacccacctgaaagagttcctggttgtagccagcgtgagcctgttgcaattagggcaggagaccgacaaattgaaaacacgcaatagagaatccatttccctcctgatgcggttagtcgttgaggaaagctcctttttgacactggacatgctggagagttgtttcccatacgtgctccttagaaacgcttaccgggaggtttccagagcttttcatttgaactag

SEQ ID NO: 28027 - DNA, 2622 bp, Artificial Sequence
  Description of Artificial Sequence: Synthetic coding sequence
atgagcttcataatgaagttgcaccgccactttcagaggacggtcattctcctggccaccttttgtatggtctccattattatttcagcctactatctttactctggttataagcaggagaacgaactgtccgaaaccgcctctgaggtggactgcggagacctccagcatcttccttaccagctgatggaagtgaaggctatgaaattgttcgacgctagccgcacggaccccaccgtcctggtctttgttgagagtcagtactcgagcctcggccaagatatcattatgatcctggagtcttcgcgcttccagtaccacatagagattgctccggggaagggggacctgcctgtcctgatcgataagatgaagggcaaatatattctgataatttatgaaaatattctgaagtatattaacatggatagttggaaccggtccctgctcgacaagtactgtgtggaatatggtgtgggcgtgatcggctttcataagaccagcgaaaaatcagtgcagagctttcagttgaaggggtttcctttttctatctacggaaacctggcggttaaggattgttgcatcaacccgcactcgcccctgataagggtcaccaagtcctcgaagcttgagaagggttcattgccgggcacagactggaccgtttttcaaatcaaccattccgcctatcaacctgttattttcgccaaggtcaaaactccggaaaatctgtctcctagcataagcaagggcgccttttacgccactatcattcacgacctagggcttcatgacggcatccagcgggtccttttcggtaacaatctcaacttttggctgcacaaactaatttttattgatgcaataagctttttgtctgggaagcgcctgaccttgagcctggacaggtatatacttgtcgacatcgacgacatttttgtgggcaaggagggaacccggatgaatactaacgatgtgaaggcgttgctggacactcaaaatctcctcagggcgcaaatcaccaatttcacattcaacctggggttcagtggcaagttttatcataccgggaccgaggaggaagatgagggtgacgactgcttgctgggcagcgtggacgaattctggtggttcccccacatgtggagccatatgcagccgcacctttttcacaatgaatctagcttggtcgaacagatgattctgaacaagaagttcgcactggaacatggcattcctacagacatggggtatgccgtagccccccatcattcaggggtgtacccggtgcacgtgcagctgtatgaggcctggaagaaagtctggaacattaagatcaccagtactgaggagtatccacacctgaagccagctcggtatcgacgaggctttatccataaaaacatcatggtgcttccccgacagacatgtgggctctttacccataccatcttttataaagaatatccaggtgggccaaaggagctggataagtccattcaaggaggagaattatttttcactgtggtgctaaatcctatctccatttttatgacacacctgagcaattacggcaatgatcgtctaggtctgtacacattcgtgaacctggccaatttcgtcaagagctggacaaacctgcgcctgcagacactgccgccagtgcaacttgcgcacaagtattttgagttgttccccgaccagaaagaccctctgtggcagaatccctgtgatgacaagcggcatagagacatctggagcaaggagaaaacttgtgataggttacctaagtttttggtaataggaccgcaaaagaccggaacgactgccctgtatctctttctcgtcatgcacccgtctattttaagtaattcgccatctccaaagaccttcgaggaggtgcagtttttcaatcgcaataactaccaccgaggaatagattggtacatggattttttccccgtaccgtctaatgtgacgacagactttctgttcgagaagagcgcaaactattttcatagcgaggaagcaccaaagagagccgcctcactagtgccaaaggcaaagataattacaattttaatcgaccctagcgaccgagcctactcttggtatcagcaccaaaggagtcacgaggatcctgccgcattgaaattctctttttacgaggtcatcagcgctggcccccgcgctccttcagagctgagggcgctgcagaagaggtgcctggtcccaggatggtatgcgtcccacatagaaagatggctggtctactttccaccttttcagctcctgatcatcgatggtcagcagctgcggactgatcctgccactgttatggatgaagttcagaagtttttaggcgtgctgccacactacaattatagcgaagccctcacattcgactcccataagggtttttggtgtcagctgctagaagaagggaagacaaagtgcctaggaaaatcaaaagggagaaagtatccccctatggatagcgacagccggacatttctatcttcatattatcgtgatcacaacgtggaactctctaaactgttgcacaagttggggcaacctctcccctcgtggctgaggcaagaactgcagaaagtccggtag

SEQ ID NO: 28028 - DNA, 1686 bp, Artificial Sequence
  Description of Artificial Sequence: Synthetic coding sequence
atgagcttcattatgaaacttcataggcactttcagcggactgtgatcctgctggcaactttctgtatggtgagcatcataatttccgcatactatctctattctggatataagcaggagaacgagctctccgagaccgccagcgaagtcgattgcggtgatctccagcacctcccataccaactgatggaggtgaaggccatgaaactgttcgacgcatcgaggacagatcccaccgtgttggtttttgtggaatcacagtatagcagtcttgggcaggacatcatcatgattctcgagtcctctcggtttcagtatcacatagaaatcgcccccggcaaaggagatcttcctgtgttgatagataagatgaaggggaaatacatcctgattatctacgagaatatactgaagtatattaacatggattcctggaaccgctccctcctggacaagtattgcgtggagtatggggtgggggttatcggattccacaaaacgtcggagaaatctgtacagagctttcagctgaaaggcttccccttctctatctatggaaatctagcagtcaaggattgctgtattaacccccacagccccttgattagggtgacgaaatccagtaaactggagaagggctcattgccgggtaccgactggacagtcttccagatcaaccactctgcatatcaacccgtaatcttcgcaaaagtcaagaccccggagaatcttagcccttctatctccaagggtgccttttatgctactatcatacatgatcttggtctccatgatggcatccagagagtgttatttggaaataaccttaacttttggctccacaagttaatttttatcgatgccatctcctttctatctgggaaaagactgactctctcactggataggtatattttggttgatattgatgacatctttgtgggaaaagagggcacaaggatgaataccaacgatgtgaaggagcatggaatccctacggatatgggctatgcagttgccccacaccattctggggtatatcccgtgcacgtgcagctgtacgaagcatggaaaaaggtgtggaacattaagatcactagtacggaggagtatccccacctgaagccagctaggtatcgcagaggcttcattcacaaaaatattatggtgctgccacgccagacttgtggtctgttcacacacaccatcttctacaaggagtaccctgggggccccaaggagctcgacaagtccatccaaggcggtgaactgttctttaccgtggtcctgaaccctataagcatatttatgacccatctatccaactacggcaacgacagattgggactctacacctttgtgaatctagctaatttcgtcaagagttggaccaacctgcggcttcagacattgccacccgtccagctcgcccacaagtattttgagctatttccagaccagaaagaccctctctggcagaacccgtgcgatgataagcgtcaccgcgatatttggagcaaggaaaagacatgcgatcgcttgcctaaatttctcgtgatcggcccacagaagacaggaacaactgcattgtacttgtttcttgtgatgcacccaagcatcttaagcaatagtcccagccccaaaacattcgaagaggtgtacggtttcctgccctcacccatatag

SEQ ID NO: 28029 - DNA, 2619 bp, Artificial Sequence
  Description of Artificial Sequence: Synthetic coding sequence
atgaaccttattgtcaagctgaggcgatcgttccggacactgatcgttttactggccactttttgcctcgtctctatcgtcatttcagcctatttcctctactctggctataaacaggaaatgacgctgattgagacaacagccgaggcggagtgtaccgatatcaaaatcttgccataccggagcatggagttgaaaaccgtgaaacccattgatacctctaagactgaccccactgttctgctcttcgtggagagtcaatacagtcagctcggccaagacatcatcgcaattcttgagagtagcagattccagtaccacatggtgattgccccaggcaagggcgacatcccgcccctgactgacaacggcaagggtaagtatactctggttatttacgagaacatccttaagtacgtgtccatggactcttggaatcgtgagttactcgagaagtactgtgttgagtactcagttagcataattggcttccataaagccaacgaaaattcactgccctcaacacagctgaagggcttccctctcaatctgtttaataacctggccctgaaggactgcttcgtgaatccacaatcacctctcctgcacatcactaaggccccaaaggtggagaagggccccctgccaggagaggattggactattttccagtataaccactctacctaccagcctgtcctcttaaccgaactccagacagagaaatctctttccagtctctccagtaagacacttttcgcaacagtgatccaggacttaggactgcatgatggtatccagagggtcctgtttggaaacaacctgaacttttggttgcacaaactgatcttcatcgacgccattagttttctctccggcaagaggctgactctgagcctcgacagatacatccttgtggatattgatgatatctttgttggcaaggagggtactaggatgaatgtcaaggacgtcaaagccctgcttgaaacccagaatctcctccgtactcaggtcgctaatttcacttttaacttgggattttctggcaaattttatcataccggaaccgaagaggaggatgaaggcgacgatctgttgttacggtccgtggatgaattttggtggttcccccatatgtggagtcacatgcagccccatctctttcacaatgaatcttcactcgtcgaacagatgattctgaacaaagaattcgccctggagcacggaataccaatcaatatgggatacgcggtggctcctcaccactccggagtatatcctgtgcacattcaactctatgcggcttggaagaaggtgtggggcatccaggtgacaagcaccgaagaatatccccacctgaaacctgctcgatatcgaaaaggcttcatccataactcaattatggtgttgccccgtcagacttgtggtttattcacgcatacgatcttttataaagaataccctggcggcccacaggaactagacaagtctattagaggcggcgagctcttcctgactattcttctgaatccaatcagtatctttatgacacatctgagcaactatggcaacgacaggctggggctgtatacattcgttaatttggttaactttgttcaaagttggactaatttaaaactccagacgctgcctcccgtgcagctggcacatcagtacttcgagctgtttccggagcagaaagatccactttggcagaacccatgtgacgacaaacgccataaggacatttggtcacgggagaagacctgtgatcatctccccaagtttctcgtgatcgggcctcagaagactggcacaaccgcactttacctgttcctactgatgcaccccagtattatttctaacctcccttcacctaagacattcgaggaggtgcagtttttcaacggaaacaattaccacaagggcatagattggtatatggacttttttcccaccccctcaaatacgacctccgacttcctgtttgagaagtcagcaaactactttcatagtgaagaagccccacgcagggcagcatccctggttcctaaggctaaaattattacaatccttatcgatcccagtgatagagcttactcatggtatcagcaccagcggtcccacgaagacccagccgccttaagattcaatttttatgaggtgatatcaactggccattgggcgcctagtgacctgaagactctgcagcggcgatgcctggtgccggggtggtacgccgtccatatcgagcgctggctaacctacttcgcgacgagccagctgctcataattgacggccagcagctgaggtctgacccagccacagtgatggacgaggtgcagaagttcctaggcgtgacacctcgctacaattattccgaggctttaacttttgacccccagaaaggattctggtgccaactcctggaaggaggcaagactaaatgtctcggcaagtccaaaggacgaaagtatccccccatggaccctgaaagtaggacgttcctcagcaattactatcgcgatcataacgttgagttgtctaaacttcttcaccggctaggccagcccctgccctcttggctgagacaggagttacagaaggtaagatag

SEQ ID NO: 28030 - DNA, 1635 bp, Artificial Sequence
  Description of Artificial Sequence: Synthetic coding sequence
atggcgacagcacctggcccagctgggattgctatgggctctgtggggtccctgctagagagacaggatttcagccctgaggagctaagggccgcactagcagggtcccgaggatctcgccaacctgacggacttctgcggaagggattgggtcagagagagttcttgtcttacttgcacttgcccaagaaggatagcaaatccactaagaatactaagcgggccccgcgcaacgagcccgccgattacgcgacactctactatcgagaacattcccgagcaggagactttagtaagacctccctcccggaaagaggcagattcgacaaatgcagaattaggccatctgtgtttaagccaacagccggtaacggcaaaggcttcctctcaatgcagtcgctcgcctcccataagggacaaaaactgtggcgtagtaatgggtcactgcacaccttggcctgtcacccgccgctgtctcccggtcctagagccagtcaggcccgcgctcagctcctgcacgcgctctctctcgacgagggcggaccagagccagagccctcactgtccgacagttcgtccggggggtccttcggccgctcacctgggaccgggccttctccttttagcagctcactaggccacctcaatcacctaggcggaagtcttgatcgcgctagccagggcccgaaggaggccgggcccccagcggttcttagctgcctacccgaacctcccccaccttacgagttttcttgctccagcgccgaagaaatgggcgcagtcctgcctgaaacgtgcgaagagctgaaacgcggtcttggtgacgaagatggctctaatccatttactcaggtcctcgaggagcgtcagcgactctggttggcggagcttaagcggctgtatgtggagcgcctccacgaggtcacccagaaggctgagaggtctgagcggaaccttcaattgcaactctttatggcacaacaggaacaacgtcgcctgagaaaggagctcagagcccagcaagggctggcccccgagcccagagcccctgggactctgcccgaggcagacccatctgctagacctgaagaagaggcgagatgggaagtgtgtcagaaaacagcggagatttccctactcaagcaacagctgcgagaggctcaggctgaactagcccagaagttggcagagattttttctttgaaaactcaactgcgggggagccgggctcaggcgcaggcacaggatgctgaactggtgagactgcgcgaggctgtgcgctcacttcaggagcaggcccccagggaagaggcgccgggctcttgtgagacagatgattgtaaaagtcgcggcctcttgggtgaagccggagggtctgaggcccgtgactctgccgaacagctgcgagctgagctgctacaagagaggttaaggggccaggagcaggctctgcgcttcgagcaggagcgccgcacctggcaggaggaaaaagaaagagtcctccggtatcagcgggaaatccaaggagggtatatggatatgtacagaaggaatcaggccttagaacaggagctccgtgcactgcgagaaccgccgactccctggtcccccagacttgaatcttccaagatatag

SEQ ID NO: 28031 - DNA, 939 bp, Artificial Sequence
  Description of Artificial Sequence: Synthetic coding sequence
atggccgcccaaaaaatcaatgagggactggaacacttagccaaagctgaaaaatacttgaagaccgggttcttgaaatggaagccagattacgattcagccgctagcgagtacggcaaagccgccgttgcgtttaagaatgcaaagcagttcgaacaggccaaggacgcgtgtctaagggaggccgtggcacatgagaataaccgagctctgtttcacgctgcgaaggcctatgaacaggccggcatgatgcttaaggagatgcagaaactgcccgaggcggtgcagctgatcgaaaaggcctcaatgatgtacttggagaatggcactcccgatacggccgccatggccctagaacgcgccggcaaacttatcgaaaatgtggaccctgagaaagccgtccagctgtaccagcaaacggccaacgttttcgagaacgaggagaggctaagacaggcggtcgagctgctgggcaaagcgtcgagattgttggtgcggggtcgtagatttgacgaggcggccctgtccatccagaaagaaaagaacatttataaagagatagaaaattaccctacgtgctataagaaaaccatcgcccaggtgttggtgcatctccaccgcaacgattacgtcgctgcggagagatgcgtaagagagtcctattccatcccaggctttaatggctccgaggactgtgccgctctcgaacagttgcttgaagggtatgaccagcaagaccaggatcaggtgagcgatgtgtgtaacagcccactctttaaatatatggataacgattatgctaagcttgggctgtcccttgtagtcccgggcggcggaataaaaaaaaagtccccagcgacaccacaggccaagcctgatggcgtaacagctacggctgctgatgaggaagaagacgagtactcaggcggcctgtgctag

SEQ ID NO: 28032 - DNA, 693 bp, Artificial Sequence
  Description of Artificial Sequence: Synthetic coding sequence
atgatgctcaaggagatgcagaaactacctgaagctgtgcaactgattgagaaagctagtatgatgtacttggaaaacggcacccccgataccgccgccatggctctggaaagggctggtaaactgattgagaatgtggacccggaaaaggctgttcagctctaccagcagactgccaacgttttcgagaacgaagaaaggctgcgccaggcggtagagcttctaggtaaggccagtcggctcctggtgagaggccggaggtttgatgaggctgccctctcaatacagaaagagaaaaatatttataaagaaattgagaactaccctacttgctataagaagaccattgcacaggtgctcgtgcatttacatcggaacgattatgttgcagcagagcgctgcgtgcgggaatcttacagtatccctggctttaatggtagtgaggattgcgcagcattggagcagctccttgaaggctacgaccagcaggaccaagatcaggtgtctgatgtgtgcaacagcccgctctttaagtacatggacaatgactatgctaaattaggccttagcttagtggttccaggaggcgggattaagaagaagtcccccgcaacaccccaggccaaacctgacggtgtcaccgctacagcagctgatgaagaggaggatgagtatagcgggggcttatgctag

SEQ ID NO: 28033 - DNA, 1611 bp, Artificial Sequence
  Description of Artificial Sequence: Synthetic coding sequence
atgcttcatctccttgccttgttcctgcattgtctccctctggcgtccggggactacgacatttgtaagagctgggtcactaccgatgaaggtcctacttgggagttctacgcttgtcagcccaaggtgatgagactcaaggattacgtcaaggtaaaagtagagccttcaggtatcacttgcggtgaccctccagagcgcttttgttctcacgaaaatccttatctgtgctcaaacgaatgtgacgcctctaaccccgatttggcccatcctccccgcctgatgtttgataaggaggaggagggccttgcaacatactggcagagcataacctggtcacggtatccatccccgctggaggccaatatcacattgtcctggaataagactgtagagttaacagatgacgtggttatgacattcgagtacgggaggcctactgtcatggtactggaaaagtctctggacaatgggaggacatggcaaccctaccagttttacgccgaggactgcatggaggcctttggaatgagcgcccggcgcgcccgcgatatgagtagctcttccgcccatagagtgctgtgcaccgaagagtatagccgttgggcaggatccaagaaagagaaacatgtccgattcgaggttagagatcggttcgcaatcttcgccggtcctgatctgagaaacatggacaatttgtatacacgcctcgaaagtgcaaaagggctgaaagagttcttcaccctgacagacctgaggatgaggctgctgcgccccgctttaggtggaacgtacgtgcaaagggaaaacctgtacaaatatttctatgctatcagcaacatcgaggttatcggacggtgcaagtgtaatctccatgccaacctctgtagcatgagggagggctccttacaatgcgaatgcgagcacaacacaaccggacccgattgcgggaagtgcaagaagaatttcaggacgcgctcctggcgagccgggtcctatctcccactcccacacggtagccctaatgcatgtaccgcccccagcggaactttttccaaagatgctttcttgcactgcgagtgctatgggcattcaaatagatgttcctacatagacttccttaacgtagtgacttgtgtctcttgcaaacacaacacacgagggcagcattgccagcactgtcgcctgggatattaccgcaatggatccgccgagttggacgacgagaacgtatgcattgagtgtaactgtaaccagatcggatctgtgcatgacagatgcaatgagactggattttgcgaatgcagagaaggcgcggccggcccaaaatgtgacgactgtcttccaacacactattggagacaggggtgctatccgaacgtctgcgatgacgatcagctgctatgtcaaaacggtggtacatgtctgcagaaccaacggtgtgcatgcccgaggggctacacaggggtgcggtgtgaacagccaagatgcgacccagcagacgatgatgggggattagactgtgacagagccccaggggccgctcctcgccctgccactcttctcgggtgcctgctgcttctgggcctggctgcacggttggggcgctag

SEQ ID NO: 28034 - DNA, 1269 bp, Artificial Sequence
  Description of Artificial Sequence: Synthetic coding sequence
atgctgcatttgctggccctgttcctgcattgcctgccgctagcatcaggtgactacgacatctgtaaatcctgggtgactactgacgaagggccaacatgggagttctatgcttgccagccaaaggtcatgcgcctgaaagactacgtgaaggttaaagtggagccctcgggaatcacatgcggtgaccctcccgaacggttttgttcccatgaaaacccttatctttgcagtaacgagtgtgatgcaagtaatccagacttggcccaccccccacgtctgatgtttgataaggaagaggaaggattagccacatactggcagtcaatcacttggagtcgttacccttctcccctggaagctaacatcactttatcatggaacaagaccgtggagctgacagatgacgtggtgatgacttttgaatatgggcgccctacagtgatggtgctggaaaaatctttagacaacggcagaacctggcaaccctatcagttttacgcagaggattgcatggaagcttttggaatgtccgctagaagggctcgagacatgagcagttcttctgcccatcgggtcctttgcacagaagaatatagcaggtgggccgggtccaagaaggaaaagcacgtgcgttttgaggtgagggaccgcttcgccatcttcgctggaccggaccttagaaacatggacaatttatatacacgccttgaatctgccaagggactgaaggagttcttcactcttacagatctgcggatgcggctccttagaccggcactgggcggaacttatgtccaacgcgaaaatctgtataagtatttttacgccatttcgaacattgaagttatcgggcggtgcaagtgcaaccttcacgccaacctttgttccatgcgggaagggagtttgcaatgtgaatgcgaacataacacgaccggaccagactgtggcaagtgcaagaaaaatttccgaacgagaagttggcgcgctggtagttatctgcccctcccccacgggtcccccaatgcgtgcgcgaccgcaggtagttttggcactctgcagaccccccctcccggccggtccccctcagccctgagaggctcgcgccggggacttgccaacgtgaaagagccggcggggtcacgccctcagatttcagagatgttactggggtgtacagtaaccttgcatcaggggtcagtgggaccacatataccgcccaagctgagtctgccagaccccggaggaccttggttaggtagccagtag

SEQ ID NO: 28035 - DNA, 1569 bp, Artificial Sequence
  Description of Artificial Sequence: Synthetic coding sequence
atgctgcacctcctggcgctgtttctgcactgcctcccactggcctctggcgactatgatatttgtaagtcatgggttactacagatgaggggcccacatgggagttctatgcatgtcaacctaaggtgatgagactgaaggattacgtgaaggttaaggtggaaccttccggaatcacttgtggtgaccctcccgagaggttctgcagccacgagaatccttatctttgcagcaatgaatgtgatgcttctaacccagacctcgcacacccaccacggttgatgttcgataaggaggaggaaggtttagcaacttattggcaatccatcacttggtcccgatatcctagtcctctggaagctaacatcacattgagttggaacaagactgtagagctcacagacgacgtggttatgacctttgagtacggcaggcctacagttatggtcctagagaagtccctggacaatgggcggacttggcagccttaccagttttatgctgaagactgcatggaagcctttggcatgtctgctcggcgggcccgggacatgtcaagtagttccgcccaccgagtgttgtgtacagaggagtactcaaggtgggccggcagcaagaaggaaaagcacgtccggtttgaagttcgagaccgtttcgctattttcgcaggacccgatttgcgcaacatggacaatctgtacacgcgactggaatccgccaagggcctcaaagaattttttactcttacagatttgcgcatgcggctgctaaggcccgcactaggggggacttacgtgcagagggaaaatctgtacaagtatttttacgccatctctaacatagaggtcatcgggaggtgtaaatgcaatctacatgccaacttgtgttccatgagggaggggtctctccagtgtgaatgtgagcataatacaaccggacctgattgtggcaaatgcaagaaaaatttccgaactcgtagttggagggccggatcatacttgcctttaccgcatgggtccccgaacgcctattgcgaatgctatggacacagcaaccgctgctcttacatcgattttctgaacgttgtgacgtgtgtgtcctgcaagcataatactaggggtcagcactgtcagcattgtagacttggctactaccgtaatggcagcgctgagctcgacgacgagaatgtctgcatcgaatgtaattgcaaccaaattggctcggttcatgaccgctgtaatgagacaggtttctgtgaatgtagagagggcgctgccggtcctaagtgtgacgattgccttccgacccactattggcgacagggatgctacccaaatgtgtgtgatgatgaccagctcctgtgccaaaatggcgggacctgcctgcagaatcaaagatgtgcatgcccccgtggctacactggagtccggtgtgagcaacctcggtgcgacccagccgacgacgacgggggtctcgattgtgaccgcgcaccaggtgcagccccacgccctgccactctgctggggtgtctccttctcctgggtttggcagccagactggggcgttag

SEQ ID NO: 28036 - DNA, 1593 bp, Artificial Sequence
  Description of Artificial Sequence: Synthetic coding sequence
atgttacatctacttgccctgtttctgcactgcctgcctctggccagcggcgattacgacatttgtaagagttgggtcacaaccgacgaaggcccaacttgggagttttatgcctgccagccgaaggtaatgagactgaaggactacgtcaaggttaaagtggaaccctctggaatcacgtgtggggaccccccggagaggttctgctcacacgaaaatccgtacctgtgttcaaacgagtgcgatgccagtaatcctgacttggcacacccccccagactcatgtttgacaaagaagaggagggccttgccacgtattggcagtcaatcacctggtctagatatccgtctccgcttgaggcgaacattaccctgagctggaacaagaccgtagagctcacagacgacgtcgtgatgacttttgagtacggaaggcccactgttatggtgttggaaaagtctctggataacggtcggacctggcagccctatcagttttatgctgaggactgcatggaggcctttggaatgtccgctagacgggcgcgcgatatgtcatcttcctcagcccaccgggttctctgcactgaagagtattcccggtgggccggatcgaaaaaagaaaagcatgttcgatttgaggttagggatcgcttcgccattttcgctgggcctgacctaagaaacatggataacttgtatacgcgactggagagtgctaaaggtttaaaagagttcttcaccctaacagacctgcggatgcgcctgctgcgacccgccctggggggtacctacgtgcagagagaaaacctgtataagtacttctacgcaatcagcaatatagaggtcatcgggcgctgcaaatgcaatctccacgccaatctctgttccatgcgggagggatcactgcagtgcgagtgcgagcacaacaccactggccccgactgcggcaaatgtaaaaagaactttagaacgcgttcttggagggccggtagctatttgcccctgcctcacggctcacccaatgcctgtgctacggctgggtcatttggtaattgcgagtgctatggccattctaatcggtgctcttatattgatttcctaaacgtggtcacgtgcgttagttgcaagcataatacgcgtggtcagcactgtcagcattgcagattgggctactataggaacggttcagctgagcttgatgacgagaacgtgtgcattgagtgcaattgcaatcagatcggcagcgttcatgatcggtgcaacgaaaccggcttctgtgagtgccgtgaaggtgcagccggacccaaatgcgacgactgcctgcctacgcattactggagacagggctgttaccctaacgtgtgtgacgacgaccaacttctctgtcaaaatggaggaacgtgcttacagaatcaacggtgtgcctgccctaggggatataccggagtacgctgtgagcaaccgcggtgcgatccggctgacgatgatgggggcctggactgcgatagagctccaggcgctgctccacgtccagcaacgctcctcgggtgcctgttgcttcttgggcttgccgctaggctgggcagatag

SEQ ID NO: 28037 - DNA, 858 bp, Artificial Sequence
  Description of Artificial Sequence: Synthetic coding sequence
atggccgctgcaagtgagcctgtggactcaggcgcgttatggggtttggaacgtcccgagcctccaccaacaaggtttcaccgggttcacggcgcgaacatccgtgttgatccgagcggcaccagagcaactcgcgttgagtcgttcgcacatggggtgtgcttcagtcgggagcctctcgcaccaggccaggtctttttggttgagatcgaggagaaggaactaggctggtgtggccacctgcgactcggcctcacagcactggatccagcctctctcgcacctgtgccggaattcagcctccccgatcttgtgaacttaggacacacatgggttttcgccatcacacgtcatcacaatcgcgtgccgcgcgaagggaggccagaggccgaggccgccgctccctctcggccacccactctcctggtggagccttacctccgtatagaacagttccgcattccgagggaccggctggtgggcagatcccgccccggcctgtatagccacttgctcgatcagctctacgaactgaatgttctgccccctactgcgagaaggtcgcgtctgggggtacttttttgcccacggcccgacggcaccgccgatatgcatattatcattaacggggaggacatgggcccaagcgcacggggcctcccagccgcccagcctctatacgctgtggttgacgtattcgccagcacgaagtctgttcgacttgtgcagctggagtacggactcccttcccttcagactctgtgtaggctcgtgatccagcgaagcatggtgcacagactggctattgacggcctgcacctccccaaagaactaaaagatttctgcaagtacgagtag

SEQ ID NO: 28038 - DNA, 441 bp, Artificial Sequence
  Description of Artificial Sequence: Synthetic coding sequence
atgtcaagctgctctaacgtgtgtggctctagacaggctcaagctgcagctgaaggcgggtaccagcggtatggagtgaggtcatatctacatcaattctatgaggattgtaccgcgtctatttgggagtatgaggacgacttccaaatccagcggagcccaaaccgctggagctccgtcttctggaaacaggagctggggtttcatacctcgtcgcacagccaggaatggaatcgcaagctgcagcacaagaactgtcctaggtgctgcttcggatccctgtctcccccgggcgaagcgctactttgcaggcactgggattggccttatcaccctaaagcgccaggatgtagcgctgaacccggtggtggaccgttccagtcgatacccacactgttgtgcgggccaaagagggggtgcttcgctagcagtgagttgtag

SEQ ID NO: 28039 - DNA, 534 bp, Artificial Sequence
  Description of Artificial Sequence: Synthetic coding sequence
atgtcttcatgctcaaatgtgtgcgggagcagacaagctcaggcagcggctgaaggcggatatcagagatacggagtacgatcctacctgcaccagttctatgaagactgcaccgcttcaatttgggagtatgaggacgactttcagattcagaggtcacccaaccggtggtctagtgtcttctggaaagtggggcttatctctggaacagtttttgtgatcctgggtcttaccgtgttagctgtgggttttcttgtccctcctaaaattgaggccttcggggaagccgattttgtcgttgttgacacccacgctgtgcagttcaacagtgcgctggacatgtataagctggcgggcgctgttctgttttgtatcggtgggacatccatggccgggtgtctccttatgagcgtcttcgtgaagtcctactccaaagaggaaaagttcctgcagcagaagttcaaagaaagaattgcagacatcaaggcccacacccagccagtgacaaaagccccgggcaccccactgagctag

SEQ ID NO: 28040 - DNA, 441 bp, Artificial Sequence
  Description of Artificial Sequence: Synthetic coding sequence
atgtcttcatgctcaaatgtctgtggcagtcgacaggcccaggctgcagctgagggcgggtaccaaagatacggagtgcgctcgtacctccatcagttctatgaggactgcaccgcctccatatgggaatatgaggatgattttcagatccaaaggtctcccaaccgctggtcgtcagtcttctggaaacaagaactgggatttcatacgtccagccactctcaggagtggaacaggaagctccagcacaagaactgtcctcggtgttgctttgggtcgctcagcccccccggggaagccctgctctgtaggcactgggactggccataccacccaaaggctcccgggtgctctgctgagcccggagggggaccttttcaatcgatccctacgctgctgtgcggtcccaagagggggtgctttgcgtctagtgagctatag

SEQ ID NO: 28041 - DNA, 588 bp, Artificial Sequence
  Description of Artificial Sequence: Synthetic coding sequence
atgtcatcttgttctaatgtgtgtggaagcagacaggcccaggctgccgctgagggtggctaccaaagatatggagttcggtcctatctgcaccaattctacgaggactgtaccgcttcaatctgggaatacgaggacgacttccagattcagcggtcacctaacaggtggtcgtccgtgttttggaaggtaggactgatctccggcactgtttttgtgatcctgggcctcacagtgctggctgtgggcttcctcgttccgcctaaaattgaagcctttggagaagcagacttcgttgtcgtagatacacacgccgtccagttcaacagcgctctggatatgtacaagctagccggggccgtgttattctgcataggtggcacctcgatggccgggtgtctattgatgagtgtctttgtgaagtcatattcgaaggaggaaaaatttttgcaacagaagttcaaagaacggattgccgatattaaagcacacacccagcccgtgacaaaggcacccggcccgggcgagacaaagatacctgttaccctatccagagtccagaatgtccagccactgctggcaacttag

SEQ ID NO: 28042 - DNA, 498 bp, Artificial Sequence
  Description of Artificial Sequence: Synthetic coding sequence
atgatgcgctgttgtagaaggcgctgttgctgtcgccagccgcctcacgctttacgcccgttactgcttttgccactggttttacttcctccattggcagccgccgccgccggccccaacaggtgtgatacaatctaccaggggttcgccgagtgtctgatccggctcggcgatagcatgggccggggcggcgaactcgagaccatttgcaggtcgtggaacgatttccatgcatgcgcatcccaggttttgtcgggctgtcccgaggaagcggcagccgtctgggaaagccttcagcaagaggcgaggcaggctcctcggccaaataacctgcataccctatgtggcgcacctgtccatgtgcgcgagcggggcactggatccgaaaccaatcaggaaactctacgtgccaccgctccagccctgcccatggcacccgctcccccacttttagccgcggctctcgcactcgcgtatttattaagaccgctcgcatag

SEQ ID NO: 28043 - DNA, 2451 bp, Artificial Sequence
  Description of Artificial Sequence: Synthetic coding sequence
atgtcacgacctcagggtctgctgtggctccctctgctatttacccctgtgtgtgtaatgcttaactcaaacgttctattatggcttacggcactcgccatcaagtttaccctgatcgattctcaggctcaatatcccgtggtcaacaccaactacgggaaaatcagaggtctcaggacgcccctaccaaatgaaattctgggacctgtggagcagtacttgggagtgccttatgcttctccaccaaccggcgaaaggcgatttcagcccccagagcccccttccagctggaccggaattaggaacactacacagttcgccgcggtgtgtccgcagcacctagacgaacggtctctgctgcacgacatgctgcctatctggtttacggccaatctagacaccttgatgacatatgtgcaggaccagaatgaagactgcttatatctgaatatttacgtacccaccgaagacgatatccacgaccagaactctaagaagccagtcatggtgtacattcatgggggatcctacatggaggggacgggcaacatgattgatgggtcaattctggcatcttacggcaatgtcattgttataacaataaactaccggttaggcatactgggctttctgtccaccggagatcaggctgcaaaaggtaactatggcctgttggatcagatacaggccctacgatggattgaagagaacgtaggtgctttcgggggcgatcccaagcgcgtcactatttttggaagcggtgctggtgctagttgtgtatctctgctcaccctaagccattacagtgagggtctgttccaaaaggcaataatccagtcggggaccgccctgtcctcttgggctgtgaactaccaacccgccaagtacaccaggattctggctgacaaagttgggtgcaatatgctggacaccacagacatggtggaatgtctgcggaataaaaactacaaggaacttatccagcaaactattactcccgccacctatcacattgctttcggcccagtcatagatggcgacgttattccggatgaccctcagatactgatggagcagggagaattcctgaattatgatatcatgctgggtgttaatcagggcgaagggctgaagttcgtggacggcattgttgataatgaagatggagttacacccaatgacttcgacttctccgtcagtaactttgtcgataatctgtatggctaccccgaaggcaaggatacactgcgagagactatcaaatttatgtacactgattgggctgacaaagaaaacccagaaacccgccggaagacactcgtggctctgtttacagaccaccagtgggtcgctcctgcggttgcaactgcagatctgcatgcccagtacggttccccaacctatttttacgccttttaccatcactgccagtcggagatgaagccatcgtgggccgactctgcacacggcgacgaggttccgtacgtttttggtatccctatgatcggtccaaccgagttgttttcctgcaacttcagcaaaaatgatgtgatgcttagtgccgtggtcatgacttactggaccaatttcgcaaagacaggtgatccgaaccagccggtgccacaggatactaaatttatacatacaaagccaaatagattcgaggaggttgcttggtcaaagtataatcccaaggaccagctttatctgcacataggactgaagcctcgagttagagaccactaccgggcaactaaggtggctttttggctcgagctggtgccgcatctgcacaacctaaatgagattttccagtacgtgtccaccaccaccaaagtgcctcctcccgacatgacatcattcccgtatggaaccaggcgctcccccgccaaaatctggcccaccactaagcgccctgcgattactcccgccaacaaccctaaacattcaaaggaccctcacaagacaggcccagaagatacaaccgtgctgatagagacaaagcgtgactattccacagagctgagtgtgaccatcgccgtgggcgcctctctgctatttctgaatatcctagcctttgccgccctttactataaaaaggataaacgccggcatgaaacacatagacgtccttccccacaacgcaataccacaaacgatatcgcacacatccaaaacgaggagataatgagtctccaaatgaagcaactggagcacgatcacgagtgcgaatcgctgcaagcccatgacacgctccgcctcacatgtcctcctgactacaccttgactctgcgtagatcacctgacgatatacccctgatgacgcctaacactattactatgatacctaatacactgacagggatgcagccgctacacactttcaataccttctctggcggccaaaactcgacaaatctcccacacggacactccactacccgcgtctag

SEQ ID NO: 28044 - DNA, 2451 bp, Artificial Sequence
  Description of Artificial Sequence: Synthetic coding sequence
atgtcacgcccccagggtctgctctggcttcccttactgtttacacctgtatgtgtaatgctaaactccaacgtgctgctgtggcttaccgccctggcaattaaattcactctaattgatagccaggctcagtacccggtcgtgaacacaaattatggaaaaatacgcggattaagaacgcccctccccaacgagattttaggccccgttgaacaatatttgggcgtgccctacgcctcaccaccgactggcgagaggaggttccagccccctgagccgccctctagctggactggaattcggaatacaacgcagtttgccgcggtctgccctcagcacttagacgagaggtccctcttacacgacatgctccccatttggttcacagcaaacctggatactctgatgacatacgtgcaggatcaaaatgaagattgtctttatttgaatatttacgtgcctacagaggacgatattcacgaccagaatagcaagaaaccggttatggtttacatccatggaggttcctacatggagggtaccggaaacatgatcgatggatcaatcctggcgagctatggaaatgtgatagtcattaccataaactatcggctcggtatcctgggctttctgagcactggggatcaggctgctaaaggaaattacggcctgctggatcagatccaggccctcagatggattgaggagaacgtcggagcgttcggcggcgacccaaaaagggtgaccatattcggcagcggggccggcgcgtcctgtgtgagcctgctgaccctttcccactatagtgaagggttatttcagaaagccattatacagagcgggacagcgctttcgagctgggctgtcaactatcagcctgccaagtatacaaggattttggctgacaaagttggctgcaacatgctggacacaaccgacatggtggagtgtctgcgtaacaaaaattacaaggagctcatacaacaaacaattactccggctacttaccatatagcctttggtccggtcattgacggcgatgtgattcctgatgaccctcaaatattgatggagcaaggggaattcctgaactatgatatcatgcttggcgtgaaccagggggagggccttaaattcgtagacgggattgtggacaatgaggatggcgtgacgcctaacgactttgacttttccgttagcaacttcgtggacaatctatacggctaccctgaaggcaaggacacactgagggagaccataaagtttatgtacactgactgggccgataaagagaatcctgagaccagaagaaaaacacttgtcgcgctcttcaccgaccatcaatgggtcgctccagctgtagcaaccgcggacttgcacgcgcaatatgggagccctacctacttttacgcattctaccaccactgtcaaagtgagatgaaaccaagctgggctgactccgcccatggagatgaggtgccctacgtgttcggcatccctatgataggcccgaccgagctttttagttgcaacttcagcaaaaacgacgtaatgcttagcgccgtagtgatgacttactggactaactttgccaaaactggcgatcccaatcagcctgttcctcaggacaccaagtttattcacacaaagcccaataggttcgaggaagtggcctggagcaagtacaacccaaaggaccaactctacttgcatattgggctgaaacctagagttcgtgatcactaccgcgccactaaagtggccttctggctcgagttggtaccacatctccacaatttgaacgaaatctttcagtacgtaagtactacaactaaggtgcctccacctgatatgacttcttttccctatggaacaaggcgtagtccagccaaaatctggccaacgaccaagagacccgccattactcccgccaataatccaaaacactccaaggatccacacaaaaccgggccagaagatacaacagttctgatcgaaacaaagagggattactcaaccgaactgagcgttactatcgctgtgggggcctctctcctgtttctgaatatcctggcttttgccgccttgtattataagaaagacaaaaggcgccatgaaacacatcggcggccgagcccccaacgtaatactacaaatgacatcgctcatatacagaacgaagagattatgagcctccagatgaagcagttagagcatgaccacgagtgtgaatcattacaggcacatgatacactgcggttgacctgtcctccggattacacattgactctccgtcgtagtccagatgacattccccttatgacaccgaataccatcacaatgattcccaacaccctgacgggtatgcagcctctgcatactttcaataccttctccggcggtcagaatagcactaatctcccacacggacattctaccacacgtgtatag

SEQ ID NO: 28045 - DNA, 2511 bp, Artificial Sequence
  Description of Artificial Sequence: Synthetic coding sequence
atgtcaagaccacagggcctcctgtggctgcccctgcttttcactccagtgtgcgtcatgctgaattccaacgtgctcctctggctaactgccctggcgattaagtttaccctgatcgactcccaggcgcagtatccagtcgttaacacaaactatggaaagattaggggactgagaactcctttgccgaacgagatcctcggccccgtggagcaatacctcggcgtgccttatgcatctccccctaccggggaaaggagattccagcctcctgagcctcccagttcttggactgggatcaggaacaccacgcagtttgccgccgtttgccctcagcatcttgatgagcggagcctgctacacgatatgttacctatctggttcaccgccaaccttgataccctaatgacctacgtgcaggaccagaatgaggactgcctgtatcttaatatttatgtgccgaccgaggacggtgctaacaccaagaagaatgctgacgacattacatcaaatgacaggggggaggacgaagatatacacgaccagaactctaagaagcccgttatggtgtacatccacggcggttcttatatggagggaaccggcaatatgatcgatggcagcatcctagcaagctacggaaatgtcattgtaattacaattaattatagattgggaatcttgggcttcctctccactggggatcaggctgctaaggggaattacgggctcttagaccagatccaggccctgaggtggatagaagagaacgtgggcgcattcggaggagatcctaagcgcgtcacaatctttggttccggcgccggcgcaagctgtgtgagtttactcaccctcagtcactattcagagggtctgtttcagaaagctatcatccaatcagggaccgctctgtcgtcatgggcggtgaattaccagccagctaagtacaccaggatactggctgataaggtgggttgcaacatgctggacacaactgacatggtggaatgtctgcgtaacaagaattacaaggaacttatccagcaaacaattacgcctgccacgtatcacatcgcgttcggacccgtgatcgacggagatgttatccctgacgacccacagatcttgatggagcaaggtgaatttctgaactatgacattatgctaggcgttaatcaaggagaggggctaaaattcgtggacgggatcgtggacaatgaggacggagtaactcccaacgattttgatttctctgtctctaattttgtggacaatttgtacggctatcctgaggggaaagacacattgagagagaccatcaaatttatgtataccgattgggcagataaggagaatcccgagacaagacggaaaactctggtcgctctattcactgatcaccaatgggttgctcccgccgtagccacagcggacctgcatgctcaatatggttcccctacctatttttacgccttctaccaccactgccagagtgagatgaaacctagctgggccgactccgctcacggagatgaagtaccctacgtcttcggcatcccgatgattggacccactgagttattctcctgcaacttctccaagaacgacgtaatgctctcagccgtggttatgacctattggacaaacttcgctaaaacaggcgatcctaatcagcccgttccccaagacactaaattcattcatacaaagcctaataggtttgaagaagtggcctggagcaaatacaacccaaaggatcagctgtatctgcatatcgggctaaagcctcgggtgcgcgaccactaccgtgccacaaaagtggcgttctggcttgagctggtcccccatctgcataatctgaatgagatctttcagtatgtgtcaactactaccaaggtgccccctccagacatgactagctttccttacggcacacggcgctcgcccgcaaagatctggcccaccacaaaacgtcccgcaatcacaccagccaataaccctaagcactccaaggacccacacaaaacgggcccagaagatacaaccgtgcttatcgagaccaagagggattattctactgagctaagtgttacaatagcagtgggcgcttccctgcttttcctgaacatcctggctttcgccgccttgtattacaagaaggataagcgtcgacatgagacacaccgtcgcccctcaccacagcgcaatacaactaatgacatagcacatattcaaaacgaggagattatgtcgcttcagatgaaacagctcgagcatgatcatgagtgtgagagtctccaggcccatgatacccttcgcttgacttgtccccccgactacactctcacactcaggaggagtcccgatgatatccccctcatgacaccaaatacgataaccatgattcccaacactcttactggaatgcagccactgcacaccttcaatacatttagcggggggcagaacagcaccaatttaccccacggtcactcaacaacacgggtgtag

SEQ ID NO: 28046 - DNA, 2451 bp, Artificial Sequence
  Description of Artificial Sequence: Synthetic coding sequence
atgtctaggccgcaagggctcctgtggctgcccttgctgttcacaccagtgtgcgtgatgttaaattccaacgtcctactgtggctcacagccctagctatcaaattcaccctaatcgatagccaggcccaatatcctgtggtgaacactaattacggcaagatccgcggactgcgaactcctctccctaatgagatcctggggcccgtcgagcaatacttgggcgttccctatgcttcaccacccacaggggagcgccggttccagccacctgagccccccagctcatggacaggtatacgcaatactacccagttcgccgccgtttgtccccaacacctcgatgagaggtcacttctgcatgacatgttacccatttggttcacagcaaacttagacaccctgatgacctacgtacaggatcagaacgaggactgtctgtacttaaatatctatgtgcctactgaggatgatatccatgaccagaattcaaaaaagccggtgatggtttacattcacgggggttcatacatggagggaaccgggaacatgatagacggttccattctggcctcttatgggaatgtgattgtgatcactatcaattaccggctggggatcctgggattcctttccacaggtgaccaagcagccaagggcaattacggacttctagaccagatccaggcactgcgctggattgaagagaacgtcggagctttcgggggggacccaaagcgtgtgacaattttcggaagcggggcgggagctagctgtgtgtctctcctgactctatctcattactccgaagggctgtttcagaaagcaatcatccagagcggtacagccctctcttcctgggccgtgaactaccagccagcaaaatacactcggattctggccgataaggtgggctgcaatatgctggacacgacagatatggtggaatgccttcggaataagaactataaagagcttatccagcagacaattacccccgcaacataccatattgcgttcgggcccgtcatcgacggggacgtgattcccgatgatcctcaaattttaatggagcagggcgaatttctaaattacgacatcatgctgggggtaaaccagggcgagggccttaagttcgttgacggtattgtggacaacgaggacggagtgacacctaatgattttgacttctcagtgtccaacttcgtggataatctttacggctatcccgaagggaaagacacgctaagggaaacaatcaaattcatgtatactgactgggcagataaggaaaatccagaaaccagaaggaagactttggtcgcactttttacggatcaccagtgggtagcgcctgccgtcgctaccgcggatctgcatgcccagtatgggtctcctacctacttctacgctttctaccaccactgtcagagcgagatgaagccgagttgggccgacagtgctcacggggacgaagtgccatatgtgtttggaattccgatgatcggccctaccgaactcttttcttgtaacttttcgaaaaatgacgttatgctcagcgccgtggtgatgacctactggaccaactttgctaagaccggggaccccaatcaaccagtcccccaggatactaaattcattcacaccaagcctaataggtttgaggaggtggcttggtcgaagtacaaccccaaggatcagctctatcttcatatcggactcaagcctagagtacgggaccattaccgtgctacaaaggtggctttctggttggagctcgtcccccacctccataatctgaacgagatttttcaatacgtctcaacaaccaccaaggtgccaccacctgatatgaccagcttcccatacgggaccagaagatctcccgcaaagatttggcccacgaccaaaaggcctgccataacgcctgccaataacccaaaacattccaaggatccgcataagacaggacccgaggacacaactgtgcttattgagaccaaaagggattattccaccgagctgtcagtgaccatcgcagtgggtgccagtctgctttttctgaatatcttagcgttcgctgcactgtactacaaaaaagataagaggaggcacgagacacacagaaggcccagcccccagagaaacacgaccaatgacatcgcacacattcagaacgaagagataatgtcactgcagatgaaacagttggaacatgaccacgaatgtgaatccctgcaggcccacgacactctgagactgacatgcccaccggattatacgctgacgctacgccgaagccccgatgatattccccttatgacccctaatactattacgatgataccaaatacgctgacagggatgcagcctttgcacacgttcaacaccttctctgggggccagaattccacaaaccttccccatggacattctactacaagagtgtag

SEQ ID NO: 28047 - DNA, 2451 bp, Artificial Sequence
  Description of Artificial Sequence: Synthetic coding sequence
atgtcccgtcctcaagggttattgtggctacctcttctcttcacacccgtgtgcgtgatgctcaatagtaatgtcctgctctggctgactgctctggctattaagttcactctcattgactctcaagcacagtaccccgtggttaatactaactatggaaaaattagaggcctcagaacccctttacctaacgagatactgggccccgtcgagcagtacctgggcgtcccctatgcaagtcctccgaccggagaaagacggtttcagccgccagaacctccatcatcttggacaggaatcagaaacacaacgcagtttgccgccgtttgccctcagcacctggatgagcgaagcctactgcacgatatgctgccaatttggtttacggcaaacctggatacgctgatgacctatgtccaggaccaaaatgaagactgcctgtatctaaatatctacgttccaacagaggacgatattcacgatcagaactctaaaaaacccgtgatggtgtacattcatgggggctcttacatggagggtactgggaacatgattgatggctccattttggcatcatatggaaatgtcatcgttatcactatcaactataggctaggcatcttgggttttcttagtactggcgatcaagccgctaagggcaattacggattgctggaccagattcaggctctccggtggattgaagagaacgttggcgcgtttggcggcgaccctaaacgcgttaccattttcggaagtggcgccggagcttcttgtgtctcactgctgacgctgtcgcattattcggaagggttgttccagaaggcaatcatccaaagcggaacagccctgtcaagctgggccgtcaattaccagcctgccaaatatactcggattctcgccgacaaggtgggctgcaatatgctcgacactacggacatggtcgagtgtttacgaaataagaattacaaggaactgatccagcagacaatcacacctgcgacctaccatattgccttcggacctgtgatcgacggagacgtaatccccgatgatccccagatccttatggagcagggagagttcctgaactacgatatcatgctgggggtcaaccaaggagagggccttaagtttgtagacggtatcgttgacaatgaagatggggttaccccaaatgactttgacttctccgtgagtaactttgtggacaacctgtacgggtatcctgagggcaaggataccttgcgggagaccattaaatttatgtatacagattgggccgacaaagaaaatcctgaaaccagacggaaaaccctcgtcgcattgttcacagaccaccaatgggtggctcctgcagtcgcaactgccgatctccatgcccagtatggaagcccgacatacttctacgctttttatcaccactgccagtccgaaatgaagccctcatgggccgactccgcccacggcgacgaggttccttacgtcttcggtatcccgatgattggcccaacggagctgttcagttgcaacttttcaaagaacgacgtgatgctgtccgccgttgtgatgacatattggactaacttcgctaagacaggagatcccaatcagccagtgccacaggacacaaagttcatccacaccaaaccaaataggtttgaggaagtcgcttggtccaaatataatccaaaagaccagctgtacttgcatatcggtctcaagcctcgcgtgcgagaccattaccgagccacgaaggtggccttctggctcgagctagtgccccaccttcataatctaaacgagatttttcaatacgttagcactactaccaaggttccaccaccggacatgaccagtttcccatatggaacacgcaggtcacctgcgaagatttggcccacaacaaagcggcctgccatcacccccgccaacaatccgaaacattccaaggatcctcacaaaaccggacctgaagacactactgtgcttatcgaaaccaaaagggactatagcaccgagctctccgtgacaatcgccgttggtgcgtctctactctttttaaacattctcgcttttgcggctctttattacaaaaaagacaagcggcggcacgaaacccatcggcgcccctcgcctcaacgcaacaccaccaatgacatagcacatatccagaatgaagagataatgtcactccagatgaagcagctggagcatgatcacgagtgcgagtccctgcaggcacatgatacccttagacttacctgtccgcccgactatactcttaccctgcggaggagtcctgacgacatccccttgatgacccccaacactataaccatgattcctaatacgctgaccggcatgcagcccttacacacttttaatacattttccggaggtcaaaacagtaccaatcttccacatgggcactctaccacccgggtgtag

SEQ ID NO: 28048 - DNA, 558 bp, Artificial Sequence
  Description of Artificial Sequence: Synthetic coding sequence
atggtgaagctgggaaacaactttgccgagaaggggactaaacagccactgctagaggatggctttgacaccataccactgatgacccctctggatgtcaaccagctccagtttccgcccccggataaagttgtggtgaagactaaaactgaatacgaacctgaccggaaaaagggaaaggcacgaccacctcaaatcgccgaattcacagtatcaattacagaaggcgtcacagagcggtttaaagtctctgtccttgttcttttcgcccttgcctttttgacctgcgtcgtgttcctggtcgtctacaaggtgtacaaatatgatcgggcctgccctgacgggtttgtgctaaaaaacactcagtgcatccctgagggacttgagtcttactacgctgaacaggattcctcagcccgcgaaaagttctacactgtgattaatcattacaacctggccaagcagtccattacacggagcgtcagtccttggatgtccgtgctcagcgaggagaagttgtcggagcaggagacggaggcagccgaaaaaagtgcctag

SEQ ID NO: 28049 - DNA, 558 bp, Artificial Sequence
  Description of Artificial Sequence: Synthetic coding sequence
atggtgaaactgggcaataactttgccgagaagggcactaaacaacccctgttggaagacggctttgacactattccactaatgacaccattggacgtgaaccagctgcagttcccgcctccagacaaagtcgttgtcaaaactaagacagagtacgagccagacagaaagaaggggaaggcaagaccgccgcagatcgctgagttcacagtgagcataacagagggggtgaccgaacgtttcaaggtaagcgtgctggttctgtttgcgcttgcgtttctcacttgtgtggttttcctggtcgtgtacaaggtctataaatacgaccgtgcatgccccgatgggtttgtactgaaaaatacacagtgcatcccagagggcctcgaatcctattacgccgaacaggactcttccgcccgagaaaaattctatactgtgatcaatcactataatttggctaaacagtctatcacccgatcagtgtccccatggatgagcgtgttatcagaagagaagctcagcgaacaagagacggaggctgctgagaagtctgcttag

SEQ ID NO: 28050 - DNA, 558 bp, Artificial Sequence
  Description of Artificial Sequence: Synthetic coding sequence
atggtgaagttggggaataattttgctgaaaagggaacaaaacagcccctgctagaggacggattcgataccatccctctcatgacaccattggatgtgaatcagctgcagtttccaccacccgataaagtggtggtcaagacaaaaaccgaatacgagcccgacagaaagaaaggaaaggctcgccccccccagattgcagagtttacagtttcaattacagagggtgtcacagaacgctttaaggtttccgtcctggtattgtttgcgctcgcgtttttgacatgcgtggtgtttttggttgtctacaaggtgtataagtacgaccgagcgtgcccagatggattcgtgctgaagaatacccagtgtatcccggagggcctggagtcatattacgccgaacaggattcctctgctagagagaaattctacactgttattaatcactacaacctcgcgaagcagagcattactcgcagtgtgagtccttggatgtcagtgctgtctgaggagaaactgtctgaacaagagacagaggcagccgaaaagtctgcctag

SEQ ID NO: 28051 - DNA, 441 bp, Artificial Sequence
  Description of Artificial Sequence: Synthetic coding sequence
atggtcaagctcggaaacaactttgctgagaaggggactaaacagccactccttgaagacgggtttgatactatccctctgatgacccccctagacgtgaaccaactgcagttccccccccctgataaggtctctgttctggtgttattcgccctcgctttcctcacttgtgtcgtgttcctcgtagtttacaaggtgtataaatacgaccgcgcatgccccgatggattcgtcctcaagaatactcagtgcattccagagggactggaatcctattacgccgaacaggatagctctgctagggaaaagttctatacagtcattaatcactataatctggcgaaacagtctataactaggtctgtttctccatggatgtcggtgttatccgaggaaaaactatcagagcaggaaacagaggccgctgagaaatcggcctag

SEQ ID NO: 28052 - DNA, 558 bp, Artificial Sequence
  Description of Artificial Sequence: Synthetic coding sequence
atggttaaactagggaataactttgccgaaaaggggactaaacagcctttactcgaggatggctttgacaccattccgctgatgacccccctggacgttaatcagctgcagttccctcccccagacaaggtcgtagtcaagacaaaaactgagtatgaacctgaccggaaaaaagggaaagcaagaccaccccagattgcggaattcacagttagtattactgagggcgtgaccgagcgatttaaagtgtccgtgcttgtcctgtttgccttagcgtttttgacatgcgtcgtgttcctggttgtttacaaagtttataagtatgacagggcctgtcctgatgggtttgtcctgaaaaatactcagtgcattcctgaagggctggagagctactacgcggagcaagactcctccgccagagagaaattctacaccgtgattaatcactataatcttgctaaacagtctatcacacgttcagtaagcccttggatgtctgtactcagcgaagaaaagcttagtgaacaggagaccgaggccgccgagaaaagcgcctag

SEQ ID NO: 28053 - DNA, 558 bp, Artificial Sequence
  Description of Artificial Sequence: Synthetic coding sequence
atggtaaaactcgggaacaacttcgccgaaaaaggcaccaagcaaccgcttttagaggacgggttcgacaccatccccctcatgactcccctcgatgtgaatcagcttcaattcccgcccccagacaaagtggtggtgaagactaaaaccgaatatgagccagacagaaaaaaagggaaagcaaggccccctcagatagctgagttcaccgtttctatcactgaaggagtgacagagcgtttcaaggtcagcgtgctcgtgctgtttgcccttgcttttttgacatgcgttgtattcctcgtggtttacaaggtgtataaatacgaccgcgcctgtccagatggatttgtgctcaagaatacgcagtgcatccccgagggcctagaatcttattacgcagagcaggatagctctgccagggaaaagttctacaccgtcatcaaccactataacctcgctaaacaaagtataactagaagcgtgtccccctggatgagtgtcttgtctgaagagaagctgtccgaacaggagaccgaggctgctgaaaagagcgcctag

SEQ ID NO: 28054 - DNA, 558 bp, Artificial Sequence
  Description of Artificial Sequence: Synthetic coding sequence
atggtcaagctggggaataacttcgcagagaaagggactaaacagcccctgctggaggacggcttcgacaccattccccttatgactcctctggacgttaatcagctccagttccctcctcctgacaaggtcgtagtgaaaaccaaaacagagtacgagcctgacagaaaaaagggcaaagcaaggccaccccagattgcggagttcacagtctcaatcacagaaggcgtcactgaaaggttcaaggtctcagtcctggttctgtttgcactggccttccttacttgcgtagttttcttggttgtctataaggtgtacaagtatgacagggcgtgcccagatggtttcgtgctcaagaacacacagtgtattccagagggcctggagagttactacgccgagcaggactccagcgcgagagagaaattctataccgttatcaatcattataacctagccaaacagagcatcaccagaagcgtgagcccatggatgtcagtgttgagcgaggagaagctctcagaacaggagaccgaagcggcagagaaaagtgcctag

SEQ ID NO: 28055 - DNA, 558 bp, Artificial Sequence
  Description of Artificial Sequence: Synthetic coding sequence
atggtgaaacttggaaacaacttcgccgagaaaggcaccaaacagccattactggaggatggatttgacactatcccgctgatgactcccctggacgtgaatcagcttcaattccctcccccagacaaagtcgttgtgaagacaaaaacggagtatgaacccgaccggaagaagggcaaagcccggccgcctcaaatcgcggaattcaccgtgtccattacagaaggcgtgactgagcgattcaaagtgagcgtgctagttctgtttgccttggcgttcctgacttgcgtcgtgtttttggtggtttacaaagtgtacaagtatgaccgtgcctgtcccgatggttttgtgctgaagaatacccaatgcatcccggagggactggaatcatattacgctgagcaggacagctcagcccgtgaaaaattttatacagtgatcaatcactacaacctggccaaacagtccattaccaggtccgttagcccatggatgagcgtgctcagtgaagagaagctttccgaacaggagacagaggcagctgagaaatctgcatag

SEQ ID NO: 28056 - DNA, 516 bp, Artificial Sequence
  Description of Artificial Sequence: Synthetic coding sequence
atggtaaagttaaacagtaatccaagcgaaaagggaaccaaacctccaagcgtggaggacggcttccaaaccgttccgcttataacgcctttggaagtcaatcatcttcagctccccgcacccgaaaaggtgatagtgaaaaccagaactgaatatcagcccgagcagaaaaacaaaggaaaatttcgagtgccaaaaattgctgagttcactgttactatcctggtatctctggccctggccttcctggcctgtattgtctttctcgtggtgtataaggctttcacatacgatcactcatgtccagagggcttcgtttacaaacataagaggtgtatccccgcatccctcgacgcgtactactcatctcaggatcccaatagtcgctcccgtttttataccgttatcagccattattcagtggcaaaacagtcaaccgccagggctattgggccctggcttagtgccgccgcagtgatccatgagcccaaaccacccaaaacgcaaggtcactag

SEQ ID NO: 28057 - DNA, 516 bp, Artificial Sequence
  Description of Artificial Sequence: Synthetic coding sequence
atggtaaagcttaattcaaatcccagcgagaaaggtaccaagcccccatccgtggaagatggattccagacggtgccgctaatcacgcccctcgaagtcaaccatctgcagctccccgctcctgaaaaggtgatcgtcaagacacgaactgagtaccaaccagaacaaaagaataagggaaagttccgagtgcccaaaatagcggagttcaccgtgaccatcctggtttcactggccctggctttcctggcctgcatcgtgttcttagtggtttataaagcctttacgtacgaccattcttgccctgaggggtttgtttataaacataaacgttgcattcccgcctctttggatgcttattattcctcacaggacccaaactcacgctccagattctacacagtgatcagtcactacagcgtcgcgaaacagtctactgcacgcgccatcggcccttggctgtcagcggccgctgttatccatgagccaaagcctcccaaaacacagggccattag

SEQ ID NO: 28058 - DNA, 441 bp, Artificial Sequence
  Description of Artificial Sequence: Synthetic coding sequence
atggtgaaactcaactcaaatccttctgagaagggcaccaagccccccagtgtggaggacggatttcagacagttccactcatcacaccccttgaggtgaatcacctacagctgcccgccccagaaaaagtgattgtaaaaacacggacagaatatcagcccgagcagaaaaataagggtaaatttcgcgtgcctaaaatcgccgagtttacagtaactattctcgtgagtctggcgctcgccttcctagcgtgcatcgtattcctggtcgtgtataaggccttcacctatgatcactcttgccctgagggttttgtctataagcacaagcgctgcatcccagcaagcctggacgcttactactcaagtcaagaccccaatagtaggagccgattctacacagtcataagccattatagtgtggcaaaacaaagcacatag

SEQ ID NO: 28059 - DNA, 480 bp, Artificial Sequence
  Description of Artificial Sequence: Synthetic coding sequence
atggtaaagctgaacagtaacccttccgagaagggcaccaaaccaccgagtgtggaagatgggtttcaaacggtacccttaatcactccattggaagtcaaccaccttcagctgccggcacctgagaaggtcatagtgaagaccaggacggagtatcaacctgaacagaagaacaaggggaaattcagggtgcccaagatcgccgagtttaccgtgacaatactggtgtccttggctctggcatttcttgcttgcattgtatttctggtagtgtataaagcatttacatacgatcactcttgtcccgagggattcgtgtataaacacaagcgctgcatccctgccagtctcgacgcatactactcaagccaggaccccaatagtcgtagtcgattttataccgtaatctcacattatagcgtggccaagcagtctacggcccgcgcaattggcccctggctgagcgcggcagcggtgtag

SEQ ID NO: 28060 - DNA, 1293 bp, Artificial Sequence
  Description of Artificial Sequence: Synthetic coding sequence
atggagggcgagccatctcagccgcctaattcctcctggcccttgtcccaaaacggaactaacaccgaggctacacctgcgactaatttgaccttttctagctattaccagcacacatcacccgtggctgccatgtttattgttgcctatgctctcatattcctgctgtgtatggtgggaaatacattggtgtgcttcatagtcctgaaaaaccgccacatgcacacagtgaccaatatgtttattctgaacctggcggtgagcgatctgctagtgggtattttttgcatgcccaccacactggtcgataacttgatcacaggctggcctttcgataatgccacttgtaagatgagtggactcgtgcaggggatgtcagtcagcgctagcgtgttcactctggtggccatcgctgtggaacggttccggtgcatcgtccaccctttccgggaaaaactcactctaagaaaggcgctcgtgaccattgccgtaatctgggcgctcgccctcttgattatgtgcccaagtgcggtcacgctcacagtgactcgcgaggagcatcatttcatggtcgacgcacgcaatcgttcgtaccccttatattcttgttgggaggcctggcctgagaagggcatgcgcagggtatatactacagttctgttctctcacatatatctggccccccttgccttgatagtcgtaatgtatgcccgtatcgcgagaaaactctgtcaggccccaggcccagcccctggtggggaggaagccgcggatcctcgcgcctctagacgccgtgccagggtggtacatatgcttgtaatggtggctctgtttttcacccttagttggcttcccctttgggccctgctgctcttaattgactatggacagttgtcggcgccacaactgcacctagtgactgtgtatgcttttccttttgcccattggctggctttctttaatagcagtgcaaacccgataatctacggttatttcaacgaaaactttcgccggggctttcaggcggcctttcgcgcaagactatgcccccgcccttctggatctcacaaagaggcttactctgagcgcccaggcggtctcctgcatagacgcgtgttcgtggtggttagacctagcgactccggactgccttctgagagcggcccctcatctggtgcacctcgcccaggccgcctcccactgaggaacggccgggtggcacaccatgggttaccgcgcgaaggtcccggatgctcccacctgcccctgactattccagcctgggacatctag

SEQ ID NO: 28061 - DNA, 1287 bp, Artificial Sequence
  Description of Artificial Sequence: Synthetic coding sequence
ggcgagccttcacagcctcccaactcaagttggccccttagtcagaacgggacaaatacagaagctacccccgcaacaaatttgaccttttcatcctattatcaacatacttctccggtcgccgctatgtttatcgttgcatatgccctgattttcctgctgtgtatggttggtaacaccttggtgtgcttcatcgtcctcaaaaacagacacatgcacactgtcaccaacatgtttattctgaacctggccgtgagcgatttgctggtgggtatcttttgcatgccaaccaccttggtcgataacctcatcaccggatggccatttgacaacgccacctgcaagatgtccggccttgtccaaggcatgtccgtcagcgcctccgtgttcacgctcgtggctattgccgtcgagcggttcaggtgtattgtacacccattcagagaaaagctgacactgagaaaagccctggttacgatcgccgtgatctgggccctcgccctcctcattatgtgcccatccgccgtgacattaaccgttacgcgggaagagcaccatttcatggtggatgccaggaacaggtcttatccgctgtatagttgctgggaagcctggccagaaaaggggatgaggcgggtatacacaacagttttgttttctcatatttatcttgctcccctcgccttgatcgtggtcatgtacgcaaggattgcacgcaaactttgtcaggcgcccggccccgccccagggggtgaggaagccgctgacccacgagcatccaggaggcgcgcccgagtggtgcatatgttagtgatggtggccttattttttacgctgtcgtggcttccattgtgggcactgctgttactgatcgattatggccaactgagtgcccctcagctgcaccttgtgactgtttatgcattcccctttgcccactggctggcattctttaactcctccgctaacccaatcatctatgggtattttaatgagaacttcagacgggggttccaggccgcgttccgagccaggctttgtcctaggccaagtggctcgcacaaggaagcctatagcgagcgcccgggcggtctcttacaccgcagggtttttgttgtggtgcgccccagtgatagcggactccccagtgaatctggaccctcgagtggcgcccctcggcctggcagactgccccttcgtaacggccgggtcgcccaccatggcttaccgcgagagggccctggatgctctcacctgcctcttacaatccccgcatgggatatctag

SEQ ID NO: 28062 - DNA, 1569 bp, Artificial Sequence
  Description of Artificial Sequence: Synthetic coding sequence
atgaacagcttcttcggaacacccgcagccagttggtgcctattggaatccgatgtgtcttccgccccggacaaagaagccgggcgagagcgtagagctctgtctgtgcagcaaagagggggacctgcttggtccggctcccttgaatggtccagacagtccgccggagaccggcggaggctgggcttgtctcgtcaaacagccaaaagcagttggtcgcggtctagggataggacgtgctgttgtagaagagcttggtggattctggtgccagctgcagacagggctcgccgtgagaggttcattatgaatgagaaatgggacactaatagctcagaaaactggcaccccatttggaacgtgaacgacaccaagcaccatctctattctgacatcaacattacatacgttaattattatttgcatcagccgcaggttgccgcaatctttattatttcatattttctcattttcttcctgtgtatgatgggaaataccgtggtgtgtttcattgttatgaggaacaagcacatgcacaccgtcacaaacttgttcatcctgaacctcgcaattagcgacttgcttgtggggatcttctgtatgcctattactcttttagataacatcatcgctggatggccctttggtaatacaatgtgtaagatttctggcctcgttcagggcattagcgtggcagcctccgtctttaccctcgtcgccatcgcggtggatcgtttccagtgcgtcgtctaccccttcaagccaaagcttacaatcaaaacagctttcgtgattattatgataatttgggtgctagcaatcacaatcatgtctccgagtgctgtgatgttgcacgtacaggaagaaaagtactacagggttagactgaatagccagaataagaccagccccgtttactggtgcagagaggattggccgaaccaggaaatgagaaaaatttacaccactgtgttgttcgcaaatatttatctggcgcccttgtccctcatcgttatcatgtacggtcgtataggaatttccctgttcagggcagctgtgccgcatacaggcaggaagaaccaggagcagtggcatgtggtctcccgcaagaagcagaagattatcaagatgttattaatcgtcgctctcctattcattctctcttggctgccactatggactcttatgatgctttcagactacgcagatctgagccccaatgagctgcagatcatcaatatctacatttacccatttgcacactggctggccttcggcaacagttctgtcaacccaatcatatacggcttctttaacgaaaacttccgccgagggtttcaggaggccttccaactgcagctctgtcagaaaagggccaaaccaatggaggcctacgctttgaaggcaaagagccacgtgctcatcaatacctctaatcagctggtgcaagaaagcacgttccaaaatcctcatggcgaaacacttctctaccggaagagcgcagaaaagccacagcaggaactcgtcatggaagagcttaaggagacaactaattcatccgagatctag

SEQ ID NO: 28063 - DNA, 399 bp, Artificial Sequence
  Description of Artificial Sequence: Synthetic coding sequence
atgaacagctttttcggcaccccagctgcatcgtggtgcctgctcgaaagtgatgtgtccagtgctcccgacaaggaagccggccgggaacgtagagccttgtccgtccagcagcgtggaggacctgcttggtccggttcgctggaatggagtagacagtctgccggggacaggcggcgactgggcctttcaagacagacagccaagtcctcatggtccagaagccgagaccgcacatgttgttgtcgaagagcttggtggatcctcgttcctgcagccgaccgggcccgccgggagagaatggccatctggaaacacgacgtgcaggaccagtggattggccctggcaatatttgccgcagcttttccctctatgtttcctgcaattgctgcaggtag

SEQ ID NO: 28064 - DNA, 1263 bp, Artificial Sequence
  Description of Artificial Sequence: Synthetic coding sequence
atgaacgaaaagtgggataccaactcatctgagaattggcatcctatttggaacgtgaacgacacaaagcaccatctttactccgacattaatataacttacgttaactactacctacatcagccccaggtggcagcaatctttatcatctcgtatttcctgatatttttcctatgcatgatggggaatacggtggtctgtttcatagtgatgcggaataagcacatgcacacggtcacaaacctttttatcttgaaccttgccatatccgacctgctcgtaggaatcttttgtatgcctatcactttattggacaacatcatagctgggtggccctttggaaacaccatgtgcaaaatctctggcctcgtgcagggaatcagcgttgccgcatctgtcttcacgttggtggcaattgcagtcgatcggtttcagtgcgtcgtgtatccattcaagccaaagctaacaatcaagacggcttttgtgataatcatgattatttgggtgctggccattactatcatgagcccgtctgcagtgatgttgcacgtgcaggaagaaaagtattatcgtgtgaggttgaactcgcagaacaaaaccagtccagtgtactggtgccgcgaagactggcccaatcaggaaatgcgcaaaatttatactactgtgctgttcgcaaacatctacctcgcacccctttccctaatcgtaataatgtatgggaggattggcataagcctctttcgcgctgccgttcctcatacagggaggaagaaccaggagcaatggcatgtcgtgtctagaaaaaaacaaaagatcatcaaaatgctgttgatcgttgctttattgtttatcctctcctggttgcccctgtggacactgatgatgctgtctgattacgctgatctcagtcctaatgagctccagatcatcaacatctacatctacccgtttgctcactggctcgcctttgggaattcgagcgtaaatcctataatctatggcttttttaatgagaattttcgacgggggtttcaggaggcattccagctgcaactttgccaaaagcgggctaaacctatggaggcgtacgccttgaaagccaagtcccacgtcctcatcaataccagcaaccagttggtccaggagtctacgttccaaaacccgcacggcgagacattactgtacaggaaatctgccgaaaagcctcagcaggagctggtgatggaagagttaaaggagactacaaatagcagcgaaatctag

SEQ ID NO: 28065 - DNA, 1272 bp, Artificial Sequence
  Description of Artificial Sequence: Synthetic coding sequence
atgttcattatgaatgaaaagtgggatactaacagctcagaaaactggcatccaatttggaatgtcaatgacaccaaacaccacttgtacagcgatattaacatcacttatgttaactactatctacaccagccccaggtcgccgctatctttattatcagttactttttaattttttttctgtgcatgatgggtaacacagtggtgtgcttcattgtcatgcgaaataaacacatgcacactgttactaatctgttcatactgaacctggccatttctgacctgcttgtcggcatcttttgcatgcctattactctgttggacaatatcattgcaggctggccttttggtaatacgatgtgcaagattagtggactggtgcagggcatctccgtggcagcctccgtgtttaccctcgtggccattgcagtggacaggtttcaatgcgtggtgtatccgttcaaacctaaactcactattaaaaccgcatttgtgatcatcatgatcatttgggtcctagccattaccataatgtctccctccgctgtcatgctgcatgtgcaggaggaaaagtactacagggtgcggttaaattcacagaacaagacatcgcccgtatattggtgcagggaggattggcctaaccaggaaatgcgcaagatctacaccacagtgttatttgctaatatttacctcgctcctctctcactgatagtgattatgtatggaaggattggtattagcctcttcagggcggccgtgccccacactggacggaagaatcaagaacagtggcatgtcgtgtcgcgcaaaaagcaaaaaatcataaaaatgctgctaatcgtggctctgctgttcattctgagctggctgccactatggactctcatgatgctaagtgattacgccgacctgagccctaatgagcttcaaattatcaatatctatatctacccgttcgcacattggttggcattcggcaattcaagtgtcaacccaatcatttacggcttcttcaacgagaactttcgccgcgggtttcaggaagcctttcagttacagctgtgtcaaaaaagagctaagcccatggaagcctatgctctgaaagccaaaagtcatgtactgataaatacatctaaccaactggtgcaagagtcgacctttcagaaccctcacggtgagacattgttgtacagaaagtccgccgaaaaaccccaacaggaactcgtgatggaggaactgaaagaaaccacaaatagttccgagatctag

SEQ ID NO: 28066 - DNA, 1002 bp, Artificial Sequence
  Description of Artificial Sequence: Synthetic coding sequence
atgcaggccgcgggccatccagagcctctcgactctagggggtccttcagcctacctacaatgggagctaacgttagtcaggacaacggaaccggacacaatgccacattttccgaaccactcccatttttgtatgtgctcttgcccgctgtatatagcggaatctgcgcagtcggactgaccggcaacaccgcggtgatcctagtcattctccgggcccctaagatgaagaccgtgactaacgtgttcatcctcaacctcgcagtcgcagatggactcttcacactcgtgttgcccgtgaatattgctgaacatctactccagtactggcccttcggagagttgctctgtaaactggtccttgcagtcgaccactacaatatcttctccagtatctattttctcgccgtcatgtccgtggatagatacctcgtggtgctcgcgactgtgagatcaagacatatgccatggaggacttatcgaggggcgaaggttgctagtctttgtgtttggctgggtgtgacagtgctggtcttgcctttctttagttttgcaggtgtctatagcaacgagctgcaggttccctcatgtggcctgtcatttccctggcccgagcaggtttggttcaaggcctctagggtttatacactcgtcctcggcttcgtgctgccggtatgcaccatatgcgtcctgtataccgacctgctcaggagattacgggctgttcggctgagaagcggtgcaaaagctctcggaaaggcccgccggaaagtgactgtgctcgttctggtggtactggccgtctgtttactgtgctggaccccatttcatctggcatccgtggtggccttaactaccgacctacctcagaccccgttggtcatcagcatgtcttatgtaataacatccctgtcatacgctaatagttgtctgaatccattcctgtatgcctttttggatgataactttcgtaagaatttccgatctattttaagatgctag

SEQ ID NO: 28067 - DNA, 1578 bp, Artificial Sequence
  Description of Artificial Sequence: Synthetic coding sequence
atggcccttgaacggctgtgcagcgtcttaaaagtgttgctgataactgtgctagtcgtcgaggggatcgctgtagctcagaaaacccaagatgggcagaatatcggaatcaaacatatcccagccacccagtgcggcatttgggtcaggacctccaatggtggccattttgcttcccccaattacccagactcttatccaccgaataaggaatgcatttacattctggaagcggctccgcgacagaggattgagctgacctttgatgagcattactacatagaacccagtttcgaatgtcgcttcgaccaccttgaggtgcgcgacggcccgttcgggttctccccgttgatcgacagatattgcggtgttaagtccccaccccttatccggagtacagggaggtttatgtggatcaagttctcgagcgatgaagaactggagggacttggctttagagccaagtacagcttcatcccagatcctgattttacgtacttagggggtatactcaaccccatacctgactgtcaattcgaactcagcggggctgatggcattgtgcgctcttcccaggtggagcaggaagaaaaaacaaaacctggacaggccgttgattgtatatggacaatcaaggccacccccaaggcaaagatttacctgcggttcttggattatcaaatggaacattccaatgagtgcaagcggaatttcgtcgccgtgtacgacggtagttcgtctattgagaacctgaaagccaaattttgctctactgtggctaacgacgttatgctgaagaccgggattggggtgattcggatgtgggctgacgaaggctcacggctttccaggttccgcatgctcttcacatcttttgtagaaccaccatgtactagcagtaccttcttctgccacagcaacatgtgcatcaacaattcacttgtctgcaacggggtacaaaattgtgcatatccctgggatgaaaaccattgtaaggagaaaaagaaggcgggcgtctttgaacaaattacaaagacccatggaaccatcattgggataacttccggtatagtgctggtgctcttgatcatttcaatcctggtgcaagttaaacagcctagaaagaaggtaatggcgtgtaagacagcttttaataagaccggattccaagaagtcttcgatccaccacactatgagctcttcagtctgagagacaaagagatcagcgctgatctcgcagatttgagcgaggaactggacaattatcagaagatgcgccgtagctctaccgccagtcggtgcattcacgatcaccattgtggatcacaggcctctagtgtcaaacagagccgcaccaacctctccagcatggaattgccatttcggaatgattttgctcagccccagccaatgaagacatttaacagcacttttaagaaatctagctacaccttcaaacaagggcatgaatgccctgagcaagcgttggaagacagggttatggaggagattccgtgcgagatctacgtaagaggccgggaagatagtgcccaagcctccatctctatagatttctag

SEQ ID NO: 28068 - DNA, 1578 bp, Artificial Sequence
  Description of Artificial Sequence: Synthetic coding sequence
atggccctcgagcggctttgttcggtcctgaaagtccttctgatcacggttcttgtggttgaaggcattgcggtggcccagaaaacacaagacggccagaacattgggataaagcatattcccgctacgcaatgtggcatatgggtaaggacttcaaacggcggccacttcgccagcccgaattatccggactcttaccctccaaataaagagtgcatttacatcctggaggccgccccacggcagcgaatcgagctcacatttgacgagcattactatatcgagcctagcttcgagtgcagatttgatcacttagaggtccgggacggaccatttggcttctctccgctgattgaccggtattgtggtgtaaagagtccgcctctaattagatctaccgggcgcttcatgtggatcaagtttagtagcgacgaggaactcgagggcctagggtttcgagccaagtactcattcattcctgaccccgattttacgtacctgggcggtatcttgaacccaatacctgactgtcagttcgagctgtcaggagccgacgggatagtccgttcctctcaggtcgaacaggaggaaaaaacaaagccagggcaggccgtggattgtatatggactattaaagcaacaccgaaagcaaaaatatacttaagattccttgattaccagatggagcattccaacgaatgcaagcggaacttcgttgcggtgtatgatgggtcaagctcaatcgagaacttaaaggcaaaattctgttctaccgtagcgaacgacgtcatgctaaagaccggcataggagttataaggatgtgggcggacgagggatcccgcctaagcagattccgtatgctttttacttctttcgtggagccaccttgtaccagtagtaccttcttctgtcactccaacatgtgtatcaacaacagcctggtgtgcaatggcgtgcagaattgtgcttacccttgggatgaaaatcactgtaaggaaaagaagaaggccggagtctttgagcagatcacgaagacccacggtacaattatcgggatcacctctggaatcgtgctggtgctgctgattatctccatacttgtccaggtgaagcagccgagaaaaaaggtgatggcgtgtaaaaccgctttcaataagacaggattccaggaggtattcgacccaccccactacgagctctttagcctccgagataaggagatttctgctgacctggcagacttgagtgaagaactggataattaccaaaagatgaggagatcgagtaccgcctcacgttgtattcacgatcaccactgtggcagccaggcatctagtgtcaagcagtctagaaccaacttaagttctatggaactgccttttcgcaatgatttcgcacagccgcagcctatgaaaactttcaattcaacatttaaaaagagttcttatacttttaagcagggtcacgaatgtcctgaacaggccctcgaggatcgagtgatggaggagatcccctgtgagatttatgtgcggggacgtgaagattcagcccaggccagcatatctattgatttttag

SEQ ID NO: 28069 - DNA, 1233 bp, Artificial Sequence
  Description of Artificial Sequence: Synthetic coding sequence
atggagacctcttcgccgcgaccacctagaccttcctcaaacccaggtctcagccttgacgccagactgggagtcgacacaagactctgggctaaagtgctgttcacggctctgtacgccttaatctgggctctgggtgccgccggtaacgctctgtcagcacatgttgtgctgaaggcaagagccgggcgcgccggtaggctgcgccaccatgttctgtcacttgccctggcaggcctgctgctgctgctggtgggcgtacctgtggagctatacagcttcgtttggttccattatccgtgggttttcggcgacttaggatgtagaggatactactttgtgcatgaactatgtgcatacgcaaccgtgttatcagttgccggcctatctgctgaacgctgtctggctgtttgccagccgctgagagctcggtcgctgctgacgccacggagaacaagatggttggtcgctttgagctgggcggcgtccttgggcctggcccttccaatggctgtaataatgggccagaaacacgagctggaaactgctgatggcgagcccgaacccgctagccgggtatgcaccgtgctcgtctccaggaccgctttacaagtgttcattcaggtgaatgtgcttgtaagtttcgtgttgcccctagctctgaccgctttccttaacggcgtaaccgtgtctcatctcctggctctgtgctcccaggtgcctagcacctctacacctggaagttccaccccctcccggttggaacttctgtccgaggagggcctgctttccttcatcgtctggaagaagactttcatccagggagggcaggtctcactagtacgacacaaagacgtccgtcggattagatccctccaaaggagtgtacaggtgctgagagccatcgtggtcatgtacgttatctgttggcttccctatcacgcccgccgactgatgtattgttacgtgccagatgacgcctggacggaccctctgtataacttctatcattatttctacatggtgaccaatacgcttttttatgtgagtagcgctgtaactcctctgctatataacgccgtgagtagtagcttccggaagctctttctcgaggccgtttctagtctgtgtggtgagcatcacccaatgaagagattgcccccaaagcctcagagtcccacactgatggacaccgcctcaggattcggcgatcccccagaaactcgaacttag

SEQ ID NO: 28070 - DNA, 1692 bp, Artificial Sequence
  Description of Artificial Sequence: Synthetic coding sequence
atgctggaagaggcaggagaagtgctggaaaacatgctgaaagcttcctgcttgccactgggcttcatcgtgtttttgccagctgttttgttgcttgttgccccaccactgccagctgctgacgccgcccacgaattcactgtgtacagaatgcagcaatatgatttacagggccaaccctatggcaccaggaatgctgtcctgaacacggaggccagaacaatggctgcagaggtgctttcacggcggtgcgtactaatgcgcctgctggacttttcttacgaacaataccagaaagccctgagacagtctgcgggagccgtcgtaatcattctgcccagagccatggcagctgtcccacaggatgttgtccgccagttcatggaaatcgaacccgagatgcttgctatggagaccgcggtgccagtgtactttgctgtcgaagatgaggccctgctgagcatctataagcagacccaggccgcatcagcctcacagggttccgcctctgctgcggaggttctgctgagaacagctacagctaacggttttcagatggtgacatctggcgttcagagtaaagcagtaagtgattggctgatagcttctgtcgaaggtcgacttacgggcctggggggcgaggacctgcctaccatcgtaatcgttgcacattatgatgctttcggcgtcgcgccctggctcagcctcggagcagattcgaacggaagcggtgtctccgtgctgctagagctggccaggcttttctcaagactctacacctacaagagaactcacgccgcgtacaatctgttgttttttgcctccgggggagggaagttcaactaccaggggacaaagcgctggctggaggataacctggaccataccgatagtagtctgctccaggacaacgtggcctttgtattgtgtctggacactgtgggccgcggcagtagcctccacctacacgtgagcaagccaccacgcgaaggaacgcttcagcatgcttttttgcgcgagctggaaacagtcgctgctcaccagttccctgaagtgcgcttcagcatggtacataagaggatcaacttggcagaagatgtactggcgtgggaacacgaaaggttcgctatcagaagactgcctgccttcaccctgtcacacctagagagccatcgagatggacagagatcctccatcatggacgttcgatcacgcgtagatagcaaaaccctgacacggaacacccggatcatcgccgaggccctgacaagggtgatttataacttaactgagaaaggcacacccccggatatgcctgtcttcactgaacagatgcagatccagcaggagcagttggactcggtcatggattggttgaccaaccagccaagggccgctcagttagtggataaggactccacgtttctctcgactctggaacaccacctgtccaggtatcttaaggatgtcaaacaacaccacgtcaaggcagataagcgcgaccctgagttcgtcttctacgatcagctcaaacaagttatgaatgcgtatcgagtgaaacctgctgtgtttgatctcctgctagccgttggaatcgcagcatatctcggcatggcttacgtggccgttcagcatttctcgttgttatataagacagttcaacgtctcctcgtgaaggctaagacgcagtag

SEQ ID NO: 28071 - DNA, 1233 bp, Artificial Sequence
  Description of Artificial Sequence: Synthetic coding sequence
atgggggcccaggtaagacttccacctggcgaaccgtgcagggaaggctacgtgcttagcctggtatgtccaaatagtagccaggcatggtgtgagattacgaatgtgagtcaactgcttgcctcacccgtgctatataccgatctgaactactctatcaacaacctctccatatccgccaacgtagagaacaagtacagtctgtacgtaggactggttcttgcagtttcaagcagcatatttatcggatcaagctttatcctgaaaaaaaagggactgctccaactggcttcaaagggctttacacgcgccggtcagggcgggcactcttacctgaaagaatggctctggtgggtcgggctgctaagtatgggggcaggggaggcagcaaactttgccgcatacgcatttgccccggccactttagtaacccccctcggagccctgtctgtcctgatcagtgctatactttctagttactttctgaacgagcacttaaacatccacggcaaaataggctgtatcttgagtattctcggatctacggttatggtcattcatgctccacaggaagaagaagtaacaagtctacacgaaatggagatgaagctgcgggatcccgggtttattagcttcgccgtgatcattacagttatctccctggtcttgatactaatagtagcaccaaaaaaggggcagacaaatatactggtgtacatctccatctgtagcttaattggggccttcagtgtaagctccgtaaaagggcttggtatagctatcaaggagttaatagagtggaagccagtctacaagcatcctctagtattcgtgctcctagctgtcttggtgctcagcgtgactactcagatcaattatctcaacaaggccctcgacacctttaacacaagtttggtcacgccgatctattacgtgttcttcacctctatggttgtgacttgtagcgcaatcctgtttcaggaatggtacgggatgaccgccggggacatcattggaactttgagcgggttttttacgatcataattgggatctttctgcttcacgcatttaaaaataccgatattacgtggagtgaattgacttcaactgcaaagaaggaagcagtctcgttgaatgtcaacgagaacaactatgtgctgctggagaatctggagtgcagtgctcccggctacaatgacgacgtgacgctcttctccagaacagacgattag

SEQ ID NO: 28072 - DNA, 1107 bp, Artificial Sequence
  Description of Artificial Sequence: Synthetic coding sequence
atggcagcagtcgcccccgccggtccgggcgatagtgctagcgccgccttggacgaactttcgctgaatttcacgtacggggcccctggcgccggcaacggcagcctgtccggggactggtatcgtcggaaccagatacacctgttcggtgtccttctggccatcctggggaatctcgtcattagcatcagtcttaatattcagaaatacagccatttgcagctcgcgcaacaggaacaccccagaccctattttaaatctgttctctggtggggaggtgtcttactgatggccgtgggtgagactggcaattttgctgcttatggattcgctcctataaccctcattgcccccctaggatgcgtgtctgtgactggatctgccatcataagcgtgacctttttaaaggacaacttacgagccagtgaccttctgggaacaacattggcttttgccggcacttacctgctcgtgaattttgcccccaatattacgcaagccatctccgcgcgcacagtgcaatattatctagtgggatggcaatttctaatttatgtgatattggaaatccttattttctgcatccttctgtacttctataagcgtaaaggaatgaaacatatggttatattgctgacacttgtggccatattagcttcactgacggttatttctgtaaaagcggtcagtggcatgattaccttttcagtgatggacaaaatgcaactgacttacccgatcttctacataatgtttatcatcatgatcgccagctgtgtgttccaagttaaatttctcaaccaggccaccaaactctacaacacaactacggttgtcccagtgaatcacatattctttactatttcagccatcatagctgggatcattttttatcaggagtttctgggggcccccttcctgaccgtctttatctatttgttcgggtgctttctttcattcctgggggtgttcttggtcaccaggaaccgagagaaggaacacctccagcagtcttacattgactttgggaatatccctgatactacacccgagaggaaggcctggcgcgagaccaatgtgggccagaatacaacccggttcacctag

SEQ ID NO: 28073 - DNA, 975 bp, Artificial Sequence
  Description of Artificial Sequence: Synthetic coding sequence
atgctgctcggcgaattgggtgtgttcgcaagctacgctttcgctcccctctccttaatagtgccattatctgccgtgtctgtgatagcgtccgccattatcggcatcatctttatcaaagagaaatggaagccgaaggatttcctccggcgatatgtgctctctttcgtgggctgcggtttagcagtcgtgggcacttatctgcttgtcaccttcgccccaaatagccacgaaaagatgactggcgagaatgtgactcgtcatctggtttcctggcctttcttgttatatatgctggtagaaattatactgttttgcttgctactatatttctacaaggaaaaaaacgcaaataacatagttgttatcctgctgttggttgcactgctgggctcaatgacagtggtcacagtgaaagcagtagccggcatgctcgtcctttctatccaggggaatctccagctggattacccaatattctatgtgatgttcgtgtgtatggtcgcaacggccgtctaccaggccgccttcctgtctcaggcatctcagatgtacgacagtagcctgatcgcttccgttgggtacattctctccacgactatcgccattaccgctggagccattttctacctggattttataggagaggatgtgttgcatatctgtatgttcgccctcggctgtctgatcgcctttctaggggtgttcttaatcacacgcaataggaaaaaaccaatcccgttcgaaccgtacattagtatggacgccatgccaggcatgcagaatatgcacgataagggtatgactgtacagcccgaactcaaagcgagcttttcgtatggagctctcgaaaacaacgacaatatcagcgaaatctacgctccagcaaccttgccagtcatgcaggaagaacacggatcaaggtcagccagcggcgtaccatacagagtgctggaacacacgaaaaaagaatag

SEQ ID NO: 28074 - DNA, 1107 bp, Artificial Sequence
  Description of Artificial Sequence: Synthetic coding sequence
atggatggttctcactctgcggctcttaaactccagcagttgcccccaacgtcgtcatcaagcgcagtgtccgaggcctccttcagttataaagagaatctgatcggagccctattagctatctttggtcatctggtagtgtctatcgcgctcaacctccagaaatactgccatataaggttggctgggtccaaggaccccagagcttatttcaagaccaagacttggtggctcggcctttttctgatgctgctcggtgaactgggggtgttcgccagctatgcattcgctcctttgagtctcatcgtccctttgtctgccgtgtcagtgattgcgtcagctatcatcgggattatctttattaaggaaaaatggaaaccaaaagatttcttgagaaggtatgtgctgagtttcgtgggctgtggactggcggtcgttggtacttacctgctcgtcacattcgcgccgaattcacatgagaaaatgacgggcgagaacgtaactcgccacctagtcagctggccttttctcctgtacatgctggtggaaataatcctcttctgcctattattgtacttctacaaggaaaagaatgccaataatattgtggttatcctgctgttagtggctttactcgggtcaatgactgttgtgacagtgaaggctgtcgccggcatgctggtgctcagcattcaggggaacttgcagttggattatcctatcttttacgtcatgtttgtctgcatggtggccaccgccgtgtaccaagctgccttcttgtctcaggcttcacaaatgtatgatagctccttgatcgcctctgtgggctacatcctgagcacaacaattgccatcacagctggggctatcttctacttagactttattggtgaagatgtcctacatatctgcatgtttgcgctgggctgcctgatcgccttcttaggcgtgtttctgatcacgcgcaatagaaagaaacctattccctttgaaccatacatatcgatggatgccatgcctgattcttaccttcacaatcgccagttattgttcaagaggtacagcaatagcaggaatctgccccatcacaacctcgaaagcctatag

SEQ ID NO: 28075 - DNA, 681 bp, Artificial Sequence
  Description of Artificial Sequence: Synthetic coding sequence
atggacggcagccattccgcagccctgaaactccaacagttgccccccacatcatcttcctcagctgtatcggaagccagcttctcatacaaagaaaacctgatcggcgccctgctggccattttcggtcacttggtggtgtcaattgccctcaatttacagaaatactgccatatacgactggccggtagtaaagatccccgggcttatttcaaaaccaagacctggtggctgggattattcctcatgctgctaggggagcttggggttttcgcatcttacgcgttcgctcccctcagtctcatcgtgccactgagtgctgtgtcggtgatcgcaagcgcgatcattggaattattttcatcaaagagaagtggaagccgaaggactttctccgtagatatgtcctgagttttgtcggctgcgggctcgcagttgttggaacttacctgctggtaacattcgccccgaactcccatgaaaagatgacaggcgaaaatgtgactcgccacctggttagctggcctttcttgctctacatgttggtcgagattatcctgttttgtctgttactgtatttttataaggagaagaatgctaacaacatcgtggtgattctgctgctcgtggccctcctagtactgctatgccaccccggctggagcgcagtggtccagtcatag

SEQ ID NO: 28076 - DNA, 1221 bp, Artificial Sequence
  Description of Artificial Sequence: Synthetic coding sequence
atggacgggagccactcggcagcactgaaactgcagcagctgccgccaacttcttcatcaagcgccgtctccgaggcttcattctcatataaggagaaccttataggagccctgctagccatttttggtcatctcgtggtaagtatagcacttaacctgcagaagtattgccatattcgactggcagggagcaaagatccccgggcctacttcaaaacaaaaacctggtggttagggctgttccttatgttgctgggggaactgggggtctttgccagctacgctttcgctcctctgagtcttatagtacctctgagcgctgtttccgttattgcgagcgccattattggaattatatttatcaaggaaaagtggaaaccgaaagacttcttgcgccgctatgtcctctcttttgtgggatgtggcctggccgtcgttgggacatatttgctggtgactttcgctcccaactcgcatgagaagatgacgggcgaaaacgtgacacgtcatctcgtttcttggccgttcttactctatatgcttgtcgaaatcatcctcttctgcctccttctatacttctacaaggagaagaatgccaacaacatcgtcgttatcctcctgctggtcgcgttgttagggagtatgacagtggtcaccgtcaaagctgtcgccggtatgcttgtgttatcgatccaggggaacctccagctcgactatcccatcttctatgtaatgttcgtgtgtatggtcgccacggcagtgtatcaggctgcatttttaagccaggcgtctcagatgtatgattcctctcttatcgcctctgtgggatacatcctcagcaccacaatcgcaattaccgctggcgctatcttttatctcgatttcatcggagaagatgttctgcacatatgcatgttcgctctgggatgcctcatcgcctttctgggggtctttttgattaccaggaataggaagaaacctatccccttcgaaccatatattagcatggatgctatgcccggcatgcagaatatgcacgataaaggcatgactgtccaaccagaactgaaagcttcttttagttacggagccttagagaacaatgataatatctccgagatctatgcccccgctaccctgcctgtcatgcaggaggaacacggcagtcggagtgcctccggtgttccctatcgcgtcctggaacatacaaagaaagagtag

SEQ ID NO: 28077 - DNA, 681 bp, Artificial Sequence
  Description of Artificial Sequence: Synthetic coding sequence
atggatgggagtcatagtgccgcgctcaagttgcagcagctgccaccaacttcctcctcttccgcggtcagtgaggctagcttcagttataaagaaaatctgattggagctcttctggctattttcggccacctggttgtcagcatcgccctgaacctccaaaaatactgccatatcaggctggccggatctaaggatcctagagcatattttaaaactaaaacttggtggctgggactcttcctgatgctattgggtgaactcggagttttcgcatcttacgcttttgcccccctctccctcatagtcccattgagcgcagtttccgtcatcgcgtccgccatcattggaattattttcatcaaagagaaatggaagcccaaagattttctacggaggtatgtgctgtcttttgtcggctgtggattagccgtggtgggtacttacttgttggtcaccttcgctccaaattcgcacgagaaaatgactggagagaacgttactcgtcatctcgtgtcctggccgtttctgctctacatgttagtggagattatcctgttctgtctgctgctctatttctataaggaaaaaaatgccaacaacatcgttgttatccttttgttggtagccttgctagtcttgttatgccatcccgggtggtcagctgtggtgcagtcatag

SEQ ID NO: 28078 - DNA, 405 bp, Artificial Sequence
  Description of Artificial Sequence: Synthetic coding sequence
tgagtggccgggatgctggtgttaagcattcagggaaaccttcagttggattatcctatcttctacgtaatgtttgtgtgtatggtcgccactgccgtttatcaggccgcatttagcaaaaccgatagttctcccgccaatgagaataattccccctatcttcgcgagtcccacgaagccttgatgcggatgagccttgggaagtgtcctgtgttcgaatctagcctcaccgatgtaaggttgttgtttgactgtcagtgtggccttcactctgtgcacaatcattgttatcatagccggtgtaacatcctgcccggcctccatcgaggtggccgagccgctcacctgcacgtctgtacgggcgtgccccattgtattctgggtcgcctgcttaatcatgcctag

SEQ ID NO: 28079 - DNA, 4515 bp, Artificial Sequence
  Description of Artificial Sequence: Synthetic coding sequence
atggccactgccaggacatttggtcccgagcgggaggccgaaccagcgaaggaagcccgtgtggtgggatccgagctggtcgatacttacaccgtttacataatccaggtgacagacggctctcacgagtggaccgtgaaacaccgctattcagattttcatgacttacatgagaaattggttgctgagagaaagatagacaaaaatctccttcctccgaagaagatcattggaaagaattcccgtagcctggtggaaaaacgggagaaggatctggaagtttacctgcaaaagctcctggccgccttccccggcgttaccccgcgagtcctggcccacttcttgcacttccatttttacgaaattaacggcatcaccgccgccctggctgaggaattatttgagaagggtgagcagctgctcggggccggagaagtctttgccatcggacctcttcagttatacgccgtgaccgagcagcttcaacaaggcaagcccacctgcgcctctggcgatgctaagacggacttgggccacatcctggatttcacatgccgtctcaaatatttgaaagtgtcagggaccgagggaccctttggtacatccaacatccaggagcagcttctgccgttcgatctgtccatcttcaagtctctgcatcaggtggagatttcacactgtgacgctaaacatataagggggcttgttgcctcaaaacctacattagcaacattaagcgtacggttttctgccacgagtatgaaggaagttctggttccggaagcatctgaattcgacgagtgggaacccgaaggcaccaccctcgaaggcccagttaccgcagtcatacccacttggcaagccctcaccacactggacctgagccacaacagtgtctccgagattgacgaatcggtgaaactgatcccaaaaatcgagttcctggacctaagccacaacggcctgctcgtggtggacaacctgcagcatctgtacaacttggtgcatctcgacctgagctacaacaagctctcatctctcgagggactgcacaccaagttagggaacatcaaaactctgaacctggccggcaatttgttagaaagcctgtccggtctgcataagctctacagtctggtgaatctggatctgcgcgataaccgaatcgagcagatggaggaagttcggtctattgggagtctcccatgcctggagcacgtcagtctcctgaataaccctcttagtatcatcccagattatcgcacaaaggtcctggctcagtttggagaaagggcatccgaggtgtgtctggacgatactgtgacgaccgaaaaagagctcgacaccgtagaggtactgaaggctattcagaaagctaaggaggttaaaagtaaactctctaatcccgagaagaaggggggtgaagatagccggctcagcgcagctccatgtataagaccctccagtagccctcctaccgtggcccccgcatctgcatctttacctcaacctatcttgtccaatcaaggaattatgttcgttcaggaggaagccctggcctcttccctatcctctactgactccctgacacccgaacatcagccaattgcccaggggtgtagcgactcccttgagagcataccagcagggcaggcggcatcagatgaccttcgggatgtgcccggcgcggtcggtggcgcaagccctgagcatgcggagcccgaagtgcaggttgtccctgggtcagggcagatcattttcctccctttcacctgcattggatacacagccaccaaccaggattttatccagaggctgagcactctaatccggcaggccatcgagcgccagctgccggcctggatcgaggccgctaaccagcgggaggaaggccaaggagaacagggcgaagaggaggacgaggaggaggaggaggaggaagacgtggctgaaaaccggtactttgagatggggccacctgacgtcgaggaagaggagggggggggccagggagaagaggaagaagaggaggaagaggacgaagaagcagaggaagaaagactggctctagaatgggcccttggcgccgacgaagattttttattggaacacatcagaatactgaaggttctgtggtgcttcctgatacacgtccaaggcagcattaggcagttcgctgcgtgcctggtgctcaccgactttggaatcgccgtgtttgagatccctcatcaagagtcccgcgggagcagccagcacatattatcatccttgcgctttgtgttttgcttcccacacggtgacctcaccgagttcgggttcttgatgcccgagctctgtctcgtcctgaaggtgcgtcactctgaaaatacattattcatcataagtgacgccgccaatttgcacgagtttcacgcagacctgcggtcctgcttcgcacctcagcacatggcaatgctgtgttcccccatcttgtacggctctcacacttcactacaggagtttttgcgccagctactgaccttctacaaggttgccggcggatgccaggaacgcagccagggctgcttccccgtatacctcgtatattccgataagcgcatggtgcagactgcagcgggcgattacagcggaaatatagaatgggctagctgtaccctctgctcagccgtgcggaggtcctgttgcgccccaagcgaggctgtcaaatccgccgctatcccgtactggctcctccttacacctcagcaccttaacgtgattaaagcagacttcaaccccatgcctaacaggggtacccataattgtcgtaacagaaactcttttaaactctccagagttcccctcagcacagtactgttggacccgactcgctcgtgcacccaaccccgcggtgctttcgctgacggacacgttctggagctgttggtgggctacagattcgtgactgctatcttcgtgcttcctcatgagaagttccattttctgagggtgtacaatcaactgcgcgccagtttacaggaccttaagaccgtagtgatcgccaagacccccgggaccggaggttcacctcagggctctttcgccgatgggcagcccgccgaacgtcgggcctctaacgaccaacgcccacaggaagtccccgcagaggccctggcgccagccccagccgaggtgcccgcaccagctcccgcagctgcaagtgcatccgggcccgctaagacccccgccccagccgaggccagcacgagcgcacttgtgcctgaagaaacacccgtggaggcccccgctccaccccctgctgaagctcccgcacagtatccatccgaacatttgattcaagctacatccgaggagaaccagattccatcgcatctccccgcttgtcccagtctgcgtcacgtggcgagtcttcggggttcagcaattatcgaattatttcactcttctatcgcagaagttgagaacgaggagctgaggcatctgatgtggagttctgtggtcttttatcagaccccggggctggaggtgacagcctgtgtcctcttaagtacaaaagctgtgtattttgtcttgcacgatggactgaggaggtacttcagtgagcctctccaggacttttggcatcagaagaataccgactataataatagtccgttccacatttctcagtgtttcgttctgaagctgtccgacctgcaaagcgtgaacgtgggccttttcgatcagcacttcagattgacggggagtacccccatgcaggtggtgacatgcctaacccgtgacagttaccttacccactgtttcttgcagcacctaatggtggtgctcagcagcctcgagaggaccccatcgccggagcccgtcgacaaggatttctactccgagtttggcaacaaaaccacaggcaagatggaaaattacgagttgatccactcctcccgagtgaagttcacgtatcccagcgaggaggaaattggtgacctaacattcactgtggctcagaaaatggcagagcctgagaaggcccctgcactgtctatcctcctttacgtccaggcttttcaggtgggcatgcccccacctgggtgctgccgcggccctttacggccgaagacactgctgctgacgtcctccgaaatctttctgttagatgaagactgcgtgcattaccctcttcccgagtttgccaaggaaccgccacaacgtgaccggtatagattggacgacggacggcgcgtgcgcgacctggatcgagtcttaatggggtaccaaacctatccccaggccctgactctggtgttcgatgacgtgcaggggcacgacttaatggggtcagtaacccttgatcacttcggagaagtgcctgggggccccgcccgcgcctcccaaggccgcgaggtgcagtggcaagtgttcgtgcctagcgccgagagtcgggaaaaacttattagcctgcttgcgaggcagtgggaagccctctgcggtagggaacttcctgtggaattaactgggtag

SEQ ID NO: 28080 - DNA, 2457 bp, Artificial Sequence
  Description of Artificial Sequence: Synthetic coding sequence
atgggcccgcccgatgtcgaagaggaggagggcggcggacaaggagaagaagaggaagaagaggaagaggacgaggaagccgaagaggaacggctggcattagagtgggcactcggggccgacgaggactttcttctcgaacacattagaatcttaaaggtcctctggtgttttctgattcatgtgcagggctccataaggcagttcgcagcctgtctggtgctaacagacttcgggatcgctgtgtttgaaattccacaccaggagagtagggggtcttctcagcacattcttagctcacttcggttcgtgttttgctttccccacggcgacctcaccgaattcggctttctgatgccagagctgtgtctggtgctcaaagtgcgacacagcgagaataccttgttcatcataagcgacgctgccaatctccatgaatttcacgcagacctccggtcttgttttgccccgcagcacatggccatgctctgctcccctatcctctacggctctcacacatccttgcaagaattccttagacagctgctgactttttacaaagtcgccggcggatgtcaagaaaggtcccaggggtgctttccagtgtacttggtctacagcgataagaggatggttcagaccgcggccggtgattactccggaaacattgagtgggcgtcttgcaccctgtgctcagcggtgcggcgctcctgctgtgccccctccgaggcagtaaaatccgccgctatcccctactggctgctgttgacgccacagcatctgaatgttataaaggctgatttcaatcctatgccaaataggggcacgcacaactgtagaaacagaaattccttcaagctgtccagagtccctctttctactgtacttttggatccaacccgaagttgcactcaaccacgcggggcgtttgctgacggccacgttttggagctgctggtcgggtatcggttcgtaaccgccatctttgtgttgccccacgaaaaattccacttcctgcgcgtctataaccagctcagagccagcctgcaggatttaaagacagtggtgatcgctaagacgccaggcacaggcgggtccccccagggctcttttgcagatggccagcctgctgagcgacgcgcctctaatgaccagaggccacaggaggtgcctgccgaggccttagcgcccgcgcctgcagaggtgcctgcccccgctccagcagctgcttctgcctcagggcctgctaagacaccggcccccgctgaggcttctactagcgccctggtaccagaagaaacacctgtcgaagctcccgctccgcctcctgccgaggccccggctcaatatccgtcagaacaccttatacaggcgacaagtgaagagaatcagatcccaagccaccttccggcctgccctagtttgaggcacgtggcaagccttcgagggagtgctataatcgaactgtttcactcctccatcgccgaggtcgagaacgaagagctgaggcacctaatgtggagctccgtggttttctatcaaactcctggactcgaggttaccgcctgcgtgctgctctcaactaaagctgtgtatttcgtgctacacgacggtctccgccgatatttttcagagcctctgcaggacttctggcaccagaagaacacagactataataattctcccttccacatatctcagtgcttcgtccttaagctgtcagacctccaatccgtgaatgttggattgttcgaccagcattttagattaaccggtagtacccccatgcaggtagtaacttgtcttactcgggacagctacctcacccactgctttttgcagcacctgatggtcgtgctctcctctctcgaacgcacgccttccccggagcctgtagacaaggatttctactcggaattcggaaacaaaactacggggaaaatggagaattatgagcttatccacagcagtcgtgttaaattcacgtaccccagcgaggaggagattggtgacctgacatttaccgtcgcacaaaagatggccgagcccgaaaaggccccagctttgagtattctgctctacgttcaagcatttcaggtaggcatgccacctcctggatgctgtagaggtcccctcaggcccaagaccttgctgctgacgtcttctgagattttcctgctagacgaggactgcgtccattaccctttgccagaatttgccaaggaaccacctcagcgagaccgctaccgcctcgacgatggaaggagagtgcgagacttggatcgggtgttgatggggtaccagacgtaccctcaagcactgacacttgtgtttgacgatgtgcaagggcacgatcttatgggctccgcggaaagtcgagagaagctgatttcactgctggcacggcaatgggaagcgctttgcggcagggaactccctgtagagttgacaggatag

SEQ ID NO: 28081 - DNA, 1287 bp, Artificial Sequence
  Description of Artificial Sequence: Synthetic coding sequence
atggctactgctaggacgtttggccctgaacgggaggcagagcccgctaaggaagctcgagtcgtgggctctgagctggtcgatacatatacagtttatataattcaagtgacagacggctcccacgagtggacggtcaagcaccggtattcggacttccacgacctccatgagaagctggttgcggagcggaagattgataaaaatctgctaccacccaaaaaaattatcggcaaaaactctagatcgttggttgaaaaaagggaaaaggacctggaagtatatctccagaagctactcacagcatgtgtgttgctttccactaaggccgtttattttgtcctgcatgacggtcttaggcggtatttctcagagcccctgcaagatttctggcatcagaagaacaccgattacaataattcaccctttcacattagtcaatgctttgtgcttaaattgtcagacctgcaatccgtgaatgtggggctgttcgatcagcattttcgcctgaccgggtccacacccatgcaggtggtgacttgtctgacgagggactcataccttacccattgcttccttcagcatctgatggtggttcttagttcgctggagaggaccccatcaccggagcccgtggacaaggatttttactctgagttcggtaacaagaccacaggaaaaatggaaaattatgaactgattcatagcagccgagtcaagtttacatacccctccgaagaggagataggtgacctcacattcacagttgcccaaaagatggccgaaccagagaaggcccctgctctatctattctgctttacgttcaggcctttcaggtggggatgcctcccccagggtgctgccggggccccctgcggcccaaaaccctgcttcttacatcaagtgagatcttcctcttggatgaggactgcgttcactatcctctgcctgaatttgccaaagagccaccacaaagggatcgatatagactggacgatggcagacgagttagggatttagaccgtgtgctgatggggtatcagacatacccccaagccctgactctggtattcgacgatgtgcagggccatgacttgatgggatctgtaacgctggaccatttcggtgaggttccaggcggaccggcccgggcaagccagggcagggaagtacagtggcaggtgtttgtgccctccgccgagtcacgcgagaaactgatctcccttcttgcccggcagtgggaggccctctgtggccgggagctgcccgtcgagctgacgggatag

SEQ ID NO: 28082 - DNA, 4515 bp, Artificial Sequence
  Description of Artificial Sequence: Synthetic coding sequence
atggccaccgcaagaacttttggtcccgaaagggaggccgaacctgctaaagaggccagagtggtggggtccgagctggtggatacatacaccgtgtacattattcaggtcacagacggctcgcacgaatggacggtgaaacatcgctactccgacttccacgatttgcatgagaaattagttgcggaacgaaaaatcgacaagaacttgctgccaccaaagaagatcatcggtaaaaacagtagaagtctggtggagaaaagagaaaaggatctcgaggtgtacctgcagaagcttctggcagcctttcctggggtgacgccccgggtgttggctcatttcctgcactttcacttctacgagatcaacggcatcacagccgccctggcagaagagctgttcgagaaaggcgaacagctgctcggtgctggtgaggtgtttgcaatcggtcctctgcaactctacgctgtaaccgagcagctgcagcaaggcaagccgacctgtgcctctggagacgctaaaaccgacctcggacatatcctggactttacgtgcaggcttaagtatttaaaagtcagtggaaccgaagggccattcggcacatctaacatacaggagcagctgctcccgtttgatctgtccatatttaagagtctgcatcaggttgaaatctcccactgcgatgccaagcacatcagaggtctcgtggcgagcaagccaactctcgcgactctgtcagtgaggttttcggccacaagtatgaaggaggtactcgtgcctgaggcctcagaatttgatgagtgggaacccgaaggcaccacactggaaggacccgtgactgccgtcatcccaacatggcaggctctcaccaccctagacctatcccataacagcgtctcggaaattgacgagagtgtgaagttgattccaaagatcgaatttctggatctgagtcacaatggcctgcttgtggtcgataatttgcagcacctatacaacctggtccacctagacctctcttataacaaactgtcttcgctggaaggcttgcataccaagcttggcaacattaaaaccctgaacctggctggaaatctgctggagtctttgtccggtctccacaaactctattccctggtgaacctggacctgcgcgataataggattgagcagatggaggaggtgcgaagtatcggctctttaccgtgcctagaacatgtgtcgctgcttaacaatccgctttctattatcccagactatcggaccaaagtattagcgcagtttggcgaacgcgcctccgaggtgtgtctagacgatacagtcacgactgagaaggagctggacaccgttgaggtgctcaaggccattcagaaagcgaaagaggtcaagagcaagctgtcaaatcctgagaagaagggaggcgaagacagccgactgtctgcagcgccctgcattcgaccaagtagttctcctcctacagttgctccagcctccgcatctctgcctcaacctatcctgtccaatcaggggatcatgtttgtgcaggaggaagcactggcatccagcttgtctagtaccgattccctgactcctgaacaccagcccatcgcacagggatgttccgactctctcgagagtatcccagctggccaagctgcttctgatgatctacgggatgtgcctggcgccgtgggcggcgcctctccagaacacgcagagcctgaagtgcaggtggtccccggctccggccaaatcatcttcctcccattcacatgtattggctacaccgcaaccaaccaagatttcattcagagactttcaactctgatcaggcaggccatagagcgccagctccccgcctggatcgaagccgcgaaccaacgcgaggaaggccagggcgagcagggcgaagaagaggacgaagaagaggaggaagaggaggacgtggcggaaaatcgatactttgagatgggacctcctgacgtggaggaggaagaaggcggagggcagggcgaggaggaggaggaggaagaggaggatgaggaagccgaggaggaacgtctggccttagagtgggctctcggggccgatgaggatttcttactggagcatattcggatcctgaaggtcctctggtgcttcctgatccatgtgcagggaagcataaggcagttcgcagcttgcctggtcctgaccgatttcggaatagctgtcttcgagatacctcatcaggaatcccggggttcctctcaacacattctgtcaagcttgcgcttcgtcttctgtttcccccacggcgacctcacagagttcgggtttctgatgcctgaactgtgtctggtactgaaagttaggcactctgagaacaccctttttattatctcagacgcagcaaatcttcatgagttccacgccgacctcaggagctgtttcgcaccacagcatatggcaatgctgtgctctccaattctgtacggcagtcacacttccttgcaggagttcctgcggcagctcttaaccttttataaagtcgcaggcgggtgtcaggaaagaagccagggatgctttccagtgtatttggtctatagtgataagagaatggtgcagactgccgcaggggattatagtggcaatatcgagtgggcttcttgtaccctgtgttccgcggtacggcgcagctgctgcgccccatctgaggccgtcaagagtgccgccattccctattggttgttactgacccctcagcacctcaatgtgatcaaggcagacttcaacccaatgcctaatcgaggcacacacaactgccgcaatcgaaactctttcaagctgtcccgggtgcccctgtctactgtgctgttggatccgactaggtcctgtacacagccccggggcgcattcgcagatggccatgtgctggaactgctcgttgggtaccgttttgttactgccattttcgtgctcccccatgagaagttccactttctgcgtgtctataatcagcttcgggcttctctgcaggaccttaaaacggtagtgattgccaagactcctggcaccgggggctctcctcaggggagcttcgccgacggccaacccgcggagcggcgggcctctaatgaccagagaccacaagaggtgcctgctgaggcactcgcccccgcacccgccgaggtgcccgcgccagcacccgccgcagctagcgcatccggtccagctaagactccagcaccagccgaggcgtctacctctgccttagtcccagaagagactccggtagaggcacccgcgccaccgcccgcggaagctcctgcacagtaccctagtgagcacctgatccaggctacttctgaggagaaccaaattcccagccatctccccgcttgccccagcctgcggcacgtagcatcccttaggggcagtgccatcattgagttgttccattcctcaattgctgaagtcgaaaacgaggaactccgccatttgatgtggtccagtgtggtgttctaccagacaccggggctggaggtgacagcgtgtgtgcttctgagcacaaaagctgtgtactttgtgttgcacgatggtttgcgtaggtacttctctgaacccctgcaggatttttggcaccagaagaatacagactacaacaactcgcctttccatatctcacagtgctttgttctcaagctcagtgatttacagagtgtgaatgtgggtctattcgatcagcacttccggctgaccggaagtactcccatgcaggtggtaacatgtcttacacgagactcatacctgacccattgctttctgcaacacctcatggtcgtcctaagttccctagagaggactcccagtcccgagcccgtggataaggacttctattcagagtttggcaacaagacgactggcaaaatggaaaactatgaactgattcactcaagccgcgttaaatttacatatcccagcgaagaggagatcggcgacttgaccttcaccgtagcccagaaaatggccgaacctgaaaaagccccagcgctgagcatcttgctgtacgttcaggcctttcaggttggtatgcccccacctgggtgctgtcgcggtcccttgaggcccaaaactcttctgttaaccagttcagagattttcctgcttgacgaggattgcgtgcattaccccctgccagagttcgccaaggaaccacctcagcgcgatagataccgtcttgatgacggtaggcgcgtaagggatttggatagagtgctgatgggctatcagacatatcctcaggccttaactctggtgttcgacgatgtacagggccacgatttgatggggagcgttaccctggatcacttcggtgaggtgcctggcggcccggctcgggcatcacagggacgagaagtccagtggcaggtgtttgtgccctctgccgagagcagagagaagcttataagtctgctcgcacggcagtgggaagccctttgcgggagagagctgcctgtcgagctgacagggtag

SEQ ID NO: 28083 - DNA, 1752 bp, Artificial Sequence
  Description of Artificial Sequence: Synthetic coding sequence
atggcgacggcccggacctttggtcctgagcgagaagccgagcccgctaaggaagctagagttgtggggagtgagttggtcgatacctatactgtgtacattattcaagtcaccgatggaagccacgagtggacggtaaagcaccgttatagtgactttcacgatttacacgaaaagctggtggccgaaaggaaaattgataaaaatctacttcctccaaaaaagattatcgggaagaattctcgtagcctagtggagaagcgggagaaggatttggaggtttaccttcaaaagctcctggccgcttttccaggcgtcacccctagagttcttgcacatttcctgcatttccatttttatgagattaacggcattaccgccgccctggcggaggaactcttcgaaaagggcgagcaactgctgggggccggagaggtgttcgccataggccccttgcagctctatgcagttactgaacagctccaacaagggaaacccacttgtgcctcaggtgatgctaagaccgatctcggtcacatcctggatttcacgtgtaggttgaagtatctgaaggtcagcggtactgaggggcccttcgggaccagcaatatccaagagcagcttcttcctttcgacctgagcattttcaaatccctacaccaggtagaaatttcacactgtgacgctaagcacattagaggattagtggcttccaaaccgactctggccacattgagcgttaggttttcagctacctctatgaaggaggtgctggtccctgaggcctcagagttcgacgaatgggaaccagaaggaaccaccctcgaaggacctgtcaccgccgtcatccctacttggcaggctttaaccacccttgacttgtcacataattcggtctccgagattgacgagtcagtgaagctgattccgaaaatcgagtttctggatctgagccataatggactactcgtcgtcgataatctgcaacatttatacaacctcgtccatctggacctgagctataacaaactctcaagccttgaaggcctacataccaagctcggaaatatcaagaccctcaacctcgccggcaacctgctagaaagcctgtctggactgcacaaactgtactctcttgtgaaccttgaccttagggacaaccggatcgaacagatggaagaggttcgatctatcggttcgctgccatgcctcgaacacgtgtcgctcctgaacaaccccctctccattatcccagactataggactaaggtgctggcacaatttggggaaagggccagcgaggtgtgtctggatgacacagttaccactgagaaagagttggatacagtggaagtgctgaaggccattcagaaggcaaaggaggttaagtccaaattgtctaatcctgagaaaaaggggggcgaggattctaggctcagcgctgccccctgtatcaggccgagtagctccccaccaaccgtagcaccagcttcagcaagcttgccccaaccaatactgtctaatcaggggaacagggtctgtattctgcttctggtagagcctcattcaccagcttgggccccctggttgggctggggctggggtcggggagcaagcacttgctttcagcaaggccaaactcagggggggcagtgtctacttcaggccggccctcgtgggggaacacatggtcgtggggcatggccggacgcctcctgttgcctattgggcgaagattcacagctcctgtag

SEQ ID NO: 28084 - DNA, 2097 bp, Artificial Sequence
  Description of Artificial Sequence: Synthetic coding sequence
atgctccccgcaagactgcccttccgactcctgtctctattcctgaggggcagtgcccccactgccgcacgacatggtctcagggaacccttactggagcggaggtgtgctgcagccagtagctttcaacattcttcctccctgggcagggaactaccctatgacccagttgacacggagggattcggggaagggggggatatgcaggagcggtttctcttcccagagtacatacttgaccccgagccacagcctacaagggaaaagcagctgcaagagctgcagcaacaacaggaggaagaggaacgacaacgccagcaacgccgtgaggagcggcgccagcagaacctgcgggcccggtctagagagcacccggttgtagggcacccggatcccgctctcccaccgtctggggttaactgtagtggttgtggtgccgagctccattgccaggacgcaggcgttcctggctacctgccccgagagaagtttctccggactgcggaagccgacggtgggctcgctcggaccgtgtgccagcgatgttggctattgtcacatcacagacgggccttgagactgcaagttagtcgggagcaatatttggagctcgtgtcagctgccctgaggagaccagggccctccctggtgctttacatggttgatctgcttgacttaccagacgcgctgttacctgatttgccagcgcttgtgggtcctaagcaactgatcgtccttggaaataaggtggatctgctgccgcaggatgcccctgggtacaggcagagactgcgcgagcgactctgggaagattgtgccagggctggcttattacttgcccctggacaccagggtccccaacgaccagtgaaggacgaacctcaggacggcgagaaccctaatccacctaactggtctcgaaccgtagtccgcgacgtgcggctgatcagtgccaaaacggggtatggtgttgaagaactgatcagcgcattacagcgatcatggcgctatcggggggatgtttacctggtcggcgctactaatgccggaaagagtactctgttcaacaccttgctcgagagtgattactgcacagccaagggttccgaagctatcgatcgggcaacaatatccccctggccaggtacaacgcttaatctcctaaagtttcccatctgtaatcccacaccttacagaatgtttaaacgccaccaacggctaaaaaaggattcaacccaggcagaggaggacctgagcgagcaggaacagaatcagctcaacgtgcttaaaaagcacggctacgtcgttggaagggtcggccggacattcctttacagcgaagagcaaaaagataacataccgttcgaatttgacgcggactcgttagcattcgatatggagaacgatcccgtgatgggcacccataaatctacaaagcaggtcgagctcacagcacaggatgtgaaagacgcacactggttctacgacactcccggaatcacaaaagagaattgtatcttgaatctgctgaccgagaaggaggtgaacatagtactccctacacagtctatagttcctcgcaccttcgtgttgaaaccgggtatggtgctgttcctaggcgccatcggtaggattgactttctacaaggcaaccagtctgcatggtttaccgtagttgcctctaatatcctgcccgtgcatataacgagcctggacagagcagatgctctgtaccagaagcatgcaggccatacgctgctgcagattcctatgggggggaaggaacggatggcaggctttcctcctttggtcgccgaggacattatgctgaaagagggactgggagccagtgaagcggtggccgatataaagttcagttccgccgggtgggtaagtgtcactccaaatttcaaagacagattacacctgcgcggctataccccagaaggaaccgttctcaccgtgagaccaccacttcttccttatattgtgaacatcaagggtcagcgaataaagaagtctgtggcttataaaacaaaaaagccccccagcttgatgtataacgtgagaaaaaaaaagggcaagatcaacgtgtag

SEQ ID NO: 28085 - DNA, 3669 bp, Artificial Sequence
  Description of Artificial Sequence: Synthetic coding sequence
atgctcgtaggacagggagctggccctctcggccctgccgtggttacggcagccgtggtgctgttactttccggcgtcggcccggcccacgggtccgaggacatcgtagtgggctgcggcgggttcgtgaaatctgatgtggagattaactattcgctgatagaaatcaagctgtacaccaaacatgggaccttgaaataccagaccgactgcgctccaaataatggatactttatgattccactatatgacaagggagattttattcttaaaatagagcccccacttggttggagttttgagccaaccacagtcgaactgcacgttgatggggtgtctgacatctgcactaagggaggcgacatcaatttcgtgttcactggcttctccgtgaatggtaaagttctgagtaagggccagccgctggggcctgccggcgtacaagtatccttacgtaacacaggtaccgaagccaagattcagtccactgtcacccagcctggcggtaagtttgcgttcttcaaggttctgcccggtgactacgagattctcgcaactcatcccacttgggcgttgaaggaggcgtcaactacggtgagagtgactaactccaatgccaacgcggcaagtcccctgattgttgctggctacaacgtgtcagggtctgttcggtctgatggggagccaatgaagggcgtaaaattcctgcttttttcgagcttagttaccaaggaagatgtgttagggtgcaacgtcagcccagtccccggattccaacctcaggacgagtccctggtctatctctgttatacagtttctcgcgaagatggttcattcagtttctatagcctgccttccgggggctatacagtcatacctttctatagaggtgaacggatcacctttgacgtggccccttcccgactggacttcacagtcgagcacgattcattaaagatagagccagtattccacgtgatgggattctcggtaacaggacgcgtactgaacggccccgagggagacggtgttcctgaggccgttgtcacactgaataaccagatcaaagtgaagaccaaagcggatggtagcttccgtcttgaaaatattacaaccggcacctacactattcacgcccaaaaagaacatctatacttcgaaacagtcactattaagatagcacctaacacacctcagcttgctgatattatcgccaccggctttagcgtctgcgggcagattagtattattagatttccagacacagtcaagcagatgaacaaatataaggttgtgctctctagccaggacaaggataagagcctcgtgacagtggagacggacgcccacggcagcttttgttttaaggcgaagcctggaacgtataaagtccaggtcatggtccctgaagccgagaccagggccgggctgacgctaaagccacagaccttccccttaaccgttaccaacaggcccatgatggatgtggcttttgtacagtttcttgcctcagtgtcagggaaggtgagctgtctggacacatgcggggaccttttggtcacattgcagtccctgtccagacagggagaaaaacgtagcttgcagctgtcgggaaaggtcaatgcaatgacctttaccttcgataatgttctgccgggcaaatataagatcagcattatgcatgaagattggtgttggaagaataaaagcctcgaagttgaagtcctggaagacgatatgtccgcagtggagttccgacagactggctatatgctaagatgttctctgtctcacgccatcactttggaattctatcaagacgggaacggcagagagaacgttggcatttataatctttcaaagggggtgaacagattttgtctgtctaaacccggagtttataaagttactcctcggtcatgccatagattcgagcaggccttctacacctatgacacctcctcaccttccatccttacactcaccgcaattaggcaccacgtcctcggcactatcacaactgataagatgatggatgtgactgttacaatcaaaagcagcatagattctgaaccggccctggtgttaggcccactcaagagcgtccaggaactccgccgagagcaacagctcgccgaaattgaagccaggagacaggagagagagaagaacggaaatgaggagggggaggagaggatgacaaagcctcccgtccaagaaatggttgacgaactgcaggggcctttttcgtacgattttagctactgggcacgctctggggaaaaaatcaccgttactccttcttcaaaggaattgcttttttacccaccttccatggaggcagtagttagcggcgagagttgtcccggcaagctgatcgagattcacgggaaagccgggttgtttctggagggtcagatccaccctgaacttgagggcgtggagattgtcatttccgagaagggcgcctcgtcacctctgatcaccgtctttaccgacgacaagggagcatacagtgttggacccctccactccgaccttgaatacactgttactagccagaaagaagggtacgtgttaaccgccgttgagggcaccataggcgacttcaaagcctacgctcttgctggtgtgtcattcgaaatcaaggcagaggatgaccagccccttcccggagtgctgctctctctttctgggggtctctttcgctcaaatcttttgactcaggataatggaattctgaccttctcaaacctcagccccgggcaatattatttcaaaccaatgatgaaagagttcaggtttgagccgtcaagtcagatgattgaggttcaggagggacagaacctgaaaattacaattacaggatatcggactgcgtactcttgttacgggaccgtttcatctctcaacggagaacccgagcagggagtagctatggaggcagtggggcagaatgattgctcaatatacggtgaggataccgtgacggacgaggagggaaaattcagactgcgagggctcctgcccgggtgcgtgtatcacgtacaactgaaggcagaaggcaacgaccacatcgagcgagctctaccgcatcaccgggttattgaggtggggaacaatgatatagacgacgtcaatataatcgtcttcagacagatcaaccaattcgatctcagcggtaatgttattacctccagcgaatatctccctaccctctgggtgaaactctacaagagcgagaatcttgataatcctatacagacggtcagcttggggcaaagtctgttctttcattttccccccctgctccgagacggcgagaactatgttgtcctcctcgacagcaccctcccacggtcgcagtatgactacattcttccccaggtgtcctttacagcagtcggctatcacaaacacatcactttaatttttaatccaacccgaaagctgcccgaacaggacatcgcccaggggtcttacatcgcactgccactgacactgctcgtgttgctggcaggatacaatcatgacaaactgatccctctgcttttacagcttacttcgcgcttgcagggagtgcgcgccctgggccaggctgccagcgacaatagcggacccgaggacgcaaagcggcaggctaagaagcagaagacaaggagaacttag

SEQ ID NO: 28086 - DNA, 3804 bp, Artificial Sequence
  Description of Artificial Sequence: Synthetic coding sequence
atgctcgttgggcaaggcgccgggcccttagggccagccgttgtgacagctgcggtggtgctgcttctgagcggtgttggacccgcccacggttcagaagacatcgtcgtcggatgtggaggcttcgtcaaaagcgatgtggagataaactatagcttgattgagattaaattgtataccaagcatggaacattgaaatatcaaacagactgtgccccaaacaacggatattttatgattcctctatacgacaagggggacttcatacttaagatcgagcctcccctgggctggtccttcgaacccaccactgtggaactgcatgtagacggcgtgagcgatatctgcacaaagggcggagacatcaatttcgtatttacgggtttctcagtcaatggcaaagttctgtcaaagggacagcccttgggcccggcgggggtgcaggtgtcacttaggaataccggaactgaagcgaaaatccagtcaacagtgacccagcccggcggcaagtttgccttcttcaaggtcctgccaggggattatgagatcctcgcgacacatccaacctgggcacttaaggaggcttcgacaactgtgagagtgactaatagcaacgcgaatgcagcgtctccactcattgttgccggttacaatgtgtctggctcagtccgaagcgatggcgaacctatgaaaggcgtgaaattcctcctgttttcatccctcgtgaccaaggaggatgtcctgggatgtaacgtttccccagttccgggatttcagccacaggatgagtctttggtgtacctgtgctacactgtgtcacgcgaggatggttctttcagcttctatagcttaccgtccggcggttacaccgttataccgttttaccggggagaaagaattacttttgacgtggctccctcccgactcgattttaccgtagaacatgactcactgaaaatcgaaccagtgttccatgtgatgggcttctccgtgactggcagagtgctgaacggccctgagggggatggtgtgcccgaggccgtggtgacactgaataaccagattaaagtcaagaccaaagccgatggcagctttcggctcgagaacatcaccactggcacatacacaatccacgcccaaaaggagcacctatattttgaaaccgtcaccatcaagatcgctcctaataccccccagctggcggacatcatcgccaccgggttttcggtttgcggacaaatcagcataatcagatttcctgataccgtaaagcagatgaacaagtacaaggtcgtgctctcctctcaagataaggacaagtcactcgtcactgtggagactgatgcccacggcagcttttgttttaaagcaaagcccggcacatataaagtccaggtaatggtgcccgaggcggaaacacgcgcaggactgaccttaaagccgcagacctttcctttaactgtaaccaaccgacctatgatggacgtggccttcgtgcagtttcttgcatccgtgtcgggaaaggtgtcctgcctcgacacctgcggagacctgctggttacattacaatcattgagtcggcagggcgaaaaaaggtctctacaattgtctggcaaagtgaatgctatgacatttacattcgacaacgtgttgccagggaagtataaaatttccattatgcacgaggactggtgctggaagaacaagtctttggaggtagaggtgctggaggatgatatgagtgccgtcgagtttcggcaaactggatatatgctgaggtgctcacttagccacgcgattacactggagttctatcaggatgggaacggccgcgagaacgtaggcatatataacctgtcaaaaggggtgaatagattttgcctgtctaaacctggagtctacaaggtgaccccccggtcttgtcaccggtttgaacaagcattttacacctatgacacgagctctcccagcatcctcacactcaccgcgatcaggcaccatgtgctgggaacaatcaccactgacaagatgatggacgtgaccgtgaccatcaaatcttccatcgactctgagccagcgctggtgctcgggccactgaagtcagtccaagagttgagacgcgaacagcagctcgcggagatcgaggcgcggagacaagagcgcgagaagaatggtaacgaggagggtgaggagcgcatgacgaagccgcccgttcaggagatggtggatgaactgcagggacccttttcctatgatttctcctactgggccaggtcaggagagaagattaccgtgacaccgtctagtaaggagttactgttttatccgccctcaatggaggcagtcgtgagcggcgagtcatgccccgggaaactcattgaaattcacggcaaggctgggctgttcctggaaggacagattcatccagaattggaaggagttgagatcgtgattagcgagaagggagctagcagtccgctcatcaccgtgttcaccgacgacaagggtgcctactcggtcgggcctctgcacagcgacttggagtatacggtcacttctcaaaaagaaggctatgttctgaccgcggtcgagggaacaatcggtgactttaaggcgtacgcactggccggcgtaagtttcgagattaaggcagaggacgatcaaccactcccaggggtgctcttgtctctatctgggggactgttcagatccaatctgctgacccaagacaatggtatactgacgttctctaatttgagccccggccaatattatttcaagccaatgatgaaggagttcaggtttgagccctcctcccagatgatcgaggtccaggaaggacagaatctgaagatcactatcaccggctatcggacggcctacagttgctatgggactgtaagttcactaaacggggagcctgaacagggggttgccatggaggcggtcggccagaatgattgcagtatttatggcgaggacacggtgacagacgaagaagggaagtttcggctaaggggactgttgcccggctgtgtgtatcatgtccagcttaaagcggaaggcaacgatcacatcgaaagagcgcttcctcaccatagagtgattgaagtggggaacaacgacatcgatgatgtgaacatcattgtgtttcggcagatcaatcagtttgacttgtcaggcaacgtaataactagcagcgagtatctccccaccctctgggttaagctgtacaagagcgaaaatttggataatcccattcaaactgtgtcattgggccagtcacttttttttcattttccacctttgctgcgggatggagaaaattacgtcgttttgctggattccaccctgcccagatcgcagtacgattacatattgccccaggtctccttcaccgcggtcggataccataaacacatcaccctgatctttaaccctacccggaaattacccgaacaggacattgctcagggttcgtatatagccctcccactcacgcttctggtattactagccggatacaatcacgataaactgataccactgctgctgcaacttacgtcccgactccagggagttcgggcccttggccaagctgcaagcgacaactcggggcccgaggacgcgaaacgacaggcaaagaaacagaagaccagacggactctgcgtctacaaggcgaatttcagctgacctggtgcctggttccctggcgcgggactttgggaatccacctgtttagctctctcccctttgccagtgaaattttacttgagactaccgccacctgtatacattactag

SEQ ID NO: 28087 - DNA, 3303 bp, Artificial Sequence
  Description of Artificial Sequence: Synthetic coding sequence
atggctcggttcgctttttttaaagtgctgcccggggactatgaaatactagcaacacatccaacatgggccctcaaagaagcaagcactactgtgcgggtgacaaactccaatgccaatgctgcgtcaccattaattgtggccgggtataacgtgtccggatccgtccgatccgacggcgaaccaatgaaaggggtcaagttcctcctcttttcttctttggtcactaaggaagacgttctgggttgtaatgtgagccctgtgccaggctttcagcctcaagacgaaagtcttgtatacctgtgctacacggtctcccgcgaagacggcagttttagcttttacagtttgccatcagggggctatactgttataccgttttaccggggcgagagaattacattcgacgtagctccctcacggctggatttcacagttgagcacgattccttgaagattgaaccagtattccacgtgatgggttttagtgtaaccggcagagttctgaacgggccagagggggatggtgtccccgaagccgtggtgactcttaataatcagatcaaagtaaagaccaaggcggacgggtcatttcgcctggagaatatcacgaccgggacttacacgatccatgcacagaaggaacacctctacttcgagaccgtcacaatcaagatcgcccctaacactccccaactggcagacatcatagctactgggttttctgtgtgtggtcagattagcatcatccgcttcccggatacagtgaagcagatgaataaatacaaggtggtgctgagctctcaggataaagacaagtccctcgtaaccgtggaaaccgatgcccatggtagcttttgtttcaaggctaagcctggcacatataaggtccaggtgatggttccagaggccgaaactagagcaggcttgaccctgaaaccccagacgttccccctcactgttacaaacaggccgatgatggacgtcgctttcgtgcaatttttggcatctgtgtccgggaaggtaagttgcctcgacacatgcggggacctcctcgttacgctgcaatcactctcacggcagggagagaagcggtctttgcagttatccggaaaagttaatgccatgactttcacctttgacaacgtccttccaggtaagtataagatatcgataatgcatgaggactggtgctggaaaaataaaagtttagaggtggaagtactggaggacgatatgagcgctgtagaatttcggcaaaccggttacatgctgaggtgctcactttcccatgcgatcacactcgaattctaccaggatggcaatggaagggaaaatgtcggcatctataatctcagcaaaggagttaaccgcttctgcttaagtaagcccggcgtgtacaaagtgacaccacgttcttgccatcgatttgagcaggccttttacacctatgacacttcttcacctagtatcctcacgctcacagctatccgacaccatgtgttgggaaccatcacgaccgacaagatgatggatgtcaccgtaaccatcaagagctccatcgactccgagccagccctggtactgggtcctttgaaaagtgtccaggagttgcgcagggaacagcagcttgcagaaatcgaagcgcgccgccaagaacgggagaagaacggaaacgaggagggagaggaacgcatgacgaaaccccctgtccaggagatggttgatgagctccaggggccattttcgtacgacttctcatactgggcaaggtctggagagaaaatcaccgtgaccccgtcttccaaggaactgctgttttatcccccttccatggaggcagtggtatctggggaatcatgccccggtaagttgatcgaaatccacgggaaagctggtctatttctggaaggacagattcatcccgaactggagggcgtcgagattgtgatatctgagaaaggtgcttcttcccctctgataacagtttttacagacgataagggggcatattctgtgggtcccttgcacagtgatctggagtacactgtgaccagtcaaaaggagggatacgtgttaacagcggtggaaggtaccatcggggattttaaggcctatgctcttgccggagtttccttcgaaattaaggccgaggatgatcagcctcttcctggggtcctgctatccctgtctggcggcctgttccggtccaatctcctgacccaggacaacgggatcttgacattctccaaccttagccctgggcagtactatttcaaaccaatgatgaaagaattccggtttgagccatcatcgcagatgattgaggtacaagagggacagaacctaaagataacgataaccggctatagaacagcgtacagttgctatggcacggtgagcagcctgaacggcgaacctgaacagggtgtggctatggaagccgtcggacagaacgactgttctatttacggagaagatacagttaccgatgaagagggaaagtttagactccggggcctgctgcctggatgcgtttatcatgtccaattgaaagccgagggcaatgaccatattgagagggccctgccccatcaccgagtgattgaggtggggaataacgatatagacgacgtgaatataattgtattccgacagatcaaccaatttgacttgtccggcaacgtgattacctcctccgagtatctccccacactttgggtgaagctgtacaagtcagagaacctggataatccgatccagacagtaagtctaggccagagtctgttcttccatttccccccactgctgagggatggtgagaactatgtggtgttgcttgattccaccttgccgcggagccagtatgactacattcttccccaggtaagcttcactgccgtggggtatcacaaacacatcactctaatttttaatccaacacgtaagttgcctgagcaggacattgcccagggaagttacatagctctccctctgacactcttggtactgctggccggatacaaccatgataagctaatccccttgctgctgcagctcacctcccgactgcagggggttagagctttggggcaagccgcaagtgacaattctgggcccgaagatgccaagcgccaggcaaaaaaacagaagacaaggcgcactctacgtctccagggagaattccagttgacctggtgtctcgtgccttggcggggcacactcggcattcacctgttttcatccctgcctttcgcgagcgagatcctcttggaaactaccgctacttgcattcactattag

SEQ ID NO: 28088 - DNA, 3669 bp, Artificial Sequence
  Description of Artificial Sequence: Synthetic coding sequence
atgctcgtgggccagggggccggtctcttgggacccgcggtggttacagccgccgtggtacttctattgtctggagtgggtccagcccatgggtctgaagacatcgttgtaggatgcggggggttcgtgaagtccgacgttgagattaattattcactcatcgaaatcaaactctacacgaagcacggaaccctcaaataccaaactgactgcgcccctaacaatggctacttcatgatacccctatacgacaaaggcgacttcattctaaagatcgaacccccactgggatggagttttgagcctactactgtcgagcttcacgtcgatggcgtgtccgacatttgcaccaaaggcggtgacattaacttcgtgttcaccgggttctctgtaaacggcaaggtcctgagcaaagggcagccgcttggccctgccggcgtacaggtgagtctgcgcaatacgggaactgaagccaaaatacagagcacagtgactcaaccgggaggaaaatttgcctttttcaaggtcctcccaggtgactacgagattctggccacccaccccacctgggcgttaaaggaggccagcactacagtgcgggtaaccaatagcaacgctaatgcggcctcccctctcatcgtcgctgggtataatgtatccggaagcgtgcggagtgacggggagcccatgaagggtgtgaaattcctcctcttctctagcctcgtaactaaggaggacgtactgggttgcaacgtgagcccagtgcctggatttcagcctcaggatgagagtctcgtgtatctgtgttatacagtgtctagagaagatgggtcattttccttttactccctcccctcgggaggatatacggtcattcctttctatcgcggtgagcggataactttcgacgtggcgccttcgcgcctggacttcaccgttgaacatgattctctgaagatcgaacccgtgttccacgtgatgggtttttccgtgactggtcgcgtcctgaacggcccggaaggcgatggcgtccctgaagccgtggtgaccctgaataaccaaatcaaagtcaagactaaagctgacgggagcttccgtctcgaaaacatcacgactgggacctacaccattcacgcgcagaaggagcatctctacttcgaaactgtgacaatcaagatagcacctaatactcctcagctggcagacatcgtcgccaccggatttagtgtatgtggaagaatctcaattattcgattcccggacactgtgaagcagatgaacaagtacaaagtcgttctgagcagccaggacaaagacaagagcctggtaactgtcgaaaccgatgcacacggctccttctgtttcaaagccaagcccggtacatacaaggtgcaagttatggtgcccgaggctgagacgcgggccggcctgacattaaaacctcaaacttttccgctgacggtgacggataggccagtaatggacgtggctttcgtgcagtttttggccagcgtgtcagggaaggtatcttgcttagatacatgtggagacctgcttgttactcttcagagtctgtcccgtcagggggagaagaggtctttgcaactgtctggtaaggtcaacgccatgacgtttacttttgacaacgtccttcccggcaaatataagattagcatcatgcacgaggactggtgctggaaaaacaagtccctagaggtagaggtcctggaggacgacgtgtcagccgtggaattccggcagacaggctacatgctgcggtgcagcctctcccatgcaataacattagagttctaccaagatggaaacgggagagaaaacgtggggatctacaacctcagtaaaggcgtgaaccgtttctgcttgtctaaacctggtgtatacaaggtgacacccagatcatgccacagattcgagcaggcgttctacacttacgatacctcatctccgagtatactcacactaacggccatcaggcatcacgtgctgggcacaataactactgacaagatgatggacgtcaccgtgactatcaaaagttcaattgatagtgagcctgcactagttctcggaccccttaagtctgtgcaagaactgaggcgagagcagcagctcgctgagatcgaagctaggaggcaggagcgcgagaagaatggaaatgaagagggcgaggagcggatgactaaaccccctgtgcaggagatggtggatgagttgcagggcccatttagctacgatttcagctactgggccagatccggcgagaagatcacggtcaccccaagtagcaaagagttgctgttctacccacccagcatggaggcagtcgtttcgggcgaatcgtgccccgggaaattgattgaaatacacggaaaagccggcctattcctggaggggcaaatccaccccgagctggaaggagtagaaatcgttatttccgagaaaggcgcttcttctcccttgatcaccgtgttcacagacgataaaggcgcttacagcgtcggaccgctgcattccgatctcgaatatacagtgacaagccaaaaagaaggttacgttctcaccgccgtcgagggcacaataggtgattttaaggcctatgctctggccggcgtctccttcgaaattaaagcagaagatgaccaaccattacccggtgtactgttgtcccttagtggagggttatttcgctcaaatctgctgacacaagacaatggaatcctgacattttccaaccttagtccgggccagtactatttcaagccaatgatgaaggaatttagatttgaaccatcctctcagatgatcgaggtccaggagggtcagaatctgaagatcacaataaccggctacaggacagcgtactcatgctacggcacagtgtccagcctgaatggcgagcctgagcagggagtggcgatggaggccgtaggccaaaatgattgtagcatttatggcgaagacaccgtgaccgacgaggagggcaagtttaggctgcgtggattgctgcctggatgtgtgtatcatgtgcagctcaaggccgaaggcaacgatcatatcgagcgagcgttacctcaccacagggtgatcgaggtcggcaataacgacattgatgacgtgaacattattgtgtttcgccagattaatcagttcgacttatccggcaatgtgattacatctagcgaatacctaccaactctttgggtcaaactgtacaaatcagagaacctggacaatccgatccagaccgtgagcctggggcagagcctgttctttcactttccaccattgctaagagacggcgagaactacgttgtgctgctggacagcacacttccacgttcccagtacgactacatcctgcctcaagtgtctttcaccgctgtcgggtaccacaaacatatcaccctgatctttaatcccactcgcaagctgcccgagcaggacatcgcccagggatcctacattgctctccccctgaccctgcttgtccttcttgcagggtacaatcacgacaaattgatccccttattgttgcagcttacgagtaggctgcagggggtgggcgctttaggacaagctgcatcagacaactctgggcccgaagacgcaaagcgacaagctaaaaagcagaaaacaaggagaacctag

SEQ ID NO: 28089 - DNA, 3804 bp, Artificial Sequence
  Description of Artificial Sequence: Synthetic coding sequence
atgttggtaggtcaaggcgctggtctgctagggccggctgtggtaacggctgctgtggtgttgctcctctctggcgtcggacctgcccacgggtcagaagacattgtcgtgggatgcggcggctttgtgaagagcgacgtggaaattaattactctttaatagaaatcaagctgtataccaagcacggcaccctgaaatatcaaactgactgcgctccaaacaacggctattttatgatccctctctacgataagggagatttcatcttaaagatagagcctcctctcggctggagtttcgagcccaccactgtggaattgcatgttgatggagtgtcagatatctgtaccaagggaggagacatcaactttgttttcaccgggttcagcgttaacggcaaggtgctcagcaaggggcaacccctgggaccagccggcgttcaggtgtccttgagaaatactggaactgaggctaagattcagagtacagttacacagcctggcggtaagtttgctttctttaaggtactacccggagattacgaaatactggccacacatcctacatgggccctgaaggaagcttcaacaaccgtgcgcgtaaccaattccaacgctaatgcagcgagcccccttattgttgccggctataacgtttctggttccgttcgctctgacggtgagcccatgaaaggggtgaagttcttgcttttcagtagtctggttaccaaagaggatgtgcttgggtgcaacgtgtcgccggtccccggatttcaacctcaggatgaatccctggtgtatctgtgctatacagtctcacgagaagacggctcgttcagcttttactcattaccttcaggtgggtacactgtgattcccttctaccgcggggagcgtataaccttcgatgtcgctccatcccgcctggattttacagtcgaacatgactctctgaagatcgaacctgtctttcacgtcatgggcttctcagtcacaggcagagtccttaatggcccagagggggacggtgtgcctgaggctgtggtgacactgaataaccagatcaaagtcaaaactaaggccgatggaagtttccgactagaaaacattaccacgggtacctatacaattcacgcacagaaggaacatttgtactttgagacggtgacaattaaaattgcacccaacacaccccaacttgccgatatcgtagccactggtttttccgtatgtgggagaatttctatcatcaggttcccagataccgttaagcaaatgaataagtacaaggtcgtgttgtcaagtcaagacaaagacaaaagtctcgtaaccgtcgagaccgacgcacatggttccttttgtttcaaggctaaacccggaacctataaagtgcaggtcatggtcccagaggcggaaacaagggcaggtcttactctgaagccccagacctttcctctgacggtgaccgataggcccgttatggacgttgcctttgttcaattcctcgcctcggtatctggaaaggtcagttgcctggacacgtgtggcgaccttctcgtgactctccagtctctgagccggcagggggagaaacggagcctacagttatcggggaaagttaacgccatgactttcaccttcgacaacgtgctccccgggaaatataaaatcagcatcatgcacgaggattggtgctggaaaaacaaaagcctcgaggtcgaggtcttggaagatgacgtgagcgcggtagagttcagacagacgggctatatgctaaggtgttccttaagtcacgcaattacactagaattctaccaggatggcaatggacgagagaacgtgggcatctataatctcagtaagggggtgaacaggttttgcctgtccaaaccgggagtctacaaagtcacacccaggtcttgtcaccgatttgagcaagccttttatacatatgacactagctcaccgtcaatactgacactgacagccatacgccaccacgtattggggaccatcacgactgataagatgatggacgtgacagttacaatcaagagttccatcgactcagagccagccctcgttctgggtcccttaaaatccgtgcaggagctgcgccgcgaacaacaactggctgagatcgaagcccggagacaggagcgagagaagaatggcaacgaggagggggaggagagaatgaccaaacctcccgtccaagagatggtggatgaattgcaagggccttttagctatgatttcagctactgggcccggtctggcgagaagattacagtgacacccagttcaaaagaactgctattttatcctccttcgatggaggcagtcgtctctggagagtcttgccctggaaaacttatagaaatccacgggaaggctggtctcttcctggagggtcagatccatccggagctggaaggggtggagattgtgattagcgaaaagggtgcaagttcccctctgattactgtcttcaccgacgataagggcgcttacagcgttggcccacttcatagcgacttggagtacaccgtcacctcccagaaggagggctatgtcctgactgccgtagaagggaccattggcgactttaaagcgtacgccctggccggcgtgtctttcgagattaaggctgaagatgaccaaccgctacccggcgtgctgctgagcttatccggcggactgtttcggtctaacctcctcacacaagacaatggaatcctgactttttctaatctctcgcccggacaatactacttcaaacctatgatgaaggaatttcggtttgaaccttcttcacagatgatcgaagtgcaggaggggcagaatcttaagatcactatcacaggctacagaacagcatactcctgctacggtactgtttcctctcttaacggagaacctgagcagggcgtggccatggaagccgtcggccagaacgattgctcgatctacggggaagacacagtgaccgacgaggaaggcaagttcaggctgcgaggcctattacctggctgtgtgtaccacgtccagctaaaagcagagggaaatgaccatattgagcgagccttgcctcaccacagagttatcgaagtgggcaataatgatatagacgacgtgaatattattgtgttccgtcagatcaaccagttcgacctcagtgggaacgtgattacctcaagtgaatacctgcccacactgtgggtaaaactgtacaagagcgaaaatctggataaccctattcaaacggtgtctctagggcaatccctgttctttcactttcctcccctcctgagggacggcgaaaactacgtcgtgcttttggactcaactttacctcggtcacagtatgattacattttgcctcaggtctccttcactgctgtggggtaccacaagcacataacgctgatttttaatcccaccaggaaactgccagagcaagatatcgcccaagggtcttacattgcactgccgctgacactactcgtgctgctggccggctacaaccatgataaattgatacctctgttactacaactgacatcccggctgcagggcgtcggagccttgggccaggcagctagcgacaacagtggaccagaagatgctaagaggcaggccaagaagcagaagactaggcgcactctgaggcttcaggaagagttccagcttatgtggtgtcttgtcccatggagggggactttagggattcacctcttcagctctctgccttttgcttctgagatcctgcttgaaactaccgccacttgcatccattattag

SEQ ID NO: 28090 - DNA, 3303 bp, Artificial Sequence
  Description of Artificial Sequence: Synthetic coding sequence
atggcacggttcgcattctttaaggtgttgcccggcgactacgaaattctggccacccaccccacctgggccctgaaagaagccagcactaccgtacgggtgacaaactccaatgccaatgccgcttctcccttgatcgtggccgggtataacgtgagcggcagcgttcggagtgacggggaacccatgaagggagtgaagttcctattgtttagtagtttggtcaccaaggaagatgtgctagggtgcaacgtgagccctgtgccgggctttcagccacaggacgagagtctggtctacctgtgttatacggtttctagggaagatggctccttctctttttacagtctcccttccggtggttacacagtcatccctttttacagaggggaacgtattaccttcgacgttgcccctagtagactggatttcaccgtggagcacgactcgctgaagattgagcccgtcttccatgtcatggggttttccgttaccggcagggtgctgaacggacctgagggcgacggggtacccgaggctgtggtcacccttaataaccagataaaggtcaaaaccaaggcagacggaagtttcagactggagaatattactaccgggacctataccatccacgcacagaaggagcatctgtatttcgagacagtgaccatcaagattgcgcccaatacaccacaacttgccgacatcgtagccaccggatttagcgtctgtggcaggatttcgatcatccgctttccggataccgtcaagcagatgaataagtataaggtggttctcagctctcaggacaaggataaaagtttggtgactgttgagactgacgcccacgggtccttctgctttaaggctaagcccggcacgtataaggtgcaggttatggtacctgaagccgagacccgcgctgggctcaccctcaagccccagacgtttccactgaccgtaaccgatcgcccagtaatggatgtggcctttgtacaattcctggcatcggtgtcaggtaaagtgagctgtctcgatacttgcggggatctgttggtgaccctccaaagccttagtcgtcagggagagaagcggtcattacaactgagcgggaaggtaaacgctatgaccttcacattcgataacgtgctccccggaaagtacaagattagtatcatgcatgaggattggtgctggaagaacaagtctctcgaagtcgaggtgctggaagatgatgtgtccgctgtggagtttcgacagactggatacatgcttaggtgtagcctctcccacgccattacccttgagttctaccaggatggaaacggtcgtgagaatgtagggatatataacctgagcaagggggtgaaccgattttgcctgagcaaaccgggcgtgtataaagttacgccacgcagctgtcaccgcttcgaacaggcattttatacctatgacacttcctccccaagtatactcacattgactgccatccggcaccacgttttagggaccataacaaccgataagatgatggacgtgactgtcactattaaatccagcatcgatagcgagcctgccttggtgctcgggccgctcaagtcagtccaggaactgaggagggaacagcagctcgcggagattgaagctcgcaggcaggagagagaaaaaaacgggaatgaggagggggaagaacggatgacaaaaccccctgttcaagaaatggtcgacgaactgcaggggcctttttcctacgactttagctactgggctaggtcaggggagaagatcactgtcactccgagttcaaaggaacttttattttatcctcctagtatggaggctgtggttagcggagaatcatgcccgggtaagctgatcgaaatccatgggaaagcgggattgtttctcgagggacagatccaccccgagctcgaaggagttgaaatcgtgatcagtgagaaaggagccagtagcccactcatcaccgtgttcaccgatgataagggcgcgtacagtgtgggaccgcttcattcagacctggaatatacggtgacaagtcagaaggaaggatatgtcctgacagccgtcgaagggacaatcggtgattttaaggcctatgccttagccggagtgtcctttgagatcaaggctgaggacgatcagcccttaccaggggtattactgtcgctttctggtggcttattccgctcaaatctcctgacccaggacaatggcatactaaccttctccaacttgagtccagggcagtactactttaaaccaatgatgaaagagttccgatttgaaccttcatcccagatgatagaagtgcaggaaggtcagaacctcaagataactattacggggtaccggacggcctactcctgctatgggactgttagctctctcaatggtgaacccgagcagggcgtggccatggaagccgtgggccagaacgattgctcaatctatggggaagacaccgttacagatgaagaaggcaagttccgcctccgggggctgttgccaggctgtgtgtaccacgttcagcttaaggcggagggcaatgatcatatagaaagggctcttccccatcatagggtcattgaggttggcaacaatgacatcgacgatgtgaatattatcgtgtttagacagatcaatcagtttgatctgtctggaaacgtcatcaccagtagtgaatacctgcccacgttatgggtcaaattgtacaagagcgagaacttagataatcccatccagactgtctctttgggccagtccctgttctttcactttccccctctacttcgagacggagagaactatgtcgtgttgctggattccacactgcccagaagccagtatgactacatcctcccccaggtgtcattcacagcggtggggtaccataaacatattaccctcatctttaatcccacccgcaaactcccagagcaggacatcgcgcaggggtcctacatagcccttcctcttacactactggtccttctggctgggtataaccatgataaactcatcccactcctgctccaactcacatcacgtctccagggagtgggcgcactggggcaggctgctagtgataactcgggtcccgaggacgccaagcgacaggccaagaaacaaaaaactcggcgcacacttcggctacaggaggaatttcagctgatgtggtgtttagtcccttggcggggaacattggggatccatctgttctcaagtctgccgtttgcgagcgagattcttctggaaaccactgccacttgcattcattactag

SEQ ID NO: 28091 - DNA, 3804 bp, Artificial Sequence
  Description of Artificial Sequence: Synthetic coding sequence
atgctcgtcggtcagggagccggaccgctaggaccagcagtggtcacggcagccgtcgtgctcctgctttccggtgtgggaccagctcacggatcagaagacatcgtagtgggctgcggtgggttcgtgaaatccgacgtggagatcaactacagcctcatagagatcaaattatatacaaaacacgggacactgaaataccaaactgactgcgcgcccaataacggttacttcatgattccattatacgataaaggcgatttcatccttaaaattgagccgccactgggctggtcgttcgagcccaccaccgtggagctgcacgtggacggtgtaagcgacatatgcaccaaggggggggacattaattttgttttcactgggttttccgtgaacggaaaggtgttgtcaaagggtcagccactgggaccagcaggagtccaagtcagtctccgcaatactgggaccgaggctaagatccagagtacagtgacgcagcctggcggtaaatttgcatttttcaaagtactgccaggcgactacgagattctggctacccatcccacttgggctcttaaggaggctagcaccaccgttagagtgactaactccaacgccaatgcggcatcccctctgatcgtagcgggctacaacgtgtccggtagcgttcgtagtgatggcgagcctatgaaaggagtcaaattcttgctgttttcttctctagttactaaagaggacgtgctgggctgtaacgtctcccccgtccccgggttccagccgcaggatgaatcgctagtttatctttgttacaccgtgtctcgggaggacggcagtttttccttctactcattgccctctggcggttataccgttatcccgttttaccggggcgagcgtatcaccttcgatgttgccccgtcacggttagatttcactgtggaacatgatagcttgaaaatcgagcctgtctttcatgtcatgggcttctctgttacaggcagggtccttaacggccccgaaggagatggcgtgccggaagccgtggtgactttaaacaatcagataaaagtaaagacgaaggctgacggtagcttccgccttgagaatataaccacaggaacatatacaatacacgcacaaaaagagcacctctacttcgagaccgtgacaattaagatcgcaccaaacacaccccagctggccgatatcgtcgctacagggttctccgtatgtggccagatctccattatcagattcccagatactgtgaaacaaatgaacaagtacaaggttgtcctatcttctcaggacaaggataagagcttggtcaccgtagagaccgacgcccacggtagtttttgctttaaagccaaccccggcacttataaggtccaggtgatggtccctgaagccgaaactcgcgccggcctgactcttaagcctcagaccttccctcttactgtgacagatcggccagtgatggacgtagctttcgtgcagttcctggcaagcgtgtctggaaaagtttcctgcctggacacgtgcggggacctgcttgtgaccctgcagtcactgtctcgtcaaggagaaaagagatcactgcaactgagtgggaaggtgaacgccatgaccttcacgtttgataacgtgctgcctggaaagtacaagatttcaatcatgcatgaggactggtgctggaagaataaatcactcgaggttgaagtgttggaggatgacgtgtctgccgtggagttcaggcaaacgggatacatgctcagatgttcattaagtcacgccattactttggaattctaccaagacggcaatggaagagagaacgtgggtatttataacctctcgaagggagtcaaccgattttgccttagcaagcctggggtttacaaagttacccccagaagctgccacaggttcgagcaggccttctatacctacgatacatctagcccgagcattttgactctgacggcaatccgccaccacgtcctgggtaccataaccaccgataagatgatggacgtaacggttacaattaagtcttcaatagattctgagcctgctttggtcttagggccactaaagagcgtgcaggaactcaggagggagcagcagctggccgaaatagaggctaggcggcaggagcgtgagaagaatgggaacgaggaaggcgaggagaggatgacaaagccacctgtgcaagagatggtcgacgaacttcaggggccgttctcctacgatttctcctactgggctagaagtggtgaaaagattacagtcaccccctcttctaaagagctgttattctatcccccaagtatggaggcagtggtatctggcgaatcttgccctggaaagctgatcgagattcacggtaaagcaggactatttctggagggccagattcacccagagctggagggtgtcgagattgttatatccgagaagggggcatcctcaccactcatcacagtcttcacagacgataaaggggcctactctgttggcccactccacagcgaccttgagtacaccgtgacaagccagaaagaggggtatgttctcactgcagtggagggaaccatcggagacttcaaggcttacgcactagccggagttagttttgagataaaagccgaggacgaccaacccctgccaggggtgctcctgtccctatctggtggcctattcagatcgaacctgctcacacaggacaatggtatcctgaccttttcaaatctttccccgggacagtattactttaagcctatgatgaaagagttcagattcgagccttcttctcagatgattgaagtacaggagggtcagaatcttaagattactatcacgggctaccgaaccgcatactcctgctacggcactgtgtcgtccctgaacggggagcccgagcagggcgtcgctatggaagccgtcggccaaaacgattgcagcatatacggcgaagatacggtcacagatgaggaaggtaagttcaggctgcgcggcctgctgcccggatgcgtctatcacgtgcagctgaaagcagagggcaatgaccatatcgagcgagctctgcctcaccacagagtcatcgaggtggggaataatgatattgatgacgtgaatattatcgtgttcaggcagatcaatcaattcgatctgtcaggaaacgttataacaagctctgaatacttacccaccctttgggtcaaactgtataagtccgaaaaccttgacaatccaatccagactgtgagcctcgggcaatccctgtttttccactttccaccccttcttagggacggtgagaattacgtggttttgctcgactctactctgcctaggtcacagtacgactatatcctgcctcaggtctcattcaccgccgtgggctaccacaagcacattacattgatcttcaatcctactcgaaaactccctgagcaagacatcgctcagggctcttacatcgccctgccactcacgcttctggtcttactggcgggctacaaccatgataaacttatcccacttctgctacagctgacttcaagattacagggcgtaggcgcgctagggcaggcagccagcgacaacagtggccctgaggacgcaaaacggcaggccaagaaacagaagacccgtcgaaccctgagactgcaggaagaatttcagctaatgtggtgcctagtaccatggaggggaactttgggcatacacctatttagttcgctgccttttgccagtgagattctgctagaaaccacagctacctgcatccactactag

SEQ ID NO: 28092 - DNA, 3669 bp, Artificial Sequence
  Description of Artificial Sequence: Synthetic coding sequence
atgctggtcggacaaggggcaggtcccttggggcccgccgttgtaaccgctgcagtggttctgctgctgtccggcgttggtccagctcacggatccgaggatattgtggtgggatgcggaggcttcgtgaagagcgatgtggaaattaattattcactgattgaaatcaagctttatacaaagcatgggacactcaagtatcagacagactgcgcccccaacaatgggtactttatgatccccctctatgacaagggggactttatactgaaaatcgaaccaccacttggatggtcttttgaaccaaccaccgtggaactgcacgtcgatggggtctcagacatctgtactaaggggggggacattaactttgtgttcaccggatttagcgtcaatggaaaagttctctctaaggggcaacccctgggcccggccggtgttcaggtgtccctgagaaacactggcactgaagctaagatccaatcaaccgttacccaacccggcgggaagtttgcattctttaaagtgctacctggcgactacgagatccttgctacccatcctacttgggcactgaaggaggccagcaccacagtgcgggttaccaacagcaatgcaaatgctgcctcacccttaatagttgcaggttacaatgtgtcgggctctgtacggagtgatggggaaccaatgaagggagtcaagtttctccttttcagctcactagttacaaaggaggatgtgttaggttgcaatgtctcgccggtgcccgggtttcagccccaggacgagagccttgtctatctttgctataccgtttccagggaagacggctctttttcattttactccctccccagcggaggttacactgtaatccccttctataggggagagcgcataacatttgatgtagctccatctcgtctggactttaccgtggagcacgattccctgaaaattgagccggtctttcatgttatgggtttcagtgtcacgggccgcgtccttaatgggcccgagggcgatggggtcccagaggctgtagtgaccctcaataatcagattaaagttaaaaccaaggcagatggctctttcaggctagagaacatcacgactggaacctatactatccacgctcaaaaagaacacttgtatttcgagactgttaccattaaaattgcccccaacaccccccagctggctgatatcgtggccacggggttcagtgtttgcggccagattagcatcataagattcccagacacagtgaaacagatgaataagtataaagtggtcctgagctcccaggataaggacaagagccttgtcacagtggagacggatgcccacggctctttctgtttcaaagccaaccctgggacatataaggtccaagtgatggttccagaggctgagaccagggccggcttgacattgaagccacaaaccttcccactcaccgtgaccgaccgacccgtcatggacgtggctttcgtccaattcctggcttccgttagcgggaaagtgtcctgtctagatacttgtggagatctcctcgtcaccctccagtccctgagtagacagggtgaaaagaggagtctacagttatctggcaaagttaatgccatgactttcacattcgataacgtcctgcctggtaagtataagatcagtatcatgcatgaggattggtgttggaagaacaagtctctggaggttgaggtcctggaagatgatgtaagcgctgtggaatttcgacagaccggttatatgctcaggtgctccctgtcacacgcgatcaccttggagttttatcaggacggaaatggtcgtgaaaatgttgggatttataatctgtccaaaggcgtgaatcgtttttgtctctcaaagcctggtgtttataaggtgactcccagaagttgccatagattcgagcaggccttttacacgtacgatacatcaagcccatcgattctcacattgacggctatccggcatcacgtcctgggtacaatcactaccgacaaaatgatggatgtgacagtgaccatcaaatcctccatcgactctgagcccgcactggtcctcggaccactgaaaagcgtccaggagctgcgacgtgagcaacaactcgctgagatagaggcaaggcgccaggaacgcgagaaaaatggcaatgaggaaggggaggagcgcatgaccaaaccacctgtacaagaaatggtggatgagctccagggaccatttagctacgacttttcctactgggctcggtcaggtgaaaaaatcactgtgacgccttctagcaaggagctgcttttctatcctccaagcatggaggcagtcgtgtccggggaatcctgccccggtaagctaattgagattcacggaaaggcgggcctgtttctggaaggtcaaatccatcctgaactggaaggggttgagattgttatttctgagaaaggggccagttcaccccttatcacagtgttcacagacgacaagggcgcgtactccgtggggcctttacacagcgacctagaatatacagtgacctcacagaaggagggttatgtgctaactgcagtggagggtactatcggggattttaaggcctacgctctggcaggagtgtctttcgaaataaaggccgaggatgatcaacccctgcccggtgtactgttatccctgtccgggggactcttccgctccaatctgttgacccaggataatggaatccttacattcagcaacctctcccccgggcaatattacttcaaacccatgatgaaagagtttaggtttgaaccaagcagtcagatgatagaagtgcaggaaggacagaaccttaagataaccattaccgggtatcggactgcgtactcttgttacgggacagtgtcttcactcaacggtgagccagagcagggggttgccatggaggctgtggggcagaatgattgttctatctatggagaggatacggtgaccgacgaagaggggaaatttcggttacgtggtttgctgcccggatgtgtctaccacgtgcaacttaaagcggagggtaacgaccatatcgagcgagcccttccccatcaccgcgtaatcgaggtgggcaataacgacattgacgatgttaatattatagtgttcaggcaaataaaccaatttgatctgtctgggaacgtgatcacctcatctgaatacttgcctaccctgtgggttaagctttataaaagcgagaaccttgataatcccattcaaaccgtttccttgggacagtccctgttttttcacttcccgcctctgctgagagatggcgaaaattacgtcgtactgctcgatagcaccctgcctcggagtcaatacgattacattctaccccaggtgagcttcacagcagttggttatcacaaacatattacacttattttcaacccgacgcggaaacttccagagcaagatattgcccagggatcctacatcgctctgccattaacacttctagtccttctggccggctataatcacgataaattgattcccctcttgctacagctcacctccagactgcagggcgtcggggctcttgggcaggcagcaagtgataactctggtccagaggatgccaaacgccaggcgaaaaagcagaaaaccaggaggacttag

SEQ ID NO: 28093 - DNA, 3303 bp, Artificial Sequence
  Description of Artificial Sequence: Synthetic coding sequence
atggccaggttcgccttctttaaagtgcttcctggcgattacgaaatcctggccacccaccctacctgggccttaaaggaggcctctactactgtcagggtgaccaattccaatgccaacgccgcatcaccactgatagtggctggatataatgtctccggtagtgtgcgatccgacggcgaacctatgaagggggtgaagttcctgctgttttccagtctcgtcaccaaggaggatgtactcggatgcaacgtgtcaccggtgcccgggttccaaccccaggatgaaagtctggtatatttgtgctacaccgtcagtagagaagacggcagcttctctttttacagcttaccctctgggggttataccgtgatacccttctacaggggggagcggattacatttgacgtcgcacccagccgactcgatttcaccgtggagcacgattcccttaaaatcgagcctgtctttcacgtgatgggattcagtgtaactggacgcgttcttaacggcccagaaggggatggcgtgcctgaggcagtggtcaccctcaataaccagataaaggtgaaaaccaaggccgatggcagctttagactcgagaatatcacaaccggcacctacactatccatgcacagaaggagcatctgtactttgagacagtgactattaaaatagcccctaacacccctcaacttgctgatattgtggcaacaggtttttcagtgtgtggtcagatcagtattatccgttttccagataccgtgaaacaaatgaataagtacaaagtggtgctgtcatcacaggacaaggacaagagtctggtgaccgttgaaaccgatgcccacggtagtttttgctttaaggccaaccccggaacgtacaaagtgcaggttatggtgcccgaggccgagactcgcgcaggactgacattaaaacctcaaactttccctctcactgtcaccgataggccagtcatggatgtggccttcgtacagtttcttgcatccgtcagtggcaaggtctcttgcctcgatacctgcggtgacctccttgttacactgcaatcgctttctcgccagggtgagaaacgttctctgcagctgtctgggaaggtgaatgccatgacttttacattcgataatgtgcttcccgggaagtacaaaatctccattatgcacgaggattggtgctggaagaacaagtccttggaggtcgaggtcctggaagacgacgtatcggccgtggagtttcgtcaaacgggctatatgcttaggtgcagcctgagtcatgcaatcacgctagagttttatcaggacggaaacgggcgggagaacgtcggtatctacaacctgtctaagggcgtgaatcggttctgcctgagcaagcctggggtgtataaagtgacaccacgatcgtgtcatcggtttgaacaggcgttctacacctatgatacaagttcaccatctatcttaactctaacagctatccgacaccacgtattgggcacaattactacagataagatgatggacgtcaccgttacaataaagagcagcatcgactccgagccggccctggtccttgggcctttgaagtccgttcaagagctcagacgagagcagcagctggctgaaattgaggctcgtagacaggaacgagaaaaaaacggcaatgaggagggcgaagaaaggatgactaaacctcccgtccaggaaatggtagacgaactccagggcccattttcgtatgacttttcgtactgggctcgaagcggcgaaaagatcaccgtaactccatcctctaaggagcttcttttctatccaccttctatggaggccgttgtgagcggtgagtcatgcccgggaaaattaatcgagattcatggaaaggccgggctttttttagagggtcaaattcaccccgaactcgaaggcgtggagatagtcatttcagaaaaaggcgcctcatcccctcttattactgtgttcacagacgacaagggcgcatacagcgtcggccccctgcattccgacttagagtacacagtgacttcgcaaaaggaaggatatgtcttgaccgctgtcgagggtacgattggggactttaaggcatatgcgcttgccggagtcagcttcgagattaaagccgaggacgatcagcccctgccaggtgttctgctgagcttgagcgggggcctgttccggagtaacctcctcactcaggataatgggatccttactttctcaaatctttcccctggccaatactacttcaagccaatgatgaaagaatttcgcttcgagccttcatctcagatgatcgaagtacaagaaggccagaacctgaaaatcaccattactggttaccgcactgcctatagctgctatggtaccgtgagttcactaaatggagaacctgaacagggcgtggccatggaggctgtgggccagaatgattgtagtatttacggggaagatactgtgaccgatgaggagggcaagtttcggctaagaggcttgctgccaggatgtgtttaccacgtgcagctgaaagctgaaggcaatgatcatattgagcgagctctcccccaccatcgggtgatagaagttggcaacaacgatatcgatgatgttaatataatcgtgttccggcagattaatcaattcgatctgtccggaaacgttatcactagcagcgaatatcttccgacgctctgggtgaagttgtacaaaagcgaaaacctggacaatcccattcagaccgtgtctttagggcaatcattgttcttccactttccgccgctcttgagggacggcgagaactacgtagtactactcgattctacactcccaagaagccagtacgattacattttaccacaggtgagcttcacagccgtgggataccacaaacacataacattgatttttaacccaaccagaaagctgcccgagcaggacatcgcacagggaagctatattgctttaccgttaaccctactagtgctgctggctggatacaaccatgataagctgattccactgcttctccagcttacttcccgtctgcaaggtgttggggccctggggcaggccgcatctgacaacagcgggcctgaggacgccaaacggcaggctaaaaagcagaagaccagacgtacgctccgcttgcaggaagagttccagctgatgtggtgccttgtgccctggagaggtactctcggcatccatctgttctctagcttgccattcgcatcagagatcctcctggagactactgctacctgtatccactactag

SEQ ID NO: 28094 - DNA, 4206 bp, Artificial Sequence
  Description of Artificial Sequence: Synthetic coding sequence
atggctccacagatgtatgaattccatttaccgttgagccctgaggagttactcaagtcaggaggagtgaaccaatatgtggtacaggaagtgctttccataaaacaccttcccccccagctaagggcatttcaagctgcatttcgagcccagggcccactggctatgttgcagcattttgacacaatctacagtattttacatcactttcgatcaattgacccgggtcttaaagaagacactcttcagttcttgatcaaagtagtgtccagacactctcaggaattgcccgcgattcttgatgatactacactttcagggtcagatcggaacgcacacctaaatgccctaaagatgaactgttacgcactcataaggcttctggaatccttcgagacaatggcaagtcagaccaacctggttgatcttgacctgggtgggaagggtaagaaggctcggactaaggccgctcacggcttcgactgggaggaggaaagacagcctatattacagttattaacccagctgctccagctggacattcggcacctgtggaatcatagtatcatcgaggaggaattcgtatcgctcgttactggatgttgttaccggctgctcgaaaaccctacgattaaccaccagaaaaaccgcccaactagggaggcaataacccacctcctgggagtagcccttacacgctataaccacatgctctctgccactgtgaagatcattcagatgttacaacacttcgagcacttggcccctgtactggtggccgcagtctccctctgggccacagactatggtatgaagtcgattgtcggcgagatagtccgggagatcggccagaagtgtcctcaggagctttcacgggatccctccggtaccaagggcttcgctgcattcttgaccgaattagccgagcgggttccggccatcctcatgagctccatgtgtatccttctggaccatcttgatggcgaaaattatatgatgcggaacgccgtcctcgcggccatggccgagatggtcctacaggtcctctctggagatcagctcgaagcagccgctcgagatacccgcgatcagttcttggataccctgcaggcacatggccatgatgtgaactcattcgtgcggtcccgagtgttacagctgttcacgcgcatcgtgcagcagaaggctctgccacttacacggttccaggcagtggtggccttggccgtgggccgtctcgccgataagagtgtgcttgtatgtaaaaatgcgatacagctccttgcttctttccttgccaataaccctttttcatgcaaactgagcgatgcggatctggccggccccctacaaaaggagacccagaagctgcaggagatgcgggctcaacgcaggaccgctgccgcctctgcagttctcgaccccgaggaagaatgggaagcaatgctcccagaactcaaaagcactctccaacagctgctgcagctgcctcagggggaagaggagatacccgaacaaattgccaatacagaaaccacagaagatgtcaagggccggatctatcaactgctggccaaggccagctacaaaaaggccattatcctcactcgggaggcaaccggccactttcaggaatctgaaccattttcccacattgacccagaggaatctgaggagacccgcctgttaaacatattgggactgatttttaagggtcctgccgcttcaactcaagagaaaaatcctagggagtctaccgggaacatggttactggacagaccgtatgcaaaaacaagcctaatatgtcggacccagaggaatcacgtggcaacgatgaactggtcaagcaggaaatgctggttcagtacctgcaggatgcctatagcttctcccggaagatcacagaggctatcggcatcatcagcaaaatgatgtacgagaatacaacgactgttgtgcaggaagtgattgaattcttcgtcatggttttccaatttggtgtgccacaggccctgtttggcgttcgccgcatgttacccttgatctggtccaaagaaccaggcgtgcgcgaagccgtgctcaacgcctaccgccagctctacctaaatccaaaaggagactctgcgcgcgcaaaggcccaggctttaattcagaatttaagtctgctgctggtagatgcatcggtcggcaccatacagtgcttggaagaaatcctatgtgaattcgttcaaaaggacgagctgaaacccgctgtgactcagttattatgggagagagccaccgagaaagttgcttgttgtccgctggaaaggtgttctagcgttatgctgctgggcatgatggcccgcggcaagcccgaaattgtggggtccaacctcgatacactggttagcattggcctggacgaaaaattcccccaggactaccgtttggcacagcaggtgtgccatgcaatcgctaatatctccgacagaagaaagccttcattgggcaagagacatccacctttcagacttccacaggagcataggctctttgagagactccgggagactgtgaccaagggcttcgtccaccccgatccactgtggatccctttcaaagaagtggctgtgacattgatttaccagttagcggaagggccggaggtgatatgcgctcaaatcctccaagggtgtgcaaagcaagctctcgagaagcttgaagaaaaaaggacatcccaggaagacccaaaagaatccccggccatgctacccacatttctgctgatgaatctgcttagtctcgccggggatgtagccttgcagcagctggtgcacctggaacaagccgtatcgggagaactctgccgacgccgggttctgcgggaggaacaagaacacaagaccaaggatccaaaagaaaagaatacatcctctgagacaaccatggaagaagaacttggcctagtcggggctactgccgacgacaccgaggcggaattgatacgcgggatctgtgagatggaactactggatggaaaacagacactggcagccttcgtgcccttactgctgaaagtttgcaacaaccccggcctctacagcaaccccgaccttagtgcagccgctagtctggccctcggtaagttttgcatgatctctgctactttttgcgatagccagctacgtctgctgttcacaatgctggaaaagagccctctccctattgttcggagcaacttgatggtagcaacaggcgaccttgccatacgattccctaatcttgtcgatccctggaccccccatttgtatgccagactccgcgatcctgctcagcaggtgcgaaagactgccggcctcgtgatgactcacttgatcctgaaggatatggtcaaagttaaaggacaagtgtccgagatggcagtcctcctgatcgaccctgagccccaaatagccgctctcgctaagaactttttcaatgagctgagtcacaaaggcaatgcaatttataacttactgcctgatatcattagccgtttgtctgatcccgagcttggtgtggaggaggaacctttccatacaatcatgaagcagttgctctcctatatcactaaggataagcaaaccgagagcctagtggagaagctgtgccagcggttccgtacctcacgaacagaacgccagcagcgcgatctggcatactgtgtgagtcaattacccctgactgaacgaggcctccgtaagatgctggataattttgactgttttggcgacaagctttctgacgagagcatcttttccgcattcctctccgtggttggaaagctgaggcgcggcgcgaagcccgagggcaaggccattattgatgagtttgagcaaaaacttagagcctgccatacccgaggacttgatggcatcaaggagcttgagatcgggcaggccggctctcagagagctccatccgccaagaagccctctacaggatcccgctaccaaccgctggctagtactgcttctgacaacgattttgtgacaccagagccaaggcgaacaacaagacgccatccgaacacacagcagcgagccagcaaaaaaaagcctaaagtggtgttcagttctgatgaatcctccgaggaagatctatcagcggagatgaccgaagacgaaacgccaaagaaaaccacccctatcctgagggcctccgccagacggcaccgaagttag

SEQ ID NO: 28095 - DNA, 2820 bp, Artificial Sequence
  Description of Artificial Sequence: Synthetic coding sequence
atggcgccgcagatgtatgaatttcatcttccactgagccctgaagagctgctcaagtctggcggagtcaaccagtatgtggtacaagaagtgctaagtatcaagcaccttccacctcagctgagagcttttcaggcggccttcagggcacaggggccgctggcaatgctgcagcactttgatacaatctatagtattcttcatctcgtcacgggatgctgctacaggctgctggaaaatccaacgatcaaccaccagaaaaatcggccgacgcgggaggctatcacacacctgctgggagtagcactgaccaggtataatcacatgctcagcgcgaccgttaagataatccaaatgttgcaacacttcgagcaccttgccccagtgttggtggcagccgtcagtctttgggctactgactatgggatgaagtcaattgtgggcgagattgtccgggagattggacagaaatgcccacaggaactgagcagagacccgagcggaacaaagggctttgcagccttcctgaccgaactggccgaaagagttcccgcaattctgatgtccagcatgtgcattttactggaccatctggatggcgaaaattatatgatgcgaaatgctgtcctggcggcgatggcggagatggtccttcaggtcctttcgggagaccagctcgaggctgccgcccgtgacaccagagaccagttcctcgacacccttcaggcacatggacatgatgtgaacagctttgtgcgctccagggtccttcagcttttcactagaatcgtgcagcagaaggccctgccgttgactcgattccaggccgtcgtcgccctcgcagtcggacgactagcagacaagagcgtcctcgtgtgcaagaacgcaatccagctcctggcctctttccttgctaacaatccttttagttgcaagttgtctgatgccgatctggctgggccgttgcagaaggagactcagaaattacaagagatgcgcgcacagaggcggacagccgccgcaagcgctgtgctcgatcccgaggaagaatgggaagccatgctaccagaacttaagagcaccttgcaacagctgctgcagctgccccagggagaagaagagatcccagagcaaatcgccaacactgagactacggaagatgtcaagggtaggatataccagctactggctaaagcttcctacaagaaggctataatcttgacccgggaggcgaccggccacttccaggagtcggaaccatttagccatatcgatccagaggagtctgaagaaacgcgattgctcaatattcttggactgatcttcaagggacctgccgccagcactcaggaaaagaacccacgtgagtcgacaggtaatatggtgactggacagactgtgtgtaagaacaaacctaacatgtctgaccccgaagagagccgcggcaatgacgagctcgttaagcaggagatgctcgtgcaatacttacaggatgcctactccttttccaggaagattactgaggcaattggaatcatttctaagatgatgtatgagaacaccaccacagtcgtccaggaggtgatcgaatttttcgtaatggttttccagtttggagtcccacaagccctgtttggcgttcgacgtatgcttccactgatctggtccaaggaacctggagttcgcgaggccgtgctcaacgcatacaggcagctatatttgaaccctaagggagatagcgcacgagccaaagcccaggctctcattcagaatctaagcctgttactggtggatgctagcgttggtactatccagtgcttggaggaaatcctgtgcgagttcgtccagaaagatgaactcaaaccagcagtcactcagctgctatgggaacgggctaccgaaaaagtggcctgctgcccattggagcgttgttcttctgtgatgttgctgggcatgatggccagggggaagccagagatagtgggctcaaacttagatacactggtcagtatcgggctagatgaaaaatttccccaagactatcgcctggcccagcaggtgtgccacgcgatcgctaacatttctgaccgaagaaagcctagtctgggtaaaaggcatccacccttcaggctgccccaggaacacaggctctttgagcgcctgcgggagaccgtcaccaaggggtttgttcatcccgatccactgtggatacctttcaaggaggtggctgtgaccctgatttatcagctggccgaaggccctgaggtcatctgtgcccagatccttcaggggtgcgccaagcaggcccttgagaaactggaggagaagcgtactagccaagaggatccaaaggaaagtccagccatgcttcctaccttcctcctgatgaatctcctgagcctggccggtgatgtcgccttacagcagctggttcatttagaacaggctgtctctggcgagttatgccggaggcgggtcctcagggaagagcaggagcacaaaacaaaggacccaaaagaaaaaaataccagttcggagactactatggaagaagagctagggctcgtaggcgcaacagctgacgacaccgaggcagaacttatccgcgggatttgcgaaatggaactcctcgatgggaaacagactctcgccgcatttgtgccgttgcttctcaaggtctgtaacaaccccggactgtactctaaccccgacttatcagccgccgccagtctggcgctcgggaaattttgcatgatcagcgctacattttgcgactctcagcattttgctatccctagaagggttgataacctgcgctag

SEQ ID NO: 28096 - DNA, 4071 bp, Artificial Sequence
  Description of Artificial Sequence: Synthetic coding sequence
atgttatgtaagaggtattgtcccagcaacatcttccaccacagtctagaactcttccgcctgcccttcgagcttaggggtccttggctatgttgtagtacgctgattttgtctactgcattctgtatggtgagccgccattcacaggaactcccggcaatactagatgataccaccctgagcggatcagataggaatgcccacctgaacgccctgaaaatgaattgctatgctctgatccgcctgctggaatcatttgaaacaatggccagccaaaccaacctagtggacctggacctcggcggaaaagggaaaaaagctcgtaccaaggccgctcacggcttcgactgggaagaagagaggcagccaattcttcagctccttacccagctgctgcagctcgacattcgacacttatggaaccatagcattatcgaagaagaatttgtgtccttagtgactgggtgctgctatcgcctgctcgaaaatcctacaatcaatcaccagaaaaaccgtcccaccagggaggcaatcacccatttactgggtgtagctctgactaggtacaaccacatgctgtccgccactgttaaaataatccagatgctccagcacttcgaacatctcgccccagtcttggtggctgccgtcagtctctgggccaccgattatgggatgaaaagtattgtgggcgaaatcgtcagggagatcggtcagaagtgcccacaagaactcagccgggacccctcaggtactaaaggattcgctgcctttctcaccgaactcgctgaaagggtaccagcaatcctcatgagtagcatgtgcatcctgctagaccatctggacggggaaaactatatgatgcgaaatgccgtgctcgccgcgatggcggagatggtgttgcaagtattgagcggggaccagttggaagctgccgcccgggatacccgggaccagttcctggataccctccaagcccacggccacgacgttaacagctttgtgcgcagtagggtcctacagcttttcactagaattgtccagcagaaagccctcccacttacgcgttttcaggcagttgttgctttggcagtagggcgtcttgccgataagagtgtcctggtgtgtaaaaatgcgattcagcttttggcctcgtttctggccaacaacccctttagctgtaagctttccgacgcagaccttgcgggccctctacagaaggagacacagaagctacaagaaatgagagctcagcggagaaccgccgcagcttctgctgtcctcgatcctgaggaggaatgggaggccatgttgcccgaactgaagtccaccctacaacagctgctgcagctacctcaaggtgaggaagaaatccctgagcaaatcgcaaataccgaaacaactgaggatgtgaagggccgcatctatcaactgctggcgaaagcctcctacaaaaaagcaatcatcctaaccagggaagctactggccattttcaggaaagcgaaccattcagtcatattgatccagaagagagcgaagagaccaggctactgaacatcctcgggctgattttcaagggacccgcggcatccacacaggaaaaaaaccccagagagagcacagggaacatggtgactggacagaccgtgtgtaagaacaaacctaatatgtccgatcccgaggagtctagggggaacgatgagcttgtgaagcaagagatgctggtccaatatctccaggatgcttacagcttttcgagaaagatcacagaggctatcggcatcatatccaagatgatgtacgaaaatacaacaaccgttgtgcaggaagtgatagaattcttcgtgatggttttccagttcggggtaccacaggcacttttcggcgttaggcggatgctgcctctcatatggtcaaaagagccaggggtccgggaggccgttttaaatgcataccgccagctctatcttaatcccaaaggggatagcgcaagagccaaggcacaggccttaatacagaacctgagtctgctgcttgtagatgcatccgttggcactatccagtgcctcgaggagatcctgtgcgaattcgtgcagaaggacgagctgaaaccagccgtgacccagctgttgtgggagagggccacagagaaggtggcctgctgtcctctggagagatgctcatcggttatgttgctgggcatgatggccaggggcaaaccagagatcgtagggtcaaatcttgacactttggtaagtatcggactcgacgagaaatttccacaggattacagacttgcacaacaagtgtgccacgcaattgcgaatatttcggaccggcgcaaacccagcctcggcaaacggcaccctcccttccgtctgcctcaggaacaccggctcttcgaaaggctgcgggagaccgtgactaaggggttcgttcaccctgacccgctgtggattccctttaaggaggtcgccgttacactgatctaccagctcgcggaggggcccgaagtgatctgcgcccaaatcctgcagggatgtgccaagcaggcactagaaaagcttgaggaaaaaagaacatcgcaggaagaccccaaagaaagcccggcgatgttgcccactttcctgctcatgaacctgttgtctctcgcgggggatgtagccctgcagcagctggtccatctcgagcaggccgtgtcaggagaactgtgcagacgtagagtgttgagggaggagcaagagcataaaaccaaggatcccaaggaaaagaacacaagttccgagacaaccatggaggaagaactgggactggttggagccaccgccgacgacacagaagctgaactgatcagaggcatctgcgagatggagctgctggatggaaagcagaccctcgctgccttcgtgccgctactactgaaagtgtgcaataatccagggctatattcaaaccccgacttgagcgcagccgcaagtttggcattgggcaagttctgtatgatctctgccaccttttgtgacagtcaacttcggctacttttcacaatgttggaaaagtcccccctccccatcgttcgatcaaatctgatggtggccacgggtgatttagccattagatttcccaacttagtagatccctggactcctcacctatacgctaggctcagggacccagcccaacaggtccgtaaaaccgcgggtctggtgatgacccatctgatattgaaggatatggtaaaagtaaagggacaagtgtccgaaatggcggtactgctgatcgatcctgaaccacaaattgccgcgctagcaaaaaatttttttaatgagctgtcacataaggggaatgctatctataaccttctcccagatatcatcagccgcttatccgaccccgaactgggcgtggaagaggaaccatttcacaccattatgaaacaactgctgtcatacatcacaaaggataaacagactgagagcctagtggagaaactatgtcagaggttccgcactagcaggacagaaaggcagcaacgtgacctggcatattgtgtcagccagctgccccttacggagcgaggcctaaggaagatgctggacaatttcgattgcttcggcgacaagttgtccgacgagtctatcttttctgccttcttatccgtggtaggcaaattaaggaggggcgccaaacccgagggaaaagccattattgacgagtttgagcagaaactgcgagcctgtcacactcgcgggctggatggcatcaaagagttagagatcgggcaggccggcagccaaagagctccgtcagccaagaagccgagcactggcagccggtaccagcccctggcctcaactgccagtgacaatgacttcgtgacccccgagccgaggcgcaccacacggcgccaccccaacacccaacagcgggcaagtaagaagaagccgaaagtcgttttcagctccgacgaatcctcagaggaggatctgagtgctgagatgacagaggacgaaacccctaagaagacgactcccattctcagagcgtccgctcggcgacaccgctcctag

SEQ ID NO: 28097 - DNA, 2382 bp, Artificial Sequence
  Description of Artificial Sequence: Synthetic coding sequence
atggactcttggtttatcctggtgctgttgggctcaggtctcatttgtgtatcagctaataatgcaaccaccgtggccccaagcgtcggtatcacacggctgataaattcgagcaccgcggaacctgtgaaagaagaagccaagaccagcaaccccacatcatcactgaccagtttatccgttgctccaaccttctctcctaacattacactgggcccgacttatttgactacggtgaactcttccgactctgataacggcaccacaagaacagctagcactaattctatcggtattacaattagtcctaatgggacctggctgcccgataatcagttcacagatgcaagaacagaaccatgggaaggtaattcatcaaccgctgccaccactccagagacctttccgcctagtgacgaaactcccatcatcgccgtgatggtagccctgagctccctgctcgtcattgtgtttatcatcatagtcctgtacatgttgcgtttcaaaaaatataaacaggcaggttcccacagcaactcgtttcgcttatcaaatggacgcactgaagatgtggaaccccagtccgtcccattgcttgccaggtctccctctactaatcgaaagtacccgcccctgccagtggataagctggaggaagaaatcaatcggcggatggctgacgacaataaactttttcgggaggagttcaacgctctcccagcttgcccgattcaggccacttgcgaggccgcctcaaaggaggaaaacaaagaaaaaaatcggtacgtgaatatattgccgtacgatcactcacgggtgcatttgacccccgtggagggcgtgcccgatagtgattacatcaatgcttcattcattaatggataccaggagaagaacaaatttattgccgcacaaggcccaaaagaggagaccgttaacgacttttggaggatgatatgggagcagaacactgctacaatagtcatggtcaccaatttgaaagaacggaaagaatgcaagtgcgcccaatactggcctgaccaaggctgctggacatacgggaacatccgcgtttccgtcgaagacgtcaccgtgctcgtcgattacacggtcagaaaattctgtatccagcaggtgggcgacatgactaatcgaaagccccaacgtttgattacacagtttcacttcacttcatggcccgacttcggagtaccgttcaccccaatagggatgctgaagttcctcaagaaggtcaaagcttgcaatcctcaatatgctggtgccatcgtggtgcattgctcagcgggcgttggacggactgggactttcgtcgtaatcgacgctatgctggacatgatgcacactgaaagaaaagttgatgtctatgggtttgtgtcacgaatcagagcccagcgttgccagatggtccaaacagatatgcagtatgtctttatttaccaggcactgctcgaacattacctgtatggggacaccgaattagaggttacttctttggaaacacacctgcagaaaatttacaataaaattccgggcaccagcaataatggactcgaggaagagtttaaaaagcttaccagcattaaaattcagaacgacaaaatgcgcaccggaaatctcccggccaacatgaagaagaacagagtacttcaaatcatcccttacgaatttaaccgcgtcattatccccgtcaaaagaggggaagagaacacagactatgtcaacgcatcgttcatagacggctacagacagaaggatagttacattgcctctcagggccctctactgcatactatcgaggacttctggcgcatgatttgggagtggaaaagttgctctatcgtgatgctgaccgaactcgaggagcggggccaagagaagtgcgcccagtattggccaagcgacggcctcgtctcttacggtgatattacagtggaactgaaaaaagaagaagagtgcgaatcctatacagtgcgggatctgttagtgacgaataccagggaaaataagagcagacaaatcagacagttccattttcatggctggccagaagtgggaatcccgtcagacgggaagggaatgatttccattattgctgccgtgcagaaacaacaacagcagtccggtaaccacccaatcacagtgcattgtagcgctggggcaggacggactgggacgttttgtgccctcagcactgtgttggagcgagttaaagctgaaggcattctggatgtattccagactgtcaagagcctgcgcctccaacggccacacatggttcagacgctggagcagtacgaattttgctacaaagtggtacaggaatatatcgacgcattctctgactacgctaatttcaagtag

SEQ ID NO: 28098 - DNA, 1119 bp, Artificial Sequence
  Description of Artificial Sequence: Synthetic coding sequence
atggccgctgagagacaggaggccctgcgggaattcgttgccgtcactggcgccgaagaagaccgagcccgctttttcctagaatctgcgggatgggatcttcagatcgcgcttgcctctttttacgaggacggcggagacgaagacatagtcacaattagccaagcgactccctccagcgtgagccgtggtacggcaccctccgacaatcgggtcacgagctttcgagacctgatccacgaccaggacgaggatgaggaggaggaagaggggcagcgagatcgtttttacgccgggggatctgagcgctctggtcagcagatcgtgggtcccccacgcaaaaaaagcccaaacgagctagtggatgatctgttcaaaggggcaaaagaacatggcgccgtcgccgtcgaacgggtgaccaaatcaccaggcgaaacatctaagccgcgaccttttgccgggggaggatataggttaggagctgctccagaggaggaatcggcatacgtggctggcgagaaaaggcagcattccagtcaagacgtccacgtggtattgaagttgtggaaatctggttttagcctagacaatggcgagctgcggagttaccaggaccctagtaacgcccaatttttggagagtattagacggggcgaagtacctgccgagctgcgacggctcgcccatggcggccaagtcaatcttgacatggaggaccaccgagacgaggactttgtgaaacccaagggagcgtttaaagcattcacaggagaaggccagaagttgggttcaaccgccccacaagtgctgagtacatcctccccagcgcagcaagccgagaatgaggccaaagccagttcatccatcctgatcgatgaatcggaacctaccacaaatatacagatcagactggcggacgggggtaggttggtgcagaaatttaatcacagtcaccgcatatctgacatcaggctgttcattgtggatgcccggcctgccatggcagccacaagtttcattctgatgaccacgtttccgaataaagagctagcagacgagagccagactctgaaggaggcaaacttgctcaacgctgtgatcgtacagaggctgacatag

SEQ ID NO: 28099 - DNA, 1020 bp, Artificial Sequence
  Description of Artificial Sequence: Synthetic coding sequence
atggcagcagaaagacaagaggctctgcgtgagttcgtggctgtgactggagccgaggaggacagagccagatttttccttgagagcgcaggttgggatttacagatagctctcgccagcttctacgaagacgggggggatgaagacatcgtcaccatcagccaggccactcccagctcagtttcgagaggcacagctccctcagataaccgagtgacatcattcagagacctgatccacgaccaggatgaagacgaagaggaggaggaaggtcagaggttctatgccgggggcagtgagcgctcaggccagcagatcgtggggccgcctagaaagaagtctcccaatgagctagtcgatgacttgtttaaaggtgccaaagagcatggtgccgtcgcagtggaacgcgtgaccaaaagtccaggagaaacctcaaagcctagagtccacgtcgtcctgaagctgtggaagtccggattcagccttgacaacggcgagcttcgctcataccaggacccatctaatgcgcagttccttgaaagtatccggcgcggtgaagtgcctgctgagctgaggcgtctagctcacggcggccaggtgaacttggatatggaagaccaccgggatgaagatttcgtgaaaccaaagggcgctttcaaggccttcaccggggagggccagaagctgggctctacagccccacaggtgctgtcgacctcctcccccgcacagcaggcagaaaacgaagccaaagcctcgagcagcatcctcatcgacgagtccgagcccactactaatatccagatccgtctggcagatggcggaaggctggtgcagaaattcaatcactcccatcggatttccgacattcgcctcttcatcgtggacgcccggccagccatggccgccacctcatttattttgatgacgacatttcccaacaaagagcttgctgatgagtctcagaccttgaaggaagccaacctgctgaatgccgttattgttcaaaggctgacatag

SEQ ID NO: 28100 - DNA, 780 bp, Artificial Sequence
  Description of Artificial Sequence: Synthetic coding sequence
atgaccaagatgaagatgcggcgcaagaggaaggccaggggcgcgaaggaacatggcgccgtagcggtggagagagtgaccaagtctccaggggaaacttccaagccccggccctttgccggaggcggttatcggctgggtgctgcgcctgaggaggaatctgcctatgtggcaggggagaagagacaacatagttcccaggacgtgcacgtcgtcttgaagttatggaagtccgggttttccttggataacggagagctgaggtcataccaggacccatcaaatgctcaatttctggaatctattaggagaggggaagtgcccgccgagcttcgacgactggcacatggcggccaggtgaacctcgatatggaggaccaccgggatgaggattttgtgaagcctaagggtgcgtttaaggctttcacaggcgagggacagaagctgggctcaaccgcacctcaggtgctctcaactagcagcccagctcagcaggccgagaacgaagccaaagcctcctcttcaattctgatcgacgagagtgagccaaccacgaatattcagatccgacttgccgatggaggaagacttgtccaaaaatttaaccattcccatcgcatttctgacatccgactgttcatcgtggatgcccgccccgccatggccgctacgtcctttattctcatgactacattccctaacaaagagctcgccgatgaaagccagaccctgaaagaggctaacctcttaaatgccgttatcgttcagagacttacctag

SEQ ID NO: 28101 - DNA, 1119 bp, Artificial Sequence
  Description of Artificial Sequence: Synthetic coding sequence
atggctgccgagcgccaggaggcactgagggaattcgtagcggtcacaggcgccgaagaggacagggccaggttctttctcgagagcgccggctgggacctccagatcgcattagcttccttttacgaggatggtggtgatgaagatatcgtaactattagccaggccacgccctctagtgtcagccgaggaacggcgcccagcgacaaccgtgtgacttctttccgggacctcatccacgatcaggatgaggacgaggaggaggaagagggacagcgatcgaggttctatgctgggggatcagagcgctccggacaacaaatcgtcggacctcctcggaagaagtcgccaaatgaactggttgatgacctattcaaaggtgcaaaggagcacggagcagttgcggtagaacgggtcaccaagtcaccaggagagacttctaagcctcgccccttcgcaggcggggggtataggctgggggccgccccggaggaagagtctgcctatgtagcaggcgaaaagcggcagcacagcagccaggatgtccacgtagtcctcaaactctggaagtcgggattctccctagacaatggtgaactcagatcctaccaggatccttctaacgcgcagttcctcgagtctatcagaaggggcgaagtgccagcggagctgcgcaggctggcgcacggcggtcaggttaacctcgacatggaagaccaccgcgacgaagatttcgtgaagcccaaaggagccttcaaagcctttaccggggagggacagaaactgggctcaactgcccctcaagtactcagtacgtcatcccccgctcaacaggctgaaaacgaagccaaggcgagctcgagcatccttattgacgaatcagagcctaccaccaacattcaaatcagattggccgacggcggacgtctggttcaaaaatttaatcatagccaccggatctctgatatccgtctgttcatcgtggatgcaagaccagctatggccgccacatctttcattctgatgaccacctttcctaacaaagaacttgccgacgaatcccagacccttaaagaggcaaatttgttgaatgctgtgatcgtccagaggctcacttag

SEQ ID NO: 28102 - DNA, 1056 bp, Artificial Sequence
  Description of Artificial Sequence: Synthetic coding sequence
atggaggattcccaagagacatctcctagcagcaataactcgagcgaagagctgtcttcggcgctgcacctgagcaaaggaatgtcaatctttctcgatatcctcaggcgcgccgataagaacgacgacggcaagttgagcttcgaggagtttaaggcttattttgctgatggagtactatcaggagaggagttacacgagttgttccatacaatcgacacacataatactaataacctggataccgaggagctctgtgaatattttagtcagcacctcggggagtacgagaacgtgttggctgcgctggaggatctgaacttgtccatcctcaaggctatgggaaagactaaaaaggattaccaagaagcaagtaacctggaacagtttgtgactaggtttctactcaaggagaccttgaatcagctccagagtttgcaaaatagtctggagtgtgcgatggagacgaccgaggagcagactcggcaagagcggcagggaccggccaaaccggaggtgctgtccatccaatggccaggaaaacggtcttcgcgccgggtgcaaagacataactcattctctccgaattctccccagtttaatgtctctgggcccgggcttcttgaagaggacaatcagtggatgacccaaatcaacagactgcagaagcttatcgatagattggagaagaaggatttgaaactcgagccccccgaggaggagatcattgaaggaaacactaagagccacatcatgctagttcagcgccagatgtctgttattgaagaggatctcgaggaatttcagctggctttgaagcattacgtggagtcagcctcaagtcaatccggttgtctcaggatttcaatccagaagctctcgaacgagagccggtatatgatttatgaattctgggaaaattctagcgtgtggaattcccatctgcaaactaactattcaaagaccttccagcggtccaatgttgattttctggaaacgcctgagctcacgtccaccatgcttgttcctgcaagctggtggatcctgaataattag

SEQ ID NO: 28103 - DNA, 303 bp, Artificial Sequence
  Description of Artificial Sequence: Synthetic coding sequence
atgcttgtacagcgacagatgtctgtcatagaggaagacctggaagagttccagcttgccctgaagcattacgtggaaagcgcctcttcccagtcaggatgtctgcggatttctatacagaagctgagtaatgaatctcggtatatgatctatgaattttgggagaattcaagcgtgtggaattcgcacctgcagactaattattccaaaactttccaacggtccaatgtggatttcctggaaacgcccgaactaaccagcacaatgctggttcctgcctcctggtggatactaaacaactag

SEQ ID NO: 28104 - DNA, 303 bp, Artificial Sequence
  Description of Artificial Sequence: Synthetic coding sequence
atgcttgttcagcgtcaaatgagcgtcattgaggaggatctggaggagtttcagctggcgctaaagcattacgtcgagtccgcaagtagccaatcaggttgtttgaggatttctatccagaaactctcaaatgagagtagatacatgatttacgagttttgggagaatagcagtgtgtggaactctcatctgcagactaattatagcaagacgttccagagaagcaatgtcgactttctggagacccccgagcttacttctacaatgctcgtccctgccagctggtggattcttaataactag

SEQ ID NO: 28105 - DNA, 2499 bp, Artificial Sequence
  Description of Artificial Sequence: Synthetic coding sequence
atgcacaagcattacaaggtgcactttgccaaggacgctcagtcccccaacggccactatttctgggacccagaattgggccacaggaaggggtgttgccaccagtggagacaggactcagcagcgctcagggcacacggtccgtgtcgtcctagcccgcagagccattggcagcttgcctatcattcacaccaggtgggagggagcggctggcggcgtggactgctacctagtgtcttgcaacagcagcgccagccgcagagtcaaccatctcccccctctccactcagacagagattgtgtccaatccatgaagctcagaaagggttgcctgcaaccagcacagtgcctaaggaacccgcaagcgcaccccaagcacctacgttgccgaccactgccccagcgatggctcgctccggaccggctttgccctcagcagcgggtgtccttctgaaaccaagtgaaccgaccgatgctcgcccactcccagccccagccgcatgcggatctttcacagcctatagctccgacattctgaccgaagatgatgtctactgctcctgtctcgccaaaacactatgtcacgtacctgtgcccgtgacggtggggttctatgctcccttcggctgtcggctgcacatgatgctcgacaagatcactgctctcatgcagcaggaagccgcccagagggaaagcgaagagctgcagcatgtgcagtggagacctagagctgtgagcggttggggtgtgcctcaattactctggtaccttgtgttcttacagcccattataacagaagtgcatctgaggagacgcaacgtgcaatttctgttcatcaggttttctgcttggcaatatgctggcacagacaaactgtgggctggactagtgaccacattatgtgagggcatacggcgccactatggagctctgccattcagcgtgtactctgtcctggggaacaaacccgccactcgtcaggactgctgccagtctgagtggcattgtcggcggcgagtgtgtctcggactgctggctctgttagctgctctgggcctcggagttgggctactgtacctgtcattgggcggccatgccttggggcacgggagcccctctggctccctattaaaagtgtttggaggtgccgccactaccttgagcgggtcagggcttctgatggccgtctatagcgtgggaaaacatttgttcgtctcccagcgcaaaaaaatagagaggctggtatcgagagagaagttcggtagccagttggggtttatgtgtgaggtaaagaaggaagtggaactcctcactgattttttgtgttttctggaaatctaccagcgtcgacgtctaagggtggttctcgaggtgacagggctggacacatgctaccctgagagggtcgtgggggtgcttaacgctataaataccctgctatcagattcccatgccccgtttatatttatcctcgtcgtggaccctagcattctggcagcctgtttagagtctgccgggaatatgaaaggtaccgctgataatggatacttattcttgaaccgtacagtgacactccccttctctgtcccaattatgggccggagaacaaagttacagtttctgcacgacgccgtgcagtcaagggacgatcttctatatcgggagatgactaggaaaccctggctgccgggggacgccggaggcgaatccgcccagcttctggccgtgcaagctcaggccggaacggaaaggggccagggtcgcattgatgacgaggctgctcgacgcatccaggaggccctcttttgtttacacgacgagcgggactgtctgtatgagtatgtgcctgacaacgtcgtaagcatgcggagaattgtgaacaccgtgccgatcaccgtcagactgctgcaacaacagcagcagcaaggggacttcgggggacccactcctcgccaagccgtggcatgggttgtcctcgctaaccagtggccttgccgcctaagctgggcactgcagtgtttggaagatcggcaacagaccgggggagctcctgagggcagggcccggttgtgggacgttttccgagacaactcccgggaacttcatactatgacaaaagcgctccaaaacgtgctagacctggacggcgatcctgagctcttcgagcgcttcctgggggctgacttcccttttacagtggctgaggctcagtcattgctcaggtgcaccgtgaacctcgatcactccatcaggagacgcatgggactgataagggccgtgtctgctttgaagccgccaagccctccgaaatcccccacacgggacaccccccacgcggcacaccgtgcaaatagcgcatcacgcgcaccccccagcggccgcgccagtggccaagctggggagggccatcataccggcgacctcgctcaccggggaaaactgtggccggtggcctgcgccctgtttaggccaggtcaatcctccccgggtggcccttag

SEQ ID NO: 28106 - DNA, 1596 bp, Artificial Sequence
  Description of Artificial Sequence: Synthetic coding sequence
atgcaacaggaagcagctcaaagagaaagcgaggagctccaacacgtgcagtggcgaccccgagccgtaagcggctggggagtgccccaattgttatggtacctagtctttttacagcctattatcaccgaggtccatctgcggcggcgaaacgtacagttcttattcatcaggttcagcgcctggcagtatgcaggcacagacaagctatgggccggactggtcacaaccctgtgtgaagggataagaagacactatggagccttgccttttagcgtttactcagtgttgggaaacaaaccagcgactcggcaagattgttgtcaaagcgaatggcactgccgcagacgggtttgcctgggcctcctcgcgctgttggcggctctgggcttgggggtgggtctgctgtatttgtcactcgggggccatgcgctcggtcacgggagccctagcggcagtctgctcaaggtctttggcggcgccgccaccacactgtcagggtctggcctgctaatggcggtgtactcagtgggaaagcacctcttcgtgagtcagaggaagaagatagagcgattggtttcccgtgaaaagttcgggtcacagctgggctttatgtgtgaagtgaaaaaggaggtggaattgcttacagatttcctttgctttcttgaaatctaccaaagacggcggctcagggtggtgctggaagtcacgggattagacacatgctatccagaaagggtggttggcgtgttgaatgctataaacacactgctaagcgacagtcacgctccgtttatcttcattttggtagtagacccttctattctcgctgcatgtctggaatctgctgggaatatgaagggcactgctgataacggctacctatttctcaatcggacggtaactctgccatttagtgttcccatcatggggagaagaacaaaactgcagtttctgcatgatgcagtgcaaagccgagatgatcttctgtaccgcgagatgaccaggaagccttggctccccggcgatgcggggggcgagagcgctcagctcctggcagtgcaagcccaagccggcaccgagagaggccagggtcgcatcgatgatgaggccgctcgccggatacaggaagccctgttttgtctgcacgacgaaagggactgtctctatgagtacgtccccgacaacgtggtgtccatgcggcggattgtgaacactgttcccatcaccgttcggctgctccaacaacagcagcagcaaggggatttcgggggcccaacccccagacaggcggtcgcgtgggtggtgctggccaaccagtggccatgccggctctcctgggcactccaatgcctcgaggataggcagcaaactggcggggcccccgaaggaagggccagactctgggacgtgtttcgggatactccccacgcggctcaccgcgccaattccgccagtagggcccccccctcaggccgtgcgagcggtcaggctggtgaaggtcatcacacgggtgatttggcccatagggggaagctgtggcccgttgcctgtgcactgttcagaccaggacagagcagccccggcggcccctag

SEQ ID NO: 28107 - DNA, 1833 bp, Artificial Sequence
  Description of Artificial Sequence: Synthetic coding sequence
atgcagcaggaagcagcccagcgtgagtcagaggagttacagcacgtccagtggagaccacgggctgtctcaggctggggtgtgccacagctgctgtggtacctggttttcttacagccaataatcacagaggtccacttacggcgccggaacgttcaatttctgtttatcagattctccgcatggcaatacgccgggaccgacaaactttgggcaggccttgtgactacgttgtgcgaaggaatcaggagacactatggagcgctgccgttcagtgtatatagcgtgcttggcaacaaaccagcaactcgtcaggattgctgtcaaagtgaatggcactgtcggaggagagtatgcttaggcctgctggctttactggccgcactgggattgggggtgggattactctacctgagtctgggaggccacgctctcgggcatggtagtccatctggaagcttactgaaggtattcggcggggccgctacaacactttctggaagcggcttgcttatggctgtgtacagcgttggcaaacacctgttcgtcagtcagaggaaaaagatcgagcgtcttgtgagtcgagaaaaattcggatcacagttaggatttatgtgtgaagtgaagaaggaggtagagctgctgacagactttctgtgttttctggaaatctatcagagacggagactgcgggttgtcctggaggtaaccggcctggacacctgctatcccgaaagggtcgttggagtgcttaatgcaatcaacaccttgctgtccgatagtcacgccccttttatcttcattctcgtggtggatccctcaatccttgccgcgtgtcttgagagtgccggcaatatgaaagggaccgccgataacggatacctgtttctgaataggacagtgaccttgccgttttctgttccgataatgggacgtaggactaaactgcagtttctgcacgacgctgttcagagtcgggacgacctcctctaccgagaaatgacgaggaagccttggctgccgggcgacgccggaggcgaaagcgcccagttgctggcagtccaggcacaggccggaacagagcggggtcagggaaggatcgatgacgaggccgctcggcgaatccaggaggcattattttgtctccacgacgagcgggactgtctctacgagtacgtgccagacaacgtcgtgagtatgcgccgcatagtgaatacagtgccgattacagtgaggcttctccaacagcagcaacagcagggagactttggaggccctacgcctaggcaagcagtggcttgggtagttctggccaaccagtggccatgcagactgagctgggcacttcagtgtctggaagatcgacagcagactggcggtgcccctgaaggccgagcaagattgtgggatgtttttagagataacagtagggagctgcatactatgacaaaggccctccaaaacgtgcttgatctggacggtgatcccgagctgttcgaacggttcctgggcgcagatttcccttttaccgtagcggaagcgcagagcttgctgcggtgtacggttaatctggatcattcaatcaggagacggatgggcctaatccgagccgtgtctgcccttaaacctcccagccctccgaaatcccccaccagagatactcctcatgcagcccatcgcgccaactcggccagtagggccccaccctccggtcgcgcaagtggacaggcaggtgagggacatcatacaggagacctcgctcaccgcggaaagttatggcctgtggcatgcgctctgttccgacccggtcagtcaagcccaggggggccatag

SEQ ID NO: 28108 - DNA, 1062 bp, Artificial Sequence
  Description of Artificial Sequence: Synthetic coding sequence
atgcggcttaggttctggctgcttatctggctgcttttgggcttcatttcacaccagcctacccctgtgtctttcttaaagacaatcttttggtctagaaacggacacgatggctcaatggacgtccagcaacgcgcatggagatcgaacaggtctcggcagaaggggttgagatcaatatgcatgcatacaaagaagcgggtgtcgtctttcagaggtaacaaaattgggctgaaggacgtcattaccctgagacgccatgtggagacgaaagtgagagccaagattagaaaaagaaaagtgaccaccaagatcaaccgtcacgataaaatcaacggcaagaggaagaccgcacggaagcagaagatgttccaaagggcacaagaactgaggcgaagggccgaggattatcacaagtgcaaaattccacccagcgcccggaagcccctttgcaactgggtgaggatggccgcggccgaacacaggcatagcagtggcctaccatactggttataccttacggctgagaccttgaagaatcgaatgggtcgccagccacctccacctacccaacagcactctattaccgataacagtctgtctctcaagaccccaccagagtgccttctgacaccgttgcctccctcagtggatgacaatataaaggagtgcccgctggcccccctgcctccgagccctcttcccccttccgtagacgataacctgaaggagtgcctgttcgtgcccttgcccccctcacctctcccccccagcgtggatgacaacctgaaagagtgtctctttgtacctttaccaccatcccctcttccaccatcagtcgatgataatctgaagactccacctcttgctactcaggaggccgaagtcgaaaaacctccaaaacctaagagatggcgggtcgatgaggtggaacagtcacctaagccaaaacgccagagggaagcggaggcgcagcagctaccaaaaccaaagcggaggcgattgagtaagctgcggacgcgacactgcacgcaggcctgggcaatacggatcaacccctag

SEQ ID NO: 28109 - DNA, 1827 bp, Artificial Sequence
  Description of Artificial Sequence: Synthetic coding sequence
atggccgagagtatcataatcagggtacagtcgccagatggggtaaagcgtattactgccaccaagagggaaaccgcagccacgttcttgaagaaagtcgctaaagagttcgggtttcagaataacgggttcagcgtgtacatcaatcggaacaagaccggggagattacagcctccagtaataaaagcctaaatctgctgaagattaaacacggggatctcctgttcttattcccaagcagtctggcagggccttccagcgagatggaaactagtgtgcccccaggattcaaggtgttcggcgcccctaacgttgtggaagacgaaatcgaccagtacctgagtaaacaagatgggaaaatatacaggtcgagagatcctcaactctgtagacatggcccacttggaaagtgcgtgcattgcgtacccctggagcctttcgatgaagactatctgaatcacctcgaacccccagtgaaacacatgagtttccatgcatatatacgcaagctgactggaggcgctgacaaaggtaagttcgtggccctcgagaacatctcttgtaagatcaaatctgggtgcgagggccacctcccgtggccgaatggcatttgcaccaagtgtcagccatcagctattacactcaatagacagaaatatagacacgtggataatattatgtttgaaaatcatactgtggcggaccggtttcttgatttctggcgtaagactgggaaccagcactttggctatctgtatggccgttatactgagcataaggatattcccctgggaatcagagcagaagtcgccgctatctacgagcctccgcagatcggcacgcaaaacagtttggaactcctggaggacccgaaagctgaggttgtcgatgagatcgcggccaagctcgggctccggaaggtcggatggatcttcactgaccttgtgtctgaagataccagaaaaggaaccgtgcgctactcacgcaacaaagacacttatttcctgagcagcgaggagtgcattactgcaggggacttccagaacaaacaccccaacatgtgccggctctcccctgacggacactttggctccaagttcgtaactgctgtagcgaccgggggccctgataatcaagttcactttgaggggtatcaggtttctaaccagtgcatggccctggtgagggatgagtgtttacttccctgtaaggatgcgcctgagctcggatatgcaaaggagtcttcatcagaacaatacgtccccgatgtgttttacaaggacgttgacaaattcgggaacgagattacgcaactcgcacgccctctacccgtggagtatctcataatcgacatcacaactaccttccccaaagaccccgtgtacactttttccatcagccagaacccttttccaattgaaaaccgggacgtattgggcgaaacccaagactttcattccctggccacttacctaagtcagaatacctcttccgtgtttctggatactatttcagactttcacctgctgttgttcctcgtgaccaacgaagtgatgcccttgcaagatagcatctctttgctgctggaggctgtccggactcggaacgaagaattggcccagacatggaagcggagcgagcaatgggccactatcgagcagctgtgttccacagtcggcggtcaacttcccggactgcacgagtacggcgcggtgggcggctccactcacactgccactgccgcgatgtgggcctgccagcactgtacattcatgaaccagccagggactggacactgtgaaatgtgttccttaccacgaacgtag

SEQ ID NO: 28110 - DNA, 1851 bp, Artificial Sequence
  Description of Artificial Sequence: Synthetic coding sequence
gccgaagtcgtgattattcgcgtccagagtccagatggagtaaagcgtattacggccacgaaaagagaaacggccgctactttcttgaagaaagttgccaaggaattcggatttcagaacaacgggttttcagtatatatcaatcggaacaaaaccggcgaaattacagcctcctccaacaaaagtctaaatctgctgaagataaagcacggtgatctgttattcttattcccatcatccctcgccggccccagttcagaaatggagacctctgtgccccccggtttcaaagtttttggcgctccaaacgtggtagaggacgaaattgaccagtatctgtctaagcaggacgggaaaatttataggtctagagacccccaactgtgtcgacacggccctttaggcaagtgcgttcattgtgtaccgctggaacccttcgacgaggattacctaaaccatctcgaaccaccggtgaaacacatgagcttccacgcgtatataagaaaactgacaggcggcgccgataaaggaaagtttgttgcattggagaacatcagctgcaaaattaagagtggctgcgaaggtcatctcccctggccaaacggcatatgcacgaagtgtcaaccgtccgcgatcactctgaatagacaaaagtataggcacgtcgacaatatcatgttcgagaaccataccgtggccgatcggtttctggatttttggcgaaaaacagggaaccagcactttggatatttatacgggagatacaccgaacataaggatatccccttaggcatcagggccgaggtcgctgcgatttacgaacctccccagatcggcacgcagaattctctggagctgctggaggacccaaaggccgaggttgttgacgaaattgccgctaaattgggactgcggaaagtagggtggatcttcaccgaccttgtcagcgaggacacgcgcaagggcacggtaaggtatagtcggaacaaggatacttatttcctgagctcagaggaatgtatcactgcaggcgattttcagaataaacatcccaacatgtgcaggctttccccagacgggcattttgggtccaaatttgtgacagccgtggcgactgggggcccagacaatcaggttcacttcgaggggtaccaggtgtccaatcagtgcatggcccttgtgcgcgacgagtgcctgctgccttgcaaggacgcccccgagctgggctacgccaaagagtcctcaagcgagcagtacgtccctgatgtgttctataaggatgtggataagtttggaaacgagattacccaactagccagacctctcccagtcgaatacctgatcatcgatataaccactacattccctaaagatcctgtctatacgttctccatttctcagaatccttttcctatcgagaatagagatgttcttggagagactcaagacttccacagcctagccacataccttagccagaacaccagctcggtgtttttggacacaatctctgacttccacctcctgctgttcctcgtgaccaatgaggttatgcctctacaggacagcatttccctcctcctcgaagccgtgaggacacggaacgaagaactagcccagacctggaagagatcagagcagtgggcgactatagagcagctgtgcagcgagtacccccaccctcttccccgccacccagtcgcgggcgcaggagaacagccaacgctgcactcctcgcctctgccagtggtgccatggattccacaccccgctgcctcatggcaggtgccttcagcaatgcagcgggtggagactcgcccaccttgccaggcacggggacgcttgaggtag

SEQ ID NO: 28111 - DNA, 1371 bp, Artificial Sequence
  Description of Artificial Sequence: Synthetic coding sequence
atgagtttccacgcctatatccgtaagctgacaggcggagctgacaagggaaagttcgtcgctttggaaaacatctcctgcaagatcaagtcaggctgtgaagggcatttgccctggcctaacgggatttgtacaaagtgtcaaccgtccgcgatcaccttgaaccggcaaaagtatcggcacgtggataatatcatgttcgagaatcatacagttgcagaccggtttcttgatttctggcggaaaaccgggaatcaacacttcggctacctgtatggaaggtacacggaacacaaagacatccccctagggattcgagcagaggtcgccgcgatctacgaacctccccaaatcggcacccaaaacagtctggaactgcttgaggatccgaaggctgaggtggtggacgagatagcagccaagctgggcctgcgcaaggtggggtggattttcaccgacctggttagcgaggatacaaggaaaggcactgtgcggtattctcggaacaaggacacatactttctgtcatctgaggaatgcatcacagccggggacttccaaaataagcatcctaatatgtgtcgtctctccccagacggacatttcggatcaaagtttgttactgccgttgcaacgggcggaccagataaccaggtccacttcgaaggttaccaagtatcgaaccagtgtatggcactcgtccgggatgagtgcctactcccatgcaaagacgcgcctgagttaggctatgccaaagagagcagcagcgagcagtatgtgcctgacgtcttttataaggacgtggataaattcggcaacgagattacccagctcgctcgacctttacctgttgagtacctgatcattgacataactaccacctttcctaaggaccccgtgtacaccttcagcatctcccaaaacccattccccatcgagaacagagacgttctaggcgagactcaggacttccactcacttgccacatacctctctcagaatactagttctgtattcctagatactatctcagacttccacctattactatttctcgtgacaaacgaagttatgccccttcaggattctatttccctgctgttggaggccgtgcgaactcgcaatgaggagctcgcccagacctggaagcgctcagaacagtgggccaccattgagcagttgtgctccgagtacccccatccactccctcgccatcccgtggccggagccggtgaacagccaacacttcacagctccccactgcccgttgtcccttggatcccacaccctgccgcaagttggcaggtgccctcagctatgcagagagtagaaacccgtcccccatgccaagctagaggccgtctcaggtag

SEQ ID NO: 28112 - DNA, 2202 bp, Artificial Sequence
  Description of Artificial Sequence: Synthetic coding sequence
atggaagccagctggcgtcaggtagcaggtggtcgtggtagatcccgtggtcgcgctacggcagccccatccgggaatggcgtccacctgcgtggcgcaggaggaggccgagaaaaggggagcgtcggcgccgtcccttccgggacgagccctggcggagtcgcgacgacagccgctgccgggtcccgtcacagcccggctggctctcaggccttgcagactaccgccgccagcgaattaatgagccaaaagaaatttgaggaaattaaaaaagcaaaccaagcagccgccagaaaactggtagaggagcagtttagcagctcttccgaagagggagatgaggacttcgagggtaaacagggcaaaattttggccaacacctttatcacgtataccacgcagaccgacggagacaccagagagcttgaacgaaccaaacaatacgtgaacgaggcctttcaagctggagccatgacctgcctgatttgcattgcaagcgtaaaaaggaatcaggcagtttggtcttgcagtgggtgtttttgcatatttcacatgccctgtatacaaaagtgggcaaaagattcccagttccttgtaagttccgttacagacgacgattttgggaagaaggattgcccatggccttgcccaaaatgcaggttcgaatataagagaagcgaaactccaagccggtactactgctactgcggaaaagtggaggatcctcccctggatccttggctcgtgccacactcatgcggtcaggtttgtgaacgggagtttaagccaccatgcggccacaagtgtctcctgctgtgccaccctggaccttgtccaccttgtcctaaaatggtcacaaccacctgctactgtaaaaaagccaagccgattccccgcaggtgtagtgcaaaagaatggtcatgtcaactgccttgtgggcagaagcttctgtgcggtcagcacaagtgcgaaaacccttgtcacgcaggtagctgtcagccttgtccccgagtgtcgcgtcagaaatgcgtgtgcggtaagaaggtagctgagcgctcatgcgcttcccccctatggcattgcgatcaggtttgcggtaagacactgccctgcggaaatcatacttgcgagcaggtttgccacgtcggggcttgcggagaatgccctcgatccgggaaacgcttttgcccttgtcaaaagtccaagttctcgctgccatgcacagaggacgttccgacttgtggcgactcatgcgacaaggtcctggagtgcggtatccatcgctgcagccagagatgtcataggggtccttgtgagacctgtcgacaggaagttgaaaagcactgtcggtgtggaaaacatacaaagcgcatgccctgtcacaaaccttatttgtgcgaaaccaaatgtgtgaagatgagggactgtcagaagcaccagtgcaggcgcaagtgttgtcccgggaattgtcctccctgcgaccagaattgcggacgaacactggggtgcaggaatcacaaatgtcccagtgtctgccacagaggatcctgctatccctgccccgaaaccgttgacgtcaaatgtaattgcggcaacacaaaggtaacagtgccatgtggacgggagcgtaccactcgcccccccaagtgtaaggaacagtgttctaggccaccaacctgccaccatacttcccaggaaaagcatagatgccactttggttcatgtccaccgtgtcatcaaccttgtcagaaggttctggagaagtgcggccacctttgcccagcaccttgtcacgaccaggcactgataaagcagacaggtcggcaccagccgacaggaccttgggagcagcctagcgaaccagccttcatacagaccgccctgccctgtcccccctgccaggttcctattcccatggagtgcctcggcaagcacgaagtgtctccactgccatgtcatgctgtgggaccttactcttgcaagcgcgtttgcggtcgaatccttgactgtcagaaccatacatgcatgaaggaatgccacaaagtaacaaaaaccgacggatgcaccggcaaaaacaagatcgggaagctgaagctttgtgatctttcgatgattcttcaacaggagagttccaaaagtgaatcaacagttcccgatttgctcacgccctctcccatgtgctcttctacgcatgtgatctag

SEQ ID NO: 28113 - DNA, 2736 bp, Artificial Sequence
  Description of Artificial Sequence: Synthetic coding sequence
atggaagctagctggagacaggttgctggaggtcgcggcagaagcagaggtcgagcaactgccgccccaagtggcaatggtgttcacctgagaggggccggcggaggtcgcgagaaaggaagcgttggcgccgtccccagtggaaccagcccagggggtgtggccaccacggctgcggcgggctcacgacatagtccggccggtagccaagcgctgcagacgacagctgcctctgaacttatgtcacaaaagaagtttgaagaaatcaaaaaagctaatcaggccgcagcccgtaaactggtggaggagcagttctcctcctcctctgaggaaggcgacgaggatttcgagggcaagcaagggaagatcctggctaatacattcatcacttacacaactcagacagacggcgacacaagagagctcgaacggacaaagcagtacgtgaatgaagccttccaagcgggagcaatgacatgcctgatttgtatcgcaagtgtcaagagaaatcaagccgtttggtcttgctccggttgtttctgcatatttcacatgccctgcatccagaagtgggccaaggacagccagttcctggtgtccagtgtgaccgatgatgactttggcaagaaggactgtccttggccatgccccaagtgtcggtttgagtataagagatcagaaacaccatcacgctattattgttattgtggtaaagtggaggacccccccctcgacccatggctggtaccacattcatgcggccaggtgtgcgaaagggagtttaaaccaccctgtggccataagtgcctgctgttgtgccaccccgggccatgcccgccttgtcccaaaatggtgaccacaacttgctactgtaagaaggctaagcctatcccccgccgatgtagtgctaaggaatggtcctgccagctaccttgcggacagaagttgctgtgcggacagcacaaatgcgagaacccctgtcatgctgggtcttgccaaccctgtccgcgggtaagccggcagaaatgtgtctgtggcaaaaaggtcgctgagcgatcgtgtgctagtcccctgtggcattgcgaccaagtgtgtggcaaaacccttccctgcggaaaccacacctgcgagcaggtgtgccacgttggtgcctgtggagaatgccctaggtcggggaaacgcttctgcccttgccagaagtccaaattttctctcccatgcacagaggacgtcccaacttgcggagactcctgcgataaggtgctagagtgcggcattcaccgctgcagtcaaaggtgccaccgaggcccatgtgaaacatgccgacaggaggttgagaaacattgtcgatgcggcaagcataccaaacgaatgccatgtcataagccctacttatgcgaaaccaagtgtgtcaagatgcgtgattgccagaaacaccagtgcagaaggaagtgctgccctggcaactgtcccccgtgcgaccagaattgcgggcgcacattagggtgtcggaatcacaaatgtccttcagtgtgtcaccgcgggtcttgctatccctgccctgagaccgttgacgtgaagtgcaattgcggcaacacaaaagtaactgtgccttgcggaagagagcgaaccacacggccccccaaatgtaaagagcagtgctcccggcctcccacttgccaccatacttcccaggaaaagcatcggtgccatttcgggtcctgtcctccctgccaccagccctgtcagaaggtacttgaaaaatgcgggcacctgtgcccggcgccatgtcacgatcaggccttgattaagcagacagggcggcaccagcccacagggccttgggagcagcccagcgagcccgccttcatccagacagccctgccatgccctccgtgtcaggtcccaattcctatggaatgcctcgggaaacacgaagtttcacctctgccttgtcatgccgtaggaccttattcctgcaagcgcgtctgcggtcgcattttggactgccagaatcacacttgcatgaaagaatgccataaagttactaaaaccgatggatgcacagggaaaaacaaagcgggccccgagtgcctacactgcgaggagggctgttctaagagtcgcccgcttgggtgtcttcatccttgcatcttgcgctgtcaccccggcgagtgtcctccatgcgtgcagatgttgaggattaagtgccactgcaagattacgtcactatatgtggagtgccggaagattacaacggcagacgtcaatgaaaaaaatttgctcagttgctgtaagaaccagtgtcctaaggagctgccatgcgggcataggtgcaaggagatgtgtcaccccggagaatgccctttcaactgtaatcagaaggtgaagctgagatgtccgtgcaaacggataaagaaagaattgcagtgcaataaggtgagagagaatcaagtgagcatcgagtgcgacaccacttgcaaggaaatgaaaaggaaagccagcgaaattaaagaagccgaagctaaagccgcccttgaagaagagaaacggcggcagcaggctgagctcgaggcatttgaaaaccggctgaaggggagaaggaagaagaacaggaagcgggatgaggtagccgtggagttaagcctctggcaaaagcacaaatattacttgatttccgtgtgcggcgtggtggttgtggtttttgcctggtacatcacacacgacgtcaactag

SEQ ID NO: 28114 - DNA, 2736 bp, Artificial Sequence
  Description of Artificial Sequence: Synthetic coding sequence
atggaggcctcatggaggcaggtcgcaggcggccgcggcagatcacggggccgggctaccgccgcacccagcgggaacggtgtgcaccttcgaggtgctggaggaggcagagaaaagggaagcgtcggagcggtgccctccgggactagcccaggcggagttgctaccacagcagccgctggctctcggcacagtccggccggttcacaggcgctccagacaacggctgcctctgagctaatgtctcaaaagaagtttgaggagattaagaaggctaaccaggcagcagcaaggaagttagtggaggagcagttcagttcaagctctgaggagggcgatgaagattttgagggtaaacagggcaagatcctcgcaaacaccttcattacctacacaacccaaaccgacggggacacaagggagttggagagaacgaagcagtatgtcaatgaggcttttcaggccggcgcaatgacctgtttgatttgcatcgcttctgtaaagcgaaatcaggctgtgtggagctgttccgggtgcttttgtatcttccacatgccttgtatacagaagtgggcaaaggactcccagtttctcgtgagctcagtgactgacgatgattttggcaagaaagattgtccttggccatgcccaaagtgtaggttcgaatacaagcgatctgaaactcccagtcggtactactgctattgtgggaaggtagaggatcctccactcgacccttggctggtgcctcattcttgtggtcaggtctgcgagcgcgaattcaagccaccatgtgggcacaagtgccttttgctctgccaccccgggccctgccctccgtgcccaaagatggtcacgacgacatgttattgcaaaaaggctaagcccatccctcgtcggtgcagcgccaaggaatggtcttgccagcttccatgcggccagaagcttttgtgcgggcaacataaatgcgaaaacccctgtcatgcagggtcatgccaaccatgccctagagtttctcgccagaagtgcgtctgtggtaaaaaagtcgctgagaggtcctgtgcaagcccactgtggcactgcgaccaggtttgcggaaaaactctcccatgtggaaaccatacctgcgagcaggtgtgccacgtaggagcctgcggcgaatgtccgagaagcgggaaaagattctgcccttgtcagaagtctaagtttagcctgccttgcacagaagacgtaccaacttgcggagacagttgtgataaagtgctcgagtgtggcattcatcggtgcagtcagaggtgccaccgcggaccgtgtgagacatgccgtcaagaagtggaaaaacactgcagatgcgggaaacacaccaaacgcatgccttgtcacaaaccttatctttgtgagactaagtgcgtgaaaatgagggactgccaaaaacatcagtgtagacgaaaatgctgccccggtaactgtccaccatgcgaccagaactgcggacgcactttaggttgccggaatcacaagtgcccgagcgtctgtcaccgggggtcatgttacccctgccccgaaacagttgacgtaaagtgcaactgcggcaataccaaagttacggtcccttgcggacgagagaggaccacgcgcccacctaagtgtaaggaacaatgttctaggccaccaacatgccatcacacctcccaggaaaagcatcgatgtcattttggtagctgcccgccttgtcaccaaccttgccagaaggtgttagagaagtgtgggcacctgtgtcctgccccatgccatgaccaggcactgatcaaacagacagggcgccatcagcctacaggaccatgggaacagccaagcgagcccgccttcattcagactgccctaccatgccccccttgccaggttcccatccccatggaatgtctgggtaagcacgaagtttcccctctgccttgccacgccgtcggcccttacagctgtaaaagggtctgcggacgcatcctggattgccaaaaccatacttgtatgaaagagtgccacaaagttacgaaaacggatggctgtacaggcaaaaacaaggccgggcctgagtgtctgcactgtgaggaaggctgttccaaaagtaggcccctgggttgtctgcacccatgcattctacgttgtcacccgggcgagtgtccaccctgtgttcaaatgctgaggattaaatgccactgcaagattacgtccctgtacgtggagtgcaggaagatcacaactgctgatgtcaacgagaagaaccttctgagttgttgtaaaaaccagtgcccaaaggaattgccttgcgggcataggtgcaaggaaatgtgtcaccctggtgaatgtccattcaactgcaatcagaaggttaagcttcgctgcccgtgtaaaagaattaaaaaggaactgcagtgtaataaagtgcgcgagaatcaggttagtatcgagtgcgacactacttgcaaagaaatgaaacgcaaggcgtctgagattaaggaagccgaggcaaaagccgccctcgaggaagaaaagagaagacaacaggcggaactggaggcctttgagaatcggctgaagggaagaagaaagaagaatagaaaacgggatgaagtcgctgtggaattaagtctctggcagaagcataagtattatctgataagcgtgtgtggagtggtagtcgttgtgtttgcatggtacatcacccacgacgttaactag

SEQ ID NO: 28115 - DNA, 5211 bp, Artificial Sequence
  Description of Artificial Sequence: Synthetic coding sequence
atgaccggctgtccagcatctagtaggcgccgcggcttcggcctgttcttcttcttgcggctccacaggctcctgttactcttcctcgtgctcaggggcacactcgccaataagctgaacgtccctcaggtattactgccatttggccgggaacctggtagagtcccctttctgctggaggcccagaggggttgctatacatggcatagtacccaccatgatgctgtgaccgtcgagcccctttatgagaacggcacattgtgttcccagaaagctgttctaatcgccgagagtacccaaccaattagattgtcttccattatactagcccgggagatcgtgacagatcacgagctgcgctgtgacgtcaaggtggatgttattaatagtattgaaatcgtgtcgagggcccgagaattatatgtggatgacagtcccctcgaacttatggtgcgcgctcttgatgcagaaggcaacaccttcagctcactagccggcatgatgttcgaatggagcattgcacaggacaatgagtcagcccgggaagaactgagctccaagatcaggattctgaaatattcagaggcagaatacgcacctccaatctacatcgcagagatggagaaagaggaaaagcagggcgacgtgattctagtgagcggcatccgaaccggggcagcagttgtcaaggttagaattcacgagcccttttataagaaggttgcagccgcactgatccgtcttttggtactggaaaacattttcctgatacccagtcacgacatttatcttctcgtgggcacttacatcaagtatcaggtagccaaaatggtacagggccgcgtgacagaagtgaagttcccgctggaacattatattctggaactgcaggaccatagagtagccttaaatgggtcacactccgagaaggtggccattctggacgacaaaaccgctatggtgaccgcaagccagctcgggcaaaccaacctcgtttttgtgcacaaaaacgtgcacatgcgctcagttagcggcttacccaactgcactatctatgtggtggagccaggatttctcggatttacagtgcaaccaggtaaccgctggtcgcttgaagtaggacaggtatacgtaatcaccgtggacgtatttgataagtcgagcacaaaggtctatatcagcgataaccttcgaatcacttatgacttccccaaagagtattttgaagagcagttaaccacagtaaatggtagctaccatattgtgaaagccctgaaggacggcgtggtggttatcaatgcctcattgacctctattatttaccagaacaaagatatccagcccatcaaattcctcatcaagcaccaacaggaggtcaaaatctatttccccataatgttaacccccaagtttctggcgtttccccatcatccgatgggtatgctctatcgttataaggtgcaggtcgagggcggtagcggcaatttcacatggacctcttctaacgagaccgtggtgatagtcactactaagggagttgtgacagctgggcaggtgagaggaaatagtaccgtgttggctagggacgtgcaaaatccgttccgttacggagagatcaaaatacacgtgctcaagctgaacaaaatggaactgttaccctttcatgcagacgtcgaaatagggcagatcatagagatcccaatcgcgatgtaccacatcaacaaggagactaaggaagccatggcctttaccgattgtagccaccttagcctggatctgaacatggataagcaaggcgtgttcactctccttaaagagggcatccagcggcccggccccatgcattgttcctctacacatatcgccgccaagtccctgggacacaccctggtcacagtaagcgtgaatgaatgcgacaaatacctcgagagctcagcgacattcgccgcttatgaaccactgaaggctctgaatcctgtagaggtggctctggtcacttggcagtccgtcaaagagatggtctttgaaggcggtcctcggccctggatcctggaaccgagcaggttcttccttgagctgaatgctgaaaaaacggagaagattggaatcgctcaggtgtggttgcctagcaaacgaaagcaaaatcagtacatataccgtatccagtgtctggatctgggagaacaggtgctgactttccgcattggaaatcacccaggcgtcctcaacccaagcccagccgtggaggtgctccaggtgcgtttcatctgtgctcatccggcctccatgtccgtgaccccggtgtataaggtgccagccggagcgcagccttgtcccctgccacaacacaataagtggctgattcccgtttcccgactacgggataccgtcctcgagctggctgtcttcgatcaacatagacgcaagttcgataattttagttcactgatgctggaatggaagtcctcaaatgagaccctcgcacattttgaggactataagagcgttgagatggtagcaaaggacgacggaagcggccagacccggctgcatgggcatcaaatactaaaggtccatcaaatcaagggtacagttcttattggtgttaactttgttggatatagcgaaaagaagtctccgaaagaaatttcaaatctgccacgtagcgtcgatgtggaattactgttggtggatgacgtaacagtcgtgcccgaaaatgctactatctacaaccacccagatgtgaaggagactttctctctggtagagggttccggatactttctggtgaactccagcgagcagggggtggtcacgatcacctatatggaagccgaatcatctgtcgaactggtcccgctgcatcccggatttttcaccctcgaagtctatgacctatgtcttgccttcttggggccagcaacagcccaccttcgcgtttcagacattcaggagctcgagctggacttgattgacaaggtcgagatcgataaaactgtgctggtgacggtgagggtcttgggctcatctaagcggcccttccaaaataagtactttcggaatatggagctgaagctccagttggctagcgccatcgtgaccctgacccccatggagcagcaagacgaatacagcgaaaattacatcttaagagccacaacgatcggacagacaactctggtcgcaattgccaaggacaaaatgggaaggaaatacaccagcacacctcgacacatcgaggtgttccccccatttagactgctaccagaaaaaatgaccttaatacctatgaacatgatgcaggtgatgagtgagggaggcccccagccacaaagcatcgtacacttctctatctcaaaccagactgtggccgtcgtcaaccgccgtggccaggttacagggaaaattgttgggaccgccgttgtgcacggcactatccagacagtgaatgaggacacaggtaaggtgatcgtgtttagccaggacgaagtgcagattgaagttgtacagttgagggcagtgaggattctagctgcggccacgagacttattactgctaccaaaatgcctgtttatgtcatgggtgttaccagcactcagacgcccttctcgttctcaaatgcaaaccccggcctgacttttcattggagcatgagtaagcgtgacgtgcttgacctggtgcccaggcactctgaggtttttttgcagctgcctgtcgaacacaattttgcaatggtcgttcacactaaagcagctggccggacctctatcaaggtgacagtgcactgcatgaactcctctagcggacagttcgaagggaatctgctagagctttctgacgaagttcagattctggttttcgaaaagctacagctgttctaccctgaatgtcagcctgaacaaatcttgatgcccatcaactcccagcttaaactgcacacaaaccgcgaaggagctgcatttgtgtcgtccagggtgctgaagtgtttccctaactccagcgtgatcgaggaggatggtgagggacttctgaaggcaggctcaatagctggcaccgctgtgctagaagtgacgtcaattgagccctttggcgtcaatcaaaccacaattacaggcgttcaggtggctcctgtaacctatttgcgggtgtctagccaacctaagctctatacggcccagggtagaactttatccgcgtttcctctgggcatgagtctcacattcacagtgcagttttacaacagcatcggcgagaaattccatacacacaacacccagctgtatctggccctgaatagagacgaccttctgcacatcggccccggtaataagaactatacctatatggcacaagccgtaaatagagggctgacactggtcggcctctgggaccggcgccatccaggaatggccgattatatccctgtcgctgtggagcacgctatcgagcccgatacaaagctgacattcgtcggagacataatttgtttttctacacatttggtgtcacagcatggggaacccggaatctggatgatcagcgctaacaacatcctgcagacagatattgtgacgggcgtgggagtggcgcgttcgcccggcacggcaatgatttttcacgacattccgggagtggtgaaaacttacagagaggtggtggtaaacgcaagctctaggctgatgttgtcatatgaccttaaaacttaccttaccaacacactcaacagcaccgtgttcaaactttttatcaccacagggagaaatggagtgaacctgaagggtttttgcacacccaatcaagccctggcaattaccaaggttcttttgcctgccaccctcatgttatgtcacgtgcaatttagcaatacgctgctggatataccagcaagtaaagtattccaggtgcattccgattttagcatggagaaagatcattgtgaggactcagctatcctgaaacgcttcaccggaagctatcagatcctgctcctcacattatttgccgttctcgcgagtacagcgagtatctttctggcctacaatgcattcctgaacaagatccaaaccgtgcccgtggtctacgtgcccacacttggcactcctcagcccggcttttttaactctacttcgagccccccccatttcatgagtctgcaacctcccctggctcagagccgcctccagcactggctgtggtccattcggcattag

SEQ ID NO: 28116 - DNA, 2010 bp, Artificial Sequence
  Description of Artificial Sequence: Synthetic coding sequence
atggggcgcaagtacaccagcacacctcgccatatagaggtgtttcctccattccgcctcctgccggaaaagatgacacttatcccaatgaatatgatgcaggtaatgtctgaaggtggtccacagcctcagtccatagtgcatttttctatctctaaccagacagttgccgtggttaatagacgaggacaagtgactgggaagattgtgggcaccgcagtcgtgcacggcactatccagacggtgaatgaggacacaggaaaagtgattgtattttcacaggacgaagtgcaaattgaagtggtccaacttcgcgccgtgagaattctggctgccgccacacgacttataacggcgacaaagatgccagtatacgttatgggcgtgacaagcactcaaactccgttctcattctcgaatgccaaccccgggctgacctttcattggagtatgtccaaacgtgatgtcctggacctagtgccgcggcattccgaggtcttcctgcaacttccggtggagcataatttcgctatggtcgttcatactaaggccgccggacggacgagcattaaagtcaccgtacattgcatgaatagcagcagcggccagttcgaggggaatctactcgaactttctgacgaggtacagatcctggtgttcgagaagctgcaactgttttatcccgaatgccaacctgaacagatcctgatgccgattaactctcagttgaagctgcacactaacagagaaggcgccgcgttcgtgtccagtagggtgctgaagtgcttcccaaactccagtgtgatcgaggaagatggtgagggactgctgaaagcagggtccattgccggcacggccgtgctggaggtgacctccatcgagccattcggcgtcaatcagacgacaatcactggtgtgcaggtggctccagtgacatatcttagagtgtcatctcagccgaagctatatactgcccagggtcgcaccttgtcggccttccccctgggtatgagtttaaccttcaccgtacagttttacaactctataggggagaagttccacacacacaatactcagctctacctggccctaaatcgcgatgatctgctgcatattggacctggaaacaagaattatacgtatatggcccaggctgtcaatcggggcctgactctggtcggtctgtgggatcgccgacaccctggcatggctgactatatccccgtagcagtagagcacgctatcgaacctgacacgaaactgacttttgtgggagatatcatttgcttttctacacacctggtctctcaacatggagagcccggaatttggatgattagtgcaaacaacattcttcagacagatattgtcactggggttggcgtggctcgctctcctggcaccgcaatgattttccacgatatccctggagtggtcaaaacctacagagaggtagtggtgaacgcaagttcacggctgatgttgtcttacgatctgaaaacctaccttaccaacaccctgaacagcacggtctttaagttattcatcacaaccggaagaaatggcgtcaatctcaaggggttttgtacccctaatcaagctttggcaatcactaaggtcctcctgcccgcgacccttatgctatgccatgtgcagttttccaacaccttgctggatattccagcctccaaagtgttccaggtccacagcgacttcagcatggaaaaggaccactgtgaggatagtgccatcctgaaacgcttcacgggatcctatcaaatcctccttctgacactcttcgcggtgctcgcctctaccgcctccatctttctggcatacaacgcctttctgaacaagatccagaccgtccctgtggtctatgttcccaccctggggacaccccaacctgggttttttaactctactagttccccgccacattttatgagcttacaaccacctttggcccaatctagactccagcactggctttggtccatcaggcactag

SEQ ID NO: 28117 - DNA, 5667 bp, Artificial Sequence
  Description of Artificial Sequence: Synthetic coding sequence
atgacagggtgccctgcatcatctcgaagacggggtttcggactcttcttcttccttcgtctgcacaggttactcctcctgttcctggtcttacgtggtacactcgccaataagctgaacgtcccccaggtactacttccgttcgggcgagagcccggacgtgttcccttcctattagaagcccagaggggctgctatacttggcattccacccaccacgatgctgtaaccgtcgaacccctctatgaaaacggaacattgtgctcgcagaaggcggtgctgatcgctgaaagtacccagccaatcaggctttcctcaatcatactggcccgcgagatcgttactgatcacgaattgcggtgtgacgtaaaagtggacgtaatcaacagcatcgagatcgttagccgggccagggaactctacgtcgatgatagccctctggagctgatggtccgcgctttagatgcggagggcaacacgttctctagtcttgcaggtatgatgttcgagtggtctattgctcaggacaacgagagtgcaagagaagagttaagcagcaagatacgtattttaaagtattctgaggctgagtacgctccacctatctacattgctgaaatggaaaaggaggaaaaacagggcgatgtgatccttgtgagcggaatcagaacaggagccgctgtggttaaagtacggattcatgaacccttctataagaaagtcgcagcagccctgatccgtcttctcgttctcgagaacatctttctgatcccctctcacgatatttatcttttggtaggcacctatatcaagtatcaggtggccaaaatggtgcaggggagagtcaccgaggtgaagttcccccttgagcattacatcttagagttgcaggatcaccgcgttgccctcaatggaagtcacagtgagaaagttgctatcctggatgataaaaccgcgatggtcactgcctcacagctgggacaaaccaacctcgtgttcgtgcacaagaacgtccacatgcggtccgtctcaggccttcctaactgtaccatctatgtcgtcgaacccgggtttcttggcttcactgtccagccaggtaaccggtggagtctcgaggtcggccaagtctatgtcattacagtggatgtgtttgacaagagtagtactaaggtatatatttccgataacctacgcataacatacgatttccctaaggaatatttcgaagagcagcttacgacagtcaatggatcttaccacatcgtgaaagcgctcaaagacggtgtggttgtcatcaacgcttcactgactagtattatctatcaaaacaaggacatccagcccattaagtttttaatcaagcaccagcaagaggttaaaatatatttccctattatgctgacacctaaatttttagccttccctcatcacccaatgggaatgttatataggtataaagtccaggtggaaggtgggagcgggaatttcacgtggacgtcctctaatgaaaccgtggtgatcgtcacaaccaaaggagtagtgaccgccggccaggtaaggggcaactccactgtcctggctagggacgtgcagaatcccttccgctatggcgagatcaagatacatgtactgaagttaaacaaaatggaactgctgccattccatgctgacgtcgagattggacagattatcgagattccgatcgctatgtatcacattaataaggaaaccaaggaagcaatggctttcactgactgctctcacctgtctctcgacttgaacatggacaagcagggcgtattcaccctgctgaaagagggaattcaaaggccagggccaatgcattgttcctctacacacatcgcagcaaagtcactggggcacactttggtaactgtatcagtgaacgagtgtgataagtatctggaaagttctgcaacatttgctgcatatgagccactaaaagcactgaatcctgtggaggtagccttggtcacttggcaatccgtgaaagagatggtgttcgagggtggcccacggccctggatccttgagcccagccgcttcttcctcgagttgaacgcagagaaaactgaaaagataggcatcgcacaagtgtggttgcccagcaaacggaaacagaatcagtacatctatcgaatacagtgccttgatttgggtgaacaggtgttaacctttcggatcgggaaccacccgggcgtgctgaatccgtcacccgcagtagaggtcctgcaggtacgattcatttgtgctcaccctgctagcatgtctgttacgccggtatataaggtgcccgccggggcacaaccttgcccactgcctcaacacaataagtggctgattcccgtgagccgtcttagggatacagtattagaactggctgtgtttgatcaacacagacggaaattcgacaacttcagttctctgatgctcgaatggaaatcttcaaacgagactctggctcactttgaggattataagtctgtcgagatggtggcaaaggatgacgggagtggtcaaacccggctgcacggacatcaaatccttaaggtccatcagatcaaaggcactgtcctcattggcgtcaactttgtgggatactcggagaagaaatcaccaaaagagatttctaatctgcctcgaagcgtggatgtagagctgttactagtcgacgatgtgaccgtggttcccgagaacgctactatttataatcatccagacgtcaaggaaacatttagcctggtcgagggctctggttactttctggtcaatagcagtgaacagggggtggttaccataacatatatggaagcggaaagttctgtggagctggtgccactacaccctggattctttaccctagaagtgtacgatctctgtctcgctttcttgggcccagctactgcccaccttcgagtctcagatatccaggagctggaactggatctgattgataaggtggagatagacaagacagttctggtcacggtccgggttcttgggtcctccaaacgccctttccaaaacaaatatttccgtaatatggaactcaagctccagcttgcctccgcaatagtgacattgacacctatggagcaacaagacgaatattctgagaattatatcctaagagccaccaccatcggccaaaccacactagttgccatcgcgaaagataaaatgggtcggaaatacacaagcaccccccgtcatattgaggttttccccccattcagattgctgcccgagaagatgacgctgattccgatgaacatgatgcaggttatgtcagagggaggccctcagccccagagtatcgtccactttagtatttctaaccagacagtcgccgttgtcaaccgccgggggcaggtgaccggaaagattgtcggcacggcagtggtgcatggaactattcagaccgttaatgaagatacgggcaaggtgatcgtattttcacaggacgaagtgcagatcgaggttgtgcagctccgggctgtcaggatcctagcagccgctactcgccttattacggccacaaagatgccggtctacgtcatgggcgtgacaagcacacagacacccttctcattttccaacgcaaatccagggctcaccttccattggtctatgagcaagagggatgtgcttgacctcgtgcctcggcactccgaagttttcctgcagttacccgttgagcacaacttcgccatggtcgtgcacacgaaggctgctggcaggacaagtattaaggtcaccgtgcactgcatgaattcctcgtccggccagtttgaggggaacttgcttgaactttccgatgaagtacaaatactggtgtttgagaagttgcagcttttctatccagaatgtcagcctgagcaaatcctcatgccaataaacagccagcttaaattacatactaaccgcgaaggcgcagcttttgtgtcctcgcgggtgttgaagtgctttccgaactcctcagttattgaggaagacggagaaggtctgctgaaggccggctctatcgctggtaccgccgtgctcgaagtgacatctatcgagcccttcggggtgaatcaaacaactataaccggtgtccaagtggcacccgtcacttacctacgagtctcctcccaacccaagctgtataccgcccagggtcgcaccttgtctgcctttcctctgggcatgagtctgactttcaccgtgcagttctataacagtattggggagaagtttcatacccacaatacacagttgtatttagctctcaacagggacgacctcctgcacattggacccggcaacaaaaattacacatacatggcccaggccgtaaaccggggtctcacacttgtgggactatgggatcggcggcaccctggaatggccgactacatccctgtagctgtggagcacgctatcgagccagacaccaagcttacctttgtaggggacatcatctgcttttcaacccatttagtcagtcagcatggcgagccggggatctggatgatatctgcaaacaatatcttgcagactgacatagtcaccggcgtgggcgtggctcgaagtccggggacagcaatgattttccacgacatcccaggagtggtgaagacctatagggaggtggtggtgaatgccagctctagactgatgttgtcctatgacctcaaaacgtatctgaccaacactttgaacagcaccgtgttcaagcttttcatcacaaccggacggaacggagtaaatctcaaagggttctgtactcccaatcaggccctcgccattactaaagtgctactgccagctactctgatgttgtgccacgtgcagttctccaataccctgctcgatattcccgctagcaaagtgtttcaggtgcatagcgatttctccatggagaaaggtgtgtacgtctgcatcatcaaggtgcgaccacaatccgaggaactcctgcaggccctttcagtcgccgacacctctgtatatggatgggccacattagtctcagagcgctccaagaatggtatgcagcgcattctgatcccctttatcccagcattttacattaaccagagtgaattggtcttatcacataagcaagatatcggagagatccgtgtcctaggtgtagatcgagtcctcagaaaacttgaggtcatcagtagctctcccgtgttagtggtggcgggccacagtcatagccccctgacccccggactagctatctattccgtcagagtggtcaatttcacctcatttcagcagatggcctctcccgttttcataaatatctcctgcgtgcttaccagccagagcgaggctgtggtcgtgagggccatgaaggataagctcggcgccgaccactgcgaggactccgccatcctcaagcgcttcacgggttcctatcagatcctgctgctcactctttttgcagttttggcgtcaaccgcctctattttcctcgcttacaatgccttccttaacaagattcagaccgtgccggtcgtttacgtcccaactcttggtacaccccagccgggattcttcaacagcactagcagcccaccccactttatgtccctacagcctccactggctcaatctagactacagcactggctctggagtatcaggcactag

SEQ ID NO: 28118 - DNA, 639 bp, Artificial Sequence
  Description of Artificial Sequence: Synthetic coding sequence
atggcgagcctgttctctggccggatattaatccggaacaactctgatcaggacgagctggatactgaagctgaagtctctcgccggctagagaaccggctcgtgcttctgtttttcggcgcaggtgcttgccctcagtgtcaggcgttcgtgcccatcctgaaggatttcttcgtcagacttactgacgaattctatgtgctccgggccgcacagttagctcttgtctatgtgtcacaagactcaactgaggaacagcaggatctcttcttgaaagacatgccaaaaaaatggctctttttgcctttcgaagacgatctacggagagatcttgggcggcagttttcggtcgagagactcccagccgtggtcgtactgaaacccgatggagatgtcttgacccgtgatggggctgacgagatccaaagactgggcaccgcgtgtttcgccaactggcaggaggctgcagaagtgctggatagaaattttcaactgcctgaggatttggaagatcaggagccccgctcactcacagagtgccttagaagacacaagtaccgggttgaaaaagcggcgcggggcgggcgagatccgggaggcgggggcggcgaagaggggggcgccggtggactcttttag

SEQ ID NO: 28119 - DNA, 423 bp, Artificial Sequence
  Description of Artificial Sequence: Synthetic coding sequence
atgctgcctgactgtctcagcgcagaaggtgagctgcgatgtaggcggctgctagcaggagctaccgccagactgcgggcacgcccagccagcgccgcggtgctggtgccactgtgttcagtgaggggagtaccggcccttctctacaccttgcgatcatcacggttaacggggagacacaagggagacgtaagttttcccggagggaaatgcgaccctgccgaccaggacgtcgtccataccgcccttcgggaaacacgcgaagagttgggtcttgctgtccccgaggaacacgtttggggacttcttcgacccgtgtacgatcctcagaaggcaacagtggtgcccgtgctggccggcgttggaccacttgatccccagtcgttgaggcctaactcagaggaagtttcttgggggatatag

SEQ ID NO: 28120 - DNA, 711 bp, Artificial Sequence
  Description of Artificial Sequence: Synthetic coding sequence
atgttgccagactgcctttctgctgagggcgaactgagatgtcggaggcttctggccggagccactgcccggttgcgtgcaagacccgcatccgcagcagtcttggtgcccctgtgtagtgtgagaggggtgcctgctctactctacacgctcagaagctctagactgacaggcaggcacaaaggagatgtgtccttccccggaggaaagtgcgatcctgccgatcaagatgtcgtgcatacggcactgcgagagacacgcgaggaactgggccttgcggtgcccgaggaacacgtttggggtttattaaggccagtctatgacccccagaaggctactgtagtccctgtcttagcaggagtgggaccgctcgacccccagagcttgagacccaattccgaagaggtcgacgaggtgtttgccctgcctctcgcgcacctccttcaaacacagaaccaggggtatacccatttctgcagaggaggccatttcagatatacactgcccgtgttcttgcatgggccccatagggtgtggggcctgaccgcagtgattacagaattcgccctgcaactgcttgcccccggcacttaccagcctcggctcgccgggttgacttgtagcggtgccgagggattggccagaccgaagcaacctctagcgagtccctgccaggccagctccacgccaggtctcaacaaagggctgtag

SEQ ID NO: 28121 - DNA, 1053 bp, Artificial Sequence
  Description of Artificial Sequence: Synthetic coding sequence
atggccggcagactgcttggaaaagctctggcagctgtctctctctctctcgcattggcctcagtgacgatccggagctctcgctgccgcggtattcaggcattccgcaactccttctcctcttcttggttccatctcaatacaaatgtgatgagcggaagtaatggatcgaaagagaattctcacaacaaagcccggacatctccataccctggatcaaaggttgagcggagtcaggtgccaaacgagaaagtcggatggctagtggagtggcaagactacaagcctgtggagtacactgccgtctccgtgttggcggggcctcggtgggcggacccacagattagcgaatctaacttttctccaaagtttaacgagaaagatggccacgttgagaggaaatctaaaaatggactgtacgagatcgaaaatggaagaccccggaatcctgccggacgcaccggtcttgtgggtagagggcttttgggtcggtggggacccaaccacgctgctgaccccattatcactagatggaagcgtgactcctctggaaacaagatcatgcaccctgtctcgggaaaacatatattgcagtttgtggcaatcaaacgcaaggattgtggtgaatgggcaattccgggaggaatggtcgaccctggcgagaagatctctgctactttgaaaagagagttcggggaggaggctctgaattccctgcagaagaccagtgctgaaaagcgggaaattgaggagaagttacacaagttgtttagccaggaccacttggtgatttataagggatatgtggacgatccgaggaacacagacaacgcttggatggagacggaagcagtgaattatcacgacgagacgggcgagataatggataatcttatgctggaggcaggtgatgatgccggcaaagtgaagtgggtcgacatcaacgacaaacttaagctgtacgcatcccatagtcagtttataaagctggtagcagagaaacgcgatgcccactggagtgaagacagtgaagccgactgccacgctctgtag

SEQ ID NO: 28122 - DNA, 903 bp, Artificial Sequence
  Description of Artificial Sequence: Synthetic coding sequence
atgagcgggagcaacggttcaaaggaaaatagtcacaataaagcgagaaccagcccatatcctgggtcaaaagtcgaacgttcccaggtccccaacgaaaaggttggatggctcgttgagtggcaggattataagcccgtggagtacacagcggtcagcgtgcttgccggtccccggtgggccgacccacaaatctccgagtccaatttcagcccgaagttcaatgaaaaagatggtcatgttgaacgcaagtccaagaacgggctttacgaaatagagaacggtagaccacgaaacccggcgggccggactgggctcgtgggccggggtctgctcggcagatgggggcctaaccacgctgccgacccgatcatcacaaggtggaagagagactcttcagggaataaaatcatgcatcctgtgtccgggaaacatatcctccagtttgtagccatcaaacgtaaagattgcggcgaatgggcaatccccgggggtatggtagatccaggtgaaaagattagcgcaaccctgaaaagggaatttggtgaagaagctctgaattctttgcagaaaacttccgccgaaaaaagggaaattgaggaaaaactgcacaagcttttctcacaggatcatctcgtgatttataagggttatgtagatgatcctcgcaacacagataacgcttggatggagactgaagctgtaaactaccatgatgaaactggggagattatggacaatctgatgctcgaggctggggatgacgccggcaaggtgaagtgggttgatatcaacgataaactgaagctgtacgcatctcacagtcagttcatcaaactggtagctgagaaaagagacgcccattggtccgaggatagtgaggccgattgccacgctctatag

SEQ ID NO: 28123 - DNA, 621 bp, Artificial Sequence
  Description of Artificial Sequence: Synthetic coding sequence
atgagtgggagcaatggttccaaggaaaattcccacaacaaggcccgaacatctccttaccctgggtccaaagtggagcgcagtcaggtgccaaacgaaaaggtggggtggctggtggagtggcaggactacaagcccgtggagtacactgccgtcagcgtgcttgctggcccgcgttgggctgatccacagattagcgagtccaacttttctcctaagttcaatgagaaagatggccacgtggagcgcaagagcaagaatggcctctacgagatcgaaaatggtagacctcggaatccagccgggagaaccggtcttgttggaagaggcctgctgggccgctgggggcctaatcacgccgccgatcccatcatcacacgatggaagcgggactcctcaggcaataaaataatgcatccagtgagcggaaagcatatcctgcaatttgtcgccattaagagaaaggactgtggtgagtgggccattccaggtggaatggtagatcccggagaaaagatcagtgccaccctcaagcgcgaatttggagaggaagctctcaactctttgcagaaaacctccgcagagaagagagagattgaagagaaacttcataaactgtag

SEQ ID NO: 28124 - DNA, 789 bp, Artificial Sequence
  Description of Artificial Sequence: Synthetic coding sequence
atggcccccgcactgctgctgatccccgcagcactcgcctccttcattctggcgtttgggactggagtggagttcgttagatttacgagtctccggcctctgctggggggaattcccgagtcaggcggcccagacgcaaggcaagggtggctcgccgcccttcaagatcgaagcatcctagctcccctggcgtgggacctcggactactgttactttttgtaggccagcactctttgatggccgcagagagagttaaagcatggaccagccgctactttggggtcttgcagaggagcctgtacgtggcatgcacagctttggccctgcagctggtgatgcgctattgggaaccaattcccaaaggccctgtgctgtgggaagctcgcgctgagccgtgggcgacgtgggtccctctgctttgcttcgtgctgcatgtaatttcttggctcttgatattttccatcctgcttgttttcgactacgccgaacttatgggcttgaagcaggtgtactaccatgtcttgggtctaggggaaccacttgccctgaaatcacccagggccctcagattgttttcccacctgaggcatcccgtctgtgttgaattgcttactgtgttatgggttgttccaacgttgggcacagatcgtttgctgttggccttcttgttgaccctctacctgggtctggcccatggactagatcagcaggatctgcgttatctccgagcccaactgcagaggaaactgcatcttctcagtagaccccaagatggtgaagctgagtag

SEQ ID NO: 28125 - DNA, 612 bp, Artificial Sequence
  Description of Artificial Sequence: Synthetic coding sequence
atggctcctgctctcctcttgattcctgccgctttagcctcattcatacttgcgtttgggacaggcgttgagtttgtgcggttcacgagccttaggccgcttctcggcggcatccccgagtctgggggacccgacgctcggcagggctggcttgccgctctacaggataggtccattctcgctcccctagcctgggatctgggtttgcttcttctgtttgtagggcagcattcactcatggccgcggaaagagtgaaagcctggacaagccgctatttcggggttcttcaacggtctctttacgtagcctgtaccgccctggccttgcaggtgtattatcatgtcctgggactcggcgaaccactcgccctgaagtccccgagagccctcagactgttttcccacctgaggcaccccgtgtgcgtcgagctgctgaccgtgctgtgggttgtacctaccttggggacggaccgcctgttgctggccttcctcctcaccctatacctgggactagctcatggactggatcagcaggacctaagatacttgcgtgctcagctgcaaaggaagctgcacctgcttagtcgaccccaggatggagaagcagaatag

SEQ ID NO: 28126 - DNA, 789 bp, Artificial Sequence
  Description of Artificial Sequence: Synthetic coding sequence
atggctccagcactgctgcttatccctgcagcattagcttcatttatcctggccttcggaaccggggtagagttcgtccgctttacctcgttacggccactgttggggggaattccggaaagcggagggcctgatgcaagacagggatggctagcagccctccaggaccgatcaatcctcgccccactggcgtgggacctgggactactgctgctcttcgttggacagcatagtctcatggctgctgaaagagtgaaagcatggacgtcacgctactttggggtcttacagaggagcttatatgtcgcgtgcacagccttggctcttcaactggtgatgaggtactgggaacctatccccaaaggtcctgtactgtgggaggctcgtgccgaaccctgggctacttgggtccctctcttgtgttttgtcctgcatgttatcagctggctgctgatttttagcatcttgctggtgtttgactatgcggaactaatggggttgaaacaagtttattaccacgtcttgggcctgggcgaacctcttgccctcaagagcccacgcgccctgcgccttttttctcacctccggcatccagtatgcgtcgagctgctcaccgtcctgtgggtagtgccaaccctaggcaccgatcggctcctgttggcgttcttactgactctctatctgggactggcgcatggcctggatcagcaagatttacgatatttgcgggctcagctccagaggaagcttcatttgctgtcccggccccaagatggggaggcagaatag

SEQ ID NO: 28127 - DNA, 612 bp, Artificial Sequence
  Description of Artificial Sequence: Synthetic coding sequence
atggcacccgctctgctgctgattcccgcggcactcgcatcctttattttggccttcggcacgggagtggaattcgtgaggttcacctctctcagaccgcttcttggaggaatccctgagagtgggggaccagatgctcgccagggatggctggccgctctgcaggaccgttctattctggcccccctggcttgggacttggggttgctgctactgtttgtgggacaacattctctgatggctgctgagcgagttaaggcatggacttctcggtacttcggagttctccagcggagcctgtatgtggcttgcactgccttagctctgcaggtgtattaccacgtcctgggactcggagagcctttggccctaaagtcgcccagggctctccgcctgttcagccatttacggcacccggtctgtgtggaattgctcaccgtgctgtgggtggttcctacactgggcaccgaccgcctcctgttagcctttctcctcaccttatacctgggattagcacacggcctggaccagcaggatttgcgctacttgcgagctcagctgcagcgaaagctgcacctcctgtcgaggcctcaggatggagaggcagagtag

SEQ ID NO: 28128 - DNA, 789 bp, Artificial Sequence
  Description of Artificial Sequence: Synthetic coding sequence
atggcccctgccctcctcctgatccctgccgcgctggcaagctttattcttgcttttggtacaggagtcgaattcgtgcggtttactagtcttagacccctcctgggcggtatccctgaaagtggaggcccagatgccaggcagggatggttagccgccctacaagataggtctatcttggctcctctggcctgggacctcggcttgctgcttctcttcgtcgggcagcacagcctcatggcggccgagcgggtaaaggcctggacatcaaggtatttcggggtgctccagcggtccctgtacgtggcctgcacggccctggccctgcaactggtcatgcggtactgggagcctatcccaaaaggcccagtgctgtgggaagcgagagcagagccatgggctacttgggtgcccttgctgtgctttgtgttgcacgtcatctcttggctgctgatttttagtatcctgctggtgtttgactatgctgaactgatgggcctgaagcaggtgtactatcacgttcttggcctcggcgagccgctagcattgaaaagcccacgtgctctgagactcttttctcacctaagacatcctgtgtgtgttgagttactgactgtcctctgggtcgtccctacactaggaacagaccgtttgctgctcgctttcctcctaaccttatacttggggttggcccacggactcgatcagcaggacctgcgttaccttcgcgctcaacttcagaggaagcttcacctactgtccagaccacaggatggcgaggctgaatag

SEQ ID NO: 28129 - DNA, 789 bp, Artificial Sequence
  Description of Artificial Sequence: Synthetic coding sequence
tgagagagtggacgagaagccactggcgagggtgacctgagttctaaactcgggactcagggacttgagttttggcgtggcgggagggtacggacagagggcgctgagaaaggcggcgaccgtagcatactaaatgcgagacaggggtggctggcggccctgcaggacaggagtatactggccccccttgcttgggatcttggcctgcttttgctgttcgtcggccagcactccctgatggcagctgagagagtgaaggcatggacatcccgttatttcggcgtgctccaacgctccctttacgtagcctgtacagcattagcactacagttggtaatgcgttattgggaacctataccaaagggccctgtgttatgggaggcccgggccgaaccatgggctacgtgggttccactcttgtgctttgtgctgcacgtcattagttggctgctgatcttttcgatcctccttgtcttcgattacgccgaattaatgggactgaaacaggtgtattaccatgttcttggtctgggcgaacccctggccttaaaaagtcctagagccctgcggctcttttcccacctgcgccaccctgtatgtgtcgaattactcacggtgttgtgggtggtgcctactctgggaacagacaggttactgctagcttttctgctcacactctacctcgggctggctcatgggctcgatcagcaggacttgaggtacctaagggcacagctgcagaggaagctccatctgctgtccaggcctcaagatggtgaagctgaatag

SEQ ID NO: 28130 - DNA, 789 bp, Artificial Sequence
  Description of Artificial Sequence: Synthetic coding sequence
atggctcccgctctcctgctgataccggcagcactggcttccttcatcctcgccttcggtaccggcgttgagtttgtccgcttcaccagtctccggcctctgcttggcgggatcccagagtccggtgggcctgatgcccgccagggttggctggcagccctgcaagaccgctcgattctggctccgctagcttgggacctgggtctgctcctgttatttgtaggccagcattctctcatggccgccgaaagggtgaaagcatggacctccaggtacttcggggttctgcaaaggtctctgtacgtcgcttgcaccgcgcttgccctgcagctggttatgagatattgggagcctattccgaaaggccctgtgctttgggaggcacgggcagagccttgggcgacatgggtgccgttactttgcttcgtgctgcacgttatttcttggctactcatcttttccattttgctggtgttcgattacgccgaattgatgggactcaagcaggtctattaccatgtgctgggcttgggcgagccacttgcactgaagtccccccgcgcactgcgtcttttctcccatctgcgacatccggtgtgtgtcgaactgctaactgtgttgtgggttgtccccacactgggaaccgaccgtctgctgctggcctttctgttaacattatacctggggctggctcacggactggaccagcaagacttgcggtacctgagagcacagttacagcgaaagctgcatctgttgtcccggccacaagatggggaggccgagtag

SEQ ID NO: 28131 - DNA, 612 bp, Artificial Sequence
  Description of Artificial Sequence: Synthetic coding sequence
atggcacccgccctcctcctgatcccagcggctctggctagctttatcttggcgttcggcactggcgtggaattcgtaagattcactagtctgcgccctctgctcggaggtattccagaatccggggggccagacgcaagacaaggatggctcgcggctctgcaggacaggtccattctcgctcccctggcatgggacctggggctgctcctgcttttcgttgggcagcattcattgatggctgcagaaagggtgaaggcctggacatctcggtacttcggtgtcctgcaaaggagcttgtacgtcgcttgtaccgcactggcgctgcaggtgtattaccacgttttgggcttgggggagccgctggccctgaagagtcctagggccttgcgcctgttcagtcaccttagacaccccgtctgtgtcgagctactgactgtgttgtgggtagtccccactctcgggacggacagattgctgttggccttcctccttacgctctatctggggttagcacacggattggaccagcaggatctccggtatcttagagcccagctgcagagaaagctacatctgttgagcaggccacaagacggagaggcagagtag

SEQ ID NO: 28132 - DNA, 789 bp, Artificial Sequence
  Description of Artificial Sequence: Synthetic coding sequence
atggcccccgccctgttattaatacccgccgctctcgcttcctttatcttagctttcgggactggcgtggaattcgtgagattcacctcactccgacctcttctcggcgggatcccggagtcggggggtccagacgctcggcaggggtggttggccgctcttcaggatcgctccatcctcgcgccgctcgcatgggacctggggctgctcctgcttttcgttggccaacactccctaatggccgcagaacgcgtgaaagcatggaccagccggtacttcggcgtactgcagcgcagtctgtacgtggcctgtactgctctcgccctccagctggtcatgcgctattgggagccaattccaaaggggccggtgctatgggaggctagggccgaaccttgggcaacctgggtgccgctactgtgtttcgtgctgcatgtcatctcatggctgcttatttttagtatactgttggtttttgactacgccgagctgatgggactgaaacaggtgtattatcacgttctgggccttggggagccactggctctaaaatctccaagggctctccggttattttcccaccttagacacccggtttgtgtcgagcttctgaccgtgctctgggtagttccaaccctcgggacagataggttgcttttggctttcctgctgacgctgtatcttggcttagcacacggactggaccagcaggatttaaggtacctaagggcccagcttcagcggaaattacacttgctgtcacgcccacaggacggggaggcagaatag

SEQ ID NO: 28133 - DNA, 789 bp, Artificial Sequence
  Description of Artificial Sequence: Synthetic coding sequence
atggctcctgccctcttgctaatacccgctgcccttgcctcattcatactagccttcggaaccggtgtcgagtttgtgcgttttacttctttgagacctctgttgggcggaattcccgaaagcggtggcccagacgccagacagggatggctggctgcattacaggaccgctccatccttgccccattagcttgggacctcggcctcctgctgctttttgtggggcagcactcacttatggccgcagagagggttaaagcttggacttctagatacttcggcgtactgcagcgctcactctacgtggcatgtacggcactggccctgcagctggtgatgcgctactgggagccgatccctaaaggtcctgttctctgggaggctagggccgagccctgggctacttgggttcctctgctctgcttcgttcttcacgtgatatcttggctgttgattttttccattctattagtgtttgactacgccgagctgatggggctgaaacaggtgtattaccacgtgcttgggctgggagaacccctcgcactaaagtctccaagagccctccgcctattcagccacttacgccatcctgtctgtgtggaactgttaacggttttatgggtggtcccaacattaggcaccgacagactgctgttggcgttcctgttaaccctctatctgggtctggcgcatggtctggaccagcaggacctgcgctatctccgcgctcaattgcagcgcaagctgcacttgctcagccgcccacaagacggtgaagctgagtag

SEQ ID NO: 28134 - DNA, 789 bp, Artificial Sequence
  Description of Artificial Sequence: Synthetic coding sequence
taagagagtggtcgggaagcgactggggagggtgacctgtcatccaagctgggcacacaaggtctggagttctggcgcggcggtcgcgtgcggacggagggcgccgagaaagggggggatcgctcaattcttaatgccagacagggttggttggcagcccttcaggatagatccatactggcccctctggcgtgggacttgggcttacttctactgtttgttggacagcactcacttatggccgcagaaagggtaaaggcatggacttctcgttatttcggggtgttgcagagatctctgtacgtggcctgcacggcgctggccttgcaattggtgatgaggtactgggagcccatccccaaagggcccgtgctgtgggaggcacgcgcggagccatgggctacctgggtgcctctgttgtgttttgtgctgcacgtgatctcttggttgctgatcttttcgatcctcttagtgttcgattatgctgaactcatgggactgaagcaagtgtactaccacgtgctgggcctgggggaaccattagcactgaagtcccccagagccctccgtctattctcccaccttaggcatccagtatgtgtcgagctgttgaccgtgctatgggtagtgcccactctgggcaccgaccgactcctgctggcttttctcctgacgttgtatctaggtctagcgcacggactggatcagcaggacctccggtatctcagggcccaactacaacgaaagctgcacctgttgagccggccacaagatggcgaagcagagtag

SEQ ID NO: 28135 - DNA, 789 bp, Artificial Sequence
  Description of Artificial Sequence: Synthetic coding sequence
atggcgcctgcgcttctcctcattcctgccgccctcgctagtttcatactggcgttcggcacaggcgtcgaatttgttcggttcactagccttcggcctctgctgggaggcatccccgaatcaggggggcctgatgccagacagggttggctcgccgccctccaggatcgctcgatactggctcccctcgcttgggacctcggcctgttgctgcttttcgtggggcagcactccctgatggccgccgagcgcgtgaaagcgtggacaagcagatacttcggggtgttgcaaaggagtctatacgtggcctgcaccgcattagccctgcagctggtgatgaggtattgggaaccaatacctaaaggtcccgttctgtgggaagcacgggcggagccttgggccacctgggtccctttgctttgtttcgtgctgcatgtaatcagctggctcttgatcttttcaattctcctggtatttgactacgctgaacttatgggactaaagcaggtgtactatcacgtattgggactgggggagcccctggccctgaaaagcccgagagctctgaggctcttctcacatctacggcacccagtctgcgtggagctgctcaccgtgctctgggtagtgccaactttaggaactgacaggcttcttcttgcattcctcctaacactgtacctgggattagcccatggcttagaccaacaggatctgaggtatcttagagcccaactccagcgcaaactgcatttgctgtcacggcctcaggacggcgaggcagagtag

SEQ ID NO: 28136 - DNA, 789 bp, Artificial Sequence
  Description of Artificial Sequence: Synthetic coding sequence
tgagagtcgggcagggaggctaccggcgagggggacttgagctccaagcttggaacacaaggtcttgagttttggcgcggcggcagggtgcgcacagaaggcgcggaaaagggcggcgaccggtcaatcttgaacgcacggcagggatggctggctgctctgcaggatagatctatcctggcgccccttgcctgggacctaggactgcttcttctcttcgtgggacagcacagtttaatggcggccgagcgcgttaaggcatggacctcacgatactttggtgtgctccagcggagcctgtacgtggcatgcacggcgctcgccctccaacttgtcatgcggtactgggaaccgattcctaagggtcccgtactgtgggaagccagggccgagccatgggccacgtgggttccattgctttgcttcgtgctacacgtgatatcatggctccttattttctcaatcctactcgtgttcgactatgccgagttgatgggattgaagcaagtgtattaccacgtgctgggcttgggggagcccttggccctgaaatcgcccagagccctgcgcctattcagtcacttgcggcatccggtctgcgtcgagctccttacagtactgtgggtcgtgcccaccctcgggacagatcggttactgttagctttcttactgaccctctacctgggcttggcccatgggttggatcagcaggacctgcgctacctgagggcccagttgcagaggaaacttcaccttctctcaaggcctcaggatggggaggccgaatag

SEQ ID NO: 28137 - DNA, 789 bp, Artificial Sequence
  Description of Artificial Sequence: Synthetic coding sequence
taggaaagtggtagagaggcgactggcgaaggagatctttcatcaaagttgggtactcagggcctggagttttggcgcggggggcgggtgaggactgagggagcggagaaagggggagacagaagcatactgaatgccaggcaaggctggctagccgctcttcaggatcggtccatccttgcacccctggcttgggatttaggtctgctgctgctgtttgtgggccagcacagtttgatggcggccgagcgggttaaagcctggacaagccgctattttggggtactgcagcgctcactgtatgtcgcttgtacagctctggctttacagttggtcatgcggtattgggaaccaatcccaaaagggccagtgctatgggaggcaagagcggaaccgtgggccacatgggtcccactcctctgtttcgttctacatgttatatcgtggcttttgatattcagcatcctgctggtgtttgactacgcggagctcatgggactgaaacaggtgtattatcatgtgctcggattaggtgaacctctcgctctcaaatcaccaagggcattgcgacttttcagtcacctgaggcatcccgtctgtgtcgagctgctgaccgtattatgggtggtccctacactaggaactgatagactgctgctggcatttcttttgacattgtatctggggttggcacacgggcttgatcagcaggatctacgttacctgagagcccagctgcagcggaagcttcatctactaagcaggccacaagacggtgaggctgagtag

SEQ ID NO: 28138 - DNA, 789 bp, Artificial Sequence
  Description of Artificial Sequence: Synthetic coding sequence
atggccccagctcttctactaattccagctgcccttgcttcctttatcctcgcttttggcaccggcgttgagtttgttcggtttactagcttgcggccactgctgggtggcatcccagaatctgggggcccagacgcccgccagggctggttggccgccctccaggaccggagcattctggcacctttggcgtgggacctcggcctcctgctgctgtttgtaggacagcacagtcttatggccgctgagagggtgaaggcatggacaagcagatactttggagtgcttcagaggagtctgtatgtggcatgtaccgctctcgcgctccagttggttatgcgatattgggagccaattcccaagggtccggtcctctgggaagcacgggctgagccttgggctacttgggtccccctgctctgtttcgtgcttcacgtgatcagctggctgctcatcttcagtatcttattagtgtttgattacgccgagctgatggggcttaaacaagtgtactatcacgtgctggggctgggggagcctctggccctgaaaagcccgcgggcacttcgactgttcagtcatctgcgccatccagtttgtgtggaattactgacagtcctatgggtggtgcccacacttgggactgatcggctgcttcttgcctttctcctaaccctctatctcgggttagcccatgggctcgaccagcaggatctcaggtatctgcgggcacagctccagcgcaagcttcacctattgtcaagaccccaagatggcgaggccgaatag

SEQ ID NO: 28139 - DNA, 789 bp, Artificial Sequence
  Description of Artificial Sequence: Synthetic coding sequence
tgagaatccggtcgtgaggcaactggggaaggtgatttgagttcgaagctgggcactcagggtctagagttttggaggggcggtcgggttagaacggaaggtgcggaaaaaggcggagatcggtctatcttgaacgccaggcaagggtggctggctgccctccaagacaggagcatcctcgccccactggcttgggatctaggtctgctcctcttatttgtgggacaacatagcttgatggccgcagagagggtgaaggcctggacctcccggtattttggcgtactgcagagatctctctatgtagcttgcacagctctggccctccaactcgtgatgcgttactgggaacctatacctaaaggaccagtgttatgggaagccagggccgaaccatgggcgacctgggttccactgttatgcttcgtcctgcacgtcatctcatggctcctaattttttcgattctactcgtcttcgactacgctgaacttatgggcctgaagcaggtttactaccacgtgctcggcttaggggagcctctggccctcaaaagtcctagagccttgcgactgtttagccaccttcgtcatcccgtctgtgtagagctgctgactgtgctgtgggtagtgccaacactgggtacagacaggctactcctggccttcttgctgacgctctacctggggctcgctcatgggttagatcagcaagacttgcgatacctccgcgctcaactccagagaaagcttcaccttctgtctagacctcaggacggtgaagcagagtag

SEQ ID NO: 28140 - DNA, 789 bp, Artificial Sequence
  Description of Artificial Sequence: Synthetic coding sequence
taagagagtgggagagaggccaccggagaaggagatttatcaagcaagctggggacacagggtctcgaattctggcgcggcggtagggtgcgaaccgaaggggccgaaaagggaggagatcggagcatcctgaatgcgcgacaaggttggctggcggccctccaggatcgctcaatccttgccccactcgcttgggacctaggcctcctgctcctgtttgtgggccaacacagcttaatggctgcagaaagggtgaaggcttggaccagtcggtacttcggggtcctgcagaggtccctgtacgtggcctgcacagcgctggccctccagctggtaatgagatactgggaaccgattccaaagggaccagtcctatgggaagctagagccgagccatgggcgacatgggtacccttgctttgttttgtcctgcatgtgatttcttggttgttgatcttctctattctgttggttttcgactatgccgaattaatgggtttaaaacaggtctactatcacgtcttgggcctgggcgagcctttagcgctgaagtcgccacgcgctttacgcctcttctcccacctcaggcaccccgtctgcgtggaactgctgaccgtcctttgggtggttcctacactcggaactgatcggttactgctggcttttctgttgaccttatatctcggccttgcccacggtttggatcagcaggatctcagatatctgagggcgcaattgcaaagaaaactgcatctcctctcacgcccacaagatggggaggccgagtag

SEQ ID NO: 28141 - DNA, 612 bp, Artificial Sequence
  Description of Artificial Sequence: Synthetic coding sequence
atggcaccggctctgctcctgattccagccgctttagcttcattcatcctggcctttggcaccggggtggagtttgtgcgttttacttccctgcgcccattactcgggggaattcccgaatccggcggcccagacgctcggcagggctggctggctgctctgcaggacaggtccattctggccccgctggcatgggatctgggcctgcttctactgttcgtgggtcagcattctctcatggctgctgagcgagtaaaggcctggacatccagatactttggggtcctgcagagatccctctacgtagcatgtaccgcactagcattacaggtctactaccatgtcctcggtcttggcgagccactcgctcttaaatcccctagggccttaagactgttttcgcacctgagacacccagtatgtgtggaactcctgaccgttctttgggtggtacccaccctgggtaccgatagactgctgctggccttcctgctgacactctacctcggcctggcacatggtctcgaccagcaagacctgcgatacctgcgagcacagcttcagcgcaaacttcatttactgtctcggcctcaggacggagaggcggagtag

SEQ ID NO: 28142 - DNA, 789 bp, Artificial Sequence
  Description of Artificial Sequence: Synthetic coding sequence
tgagaaagtggtcgcgaggctaccggtgaaggcgacttatcaagcaagttgggcactcaaggcctggaattctggcggggcggacgggttagaacggagggggctgagaagggaggggaccgttctattttaaatgctcgccagggctggctggccgctttgcaagacagatccattctagccccactggcttgggacctgggacttctgttgcttttcgtagggcagcattctctgatggccgcagagcgcgtgaaagcctggacctcccgctacttcggtgtacttcaaaggagcctgtacgtagcatgtacagcactggcgctgcagctggttatgcggtattgggaaccaatcccaaagggacccgtcctttgggaagctagagcagaaccatgggcgacatgggtgcctctgctgtgctttgtgttacatgtgatatcatggctgctcatcttctcaatattgctcgtgttcgactatgccgagctgatggggttgaagcaggtgtattatcatgttctgggcctgggcgaacctttggcactgaagtcgccgcgagctctcaggttgtttagccaccttagacatcctgtctgtgtagagctgctaaccgttttatgggtggtgcctaccctaggcaccgaccgtctgctcctagcctttctcctgacactctatttgggcctcgctcacggactggatcagcaggatctcaggtatctgcgggcccagctccagcgaaagctgcacctattaagccggccacaagacggggaggcagagtag

SEQ ID NO: 28143 - DNA, 612 bp, Artificial Sequence
  Description of Artificial Sequence: Synthetic coding sequence
atggcgcccgctctgctcctgatcccggccgccctggcaagttttatacttgccttcgggaccggagtagaatttgttcggtttactagcttgcgaccccttctggggggaatccctgagtcaggcggcccggacgctagacaggggtggctcgctgccttgcaggacagatctattttggcccccctggcatgggacttggggctgcttctgctttttgtcggtcagcactcattaatggcggccgaacgtgtgaaagcctggacgtctagatacttcggcgttctgcagagaagcctgtatgtggcatgtaccgccctggccctgcaagtgtactaccacgtcctcggcctaggggagcctttagccttgaagagcccgagagcccttagacttttcagtcacctccgtcaccctgtctgcgtcgagcttctgactgtgctatgggttgtcccaaccctcggaactgaccgtctactgctcgctttcctcctgacattgtatctggggctggcccatggccttgatcaacaagatctgaggtacttacgggctcaactgcaacggaagttacatctcctaagtcgaccacaggatggagaagccgagtag

SEQ ID NO: 28144 - DNA, 612 bp, Artificial Sequence
  Description of Artificial Sequence: Synthetic coding sequence
atggcgcccgccttattgcttatccctgcagccctggccagcttcattctggcattcgggaccggcgttgagtttgtacggtttacttcactgaggcccctactgggcggcatccctgagagtgggggtcccgatgctaggcaaggctggttggcagcgctgcaggataggagcatcctggcccccttggcctgggatctgggcctgctgctgcttttcgtcgggcagcattcgcttatggctgccgaacgcgtgaaggcttggacttcccggtacttcggcgtcctgcagagatccctttacgtggcttgcactgcccttgccctccaggtgtattatcacgtgctgggcttgggcgaaccactggcattgaaatctccacgcgccctgagacttttcagtcacctgcgccaccctgtgtgtgtggagctattaaccgtcctatgggtggtgcccacactggggaccgataggctgttattggcttttctgttaactctgtatctgggacttgcccatggactggaccagcaagacctgaggtatttgagagcacagctgcagagaaaactgcacttgttgagtcgaccacaagacggggaggccgagtag

SEQ ID NO: 28145 - DNA, 612 bp, Artificial Sequence
  Description of Artificial Sequence: Synthetic coding sequence
atggccccagccttgctgcttataccggcagcactcgcctcctttatcctggcttttgggactggagtcgagttcgtgaggtttacgtcactgagaccgttgctgggcgggattcctgaatcaggaggccccgatgcccggcagggctggcttgcggctctgcaagatcgctcaatcctcgcccctttagcctgggacctgggcttattgctgctattcgtgggccagcattccctgatggctgcagagagagtgaaagcctggacttcgcgctacttcggtgtactgcagagatcgctgtacgtcgcttgtaccgcacttgctcttcaagtgtactaccatgtattaggacttggcgagccactggcattaaaaagcccacgggccctcagattgttctcccacctccgccaccccgtgtgtgtggaacttctgacagtgctgtgggtggttccgactctcgggaccgatcgacttctgctggccttcctcctgactttgtacctggggctcgcccacggcttggatcagcaagacttgaggtacctccgagctcaacttcagaggaaattgcatttgctgtcgcggccgcaggacggtgaggccgaatag

SEQ ID NO: 28146 - DNA, 750 bp, Artificial Sequence
  Description of Artificial Sequence: Synthetic coding sequence
atggcaatgctgagagtccagcctgaggcccaggccaaggtggacgttttcagagaagacctttgtactaagaccgagaatctcctgggatcttatttcccgaagaagatatccgagcttgacgcctttctgaaagagccagcactgaatgaggccaatttgagcaacctcaaggctccacttgacatacccgtccctgaccccgtcaaagaaaaggaaaaggaggaaagaaaaaaacagcaggagaaagaagacaaagacgagaagaaaaaaggagaagacgaggacaaaggacctccatgtggaccagtgaattgtaatgaaaaaattgtggtccttctccagcgtctaaagccagagatcaaagacgtcatcgaacaattgaacctggtgaccacatggctgcagctgcagattccccgcattgaggacgggaacaacttcggtgtcgcggtccaagagaaggtcttcgagctgatgacctctctgcacacaaagctggaggggtttcatacgcagatttccaagtacttttccgagcgcggcgatgcagtgaccaaagcggctaagcaaccacacgtgggagactaccgacagttggtccacgaactcgacgaggccgaataccgtgacatcaggctaatggtgatggagatacgcaatgcatatgccgtgctctatgacatcattctaaaaaatttcgaaaaactgaagaaacctcgtggcgagaccaaggggatgatatactag

SEQ ID NO: 28147 - DNA, 5697 bp, Artificial Sequence
  Description of Artificial Sequence: Synthetic coding sequence
atgcttctctcaggcggcgatcctccagcacaagaatggtttatggtgcagactaaatctaaaccccgcgtacaaaggcagaggctgcaggtccagcgaatttttcgtgtcaaattaaacgcgttccagtcccgccccgatacgccctacttctggctgcaactcgagggccccagagagaacatgggtaaggctaaagagtacctaaagggattgtgcagtcccgagctgtggaaggaagttaggtatccccccattctgcattgtgctttcctaggggcgcaggggctgtttctggactgcctgtgttggtctacgctggcctaccttgttccggggcccccaggcagtttgatggtggggggacttacagagagcttcattatgacccaaaactggctggaggaattagtcgggaggctgcgttgggggccagctccactcctcactcccaggggaatctgggaagcggaagtcactagagcctttggggccttggtctggattaggggtgatcagcacgctggggaccttctgcagctgccgcctgccgtccaggaacttctgctgagtttggtgcgcgacgcagccggaaaggaagacataattgagtggctatcccgctttgggatctcggattctcactccgacccggaagtgctgatctgtcctccacagcagcagaaagaagctcccgccatggtgtccgtgggagaaagtccaggcccttttgttgacatggggactctccagaatcgggggcctgagaacagtaagcggcttagctcattgggagccaccggatcccttattacggctcaatcaactccccaggaggccgctaatcagctcgtccgggtgggctcgaacaatcaggacggtatggatagcgcccaggaagaggggacagtgcaggctacttcctctcaggattctaccaatcatactcaagcgctactgaagcagaggcaggtacagaaaatcgaggataagctgctgttccagccccctgtgtctgccctgggagtttgtcctccatggaaagcgtggaccccaggtcctgccttcggtcccttatggcctggagcaatagcagctactttttggcgtataaacgagttgcattcccttcacttggcctggttgttgagccaggcctgcttcaacttccccttttggcagcgccccctggggccgattcagttgaaactgcctgggcagaatccactgccactgaacttggaatggaagcaaaaggagttggcaccactgccctcagccgagtctcctgccggacgcccagacgggggtctgggtggggaggctgccctgcagaactgtcctcggcccgagatatcacccaaagtaacaagcttgctggtggtcccggggagctcagatgttaaagacaaggttagctccgacctacctcagatcggaccgccccttacatctacaccccagctgcaggcaggtggagaacccggtgatcagggcagcatgcagcttgactttaagggcctcgaggagggaccagctcccgtgctaccaaccggtcagggcaaaccggtagcgcaggggggcttgacagatcagtctgtgcctggcgctcagacagtgccagaaacgctgaaggtgcctatggctgccgctgttcctaaggcggagaatccctcccgcacacaagtgccgagcgccgcaccaaaactccccactagccggatgatgctggcagtccacaccgaacccgcagcaccggaagtgcctctggcgcctacaaaacctactgctcagctcatggcaaccgctcagaagacagtcgttaatcagcccgttttagtggctcaggtagagcctactacacccaagacccctcaagctcagaaaatgccggtggccaagacttcccctgctggaccaaaaactccgaaagcccaagctggcccagctgcaactgtctccaaagcacccgccgcctccaaggccccggccgccccgaaagtccccgtcacaccaagagtatcaagggcgccgaagaccccggcggctcagaaggtgcccacagacgctggccctacattggacgtcgctcgcctgcttagtgaagtccagcccacttcacgggcgtctgtaagcctgctgaagggacaaggacaggcgggtaggcagggacctcaatcctccggtaccctagccttatcatcaaagcatcagtttcaaatggaggggctgttgggcgcgtgggaaggtgctccaaggcagccacctcggcatctacaggcaaatagtacggttacctctttccagagatatcatgaagctctgaacactcccttcgagttaaatttgagcggagagcccggaaaccagggcttacgaagagtggtcattgatgggagctctgtggctatggtgcacggccttcagcacttcttctcttgtagggggatcgccatggccgtgcaattcttttggaacagaggccaccgggaagtgacagtgtttgtgccaacctggcagctgaagaaaaaccggagggtgagggagtcacatttcctgacaaagcttcacagcctgaagatgctcagcataacgccatcacagcttgagaacggcaagaagataacgacctatgactacagatttatggtgaagttggccgaggagactgacgggatcatagtcactaatgaacagatccatatcttaatgaacagctccaaaaagctgatggtgaaagacaggctgctccctttcacgttcgcggggaatctttttatggtgcctgacgacccactgggccgggatggcccaacactcgacgagtttctcaaaaaacccaaccgtctggacaccgacatcgggaatttccttaaggtctggaagactctgccgccctcttctgcttctgtcacagaactatccgacgatgccgattctggcccgctggagtctctccccaatatggaggaggttagagaggaaaaggaggagcgccaggatgaggaacaaaggcaggggcaggggacccaaaaggccgccgaagaagacgatctagatagcagcctcgctagcgtctttcgagtcgagtgcccatccctttctgaggagatcctacgctgtctctccctccacgatccccccgatggggccctggatatcgaccttcttccaggggctgcctccccttacctgggcattccatgggatggaaaggccccatgccagcaggtcctcgctcacctggctcaactgacaattccctccaacttcacggctttgagctttttcatgggatttatggatagccatcgggatgcaatacctgattacgaagccctagtgggtccattgcactcccttctcaagcagaagcccgactggcaatgggatcaggagcatgaggaagcattccttgctctgaagagggccctggttagtgctttgtgtctgatggcacctaattcacagctgccgttcaggctggaggtgactgttagccacgtcgccctgaccgcaatcttacaccaagaacatagtggtagaaaacacccaatagcctacacaagcaaacctctcctgcctgacgaggagagccagggcccccagagtggaggcgattctccttacgctgtggcctgggctctgaagcacttcagtcgttgtattggagatacccctgtggtcttggatctttcatacgctagcaggacaacagccgatcccgaggtcagggagggcaggcgggttagtaaggcgtggctcatccgctggtctctgcttgtgcaggataaaggcaagcgcgcccttgagctggctctgttacagggcctgctgggcgagaatcggctcctgactcctgccgcctccatgccaaggtttttccaagttttgccccccttcagtgatctttctaccttcgtttgcattcacatgagcggatactgcttctaccgtgaagacgaatggtgcgctggctttgggctctatgtgttgagtccaacctcccctcctgtatctctgtccttctcttgctccccatataccccaacgtatgcccaccttgccgcagtggcatgcggattggagagatttggacagtcacccttacccgtagtttttctgacgcactgcaactggatattcagccttctgtgggaactgctgccgctctggcgggccagaggattcctgtcttcagatggcgcgccacttccacatcccagtctgctttcctatattatcagcttgactagcggccttagttcattgccttttatctatcgtacgtcatataggggctccttgtttgcggtgacggtcgataccctagcaaagcagggcgctcaaggaggcggccagtggtggtccctaccgaaggatgtgccagcccccacagtgtcaccccatgcaatgggaaagagacctaaccttctggctctgcaactgtctgattctactttagcagatattatcgcgaggctccaagccgggcaaaaactgtcaggcagcagcccgttttcctcagcattcaattcactgtctctggacaaagagtccgggctgctcatgtttaagggggacaaaaaaccgagggtgtgggtcgtgccaactcaacttcgacgagacctcattttcagcgtccacgatattccattaggcgcccaccagaggccagaggaaacttacaagaagctgcggttactgggatggtggcccggaatgcaggagcacgtgaaggactattgccggagctgtctgttttgtatcccacgcaaccttatcggatccgagttaaaagtaatagagagcccgtggccactccggtctacggctccttggagtaatttgcagattgaagttgtgggccccgtaactattagtgaagagggacataaacacgttttaatcgtcgcggaccccaatacccggtgggtggaggcattccccttgaagccttacacccatactgccgtggcccaagttcttctgcagcatgtatttgcacggtggggtgttcccgtgaggctcgaagcggctcagggtccccagtttgcacgccacgttttggtcagttgtggcctggctttaggcgcacaagtggcctccctctctcgggaccttcagtttccatgcctgacttccagtggtgcctactgggaatttaagcgtgccttgaaagagttcatctttcttcacggaaaaaaatgggcagccagtttgcctctgttgcatctggcgttccgggcttcatcaaccgatgccacaccttttaaggtactaacaggaggggaatcacgtctgactgaacctctgtggtgggagatgtcatcagcgaacatcgaaggcctgaaaatggatgtgttcctgctgcagctcgtgggggagttgctggagttgcattggcgggtggctgacaaagcatccgaaaaagccgagaatagaaggtttaagcgggagagccaggagaaggaatggaacgtcggcgaccaggtcctcctactatctctgccgagaaatggaagctccgccaagtgggtaggccccttctatatcggggatcggctatccctaagtctataccggatctggggcttccccactcccgagaaactcggctgtatctatccctcctctctgatgaaggcgtttgcaaaatccggcacacccttgagcttcaaggtgctggaacagtag

SEQ ID NO: 28148 - DNA, 7797 bp, Artificial Sequence
  Description of Artificial Sequence: Synthetic coding sequence
ggccggcctattccgcctacaagcagtccaagccttctgccctctgcccagcttccaagttctcataatccccccccggttagctgccagatgcctcttttagactctaatacatcacaccagataatggataccaatccggacgaggagttttccccgaactcctatcttctgagagcttgttccggcccgcagcaagcaagctcaagtggccccccgaaccaccactcacagagcacattgagacccccattgcccccgccacacaaccatactttgtctcaccatcactcgtcggctaatagcttgaaccggaattcactgacgaacaggaggagtcagatccacgcccctgcacccgcccctaatgacctcgcaaccaccccagaatcggtgcaactgcaagattcctgggtcctgaactctaacgtaccacttgagacgaggcacttcctcttcaagacatctagcggcagcacacccctgttttcgtccagttcacctggatatcctctgacttccgggacagtgtatacccctcccccccgactcctccctcgcaacacattttcacgcaaggcattcaagctgaaaaaaccttctaagtactgcagttggaagtgtgcagctctttctgccatagctgcagcgctgttactagcaattctcctggcctacttcatagccatgcacttactgggtctgaattggcagctccagcctgcagacgggcatacattcaataatggtatcaggactggtttgcccggtaacgacgacgtagctacaatgccttccggtggtaaggtaccatggtcattaaaaaactcctccatcgatagtggcgaagctgaagttgggcgtagagtcactcaggaagttccaccaggggtcttctggaggagccagatccatatatcacagccgcagttcctcaagttcaacatctcactgggaaaggatgctctgtttggcgtgtatatccggcggggcctgcccccatctcatgctcagtacgattttatggagaggctcgacggaaaagagaaatggtcagtcgtggagtcgcctcgtgagagacgcagcattcagacccttgtgcagaatgaggccgtttttgtacagtatcttgacgtgggattgtggcatctcgcattctataacgatggaaaggataaggagatggtgagtttcaacaccgtggtgctggattccgtgcaggattgcccaaggaattgccacgggaacggagaatgcgtgagcggcgtatgccactgtttcccaggattcctgggcgccgattgcgcaaaagccgcatgccccgtcttatgctctgggaacgggcagtatagtaagggtacctgtcagtgttactccgggtggaagggggctgaatgtgacgtgccgatgaatcaatgtatcgatccgtcatgtggagggcatggcagctgtatcgatggtaactgtgtttgctctgctggatataaaggggagcactgtgaggaggttgattgtctggaccccacatgttccagccatggcgtgtgcgtcaatggcgagtgcctatgttcccccggttgggggggcctgaactgtgagctcgcccgggtgcaatgccccgaccaatgtagtgggcacggcacctacttaccagataccgggctgtgctcttgcgaccccaactggatgggccccgattgctctgtcgaggtgtgttccgtggactgtgggacccacggagtctgcatcgggggggcctgcagatgtgaagagggatggaccggcgcagcatgcgaccagcgggtgtgccaccccagatgcattgagcatggcacatgcaaggacggaaaatgtgaatgccgtgagggctggaacggcgagcattgtactatcgatggatgccctgacctgtgcaacggcaatggccggtgtacactgggacaaaactcatggcaatgtgtctgtcagaccggctggcgtggacctggatgtaatgtcgccatggagaccagttgcgcggataacaaggacaatgaaggtgatggtctcgtggactgtcttgatcctgactgctgcctgcagtctgcctgccagaattccctgctgtgtagagggtcaagggatccccttgatatcatccagcagggccaaaccgactggcctgctgtgaagtctttttatgatagaattaagctgctggccggcaaggattctacccacattataccaggagaaaacccatttaatagcagcctcgtgtctctgatccgcggccaagtggtaaccaccgatgggacaccgcttgtaggagttaacgtgtcttttgtgaagtatcctaaatacgggtacactattactaggcaagacggaacctttgatctcattgccaatggcggggcttctcttactctgcattttgagcgtgctccttttatgtctcaggagcggaccgtatggctaccatggaattcattttacgcgatggacacgctcgtcatgaaaacagaggagaactctatcccatcgtgtgatctgtctggcttcgtacgccccgatcccataatcatttcctcgccactttcaacattcttctccgcggctcccggacaaaatccgattgtgcctgaaacccaggtactgcacgaggaaatcgagctaccaggtagcaatgtcaagctgcgatacctgtcctctagaacagcaggatataagagccttctgaagataaccatgactcaaagcactgtgccactgaacctcattcgtgtgcatttaatggtggccgtggaagggcatctctttcagaaaagcttccaagcttcgcctaatctggcctatacgttcatttgggacaaaactgacgcgtacggccagcgagtctatggcctctcagacgcggtggtatctgtcggctttgagtatgagacctgcccctcactgatcctgtgggaaaaacggaccgcgctgctgcagggttttgagttagacccatctaacttgggcgggtggagtctggataaacaccacattctcaacgtgaaatctggcatattgcataaaggtacgggcgagaatcaattccttacccagcagcccgctattataacctccatcatgggcaatgggcgccgaaggtccatcagttgccctagctgcaatggccttgccgagggcaacaaattgctagcacccgttgctttagccgtgggtattgatgggtctctctatgtcggcgacttcaactacatacggcgtattttcccttcaaggaatgtgactagcatcctcgagctgaggaacaaagaatttaaacatagcaacaatcccgcgcacaagtactacctcgcggtggatcccgtaagcggtagcctctacgtatcagatacaaactcccgaagaatatatcgggtaaagagcctgtccggtactaaggaccttgctggaaactccgaggtcgtggctggcaccggagagcagtgcctcccatttgacgaggctaggtgtggagacggcggaaaagcgatcgatgctacgctaatgtcacctaggggcattgctgtggacaagaatggcttgatgtacttcgtggatgctaccatgattaggaaggtcgaccagaacggtattattagcacccttctgggcagcaatgacctaaccgccgtccgcccattgagctgtgacagctcaatggatgtggctcaagtgagattagaatggccaaccgacctcgccgtgaatcccatggacaatagcttgtacgtactcgagaacaatgtgatcttgcggatcacagaaaaccatcaagtctcgattatcgctggccgaccgatgcattgccaggttccggggatagactactctctgtctaaactcgctatccacagcgctctggaaagcgcgtctgccatcgccatctctcacaccggagttctatatattaccgagacagacgagaaaaaaattaaccgcctccgtcaggtcacaacgaacggcgagatatgcctgctcgctggtgcagcctccgattgtgattgcaagaatgatgttaactgcaattgttatagcggggatgatgcgtacgcaacagatgcaatactcaattctccaagttccttggccgtggctccggacggtacaatctatattgcagaccttggaaacatacggatccgtgccgtctcaaaaaacaaacctgtgttgaacgcttttaatcagtacgaggcggccagccccggggagcaggaattgtacgtctttaatgccgacgggatccatcagtacaccgtcagcctggtgacgggtgagtacctttataactttacatactccaccgacaatgatgttaccgaattaatcgacaacaatggtaattccctgaaaattaggcgcgatagctccggtatgcctcgccatctcctgatgcccgacaaccaaatcattacactgactgttggcactaacggcggactgaaagtggtttctacacagaacctggaactgggactaatgacttatgacgggaacacgggcctcttagcaactaagagcgatgagacgggctggaccactttctatgattatgatcacgaaggacgtctaaccaacgtcacacgtcccaccggcgtggtcacctctctccaccgtgagatggagaagtcaatcactattgatatcgaaaactctaacagggatgacgatgtgaccgtaataacaaaccttagctcagtggaggccagctacactgtagttcaggaccaggtgcggaatagctaccaactctgcaataacggcacactccgtgtgatgtatgccaatggtatgggaatctctttccactctgaaccccacgtactggctggaacaatcactccgaccattggccgctgtaacatatctttgcccatggaaaacgggctaaatagcattgagtggagactcaggaaggagcaaattaaagggaaggtcactatctttggtcgcaagttaagggttcatggccggaacctgctcagtatagattacgatcggaatattagaactgagaaaatatatgatgatcacagaaagtttacacttaggatcatctacgaccaggtcggtaggccctttttatggttgcccagctctggactcgccgcagttaacgtcagttatttctttaatggacgtttggctggactgcagcgcggcgctatgagtgagcggaccgacattgacaaacaggggaggatcgttagccgcatgttcgccgacggcaaagtctggtcttattcttacttagataaaagcatggtgctccttctgcagtcacagcggcagtacatcttcgagtatgactcctcagataggctccttgcagtcactatgccatccgtcgcaaggcattccatgagtacccatacctctataggatatatccggaatatttataaccctcctgagtcaaacgccagcgtcatcttcgactactctgatgatgggaggatcctcaaaacatctttcctagggacaggccggcaagtattctacaagtacggaaaactctcaaagctgtccgagattgtgtacgactccaccgctgtgacattcggctatgatgagactaccggcgtactgaaaatggtgaacctgcagtcgggcggtttctcttgcaccattagatatcggaagatcggccctctggtggacaaacagatttacaggttttcagaggagggcatggtgaacgctcggtttgattatacctaccacgataacagcttccggatagctagcataaagcctgtcatctccgagacccctctgccagttgacctctatcgctatgatgagatttcgggtaaagtggaacatttcggaaaatttggcgttatctattacgatatcaaccagataatcacaaccgcagtgatgaccctttcaaaacatttcgatacccacggcaggattaaggaggtgcagtatgagatgttcagatctctaatgtattggatgactgttcagtatgactccatgggcagagttataaagcgggagcttaagttaggcccctacgccaacacaaccaagtacacatacgactacgatggcgacgggcagttacagtccgtcgccgttaatgaccgccctacctggaggtactcctacgacctgaacggaaacttgcatctgttaaaccccggcaacagcgtgcggttgatgcctctacggtatgacctgcgagataggataactcgtctgggggacgtgcaatataagattgatgatgacggctacctttgccagcgtggaagcgacatcttcgagtacaattccaagggactcctcacgagagcttacaataaggcctcaggctggtctgtacagtacaggtacgacggtgtgggaagacgggctagctacaagacgaacctgggccatcacctgcagtatttttacagcgatctgcataaccccactagaatcacacatgtctacaaccattctaatagcgaaatcacctccctctactatgacttgcagggtcacttatttgccatggagagttcctctggcgaagagtattacgttgcctctgataacactgggacgcccctggctgttttttcgataaacggattgatgattaaacagctgcagtacacagcctacggcgagatatattacgacagcaatccagatttccagatggttattggctttcacggtggcctgtatgaccccttgacaaagctcgtgcatttcacacaaagagactatgatgtcctggcagggcggtggacctcacccgactatacaatgtggaagaacgtgggaaaggaacctgctccctttaatctgtacatgttcaagagcaataacccactgtctagcgaactggacctcaaaaattacgttacagatgtgaagagctggttggtgatgtttgggttccagttgtctaacattatccctggtttcccacgggctaaaatgtacttcgttccacccccatacgaactctctgagtcccaagcctccgaaaacgggcagctgatcaccggcgtacagcagacaacggagcggcacaatcaagcattcatggcattggaggggcaggtgattactaaaaagcttcatgcctctatccgcgagaaggccggacactggtttgctactacgacccctattattggaaaaggcattatgttcgccattaaagagggtcgggtgacaacaggggtttccagcattgcctcggaggatagccgtaaggtcgcatccgtcttgaataacgcctattatctggataaaatgcattacagtatcgaaggcaaagacactcactactttgtgaaaataggtagtgctgacggtgatctcgtgacactaggcaccacgataggacgaaaggttctggaaagcggtgtaaacgtgacagtgtctcaacccacacttttggttaatggtagaacaagacgattcaccaatatcgaattccagtattctacgttgttgttgtcaatcagatacggcttgacccctgatactctggatgaggagaaggctagagttctggaccaggcaaggcagcgcgccctggggactgcatgggctaaggaacagcagaaggcacgggatggccgggaggggagcagactgtggacagagggggaaaaacagcaactgctgtcgactggtcgagttcagggctatgaggggtactatgtcctcccggtcgagcagtatccagagctcgctgatagctccagcaacatccagttcctacgccagaatgaaatgggaaaacggtag

SEQ ID NO: 28149 - DNA, 8325 bp, Artificial Sequence
  Description of Artificial Sequence: Synthetic coding sequence
atggatgtcaaagatcgcaggcaccgctccctcacgcgggggcggtgcggtaaggagtgcagatacacctcttcgagtcttgattcggaagactgccgcgtaccaacacaaaagagctactccagcagcgagactctcaaggcttacgaccacgatagtcgcatgcactacgggaaccgcgtgaccgacctcattcatagagagtccgatgagttcccgaggcagggcacaaactttactttagccgaacttgggatttgcgagccatctccacacaggtcagggtattgcagcgacatgggtatccttcaccaggggtactcactgagtactggctccgacgccgattctgacacggagggggggatgagccccgaacatgccattcggctgtggggccgggggattaagagccggcggtcttccggactgtccagtcgggaaaattctgcccttacccttacagacagtgacaatgaaaacaaaagtgatgacgaaaatggccggccaatcccccctacctcctcaccgagcttgctcccctccgcccagcttccgagttctcataacccaccccccgtttcatgccagatgcctcttcttgactcgaacacgagccatcagattatggataccaacccggatgaggaattctctcccaattcttacctgctgcgcgcatgtagcggcccgcagcaggcttcttcgagtggcccacctaaccatcatagccagagcactctgcggccccccctaccgcctccacacaaccatacgcttagtcaccatcacagttcagcgaatagcctaaaccggaattccctgacaaatagaaggtcccagatccacgcgccagccccagcacctaatgatctggccaccaccccagaatcagtgcagctgcaggacagctgggtccttaactccaatgtgcctctcgagactcgacatttcttgttcaagaccagctcgggttccacacccctgtttagttcctctagccccggctatcccttaacgagcggcacagtttatactcccccaccaaggcttctcccaaggaacacctttagccgcaaggccttcaaacttaagaagccctcaaaatattgctcttggaaatgcgccgccttgtcggccatagctgccgcactgctgcttgccattttgctggcctattttattgccatgcacctgctggggctgaactggcagctgcagcctgcagacggacatacatttaacaatggcatcaggaccggcctccccggaaacgatgatgtggctacaatgccctctggggggaaggtcccttggtcccttaagaactcaagcatcgacagtggcgaggctgaagtcgggcgacgtgtaacccaggaagtgcccccaggcgtcttttggcgctcacagatacacatctcacagccacagttcctgaagttcaatatctccctgggcaaagatgccctgttcggagtctacatccgtagagggctgcccccaagccatgcccagtatgacttcatggaaagactcgatgggaaggagaaatggtcagttgtggaatcaccacgagaacgaagatccatccagacgcttgtgcagaatgaagctgtcttcgtgcagtacctggacgttggtctatggcatttggccttctacaatgatggcaaagataaagaaatggtaagtttcaacacagtcgtgctggacagcgttcaagactgtccgcgtaattgccatggaaatggagagtgcgtgagcggggtctgtcactgtttccccggattccttggggcagactgcgccaaagccgcttgtccagtcctatgtagcggcaacggacaatattccaaaggcacgtgtcagtgttactccggttggaagggagctgaatgcgatgtccccatgaaccagtgcatcgacccaagctgcggaggccacggctcatgcatcgatggaaactgcgtctgcagcgccgggtataagggggaacattgcgaagaagtggactgcctggatccaacatgttcttcacacggggtttgcgtaaatggcgagtgcttgtgctctccagggtggggaggtctgaattgcgaattagcaagagtgcagtgcccagaccaatgtagcgggcatgggacttacctgcctgatactggtctgtgctcttgtgatccgaactggatgggacccgactgctctgttgaggtgtgcagtgtcgattgtggaacccatggtgtctgcatagggggtgcttgcagatgtgaggaaggctggaccggcgctgcctgtgaccaaagggtctgtcacccgagatgcatcgagcacgggacatgcaaagatgggaagtgtgagtgtcgagaaggctggaatggggaacattgcacaattggacggcagaccgcgggcaccgaaaccgacgggtgccctgacttatgcaatgggaacggtcgatgcacattaggccagaattcatggcaatgcgtatgtcaaacgggatggcggggccccggctgtaatgttgcaatggagacctcatgcgccgataataaggataatgagggggacggcctggtggattgtcttgatcccgactgttgcctgcagtccgcctgccagaatagcttgttgtgtagaggctcacgggacccgctggatattattcagcaggggcaaacagactggcctgctgttaaaagtttctatgacagaattaaacttttagcaggcaaggatagcactcacataattcctggcgagaaccccttcaacagtagcttggtgagtcttatccggggccaagtcgtgaccaccgatggtactccccttgttggcgtcaatgtgagctttgttaaatatcctaaatacggatatacaatcaccagacaggacggtacctttgacctcatcgctaacggaggcgcctccctaaccctgcactttgagagagcccctttcatgagtcaagagaggactgtttggcttccctggaacagcttctatgctatggatactcttgtcatgaaaacagaagaaaattcaatcccatcgtgtgatctctctgggtttgtgagaccagatcccatcatcatttcttcacccctctcaacattttttagcgctgctccaggccagaatcccattgtccctgaaacccaggtgctccacgaagaaatcgaactccctggcagtaacgtgaaattgcggtacttgtcctctagaactgctggctataaaagtctcctgaagatcacaatgacacagagtaccgtaccactgaacctgattagagttcacctcatggtcgctgtcgagggtcatctgtttcagaagagcttccaagcatcgccaaatctggcatacacctttatttgggataaaacagacgcatatggccagagagtatacggtctcagcgacgcggtggtgtccgttggtttcgaatatgaaacctgtccttctctcattctgtgggagaaacggacagccctgttacagggcttcgagcttgaccctagcaacctgggtggatggagtttggacaagcaccacattctgaatgtgaaatcaggaatactgcacaaaggcacgggcgagaatcagtttctcacgcaacagccggccatcatcacatctattatgggcaatgggaggaggagaagcattagttgccctagctgtaacggattagctgaaggcaataaattgctggcgcctgtcgcgttagcagtcgggatcgacgggtccctctatgtcggagatttcaattatattagacgcatcttcccatcacgaaacgtgacaagtattctggaactgaggaacaaagagttcaaacacagcaacaatcccgcacataaatactatttagcagtggatcctgtatccgggtctttgtacgtgtccgataccaactctaggcgtatataccgggtgaagtcactgtctggtaccaaagacctcgccgggaactctgaggtcgtggctggtactggagaacaatgcttaccctttgatgaggctagatgtggtgacggaggcaaggctatcgatgcaacactcatgagcccacggggcatagccgtggataaaaatggtctaatgtattttgtggacgcaactatgatacgaaaggtcgatcagaacgggattatcagtacactactgggctccaacgatttgacagccgtcaggcctttgagttgtgacagctcgatggatgtggctcaggttcggctggagtggcctacagacctggctgtgaatcccatggacaattcgctatatgtgttagagaataacgttattttgcgcattactgagaaccaccaggtctccatcatagctgggaggccaatgcattgccaggtacccggaatagactacagtctgagcaagctcgctatacattctgcactggagagcgcctctgctatcgctatctctcacaccggagtgctctacatcactgaaaccgatgaaaagaagatcaaccgtcttagacaggtgaccaccaatggagagatttgcctactggccggtgcagccagcgattgcgactgcaaaaatgatgtgaattgtaactgttatagtggggacgacgcctatgccactgacgcgattctcaatagcccctcttcgctcgctgtagcgccagacggaaccatttatatagctgacctcggcaacatccgcataagggctgtgagcaagaataagcctgtgctgaatgcctttaatcagtacgaggccgcctcccccggggaacaggaactgtacgtatttaacgcggatggcattcatcagtacaccgtatcgttggtcacaggagaatatctatacaacttcacttatagcaccgataacgatgtgacagagctcattgataataacggcaacagcttgaagattaggcgcgattcctccggcatgccaagacaccttctcatgcccgacaaccagatcattacgctgacagtgggcaccaatggcggcctgaaggtagtctccacgcaaaacctggaacttggcctcatgacttatgacgggaacactggcctactagcgacaaagtcagacgagaccggttggacaactttctatgattacgatcatgagggcaggcttacaaatgtgactagaccaacaggcgttgtgacatccctccacagggagatggagaaaagcattacaatcgacatcgagaactctaatagagacgacgacgtgaccgttattacaaacctgagctccgtggaagccagttacaccgtagtacaggaccaggtcaggaactcttaccagctttgcaacaacggcacactccgcgtaatgtacgctaacggaatggggatcagctttcattctgagccccacgttctggctggtaccattacccccacaatcgggaggtgcaatatcagccttccaatggagaacggcttaaattctatcgagtggagattacggaaagagcagataaagggcaaagttacaatcttcggacggaagctccgcgtacacgggagaaatctgctaagtatcgactatgatcgaaacatccgcacagagaagatctatgacgatcaccgtaaatttacactccgtataatttacgatcaggtcggcagacccttcttgtggcttccatccagtgggctggccgccgtgaatgtgagctattttttcaacgggcgcttggcaggactccaaagaggtgccatgtcggagcggacagatattgataaacagggccgcatagtttcgaggatgttcgctgacgggaaagtttggagctatagctacctcgacaagagcatggtgttgctgctgcagtcacagcgccaatacatcttcgagtacgacagtagcgacagattgctggccgttactatgccaagtgtggcccgccattcaatgtccacccacacaagtatcggatacattaggaacatttataatccgcctgagtccaacgctagtgtgattttcgactacagcgatgacgggcgcattcttaagacatccttcctgggtacaggacgtcaagttttctacaaatacggaaaacttagtaagctaagcgagatcgtgtatgactcgacagcagtcacttttgggtatgatgagaccacgggggtgttgaagatggtcaatctgcaatctggcgggttttcttgcacaatacgttaccgaaagattgggccactggttgataaacagatttatcgcttcagcgaagaggggatggtcaacgcgcggttcgattacacataccacgataatagcttccgcatagcatcgattaaaccagtcataagtgaaaccccactgcccgtggacttatataggtacgatgagattagcggcaaagtggagcacttcggtaaattcggagtgatctattacgatattaaccaaatcataaccacagccgttatgaccctcagcaagcatttcgatacgcacgggcggataaaagaagtacagtacgaaatgtttaggagcctcatgtactggatgactgtgcagtatgattctatgggacgggtgatcaagcgagagttgaagctgggaccctatgccaacaccacaaagtacacctatgactacgacggagatggccagctgcagagcgtcgctgtcaatgaccgcccaacatggcgctattcatatgatctgaatggaaatctccatttgttgaaccccgggaactccgtccggcttatgcctctacgctatgacctcagagatagaattactcgcctgggtgacgtgcagtacaaaattgacgatgacggttatctgtgccaaagagggtccgacatcttcgagtataattcgaaggggctgctgacaagagcatataacaaggcgtcaggctggtcagttcagtacagatacgatggtgtaggtcggcgcgctagttataagacaaatttaggccaccacctgcagtatttctatagcgacctgcataaccctacccgaattactcacgtatacaatcactctaattctgagataacgagtctgtactacgaccttcaaggacacctgtttgccatggaatccagcagtggtgaagagtattatgtggcatcagataacactggaacaccgctcgcagtgttctcaataaacggtcttatgataaagcagctgcagtacaccgcctatggggagatttactacgatagcaatcctgacttccagatggtgattggctttcatggcgggctctatgacccccttacaaagctagttcacttcacccagagggactacgatgtcctggccggccggtggaccagtccagattataccatgtggaaaaacgtcggtaaggagccggccccgtttaatctctatatgtttaaaagcaacaatccactctcgtctgagttagacctgaaaaactacgtgaccgatgtgaagagttggttagtgatgtttggatttcagctcagcaacatcatccctgggtttccgagggcaaagatgtattttgttccaccaccttacgaacttagtgagtcccaggctagcgagaatgggcagctcataactggcgtgcagcagactaccgagaggcataatcaggcttttatggccttagaggggcaggtcatcactaagaaactccacgctagcatcagagaaaaagctggccactggttcgccaccacaaccccaatcatcgggaaggggatcatgttcgctataaaagagggtcgcgtaactaccggcgtgagctcaattgcctcagaggacagccgaaaagtcgcatctgtcctgaataacgcctattatctggataagatgcactattcgatcgaggggaaggacacgcattactttgtcaaaatcggctcagctgatggcgacctcgtgaccctcggcaccaccatcggacggaaggttctggaaagtggcgtcaatgttacggtgtcacaacctaccctgctggttaatggacgcactcggcgtttcaccaatatcgagtttcagtatagcactctgttattgtccattcgatacggactgactcccgacacactggacgaggagaaggcgcgtgttcttgatcaggccagacagcgggcgctgggaacggcctgggcaaaggaacaacagaaggctcgcgatggacgagagggttcacggctctggactgagggggagaagcaacaactcctgagcactggaagagtgcagggctatgagggttactacgtgctgcccgtagagcaatacccagaattggcggactcttcatccaacatacaattcctcagacagaatgagatggggaaacgatag

SEQ ID NO: 28150 - DNA, 8322 bp, Artificial Sequence
  Description of Artificial Sequence: Synthetic coding sequence
atggacgtaaaagatcggagacatcggtccctaacaaggggcaggtgcgggaaggagtgtagatacacatccagcagtctggactccgaagattgtcgagtgccgacccagaagtcctacagctcctctgagaccctaaaagcttacgatcacgatagtcgaatgcattacggaaaccgcgttaccgatctaatccatcgcgagagcgatgaattcccacgacaggggacaaacttcaccttagccgagctaggtatctgtgagccctccccacacagatcaggatactgtagtgatatggggatccttcaccagggttactccctgtccactggatctgatgctgacagcgacactgagggtggaatgtctccagaacatgccattcggctctggggtcgcgggatcaaaagtcggcgcagttctgggttgagctcccgcgagaactctgcacttacccttaccgattctgataacgaaaacaaatcggatgatgagaatggacggccgattccccccacaagttcacctagcctactgccatcagcccaactcccttcctctcacaatcctccacccgtctcctgtcaaatgccactcttggacagtaatacttcccaccagatcatggacaccaaccctgacgaggaattcagtcctaatagctacctgctgagggcttgttcgggaccccagcaagcatcctccagtgggccaccaaaccaccacagtcagtcaaccctgaggccaccactcccccctccccacaaccacacactcagtcatcaccactcatccgccaactctctgaaccgcaattcattgaccaatcggcggagccagatccacgctcccgctccagcaccgaacgaccttgctaccacacccgagtcagtgcagcttcaggacagttgggtactgaactctaacgtgcccctcgaaacaagacactttctttttaaaaccagcagcgggagtactcctttgttttctagttcctcaccaggctatcccctgacaagtgggaccgtatacacccctccccctaggctcttgccacgtaatacctttagccggaaagcttttaagctcaagaagccatcgaagtattgcagctggaaatgtgcagctctcagcgctatcgctgccgcactgttgctcgcaattttgcttgcctacttcatcgcgatgcatttgctgggtttgaactggcagttgcagccagcagatgggcacactttcaacaacggcatccggacagggctgccagggaatgacgacgtggctacgatgccgtcaggcggtaaagtgccatggtctctgaaaaattcatcaatcgattcaggcgaagcagaggtcggtagaagggtcacccaggaggtcccccctggggtgttctggaggtcccaaattcacatttcacaaccccagtttttgaaatttaacatttcactcggaaaggacgccctgttcggcgtctatatccggagaggcttgccgccttcgcacgcccaatacgactttatggaacgactcgacggaaaggagaagtggtctgtggtggagagccctagagagcgaaggtcaatacagacattggtccaaaacgaggccgtctttgtgcagtatctggatgtgggcctttggcatctggctttttacaatgatggaaaagacaaagagatggtgtctttcaacaccgtcgtcttggatagcgtgcaggactgtccgcgcaattgccacgggaacggcgaatgtgtgtctggcgtttgccattgttttcccggcttcctgggggctgattgcgccaaagcggcatgccccgtcctttgtagcgggaatggccaatattctaagggtacctgccagtgttattcaggctggaaaggagccgaatgcgacgtccctatgaaccagtgcattgacccgtcttgtggaggtcatggttcctgtatagatggcaactgtgtgtgcagcgctgggtataaaggtgaacactgcgaggaagtcgactgcttggatcctacctgctctagccacggcgtctgcgtaaatggcgaatgtctttgctcccctggttgggggggtcttaactgtgagctggctcgtgttcagtgccccgaccaatgtagcgggcatgggacttaccttcctgacacaggactctgttcttgcgatccaaactggatgggccccgactgttctgttgaagtgtgttccgttgattgcggcacccatggtgtttgcattggcggcgcctgtcggtgtgaggagggttggacaggtgccgcctgtgatcagagagtctgccatcctagatgtatagaacacggtacttgtaaggatgggaaatgcgaatgtcgggaaggatggaacggggagcattgcactattgtgcgagagacaattggtggggagtgctacgggtgccccgatctctgcaacggcaacgggaggtgtacgcttgggcaaaattcctggcagtgtgtttgccagacaggttggcgcggacccggatgtaacgttgccatggagacttcctgtgccgataacaaggacaacgaaggcgacggtctcgtggactgtctagaccctgattgctgccttcagtcagcttgtcagaactccctcttatgtcgaggatcacgcgacccattggatattatccagcagggacaaaccgattggccggccgtgaaaagcttttacgaccggatcaagctgctagctggcaaggactccacgcatataatcccaggagagaacccattcaactcttcacttgtttccttgatccggggtcaagttgttaccacggatggcacacctctggtcggagtcaacgtctcattcgtcaaataccctaagtacggatacacaattactcgtcaggacggtaccttcgatctgatcgcgaatggcggtgctagcctgacgctgcacttcgagcgggctccctttatgagccaggagcggaccgtatggcttccctggaatagtttctacgctatggatacgctggtgatgaaaactgaggagaatagcataccttcttgcgacctgagtggttttgtacgcccagatccaatcattatttcttcaccactcagcactttctttagcgccgctccgggacaaaatcccattgtgcccgaaactcaggtgttgcatgaagagatcgaacttcctggtagtaatgtcaaactgcgttacttaagcagtagaactgcgggatacaaatccctgttgaagattacgatgacacaatctacagttccactgaatctgataagagttcatctcatggtggccgttgaaggccacctattccaaaagtcatttcaggcaagcccaaatctggcctacaccttcatctgggacaaaaccgacgcatacggacagcgcgtttatgggctgtccgatgccgtcgtgagcgtcggcttcgaatacgaaacatgcccctcattaatcttgtgggagaagagaactgctctgttgcagggtttcgaactggacccctctaatctgggcggctggagcctagataagcatcatatccttaacgtgaaaagcggtattctgcacaaaggcaccggcgagaatcagttcttaacccagcagcccgcgattatcacatccatcatgggcaatgggaggaggagatctatctcatgcccgtcctgcaatggacttgccgagggcaataaactcctggcgccagtagcccttgccgtagggatcgatggaagcttgtatgttggggactttaactacattcgccggattttcccgagcaggaatgtgacctccattctggagcttcgcaacaaagagttccataacaataaccctgcccacaagtactatctcgctgtggatcccgtcagcgggagtctttatgtttcagacaccaatagccgtagaatctatagggtgaaaagcctatcgggaacaaaagatctcgccggcaattccgaagtagtggctgggacaggagagcagtgtttaccattcgacgaggcccggtgcggtgacggcgggaaggccattgatgctactctgatgagcccccgcggaatagcagttgataagaacggtctgatgtattttgtggatgcgaccatgatcaggaaggtggatcagaatggtatcatatcaaccctcctgggcagcaatgacctaacggctgtacgtccactttcctgcgacagctctatggacgtagctcaggtgaggctagagtggcctaccgatctcgctgtcaatcccatggataacagcctgtatgtgttggaaaataacgttatcctgagaatcaccgaaaaccaccaggtttccatcatagccggaagacctatgcattgtcaggttccaggcatcgactacagtctatctaaattggctatccatagtgcactggaatccgccagcgcgattgccatatctcacaccggggtgttgtatatcactgagaccgacgagaaaaagattaaccggctgaggcaggtgaccaccaatggggagatctgtcttctggccggagctgcttctgattgtgactgcaaaaatgatgtgaactgcaactgctatagtggcgatgatgcttatgcgaccgacgccattctgaactccccaagcagcctagctgttgcgccggatgggaccatctacattgctgacttaggaaacatcaggattagggccgtctctaaaaacaaacctgtgctaaatgcctttaaccagtatgaagccgcctcgcccggcgaacaggagctctatgtcttcaatgccgacgggattcaccagtacacggtgagtttggtgacaggggaatatctgtataacttcacttactcaacagacaacgatgtaaccgagctgatcgacaataatggtaatagcttgaagataaggcgagacagcagcggtatgcccagacatctgttgatgccagacaatcagatcatcacattgacagttggtaccaacggcggtctcaaggtagttagtactcagaacctggaacttggactgatgacctacgatggtaataccggtctgctcgctacgaagtccgacgagacgggctggacgacattctatgactacgaccatgaaggccggttaactaatgtgacacggccaaccggcgtggtaacctcactgcaccgagagatggagaaatcgattacaattgacattgagaatagtaatcgggacgatgatgtgacagtgattacaaatctgtcctcagtagaagcgtcatacacggtcgtacaggaccaggtgcggaactcgtaccaactgtgtaacaatgggactctccgggtcatgtacgccaatggaatgggtatctcatttcacagcgaaccccatgttcttgccggcacaatcactcccaccattggccggtgcaatattagtctgcctatggagaatggtctgaactcgatcgaatggagactccgtaaggaacagattaaaggcaaagtgactatcttcggccggaagctgcgggtgcacggcaggaacctcctgtccattgactacgatcgtaacatccggacggagaaaatctacgatgatcacagaaagtttactttgcgaatcatatacgatcaggtggggcgccccttcctgtggttaccctccagcgggttggccgcggtgaacgtgtcttacttcttcaacggtagactcgcagggctgcagaggggggcaatgtctgagaggaccgacattgacaaacaggggcgcatcgtgtctcgtatgtttgccgacggaaaagtgtggtcctacagctatctcgacaaaagcatggtactgcttcttcagtcacaacgccagtacatttttgagtacgattctagtgaccgcttactggccgtcacaatgccttctgtggccaggcactccatgtctacacatacctcaattggatacatccggaacatctacaatccacccgagagcaacgcttccgttatctttgattactccgacgacggacggatcctgaagacttcattcttaggcaccggacgacaggtcttctacaagtacggcaagctcagcaagctttccgagattgtgtacgactctactgctgtaactttcggatacgacgaaaccaccggggtgttaaaaatggttaatctgcagagtggaggtttcagctgtacaatcagatatcgcaagatcggacctctggtggacaaacagatctacaggttctccgaggagggaatggtcaacgccaggttcgattatacctatcacgacaattcatttagaattgcctccattaaaccagtaatttccgaaacgcctctgccagttgacctgtatagatacgacgaaatcagtggaaaggtcgaacacttcggcaagttcggagttatctattacgacatcaaccagattattactaccgccgtgatgacgctatctaagcacttcgatacccacggacgaatcaaggaggtccaatatgagatgtttcgttccctgatgtactggatgacagttcaatacgattctatgggaagggtgatcaaacgcgaactgaagcttggcccttatgcgaacacaaccaaatatacatacgactacgacggggacggccagctgcaaagcgttgcggttaacgaccgccctacatggcggtattcgtatgatctaaatgggaatctgcaccttctaaaccctgggaattctgtgcggctgatgcccttaagatacgacctgagggataggatcacccggctcggcgacgtgcagtataaaatcgatgacgacggctacctgtgtcagcgcggatcagacatttttgaatataactctaaaggccttcttaccagggcatacaataaggcttctggatggtccgtgcaataccggtatgatggggtgggaagacgggctagttacaaaacaaacctgggccaccatttacaatatttctactccgatcttcacaatccaacccggattacacatgtatacaatcatagcaactcagaaatcacttctctttattacgatctgcaggggcatctttttgcaatggagagctcttcgggggaggaatattatgtcgcttcagataacacagggacccctcttgccgtctttagtatcaacggtctgatgataaaacagctccagtatacagcttacggtgagatctactacgactctaaccccgattttcagatggtgatcggctttcatggcggcctgtatgaccccctgaccaaactcgtgcattttacacagagggattacgacgtactcgccggccggtggaccagcccggattatactatgtggaagaacgtgggtaaagagccagcaccattcaatttgtatatgtttaagagcaataaccctctcagctctgaactggatcttaagaattatgtcacagatgttaagagctggctcgtgatgttcgggtttcaactcagtaatatcattccaggtttcccccgcgctaaaatgtattttgttccaccaccgtacgagctctctgaatcacaggccagtgagaacggccagttgatcaccggcgtgcagcagaccactgagcgacacaatcaggcctttatggctctggagggacaggtcatcactaaaaagcttcatgcctctattcgcgaaaaggcagggcactggttcgcaacaacaacacctatcatcggcaaagggattatgtttgctattaaagaaggccgtgttacaaccggcgtgtctagcatcgcctcagaagacagtaggaaggtggcctcagtgctgaataatgcctactacctggacaaaatgcactatagcattgaaggcaaagacacccattacttcgtgaagatcggcagcgcagatggcgacctagtgacccttggtacgacaattggcagaaaggtgctcgagtcgggggtgaacgtaactgtttctcagccaaccctgctggtgaatggacgtactagacgttttacaaatatcgaatttcagtattccactttgttgctatctatcagatacgggctgacccctgatacattggacgaagaaaaggctagagtactggaccaggccagacagagagccttgggaacagcgtgggccaaggagcaacagaaagccagggacggacgcgaaggaagcaggctctggaccgagggcgagaagcaacagttgttgtctacgggcagggtccagggttacgaagggtactatgtgctcccagtggaacagtatccagaactcgctgacagctcatctaatattcagttcttgaggcagaacgagatgggaaagcggtag

SEQ ID NO: 28151 - DNA, 8100 bp, Artificial Sequence
  Description of Artificial Sequence: Synthetic coding sequence
atggacgtgaaagaaagaagaccatattgttccctcaccaagagcagacgagaaaaggaacgcagatacaccaacagctctgccgacaacgaagagtgcagggtgcccacccagaagtcctactcatcctccgaaaccctgaaagccttcgaccacgactcctcaaggctactgtacggaaatagggtcaaggacctggtgcacagagaggctgatgaattcacccgccaggggcagaacttcacactgcgccagttgggtgtttgcgagcctgccacacgccgcggactcgctttctgcgcggagatgggattgccacatcggggctatagtattagcgccggaagtgacgccgataccgagaacgaagccgtgatgagccctgagcatgcgatgaggctgtggggccggggcgtcaagtctggcaggagctcctgcttgtccagtaggtctaattccgctttgacactgacggatactgagcacgaaaataaatcagactcagaaaacgagcagcccgccagtaatcaaggccagagcacacttcagcctctccctccatctcataaacagcacagtgcccagcatcatccgagtataacgagcttaaaccgtaattccttgacaaatagacgtaatcagtcccctgctccgccggcggccctccctgccgagctccaaacaacgcccgagtctgttcagctgcaggactcatgggtgctcggtagcaacgtgcccctagagagccggcacttcctgttcaagactggcaccggcaccacgcctctctttagcactgcaactccgggttacacaatggcttcagggtccgtgtacagcccaccaactagaccgctgccgcgcaacacactgtcccgctccgctttcaaattcaaaaaaagcagtaaatactgctcatggaagtgtaccgccctgtgtgccgtgggcgtctctgtgctgcttgcgatattgctttcgtatttcatcgccatgcacctattcggcctgaactggcagttgcagcagacagagaacgacacatttgagaatgggaaggtgaattcagacactatgcccacaaatacagtgtctcttccttccggcgacaatggcaaactgggcggattcacccaggagaataacacaatcgattctggagagctcgatattggtcgcagggccattcaggagatccctccagggattttctggagaagccagctgttcatcgaccagcctcagtttctgaaatttaatatatccctgcagaaagatgcccttattggggtatacggacggaagggcctgccccccagccatacccaatacgacttcgtcgagttgttggacggatcaaggctgattgcacgcgaacagcgcagcttactggagaccgaacgagccgggcgtcaagctcgctccgttagtttacacgaggccggcttcatccagtatctggactcaggaatttggcatttagctttctataacgatgggaagaacgccgagcaggtaagcttcaacactattgtgatcgaatccgtcgtggagtgtccacggaattgccacggcaacggagagtgcgtctccgggacatgtcactgctttcccggctttctcggtcccgactgttctagggctgcttgcccagtgctgtgctccgggaacggacagtacagcaagggtaggtgtttgtgtttttccgggtggaagggtactgaatgcgatgtgcccacaacccaatgtattgatccgcagtgcggcgggcggggcatctgtatcatgggtagctgcgcttgtaattcgggctataagggagagtcatgcgaggaggcagactgtatcgatccagggtgctccaatcatggcgtgtgcatccacggtgagtgtcactgctctccaggctggggaggctcgaactgtgagattcttaaaacgatgtgccctgaccaatgcagtggacacggtacctatctccaagagtcaggatcttgtacctgcgaccctaactggactgggcccgattgttctaacgagatctgcagcgtagactgcgggtcccatggcgtctgcatgggcggtacttgcagatgtgaagaaggttggacagggccggcctgcaatcagagggcgtgccatcccagatgtgcggagcacggtacgtgcaaggatgggaaatgcgagtgctcccaggggtggaacggcgaacattgtaccatagaggggtgcccgggtttatgtaactccaacggtcggtgcactctagatcagaatggctggcattgtgtctgccaaccaggctggagaggagccggatgtgacgtggcaatggaaacattgtgtacagactctaaagataacgaaggagacggattgattgactgcatggaccctgattgctgtcttcagagttcatgtcagaatcagccctactgccgcgggctgccagaccctcaggatatcatatcacagtccttgcaaagcccgtcacagcaggccgccaagtctttctacgaccggatatccttccttattggctccgattcgacccatgtgattccaggtgagtcaccattcaacaagtcacttgcctcagtgatccgaggtcaggttcttactgctgatggaacgcctctgataggggtgaatgtatcattctttcattatccagaatatgggtacaccataacccggcaagacggtatgtttgaccttgtcgccaacgggggggcaagtctgacattggtgttcgaaagaagccccttcctgactcaatatcacactgtctggatcccatggaatgtgttctacgtgatggacacccttgtaatgaagaaggaggagaatgacattccctcatgcgacttgtcaggattcgttaggcccaaccctattattgtgtcatcacctttatccactttctttcgctcaagccctgaagactctccaatcatccctgaaactcaggtattgcatgaggaaaccacaattccaggaactgatctcaaattgtcctatctgagtagcagagccgccggctataagtctgtgttgaagataaccatgacacagtcaattattccgttcaacctgatgaaggtccatctgatggttgcagtggttggcagactctttcagaagtggtttcctgcctctcctaatctggcgtataccttcatatgggacaagaccgatgcctacaatcagaaggtttacggtctgtcagaggcagttgtgagcgtgggatacgaatacgagtcttgtttagatctgacactctgggaaaagcgcactgccatccttcaaggatatgaattagatgcctccaatatgggtggttggacgttagacaaacaccacgttctcgacgtgcagaacgggatcttgtataaagggaacggggagaaccagttcatctcccagcagccccccgttgtctcctcaatcatgggcaatgggcgaaggagatccatcagttgcccttcctgtaacggccaagccgacgggaataaactgctggctccggtggccctggcttgtggtatcgatggttcgctctatgtgggggattttaattatgtgcgacgaatttttccctcaggcaatgtgacttctgtactcgaactctcttccaaccctgctcacagatactacctggccactgaccccgttacaggcgatctgtatgtgagcgatacaaataccaggaggatctaccggcctaaatctttgaccggggcgaaggatcttaccaagaacgctgaagtagtggcggggaccggagagcagtgcctgccttttgacgaggcacggtgcggcgatgggggtaaggccgtcgaggcaacgctgatgtcccccaagggcatggccgtagataagaacgggcttatctattttgtcgatgggacgatgatacggaaagtggatcagaatggcatcatcagcaccctcctgggttctaatgatctgacgagtgcccgaccactgacctgtgacacatccatgcatatctcgcaggtgcgcctggaatggcccactgatctagccattaaccccatggacaatagcatttacgtcctggacaataacgtcgtcctccaaattaccgaaaatagacaagtccggattgcagccggacgcccaatgcactgccaagtgcccggcgttgagtatcccgtgggcaagcatgccgtacagacaaccctagagtcagcaaccgcgattgcagtatcctattcgggtgtcctctacataaccgagactgacgagaagaagattaacagaatccgacaagtgaccacagatggcgagatttcgctggtagcagggattccatccgagtgtgattgcaaaaatgatgccaattgcgattgttaccagtccggcgacggctacgcgaaggacgcaaagctgtctgcaccaagctccctagcagcctcccccgacggtaccttgtatatagccgatctggggaacatccgcattagagccgtttctaaaaataagcccctcctcaattctatgaacttttacgaggtagcctccccgaccgaccaagagctgtacatcttcgatattaacgggacacatcagtatactgtgtctttagtcactggggactacctctacaactttagctacagcaatgacaacgatatcaccgcggttactgacagcaatgggaataccctgaggatccgacgagacccaaacagaatgcccgtgagggtggtctctcctgataaccaggttatttggcttacgatcggtactaatgggtgtctgaagtctatgactgctcaaggcctcgaactcgtgcttttcacataccatgggaatagcggcctgctggccacaaaatccgatgaaacaggctggacaaccttttttgattatgatagtgaagggaggttgaccaatgtgacttttcctacaggggtcgtgactaatctgcatggcgacatggataaggcaatcaccgtggacatcgaaagcagctcccgggaggaagacgtcagcattaccagtaacttgagttcgatcgattccttttacaccatggtgcaggaccagttgcgaaatagctaccaaatcggatacgacggctctctgcggatcatatatgcatcaggtctggactctcactaccagactgagcctcatgtgctggctggcacagccaaccctaccgtcgctaagcgcaacatgactttgcctggcgaaaacggtcagaatctcgtggaatggcggttccgaaaggaacaagctcagggcaaggtcaacgtcttcggcaggaaattacgggtgaacgggagaaacctgctgtccgttgatttcgatcggaccactaagaccgagaagatttacgacgaccacaggaaatttctgttaagaatagcttacgacacatccggccatcccaccttgtggctcccaagcagcaaactcatggccgtcaatgtaacttatagctctacaggacagattgcctccattcagcggggtactacttcggaaaaagtcgattacgatggtcagggaaggattgtaagcagagtgtttgcagacggcaaaacttggagttacacctaccttgaaaaatccatggtgctgctcctgcattcacagaggcagtacattttcgagtatgacatgtgggatcgcctatcggcgatcactatgccatctgtggctcgtcatacgatgcagactattcgcagcattggttactaccgaaatatctacaatcctcccgaaagcaacgcgtcaataatcactgattacaatgaggaaggccttctcctgcagaccgcctttctggggactagtcggagggtactcttcaaatatcgacgtcaaacccgattaagtgaaatattgtacgattctacccgggtgagctttacctacgatgagacagctggagtgctgaagacagtgaatctccagagcgatggtttcatttgtactatccgctaccggcaaatcggacccctgatcgaccgccaaattttccgattcagcgaggacggcatggtgaatgcccggttcgattacagttacgacaattcattccgagttacatcaatgcagggagtaatcaatgagacccctctcccaatagatctctaccagttcgatgatattagcgggaaggtggagcagttcgggaagttcggtgtgatctattatgacatcaaccagattatctctactgcagtgatgacttatacaaaacatttcgacgctcatgggcggattaaggaaattcagtacgagatattccgaagtctgatgtattggatcacaatccagtacgataacatgggtcgcgtaacaaaaagggagatcaaaatcggccctttcgctaatactacaaagtatgcttatgaatatgacgtggatggccagctgcagactgtgtatctgaacgaaaagattatgtggcgatacaactacgatttgaatggaaatcttcacctcctgaatccctccaattccgcaaggttaacacccctaagatacgatttacgcgaccgaatcacacgtttgggcgacgtgcaatatagactggacgaggacggattccttcgccagagaggaactgagatttttgaatacagtagtaagggtctcctgacaagagtgtatagcaagggaagcggatggactgtgatctatcggtatgacggtttgggacggcgcgtgtcttcgaaaacctctttggggcaacacctgcagtttttttacgcggatttaacatatcccacccgaatcacccacgtatacaatcactcaagtagcgagatcacatccttgtactacgaccttcagggacatttatttgcaatggaaatctcctcaggggacgaattctatatcgcatcagacaacactggcactccactcgctgtttttagctcaaatggtttaatgctgaagcagattcagtatactgcttacggtgagatatatttcgactcaaacattgacttccagctggtcatcggctttcatgggggcctgtacgacccgcttacaaaactaatacattttggggagcgcgattatgatatcctcgcaggccgttggacaaccccagacattgagatatggaaacgtatcggaaaagatccggctccctttaacttgtacatgtttcggaataacaaccctgcttcgaagattcacgacgtgaaagactatatcaccgatgtcaactcatggcttgtcacctttggctttcatcttcacaacgccattccagggtttccagtgcccaagttcgacctgacagagccctcctatgaactagtgaagagccagcaatgggacgacattccgccgatctttggcgtgcagcaacaggtcgccaggcaggccaaagcctttctgtcactcgggaaaatggctgaagttcaggtgtcccgccggagggccgggggcgcgcagtcgtggctctggttcgcaacggttaaatccctgatcggcaaaggtgtcatgctcgctgtcagccaaggtcgcgtgcagacgaatgtcctcaatatcgctaatgaagactgtattaaggtggctgctgtcctgaataatgccttctacctggaaaatctccacttcactatagagggcaaagacacacactactttatcaaaacaactacccccgagtcagatctcggaacattaagactcacctctgggagaaaagcccttgagaatgggattaacgttacggtctctcagagcacaaccgtcgtgaacgggagaacacgcagattcgccgatgttgagatgcagttcggtgcactggccctgcacgtgaggtacggcatgactctggacgaagaaaaagctagaatacttgagcaggctaggcagcgtgcgctggccagagcttgggcacgcgagcagcaaagggtaagagatggtgaggaaggtgcgcgcctgtggacagaaggcgagaaaaggcagctcctttccgccggcaaggtccagggctacgatgggtactacgtgctgagtgttgagcagtatccagaacttgccgattctgccaataatatacagtttctgcgacagagcgaaatcgggcggcgttag

SEQ ID NO: 28152 - DNA, 8100 bp, Artificial Sequence
  Description of Artificial Sequence: Synthetic coding sequence
atggatgtgaaggagcggaggccatactgttctctgacaaagagccgccgggagaaagagcgtagatacaccaacagtagtgccgataacgaggaatgccgcgtgcccactcagaaatcttattccagctctgagacccttaaggcatttgaccacgacagctcaaggctcttgtacggcaatcgtgtgaaagacctagttcatagggaggctgacgaattcacaagacagggtcagaatttcactctgcggcagctgggagtatgcgaaccggccacccggcggggtctggcgttctgcgctgaaatgggcctcccccacagaggttactctatcagtgcaggttcagatgccgatacagaaaacgaggctgttatgtctccggagcatgcaatgagactgtgggggcgtggcgttaaatccggcagatcttcctgcctctcaagcaggtcaaattcagccctgaccctcaccgacaccgagcacgagaacaaatccgattctgagaacgaacaaccggcgtctaaccagggccagtcaactctgcagccattacctccctcccacaaacagcactccgctcagcaccacccgtcgatcacgtccctgaacagaaacagcctcactaatcgtcggaaccaatcaccagctccacccgcggctctgcctgcggaacttcagacaactcctgaatccgttcagctgcaggacagttgggtgttgggctctaacgtgccccttgagtcaagacatttcctttttaaaacagggactggcacaaccccacttttctcaaccgccactcctggctacactatggcctcggggagtgtttattcccccccgacgaggcccctgccacgaaacacacttagtcggagtgcttttaaatttaaaaagagcagtaagtactgttcttggaaatgtacagccttgtgcgctgtgggtgtgtctgtactattggccattctcctgtcctactttatcgctatgcacctttttggattaaactggcagttgcagcagaccgaaaatgacacattcgagaatggcaaagtaaacagtgacacaatgcccactaacacagtctcactgccttctggtgacaacgggaagcttgggggtttcacacaagagaacaacacaatcgactctggcgagttggacatcggacggcgcgctattcaggagatcccacccggaattttctggaggtcccagctgttcatcgaccagccgcagtttctgaagtttaacatcagcttacagaaggacgcacttattggggtgtatggacggaagggactgccaccgtctcatacacagtacgactttgtagagctgctggacggatctcgcctgattgcccgggaacagcgctccctgctagagactgaaagggccggtcgacaggcaagatccgttagccttcacgaggccgggtttattcaataccttgattccggaatctggcatttagcattctacaatgatggcaaaaacgccgagcaggtatctttcaacactattgttattgagagcgtagtcgagtgcccgaggaattgtcacggaaatggggagtgtgtgtccggcacatgccattgtttccctggatttctaggacctgactgttctagagcggcttgccctgtcctgtgtagtggtaacggccaatatagcaaggggcgctgtctttgtttttctggctggaagggcactgagtgcgatgtgccaactactcagtgtatcgacccacagtgtggcggtcgcgggatatgcataatgggctcctgcgcctgcaattctggatataaaggcgagtcttgcgaagaggcagactgcatagatcccgggtgcagcaaccatggggtctgcattcatggtgaatgtcactgttcacctggctggggcggatctaattgtgaaatcctgaaaacgatgtgccccgatcagtgctcagggcatggaacttatttgcaggagagcggatcttgcacctgcgatcctaactggacaggccctgactgcagcaacgagatctgcagcgtagactgtggaagccatggggtctgcatgggcggaacatgtcgctgtgaagaaggttggaccggtcccgcttgcaaccaacgggcttgccacccgcggtgcgctgaacatggaacttgtaaggacggtaagtgtgaatgctcccaaggttggaacggcgagcactgcacaatcgaaggttgtcctggtctctgcaactctaacgggcggtgcactctggatcagaatgggtggcactgtgtctgtcaaccgggctggaggggtgccgggtgtgacgtggctatggagacactttgcacagatagcaaagacaacgaaggagacggactgatcgattgcatggatcctgactgctgtttgcagtcgtcctgccaaaaccagccatattgcagaggcctccctgacccccaggacattatatctcagtcgttgcagtcccccagtcagcaggccgcgaagtctttttacgatcgcattagcttcctcataggaagtgacagtacgcacgtaatacctggcgagagcccatttaataaaagcctggcctcagtgattagaggccaggttctgactgccgacgggaccccgcttattggggtgaacgtcagcttttttcactaccccgaatacggatatacgatcacacgccaagacggaatgttcgacctcgtggccaacggaggagcctcactgacactcgttttcgagaggagccccttcttgacgcaataccataccgtgtggataccttggaatgtattttatgttatggacacactggtaatgaagaaggaagagaacgacatcccttcatgcgatcttagtggctttgtgcgtcccaaccctattatcgtctctagtcctctctctactttcttccgctctagtcccgaagatagccccattatcccggaaacccaagttctacacgaggagacaacaatccccggcactgatctgaaactgagctacctttccagtcgtgctgcagggtacaaatccgtgcttaagatcactatgacgcagtcaataatacctttcaatcttatgaaagtccacctgatggtcgcagtggttgggagactttttcagaagtggtttcctgcctccccaaatctggcttacactttcatatgggacaagactgatgcctataaccagaaagtgtacggactttccgaagctgtcgtctcagtgggctatgaatatgaaagttgccttgacctaaccttatgggagaaaaggacagccatcttacagggatacgagcttgacgcctcaaatatgggcggctggacactggacaaacaccacgttctcgatgtccagaatggtatcctgtataagggcaatggcgagaatcagtttattagtcaacagcctccagtcgtaagttccattatggggaacggcagaaggcgatcgatttcgtgtccgtcatgcaatggccaggccgacggcaataaattgctggccccagtggcgttggcatgtggtatcgacggctccctgtatgtgggcgattttaactatgtcaggcggatcttcccaagtgggaatgtgacaagcgtcctggaactctcaagtaaccccgctcatcggtactaccttgccacggaccctgtcactggggacctgtatgtgagcgataccaacactcgcagaatctatagaccaaaatccttaacaggggctaaggacctcacaaagaacgcggaagttgtcgcgggaactggggagcaatgccttcctttcgacgaggcccgctgtggcgatggagggaaagcagtggaggctaccctgatgagcccgaaaggaatggccgtagacaagaacggactgatttatttcgtcgatggcacaatgatcagaaaagtcgaccagaacggtatcatcagcactctgcttggttcgaacgatctgacctcggctcggcccctgacatgtgacacctctatgcatatatctcaggtgcggctggagtggccgacagatctcgccatcaaccctatggacaactctatttacgtcctggacaacaacgtggttctgcaaattacagaaaatagacaagtcagaatcgccgcaggacggcccatgcactgtcaggttcctggcgtggagtacccagttggtaaacatgccgttcaaaccactctagagtcggctacggccatagccgtatcctacagcggtgttctgtatataaccgaaaccgatgagaaaaaaataaacaggattaggcaggttactactgacggagaaatttccctcgtggccgggatccctagcgagtgtgactgtaagaatgatgcaaattgcgactgttaccagagtggcgatgggtacgccaaggacgcaaagctctcagcaccctcatcattagcagcctcaccggacgggacattatatattgccgacctgggtaacatccgcattagggccgtgtccaaaaataagcccctactgaattcaatgaacttttacgaggtagcttcacctacggaccaggaactatatattttcgatatcaatggaacccaccaatacactgtgtctctagtcacaggcgattatctgtataatttttcttacagcaatgacaacgacatcacagctgtgactgacagcaacggaaacacacttagaattcgacgtgaccccaacaggatgccagtaagggtggtgtccccagataaccaggtgatctggcttaccattggcaccaacgggtgcttgaaaagtatgaccgcccagggactcgaactggtattattcacatatcatggcaatagcggattgctggcaactaagtccgacgagaccggctggacgacttttttcgactacgactccgagggtagactgaccaacgtcacttttcctaccggcgtcgttactaaccttcatggagacatggacaaggcgatcaccgtggatattgagagctcatctagggaggaggacgtgagtatcactagcaatttatcctccatagatagcttttatacgatggttcaggaccagttacgaaactcatatcaaattggctacgatggctcactgcgaattatctacgcctccggactcgacagccactaccaaacagaaccgcacgttctggccgggaccgccaacccaacagtcgctaagagaaacatgaccttgcctggggaaaacggccaaaatctagtagagtggagattcagaaaggaacaggcccaggggaaggtgaatgtcttcggaagaaagctgagagtgaatgggaggaacttgctgagcgtggactttgaccggacaacaaagacagagaagatttacgatgatcacaggaaattcttactgagaattgcttacgatacaagcggacatcctaccctgtggctgccttcgagcaagctcatggccgtcaacgtcacttattcctcaacaggccagatcgcatctattcaacggggtacgacaagcgagaaagtagactatgatggtcagggacggatagtttcaagagttttcgccgacggaaagacctggtcttacacgtatctggagaagtcaatggtactccttcttcacagccagcgacagtacatatttgaatatgacatgtgggaccgcctctccgcgataaccatgccctctgtggctcggcacactatgcagaccataaggtctattggctactatcgcaatatctataacccacctgaatccaatgccagcatcatcacggattataatgaggaaggcctgctcctccagactgccttcttgggcacaagcaggcgtgtgctattcaagtatcgcaggcagacgaggctcagcgaaatcctatacgatagcacccgagtttctttcacttatgacgaaacggcgggggtgctgaaaactgtgaatctgcagagcgacggattcatttgtaccatcaggtaccgccaaatcggccctttgatcgacaggcagatcttccgattctccgaggatggcatggttaacgccaggtttgactacagttacgacaacagtttcagggtgacaagcatgcagggcgtgattaacgagacccccctgcctatcgatctgtatcagtttgacgacatcagcggcaaagtcgagcagtttggaaaatttggcgtcatctactacgacattaatcagatcataagcacagctgtgatgacttacacaaagcactttgacgcccacgggaggattaaggaaatccagtatgagatatttcggtctctgatgtattggatcactatccagtacgataacatgggccgcgtcaccaagcgcgaaatcaagatagggccttttgccaacaccacaaaatacgcctatgagtacgatgtggatgggcaattgcaaaccgtgtatttaaacgagaagataatgtggaggtataattacgacctaaatgggaacctgcacctgttaaacccttcaaattccgcccggctcaccccacttcggtacgatctcagagatcgtatcacccgattgggcgatgtccaataccggctggatgaagatgggtttctcaggcagcgggggactgagatctttgagtattcttctaaggggctgctaacacgggtgtactccaagggttccggctggacagtgatctaccgatatgacggactgggaagacgtgtgtcatcaaagacctccctcggccagcatctccaattcttttatgctgatcttacctacccaacaagaattacccatgtgtacaaccacagctctagtgaaatcacatctctgtactatgaccttcagggtcacttgttcgctatggagatctccagtggcgatgagttctatatcgcctctgataacacaggcacgcctttggccgtctttagttctaatggactgatgctgaagcagattcagtatacggcttacggggagatctactttgactccaacatcgatttccagttagtcattggatttcacgggggactgtacgaccccctgactaaactgattcacttcggagagcgagactatgacattctggccggaaggtggaccactccagatatagaaatatggaagcgaataggcaaggaccctgcacccttcaatctgtatatgttcagaaataacaatcccgcatcgaagatccatgacgtcaaggactatatcaccgacgtaaacagctggctggtaacatttgggttccatttgcataacgccatccctggtttccccgtgcccaagttcgacctgacagaacccagttacgaattggtgaagtcccagcagtgggacgatattccccccatctttggcgtgcagcaacaagtggcccgacaggcgaaagcattcctctcattgggtaaaatggccgaggtgcaggtgtcccgcaggcgggcagggggcgctcaatcctggttgtggttcgccactgtcaagtccttaatcggcaagggtgtgatgttggctgtctcccaagggagggtgcagacgaatgtgctgaacatcgcaaacgaagactgcattaaggtggccgccgtgctgaacaatgctttttacctggaaaacttacacttcacgatagagggcaaggatacacattattttatcaaaactaccaccccagagtcggatctggggactttgcgccttacctctggccgcaaggccttggagaacggcattaacgtcacagtatcccaatctacaacagtcgtgaatggcaggacccggaggtttgcagacgttgagatgcagttcggtgccttggcactgcacgtaaggtacggaatgacgttagatgaggaaaaagccagaatcctggagcaggcgagacagcgggccctggcccgggcctgggctcgcgaacaacaacgagtgagagatggggaggaaggggcccggctatggacagaaggtgaaaagaggcagctgctctcagccggaaaggtacagggctacgacggttattatgtcctctctgttgagcagtatcctgaactggccgattctgcaaacaatatccagttccttcggcagtcagaaattggtagacgctag

SEQ ID NO: 28153 - DNA, 513 bp, Artificial Sequence
  Description of Artificial Sequence: Synthetic coding sequence
atggatgtgaaagaacggagaccatattgctccctcaccaagtccaggcgggaaaaagaacgaagatataccaattccagtgctgacaacgaggaatgtcgagtccccactcaaaaatcgtactccagcagtgaaaccttgaaagcattcgaccacgactcatccagactgctctatggtaacagagtgaaagacctggtccacagggaagcggacgagtttacacgccagggccagaattttacgctcagacaacttggggtctgcgagcccgctacccgacgtgggctggccttttgcgccgaaatgggtcttccccatcgcgggtatagtatctccgctggcagtgatgccgacacggagaatgaggccgtgatgagccccgaacatgcaatgagactgtggggccgcggtgtgaaaagcgggcggagtagttgcctctcatcccggagtaacagcgccttgacactcaccgatacagaacatgagaataagtccgactccgagaattag

SEQ ID NO: 28154 - DNA, 981 bp, Artificial Sequence
  Description of Artificial Sequence: Synthetic coding sequence
atgtgcccattgaccctccaagtaactggcctgatgaatgtgtcagagcctaatagtagcttcgcttttgtcaatgagtttattctgcagggcttcacttgcgagtggactattcagatcttcctgttcagtctctttaccaccacatatgccctgactatcacaggcaatggtgctattgccttcgttttgtggtgcgactggcggctgcacactcctatgtacatgtttctgggcaatttctcttttcttgaaatctggtacgtttctagcactgtccctaaaatgctggtgaacttcctttctgagaaaaaaaacatctctttcgctggatgcttcttacagttctactttttctttagcctgggaaccagtgagtgcctactcctcaccgtgatggctttcgatcaatacctggccatatgtcggcctctgctgtaccccaacattatgaccggccacctgtgcgccaaactggtgattctctgctgggtgtgcggatttctctggtttctcatccccatcgtgcttatttcacaaatgccattttgcggccccaacataatcgatcatgtggtatgtgaccctgggccacggttcgccctcgactgcgtcagcgcccctcgaattcagctgttttgctataccctctccagcctggtgatcttcggcaatttcctctttattattggatcctacacactggtgctaaaagccgtactcggcatgcctagtagtactggcaggcacaaggcttttagcacttgcgggagccacttagctgtcgtcagtctgtgctacagttctttgatggttatgtatgtgtcacctggactaggccatagtaccggaatgcagaaaatcgaaactctgttctatgccatggtcaccccgttgttcaatcctcttatctacagcctccagaacaaagaaatcaaggccgctctcagaaaagtcctgggatcttcaaacattatttag

SEQ ID NO: 28155 - DNA, 960 bp, Artificial Sequence
  Description of Artificial Sequence: Synthetic coding sequence
atggagcccggtaacgatacgcaaatttctgaatttctgttgctcggcttctctcaggagcccggactccagccatttcttttcggattgtttctcagcatgtatttggttaccgttttaggcaacctcctgattattctggctactatttccgacagccacctgcacacaccaatgtatttctttctttcaaacttgtccttcgctgacatctgcgttacatctaccacaattccaaaaatgctgatgaatatacaaacacaaaacaaggtgatcacatacatcgcatgtctgatgcagatgtatttttttatactttttgctggctttgagaactttctgttatctgtgatggcttacgaccgcttcgtcgctatttgccatccactgcattacatggttatcatgaatccccatctctgcggcctgttggtgctcgctagttggaccatgagcgcactgtatagcttactccaaatattgatggtggtgcgcctatctttttgtaccgctttagagatccctcactttttttgtgagctcaaccaagtgatccagctcgcttgctcagacagttttctaaatcacatggtcatctattttacggtcgcactgttaggcggaggacctctcactggaatactttacagttactcaaaaatcatttcctccattcacgcaatcagtagtgcccaaggaaagtacaaagcctttagcacatgtgcttcccatctgagcgtcgtgtctctgttctatggggctatcctcggcgtctatctgtcaagcgccgctactagaaactcccactcaagcgcgacagctagtgttatgtatactgtggtcacacctatgctcaacccctttatttacagccttcgcaataaagatatcaaacgggctctcgggatccaccttttgtgggggacaatgaaggggcagttctttaagaaatgcccctag

SEQ ID NO: 28156 - DNA, 930 bp, Artificial Sequence
  Description of Artificial Sequence: Synthetic coding sequence
atgcgcgagaacaaccagtcctctacgcttgagttcatacttctgggggttactggccagcaggagcaagaagatttcttctacatcctatttctcttcatttaccccattactctcattggtaatctcctgattgttctcgctatctgcagcgatgtcaggctgcataacccaatgtattttctcctcgccaacctgtctcttgtcgacattttcttcagcagtgtgacaatacctaagatgcttgctaatcatctgctgggcagcaagtctatttccttcggagggtgccttacacagatgtactttatgatcgcactgggcaacaccgattcgtacatacttgctgcgatggcctacgaccgcgctgtcgctatatcgcgaccattacactataccaccataatgagtcctagatcgtgtatatggctgatagctggctcctgggtgataggcaacgcgaatgcccttccccacaccctcctcaccgccagcttgagtttctgcggcaatcaggaggtagccaatttttattgtgatatcacgccgctgctgaagctgtcatgcagcgatatccacttccacgtcaagatgatgtatctgggagtgggaatttttagcgttcccctgctgtgtataattgtttcatatattagagtctttagtacagtgttccaagtccccagcacgaaaggagtgctgaaagcttttagcacctgcggttcccatcttacagtggtaagtttgtactacggcacagtcatgggcacttatttccgacccttgactaattatagcctgaaagatgccgttatcaccgtcatgtacactgccgtcacaccaatgctcaacccattcatttattccctacgcaacagggacatgaaggccgcccttagaaagctgttcaataaacggatatcatcttag

SEQ ID NO: 28157 - DNA, 930 bp, Artificial Sequence
  Description of Artificial Sequence: Synthetic coding sequence
atgaagaaggaaaaccagtctttcaacctggacttcatcctgcttggcgtaacgtcacagcaggagcagaataatgtgtttttcgtgatcttcttatgtatctacccaatcactctgaccgggaatctcttaatcatactggcaatctgtgccgatatccgacttcataacccaatgtactttcttctggctaacctctctcttgtagatattattttttccagtgtcacaatccctaaggtgcttgctaatcacctgctcggttcaaaattcatctcattcgggggttgcttaatgcaaatgtactttatgatcgctctggcaaaggcggattcatacacactggcagctatggcttacgaccgagccgtggccatctcctgcccactccactacactaccataatgtcaccacgttcatgtatcctccttattgccggtagttgggtcattggaaatacgagcgcactccctcacaccctgctaaccgcatctcttagtttctgcggaaatcaggaggtggctaatttctactgtgacatcatgcctcttctgaaattatcctgttccgatgtgcattttaacgtcaagatgatgtacctgggtgttggcgtgtttagcctccctctcctctgcattatcgtctcttacgtgcaagtgttttctacagttttccaggtcccaagtacgaaatcgctctttaaggctttttgcacatgcggatcccatctgacggttgtttttctatattatggaacaaccatgggaatgtactttcgccctctcacatcctactcacccaaggatgcagtcattaccgtcatgtacgtcgccgtcacgccagcattaaatccctttatctatagtctccgcaattgggatatgaaggcagcccttcagaaactcttttctaagagaatttcaagctag

SEQ ID NO: 28158 - DNA, 957 bp, Artificial Sequence
  Description of Artificial Sequence: Synthetic coding sequence
atgatgagcttcgctcccaacgcaagtcactcacccgtttttctgctcctcgggttttccagagctaacatctcctacacgctgctcttcttcctgttcctggccatctatttaacaacaatcctgggaaacgtgaccttagtactgttgataagctgggattctcgtttacattcaccaatgtactacctgctgagagggttgtcagtcatcgacatgggcttaagtacagtgaccctgcctcaactgcttgcccacctcgtgagccattatccaacaatccctgctgcaaggtgtctggcacagttcttctttttctacgctttcggcgttacagacacgctcgtcatcgccgtgatggcgctagataggtatgttgcaatctgtgacccattacattacgcactggtaatgaaccaccagagatgtgcatgccttctggcactgagctgggtggtgtcaattctgcatacaatgttaagggtggggctagtcttgccactgtgttggacgggagacgccggcggaaatgttaacctgccacacttcttttgcgaccaccgaccactgctgcgggcctcgtgctcggacatccactccaatgaactcgctattttcttcgaagggggctttctgatgctgggcccctgcgcacttattgtcctcagctacgtgcgtattggggcagcgatcctgagactcccttccgccgccggcagacgacgggccgtgtcaacttgcggcagccatctgacaatggtgggattcttatatggcaccattatctgcgtctattttcagcctccctttcaaaattctcaataccaggacatggtggcctctgttatgtacacagcaattaccccattagctaatccatttgtgtattcactgcacaacaaggatgtgaaaggcgctttgtgcaggttattggagtgggtgaaggtcgatccttag

SEQ ID NO: 28159 - DNA, 945 bp, Artificial Sequence
  Description of Artificial Sequence: Synthetic coding sequence
atggagaaacgtaacctgacagtggttcgcgagttcgtgctgctcggattgccctctagcgcggaacagcagcaccttctgtccgtactcttcctctgcatgtatctcgccacgaccttgggcaacatgctgataattgctactattggcttcgattctcatctacactctccaatgtacttttttctgtctaacctggcatttgttgacatctgcttcacaagtacaacagtccctcagatggtggtgaatattttaacaggaaccaagactatctcattcgcggggtgtctgacccagctctttttcttcgtctcttttgtgaacatggattcactgctgctgtgtgtgatggcctatgacaggtatgtggctatctgtcacccgctccactatacagcccggatgaacctgtgtctgtgtgtgcagctggtggctggtttatggttagtgacctatcttcacgcactcctgcacacagtgctcattgcacaactttccttctgcgctagcaatatcatccatcacttcttttgtgacctgaatcccctcttgcaactaagttgtagcgacgtctccttcaatgtgatgatcatattcgctgtgggaggcctcctcgcgttaaccccgctggtttgtatacttgtaagctatggcctaatatttagcactgtccttaagatcacatcaacccaggggaagcagcgtgcagtatccacgtgctcgtgccacctgtccgtcgttgttttattctacggcaccgcgatcgccgtctacttctctccgagttccccccatatgcccgagtctgacaccctttcaaccatcatgtactcgatggtggcgcccatgctgaacccatttatatacaccctcaggaatcgagacatgaaacgtggtctgcaaaagatgctcctcaagtgtacggtgtttcagcagcagtag

SEQ ID NO: 28160 - DNA, 945 bp, Artificial Sequence
  Description of Artificial Sequence: Synthetic coding sequence
atgatgggccaaaaccagacctctatcagcgacttccttctcttgggactcccaatccagccagagcaacagaacctgtgctacgctctcttcctcgcaatgtacctcacgacccttctcggaaatctcctcatcattgtcctcattcgccttgactcccacctgcatacacccatgtacctcttcttgagtaatttgagtttctccgatctttgcttcagttccgtaacaatccctaagttgctccagaatatgcaaaatcaggacccgtcgatcccttacgcagactgtctgacccagatgtacttttttttgctgttcggggacctggagagcttccttctcgtcgcgatggcttatgatcgctacgtggccatttgtttccctctgcattacacagccatcatgtcccccatgctctgcctggcactggtcgccctttcttgggtgttgactacttttcacgctatgttacatacactgttgatggccaggctgtgcttctgcgctgataatgtgatcccccacttcttctgtgatatgagcgccctgctcaaactcgctttctctgacaccagggtgaacgaatgggtgattttcataatgggcggactaattttggtgatcccgtttctcctgatactggggtcatatgccaggatcgtcagctctatcctcaaggttccatcctccaaaggaatctgcaaggcctttagtacgtgtggctcacatctgtctgtggtttctctgttctatggaacggttatagggctgtacctctgcagttccgcgaatagctccactctgaaggataccgtgatggctatgatgtacaccgtcgtaactcccatgctgaatccattcatctacagcctaaggaaccgggacatgaaaggtgctttgagccgcgtaattcatcaaaagaagacattcttcagcctgtag

SEQ ID NO: 28161 - DNA, 972 bp, Artificial Sequence
  Description of Artificial Sequence: Synthetic coding sequence
atgatggggcaaaaccagacctccatctcagattttctcctgctgggtttgcctattcaaccagaacagcaaaacctgtgctatgccctctttctagcgatgtatcttacgactctgttgggtaacctacttattatcgttctgatccgcctggattcgcacctgcacactccagtgtacctgtttctatccaatttgtctttttccgatctgtgtttttcgagtgtgaccatgcccaagctcctccagaatatgcaaaatcaagatccttcgatcccatatgccgactgcctgactcagatgtactttttcttgtacttttcagatctggagtcgtttcttctcgtggcgatggcttatgacaggtacgtggccatctgttttcctatgcactatacagcaatctgcttcctgctccactacacggccattatgtctccaatgctctgtctgtctgttgtcgccctttcctgggtacttactactttccacgcaatgctccacacgttactgatggcaagactctgcttttgcgctgataatgtcataccccactttttttgcgacatgtcagctttgctaaaactcgcctgttccgatacccgtgtcaatgaatgggttatctttattatggggggcctaatcctggtgatccccttcttgctgatcctcggctcttatgctaggatcgtcagcagcatcttaaaggtgccaagttcgaagggaatatgcaaggctttcagcacttgcggaagccacctgtctgtagtctccctgttttacggtactgtcataggcttatacctgtgccctagcgcaaactccagcacccttaaagacaccgtcatggccatgatgtatacagtagttaccccaatgctgacgccattcatatattcgctccgaaaccgggatatgaaaggcgcgttggaaagggtgatctgcaagagaaagaacccatttctcttgtag

SEQ ID NO: 28162 - DNA, 942 bp, Artificial Sequence
  Description of Artificial Sequence: Synthetic coding sequence
atggaaggcaagaaccttactagtataagcgagtgttttctacttggattcagcgaacaactcgaagaacagaaaccacttttcggcagcttcctctttatgtacctggtgaccgtagcaggcaatcttctgataattctagttatcatcaccgatacccagctgcacacccccatgtactttttccttgccaacctgtctctggcagacgcctgctttgtctcgaccacagtgccaaaaatgttggcgaacatccagatccaatctcaagcaatttcctattctggttgcctactgcagctgtacttttttatgctgtttgtcatgctggaagccttcctattggcagtcatggcctatgactgctatgttgcaatttgtcaccctctacactatatactgataatgagtcctggcttgtgtatttttttggtgagcgcctcctggataatgaacgcattgcactctctgctacataccctcctgatgaacagtctctctttttgcgccaaccacgagatcccacatttcttttgcgatataaatcctctgctgtctttatcttgtacggatccttttacaaacgagctcgtaatctttataaccggcggcctgacaggtctcatctgtgtgttatgcttaatcataagctacacaaacgtgttctccaccattctaaaaatcccttccgcacagggaaagcgtaaggcctttagcacatgttcctctcacctgagtgtcgtatccctcttcttcggtacatcattctgcgtagactttagttccccaagtacccactctgctcagaaggacaccgttgcctctgtgatgtatactgtggtcacacccatgctgaacccattcatctattcactgaggaaccaggaaataaagagcagtctgcgaaaactgatctgggttagaaagattcatagtccctag

SEQ ID NO: 28163 - DNA, 1611 bp, Artificial Sequence
  Description of Artificial Sequence: Synthetic coding sequence
atggccgagcacgccccccgcaggtgttgcttgggttgggacttctcgacccagcaggtcaaggtggtggctgtggatgcagaactgaacgttttttatgaggagagcgtccacttcgatcgggatctacccgaattcggaacccagggaggcgtgcacgtgcataaagatgggttaacagtcacctctcccgtcttgatgtgggtgcaggcgttggatattatactggaaaagatgaaagccagcggcttcgatttcagccaggtgctcgccctctctggcgccgggcagcaacatgggtccatttattggaaggctggcgcccagcaagctctgacaagcctgtcgcccgatctcaggttgcaccagcaactgcaggactgctttagtatatcggactgcccagtatggatggattcatcaaccaccgcgcaatgcaggcagctcgaagctgcggtgggaggggcgcaggctctcagttgtctcacaggttcgagggcatatgagagattcactgggaatcaaatagcaaaaatatatcaacagaacccagaagcttactctcacactgaaaggatctcacttgtatctagctttgctgcttctctgttcctcggttcctacagtccaatagactattctgacggctcaggaatgaatctactgcagatccaagacaaggtgtggtcacaggcatgtctaggcgcttgtgctcctcatctggaagaaaagctcagccctcccgtcccatcttgttcggtggtgggcgctatcagctcgtactatgtgcagcgttacggattccctcccggctgtaaggtcgtagcgtttactggagataatccagcttcactcgcaggcatgcgtctggaggaaggggacatcgctgtatccttggggacaagcgatactctgtttctgtggctgcaggaaccaatgcccgcgctggagggccacatcttttgcaaccctgttgattcgcagcactacatggcgctactctgctttaagaacgggagcttgatgagagaaaagatccgaaatgagtccgtttccagaagttggtcagatttcagtaaagctctgcagtctactgagatgggtaatggaggtaatttaggcttttatttcgacgttatggagataaccccagagataattggcaggcatcggttcaatactgaaaaccacaaggtagcggccttccccggggacgtggaagtccgggccctcatagaagggcaatttatggcaaaaagaatccacgctgaaggcctaggttatagggttatgtccaagaccaagatactagccacaggtggggctagtcacaaccgggagatcttacaagttctcgccgacgtgtttgacgccccggtctacgtcatagacacagcgaactccgcttgcgtgggctcagcctaccgtgctttccatggtctggctggcgggacagatgttcctttctccgaggtggtcaagctggcccccaacccaagattggccgctacccccagcccaggcgctagccaggtctatgaagcgctcctgccccaatatgctaagctagaacagcgcatcctgtcccagaccaggggtccccccgaatag

SEQ ID NO: 28164 - DNA, 969 bp, Artificial Sequence
  Description of Artificial Sequence: Synthetic coding sequence
atgtcccccgagaaccaatctagcgtaagtgagttccttctcttggggctgcccatccggcccgaacagcaggccgtgttctttgctcttttcctcggaatgtacctaacaacagtgttaggtaacctgctgattatgctgctcatccaactggactctcacctgcatacacctatgtatttcttcctgtcccatctcgccctcacagacattagtttctcatccgtgaccgtcccaaagatgctgatgaatatgcaaacacaacacctcgccgtgttttataaggggtgcattagccagacatacttcttcatattctttgctgacctggactcatttctgattacctctatggcgtacgaccgctacgtcgccatttgccatccgttgcattatgctacaattatgacccaatctcaatgcgtcatgctggtggctggcagctgggtgatagcttgtgcttgtgcactgctgcacaccctgctcttggcacagctgagcttctgtgccgaccatatcattcctcactatttctgtgatctcggcgccctgctgaaattaagctgttctgatactagtcttaaccagctcgcaatctttaccgctgcgctgaccgctattatgctcccattcctgtgtatccttgtgagctatggacatatcggcgtcacgattttgcagatcccgtccaccaagggtatctgcaaggcactgtctacctgcggcagccatttgagcgtggtgaccatttattatcggaccattattggcctctacttcctcccccccagcagcaataccaatgataaaaacatcatcgctagtgtcatctataccgcggtcacgccaatgctcaatccattcatttacagtctgcgaaacaaggacataaaaggagccctgcggaaactcctgtctcgaagtggtgcagtggcgcacgcgtgcaacctcaacacactgggggggtag

SEQ ID NO: 28165 - DNA, 942 bp, Artificial Sequence
  Description of Artificial Sequence: Synthetic coding sequence
atgtctcccgagaaccagtcgtctgtgagcgaatttctgttgttgggtttgccaatacgcccagaacagcaagcggttttttttaccctctttctgggcatgtacctgacaaccgtgctggggaacctcctgatcatgttattaattcagttagactcccatctccatacccctatgtatttcttccttagccacttagcactaaccgatatatcttttagctctgtcaccgttccaaagatgctcatggatatgcgaacaaagtataagagcatcctctacgaagagtgcatctcacaaatgtatttttttatattttttacggatctcgactccttcctcattacttcaatggcttacgatcgttatgttgccatctgccatccacttcactacacggtgattatgcgggaggagttatgtgtcttcctggtggcagtgagttggattttgagctgtgcttcctcactgtctcacaccctcctgctgacaagactgagcttctgtgctgccaacaccatccctcatgtattctgtgacctggcagccctgctcaagctgtcatgttctgacatattcctgaacgagctggtgatgtttactgtgggggttgtggtcattacactcccctttatgtgcattctggtgtcctatggatatatcggtgcgacgatattgagggttccttcaactaagggcatccataaagcactctcgacttgtggaagccatctttcagtcgtctctctttattacgggtcaatattcgggcagtatctttttccaaccgtttctagcagtattgacaaggatgttatcgtggcgcttatgtacactgtcgtgactccgatgctgaatcccttcatttactccctccgtaaccgcgatatgaaggaagcgctgggaaagctattctcgcgtgctaccttcttctcctggtag

SEQ ID NO: 28166 - DNA, 942 bp, Artificial Sequence
  Description of Artificial Sequence: Synthetic coding sequence
atgtcccctgagaaccagtcaagcgtgtctgagtttctgttgctagggctaccaattaggcccgaacagcaggctgtgttcttcacactgttcttgggcatgtacctaaccaccgtgttgggcaatctgctgatcatgttgctgattcagctggattcccatcttcacactccaatgtattttttccttagccacctggctctgactgatatcagttttagctccgtaacagtgcctaaaatgctgatggacatgagaaccaagtataagtctattttgtacgaggagtgcatttctcagatgtactttttcattttttttaccgatcttgacagttttctgatcacttcaatggcgtatgacagatatgttgccatatgccacccccttcattacactgtaatcatgagagaagaactgtgcgtctttcttgtggctgtctcatggatcctgtcctgcgcctctagcctctctcacaccctcctgcttacaagactgatgaagagggaaaatcagtcaagtgtaagtgagttcctcctactggacctgcccatttggcctgagcagcaggctgtatttttcactctgttccttggcatgtatctgatcactgttctgggcaacctgcttattattttactcattagattggactcacacctccacacccccatgttcttcttcctatcccatctggcgctcaccgatatcagcctgtcatcagtcactgtacccaaaatgctgctctcaatgcagactcaggaccagagcattttatacgcgggatgcgtaacccagatgtattttttcatcttctttacggacctcgacaatttcctgctgacttctatggcctacgatcggtacgtggctatctgccatccgctcaggtacacaacgatcatgaaagagggtctgtgcaacctcctagtgacggtttag

SEQ ID NO: 28167 - DNA, 942 bp, Artificial Sequence
  Description of Artificial Sequence: Synthetic coding sequence
atgaaaagagagaatcaatccagcgtctcagaattcttgctcctagatctgcccatatggccggagcagcaagccgtttttttcacgctgttccttgggatgtacctgatcaccgttcttggaaatctgttaattatcctgctgatcaggctagattcccatctccacactccaatgttcttcttcctcagccatctagctctgacggatatttccctttccagcgttacagtgccaaaaatgctgctctctatgcagacacaggaccagagtattctgtacgctggatgcgtcactcagatgtacttcttcattttcttcaccgacctggacaattttctgctaacaagtatggcgtatgataggtatgtagccatctgccaccctctgcggtatactaccatcatgaaggagggactttgcaacctgctggttacagtgagctggatccttagctgtacaaacgctctgtctcacactctcctccttgctcaactgtctttctgcgccgacaacactataccgcacttcttctgcgacctggtcgccctgttgaagctatcctgtagcgatatcagcttgaacgagctagtgattttcaccgtcggccaggctgtcattaccctgcctcttatttgtattttaataagctacggccacataggggtgactatccttaaggccccctccaccaagggtatcttcaaagccctgagtacttgcgggtcgcatctgtcagtagtgagtctatattatggtacgatcatcggactgtacttcctgcctagctcatccgcgtcctcagataaggatgtgatagccagtgtgatgtacacagtgattactcccctactgaaccccttcatctatagtctgagaaaccgagacattaagggcgctctggaacggcttttcaaccgggccacagttttgagccagtag

SEQ ID NO: 28168 - DNA, 951 bp, Artificial Sequence
  Description of Artificial Sequence: Synthetic coding sequence
atggaggctgcaaacgagtcatcagaaggaatctctttcgtcctcctgggccttaccaccagtccagggcagcagcgccccctgtttgtcttgttccttctgctatatgtggcatcactactgggaaatgggcttatagttgcggccattcaggctagccccgcactccacgccccaatgtatttcctcctcgcccacctgtcttttgcagatctctgcttcgccagcgtcaccgtaccaaaaatgctggctaacctgctggcgcacgaccactccatatccttagcaggatgcctgacacaaatgtactttttcttcgctctgggggtcaccgacagctgcctgctggccgctatggcatacgattgctatgtagctatccggcaccccctcccctacgcaaccagaatgagtagggctatgtgtgcagccctggttggtatggcttggttggtgtcccatgtgcactctttgctgtacatccttctgatggctagactgagtttttgcgcaagtcatcaggtgccccattttttctgcgatcaccagcctctgctgcgactttcttgttctgacacacatcatatacaactgttgatttttaccgagggtgccgccgttgtcgtcacacctttcctgttaattctggcaagttatggggccatcgccgcagcagtgttgcagctcccgtcagcctccgggcggctaagggccgtgtctacatgcgggagccatctggcagttgtgtccctgttttatggtaccgtcatcgctgtgtactttcaggctaccagcaggcgcgaggcagaatggggaagagtggccaccgtgatgtataccgtcgtgacacccatgctgaatcccattatatacagtctctggaatagagatgtccagggtgcacttagagctttgctcatagggcgccggatctccgccagcgatagctag

SEQ ID NO: 28169 - DNA, 933 bp, Artificial Sequence
  Description of Artificial Sequence: Synthetic coding sequence
atgggcaggaataatctgacccgaccctctgagtttatactcctcggcctgagctcaaggcccgaggaccagaagccccttttcgcagtgttcctgccaatatatctaattactgtgatcgggaatctcctgatcattttggccataagatcggacacacggctccaaactcctatgtactttttcttgagtatcctcagcttcgtcgatatctgctacgtgactgtgattatcccaaaaatgctggtaaatttcttgtccgaaacaaagaccatcagttactccgagtgcctgacccagatgtactttttcctggcctttggtaacaccgacagttatctgctggccgctatggccatcgatcgatatgtggccatatgtaatcctttccactatattactatcatgtctcacagatgctgcgtgctgttgttagttctcagcttttgcatcccacactttcactctttgcttcatattctcctgaccaatcagctgattttttgcgcctcaaacgtgattcatcactttttctgtgatgatcaaccagtcctgaagctttcctgttcatcgcactttgtgaaggagattacggtgatgactgaaggattagctgtgatcatgaccccattcagctgtatcatcatatcctatctcagaatcttgatcaccgtgctgaagatcccttctgccgccggcaagcgtaaggctttctccacctgcgggtcacacctgactgtcgtgaccctcttttacggaagtatttcctacctgtactttcagcctctctctaattacacagttaaggaccaaatcgccacaatcatttacaccgtcctcactcctatgttgaatccattcatatatagcctccgaaacaaagacatgaagcagggtctggctaaactgatgcatcgcatgaaatgtcagtag

SEQ ID NO: 28170 - DNA, 1083 bp, Artificial Sequence
  Description of Artificial Sequence: Synthetic coding sequence
atggagcgcaaccataacccagacaattgtaatgttcttaatttcttttttgcggacaaaaaaaacaagaggcgtaattttggtcagatcgtttcagatgtaggcagaatttgctacagcgtgagtctttcactgggggaaccaacaaccatggggcgtaacaatctgacacggccctctgagttcattttgctgggactgtctagcagaccagaggaccagaagcctctctttgcggtgtttttgccaatttatctgataactgtgattggaaatctgctgattattctggccatcagaagcgacaccaggctgcagaccccaatgtatttcttcttgtcaatcctttctttcgtggatatctgctacgttacagtgattatccccaagatgctggtgaattttctaagtgagacgaagacgatcagctattctgaatgcctgacccagatgtatttcttcttggcctttggcaatacagattcatacctgctcgccgcgatggctatcgataggtacgtggccatttgtaaccctttccactacattaccattatgtcccaccggtgttgcgtcctactgctggttctgagtttctgcatcccccattttcactcccttctccatattctgttgaccaaccaactaatcttctgtgctagtaatgtgatccatcacttcttctgcgatgaccagcccgtactgaagctttcctgttcctcgcacttcgtaaaagagatcacagtgatgaccgagggactggcggtcataatgactccctttagttgtattattatatcctacctgagaattctgatcacagtgctcaaaataccaagtgccgcggggaagcgcaaagcctttagcacctgcggatcccacctgacggtggtgaccctgttttacggctcaatctcctacttgtattttcaaccgctgagtaactacaccgtaaaagatcagatcgctaccatcatctacactgttctcacccctatgctgaacccattcatatacagccttaggaataaggacatgaagcagggactggccaaactgatgcaccgaatgaagtgccagtag

SEQ ID NO: 28171 - DNA, 975 bp, Artificial Sequence
  Description of Artificial Sequence: Synthetic coding sequence
atgggtatgagtaacctaacgcgcctgtccgagttcatccttttggggctgtcgagccgaagcgaagaccaacgtcctttgtttgcactctttctgattatatacctcgtgaccctgatgggaaatctcctaatcattcttgcaatccacagcgaccctagattgcagaaccccatgtacttcttccttagcatactctcttttgcagatatttgctatacgactgtgatcgtgcccaagatgctggtgaacttcctgagtgaaaagaagactatttcctacgccgagtgcctggcccaaatgtatttttttcttgtcttcggtaacattgattcctacttgctggcagcaatggctatcaatcgctgcgttgccatttgtaacccgttccactacgtcacagttatgaacagacgttgctgcgtgctcctactggcatttcccattaccttctcatatttccattcattactacacgtcttactggtgaatcgcctgaccttctgcaccagtaatgtaatccaccactttttctgtgacgtcaatccggttcttaaactctcctgtagctctacattcgtgaacgaaatcgtggctatgacagaaggcctggcctcggtgatggccccattcgtatgcataattatttcttatctccggatcctgatcgccgttctcaagatacctagtgccgcaggaaagcacaaggccttctcaacttgctctagccatctcacagtcgtgattctgttctacgggagcatctcttacgtctacctccagccacttagttcatacactgttaaggatcgaatcgcaacaataaactatactgtccttacttctgtacttaaccccttcatttactccctacgcaacaaagatatgaaaaggggtttacaaaaactcattaacaagattaagtcccaaatgtcccgcttttcaaccaagaccaataagatatgtggtccatag

SEQ ID NO: 28172 - DNA, 936 bp, Artificial Sequence
  Description of Artificial Sequence: Synthetic coding sequence
atggaaacaaaaaattattccagtagtacttcagggttcatcttgctgggcctgagttccaacccgaagttgcagaagcctctcttcgccattttcctgattatgtacttgctgaccgcagttggaaatgttctcattatccttgctatctatagcgatccacgactccatacacctatgtatttctttctttctaatctttctttcatggacatctgtttcactactgttattgtgcccaagatgctagtgaattttctgagtgagaccaaaattatcagctatgttggatgtttaatccaaatgtacttttttatggcgttcggtaataccgactcttaccttctggctagtatggccattgaccggctggtcgctatctgtaacccactccattacgacgttgtcatgaagccttggcactgtctgttgatgttgttgggttcttgctctatttcacaccttcactcactctttagagtcctccttatgagtaggctttctttctgcgccagtcacataatcaagcattttttttgcgacacacagccggtgctcaagctcagctgcagtgatacaagttccagccagatggttgtgatgacagaaaccctggctgttattgtgacaccgttcctgtgtactattttcagttacctccagatcatcgtgacagtgctgcgcatccctagcgcggcaggtaagtggaaagcgtttagtacatgcggcagccatctgaccgtcgtggtacttttctacgggagcgttatctatgtttatttcaggcctctcagtatgtacagtgttatgaaaggtcgggttgcaactgtgatgtacaccgttgtaacaccaatgctcaatccttttatctacagtctgagaaacaaagatatgaaaaggggactaaagaaacttcgacatcgcatttactcttag

SEQ ID NO: 28173 - DNA, 936 bp, Artificial Sequence
  Description of Artificial Sequence: Synthetic coding sequence
atggagatcaaaaactatagtagctctacttctggctttattctgttaggcctgtcatctaaccctcagctgcagaagcccctatttgctatattcctgattatgtatctcctggccgcagtggggaacgtgttaattattccagcaatctactcagatccccgcctccacaccccaatgtactttttcctgtcaaatttatctttcatggacatctgttttactaccgtgatagttccaaagatgctggttaattttttatcagaaacaaaagtgatctcatatgtggggtgtctagcacagatgtacttttttatggccttcgggaacacagactcatacctgcttgcttcaatggctattgaccggctggtggccatctgcaaccctctccattatgacgtggtgatgaagcctaggcattgcctccttatgctgttgggtagctgctccatcagccatctgcacagtctttttagggtgcttttgatgtctcggttgagcttttgcgcatcccacatcataaagcatttcttttgtgatacccaaccggtcctcaagctttcttgtagcgataccagctcttctcagatggtcgttatgacggaaacccttgctgttattgtgacccccttcctgtgcatcatatttagctacctgcgcattatggttacagtgctgcggatcccgagtgctgccggaaagtggaaggcgttctctacctgcggatctcacctgacagccgtggctctgttctatggaagcattatatatgtgtacttccggcccttgtctatgtattccgtcgttcgtgaccgcgtggctacagtaatgtacactgttgttacacctatgttgaatccattcatctacagtttaaggaataaagacatgaagcggggcctgaagaagttacaggatcggatctacagatag

SEQ ID NO: 28174 - DNA, 1044 bp, Artificial Sequence
  Description of Artificial Sequence: Synthetic coding sequence
atgagttacttctataggttgaagctgatgaaagaagcagtgcttgtgaaactgcccttcacctcattacccctcttgctgcagaccctgtcaaggaaatccagagacatggaaataaaaaattactcttcctcaactagcggcttcatacttttaggactcagctctaatccgcaacttcagaagcccctgtttgccatctttctgattatgtatttgcttgcagctgtaggcaacgttctgattattcccgcaatctatagcgaccctaggctccacacccctatgtattttttcctgtccaatctgagcttcatggacatttgtttcacaacagtgatcgtccccaaaatgctagtcaacttcttgtctgaaaccaaagtaatcagctacgtcggctgcctagcccaaatgtatttttttatggccttcggcaataccgactcttatctactggccagcatggccatcgatcgccttgtcgctatctgtaatccgttacactacgacgtcgtgatgaaaccacggcactgtctcctaatgttgctcgggtcatgttcaatctctcatttgcattcactcttccgggtccttctgatgtctagactgtctttttgcgcctctcacattatcaagcactttttctgcgatacgcagcccgtcttgaaactatcatgcagcgatactagtagttcccagatggttgtcatgacggagacgctggcggtgattgtgacaccctttctgtgtattatttttagctatcttcgcattatggtgactgtcctgaggattccctcagccgcgggaaagtggaaagcattctccacttgcggatcccatttgacagctgtggccctgttttacggctctattatttacgtctactttcgaccactatctatgtatagcgtggtccgggatcgtgtcgccaccgtcatgtacacagtggtgacgccaatgttaaaccctttcatctactctttgcgcaataaggacatgaaacgcgggctcaaaaaactccaggaccgaatttacagatag

SEQ ID NO: 28175 - DNA, 930 bp, Artificial Sequence
  Description of Artificial Sequence: Synthetic coding sequence
atggagcgaattaatcatacaagctccgtatctgaattcatattgttaggattaagctctcgcccagaagatcagaagactctttttgtcctttttctcattgtgtacctagtgacaatcacaggaaacttactgattatcctggcgatacggttcaatcctcacctacagactcccatgtacttcttcttgagcttcctgagtcttaccgacatatgttttacgacttcagtcgtcccaaagatgttgatgaatttcctaagcgagaagaagaccatctcctatgcaggctgtctgacacagatgtatttcttgtatgccctcgggaactctgactcgtgtcttctcgcagtgatggccttcgaccgttacgtggcagtttgtgacccctttcactatgtgaccacaatgagccaccaccactgcgttctgctggtcgcattcagctgctctttcccccacttgcactccctactgcacactttgttgttaaaccgattaactttctgcgactccaatgttatccatcacttcctctgtgatctgtcacctgttctgaagctgagctgctcctccatctttgttaatgagatagttcagatgactgaggcacctattgtccttgtcactcgttttctctgtattgccttctcctatattaggattctcaccaccgtgctgaagattcctagtacatcaggaaaaagaaaagcatttagcacctgtggattctacctgacagttgttacacttttttacgggagcatcttctgcgtgtacctgcagccaccttctacatacgcagtaaaagatcatgtcgctacaatcgtgtatacagtgctcagttcaatgctgaatccctttatctattcactaaggaacaaagatctgaagcagggactccgaaaacttatgagcaaaaggagctag

SEQ ID NO: 28176 - DNA, 951 bp, Artificial Sequence
  Description of Artificial Sequence: Synthetic coding sequence
ataacacccatggagcctcggaaccaaacatctgcttctcaattcattctccttggactgagcgagaagcccgaacaggagacactgctgttctcactgttcttttgcatgtatttggtaatggtagtgggtaacctcctcatcattctagccatctcaatcgattcacacctgcatacacccatgtatttcttcctcgcaaacctgtcactggtggatttctgcctggctaccaacacaatcccgaaaatgctggtatcactccaaactgggagtaaggccatttcttacccatgttgtctcattcagatgtattttttccatttctttggaatagtcgattctgtaatcatcgcaatgatggcatacgatcgattcgttgccatatgtcacccactgcattatgcaaagataatgagcctgaggctttgtaggttgctggtcggagccctctgggcatttagctgctttatcagtcttacgcatattctgctcatggccaggctagtcttttgtgggagccacgaggttccgcattacttttgtgatcttacccccatccttcgcctcagctgtaccgacacttctgttaaccgaatattcatactgatcgtggctggaatggtgatcgctaccccttttgtgtgcattctcgcttcatatgccaggattctggttgcgatcatgaaagtgccaagtgccggagggagaaagaaggctttctctacctgctccagtcatttgtctgtcgtcgcccttttttacggcacaaccattggtgtgtacctgtgtccctcctccgttctcaccacggtaaaagagaaggcatccgccgttatgtatacagctgtgactcccatgctgaatccgttcatttactcgttgaggaaccgggacctcaagggtgctttgcgaaagctcgtcaataggaagatcacttccagtagctag

SEQ ID NO: 28177 - DNA, 942 bp, Artificial Sequence
  Description of Artificial Sequence: Synthetic coding sequence
atggaaccgcgaaatcagacaagcgcttcacaattcattctgctggggttaagtgaaaaacctgagcaggagaccctgctgttctccctattcttctgtatgtacctggtgatggttgtcgggaatttgctgatcattttggctatcagcatcgattcccatttgcacaccccaatgtacttcttcttggcaaatctcagccttgttgacttctgcttggctacaaacaccattcccaagatgctagtgtccttacaaacaggatcaaaggccatctcatacccctgctgtcttatacagatgtacttcttccatttctttggaattgtagacagcgtaatcattgctatgatggcctatgataggttcgtcgccatttgccatccactacattacgctaagataatgagcttacgattgtgtcggctcctggtgggagccctgtgggctttttcatgttttataagcctgacacacatcttgttgatggcccgcctggtcttctgcggatctcacgaagtcccacactacttctgtgatctaacccccattctccgcctcagctgcaccgacacgagcgttaatcggatcttcattctcatcgttgcaggaatggtaatcgccacgcccttcgtgtgtatcctagcatcatatgcccgaatcctagtggccataatgaaagtgcctagtgccggcggaagaaagaaggcattctcaacatgcagctcacatctgagcgtggtcgccctcttctacggaaccacgataggcgtctatttgtgtcccagctctgtccttacaaccgtgaaagaaaaagcttcagccgtcatgtacaccgccgtcacccccatgctaaatccttttatttactctctccgcaacagggatctgaaaggagcccttcgtaagctcgtgaaccgtaagatcacttccagctcttag

SEQ ID NO: 28178 - DNA, 936 bp, Artificial Sequence
  Description of Artificial Sequence: Synthetic coding sequence
atggagaatcagtcctctatcagcgagttctttctgcgggggatttcagcccctccagaacagcagcagtctctctttggcatttttctgtgcatgtatctagtcactctgaccggaaacctgctcatcatcctcgccatcggatcagacctgcacctccacacaccgatgtatttttttcttgccaacctctctttcgtggatatgggcctaacttctagcaccgtgaccaagatgctcgtgaatatccaaacacggcatcacactatatcatacaccggctgcctgacccaaatgtatttttttctgatgttcggcgatctggacagtttttttctggccgccatggcttacgaccgatacgtcgccatctgccatcccctgtgctacagtacagtcatgcggcctcaggtctgcgcattaatgttagctttgtgttgggtgcttacaaatattgtggccctaacccacactttcctgatggcgagactgtctttctgcgtgactggggagattgctcattttttctgcgatataacgcccgttcttaagttgagctgtagcgacacacacatcaatgagatgatggttttcgttcttggcgggaccgtgctcatcgttccttttttgtgtattgttacatcctacatccatatagtcccagcaattcttagggttcggacccgaggcggtgtcggaaaggctttttccacttgctcttcccacctttgtgtggtctgcgtcttctacggtacactcttttctgcctatctgtgtcccccatcgattgcctccgaagaaaaggacatcgccgcagctgccatgtacaccatcgtgacccccatgctgaaccccttcatctacagcctgagaaataaagatatgaaaggtgctttaaaaaggctttttagtcaccgctccattgtcagctcttag

SEQ ID NO: 28179 - DNA, 993 bp, Artificial Sequence
  Description of Artificial Sequence: Synthetic coding sequence
atggagggcttctatctgaggcgctctcacgagctccaaggaatgggaaaacctggccgtgtgaatcagacgactgtcagtgacttcctgctgctcgggctcagtgagtggcctgaagagcagcccctgctattcggcatctttttaggaatgtatttagtgaccatggtggggaacctgctgatcattttggctatttccagtgatccacatttgcacactcccatgtactttttcctggccaatttatcgctcaccgacgcctgcttcacttctgcctcaatccctaagatgttggctaatatccacacccaatcccagattatatcatacagcggctgcctggcacaactgtactttttactgatgttcggaggcctcgacaactgcttactcgctgtgatggcctacgaccgctacgtggctatatgccagccattgcactattctacaagtatgtccccccaactgtgtgccctcatgttgggtgtgtgttgggtgctcactaactgcccagcactgatgcacactctcctgctaaccagagttgccttttgtgcccaaaaagcgataccccacttttattgtgacccctcggcgctgctcaaactggcctgttcagacacacacgtgaacgaactcatgatcatcacgatgggccttctgtttttgaccgtaccactgttactcatagtgttttcctatgtccgcattttttgggctgtgtttgtcatctcttcccctggaggcagatggaaggctttcagcacttgcggatcacacttaactgtggtgctcctcttctacggttctctaatgggcgtatacttgttacccccaagtacctacagtactgagagggaaagccgcgctgccgtcttatacatggtgatcataccaactctcaaccccttcatatactccctccggaacagggacatgaaggaggcgttaggcaagctgttcgtgagcggcaagacatttttcctatag

SEQ ID NO: 28180 - DNA, 945 bp, Artificial Sequence
  Description of Artificial Sequence: Synthetic coding sequence
atggataacagcaactggacctccgtgtcgcactttgtgctgctcggtatcagtactcaccccgaggaacagattccactgtttttggtgttctcgttgatgtacgctattaacattagcggcaatttagccatcataactctaattttgtccgccccgaggctacacattccgatgtacatcttcctctccaaccttgccctgaccgatatatgtttcacaagtactaccgtgcccaagatgctgcagattatcttcagcccaacaaaggtcatcagctacactggatgcctggcacagacatattttttcatctgtttcgctgtcatggagaatttcatcttagccgtgatggcttacgacaggtacattgccatctgccatcccttccactacactatgatcttgacacgcatgctttgtgtgaagatggtagtaatgtgtcacgccctctcccacctccatgctatgctgcacactttcctgatcggccagctgattttttgcgccgacaatagaatcccacacttcttctgtgacctgtatgcactgatgaaaatttcctgtacatcaacctatctgaataccttaatgatccataccgaaggcgctgtggtgatttctggcgccctggcctttatcaccgcctcatatgcttgcatcattctggttgtgttgcgtatccccagcgctaagggcagatggaagactttcagcacgtgtggttcgcatttgacagtagttgcgatattttacggtacgctgtcctgggtatactttcggcccctgtcaagctactctgtgacgaaagggcgtatcatcaccgtcgtttacacagtagtgacaccgatgctcaacccgttcatatacagcctgcggaacggagatgtgaagggcggctttatgaagtggatgtcccgaatgcagacgttcttttttcggtag

SEQ ID NO: 28181 - DNA, 978 bp, Artificial Sequence
  Description of Artificial Sequence: Synthetic coding sequence
atgaagaccttctcctcattcctccagatcggacgaaatatgcatcagggcaaccagacgaccatcactgaatttattcttcttggcttcttcaagcaggacgaacaccagaacctcctcttcgtgctgttcctcggcatgtacttagtcacagtcattggaaacggacttatcatcgtcgccatttctcttgatacctacctgcatacccctatgtacctgtttctcgcaaatctaagttttgcggatatctcttctatctcaaattctgttccaaaaatgttggtgaatatccagaccaagagtcagtctattagttacgaatcctgtatcacacagatgtatttttccattgtgtttgttgttatagacaacctgctgttgggcactatggcttacgatcatttcgtcgcaatatgccacccactcaattacaccattttgatgcgtcctcgtttcggcatattgctcactgttatcagctggtttctgtccaacattatcgctctgacccataccctgcttcttatacagctgctcttctgtaaccacaacacactcccgcattttttctgtgatctcgctccattgctgaagctcagttgcagcgacaccctgatcaacgagcttgtccttttcatcgtgggcttatctgtcattatcttcccctttaccctatctttctttagttacgtctgcattattcgcgcagtgctgagggtgtcttcaacccaagggaaatggaaggcattcagcacttgtggttctcaccttaccgtcgtcctgctgttttacgggactatcgttggtgtctatttttttcccagcagtacgcatcccgaggatacagacaagattggcgcagtgctgtttaccgttgttactcccatgatcaacccctttatctactcactgagaaacaaggacatgaagggcgccctgcgcaagctaatcaaccggaagatctcctctctctag

SEQ ID NO: 28182 - DNA, 978 bp, Artificial Sequence
  Description of Artificial Sequence: Synthetic coding sequence
atgaaaacattatgcagttttctgcagatatctagaaacatgcatcaagaaaaccagacaacaattactgagttcattctgctggggttatccaaccaggccgaacatcagaatttactgttcgttctctttctgtcgatgtatgtagtcaccgttgtgggaaacggactgattatcgtggcgatttcgctggacatctatctgcacacccctatgtacttgttcctggcatatctgtccttcgcagacatctccagtatatctaacagtgttccgaagatgctcgttaacatccaaaccaattcccagagtataagttacgagtcctgcatcacacagatgtatttttccattgtgttcgtcgttaccgacaatttgctgttaggtactatggcttttgatcacttcgtcgccatttgtcacccactgaactacacaactttcatgagagcccgtttcggtacgctgctgacagttattagttggtttttatccaacattatcgccttgactcacacgcttctccttatacagctgctgttctgtgatcacaacacgctgccgcatttcttctgcgacctggcccctctgctgaagttaagctgttcagacactatgattaacgaactcgtactctttattgtcgggctgtccgtgatcatctttccatttgtgctaatttttttttcgtatgtgtgcattattcgtgctgttttgggagtttcgagtactcaagggaaatggaaggccttttcaacatgtggctcccatctgaccatagcacttctcttttacgggacgaccgtaggtgtgtacttcttcccatcttcaacacacccagaggacaccgataagatcggagccgtgctgttcacagtagtaacaccaatgatgaacccattcatttattccctcaggaataaggacatgaagggggcgttgagaaaattgattaaccggaagatttctagcttgtag

SEQ ID NO: 28183 - DNA, 912 bp, Artificial Sequence
  Description of Artificial Sequence: Synthetic coding sequence
atgtcgttttcaagcttgcctactgagatccagtctttgcttttcctcacattcctgacaatatacctggtgactctgatgggtaattgtctgattatcctggtgaccctggctgaccctatgctacatagccccatgtactttttccttagaaacctgtctttcctcgaaataggcttcaacctggtcatcgtacccaaaatgctcgggactctgctggcccaagacacgaccatttcattcctgggctgcgctacacagatgtatttcttttttttttttggagttgcggagtgcttcctgctcgctactatggcctacgatcgttatgtcgccatttgcagtcctctccattaccctgtcatcatgaatcagcgaacccgcgctaagctggccgccgcatcctggttcccaggatttcccgtcgccaccgttcaaactacctggctgtttagctttcctttttgcggcacaaataaggttaaccattttttttgcgactccccccctgtacttcggcttgtctgtgccgacacagcactgttcgagatctacgccatagtgggaacaatccttgtggtcatgattccctgtttactcattctgtgtagctatacccacatagcagctgccatacttaaaataccatcagcgaagggaaagaacaaggcatttagcacgtgtagctctcatctgctggtcgttagcctgttctacatctcactttctctgacctattttcggcctaaaagtaacaactcgcccgaaggtaaaaagctgctctccctttcatacacagtgatgactcccatgcttaatccgattatctattccctgcgcaataatgaggtgaagaatgccctatccaggaccgtatcaaaagccttagccctgaggaattgcattccttag

SEQ ID NO: 28184 - DNA, 945 bp, Artificial Sequence
  Description of Artificial Sequence: Synthetic coding sequence
atgaagaggcagaaccagtcttgtgtcgtggagttcatactgttaggcttcagtaacttccccgagctgcaggtccagctctttggcgtgttcctagtaatttatgttgtaacactcatgggaaacgcaatcattactgtgatcatttccttgaaccaaagtcttcatgtgcccatgtatctgtttctgttgaacctgagtgttgtcgaagtcagctttagtgccgttatcacgccagagatgctggtagtcctgtcaaccgaaaagaccatgataagctttgtcggatgctttgcacagatgtattttatcttgttgtttgggggtaccgagtgttttctgttaggcgctatggcatacgacaggttcgccgccatttgtcacccactcaattacccagtaataatgaacaggggtgtattcatgaagctagtgatctttagctggattagcggcataatggtcgccacagttcaaacaacttgggtgttctctttccctttttgtgggccaaacgagataaatcatctgttttgcgagaccccaccggtgcttgagctggtttgtgcggatacatttctgtttgagatctacgcattcactggaaccattcttatcgttatggtcccctttctgttaattctgttatcatacatccgagttctgttcgctattctgaagatgccatcaacgactggcagacagaaagctttctccacatgtgcgtctcacttgacctctgtgacactcttttatgggacagcaaatatgacgtaccttcagccaaaaagtggctactcaccagagacaaaaaaacttatctcactcgcatacaccctgctgactcccctcctgaaccctctcatttattctctgagaaacagcgagatgaagaggaccctcatcaaattgtggagacgcaaggtgatcctacatacgttctag

SEQ ID NO: 28185 - DNA, 948 bp, Artificial Sequence
  Description of Artificial Sequence: Synthetic coding sequence
atgatgtgggaaaactggactatcgtgtccgagttcgtgttggtttcctttagtgccctctctacagagcttcaggctctcctgttcctcttgttcctaacgatttatctcgtgacactcatgggtaacgtccttatcatcctagtgacaatcgccgatagtgccttgcaatctcctatgtatttcttcctcagaaacctcagcttcctcgagatcggattcaacctggtgatcgttcccaagatgctcggcactttgataattcaagacactacgatctctttcctgggttgcgccacacagatgtacttttttttcttcttcggtgccgctgagtgttgtctgcttgctaccatggcttatgatagatacgttgcaatctgcgatccgctccattatcctgtgattatgggtcatatctcatgtgctcaactggccgccgcttcctggttttccggcttctcggtggctacagtgcagactacatggattttctcatttcctttctgtggaccaaatcgcgtcaaccatttcttttgcgacagtcctcctgtgattgccctggtgtgcgcagacacctctgtgttcgaactggaagcattgactgccaccgtgttattcattctgttcccttttcttctgattctgggttcttatgtgaggattctgtcaactattttccgcatgccatctgccgagggcaagcaccaggctttcagtacttgttcagcccatcttctcgtggtgagccttttctactccactgcgatcctcacctatttccggccccagtcttctgcctcctccgagagcaagaagctgctgtcactctccagcaccgtcgtgaccccaatgctgaacccaataatttattctagtagaaataaggaggtgaaggccgcactgaagagactgatccacaggaccttaggatcccaaaagctgtag

SEQ ID NO: 28186 - DNA, 954 bp, Artificial Sequence
  Description of Artificial Sequence: Synthetic coding sequence
atggctatcggaaactggaccgaaatttccgagttcatcctgatgtccttttcctctctccccactgaaatacagtcactgctatttctgacatttcttactatctacctggtgacactgaagggtaactcacttatcatccttgtcacactcgcagacccaatgttgcacagcccgatgtatttttttctgcgcaacctgagcttcctcgaaatcggctttaacctcgtgattgtgcctaagatgctggggaccctgctggcacaagatactaccatcagttttctgggttgcgctacacaaatgtactttttcttttttttcggggttgccgagtgctttcttctcgccaccatggcctacgaccgctatgtcgcaatttgctcacctcttcactatcctgtaatcatgaaccaaaggacacgggccaaactagctgccgcatcatggtttccggggttccccgttgctactgtgcagaccacatggctcttcagcttccctttctgcggaaccaataaagtcaatcattttttctgcgacagtcctcccgtgctaaagctcgtgtgtgctgacaccgcactctttgagatctatgccatcgtgggtactattctagtggtcatgatcccctgtctgctgattctttgcagttacacgaggattgcagctgccatcctgaagatccctagtgctaaagggaaacacaaagcttttagcacctgtagctcacacctacttgtcgtgtcgttgttttacatttcgtctagcttgacttacttctggcctaaaagcaacaattcacccgagtcaaagaagctgctgagtctctcatacaccgtggtcacgcctatgctgaaccctattatttactcgctgagaaatagtgaggttaaaaatgcactgtctcggacctttcataaagttctggctctgcgcaattgcatcccctag

SEQ ID NO: 28187 - DNA, 966 bp, Artificial Sequence
  Description of Artificial Sequence: Synthetic coding sequence
atgcctatattaatggcgattgggaactggaccgagatctcagagttcatccttatgtcatttagttctcttcccaccgagattcagagcctgctattcctgacctttctcaccatctatctggttaccctcaagggcaactccttgattatcctggtcactcttgccgatccgatgcttcatagccctatgtactttttcctgcggaacctgagtttcttggaaatcggctttaaccttgtcatcgtgccaaaaatgcttggaacactgctggctcaggacaccactatcagtttccttggatgcgcaacccagatgtatttttttttctttttcggcgtggctgaatgcttccttttagcgaccatggcatatgaccggtacgtggcgatttgttctccactgcactaccctgtgattatgaaccagcgaacaagagctaaacttgcggccgcatcttggttccctggatttccagtagccacagttcagaccacttggctcttttcatttcctttttgcggtaccaataaagtgaaccacttcttctgtgattcaccccctgtgctcaaattggtttgtgctgatactgcgctgtttgagatctacgccattgtcggtactatcctggtggtgatgattccgtgtcttttgatactatgcagctacacacgtatcgcggctgcgatcctgaaaatccccagcgctaagggcaaacataaggcctttagtacctgctcaagccatctcctggtcgtttccctgttttatatatcttcctcactgacgtacttttggcccaaaagcaataacagtcctgagtctaagaaactactaagtctctcatataccgtggttactccgatgctcaatcccatcatttattccctccgaaatagtgaagtgaaaaacgctctgtctcgtacttttcacaaggtcctcgcgcttcgcaattgtataccatag

SEQ ID NO: 28188 - DNA, 945 bp, Artificial Sequence
  Description of Artificial Sequence: Synthetic coding sequence
atggagcgccagaatcagagttgcgtagtggagtttatcttattgggattctctaattacccggaattacagggccaactttttgttgcttttctcgtgatataccttgtcactctgatcggcaacgcaattatcattgtgattgtctctctcgaccagtcccttcacgtcccgatgtacctgttcctcttgaatctgtccgtggtggatctgagctttagtgctgtgattatgccagagatgcttgtggtgctctctacagagaagacaactataagcttcggcggctgttttgcccagatgtactttatacttctgtttggaggggcagagtgctttctcctcggtgccatggcctacgaccgtttcgccgcgatttgccacccactgaactaccaaatgataatgaataaaggtgtgttcatgaagttaataatattcagctgggccctgggtttcatgcttgggactgtgcagacctcttgggtgtccagcttccctttctgtggccttaacgaaattaatcacatttcatgcgaaactcctgcagtattagaactagcttgtgctgacaccttcctgtttgaaatttacgccttcaccggaacctttttaattatcttggttccattcctcctcattctgctcagttacattcgtgtcctgttcgccatactcaagatgcctagtacaactgggcgacagaaagctttctctacttgcgccgctcatttgaccagtgtgacccttttttacggcacggcttctatgacctatctccagccgaaatccggatacagtcctgagaccaaaaaagtgatgtctctatcttatagcttgcttactccactcctaaacctgttaatctatagcttgagaaactccgaaatgaagagggcactgatgaaactctggcggcgcagagtggttttgcacactatctag

SEQ ID NO: 28189 - DNA, 951 bp, Artificial Sequence
  Description of Artificial Sequence: Synthetic coding sequence
atgatctgtgagaatcatacccgggtgaccgagtttattctcttgggtttcaccaataatccggaaatgcaagtgtccctgtttatctttttcctggctatttacactgtgacgctactgggcaatttcctaattgtgactgtcacctctgtcgacctggctctgcaaacaccaatgtacttctttctacagaacctgagcctactcgaggtgtgtttcaccctggttatggtacctaagatgctcgtagacctcgtgtcaccgcgtaagatcattagctttgttgggtgcgggacccagatgtacttcttcttcttcttcggaagttctgagtgcttcctgctgtctatgatggcctacgaccgcttcgtggccatctgcaacccccttcattactcagtcataatgaaccggagtctctgtctttggatggccataggatcgtggatgagtggagttcccgtctccatgctacagactgcctggatgatggctctccccttctgcgggcctaatgcagtggatcatttcttttgtgacggacctcccgtgctgaagctggtgactgtggatactacgatgtacgagatgcaagccctggctagtaccctgctcttcatcatgtttccattctgcttaatcctggtatcctacactcggatcataatcacaatcctaagaatgagctccgctactggcagacaaaaagctttttccacttgcagttcacacttgatagtcgtctccctgttctacgggacagcctctttaacctacctgcgccccaaatccaaccagtctcctgagtctaaaaaacttgtctccctttcgtacactgtaattactccgatgcttaatccaataatctatggtctgcggaacaacgaggtcaaaggggctgtgaaaaggactatcacccaaaaagtactccagaagttggatgtgttttag

SEQ ID NO: 28190 - DNA, 1020 bp, Artificial Sequence
  Description of Artificial Sequence: Synthetic coding sequence
atggaaaagcgcgagattaattcagctttcggagtgaaaagtcggtacagatatctgggcccactgtatgtcatttatacctattaccatattagaatcatactgttgtttacacaggcgccagatctagatttgtttccagcggccaatgtgagcatcatgggggctatcaagttgagccacaaccttcacacaccaatgtatttttttctgtgcggactgagcttttctgagacctgcacaacagttgtggtgatcccccgaatgctggtcgacttcttgagcgagagcaagactatatctcttccggagtgcgcaacccagatgttctttttcctcggcttcgcatccaacaactgcttcattatggccgcgatgagctatgatcgctatacggctattcataaccccctgcagtatcatacgctgatgacccggaagatctgccttcagatgatgatggctagctggatggtgggttttctcttttccctgtgcataatcgttactgtttttaatctgtctctctgtgacctgaatacgatccagcattacttttgcgacattagtcccgtagtgagcctggcatgcaactacacattctatcacgagatggccattttcgtgctcagcgcttttgtgcttgttggctcttgcatccttattatgatttcttacgtattcattgtgttcattgtgatcaagatgccttcagctaagggccgaagcaaggcattttccacttgtagctctcacctgactgtggtgtcgatacattatggcttcgcttgttttgtgtatttgcgccccaaaaactctaactctttcgatgaagacatgttgaccgccatgatctatacaatcctgatgccgctcctaaacccaattgtgtattctcttaggaataaagaaatgcagatcgcgctgagaaagactctcgggagcgtttttggagtgttcccgcagaagaccaaaaaggaaccagagcacctgaaaaagcttcatagcatcgataaatag

SEQ ID NO: 28191 - DNA, 954 bp, Artificial Sequence
  Description of Artificial Sequence: Synthetic coding sequence
atgctgaggaacggctctattgttaccgagttcatactggtcgggtttcaacaatctagcacctcgacacgcgctctgttatttgcactgttcctcgctctgtattcactaaccatggccatgaacgggctcatcatcttcattacctcgtggaccgacccgaagctcaacagccctatgtatttttttcttggccacctgagcctactggacgtgtgttttattacaaccaccatcccacagatgcttattcatttggtggtccgggatcatattgtgagcttcgtatgttgtatgactcagatgtatttcgtattttgcgtaggcgtggccgaatgtatacttctggcctttatggcatacgacaggtatgtagcgatttgctacccactgaactacgttcccatcatctcgcagaaggtgtgcgttcggctcgtgggaaccgcatggttcttcgggctgattaatggaatcttcttggaatatatcagctttcgggaaccatttcgacgggataatcacatcgaatcgttcttctgcgaggccccgatcgtgatcggcctgagttgtggagacccacagttttctttgtgggccattttcgctgacgccatcgtcgtgattctctcaccgatggtgttgacagttacttcatacgtccatattctcgcgacaatactgtccaaggctagctcctcagggaggggaaagaccttctcgacctgtgctagccatctgactgtggtcatttttctatacacctctgccatgttctcctatatgaacccacattccactcatgggccagataaagacaagcccttcagtctgttgtataccattattaccccgatgtgtaatcccatcatctatagttttaggaataaggaaatcaaagaggccatggttagggctttgggcagaactagactcgcacagccacagtccgtgtag

SEQ ID NO: 28192 - DNA, 906 bp, Artificial Sequence
  Description of Artificial Sequence: Synthetic coding sequence
atggaatttgttctgttgggcttttccgacatcccaaacttgcactggatgctttttagtatcttcctgctaatgtacctcatgatcctcatgtgtaatggaattatcattctgctgataaagatccacccggccttacagaccccaatgtacttttttctctccaatttttctcttttggagatctgctacgtgactatcatcatacctcgcatgttgatggatatatggacacagaaggggaatatttcgctattcgcttgcgccacccagatgtgcttttttctcatgctgggtggcaccgagtgcttactcctaaccgtgatggcgtacgaccgttacgtcgccatttgtaagccactccagtaccctctggtcatgaatcataaggtctgcattcaactgattattgcatcctggaccataacaatccccgtggttatcggggaaacatgtcagattttcttgctgcctttttgcgggacaaataccatcaatcattttttctgcgacatacctccaatcctgaagttggcctgtgggaacatcttcgtgaatgagatcactgtccatgtcgtcgctgtcgtattcattacagtccccttccttttgatagtcgtcagctatggaaaaattattagcaatattctcaaattgagttctgctcgcggcaaggcgaaggctttctccacgtgttccagccacttgattgtcgtgatccttttttttggagcagggaccataacttaccttcagccgaagccgcatcagttccaaagaatgggaaagctgattagcttgttctacacaattcttattccaaccctgaatcccatcatctatactctccggaataaagatatcatggtggccctcaggaagctgctggcgaagttattgacgtag

SEQ ID NO: 28193 - DNA, 939 bp, Artificial Sequence
  Description of Artificial Sequence: Synthetic coding sequence
atgagcgcgaacacctcgatggtgactgagttccttttgctgggtttcagccatctggccgatctgcaggggctactgtttagcgttttcctgaccatctatctgctgacagtcgccggtaattttctgatcgttgtactcgtgagcacagacgcggccctgcagtctcccatgtatttctttcttcggacattgtcagcgctagagataggatatacgtcagttaccgtgcccctgctgctccatcacttacttacgggccggagacatattagtcggagtgggtgtgccctccaaatgtttttttttctcttcttcggcgctacagaatgttgccttctggccgccatggcatatgaccggtatgctgctatctgcgagccattacgttaccctctccttctatcccatcgggtctgtttgcagctggctggctctgcatgggcttgtggagtactggttggactgggtcacacaccttttattttctcacttcccttctgcggtcctaacacgattccccagtttttctgtgagatccagcctgtgctgcaactcgtttgcggagatacatcgctgaatgagttgcagatcatcctagccaccgcacttctgatcttatgtccctttggtctgatcctgggatcctacggacgtatcctggtcaccatcttccgaatcccatcagtagcaggtagaaggaaagccttttccacatgttcatcacacctcattatggtctctctgttctacgggacagccttattcatctacatacgtccaaaggcctcctatgatccagccaccgatccactggtcagcttgttctacgcagtggttactcctatattgaatcctatcatctattcccttagaaacaccgaggtgaaggcagcattgaaaagaaccattcaaaagacagtacccatggagatctag

SEQ ID NO: 28194 - DNA, 939 bp, Artificial Sequence
  Description of Artificial Sequence: Synthetic coding sequence
atgagtgccaataccagtatggttaccgagttcctcctgctgggcttctcacatctcgcggacctccaaggcttacttttctcagtgtttctgactatctacctgctgaccgtggccggcaatttccttatcgttgtattagttagcaccgacgcggccctgcaatcaccaatgtatttcttcctgcgaactttgtctgcgctggaaatcggatacactagcgtcacagtgccactcctgttgcaccatcttttaaccgggaggcgccacatctcccgatcgggatgcgccttgcagatgtttttctttctgttcttcggagccacagaatgctgtctgctggccgcaatggcatatgataggtatgcagcaatctgtgagcctcttcgttatcccctactgttgagccacagggtgtgccttcagctcgctgggtccgcctgggcttgcggggtgttggtcggacttggtcatacgcctttcatattttcactgcctttttgcgggcctaatacgatcccccagtttttctgcgaaattcagcccgtattgcaattagtgtgcggggatacctcactgaacgaactgcaaatcattcttgcgacagctttgctgattttatgcccctttggacttatactgggcagctatggcagaatcctggtcaccatcttccggatacccagcgttgctggtagaagaaaggcgttttcgacctgctcctcacatcttataatggtgagcttgttttatggaaccgccctgtttatttacattcgtccgaaggcctcctacgatcccgccaccgatcctctagtgagtctgttctacgctgtcgtcaccccaatcttaaacccaattatctacagcttgagaaataccgaggttaaagccgccttgaagaggacaatccagaaaaccgtccctatggagatctag

SEQ ID NO: 28195 - DNA, 939 bp, Artificial Sequence
  Description of Artificial Sequence: Synthetic coding sequence
atgtcagccaatacatccatggtcaccgagtttctcttgctgggtttttcacacctcgctgatctgcaagggctgctgttcagtgtgtttctaactatatacctgctgaccgtggccggtaacttcctgatcgtggtccttgtttccaccgatgcagcccttcagtctcctatgtatttgttcctgcggacactgagcgcactggaaatcggttacacgtcggtgaccgttcctctcctgctacatcacctcctgaccggcagaaggcacatttccagaagtgggtgcgcattgcaaatgttctttttcctgtttttcggcgcaaccgagtgttgccttcttgccgccatggcctacgatcggtatgccgcaatctgtgagcccttacggtacccgctgctcctgtcccatagggtgtgtctccaacttgccgggtccgcttgggcttgcggtgtcctcgtcggtttgggacacacacctttcattttctctctcccattttgtggtcccaacactatccagcagtttttctgtgaaatccagcccgttcttcagcttgtgtgtggggatacaagtctgaatgaactccagattatcctggcgaccgccctgctgattttgtgccctttcggcctgatcctgggatcctatgggaggatcttggtcaccatcttccgcatcccatcggtagctggccgccggaaggcgttctccacgtgttcaagtcatctgattgtggtgagcctgttctatggcactgcgttattcatctatatcaggccgaaagcctcttatgatcccgcgactgatccactggtgtccctattctatgccgtcgtcacgcctatcttgaaccccatcatatactccctgagaaacactgaggtgaaagctgctttaaaaaggactatacagaagaccgtcccgatggaaatctag

SEQ ID NO: 28196 - DNA, 939 bp, Artificial Sequence
  Description of Artificial Sequence: Synthetic coding sequence
atgtccgctaacactagcatggtgactgaatttctactattaggattctctcatcttgccgatctacagggtcttctgtttagtgtcttcctgacaatctacctcctcacagtcgcaggcaacttcctgattgtggtcttggtttccaccgatgccgccctgcagtcaccgatgtacttcttcttgagaacactgtcagcccttgagatcgggtacacttctgtgaccgtgccactcttactgcatcatctccttaccggccggcggcatatcagccgctcagggtgcgccctccagatgttcttctttttgttcttcggcgccaccgagtgttgcctgctggctgcaatggcctacgatcgatatgctgccatatgcgaacctctgaggtatcctctgttgctgtcacatcgtgtctgtctgcagttggccggcagtgcttgggcatgtggggtgttggtgggcctcggtcacacaccgttcatcttctctttgccattttgtgggcctaacactattccacaattcttctgcgaaattcagcctgtcctccagttagtgtgtggggataccagcctgaatgaactacagatcattttagccactgccctgctgatcctgtgtccatttggcctcatcctgggaagttatggccgcatcctggtaactatcttcagaataccaagtgtggcagggagaaggaaggccttttctacctgtagttcccatctgatcgttgtgagcctgttctatggcaccgccctgtttatctacataaggcctaaggcatcttacgacccagccactgacccgcttgtgagcctcttctacgctgtggtgacccctatcctgaatcccatcatttattctcttcgcaatacggaggttaaagctgccttgaagaggaccatccagaagaccgtaccaatggagatttag

SEQ ID NO: 28197 - DNA, 939 bp, Artificial Sequence
  Description of Artificial Sequence: Synthetic coding sequence
atgtccgctaatacgtctatggtgactgagttccttctactggggtttagtcacttggccgacctccagggactcctgttcagcgtgtttctgacaatctatctactgactgtggccggtaattttctgatcgttgtgctggtgtcaacagatgcggcactgcagtcccccatgtatttctttctgagaactctcagtgccttggagatcgggtacacctccgtgaccgtgcctctgctcttacaccacctgctcacaggaaggcgtcatatctcccgcagcgggtgtgcgctgcagatgtttttcttcctgttctttggagcgacggaatgttgcttgttggccgctatggcatacgacaggtacgcagctatctgtgagcctctccgctaccctctgcttttgtcccacagagtttgcctgcagctcgctggtagcgcctgggcatgcggggtgctcgtcggactaggtcacacccccttcatattcagcctgcccttctgcggacctaacactataccccagttcttttgtgaaatacaacctgttctgcaactagtctgtggcgatacgtccctaaatgagctgcaaattatcctggcaactgcccttttgatcttgtgcccttttggcctgatactcggttcgtatggccgaattcttgttaccatattcagaattccgtccgtggcgggacgccggaaagcatttagtacatgtagctcacatctgattatggtcagtctgttttatggtacagccctctttatctatattaggccaaaagcgagttatgatcccgccactgatccactggtgtcactgttctatgccgtggtcaccccaatcctgaaccctattatttactctctaagaaacacagaagtgaaagctgccctgaagcggacaatccaaaaaactgtgcctatggagatctag

SEQ ID NO: 28198 - DNA, 939 bp, Artificial Sequence
  Description of Artificial Sequence: Synthetic coding sequence
atgagtgccaatacgagcatggtgacagaattccttctactggggtttagccaccttgccgaccttcaagggttgctatttagcgtctttctgacaatttatctcctgactgtcgcaggaaactttctgattgtggtacttgtttcaaccgacgctgcactacagtcccccatgtacttttttctaagaaccctgagtgctctagagatcggctatacttcagttacagtgcccctcctcctgcaccatctactgaccggtcgcagacatatttcccggtcagggtgtgccctgcagatgtttttcttccttttcttcggtgcaaccgaatgctgcctgctggctgctatggcttatgatcgctatgcagccatttgcgagcccttgcggtatcccctcctgctcagccaccgagtttgccttcagttggcaggtagcgcttgggcgtgtggagttcttgtcggcctaggacacactcccttcatcttttcactacctttttgcggcccaaatacaatcccccagttcttctgtgagatccaacccgtgttgcagctcgtctgcggtgacaccagcttaaatgagctccagataatacttgccaccgccctcctcattctatgcccattcgggttgatactgggatcatacggccggattctagttacaatttttcggatcccctccgtagcgggccgtaggaaagccttttcaacttgttctagtcacctgatcgtggtcagccttttttatggcacagcgctcttcatctacatccggcctaaagctagctacgatcccgctactgatcctctggtgtctctgttctacgccgtcgtgaccccaattctcaacccaatcatctactcgctgagaaataccgaagtcaaggccgcgctaaaaaggactatacagaagactgttcccatggagatctag

SEQ ID NO: 28199 - DNA, 939 bp, Artificial Sequence
  Description of Artificial Sequence: Synthetic coding sequence
atgtctgctaatacctccatggtgacagagtttctcctcctcggattctcacatctggcagatttacaggggcttctgtttagcgtgtttctcaccatctaccttcttacagtcgctggcaactttttgatcgtggtgttggtgtctaccgatgctgcactgcagtccccaatgtactttttccttagaacactttctgcgctcgaaatcggttacacttcggtcacggtgcccctgctgcttcaccatctcctgactggcaggcgtcacataagcagatccgggtgtgccctccagatgtttttcttcctgtttttcggcgccaccgagtgctgcctcctcgcagctatggcctacgaccgctacgctgctatctgcgagccactgcgctaccccctcctgctctcccatcgagtctgcctgcagcttgctgggtcagcctgggcctgcggggttttggtgggcctgggccataccccgtttatttttagtctccccttttgcggccccaatactattccacagttcttttgcgaaattcagcctgttctccagctggtgtgcggagacacttccctgaacgagctccagattatcttggctaccgccctgctgattttatgtccttttggtctcatcctcggctcctacgggcgaattctcgtcacaatattcaggattccttcagtggcaggcagacggaaagcgtttagtacgtgtagttcccacttaattgtcgtctcccttttctacgggaccgcattgtttatctatatccggccgaaggcgtcatacgaccccgccacggatcctcttgtgagcctgttttatgccgtcgtcacaccaatactgaatcccattatttactctctgaggaacaccgaagttaaggccgccctgaaaaggacaattcaaaaaactgtgccaatggagatttag

SEQ ID NO: 28200 - DNA, 939 bp, Artificial Sequence
  Description of Artificial Sequence: Synthetic coding sequence
atgtcagctaacactagtatggtgaccgagtttctactactagggttttcccatttagctgatctacagggcctgctattcagcgtcttcctcactatttaccttctgaccgtcgctggaaattttctgattgttgtgctggtctccactgacgccgccctgcagtcacccatgtatttctttctgcgtaccctgtccgcacttgagatcgggtacacaagcgtgaccgtgcccctgctcctccatcacctccttactggcaggaggcatatttcccggagtgggtgcgccctgcaaatgtttttctttctctttttcggcgccactgagtgctgtctcctggcggccatggcctacgaccgatacgcagccatttgtgagcccctgcggtaccctttattgctgagtcatagagtatgtctgcagctcgcaggaagcgcctgggcctgcggagtactcgtgggtttaggccacacacctttcattttcagtttgccgttctgtggcccaaacacaataccacagttcttctgcgagatccaacccgttttgcagctcgtatgtggcgatacctccctcaacgaacttcaaattattctggctacagctctgctgatattgtgcccatttgggctgatccttgggtcatacggaaggatactggtcaccatttttcggatccccagtgttgcagggcgccggaaggctttctctacttgtagcagccacctgatcgtggtcagcttgttctatgggactgcactttttatatacataagacccaaggcaagctatgaccctgccaccgatccattggtgtctctgttctatgctgtcgtgacccccatcttgaatcctattatttacagcctacgcaataccgaggtgaaagccgcactgaaacgtacgatacagaagaccgtgccaatggagatctag

SEQ ID NO: 28201 - DNA, 888 bp, Artificial Sequence
  Description of Artificial Sequence: Synthetic coding sequence
tctgtcacagaattcctgcttctcggcgtcaccgacatccaggagctgcagccattcttgtttgtcgtgttcttgacaatctactttatttccgtggctggcaacggagcaatacttatgatagtgataagcgacccacgcctgcacagcccaatgtactttttccttgggaacctgtcttgcttagacatctgctatagttccgttaccctgccaaagatgctgcagaactttctcagcgcccataagatcagcaggagcggctgcgctcttcagatgtttttctttctctttttcggagcaacagagtgctgcctgcttgccgcaatggcatatgacaggtacgccgccatatgcgaaccgctgcggtatcccctattgctgtcccatagagtatgtttgcagctcgcaggatccgcttgggcgtgcggagtattggtgggtttgggacacactccattcatcttcagtctaccattctgcgggccaaacacaattccacagttcttctgtgaaatccaacccgtccttcaactggtctgtggagatacatccctaaatgagctgcagataatcttggctacagcgctgctaattttgtgtcccttcggtttgatcctagggagctacggacgcattctcgtgacaattttcagaatcccctcagtggcaggaagaaggaaagctttctccacatgtagtagtcatctgataatggtatctctgttttatgggaccgcgctgtttatttacattcggcccaaagcgtcatatgatcctgctacggatcccctagtctccttgttttatgctgtagttactccgatcctcaacccaattatatatagcctcagaaacactgaggttaaggctgcattaaaaagatag

SEQ ID NO: 28202 - DNA, 888 bp, Artificial Sequence
  Description of Artificial Sequence: Synthetic coding sequence
tccgtgaccgaatttctgcttctcggggtgacagacatccaggaactgcagcccttcctgttcgtggtgttcctgaccatatatttcatctctgtggctggcaacggcgcaattctgatgatagtgatttccgatcccaggctacactctccaatgtacttttttctcggtaatctgagctgcctggatatatgctactcatccgtgaccctgcccaaaatgttgcagaacttcttatccgcccacaagatctctcggagcggctgtgccctgcagatgtttttctttctatttttcggtgctacggagtgttgcctcctcgccgccatggcctacgatcgatatgccgcgatctgcgaaccactcagatacccactgctgctcagtcatagagtctgcctgcagttggcgggatcggcatgggcatgcggtgtgctggtgggcttgggccatactccctttatcttcagccttcctttctgtggccccaataccattccccagtttttctgcgagattcagccggtgctgcagctggtttgcggggatacatccctgaacgaacttcagattatcctggctaccgcacttctgatcctgtgcccattcgggctcatcctaggatcttatggtagaatcttagtgaccatttttcgaataccaagcgtcgcggggcggagaaaggcatttagtacatgtagctcacacctgatcatggtgagtctgttctacggaacagccttattcatttacatccgaccgaaggcctcttatgaccctgcgaccgaccctctggtgagtcttttctacgccgtcgtgacaccaattctaaatccaatcatatattcccttcggaatacagaggttaaagccgccctaaagcgatag

SEQ ID NO: 28203 - DNA, 888 bp, Artificial Sequence
  Description of Artificial Sequence: Synthetic coding sequence
agtgtgacagaattcctattactgggtgtcaccgatatacaggagctgcagccattcctgtttgtggtcttcttaactatttattttatatcagtggctggaaatggagctatcctaatgatagtcatcagcgacccccgcctgcacagccccatgtacttctttcttgggaatctgtcttgcctggatatctgttactcctcagtgacactgcctaagatgctgcagaacttcttgagtgctcataaaatcagccgtagcgggtgcgcattacagatgtttttttttctcttctttggagccacggaatgctgcctcttggccgcgatggcatacgataggtatgccgctatttgtgagccccttcgttaccccttgcttctgtctcaccgggtgtgcctgcaacttgctggttccgcctgggcatgcggggtgctcgttggtctaggacatacacccttcatcttcagccttcccttctgcggccctaacaccattcaacagttcttttgcgaaatacagcccgtactccagctggtgtgtggcgatacatccttaaacgaattgcaaattatccttgcaacggccctgcttatactttgcccttttggcttaatactggggtcatacggcaggatccttgtcaccattttccgtatccccagcgtagcagggaggcgtaaggctttttcaacatgctcatctcacttgattgtggtgagcctattttatgggactgcgctgttcatttacatcaggccgaaggcatcttatgacccagccactgaccctttagtcagcttattctatgcagttgtaacaccaatactaaacccaattatctactcactccggaacacagaggtaaaggcggctctcaagcggtag

SEQ ID NO: 28204 - DNA, 888 bp, Artificial Sequence
  Description of Artificial Sequence: Synthetic coding sequence
tcggttacagaattcctcctcttaggggtaacggacattcaggagttgcagccgtttctttttgtagtatttctcacaatttattttatctctgttgccggcaatggcgctatactcatgatcgtcatctcagaccccaggctgcacagccccatgtacttctttctgggaaatcttagctgtctggatatttgttatagcagtgtgacgctccctaagatgctgcagaatttccttagcgcccataaaatatcccgcagcggttgtgccctccagatgttctttttcctattcttcggggccactgaatgctgcttgctggctgccatggcatatgacaggtacgccgcaatctgcgagcccctaaggtatcctctgttactgtcccatcgggtatgcttgcagcttgcaggatctgcctgggcatgcggtgtattggttggacttggtcacactccattcatcttctcgcttcccttttgtggccctaacacgattccccagttcttttgcgaaattcagcctgtactccaactggtttgcggagatacctcccttaacgaacttcaaatcatcttagcaacagctcttctaatcctgtgcccattcggcctaatattaggctcatatggtcgcatcttagttacgatattccggatcccgtccgttgctggacgaaggaaggctttctcgacgtgtagttctcacttaatcgtggtttctctcttttatggcacggcattgttcatatatatcagacccaaggcttcgtacgaccctgcaactgaccccttggtctctcttttttacgccgtggtcaccccaattctgaacccgattatctactcgttaaggaacacagaggtaaaggccgctctaaagcgatag

SEQ ID NO: 28205 - DNA, 915 bp, Artificial Sequence
  Description of Artificial Sequence: Synthetic coding sequence
gagcggatgtccgctaacacaagcatggtgactgagttcctcctgctgggatttagccatctcgccgacctccaaggcctcctgtttagcgtgttcttaacaatctatctgcttactgttgccggaaatttcctgatcgttgtgctcgtgtcaactgacgctgccctgcaaagcccgatgtatttcttcctgcgaacacttagtgctctggagattggatacacctcagtcactgtcccccttctgctgcatcacctgctaaccgggcgacggcatatctctcgtagcgggtgcgcgctccagatgttttttttcttattctttggggctaccgagtgctgtctccttgccgccatggcgtatgacagatacgccgcaatctgcgaacctctgaggtaccctcttttgctgtcacaccgcgtgtgcctgcagcttgccggctcagcatgggcttgcggtgtgctcgtgggcctcgggcataccccttttatcttcagcctccccttttgcggcccgaataccatcccgcaatttttctgcgagattcagccagtattgcagcttgtttgcggagacacatcactcaacgaactccagatcattttggccacagccctgttgattctttgcccatttgggttgatcctggggtcatatgggcggatcctggtaactatcttccgcatacctagcgtggcgggcagacgtaaagccttctccacgtgttcatcccatcttatcgtcgtgtcattgttctacggcacagccctgttcatatatattcggccaaaagcatcatacgatccagcaacagatcctctggtttctctcttctacgcagtcgttacacccatccttaaccccatcatctactctcttaggaatacggaggtgaaggctgcccttaagagatag

SEQ ID NO: 28206 - DNA, 888 bp, Artificial Sequence
  Description of Artificial Sequence: Synthetic coding sequence
tctgtcacagagttcctactgctgggggttactgacatccaggaattacaaccattcctctttgtcgtgttcctgactatatacttcatctctgttgccggtaacggggccattcttatgatcgtgatcagcgatccccggctgcatagccctatgtatttcttcctgggtaaccttagctgcttggatatttgttattcatccgtcacactccctaagatgctgcagaactttctgtcagcgcacaagatctctcgaagtgggtgcgccctccagatgttcttcttcctgtttttcggggccactgagtgctgcctgttggccgctatggcttatgaccgttacgctgcaatctgtgaacctctccgctatccactactgcttagccaccgagtgtgtctccagcttgcgggaagcgcgtgggcttgtggcgtgctagttggcctcgggcatactccctttattttctccttgcctttttgtggcccaaacaccatacctcaattcttctgtgagattcaacctgtgctgcagcttgtctgtggcgacacatcattaaatgagttacagattattctggccacagctcttctgatcctctgtccattcggacttatcctgggctcttacgggcgaatcctcgtgaccattttccggattccttctgtggcaggacgtcgaaaagcgttctcaacctgcagctctcatttgatcgtggtcagtctgttttacgggactgcgctgtttatctatatccgacccaaagctagttatgaccccgctaccgaccccctggtgtcactcttctacgcagttgtgacacctatactgaaccctattatctacagtctaagaaacactgaggtaaaggcagctttaaaacgctag

SEQ ID NO: 28207 - DNA, 888 bp, Artificial Sequence
  Description of Artificial Sequence: Synthetic coding sequence
tctgttacggaatttctgctgcttggcgtaaccgacatccaagaactgcagcccttcctttttgtggtgtttctaacaatatattttatatccgttgcgggaaatggagcaatactgatgatcgttatctctgacccacggctgcattccccgatgtacttctttcttggaaatctgagttgtctggacatttgttacagttcggtgacccttcctaagatgttacagaacttcctgtccgcgcacaaaattagtcgtagcggttgtgctttgcaaatgtttttcttccttttctttggagccacagagtgttgtctgttagcagccatggcgtatgaccgctatgctgctatttgcgaacctctgaggtaccctctgttacttagtcacagagtctgcctacagctggccggatctgcctgggcttgtggcgtgctagtcgggctggggcatactcccttcatctttagcttacctttttgcggtccgaataccattccccagttcttttgcgagattcagcctgttttacagttagtatgtggagacaccagcctgaatgagctgcagattatcctcgccaccgccttactgattttatgccccttcggcctaatcctggggagttacggccggatcctggtcaccatttttaggatcccgtccgtcgcaggcagacgcaaggccttctctacatgttcatctcacctgattgtcgttagtctgttctacggcacagccctgttcatctatatcagaccgaaggcctcctatgaccccgcaacagaccctctcgtgtcccttttttatgcagtagtgaccccaattctgaatccgatcatctacagtctccgtaacactgaggtcaaagcagccctgaagcgttag

SEQ ID NO: 28208 - DNA, 939 bp, Artificial Sequence
  Description of Artificial Sequence: Synthetic coding sequence
atggaggtaaaaaattgctgcatggtgaccgagttcatcctgctcggcattccccataccgaagggctggagatgactcttttcgtcctgtttctgccattctacgcctgtactttgttgggcaatgtatccatcctagtagccgtgatgtccagtgcaagacttcacacccccatgtatttctttttaggaaatctctcggtgttcgatatggggttctcctcagtaacatgccccaagatgcttctttatcttatgggcctgtcccgtctgatatcgtacaaggactgcgtgtgtcagctatttttcttccattttctcggctcaatcgaatgcttcctctttaccgtgatggcctatgaccgattcacagcaatatgttacccgttgcgctatactgttatcatgaaccctcggatttgcgttgccctggcggtgggcacttggctgctgggctgtattcacagttccattctgacctcactgaccttcacattgccgtactgtggtcctaacgaggtggaccatttcttttgcgacatccccgccctcctgcctctcgcatgcgccgacacatctcttgcccagagagtgagcttcactaatgttggccttattagccttgtatgtttcctccttatcctcctgagttacactcgaatcacaatttcgatcctcagcattcgaacgaccgaagggcgacgccgtgcttttagtacttgctccgcccacttaatcgcgatcttgtgcgcttacggaccaatcatcaccgtgtacttacagcccaccccaaaccctatgctgggcactgttgtccagattctcatgaacctcgtgggcccaatgctgaaccctctcatttatactttgcgcaacaaggaggtcaagaccgctctgaagaccatcttacataggaccgggcacgtgccggagtcatag

SEQ ID NO: 28209 - DNA, 933 bp, Artificial Sequence
  Description of Artificial Sequence: Synthetic coding sequence
atgggcaagacaaagaacacaagtttggatgcagtggtgacagattttatattattgggcctgagccatcctccgaatctgaggtcactccttttcctggttttttttattatctacatccttacgcagctcggcaatctcctcatactgctgacaatgtgggcagacccaaagttgtgtgccagacccatgtacatactcctcggcgtgctgtcatttctcgatatgtggcttagcagcgtaacagtaccaaggctgattctcgactttaccccctccattaaggccataccattcggtggatgcgttgcacagctatattttttccacttccttggtagcacccaatgtttcctctacaccctgatggcttacgataggtacctggctatatgccagcccctccactatccagtgctgatgaacggacggctgtgtacagttcttgtggctggggcttgggtcgctgggagcatgcacggtagcattcaagcaactctgacatttagattgccctattgcggccctaaccaggtagactacttcatctgcgacatacgggctgtattgaggctggcatgcgcggacactacagtaaatgaactggtcacatttgtggatgtgagggtcgtggcagccagctgttttatgctgattctcttaagctacgcaaacattgtgcatgccatcctaaagatcagaaccgcagacggacgcaggcgagccttcagcacctgtggtagtcatctgatcgttgtcacggtgtactacgtgccttgtatcttcatctacctcagggccggttcgaaagaccctctggacggcgctgccgctgtgttctataccgtcgttacgccacttctcaatcctctgatctacacactgcggaaccaggaagtgaaatcagccctcaagagaatcactgcaggatag

SEQ ID NO: 28210 - DNA, 942 bp, Artificial Sequence
  Description of Artificial Sequence: Synthetic coding sequence
atggagcgcatcaactccaccctgcttaccgccttcattctgaccggtatcccctatcccctccgactccgcacactcttcttcgtcttcttttttctaatctacatcttaacacagctgggcaatctcctgatcctcattacagtgtgggccgacccacgattacacgccaggcccatgtacattttcctcggggtgctgtcagtcatcgatatgagtatctcaagtataatcgtcccccggctgatgatgaacttcacactgggcgtgaagcccataccttttggcgggtgcgtagctcaactgtacttttaccattttctggggtcgactcagtgctttttgtatacactcatggcctacgaccgctatctcgccatttgtcagcccttacgttacccagtgctgatgacagcaaaactaagtgcactgctggtggcaggggcgtggatggcaggttcaatccatggcgccctccaggccattctaacctttaggctgccatattgtggccctaaccaagtggactactttttctgtgacataccagccgtattgcgcctggcctgtgccgatacaaccgtgaacgaattggtaacatttgtggatattggcgtggtcgtggcaagctgtttcagtttgatcctcctctcgtacatccaaataatccaggctattttgaggattcacacggcagacggcaggcggagagccttctccacatgcggtgcccacgtgactgtggtaacggtgtattatgtgccttgtgcctttatctacctgcggcccgaaacaaactctcccctcgatggcgcggctgcattagtcccgacggccatcaccccttttcttaatccgctcatctatacgctccggaatcaggaggtgaaactcgccctaaagagaatgctgaggagccctcgcacgccctccgaggtctag

SEQ ID NO: 28211 - DNA, 936 bp, Artificial Sequence
  Description of Artificial Sequence: Synthetic coding sequence
atgagtaacgcatcattagtcacagctttcatcctgacaggactaccccatgcccctggtctcgacgcactcctgtttggcatattcctcgttgtctacgtgctcacagtccttgggaacctccttatcctccttgtgatccgcgtggactctcatctccatacacctatgtattattttctgaccaatctaagcttcatcgacatgtggttctctacagtgaccgtacccaagatgcttatgaccttagtgagccccagtggccgagcaatctcattccattcatgtgtggcccagctgtacttttttcattttctcggaagcaccgagtgttttttatacaccgttatgtcttatgaccgctatctagctatctcgtatccactcaggtacacatccatgatgtctgggtcacgatgtgctctcctggcaacagggacctggctttccggctccttacacagcgcagtgcagacaattctgacttttcaccttccatactgtggtccaaaccaaattcagcactatttctgcgacgccccacctatccttaaactcgcgtgtgccgatacaagcgcaaatgtcatggtcatattcgtggatattggaatcgtggctagtgggtgctttgtcctgattgtgctgtcatacgtgtcaatcgtttgctctatactcaggattcggacttccgatggtcggcgcagggcctttcagacctgcgcttcccattgcattgtagtgctgtgtttctttgttccttgtgtcgtgatctacctccggcccggttctatggacgccatggatggcgttgtggccattttctacaccgtgctgactcccttattaaatcctgtagtctacacattacggaataaggaggtcaaaaaggctgtgctcaagctccgggataaagttgctcacccgcagaggaaatag

SEQ ID NO: 28212 - DNA, 936 bp, Artificial Sequence
  Description of Artificial Sequence: Synthetic coding sequence
atgtctaatgctacactcctgacagccttcatactgactggcctgcctcacgctccaggcctggacgcaccgctgttcggaatctttctggtcgtttatgttctgaccgtcttgggtaatttactcattctgttagtaatacgagtggacagtcatctgcatacccccatgtactattttttgactaacctctctttcatcgacatgtggttcagtaccgttacagtaccaaagatgctgatgactctggtgtccccctcaggccgtaccataagcttccatagctgcgtagcacaattatacttctttcactttctgggctctactgaatgcttcctatacactgtgatgagctatgataggtatctggcgatctcttatcctctgcgatatacaaatatgatgacaggcaggagctgcgccctgctggccaccgggacatggttgtctggtagcctgcatagtgctgttcagacgattctgacgtttcatctcccctactgcggcccaaaccagattcagcactacttctgtgatgctccaccaatcttgaaacttgcttgcgccgacaccagcgcaaatgagatggtgatctttgtgaatatcgggctagtagcctcaggctgtttcgttctcatcgtgctgtcctacgtttctatcgtgtgcagtatcctgaggattcggacttcagagggacgccaccgggcattccagacttgcgcatcccattgcatcgtggttttgtgtttctttggccctgggctatttatctaccttcgacccggtagccgggatgctctccacggagtcgtcgcggttttttacaccactttgactcctttgtttaaccccgttgtgtacacgctaaggaacaaggaagttaaaaaggctcttctgaaacttaagaacggcagcgtcttcgcccagggagagtag

SEQ ID NO: 28213 - DNA, 936 bp, Artificial Sequence
  Description of Artificial Sequence: Synthetic coding sequence
atgagtaatgcttcacttctaacagcctttattcttatgggcctaccacatgccccagccctggacgcacccctgttcggggtgttcctcgtggtgtacgttcttactgtacttggaaatctgcttatacttcttgtcattagggtcgattctcatctgcacacaacaatgtactattttctcactaatctgagctttattgacatgtggtttagcactgtgactgtgccgaagctcttgatgaccttggtgtttccttccggacgcgcgattagtttccacagttgcatggcccagctatacttctttcatttcctgggcggcaccgagtgtttcctgtatcgtgtgatgtcatgtgaccggtatctcgcaattagctatcccctacggtatacatctatgatgactgggagaagctgcaccttattggctacgtcaacatggcttagcggttccttacattccgctgtgcaagccattcttacgttccacttaccttactgtggcccaaattggatccagcattatttgtgtgatgctccaccaatactcaagttagcttgtgccgacactagtgctattgagaccgtcatcttcgtgaccgtaggaatcgtggcgtcaggctgctttgttttaatcgtgctgtcatatgttagtattgtctgcagtattctgcggatcagaactagcgagggtaagcatcgcgcattccagacctgtgcctcccattgcattgtcgtcctttgtttctttggcccaggactttttatctaccttagacctggttctcgcaaggcagtggatggcgtggtggctgtcttttatacggtgctcactccactacttaaccctgttgtgtacaccctcaggaacaaagaagtgaagaaggctcttcttaaacttaaagacaaggtggctcattctcagagtaagtag

SEQ ID NO: 28214 - DNA, 936 bp, Artificial Sequence
  Description of Artificial Sequence: Synthetic coding sequence
atgagtaagacctctctggtgacagccttcattctgaccggccttccgcatgccccaggactggatgcacccctgtttgggattttccttgtggtgtatgtgctgaccgttctgggcaacctcctgatcttgctggtcatccgcgtcgatagccatctgcatacccccatgtactacttcctgactaatctatctttcatagacatgtggtttagtacggtaaccgttccaaagatgctgatgaccctcgtgtcacctagcggtcgggcaatctcattccattcatgcgtagcgcagctttacttttttcacttcctaggaagcacggagtgcttcctctacaccgttatgagttatgataggtatctcgcgatctcctacccactccggtacacctctatgatgtccgggtcaagatgtgctctgctagcaacctctacgtggctgtccggatcactccatagcgctgtccaaaccatcctgacttttcacctcccctactgtggccctaaccagatccagcactacttatgtgatgcccctcctatcctgaagctggcctgtgcggatacaagtgcgaacgaaatggtgattttcgtagacattgggcttgtggcctctgggtgtttcttgctcatcgtactcagctacgtgtctatcgtgtgtagtatcctgaggatacacacaagtgaggggcgacatcgggctttccagacttgcgcaagccattgcatcgtcgtgttgtgcttttttgtgccctgcgtgttcatctaccttaggccagggtcccgagacgtcgtggacggcgtggtggctatcttctacactgtgttgacgcccctcttgaatcccgtggtctatacccttagaaacaaagaggttaaaaaggccgtattaaaattgagggacaaggtggctcacagccaaggtgaatag

SEQ ID NO: 28215 - DNA, 957 bp, Artificial Sequence
  Description of Artificial Sequence: Synthetic coding sequence
atgcaacgggcaaatcattccactgtgactcaattcatcctggtgggcttctctgtgtttcctcacctgcaactgatgctgtttttgctgttcctcctgatgtatctttttactctgctgggaaaccttttgatcatggcaacagtgtggtctgagaggtctctgcacacacctatgtacctgtttctttgcgccctcagcgtgtccgagattctctataccgtcgccattatcccaagaatgttggctgatctgctatccacacagagaagtattgcgttcctagcttgtgcctcacagatgtttttcagcttctcctttggcttcacacactccttcctcttaacagtgatgggttacgataggtacgtggcaatttgtcaccctctccgatacaatgtgttgatgtccccgaggggctgtgcttgtctcgtcggttgtagttgggctggcgggttagtcatgggtatggtggtgacctctgcaattttccatctagccttctgtggtcataaagaaattcatcactttgcctgtcacgtgcctcctctcttgaaactcgcatgtggcgacgacgttctggtggtagccaagggcgttgggctggtgtgtatcaccgcgttactcgggtgtttcttgttgatcttgttgagttacgcatttatcgtagccgccatcctcaaaattccctccgctgaaggaagaaataaagcattctctacctgtgcatcccaccttaccgtggttgtggtgcactacgggtttgccagtgtgatttatcttaagcccaagtccccgcagtccttggagggcgatacattgatgggcatcacctataccgttctaactccattcttaagccccattatcttctctctaagaaacaaggaattgaaggtcgcaatgaaaaagacttttttttctaagctgtacccagagaagaatgtgatgatgtag

SEQ ID NO: 28216 - DNA, 948 bp, Artificial Sequence
  Description of Artificial Sequence: Synthetic coding sequence
atgctgggtctcaatcacacaagtatgagcgagttcatcctcgtgggattctccgccttccctcatctgcagcttatgcttttcctgttgtttctgctgatgtatctctttacgctgcttggaaacctactgatcatggcaaccgtgtggtctgagaggtcattacacactcctatgtatctatttctttgcgttctgagcgtgtccgaaattttatacacagttgcgatcatcccccgtatgctggctgatttgctttccacacagcgcagcattgccttcctggcttgtgcctcacagatgtttttttccttctcctttggcttcacccactctttcttacttaccgttatgggatatgatcgctatgtggcaatctgccatcccttgcgctataacgtactcatgagcccacgcgggtgtgcctgtcttgtgggctgctcttgggccggggggagcgtgatgggtatggtggtgacttcagctatcttccagctgacgttttgcggttcccatgagatacagcactttttgtgccacgttcctcccctgctcaagctcgcctgcggcaacaatgtgcccgccgtcgctctgggggtgggtcttgtatgcattatggctctcctggggtgttttctgctaatccttctgtcctacgcctttattgtcgccgatattctgaagatcccttcagctgaaggacggaacaaggcctttagcacatgcgcgtctcatctcatcgtagtgattgtgcactatggatttgcatctgtgatctacctgaaacccaaaggaccccatagccaggaaggagataccctgatggccaccacctatgccgtccttacaccttttctttcccctatcatttttagcttgaggaacaaagaacttaaggtggctatgaaacggacctttctgagcacactgtattcctcggggacctag

SEQ ID NO: 28217 - DNA, 951 bp, Artificial Sequence
  Description of Artificial Sequence: Synthetic coding sequence
atgccagggcagaattatcgtacaattagcgagtttatactgtctggattctctgcgttcccacagcaactgctgcctgtgttatttcttctttatctcttaatgtttcttttcacattgctgggtaacttactgattatggcaacagtgtggatcgagcgacggctgcacacacctatgtatctctttctctgtgctctgagcatcagcgaaatcttgtttaccgtggctattacgccccgcatgctagctgacctgctttttactcacagatccattaccttcgtggcttgcgctattcaaatgttcttttccttcatgtttggtttcacccactccttcctcctgatggtgatgggctacgatcactatgtgacgatttgtcaccccctgcactataacatgctgatgagccctagaggctgcgctcatctcgtggcctggacctgggccggcggaagtgtgatgggaatgatggtgaccatgatggtgttccacctcaccttttgcggatcaaatgtgattcatcactttctttgtcatgtacttagcttactgaaactggcctgcggatccaaaaccagctcagtgatcatgggcgtgatgctggtgtgcgtgacagcactgattggctgcctgttcttgatcattttgagttttgtgtttatcgttgccgcgatccttcgaatcccctctgccgaaggacgacacaagaccttctccacctgcgtgtcacacctgaccgtggtggtgatgcattacagcttcgcaagtctgatctacctgaaaccaaaagggctccattcaatgtactccgacgcccttatggctactacgtacactgtgttcacaccattcctctcaccgatcatcttcagcttacgcaacaaggagctgaaaaatgctataaacaaaaacttctgcaggcgcttctgtccgctctcgagctag

SEQ ID NO: 28218 - DNA, 951 bp, Artificial Sequence
  Description of Artificial Sequence: Synthetic coding sequence
atgccgagtcagaattatagtatcatatctgagttcaatctcttcggcttcagcgcgtttccccagcaccttttgcctatcctgttcctgctgtacttattgatgtttctgttcacattgctgggcaacctgcttattatggccactatttggatcgaacacagactgcacaccccgatgtatttgttcctctgcactctttccgtgtccgagatcctcttcacagtggccatcactccacgcatgttggccgacctgctgtcaactcaccactctatcacttttgtggcctgtgctaaccaaatgttttttagcttcatgttcggctttacccatagtttcctgttattggttatgggctacgacaggtacgtcgccatatgccaccccctccggtacaatgtgcttatgagtccccgtgactgcgcacatctggtcgcctgcacttgggctgggggcagtgttatgggtatgatggttaccacaatagtatttcaccttacattttgtggcagtaatgtcattcatcatttcttttgccatgtgctgtcgctactgaagcttgcgtgtgagaacaaaactagctccgtcattatgggcgtgatgctcgtatgcgtgacagcactcatcggttgcctgttcctgattatactgtcttacgtgtttatcgtcgcagccattcttagaataccatccgccgaagggcgccacaagacattctccacttgcgtttctcacctcaccgttgtagtgacccactactcatttgccagtttcatctacctgaagcccaaaggactccatagtatgtattcagacgcactgatggccactacgtacaccgtcttcacgcctttcctgagtccaataatctttagtcttaggaataaggagctgaaaaatgccatcaataaaaacttctatagaaaattttgccccccgagcagctag

SEQ ID NO: 28219 - DNA, 948 bp, Artificial Sequence
  Description of Artificial Sequence: Synthetic coding sequence
atgcaaggtctcaaccatacctccgtgagcgagttcatcctcgtagggttctcagcatttccacacctccagctgatgctgtttctcctgttcttgctgatgtatctgttcactttgctcgggaatctgctgattatggctactgtttggtcagagcgctctctccatatgccaatgtatctgtttctttgcgctctgtcaataacggagatactgtacactgtggccatcatcccaaggatgctcgctgacttgctgtccactcagaggtcaatagccttcctcgcctgcgcttctcaaatgttcttcagcttctcgtttggattcacccactcatttctactgacagtcatggggtacgacagatacgtcgctatttgccacccgctgagatataacgtactgatgagcctgaggggatgtacatgccgggtgggctgctcgtgggcaggagggctagttatgggaatggttgtcacatcagccatctttcaccttgcattctgtggtcataaggagatccatcatttcttttgtcacgtgcctcctctgttaaagctggcttgcggggatgacgtgcttgtggtcgctaaaggggtcggtctcgtctgcattactgctcttctcgggtgcttcctcctaatcctattgagctacgcattcattgtggcggccatactgaaaatcccaagcgctgagggcaggaacaaggcattttcaacctgtgcctcccacctgacagtcgttgtggtccactatgggtttgcatcagtgatctacctcaaaccaaagggaccccaatcacctgaaggcgataccttaatgggcatcacatacacagtgctcacaccattcctctctcctataatcttttcactccgcaataaggagctgaaggttgcgatgaagaaaacatgttttaccaaactctttcctcagaactgctag

SEQ ID NO: 28220 - DNA, 963 bp, Artificial Sequence
  Description of Artificial Sequence: Synthetic coding sequence
atgctcctgtgcttcagatttggaaaccaaagtatgaagcgggaaaatttcacactgatcacagacttcgtgttccaggggttcagcagcttccacgagcagcagattacccttttcggcgtgttccttgcattgtatattctgaccctagcaggtaacataattattgttactatcatcaggatggaccttcatttgcacaccccaatgtatttctttctctccatgctttcaacttctgaaacagtgtatacccttgtcattctgcctagaatgttaagcagtctagtcggtatgtctcagcccatttctctggctgggtgcgccactcaaatgttcttctttgtcacttttgggattaccaactgctttttgcttactgccatggggtacgatcggtatgtcgcgatctgcaaccccttacgctatatggtgattatgaacaagaggttacgcattcagctggtgcttggggcttgcagcatcggattgatagtcgccatcacccaggtaacctccgtgttccggctgcctttctgtgcccgcaaggtcccccatttcttttgcgatatccggcctgttatgaagctgtcatgcattgatacaaccgtgaatgaaattctgacccttattatcagtgttctggtactggttgtgcccatgggtctggtctttatctcctacgttcttataattagtactattctgaagatcgcctctgtggaagggaggaaaaaggctttcgcgacttgcgctagccatctaacagtagtcattgtacactatagctgtgcaagtattgcatacctgaaacctaagtccgaaaataccagggagcacgatcaactaatttctgtgacctataccgtgataacacccctgctcaatcccgttgtttataccctgagaaacaaagaggtcaaagatgccttatgccgagctgtgggcggcaagtttagctag

SEQ ID NO: 28221 - DNA, 990 bp, Artificial Sequence
  Description of Artificial Sequence: Synthetic coding sequence
atgcctaagcttaactccactttcgtaacggagttcctgtttgaaggtttctccagttttcgacggcaacacaagcttgtgttctttgtcgtgtttctgacactttatctcctcacgctatccggtaatgtgattattatgacaattattcgcctcgatcaccacctgcacacgcccatgtattttttcctgtgcatgctgtcgatatcagagacctgttacacagtggcgatcatccctcatatgctctcaggccttctgaacccacaccagcctatagcaactcagagctgtgccacccagttgtttttttacctcacctttggcattaacaattgcttcctcctaacggtgatgggctacgatagatatgtagctatctgtaacccgctgcgctacagtgttattatgggcaagagagcatgtatccaactcgccagtggttccctcgggataggcctcggaatggcgattgtacaggttacatcagtgttcggcctgcctttctgtgacgcttttgtgatctctcatttcttttgcgacgtgaggcaccttctcaaactggcctgtacagacacaactgtgaacgagataataaacttcgttgtctccgtctgcgtcttggtattgccaatgggcctggtattcatttcatatgtgcttataatctctacaatcttgaagattgcctccgccgaaggccagaagaaggccttcgcaacctgtgcctcgcacttaacagtcgtgatcatccactacggctgtgcgtcaatcatatacttgaaaccaaaatctcaatcaagcctgggacaagatcgcttaattagtgtgacatacacgcatcactccccaactgagccctgttgcgtccagcccgaagaacagggcggccaaaggtgttccgcacaaagcaggggagccaaaaattctgtttcccttatgaaacggggatgcgaaggcttctcgtttgcctttataaacatgtattag

SEQ ID NO: 28222 - DNA, 930 bp, Artificial Sequence
  Description of Artificial Sequence: Synthetic coding sequence
atgaaacggaagaatttcacggaagtttctgaatttatttttttgggattcagctcctttgggaaacatcagatcacacttttcgtggtatttcttaccgtttatattctcacattggtcgccaacattattatcgtgaccatcatctgcatcgaccaccacctccataccccaatgtactttttcctaagtatgctggcatcgagcgagaccgtgtatacactcgtgatcgttcccagaatgctcctgtccttaatcttccacaatcagcccatctcactggcaggatgcgccacccagatgtttttctttgtgattctcgccactaataactgttttcttctgactgctatgggatatgacaggtacgtcgcaatttgtcgcccactgcgctacaccgttataatgtccaagggtttgtgcgcccaactggtgtgcgggtccttcgggattgggttgacaatggccgtccttcatgtgacagctatgttcaacctccccttctgcgggactgtagtggatcactttttttgtgatatataccctgtcatgaaattgagttgcatcgacactactatcaacgagatcatcaactatggcgtgtcatcatttgtgatctttgtccctattggacttatcttcatctcctacgtgttggtcatttcctctatcttgcagatcgccagtgctgagggccgcaagaagacatttgccacttgtgtgagccatttaacggttgtgattgtgcactgcggatgtgcatctattgcgtatttgaagcccaagagcgaaagtagcatcgagaaggacctggtgctgtctgtgacgtataccatcattacaccccttctgaatcctgtcgtttatagcctaaggaataaagaggtcaaagatgcgctgtgcagggtagtgggtcggaacatctcatag

SEQ ID NO: 28223 - DNA, 942 bp, Artificial Sequence
  Description of Artificial Sequence: Synthetic coding sequence
atggaacaggttaacaagacagtagtgcgggaatttgtggtgctcgggtttagctccctcgctcggctgcagcaattactgttcgtgatcttcctgcttctgtacctgttcacactgggtaccaatgccataatcatatccaccatcgtgctggacagggcactgcacaccccaatgtactttttcctggcgatactcagctgcagcgagatctgctacacatttgtcatcgtgccaaagatgttagtggacctgctgtcccagaagaaaacaatcagttttctgggctgcgcaattcagatgttcagctttctattctttggatcctctcactcatttctgctcgccgctatgggctatgataggtacatggctatctgcaacccactccgctactcagtcctgatgggccacggcgtgtgtatgggtttgatggccgcggcctgcgcttgtggttttacagtgagcctggtcacaacgtcattagtcttccaccttcccttccattcctctaaccagctccaccactttttttgtgacatcagcccagttctgaaactggcaagccaacactctggattcagccaactggtaatcttcatgcttggcgtctttgcattggttatacctttgctactgattcttgtaagctatatcagaattatttccgcgatcttaaaaatcccatcttccgttgggcgatacaaaaccttctctacatgtgcatcacaccttattgtggtcaccgtgcactactcctgtgcaagctttatctatctgcgcccgaagaccaactatacctcatctcaggatacactgatcagcgtctcctacaccatcctgactcccttgttcaatccaatgatctactctttgagaaataaggagtttaagtccgccttgcgtaggaccattggtcagactttctatcctctgtcgtag

SEQ ID NO: 28224 - DNA, 939 bp, Artificial Sequence
  Description of Artificial Sequence: Synthetic coding sequence
atggaacgtgtgaacgagacagttgtcagagaggtgatcttcttgggattctcatccctggcacgcctgcagcaattgctttttgtcatcttcctcctgctctatctgtttactctcggcaccaatgccattattataagtactatcgtactggacagagccctgcatatacctatgtattttttcttggctatactgtcttgtagtgagatctgttacacttttattatcgtccccaaaatgctggtcgatctcttgtctcagaagaaaactatttcttttctgggatgcgctattcaaatgtttagttttctctttctgggatgctcacacagtttcttgctggcagtcatgggttatgaccggtacattgccatttgtaatcccttgcggtacagcgtgctgatgggccacggtgtgtgcatgggcttggtagcagcagcttgcgcctgtgggttcactgtggcacagatcattacatcactggtttttcacctccccttctactcgtctaatcagctgcatcacttcttctgcgacatagcccctgttctgaagctcgcctcccaccacaaccatttttctcaaatcgtgatcttcatgctctgtacactggtactggccatccccctgctcctgatcttagtgtcgtatgtccacatactcagtgctattctgcaattcccgtcaacactgggccgatgtaaggccttttcaacgtgtgtgagccatttaatcatcgtgactgtgcactacggttgcgccagctttatatatctgagacctcagtcgaattactcatcttctcaagatgcactgatttcagtgtcttatacaataataactccattgttcaatcccatgatctactcattaagaaacaaggaatttaagtccgccctttgcaagattgtccgacgcaccatttctctcctttag

SEQ ID NO: 28225 - DNA, 942 bp, Artificial Sequence
  Description of Artificial Sequence: Synthetic coding sequence
atggccggtgaaaaccacaccacgctgcctgagtttctcctcctcggctttagtgacttgaaggcactgcaggggccattattctgggtagtgctgctggtgtacttggttacactactcggcaatagccttatcatcctgttaacccaggtgtcacccgccctccattcaccaatgtatttttttctgcgacagctgtctgtagttgaactgttctataccaccgacatcgtgccccgaactttggccaatttaggttccccacacccccaagcgatttcattccaggggtgtgctgcccaaatgtatgtgtttatagtgctcggaataagcgagtgttgcctgttgactgccatggcatacgatagatacgtggccatctgccagcccttgcgctacagcaccctgttatcccctcgggcctgcatggccatggtcgggacttcatggttgaccggaataatcaccgccaccacgcacgcaagcctgattttcagccttccttttcgcagtcaccccatcattccacacttcctctgcgacatcttacctgtcctccgcctcgctagcgctgggaagcatcgatctgagattagcgtcatgacagcaaccatagtgttcatcatgatacctttctctcttatagtaacgtcttatatccgtatcctgggcgctattttggcaatggcttctacacagtcacgcagaaaagtgtttagtacatgctcctcccacctgctggtcgtctccctgttttttggtacagcatcaatcacctatatcaggccccaggctggcagctccgtgaccacggatcgtgttttgagccttttctatactgttattaccccaatgctgaatccgataatatataccttgcggaataaagatgttagaagggccttaagacacctggtgaaaaggcagcgaccctcaccctag

SEQ ID NO: 28226 - DNA, 960 bp, Artificial Sequence
  Description of Artificial Sequence: Synthetic coding sequence
atgcccgtcggtaaattggtgttcaatcaatcagaaccgactgaattcgtgtttcgagcatttaccaccgcgaccgagtttcaagtgctgctgttcctcctctttcttttgttgtacttgatgatcctgtgcggcaacacagcaatcatctgggtggtatgtacacattccactctccggacacctatgtacttttttctatctaatctgtcgttcttagaattgtgctacaccactgtggttgtccccctgatgctctccaatatcttgggcgctcagaagccaatcagcctggctggctgcggagcccaaatgttctttttcgtcactctcgggagtaccgactgtttccttttggccataatggcttacgataggtacgtggctatatgtcaccccctccactatacactgatcatgacgcgggaactctgtacgcagatgctgggtggggcgctgggcttggctttgttcccttctcttcaacttaccgcactcatttttacgctgccattttgtggacatcatcaagaaatcaaccacttcttgtgcgatgtgccaccagtgctcaggttagcttgtgccgacattcgggtccaccaagccgttctctatgtagtgagcatcctggtgctgaccataccttttctgctgatatgcgtgagttatgtattcatcacttgcgcaatcctgagcataaggtccgcggagggccgcaggagggccttctccacttgcagttttcatctgacagtggtccttctccagtacggctgttgttccctggtctatttgcgtccgcgcagctctacttccgaagatgaagattcacagatcgcgctggtttacacattcgtcacacccctgttaaaccctctgctctactcgcttaggaacaaggacgtgaagggagcgttaagatccgccataatcaggaaggccgcaagcgacgctaattag

SEQ ID NO: 28227 - DNA, 1008 bp, Artificial Sequence
  Description of Artificial Sequence: Synthetic coding sequence
atgccacaaatccttatatttacctacttaaacatgttctacttctttccccccctccagatcctcgccgagaacttaacgatggtcacagaattcctcctgcttggtttttcgtctctcggggagatacagctcgccctgttcgtggtgtttttatttctttatttggtgattctctcgggtaatgtgacgattatcagtgtcattcatctggataaaagcctacatacccccatgtatttcttcctggggattctcagcacgagcgaaacgttctacaccttcgtcatcttacctaagatgctgataaacctcctttcggttgcccgaacgatatctttcaattgttgcgccctgcaaatgtttttttttctaggtttcgctatcacaaactgcctgctgctgggtgtcatgggctacgaccggtatgccgcaatctgccaccctctccactaccctaccttgatgtcctggcaggtttgtggcaaactagccgcagcgtgtgctatcggcggatttctggcatcattgactgtggtcaacctcgtgttttccctgccattttgttctgcaaataaagtgaaccactacttctgtgacataagcgcagtgattctactggcctgcacgaatactgatgtcaatgagttcgtaatcttcatttgcggcgttctggtgcttgtcgtgccattcctttttatatgcgtatcttacttgtgcatcttaagaaccatactcaagatcccaagcgcagaaggccgcagaaaggccttcagtacctgcgcttcccacctgagcgtggtgatcgtccactatggttgcgctagctttatatatctccggcccactgcgaattacgtgtcgaataaggacagactagtgacagtcacatacaccattgtcactcccttgttgaatcctatggtgtattctctgagaaataaagatgtacagcttgcgatccggaaggtgctggggaagaaggggagcctcaaactgtataattag

SEQ ID NO: 28228 - DNA, 996 bp, Artificial Sequence
  Description of Artificial Sequence: Synthetic coding sequence
atgacctcccggagtgtttgcgaaaaaatgacaatgacaaccgagaaccccaaccagaccgtagtctctcacttttttctggagggacttagatatactgccaaacactctagtctattcttcttacttttccttctcatttattccattactgtcgctggtaatctattgatactgctgaccgtcgggagtgattctcatctgtctttgccaatgtaccactttctcggacacttgagttttctcgatgcttgtctcagcacagttaccgtgcctaaggtcatggcagggttgctaacattagacgggaaggtgatatccttcgagggatgtgcagtccagttatattgtttccactttctggcatccaccgaatgttttttgtacactgtgatggcctatgatcgatacttggcaatttgccagcccctccattatcccgtcgcaatgaataggcggatgtgcgccgagatggcaggaatcacctgggccattggggccactcacgccgcgatccacacatctctaacattccggctcctatattgtggtccttgccacatcgcctactttttctgcgatattcctcccgtccttaagttggcatgtaccgacactaccattaacgaactggtgatgctcgccagcatagggatcgtagccgcgggttgcttgatcctgatcgtgatttcgtatatcttcattgtggccgctgtactgaggattcggacagctcagggccgacagcgtgccttcagtccgtgtacagcccaattgaccggggtcctgctgtactacgtcccacctgtgtgtatctacctccaaccacggagctccgaggctggtgcgggagcgcccgcagtgttttacaccattgtcaccccaatgcttaatccattcatttataccttgcggaataaggaagtgaagcatgcacttcaacggttactgtgttcgtcctttcgagaatccactgccggctcaccaccaccatag

SEQ ID NO: 28229 - DNA, 945 bp, Artificial Sequence
  Description of Artificial Sequence: Synthetic coding sequence
atgcgcggattcaacaagacaaccgtggtgacccagtttattcttgttgggttctcgtcactgggtgaactacaactgttactgttcgtgatatttctgctcttgtatctgacaatactggtagcaaacgtgacaattatggccgtgattcgattttcctggacgctgcacacccccatgtatggctttctgtttattctaagcttctctgaatcttgttataccttcgtcattatcccacagctcctggtgcatctcctgtcggataccaaaactatatcatttatggcctgcgccacccagctctttttctttctcgggtttgcctgtacaaactgtctgctcatagcagtgatggggtatgaccggtacgtcgccatatgtcaccccctgagatacacactcattattaacaagcggttgggcctggagctgatttctctttcaggcgctacagggttcttcatcgctctggtcgctaccaaccttatttgtgatatgcgcttctgcggccccaatagggtcaatcactacttctgtgatatggctcctgtgatcaagctcgcctgcactgacacccacgttaaagaattagcccttttttcactaagcatcttggttattatggtcccattcctgctgatcctcattagttacggctttatcgtgaacaccattctcaagatccctagtgctgaagggaagaaggcattcgtgacatgtgcttcacacttaactgtagtcttcgtgcactacgggtgtgcctctattatttatcttaggcccaagtccaaatcagcaagcgacaaggatcagctcgtcgccgtgacttacactgtcgtgacccccttactcaatcctctagtgtactcattgcgcaataaggaggtgaagaccgccctcaaacgggtgctgggcatgcctgtagctaccaaaatgtcttag

SEQ ID NO: 28230 - DNA, 930 bp, Artificial Sequence
  Description of Artificial Sequence: Synthetic coding sequence
atggagggaatcaataaaaccgccaagatgcagttttttttcagaccgtttagtcccgacccagaggtgcagatgctgatcttcgttgtatttctgatgatgtatcttacaagtcttggcggtaatgctaccatcgcggtgatcgtgcagataaaccattctctgcacacgcccatgtacttttttttggcgaatctggcagtactcgaaatattctacacctctagtatcactccactcgccctggccaacttactgtcaatgggcaagaccccggttagcattaccggatgcgggactcagatgtttttctttgtgttcttaggcggagcggactgtgttctgctggtcgtcatggcttatgaccagttcatcgcgatctgtcatccattgaggtatcggcttatcatgtcatggagcttgtgtgtcgaacttctagtaggttcgttagtgctgggcttcctactgtccctacctctcacaatcctgatcttccatttacctttctgccataacgatgaaatttaccatttttactgtgatatgcccgccgtgatgcggctggcatgcgctgacacacgtgttcataagacagcactgtatataattagtttcatagtgctgagtattcccctatccttgatctctatctcctatgtctttattgttgttgctatcttgcgaattcgctcagcagaggggaggcagcaagcctatagcacgtgtagcagtcacatacttgttgtcttgctgcagtacggttgtaccagtttcatttacttatctccctcatcgtcctatagccctgaaatgggtagagtggtatccgttgcatacacgttcatcaccccaattctcaatcccctcatctattcacttcggaacaaggagctgaaggacgcactgcggaaagccctcaggaagttctag

SEQ ID NO: 28231 - DNA, 918 bp, Artificial Sequence
  Description of Artificial Sequence: Synthetic coding sequence
atggagtttgtctttctcgcttatccctcctgtccagagctgcatatactgagtttcctaggagtctccctggtgtacggattgattattactgggaatatcctgatagtagtaagtatccacacagaaacatgcttgtgtacctccatgtactattttcttgggagtctgagtggcatcgagatatgttacaccgccgtggtggtcccccacattctggccaacaccctgcagagtgaaaagactattactttgttgggctgcgcaacccagatggcattctttattgccctgggctcagctgactgtttcctgttggcggcgatggcctacgaccgttacgtggcaatctgtcaccccttgcagtaccctcttctgatgacactgactctgtgtgttcatcttgttgtcgcttcagtgatcagcggcctgttcctgtcacttcagctagtggcgtttattttctcactaccattctgccaggcacagggcatagagcatttcttctgcgacgttcccccggtcatgcacgtcgtttgtgcacaatcccatattcatgagcagagtgttctcgtggccgctattttggcaatcgccgtgcctttttttctcatcacgacaagttacacgttcatcgtggcagcacttctgaaaatacacagcgctgccggccggcacagggccttttctacttgctcaagtcatctgaccgttgtgctgcttcagtacggctgttgcgcattcatgtatttgtgcccaagttcaagctacaatccaaagcaggatcggttcatttctctggtatacactctaggcaccccactgcttaatccccttatctatgccctacggaatagtgagatgaagggcgcagtgggacgggtgctgactcgcaattgcctgagccagaacagctag

SEQ ID NO: 28232 - DNA, 981 bp, Artificial Sequence
  Description of Artificial Sequence: Synthetic coding sequence
atggtgctgaatgtctactgctgcttctttcagatctcagatatccaaacaatgaagattaaccagaccatccttaaagagtttattctggttggcttttcagtctatccgcatgtgcaaacgtttctctttgtggtgttcttctgcctgtacctactcaccctggccggaaacttgatcatcatgggactgacatgggtcgataggagccttcacacccctatgtacttattcctcagcgctctgtcattctctgaaacctgttatacgctgaccatcgtgcccaagatgttagaggacctgttggcaaaggaccgatccatttcagtcaccgggtgcagcttgcaaatgtgtttctttctggggctgggcggtacgaattgcatcatcctgacacttatggggtatgataggtttttggctatttgcaatcctctgaggtatcctttgctgatgactaatatcgtgtgcgggcagctggttgctagcgcttgcacagctggatttttcatttctttgacggagaccgccttgatttttcgcgattcattctgtcggccaaatttggttaagcacttcttttgtcatatgctcgccgtcataagactgagttgcattgatagtaaccacacggagttcatcatcacgctgatctccgtgagtgggctgctggggaccctcttgctgataattctgaccgacgtgttcatcattagtactgtccttcgaatcccttctgcagagggtaagcagaaagcttttacaacatgtgcgtctcatctgacagtcgtcattatccatttcggatttgctagcatcgtgtatttgaagccagaggcctcgggagacgacacactgatcgccgtgccatataccgttattactcctttcctgtcccccataatcttctctctacgtaacaaagacatgaaaaatgcgttccggcggatgatggggaataccgttgctctgaaaaaatag

SEQ ID NO: 28233 - DNA, 942 bp, Artificial Sequence
  Description of Artificial Sequence: Synthetic coding sequence
atgggacaaaccaacgtaactagttggagggatttcgtctttcttggattcagcagctctggcgaactccaacttctgctgtttgcactcttcctttcattatacctggtgacactcacttctaacgtgttcataatcatcgcgattcgtctggacagccacctgcatacacccatgtacttgttcctgtccttcctgtcattcagtgaaacctgctacacactgggaattatccctagaatgctgagcggcctcgcaggaggcgatcaggcaatctcttacgtcggatgtgccgctcaaatgttcttcagcgcctcttgggcatgtaccaactgcttcctgctggctgcgatggggttcgaccggtatgttgcaatctgtgcccccctgcactatgcaagccacatgaatcctacactgtgcgctcagctcgtgatcacctcctttctcaccggatatctgttcggcctaggtatgaccctggtaatattccatctgtcattctgttcgtcacatgaaatacagcactttttctgtgataccccccctgttctcagtttagcttgtggggacacaggccctagtgaactgcgcattttcatcctgagcctcctggtgctactggtgtcgttctttttcattacaatttcttatgcttacatcctcgctgcaatcctacggataccatcagccgagggtcagaagaaagcattctctacttgtgccagtcacctgactgtggtgataattcactacggctgtgcttcgttcgtctatctgcggccaaaggcttcctacagcttggagcgagatcagctgatcgccatgacatacactgtggtcacccctcttctgaacccgatcgtctatagccttcgtaatagagccattcaaacagccttacgcaatgccttccgggggcgtctgctcggcaagggctag

SEQ ID NO: 28234 - DNA, 39 bp, Artificial Sequence
  Description of Artificial Sequence: Synthetic coding sequence
gtcactccgcaaaagcttagtttctgctcaagccattag

SEQ ID NO: 28235 - DNA, 948 bp, Artificial Sequence
  Description of Artificial Sequence: Synthetic coding sequence
atggagattgtcagcacgggcaatgagacaatcaccgaatttgtgttactcgggttctatgacatccctgagctgcactttttgttctttatcgtattcacagctgtgtatgtttttattatcattgggaacatgctgataattgtggccgtagtgtctagccagagattgcataagcctatgtacatctttctagctaacctttctttcctggacatcctctacacctctgcagtcatgcccaagatgctggaggggttcctgcaagaggcgacaattagtgtcgctggatgcctgcttcaattttttatattcggatccctggccacggccgagtgtctgctgctggccgtcatggcctacgaccgatatctggctatatgttacccattgcactatcctttgctcatggggcctcgaagatacatgggtctggtggttactacgtggctgtcaggttttgtagtcgacggattggtcgtggcattggtcgcccagcttaggttctgcgggcccaatcacatcgaccagttctattgcgattttatgcttttcgttggactggcttgctccgacccacgcgtggcacaggttaccactttgatcctgtccgttttctgccttacaatcccttttggattaattcttacgtcctatgctcggatcgtggtagctgtactgagagtgcctgctggcgcctctcgtagaagggcttttagcacgtgtagctcacacctggcagttgtgacaacattttacggcaccctgatgatcttttacgttgccccgagcgctgtacacagtcagctcttgtccaaagtttttagcctgctctacactgtggtgacaccactcttcaatcccgtaatctatacaatgcggaataaggaagtgcaccaggcattgagaaagattctgtgtatcaaacagaccgagacactggactag

SEQ ID NO: 28236 - DNA, 948 bp, Artificial Sequence
  Description of Artificial Sequence: Synthetic coding sequence
atggagatagtcagcaccggcaacgagacaataaccgaattcgtactgttgggcttctacgatatccctgagctgcatttcctgttctttatagttttcaccgctgtctatgtctttattatcataggaaatatgcttatcatcgtggccgtggtgtcctctcaacggctgcacaagccaatgtacatattcctcgcaaatctatccttcctggatattctttacaccagcgccgtgatgcccaaaatgctcgagggcttcctccaggaagctactatcagtgtcgctggatgcctgctgcagttcttcatcttcggctcccttgctaccgcggaatgtttactcctcgccgttatggcctatgaccggtaccttgccatatgctaccctctacactacccattgctgatggggccgcgaagatacatggggctcgtggtgacgacctggctgagcggatttgttgtagacggcctggtggtcgccctggtcgcccagctgcgtttttgcgggcctaaccatattgatcagttctattgtgattttatgttgtttgttggcctggcttgctcagatccacgcgtggctcaagtgaccaccctgattctcagcgtgttttgtctgaccatacccttcgggctcattctgacaagctatgcaaggatcgtggttgcggttctgcgggtgccagccggcgcctctcgacggcgggcctttagtacatgttcctcacacctggccgtggtaactacattttacggaaccctaatgatcttttatgtagctccatcagccgtccactctcaactcctgtcaaaggtgttcagtctcctgtataccgttgtcacacccctgtttaacccagtgatatacactatgcgtaataaggaagttcaccaagcccttcggaaaattctttgtatcaaacagaccgagactttagattag

SEQ ID NO: 28237 - DNA, 948 bp, Artificial Sequence
  Description of Artificial Sequence: Synthetic coding sequence
atggagattgtgtcaactgggaatgaaaccatcactgaatttgtgcttctggggttctatgacattcctgagctgcacttcctgtttttcattgtctttacagccgtttatgtgtttatcattatcggcaacatgctgatcattgtggctgtggtgagctcgcagcggcttcacaaaccgatgtacatcttcttggctaacctctccttcttggacatcctgtatacttccgccgtgatgcccaaaatgctcgagggattcctgcaagaagccaccatctccgtcgccggttgccttctccaatttttcatttttggatccctcgcaactgccgagtgtctgttgctggcggtaatggcctatgacaggtatctcgccatttgttaccccctacactatcccctgttgatgggcccacgccgttacatgggtttggtcgtgacaacctggttgtctggatttgtggtggatggcctcgtggtggccctggttgctcaattacgattctgcggacccaatcacattgatcaattttactgtgacttcatgctctttgtgggactggcctgcagcgacccccgcgtagcacaggtaactactctgattctcagcgtgttctgcttgacgattccgtttggccttattttaacctcctacgccaggattgtggtcgccgtgctccgagtacctgcaggggcctcacgcagacgggctttttcaacttgttccagccatctggcggtagtgaccaccttttacggtaccttgatgattttttacgtcgcccccagcgcggtacacagtcagctgctctctaaagtgtttagtctcctgtatacagtggtcacccccctgttcaatccagtgatttacacaatgagaaataaggaggtccaccaggctctgcgcaaaattctctgtatcaagcaaaccgaaaccctggattag

SEQ ID NO: 28238 - DNA, 948 bp, Artificial Sequence
  Description of Artificial Sequence: Synthetic coding sequence
atggagatcgtgagcaccgggaatgagaccatcacagagttcgtcttgctcgggttctatgatatccctgagctacattttttattcttcatagttttcactgccgtgtacgtgtttatcatcatcggcaatatgttgataatagtggccgtcgtctcttctcagaggctgcacaagcccatgtatattttccttgccaatctctcctttttagacatcctctatacatccgcagtcatgccaaagatgcttgaggggttcttacaggaagccactatttcagttgccgggtgcttactccaattcttcatctttggaagcctggctaccgcagagtgtttgcttctcgctgtaatggcatacgatcgctaccttgctatctgttatcccctccactacccacttttgatggggcctcggaggtatatgggtttggtggtaaccacttggctgagtggctttgttgtagacggactggtcgttgcactggttgcccagcttcggttttgtgggcctaaccatatcgatcagttttactgcgacttcatgctgtttgttggactggcttgcagtgatccaagagttgcacaggttactaccctgatcctgtccgtgttctgcctgaccataccgttcggactcattctcacatcctacgcccgtatcgtcgtcgccgtcctgcgcgttccagcgggggcatcgcgccgccgagcgttttcaacatgcagctctcacttagctgtcgtgactacattctatggcacactaatgattttttatgttgccccttcagcagtccattctcaactcttgtcaaaggtgttcagtcttctgtacactgtagttactccgttgtttaacccagtgatttacacaatgcggaataaagaggttcaccaggcactccggaaaattttgtgcattaaacaaacggagaccctcgactag

SEQ ID NO: 28239 - DNA, 948 bp, Artificial Sequence
  Description of Artificial Sequence: Synthetic coding sequence
atggagatcgtgtccacaggcaatgagacgattacggaattcgttctgttggggttctacgacattcccgagctgcatttccttttcttcatcgtgttcaccgcagtgtacgtctttatcataattgggaatatgctcataatcgtagcggtggtctccagtcagaggctgcataagcctatgtacatcttcttagctaacctgagctttctcgatatcctctacacaagcgccgtgatgccaaagatgctggaaggatttttgcaggaagcaaccatcagtgtggccggctgtcttttacagtttttcatttttggaagtctggctactgccgagtgtctgctgctcgccgtgatggcttatgaccgctacctagccatctgttacccacttcattaccctctgctcatggggcctaggagatacatgggtctagtggtaacaacatggctttccggattcgtcgtcgacggactggtggtagcgctagtggcacagctcagattttgcggacccaaccacattgatcagttctactgtgactttatgttatttgttggcctggcttgttccgacccgcgggtcgcgcaagtgaccactcttattttatccgttttctgcttgaccatcccatttggcctcatcctgacctcttatgctcgcatcgtcgtcgccgtcttgcgtgtgcctgcaggcgcttctcggcgaagggcatttagcacttgctctagccatctggctgttgttaccaccttctatggcacattaatgattttttacgtggccccctctgctgtgcatagccagctacttagtaaggtattcagtctgctgtacacagtggtcacaccattatttaaccccgtgatttacacaatgagaaacaaggaggtgcaccaggcactgcgaaaaatcctgtgtatcaagcagacggagacactggactag

SEQ ID NO: 28240 - DNA, 948 bp, Artificial Sequence
  Description of Artificial Sequence: Synthetic coding sequence
atggagatcgtcagcaccggaaacgagacaatcactgagttcgtactcctgggtttttatgatattccggagctccacttcttgtttttcatcgtctttacagcagtatatgtgttcatcatcataggtaacatgctgattatcgtggccgtcgtctccagccagaggctacacaagcccatgtatatttttcttgcaaacctgagcttcttggacatcctttacacctctgccgttatgccaaaaatgttggaaggatttctgcaggaggccaccattagcgtggcgggatgtttgctccagttctttatcttcggcagcctcgcgactgcagagtgtctgctcttggctgttatggcctatgacagatacctggctatctgctatccactccactatcctctgctgatggggccacggcgctacatgggcttagtcgtgacaacttggctgtccggatttgtggtcgatgggctagtggtcgccctggtggcccagctgcgcttctgtggccccaaccacatcgaccagttttactgcgatttcatgctattcgtaggcttagcttgcagtgatccccgagtagcccaggtgacgaccttgatactctctgtgttttgtctaacaataccattcgggctgattcttactagctatgccagaatcgtggtcgcggtacttcgcgtgcccgccggcgccagtcgcagaagggccttctccacttgctcttcccacctggccgtggttaccacgttttatgggacacttatgattttttacgtggcaccctcagccgtgcactcccaactgctctcaaaagtcttttcattattgtacacagtcgtcaccccactgttcaacccagtgatctatacgatgcgcaacaaggaggtgcaccaagccctgagaaagatattatgcattaagcaaacggaaacactcgactag

SEQ ID NO: 28241 - DNA, 948 bp, Artificial Sequence
  Description of Artificial Sequence: Synthetic coding sequence
atggaaatcgtttcaactggaaatgagaccattaccgagttcgttctgctggggttctacgacatccccgagctgcacttcttgttctttattgtattcactgcagtgtacgtgttcatcatcatcggcaatatgcttatcatcgtagccgtcgtgagtagccaacgattacataaaccaatgtacatcttccttgccaatttatcatttttggatatcttgtataccagcgccgtgatgcccaaaatgttggaaggttttttacaggaagctaccatctctgttgctggatgtcttctccagttctttatctttggatcccttgcgaccgcagaatgccttctgctggcagtcatggcctatgatcggtatctcgcgatatgctatcctttgcactacccactgcttatgggcccccgtcggtatatgggactcgtcgtaacaacatggttgtccggatttgttgtcgatggcttggtcgtggcgctggtcgctcagttaagattttgtggaccaaatcacattgaccaattttattgtgattttatgctatttgtcgggctcgcttgctctgatccacgagtcgcccaggtgactaccctgattctgagcgtcttttgtctgaccatcccattcggtttaatcttaacatcttacgctcgaatcgtcgtagccgtcctgcgggtgccagcaggcgccagccgtaggagggcctttagtacttgtagttcccacctcgctgtggtgacgacattttatgggactttgatgatcttttatgtggccccttctgccgtgcattctcagctgctttccaaggtgttcagcctactgtacacggtggtgacacctctgttcaatccagtcatttatacgatgaggaataaagaagtgcaccaagcactgcgcaagatcctgtgtattaagcagaccgaaacattggactag

SEQ ID NO: 28242 - DNA, 948 bp, Artificial Sequence
  Description of Artificial Sequence: Synthetic coding sequence
atggagatcgtgagcactggtaatgagaccataacagagttcgtcctgctcggattttacgatatcccagaattgcacttcctgttttttatcgtgtttaccgccgtttacgtgttcatcataatcgggaacatgcttataattgtggcggtggtgagtagtcaacgcttgcataaacctatgtatatttttttggctaacctgtcattcttagacatcctgtacacctccgccgtgatgccgaagatgttggaggggtttctgcaggaggctacaattagcgtggcagggtgccttctccaattttttatctttgggtcccttgccactgccgagtgcctgctcttggccgtcatggcctacgatcgctatctagcaatctgctaccccctccattaccctctgttgatggggccacgaagatacatggggcttgtcgtcactacatggctgagcggatttgtcgtggacgggctggtggtcgctctggtggcgcagctcaggttctgcggtcccaaccacatcgaccaattttattgtgacttcatgctttttgtgggacttgcgtgtagcgatccacgagttgcccaggtgacaactctgatcctgtctgttttctgcctgactattccctttggattgatcttaacttcgtatgccaggatagtggtggcagtgctgagagtgccagccggggcaagcagaagaagagctttctcgacttgctcatctcatttggcggtggtcacaacattttacgggacactcatgattttctatgtggcaccatccgccgtgcactctcaattgctgtcaaaggtgttttccttattatacaccgtggtaaccccgctgtttaatccggtgatatacaccatgcggaacaaagaggtccaccaggccctgcggaaaattttatgtataaaacagacagagactctggactag

SEQ ID NO: 28243 - DNA, 948 bp, Artificial Sequence
  Description of Artificial Sequence: Synthetic coding sequence
atggagatagtttctacagggaacgaaactattaccgagtttgttctactcggattctacgatatccctgagctccattttctctttttcatcgtcttcactgcagtgtatgtatttattatcattggaaacatgctaatcatcgtggccgttgtaagcagccaacggctgcataagccaatgtacatcttccttgcaaacttatctttcttagatatcctgtataccagcgccgtgatgccaaaaatgctcgaaggcttcctgcaggaagcaactatctccgtggctggctgtttgctgcagttcttcattttcggaagcctggccactgcggagtgtctgcttttagcagtgatggcttacgacagatacctggccatttgctatcccttacattatccgctgttgatgggacctcgccggtacatggggctcgtggtgacaacatggctcagcggattcgttgtggatgggttggtggttgctctagttgctcagctgcgcttctgcgggcccaatcacattgatcagttctactgcgattttatgctgttcgtcgggttggcttgtagcgatccgagggtggcccaggttacaacgttgatacttagcgtgttttgtctgaccatacctttcggcttaatactgaccagctacgctcggatcgtcgtcgccgtgctgagggtcccagcgggggcctctcgcagacgtgctttttcgacttgttcttcccacctggccgtggtgacaacgttctatggaaccctgatgatcttttacgttgccccaagcgcagtgcactcccagctcctgtctaaggtttttagtttgctgtataccgtggtcactccgttgttcaatcctgtaatctacaccatgcgcaacaaggaggttcaccaggccttgcgcaagatcctttgtataaagcagacagaaacactggattag

SEQ ID NO: 28244 - DNA, 948 bp, Artificial Sequence
  Description of Artificial Sequence: Synthetic coding sequence
atggagatcgtaagcacaggcaacgagaccataacagagtttgttctgctcgggttttatgacatccctgaacttcactttttgttctttattgtctttactgcagtgtacgtctttatcatcattgggaacatgctcataatcgtcgcggtggtgagttctcagcggctccacaaacccatgtacattttcctggccaatctctctttcctggacatactatatacttcagccgttatgcctaaaatgttggaggggttccttcaggaggccacaatttccgtcgcggggtgccttctgcagttcttcatctttggatccctggcaacagcagaatgcttgctccttgccgtgatggcctacgacaggtacctcgctatatgctacccattacactaccccctgttaatgggccctcgacgctatatggggttagtcgtgacgacttggctctccggcttcgtcgtggacgggctcgtggtggctctcgtagcccagctgcggttctgtgggcctaaccatatcgatcagttttattgcgactttatgctgttcgtgggcctggcctgttccgatccaagagtcgcccaggtgacaaccctgattctctccgttttctgtcttaccatccctttcggtctgatcctgaccagttacgcccgcatcgtggtcgccgttctgcgtgttcccgccggtgcgtcgcgtcgacgtgcgtttagcacatgtagctcccatctggcggtcgtgacaaccttttatggaaccctcatgatattttacgtagcccctagtgcggtacactcacagctattgagcaaggtattttctctattgtacacagtagtgacgcctctgtttaaccctgttatatatacaatgaggaataaggaagttcaccaggcgctgcgcaagatcctatgcattaagcagactgaaacactcgactag

SEQ ID NO: 28245 - DNA, 948 bp, Artificial Sequence
  Description of Artificial Sequence: Synthetic coding sequence
atggagatcgtatctactgggaacgagaccatcacagagttcgtccttctaggtttctacgacatccccgaactgcatttcctgtttttcatagtattcacagcagtgtacgtattcatcatcatcggcaacatgctgatcatcgttgccgtggtgagcagccaacggctccataagcctatgtatattttcctggccaacctgtccttcctggacattctgtacaccagcgctgtcatgcctaagatgcttgagggtttccttcaggaagcgacgatctcagtggccggctgcctcctgcagtttttcatttttggcagccttgccactgccgaatgcctgctcttggccgtcatggcatatgacaggtatctggctatttgctaccccttacactaccccctgctaatgggtccccggcggtatatgggcctggtggtcacaacgtggttgagcgggttcgttgtagacggcctggttgtggcactcgtggcgcaactccgtttttgcggacccaatcacatcgatcagttttactgtgactttatgctttttgtgggcctggcatgctccgatcccagggttgcgcaggtcactacccttatcctgtccgtgttttgcctgaccatcccatttggactgatactcacctcttacgcaaggattgtcgttgcagtcctcagggtccccgccggggcatcacgcaggagggcattcagtacatgttcctcgcatctggccgtggtcacaactttttatggaacactaatgattttctacgtggccccatctgcagtacatagccagctgttgtctaaagtgtttagcttgctttacaccgtagttacacctcttttcaaccccgtaatttacactatgaggaacaaggaggtccaccaggctctccggaaaatcctgtgtatcaaacaaaccgagacccttgactag

SEQ ID NO: 28246 - DNA, 948 bp, Artificial Sequence
  Description of Artificial Sequence: Synthetic coding sequence
atggaaatcgtgagcaccggcaatgagacaattactgaattcgtgctgctgggtttctatgatatacctgagctgcactttctattttttatagtgttcaccgccgtgtacgtattcattataatcggcaacatgctgataattgtagcagtggtgagtagccagcgtttacataagccaatgtacatcttcctcgctaatctgtcgttcttagacatcctgtacactagtgccgtaatgccaaaaatgctggaaggatttcttcaggaggctacaatctcagtagccggctgccttctgcagttctttatttttggaagtctggccaccgcagaatgcttgttactcgcagttatggcctacgatcggtatctggccatctgttaccctctccactacccgcttctgatggggccccggagatacatgggtctggtggtaaccacatggctgagtggtttcgttgtcgacgggctggtagtggccctagttgcgcagctgaggttctgcggtccgaatcacatcgatcagttttactgtgactttatgctctttgttgggttggcctgcagtgacccccgggtcgcacaggtgaccactctgattctcagtgtgttctgtctaactataccgttcggactgatactgaccagctatgctaggattgtggtggctgtgctacgggtcccagcgggtgcttctcgacgccgggccttttcaacctgctcatcacatctcgccgtggtgacgactttttatggtacgctgatgattttctacgtggcaccaagtgccgtgcattcacaactcctgtcaaaggtattctctcttctctatactgtcgtcacaccactctttaaccccgtgatctataccatgcgcaataaagaggtccaccaagcactcaggaaaattttatgcattaaacagaccgagacattagactag

SEQ ID NO: 28247 - DNA, 948 bp, Artificial Sequence
  Description of Artificial Sequence: Synthetic coding sequence
atggagatcgtgagtaccggcaacgagaccataaccgaattcgttctgctgggtttttacgacattcccgagctccacttccttttcttcatcgtctttaccgctgtgtatgttttcataatcatcgggaacatgttgattatcgttgccgttgtttcctcacagcgtttgcataagcccatgtacatattcctcgccaacctgagctttctggatatcctctacacctccgctgtgatgcctaaaatgctcgaaggattcctccaggaggccaccatctccgtagccggatgtctgttgcagttctttatcttcgggtcgctagccacagcagagtgtctgctactggctgtaatggcctatgatcggtatctggctatctgttatccgttacattatcccttgctgatgggtcctagacgttatatgggtttagtggtgacaacatggctgtctggatttgtggttgatggcctagtggttgccttggttgcacagttacggttctgtggtcccaatcacatagaccagttctactgcgattttatgttgtttgtgggattagcatgtagcgacccacgagtggcccaggttaccaccctgatactgtctgtgttttgcctaactatcccttttgggcttattcttacgtcgtacgcacgcattgtggttgcggtcctccgcgtgcccgcgggtgccagccgtcgccgggcgtttagcacatgcagcagtcatctggccgtcgtcaccacgttctacgggacactcatgatattttacgtcgcgccctccgccgtgcactcccagctgctcagcaaggtgttctccctgttatacaccgtcgtaactccactcttcaatcctgtaatttatacgatgcgcaacaaagaagtgcatcaggccctgagaaaaatcttatgcattaagcagactgagacccttgactag

SEQ ID NO: 28248 - DNA, 948 bp, Artificial Sequence
  Description of Artificial Sequence: Synthetic coding sequence
atggaaattgtgagtacaggaaacgagacaatcactgagttcgtcctgctcggcttctacgacattcccgagctgcacttcttgtttttcatcgtgttcactgccgtctacgtttttataatcattgggaacatgctgattattgtggcagtggtatcttctcagcgactgcataaacccatgtacatttttctcgccaatctttcattcctcgacatactgtacaccagtgccgtaatgcctaagatgctagaggggtttttgcaagaagccacgatcagcgttgctggctgtctcctccaatttttcattttcgggtcactggcaacagctgagtgcctcctgctggcagttatggcctatgaccggtatctggccatttgttatcctttacattatccccttctcatgggaccaaggcggtacatgggcctcgtggtgactacgtggttgtctgggttcgtggtggacggcctcgtggtggccctcgtggcgcagttgcggttttgtggacctaaccacatcgaccagttctattgtgacttcatgctgttcgtgggtctggcttgctcagatccccgagtcgcccaggtgacaactcttatactcagtgtattttgcttaacaatcccttttggactgattctgacctcctatgcccggattgtggtcgctgtgctgcgggtgcctgccggggcatccaggagacgcgcttttagtacgtgttccagtcacctcgccgtcgtcaccactttctacgggactttgatgatcttttatgtggcccctagcgcggttcacagtcagttactgagcaaagtgtttagtctcctttacacagttgtaacgccactatttaatcctgtgatttacaccatgaggaataaggaggtgcaccaggcactgagaaaaatcctgtgcatcaagcagactgagaccttagactag

SEQ ID NO: 28249 - DNA, 948 bp, Artificial Sequence
  Description of Artificial Sequence: Synthetic coding sequence
atggaaatcgtgagtaccgggaacgagaccatcacagaattcgtgttgctggggttttacgacattcccgaactgcacttcctattttttattgtattcactgcggtgtacgtcttcatcataatcggtaacatgcttattatcgtggccgtggttagtagccaacggctgcacaaacccatgtatatcttcttggcgaacctgtcattcctggacatcctgtacacttctgccgtaatgcctaagatgctcgagggcttcctccaggaggcgactatctctgtcgccggctgtctcctgcagttcttcatcttcggatctctggctacggccgagtgcctgcttctggccgtcatggcttacgaccgctacttagctatatgttatccactgcactaccccctgctcatgggccctcgaaggtacatgggcctagtcgtcacaacatggctgtctgggttcgtggtggacggactggtggtggcactggtggcccaattgcgtttttgcgggcccaaccatatcgaccagttttattgtgattttatgctgtttgttggactcgcatgctcagaccccagggtcgcccaggtcactactcttattctcagcgtgttctgtctgacaatcccattcggcttgatcctcacttcatatgctaggatcgtggtggcagtgttaagggtgcctgctggtgcttcacggcgccgggcctttagcacttgcagcagtcacttggcagtagtgacgactttctacgggacactgatgatcttttacgttgcccctagtgcagtgcattctcagctgcttagtaaggtgttcagcctgctgtacactgtggtcacccctctgtttaatcctgtgatctacactatgagaaataaggaggtacaccaggcactcaggaaaattttgtgcataaagcagaccgagacactcgactag

SEQ ID NO: 28250 - DNA, 948 bp, Artificial Sequence
  Description of Artificial Sequence: Synthetic coding sequence
atggagatcgtgtctactgggaatgagaccattaccgagttcgtgctgttaggcttctatgatataccagaacttcactttctcttttttatcgtattcacggctgtctacgtgttcataattatagggaacatgcttataatcgtggcagtggtgtcctcacagcgactgcacaaacccatgtacatcttcctggctaatctgtcattcctggatatactttatacttctgcagtgatgccgaagatgctcgaagggttccttcaggaggcgacaatttcagtggctggatgtctgttacagtttttcattttcggctcactagccaccgccgaatgcctgcttctcgccgtgatggcctatgaccggtaccttgctatttgttacccactgcattatcctcttctgatggggcctcgcagatatatgggtcttgtcgttaccacctggctgtctggttttgttgtcgacggcttggtggtggccttggtggcgcagctgaggttctgcgggccaaatcatatagaccagttctactgtgatttcatgctgttcgttggcctcgcatgttctgacccaagggtggctcaggtgaccaccttaatcctgagtgtattctgcctgacaattcctttcggcttgattttaacctcctacgcccgtatagttgttgccgttctgagggtccctgcaggcgcaagcagacggcgagcattttccacatgctcaagtcacctggctgtcgtcacaacattttacgggacactgatgatcttctacgtggcccctagtgccgttcatagtcaactgctgtcgaaagtcttttcacttctatacacagtcgtgactccactctttaatccagtgatctatacaatgaggaacaaggaggtccaccaggctctccgtaagatcctctgtattaagcagaccgagacactcgattag

SEQ ID NO: 28251 - DNA, 948 bp, Artificial Sequence
  Description of Artificial Sequence: Synthetic coding sequence
atggagattgtgtctactgggaatgagaccatcaccgagttcgtactcctgggcttctatgatatccccgagctgcatttcctcttctttatcgtgtttacagcagtatacgtcttcatcatcatcgggaacatgctcatcatcgtcgccgtggtcagctcccagcgacttcataagcccatgtatatcttcctggccaatctgtcatttctggatatcctgtacacaagtgcagtgatgcccaagatgctcgaagggtttcttcaagaagccacaataagcgtggcaggatgcctgctccagttctttattttcggtagcctagccacagcagaatgcctcctgctggcagtcatggcctatgatcgctacttggctatttgctacccacttcattaccccctgcttatgggcccgcggagatacatgggtttggtggttactacatggttaagcggattcgtcgtggacgggctggtagtcgctctggtcgcacagcttcggttttgtgggccgaatcatattgaccagttctactgcgactttatgctgttcgtgggcctggcttgcagcgatcctagagtggctcaggtaaccacactcattctttctgtgttctgtctgactattcctttcggccttattctgacttcttatgcccggattgtggtcgctgtgcttcgggtacctgcaggggcctcgcgaaggagggctttctctacatgcagctcccatctcgctgtggtgaccactttctacgggacactgatgattttttacgttgcaccctctgcagtgcacagccaactgctgtcgaaagtcttttccctactctatacagtggtcactccactcttcaaccctgtgatatacactatgagaaacaaggaagtgcatcaggcactccggaagattctgtgtatcaagcagaccgaaaccctcgactag

SEQ ID NO: 28252 - DNA, 948 bp, Artificial Sequence
  Description of Artificial Sequence: Synthetic coding sequence
atggaaattgtgtcaacaggcaacgaaactattactgagttcgttcttcttggcttttatgatattcctgagctgcacttcctttttttcattgtgtttactgctgtatatgtgttcatcatcatcggaaatatgctcatcatagtggcagtggtctcttcgcagcgacttcataaacccatgtatatttttctcgccaacctctcattcttagacattctatacaccagtgcagtcatgccaaagatgctggagggcttccttcaggaagcgaccatatcagtggctggatgcctgctccagtttttcatctttggttcgctcgcaactgcggagtgtctgctactggccgttatggcctacgacagatatctggcaatctgctatcctttgcattacccgctgctaatgggcccacggcggtacatggggctggtggtgactacatggttatccgggttcgtggttgacgggctagtcgtagcactcgttgctcagctccgcttctgtggaccaaaccacatcgatcagttttactgcgatttcatgctgttcgtcggcctggcttgttccgaccccagagtggctcaagtcacaaccttaattctctcagttttctgtctcacaattcctttcggcctgattctgacttcttacgcaagaattgtagtcgctgttttacgcgtacctgccggcgccagtagacgccgggccttctccacctgttcttcccatctggcagtggtgaccaccttctacggaacacttatgatcttctacgtggccccgagcgccgtgcatagccagctgctaagcaaagtcttttcactgctgtacaccgttgtcacacctctattcaacccagtgatttatacgatgagaaacaaagaggtgcatcaggccctgaggaaaattctctgtattaaacagacagagaccctggactag

SEQ ID NO: 28253 - DNA, 948 bp, Artificial Sequence
  Description of Artificial Sequence: Synthetic coding sequence
atggaaattgtttccactggtaacgaaaccatcacagagtttgtacttctgggattctatgatattcccgagttacattttctgttcttcatagtgtttaccgccgtatacgttttcatcatcatcggcaacatgttaattatcgtggccgttgtttcctcacagaggcttcacaaaccaatgtatatatttcttgccaatctctcattcctcgacatactgtacacatccgctgtgatgccgaaaatgcttgagggatttctccaggaggccacaatctctgttgcgggttgtttactgcagttttttatattcggctccctggccactgctgagtgccttctcctcgcggtgatggcctacgaccggtacttagcaatctgctatcctctgcactatcctctcttgatgggtccaaggcggtacatgggactggtagtaaccacgtggctttctggattcgtggtggacggattggtggttgcactggtcgctcagcttcggttttgcggcccaaaccatatcgaccagttttattgtgattttatgttgtttgttgggcttgcgtgctctgatccacgcgtggcacaagttacaacgcttattctgtctgtcttctgtttaacgattcccttcggtctgattctcacgagttatgcacgtatcgtggtggcagtgcttcgggtcccagctggtgcatctcgcagaagagctttttcgacctgtagcagccacctggctgtggtcacgaccttttacggcaccctgatgattttttacgttgctccatctgctgtccatagccaattgctctcaaaagtctttagcctgctgtacaccgtcgttaccccactgtttaatcccgtaatttacacaatgcggaacaaggaggtgcatcaggcgctccgcaagatcctgtgcattaagcagaccgaaactttggattag

SEQ ID NO: 28254 - DNA, 948 bp, Artificial Sequence
  Description of Artificial Sequence: Synthetic coding sequence
atggaaatcgtgtcaaccggtaatgagacaattaccgagtttgttttactcgggttctatgatatccccgagctacactttcttttcttcatcgtgttcaccgccgtgtacgtgttcatcatcattggaaatatgctgataatcgtggccgtagtatctagtcagcggctccataaacctatgtatatatttctggctaatctaagtttcctggacatcctgtacactagtgccgtaatgcccaagatgctggaagggtttttgcaagaagcgaccattagcgtggctgggtgcctgcttcaattcttcatctttggctcactggcaaccgctgagtgtctactgctggcagtgatggcctatgaccgatatctcgcaatctgttatcctctgcattatccattactgatgggccccagacggtatatgggcctagtcgtgaccacctggctgtctggctttgtggtcgacggactcgtggtggccctggtagcgcaactccgtttctgtgggcccaaccacatcgaccaattctactgcgatttcatgctgtttgtcggtctcgcttgctcagaccctagagtcgcacaggtgaccaccctgatattatctgtgttctgtctcactattccattcgggctcatcctgacttcttatgcacggatagtggtggccgtgttgagagttccagccggtgcttctaggaggagagcatttagtacctgctcctctcacctggctgtggttacaaccttttacggtaccctgatgattttctacgtcgcaccctctgcagtgcacagtcaactcctatctaaagttttctctttactgtatacagtcgtgacgcctctgttcaatccagtgatttacacgatgcgaaacaaggaggtgcaccaagctttgcgcaagattttgtgcatcaagcagaccgaaaccttggactag

SEQ ID NO: 28255 - DNA, 948 bp, Artificial Sequence
  Description of Artificial Sequence: Synthetic coding sequence
atggaaatagtgagcacgggcaatgagaccattacagagttcgtgctgcttgggttctacgacatacctgagctacatttccttttcttcattgtgttcaccgctgtatatgtcttcattatcatcggcaatatgctcattattgtcgcagtcgtcagcagccagagactgcataagcccatgtatatattcctggcgaacctgtcctttttagacatcctgtacacctctgcggtgatgcccaaaatgttggagggctttcttcaggaggctaccatcagtgttgccgggtgtctgttgcaattttttatcttcggcagtctcgcgacagccgagtgcctattattagctgtgatggcttatgatcgctacctggccatttgctaccccctacactaccccttgctgatgggtccacgtaggtatatgggcctggtggtcacgacctggttgtcagggttcgtcgtggacgggctggttgtcgctctggtggctcaactgcggttctgtgggcctaatcacattgatcagttttattgcgacttcatgctctttgtggggttggcctgcagtgatccgagggtggcccaagtgaccacgctgattctgtccgtcttctgtctgactattccgtttgggctcattttgactagctatgccaggatcgtggtggccgtgctgagagtgccagccggggcctcacgcagaagggccttttccacgtgcagttcccatctagctgtggtgacaactttttacggaactttgatgattttttatgtcgcaccctcagctgtgcattcccaactgctgtccaaggtgttctcattgctgtataccgtcgtcacacctctgttcaatccagtaatctacactatgcgcaacaaggaggtacaccaagcgctcagaaaaatcctgtgcattaaacagaccgaaaccctcgattag

SEQ ID NO: 28256 - DNA, 1038 bp, Artificial Sequence
  Description of Artificial Sequence: Synthetic coding sequence
atgcacttccttagccagaacgacctgaacatcaatctgatcccccatctgtgtctccatcgccactccgtaattgctggagccttcaccatccaccgccatatgaagatctttaatagcccaagtaactcttcaacatttaccgggttcatacttctgggctttccctgcccaagagagggacagatcttactgtttgtgctgtttactgttgtgtacctactaacccttatgggaaacggatcaataatctgtgcagtgcactgggatcagcgactccatgcacctatgtacatacttttggctaatttctcctttcttgaaatttgttatgtgacaagcactgtccccagcatgcttgctaacttcctatctgatacgaagattataagcttcagtgggtgttttctccaattctatttcttcttttccctgggatctactgagtgtttttttctggcggtgatggccttcgacaggtacttggccatttgtcgtccgctcaggtaccctacaattatgacaagacgcctttgcacaaatctggtcgttaactgctgggtcctagggttcatttggtttcttatacctatcgtcaacatctcacaaatgagcttctgtgggagtcgcataattgaccacttcctttgtgatcccgcccccttgctcaccttgacatgcaaaaagggcccggtcattgagttagtcttttccgtgctgtctccactgcccgtcttcatgctgttcttattcattgtggggagttatgctttggtcgtgcgggctgtgttgcgagttccatccgccgccgggcgcaggaaggcattttcaacatgtggcagccacctggccgtcgtgtcattattctacggctctgtgctcgtcatgtacggatcccctccatctaagaatgaagccggaaaacagaagacggttacccttttctactcagtcgtgactcccctccttaaccccgtcatttacagcctcaggaataaggacatgaggaaggcactcaagaagttttgggggacctag

SEQ ID NO: 28257 - DNA, 981 bp, Artificial Sequence
  Description of Artificial Sequence: Synthetic coding sequence
atgtgcccactcaccctacaggtgacgggacttatgaatgtttccgaaccgaatagctctttcgctttcgttaatgagtttatcttgcaaggcttcagctgcgaatggaccattcaaatcttcctcttcagcctattcaccaccacttatgctctgaccatcaccggaaacggcgctatcgcgttcgtgctgtggtgtgatcggaggcttcacaccccgatgtatatgtttcttgggaacttttcatttctggaaatctggtacgtgtcttcaactgtacccaagatgttggtaaactttctttctgagaagaaaaatatctcattcgcaggttgttttctgcagttctacttcttttttagcctggggacaagcgagtgcctgctgctgacggttatggcatttgaccagtatcttgccatctgcagaccgctgctgtaccccaatataatgacaggtcacctgtacgcaaaactcgttatcctctgttgggtgtgtggcttcctctggttcctgattcccatcgttttgatcagccagatgccattttgcggccctaatattatagatcacgtggtctgtgatcctggtccccggtttgccttggattgcgtctctgctcccaggatccagttattctgctataccctctcatcccttgtaattttcggcaactttctgttcattattggaagttacacccttgtccttaaagccatgctgggtatgccctcatccacaggtagacacaaggccttcagcacatgcgggtcacatttagctgtggtctccctctgctacagctctctgatggtgatgtacgtgtcgccgggacttggccacagcacgggcatgcagaaaattgagacactattctatgcaatggtaaccccactgttcaatcctctcatttactctctgcagaataaagaaattaaggccgccctgagaaaagtgttgggcagttctaacatcatctag

SEQ ID NO: 28258 - DNA, 975 bp, Artificial Sequence
  Description of Artificial Sequence: Synthetic coding sequence
atgtcttttttttttgtggacttgcgccccatgaacaggagcgccacccacattgtgaccgaattcatcctcctcggatttcccggctgctggaagatccagatcttcttattttcattattcctggtgatctatgttctgacactgttagggaatggcgctattatttatgcggtgcggtgcaatcctctgttgcacacgcctatgtacttcctcctgggaaatttcgcatttctggagatctggtatgtgagttcaaccattccgaatatgctcgttaatattctatccaaaaccaaggccatcagcttcagcggttgctttctccaattctatttctttttctctttaggaacgacggagtgtctttttttggccgttatggcctatgatcggtacctcgcaatctgccatcccctacaatatcccgctatcatgacagtgcgattctgtggaaaattagtctccttctgttggctgattggatttctcggatacccgattcctatcttttacatctctcagctgcctttctgtggtccgaacattatcgaccattttctgtgcgatatggacccattgatggccctttcctgtgcacccgcccccatcacagaatgcattttttatacacagtcctcacttgtcctattttttaccagcatgtatatactccggtcttacattctgcttctcactgccgtgtttcaggttccttctgccgctgggaggaggaaagccttctctacgtgtggcagccatttagtggtggtctccctgttttatggaactgtcatggttatgtatgtgtcaccaacgtatggaatacccactctactgcagaagattctgacgctcgtctattctgtaactactccactctttaatcccttaatttacaccttgcgcaataaggatatgaaacttgccctgagaaacgttctcttcggcatgcggatcaggcagaattcgtag

SEQ ID NO: 28259 - DNA, 993 bp, Artificial Sequence
  Description of Artificial Sequence: Synthetic coding sequence
atgttctttatcattcactccctggtcactagcgtgttccttactgcgcttggacctcaaaatcggactatgcatttcgtaaccgagttcgtactgctgggatttcatggccagcgagaaatgcagagctgttttttttccttcatactggtgctgtatctgctgactctgctcggcaacggcgccatcgtgtgtgctgttaaacttgataggcgtctgcatacacccatgtatatacttttaggtaatttcgccttcctagaaatctggtatatatcttctacagtgccaaacatgctcgttaacattctgtctgagatcaagactatttccttctccggctgttttctccagttttatttctttttcagtctcggcacaactgaatgcttctttctgtccgtcatggcatatgacagatatttggccatatgccggccattgcactacccttctatcatgactggtaagttctgtatcatccttgtgtgcgtctgttgggtcgggggcttcctctgctatcctgtccccatcgtgttaatcagccagttgccattctgtggacctaacatcatcgatcatttagtctgtgaccctggtcctctgttcgctctggcgtgtatctccgccccatctacggagctgatctgctacaccttcaactccatgatcatcttcggccctttcctgtctattcttgggtcctacactttggtgattagggctgtgctgtgcatccctagcggggctggccgaaccaaggctttttctacctgcggcagccacctaatggttgtcagccttttctatgggaccctgatggtgatgtacgtctctcccacaagtggcaaccctgccgggatgcagaaaatcattactctggtgtatacggccatgaccccctttctcaaccctctaatttactccctacggaataaagacatgaaggacgcacttaaaagggttctggggctgaccgtgtctcagaactag

SEQ ID NO: 28260 - DNA, 969 bp, Artificial Sequence
  Description of Artificial Sequence: Synthetic coding sequence
atggagccccagaatacctctacggtcactaattttcagcttctggggtttcagaatttgctagagtggcaggcactgctgttcgtgatctttttgttaatttattgccttaccattattgggaatgtggtaatcattaccgtggtatcccaaggccttaggctgcacagccccatgtatatgttccttcagcatctctcctttctggaggtatggtacacctcaaccaccgttcccctcctgcttgctaatctcctgagctgggggcaggcgatctcttttagtgcatgtatggcccaattatacttcttcgtattccttggggcaactgagtgtttcctgctggcgttcatggcctatgaccgctatctggcaatatgctcaccgctccgatacccctttctcatgcaccggggtctgtgtgctcgactagtcgtggtgtcgtggtgtactggtgtcagcactggcttcctgccttccttgatgatctctagactcgatttctgcggccggaatcagatcaatcatttcttttgtgatctgcccccactcatgcagctgagctgctctagagtatatataacagaggttaccatcttcatcctcagcatcgctgtcctgtgcatttgcttcttcctcacactcggcccttacgtgtttattgtaagctctatacttaggattccaagcacttcagggcggcgcaagacattcagcacatgcggatcgcacctggcagtcgttaccctctactatgggacaatgattagtatgtacgtctgcccatccccccacctcttacctgagatcaacaaaattattagtgtcttctatacagtcgtgactcctctgctgaaccctgtgatttattccctgcggaacaaggattttaaggaggccgtaaggaaggtcatgcggcgaaagtgcgggatcctctggagcacatctaagcgaaaatttttgtactag

SEQ ID NO: 28261 - DNA, 924 bp, Artificial Sequence
  Description of Artificial Sequence: Synthetic coding sequence
atgctgaataccacaagcgtgacagagtttctccttctcggcgtgactgacattcaggaattgcaaccttttctgtttgtggtatttctgacgatatatttcatttccgttaccggcaatggcgctgtgctgatgatcgttatcagcgatccccgccttcattctcttatgtacttctttctagggaacttgtcttacctagatatatgttactccaccgtcacattaccgaagatgctgcagaatttcctgtctacccataaggccatctctttcctggggtgtatcagccaattgcatttctttcacagtctggggtcaaccgaatccatgctttttgccgtgatggccttcgaccttagtgtcgcgatctgtaagcccctgcgatacaccgtgattatgaacccccagctctgtactcagatggccattaccatctgggtgattggctttttccacgcattactgcactctgttatgacaagtaggctcaacttttgtggcagcaatcgaatacaccacttcttgtgcgatatcaaaccactcctgaagctcgcatgcggtaacaccgaactaaaccagtggctacttagcaccgttacaggcacaatcgcaatgggcccattctttctcactctgctttcctatttttatattattacctatctgtttttcaaaactcggagctgtagtatgctttgtaaggccctgtccacttgtgcttcacacttcatggtcgtgattctcttctacgctccagtcctgttcacgtatattcacccagcgctcgaaagcttcatggatcaggataggattgtggctattatgtacactgtagtgactcccgtcctgaacccgctgatatacaccctgcgcaataaagaagtgaaaggcgcactgggcagggtcatcaggcgcttgtag

SEQ ID NO: 28262 - DNA, 924 bp, Artificial Sequence
  Description of Artificial Sequence: Synthetic coding sequence
atgcttaacacgacatccgtaacggagttccttctgctcggcgtaactgatatccaggaactgcagccattcttattcgtcgtgtttctcactatatattttatcagcgtgactggaaacggagcagtactgatgatattcatctcagaccctagactgcattctcccatgtactttttcctgggtaacctgtcgtacctggatatttgttacagcacagtaaccctgcctaagatgttacagaacttcttaagcacacacaaagccatcagctttttaggatgcatatcacaactccactttttccacttcttagggtcaactgagtctatgctcttagcggtcatggctttcgatcggtcagtagcaatctgcaaacccctgcgatatactgtcataatgaatccacagctatgtacccagatggccatcacaatctgggtcatcgggtttttccatgcgttgctccatagcatcatgacctcaaggcttaatttttgcggctcaaatagaattcaccattttctttgcgatataaagcccctgcttaagctggcgtgcggtaatacggagctcaaccagtggctgttgagcaccgtgacaggcaccatagctatgggtcctttctttttaacacttctctcctatttctacatcataacctatctgttttttaaaacccggtcttgttcgatgctgtgtaaagctctttctacctgcgcatcccacttcatggtcgtaatccttttctatgccccagttcttttcacatatattcaccctgcgttagagagcttcatggatcaggataggatcgtggccatcatgtataccgtcgtgacaccagtgctgaatccccttatctatacgctgcgcaataaggaggtcaaaggggccctgggccgggttatacgacgtctctag

SEQ ID NO: 28263 - DNA, 924 bp, Artificial Sequence
  Description of Artificial Sequence: Synthetic coding sequence
atgctgaacaccacgtccgttaccgagtttctgctgctaggagtgacagatattcaagaattacagccgttcctctttgtggtctttcttacaatctatttcatttccgtgacaggcaatggcgccgtgctgatgatcttcattagcgatcctcggcttcatagtccaatgtacttttttctgggcaatctgtcttatctggacatttgctacagtactgtcacactgcccaaaatgttgcagaatttcctgtccacgcataaggccatatccttcttagggtgtattagccagcttcacttttttcacttccttgggtccacagagtccatgcttctggcagtgatggctttcgataggtgtgtggccatttgtaaacctcttcgctacaccgtgataatgaatccacagctgtgtactcagatggccattaccatatgggtaatcggcttctttcacgctttgcttcactccataatgacatccagactcaacttttgtgggagcaatcgaattcaccatttcttgtgcgacattaagccacttcttaagttggcctgcggaaatactgagctaaatcagtggttactttcaaccgtgactgggacaatcgcaatggggcccttttttctgactctgctctcttatttttatatcatcacttatctgttttttaagactagaagttgcagcatgctgtgcaaagcgctttctacttgtgccagccactttatggtggtgattctgttttatgctcctgttctttttacatacattcatcctgcgctggagagtttcatggaccaggacagaatagtagcaatcatgtacacagtcgttactccagtcctgaacccccttatctacacactgaggaataaagaagtcaagggcgccctgggaagggtaataaggcggttgtag

SEQ ID NO: 28264 - DNA, 951 bp, Artificial Sequence
  Description of Artificial Sequence: Synthetic coding sequence
atggagaatgtgacaactatgaacgagttcctccttctcgggttaacgggagtccaagagttacagccatttttctttggaatcttcttaattatctacctcattaacctgatcggcaacggatccatcctggttatggtggtcctcgaaccgcagctacacagccccatgtactttttcttaggaaacctgagctgtctagatatcagttattcctccgtgaccctacccaagcttctcgtgaaccttgtctgctcgcgccgcgccattagttttctgggatgcattacccaattgcacttcttccacttcctaggaagtaccgaggccattctcctggcaattatggctttcgacaggttcgtcgccatttgcaatcctctgcgctacactgtaattatgaatccacaagtgtgcatcctgcttgcagctgccgcctggctgattagcttcttctatgctctcatgcactcagtgatgacagcccacttatccttctgcggttcacagaagctgaaccactttttctatgatgtgaagcccctgctcgagcttgcctgcagcgataccctgttgaatcagtggctcctgtctattgtcactggctcaatcagcatgggtgcgtttttcctaacattgctgagctgtttctacgtgatcggtttcctgctttttaagaaccgaagctgtagaattctccacaaggccctctctacatgcgcatcccactttatggtggtttgccttttttatggtcccgtcggctttacctacattcgccccgcatccgctacttccatgatccaggatagaatcatggctatcatgtacagcgcagttacgcctgtgctcaaccctttgatttacacactgcggaacaaggaagtcatgatggcattgaagaaaatctttggccgcaagctgtttaaggactggcagcagcatcactag

SEQ ID NO: 28265 - DNA, 951 bp, Artificial Sequence
  Description of Artificial Sequence: Synthetic coding sequence
atggaaaatgtgacaaccatgaatgaatttctgttgctggggctcactggagtgcaggaactgcagccgtttttctttggtatcttcctgatcatctatctgattaatcttatcggcaatggatctatcctggtgatggttgttctagagccacagctgcattcacccatgtacttctttttaggcaacctgtcctgcctagacatttcttactcgagcgttaccttacccaagcttctagtcaacttggtttgctctcgcagagcaatttcattcctgggctgcatcacacaattgcacttcttccactttctagggagcaccgaggccatcctgctggctattatggcgtttgacagattcgtggcgatatgtaatcccctaagatacacagtgatcatgaatccccaagtgtgcattttactcgctgctgctgcctggttgatcagttttttctacgcactcatgcactccgtgatgaccgcgcacctgtcattttgtggctctcagaaactgaatcacttcttttacgacgtgaagccactcctggagcttgcttgctccgacaccttgttgaatcaatggttgttatcgattgtgacgggtagcatttccatgggggctttctttctcacccttctgtcttgcttctatgtcattgggtttctgcttttcaagaaccggagctgcagaatacttcataaggctctttccacatgcgctagccatttcatggtggtgtgcttgttctacggtccagtagggtttacatacattagacccgctagcgctacgagtatgatccaggataggatcatggctatcatgtatagtgcggtcacacctgtgttgaatcctcttatctacaccttgaggaacaaagaggtcatgatggcactaaaaaagatcttcggacgaaagctgtttaaggactggcagcaacatcactag

SEQ ID NO: 28266 - DNA, 951 bp, Artificial Sequence
  Description of Artificial Sequence: Synthetic coding sequence
atggaaaacgtcaccacaatgaacgaattcctcctcctcggcttgactggcgttcaggaattacaacctttctttttcggtatcttcttgattatctacctgataaaccttattggtaatggaagcattctcgttatggtggttctcgaaccacagctgcatagccctatgtacttcttcctcggcaatctgagttgtttagatatcagttacagtagtgttactctcccaaaactcctggtgaacctagtatgttcccgacgggctataagctttctgggatgcatcacccagctacactttttccattttttaggaagcacagaggccattctgctagcgatcatggcgttcgacaggtttgtggcaatttgtaaccccctaagatacaccgtgatcatgaatccgcaggtctgtatcttgcttgcagccgcagcgtggcttattagtttcttctacgccctaatgcactcagtgatgacagcccacctgagtttttgtgggtcacagaaattaaaccacttcttttatgatgtcaaacctctgctggagctggcatgcagcgacactctcctcaaccagtggttgctgagtattgttactgggtcaatctcgatgggcgccttcttcctgaccctgcttagctgcttttacgttatcggcttcttgctctttaagaatcggtcctgccggattctgcacaaggccctgagcacctgcgccagccacttcatggtcgtgtgcctgttttatggtccagtgggattcacgtatatccgacctgcatcggctacctctatgattcaggacaggatcatggcaattatgtactccgccgttacacctgtccttaatcccttaatttatacgctgaggaataaagaagtcatgatggcattgaagaagatctttggcaggaagctgtttaaggattggcagcaacaccattag

SEQ ID NO: 28267 - DNA, 951 bp, Artificial Sequence
  Description of Artificial Sequence: Synthetic coding sequence
atggaaaacgtaaccacaatgaatgagtttctcctgttagggctcaccggcgtgcaagagctgcagccctttttcttcggaatttttctgatcatatatttaatcaacctgattggcaacggttcaatcctagttatggtggtgctcgagccccagcttcactctcctatgtatttttttctgggcaacctgagctgtttggatataagctacagcagtgttacactccctaagctattggtcaatcttgtctgctctcgcagggctatatccttcctcggatgtattacacagctgcacttcttccatttcctgggaagcacagaggctatcttgctggctattatggcattcgacagattcgtggctatctgcaatccattgcgatacactgtgattatgaatccacaggtgtgcatattgctggctgccgcggcatggctgattagcttcttttacgcattgatgcactccgtgatgaccgcccacctctcgttttgcggcagccagaagctgaatcatttcttttacgatgtcaagcccctgctggaactagcatgcagcgacacactgctaaatcagtggctgctttcaatcgtgacgggaagcatctccatgggtgctttcttcctgaccctcctgagttgcttttatgtgattggcttcctcctgttcaagaaccgctcctgtcgcatcctgcataaagccctgtcgacctgtgctagccatttcatggtcgtgtgtctcttctacggtccggttggttttacttacattaggccagcgtccgccacatctatgatccaggataggattatggcaataatgtattctgccgtgacacccgtcctcaaccctcttatctacacacttcgaaataaggaggtgatgatggctttgaagaagatcttcggcagaaaactatttaaagattggcagcagcaccattag

SEQ ID NO: 28268 - DNA, 951 bp, Artificial Sequence
  Description of Artificial Sequence: Synthetic coding sequence
atggagaacgtgaccacaatgaacgagttcctcctgctggggctgactggcgtacaggaacttcaacccttctttttcgggatttttctcatcatctacttaattaacctcatcggcaatggctctatcctggtgatggttgttcttgagccacagctgcactctcccatgtactttttcctgggcaaccttagttgtctcgatatctcgtactcgtctgtgacactcccaaagctgttggtcaatctggtgtgctctcgtcgcgccatctcattccttggatgcataacacaattacacttcttccacttcctgggctctaccgaggccatattgctcgctattatggcttttgacaggtttgtggctatatgtaacccgctgcgctacaccgtgattatgaatccgcaggtttgtattttgctggccgcagccgcctggctcatctcattcttttacgcactgatgcactccgtgatgaccgctcaccttagcttttgcggaagtcagaaacttaatcactttttttatgacgtgaagccacttctcgagttagcctgctccgacacactgctcaaccagtggctgctgagcatcgttacaggctctatttccatgggcgcttttttcctgaccctgctcagctgcttttacgtgatcggttttctgctgttcaaaaatcgtagctgccggattcttcacaaagcgctgtcgacatgtgcatcccattttatggtggtgtgcctgttctatggtcccgtcggttttacctatatccggccagcttccgcaacgtccatgattcaggaccgcattatggcgatcatgtattcggcggtcacacccgtcctgaatcccctcatatacacactgaggaataaagaagtgatgatggcgttgaaaaagatctttggtcggaaactgttcaaagattggcagcaacaccactag

SEQ ID NO: 28269 - DNA, 951 bp, Artificial Sequence
  Description of Artificial Sequence: Synthetic coding sequence
atggaaaatgtaactaccatgaacgagtttttgctcctcggcttaaccggggtccaggagctgcagcctttcttttttggcatttttctgattatctatctgatcaaccttattggcaatggttcaattttggtaatggtcgtcctggagccccagttacactctcccatgtatttcttcttaggaaatctgtcctgtctggatatatcctactcgtccgtgacactgccgaaactcctggtgaatctcgtgtgctcccgacgcgccatatcctttttggggtgtatcactcagctgcatttcttccacttcctcgggagcactgaggcaattctcctggctatcatggcattcgatcgatttgtcgctatttgtaaccctctaaggtacacggtcatcatgaatccacaggtgtgtatactacttgcggctgctgcatggctgatctcttttttctacgctctaatgcactcagtcatgactgcgcatctctctttctgcggaagccagaagctgaatcacttcttctatgacgtgaagcctctcctggaattggcctgtagcgatactttgctaaatcaatggttgctgagcatcgttaccggctctattagtatgggggcctttttcctgactctgttgagctgtttctacgtgattggattcttgttgtttaagaaccgaagctgccggatcctccataaagctttgagtacctgcgcttcacacttcatggttgtgtgtttgttttatggtcccgtgggcttcacatacatacggccagcctcagcaacttccatgatacaggaccgtattatggccatcatgtactcagctgtgacacccgtgttaaatcctctgatttacacactcaggaacaaagaggtaatgatggcactgaagaaaattttcgggagaaaattgttcaaagactggcagcagcaccattag

SEQ ID NO: 28270 - DNA, 951 bp, Artificial Sequence
  Description of Artificial Sequence: Synthetic coding sequence
atggagaacgtaaccactatgaacgaatttctgctcttggggctcacaggcgtacaagagctgcaaccttttttttttggaatattcctaattatttacctaattaacctcatcgggaatggctctatcctcgtgatggtggtgttggagccgcagcttcactccccaatgtattttttcctggggaacctgtcctgcctggacatttcttatagcagcgtgaccttgccaaaactgctcgttaatctggtatgtagtaggagagctatctccttcctgggttgtatcacacagcttcacttttttcactttctgggatctaccgaagcaattctgctggctattatggcctttgatcgttttgtggcgatctgtaaccccctgaggtacacggttatcatgaacccacaggtgtgtatattgctggcagctgcagcctggctcatttcatttttttacgctctcatgcatagtgtgatgaccgctcacctgtctttttgcggttctcaaaaactgaatcattttttttatgatgtgaagcccctgctcgaactggcctgttccgatacgctcctcaaccagtggttactttcgattgtcactgggtccatatcaatgggtgcattctttctgacattgctttcatgtttttacgtgattggtttcttgctgtttaagaaccgctcctgtaggatcctgcataaggcgctaagtacctgcgcttctcacttcatggtggtgtgtctattttacgggcctgtcggttttacctacatccgcccagcttcagccacctctatgattcaggacagaatcatggctatcatgtactccgcagtcacccctgtcctgaaccctctgatttatacattgcgcaacaaagaggttatgatggctctgaagaaaatatttggaagaaagctgttcaaggactggcagcaacaccactag

SEQ ID NO: 28271 - DNA, 951 bp, Artificial Sequence
  Description of Artificial Sequence: Synthetic coding sequence
atggaaaatgttaccaccatgaatgagtttttactgctgggcttaactggcgtgcaggaactgcagcctttttttttcggcatattcctcattatttacctgatcaaccttatcggtaacggctctatcctggtcatggttgtgctcgaaccacagctgcattctcccatgtatttctttctcggcaacctttcttgcctggatatttcctactctagcgtgaccctcccaaagctactggtgaacctagtctgctctcgcagagctataagctttctaggctgcatcactcaactgcactttttccattttcttgggtctactgaggcaatcttgttggccataatggccttcgaccgttttgtggccatctgtaaccctctgaggtacacagttattatgaacccacaggtttgcatcttactagcggctgctgcctggctcatcagttttttctatgccttaatgcatagcgtgatgaccgcgcacctgtctttctgtgggtctcagaaactgaatcacttcttttacgatgtgaaaccgctccttgaactggcttgtagcgatacccttcttaaccagtggctgctgagcattgtcaccggcagcattagcatgggagccttctttctgaccctgctcagctgcttctatgtgataggttttttgcttttcaaaaaccgtagttgccggatccttcataaagcactcagcacgtgcgcaagccactttatggttgtttgcctgttctatggcccagttggatttacatacattagaccagcctccgcaacctccatgatccaagaccgtattatggctattatgtattctgccgttacaccagtattgaatccgctgatctataccctccgtaataaggaagtgatgatggcattaaaaaaaatttttggccgcaaacttttcaaggattggcagcagcatcattag

SEQ ID NO: 28272 - DNA, 987 bp, Artificial Sequence
  Description of Artificial Sequence: Synthetic coding sequence
atgaagctgtggatggaatctcacctcattgtgcctgagaccaggccatccccaaggatgatgtcaaatcagacccttgttaccgaattcattttacaagggttttccgagcatccagaatacagagtctttctcttctcctgcttcctgtttctttactcgggtgcgctgacaggcaatgttctgattactctggccatcacttttaaccctggactacatgcacccatgtacttcttcctgctgaacttggcaaccatggatataatttgcaccagtagcatcatgcctaaggctctggcttctctggtgtccgaggaaagctcaatcagttatgggggatgtatggcacagctgtactttctaacttgggcagcttcatcagagttactgctgctaactgtaatggcctacgaccgctatgcagccatttgccaccctctccactactctagcatgatgtcaaaagtgttctgtagcggcttagcaaccgccgtgtggttgctgtgtgccgtgaacacggccatacacacaggacttatgttaagattggacttctgtggccccaatgtgatcattcattttttctgcgaggtgcctcctctcctgctactttcctgctcgtctacctatgtcaatggcgtgatgatcgttctagctgatgcgttttacggtatcgtgaacttcctaatgacaatcgctagttacggttttatcgtgtcctccatccttaaagttaagaccgcatgggggagacagaaagcattcagcacttgcagctctcatctaactgtggtgtgtatgtattacacagccgtgttttatgcatatatatcacccgtctccggctacagcgctgggaagtccaaattggcaggcctgctctataccgtgttatccccaacactgaacccacttatctatacccttcgcaataaagaagtcaaggctgcactgcggaagctgtttccattttttaggaactag

SEQ ID NO: 28273 - DNA, 987 bp, Artificial Sequence
  Description of Artificial Sequence: Synthetic coding sequence
atgaagctgtggatggaaagtcatctcatcgtccccgaaaccaggcccagtcctcgtatgatgagcaaccaaaccttggttactgaatttatacttcagggattttcggagcaccccgaatatcgggtcttccttttctcctgtttcttatttctctatagcggcgcacttaccgggaatgtgctgatcactctggctattacttttaatccgggtctccacgcgcccatgtattttttcctcctgaatctggcgacaatggatatcatctgcacgagcagtataatgcctaaggctctagcttcactggtgtccgaagagtcttctatctcatatgggggctgcatggctcaattgtacttccttacttgggctgcatcctccgagttgttgctgttaactgtcatggcctacgacagatacgcagctatttgtcatcccttgcactattccagtatgatgagtaaagtgttctgttcgggcctagccacggcagtgtggctgttatgcgcagtgaacacagcgatacacacagggctgatgttacggttggacttttgtgggcccaatgttattatccatttcttctgcgaggtgccccctttactgctcctgagctgctcatcaacatacgttaacggtgtgatgattgtgctggccgacgccttctacggcatcgtaaatttcctgatgactatcgcctcttacggattcatagtgagttccattctgaaggtgaagacggcctggggccgtcagaaggctttctcaacatgtagctctcacctgacggttgtgtgcatgtactataccgccgtgttttacgcctatatcagccctgtaagtgggtattctgctgggaaaagtaaattagccgggctgttgtataccgtgctgagcccaaccctcaaccccctgatttacacactgaggaacaaagaggtgaaagccgcgttacggaaactgtttccattcttccgcaactag

SEQ ID NO: 28274 - DNA, 987 bp, Artificial Sequence
  Description of Artificial Sequence: Synthetic coding sequence
atgaagctgtggatggagtcccatctcattgttcctgagacgcggccatcaccaagaatgatgagtaatcagacgttggtcactgagtttattcttcaggggtttagtgaacatcccgagtacagagtttttttgttttcctgctttttgttcttgtatagtggtgccctgaccgggaacgtgttgataactctcgccattacgttcaatcctggcctacacgcccctatgtatttcttcctgctgaacctggccacgatggatataatctgcaccagtagcatcatgcctaaggctctggcaagcctggtttccgaagagtcctcaatctcgtacggaggttgtatggcacagctgtatttcctaacttgggcagcctcctccgaacttctgctgctcactgtcatggcctatgaccgctacgctgccatctgccatcccctgcactatagcagtatgatgtccaaagtgttttgtagtgggcttgccacggccgtctggctgctgtgtgccgtaaataccgctattcatacgggactaatgctgcgcctcgacttctgcggccccaacgttatcattcactttttttgtgaagtgcctccattactgcttctgagctgcagcagtacatacgtcaacggagtaatgattgtattagctgacgccttttacggtatagtcaatttcctgatgacaattgcatcatacggattcatcgtgagcagcatacttaaggtcaagaccgcttggggtaggcaaaaagcgttttctacttgcagctctcacctgacggtggtgtgtatgtattatacagccgtgttttatgcttacatctctcccgtcagtgggtattctgccgggaagtccaagctcgctgggctgctatacacagtgctttcccccactttgaacccactcatctacacactccggaataaagaagtaaaagccgcactccggaagcttttcccgttcttcagaaactag

SEQ ID NO: 28275 - DNA, 957 bp, Artificial Sequence
  Description of Artificial Sequence: Synthetic coding sequence
atggagtgggaaaaccatacaatcctggtggagtttttcttgaaaggcctttccggccacccaagattagaactcttgttcttcgtgctcattttcattatgtacgttgtcattctcctaggcaacgggaccctgattctcatctcaattttggatccccaccttcatacccctatgtattttttcctggggaatttatccttcttagatatctgttacacaactacctctatcccttccaccctggtctctttcctatctgaaagaaagactatcagcctttccgggtgtgctgttcagatgtttttgggactggccatgggcacgacggagtgcgtccttctggggatgatggcatttgacaggtatgtcgccatttgcaatcctctgcggtatcctatcattatgagcaaagacgcctacgtgcccatggcggccggcagctggatcattggcgccgtgaattctgctgtgcaatctgtttttgtagtccagctcccgttctgcagaaacaacattatcaaccacttcacttgcgaaatcctcgcagtgatgaaactcgcctgcgccgacatctctgataatgaatttattatgctggtagcaacaaccctctttatcctaacacctctgctgctgataatcgtgtcttacaccctgataattgtgagtatcttcaagatttcctctagtgagggtcgaagcaaggcgtcctccacttgctccgcccaccttactgtggtgatcatcttctacggaacaatccttttcatgtatatgaaacccaagtcaaaagagacacttaactctgacgacctcgatgcaacagataagattatcagcatgttttacggcgttatgactccgatgatgaatccactgatctatagtctccgcaacaaagatgttaaagaggccgtcaagcatctgcttaacaggcgattttttagtaagtag

SEQ ID NO: 28276 - DNA, 1044 bp, Artificial Sequence
  Description of Artificial Sequence: Synthetic coding sequence
atgatcgtacagttaatctgtaccgtatgcttccttgcagtcaacacctttcatgtgcggtcatcctttgatttcctgaaggccgacgatatgggagagattaatcaaactctggtttcggaatttctcttattgggactgtccggataccccaaaatcgagatagtgtattttgctctcattctggttatgtacttggtcattctgatcggcaacggagtcctgataatcgcttctatttttgactcccacttccatacacccatgtatttctttctgggcaatctgagcttcctcgatatttgctatacatcctcctccgtcccctccacccttgtgagcttgatttcgaagaagcgaaacattagttttagcgggtgtgcagtccagatgttctttggctttgcgatgggatctacggaatgcctgctcctgggcatgatggctttcgacagatacgtggctatttgcaatcctttgaggtatccaatcattctcagcaaagttgcatacgtacttatggcgtctgtcagttggcttagcggaggcatcaacagtgctgtccagaccctgctggccatgcgacttcctttttgcggcaataacataatcaaccactttgcatgcgaaattcttgccgttctaaagctggcttgtgctgacatcagccttaacatcattaccatggtgatatcaaacatggcctttcttgtccttcctctcatggtgatttttttcagctacatgtttatcctgtatactatcctccaaatgaattctgctactggccgtcgcaaggctttcagcacatgctccgctcatctaaccgtcgttattatcttctatggcacaatcttcttcatgtatgccaagccaaaaagccaagacctcatcggcgaggagaagctgcaagcccttgacaagctcatctctctcttctacggggtcgtaacacccatgctgaaccccattctctatagcctgaggaataaagatgtcaaagcagccgttaagtatctgctgaacaagaaaccaatccattag

SEQ ID NO: 28277 - DNA, 957 bp, Artificial Sequence
  Description of Artificial Sequence: Synthetic coding sequence
atggataaaataaatcagacttttgtgcgggaattcatcctgttaggtctttcggggtatccaaagcttgagatcatcttcttcgctcttatcctggtaatgtatgttgtgattctcataggaaatggggtgcttattattgcatctatcttggactctcgactccacatgcctatgtactttttccttggcaatctctcttttcttgacatttgttacacaactagcagcatacctagcactctggtgtcgctgatcagcaagaaaagaaacatcagtttcagtggctgcgcagtgcagatgttctttggatttgctatggggagtaccgagtgcttcctattgggcatgatggctttcgataggtacgtggccatttgcaatcccctgcgctaccccattattatgaacaaggtggtgtacgttttattgacaagcgtcagctggctgagtggagggatcaatagcaccgtgcagacttcccttgctatgagatggccattttgcgggaataatattatcaatcatttcctgtgcgaaatacttgcagttcttaagctcgcctgctctgatatttcggtcaacatagtgacgctcgcggtgagtaacattgcttttcttgtcctgcccctgctagtgatttttttcagctacatgtttatcctgtatactatcctcagaacaaatagtgctaccggcaggcataaggcattcagcacttgcagcgcccacctgaccgtggtcatcattttctacggcaccattttttttatgtatgccaagcccaaaagccaagacctgcttggcaaagacaaccttcaagcaactgagggtcttgtgtctatgttctacggcgtcgttactcctatgctcaatcctattatatactcattgaggaacaaggacgtgaaggccgctattaagtacctcttatcacgaaaagccataaaccagtag

SEQ ID NO: 28278 - DNA, 1041 bp, Artificial Sequence
  Description of Artificial Sequence: Synthetic coding sequence
atgtttatccaggtcatcttttacatatgctgcctggccgtcaagattctttatataggttcctcctttggaatccttaaagcagacatggacaagattaatcagaccttcgtgcgcgagttcatcttactcggtctgagcggctatccgaaactcgagatcattttttttgcgctgatcttggtcatgtatgtggtgatacttattggcaatggagtcctgatcattgcatctattctcgattctcgtttacacatgcctatgtacttttttctcggcaacctgtccttcctggacatctgctatactacctcatctattccaagtaccttggtgtcactgatctctaaaaagagaaacatatccttttctggttgtgcggtccagatgttcttcggcttcgcaatggggtcaaccgagtgttttctgctggggatgatggcattcgaccgctacgttgccatctgtaatccccttcgctaccctatcataatgaacaaggttgtctatgtccttctgacctctgtctcttggcttagcggcggcattaattcaacggttcagacctccctagccatgcgctggccattttgtggaaacaacattattaaccactttctgtgcgagattcttgcggttttgaaactcgcatgcagcgatatatctgttaatatagtgaccctcgctgtttccaacatagcttttctcgtactgccactgctagtaattttcttctcctatatgttcattttgtacacaatcctccgaacgaacagtgctactggcagacataaggccttttctacgtgcagtgcgcacctcacggtcgtcattattttctacgggaccatctttttcatgtacgccaagcccaagtcacaggacctgctcggtaaggataatctgcaagctactgaaggcctggtgagtatgttctacggtgtggtgaccccaatgcttaatccaataatttattcactccgaaacaaggacgttaaagccgcaattaagtacctccttagccgcaaggccatcaactag

SEQ ID NO: 28279 - DNA, 957 bp, Artificial Sequence
  Description of Artificial Sequence: Synthetic coding sequence
atggaatgggaaaatcacacaatccttgtcgagttttttttaaagggcctgtcagggcacccaaggctggaactgctcttttttgtgctaatcttcataatgtacgtggtgatcctgcttggaaacggtacccttatcctgatatctatattggatccgcaccttcatactccaatgtactttttcctgggcaatctttctttcctggacatctgttatacaacaacgtccattccttcaacactggtgagttttctttctgagagaaaaaccataagcctgagcggatgcgccgtgcagatgttcctgtcgctggccatgggaactaccgagtgcgtgttgttgggggtgatggcttttgatcggtacgttgcgatttgcaatccactgaggtaccctatcattatgtcgaaagacgcctatgtccccatggcagctggatcatggattattggagccgtcaattctgctgtccagaccgtgtttgtggtccagctgcccttctgtaggaataatataatcaatcacttcacatgtgaaatcctggcagttatgaagttagcttgtgccgatatttccggcaatgaatttattttactagttaccactacgctgtttctgttgacccccctgcttcttattatagtgtcttataccctgatcatattgtcaatttttaaaatatcttcaagcgaaggccggtccaagccctcctccacatgttccgcccgtctgactgtggtcataacattttgcgggactatctttctgatgtacatgaagcccaaatcacaggagacattgaattcagacgacctggacgctacagacaaactcattttcattttctaccgcgttatgactcctatgatgaatcctctgatatactcactgaggaataaggatgtgaaggaagccgtcaagcacttattaaggcgtaagaattttaacaagtag

SEQ ID NO: 28280 - DNA, 963 bp, Artificial Sequence
  Description of Artificial Sequence: Synthetic coding sequence
atggagcggactaatgactccactagtactgagtttttcctcgtgggtctgtctgcgcaccccaagttacaaaccgtgtttttcgtgctgatactgtggatgtaccttatgatccttctcggcaacggcgtgctgatttccgtaatcatatttgattctcatttgcacaccccaatgtatttttttctctgcaatctgtcctttcttgacgtttgctacaccagctctagcgtccccctaatcctggcgtcctttcttgccgtgaaaaagaaagtatctttttcagggtgtatggttcagatgtttatctccttcgcaatgggggctactgaatgcatgatcctcggtaccatggctctagaccgctacgtggcaatctgttacccattgcgttaccccgttatcatgtcaaaaggcgcctatgtggcaatggccgctgggagttgggtgaccggcctggtggactcagtggttcaaaccgcatttgcgatgcagttaccattctgcgccaataacgtcatcaagcactttgtctgcgaaattttagctattctgaagctggcctgcgccgatattagcataaatgtcattagcatgacgggcagcaatcttatcgtcctcgttatccccctcctggttatctcaatttcatacatttttatcgtcgccacaattctgcgcatcccctccacagagggaaagcacaaggccttcagtacatgctccgcacacctcactgtagtgattatcttctacggcacgatctttttcatgtatgcaaaaccagagtcaaaggctagcgtggacagcggtaacgaagacatcatagaagcactcatctctcttttctacggagtcatgacacccatgttgaatcctttgatttacagcctgcgcaacaaagatgtgaaagctgccgtaaagaatattttgtgcagaaaaaactttagcgatgggaagtag

SEQ ID NO: 28281 - DNA, 957 bp, Artificial Sequence
  Description of Artificial Sequence: Synthetic coding sequence
atggagtgggagaaccaaacaattctggtggagtttttccttaaaggtcacagcgtgcatcccaggttggagctcttgttctttgtacttatttttattatgtacgttgtgatcctgctcggcaacggcacccttattctcatcagcattctcgatcctcacctgcatacccctatgtatttctttttgggtaacttgtcctttcttgatatttgctatactactactagtatcccctctacgttggtgtctttcctgtctgagaggaaaaccataagcttttcagggtgtgccgttcagatgttcctgggtttggccatgggcacgaccgagtgcgtgctcctaggaatgatggcctttgaccggtatgtagccatttgtaaccctctccgatatcctatcatcatgtccaagaacgcctacgtccccatggccgtaggcagttggttcgccggcattgtgaactccgccgtgcagacaacgttcgtcgtgcagcttcccttttgccgaaagaatgtcataaatcactttagttgcgagattcttgcagttatgaaactcgcttgcgcagatatttccggtaacgagtttctgatgctcgttgcgaccatcttgtttactctcatgcccctgctgttaatcgtgatttcctacagtctgattatttcctctatactgaagattcactcttcagagggccggtcaaaggcattctccacttgctctgcgcatctgaccgtggtgattattttttacggcaccatccttttcatgtacatgaaacctaagagtaaagagacattaaattctgacgatcttgacgccaccgataagattatctcaatgttttatggggttatgacccctatgatgaatccattgatatattcactgaggaacaaagatgtgaaggaggccgttaaacacctcccaaaccggagattcttcagcaagtag

SEQ ID NO: 28282 - DNA, 1041 bp, Artificial Sequence
  Description of Artificial Sequence: Synthetic coding sequence
atgtaccgctttacagattttgacgtaagtaacatttccatctacctcaatcacgttttattttataccacgcagcaggctggagaccttgaacatatggagacaaggaattactcagccatgacggagtttttcttggtgggactttcacagtatcctgaactgcagctgtttcttttcttactctgtctgattatgtatatgattatcctgttgggaaattctcttcttatcatcatcacaattctggactctcgactgcacacacccatgtacttctttctcgggaacttgtcctttctggacatctgctatacaagcagttccataccacctatgctgatcattttcatgtccgagcggaagtccatttcatttatcggctgtgccctccagatggtggtatccttggggctgggtagtaccgaatgcgttctcttggccgtgatggcatacgaccactacgtggctatttgtaatccactaaggtactccattatcatgaatggtgtgttgtacgtgcagatggccgcttggtcctggattataggttgtttgacttctctactccagactgttttgacgatgatgctgccattttgcgggaataacgtgatagatcatatcacctgcgagattctggcactgctcaagctggtgtgttcggatattaccattaacgtgctgatcatgactgtgacaaatatcgtgagtctggtgattcttctgctgctcatttttatctcttacgttttcattctatcaagtatactgcgtatcaattgtgcggagggccgaaagaaagcgttctccacatgtagcgcacactccattgttgtgatcctgttttacggaagcgctctgttcatgtatatgaagcctaagtctaaaaacaccaacaccagcgacgaaattataggcctcagttacggagtggtttcccccatgcttaatcctataatatattcactccggaacaaagaagtcaaagaagccgttaaaaaagtgctgagcaggcacctgcatctcctgaagatgtag

SEQ ID NO: 28283 - DNA, 960 bp, Artificial Sequence
  Description of Artificial Sequence: Synthetic coding sequence
atgttccccgcaaactggacgtccgtgaaggtgtttttctttttgggcttcttccactacccgaaagttcaagtaattatattcgccgtgtgtctcctaatgtacctgattactctcctcgggaacatatttcttatctcgatcacaatcctcgattctcacttgcatacccccatgtatctgtttttgtctaatctgtccttcctcgatatatggtacagctcaagcgcgctcagccctatgttggctaattttgtcagtgggcggaacaccatttcatttagcgggtgtgccacacagatgtatctgtccctggccatgggcagcacagagtgcgtgctactgcccatgatggcttatgaccgatatgttgctatatgcaatcctctccggtatccagtgatcatgaatcgccgcacatgcgttcagatcgcggcgggctcctggatgacagggtgcctcaccgccatggtcgagatgatgagcgttcttcctctttcactgtgcgggaacagcattattaaccactttacatgtgagatcctggctatcctgaagctggtatgtgttgacacttccctagttcagcttatcatgctggtgattagtgtgcttctcctccctatgcctatgttgctgatatgcataagctacgccttcattctcgccagcatcctccgcatttcctctgtggaggggcgaagtaaagcattcagcacctgtactgcccacctgatggttgtggtacttttttacgggaccgctcttagtatgcatttgaagccatccgccgttgattcacaggaaattgataaattcatggcactggtgtatgccgggcaaacgcctatgctcaacccaatcatttattcactgaggaataaagaggtaaaagtagccctgaaaaaactcctgatcagaaaccactttaacacagcgttcatctctatcctaaaatag

SEQ ID NO: 28284 - DNA, 927 bp, Artificial Sequence
  Description of Artificial Sequence: Synthetic coding sequence
atggccatggataacgtgactgcggtctttcagttcctgctgataggtatttcaaactatccgcagtggagggatacgttcttcactctagtgctgattatttatctatcaaccctgctgggaaatgggtttatgatcttccttatccactttgatccaaaccttcatacacccatctacttttttttgtccaacttgtcattcttagacctgtgttacggcactgcctctatgccgcaagcattggttcattgcttttccacccacccatacttaagttatcctcggtgcctggcgcaaacctctgtgtcactggcacttgccaccgccgagtgtctcttgctggcggcaatggcctatgatagggtcgtggcgatctccaatccgctgcgctatagtgtggtcatgaatggccccgtgtgtgtttgtctcgtggcaacgtcatggggcacttcacttgtcctgaccgccatgctgattttaagcttaagactacacttctgcggggctaatgtgatcaaccactttgcctgcgaaatcctgtcccttattaagctcacttgctcagacacgtcacttaacgaattcatgatcctcatcacatcaatttttacactgctcctccctttcggttttgtgctgctgtcttacatccgcatagccatggccattatacggatcaggtccctgcagggaagattgaaggcattcactacctgtggttcacaccttacagttgtaacgattttttacggctctgccatatcaatgtatatgaagacccagtcaaaatcatatcccgaccaagataagttcatttccgttttctatggagccctaactcccatgctgaaccctctaatttacagtctgcgcaaaaaggacgtgaaacgagccatcagaaaggttatgctgaaacgtacttag

SEQ ID NO: 28285 - DNA, 939 bp, Artificial Sequence
  Description of Artificial Sequence: Synthetic coding sequence
atggagccactcaatcggaccgaggtatccgagtttttcctcaaaggattcagtggatatccggccttagagcacctgctgtttccactgtgcagcgccatgtatcttgtgactctcttaggaaacacagccattatggccgtatcagtgctggatatacacctgcatactccagtgtatttttttctcggaaacctgagtactctggatatttgttacacccccacatttgttcccctcatgcttgtgcatctcctgtcctcacggaagacaatcagctttgcagtgtgcgccatccagatgtgcttatctttgtctacagggagcactgagtgtctcctcctggctattaccgcctatgatcggtatctcgcaatttgtcagccactccgataccacgtcttaatgtcacaccggctgtgtgtgcttctcatgggtgccgcttgggtgctgtgccttctgaaatccgtgacggagatggtaatctctatgcgattaccattctgcggacaccatgtggtgtctcactttacctgtaaaattctcgctgtgctcaagttggcctgtggaaatacgagtgtgagcgaggacttccttttagcaggaagcatcctgctcctcccagtgcccctcgctttcatttgtcttagctatctgctcattctggcgaccatcttgagggtgccttctgctgctcggtgctgtaaagcttttagcacctgtctggcgcacctagcagttgtccttctcttctacgggacaatcatctttatgtacctcaaacccaagtccaaagaagctcacatcagcgacgaggtattcaccgtcctgtacgccatggtgactactatgctgaaccccaccatttattcactgcgcaataaggaagtgaaggaggctgcccggaaagtttggggacggagccgtgcttcaagatag

SEQ ID NO: 28286 - DNA, 930 bp, Artificial Sequence
  Description of Artificial Sequence: Synthetic coding sequence
atggcaaacctgaccatcgtgactgagtttattttgatggggtttagcactaataaaaatatgtgcattttacattccattttgtttctgctgatttatctctgtgccctgatggggaacgtgttgatcataatgattacaacactggatcaccacctgcatactcctgtctattttttcttgaaaaatctgtcattcctcgacctgtgtcttatcagtgtaaccgctcccaagagcatcgccaacagtttaatacataacaacagtatttctttcctcggatgtgttagccaggttttcctgctactgagttctgcgagcgccgagttgctacttctgaccgtcatgtcatttgaccgctatacagctatctgtcaccctctccactacgacgtgataatggataggtcaacctgcgtgcaaagggctaccgtcagctggctgtacgggggcttgatcgccgttatgcataccgccggcaccttctccttgtcctactgtggcagcaatatggtccatcagtttttctgcgacatacctcagctgctcgccatcagttgtagtgaaaatctaatccgggaaatcgctcttatactgattaatgtagtccttgacttctgttgcttcatcgtgattattattacctacgtccacgttttctcaaccgtgaagaagatcccatccacagagggacagtctaaagcttacagcatttgtttgccccacctgctggttgtgctgttccttagcaccggatttattgcatacctgaagcccgcgagtgaatcgccctctatattagacgccgttatcagcgtcttctatacgatgctgcctccaacatttaatccgataatttacagtctgagaaataaggccattaaggtggccctgggaatgctgataaaggggaagctcactaagaagtag

SEQ ID NO: 28287 - DNA, 945 bp, Artificial Sequence
  Description of Artificial Sequence: Synthetic coding sequence
atggccaacgtgactctcgtcacagggttcctgctaatgggcttcagtaatatccaaaagcttcggattctttatggggtcttgttcttacttatctacttagccgctttgatgagtaatcttttgatcataacactgattacactggacgtgaaactccagaccccaatgtatttctttcttaagaacctatcgttccttgacgttttcttggtgagcgttcccatacccaaattcatcgtcaataatttgactcataataacagcattagtattctggggtgcgcttttcagctcttgctcatgacctccttctccgctggagagatctttattctgacagcaatgagctacgatcggtacgttgccatttgttgtcctctcaattatgaggttatcatgaatactggagtgtgcgtactcatggcgtctgttagctgggccatagggggcctgttcggtactgcctatactgccggcacattttccatgcccttttgtggatcatctgtgatccctcagttcttttgcgacgtgccaagtcttctgcggataagctgttctgaaaccctaatggtgatctatgctggcatcggagtgggtgcttgcctatccatttcatgttttatttgcatcgtcatttcttacatttatattttcagcactgtgctcaaaattcctacaacaaaaggacagagcaaggcattctcaacatgctttccccatctcacagtgtttacagtgtttataattacagcttacttcgtatatctaaagcctccaagtaactcaccctctgtaatcgatagactgctgagcgtcatatacacagtcatgccaccagtgtttaatcccgtcacttactccctccgcaacaatgatatgaagtgtgctctaattcgactactgcagaaaacctatgggcaggaagcttattttatatag

SEQ ID NO: 28288 - DNA, 939 bp, Artificial Sequence
  Description of Artificial Sequence: Synthetic coding sequence
atgccaaatagtaccacagtgatggagttcctcctgatgaggttcagcgacgtatggactctgcagattctgcacagtgcctctttctttatgctatacctggtgacattgatgggcaacatattgatcgtcactgtgacaacctgcgacagctcgctccatatgccaatgtactttttcctccggaatttgtctatccttgacgcatgttacatctccgtgacggtccctaccagctgtgtgaactctttactggatagcactacaatctcaaaggccggctgcgtcgctcaagtatttttggtggtgttcttcgtgtacgtagaactgttgttcctaactatcatggcacacgaccggtacgtcgccgtctgccaaccactgcactaccccgtgattgtcaactcacgcatctgtattcagatgaccctggcctcactgttatcaggattagtgtatgctggcatgcatactggcagcaccttccagctgcctttttgcaggagcaacgtcatccatcagttcttttgcgatatcccttctttattaaaactcagctgttcggacactttctctaacgaggtcatgattgtggtcagtgcactcggagttggaggaggttgcttcattttcatcattagatcgtacatccatatttttagtaccgtgttgggattcccaaggggagctgacagaacgaaggcgttctccacctgcatcccacacatcctggtggtctccgtgttcttgtcttcgtgtagctctgtgtacctaagacctccggccattccagccgccactcaggatctgatcctgtccgggttttatagcatcatgccaccccttttcaaccccataatctatagcctgcgaaataaacagatcaaagtggccatcaaaaaaatcatgaagagaatattttattcagaaaacgtatag

SEQ ID NO: 28289 - DNA, 3666 bp, Artificial Sequence
  Description of Artificial Sequence: Synthetic coding sequence
atgatgttcagatcagaccgaatgtggtcttgccattggaagtggaaaccaagtcctctcctgttcctgtttgctttgtatattatgtgtgtaccgcacagtgtgtggggctgcgccaactgtcgtgtcgtgctgagcaatccatccggcacttttacttctccgtgctatcccaacgattaccctaactcacaggcatgcatgtggacgctgagagcccctaccgggtacataatccaaatcacattcaatgacttcgacatcgaagaggctcctaactgcatatacgactctcttagtctcgacaatggcgagtcccagacaaagttttgcggagccaccgccaaagggttgtccttcaatagttcagccaatgagatgcacgtgtcatttagctctgattttagcattcagaaaaaggggttcaatgcctcctatatcagagtcgctgtgtcattgagaaatcagaaggtgattctacctcagactagcgatgcctaccaggtgtctgtggctaaatccatatcaatccctgaactcagtgcgtttactctgtgttttgaggccacaaaggttggacatgaggattccgattggacagctttcagctacagcaatgcctcatttactcagctgctgagtttcgggaaagccaagtctggctacttcctgtccatttccgactccaagtgcctcctgaacaatgccctcccagttaaagagaaggaggatatcttcgccgaaagcttcgaacagctttgcctggtgtggaacaactcactgggctctattggtgtaaactttaagcgaaactatgaaaccgtcccttgtgattccacaatctccaaggtgatcccgggaaacggaaagctgctgctcggatccaatcagaacgagatagtgagcctgaaaggagatatctacaatttcaggctgtggaactttactatgaatgccaagatcttaagtaatcttagttgcaatgtgaaagggaatgtcgtggattggcaaaatgacttttggaacatcccaaacctggcccttaaagccgaatcaaacctgtcctgtggcagttacctcatccctctgccagccgcagagcttgcttcttgcgcggacctcggcactttgtgtcaagcgacagtgaattccccttcgaccaccccgcccacagtcacgacaaatatgccagtaacgaaccgaattgacaagcagaggaatgatggcatcatatacagaatttctgtcgtaatccagaatattttacgccatcccgaggtcaaggtccagagcaaagtggctgaatggctgaattccaccttccaaaattggaactataccgtctatgtggtgaacatctcttttcatctctctgccggggaggataagatcaaggtcaagagaagcttggaggatgagcctcgcctcgtgctctgggctttactcgtctataacgcaactaataacacaaatctggaaggaaagatcatccagcaaaaattgcttaagaataacgagtcactggatgaggggctgcgcctgcacaccgtgaacgtgcgtcagcttggacattgccttgccatggaggagcctaaaggttactattggcccagcatacaaccttctgagtatgtgctcccgtgtcctgataaaccaggtttctcagcaagccggatatgcttttacaacgccactaatcctcttgtcacgtattggggtccagtggatatatccaattgtctcaaagaggcaaatgaagtggccaaccaaatcctgaacctgaccgctgatggacagaatctgactagcgcaaacattactaacattgtggagcaagttaagcggatcgtcaataaagaagaaaacatcgacataactctgggatccactctcatgaacattttttctaacatactctcatcatctgatagcgatttattagagtcttcaagtgaggctcttaagactatcgacgaactggctttcaaaattgacctgaatagcacctcccacgtaaacattactactaggaaccttgctctgtcagtgtccagtctgctccccgggaccaacgcaatctccaacttctccataggcctgccttcaaacaatgagagctattttcaaatggacttcgagagcgggcaggtcgacccattagctagcgtgatcctacccccgaacctgcttgaaaacctgagccctgaggactccgtgctggtgcgccgcgcccagtttacttttttcaacaagaccggtctgtttcaggacgtcgggcctcaaaggaagacgctcgtctcatatgtgatggcctgctcaattggcaacataaccatccagaaccttaaggaccccgtgcaaattaagattaaacatactaggactcaggaagtccaccaccctatctgcgccttttgggacctgaacaagaataaatcgtttgggggatggaatacctctggctgcgtggcccacagggacagcgatgccagcgagacggtgtgcctgtgcaatcatttcactcattttggcgtgcttatggaccttccaaggtcagcctcccagcttgacgctcgtaataccaaagtcctcacgtttatcagctacatcggttgtggcatttccgcaatctttagcgctgcaacactgttgacctatgtggcctttgaaaagctgcgccgggactatccaagtaagattcttatgaacctctccaccgcactgctgttcctgaatctgctgttcctcttggacggctggatcacaagttttaacgtggacggcttgtgtatcgcagtagccgtgctgctgcacttcttcttgctggccacctttacctggatgggccttgaagctattcatatgtatatagctcttgtaaaagtctttaatacctacatccggcgatatatcctaaaattctgtattatcggctggggccttccagccctggtggtatctgttgtcctcgctagccggaataacaacgaggtctacggaaaagagtcttacggcaaggaaaagggcgatgaattctgttggattcaggacccagtcattttttacgtcacgtgcgccggctacttcggcgtcatgttctttctcaatatagccatgtttattgtcgttatggtgcaaatctgcgggaggaacggcaagcgatcaaacaggactctcagagaagaagtcttgcggaacctgcgtagcgtggtttcactaacattcctcctgggcatgacttggggattcgctttcttcgcatggggacccctcaacataccatttatgtacctgttcagcattttcaattcactccaaggcttatttatttttatcttccattgtgctatgaaagagaacgtgcagaaacagtggcggcagcacctgtgttgcgggaggtttcgcctggccgataacagtgactggtcgaagaccgcaaccaacattataaagaaatccagtgacaacctcgggaaatctctaagcagctccagcattgggtcaaattcgacctacttgacatctaagtctaagagttctagcacaacgtatttcaagaggaatagtcataccgacaatgtgagctatgagcacagcttcaacaaatccggcagcctacgacaatgctttcacggccaggtgctcgtgaagacgggcccctgttag

SEQ ID NO: 28290 - DNA, 966 bp, Artificial Sequence
  Description of Artificial Sequence: Synthetic coding sequence
atggttaatttaacctcaatgtcggggtttctgttaatgggattttctgatgagcggaaactgcagatccttcacgcgctcgtgtttcttgtgacctatctgctggccttgactgggaatctacttatcattactattattacggtggatcgacgactgcactccccaatgtactatttcctgaaacacttaagcctgctggatctgtgtttcatatctgtgacagtgcctcagtcaatcgcaaacagcttaatggggaacggctacatctccctggtgcaatgcatactgcaagtgttttttttcatcgctctcgcaagctctgaagtggccatactaactgttatgtcctacgaccgctatgcagccatctgccagccactacactatgagactatcatggatcctagagcatgtcggcacgccgtcattgcagtttggattgcgggcgggctgtccggtctgatgcatgcagcaatcaacttttcgatacccctgtgtgggaaacgcgtcatccaccagttcttctgcgacgtgccgcaaatgcttaaactggcgtgtagttacgagtttatcaatgaaatcgcactggctgctttcaccactagcgcggccttcatatgcctgatttcaatagtcttaagctacatccggatcttcagcaccgtgctgcggattccgagcgcggagggacgcaccaaagtgttttccacctgtctgccccacctgtttgtcgccaccttcttcctgtccgctgctggttttgaatttttaagactaccatcagattcaagcagcaccgtggatcttgttttttccgtgttctatactgtcatcccgcccaccctcaatcccgtcatctatagtctcagaaacgacagcatgaaagctgccctccgcaagatgctgtccaaagaggagctccctcaaaggaaaatgtgcctgaaagctatgttcaagctgtag

SEQ ID NO: 28291 - DNA, 966 bp, Artificial Sequence
  Description of Artificial Sequence: Synthetic coding sequence
atggttaacctgaccagcatgagcgggttccttctgatggggttcagcgatgaacggaagctccagatactccacgcacttgtctttctggttacctaccttctagcattgaccgggaatttactaatcatcaccataataacggttgatagacgcctccattctccaatgtactattttctaaagcatctgtctctattggacttgtgtttcatttcagtaaccgtgccacagagtattgccaattcgttgatgggaaacgggtatatttctctcgtccagtgtatcctgcaggttttttttttcattgccctcgccagctcagaggttgctatcctgactgtgatgagctatgacagatacgctgctatctgccagccactccactacgagaccatcatggacccgcgggcctgccgacacgctgtcatagccgtctggatcgccggggggctcagcggacttatgcatgcagccatcaacttctctattccattatgcggcaaaagggttatccaccagtttttttgcgatgtcccacagatgctcaagctggcttgcagctacgagtttatcaatgagattgctctcgccgcattcactacatccgctgccttcatttgcctgatctctattgtgctgtcctacatccggatttttagcaccgtactccggataccctcagcagaaggtcgcacaaaagtctttagtacttgtctcccccacctcttcgtggctacatttttcctctccgcagctggattcgaatttttacggttgcctagtgacagtagctcaaccgtggacctggtgtttagtgtgttttacacagttatcccccccaccctcaaccccgtcatctactcacttcgcaatgacagtatgaaggcagcactgaggaaaatgctcagtaaggaagaacttccgcagcgcaagatgtgtctgaaagctatgttcaaactgtag

SEQ ID NO: 28292 - DNA, 945 bp, Artificial Sequence
  Description of Artificial Sequence: Synthetic coding sequence
atgaccaaccagacccagatgatggaattcctgcttgtgcgttttaccgagaactgggtactgttgaggctgcacgcgctgctcttttctctgatttacttgacagctgtgctcatgaatctggtcatcatcttgttaatgatcctcgaccacagactacacatggcgatgtactttttccttcgacatttgtcttttctggacctgtgcctgatctccgcaactgttcccaaaagcatcctcaactccgttgctagtactgattccatctccttcctgggttgtgtgctgcagcttttccttgtggtacttctcgccggctctgagattggaattctcactgcgatgtcctatgatagatacgccgctatttgctgtccactccactgtgaagcagtcatgagcagaggcctttgcgttcaactaatggccctgtcatggttgaacagaggggctctgggattgctgtataccgctggcaccttttccctgaatttctatgggagtgatgagctacatcagttcttctgtgacgtccctgccctcctgaagctgacctgcagcaaggaacacgcaataatctccgttagcgtggctattggagtctgctacgcattctcttgcctggtgtgcatcgttgtgagttacgtgtatattttttccgctgttctcaggatcagccagagacaacgccagtcaaaagcctttagcaattgcgttcctcacctcatagtagtgaccgtctttcttgtgactggcgctgttgcgtatttaaagcctggttccgacgctccaagcattttagacctactcgtgtcagtgttttactcggtggccccgccgaccctcaatccggtcatctactgtctgaaaaataaagatataaaatccgcactgtccaaggtgctctggaacgttcgcagttccggagtgatgaaacgttag

SEQ ID NO: 28293 - DNA, 933 bp, Artificial Sequence
  Description of Artificial Sequence: Synthetic coding sequence
atgggtgagaatcagacaatggtaactgaatttctactgctgggctttttacttggaccgaggatccagatgctcctgtttgggctgttctccctcttctatatttttacactcctcgggaatggcgccattcttggcctgatttctttggattctcgcctgcatacccctatgtatttctttctgagtcacctggccgtggtagatatagcttatacacgcaacaccgttccccagatgttggcaaatttactgcaccctgcgaaacccatttcttttgctggatgcatgactcaaacctttttatgcctgagttttgggcactccgagtgcttgctgctcgtcctgatgtcctatgatagatatgtcgctatttgtcatccactgagatattccgtgatcatgacctggcgggtgtgtattaccctcgctgtgaccagctggacgtgcggtagtttgctcgctttggcacacgtcgttctcatcctgagactgcctttctctgggcctcatgagattaatcactttttttgtgagatcctgtcagtcctgcggttagcatgtgcagacacctggttgaaccaggtcgtgatttttgctgcatgcgtcttctttctcgtgggtcccccttcactggtgctggtgtcttacagtcatattttagctgctatcctcagaattcagagtggagagggccggcgcaaggcgttttcgacttgttccagtcacctatgcgtggttggactgtttttcggctctgccattattatgtacatggctcctaagagcagacaccctgaagagcaacagaaagtatttttcctgttctactcattcttcaatccaactcttaaccccctgatatacagcctccgtaatggggaggtaaaaggggccttgcgtagggccctgggcaaagagtcccactcttag

SEQ ID NO: 28294 - DNA, 933 bp, Artificial Sequence
  Description of Artificial Sequence: Synthetic coding sequence
atggagagcaaccaaacatggatcactgaggtgatactactaggcttccaggttgatccggccctcgagctctttctgttcgggttctttttattattctactcattgaccctcatgggaaacggtatcattctcggcctcatctacctcgactcacgactccacactcccatgtatgtgttcctgtcccatctggcaattgtcgacatgagttatgcttctagcaccgttcccaaaatgctcgccaacttagtgatgcacaaaaaagttatcagtttcgctccctgtatactccagacctttctgtacctggctttcgcaatcaccgaatgcttaatccttgtcatgatgtgctatgatcgctacgtagcaatttgccatcccttgcagtacacccttataatgaactggcgcgtgtgtaccgtgctggccagtacctgctggatcttttccttcctgctggcgcttgtgcatattaccctaatccttcgccttcccttctgtggcccccagaagattaatcatttcttctgccagataatgtccgtcttcaagctggcctgcgcggatactcgcttgaaccaggttgtactgttcgcagggtcggcttttatcctcgtggggccactttgtttggtcctggtgagttacctgcatatcctggtcgccatcctaaggattcagtctggcgaaggtcggagaaaagccttcagtacctgctcttcgcacctgtgtgtggtgggcctattctttggtagcgccatagtcatgtatatggcgcctaagtcttctcattcccaggagcgccgcaaaatcttgtccctattctattcactgtttaatcccattctcaatccactcatctatagcctccgtaacgctgaggtgaagggggcactgaaaagggtcctgtggaagcagagatcaatgtag

SEQ ID NO: 28295 - DNA, 933 bp, Artificial Sequence
  Description of Artificial Sequence: Synthetic coding sequence
atggaaggtaataaaacttggattaccgacattacattgccaaggtttcaggtaggtccagctctggaaatcttactatgtgggttattcagtgctttttacaccttgacgctcctaggcaatggcgtcatattcggtataatctgtcttgactgcaagcttcacactcctatgtacttcttccttagtcatttggcaatcgttgacatctcatacgccagcaactatgtgccaaagatgcttaccaacttaatgaaccaggagtctactatcagcttctttccttgtatcatgcagacctttctgtacctggcatttgcgcacgtggaatgtcttatccttgtggtcatgtcatatgatcgttacgcagacatctgtcaccccctgcgatacaacagcctgatgagctggagagtctgcactgtactggctgtggctagctgggtgttttccttcctcctggctctggtgccattagtgctgatactgtcgctgcccttctgtggaccccatgaaataaaccactttttctgcgaaatcctgagtgtgctgaaactggcctgcgctgatacttggcttaaccaggtggttatcttcgccgcctgtgtgttcatattggtgggccctttgtgcctcgttctagtgtcctacttaagaatcttggctgctattttgagaattcagagtggcgaggggcgccggaaggccttttcaacctgctcttcgcacttatgtgtggtgggcttgtttttcggcagcgccattgtgacttacatggccccgaagagccggcaccccgaggaacaacagaaggtgttatcactcttctacagcctgttcaatcccatgctcaaccccctgatatactctctgcgtaacgcagaagtgaagggtgccctcagaagagcgcttcgaaaggaacgtctcacctag

SEQ ID NO: 28296 - DNA, 957 bp, Artificial Sequence
  Description of Artificial Sequence: Synthetic coding sequence
atggagggcaatcagacttggataactgacattacactcctgggcttccaggtcggccctgctcttgctatcttgctgtgcggcttgttcagtgtcttttacacactgaccttgctgggaaatggagtgatctttggcatcatatgtctggactccaaacttcacaccccaatgtacttctttctcagccatttggccatcatcgacatgtcctatgcgtcaaataacgtccctaaaatgctggctaatctgatgaaccaaaaacgcaccatcagcttcgtcccatgcattatgcagacatttttgtatcttgctttcgctgtgacggagtgtttaatcctggtggtaatgtcctacgacagatacgtagccatttgtcacccattccaatacacagtgattatgtcgtggcgcgtatgcacaattctggtgctcacctcatggtcttgcggtttcgccctgtctctggtgcacgaaattctgttgttgcggctccctttctgcggacctagggacgtgaaccatctgttctgcgagatcctctctgttctgaaactggcctgtgctgatacctgggtgaaccaggtggttattttcgcgacgtgcgtcttcgtgctcgttgggcccctgagtttgatcctggtgtcatacatgcatattcttggggctattttaaaaatacagacaaaggagggcaggattaaggcattttcaacctgtagtagtcacctctgcgttgtggggctgttttttggaatcgcaatggtggtgtatatggtgcctgacagcaaccagcgggaagagcaggaaaaaatgctgtcactatttcactccgtcttcaacccaatgcttaacccacttatttattctctgagaaacgctcagctgaagggcgctctgcatagagcgctacagcggaaacgctctatgcgaacggtgtatggcctgtgcctgtag

SEQ ID NO: 28297 - DNA, 933 bp, Artificial Sequence
  Description of Artificial Sequence: Synthetic coding sequence
atgggagggaaccagacctctattacagagttcctgttacttggctttccaatcggaccgagaattcaaatgctcttattcgggttgttctcacttttctacatctttattctgcttggaaacggtactatactgggactgattagcctggattccaggctgcacacccccatgtactttttcctgtcgcatctcgccgtggtcgatatcgcttgtgcctgtagcactgttcctcagatgcttgtgaatttactccatccagccaagcctattagctttgccgggtgtatgacacaaatgttcttgttcctgtcattcgcacatactgaatgcctgttgctggtggtcatgagctatgatagatatgtggccatatgtcacccactgcgctactctaccatcatgacctggaaggtatgcatcacgctagccttgacaagttggatacttggtgtactcctagccctggtccatctggtcctcctccttccactgagcttctgtggcccacagaagctgaatcacttcttctgcgaaatcatggcggtgctgaaacttgcctgcgccgacacccacatcaatgaggtgatggtcctcgcgggggcggtctcagttctggttggggccttcttcagcaccgtcatcagctacgttcacatcctgtgtgcgatactgaagatacagtccggagaaggctgccaaaaggcattctctatctgcagtagtcatttgtgcgtggtaggtctgttctacgggacagccataattatgtatgtggaacctcaatatgaaagccctaaagaacaaaaaaaataccttttgctctttcactccctatttaatccaatgttaaatcctttgatctacagcctgcgcaataaagaggtacagggaactctcaagcggatgctggaaaagaagcgtacctcttag

SEQ ID NO: 28298 - DNA, 933 bp, Artificial Sequence
  Description of Artificial Sequence: Synthetic coding sequence
atgggagataatatcacttcaattcgggagtttctgctgctgggcttccccgtaggacctcgcatacagatgcttctgtttggactcttctccctgttttatgtctttactttgttgggaaacgggaccattctagggttgatctccttagactctcgcctgcatgccccgatgtacttcttcctgagtcacctggcggtcgtggacatcgcctacgcgtgtaacacagttcctcgaatgttggtgaacttactgcacccagcaaagcccattagtttcgctggacggatgatgcagacttttcttttttctacctttgccgtgaccgagtgcttgctcctggtggttatgagctacgacttatacgtcgccatctgtcatccactgaggtatctagcaatcatgacatggcgcgtgtgtatcacattggcagtgacgtcctggaccacgggtgtgctactgtctctgatccatttagtgctgctactccccttgcccttttgtcgccctcagaagatctaccattttttttgtgaaatcctggctgtgctaaaactcgcctgtgccgatacacatattaacgagaatatggttctcgccggcgctatctctggcttggtcgggcctctgtcaactatcgtcgtttcctatatgtgtattctttgcgccatactgcagatccagagcagggaagtgcagcggaaagcatttagaacgtgtttctctcacttatgtgtgataggcttagtgtatggcacggctattattatgtacgtgggtcccagatatggcaatcctaaggaacagaaaaagtatctcctcttgttccatagtctctttaatcctatgctcaatcctctgatttgtagcctgaggaactctgaggtaaagaatactctgaagcgggtactgggcgtcgagcgcgccttgtag

SEQ ID NO: 28299 - DNA, 933 bp, Artificial Sequence
  Description of Artificial Sequence: Synthetic coding sequence
atgggggaaaatcagacaatggtaacagagtttttgctgctgggctttctcttgggacccaggatacagatgctcctgttcggattgttcagcctattctacatcttcacactgttgggtaatggagcaattcttggacttattagcctggattcaagactgcatacccctatgtacttcttcctctcccacctcgccgttgtagacatcgcatacaccagaaatactgtcccacagatgctagccaacctgctacaccccgccaaacctatatccttcgctggttgcatgacacagacttttctgtgcttgagttttggtcattccgagtgtctgttgttggtgttgatgagctacgaccgttatgtggccatctgccatcccctgaggtattccgtgatcatgacatggcgggtctgcatcactctggccgtgacctcatggacctgtgggtccttgctggcactggctcatgtggtcttgatcctccgcctgccatttagtgggcctcacgaaattaatcatttcttttgtgagattctgagtgtgcttcgccttgcatgcgctgacacctggttgaatcaagtcgtgatctttgcggcctgcgtgttttttctggtaggtccaccctctttggtgttagtttcatactcccacatccttgctgccatcctccgcatacaatctggagaaggccgcagaaaagccttttctacatgcagcagccatctttgcgtggtgggactcttctttggctcggccattatcatgtacatggctcccaaatctcgccaccccgaggaacagcagaaggtcttctttctattttactctttttttaacccgactctcaacccactgatctattccctgaggaatggtgaggtcaaaggagccctgcgacgggctctcgggaaagagtcccactcctag

SEQ ID NO: 28300 - DNA, 936 bp, Artificial Sequence
  Description of Artificial Sequence: Synthetic coding sequence
atgactaaaaaccaaacatgggttaccgagttcattctgttgggattcccactttccctgagaatccagatgcttctgagtggtcttttttctctcctgtacgttttcacactgctgggaaatggcgccatattggggttgatttggctagatagccgattgcacacacccatgtacttcttcctctcccatcttgctattattgatatcagctacgcgtccaacaacgtccccaaaatgctaacaaacctggggttgaacaaaagaaagacaatcagttttgtcccatgtacgatgcagacattcctatacatggcgtttgcacacaccgagtgcctcatcttagtaatgatgtcctacgacaggtatatggcgatctgccacccattacaatacagcgtgatcatgaggtggggggtgtgcactgtcctggctgtgacctcttgggcatgtggatcactcctcgctttggtacatgtggtcctgatcctgagactccctttctgtggacctcacgagataaaccattttttttgtgaaatcctcagtgtgctgaaactggcttgtgccgatacctggctgaatcaggtcgtgatatttgcagcttccgtgtttattctcgtgggtcctttgtgtctggtgctggtgtcctactcacggattctggctgcaattctcagaattcaaagcggcgaggggcgacgaaaggcctttagcacttgctccagccacctgtgcatggtaggactcttctttggaagcgctatcgtcatgtacatggccccgaagagccggcacccggaggaacagcagaaggtgctatcactgttttactctctgttcaatcccatgctgaatccactcatatacagtctaagaaacgcagaagtaaagggcgctctcaagcgcgtgctgtggaaacaaaggtcaaagtag

SEQ ID NO: 28301 - DNA, 933 bp, Artificial Sequence
  Description of Artificial Sequence: Synthetic coding sequence
atgggggacaacatcacttcgatcactgagttcctactgctgggctttccagtgggccctcgaatacaaatgctcctgttcggtctgttctccctgttttacgtatttaccttattagggaatgggacaatcttgggtttgatctccttggattcccgcttgcatgctccaatgtatttcttcttaagccacttggcagtggtcgacattgcgtatgcctgcaataccgttcctaggatgctggtgaacctcctccacccagccaaaccaatttcctttgctggacgcatgatgcagacgttcctattttccacattcgctgtgaccgagtgcctgctcttagtggtgatgtcctatgatctgtacgtggcaatttgtcatcccttacgctacctggcaattatgacctggcgagtgtgcatcaccctggccgtaacttcttggaccactggggtactgttaagtcttatccatctggtactgctgctgcctctgccattctgtcgaccacagaagatctatcacttcttttgcgaaatcctggcggtactgaagctcgcctgtgcagatacacacatcaatgagaatatggttctggctggtgccatcagcggcttggttgggcctctctctactattgtggtgagctacatgtgcatcctctgcgctatccttcaaattcaatctcgagaggtgcagaggaaggccttctgtacctgcttctcacacttgtgtgtcataggtctgttttatggtaccgcaatcatcatgtacgttggccctaggtatggaaacccaaaggaacagaagaaatacctgcttctattccattccctctttaaccccatgctgaatcccttgatttgcagtctgcgcaactccgaggtaaaaaatacactcaaacgagtgttgggagtggaacgggcactgtag

SEQ ID NO: 28302 - DNA, 972 bp, Artificial Sequence
  Description of Artificial Sequence: Synthetic coding sequence
atgtggcagaagaatcaaaccagcctggctgactttatattggagggactatttgacgacagcttgacacatttgtttctcttcagtcttactatggtagtattcctgatcgctgtctcaggaaatacattgactatacttctcatttgtattgatcctcaacttcacacccccatgtatttcctgctatcgcagctctcgctgatggatctgatgcatgttagcaccatcatcctcaaaatggcaactaactacctcagcggaaaaaagtcaattagtttcgtggggtgcgctacccagcatttcctgtacctgtgtctcggcggtgctgaatgcttcttgctcgcggtgatgtcttatgatcgttacgtcgccatttgtcatcccctgagatacgccgtgctcatgaacaagaaggtgggcctgatgatggcagtgatgtcttggcttggggctagcgtaaatagtttgattcacatggcgatcctgatgcattttccgttttgtgggccaaggaaggtctatcatttctactgcgagtttccagctgtcgtgaaacttgtatgcggcgatatcacagtatacgagactacggtctatatatcatctatccttctgctgttgcccatctttctaatttcgactagctacgtcttcattcttcagtccgtaattcagatgcgcagttccggaagcaaacggaacgcctttgcaacctgtggctcacacttaacagttgtgagtctctggttcggagcatgcatattttcatacatgcgaccgaggtctcagtgcactttattgcaaaataaggtgggatccgtgttttattccatcatcacccctacactcaacagtcttatatatactctgaggaacaaggacgtagcaaaggccctgaggcgagtgcttagacgagacgtgattacccagtgtatccaacgcctgcagttgtggctccccagggtgtag

SEQ ID NO: 28303 - DNA, 951 bp, Artificial Sequence
  Description of Artificial Sequence: Synthetic coding sequence
atggagttgtggaatttcacgctggggagtggctttattttggttggaattctcaacgactctggcagtccggaattgctgtgtgccactattacgatcttgtacctcctagccctcatcagcaacgggcttcttctgctggccataaccatggaggccaggctccacatgcccatgtacctgctgctgggacaactctctttgatggacttgctgttcaccagtgttgtaactcctaaagccttagccgactttctccggagggaaaataccataagctttgggggttgtgcactccagatgtttttggccctgacgatggggggagccgaggatttacttctggccttcatggcttacgatcgatatgtggctatctgccaccccttaacctatatgacacttatgtcgtctagagcgtgctggttgatggtggcaacatcttggatcctggccagtctgtcggctttgatctacacagtgtacacaatgcattaccctttctgccgggctcaagagataagacacctactctgcgaaattcctcaccttctgaaagttgcatgcgcagacaccagtaggtacgaattaatggtctacgttatgggggtgacattcctcattccttccctggcggccattctcgccagctatactcagatccttctcacagtactgcatatgccgagtaatgaggggcgtaagaaggccttggttacctgttccagccacctgacagtagttggtatgttttacggggccgcaactttcatgtacgttcttccctctagtttccacagcacccggcaagataacatcatcagcgttttctataccatcgttactccagctctgaacccccttatatactctctgcgaaataaggaggtgatgagggcattgcgccgagtactgggaaaatacatgttacccgcccatagtaccttatag

SEQ ID NO: 28304 - DNA, 987 bp, Artificial Sequence
  Description of Artificial Sequence: Synthetic coding sequence
atgggccaccaaaatcacaccttctcatcagatttcattctccttggccttttctcttcatcccctacatcagtggtgttcttcctcgttcttttcgtgatcttcattatgagcgtaaccgagaatacactaatgatcctgttgattcgaagcgatagccgcctgcacactccaatgtatttcttgctgtctcatctcagtctcatggacattctccacgtgtccaatatcgtgcctaagatggttacgaatttcttaagcggatcacgcacaatttcatttgccgggtgtgggttccaggtgttcttgagtctgacactgctgggtggcgagtgtctcctcttggccgccatgagctgcgaccggtacgtcgctatttgccaccccctgaggtaccccatcctgatgaaagagtatgccagtgccctgatggctggagggtcatggcttataggtgtatttaactcaacggttcatacggcatatgccctccagtttcctttctgcggtagcagggcaatcgaccatttcttctgtgaggtcccagctatgctcaagctgtcatgcgccgacacgactcgctatgagcgtggtgtgtgtgtatccgctgtcatctttttattaattccattctcattgatcagcgccagttatgggcagattatcctgaccgtcttgcagatgaaatctagtgaagcacggaaaaaatcattttccacatgctcttttcacatgatcgtagtgactatgtactacgggccattcatctttacctacatgcggccgaagtcttaccatactcccggacaggataagtttttagccatcttttacaccattctcacaccaacactaaaccctttcatatactcctttagaaataaggacgttcttgccgtcatgaaaaacatgcttaagtccaactttttgcacaaaaaaatgaacaggaagatacctgagtgcgtcttttgcctctttctgtgctag

SEQ ID NO: 28305 - DNA, 1008 bp, Artificial Sequence
  Description of Artificial Sequence: Synthetic coding sequence
atgaacatctcagacgtgatatctttcgacattttggtcagtgcgatgaaaaccggtaaccagtcatttggaacagacttcctgctggtagggttatttcagtatggttggatcaatagcctattgttcgtggtgattgcgacacttttcacagtggcgttgaccgggaacataatgctaattcacctcatccgtctgaatacacgcttgcacacacctatgtatttccttttgtctcaactttcaatagtagatctgatgtatatttctacgaccgtgccaaagatggctgtgagctttctgtcacagtccaagaccatacggttccttggttgtgaaatccagacctacgtgttcttagcactggggggtaccgaggccttgctgcttggcttcatgagctatgatcggtacgtggctatctgccatcccctgcattatccaatgctgatgtccaaaaaaatctgttgtctgatggttgcctgcgcctgggcatctgggtcaataaacgccttcatacacaccctgtacgtctttcagcttcccttttgcagatcacgactgatcaaccactttttctgtgaggtgcccgccctgcttagcctcgtgtgccaggacacctcgcagtatgaatacactgtgctactgagcggccttatcatcctcctgctgcccttcttagcgatcctggctagttatgcgcgcgtgctgatcgtggtctttcagatgagttcaggtaaagggcaggctaaggctgtcagtacttgcagttctcacctcattgttgctagcctgttctatgcgacaactttgtttacgtatactaggcctcacagcctgagatccccatcaagagacaaggcggtggcagtgttctacaccatcgttacacctctgttgaatcccttcatatactcactgagaaataaggaggtgacaggtgcggttagacgcttactcgggtactggatttgctgtcgtaagtacgacttccggagtctctactag

SEQ ID NO: 28306 - DNA, 930 bp, Artificial Sequence
  Description of Artificial Sequence: Synthetic coding sequence
atgaaaaacaaaaccgttcttactgaatttatcctactgggcctgaccgatgtgcctgaactgcaggtcgcggtttttacattcctcttcttggcctatcttctgtctatcctgggcaatctcacaatccttatactgacccttctggattcccacctgcaaacacccatgtattttttcttgcgcaatttcagctttctggagatttccttcacaaacattttcatcccccgggtcctgatcagcattacaaccggtaacaagtccatttctttcgccgggtgcttcacgcagtattttttcgcaatgttcctgggagcgactgagttctatctgcttgccgcaatgtcctacgatcgctatgtggctatctgcaagcccttgcactacactactatcatgtcaagtagaatatgtattcagctgattttttgttcctggctcggcggactgatggctattattccaacaatcaccctaatgagccagcaggatttttgcgcctccaacagactgaaccactacttttgtgactacgagcctctactagagctgagttgcagcgatacttctcttatcgaaaaagtcgtttttttggttgctagcgtgactctggtggtcactttggtcttggtgattttatcgtacgcctttattattaagacaatcctgaagttgccatctgcacagcagcgtaccaaagccttctcaacatgttcatcgcacatgatagtaatcagccttagctatggaagctgtatgtttatgtatataaacccgagcgccaaggaaggcgacacctttaataagggggttgccctcttgattacctcagtcgccccactcctcaaccccttcatctatacactccgcaatcagcaagtgaaacaaccgtttaaggatatggtgaaaaagttgctgaatctctag

SEQ ID NO: 28307 - DNA, 963 bp, Artificial Sequence
  Description of Artificial Sequence: Synthetic coding sequence
atggacgcaaccgcctgcaacgaatccgtcgacggcagcccggtgttttatctgttgggtatcccatctttacccgagacctttttcctgcccgtgttcttcatctttttactcttttatctgttgatcctaatgggcaatgcgctcatcttggtcgctgttgtggccgaaccatccctgcacaagcctatgtatttcttcttgattaatctgtcaacactggatatattgtttaccacgaccacggttccaaagatgctgtccttattcctcttgggcgatcgattcctgtcctttagcagctgccttcttcagatgtacctgttccagagcttcacgtgctctgaggccttcattcttgttgtgatggcatacgatcggtatgtggccatttgccacccgctgcactaccctgtcctcatgaaccctcagacaaatgctaccctcgctgccagcgcatggctgaccgccttactgctgcccattcccgcagtcgttaggacctctcagatggcgtataatagcatcgcgtatatctaccactgcttctgcgaccacctggcggtcgtgcaggctagctgtagcgacactactccccagacactgatgggattctgtattgctatggtcgtctctttcctgccccttttgttggtgctgttgagctacgttcatatccttgcctcagtgctgcggattagcagcctggagggacgcgctaaagcttttagtacatgcagcagccacctcctggtggtggggacgtactactcttcgattgccattgcctacgttgcttacagggcggaccttccactggatttccacattatggggaacgtggtgtatgctatcctgacccccatcttaaaccctttgatttataccttacggaatagggatgtgaaagcggccataacgaagatcatgtcccaagatccaggctgtgacagatctatttag

SEQ ID NO: 28308 - DNA, 954 bp, Artificial Sequence
  Description of Artificial Sequence: Synthetic coding sequence
atgaagagtgataatcatagctttctgggtgattctcctaaggctttcattctgctgggggtgagcgatagaccttggctagaattgccacttttcgtggttttactgttaagttacgttctcgctatgctagggaacgttgctattattctggcttcccgggtcgacccacagcttcacagtcccatgtacatctttttatctcatctgtcatttctcgatctttgttacacaaccactacagtgcctcagatgctggtcaacatgggatcctctcagaaaacgatttcatacggaggctgtaccgtacaatacgcggtctttcactggctcggatgcaccgaatgtatcgtactggctgccatggccctggatcggtatgtggctatctgcaagcccttgcactacgcagtcctgatgcaccgagccctatgccaacagttagtggcattagcatggctgagtgggtttgggaattcgttcgtgcaggtggttctcaccgtgcagctgcccttttgcggtcggcaggtccttaacaactttttctgcgaggtgcccgcagtcataaagctttcttgcgcagacaccgccgtgaacgacacaatcctggctgtgttagtcgcctttttcgtccttgtgcccctggccctgattttgctttcttacggctttattgctcgggccgtgctccgaatacaaagctccaaggggcgacataaggcgtttggaacatgttcctctcacttaatgatcgtatctctcttctatctacctgccatctatatgtaccttcagccacccagcagctactctcaggagcagggaaagttcattagcctattttactcaattatcaccccaacactcaaccctttcacttatacacttcgaaacaaggatatgaagggcgccttgcggagactcttggcaaggatctggcgtctctgtgggtag

SEQ ID NO: 28309 - DNA, 1074 bp, Artificial Sequence
  Description of Artificial Sequence: Synthetic coding sequence
atgaactgggttaacaaatctgtcccacaggaattcatactgctggtcttcagtgatcagccttggttagagatccccccattcgtgatgtttttgttctcctacatactaacaattttcggcaaccttaccattatcctcgtgtcccacgtggactttaagctgcacaccccaatgtacttttttctgtccaatctgagtctcctggacctctgctacaccacaagcacagtgccacaaatgctggtgaacatctgcaataccagaaaagttatttcatatgggggatgcgttgcacaactgttcattttcctggctctgggaagtaccgaatgcctgcttttagctgtcatgtgcttcgatagatttgtggctatttgccggccattgcattacagcataatcatgcaccagaggctttgcttccaactggcagctgcctcgtggatctccggatttagtaacagcgtcctgcagtctacttggaccctgaagatgccgctctgcggacacaaagaggtcgatcacttcttctgtgaggttcctgctctgctgaaactgagctgcgttgatacgacagcaaacgaggccgaattgtttttcatctccgtcctgtttctgttgatcccagtaactctcatcctgattagttatgcgtttatcgttcaggccgttttgagaatccagtccgccgaaggccagcgcaaggcattcggtacatgcggttcacatctgattgtagtaagcctgttctacggcacggccatttctatgtacctgcaaccccctagtccctcttccaaagaccgaggaaagatggtgtccctgttttgcggaatcatcgccccaatgttgaatcccctcatctatactctcagaaacaaagaggtaaaggaggcgttcaaacgcctggtcgcaaagtccctgctcaaccaggaaataaggaacatgcagatgatcagcttcgccaaagatacagtcttgacctatctcacgaacttttccgcctcctgtcctatttttgtcatcacgatagaaaattattgcaatctgccacaacgcaagtttccatag

SEQ ID NO: 28310 - DNA, 942 bp, Artificial Sequence
  Description of Artificial Sequence: Synthetic coding sequence
atgaactgggagaacgagagctcacccaaggagttcatcttgctcggattcagcgaccgggcgtggctgcagatgccactgttcgtggtgctgctgatttcctacaccattactatatttgggaacgtatccataatgatggtgtgcatcctagatcccaagcttcatacacctatgtacttcttcctaactaatcttagcatactcgatctgtgctacacaacaaccactgtgccccacatgctcgtgaatatcggatgcaataagaagacaatcagctacgctggctgcgttgcacatctgatcatctttttagctcttggcgcaactgagtgcctgctgctagctgtcatgagcttcgacaggtacgtggcggtgtgccggccactccactatgtggtgatcatgaattattggttttgcctaaggatggcagccttctcctggctcatcggatttggcaactccgtcctgcagagttcactcaccctgaatatgccccgctgtgggcaccaggaagtggaccatttcttttgtgaagtgcctgcgctgctgaaactttcatgtgccgacaccaagcctatcgaggctgagctcttctttttcagtgtcctgattttactgatacctgtcacactgatcttgatcagctacggattcattgcacaggccgtgctcaagatcagatctgcagagggacggcagaaggcatttggtacctgcggatcacatatgatcgtggtgtctctgttttacggcaccgctatatatatgtacttgcagccgccctcatccacaagcaaagattggggcaagatggtatctcttttttacgggattattaccagcatgctgaacagcctcatctattcactgcgtaataaggatatgaaggaagcattcaaaaggctcatgccccgcatattcttctgcaagaagtag

SEQ ID NO: 28311 - DNA, 942 bp, Artificial Sequence
  Description of Artificial Sequence: Synthetic coding sequence
atgaattgggagaatgagtcatcccccaaagagttcatcctattgggttttagcgaccgggcctggctgcagatgccgttgttcgtggtgttgctgatttcgtatacgatcacgatctttggtaatgtcagcattatgatggtgtgcattctggatcccaaattgcacaccccaatgtacttttttctcactaacttgagcatccttgatctgtgttacactaccacgaccgttcctcacatgttggtgaatattgggtgcaacaaaaaaacaatttcatacgccgggtgcgtggctcatctaatcatttttctcgcgctgggcgcaaccgaatgtctactgcttgccgtgatgagcttcgatcgctacgtcgccgtgtgccgaccacttcactatgttgtgatcatgaattactggttctgtcttcggatggcagccttctcatggctgatcggtttcggcaactctgtgctccagtcctccttgaccttaaatatgcccaggtgtggtcaccaggaggtcgaccactttttctgcgaagtgcctgctctgctgaagttgagctgtgcagacactaagcctatcgaggccgagctgttcttctttagtgtcctgatcttactgatacctgtcaccctgatcctcatctcgtacggctttattgcgcaggctgtgctcaaaattaggtcagcggagggacggcagaaagcatttggtacttgcggatcgcacatgatcgtggtttccctcttctacggcacagccatctacatgtacttgcagccacccagctctacatccaaggattggggtaaaatggttagtttgttttatgggatcatcacgtcaatgttgaattcactcatttacagtttacggaataaggacatgaaagaggcgtttaaaagattgatgccgcgcatcttcttttgtaagaagtag

SEQ ID NO: 28312 - DNA, 942 bp, Artificial Sequence
  Description of Artificial Sequence: Synthetic coding sequence
atgaactgggagaatgaaagctctcccaaagagttcattctgctcgggtttagcgatcgcgcttggctgcaaatgcccctgttcgttgtcttgctcatatcatataccatcacaattttcgggaacgtctctattatgatggtgtgcatcctggatcctaaacttcatactccaatgtatttttttttaaccaacctgagtatactggatctttgttacacgacaaccaccgtcccccacatgttagtcaacatcggatgtaataagaagacaatcagttatgcaggctgtgtggcccacttaatcatattcctggcgctcggtgctaccgaatgtcttctcctcgctgtgatgagcttcgatcgttatgttgctgtgtgccggccacttcattacgtggtgataatgaattactggttttgcctgaggatggcagcttttagctggctcattggattcggcaactccgtattacagtcctccctcaccctgaacatgcctcggtgtgggcaccaggaagtggaccatttcttctgtgaggtgccagcgttgcttaaactatcgtgtgccgacacaaaacctattgaagcagaactgttctttttcagcgtgctgattctgctgatcccagttactttgattctcatatcctatggtttcatcgcacaggccgttttgaaaatccgctctgccgaggggaggcaaaaggcctttggcacctgcgggtctcatatgattgtggtcagtctcttctatggcaccgctatttacatgtacctccagcctccgagcagcacatccaaggattggggtaagatggtttccctattctatggaataataaccagcatgctgaacagccttatctatagtctccgtaacaaggatatgaaggaggccttcaagcgcctgatgccccggattttcttctgcaaaaagtag

SEQ ID NO: 28313 - DNA, 942 bp, Artificial Sequence
  Description of Artificial Sequence: Synthetic coding sequence
atgaattgggagaacgagtcaagtcctaaggagttcattctgttgggtttctcagatagggcctggcttcagatgccactctttgtggttcttctgatatcttacacaataactatatttgggaacgtcagtatcatgatggtatgcattttggatcctaagctgcatacaccaatgtacttcttccttaccaatctcagtattttagacctctgctataccaccaccacggtcccccacatgctcgtaaatatcggctgcaacaaaaagacaatcagctacgctggctgtgtggcccatcttatcatctttctggctttgggcgccaccgagtgcttactgcttgcagttatgtccttcgaccggtatgttgccgtctgtcgtcctttgcactacgtagtaattatgaactattggttttgcctccggatggctgctttctcctggctgattggctttggcaactccgtgctccagtcatccctgaccctcaatatgccaagatgtggccaccaagaagtcgaccatttcttctgcgaggtacctgccctactcaagttgagctgtgccgataccaagcccattgaagcggaacttttttttttctcagtcctcatactgttaattcccgtcacgcttatactcatcagttacggatttattgcccaggcagttctcaagattcgcagcgccgaaggaaggcagaaagccttcgggacatgcggcagccatatgatcgtcgtgagcctcttctacggcactgccatttatatgtacttacagccaccctcaagcacatccaaagattggggcaagatggtgtccttgttctatggcatcatcactagcatgctaaactccctgatttactccttaagaaataaggatatgaaggaggccttcaagcgtctcatgccaaggatctttttctgcaaaaaatag

SEQ ID NO: 28314 - DNA, 942 bp, Artificial Sequence
  Description of Artificial Sequence: Synthetic coding sequence
atgaattgggagaacgaatcctcaccaaaggagtttatcctactaggattttccgacagagcttggttgcagatgcctcttttcgtggtgcttcttatctcatataccattaccatatttgggaacgtgagcataatgatggtctgtattctagaccccaaactgcacacccccatgtactttttcctgactaatctgagtatccttgatctgtgttacactacaaccacagtgccccacatgctggtcaatattggatgtaataagaagaccatctcctatgctggctgtgtcgcccatcttatcatcttcctagcgctcggagctacagagtgtcttctgctcgccgtcatgtcatttgacagatacgtggctgtttgtagaccccttcactacgttgtgatcatgaactattggttctgtctgcggatggccgctttttcctggcttatcggattcggaaactccgtgctccagtccagcctcacacttaacatgcccaggtgtggccaccaggaggtggatcacttcttctgcgaagtgcccgcactgctgaagctgagctgcgcggataccaagccaatcgaggctgaactcttcttcttcagcgtgctcatcttgctgattcccgtgaccctcatcttgatcagctatggctttattgcccaggccgtactcaagattagaagtgctgaagggagacagaaagccttcggaacatgtgggtctcacatgatcgtggtctcccttttttacgggactgccatttatatgtaccttcagcccccctcctcaacttctaaagattggggaaaaatggtgagcctgttctacggcattataacaagcatgctgaattccttaatttattccctgagaaataaagacatgaaggaggcattcaagcgactaatgcctcgaatcttcttttgtaagaaatag

SEQ ID NO: 28315 - DNA, 942 bp, Artificial Sequence
  Description of Artificial Sequence: Synthetic coding sequence
atgaactgggaaaacgagtccagtcccaaagagtttatactcctcgggttctcggacagggcgtggcttcagatgccactgttcgtggtcttactgatctcttatactatcaccatctttggtaatgtctccatcatgatggtgtgcatcttggatcccaaattgcacacacctatgtattttttccttactaatttgagcattctggacctgtgttatacaaccactactgttcctcacatgctcgtaaacatcggttgcaacaagaagacaatctcctatgcagggtgcgttgcacatctcattatctttctggccttgggggctactgaatgcctcctcctggccgtcatgtcttttgaccgctatgtcgcagtgtgtagaccactgcactacgtggtaattatgaactactggttctgtctgcgcatggcggcttttagctggctgattgggttcgggaatagtgtactgcagagctctctcaccctcaacatgccccgttgcgggcaccaggaggtagatcactttttctgtgaagtccctgctctgcttaagctgtcatgcgcagacaccaaacccattgaggcagaactttttttcttcagtgtgctaatcctcctgatcccagtaacactcattctcatatcttacggattcatcgcacaggccgttttaaagatcagatccgccgagggaaggcagaaagccttcgggacttgtggaagccacatgatagtagtgtcgctgttttacggtacagccatctacatgtatctgcaaccccctagttccacctccaaggactggggtaagatggtgtcactgttctatggcataattacttctatgctaaactccttgatctattccctgcgcaacaaagacatgaaagaggcatttaaaaggttgatgccgcggatctttttttgcaagaaatag

SEQ ID NO: 28316 - DNA, 942 bp, Artificial Sequence
  Description of Artificial Sequence: Synthetic coding sequence
atgaactgggagaatgagagttcccctaaggagtttatcctcctgggcttcagtgatcgggcatggctacagatgccgctgtttgtggttctgctgatttcatacactatcacaatcttcgggaacgtctcgatcatgatggtgtgtatccttgatcccaagctgcacacccccatgtatttctttttaactaatctctcgattttggatctgtgctatacaacaaccaccgtgccacacatgttagtaaatatcgggtgtaacaaaaagacaataagctacgctgggtgcgtggcccatcttatcatttttctggccctgggagctaccgagtgcttgctgttagctgtgatgtctttcgatagatacgtagctgtctgtaggccactacactacgtcgtcattatgaactactggttctgtctgcggatggcagcgttctcctggctcatcggttttggtaacagcgtgcttcagagcagtctcactctcaacatgccccggtgcggccaccaagaggttgaccactttttctgcgaggtccccgccttgctaaagctttcatgtgccgacaccaaacctatcgaggcagagttgttctttttctccgtcctgattctcctcattccagtgacccttatccttatttcttacgggttcattgcccaggccgttcttaagattcgctctgcagaagggcgccagaaggccttcggtacatgtggtagccacatgattgtcgtgtctctgttctatgggacagcaatctacatgtatctgcagccacccagcagcaccagcaaggattggggaaaaatggtttctcttttctatggcattataaccagcatgctcaactcactgatatattcgctgagaaacaaggatatgaaagaagcttttaagagactgatgcctcgtatcttcttttgcaagaagtag

SEQ ID NO: 28317 - DNA, 942 bp, Artificial Sequence
  Description of Artificial Sequence: Synthetic coding sequence
atgaattgggagaatgagtcatcacctaaagaattcattctactcggtttctcggaccgagcttggctgcagatgccactcttcgtggtcctgctgattagctatactattactatcttcggtaatgtcagcataatgatggtatgtattctggatcccaagctgcataccccgatgtattttttcttaacgaacctaagtatacttgatctgtgttatacaaccacgaccgtaccccatatgcttgtcaatattggctgcaataagaaaactatttcctacgcgggttgcgtggcgcacttgataatctttctggcactgggtgctactgaatgcctcttgctcgccgtcatgtcattcgatagatacgtggcagtctgtagacccctacattacgtggttataatgaactattggttctgcctaaggatggccgccttttcatggctgatcggcttcggaaattctgtgttacagtctagtttaactctcaatatgccgaggtgtggacatcaggaggtggatcattttttctgcgaagtgcctgcacttctcaagctgtcttgcgcagacactaagcccattgaggccgagctcttcttctttagtgtcttgatcctactgatcccggtcaccctcattctgatcagttatggctttattgcccaggcagtcctgaagattaggagcgctgaggggcggcaaaaagctttcggaacctgtggtagccacatgatcgtggtctcacttttctacggcaccgcgatttatatgtaccttcagcctccgagctcaaccagtaaggattggggcaagatggtctcactgttctatgggattattacttctatgctgaactcactgatctactctttaagaaataaagacatgaaggaggctttcaagagactcatgcccagaatctttttctgcaagaagtag

SEQ ID NO: 28318 - DNA, 942 bp, Artificial Sequence
  Description of Artificial Sequence: Synthetic coding sequence
atgaattgggtcaatgacagcatcattcaggaatttattctattgggttttagtgaccgaccttggctggagttccctctgctcgttgtctttctgattagctacacggtgacaatttttggtaatctgacgattatcctggtgtctagactagataccaaactacacactccaatgtatttttttctaactaacctctctcttcttgatctctgctacactacatgcaccgttccacagatgcttgtgaatctgtgcagcattcgtaaagttatcagctatcgcgggtgcgtagcccagctgtttatcttcttagccctgggagcgacagagtatctgctccttgccgtaatgagctttgaccgattcgttgcgatatgtcgcccgttacactacagtgtcattatgcatcagagactctgccttcagctagcggctgccagttgggtgactggctttagcaactccgtctggttatctacccttacactgcaactccctttatgcgatccgtacgtgatcgatcacttcctctgcgaggtccctgcgctgctgaagctaagctgcgtggagaccactgcaaacgaggcagaactcttcctggtaagcgaactgttccacttaattccccttacattgatactcatcagttacgcgttcattgtgagggcagtgctgcgcatccagtcggcagaggggcgccagaaggcattcggaacctgcggttctcatctcatcgtggtgagcctgttttactccacggccgtgagcgtgtaccttcagccgccatcaccaagctccaaagaccaggggaagatggtgtcgctgttttatggcattatagctcccatgctgaatccccttatctacactctccgtaacaaggaagtgaaggagggattcaagaggctagttgccagggtcttcctgattaaaaagtag

SEQ ID NO: 28319 - DNA, 939 bp, Artificial Sequence
  Description of Artificial Sequence: Synthetic coding sequence
atggacggcgtaaacgactccagtctacaaggttttgtgttgatgggtatttctgatcaccctcaactggaaatgattttttttatcgcaatcttattcagctatctgctcacactgttggggaactcaaccattatcctgttgagccgcctggaagcccgtctgcatacacccatgtacttctttctgagtaatctatccagcttggacctcgcctttgctacctcaagtgttccacagatgctgatcaacctctgggggcccggaaagaccatttcatacggtggctgcatcacacagttgtacgtgtttctgtggctgggtgcaaccgaatgcatactcctcgtggtgatggccttcgacagatacgtcgcagtgtgtaggcccctccgctacacagcaattatgaatccacagctgtgctggctgctcgcggttatcgcgtgcctggggggactggggaattccgttattcagagcaccttcaccctgcagctgccgctatgcggacatcgtcgtgtggagggatttctgtgtgaagtaccggctatgatcaagcttgcgtgcggagacacgtctctaaatcaggccgtccttaatggcgtgtgtacattctttacggccgtgcctttgagcattattgtgatctcctactgcctgattgcacaggccgtcctcaagatccgcagtgctgaaggcagacgaaaagcctttaatacctgcttatcccatttgctggtcgtcttccttttctacggcagcgcgtcatacggctatctgctgcccgcaaaaaactcaaaacaggaccaggggaaattcatctcccttttttacagcctggtgaccccaatggtaaatccactcatctataccctcaggaacatggaggtgaagggagcccttcggcgtctgctcgggaaggggcgggaggttggctag

SEQ ID NO: 28320 - DNA, 963 bp, Artificial Sequence
  Description of Artificial Sequence: Synthetic coding sequence
atgatggaaatagctaacgtctcgagtcctgaggtcttcgtactgttgggattctctactagaccttcgctggaaacagttctgttcatagtagttctgtctttttacatggtgagtattcttggcaacggaattattatcttggttagccacactgatgtccatttgcatacgccaatgtatttctttttggcgaacctcccgtttctggacatgtctttcactactagcatcgtcccacagctgctggccaacctctgggggcctcagaagaccatctcctacggaggctgtgtggtgcagttttatatttcacactggctgggtgctacggagtgtgtgctgctggcaacgatgagctacgataggtacgccgctatctgccgccccctccactatacagtcattatgcacccgcaattatgtctggggttggcccttgcttcatggctcggcggacttacaacttcaatggtcggtagcactctgacgatgcttctgcccctgtgtggtaacaactgcatcgaccacttcttttgcgaaatgcctctgatcatgcagctagcctgcgttgatacgtctcttaatgagatggagatgtatttggcttcctttgtcttcgtagtgttgcctcttggactgattttagtctcctatggccacattgctagagcggttttaaaaatcaggtccgcagagggacgacgaaaagcgttcaatacttgtagctctcatgtcgccgtggtttctctcttttacggtagcatcatattcatgtatctacagcctgctaaatccacatctcacgagcagggaaaatttatcgccctgttttacactgtcgtgactcccgccttgaaccctctcatctacactctgcggaacacagaggttaagagtgctctgagacatatggtgttagaaaactgctgtgggtcggccggaaagttggcccagatttag

SEQ ID NO: 28321 - DNA, 927 bp, Artificial Sequence
  Description of Artificial Sequence: Synthetic coding sequence
atgcggcagataaaccagacacaagtaacagagttcctgctgttgggcctgtccgatggcccacacactgagcagctgctattcatcgtgctgctcggagtgtacctcgtgacggtgctcgggaacctcctgctgatcagcttggtgcacgttgactctcagcttcacacccccatgtatttctttctctgtaatttgagtctggccgacttgtgtttctctactaatatcgtaccgcaagctctggttcatctcctgtcaaggaaaaaggtgatcgcctttaccttatgtgcagcaagattgctgttctttctcatattcggatgtacacagtgtgccctgcttgcagtgatgagttatgatcgctacgttgcaatctgcaacccccttaggtatcccaatatcatgacgtggaaagtttgcgtacagctggcaactgggagctggacctctgggatcctcgtgtccgtagtggacactacttttatcctccggctgccgtatcgggggagcaattccatagctcacttcttttgtgaagcaccagcgctcctcattctggcctcaacagacacccacgcatctgagatggccattttcctcatgggggtagtcatcctgctcatcccagtattcctcatcctcgtgagctacggtcgcatcatcgtaaccgtcgtgaaaatgaagagtacagtcggatcacttaaagcgttctcgacatgcggatctcatttgatggtcgtgatccttttctacggatcagccatcatcacatatatgacgccgaagtccagcaagcagcaggagaagtctgtgtctgtgttctacgctatcgtcacacccatgttaaaccctctgatctattctcttaggaataaggacgtgaaggcagcattgcgtaaggtggcaactcgcaatttcccctag

SEQ ID NO: 28322 - DNA, 993 bp, Artificial Sequence
  Description of Artificial Sequence: Synthetic coding sequence
atgtgttccttctttctctgtcagacagggaaacaggccaaaatctctatgggagaagagaatcaaacgttcgtgtcaaagttcatcttcctggggttatctcaagacctacagacacagatactgttgtttattctcttcttaataatctacctgttgaccgtcctgggcaaccagctaatcattatcctgatctttcttgatagccggctccacactccgatgtatttcttcctgcggaatctgagctttgccgatctgtgcttcagtacttcgattgtccctcaggttctagtacacttcttagtgaaaaggaagactatatctttttacggatgcatgacccagatcatagtctttctactggtgggatgtaccgagtgcgctttgctagcagtcatgagctatgaccgatacgtcgccgtgtgcaagccattatattattccaccatcatgacacagcgcgtgtgtctctggcttagttttcgcagttgggcctcgggggcgctggtgtctctggtggacacaagcttcaccttccacctaccatactggggccagaacatcatcaaccactacttttgcgagccaccggctctgctgaagctcgcatctatcgatacctatagcaccgagatggctatattctccatgggcgtggttattttattggctcccgtttcgctgattcttggatcatattggaatattatctccactgtgattcaaatgcaaagcggagaggggaggctgaaggccttttctacctgcggcagtcatcttatagtggtggttttgttctacggttccggtatctttacttatatgagacccaatagcaagactaccaaggagcttgacaagatgatttcagtgttctatacagccgtaacaccaatgctaaatccaatcatctacagtttacgcaataaagacgtgaagggggctctgaggaagctagtcggcaggaagtgctttagtcaccggcaatag

SEQ ID NO: 28323 - DNA, 954 bp, Artificial Sequence
  Description of Artificial Sequence: Synthetic coding sequence
atgggaactgataaccaaacgtgggtttccgaattcatcttactgggcttgtcctcagactgggacacccgggttagcctgttcgtgttgtttttagtgatgtacgttgtgacggtcttgggcaactgtctcattgtccttctgatccgccttgactccagacttcatactcctatgtatttttttctgacgaacctgtccctggtggatgtttcatacgccacctccgttgtgcctcaacttctggcgcatttcctcgccgagcacaaagccataccatttcagagttgcgcggcgcagctcttcttctcactcgcactgggcgggattgagtttgtgctgctggcagttatggcctacgaccggtatgttgcagtgtgtgacgccctgagatactcagccatcatgcatggggggctgtgcgcccgtctggcaatcacaagttgggtgagtggcttcataagctccccagtgcaaaccgctattacatttcagctccccatgtgcagaaacaaattcatcgatcacatatcctgcgaactccttgccgtcgtgcgcctggcttgcgtcgacacatcaagcaacgaggtaactataatggtgtctagtattgtgttgctgatgactcccttctgcctcgtactcttgagttatatccagattatcagcaccattctcaagatccagtcccgagaaggaagaaagaaagcgttccacacgtgcgctagccatcttaccgttgtggcgctgtgctatggcgttgctattttcacttacatccagcctcacagttcaccgtcagtacttcaggagaagttgttttctgtgttttacgccatcctgacccccatgttgaacccaatgatctactcacttagaaacaaggaagtgaaaggcgcctggcaaaagctgctctggaaattttcggggctgacctctaaactagctacatag

SEQ ID NO: 28324 - DNA, 954 bp, Artificial Sequence
  Description of Artificial Sequence: Synthetic coding sequence
atggagatcgacaaccaaacttgggtgcgagaattcatattgctggggctatcttcggattggtgtacacaaatttcacttttcagcctcttccttgtcacgtaccttatgaccgttctgggaaattgtcttatcgtgcttcttattcgcctggactcgaggctgcacacaccgatgtacttctttctgaccaatctctctctcgttgatgtctcctacgccacaagtgtagttccgcagctcctggcacactttttagctgagcataaggcaattcctttccaatcttgtgcagcacagctgtttttttcgttagcgctgggagggatcgagtttgtactgctggcagtgatggcgtacgatcggcatgtagcggtgtcggacaggctgaggtatagtgccattatgcatggaggtctctgcgccaggctagctataacctcctgggtgtccggaagtataaactctttagttcagacggcaatcacctttcagcttcctatgtgtaccaacaagttcatcgatcacatctcatgcgagttgctggccgtggtgcgtctggcatgcgtcgacacgagcagtaatgaggccgccattatggtgtcttctatcgttcttctaatgacaccgttctgtctggtccttttaagttatatcagaattatcagcacaatcttaaaaattcaatccagagagggtcgtaagaaagctttccacacatgcgcttctcacctgacagtggtcgctctttgctatggcacaaccatcttcacctacattcaaccccactccggacctagcgtgcttcaggagaaactcattagtgttttctacgctatcgtcatgccattgctcaatcctgtcatttactctttgaggaacaaggaggtaaaaggagcatggcataagctgctagagaaattttcaggcctaacaagtaagctgggcacctag

SEQ ID NO: 28325 - DNA, 954 bp, Artificial Sequence
  Description of Artificial Sequence: Synthetic coding sequence
atgggaatggttaggcataccaatgaatccaacctcgctggcttcatactactggggttttctgactatccacaacttcagaaggtgctatttgtgctcattctcattttgtaccttctgaccatattgggaaacacaaccattattctcgtgtcccggctggaaccgaaactgcacatgcccatgtatttttttctcagtcatctgtcctttctataccgctgcttcaccagttccgtgattccccagcttctcgtgaatctgtgggaacctatgaagacaatcgcgtatggaggctgcttagttcatttatataattcccacgccctgggctcaacagagtgtgtgcttccagccgttatgtcttgcgaccgctatgtagccgtctgcaggcccctccattacaccgtgctcatgcatatccacctatgcatggccctcgcttcgatggcgtggttgtcaggtatcgcaactacactggtgcagtccactctcaccctacaactgccattctgcggccacaggcaggtggatcactttatttgtgaagtcccagtgctgatcaagctcgcctgtgtggggacgacattcaacgaggcggaactgtttgtggcctctattctgttcttaatcgtgcctgtatcttttattctagtctcctcaggctacattgcccatgctgtcctccgtattaaatcagcgacacgcagacagaaggcgtttggaacctgcttctctcatctcactgtggtcacgattttttacggaaccattatatttatgtaccttcaacccgccaagtccaggagcagagaccagggcaagtttgtatccctgttctataccgtcgttacacgcatgctcaaccctctgatctacacgttgcgcattaaagaagtcaagggggccctgaaaaaagtcctcgctaaagcactgggcgtgaacattctctag

SEQ ID NO: 28326 - DNA, 930 bp, Artificial Sequence
  Description of Artificial Sequence: Synthetic coding sequence
atggggctcggaaatgaatcctccctcatggattttatcctgctcggtttctccgaccacccgcggcttgaagctgttctgttcgtgtttgtactgttcttctatctactcaccctcgtgggcaacttcacaatcataatcatcagctatttggacccacctctgcatacccctatgtacttcttcttgagcaacttatctctgctcgacatctgctttacaaccagcttggcacctcagaccctggtcaacctccagagaccaaagaagacaatcacatatggtgggtgtgttgctcagctctatatatctttggcacttgggtcaacagaatgtattttgctggctgatatggccctggatagatatattgcggtgtgcaaacctctccattacgtggttatcatgaatcctcgcctctgccagcagctcgctagtatttcgtggctgagtgggttagcatctagcctcattcatgcaacttttacacttcagttgccactttgtgggaatcatcggctggaccactttatctgcgaggtgccagcgctcctgaaactggcatgtgtagatactacagtaaacgagcttgtgctttttgtcgtctcggtactttttgtggtgatcccacctgcgctgatatctatcagctacgggttcatcactcaagcagtgctcagaattaagtctgtggaggcccgccataaggccttctccacttgtagtagtcacctgaccgtcgttattattttctatggaacaatcatctatgtctacttacaaccttctgacagttatgctcaggaccagggcaagttcatcagccttttctataccatggtcactcctacgctcaaccccatcatttatacgctcaggaataaggatatgaaagaagctttaaggaaattgcttagtggcaagctgtag

SEQ ID NO: 28327 - DNA, 951 bp, Artificial Sequence
  Description of Artificial Sequence: Synthetic coding sequence
atggaggagaccaacaactctagcgagaaagggtttctactgctcggattctcggaccagccacaattagagcgcttcctgttcgctatcattctgtatttttacgtattgtctctgctggggaatacagcattgattctggtgtgttgcctggactcgcgattacacacaccaatgtacttcttcttatctaatctgagctgtgtcgatatatgctttactactagtgtggccccacagctactggttaccatgaataaaaaggacaaaaccatgagctacgggggctgcgttgcccaactgtacgttgccatgggtctgggaagttctgagtgtatcctgctcgctgtaatggcatacgatcgctatgctgccgtgtgtagacccttacgctatatcgcgattatgcaccctaggttctgcgccagcctcgcaggcggcgcctggctgtctggcctcatcaccagcctaatccagtgctcgctgacagttcagttgcccctgtgtggacatcgaacattagaccacatcttctgtgaggtacccgtactcataaaactggcctgtgttgatactacctttaatgaagccgaactgtttgtggctagtgtcgtatttttaatcgtgccagtgttactgattctagtcagctatggattcattactcaggccgtgctgcgcataaagagcgcggcaggacgccagaaagcgttcgggacgtgctcttctcatctggtggtggtgatcatattctatggaactatcatttttatgtatctccagccggccaatcggaggagtaagaatcaagggaagtttgtgagtcttttctatacgatcgtcacaccactcttgaatcccatcatctatacgttgcggaataaagatgtgaagggtgcactgaggaccctgatactcggtagcgccgcaggacagagccacaaggactag

SEQ ID NO: 28328 - DNA, 951 bp, Artificial Sequence
  Description of Artificial Sequence: Synthetic coding sequence
atggtcaaccagtccagccctatgggcttcctgttgctgggcttctcggagcatcctgctctagagcgaacactgtttgtggtcgttttcacatcttacctgctcaccctggtggggaatacgttgattatcttactttccgtgttataccctcggcttcattctccaatgtatttctttctgagcgatctctcttttttggacttgtgtttcacgaccagctgcgtgccacagatgctggtgaacctgtggggcccaaagaagacaattagcttcctggggtgctcagtgcagctctttatctttctatcacttggcaccacagagtgtatcctgctgactgttatggctttcgacagatacgtcgccgtgtgtcagcccctgcattatgccaccattatacacccccgcctttgttggcagcttgcttcggtggcttgggtgatgtctctcgtgcagagtatagtgcaaacaccatctacattacaccttccgttctgcccacatcagcaaatcgacgacttcctgtgtgaggtgccatccctcataaggctctcatgtggggataccagttataacgagatccagttggcagtttcctctgtgatctttgtcgtggttccattgagtctaatcctcgcgtcctacggggctaccgcccaagccgtccttcgaattaatagcgcaacagcttggcggaaggcattcggaacgtgtagctctcatctgacggtggtgaccctgttctattccagtgtcattgctgtctacttacagcccaaaaatccttacgcgcagggtcgggggaaattcttcggactcttctatgccgtcggcaccccgagcctgaacccacttgtgtacactctgaggaataaggaaatcaagagggcccttcggcgacttctgggcaaggaaagagactcgcgggaatcttggcgtgcggcctag

SEQ ID NO: 28329 - DNA, 951 bp, Artificial Sequence
  Description of Artificial Sequence: Synthetic coding sequence
atggtgaaccagtccagccccatgggatttctcctcctcggattctctgaacatcctgcactggagcgcaccttgttcgtggtggtgtttacctcttatctcctcacactggtgggaaatacactcatcatattactgtccgtgttgtaccctcgcctgcatagcccaatgtatttctttctgtcagacttgagctttctggacctgtgttttaccacatcctgtgtaccccagatgctggtcaacctctggggacccaagaagacaattagctttcttggctgcagtgtccagctgttcattttcctgtctcttggcactacggaatgtatactactgacagtgatggcctttgatcgctatgttgccgtgtgccagccactacattacgctaccattatccacccaaggctttgttggcaattggcaagtgtggcctgggtgatgagtcttgtacaatcaatcgtccagacgccttcgactctgcacctgcccttctgcccacatcagcaaatcgacgattttctctgtgaggtgcccagcctgattcgcctgtcctgtggggacacttcttacaacgaaattcagttggctgtgagctccgttatctttgtggtggttcccctgtcactgatactggcttcttatggcgccactgcgcaggctgtccttaggattaatagtgctacggcttggagaaaggcattcggcacttgctcctcacatctgaccgtggttaccctgttctactcctccgtaattgccgtgtacctgcagcccaagaacccatatgctcagggtcgcggcaaatttttcgggctcttctacgctgttggcactcctagcctgaatcccctagtttacactctccgtaataaagagattaagcgcgcactgcggaggttactgggaaaagagcgggactcccgggagagctggcgggcggcttag

SEQ ID NO: 28330 - DNA, 951 bp, Artificial Sequence
  Description of Artificial Sequence: Synthetic coding sequence
atggtgaaccagtcctcacccatgggctttcttctgctcggcttttccgagcaccctgctttagagcgcactctgttcgtggttgttttcacttcctacctgctcacactggtggggaatactcttatcatcctgctcagcgtcctctatcctagactgcactccccaatgtatttctttctgtcagacttgtcctttctggatctctgttttactacctcatgtgtccctcagatgttggtcaatttatggggaccaaagaagaccatatcatttctcgggtgtagcgtgcagctcttcatctttctgagcctgggaactacagagtgcattttgctgacggtgatggctttcgatcgatacgtggctgtttgccagccactccattacgctactataatccaccctaggctgtgctggcagctcgcatccgttgcctgggtgatgtctcttgttcaaagtatcgttcagaccccaagtaccctgcatctccccttctgtccccaccagcagatcgacgacttcttgtgcgaggtgccgtccctgattcgcctgtcctgcggggatacgtcatacaacgagatccagctagcagtctcatctgtcatttttgtggttgtgccactatctctgatcctggcttcttacggcgccactgcgcaggccgttctgagaatcaactcggctacagcctggaggaaagcatttggcacatgttcttcccacctgaccgtcgttactctcttctactcttctgtgatcgccgtttacctgcagcctaaaaatccgtacgctcaaggaagaggcaaattctttggacttttctacgctgtaggcacgccatctcttaacccactcgtctatactttgagaaataaggaaatcaagcgcgctctgaggcggttgctgggcaaggaaagggatagccgagagagctggcgcgctgcttag

SEQ ID NO: 28331 - DNA, 951 bp, Artificial Sequence
  Description of Artificial Sequence: Synthetic coding sequence
atggtcaaccaatccagtcctatgggcttcttgctcttgggctttagtgaacaccctgctttagagaggacactttttgtcgttgtgttcacctcatatctcctcactcttgtggggaataccctcatcatcttgttgtccgtattataccccaggctgcactcccccatgtactttttcttatccgacctttcttttctcgatctctgtttcactacctcgtgcgtgccccaaatgctggtcaatctgtggggaccaaagaaaaccataagcttcttaggttgttcagtccagctgtttattttcctgtctctcggtacgaccgagtgcatcctgcttaccgtgatggcctttgacagatacgtcgccgtctgtcagcctctgcactacgcaactatcattcatcccagactctgctggcaacttgcctcggtggcctgggtaatgagtctggttcagtcaatcgtccagaccccttctaccctccacctccctttctgtccacatcagcaaattgatgattttctgtgcgaggtaccttcgcttatccgattgagttgcggggacacctcatacaatgaaattcaactggctgtctcttccgtaattttcgtagtcgttccgctgtcccttatcctagcatcttatggagccacagcccaggcagtcctcagaattaactctgctacagcttggcgaaaggcctttggcacttgctctagtcacctgaccgtcgtaaccctgttctacagttcagttatagccgtctatttgcagcccaagaacccatatgcacaaggacgaggaaaatttttcggcctgttctacgcggtcggcaccccaagccttaatccattggtttacactctgcgtaacaaggaaatcaaacgagccttgagacggctgctggggaaagagcgggactcacgcgaatcatggcgcgctgcctag

SEQ ID NO: 28332 - DNA, 951 bp, Artificial Sequence
  Description of Artificial Sequence: Synthetic coding sequence
atggtaaaccagagttctccaatgggatttctgctgctcggcttctcagagcaccctgcgctggagcgcacactgtttgtcgtggtctttaccagctatctgctgactctggtgggaaataccttgatcatcctgctcagcgtactctacccacgtttacattcgcctatgtactttttcctatctgacctctctttcttggatctgtgcttcacaacaagctgcgtccctcaaatgctggttaatctgtggggtccgaagaaaactatctctttccttggttgtagtgtccagctcttcatctttttatcactgggcacaacggagtgcatcttgctgactgttatggcatttgacagatacgtggccgtttgtcagccactgcactatgctaccatcatacatcctcggctgtgctggcaactcgctagcgtggcatgggtgatgagtttagtgcagtcaatagtccagacaccctccacactgcatctgcctttttgtccgcaccaacagatcgatgactttttatgcgaggtccctagtctgatccgactgagttgtggggatacctcctacaacgagatccagctggccgtgtccagtgtgatttttgtggtggtcccgctgtcgctcattctagccagttacggagctactgcacaggcggtgctaagaatcaacagcgctacagcttggcgcaaggcctttggaacttgcagttcccacctcacggtcgtcacactgttctacagttcagtaatcgctgtgtatctccagccaaagaatccttatgcacagggccgaggcaagttttttggtctgttctatgctgtgggtacccctagcttaaaccctttggtgtacaccctgcgtaacaaggaaattaagagggccctgaggaggcttctgggcaaggagcgagacagccgtgaatcctggcgggctgcttag

SEQ ID NO: 28333 - DNA, 951 bp, Artificial Sequence
  Description of Artificial Sequence: Synthetic coding sequence
atggtaaatcagagcagtccaatgggttttttactccttggcttttccgagcacccagcgcttgagcgtaccctgttcgtcgttgtgtttacatcatacctcctgaccctggttggcaacaccttaataatcctcctcagcgtcctctatcctaggctgcacagtcccatgtatttcttcctgtcagatctgtcatttctcgacctgtgcttcacgaccagctgcgtgccccagatgcttgtaaatctgtggggccctaaaaagactatctcctttcttggatgtagcgtccagctcttcattttcctgtccctgggtaccacggaatgtattttactgacagtcatggcatttgacaggtacgtggctgtatgccagccgctgcactacgcaacgatcattcaccccaggctttgttggcagctcgctagtgtcgcctgggtgatgtctctcgttcaatccattgtccaaactccctccactctccatctgcctttttgcccccatcagcagattgacgacttcctgtgtgaggtgcctagcttgatccgcttgtcttgcggagacaccagctacaatgaaatccagttggctgtatccagcgtgatcttcgttgtagtgccactaagtctcatcctggcatcatacggagctaccgcacaagctgtactgcggatcaattcagccactgcctggagaaaagcctttggaacctgtagttcccatctaaccgtcgtaaccctgttttatagctctgtaatcgcagtgtacctgcagccaaaaaacccatacgcccaagggaggggcaagttctttggtctcttctatgccgtgggcacacccagtttgaacccgctagtgtatacgctcaggaataaggagataaaacgcgcacttcgccgtctcctgggtaaggagcgtgactcacgtgaaagctggagagccgcatag

SEQ ID NO: 28334 - DNA, 951 bp, Artificial Sequence
  Description of Artificial Sequence: Synthetic coding sequence
atggtcaatcagtccagtcccatggggtttctgctgttggggttcagtgaacatccagcactcgagcggaccctctttgttgtggttttcacgagctacctcctgacactggtaggcaatacgttgattatcctgcttagcgtgctatatccacgccttcactcccccatgtacttctttctgtcggatctgagcttcttagatctctgcttcaccacctcctgcgtgcctcagatgcttgttaacctctggggccctaaaaaaaccataagtttcttgggatgctcagtgcagctgtttatttttttatccttggggaccaccgagtgtatcctcctgaccgtgatggcctttgataggtacgttgccgtttgtcaacccctgcactacgccacaattattcaccctcgtttgtgttggcaactggcatccgtcgcatgggtgatgtctttggttcagtccatcgttcagactccttccaccctgcatctccctttctgtcctcaccagcagattgacgatttcctctgtgaggttcccagcctgatccggctgagctgtggcgataccagttataatgaaattcagctggcggtgtcaagcgtgatcttcgtggtcgttccgctgagcctgattttggcatcctacggcgcaacagctcaggccgtgttgagaattaacagcgcgactgcatggcgtaaagctttcggaacatgtagctcacacctgaccgttgttactttgttctattcaagcgttattgcagtgtacttgcagcctaaaaatccgtatgcacaagggcgcggaaagtttttcgggctcttctacgccgtagggactcccagtctcaatcccctggtctacaccctccgcaataaagagatcaagcgggcgttgcggaggctcctgggtaaggagcgcgacagccgagagagctggagagccgcctag

SEQ ID NO: 28335 - DNA, 951 bp, Artificial Sequence
  Description of Artificial Sequence: Synthetic coding sequence
atggtaaatcaatccagcccgatggggtttctcctgttggggttctcagagcacccagccctggagcgcactctgttcgttgtggtgttcaccagttatttgcttacactcgtggggaacactctgataatcctgttaagcgtgctctatcccaggttgcactctcctatgtacttcttcctctcagacctctcgtttctggatctctgttttacaacttcttgcgtcccccaaatgctggttaacttatggggtcctaagaaaaccatctcattcctcgggtgtagcgtccagctgtttatcttcctctccttaggtaccacagaatgtatccttcttacagtgatggcctttgaccgttacgtggctgtgtgccagcctctgcactacgccacaatcattcacccgcgtctgtgctggcagctcgcctctgtcgcctgggtgatgtctctcgtccaatcaatcgtccagacaccttctaccctccatcttccattttgcccccatcagcaaatcgacgattttttatgcgaggtccctagtctgatacgattgagctgcggcgacacttcttataacgaaatccagctggcggtcagctctgtaatcttcgttgtggtacctttgtcgctgatcctggccagctacggcgctaccgctcaagcggtgctaagaattaactcagccactgcttggaggaaggcctttggaacctgtagctctcatctgaccgtggtgaccctgttctatagctccgtgattgccgtttatctgcagcctaagaacccctatgcccaggggcgtggcaaattttttggactgttctatgcggtgggcactccatcactgaatccccttgtctacaccttgcggaacaaagagatcaagagagccctgaggcggctcctgggtaaagagagggattcgagagagagttggcgcgccgcatag

SEQ ID NO: 28336 - DNA, 951 bp, Artificial Sequence
  Description of Artificial Sequence: Synthetic coding sequence
atggtgaatcagtcctcccccatgggtttcttgctgctcgggttctccgaacatccagcccttgaacgaaccctgttcgtggtggttttcacttcctacctgctcacactggttggcaatacccttattatcctgctctctgttttatacccccgattacatagtccaatgtacttcttcctcagtgatctaagttttctggacctttgcttcaccacgtcatgtgtgccccagatgttggtaaacctatggggccccaaaaaaactatatccttcttaggctgtagtgttcagctgtttattttcctgtccctgggaacaactgagtgtattctgctgactgttatggcttttgacaggtacgtcgccgtgtgtcagcccctgcactatgcaaccatcatccatccacgactgtgctggcagttggcaagcgtggcatgggtgatgagcttggtgcagtccattgtccaaactcctagtacattacacctgcctttttgcccccaccagcaaatagatgacttcctttgtgaggtgccctcccttattagactctcatgcggcgatacaagctataatgaaatacagttagccgtatccagcgtaattttcgtcgtagtgcctctttctttgattctggctagctatggagcaacagctcaagcagtcctccggatcaattctgccacagcatggagaaaggccttcggcacgtgcagctcccatttaacagtggtcaccctattctatagcagtgtaattgccgtgtacctccagccgaagaacccatatgcccagggccgaggaaagttttttggccttttttacgccgtcggcacaccatctctgaatcctctcgtgtacaccctaaggaacaaggagatcaaaagagccctccgccgtctgctcggaaaagagcgagattctcgggaaagctggagagccgcgtag

SEQ ID NO: 28337 - DNA, 951 bp, Artificial Sequence
  Description of Artificial Sequence: Synthetic coding sequence
atggtcaaccagagcagtccaatgggttttcttttgctcggcttctctgaacacccggccctggaacgaacactttttgttgtggtcttcacttcatatcttttgacactggtagggaatacactgatcattttgctgtctgtgctctatcctcgattgcacagcccgatgtattttttcctgagcgatctctccttcctggatctttgctttaccacaagctgcgtgccacagatgctcgtgaatttgtggggtcctaagaagacaatatctttccttggatgtagcgtccagttgttcatctttctttccctcgggactaccgagtgcattctgttgacggtgatggcattcgataggtacgtggctgtgtgccagcccctgcactacgcaaccatcatccatcctcggctgtgttggcaactggcttctgttgcttgggtgatgtccctggttcagagtatcgtccagactccttccaccctgcacctgcccttctgtccccatcagcagatcgacgacttcttgtgcgaagtgccttcgctgatccggctttcatgcggggatacctcttacaatgagatccagctggccgtgagctctgtaatttttgtggttgtgccactttcgctaatcttggccagctacggcgcaactgctcaggccgtactgagaatcaactccgctactgcctggcgaaaagccttcggcacctgctcttcacacttgaccgtggtcactctgttttattctagcgtcattgcagtttacctccagccgaaaaacccatacgcccaaggccgcggaaagttctttgggcttttttacgcggtgggcactccgtcgttgaaccccctcgtctacaccctaagaaacaaggaaatcaagcgcgccctgagaaggctgctgggtaaggagcgagattcccgcgaatcttggcgggctgcttag

SEQ ID NO: 28338 - DNA, 951 bp, Artificial Sequence
  Description of Artificial Sequence: Synthetic coding sequence
atggtcaatcagtcctctccaatgggctttctcttgctgggtttctccgagcaccccgccctcgaacgcacgctgtttgtagttgtatttacatcataccttctaacgctcgttggcaacacactcatcatccttttaagcgtgttatacccccgccttcattcacccatgtatttcttcctctctgatctcagcttcctcgacctctgtttcactacatcctgcgtcccccagatgttggtcaatctgtggggcccaaaaaaaaccatctccttcttgggatgcagcgttcagctgttcatattcttgtctctgggaactacggagtgcatactgctgacagtgatggccttcgatcgctacgtggccgtgtgccagcctctgcactatgccacgatcatccacccaaggctgtgctggcagctcgctagtgttgcttgggtcatgagcctggtccaaagcatcgttcaaacgccaagtaccctgcatctccccttttgtccgcaccagcaaatagacgacttcctctgcgaggttccttctctgataaggctgtcctgcggagacacgagctataatgagattcagctggctgtaagcagtgtcatctttgtggtggtcccccttagtctaatactggccagctacggggcgaccgcacaggcagtcttgcgcattaactcagccacagcttggcggaaggccttcggaacctgcagctctcacctgaccgttgttactctcttctactccagtgtcatcgctgtctaccttcagccgaagaatccttatgcccagggccgcggaaagttctttgggctgttttacgctgtcggcactccctccttaaaccccctggtgtatacactcagaaacaaggagataaagagagcgctgcggcggctccttgggaaagaacgggacagccgggaaagctggcgggccgcctag

SEQ ID NO: 28339 - DNA, 951 bp, Artificial Sequence
  Description of Artificial Sequence: Synthetic coding sequence
atggtaaatcagtcaagcccgatggggttcctcctgttaggtttcagcgagcaccctgcattagaacgcactcttttcgtggtcgtgtttacatcatacctgctgacactggtgggaaatactcttattatcctgctgtccgttctgtacccacgtcttcactctcccatgtattttttcctgagtgacctttcttttcttgacttgtgtttcaccacttcttgtgtgccccagatgctggttaatctctggggtcctaaaaaaacaattagctttttgggctgctctgtgcagctcttcatcttcttgtctctcggaactaccgagtgcattttactgaccgtaatggcatttgaccgatacgttgcggtctgccagcctctgcactacgccactatcatacatccaagactgtgttggcagctggcctccgtcgcatgggttatgagtctggtgcaaagtatcgtccagaccccaagtacactccatctgccattttgtccgcatcagcagattgatgatttcctttgcgaggttccctcactaattcgtttaagctgtggagatacaagttataacgaaattcagttggcagtatcctcagtcatatttgtagtggtccccctctccctcatccttgccagctacggcgccaccgctcaggccgttctccgtattaattccgctacagcatggcgaaaagctttcggcacgtgttcttcccacttaaccgttgtaacactgttctactcatcagtcatcgccgtgtatctccagccaaaaaacccttatgctcaggggaggggcaagtttttcgggcttttctacgctgtggggactccttccctaaatccactggtttacactctgcgaaacaaagaaattaagcgggccctgaggaggctgttagggaaggagagagacagccgcgagtcgtggcgggccgcttag

SEQ ID NO: 28340 - DNA, 951 bp, Artificial Sequence
  Description of Artificial Sequence: Synthetic coding sequence
atggttaatcagagctctcccatgggatttcttctgctcggtttttctgaacatcccgcactcgaacgcaccctctttgtcgtggtgtttacgagctacctcctgaccctcgtgggtaacacacttataattctactctccgttctgtatccgcgcctgcattctcctatgtacttctttttatcagacttatcttttctcgatttgtgttttacaacttcgtgcgtgcctcagatgctcgtgaacttatgggggcccaaaaaaactatctcttttttgggctgcagcgtgcagctttttatcttcctctcgttgggcaccaccgagtgcattctcctgaccgtgatggcttttgaccgctacgtggccgtgtgccagcctctccattacgcaacaatcatacacccacggttgtgctggcagttggcaagcgttgcatgggtcatgtcgctggtgcagagcatagtacaaacccctagcacgctgcacttgccattctgcccacatcaacagattgacgacttcctgtgcgaggtaccctctctgattcgcttgtcatgtggtgacaccagctataacgagatacaattggccgtaagctccgtgatcttcgttgtggtgcccctgagcctgatactcgccagttacggggccactgcgcaggctgtcctgaggattaacagtgctacagcatggagaaaagcttttggtacatgcagcagtcatctgacagtggtgacactgttctattcttctgtaatagctgtgtatctacagcctaagaacccctatgcgcagggccgtgggaagttcttcggtctattttatgccgttggcactcctagtctcaatccactagtgtatacactgcggaataaagagataaaacgagccctgcggaggttactgggaaaggagcgggacagtagggagtcttggcgggctgcatag

SEQ ID NO: 28341 - DNA, 951 bp, Artificial Sequence
  Description of Artificial Sequence: Synthetic coding sequence
atggtgaaccagtcttcaccaatgggatttttgctactgggcttcagcgagcacccagctcttgaaagaacattgtttgtcgtggtgttcaccagctacctgctcaccctggtcggtaataccctgatcattctcttgagcgtactgtaccctcgcctacacagcccaatgtactttttcctgtcagatctgtcttttctggacctgtgcttcaccacatcatgcgtaccccagatgctggtaaatctgtggggacctaagaagactatatcctttttgggctgttccgtgcagttattcatctttctcagtctgggcactacggaatgcatcctacttacagtcatggccttcgaccgttatgtggccgtgtgtcagccacttcactacgcaacaattatccaccctcggctatgctggcagctcgcgagcgtcgcttgggtcatgtcccttgttcagagcattgttcagactccttctacgctccacctccccttttgtcctcatcagcaaattgacgactttctatgcgaagtcccttcactgatcaggctgagctgcggagacacatcgtacaacgagatccagctggctgtcagctcagtgatcttcgtggtagttccgctcagtcttatcctcgcctcatatggagccacagcccaggctgttctacgtatcaactcagctacggcatggagaaaagccttcggcacctgctctagtcatctcacagttgtgacactcttttactcatcagtcatcgccgtctatctgcagccgaagaatccatatgcgcagggtcgtggaaaattttttggacttttctacgcggttggcacaccttcgctcaacccccttgtctacacacttcggaataaagaaatcaagcgcgcactgaggcgcctgttagggaaggaacgcgacagccgagaatcatggagggcagcttag

SEQ ID NO: 28342 - DNA, 951 bp, Artificial Sequence
  Description of Artificial Sequence: Synthetic coding sequence
atggtgaaccaatcttcacccatgggattcctcctgctgggattctctgaacaccctgctctggagcgaaccctgttcgtggttgttttcactagctaccttcttacactggtgggcaacaccctcatcatccttctcagtgtgctataccctaggctacactctcccatgtatttctttctgtctgacctgtcttttctcgacctctgtttcacaacttcctgcgttcctcagatgctggttaacctttggggacccaaaaagacaatctctttcttagggtgttcagtccaactctttatctttctgtctctggggacaaccgaatgcattctcctcactgttatggcctttgatcgatatgtcgcggtgtgccagcctctgcactatgccacaataatccatccccgtttgtgctggcagctggcctctgtagcttgggtaatgtccttggtccagagtatcgtgcagaccccctctacactgcatttgcccttctgtccacatcagcagattgatgatttcctgtgcgaggtgccaagtttgatccggctgtcttgtggcgacacgtcatacaacgagatccagctggccgttagtagtgtgatttttgtggtggtgccactgtctctgatactggcttcatacggcgctacagcgcaagcagtccttcgaattaattccgcaacagcatggcggaaggcttttggaacctgctcgtcgcacctgaccgtggtgactcttttttactcatccgtgatcgcagtgtatctgcagccaaaaaatccctatgctcaaggcagagggaaatttttcggacttttctacgctgttggtacaccgtccttgaatcctctcgtctatacgttaaggaacaaagaaataaagcgcgcactccggcggctcttaggcaaggaacgagattccagagagagttggagggccgcatag

SEQ ID NO: 28343 - DNA, 951 bp, Artificial Sequence
  Description of Artificial Sequence: Synthetic coding sequence
atggtcaatcaaagttcaccaatggggtttctgctcctgggcttctccgaacacccagccctcgaaagaaccctgttcgtggtcgttttcacgtcctatctgttaacactcgttggtaataccttaatcatcttactgagtgttctgtatcctagactccacagccccatgtacttcttcttatctgatctgtcattccttgacctgtgtttcacaacaagttgcgttcctcagatgctggttaacctttggggaccaaagaagactatctcgtttctaggttgtagcgttcagctgtttatcttcctgagtttgggcaccaccgaatgtatcctgctcaccgtgatggccttcgataggtatgttgccgtgtgccaaccactgcactatgcgacaatcattcacccaagactttgctggcagctcgcttcagtcgcttgggtgatgtcgctagtgcagagtatcgtgcaaacaccaagcaccttacacctgcctttctgtccgcaccagcagatagatgattttctctgcgaagtgccaagtctcatccggctttcctgtggcgacacttcatacaatgagatccaactggccgtctccagtgtcattttcgtcgttgtgcccctcagtctgattctcgccagttacggcgccaccgctcaggcagttttgcggatcaactccgccaccgcttggaggaaagccttcggtacctgctcatcccacctcacagtggttaccctcttttactcttctgtaatagccgtatatctgcaaccaaagaacccctacgctcagggcagaggaaagttctttggtcttttctatgccgttgggaccccgtccttgaatcctctagtgtatacgctgcgaaataaggaaatcaagcgagccttacgccgcttgttaggcaaggagcgagattcaagggaatcttggcgcgccgcttag

SEQ ID NO: 28344 - DNA, 951 bp, Artificial Sequence
  Description of Artificial Sequence: Synthetic coding sequence
atggtcaatcagtctagccccatggggtttttactgttggggttctccgaacacccagccctggagcgcacccttttcgtcgtagtgttcacctcttatctgctcaccctggtcggtaatacgctgattatcctgctttcagtgctctaccctaggctgcatagccctatgtatttctttctgtcagacctgagctttctggatctgtgctttaccacctcttgtgtgccccagatgctggtcaacctctggggaccaaagaagaccatatctttcctagggtgctccgtgcaactgttcatattcctttcgttaggaactactgaatgtatcctgctcactgtgatggccttcgacaggtatgtcgccgtatgtcagcctcttcactatgccaccattatacaccccagactctgctggcaactagcctctgtggcgtgggtgatgagcctcgtgcagagcatcgttcagaccccctccaccctgcacctgccattttgccctcatcaacaaatcgacgattttctttgcgaagtaccttccctgatcaggctgagctgcggcgatacctcctacaatgagatccaactggccgtttcctcagtgattttcgttgttgtccctcttagcctaatcctggcgtcttacggggcaacagcgcaggccgtgttgcgaataaatagcgcgaccgcgtggaggaaagctttcgggacctgctcatcccacctgactgttgtcactctcttctattcttctgtcatcgcggtctacctacagcctaaaaacccgtacgcccagggaagaggtaagttttttggcctgttctatgccgtcggcacgccctctctcaacccccttgtctatacattgcgcaacaaggagatcaaaagagcgttaaggcgcctgctcggaaaagagagagatagtagggaaagttggagggccgcttag

SEQ ID NO: 28345 - DNA, 951 bp, Artificial Sequence
  Description of Artificial Sequence: Synthetic coding sequence
atggtgaatcagagctctcctatgggctttttgctcctgggtttctctgagcacccagctctggaaagaactctgttcgtggtggtgttcacatcctatctgcttacgctggtaggtaataccctaattatattgctgagtgttctgtatcctcgcctgcatagccctatgtatttttttctttccgatctttccttcttagacctatgctttaccacctcctgtgtccctcaaatgcttgtgaatctgtggggccctaaaaaaactatttcatttcttggctgctccgttcagctctttatttttctgagcttgggcaccacagagtgtattctcttaaccgtgatggcatttgacagatatgtcgctgtgtgtcagccactgcattacgccactattatccatccgaggctgtgttggcagttggccagcgtagcctgggtgatgtccctggtgcagtcaatagtgcaaaccccatccaccctccacctgccattctgtcctcaccagcagattgatgacttcctttgcgaggtgccctccctaattcgactgagctgcggagacactagttacaatgaaattcagctagctgttagctccgtaatctttgtagtcgtgcctctcagcctgatcctggcctcttatggcgctaccgcccaggcagttctacggatcaactctgcgaccgcctggcgaaaggcattcgggacgtgttcatctcacctgactgtggtcacattattctacagctcagtcattgccgtgtatttgcagcctaaaaatccatacgcccaggggcggggcaaattcttcggccttttttacgccgtcggtactccatcgctgaaccctctggtgtacacactaaggaataaggaaataaagagagccctgcgccggcttctcgggaaagaacgagattcccgcgaatcctggagggcggcctag

SEQ ID NO: 28346 - DNA, 951 bp, Artificial Sequence
  Description of Artificial Sequence: Synthetic coding sequence
atggtgaaccaatcctctccaatgggctttttgttgttaggcttctctgaacacccggccctcgagcgcactctgttcgtagtggtcttcacaagctacctccttaccctagtcgggaatactttaattatactgttgtctgtgctgtatcctcggctccatagccccatgtatttcttcctatccgatcttagtttccttgacctctgttttaccacttcttgcgttcctcaaatgttagttaacctgtgggggccaaagaaaaccatttcatttttgggctgcagcgtgcagctgtttatattcctaagtctggggacaaccgaatgcatcttactcacagtgatggctttcgaccggtacgtggccgtgtgtcaacccctgcactacgccacaatcattcatccaagactgtgttggcagctggctagcgtcgcatgggtcatgagcttggtccaatccatcgtgcagaccccaagtactttgcatctgcccttttgtccccaccagcagatcgacgacttcctgtgcgaagtgccaagtctgatccgactgtcatgcggagataccagttacaacgaaatccagctcgcagtgtcttccgtgatattcgttgtggtgcctctgtccctcattctcgccagttatggcgccacagcccaggcagtgttgcggatcaacagtgctactgcctggaggaaggcgtttggtacctgcagctcgcacctgacagtagtgaccctcttttactcctctgtaatcgccgtctacctgcagcccaagaatccctacgcacaggggcgagggaagttctttggcctgttttacgcagtgggcacaccttcattgaaccctctggtttacacacttagaaacaaggagatcaagagggcactccgaaggctgctgggcaaggagagggatagccgggaatcatggcgggccgcatag

SEQ ID NO: 28347 - DNA, 951 bp, Artificial Sequence
  Description of Artificial Sequence: Synthetic coding sequence
atggtcaaccaatcctcccctatgggctttttgctcctcggtttttctgagcaccccgctcttgagcgaaccctgttcgtggtcgtcttcaccagttaccttttgacgctcgtgggcaacacgttaatcatactgctaagtgtgctctaccctagacttcactcccccatgtatttttttctaagcgacctcagctttctggacctttgttttacgacttcatgtgtgcctcagatgttggtgaacctgtggggacccaaaaaaactattagcttccttggttgttcagtccagcttttcatctttctcagcctggggacgacagaatgcatcctgcttactgtaatggcttttgaccgatacgtcgcggtgtgccagccattacactacgcaacaatcatccatccaaggctgtgttggcagctggcatctgttgcttgggtcatgtcactcgtgcaatccatcgtccagaccccttccactctccacctcccattttgcccacaccagcagattgacgacttcttatgtgaggtgcctagcctcatcagactatcttgcggagataccagctataatgaaatccagctggctgtctcatcggtgatcttcgtagtggtgcccctttctctcatcctggcgagttatggagccacagcacaagcagtgttgaggatcaacagcgccacagcctggcgtaaggcgtttggcacttgttcatcccacctaactgtggtgaccttattctacagcagcgtgattgctgtgtacctacagcccaagaacccatatgcccaggggagaggcaagttctttggacttttctacgcagtcggcaccccatcactgaaccccttggtatacaccctgcggaacaaagaaatcaaaagggcattgagaagactccttggaaaagagagggacagcagggagtcctggcgggcggcttag

SEQ ID NO: 28348 - DNA, 951 bp, Artificial Sequence
  Description of Artificial Sequence: Synthetic coding sequence
atggtaaatcagtctagccccatgggctttttgctgctgggcttctccgagcacccagcactggaacgcacactctttgtggtagtctttacctcttatcttttgaccctagtgggaaacactctgattatcctgctgagcgtgttatacccacgactacacagccctatgtatttctttctaagcgacttgtcctttttagacttgtgttttacaactagctgcgtacctcagatgctggttaacctctggggacctaagaaaacaatctctttcctgggttgctccgtgcagctatttattttcctcagcttggggacaacagaatgtattcttctcaccgtgatggcctttgacagatacgtggctgtttgccaacccctccactatgctaccataatccatcccagactgtgttggcagctcgcctctgttgcctgggttatgtccctagtccaatctatcgtccaaacacccagtacgctgcacctcccgttctgccctcaccaacagatcgacgatttcctgtgtgaggttccctcactgataaggcttagctgcggcgatacctcctacaatgagatccagctggctgtttctagtgtgatatttgtcgtggtaccactttctctaatcctggccagttacggggccaccgcacaagcggtgctgcgcatcaactcagccactgcatggcggaaggcctttggcacctgttccagccacctaacagtcgtgaccttattttactcttcggtaatagcagtgtatctgcagcctaaaaatccatacgcacaagggcgaggaaagttcttcggcctcttctacgccgtgggaactcctagcctcaatccgctagtgtataccctgagaaataaggaaattaagcgcgccctgagaaggctcctgggcaaggagcgcgactcccgcgagtcatggcgcgccgcatag

SEQ ID NO: 28349 - DNA, 951 bp, Artificial Sequence
  Description of Artificial Sequence: Synthetic coding sequence
atggtgaaccaatcgagtcctatggggtttctactgcttggattctcggagcatccagccttggagaggacactcttcgtcgtggtgttcacctcctacctgctcactctggttggaaacacgttgattatcctgctgtcggttctctaccccagactccattctccaatgtattttttcctttccgacctgagtttcctggatctgtgttttacgacctcttgcgtccctcagatgctggtgaacttatggggacctaaaaaaaccataagtttcttaggatgttctgttcaactcttcattttcctgagtctggggacgaccgaatgtatcctgctgacagtcatggctttcgatcgctacgtggctgtctgccaaccgctgcactatgcaactatcatacatccacgactatgttggcagctcgcaagcgtggcctgggtgatgtctcttgtgcagtctattgtgcagacaccttctactctgcatctgccattttgtcctcaccagcagatcgatgacttcctctgtgaggtgccaagtctgattaggctaagttgtggggacactagctacaacgaaatccagcttgcggttagctccgtcatattcgtcgtggtgccactctctctgattctggcttcatatggagcgaccgctcaggctgtgctgaggatcaacagcgccacagcctggcgcaaggcctttggcacatgttcaagccatctaactgttgtaacgttgttctattcaagtgtcatcgccgtgtacctgcagcccaagaacccatacgctcagggccggggcaagttcttcggtcttttttacgcagttggcactcccagtttgaaccccctggtgtatactctccggaataaggaaatcaagagagccttacgccggctattaggcaaagagcgtgactccagggagtcctggcgggccgcctag

SEQ ID NO: 28350 - DNA, 951 bp, Artificial Sequence
  Description of Artificial Sequence: Synthetic coding sequence
atggttaatcagagttccccaatgggatttcttcttctgggtttctccgagcatcccgcgctggaaagaacactgttcgtcgtagtgttcacatcctatctgctaacactggtgggaaacacactcatcatcctgctatctgttctgtacccacgcctccattcgcctatgtatttttttctaagcgatttatctttcctggacctatgctttacaacctcctgtgtcccccagatgctagtcaacctctggggccccaaaaagacaatctccttcctgggatgtagtgtgcagctttttatttttctgtccctgggcacaacagagtgtattctactaactgtcatggcatttgaccgttatgttgccgtttgccaaccacttcattatgccactataattcaccctaggttatgctggcagctggcctcagtggcctgggtgatgtcattggtgcagtccatcgtgcagacgccctctactcttcacctgccattctgcccgcatcagcagatcgacgattttctgtgtgaagtgccaagtctgattcgcttatcatgcggagacacttcgtacaacgaaattcagctggctgtgtcaagtgttattttcgtagtcgtccccctgtctctgatcctggcgagttatggggccaccgcccaagccgttctgagaattaattccgcaaccgcttggagaaaggccttcggcacatgcagttcccacctgaccgtggtgacactgttctactcttcagttatcgccgtgtacttacagcctaagaatccttacgcccaggggcgaggcaagttttttggcttattctatgccgttggaaccccttctctcaaccccctcgtttacacactgcgtaataaggaaatcaaaagggccctcaggaggttattgggaaaagaacgggattcccgagagagttggcgggcagcctag

SEQ ID NO: 28351 - DNA, 951 bp, Artificial Sequence
  Description of Artificial Sequence: Synthetic coding sequence
atggttaaccagtcgtcccccatgggatttctccttctgggtttttcggagcaccccgctttggaacgaaccctgtttgttgttgttttcacaagttacctactcactctggtcggcaatacactgatcattctgctatccgttttatatccacggttacacagccccatgtacttcttcctgtcggatctgagttttctcgatctgtgctttaccacatcctgcgtgccacagatgctggttaacctctggggcccgaaaaagactatcagcttcctggggtgtagcgtgcaactgttcatttttctgtccctaggcaccactgagtgtatacttctcaccgtcatggcctttgataggtatgtcgcggtgtgccagcccctgcactacgccactattatacacccgaggctgtgttggcagctcgcttccgtggcctgggttatgagcctggtgcagtccatcgttcaaaccccgagcaccctgcatctccccttctgccctcaccagcaaattgatgactttctgtgcgaagtcccttccctcataaggctgtcgtgcggggacacgtcatataatgagattcagctcgccgtttctagcgtgatctttgttgtggttcctctgagcctgattctggcgtcctacggagccacagcgcaggccgtgttacgcattaactcggcgacggcttggcgtaaagcgttcggcacttgctcgtcacaccttactgttgtgaccctcttctactcttctgttatcgccgtgtatctgcaacctaagaatccctatgctcaaggccgggggaaatttttcggtctgttctacgctgttgggaccccttctctgaacccactggtctacaccctacgtaataaggagataaagagggcgcttcggcgtttacttggcaaggagagggacagtcgcgaatcttggagagcggcgtag

SEQ ID NO: 28352 - DNA, 951 bp, Artificial Sequence
  Description of Artificial Sequence: Synthetic coding sequence
atggtgaaccagagcagccccatgggtttcctcctgctgggcttctccgagcatcccgctctggagaggactctgttcgttgttgtcttcacatcatatctgctcacacttgtcggaaacactctgatcatcctgctcagcgtgctctacccccgcctgcacagtccaatgtacttcttccttagtgacttgtcctttctggatttatgtttcactacttcttgcgtgccgcagatgttagtcaatctgtggggaccaaaaaaaaccatctcctttctgggctgctccgttcagctgttcatatttctgtcgctgggcaccactgagtgtatcctgctcacagtgatggcctttgacagatacgtcgccgtttgtcagccgcttcactatgccacaatcatacacccccggttgtgttggcagctggccagcgtcgcctgggtaatgtcgctggtgcaatcaatagtgcagacaccctccacactccacctacctttctgcccacaccagcagattgatgactttctgtgtgaggtcccatccctaatacgcctgtcctgtggcgacacgtcttacaatgaaattcagttagcagtctcatcggttatatttgtggtggtgccgctctctttgattttggccagctacggcgcaactgcacaggcagtgcttcgtatcaatagtgcaacagcctggaggaaagccttcgggacttgtagttcacacctgacagtggtgacattgttttacagcagtgtcatcgcagtgtacctgcagcctaaaaacccatacgcccagggccggggcaagttcttcgggctcttctacgcggtgggcacccctagtttgaatcccttggtgtatacactcagaaacaaagagatcaagcgagccctgagaaggctgttgggaaaggagcgtgactcgagagagtcctggagagcggcttag

SEQ ID NO: 28353 - DNA, 951 bp, Artificial Sequence
  Description of Artificial Sequence: Synthetic coding sequence
atggtgaatcagtcatctcccatgggttttctgttgctcggcttctccgagcaccccgctttagagagaacactgtttgtggtggtgtttacttcatacctactgaccctggttggaaatacactgattattttactgagtgtgctctacccacggctccacagcccaatgtattttttcctttctgacctttcctttctcgatttatgctttacaacttcttgcgttccacaaatgctggtgaacctgtggggcccaaagaaaacaatctctttcttagggtgttctgtgcagctttttattttcctgtcactgggcacaacagagtgcattctgctcaccgtcatggcattcgaccggtatgtggccgtctgccagcctctgcactatgcaactatcatccaccccagactttgttggcaactcgcaagtgtagcctgggtgatgtcccttgtgcagagtatcgtacagacgccaagtacccttcacctgcccttttgccctcatcagcagatcgacgatttcctatgtgaggtgccttccctgatcaggttgtcctgcggagacaccagctataacgagatacagctggcagtcagttcagtcatattcgtggtcgtaccattgtctttgatccttgctagttacggagctacagctcaggcagtgctgcgtatcaacagtgcaaccgcttggaggaaggccttcggaacatgttcctcacatctgacggtcgttaccctgttctattcaagtgtcatcgcggtttatctccagccaaagaacccctacgcccaaggccgtggcaagttttttggactgttttacgcagtgggaactccctcccttaaccccctggtgtacaccctacgcaataaggagattaagcgggctttgcgccggctgctcggcaaggaacgggactcccgagagtcttggagagcggcttag

SEQ ID NO: 28354 - DNA, 951 bp, Artificial Sequence
  Description of Artificial Sequence: Synthetic coding sequence
atggtcaatcagagcagccccatgggctttttgctgctgggattcagcgaacacccagcactcgagcggactctctttgtcgtggtgtttaccagttacctgctcacactggtggggaataccctgatcatactgctctccgttctgtatccgaggctccattccccaatgtatttctttctctctgacctttctttcttggatctctgcttcaccacaagttgcgtcccacagatgctggtgaatttatggggaccaaaaaaaactatcagtttcctggggtgcagcgtgcaactgttcatatttttgtcgttaggtacaacggaatgcattctcttgacagtgatggcctttgatagatatgtcgccgtttgccaacccctccattacgccacaatcattcaccctagactctgctggcagctggcctcagtggcctgggtgatgtcattagtgcaatcaatagttcagacaccatctacactccacctcccgttctgtccccatcagcagattgacgacttcctatgcgaagttccttccttaatccgccttagctgtggcgacacaagctacaatgaaatacagctggccgtgagctccgttattttcgtggtggtacccctctccctcattctagcgagttacggcgctactgctcaggcagtgctaagaatcaatagcgcaacagcatggcgcaaagcattcggaacctgttcatctcatctcacggtggttaccctgttttactcgtctgtgatcgccgtgtacctccagcctaagaacccttatgcccaagggagaggaaaatttttcgggctgttttatgcagtggggactcctagtctcaaccctctggtctatacactgaggaacaaggagatcaagagggccctcagaagactactgggcaaggagcgcgacagccgcgagtcatggagagctgcatag

SEQ ID NO: 28355 - DNA, 951 bp, Artificial Sequence
  Description of Artificial Sequence: Synthetic coding sequence
atggtgaaccaaagctctccaatgggttttctgctgttgggtttcagcgaacaccctgccttggaacgcacactcttcgtcgtggtcttcacgtcctacttactgacgcttgtcggaaacacattgattattctactgagtgtcctttatccgcggctgcacagtcctatgtattttttcctcagcgatctcagctttctcgatctttgctttaccactagctgcgtgccccaaatgctggtgaacctgtggggccccaaaaaaacgataagtttcctcggatgctctgtccagctgtttatctttcttagcctgggtacaactgaatgtattcttctgacagtgatggctttcgaccgctatgtggcggtgtgtcagcctttacactacgccacgatcatccacccgcgtttgtgttggcagctcgccagcgtggcgtgggttatgtcgcttgtacagagcatcgtgcagactccatccacacttcacctgcccttctgtcctcaccaacaaattgacgatttcctttgtgaggtcccatcactgattcggctctcatgtggcgatacaagttacaatgaaatacagctggctgtgtcaagcgtgattttcgtggtggtgcccctatcccttattttggcctcttatggggctactgcgcaggctgttctgcgcattaattcagccacagcatggcggaaagctttcgggacgtgctcctctcacctgaccgttgtcactctgttctacagttcagttatagcagtctacctccagccaaaaaatccctacgcccagggccgggggaagttcttcgggctattctatgccgtcggtacgcccagtctaaacccccttgtgtacactctgagaaataaggaaatcaagcgagcactgcggagactactaggtaaggagagagattctagggagagctggcgtgcggcgtag

SEQ ID NO: 28356 - DNA, 951 bp, Artificial Sequence
  Description of Artificial Sequence: Synthetic coding sequence
atggtgaaccagagttcaccaatgggctttctgctcctggggttcagtgagcaccctgctctggaacggactctgttcgttgtggtcttcacctcatatctgctgaccttagtcggaaatacccttatcatccttctcagcgtgctgtatcccagactgcactcacccatgtatttctttctttctgatctttcattcctggacttatgttttacgaccagctgtgttccgcagatgctggtcaacctatggggaccaaagaagacaatcagtttcctaggttgcagcgttcagctgttcatttttctttctcttggaactactgagtgtattctgctaacagttatggcattcgaccgttatgtggcagtatgtcagcctctccactatgctacaatcatccacccccgcttgtgttggcagctcgcctccgtggcctgggttatgtctctggtgcagtccatcgtgcagacaccttctaccctgcaccttccattctgcccccatcaacagatagacgacttcctatgtgaagtgccaagccttatccgtctgtcatgtggcgacacctcctacaacgagatccagctcgccgtcagttcagtcattttcgtggttgtgccactgtccctcattctggcatcatacggcgccaccgcccaagctgtgttacggattaacagcgcaacagcctggcggaaggcattcggcacgtgttcctcccacctaaccgtggtaacacttttttactcaagcgttattgctgtctatctccagcctaaaaatccgtatgcccaggggaggggcaagttctttggcctattttatgcagttgggacacccagccttaaccctttagtgtacacacttcgcaacaaagaaatcaaacgggcactacgaaggctgttaggaaaagaaagagatagccgggagtcatggagagccgcatag

SEQ ID NO: 28357 - DNA, 951 bp, Artificial Sequence
  Description of Artificial Sequence: Synthetic coding sequence
atggtcaaccagagctctcctatgggttttctgctgctaggattttccgagcatcccgcccttgagcgtactctattcgtagtagtgtttacctcctatctccttaccctggtgggcaacactctgattattttgctctccgtgttatacccccgcctgcactctccgatgtattttttcctgtctgacctcagctttttggacttgtgtttcacaacatcatgcgtccctcagatgctggtgaatttgtggggaccaaagaagactatttcatttctgggctgtagcgttcaattattcatcttcctgtcgctgggtaccactgagtgtatcctcctgacagttatggccttcgatcgctacgtggccgtgtgtcagcccttgcactacgcaaccatcattcatccacggctgtgttggcagctggcttctgttgcctgggtcatgtcactggtgcagagcattgttcaaacgccctcaacactacatctgcccttctgcccccaccagcagatcgacgactttctgtgtgaagtccccagtctgatccgcctttcctgcggagacacttcttacaatgaaatccagctggcagtgagctctgtaatctttgtcgtcgtgcccttgtctcttattctggcctcatatggcgcaaccgctcaagcggtgctaaggattaattctgccacggcttggaggaaggcttttgggacatgcagtagtcacttaactgtggtgactcttttctacagctccgttatagccgtgtacttacaacccaagaatccttacgcacagggccgaggcaagttttttggactgttttatgccgtgggtactcccagcttgaacccattagtttacacgctccggaacaaagagataaagagggctctaagaagattactcgggaaagaaagggatagccgggaaagctggcgtgctgcttag

SEQ ID NO: 28358 - DNA, 951 bp, Artificial Sequence
  Description of Artificial Sequence: Synthetic coding sequence
atggtcaaccaaagctcccctatggggtttctcctgcttggattctccgagcatccagccctggagcgcaccctgttcgtcgttgtgttcaccagttacctgcttacgctagtgggtaacacactcattattttgctgtccgtcctctatcccaggctccacagccctatgtatttcttcctgtccgacctttcattcctagacctctgctttaccacttcctgtgtcccccagatgctcgtgaacttatggggaccaaagaagacgataagtttcctgggctgctccgtgcagctgttcattttcctgtccctgggaacaactgagtgcattttgctaaccgtcatggcctttgatcggtatgtggccgtgtgtcagccattacattacgctaccataattcaccctaggctgtgttggcagctggcgtccgtggcatgggtaatgtcacttgtccagtcaatcgtgcaaacacccagcactctgcaccttcctttttgcccccaccaacagattgatgattttttatgcgaggttccaagcctcatacgcctctcctgtggggatacatcatacaatgagatccagctggctgtttcaagtgtgatttttgtcgtcgtgcccctttccctgatcctcgcatcctatggcgcaaccgctcaggccgttcttcgcatcaactctgcgacggcgtggcggaaagcttttgggacatgcagcagccacttgacagttgtgactctgttttatagtagtgtgattgctgtatacctccagcctaagaatccctatgctcagggtcggggcaagtttttcggattgttctatgccgtcggtacgccttctctgaatcctcttgtttataccctgcgcaataaggagatcaagagagctcttaggagactcctggggaaggaacgggactcgagagagagttggagggctgcctag

SEQ ID NO: 28359 - DNA, 951 bp, Artificial Sequence
  Description of Artificial Sequence: Synthetic coding sequence
atggtcaaccagtcgtcacctatgggatttcttctgttaggattcagcgagcatccggccctcgagcgcacattattcgtggttgtgttcaccagttacttactcaccctggtggggaatacgctgataattctgcttagcgtcttgtatcctcgcttgcacagcccaatgtacttttttctgtccgacctttcttttttggacttatgtttcaccacctcctgtgtgccccagatgctggtgaacctgtggggtccaaaaaaaactatctccttcctggggtgcagcgtgcagctgtttattttcctatcactaggtacaaccgagtgtatactactcactgtgatggcattcgaccggtacgtagccgtttgccagccactccactacgccaccatcatccatccacgtttgtgctggcaactcgctagcgtcgcttgggtaatgtccctggtgcaatccattgttcaaaccccctctacattacatttgcctttttgtccccaccagcagatcgatgatttcttgtgtgaggtgcctagtctgatcaggctgagctgcggagacacatcttataatgagatccagctggctgtctcatctgttattttcgttgttgtgcccctgtcgctcatcctggcttcatatggcgccaccgcacaggcggttttgcgaattaacagtgcgacagcctggcgcaaagcattcgggacgtgctctagccaccttaccgtggtgaccctgttttacagctctgttattgctgtgtacctccagcccaaaaacccatatgcccagggccgcggcaaattttttggactattttatgctgtagggacgcctagccttaatcccctagtgtatacactgcgtaataaagagatcaaaagggcactgcgccgactgctggggaaagagagagactcgcgggagtcgtggcgagctgcctag

SEQ ID NO: 28360 - DNA, 951 bp, Artificial Sequence
  Description of Artificial Sequence: Synthetic coding sequence
atggtgaatcaaagctcaccaatggggttccttctgctgggcttctcggagcatccggctctggagcgaacactattcgtcgtggtttttacttcctacctattgacactggtgggaaatacactgattatcctattgagcgtactctacccaaggctgcattctcccatgtattttttcctgagcgacctgtctttcctcgacctgtgctttactacatcttgcgttcctcaaatgttagttaacctttggggcccaaaaaaaactatcagctttttaggatgcagtgtgcagctgttcattttcctctccctcgggaccacggagtgcattttgttgacagtaatggcttttgataggtacgtcgctgtttgtcaacctcttcactatgctacaatcatccatccccgtctgtgctggcagttagcgtccgtggcttgggtgatgtccctcgttcagtccatcgtacaaacaccctccactctccacctgcccttctgtccgcatcagcaaattgacgactttctttgtgaggtgcccagccttatcaggctgagctgcggcgatacaagctacaatgaaatccagctggcagtgagcagcgtgatttttgtcgtggtcccactgagcctcatactggcgagttatggagcaaccgcacaagcggtgctccgcatcaactccgccacggcttggcggaaggcatttggaacatgcagtagccatcttaccgttgtgactcttttctattcatccgttattgctgtgtacctacagccaaagaatccttatgcacaaggccgaggtaagttttttggactgttttatgccgttggaacccccagcctgaacccactggtgtatactttgcgtaacaaggagattaagcgggcattgcgcagactactgggcaaggagagagacagtagagagagctggagggctgcttag

SEQ ID NO: 28361 - DNA, 951 bp, Artificial Sequence
  Description of Artificial Sequence: Synthetic coding sequence
atggtaaatcagtcctcccccatgggattcctgttactcgggtttagtgagcatcccgctctggaacgcacactctttgtggtggtgtttaccagctaccttctgactctggttgggaatacgttaattatcctgctttcagtcttatatcctaggctccactctcccatgtacttctttctcagtgacctgagcttcctggacctttgttttaccacttcctgtgtcccacagatgttagtgaacctgtggggtccaaagaagacaatctctttcctagggtgttcagttcagcttttcatcttcctcagcttgggaactacagagtgcatactgttgacggttatggcttttgaccgatatgtcgctgtatgccagcctctacactatgcgacaatcattcatccccggctgtgctggcaacttgcttccgtggcttgggtgatgtctttggttcagagcatcgtccagaccccttccaccctccacctgcctttttgtcctcatcagcagatcgacgatttcctatgcgaagtcccaagtttaatacggctgtcctgcggggatacgagctacaacgagattcagctggctgtaagttctgtgatctttgttgtggtgccattatccctgatcctggcaagttatggggccacggcccaggctgtcttaagaattaactctgctacagcctggcgcaaggcatttggcacttgttcctctcacctgactgtcgtcaccctgttttactccagcgtcatcgctgtgtatttgcagccgaagaacccatacgcgcagggcagaggcaagttttttgggctattttacgccgtgggaacgccatccttgaatcccctggtctataccttacgaaataaggagatcaaacgtgccctgaggaggcttttgggcaaggaacgcgactcacgggaatcatggcgggctgcctag

SEQ ID NO: 28362 - DNA, 951 bp, Artificial Sequence
  Description of Artificial Sequence: Synthetic coding sequence
atggtgaaccagtcaagccctatggggttcctcctgttgggcttctctgagcacccggctcttgagaggaccttatttgtagtggtgtttacctcatatctccttacactggtcggaaacacactgattattctcctgagtgtgctgtatcctcgcttgcactctcctatgtacttcttccttagtgacttgagcttccttgatctgtgttttacgacctcatgcgtcccccagatgctggtaaacctgtggggaccgaaaaaaaccatttcatttttgggatgctccgtccagttgtttatctttttgagcctgggaaccaccgagtgcatcctgttgactgtgatggcttttgaccggtacgtagcagtgtgtcagccacttcattacgccaccatcattcatcctaggctgtgttggcagcttgcctctgtagcctgggtcatgagtctggtgcaatccattgtacaaactccgtctacactgcatcttcccttttgccctcatcagcagattgatgatttcttgtgtgaggtgcctagtctgatccgattgtcgtgcggcgatacctcttacaacgaaatccagctcgccgtatcctcggtcatattcgttgttgtcccactttccctcatcctggctagttatggagccacagcccaggccgttcttaggatcaacagtgctaccgcctggcgtaaagccttcggaacctgttccagccatctgacagtggtgaccctgttctactccagtgtcatcgccgtatacctgcaaccgaagaacccttacgcccaggggcggggcaagttttttgggctcttctatgccgtaggaacaccctccttgaatccactagtgtatactctgcgcaataaggagattaagagagcccttcggcggctcctgggaaaagaacgggattcacgagagtcttggcgcgcagcctag

SEQ ID NO: 28363 - DNA, 951 bp, Artificial Sequence
  Description of Artificial Sequence: Synthetic coding sequence
atggtgaaccaaagctcacccatgggctttctgctcttgggtttctcagaacacccggcactggagcggaccctgtttgtggtagttttcacaagttacttgttaactctcgtggggaacaccctgatcattttgctatcagtcctttacccccgcttacattcccccatgtatttctttctgtcagatctaagcttcttagatttgtgcttcacaactagctgcgtgccgcagatgcttgtgaatctctggggtccaaagaagacaatcagctttctgggctgtagtgtgcagctcttcatattcttgtccttgggtacgacagagtgcatcctgttaactgtgatggcgtttgaccggtacgtcgcagtgtgtcagccattgcactatgccaccataatccacccacgcctttgctggcagttagcttccgttgcatgggtcatgagcttggtgcagagtattgtacaaacaccttctaccttgcacctccctttttgcccacaccagcaaattgatgactttctgtgtgaggtgcccagtctgattaggttaagttgcggcgacacctcttacaatgaaatccaactggccgtgagttccgtaattttcgtggtagtccccctgagcctgatcctggcctcgtatggcgctacagcgcaagccgtgctgcgaatcaacagtgcaacagcttggagaaaggcctttggcacgtgttcctctcacctgactgtggtgacccttttctactcttccgtcatagccgtgtacctccagcctaaaaacccttatgcccaggggcgtggaaagttctttggcctgttttacgctgtggggacgccatctctgaaccctctagtgtacacactgagaaacaaggaaataaaaagggctctgagacggctgctcggcaaggaacgcgacagccgggagtcttggagagcagcatag

SEQ ID NO: 28364 - DNA, 951 bp, Artificial Sequence
  Description of Artificial Sequence: Synthetic coding sequence
atggtaaatcagtcaagccctatgggttttttgctgctcgggttctcggaacatccggctctcgaacgaaccttattcgtcgtcgtctttacgtcgtatctgctaacactggtggggaacacactgataattctgctgagtgttctatatccacggctgcattcgcccatgtacttcttcctgtctgacttgtcctttctcgacctgtgcttcactacatcctgtgttccgcagatgttagtcaacttgtggggaccgaagaagaccatcagtttcctgggatgttccgtgcaactgttcatctttctgtcgctgggcacgacagagtgcatcctgcttacggtaatggccttcgacaggtatgtggcagtatgccaacccttacattacgccaccattatccacccccgcctttgctggcagttggcctctgtggcttgggtgatgtctctcgtgcaatctatcgtgcagactccaagtaccttacacctgcccttctgcccacatcagcaaattgacgactttctctgcgaggtgcccagcttaatccggctgagttgtggagacacctcatataacgagatccagcttgcagtaagcagtgtgattttcgtcgtcgtgcccctttccctgattcttgccagctatggggcaaccgcccaggctgtattgagaatcaattcagccacagcttggcgaaaggcatttgggacatgttccagtcacctgacagttgtgactctgttttattcgagcgttatagccgtttacctgcaacccaagaatccttacgctcaggggcgcggcaaattttttggactcttctacgcggtggggaccccatctttgaatcccctcgtttatactctgcgaaacaaggagatcaaacgagcactccggaggctgctcggcaaggaacgggacagccgtgagagctggagagcagcttag

SEQ ID NO: 28365 - DNA, 951 bp, Artificial Sequence
  Description of Artificial Sequence: Synthetic coding sequence
atggttaaccaaagcagtcctatgggcttcctgctgttaggatttagtgagcatcccgcccttgagcgcacgctgtttgtggtggtcttcaccagttacttgctgacccttgtgggcaataccttgataattctgctgagcgtactctatccgaggcttcactcccctatgtatttctttttgtccgatctgtccttcctcgacctatgctttactacctcctgcgtgccacagatgttagttaacctgtggggccccaagaaaaccatatcctttctaggatgctccgtccaattattcattttcctgagcctgggaaccaccgagtgtatcctgctcactgtgatggccttcgacagatacgtggcggtatgccaacccctccactacgcgacgatcatccatccaagactctgttggcagcttgcttctgtggcgtgggtgatgagtctggtacagagcattgtgcagacacctagcacattgcacctgccattctgcccccaccagcaaattgacgattttctgtgtgaagtgccatccctgatccgactgtcctgtggggacactagttacaatgaaatccagctagcagtgagctccgtgatcttcgtcgtggtgcctctgtctctcatccttgcgagttacggtgccacggcacaggcagtgctcaggatcaactccgcgaccgcctggagaaaggcctttggcacgtgctcaagccacctgacagttgtaacattgttttacagttctgtgattgccgtgtacttacagcccaagaatccctacgcgcagggacggggcaagttttttggcctattctatgcagtgggcactccatctttgaatcccctggtctatacactccgcaataaggaaatcaaacgcgcactgcggcgcctcttagggaaggaaagggatagtagggagtcctggcgtgccgcatag

SEQ ID NO: 28366 - DNA, 951 bp, Artificial Sequence
  Description of Artificial Sequence: Synthetic coding sequence
atggtcaatcagtctagtcctatgggttttctgctcctgggtttctctgaacaccccgccttagagaggacattgtttgtggtcgtcttcacaagctatcttctgactctcgtgggcaataccctgattatcctgttgtctgtcttatatccaaggctacacagcccaatgtacttcttcttgagcgatctgtccttcctcgatctctgctttaccacatcctgcgtcccacagatgctggtgaacctctgggggcccaaaaaaacaatctccttcctgggctgtagcgtgcagctgttcatcttcttgtctcttggcactaccgaatgcattctcctgaccgtaatggcctttgacaggtacgtagccgtgtgccagcccttgcattatgctaccatcatacatcccaggctctgctggcagctggcatcagtggcttgggtgatgtccttagtgcagtccattgtgcagacgccttctactctgcacctacctttttgcccccaccagcagattgatgacttcctgtgtgaggtgcctagtctcatcaggttgagctgcggcgacaccagctacaacgagattcagttggcagtcagcagcgtgatatttgtcgtagttcccctttctctgatcctagcttcctacggtgccactgctcaggcagtgcttaggattaacagcgcaaccgcttggcggaaggccttcggcacatgcagtagccatctgacagtggttaccctgttttattcttcagttattgccgtctatctgcagcctaaaaatccctatgctcaaggaagaggtaaattctttggtctgttttatgctgttgggactccctcactgaatccgttagtctacacattgagaaataaggaaataaagcgcgctttaaggaggctgttgggaaaggagagggattctcgcgaaagctggcgggctgcatag

SEQ ID NO: 28367 - DNA, 951 bp, Artificial Sequence
  Description of Artificial Sequence: Synthetic coding sequence
atggtcaatcagagctcccctatgggcttcttgctcctggggttttcagaacaccctgcactcgagcgcaccctgttcgtagtcgtgtttactagttatttgctaactcttgtaggaaacacgctaattattctgctttccgtgttgtatccacggctgcatagtccaatgtacttttttttgtcggacctcagctttttggacctgtgcttcacaaccagctgtgtgcctcaaatgctggtaaatttatggggtcctaaaaaaacaatcagttttttggggtgcagtgtccagctgtttatatttctgagtctgggcacaacagagtgcattctgctgaccgtcatggcctttgatcggtatgtggcggtgtgccagccccttcactatgctaccatcatccacccccgtctatgctggcaactcgcgtcagtggcatgggtgatgagccttgtgcagtcaattgtgcagacgccgtccactctccatctgcctttctgcccccaccaacagattgacgacttcctgtgtgaagtccccagcctcattcgactaagttgcggtgacacctcctacaatgaaatacaactagctgtttccagcgtgatttttgtggtggtacccctgtcactcattctggctagttacggcgccaccgcccaggccgtactaaggatcaactcagcgacagcttggcgcaaagcattcggaacatgttcttcacacctgacagtggtgacattgttctattcaagcgttatcgccgtctatctgcagcctaagaacccatacgctcaaggccgtgggaagttcttcggccttttctacgcagtgggaacaccaagtttaaatccactggtctatactctgaggaacaaagagattaaacgcgcactgagaagactgctcggtaaagagcgcgattccagagagagttggcgcgcagcttag

SEQ ID NO: 28368 - DNA, 939 bp, Artificial Sequence
  Description of Artificial Sequence: Synthetic coding sequence
atggtcaatcaaagcagcactccgggatttctgctgttaggattctcggagcacccaggcctcgagcgcaccttattcgtggtggttctcaccagttacttgctcacccttgtggggaatactctgattatattattatctgccctcgaccccaaattgcattctcctatgtatttttttctgtccaacctgagtttcctggacctatgcttcacgactagctgtgtcccacaaatgttggtcaacctctgggggcccaaaaagacaatctctttccttgattgttcagtgcaaatctttatctttctcagcttggggacaaccgagtgtatcctgctgaccgtgatggcctttgatcgctacgtggctgtctgccagccgcttcactatgccacgatcattcaccctagactgtgttggcagctggccagcgtcgcctgggttatcgggctcgtggagtccgtcgttcaaaccccaagtaccctccacttacccttttgccctgaccgccaagtggacgatttcgtgtgtgaggtccctgcattgatccgcctctcatgtgaggataccagctataacgagatccaggtggccgtcgcctctgtatttatcttggtggtcccactgagcctcattctggtctcctacggcgctattacttgggcggtgcttcggattaattcggcgaaaggccgacggaaggcctttgggacctgcagttcccacctaaccgtagtaacgttgttttattccagtgttatcgccgtgtacctgcagccaaaaaatccatacgcccaagagcgggggaagttcttcggcttgttctacgccgtgggcacgccgtctctaaatcccctaatttatactcttaggaataaggaggtgacccgagcctttcgcagactgctggggaaagagatgggtctcactcagtcttag

SEQ ID NO: 28369 - DNA, 939 bp, Artificial Sequence
  Description of Artificial Sequence: Synthetic coding sequence
atggtgaatcagagcagtacacctggctttctactacttggattctcagaacacccaggccttgaacgcactctgttcgtggtcgtgctcacgtcctacctcctgaccttggtgggcaacaccctcattatcctactgtctgccttagatcccaaattgcacagcccaatgtattttttcctctccaacttgtctttcttagacctgtgtttcaccacgagctgtgtaccccagatgctggtcaacctgtggggcccgaaaaagacaatctctttcctggattgtagcgtgcagatattcatttttctgagcctgggaactacagaatgcatccttctgaccgtgatggcattcgaccgatatgtggcagtgtgccagcctttgcattacgctaccatcattcaccctcgcttatgttggcaactggcctctgtcgcttgggttattggactagtggagagcgtcgtgcaaacaccatccaccttacatctcccattctgccctgaccgtcaggtggacgactttgtttgcgaagtcccggccctgataagactttcatgtgaggacacttcctacaatgaaattcaggtggccgttgcttctgtctttattctggtcgtgcctctttcgcttatcttagttagctacggtgccattacttgggcagtccttaggatcaactccgctaagggccggaggaaggctttcgggacatgtagctcccatctgaccgttgtgaccctcttctatagcagcgtaatcgcagtgtaccttcagcccaaaaatccatatgcacaggaacggggtaaattcttcggcctattctacgccgtggggacgccttctttgaatcctctgatatacactttgaggaacaaggaggtgacacgtgccttcagaagactgctcggaaaggagatgggcctgactcagagctag

SEQ ID NO: 28370 - DNA, 939 bp, Artificial Sequence
  Description of Artificial Sequence: Synthetic coding sequence
atggtaaatcagagttccactccaggattcctactgttggggttttcagaacaccccgggctcgagagaacgttgtttgttgtggtcctgaccagttacctgctcacgctagtcggaaacacactgataattctgctcagcgcactggacccaaaacttcactcaccgatgtactttttcttgagcaatctgtccttcttagatctatgtttcactacctcctgtgtacctcagatgttggtgaatctctggggtccaaaaaaaactatctccttcttagattgcagcgtgcaaattttcatttttctttctctggggactacggaatgcattctgctaacagtgatggccttcgacagatatgtcgccgtttgtcagccgctgcattacgcaacaatcatccatcctcgcctctgttggcagctcgcaagtgtggcatgggtgattgggctcgtcgaatcggtggtccagacaccatccacgctccacctgcccttctgtccggaccgccaagttgacgatttcgtttgtgaagtgccagccctgattcgactctcttgcgaagacactagttacaatgagatccaggttgctgttgcctcagtgttcatcttggtggtgccactcagcctcatcttagtcagttacggtgctattacatgggctgttctgcggattaatagtgcaaaaggcagacgaaaagccttcggtacctgttccagccacctgaccgtggtaaccttattttacagtagtgtgatcgctgtttatctgcagcccaagaatccttacgcccaggaacggggaaagttctttgggctgttttacgctgtgggtacacccagtctcaaccctttgatttacacccttaggaacaaggaagtaacaagagcctttcgaagactcctgggaaaggaaatgggcctcacgcagtcatag

SEQ ID NO: 28371 - DNA, 939 bp, Artificial Sequence
  Description of Artificial Sequence: Synthetic coding sequence
atgctgatgaagaaaaacgcatctttcgaggatttcttcctcctactgggcttttctaattggccgcaccttgaggtcgtgctttttgtggtgatcctgatattctatctgatcaccctgattggcaatcttttcatcattatcttatcatatctcgacagccatctgcatactcctatgtatttttttctcagcaatctgagcttcctggatctatgctatactacaagcagtattcctcagctgctggtgaacctctggggccccgaaaagactatctcgtatgctggatgcactgtgcaactgtacttcgtcctggcgttaggaacagccgagtgtgtgctccttgttgtgatgtcctacgaccgttacgccgcagtgtgcaggcccttgcactacaccgtgttaatgcaccctcgcttttgtagactgctagcagctgcgtcttgggtatctgggttcacgactagtgcccttcactcatctttcactttttggatcccactatgcaggcatcggctggtggatcacttcttttgcgaggtcccggctctcttacggctgagttgtgttgatacgcaagccaatgagctcaccctgatggttatgagttctattttcgtcctgatcccgttaattctgatactgacatcttacggcgccattgcacgcgctgtgctgtcgatgcagtcaaccacggggctgcagaaagttctcagaacctgtggggcacatttgatggtggttagcctgttttttatcccagtgatgtgcatgtatcttcagcctccttccgagaatagccaggaccagggcaagtttatcgccctgttttataccgtagttactccctctcttaatcctctgatatacacctttagaaacaaggacgtgagaggagccgtgaagcgtctgatgggttgggaatgggggatgtag

SEQ ID NO: 28372 - DNA, 939 bp, Artificial Sequence
  Description of Artificial Sequence: Synthetic coding sequence
atgatgatcaagaaaaacgcgtcctctgaagatttcttcatcctgctgggcttctctaattggccccagctcgaagttgtactgtttgtggtcatcttgattttctacttgatgacacttactggtaatctgtttatcatcatattgagctatgtcgacagtcatctgcatacccccatgtacttcttcttgtctaaccttagtttcttagatctgtgccacaccacgtccagcataccacagttgttggtgaacttgcggggacctgagaagactatatcttatgccggatgcatggtccagctctatttcgtgctggctctggggatcgcggaatgcgtgctattagtcgtgatgagttatgatagatatgtagcggtttgccggccactccattatacagttctcatgcatccaagattttgccatttgctagccgctgccagctgggtgattggcttcacgatcagcgcccttcattcaagtttcactttttgggtcccactttgcggccatcgcctggtcgaccacttcttctgcgaggtccccgccctcctaagactgtcttgtgtggatacacatgccaacgagctgactctgatggttatgagttcaatcttcgtgctcattccactgattcttattctcactgcctacggggccattgcaagagccgtcctctcaatgcagtcgactacagggctgcagaaagtcttccgaacttgcggggctcatttaatggtggtgtctctgtttttcattccagtcatgtgtatgtaccttcagccacccagtgaaaattcaccagatcagggaaaattcatcgccctgttttacactgtggtaactccatccctaaacccactcatttacaccttgcgaaataaacacgttaagggcgctgccaagagactgctgggctgggagtggggcaaatag

SEQ ID NO: 28373 - DNA, 939 bp, Artificial Sequence
  Description of Artificial Sequence: Synthetic coding sequence
atgatgatcaagaagaacgcttccagcgaggactttttcatcctcctcgggttcagcaattggccccaattagaagtcgttctgttcgtcgtgattcttatattctatttgatgacactaaccgggaacctgtttattatcatcctttcctatgttgacagccatctgcatacgcccatgtatttcttcctgtcaaacctgagctttctcgacctatgccacacaacatccagtataccacagctattggtgaatctacgaggaccagagaagacaattagttacgcaggctgtatggtacagctctatttcgtgcttgctttaggtatcgctgagtgcgtcctgctggtggtgatgtcttacgacagatatgtcgctgtgtgccgcccactgcattatacagtgctgatgcacccacgtttctgtcatctcctggcagctgcttcttgggtgatagggttcaccatatcggccctgcatagctcattcaccttttgggtcccactttgtggtcaccgcctagtggaccacttcttctgtgaagtgcctgcacttctgcgactgagttgtgtggatacccatgcaaacgagctgactctgatggttatgagcagcattttcgtactcattcctctgattttaattttgacggcgtacggagccatcgctagggccgtgctctctatgcagtctaccaccgggttgcaaaaagttttccgcacgtgtggggcccacctcatggtggtgagccttttttttattcctgtcatgtgtatgtatctccaaccaccatcagagaactccccggaccaggggaagtttattgccttgttctacaccgttgtcactccatctttaaacccattaatttatacactccgaaataagcatgtgaaaggagcagcgaaaaggctcctgggctgggaatggggcaaatag

SEQ ID NO: 28374 - DNA, 939 bp, Artificial Sequence
  Description of Artificial Sequence: Synthetic coding sequence
atgatgatcaagaaaaacgcttcctctgaagactttttcattctgctgggcttcagcaactggccgcagctggaagtcgttctgttcgttgttatacttattttttacctcatgactctaaccgggaacttgtttataattatcctctcttatgtcgactcccatctgcacacacctatgtatttttttctgtccaacctttcctttctcgacttatgccacaccaccagcagtattccacagttgctagtgaatctgaggggacccgagaaaactatttcttatgctggctgcatggtgcagttatatttcgtgctggcccttgggatcgctgaatgtgttctcctggtcgtcatgagctacgatcggtatgtagctgtgtgccgaccactgcactatacagttctcatgcacccaaggttctgccacctgttggccgcagcctcttgggtgattggatttaccatcagtgcgctacactcttcatttactttctgggttcccctgtgcggccatagactggtggatcacttcttctgtgaggtaccggcgctgctgagattgtcttgcgtggacacccatgcaaacgagctcaccctgatggtgatgagttctatctttgtactcatccccctgatcctgattcttacagcatacggggccatcgctcgagcggtgctgtcaatgcagagcacgactgggctgcaaaaagtgttccgcacatgcggggctcatctaatggtggtttcgcttttcttcatccctgtgatgtgcatgtacttacagcccccctcagagaactcacccgatcaagggaaatttatcgccttgttctacacggtcgtcaccccaagtcttaacccactgatctacaccctgcgcaacaagcacgtgaagggggcagctaaaagactgctggggtgggagtggggaaagtag

SEQ ID NO: 28375 - DNA, 939 bp, Artificial Sequence
  Description of Artificial Sequence: Synthetic coding sequence
atgatgatcaagaagaatgcatccagcgaggacttcttcattttattgggattttctaactggccgcagctcgaggtcgtcctatttgtagtgatcctcattttttaccttatgactctgaccggaaacctgtttattatcatcctgtcttatgttgactctcaccttcacacacccatgtacttctttctgagcaatctgagcttcctggatctctgccatactacgtcatctattcctcagctcttggtgaacctccggggtcctgagaaaacaattagctatgctggttgtatggtccagctctactttgtcttggccctcggtatcgcggagtgcgtgctgctggtcgtgatgtcctacgatcggtacgtcgcagtttgcagacctctgcattatacagtgctgatgcacccacggttttgccatcttctggctgccgcctcctgggtgattggtttcacaatttccgcactccattcgtcctttacattctgggtgcctctatgtggccaccgccttgtggatcactttttctgcgaggtccccgctctcctcagattgagctgtgtggacacacacgccaacgagctgacccttatggtgatgagctctatctttgtgctgatcccgctgattctgatattgacagcgtacggagctatcgctcgagcagtgctatctatgcaatccaccaccggattacagaaggtattccgcacctgcggggcccacctaatggtggtgtcccttttctttatcccagtgatgtgtatgtacctgcagccccctagtgagaactcacccgaccaaggcaaattcatcgcactcttttatactgtggttacaccaagtctgaacccactgatctatacattgcggaataaacacgtcaaaggggccgctaaaaggctattgggctgggagtgggggaagtag

SEQ ID NO: 28376 - DNA, 939 bp, Artificial Sequence
  Description of Artificial Sequence: Synthetic coding sequence
atgatgattaagaaaaatgctagtagcgaggacttcttcatcttgcttggtttctcaaactggccacagctggaagtagtgctgttcgtcgtgatcttgatcttctatttgatgactctaactggcaatctgttcatcatcatcctgtcatatgtagatagccatcttcataccccaatgtactttttcctcagcaatctgtcctttctcgatctttgtcataccaccagctccataccacagctgttagtcaacctgcgagggcctgaaaagaccatctcttatgccgggtgtatggtccaactgtacttcgtgctggctctcgggatcgctgagtgcgtccttttggtcgtgatgagctacgacaggtatgtcgcggtctgtaggccactgcactacactgtgcttatgcatccccgcttttgtcacttactggctgccgcatcctgggttatcggcttcaccattagtgcgcttcactcctccttcacgttttgggtccccctctgcggtcaccggctagttgatcatttcttttgtgaagtgccggccctcctgaggttaagctgtgtggatactcatgcaaatgagcttacgctgatggtgatgtcctccatcttcgttctcatccctctgattcttatcctcactgcctatggtgcgatcgccagggcggtgctatcaatgcagtccacgactgggctccaaaaggtcttcagaacatgcggggcccacctgatggtggttagcctgttttttatcccagttatgtgcatgtacttacagcccccaagcgaaaacagccctgaccaggggaagtttattgcgctcttctacacagtggttacccccagcctgaatcctcttatttatacccttaggaacaagcatgtcaaaggcgccgccaagcgcctgttgggctgggaatgggggaagtag

SEQ ID NO: 28377 - DNA, 936 bp, Artificial Sequence
  Description of Artificial Sequence: Synthetic coding sequence
atgaatgacgacggtaaggtgaatgccagttcggaaggctacttcatcctggtgggattctccaactggcctcacctcgaggttgtgattttcgttgtggtcctgatcttctacttgatgacactgataggtaatctgttcattattatcttgtcgtatcttgatagtcacctgcacactccgatgtacttcttcctgagcaatttgtcgttcctagacttgtgttatactacctcctcaatcccacagctacttgttaatctgtggggccccgaaaaaacgatatcctacgccgggtgcatgattcaactgtacttcgttttagcactgggaacgaccgagtgtgtactgttggttgttatgtcttatgatcgttatgctgcagtgtgtaggccactgcactacaccgtcttaatgcatcctcgtttctgtcatctgttggccgtggcaagctgggtcagcggattcaccaattcagccctccactcgtcttttactttctgggtccccctctgcgggcaccggcaggtggaccacttcttctgtgaagtgcccgccctcctgcggctcagttgcgtcgatactcacgtcaacgagctaactctcatgattacgtccagcatctttgtcttaatccccctgattctcattctcacctcatatggggccattgtgcgagcagtgctgcgcatgcagagcactaccgggttacaaaaagtgtttgggacatgtggcgctcatctgatggcagtctccctcttcttcatccccgcaatgtgtatttatcttcaaccaccttcaggcaatagtcaagatcaaggcaaattcatagcactcttttatactgtcgtaactccgtctttgaacccactgatctatactctgcgcaataaagtagtgcgcggggcagtgaaacggttgatggggtgggagtag

SEQ ID NO: 28378 - DNA, 936 bp, Artificial Sequence
  Description of Artificial Sequence: Synthetic coding sequence
atgaatgatgacggcaaggtgaacgccagttccgaagggtatttcatcctggtgggcttctccaactggccccatctcgaagtcgttattttcgtggtggtgctaattttctatcttatgactctgattggaaatctttttatcatcatcctctcctacctagactctcacttacacactccaatgtacttcttcttgtctaatctgtcattcctagacttgtgctacacaacctcttcaatcccccaacttttggtgaacttgtgggggccagagaaaactatcagctatgccggatgcatgatccaactttacttcgttctggccctgggtactacagaatgtgttctgcttgtcgttatgtcttatgaccggtacgctgccgtctgtcgacccctgcattataccgtgctgatgcatccccggttttgtcaccttcttgcggtcgctagttgggtctcgggctttacgaatagtgccctccattccagcttcactttctgggtgcctttatgcggccatagacaggtggaccattttttctgcgaggtgccggcacttttacgattaagctgcgtggacactcatgtcaatgagctgacactcatgatcacatcgtctatctttgtactcattcccctgatacttatcctgacgtcatatggagcgatcgtacgggcagtgttgagaatgcaatcaaccacaggcctgcagaaggtcttcggaacttgtggcgcccatcttatggctgtgagcctgtttttcataccagcgatgtgcatctatcttcagcctcccagcgggaattcccaggatcagggcaagttcattgcgctcttttatactgttgtgactcccagcctaaaccctcttatctatactttaagaaataaagtagtccggggcgctgttaaaagactcatggggtgggaatag

SEQ ID NO: 28379 - DNA, 936 bp, Artificial Sequence
  Description of Artificial Sequence: Synthetic coding sequence
atgaacgatgacggcaaggtgaatgcgagctccgagggctacttcattcttgttggcttctccaattggccccatttagaagttgtcatcttcgtggttgtgctaatcttctacctgatgaccctgataggcaacctgttcattattattctgtcctacctggacagccacctgcatacccctatgtacttcttcctgtcgaacttgtcttttctggatctgtgctacaccactagcagcattcctcagctgctggtgaacctgtggggtcccgaaaagacaatttcttatgccggctgcatgatccagctttactttgtcttggccctgggaactactgagtgcgtgctgctcgtggtaatgagctatgaccggtacgccgctgtgtgcaggccattgcactacactgtgcttatgcaccctagattctgccaccttctcgccgtggcctcctgggtgtccggctttaccaactcagctctgcattcctcattcacattctgggtaccgctctgcggccacaggcaggtggaccattttttttgcgaggtaccagccctcctgaggctctcctgcgtggacacccatgtaaacgagctaactcttatgattacttcaagcattttcgtgttgatccccctaattctgattctaacttcctatggcgccatagtcagggcagttcttcgaatgcaaagtacgaccggcctgcagaaagtgttcggaacctgcggggcccacctcatggcagtatctctattcttcatcccagcaatgtgcatctacttgcagccaccctccggcaactctcaagatcagggaaagttcattgcattgttctacactgtggtcacccctagcttgaatccactgatctacaccttaagaaataaagttgttcggggcgccgtcaaacgcctcatggggtgggaatag

SEQ ID NO: 28380 - DNA, 936 bp, Artificial Sequence
  Description of Artificial Sequence: Synthetic coding sequence
atgaatgacgatgggaaagtaaacgctagctccgaggggtatttcatcctggttggcttcagcaattggccgcacctcgaagtggtgattttcgtggtggtgctgatcttttacctgatgaccttgattggaaatctgttcatcatcattttaagctatctcgacagccatttacacacacctatgtacttttttctgtccaacctgtcgtttctagatctctgctacaccacgagctccattccacaactgctggttaacttatgggggcccgaaaagaccatttcctatgctgggtgcatgattcaactgtacttcgtactggcccttggcaccactgagtgtgtcttactcgtggtgatgagttatgatcgctacgccgccgtgtgcaggcccctacattacaccgtgctgatgcacccaaggttctgccatcttctggccgtggctagctgggtgtctggattcaccaactcagcattacattcttcatttactttctgggtaccactgtgcggccaccgacaagtggatcactttttttgtgaggtgcccgctttgctccggctcagttgtgtggacacccacgtgaatgaactcacacttatgattacatccagtattttcgtccttattcccctgattctgattttgacaagctacggcgccatcgtcagagcagttctgcgcatgcagagcaccactggcctgcaaaaggtttttggaacgtgtggagcccatctcatggctgtatctctcttttttatccctgccatgtgcatctatcttcagcctccttccgggaactcccaggatcagggaaaattcattgccctcttttatacagtggtgacgcccagcctgaacccactcatctacaccctgaggaataaagttgtccggggagccgtgaaacgcctgatgggatgggagtag

SEQ ID NO: 28381 - DNA, 777 bp, Artificial Sequence
  Description of Artificial Sequence: Synthetic coding sequence
atgaatgacgatggaaaggtgaatgcatcttctgaaggatactttatcctggtcggattcagcaactggcctcatctcgaggtggtgatcttcgtcgtggtgctaattttctacctgatgactctgatagggaatctctttatcatcattctgagctatcttgattcccacctacacacaccgatgtacttctttttgtcaaacctgagctttttggacctgtgctacaccacctccagtattccgcagctattggtcaacctgtggggacctgaaaagactataagctatgccgggtgtatgatccagctgtactttgtccttgctctaggtacgacagagtgcgtgctccttgtggtcatgagttacgatcgctacgctgcggtttgcagacccctgcattacactgtgctaatgcacccaagattctgtcatctcctggccgtggcaagctgggttagtggatttacaaactccgctctgcattcctctttcacattttgggtccctctgtgcggacatcgccaagttgaccactttttttgcgaagttcccgcactgctacgtctgtcatgcgttgatactcacgtgaatgagcttaccctcatgattacatcatcgatatttgtactgatcccacttatactcatcctgacatcatatggggcgatagtccaagccgtgctaaggatgcagtctacaaccggcctgcagaaggtgttcggaacgtgtggtgctcacttaatggcagtctctctgttttttataccagcttag

SEQ ID NO: 28382 - DNA, 936 bp, Artificial Sequence
  Description of Artificial Sequence: Synthetic coding sequence
atgaatgatgatggaaaggtgaatgcctcctctgaggggtacttcatacttgtcggcttctctaattggccccatttagaggttgtgatttttgtcgtcgtgttaatcttctatctgatgaccctgatcggcaaccttttcattatcattctctcgtatttggactctcatctgcatactcccatgtactttttcctgtcaaacctgagcttcctcgatctttgttacacgacctcaagcattcctcagctcctcgtgaacctgtgggggcccgaaaaaacgatttcatatgccggctgtatgatccagttgtactttgtgctggccttgggaacaactgagtgcgtacttctcgtggtgatgtcctacgatagatacgcagccgtttgccgccccctgcattatactgttctgatgcatcccagattttgtcacttactggcggtcgcctcctgggtgagtggctttaccaattcagccctccactcttcattcaccttctgggtgcccctctgtggccatcgacaggtagatcactttttttgcgaagtccctgctttactccggctgtcttgcgtcgacacgcacgtaaacgagctgacattgatgattaccagttcaattttcgttctgatcccactgattctgatccttacctcatatggagctattgtgcgagctgtgctcagaatgcaatctactactggactgcaaaaagttttcgggacatgtggagcacacttgatggcagtctccctcttctttattcctgcaatgtgcatctacttgcaaccaccttcagggaactcacaagaccagggtaaatttatcgccctgttctatactgtggtgacaccttccctgaatccactcatttacacgctccgtaataaagtcgtgaggggcgccgttaaacggctgatgggctgggagtag

SEQ ID NO: 28383 - DNA, 936 bp, Artificial Sequence
  Description of Artificial Sequence: Synthetic coding sequence
atgaacgacgatgggaaagtcaacgcttctagtgaggggtacttcatcctggtgggtttttcaaactggccccatttagaagtcgtgatctttgtggtggtcctcatcttttaccttatgactctgataggcaatctgttcattattatcctttcctacttagattctcacctgcacacacccatgtacttctttctctcaaatctctctttcctggacctatgctataccactagcagcatccctcagctgttggtaaacctgtggggccccgagaagaccatctcgtatgccgggtgcatgattcaactctattttgtgttggctttgggaaccacagaatgcgttttgctcgtagtcatgtcctacgatcgctacgctgccgtgtgtagaccgcttcattataccgtcctgatgcacccacggttttgccaccttctggccgtcgcctcttgggtgtcggggtttaccaactcagctctccactcctcctttacattctgggttcccctgtgcggacacaggcaggtcgaccattttttctgcgaggtccccgcactcctgcgtctttcttgtgtggatactcatgtcaatgaactgacactcatgatcaccagctcaattttcgtcttaatcccgctgatcctgatccttaccagctacggagcgatcgtgagagccgtactgaggatgcagtcgacgaccggcctacagaaggtgttcggtacttgtggagcccatttaatggctgtatccttattttttatacctgctatgtgcatttatctccagcccccatcaggcaactctcaggaccagggtaaatttattgcacttttctataccgtagtgacgccatctctgaacccactgatttacacgttgagaaacaaggtggtccggggcgcagttaagcggctgatgggctgggagtag

SEQ ID NO: 28384 - DNA, 951 bp, Artificial Sequence
  Description of Artificial Sequence: Synthetic coding sequence
atgcagggcgagaatttcacaatttggtccatcttctttctagaggggttctctcagtatcctggcctcgaagttgttctttttgtgttcagcctggttatgtatctgacaacactcttagggaatagcaccttgatccttattacgatcctggattctaggcttaagacccctatgtatctctttctcggcaacctgagcttcatggacatttgttatacttccgcatcagtgcctaccctactcgtgaacctgctgtcctcacagaagactatcatcttttctgggtgcgctgtgcaaatgtatttgtcgttagccatggggtctaccgagtgcgtgctgctggcggtcatggcctatgataggtacgtggccatttgcaatcctctcagatacagcattatcatgaaccgctgcgtgtgtgcgcggatggcgacagtgagttgggtaacaggctgcttgacagcactgctggagacaagcttcgccctgcaaatcccattgtgtgggaacctgatcgaccattttacctgtgaaattctcgccgtcctgaagctggcctgcacaagctctctcttaatgaatacaattatgctggttgtgtcaatcctgctcctccccatccctatgctgctggtatgtatctcctacatcttcattttatccacgatcctgaggatcacatctgcagagggacgaaacaaggcctttagcacttgtggagctcaccttacagtggtcatcctgtattacggagctgctttatccatgtacctgaagcctagttcttcgaatgcgcagaagattgataagattatttctctgctgtacggcgtgctgacgcccatgctgaacccgataatctactcactccggaacaaagaggtcaaggacgccatgaagaagcttctgggcaagatcaccttgcaccagacccacgagcacctgtag

SEQ ID NO: 28385 - DNA, 1038 bp, Artificial Sequence
  Description of Artificial Sequence: Synthetic coding sequence
atgaatatcaccctgtatagctttttgtacgttctccgattaaatgaggggaactctaccgggcgcaatattgacgagagaaagaagatgcaaggcgagaatttcacaatttggtccattttttttttggaaggcttctcacagtatcccgggctagaagtcgtcttgtttgtgttttcgttggtaatgtaccttactactctcttggggaatagcacccttatcctcattacgatcctagacagcagattaaagactcctatgtacctcttcctgggtaacttgtcctttatggacatatgttacacctcagcatctgtgccaacactgttggtcaacttactctcctctcaaaagactattatcttcagtggctgtgcagttcagatgtacctgtccttggctatgggttctactgagtgtgtcctactcgccgtgatggcttatgacaggtacgttgcaatctgtaatccattaagatacagcattataatgaaccggtgtgtgtgtgcacgaatggctaccgtctcctgggtgaccgggtgtctgactgcattgctcgagacgtcattcgcattgcagataccattgtgcggcaaccttattgatcattttacctgtgagatccttgctgtgctgaaactggcctgcactagtagcttgctgatgaacacaattatgctggtcgtctcgattttactgctgcccatacctatgttacttgtgtgtataagttacatcttcatactgagcaccatcctacggattacttctgcagaggggcgcaataaggcatttagcacgtgcggtgcccatctgacagtggtgatactctactatggcgccgccctcagcatgtaccttaaaccgtccagtagcaacgcccagaagatcgataagataatcagtttgctgtacggagttctgacgcctatgctgaatccaatcatttactcactgcgcaacaaggaggtcaaggacgctatgaaaaaactgctggggaaaatcactctgcaccagacccatgagcacttgtag

SEQ ID NO: 28386 - DNA, 939 bp, Artificial Sequence
  Description of Artificial Sequence: Synthetic coding sequence
atggaaaagtggaaccacaccagcaatgatttcattctgctcgggcttcttccgccgaatcagacaggcatctttctgctgtgtctaatcatactcatcttttttctggcttcagtcggaaacagcgccatgattcacctgatccatgttgaccctaggttgcacactccaatgtatttcttattatcacagctgtctctgatggacctaatgtacatttctacgactgtgccaaagatggcctacaactttcttagcggccagaagggaatcagctttctgggctgtggcgtgcagagcttcttcttcctcacgatggcatgctccgaagggctgctcctgaccagcatggcttacgaccggtacttggccatttgccattcgctgtactatccaatcagaatgagcaagatgatgtgtgtaaagatgataggaggttcttggacacttggtagtataaatagcctagcccacacagtgttcgctctgcacataccatactgcagatctagggccatagatcactttttctgcgacgtgccagctatgcttctgcttgcctgtacagatacctgggtttacgagtacatggtctttgtgtccacgtctttgtttctcctttttcctttcatcggcataaccagcagctgtggccgggtgctcttcgctgtctaccatatgcattcaaaagagggtcggaagaaggccttcactacaatctcgacccacttgaccgttgtcatcttctattatgctccctttgtgtacacttacctcaggccgcgaaatttacgctctcctgccgaggataaaatactcgccgtcttttatacaatcctgacaccaatgctcaaccctatcatctactcacttcgcaacaaagaggtgttgggagccatgcggagggtcttcggtatcttttcttttctcaaggagtag

SEQ ID NO: 28387 - DNA, 939 bp, Artificial Sequence
  Description of Artificial Sequence: Synthetic coding sequence
atggagaagtggaaccatacctcaaatgattttatcttgctgggcctgctcccccccaatcagacggggatcttcctgctctgcctaattatcctcattttctttctggcatcagttggtaatagcgccatgatacacctcattcatgttgatcctagattgcacaccccaatgtactttctcctgagtcagctttccttaatggatctgatgtatattagtaccaccgtgcctaaaatggcttacaattttctctccggtcagaagggcatcagcttcctgggctgtggggtacagagcttttttttcctgaccatggcttgtagtgaggggctgcttctcacaagcatggcgtacgacaggtacttagcaatctgtcacagtttatactacccaatcaggatgagtaaaatgatgtgcgtcaaaatgattgggggaagctggacgttaggctcaattaacagcttggcgcacacagtatttgccctccatattccctattgtcggtcacgggccatcgatcacttcttctgcgatgttccagccatgctgcttctggcatgcaccgacacctgggtgtacgagtacatggtctttgtgagcacgtctcttttcctgttattccccttcattggtattacttcgagttgtgggcgagttctctttgcggtctaccacatgcacagcaaagagggccggaagaaagccttcaccaccattagcactcacctgaccgtagtaatcttttattatgccccatttgtttacacctacctaaggcctcgcaacttaagaagcccagccgaagacaagattctggctgtattttatacaatcctaactccaatgctcaaccctataatatattccctgcggaacaaggaggtacttggggctatgcggagggtgtttggcattttttccttcctgaaggagtag

SEQ ID NO: 28388 - DNA, 939 bp, Artificial Sequence
  Description of Artificial Sequence: Synthetic coding sequence
atggaaaattacaatcagaccagtactgacttcattttactcggcctattccctcagagtaggattgggctgttcgtgttcaccctcatttttcttattttccttatggccctgatcggtaacctgagcatgatattgttgatcttcctggacatccacctacacacgcccatgtacttcctgctgtcacagctctcgctgatagacctgaactacatttctaccatcgtacccaaaatggtgtacgatttcctctatggcaacaaaagcatcagcttcaccggctgcggaatccagagtttctttttcctgaccctggccgttgcggagggattactgctgacgagcatggcttatgacagatacgttgctatctgcttccctctacactacccaattaggatcagtaagagagtgtgcgttatgatgatcacaggctcatggatgatatcatccataaacagctgcgcacacacggtttacgcgctctgcatcccttactgtaaaagtcgtgcgatcaatcacttcttctgtgatgtaccagcaatgttgaccctggcatgtacagatacgtgggtgtatgagagcacagtttttctaagctccacaattttcttggtgctgccattcacaggaattgcctgctcctatggaagagtgctgctggcggtttaccggatgcattcagcggaaggccgaaagaaagcgtactcgacatgttctacgcacttgacagtggtctcattttactacgctcctttcgcttacacatacgtgaggccaaggtcgctgagaagtcctactgaggacaagattttggcagtgttctacactatattgactcccatgctcaaccccataatttacagcctccgcaataaggaggtgatgggagcgcttacccaggtgatacaaaaaatcttctctgtgaagatgtag

SEQ ID NO: 28389 - DNA, 939 bp, Artificial Sequence
  Description of Artificial Sequence: Synthetic coding sequence
atggagaactataatcagacctccactgacttcattttgttgggattcttcccccctagtaggattggtctgtttttgttcattcttatagtgtttatcttcctgatggctctcatcggaaacctctcgatgattctgctcatcttcctcgatacccacctccacactcccatgtacttccttctgtctcaactgtctctgatcgatttgaactacattagcacaatcgtgcctaaaatggcatctgacttcctgtctggcaacaaatcaatcagtttcaccggatgcgggatccagtcttttttcttctcggctctggggggggcagaggcattgctgttggcatctatggcatatgataggtatatcgctatctgctttccactgcactaccctatccgtatgtcaaagagaatgtgtgtcctcatgattaccggctcctggattattggatcaatcaacgcatgtgcgcatacagtttacgtgcttcatatcccttactgtcagagccgcgctatcaaccatttcttctgtgacgtgcccgccatggtgacactggcgtgcatggacacttgggtatacgaaggaacagtgtttctctctactacaattttcttagtgtttccgtttatcgcgatatcatgtagttacggccgcgtgctgttggctgtgtaccatatgaaatccgctgagggaaggaaaaaagcttaccttacctgctcaacccatctcaccgtggtgacgttctattacgcaccctttgtgtacacatacctgaggcctaggtccttacgatcaccaactgaggacaaggtccttgctgtattctatactactcttacacctatgttaaacccaatcatttactccctccgcaataaggaggtaatgggagccttgacacgagtcagccaacgaatttgctctggtaagatgtag

SEQ ID NO: 28390 - DNA, 939 bp, Artificial Sequence
  Description of Artificial Sequence: Synthetic coding sequence
atggagaattacaaccagactagcacagattttatcctgctggggcttttccctccttccaaaattggtctcttccttttcatcctgttcgtcttgatctttctgatggcactgataggcaacctaagcatgatcctcttaatatttctcgacactcacctgcataccccgatgtattttctgttaagccaacttagcctgattgacctcaactacataagcaccatagtacctaaaatggcctccgattttctgtacggcaataaatcaatttcctttatcggatgtggcattcaaagtttcttcttcatgaccttcgctggggctgaagccttgcttctcacatcaatggcatatgataggtacgtggctatctgtttcccgctacactatcctatccggatgagtaaacgcatgtatgtactaatgatcaccgggtcatggatgatcggttccataaattcctgcgcgcatacagtgtacgcctttaggataccctactgcaaatcccgcgccattaatcactttttctgcgacgttccagccatgctgaccttggcctgcaccgatacgtgggtgtacgagtacaccgtgttcctcagtagtacaatcttcttagtctttcctttcaccggcatcgcttgttcctacggttgggtcctactggccgtctaccggatgcattccgcagagggtcggaagaaagcttactcgacgtgcagtactcacctaactgtcgtgaccttctactatgcccccttcgcctacacctacttgtgtccccggagcttgagatccttaacggaggataaggttttggccgtgttttacacaatcttaacccccatgctcaatcccatcatttactcactgcggaacaaggaagttatgggggccttaacacgtgttatccagaacatcttcagcgtgaagatgtag

SEQ ID NO: 28391 - DNA, 939 bp, Artificial Sequence
  Description of Artificial Sequence: Synthetic coding sequence
atggagaactacaaccagacttctacagacttcattctactggggctgttcccgcccagtagaatcgacctcttcttcttcatcctgatcgtcttcatttttctgatggcactgatcggaaacctgtccatgattctcttgatattcttggacacccacctacacacaccgatgtattttcttttgagtcaactgtctctcattgatcttaactacatcagcactatagtgccgaaaatggcctcagatttcctgcacggcaataagtctatcagtttcacggggtgcgggatccaatctttcttttttctggcactcggaggcgccgaagcactcctgctcgcatctatggcctatgatcggtatattgcaatctgtttccccctgcactatctcattcggatgtccaaaagagtgtgcgtgctaatgataacaggaagttggatcattggatccatcaacgcttgtgcacacacagtgtatgttctccatataccttattgcaggagtcgcgccatcaaccacttcttttgcgacgtgcccgcaatggtcactctagcttgtatggatacatgggtgtatgaaggaacagtctttctgtcggcaacaatcttcctggtatttccattcattggtattagctgctcctacgggcaagtgctctttgcggtgtatcatatgaagtccgccgaagggagaaaaaaggcatatttgacgtgtagtacgcacttgaccgtggtgacattttattatgctcctttcgtgtatacatacctcaggccccgaagcctgcgatcgccaacggaggataaagtactggctgtcttctacaccatattaactcccatgttgaatccaattatttactccctgcggaataaggaagttatgggagcactgactagggtttcacagaggatctgcagcgtgaagatgtag

SEQ ID NO: 28392 - DNA, 1044 bp, Artificial Sequence
  Description of Artificial Sequence: Synthetic coding sequence
atggcttgggagaaccaaacatttaactctgatttcatcctcctgggaatattcaaccatagcccacctcacacgttcctctttttcctggtactgggaatctttctggtcgccttcatggggaactcagtgatggtgcttcttatctatttggacacacagcttcacactccaatgtacttccttctgtctcaattgtctctgatggatctgatgctcatctgcaccaccgtgccaaaaatggctttcaactacctgtcaggttctaaatccatctctatggcggggtgcgtgacccaaatatttttttatatttcattgagtggtagcgaatgctttttgctggctgtgatggcatacgaccgttacatcgcaatctgtcaccctctgaggtataccaatctcatgaaccccaaaatctgcgggcttatggccaccttttcatggatattaggctctacagatgggattatagacgccgttgcaacatttagcttttctttctgtgggtctcgagagatcgcccattttttttgcgagtttcccagcctgctgattctctcctgcaatgataccagcatttttgaagaggtcatttttatttgttgcatagtaatgctggtctttcccgtcgcaataattatagctagctatgcaagagtgattctcgccgtgattcacatgggctccggagaaggccgctgcaaggccttcacaacatgttcatctcatcttatggtcgtagggatgtactacggcgctgccttattcatgtacatccggcccaccagtgatcacagtccgacccaggacaagatggttagtgtcttctacacaattctgacaccgatgctcaatcccctgatctacagcttgcgaaataaggaagttaccagggcatttatgaagatcctgggtaagggtaaaagtgaatccgaattaccccacaagttatacgtcctgctgttcgccaagttttttttcctgatttcgattttcttttatgatgtcaagattctggcccttatcatgtacattgcctag

SEQ ID NO: 28393 - DNA, 939 bp, Artificial Sequence
  Description of Artificial Sequence: Synthetic coding sequence
atggccagggaaaactcaacatttaattcagattttatcctactggggattttcaatcatagtcctactcacacttttctcttttttcttgtcctggctatcttctcagtcgccttcatggggaactccgtgatggtgctgctgatctatttggacacgcagctgcatacacctatgtatcttctattgtcacagcttagtctcatggaccttatgctgatatgcactaccgtacccaagatggcttttaattatctgtctgggtcaaagtccatcagtatggcaggctgcgcaacccagatttttttctatacttcactgctgggctcagaatgctttttgctggcagtgatggcttatgatcgctatacagccatatgccatcccctgaggtacactaatctaatgagcccaaagatctgtggtctcatgacggccttttcatggattctaggctcaactgatggcatcatcgatgtcgtggctacgttcagtttctcttactgtggcagcagggagatcgcacactttttctgtgacttcccaagcttacttatcctgagctgctccgacacgtccatttttgagaagatattgtttatctgttgcatcgtgatgatcgttttccccgtggctataatcattgcaagttatgcgcgtgttatcttagccgttatccacatgggtagtggcgagggaaggcggaaagcctttactacctgcagctcccacctgttagtggtgggcatgtactacggcgcagccttatttatgtacatacgcccaacaagcgatcgttccccaacccaggataagatggtaagcgtattttacactatcttaacgcccatgctgaatccactgatatactcgttacgtaataaagaggtgaccagagccttcatgaaaattctcgggaagggcaagtctggggagtag

SEQ ID NO: 28394 - DNA, 936 bp, Artificial Sequence
  Description of Artificial Sequence: Synthetic coding sequence
atggtctgggagaatcaaacctttaactcaatctttattcttctcggcatatttaatcacagcccaactcacacctttctcttcagcttggtgcttggaattttctcactcgccctgatggagaacattagtatggtccttctcatttacatcgagaagcaactacacactcccatgtacttcctgctttctcagctttcgcttatggatctgatgttgatttgcaccacacttcccaaaatgattttttcttacctgtccgggaaaaagagcatttccctggccggatgtgggacccaaatatttttttacgtgtcactcctcggcgctgagtgtttcctgcttgccgtcatggcctacgatcggtacgtagctatatgtcacccactccagtatacgatcctcatgaatcccaagctctgcgtattcatgaccgtcgccagctggactctcggtagtttggatggcatcattgtgcttgctgccgtcctgagcttctcttattgcagtagtctggagatacaccactttttttgtgatgttgccgccctgctgccactctcatgcacggagaccagcgccttcgaaagacttctcgtaatctgctgtgtggtcatgctgattttccccgtgagtgtgattatactgtcttactctcacgttctgagagcggtcattcatatgggaagcggggagtctaggcggaaggcttttactacatgttcttcccacctttctgtagttgggctttattatggcgcggccatgttcatgtatatgagaccggcaagcaaacatactcccgaccaggacaagatggtgtcagccttctacactatcttgaccccgatgctcaacccactcatatactctctgcggaacaaagaggtgtttagagcactccagaaggtgctaaaaaaaagaaaacttatctag

SEQ ID NO: 28395 - DNA, 939 bp, Artificial Sequence
  Description of Artificial Sequence: Synthetic coding sequence
atggcttgggagaaccagacttttaatagcgattttattcttctagggatatttaaccatagcccgactcacacgttcctgttcttcctggtactcgcgatcttctcagttgcctttatgggtaacagtgtgatggtactactgatctatttggatacccagctccacacccctatgtacttcctcctcagccagttatttctgatggatttgatgctgatctgtagcacagtgcccaaaatggcattcaattacctgtctgggtctaaaagcatcagcatggcaggttgtgctacgcaaatcttcttttatgtatctctcttaggaagtgagtgtttcctgttagctgtcatgtcctacgaccgctatatcgcaatatgccatcccttaagatataccaatttgatgcggccaaaaatctgtgggcttatgactgcctttagctggatactgggctccatggatgccatcattgatgcagtcgcgaccttcagtttctcttactgtgggtcccgcgagatagcccacttcttttgcgacttcccttctttactgatcttgagttgtaatgataccagtattttcgagaaagtactgttcatttgctgcatcgtgatgattgtcttccctgtggccatcattatagctagctacgcaagagtcatactcgcagtgattcacatgggttccggggaaggtaggcgaaaagctttcacgacctgctctagtcatctgatggttgttggtatgtattatggagcaggattgttcatgtacatcagacctacctccgacagatcccctatgcaggacaaactggtctcggttttttatactattctgaccccaatgctcaacccactgatctattctctacgcaacaaggaggtcaccagagccctgagaaaggttctcggtaaaggcaaatgtggagagtag

SEQ ID NO: 28396 - DNA, 939 bp, Artificial Sequence
  Description of Artificial Sequence: Synthetic coding sequence
atggcatgggagaatcagaccttcaactcagatttcctgctactcggcatctttaaccacagccccacccacaccttcctcttctttctggtgctcgccattttcagcgtggcatttatgggtaacagcattatggtcctgctgatctatctggacacccaactgcatacaccaatgtattttttgctttctcaactgagccttatggatctgatgctgatctgcacgacggtgccgaaaatggcctttaattatttgtctggctcgaagtccattagcatggctgggtgcgcaactcaaatctttttttatatatcccttctgggttctgagtgcttcctgctggccgtcatgagttacgaccggtacaccgcgatttgtcatcccctgaggtacaccaacctaatgcgacctaaaatttgtggattgatgaccgccttctcttggattcttggaagcaccgacggcattatcgacgcggtcgcaacatttagtttctcctactgcggctccagagagatcgcccatttttgctgtgactttcctagcctccttatattgtcatgcaacgatactagtatatttgaggaagttatcttcatctgttgcattgtgatgctggtcttcccagttgctatcattatcacatcttacgcgagggttatcctggcagttatacacatgggctcaggcgaggggcggagaaaggccttcaccacctgtagcagtcaccttatggtagtgggaatgtattatggggccggcttgtttatgtgtatccagcccactagccatcactctccgatgcaggataagatggtatccgttttctataccattgtgactcctatgctgaaccctttgatatattctcttcgtaataaagaggtcacaagggcccttatgaaaattctgggcaaaggaaagtctggcgattag

SEQ ID NO: 28397 - DNA, 960 bp, Artificial Sequence
  Description of Artificial Sequence: Synthetic coding sequence
atggaaaaggcgaacgaaacatcccctgtgatgggttttgtcttgttaaggctttccgcccaccctgaactggagaaaacgtttttcgtgctgatcctgcttatgtacctcgtcatactcctggggaacggtgtgctgattctggtgactatcttagatagccggttacataccccaatgtacttctttctgggtaacctgtctttcctggatatctgctttacgacttcatccgtacccctagtactggatagttttctgacaccgcaggagacaatcagctttagtgcctgcgcagtccagatggccctatcattcgcgatggcgggcaccgaatgcttgctcctttccatgatggcgttcgacaggtacgtcgctatctgtaatcccctacgttatagcgtgattatgtcaaaagctgcctatatgcccatggctgcttcatcctgggccatcgggggcgccgcttcggttgtgcatactagcttggctattcagttgcccttctgtggagacaacgtcatcaatcactttacctgcgaaatcctcgcagtgctgaagctcgcgtgcgctgacatttccattaatgttatctctatggaagtcaccaatgtgatttttctaggcgtgcctgttctctttatcagcttctcctacgtgtttattataactaccatcctgcgaattccgtccgcagagggccgcaaaaaagtgtttagcacctgctccgcccacttaactgtggtgatcgttttttacggcacattatttttcatgtacggtaaacctaagtccaaggattctatgggcgctgataaggaggatctttctgacaaactgatcccactgttttacggtgtcgtgacacccatgcttaaccctatcatatatagtttgcgtaacaaggatgtgaaggccgccgtcaggagactgcttaggcctaaaggcttcacccagtag

SEQ ID NO: 28398 - DNA, 1110 bp, Artificial Sequence
  Description of Artificial Sequence: Synthetic coding sequence
atgtggcaggagtattatttcttgaacgttttctttcctttgcttaaggtatgctgcctgaccataaactcccacgtcgtaatattgctaccctgggaatgctaccatttgatttggaagatcctcccctacattggaaccaccgttgggtcaatggaggagtacaatacctctagcaccgacttcacattcatgggcctgtttaacaggaaggaaacgtcaggcctgatcttcgctattatatccatcatcttcttcactgctctgatggctaacggagttatgatatttctgatccagacagacctgcggctccatacccccatgtattttctcttatcacacctgtcccttattgatatgatgtacatttcgacaatagttcccaagatgctggtgaattacctgcttgaccagaggacaattagctttgtcggctgcactgcgcagcactttctgtatttgaccttggtgggagcagagttttttttgctggggttgatggcctatgataggtatgtggctatttgtaatccccttcggtaccccgtgctcatgtcgagacgggtctgctggatgattattgccgggtcctggttcggcggcagtttggacggttttctgttgaccccgataactatgagcttcccattttgtaactcccgagaaataaaccattttttctgtgaagccccagccgtcctaaagctcgcgtgtgccgatacagccctgtacgaaacagtcatgtacgtgtgttgcgtgttgatgctgttgattcctttcagtgtcgttctggctagctatgcaaggatcctgaccaccgttcaatgtatgtcatccgtggagggccggaaaaaggcgttcgccacttgcagttcgcacatgaccgtggtgagcctgttctatggcgccgcaatgtatacatatatgttgccgcactcctaccacaagccagcccaggacaaagtgcttagtgttttctacacgattttgactccaatgctgaacccgctgatttactctttgagaaataaagatgtcacaggagctttgaaacgggctctcggaaggttcaagggcccccagagagtgagcggcggggtgttctag

SEQ ID NO: 28399 - DNA, 939 bp, Artificial Sequence
  Description of Artificial Sequence: Synthetic coding sequence
atgaggttggcaaaccaaacactgggcggtgatttctttctgttgggaatctttagccagatctcccatcctggccgactgtgcctgcttattttttctatcttcttgatggccgtcagctggaacattacactgattcttttgattcacattgatagttcccttcacactcctatgtatttcttcatcaaccagctgtcactcatagatctcacgtacatatctgttacagtccccaagatgctcgtgaaccagctcgctaaagacaaaaccatctctgtgctcggctgcggcacacaaatgtatttttatctgcaattgggcggggcggaatgctgcctccttgctgccatggcctatgaccggtatgtagcgatctgtcaccctcttcggtactccgtgttaatgtcccaccgggtctgcctgctgctggcgtcagggtgttggttcgtgggatcagtcgatggctttatgctcacccctatagccatgtcattcccattttgtcggagccacgaaatacaacacttcttttgcgaagtgcctgcggtgttgaaattgtcatgttctgacacgagcctgtacaagattttcatgtatctctgttgtgtcattatgctcttaatccccgtcaccgtaatctccgtgtcctactattacatcatcctgacaatccacaagatgaatagtgtcgagggccggaagaaagcttttaccacctgctcttcacacattactgtggtgtccctcttctatggagcagcaatctacaactacatgctcccatccagttaccaaacccctgagaaggatatgatgagctcgtttttctacacaatactgacaccggtgcttaaccccattatatattcattccgcaataaggacgtcaccagagccctcaagaagatgctttctgtccaaaagcccccatactag

SEQ ID NO: 28400 - DNA, 951 bp, Artificial Sequence
  Description of Artificial Sequence: Synthetic coding sequence
atgacaaataccagctcatccgacttcacgttgctgggcctgctagttaattccgaggccgccggtatcgtcttcaccgtgattctggctgtgttccttggagctgtcaccgctaacctcgtcatgatttttcttatccaggtggattctaggctgcacactcccatgtactttctgctgtcccagctcagtataatggacaccctgttcatttgtacgacagtgcctaagctgctggctgacatggtaagcaaagaaaagatcattagcttcgttgcctgtggcatacagatctttttatacctgacaatgataggctctgagttctttttactgggtctgatggcatacgactgttatgtggccgtgtgcaatccactgaggtaccccgtcctaatgaatcgcaagaagtgcctcctcctcgccgcaggcgcctggttcgggggaagccttgatggatttctattaacccccattactatgaatgttccttattgcggctcaaggtctattaaccatttcttctgcgagattcccgctgtcctgaaattagcctgcgcggatacaagcttgtatgagactttaatgtacatttgttgcgtattgatgctcctgattcctatttcaatcatcagcaccagctactccctcatactcctgaccattcacagaatgccttctgccgaaggtcggaaaaaagcattcaccacctgctccagtcacctgaccgtggtcagcatcttctatggggctgctttctacacatacgttctcccacagtccttccatacacctgagcaagataaagttgtatctgcattttatactattgttacccccatgttgaacccacttatctattctctgcggaacaaggacgtgatcggagcattcaaaaaagtgtttgcttgttgttccagcgctcagaaggtcgctacaagcgacgcctag

SEQ ID NO: 28401 - DNA, 963 bp, Artificial Sequence
  Description of Artificial Sequence: Synthetic coding sequence
atggagatgagaaacacaacgccggactttattctgttggggctcttcaaccatacgagagcccaccaagtgctttttatgatgctgttagctaccgtgttaacatctctgttctcaaacgccttaatgatcctgctgatccactgggatcataggcttcacagaccaatgtattttttactgtcacagctgagccttatggacatgatgctggtgtctactaccgtccctaagatggccgcggattatttaaccgggaacaaggccatttctcgcgctggatgcggcgtgcagattttttttttaccgactctcggaggtggcgaatgttttctgctggccgccatggcttatgatcgatacgcagctgtttgccaccctctgagataccccactttgatgtcctggcagttgtgtttaaggatgaccatgtcctcttggctgctgggagctgccgacgggttgttacaggccgtggctacactttcatttccctattgtggcgcccacgaaattgaccactttttttgcgaggcacccgtgctggtgagactagcttgtgctgataccagcgtgtttgaaaatgccatgtatatctgctgcgtcctgatgctcctggttccgttttccttgatcctttcatcttatggcctgatccttgcagctgtgctcctaatgcgatccactgaagcccggaagaaagccttcgcgacctgctcctctcatgtggctgtcgtcggcttgttttatggcgccgggattttcacatatatgaggcctaagtcacatcgatctaccaatcacgacaaggtggtaagtgcattctacaccatgttcacacctctgttaaaccccctaatttatagtgtgaggaattcagaggtaaaggaggctttgaaaaggtggttgggaacctgtgtgaatcttaagcatcaacagaatgaagcccatcgatctcgctag

SEQ ID NO: 28402 - DNA, 975 bp, Artificial Sequence
  Description of Artificial Sequence: Synthetic coding sequence
atgggtatggagggactcctccagaacagcacgaactttgttttaactggactgattacacatccagcctttccaggcttgcttttcgctatagttttttctatttttgttgtggccattacagcaaacctcgtaatgatcctcctcatccacatggactccagactccacacacctatgtatttccttctgtcccagctgtcaatcatggataccatttacatttgtattacagttcccaagatgcttcaagatcttcttagcaaggataaaacaatctcttttctgggatgtgcagtgcaaatattcctgtatttaacactaatcgggggcgaattcttcctgcttggcttaatggcatacgacagatacgtcgcggtctgtaatccactgcgctaccctctactgatgaatcgcagggtgtgtctcttcatggtcgtgggctcttgggtgggaggatctctcgatggattcatgctcactcccgttaccatgtccttccctttttgccgcagccgagagattaaccacttcttctgtgagataccggccgtgctgaagctgagctgcaccgacacatctctgtacgagacgttgatgtacgcttgttgtgtgctgatgcttcttatcccactctctgtcatcagtgtgagctatacccatatcttacttacagtacaccggatgaattcagccgaggggagacgcaaggcttttgccacttgctcgtcacacattatggtggtttcagtgttttacggtgccgcattttatacgaacgtgttaccacacagctatcacacgccagagaaggataaagtggtgagcgcattttacactatcctgactcctatgctgaatccactgatctacagcttaagaaataaggatgtggctgccgctctacgtaaggtgttagggcgctgtggaagtagccaatctatccgggtggccaccgtgattagaaaggggtag

SEQ ID NO: 28403 - DNA, 954 bp, Artificial Sequence
  Description of Artificial Sequence: Synthetic coding sequence
atggaacagtcaaactactccgtttatgctgacttcattctacttggactgttttccaatgccaggttcccatggctgctgttcgcactgatactgctcgtattcttgacctctatcgcgtcaaatgtggttaaaatcatcctcatccatattgacagtcggctgcatacccctatgtattttcttctcagtcagttgagcctgagggacatactctatatttccaccatcgtcccgaagatgctcgtggaccaggtgatgtctcagagggccatcagttttgctggttgcacagcccagcatttcctgtacctcactctagctggggctgaattctttctgctaggtttaatgagctacgatcgatatgttgcaatatgtaacccacttcattatcctgtcctcatgtccagaaagatctgctggctgatagtcgcagctgcctggctcgggggatcaatcgacggcttcctgctgactcccgtgaccatgcagttccccttctgtgccagccgggagattaaccactttttttgcgaagtgcctgccctgttaaaactgagctgcacagatactagtgcctatgaaactgcgatgtacgtatgttgcattatgatgttgctgatccccttttccgttatcagtggaagctacacccgcattttgatcactgtgtataggatgagcgaagcggagggtaggggcaaggcagtggcaacttgtagctcacacatggttgtggtgagcttgttctatggggctgccatgtatacttacgtacttccacactcttaccatacaccagagcaggacaaggccgttagcgcattctatacgatattgacgccaatgctgaacccacttatttacagtcttaggaataaagacgtcacaggggctctacagaaggtcgtgggaaggtgtgttagcagcggcaaggttacaactttctag

SEQ ID NO: 28404 - DNA, 948 bp, Artificial Sequence
  Description of Artificial Sequence: Synthetic coding sequence
atggccaacattacaaggatggccaatcatacgggcagacttgactttattctgatgggcctctttaggcaaagcaagcacccagccttactttcagttgtgatcttcgtggtcttccttaaagcattatccggcaacgctgttctcatcctcttgatacattgtgacgcccatctgcactctcctatgtattttttcatttcacagctaagtctgatggatatggcttacatttcagtgacagttcccaagatgctgctggaccaggtgatgggagtcaataaggtcagtgctcccgaatgtggaatgcagatgtttctgtacctcaccttagctggctctgagttcttcctcctggctaccatggcttacgaccgctacgtagcaatctgtcacccactgcgataccccgtgttgatgaaccacagggtctgccttttccttgcttcgggctgttggtttttggggtccgtcgacggatttatgttaacgcctattactatgtcttttcctttctgccgctcctgggaaattcaccattttttctgtgaagttcctgctgtgacgatcctttcatgcagcgatacctctctgtatgagaccctgatgtatctttgctgcgtcttgatgttgctgatcccagtcaccattatctcatcttcctatctgcttattcttctgacagtccataggatgaattcagccgaaggaaggaagaaggccttcgccacctgttcaagtcacctgacagtcgtcattctgttttatggagcagcggtttatacttacatgctgcctagctcataccatactcctgagaaggatatgatggttagtgtcttctacacaatcctgacgcctgtgctgaacccgctgatatactcactgcgcaacaaggacgtgatgggcgctttgaaaaagatgctgactgttagatttgtgctctag

SEQ ID NO: 28405 - DNA, 957 bp, Artificial Sequence
  Description of Artificial Sequence: Synthetic coding sequence
atgtgttccggaaatcagacatctcagaaccagaccgccagtacagactttacactgacaggactgtttgccgagtcaaagcacgccgcactcctctatacagtaaccttcctcctgttccttatggcactgaccggaaatgccctgttaattttactcattcactccgagcctcgcttgcatacccccatgtattttttcatttcccagttggctctcatggacctcatgtacctgtgcgttaccgtacctaagatgctggtcggccaggttacgggggacgatacaatctctcctagcggctgtggcatccagatgttcttttatctcacactggccggagccgaggtgttcttgttagccgccatggcttacgataggtacgcggctgtgtgccgtcctctgcattacccactcctgatgaatcagcgagtgtgtcagttgctggtgtccgcgtgttgggtgctaggcatggtggacggcctgctgcttactccgatcaccatgtcttttccattttgccagtctcggaagattcttagtttcttctgtgaaacacctgcactgctgaagctgagctgtagtgatgtgagcctgtataagactctgatgtatctctgttgcatacttatgctgctggctcctatcatggtcattagctcatcctataccctgatactccacttaattcaccgcatgaattcagcagcagggcatagaaaagcattagccacatgtagctctcacatgatcatcgtgcttttgctgtttggcgcaagcttctacacgtacatgctgccctctagttatcacactgctgagcaggatatgatggtttcagcattttataccatctttacccctgtccttaaccccctgatctactctctgaggaataaagacgtgacacgggccctgcgctcaatgatgcaatcccggatgaaccaagagaagtag

SEQ ID NO: 28406 - DNA, 963 bp, Artificial Sequence
  Description of Artificial Sequence: Synthetic coding sequence
atggaaatgaggaacactacccctgacttcattcttctcggtctatttaaccacacaagagcccaccaggttttatttatgatggtgctgtcaattgtccttacatctctgtttgggaatagcttgatgatcctgctgatccattgggatcacagactacacacccctatgtatttcttgctgagtcagttgagcctaatggatatgatgctggtgagcactaccgtacccaagatggccgccgactacttgacaggcagtaaagccatatcccgagcagggtgtggtgtgcagatctttttcctgccaacccttgggggaggcgaatgcttcctgttagccgcaatggcatatgaccgctatgccgccgtttgtcacccgctgcgctacccgacactgatgtcttggcaactctgtctgcgtatgaccatgagctgttggctgttgggagccgccgatgggttgctgcaagccgtggtaactctcagtttcccatattgcggggcccatgaaattgatcactttttttgcgagacccccgtgctagtgcgcttggcctgcgcagacacatctgtctttgagaatgcgatgtatatttgctgtgtgcttatgctcttagtccccttctctctgattctgtcaagttacggccttatcttggccgcagtcttgcacatgcgatctacggaggcccgcaagaaagcctttgcgacctgcagctctcatgtggctgtagttggcttgttctacggtgccgctatattcacatacatgcgccctaagagtcataggagtaccaaccatgacaaggtcgtgtctgctttctacacgatgttcacacctctactgaaccccctcatctactccgtcaagaatagcgaggtcaagggcgcactcaaacgctggcttggaacctgtgtgaacatcaagcaccagcagaacgaggcacaccgctcgcggtag

SEQ ID NO: 28407 - DNA, 957 bp, Artificial Sequence
  Description of Artificial Sequence: Synthetic coding sequence
atgtgttccggtaaccagacaagccagaaccaaacggctagtacagacttcactttgacagggctcttcgctgagtccaagcacgcagctctgctgtataccgtcacattcttactgtttttgatggcactaacgggtaatgcactgctgatccttctcatccacagcgagccaagactgcatactcctatgtatttcttcatatctcagcttgccttgatggatctcatgtacctctgtgtaactgtgcctaaaatgttggtgggtcaggtcactggggatgacactatcagcccgtccgggtgtggtatacagatgttctttcacctcacactggcgggagcggaagtatttttgctggccgccatggcctatgatcggtatgcagctgtttgtcgaccgcttcattaccctctcctgatgaaccagcgggtgtgccagttgctagtgagcgcctgctgggtgcttggcatggtggacggcctgctgttgacccccattacaatgtctttccctttctgccagtccaggaagattctatcctttttttgcgagaccccagccttgcttaaattgagctgctcagatgtgtctctgtacaagatgctgacatatctgtgttgtatcctcatgctgctgaccccgatcatggtcatatccagcagttacacactgatcttgcatctaatccaccgcatgaattcagctgcgggacgccgcaaggccctggccacatgctcctcccacatgatcatagtgctgctcctcttcggggcctctttctacacctatatgcttcggagcagctaccacactgcagagcaggacatgatggtttctgccttctatacaatctttacaccggttctaaatcccctgatttactctcttcgcaataaagatgtaacaagggcactcaggtctatgatgcagagccggatgaaccaggagaaatag

SEQ ID NO: 28408 - DNA, 972 bp, Artificial Sequence
  Description of Artificial Sequence: Synthetic coding sequence
atgggaatggaaggcctcctgcagaattccactaatttcgttctgacagggctgatcacacacccagccttcccaggactgttgttcgcagtggtgttctcaattttcgtggttgcgattaccgctaacctggtgatgatcctgctcattcatatggactcgagactccataccccgatgtacttcctccttagtcaactttctatcatggatacgatctacatctgcattaccgtccccaagatgcttcaggatctcttatccaaagacaagacaatctctttcttaggttgtgctgtgcagatcttctatctgacactgatcggtggggagtttttcttgctggggctgatggcttatgatagatatgtcgccgtctgtaaccccctgcgctatcctctgctcatgaaccgccgggtttgtctatttatggtcgttgggtcttgggtgggggggtcattggacggctttatgttgactccagtgaccatgagttttccattttgtcgttctagagaaattaatcactttttctgcgagattcctgcagttctgaaactgagttgcacagacactagcctttacgagacccttatgtatgcctgttgtgtgcttatgctgctgattcctctgtcagtgatatccgtgtcctacacccacatcctcctaaccgttcaccgcatgaattctgccgaaggtcggaggaaagccttcgctacctgctccagtcatatcatggtcgtgagcgtgttttacggtgcagctttctacaccaatgtgctcccacacagctaccatacaccggagaaggataaggtggttagcgccttctacaccattcttacaccgatgctgaatcctctgatctattcattacgtaacaaggacgtggccgctgccctgaggaaggtcctgggcaggtgcggatcgagccagagcattagggtcgcgacagtcatccgcaagggatag

SEQ ID NO: 28409 - DNA, 1047 bp, Artificial Sequence
  Description of Artificial Sequence: Synthetic coding sequence
atggataatattacctggatggccagccatacaggttggagtgattttattttaatgggcctatttagacagagtaagcaccctatggcaaacatcacctggatggctaatcacaccggctggtcggactttatcctgctgggcctgtttcgtcagtccaaacaccccgctcttctgtgtgtcgtgatttttgtcgtgttcctcatggcactgtcgggcaacgccgtcctgatcctgctgatacactgcgatgcccacctgcacacccccatgtacttctttatcagccagctctctctgatggatatggcatacatttcagtaactgttccaaagatgctgttggaccaggtcatgggtgtaaataaaatcagtgctcccgaatgcggcatgcagatgttcttctacgtcactctggcagggtctgagtttttcctgctggccaccatggcgtacgaccgatacgttgctatatgccatcccctgcggtatccagtgcttatgaatcaccgagtctgtttattcctatccagcggctgctggtttttgggcagtgttgacgggttcaccttcactcccatcacaatgacttttccgtttagaggctcccgagagatccaccatttcttttgtgaggtgcctgcggtcttaaacctctcttgttcagacacatcactgtatgagattttcatgtatctatgttgcgttctcatgctcctcattcctgtggtgatcatctcctcttcctatctcctgattcttctgaccatccacgggatgaacagtgctgaaggacgcaaaaaggcttttgccacttgtagttcccacttgacagtggttattctgttttatggggctgccatctacacttatatgctaccatctagctaccacactccagagaaggatatgatggttagcgtgttttacaccatcctgacccccgtggtgaatcccctcatatacagcctgaggaataaagatgtcatgggcgcccttaagaagatgctgaccgtggagcccgcctttcagaaagccatggagtag

SEQ ID NO: 28410 - DNA, 948 bp, Artificial Sequence
  Description of Artificial Sequence: Synthetic coding sequence
atggccaacattacccgtatggcaaaccataccggtaagcttgatttcatcctgatgggcctgttcaggcggtcaaagcacccggcactgctgtctgtggtgatcttcgtggtattcttgaaagccctgtctgggaacgccgtgcttatcctcctcattcattgcgacgctcaccttcacagtccgatgtattttttcatttcccaactttccctcatggacatggcctatatctccgttacagtgcccaaaatgctgctcgatcaggtgatgggcgtgaataaagtgtctgccccagagtgtgggatgcagatgttcctgtatctcactctcgctggatctgaattctttttgcttgcaacaatggcctatgaccggtacgtcgccatctgccaccctctcagataccccgtgctgatgaatcacagggtgtgcctgtttcttgcctctggatgttggtttctgggtagcgtggatggctttatgctgacgcctatcactatgtcattccccttttgtcgctcttgggaaatccaccatttcttttgtgaggtaccagccgtgactatcctgtcatgtagtgatactagcctttatgagaccctcatgtacttatgctgcgtcttgatgctccttataccagtcacaatcattagctcttcatatctgcttatactcttaactgttcaccgcatgaatagtgctgaggggcggaaaaaagccttcgctacgtgtagctcgcatttaacggttgtgattctcttttacggtgcggcagtatatacctatatgctgccatcatcctaccacactcccgagaaggacatgatggtgagtgtgttttatacaatcctgacccccgttttgaaccctttgatctactcactgaggaataaggatgtcatgggagccctgaagaaaatgcttacggtcagatttgtgctatag

SEQ ID NO: 28411 - DNA, 927 bp, Artificial Sequence
  Description of Artificial Sequence: Synthetic coding sequence
atgaatgaaaacaacgaaaccctaacacggggattcacactgatggggctctttacgcacaataagtgctcgggcttttttttcggcgttatttgcgccgtattctttatggcaatgattgccaacggggtgatgatattcctgatcaacatagatcctcacctccacaccccaatgtattttttgctatcccacctatccgtgattgatacactctatatttcaactatcgtcccgaaaatgctggtggattatctcatgggagaaggcaccatcagttttatcgcctgcacagcccaatgcttcttgtacatgggcttcatgggggcagagttttttttgctaggcctcatggcctatgaccgatatgtggcgatttgtaatcccctgcggtacccagtgctgatctcctggcgcgtctgctggatgatcctggcaagttcctggtttggcggcgccttagactctttcttgcttacacccatcacaatgagcctacctttctgcgcttcccaccagattaaccatttcttttgtgaagcacccacaatgctgcgcttagcctgcggcgacaagaccacctatgagaccgtgatgtacgtttgttgcgtggcaatgctcctgatacctttctccgtggtcactgcatcttacactcggatattgatcaccgtgcaccagatgacatccgctgaagggagaaaaaaggccttcgccacctgctcttcacatatgatggtggtcacgcttttctatggcgccgccctgtatacgtacacactccctcagagctaccatactccaatcaaagacaaggtgttctccgcattctacacgattctgactcccctccttaaccctcttatttactcactgaggaaccgagacgttatgggggcgctgaagagggtagtggctcggtgctag

SEQ ID NO: 28412 - DNA, 948 bp, Artificial Sequence
  Description of Artificial Sequence: Synthetic coding sequence
atgggtagatgggttaaccagtcttacactgacggattcttcctcctggggatctttagtcacagccaaactgatctggtgctgttcagcgccgtaatggtggtgtttactgtggcactgtgtgggaatgttctcctgatctttctcatttatctagatgccgggctccacacacctatgtacttcttcctcagccagttgagtctcatggatcttatgcttgtatgtaacatcgtgcccaaaatggctgcaaattttctttctggccgaaagtcaatctcttttgtgggctgtggaatccagattggattcttcgtgagccttgtaggcagcgaaggcctcttgctcggcctgatggcttatgacaggtatgtggcggtttctcacccccttcactatcctatcctgatgaatcagagagtttgtctacagatcacaggatcctcatgggctttcggcattatagacggtgtcatccagatggtggccgccatggggctaccatattgtgggtcgcggtctgttgatcattttttttgtgaggtgcaggctctgctaaaactggcatgcgccgatacaagcctttttgacactctgctgtttgcttgctgcgtgtttatgctgctgctgcccttctccattattatggctagctatgcatgcatcctgggtgccgtgctgcgcatcaggtctgcccaggcttggaagaaggctctcgcgacatgctcaagtcacctgaccgccgtgacccttttttatggagccgccatgttcatgtatttacgcccaaggcggtaccgtgcgccaagccatgataaggttgcttcaatcttttatacagttctcacccctatgcttaaccccctgatctacagtctgcgcaatggggaagtgatgggagctctcaggaaaggattggacagatgtcgcataggtagtcagcattag

SEQ ID NO: 28413 - DNA, 948 bp, Artificial Sequence
  Description of Artificial Sequence: Synthetic coding sequence
atggagacttgggtgaaccagtcatacacagatggattcttcctgcttggaattttttcacactccaccgccgatctggtcctattttcagtggtaatggccgtcttcacggtggctttgtgtggcaacgttctactcattttcctgatttacatggaccctcatctacacacccccatgtacttctttttgtctcaactttcgctgatggatctgatgctggtgtgtaccaatgtgccaaaaatggctgccaacttcctgagcggaagaaaatccataagctttgtgggctgtggcatacagattggcctgtttgtctgcctggtggggtcggagggtctgcttcttggccttatggcatacgaccggtatgtggctatttcccacccattgcactaccccatactgatgaaccagcgggtgtgtcttcagatcactggctccagttgggcctttgggatcattgatggcttaattcagatggtcgtcgtgatgaacttcccgtactgcggactcagaaaggtcaaccactttttctgtgaaatgctctccctgctgaagctcgcatgtgtggacacaagccttttcgagaaagtgatctttgcatgctgtgtgtttatgttactgttcccattttctattattgtggcgagctatgcccatattctgggaactgtattgcagatgcattcagcccaagcttggaaaaaagcattggcaacttgcagctctcacctgaccgctgtgacactattctacggagctgctatgtttatatatctgcggccccgccattatcgcgcccctagtcatgacaaggtcgcctctatcttttacacagtactcacccctatgcttaaccctctgatctactcactgcgcaatagagaagttatgggcgccttgagaaagggcctcgaccggtgtagaatagggtctcagcactag

SEQ ID NO: 28414 - DNA, 963 bp, Artificial Sequence
  Description of Artificial Sequence: Synthetic coding sequence
atggaccagtccaactactcctcgctacatgggttcattcttcttggcttttcgaaccatcccaaaatggagatgatactctcaggcgtcgtggctatattttatctgataacgctagttggcaacaccgccatcattttagccagtctgcttgattcccagctccatacacccatgtatttttttctcaggaatctgtctttcctggatttgtgctttacaacatccataattcctcagatgcttgtcaatctttggggtcctgacaaaaccatctcctatgttggctgcattatacagctttacgtctacatgtggttagggtccgttgaatgcctgctcttggccgtgatgtcctatgacaggttcacagctatctgcaagcctctccactactttgtggtcatgaacccacacctctgcctgaagatgatcatcatgatatggagcataagcctggctaacagcgtagtgctgtgtacactgacactgaaccttcctacatgcggaaataacattctggatcatttcttgtgcgagttgccagccctggtgaagattgcatgtgtggatacaaccactgtcgagatgtccgtattcgcactggggatcattatagttctgacccctttaattctgatcttaatcagctacgggtatatcgctaaggccgttttgcgcaccaaatcgaaggcctctcagaggaaagccatgaatacatgtggcagccacttgactgttgtctccatgttctacggcacgataatatacatgtatctgcagcccgggaatcgggcttcgaaagatcaaggaaaattcctgaccctcttttatacagtcatcacaccgagccttaaccctctcatatatacactgcggaataaggacatgaaagacgccctgaaaaaactgatgagattccaccataagagtaccaaaatcaagagaaattgtaagtcttag

SEQ ID NO: 28415 - DNA, 963 bp, Artificial Sequence
  Description of Artificial Sequence: Synthetic coding sequence
atggatcaaagtaactatagttctcttcacggcttcatactactgggattcagtaaccatccaaagatggagatgatcctgtccggcgttgtcgctatcttctacctcattaccttggtggggaacacggctatcatcctcgcaagtttactggacagccagctccatacgcctatgtacttttttctaaggaacttgtcttttctggatctttgcttcactacctccatcattccccagatgcttgtcaatctgtggggcccagataaaaccatctcctacgtgggctgtataatccagctgtatgtttacatgtggttggggtccgtggaatgcctccttctcgctgtgatgagctacgaccggtttacagcaatatgcaaacccctgcattattttgttgttatgaatccccacctgtgtttgaagatgattatcatgatttggagcatcagcttagcgaactcggtcgtcttgtgtacacttacacttaacctgcctacttgtggcaataacatattggatcacttcctttgtgagcttccagctctcgtgaaaattgcatgtgttgataccaccacagtggaaatgtctgtgttcgcccttggtatcattatcgtgctgaccccattgatacttattctcattagctacggttatatagccaaggcagtcctgcgcacaaaaagtaaagcgagtcaacgaaaggctatgaatacatgtgggagccacctaactgtggtctctatgttttacggaaccattatttacatgtacctccagcctggaaatcgggcgagcaaagatcagggcaagttcctgaccctgttttacaccgtaatcactccgtctttaaaccctctgatttataccttgcggaacaaagatatgaaagatgcattgaagaaattgatgagattccaccataagtcaactaagataaagagaaactgtaagtcctag

SEQ ID NO: 28416 - DNA, 963 bp, Artificial Sequence
  Description of Artificial Sequence: Synthetic coding sequence
atggaccagtccaattatagctccctgcacggttttattctgctgggtttctccaaccaccctaagatggagatgatcttgtccggcgtggtggccattttctacctgataaccctcgtggggaatacagcaatcatcctggcctcactgctggattctcagctgcatacccccatgtacttctttctgaggaatttaagctttctcgacttatgttttactacctctatcatacctcagatgcttgtgaacctatgggggcctgacaaaaccatcagctatgttggttgtatcattcagctgtacgtttacatgtggctcggctcagtggagtgtttgctcctggcggtcatgagttatgatagattcaccgcaatttgcaaaccacttcactactttgtggtgatgaacccccacctgtgtctgaagatgattatcatgatatggtcaattagtctggccaattcagtggtcctatgcactctgacactgaacttgccaacttgcggcaataatatcttggaccatttcctgtgtgaactgccagctctggtcaaaattgcctgcgttgacacaaccaccgtggagatgagcgtgttcgctttgggaatcatcattgtattgacaccgctcatcctgatactgatttcttatggctatatcgccaaggccgtcttgagaaccaaaagcaaagcctcccagcgcaaagccatgaatacctgcggcagtcacctgaccgtggtgtctatgttttatgggaccattatttatatgtatctgcagccgggtaacagggcatcgaaggaccagggaaagttcttgaccttgttttataccgttattacaccgagcctgaacccactcatatatactctcaggaacaaggatatgaaggacgcactgaaaaaacttatgagattccaccacaagtcaaccaagatcaagagaaattgcaagagctag

SEQ ID NO: 28417 - DNA, 963 bp, Artificial Sequence
  Description of Artificial Sequence: Synthetic coding sequence
atggatcagagtaactattccagcctccacggctttatcctgcttgggttcagcaatcacccaaaaatggaaatgatcttgtccggcgtcgttgcaatattttacctgattaccttagtggggaatacagcgatcatcctggccagcttgcttgactcgcagttgcacacgcccatgtacttcttcctccggaatctgagctttctggacctgtgtttcacaactagcattattccccagatgctggtgaatctgtggggcccggacaaaactataagttacgtagggtgtatcatccagctctatgtttacatgtggctgggaagcgtggaatgcctgctgctggcagtcatgtcatacgaccgctttacggccatctgcaagcccctgcactactttgtggtaatgaacccccatctctgcctgaagatgattatcatgatttggagcattagccttgccaactctgtcgttctgtgcactctgactctgaacttacctacttgcgggaacaacatactagaccactttctttgcgaactgcccgcactcgtcaagatcgcatgtgtcgacacaaccacggtcgaaatgagcgtgttcgcactcggaattattatcgtactcaccccattaatactgattctcatttcttacggctacatcgcgaaggccgtcctccgaactaagtcgaaagcctctcagagaaaagccatgaatacatgtggcagtcatctgacagttgtatcgatgttctatggtactatcatctacatgtatctccagccaggtaatagggcatccaaggaccaaggcaagttcctaaccttattttacaccgtcatcactccctcgttgaatcctctgatctacaccctccggaacaaagatatgaaggacgccttgaagaagctgatgcgcttccaccataagagtaccaaaataaaacgtaactgtaaaagctag

SEQ ID NO: 28418 - DNA, 963 bp, Artificial Sequence
  Description of Artificial Sequence: Synthetic coding sequence
atggaccagtcaaactactcgtccctacatggattcatccttctgggattttctaatcatccgaaaatggagatgattctctccggggtggtggcgatcttttacctgattactctggtgggcaataccgcaatcatcctggcctccctgttggacagccagctgcacactccaatgtacttctttctgcgcaatctcagcttcctcgacctgtgttttacaacgagtatcattccacaaatgctagtgaacctatgggggccggacaagaccatttcttacgtggggtgcatcatacaactgtatgtgtacatgtggctcggcagcgtggagtgcctgctactggctgtcatgtcttacgaccgttttactgcaatctgcaaaccgctgcattattttgtggtgatgaatccccacctttgtttgaagatgatcatcatgatctggtcaatctccttagccaacagcgtagtcctgtgtaccctcacactcaatctgccgacgtgtggcaacaacattctcgaccactttctttgcgagctgccggctctggtcaaaattgcttgtgtggatacaacaaccgtcgagatgagtgtcttcgctctgggaattatcattgtgcttacccccctgattctgatcctgattagttacggctacatcgccaaggcagtattgcggacaaaatcaaaagcatcccagcgcaaggccatgaacacatgtgggtctcacctgacagtggtgagcatgttttatggtactatcatttacatgtaccttcagcctggcaatcgagcatctaaagatcaggggaagttcctgaccttgttttataccgtcattaccccctctttgaaccccctgatttatacgctgcgcaataaggatatgaaggacgcgctcaaaaagctcatgagattccatcacaaatctacaaagatcaagaggaattgtaagtcctag

SEQ ID NO: 28419 - DNA, 963 bp, Artificial Sequence
  Description of Artificial Sequence: Synthetic coding sequence
atggatcagtccaattactcatctctccatgggtttatcttattggggttctccaaccatccgaaaatggagatgatactgagtggagtggtggccattttctaccttataactctggtggggaacacagctattatccttgcttcccttctggacagtcagttgcacactccaatgtacttctttctccgcaatctttctttccttgacctgtgctttaccaccagcattattccgcaaatgctggtcaatttgtggggacccgacaagaccatctcatatgtgggctgtattatccagctgtatgtgtatatgtggctgggctccgtcgagtgccttctgctggctgttatgagctacgataggtttacagcgatatgcaaacctctacattactttgtggttatgaatccccacctctgtcttaaaatgataattatgatatggagcatctctctggccaactccgttgtgctctgcaccctgaccttgaacctgcccacatgcggcaacaacatcctcgatcactttctgtgtgagctgccagccctggtaaaaatcgcctgtgtggatacgacgaccgtggagatgtcagtgtttgccctcgggattatcatcgttttgactcctctgatcctcatactgatcagctatggctacatagccaaggcagtgttacgcacaaagtcaaaggctagccagcgaaaggcaatgaacacgtgcgggtcacacctcacagtggtcagtatgttctacggcacgatcatttacatgtatctccagccaggaaaccgagcctccaaggatcaagggaaatttctcacactgttttatactgttataactccctcactgaaccctctcatatacaccctgagaaacaaggacatgaaggatgccctgaagaaactaatgagatttcaccataagagtactaagataaaaagaaattgtaagagctag

SEQ ID NO: 28420 - DNA, 963 bp, Artificial Sequence
  Description of Artificial Sequence: Synthetic coding sequence
atggaccagtccaactattcctcattgcatggcttcatcctcttgggcttctcaaatcatcccaagatggaaatgatcctctcaggcgtagtggctattttttatttgatcaccctggtgggcaacaccgccattatacttgcttcactccttgacagccagctccacacccccatgtatttttttctgcgcaatttgagttttttggacctctgctttacaacatccattatcccacaaatgctagtcaatttgtgggggcccgataaaacaatttcttacgtcggatgtattatccagttatacgtttacatgtggttgggctcagtggaatgtctgctactagctgtcatgagttatgatcggtttaccgcaatatgtaaacctctccactattttgtcgtgatgaacccccatctatgcctcaagatgatcattatgatatggtccatctctctggcgaattcggtggtcctgtgtactcttacgctgaatttgccaacctgcggcaataacatcttggaccacttcctgtgcgaattgcccgccctggtgaagattgcatgcgtggacaccacaaccgtggagatgagcgtctttgcactcgggatcattattgtactgacccccttaattctgatcctgatcagttacggttatatagctaaagctgttcttagaactaagagcaaagcctcccaacgcaaggccatgaacacatgcggtagtcacctgaccgtagttagtatgttctacggcactattatctatatgtatttacaacctggcaatcgtgcctccaaagatcagggtaaatttctgaccctcttctacacggtgatcaccccttccctgaatcctctcatctacactctcagaaacaaagacatgaaagacgcccttaaaaaactgatgcggttccaccataagagcacaaagatcaaaagaaattgtaagtcttag

SEQ ID NO: 28421 - DNA, 963 bp, Artificial Sequence
  Description of Artificial Sequence: Synthetic coding sequence
atggatcagagtaactattctagcctgcatggattcatcctgctgggtttctccaatcatcccaagatggaaatgatcctatctggtgttgtggccatcttctatctgattaccctggtcggcaataccgcgatcatcctggcttcactgctggattctcaactgcatacgcctatgtatttcttcttacgcaacctttcttttcttgacctctgcttcactacttccattattccccagatgctggtgaacttatggggtcctgacaagactatctcttatgtcggctgtatcatccaactgtacgtctatatgtggctgggctctgtcgagtgtctcttgctagcggtgatgtcctatgataggttcactgccatttgtaaaccactgcactactttgttgttatgaacccccacctgtgcctcaagatgatcatcatgatttggtcgatatctctggcgaacagcgtggtcctgtgcacccttaccttgaatcttccgacgtgtggcaataatattttggaccacttcctgtgcgaactgccagcgctcgtcaaaatcgcctgcgtggataccacaacagtggaaatgtctgttttcgcgctgggtatcatcatcgtgctcacccccctgattctcatcctcattagctacggctatatcgccaaagctgtactgcgtacaaagagcaaggcctcacagcggaaggctatgaacacttgtggttctcacttgacggtggtgagcatgttctacggtaccatcatctatatgtacctgcagcctggtaacagagcctctaaggatcagggtaagttcctgactctgttctacaccgtgattacacccagtctgaatccactgatttacacccttcgcaataaggacatgaaggacgccctgaaaaaattaatgcgcttccaccacaagtcaaccaaaattaaacgtaattgtaagtcctag

SEQ ID NO: 28422 - DNA, 945 bp, Artificial Sequence
  Description of Artificial Sequence: Synthetic coding sequence
atggatggaacaaacggttctactcagacacacttcatcttgctcggtttctcagacaggccgcacctggaaagaatcctcttcgttgtgatcctaattgcttatttgctgactttggtcggcaacacaactataatcctggttagccgcctggatccccacctccacacacccatgtactttttcctcgcacacctgtcctttttggatctgtctttcacgacaagcagtattccccagttgctttataacttgaatggttgtgacaaaaccatctcctacatgggatgcgcaatccagttatttctcttcctgggcctggggggggttgaatgcttgttactggccgtcatggcgtacgacagatgtgttgcaatctgcaagcccctgcactacatggttatcatgaaccccagattgtgcagaggacttgtctctgtaacttgggggtgtggagtggcaaatagtcttgcaatgagccccgtgacactgaggctcccccggtgtggccaccacgaggtggaccactttctgcgggaaatgcccgctctgatccgaatggcctgtgtttcgacagtggctatcgagggcaccgtgttcgtcctcgccgtcggggttgtactttcgccgcttgtctttatcctgttatcttactcttatattgtgcgcgctgtattacagatcagatcagcttccggccgccaaaaagctttcgggacgtgcggttcacacttaacagtggtgtctcttttctacggaaatatcatctatatgtacatgcaaccaggagcgtctagcagccaggatcagggaatgtttctgatgttgttttacaatattgtgacaccactcctgaaccccttgatctataccctgcggaatcgggaggtgaaaggggcactgggcagactgcttctcgggaagcgcgaattagggaaggaatag

SEQ ID NO: 28423 - DNA, 945 bp, Artificial Sequence
  Description of Artificial Sequence: Synthetic coding sequence
atggatggtactaatgggagcactcagactcatttcattctactgggcttttctgatcggcctcaccttgaacggatcctgtttgtggtcatcctgattgcctatctgctcaccctagtgggaaacaccaccatcatcctggtcagtagattggatccccacttgcacactcctatgtatttcttcctggcccacctttcattcctcgacctgtcctttaccacctcaagcattcctcagctactctataatcttaacggctgcgataaaaccatttcatatatgggctgcgcgattcagctgtttctgtttctcggccttggaggagtggagtgtttgctgttggcggtgatggcatacgatagatgtgtggcaatctgcaaacctttgcattatatggttatcatgaatccgcgtctctgcagagggttggtgagcgttacttggggatgtggagtcgccaattcgctggcgatgtccccagtgaccctcaggctgcctcggtgtggtcaccacgaagttgatcattttctgagggagatgcctgcccttattcgaatggcatgtgtgagcacggtggcgattgagggcacagtcttcgtgctggccgtaggtgtagttctgtccccactggtgttcattctcctgtcctatagctacatcgtgcgcgccgtactccagattaggtccgcatcaggcagacaaaaagccttcgggacatgtggctcacatctgaccgtggtgtccctgttctatggaaatattatctacatgtacatgcaaccaggtgcttcttcttcacaagaccagggcatgtttctgatgctgttttacaacatcgtaacccccctgctgaatcctttaatctacactctgaggaaccgagaggttaagggcgcacttggtagactccttctgggcaagcgtgagctaggaaaagagtag

SEQ ID NO: 28424 - DNA, 936 bp, Artificial Sequence
  Description of Artificial Sequence: Synthetic coding sequence
atgggatcatttaacaccagttttgaggatggcttcattctggtcggatttagcgattggccacagttggaacccatcttgttcgtgtttatttttattttctattcactgacactgttcgggaacacgattattattgcgctgagttggctggacctgaggctgcacactccaatgtacttttttttgagtcatctctccctgctagatctgtgctttaccacgagtactgtgccccagctcctgattaacctgtgcggagttgatcgcacaattaccagaggtggctgcgtggcgcagttattcatatatcttgctctgggctctacagagtgtgttttattggttgtgatggccttcgacaggtacgccgccgtatgtaggcctttgcactatatggccataatgcaccctcatctttgccagacgctggccattgcctcttggggcgctggattcgtcaattccctcattcagacgggactggcaatggcaatgcccttatgcggccatagactgaatcattttttctgtgagatgcccgtgttcctcaaactggcctgcgcagataccgaaggcacggaagccaagatgttcgtcgccagagtcatagtggtagccgtccccgctgctttgatcctcggaagctatgtacatatcgctcatgctgtcctgcgcgttaagtcaacagccggcagacgtaaggcattcggaacatgcggctcccacttgcttgtggttttcctcttctatggaagtgcaatttacacctatctacaatcaatccacaattatagcgaacgtgaggggaaatttgtggcactgttctacactatcatcactcccattctgaacccactgatttatacacttagaaacaaggacgtgaagggtgccctgtggaaagtgttgtggcgtggcagagactcagggtag

SEQ ID NO: 28425 - DNA, 945 bp, Artificial Sequence
  Description of Artificial Sequence: Synthetic coding sequence
atgggtgatgtaaatcagtccgttgcctcggacttcatattggtcggattattttcccactctggtagccggcagctcctattctctctggtcgctgtgatgtttgtgatcggtctgctggggaatactgtgctgctttttttgattcgcgttgactcacgcttgcacacacccatgtacttcctcttgtcccagctgagcctcttcgatataggctgtcccatggtcaccatccccaaaatggcttctgactttttacgaggggaaggggctacatcttacggcggaggagccgcacagatttttttcttaacactgatgggcgtcgccgagggggtgttattggttctgatgagttacgaccgctacgtcgcagtatgtcagcccctgcagtacccggtcctgatgcgccgccaagtatgtctcctaatgatgggctctagctgggttgttggagtgctcaacgcctcaatccagacatccatcacgctccacttcccatactgcgcctcgaggatcgtcgaccacttcttttgcgaagtgcccgctctgctgaaacttagctgcgcggatacctgcgcatacgagatggccctgagcacctcaggagtgctgatactgatgttacccctgtctctgatcgctacgagttacggacacgtgctgcaggccgttctgagcatgaggagcgaggaagcccgtcacaaggcagtaacgacatgctcttcccatatcacggtagtggggcttttttacggagccgctgttttcatgtatatggtcccttgcgcgtaccattcgccacagcaggacaatgtggtgtctctcttctacagcctggtaactcccacacttaaccccctaatttactctcttaggaacccagaggtatggatggctttggtgaaagtgttgtccagggccgggctgcgccagatgtgctag

SEQ ID NO: 28426 - DNA, 948 bp, Artificial Sequence
  Description of Artificial Sequence: Synthetic coding sequence
atgcagcccgagtccggcgctaacggcacagtgattgcggaatttattttgctgggcttgctggaagccccaggactccagcccgtggtctttgtgctgttcttgtttgcatacttggtaaccgtgagggggaatttgtccatccttgccgccgtgctagttgaaccaaagttgcataccccaatgtacttttttcttggcaacctgtccgttctcgatgtcgggtgcatcagtgtaaccgtcccatctatgctgtctcgtctcctgtctcggaaacgggctgtgccttgtggtgcctgcctgacccagctcttctttttccacttgtttgtgggcgtggactgtttccttctcactgccatggcttacgacagattcctggcaatctgtcggcctttgacgtacagtaccagaatgtcccaaacagtgcagaggatgctagtcgctgcaagttgggcatgtgccttcacaaacgcgctgacccacaccgtggccatgtctactctgaacttctgtggacctaatgtcatcaaccatttctactgtgatctgcctcagctgttccaattgtcgtgttcctccacccaactgaacgagctgttactgttcgccgttggctttataatggcagggactcccatggctctcattgtcatctcatacattcatgtcgctgccgccgtgttaagaatcagatcagtggagggccgtaaaaaggcattctccacgtgcgggtctcacctaaccgtcgtggccatcttttatggatctggcatttttaattacatgcggctcggcagcactaagctatctgataaagataaggccgtgggcatctttaatacagtgatcaaccctatgctaaatccaatcatttattcctttcgcaatccagatgtccaatccgcgatctggcggatgttgaccggccgcaggtccttagcctag

SEQ ID NO: 28427 - DNA, 966 bp, Artificial Sequence
  Description of Artificial Sequence: Synthetic coding sequence
atgtcgctgcagaagttgatggaacccgaggcgggaacaaataggacagcggtggccgagttcatcttgcttgggttggtgcagacagaggaaatgcagcctgtggtctttgtcttattgcttttcgcctacctggtgactaccggcggcaatctgtctattctggccgctgtgctggtggagcccaaacttcacgcacccatgtatttttttctgggtaatctgtccgtactggacgtgggctgcataacggttaccgtgcctgctatgctcggcagactgttgtctcataagagtactatctcatacgacgcatgccttagccagctcttttttttccatctgttggccgggatggactgctttctgctgaccgctatggcatatgaccgattactcgctatctgccagccactgacatactccacacggatgtcccagacagttcagcggatgcttgtcgctgcaagcctggcctgtgcttttacaaacgctctgacgcataccgttgcaatgagcaccctgaatttttgcgggccgaacgaggttaatcacttctattgtgatcttcctcagctattccagcttagttgcagttccactcaattgaacgaacttttactgttcgcagttggctttataatggctggaacccccctcgtcctgattatcacagcatattcccacgtggccgctgccgtactcagaattagatcagtggaagggagaaagaaggcttttagtacctgcggttctcacctcacagttgtctgcctattcttcggcagaggaatctttaactatatgagactcgggtctgaagaggccagcgacaaagataagggtgtcggggtctttaacacagttatcaaccccatgctcaaccccttgatttatagtttgagaaaccccgatgtgcagggcgccctctggcagatctttctaggcagacggtcattaacctag

SEQ ID NO: 28428 - DNA, 966 bp, Artificial Sequence
  Description of Artificial Sequence: Synthetic coding sequence
atgagccttcagaagctcatggagcccgaagccggtacaaacaggaccgctgtggccgaattcatcctcctgggactggtccagactgaggaaatgcagcccgtggtattcgtactactgctgttcgcatacctggtgactaccggcggtaacttgagcatcctggccgctgttttagtggagcccaaactgcatgcaccaatgtatttttttctggggaacctgagcgtgttggatgttggatgtatcacagtgacagtgccggccatgttaggcagacttctgtctcacaagtcaaccatttcatacgacgcttgtttatcgcagctgttcttctttcacctgctggccggtatggactgttttcttctcaccgccatggcatacgacaggcttctggcaatttgtcagccactcacctattctacaagaatgagtcagactgttcagcgaatgttggtggcggcctcctgggcctgtgcgtttactaacgcactgacccacacagttgcaatgtcaaccctaaacttttgcgggcctaacgaggtcaaccatttttattgtgacttgccacaattgtttcagctatcctgcagctctacccaacttaatgaactcctcctttttgtggcagcggcatttatggctgtggctcccctggtgttcatttctgtttcatacgcccacgtggtcgcggccgtgctccagattcgatcagcggaaggtcgtaaaaaggcctttagcacgtgcgggagccacctgacagtggtgggcattttctacgggaccggagtgttttcgtatatgcgcttagggagcgttgaaagcagtgacaaggacaaaggcgttggtgtgtttatgacggtaataaatccaatgctcaaccccttaatctactccctgaggaatacggatgtgcagggcgccctttgtcaactgctggtgggaaagagatcacttacgtag

SEQ ID NO: 28429 - DNA, 1035 bp, Artificial Sequence
  Description of Artificial Sequence: Synthetic coding sequence
atggaactcctcacaaataacctgaagtttataactgaccctttcgtatgtcggctgcggcatctaagtcctactccgtctgaggagcatatgaaaaataagaacaatgtgaccgaatttatattactgggtttgactcagaatccggaaggccagaaagtgttatttgttactttccttttaatttatatggtaactatcatgggaaatttactgattatagtgactataatggcatcccagtcgctcggttctcctatgtacttctttcttgcttctctgagttttattgataccgtctacagtaccgcgttcgcacctaagatgatcgtggatttgttatctgaaaagaagaccatcagttttcaggggtgcatggcgcagctcttcatggaccacctgtttgcaggcgccgaggtgatccttctggtcgtaatggcgtacgataggtatatggcaatatgcaaacccctgcatgagctgatcactatgaacagaagagtgtgcgtcttgatgttgctcgccgcatggataggcggctttctgcactccctggtgcaatttcttttcatctatcagctgccattctgcgggccgaacgtgattgataacttcctctgcgacctgtacccacttttgaagctagcttgcactaatacgtatgttaccgggctgtcaatgattgctaacggtggagccatctgcgctgtgacattcttcaccatcctcctgagctacggggtcatcttacactccctgaaaactcagtctctagaaggcaaacggaaggcgttttacacctgtgcttcccatgtcacagtggtcattctgttttttgttccttgtatattcctgtatgccagacctaatagtaccttccctatcgacaagtctatgacagtagtgttgacctttatcacacccatgctaaacccattgatctacacccttaaaaacgctgagatgaagtccgctatgcggaaactgtggtctaagaaggtgagcttagccggcaaatggctatatcatagctag

SEQ ID NO: 28430 - DNA, 987 bp, Artificial Sequence
  Description of Artificial Sequence: Synthetic coding sequence
atgcgaccaagcagtaatgtgacagagtttgtcctgctcggcctgacacaggaccccgacgtcaagaagaccctcttcgttatgttcctgctcatttacattgttactatggtcggaaatttgctgatctgggtgactacgatcggaagcccctcactgggtagcctcatgtatttttttttagcctatttgtccttaatggacgcaatctattcaacagcaatgtccccaaagctcatgatagacttgctgtgtgacaagatcgccatatcactgtcagcgtgtatggggcagttgtttatcgagcaccttctgggaggagctgaggtgtttctcttagtggtcatggcctatgacaggtacgtggcgattagcaagccgctgcattacctaaacatcatgaatcgcctagtctgtatcttgttgctggtggtggcaatgattggcgggttcgtccatagtgttgtccagatcgtgtttctctactcactaccaatctgtggcccaaatgtgatagatcactctgtctgtgatatgtatcctttgctcgaattgctctgtctcgatacatactttatcggactcacggtggtggctaatggcggaattatttgtatggtgatattcacctttctgttgatctcttgcggcgtcatcctgaattttctgaaaacatactctcaagaagagcgccacaaggctcttcccacttgtatttcgcacatcatcgtggtggccctggttttcgtaccgtgcatctttatgtatgtccgtcccgtgtctaatttcccatttgataagctcatgaccgtgttttacagcattatcacgcttatgctgaacccacttatctatagtctgcggcagagcgaaatgaagaacgccatgaaaaatctctggtgtgagaaattgtctatagtccgaaagagggtgagccctaccttgaatattttcatcccctcttccaaagccaccaacaggagatag

SEQ ID NO: 28431 - DNA, 930 bp, Artificial Sequence
  Description of Artificial Sequence: Synthetic coding sequence
atggagccacgaaagaacgtgacggacttcgtcctgctggggttcacgcagaaccccaaagaacaaaaggtgctgtttgtaatgttcctgcttttttacatccttaccatggtgggcaacctgctgatcgtcgtgaccgtgaccgtctctgagactctcgggtctcctatgtacttttttctcgcagggctctcctttatagacatcatctactccagcagcataagccccaggctgatatctggccttttcttcggcaacaattctatatccttccagtcgtgcatggcccagctctttattgagcacatcttcggcggttctgaggtgtttctgctgcttgttatggcgtacgattgttacgtggctatttgcaaacccctacattacctggtcataatgcggcagtgggtctgcgtggtccttctcgtggtctcttgggtcggggggttcctgcatagcgtgttccaactcagcataatttatggactccccttctgtgggcctaatgtgattgatcacttcttttgcgatatgtaccctctgctaaagcttgtttgcaccgatactcatgctattggactgttagttgtggcaaatgggggccttgcatgcactatcgtcttcctgctcttactgatttcctatggcgtgattcttcactctctcaaaaacttgtcacagaaagggcgacagaaagccttgtcaacatgcagcagtcatatgaccgtggtagtgtttttcttcgtaccttgtatattcatgtatgctcggcccgcacgcacgttccccatagacaaatcagtgagtgtgttttacaccgtcattactcctatgctcaacccgttgatttatacccttcgaaatagtgagatgactagtgcaatgaagaaactgtggagacgcgaccttatttcgtcgtccacctag

SEQ ID NO: 28432 - DNA, 948 bp, Artificial Sequence
  Description of Artificial Sequence: Synthetic coding sequence
atgaggcagaataacaatatcaccgagttcgtgctgctgggcttctctcaagatcctggagtgcagaaagcactatttgtcatgttcttgctgacgtacctggtaactgtagttgggaacttgctgatcgtggtcgacatcatagcatccccttcgctgggatctccaatgtacttttttctggcatgcctgtccttcatcgacgctgcctattcaaccaccatttccccgaaattgattgtgggcctcttctgtgacaagaaaaccatttctttccaaggatgcatggggcaattgttcatcgatcatttcttcggtggtgccgaggtgtttctgctggttgttatggcgtgtgacagatacgtggccatctgtaagcccctccattatttgacaatcatgaaccgccaagtttgctttcttcttctcgtcgttgcaatgatcgggggatttgtgcactcagcttttcagatcgtggtatattcgctgcccttttgtgggccaaatgtaattgtgcacttttcctgcgatatgcaccccctattggaattggcctgtacggatacctatttcattggactaaccgttgtggtcaactccggagctatctgcatggttatctttaacctcctactgatttcttacggcgtcatcttaagttccctcaagacctacagccaggagaagaggggcaaggccctgtctacctgcagtagcggctctaccgttgttgtgctattttttgtgccatgcatattcatatacgtaagaccggtatcaaatttcccaaccgataagttcatgacagtcttctatactattatcacgcatatgttaagtcccttgatttacacattgcgcaatagtgaaatgagaaatgcaatcgaaaagcttttagggaaaaaactgacgattttcatcatcggaggtgtgtctgtgctgatgtag

SEQ ID NO: 28433 - DNA, 930 bp, Artificial Sequence
  Description of Artificial Sequence: Synthetic coding sequence
atggcttcaacgagcaacgtaactgaactgattttcaccgggctcttccaagacccagctgtacaaagtgtgtgctttgtcgtgttcctccccgtttatcttgctactgtggtgggaaacggtttgatcgtcctgactgtgagcatcagcaagagtttggattctcctatgtatttttttctcagctgtctcagcctggtagagatttcttatagctcgaccattgctcctaagtttataattgatctactcgctaagatcaaaacaatatcgctggagggctgcttgacgcagatattcttctttcatttttttggcgtggcagagattctgctgattgtggtgatggcttatgactgttacgtggcgatttgcaagcctctgcattacatgaatatcatcagcaggcagttgtgccatcttctggttgcaggaagctggttgggtggcttctgccattcaattatccaaatcttggtaattatacagctgcccttttgtgggcctaatgtcatagatcactatttctgtgaccttcagccgttgtttaaactcgcatgcaccgatacattcatggagggagtcatcgtcctggccaatagtgggctgttctccgtgttctccttcctcatcctggtcagctcatacatcgtgattctcgtgaacctgcgaaatcattctgccgagggacgccataaggccctttcaacatgcgccagccacatcacagttgtcatcctattctttggacccgcaatcttcctatatatgcggccatccagtacattcactgaggacaagctcgtggctgtgttctatactgtgatcacacccatgctgaacccaatcatttataccttacgaaatgccgaagtgaaaatcgccatacggcggttatggagcaagaaagagaaccctggcagagagtag

SEQ ID NO: 28434 - DNA, 933 bp, Artificial Sequence
  Description of Artificial Sequence: Synthetic coding sequence
atgcagcagaataacagcgtaccagaatttatactgctggggctcactcaagatcctctgagacagaaaattgtctttgtgatcttcttgatcttttatatgggaaccgtggtgggaaatatgctaatcatcgtcaccattaaatcaagccggaccctggggtctcccatgtattttttcttgttctatctgtccttcgcagactcctgcttcagtacaagcactgccccaaggttgatcgttgatgccctctcagagaagaaaattataacttataatgaatgtatgacgcaggtatttgcgctgcaccttttcggatgcatggagatttttgtgctgattctcatggctgtggaccgatacgtggccatctgcaagccactccggtatccgactatcatgagccaacaggtgtgtatcatcctgattgttctggcttggatcggctccctgattcacagcactgcccaaattattcttgcactcaggctgcccttttgcggtccgtacctcattgaccactactgttgcgatctccagcctttactgaagctggcctgcatggatacttatatgattaacctcctcctggtatcaaactctggggcgatctgttcttcatctttcatgattctcattatcagctacatcgtaatcctgcattctctccggaatcattccgcgaagggcaaaaaaaaggcgctgtcggcctgtacttcccacatcatcgtggtcatccttttctttggaccttgcatttttatttatacccgtcccccgacaacgtttccaatggacaaaatggttgccgtgttttacacaataggaacgccgtttttaaaccccctgatctatacactccgtaacgcagaggttaagaacgccatgaggaaactgtggcacggcaagattatctctgagaacaaggggtag

SEQ ID NO: 28435 - DNA, 930 bp, Artificial Sequence
  Description of Artificial Sequence: Synthetic coding sequence
atggagaaaaagaaaaacgtgacagaattcattctgattggtctcactcagaaccctatcatggaaaaggttacatttgtggttttcctggtgctctacatgattacgctgagtgggaatcttctgatagtggttacaatcaccacttctcaggcattatcgtcacccatgtatttctttcttacccacctgtctttgatagataccgtttacagctcttcctcggccccaaaactcatcgtcgactcatttcaggagaaaaagataataagctttaatggttgtatggcccaagcctacgctgaacacatttttggagcaactgaaataatactgctaaccgtcatggcatgcgactgttatgtggcaatatgcaagcccctcaattataccacaattatgtcccactcactctgtatacttctggtggcagtcgcctgggtcgggggcttcttgcatgcaacaatccagattctgttcaccgtatggctgccattttgtggcccgaatgttatcggtcatttcatgtgtgatttgtaccccttgttgaaattagtgtgcatcgacacacacacattgggactgttcgtcgctgtgaattcaggattcatctgcctcctgaactttctcatcctagttgtctcctatgtgatcattctgcgatcattgaagaacaactccctggaagggcgctgtaaagccctctccacctgcataagccatatcattgtagtagtgcttttcttcgtgccgtgcatattcgtctacctccgaagtgtaaccacattgcccatcgataaagccgtcgccgttttctacactatggtggtacccatgcttaatcctgtggtatacacattacgtaatgctgaggtaaaatctgcaatacggaagctgtggaggaagaaggtcacatccgataacgattag

SEQ ID NO: 28436 - DNA, 930 bp, Artificial Sequence
  Description of Artificial Sequence: Synthetic coding sequence
atggccaatcgcaacaatgttacagaattcatactgttaggactaaccgaaaaccctaaaatgcagaagatcatatttgtggtgtttagtgtcatctacataaatgcgatgattgggaatgtcttgattgtggttaccatcacagcttcacctagtctccgttctcctatgtatttcttcctggcatatttgtcattcatcgacgcctgttatagtagcgtgaatacaccaaaattgatcacagattcactctatgagaacaagaccatactttttaacggctgtatgactcaggtctttggcgaacattttttccgaggggtggaagtgatcctcctgacagtgatggcctatgaccattacgtggctatctgtaagccgctgcattatacaactgtcatgaaacaacacgtgtgttctctgttggttggcgtgtcttgggttggcggctttttgcacgccacaattcagatcctgtttatttgccaactgcccttctgcggacccaatgttatcgaccactttatgtgcgacctgtatacattgataaatctcgcctgcaccaacacacacacactggggctatttatcgccgcaaactcaggctttatttgtcttctaaactgtcttctgcttctcgtgtcgtgcgtggtcatactgtatagtctgaaaacacattccctggaggccaggcatgaagccctgagcacttgcgtgagtcacatcaccgtggtgatactgtcatttataccctgcatctttgtgtatatgcggcctcccgctacactgccaattgataaggcggttgccgtgttctatactatgatcacaagcatgctgaatccgctgatctacacgctgcgcaatgcccagatgaaaaatgccattaggaagctgtgctcacgcaaagccatttccagtgttaagtag

SEQ ID NO: 28437 - DNA, 1113 bp, Artificial Sequence
  Description of Artificial Sequence: Synthetic coding sequence
atgttcagtatgaccaccgaggccttgaataattttgccttaggctgcacaaacctcctgatgacaatgattccacagatcgacttgaagcagatctttttatgcccaaattgtcggttatatatgattcctgtgggcgcattcatcttctccctcgggaatatgcagaatcagtcattcgttactgagttcgtcttgctgggtctttctcagaaccccaatgtacaggaaatcgtgtttgtagtctttttatttgtgtatatcgcaacagtaggaggtaatatgctcatagtcgttactatacttagctcacccgcgttgttagtctccccaatgtacttcttcctgggctttctgtccttcctggatgcgtgcttttccagtgtaatcacccccaagatgattgtggatagcctttacgtgaccaaaactattagcttcgagggttgcatgatgcagctttttgcagagcattttttcgccggggtggaagtcatcgtgctgactgctatggcgtacgatagatacgtggcaatttgtaaacctctccactacagctctattatgaaccgacggctctgtggaatcttaatgggcgtggcatggaccggcggactcctgcattcgatgatccaaatactgttcacattccaactgccattttgtggccccaatgtcataaaccacttcatgtgcgacctataccctctgttggaactggcttgtacagatacccacatctttgggcttatggtagtcatcaattccggatttatctgcatcatcaatttctctttgctgctcgtaagctatgctgtgatactccttagtctacggacgcactcctctgagggacggtggaaggctctcagcacatgtggaagccatatcgccgtggtgattctgtttttcgtgccatgtatatttgtgtacacacgtcccccaagcgcattctcacttgacaagatggcagctatcttctacattatacttaatccgttgttaaatcccttgatctacacttttcgtaacaaggaggtaaagcaggctatgaggcgtatatggaacaggcttatggtcgtgtccgacgagaaagagaacatcaagctatag

SEQ ID NO: 28438 - DNA, 933 bp, Artificial Sequence
  Description of Artificial Sequence: Synthetic coding sequence
atgcaattaaataacaacgtcactgagttcatcctgttaggcctgacgcaggacccattttggaagaaaattgtcttcgtgatcttcctgcgactatatctgggaacccttctgggtaacttattgatcatcataagcgtgaagacaagccaggcgctcaaaaatcccatgttcttttttctcttctatctatctctgagcgacacgtgcttgtctacatcgataacgcctaggatgatcgtggatgccctcctcaagaagactacgatttccttctctgagtgtatgattcaggtcttctcatctcatgtatttgggtgtctcgagatatttattctgattctgaccgccgtggataggtacgtggatatttgcaagccgctgcactacatgactattattagccagtgggtatgcggcgtgttaatggctgtcgcctgggtgggtagctgcgtccactcactggtccagatctttctcgcgctgagcctgcccttttgcggccctaacgttataaaccattgtttttgtgatcttcagccactcttgaagcaagcgtgtagcgagacctatgtggttaacctgttgctggtgtctaactccggagcgatctgtgcggtgtcttacgtcatgctcattttttcatacgtcatcttcttgcatagcctacgtaatcacagtgcagaggtgatcaagaaggccctttctacctgcgtctctcacatcattgtggttatcctcttctttggaccttgcattttcatgtacacctgcctagcgactgttttccccatggataaaatgatcgcagtgttttacaccgttgggacaagctttctgaatcccgtaatatacaccctgaagaacaccgaagtgaaaagcgcaatgaggaaattgtggagcaagaaactgatcaccgatgacaagcggtag

SEQ ID NO: 28439 - DNA, 990 bp, Artificial Sequence
  Description of Artificial Sequence: Synthetic coding sequence
atgcagttagtgctccttctgatgtttctcttggtattcatcggaaatactgcccctgcatttagcgtgacgctggagtccatggacattccacagaacattacggaattcttcatgttaggcttgagccagaatagtgaagtgcaacgcgtcctcttcgtggtgttcctactgatctacgtggtgaccgtttgcggtaacatgctgattgttgtcaccattactagtagccccacgctcgcatctccagtgtatttcttcctagccaacctctctttcattgacaccttctattcctcaagcatggcacctaagctaattgctgactctctgtatgagggacggacgattagctatgagtgctgtatggcccagttgtttggggctcattttctcggcggggtggaaatcattcttttaaccgtgatggcctatgacaggtatgtagctatttgtaaacccctacacaacaccacgatcatgaccagacacttgtgtgcaatgcttgtgggggtcgcctggcttggaggtttcttacactccctggtccaactcctactggttctttggttgccattttgcgggcctaatgtgataaatcattttgcctgcgatctgtatccattgctggaagtagcctgtactaatacttacgttatcggactcctggtggtcgcgaactctgggttaatctgtcttctaaattttctgatgctcgctgcctcatatatagtgatcctttacagcctgagaagccatagcgcggatggtaggtgtaaagcgctatcaacgtgcggcgctcatttcatcgtcgtagccttatttttcgtcccctgcatcttcacctatgtgcaccctttcagtaccttgcctatcgacaagaacatggctttattttacggaatcttgactcccatgctcaaccccttaatctacactctcagaaatgaggaggtcaagaacgctatgaggaaactgtttacatggtag

SEQ ID NO: 28440 - DNA, 603 bp, Artificial Sequence
  Description of Artificial Sequence: Synthetic coding sequence
atcttactgacagtgatggcatacgatcgatacgtcgctatttgtaagccccttcacaacactacgattatgacgaggcatctgtgtgccatgctcgtaggagtcgcctggctgggtggctttctccatagcctagtgcagctcctgctggtgctttggctccctttttgcggcccgaatgtcatcaatcatttcgcatgcgacctttatcctcttttggaggtggcgtgcaccaatacctacgttattgggctgttggtcgtcgctaactccggacttatttgcttgctaaactttctgatgctagccgcttcctatattgtaatcttgtatagtctcaggtctcatagcgccgatggcaggtgtaaagctttgagcacttgcggtgctcactttatcgtcgtggccctgttcttcgtaccatgcattttcacatacgttcacccattcagcactctgccaatcgataagaacatggccctcttttatggtatattaacacctatgttgaatccgctgatttacaccttacgaaacgaggaggttaagaataacacgatcaaacacttctggaagcatattctggaggaagacaagacctag

SEQ ID NO: 28441 - DNA, 981 bp, Artificial Sequence
  Description of Artificial Sequence: Synthetic coding sequence
atgtacgtttccaattgcaacccatgtgcgattcataggaaaatcaactatcctaataccaagctcgacttcgaacaagtaaataacatcacagagttcattctgttggggttgacacagaacgccgaggcacagaagctgcttttcgccgtattcacgctcatatatttcctaaccatggtcgacaacctaataatcgtggtaactattactacgtctcctgcattagattcccctgtctacttctttctgagcttcttctccttcattgacggctgcagcagttcaacaatggcaccaaagatgatctttgatcttctgaccgaaaagaaaacaatctcctttagtggatgcatgacacagctcttcgtggagcacttcttcggaggagtggaaatcattctactggtcgtgatggcatacgattgctacgtcgcaatttgtaaacccctctactacttaatcacaatgaatcggcaggtgtgtggcctgctagtggctatggcctgggtcggcggtttcctgcacgccttgatacagatgctccttatcgtgtggctacccttttgcggccccaacgtcattgatcattttatttgtgacctttttcccctgctgaaactgtcatgtaccgatacccatgtgttcgggctctttgtggccgcaaacagtggactgatgtgcatgctaatcttttcaattctgataacgagctatgttcttatcctgtgttcacaaagaaaagcactttctacatgtgccttccacattaccgtcgtcgtgctgttcttcgtcccatgtatcctggtttaccttaggcccatgatcactttccctattgataaagccgtgtccgtgttctacacagtcgtaacccctatgctgaacccactgatctacacacttcgcaacactgaggtcaagaacgccatgaaacagctctggtcacagatcatctggggaaataatctgtgcgattag

SEQ ID NO: 28442 - DNA, 930 bp, Artificial Sequence
  Description of Artificial Sequence: Synthetic coding sequence
atggagaatcagaacaacgtaaccgagtttatcctccttgggctcaccgaaaacctcgaactttggaaaatattctcggctgtgttccttgtcatgtacgtggcaacagtgttggagaatctccttatcgtggtgactattataactagccagagcctgcggagccctatgtacttcttcttaacatttttgtctctactcgatgttatgttctcatccgttgtcgccccgaaagtcatcgttgacacgctgagcaagtcgactactattagcttgaaagggtgtttaacacagctttttgtggaacattttttcggtggtgtcggcataatccttttaaccgtcatggcgtacgaccggtatgtcgccatttgcaaaccccttcactacacaatcatcatgtccccccgtgtctgttgcctaatggtggggggagcatgggtgggaggtttcatgcacgcgatgattcagctcctatttatgtaccagattcccttctgtggacccaacataattgaccatttcatttgcgacctattccaactgttaaccctagcatgcaccgatacccatatcttgggacttctcgtaaccttgaattctgggatgatgtgtgtagccattttcttgattctcattgcaagctacacggttatactgtgctccctgaaaagctactcttccaaaggcagacacaaggccctttcgacatgctcgtcacacctgaccgtggtggtattatttttcgttccttgtattttcctgtatatgcggcctgtcgtcactcacccaatcgacaaagccatggccgtttcagactcgattattacacccatgttaaacccactcatttatacattgcgcaatgcagaagtgaagtcagccatgaaaaaactttggatgaaatgggaagctctggctggaaagtag

SEQ ID NO: 28443 - DNA, 933 bp, Artificial Sequence
  Description of Artificial Sequence: Synthetic coding sequence
atggaaccccagaacacgacccaggtttcaatgtttgtactgctcggtttcagtcaaacacaggagctgcaaaagtttttgtttttgctctttctgctggtctacgtaactacaatcgtcgggaatctgctgattatggtgaccgtcactttcgactgtcgtcttcatacaccaatgtactttttgctgcgcaaccttgctctcatcgatctgtgttactctacagtcacttctccaaagatgctggttgacttcttacacgagactaaaaccattagttaccagggatgtatggcccagatttttttcttccaccttcttggcggcgggaccgttttcttcctcagcgtcatggcctatgatcgctatatagccatcagccagccattgagatacgtgacaatcatgaatacccagctctgcgtcggcctggtggttgccgcctgggtcggagggttcgtccattctatagtgcagcttgcgctgattctaccgttacctttctgtgggcccaatattctggataacttctactgcgacgtcccgcaggtgcttcgtctggcctgcaccgacacctccctgcttgaattcctcatgattagcaatagtggcctgcttgtaatcatttggttcctgcttctcctgatatcttatacggtgattctagtcatgctgcggtctcactccggtaaggctcgtaggaaggccgcttctacctgcacaacccacataattgtagtcagtatgatctttatcccctgcatatacatttacacatggcctttcacaccctttctcatggataaagcggtgtctattagctataccgtgatgacccctatgctgaacccgatgatttatacgctccggaatcaagacatgaaagccgctatgaggcgactcggcaagtgcctcgtaatctgtagagagtag

SEQ ID NO: 28444 - DNA, 936 bp, Artificial Sequence
  Description of Artificial Sequence: Synthetic coding sequence
atggaaatggagaattgcactagagtgaaagagtttatttttttgggcctcactcaaaatagggaggtcagcctggttctgtttctgttcctgttgcttgtctacgtgacaactctgctgggtaacctactgattatggtcaccgtgacatgtgaaagccgtcttcatactcccatgtatttcctgctgcacaatttgagcattgcagacatttgtttctctagtatcactgtgccaaaggtactggtcgacttgctaagcgaacgtaaaacaatctcttttaaccactgcttcacccagatgttcctgttccatctgattggcggagtcgacgtgttcagcctgagtgtaatggctctggaccgttatgtggctatctcaaaacctctacactacgccaccatcatgtcaagagaccattgtatcgggctgacagtcgccgcctggctaggtggtttcgtgcattctattgtccagatatctctcctgctccccctacccttttgtggcccaaatgtcctcgacacattctattgcgacgtacatcgggtgctgaagctggcccacactgatatcttcatcctcgaacttctgatgatctcgaacaatgggctgctgaccacactttggtttttcttgttactggttagttacatcgttatcctgagcctccccaagtcccaggctggtgagggccgccgcaaagcaatttccacctgtacctcccacatcacagtggtaactcttcacttcgtcccttgtatttacgtgtacgccaggccttttactgctttacccatggataaggctatctctgtcacattcaccgttattagcccgttgctgaacccacttatttataccctgagaaaccatgagatgaagagcgccatgcgccgtttgaagcgccgactggtcccttccgaccggaagtag

SEQ ID NO: 28445 - DNA, 936 bp, Artificial Sequence
  Description of Artificial Sequence: Synthetic coding sequence
atggagctcggtaacgtaacaagggtcaaggagtttatctttctcggcctcacgcaatcccaggatcagagtctcgtgctgttcctctttctttgtctagtctacatgaccaccttgctgggaaatttgttgatcatggtcacagtgacttgtgaatccaggcttcacacaccaatgtacttcttgctcagaaatctggctattcttgacatatgtttttcgagcactacagctcctaaggtgttgctcgacctgctgtctaaaaagaagactatcagttacacaagctgtatgacccaaatctttctctttcaccttctgggaggagctgatatcttcagcttgtccgtgatggctttcgattgttacatggccattagcaagccactccactacgtgactattatgtcccgcggtcagtgcactgcgttaatttcggcctcatggatgggcggattcgtgcatagcatagtgcagatcagtctgctgctgccactccccttttgtggcccaaacgtactcgacactttctactgtgacgttccacaggtgctgaagctgacatgtactgacactttcgcactcgaatttctgatgattagcaataatgggctggttacaaccctttggtttatctttctgctagtgtcttacacagtgattcttatgacactaaggagccaggctggagggggaaggaggaaggctatatccacatgcacctcacacatcactgtggtgacactgcatttcgtgccatgcatttacgtttatgcccgaccctttactgccctgcccacagagaaggctatctccgtcacgtttactgtgatctcccctctcctgaaccccctgatctacaccctccgcaatcaggaaatgaagtctgctatgcggcgtctgaaacggaggctggtccccagtgaaagagaatag

SEQ ID NO: 28446 - DNA, 924 bp, Artificial Sequence
  Description of Artificial Sequence: Synthetic coding sequence
atggagacaggcaacctgacctgggtttcagattttgtattcctcgggctatcacaaacccgcgagctgcaacggttcttgtttctgatgttcctcttcgtttacattaccactgtgatgggcaatatcctgataatcatcactgttacaagcgactcccagctccatacacccatgtatttcctgctcagaaatttagccgtcttggatctgtgttttagttctgtcacggctcctaagatgttggtggatcttcttagcgaaaaaaaaacgatctcctatcaaggatgtatgggtcaaattttcttttttcacttcttgggcggggccatggtgttcttccttagtgttatggcattcgaccgcctgatcgccatatcgcggcccctacggtatgttacggtcatgaatactcagctctgggtggggttggtggtggcgacttgggtgggcgggtttgtacactcaatagtgcagcttgccttaatgctgccgctcccattttgcggccccaacatcctagacaatttctattgtgacgtgcctcaggttctgaggttagcctgcacagatacatccctgctcgaattccttaaaatcagtaacagcgggctgttagatgtggtctggttcttcctcctccttatgtcatacctgttcatcctggtaatgcttcggtctcaccctggcgaggccaggagaaaggctgctagtacatgcaccacacacataattgtcgtatccatgatatttgtcccttctatttacttatatgctcgacctttcacaccatttcctatggataaattggtgtcaattggacacacagtgatgactcccatgctgaatccaatgatatatacgctgcgtaaccaggatatgcaggctgctgtccggcgcttgggtcggcacaggttagtttag

SEQ ID NO: 28447 - DNA, 957 bp, Artificial Sequence
  Description of Artificial Sequence: Synthetic coding sequence
atgaatcccgcaaaccactcacaggtagctggttttgtcctgctggggctttcacaggtctgggagctgagattcgtgtttttcactgtcttttctgccgtgtattttatgacagtggtgggcaatttattaattgtggtaatcgtaactagtgacccacacctccacactacaatgtactttctgctgggtaacttatcattcttggatttttgttattcttccataacagcacctcgaatgctggttgacctgctgagcggcaacccgactataagcttcggtggttgcttgactcagctgttcttcttccactttattggaggtattaagatattcctgttgaccgtaatggcatatgaccgttacatagccattagccagcctctgcattacacactgatcatgaatcagaccgtgtgcgctctgctgatggccgctagctgggtgggcggttttatccattccattgtgcagatagcactcacgattcagctgcccttctgcgggccagacaaacttgacaatttttactgcgatgtgccccaactgattaagctggcgtgtacagacacgttcgtgctggaactcttgatggtgagcaacaatggcctagttacgctgatgtgttttttagttctcctgggctcttacacggccctgctggtcatgctcagaagtcattcccgcgaagggcggagcaaagcactgtcaacatgtgcctcacatatcgcggtggtaaccctgatctttgtgccctgtatctacgtttacacacgacccttcagaacattccccatggacaaggccgtctccgtactctacacaattgtaacccctatgctgaatcccgcgatatatacacttcggaacaaggaggtgattatggcaatgaagaaactttggcgccggaagaaagatcccattggacccctagaacaccgcccactgcattag

SEQ ID NO: 28448 - DNA, 945 bp, Artificial Sequence
  Description of Artificial Sequence: Synthetic coding sequence
atggatcagataaatcataccaacgtcaaggagttcttttttctggagctaaccaggagccgggagctggaattctttctctttgtggtcttcttcgccgtgtatgtggccactgttctcggcaacgctttaatagtagttaccatcacatgcgaatcacgccttcatacacctatgtattttctgctgaggaataagtcggtgctggacattgtgttctcaagcatcaccgttccaaagttcctggtcgatctgttgtcagaccgaaagaccatttcttacaacgattgtatggcccagatcttctttttccactttgccggtggcgccgatatattcttcctctccgtcatggcgtacgacagatacttggccatcgccaaacctctccactacgtgacaatgatgagaaaagaagtgtgggtcgctctagtagtggcgagctgggtttctgggggactccacagcataatccaggtaattctgatgctccccttccccttttgtggccccaacacattggatgccttctactgttatgtgcttcaggtggtgaaactggcttgcaccgacaccttcgccttggagctttttatgatcagcaataatggcttagtgaccctcctgtggtttctcctcttgctcggctcttacacggtgatcttggtcatgctgcggtctcacagcggggagggcaggaacaaagccctgtcgacctgtaccagtcacatgcttgttgtgaccctccattttgtgccttgcgtgtacatctattgtagacccttcatgacgttacctatggatacaactatcagcattaataacacggtcataacccctatgttgaatcctatcatttactctttgaggaaccaagaaatgaagtctgctatgcagagacttcagagacgactggggccatcagaaagcaggaaatggggctag

SEQ ID NO: 28449 - DNA, 945 bp, Artificial Sequence
  Description of Artificial Sequence: Synthetic coding sequence
atggatcaaagaaactataccagagttaaggagttcacttttcttggcatcacacagtctagagagctgtctcaggtgttattcaccttcctgttcttagtttacatgaccactctgatgggaaactttctgattatggtgaccgtgacttgcgagtctcacctgcacaccccaatgtatttcttgctgcggaatctctccatactcgacatttgctttagctccatcaccgcccccaaagtcttgatcgatctgctgagcgagacgaaaactatcagctttagcgggtgtgtcacccaaatgttcttcttccacctgctgggcggggctgatgttttctccctctcagtaatggcattcgaccggtacatagctattagtaaacctctgcactacatgactattatgagtcgcggaagatgcacgggacttatcgtggcatcgtgggtcggcgggtttgtccattctatcgcccaaatcagcctgctcctgcccttgccattctgcgggcctaacgtactcgacacgttttattgtgatgtgccgcaggtcctcaagctcgcttgcaccgatacgttcaccctggagctgctcatgatttctaacaatgggcttgtgtcttggtttgtttttttcttcctcctcatctcatacacagtgatccttatgatgctgcggagccacacaggtgagggccggagaaaagccatctccacctgtacctctcacatcactgtggtgacccttcacttcgtgccctgcatttacgtctacgctcggccattcaccgctctgcccaccgacacggccatcagtgtgacctttaccgttatctctccgttgctgaacccaattatttacacactgagaaaccaggagatgaagttggccatgcgcaagcttaagcgcaggttggggcagtccgaacgaattctgattcaatag

SEQ ID NO: 28450 - DNA, 942 bp, Artificial Sequence
  Description of Artificial Sequence: Synthetic coding sequence
atggattccctgaaccagaccagggtcaccgaattcgtgttcctagggctcactgacaaccgcgtgctggagatgttattttttatggccttcagcgctatctacatgttaaccctgtcaggaaatattctgataataatagccacagtcttcacgccgtccctgcacacaccaatgtacttctttcttagtaacttgagtttcatagacatttgccattccagcgtcactgtgcccaagatgctggagggtctgctcctagagaggaaaactatctccttcgataattgcataacacagttgttttttctgcatttgttcgcgtgcgctgagatattccttctgatcatcgtcgcatatgataggtatgtcgcgatttgtacacctctgcactaccctaatgtgatgaatatgagggtgtgcatccagttagttttcgccctatggcttggcggaactgtgcacagccttggacagacgtttctgacaatcaggctaccctattgtggccctaacatcattgatagttatttctgcgacgtcccactggtcatcaagctggcatgtaccgatacatacttaacaggcatcctcattgttaccaatagtggtactatctcattgagctgtttcttagcggttgtaacgagctatatggtgatcctcgtgtctcttcgaaagcacagcgctgaagggaggcagaaggctctgtccacatgttccgcgcattttatggtagtggctctttttttcggcccttgcatattcatttacacacggcccgacacgtcatttagcattgacaaagtggtcagcgtgttttacactgtggtgacaccactcctaaacccgttcatctacacccttaggaacgaagaggtcaagtctgccatgaagcaactgcgacagcgacaggtgttcttcaccaaatcctatacttag

SEQ ID NO: 28451 - DNA, 939 bp, Artificial Sequence
  Description of Artificial Sequence: Synthetic coding sequence
atgaatgggatgaaccacagcgtggtcagcgaatttgtgtttatgggtctgacaaattctagagaaatacagctcttgctattcgtgttcagtttgctgttctacttcgccagtatgatgggtaacctcgtcatagtgttcaccgtaacaatggacgcacacctccactctcccatgtatttcttactggcgaatctgtctataatcgacatggccttttgtagcattacggccccaaaaatgatatgcgacatttttaagaaacacaaagctataagtttcagggggtgcatcacacaaatcttcttctctcatgcgctgggcggaaccgagatggtcctgcttatcgccatggcctttgaccggtacatggcaatttgcaagcccctccactatttgactataatgtcaccacgaatgtgcctgtacttcttggcaacaagcagcatcataggcctgattcactccctggtgcagttggtcttcgtggtggacctaccattttgcggtccgaatatctttgactccttttattgcgacctaccccgtctgttgcggctcgcgtgcaccaacacgcaagaactggagtttatggtgaccgtcaacagcggactgatttctgtcggttctttcgtgttactcgtcattagctatattttcattctatttactgtgtggaagcattcatcaggcggcctcgccaaagcactttccaccctgtccgcacacgtgacggtggtgatcctattcttcggaccccttatgttcttttacacctggccctcaccgacgtcccatctggacaagtacctggctattttcgacgctttcataacacccttccttaatcctgtgatatacacttttaggaataaagacatgaaagtcgcaatgaggagactttgtagcaggttagctcacttcaccaagattctgtag

SEQ ID NO: 28452 - DNA, 939 bp, Artificial Sequence
  Description of Artificial Sequence: Synthetic coding sequence
atggatggcgaaaatcattccgttgtgtccgagtttctgttcctcggtctcacccactcctgggagatccaactgctgctgttggtctttagtagtgtgctttatgtggctagcataacagggaatattctgatcgtcttctctgtaaccacagatccacatttacactctcctatgtattttctgttggcctcactcagcttcatcgatcttggtgcgtgctctgtcacctcacccaaaatgatttacgacctgttccgcaagcgaaaggttattagctttggggggtgtattgcacagatcttctttatccatgtggtgggcggtgtcgagatggtgctgctgatcgccatggcattcgatcgttacgttgccctgtgcaagcctttacattaccttactataatgtcacccagaatgtgtctttcgttcctcgcagtagcttggaccttgggggtgagtcacagcctatttcaactcgcctttctggtcaacctggccttttgtgggcctaacgtccttgactcattttattgtgacttgcctcgacttctccggctcgcatgcactgatacttacagactgcaatttatggtaaccgttaatagcggattcatatgtgtgggaacatttttcattcttctgatcagttatgtgttcattctgttcacggtctggaagcattcatccggcggcagttccaaggccttgtcgaccctctcagcgcattcaacagtcgttttactcttcttcgggccgccaatgtttgtgtataccaggccccaccctaactcccagatggacaagttcctcgcgatcttcgacgctgttcttaccccttttttgaacccagtcgtatacaccttcaggaacaaagaaatgaaggctgccattaaacgagtgtgtaagcagctagttatttataagagaatctcatag

SEQ ID NO: 28453 - DNA, 918 bp, Artificial Sequence
  Description of Artificial Sequence: Synthetic coding sequence
atggtcacagaatttatattcctggggttgagtgattcccaggggttgcaaacctttttattcatgctgttttttgtgttctacggcgggatcgttttcggtaatcttctgattgtaatcacagtcgtcagtgatagtcatctccattccccaatgtacttcttgttggccaacctcagcctgattgatctgtcactgagctcagtgaccgcaccaaagatgatcacagacttttttagtcaaagaaaggtgattagcttcaaaggctgtctggttcagatctttctccttcacttcttcggaggtagcgaaatggttattttgatcgccatggggtttgacaggtacatcgcgatttgtaagcctctccactataccacaattatgtgtgggaatgcttgcgtgggaatcatggctgttgcatggggcatcggttttctgcactctgtgagtcagttagctttcgccgtccaccttcccttttgtggccctaatgaagtggactcattctactgtgacctgcctcgggttatcaaattagcttgcacagatacttataggcttgatattatggtgatcgccaattccggggttttgaccgtctgtagtttcgttcttctgattatcagctataccatcatactgatgacaatccaacaccgcccattggacaagagttctaaggctttatccaccctgactgcacatataaccgtggttttactgttctttggtccctgcgttttcatctacgcctggccctttcccatcaaatctctggacaaattcttagcagtgttctacagcgtaatcactcccctccttaacccgataatttataccctgcgtaataaagacatgaaaactgcaatccgccagctgcgaaagtgggacgcccatagctccgtcaaattctag

SEQ ID NO: 28454 - DNA, 885 bp, Artificial Sequence
  Description of Artificial Sequence: Synthetic coding sequence
agcccaggcccagtgtttagttatccaccccctagcctgctgttcattatccccgtgaaactcggcttagaacatttcttccacatcaaggtgactgctgaggctatttcctggaatgagtccacctccgaaaccaataatagtatggttaccgaattcattttcttgggtttgtctgactcccaggggctccaaacttttcttttcatgctcttttttgtcttttacggaggaatcgtgtttgggaacctgctgatcgttattacagtggtttctgactcccatctgcattccccgatgtatttcctgttagcaaatctgtcactaatcgacctaagtctgtcctctgtgaccgctcccaagatgattaccgactttttcagccaacgcaaagttatctcttttaagggatgtctggtacagatctttctcctgcactttttcggcggttccgagatggttattctgatcgcaatgggtttcgatagatacattgctatttgcaagcctctccattacacaaccattatgtgtgggaacgcctgcgttggaatcatggcagtagcttgggggatcggcttcctgcactccgtctctcaacttgccttcgccgttcatctgcctttctgtggacccaatgaggtggactccttttattgcgacttgccccgagtgattaagttggcttgtacagatacgtaccggctcgacattatggtcatcgcaaactctggagtgctgactgtgtgttcattcgtgttgttaattatcagctacaccatcatccttatgactattcagcatcgcccacttgataagagcagcaaagctctctcaaccttgaccgcccatatcaccgtcgtcctgttatttttcggcccttag

SEQ ID NO: 28455 - DNA, 939 bp, Artificial Sequence
  Description of Artificial Sequence: Synthetic coding sequence
atggacggagagaaccacagcgtggtttcagagtttctgtttttgggcttaactcattcatgggaaatccagctgttgttgctggtgttcagcagcgtactctacgttgcctctatcaccggcaatatttttattgtgttttccgtgacaactgatccccacctgcactcacctatgtacttcctgctcgcatcactctcttttattgacctcggcgcgtgttctgtgacgagtccaaagatgatctacgatctgtttcggaagagaaaagtgattagcttcggggggtgcatcgcccagatttttttcattcatgttataggcggtgtggaaatggttctattaatagccatggcttttgacaggtatgtggccttatgcaagccacttcattatctgaccataatgtctccgcggatgtgtttgtctttccttgctgttgcctggacgttgggagtttctcactccctctttcagctcgccttcctagtgaatttggctttttgcggccccaatgttttagactccttttactgcgacctgccgcgattactccgtctggcatgcaccgatacctaccgcctgcagttcatggttaccgttaattccgggtttatttgcgtggggaccttttttattctactgatcagctatgtgtttatcttgtttaccgtgtggaaacacagctccggcggttcatccaaggcacttagcacactcagcgcccattccacagtggttctcctcttcttcggtcctcccatgtttgtttacacaaggcctcacccaaattcacagatggacaaattcctggctatctttgacgccgttctgaccccctttttgaaccctgttgtgtacacctttagaaacaaggagatgaaggccgccattaagcgcgtatgtaagcagttagtcatatacaaaaagatatcctag

SEQ ID NO: 28456 - DNA, 939 bp, Artificial Sequence
  Description of Artificial Sequence: Synthetic coding sequence
atggatggagagaatcatagcgtggtgtctgaattcctgttcctcggcctaacacactcttgggaaattcaactgttgctgttggttttttcttctgtactatacgtggccagtatcacaggaaacatcctaattgtgtttagcgtaactactgatccacatcttcacagcccaatgtatttcctcctggcttctttaagtttcatagatctgggggcatgctcagtgacatcccccaagatgatctatgacctgttccgaaagcgtaaggtcattagttttggcgggtgtatagcacagatttttttcatacatgtggtgggaggcgtggaaatggtgctcctgattgctatggcctttgatagatacgtcgcactatgtaaacccctgcattacctgacgatcatgtctccgcgtatgtgcctctcctttttggcagtggcatggacactcggggtctcacactcactctttcagctcgctttcttggttaatttggcattttgcggccctaacgtcctcgactcattttactgcgatcttccgcgcctgttaaggctggcctgcaccgacacctaccggctccagtttatggtgactgtgaactctggctttatttgcgtgggaaccttctttattctcctcatctcatatgttttcatcttgtttactgtctggaagcacagtagcggggggtcatccaaggcccttagcacactgtccgcccactctacagtcgtgttgttattctttggccctcctatgtttgtctacactaggccacacccaaatagtcagatggacaagttcctggccatcttcgacgccgtactcacaccattcctcaatcctgtcgtatataccttccgcaacaaggagatgaaagcagccattaaacgggtttgtaagcagctagtgatctacaaaaggattagctag

SEQ ID NO: 28457 - DNA, 939 bp, Artificial Sequence
  Description of Artificial Sequence: Synthetic coding sequence
atggatggtgagaatcactcagtcgtgtctgaattcttattcctgggtctgacacacagttgggaaatccagctgctactgttggtgttctcctcggtattatacgtggcctccatcactgggaacattcttatcgtgtttagcgtgactacagacccgcaccttcatagtcctatgtattttctgctcgcatctttaagttttatcgatctcggagcatgcagcgtcacaagcccgaaaatgatctacgacttattccgcaagcgtaaggtgattagctttggagggtgcatcgcacagattttttttatccatgtcgtcggcggtgtcgagatggtgctactaatagcgatggcctttgaccggtatgtggctctctgcaagcctctgcactatctgacaatcatgtctcctagaatgtgcctgagcttcctagctgtagcctggacactgggtgttagtcattcccttttccaattagcctttctcgtcaatctagctttctgcgggccaaatgtcctggactctttctattgcgatctgcccaggctgctgcgactggcttgtactgacacctaccgcctgcagttcatggtgaccgtcaactcaggcttcatttgtgttgggacctttttcatattgctaatctcatacgtgttcatactcttcacagtttggaaacattcttccggcggctccagcaaagctctttcaacactgtcagcccacagcaccgtggtgctgctcttctttgggccccccatgtttgtgtatactaggccccatcccaactctcagatggacaagtttcttgccatttttgatgccgtgcttaccccgttcctgaaccccgttgtgtacacatttcgtaataaagagatgaaggctgcaatcaagcgggtatgcaagcagctggtgatatataagcgcattagttag

SEQ ID NO: 28458 - DNA, 918 bp, Artificial Sequence
  Description of Artificial Sequence: Synthetic coding sequence
atggtgacagagttcattttcctcggattatctgactcacaagagttgcaaacatttctctttatgctcttcttcgttttttatgggggaattgtgttcgggaaccttctgattgtgatcactgttgtcagtgacagccacttacactcacccatgtatttccttctggcaaatttatcactcatcgatctgtccctaagcagcgtgacagcgcccaaaatgataactgatttctttagccagaggaaggtgattagtttcaaaggatgccttgtccagatctttctccttcacttcttcggcggctccgaaatggtgattctgatcgccatggggttcgatcgctatatcgccatctgcaaaccacttcattataccaccataatgtgcggcaatgcttgcgtgggaatcatggcggtcgcctggggcataggttttcttcatagcgtctcccaattggcctttgccgtgcacctacccttctgtggccccaatgaagttgattccttctattgtgatctacctcgcgttatcaagctggcatgtaccgatacataccgtctggacattatggtgatcgcaaacagcggcgtattgactgtgtgttccttcgtgctgctaatcatctcatatactatcatcttaatgacaatccaacattgcccactggacaagtctagcaaggccctcagcacgcttaccgcccatatcactgttgttctgttgttctttggaccctgcgttttcatatatgcatggccctttcccataaagagcctggacaagtttctggccgtcttctattcggtgatcacgcccctgttgaatcccatcatctacaccctgcgcaataaagacatgaagacagctatcagaaggctgcgcaagtgggatgcacactcttccgtgaagttttag

SEQ ID NO: 28459 - DNA, 918 bp, Artificial Sequence
  Description of Artificial Sequence: Synthetic coding sequence
atggtgaccgagttcatttttttgggtctgtccgacagccaggagcttcagacatttctcttcatgctgttcttcgtgttttacgggggtatcgttttcggaaaccttctcattgtgatcacagtggtcagtgacagccatctgcattctcccatgtacttccttctggctaatctgtcactgatcgatctgtccttgtcctccgtgactgcccctaagatgattactgattttttctcacagaggaaggttatttcattcaaggggtgcctggtgcagatctttttactgcatttttttggcggatccgaaatggtcatactaatagccatggggtttgatagatatatagcgatctgtaaacccctgcattataccaccataatgtgcgggaatgcgtgtgtgggtattatggctgtgacatgggggatcggattcctgcatagtgttagtcagcttgccttcgcagttcacctgctgttttgtggcccgaatgaggtcgactctttttattgcgacctgccacgcgtgatcaagttagcttgcacggacacctacagacttgacattatggtgattgccaactctggggtcctaactgtctgctccttcgttctgctcataatttcttataccatcatactaatgaccattcaacaccgccctctggacaagagcagcaaagccttatccaccctgaccgcgcacatcaccgtcgtcctcttgttctttggaccatgtgtcttcatctatgcctggccctttcccattaaaagcttggacaagttcctggctgtgttttattccgtgataacaccccttctgaaccctattatctacactctccggaacaaagacatgaaaacggcaatacgtcagctgcgtaagtgggacgcacactcatccgtgaagttttag

SEQ ID NO: 28460 - DNA, 939 bp, Artificial Sequence
  Description of Artificial Sequence: Synthetic coding sequence
atggatgaggccaaccactcagtggtgtcggagttcgtgttcttgggactcagcgatagccggaagattcaactgctgctgttcctgtttttcagtgtgttctatgtgtcaagcttgatgggaaacctgctcatcgtgctgacggttaccagtgacccaagactgcaatctcctatgtatttcctgctagcaaacctctccatcatcaatctggtgttctgcagtagtaccgccccaaaaatgatctatgatctatttagaaagcacaagacaattagctttggtggttgtgtagtgcagatattctttatccacgctgtgggcgggacagagatggtgttactaattgcaatggcatttgacaggtatgtggcgatttgcaaaccgttgcactatctcacgataatgaatccccagcgctgcatactgtttctcgttatttcttggatcataggaatcattcatagcgtcatccagcttgcctttgtagtggatctgctgttttgtggaccaaatgaactggattccttcttctgtgatctgcctcgattcataaaacttgcctgtattgagacctatactctgggtttcatggtcaccgctaactctggctttatcagtctcgctagtttccttatcctcatcatctcatacatctttattctggttactgttcaaaagaaatcttcaggaggcatatttaaggctttttcaatgctgagcgctcacgttattgtcgtggtgctggtgttcggacccctgatcttcttctacatctttcccttcccaacttcccatctggacaagtttctggccatattcgatgcagtcatcacacctgtgctgaatcccgtgatctacacattcagaaacaaggaaatgatggtcgccatgaggcgtcggtgctcccagttcgtgaactacagcaagatcttttag

SEQ ID NO: 28461 - DNA, 936 bp, Artificial Sequence
  Description of Artificial Sequence: Synthetic coding sequence
atggcccatacgaatgaatctatggtgtcggaatttgttctgctgggcttgtcaaacagttggggattacaattgttcttctttgctatcttttccatcgtgtacgtgacatccgtgctggggaatgttttaatcatcgtgatcatcagcttcgattctcatctcaatagccccatgtattttctgctttccaaccttagctttatcgacatctgccagtctaactttgccactccaaagatgctagtcgatttttttatcgagaggaagaccattagttttgagggatgcatggcccagatcttcgtgctccactctttcgttggaagcgagatgatgctgctcgtggcaatggcgtatgaccggtttatcgctatttgtaaaccactccattattcaacaatcatgaaccgacggctatgcgtgatcttcgtctcgatatcttgggccgtgggcgttctccattcagtgagccacttggctttcactgtcgatctgccattctgtggcccaaacgaagtcgactcattcttctgtgatcttccactcgtgattgaattggcatgtatggatacttacgagatggagatcatgacactcaccaactccggcctcatctcactctcttgtttccttgccctaattatcagctataccattatccttatcggcgtgaggtgccggtcctccagcggctcatccaaagccctatctaccttaaccgcccatattaccgtcgtgattctgttcttcggcccgtgtatctacttctatatctggccctttagccgtttgcctgtcgacaagtttctttcagtgttctacactgtatgtaccccactcctgaatccaatcatttatagcctgcgaaacgaagatgtaaaggccgccatgtggaaactgagaaatagacacgttaattcctggaaaaactag

SEQ ID NO: 28462 - DNA, 915 bp, Artificial Sequence
  Description of Artificial Sequence: Synthetic coding sequence
atggaaagagcaaatcattctgtggtctccgaattcatcctgctgggcctgtctaagtcccagaatctccagatcctctttttcctcggattcagcgtcgtgtttgtgggtatcgtgctgggtaaccttctgatccttgtcactgtcactttcgatagcctgctgcatacccctatgtatttcctgctgtctaacctttcgtgcattgatatgattctggcatccttcgctaccccaaagatgatcgtggattttttgagggagagaaaaacaatctcctggtggggctgttattcacaaatgttctttatgcatctgctgggcggctcagaaatgatgctgctggtggctatggctatcgatcgctatgtcgccatttgcaagccgctacattatatgactattatgtcgccccgagtgctcactggattgcttttgtcgtcctacgcagttggattcgtccactcgagtagtcagatggcgttcatgcttaccctcccattctgcggacctaacgtcatcgatagcttcttctgtgacctacctttagtgataaagttggcttgcaaagacacttacatcttgcagcttctggtaatcgcagacagtggtcttctaagcctcgtctgctttctgcttttactcgtatcatacggcgtcatcattttctctgtgcgatatagagccgctagcagatccagtaaagcgttctcaacgctgtcagcacacatcaccgtggtgacactgttttttgcgccatgtgtgttcatctacgtgtggccgttttctagatattccgttgacaagatcctcagtgtgttttatacaattttcacccccctgctgaatcccattatttataccctgcgcaaccaggaggtgaaggccgcaataaagaaaaggctttgtatctag

SEQ ID NO: 28463 - DNA, 933 bp, Artificial Sequence
  Description of Artificial Sequence: Synthetic coding sequence
atggacccacagaactatagtttagttagcgaatttgtcctgcacggtctttgtacatctcgccacctgcagaatttttttttcatctttttcttcggtgtgtatgtggccatcatgcttggcaatctgctgattctcgtcacagtgataagcgatccctgccttcattcctcacctatgtacttcctgctggggaacctagccttcctggacatgtggttggcgtccttcgccacacctaagatgatccgtgatttcctatccgatcagaagctgatttctttcggaggatgcatggcgcagattttcttcttgcattttaccggcggcgcagagatggtccttctagtgagtatggcatacgatcgttatgtggctatctgtaaaccgctgcattatatgacactaatgtcatggcagacttgcattaggctagtgctggcgtcctgggtagtcggcttcgtgcactcgatttcccaggtagcattcacggtgaacctgccatactgcgggccaaacgaagtggacagttttttttgcgatctgccgctggtcattaagctggcctgtatggacacctatgtgctggggattattatgattagtgattcgggattactctctctgagttgtttcctgttgctgctaatttcctatactgtgatccttttggcaattaggcaacgggccgccggaagtacatccaaagcactctccacctgttctgcacacatcatggtcgttaccttgtttttcggaccttgtatatttgtgtatgtgcgacctttctcccgcttctcagttgataagctgttgagtgtcttctacaccattttcacaccactgctcaaccctattatctacaccctgcgaaatgaggagatgaaagctgcaatgaaaaagttacagaaccggagggtcaccttccagtag

SEQ ID NO: 28464 - DNA, 1047 bp, Artificial Sequence
  Description of Artificial Sequence: Synthetic coding sequence
atgctgacatccctgacggatctctgcttcagccccatccaagtggcagagatcaaatccctgccaaagagtatgaacgaaacaaaccacagtagggtaacagagttcgtgctgctggggctgtcctcgagccgcgaacttcaaccgtttttgttcctgaccttctctctcctataccttgccatcctgctaggcaacttcttaattattctgacggtgacgagcgactctcggcttcatacccctatgtacttcctgctggccaacttatcctttatcgacgtttgcgtggcctcattcgcaactcctaaaatgatcgcagatttcctggtggaaaggaagacaatttcattcgacgcgtgtttggcccagatcttttttgtgcatttgttcaccggttccgagatggttctgctggtgtcaatggcttacgacagatatgttgccatttgcaagccacttcactacatgacagtcatgtcacggagggtgtgtgttgtcctcgtgttgattagttggtttgtgggttttatccataccaccagccagctggcattcaccgtgaatttgcctttttgcggcccaaacaaggtggattctttcttctgcgaccttcccttggtgaccaaactagcatgtattgatacatacgtcgtgagcctgttgattgtggcagactctggttttctgagcctctcaagcttcctcctgttagtggtgtcatatacagtgatactcgtcaccgtccggaaccgaagtagcgcctccatggctaaggctcgttctactttaactgcacatattacagtggttactctcttttttggaccatgtatctttatctacgtctggccattcagctcttactctgtggataaggtgctcgccgtgttttacacaatctttactctgatattaaacccggttatatataccctgagaaacaaagaggtgaaggctgcgatgtcaaagctgaaatcgcgttacctcaaacccagtcaggttagcgtggtgatccggaatgtgttgttcctcgagaccaaatag

SEQ ID NO: 28465 - DNA, 1032 bp, Artificial Sequence
  Description of Artificial Sequence: Synthetic coding sequence
atggcactctacttctctctcatcctgcatgggatgtctgacctgttctttctctcaactggtcatccccgggcctcttgccgcatggaagccatgaagctgcttaaccagtctcaggtctcagaattcatcttactcgggttaacgagctctcaggacgttgaattcttgctgtttgccctgttctcggtcatatacgtggtgacggttctgggcaacttgctaataattgtgaccgtttttaacacgccaaatctgaatactcctatgtatttccttttaggcaatctttctttcgtggatatgaccctggcaagctttgccacacctaaagtcatcttgaatctgctgaagaaacaaaaagttatctcttttgctggctgcttcacccaaattttcctcctgcatctgcttggcggagtagaaatggtactgttggtgtcaatggctttcgaccgctatgttgcaatctgcaaaccactacactacatgacaattatgaataaaaaggtgtgtgtgttgcttgtcgtcacttcctggctccttgggttgttgcactcaggtttccagattcccttcgcagtcaatttgcccttctgcgggccaaacgtcgtggattcgatcttctgtgacctccccctggttaccaaactcgcttgtattgatatctactttgtgcaggtcgtgatcgtggctaactccggtataatctccttgtcttgttttataatcttgctgataagctattcactaattctcatcactatcaaaaaccactcaccaaccggccagagcaaggccaggtcaaccctgacagctcatataacggtggttatcctcttcttcggaccatgcatttttatctacatctggccattcgggaatcacagtgttgataaattcttggccgtcttctacaccattattacccccatcctgaatccaattatttataccctgcgcaacaaggagatgaaaataagtatgaagaagttgtggcgagcttttgtcaacagccgtgaagacacgtag

SEQ ID NO: 28466 - DNA, 945 bp, Artificial Sequence
  Description of Artificial Sequence: Synthetic coding sequence
atggatgtcggtaacaagagtactatgagcgagttcgtgctactgggcctgagcaatagctgggagctgcagatgtttttcttcatggtgttctcactgctgtacgttgctacaatggtagggaactctcttatagtcataaccgtcattgtcgatcctcacctgcattcacctatgtacttcttgctaactaatctcagcatcattgacatgagtctggcctccttcgccactcccaaaatgataaccgattatttgaccgggcacaaaacaatttcatttgatggttgtcttactcagattttctttctacacctctttaccggtactgagatcattttattgatggccatgagtttcgacagatatattgccatatgcaaacccttgcattacgctagcgtaattagcccgcaggtgtgcgtggccctggtagtcgcgagctggattatgggagttatgcactcgatgtctcaggtgatctttgctctgaccctgcctttctgtggtccctatgaagtcgacagttttttttgcgacttgcctgtggtgtttcagttagcgtgtgtggatacctatgtgctcgggctttttatgataagcacctcaggcataattgctctcagttgcttcatagtgttattcaatagctacgttattgtcctggtcacggtgaagcaccactcatcccggggctcgtctaaagcattatcgacctgcactgctcactttattgtcgtgtttttgtttttcgggccatgcatctttatttacatgtggccattgtcaagcttcctcaccgataagattctgtctgtgttttataccatcttcacccctacccttaaccctatcatctacactctgcgcaaccaggaggtgaagattgccatgcgcaagctgaagaacagatttctcaatttcaacaaggcaatgcccagctag

SEQ ID NO: 28467 - DNA, 972 bp, Artificial Sequence
  Description of Artificial Sequence: Synthetic coding sequence
atggacaaaagtaatagttctgttgtgtcagaattcgtccttttgggactatgctcctctcagaagctacaattgttctacttttgtttcttctctgtcctatacaccgtgatcgtgctggggaatctgctgatcatcctgaccgttacatctgacacttcacttcatagccctatgtatttcttacttggcaatctatcttttgtggacatctgccaggcctcattcgcaactcccaagatgattgcagatttcctgtccgcccacgaaacaatatccttttcagggtgcatcgcgcagatcttctttattcacctgttcaccggtggcgagatggtgctattggtctccatggcttacgacaggtatgtggctatctgtaaacctctgtactacgtggtgataatgtctagacgtacttgcacagttctcgttatgatcagttgggcagtgtccctggtccataccctctctcagctgtcctttacagtcaaccttcctttttgcggtcccaatgtagtcgactcttttttttgcgatctcccgcgagttacaaagctcgcctgtcttgattcttacataatcgaaatacttatcgtggtcaactctggaatcctgagcttatctactttctctctgctcgttagtagttatatcattatcctggtgacagtttggcttaagtccagtgccgccatggcaaaggcattcagcactctcgcgagtcacattgctgtggtcattctcttcttcggcccttgcattttcatctacgtttggcccttcacgataagcccattagataagtttctggccattttttacactgttttcacccccgtgctcaatcccatcatctacacactgcgcaaccgcgatatgaaagcagccgtacggaagatcgtcaatcactacttacggccacggagaatcagcgaaatgtcccttgtggtcaggacgtcttttcattag

SEQ ID NO: 28468 - DNA, 939 bp, Artificial Sequence
  Description of Artificial Sequence: Synthetic coding sequence
atggacctgaagaacggctccctagttacagagttcatcctgctgggcttcttcggaagatgggagctccagattttcttctttgttaccttctctcttatatacggagccacagtcatgggcaacatcctgatcatggtgacagtgacttgccgctctacactccatagccccctgtacttcttgctgggaaacctgagctttcttgacatgtgcctgtctaccgcgacaaccccaaagatgataatagaccttctgacagaccataagaccattagcgtatggggttgcgtgacccagatgttctttatgcactttttcggaggcgccgaaatgactctcctgataatcatggcgtttgacagatacgtggccatctgtaagcccctgcactaccggaccatcatgagccacaaacttctcaaaggcttcgcaatcctgtcgtggataatcgggttcctgcacagcataagtcagattgtgctcacaatgaacctgccattttgtggccataatgtgatcaacaatattttttgcgacctacccttggtaattaagctggcctgtatagagacctacacattggagctcttcgtgattgctgatagcggcctgctgtcctttacttgcttcatcttgctgctcgtttcttatattgtgatcctagtctcagtgccgaaaaagtcttcccatggactcagcaaggccctttcaacactctccgcgcacatcatcgtggtgactttgttttttggcccgtgtattttcatctacgtctggcccttttcctccctagcaagcaataagacccttgccgtgttttatacagttataacacctctgctcaacccctccatctatacgttgagaaataagaaaatgcaggaagctattagaaagctccggttccagtatgtctcatccgctcagaatttctag

SEQ ID NO: 28469 - DNA, 942 bp, Artificial Sequence
  Description of Artificial Sequence: Synthetic coding sequence
atggagaccgctaattacaccaaggtgaccgagtttgtcctgacaggcctctcccagacaagggaagtccagttggtgctgttcgtgatctttctgtcgttttacctatttatcctgccggggaatatcctgattatctgtaccatcaggctcgatccgcacctcacgtctccgatgtacttcctcttggccaacctggctttactggatatatggtactccagtatcaccgctccaaaaatgctcatcgatttttttgtagagagaaaaatcataagcttcggcgggtgtattgcccagctttttttcctgcacttcgtgggtgcttcagagatgtttctgttaacagttatggcgtacgaccggtatgcagccatatgcaggcccctccactatgccaccattatgaaccgaaggttgtgctgcatcctcgtggcgctctcctggatgggtgggttcattcactccataattcaggtggctctaatcgtcagattgcccttctgtgggcccaacgaactcgattcctacttttgtgacattacccaggttgtccgcatcgcctgtgcgaataccttccccgaagagctcgtgatgatttgctcaagtggcttaatcagtgtcgtgtgttttattgccctgctgatgagttatgcctttctgttggccctgctgaaaaaacactccggaagcggagaaaacacaaaccgagccatgtcgacttgctacagtcacatcacaatcgtcgtcctgatgttcgggccctctatctatatctatgcacggcctttcgacagcttttccctcgacaaggtggtttctgtgttccacacagttatttttccgctgttgaatccaataatctatacattacgcaacaaagaagtgaaagccgccatgagaaaggtggttactaagtacatattatgtgaagagaagtag

SEQ ID NO: 28470 - DNA, 942 bp, Artificial Sequence
  Description of Artificial Sequence: Synthetic coding sequence
atggagacagctaattatacaaaggtcactgaattcgtgctaaccggcctatcacagacaccagaggtacagcttgttttatttgtgattttcttatccttctacctttttatcctccctggaaatatcttgatcatctgcactatcagtctagacccccatttgacttctcctatgtacttcctattagctaacctagccttcctggacatttggtattccagtatcacagcgcctgaaatgttgattgatttctttgttgaacgcaaaataatttcctttgatggatgcattgcgcagctgttcttcttgcatttcgccggcgctagcgagatgttcctccttacagtaatggccttcgatttgtacaccgcaatctgtcgccccttgcattacgctactatcatgaaccagaggctgtgttgcattcttgttgccctcagctggagaggcggctttattcatagtatcatccaggttgccctgattgttaggcttcccttctgcgggcccaacgaactggacagttatttttgtgatatcacgcaagtagtacgtatcgcctgcgctaacactttccctgaagagcttgtgatgatatgctcttccgggttaatctctgtggtctgcctgattgcactcctgatgtcctacgcctttctgctggccctgtttaagaagctttctgggtctggcgagaacactaaccgcgcaatgtccacatgctattcacacatcacgattgtggtgctgatgtttggtcctagtatctacatttatgcccgaccctttgacagtttttccttggacaaagtggtctccgtgtttaacacacttattttccctcttcgaaacccaataatctataccctccggaataaggaggtcaaggctgccatgagaaagctcgtgacgaaatatatattgtgcaaagaaaagtag

SEQ ID NO: 28471 - DNA, 924 bp, Artificial Sequence
  Description of Artificial Sequence: Synthetic coding sequence
atggagtccgaaaatcgcactgtgattagagagttcatcctacttggcctgacacagtcgcaggacatccagcttctcgtttttgtcctggttctgatcttctatttcatcattttgcccggcaatttccttatcatttttacaatcaagtctgatcccggactcaccgccccattgtacttcttcctgggcaatctggccttcttggacgctagctattcatttatcgttgcccctagaatgcttgtggactttttgtcggccaagaagataattagctacagggggtgtatcacccagctattctttctgcattttctcgggggaggcgaaggcttgctgttggttgtaatggcattcgatcgctacatcgctatctgtcgcccattgcactacccgactgtgatgaacccccgtacatgctacgctatgatgttagccttatggctggggggcttcgtccactccattatccaggtcgtgcttatcctgcgccttcccttctgcggcccgaaccagcttgataatttcttttgtgacgttccccaggtgatcaaactagcttgcacagatactttcgtcgtggaactcctgatggtatttaatagcggtctaatgactctgctttgtttcctagggctgttggcctcatacgctgtgatcctctgcaggattcgtgggtcgtccagcgaggccaagaataaggctatgagcacctgtatcacacacatcatagtgatatttttcatgttcggtcccggcatattcatatacaccagaccttttagagccttcccggcggataaggtggtgtccctgtttcacaccgtgatatttcctctcctgaatccggttatttacacactgcggaatcaagaggtgaaggcatcaatgaagaaggtgttcaacaagcatatcgcttag

SEQ ID NO: 28472 - DNA, 66 bp, Artificial Sequence
  Description of Artificial Sequence: Synthetic coding sequence
atggagtccgaaaatagaaccgtcatccgagaattcatcctcctcggactgacacagagtcagtag

SEQ ID NO: 28473 - DNA, 441 bp, Artificial Sequence
  Description of Artificial Sequence: Synthetic coding sequence
atggagtctgagaaccggacagtgatcagggaattcatcctgctcggcctcacccaatcccaagatattcagcttttagtgttcgttctcgtgcttattttttacttcataatccttcccggaaattttttgataatctttactatcaagagcgaccccggactgaccgctccattatatttttttcttgggaacctggctttcctcgacgccagttactcgtttatcgtggcaccacgcatgttggtggatttcctgtccgcaaaaaagataattagttaccgcggatgcatcacacaactatttttcctacactttttagggggcggggaaggtctgcttctggtcgtcatggcctttgacaggtatatcgcgatttgccgcccattgcactaccctaccgtgatgaacccgcgaacatgctacgctatgatgttgtag

SEQ ID NO: 28474 - DNA, 951 bp, Artificial Sequence
  Description of Artificial Sequence: Synthetic coding sequence
atgaaaattgcaaataacaccgtagttacggagtttatccttctcggattaacacagagtcaggacatacagctgctggtattcgtcctgatccttatattctacctgatcattcttccaggcaatttcctgattatctttacaattcggagcgatcctgggctgacagcgccactctaccttttcctcggtaatctggctttcctcgacgcttcgtattcttttatcgttgcaccccggatgctagtcgactttctctccgagaagaaggtgattagttatagagggtgcattactcagctctttttcctgcattttctcggcggtggagaggggctgcttcttgtggttatggcttttgacagatatattgcaatttgtcgccctctgcattgtagcaccgtgatgaatcctcgagcatgctacgcaatgatgctcgcactgtggctcggaggctttgttcacagcattattcaggtggtgctgatccttaggctgcctttttgtggaccaaaccaattggacaacttcttttgcgacgtgaggcaggtgatcaagctggcctgcactgacatgttcgtcgtggaactgcttatggtctttaatagcggtctcatgaccctgctttgttttctgggcctgctggcatcttacgccgtgatcttgtgccacgtccgcagggctgctagtgaggggaaaaacaaggcgatgtcaacctgtaccactagggtgatcatcattctccttatgtttggcccggccatctttatctacatgtgtcctttcagagcactgcctgccgataaaatggtatccttatttcacaccgtcatctttccactgatgaatcctatgatttatactcttcggaaccaagaagtcaagacctccatgaagcggcttctgtcacgccacgtagtgtgtcaggtcgactttatcatccggaattag

SEQ ID NO: 28475 - DNA, 927 bp, Artificial Sequence
  Description of Artificial Sequence: Synthetic coding sequence
atggagacacaaaacctgaccgtggtgacagagttcattctgttaggcctgactcagtcccaggatgcacagttgctggtattcgtgctagttcttattttttatttgattatcttgccaggaaatttcttgataatctttacgatcaaaagcgatccaggcctgaccgccccgctctatttttttttgggaaacctggctctgctcgatgcctcctactcattcattgtggttccacgcatgctggtcgattttttgtccgagaagaaggttatttcatacaggtcttgcattactcagctgttcttccttcactttttgggggccggtgaaatgttcttgctcgtagtgatggctttcgacaggtacatcgcaatatgcagacccctacactacagtaccatcatgaatcccagggcgtgttacgccttgtctctcgtgctgtggctaggaggattcatccacagcatcgtacaggtggcgctgatactccacttaccattctgtggtccgaatcaattggataattttttttgtgacgttccccaggtgattaagctggcctgcacaaacaccttcgtggtcgagctgctgatggtctcaaactctggactgttgtcacttctgtgcttcctggggctgctcgcctcttacgccgtgatcctgtgccggatacgtgaacacagctccgaggggaagtctaaggcgatttctacttgcactactcatattatcataatctttcttatgttcggtccggcaatattcatttatacctgcccattccaggccttccccgccgataaggtggtctccctgttccatacagttattttccctctgatgaacccggtgatatatacacttcgcaaccaagaagtgaaagcaagtatgcgtaaacttctcagtcagcacatgttttgctag

SEQ ID NO: 28476 - DNA, 939 bp, Artificial Sequence
  Description of Artificial Sequence: Synthetic coding sequence
atggaaaagtctaacaacagtactcttttcattctcctgggtttttcccaaaacaaaaacattgaagtactttgcttcgtgcttttcctcttctgttacattgcaatttggatggggaacttgctcatcatgatttcaattacttgcacccagctcatccatcagcctatgtatttttttttgaattacctctccctgagcgatctgtgttacaccagcacagtgacacccaaattgatggtagatctgcttgccgaaaggaagaccatctcctataacaactgtatgatacagttatttacgacacattttttcggaggcatagagattttcatactgactggcatggcctatgatcgctatgtggctatttgtaaacctctgcattacactattattatgtcacggcagaaatgcaatacaatcatcatcgtgtgttgcactggtggattcatccattccgcgtcacaatttcttctcaccatcttcgttcctttctgcgggcccaacgagatcgaccattacttctgtgatgtgtaccctttgctgaagctggcgtgtagtaacatacacatgattggactcctggtgattgccaactcgggcctcatcgctctagtcaccttcgtcgttctcttgctcagctatgtttttatcttgtacacaattcgagcttatagtgccgagcgccgtagtaaggccctggccacttgttctagtcacgtaattgtggtcgtgctctttttcgctcccgccctctttatatacatacgaccagtcacaaccttctctgaggataaagtatttgccttattctacactatcatcgcaccaatgtttaacccccttatatacacactgaggaacactgaaatgaaaaatgctatgagaaaggtttggtgctgccaaattctgcttaaacggaatcaactgttttag

SEQ ID NO: 28477 - DNA, 942 bp, Artificial Sequence
  Description of Artificial Sequence: Synthetic coding sequence
atgaagaaagagcaggactctaatgtgacagaattcgtcttgctgggacttagtagctcatgggagctgcagctttttctgtttctgcttttcttgtttttctacatagctatcgtactcggcaacctccttatcgtggtgaccgtccaggcacacgcacatcttttgcagtcgcctatgtactactttctgggacacctctcctttattgacctgtgtctcagttgcgttactgtaccaaaaatgctgggcgattttctgcagcaaggcaagagcatttcattttcaggctgcctcgcccagatctattttctccacttccttggagccagcgaaatgttcctgctgactgtaatggcctacgatcgctacgtggctatttgcaatcccctccggtacctcacggtgatgaaccctcaactgtgtctttggctagtgctggcatgctggtgtggaggttttatccattctataatgcaggtcatcctggtcattcaactgccgttctgcggaccgaatgagctggataatttttactgcgatgtgccccaggtaattaaactcgcctgcatggacacttacgtggtagaggtactcgtgatcgccaactccgggttgctgtccctcgtttgcttcttagtccttttatttagttacgccataatcctgatcacgctgcgtactcatttctgtcagggacaaaacaaggtgttctccacgtgcgcctcccacctgaccgtggtgagcctcatttttgttccctgtgtattcatctacctccgtccattttgtagcttttcagtggataaaatctttagcttgttctacaccgtgataacccccatgttgaatcctcttatctataccctccgcaatacggacatgaagaccgccatgaaaaagcttcgaatcaaaccctgcgggattccactcccttgttag

SEQ ID NO: 28478 - DNA, 930 bp, Artificial Sequence
  Description of Artificial Sequence: Synthetic coding sequence
atgggcgccaagaacaacgtcactgagttcgtcttgttcggcctattcgaatcccgcgagatgcagcatacttgcttcgtggtattttttctgttccacgttctgacagtgctcggaaacctcttagtgatcatcaccattaatgctcgcaagacactgaagtccccaatgtacttttttctctcccagctgagcttcgccgacatctgctacccatccactaccataccgaagatgatagcggataccttcgtcgaacacaagatcatctcgttcaacggctgtatgacccagcttttttctgcgcacttctttggcggtacagagatctttttactgactgccatggcgtatgacagatacgtggctatatgtcgtcctctccactacaccgccattatggattgtcgcaagtgtgggctccttgccggcgcatcctggttagcagggttccttcacagcattctgcagactttactgaccgtccagctgcctttttgtggaccgaacgagatagataatttcttctgtgatgttcaccccttactcaagctggcctgcgccgacacttacatggtagggctcatcgtcgttgctaatagcggtatgatctcacttgctagcttttttattctgattatcagctacgtgatcattctgctgaacttgcgcagccaatccagtgaagatcggcggaaggcagtgtctacttgcggctcccacgttatcacagtgctgctggttttgatgcctcccatgttcatgtacatccgcccttctacaacgttggccgcagataaactgattatcctattcaatattgtgatgcctcctcttttgaacccgctaatctatacccttcgcaacaatgatgtaaaaaatgcgatgagaaagctcttcagagtcaagcgctcacttggagagaagtag

SEQ ID NO: 28479 - DNA, 936 bp, Artificial Sequence
  Description of Artificial Sequence: Synthetic coding sequence
atggagaaaattaacaacgtaacagagttcatattttggggtctgagccagagccccgaaattgaaaaggtctgctttgtggtgttctccttcttttacattatcattcttctggggaaccttctcatcatgctgaccgtttgtttgtccaatctcttcaagagcccaatgtatttctttcttagcttcctctcttttgtcgacatttgttactccagcgtaacagcccctaaaatgatagttgaccttttggcgaaggataaaactatatcttacgttggctgcatgctccaactgtttggtgttcacttcttcggttgtactgagatctttatattaaccgtgatggcttacgaccgttacgtcgcgatttgcaaacctctacactacatgaccataatgaacagggagacatgtaacaagatgctgctgggtacatgggtgggcggatttctgcattctatcatacaggttgccctggtggtccaactacctttttgcggccctaatgagatcgaccattatttctgtgacgtgcacccagtgcttaagctggcctgtaccgagacctacatcgtgggagtcgtcgttaccgcaaactcaggaacaattgcactgggaagcttcgtgattctcctgatcagctatagcattatcctggtgtctctccgcaaacagtcagccgagggacgccggaaggccctctccacctgcggatctcatatcgccatggtggtgattttttttggcccctgcaccttcatgtacatgcgcccagacacaaccttttctgaagacaagatggtcgcggtcttttatactatcatcacaccaatgcttaatcctctcatttatacccttcggaatgctgaagttaaaaacgccatgaagaagctgtggggacggaacgtgtttttagaggccaagggaaagtag

SEQ ID NO: 28480 - DNA, 918 bp, Artificial Sequence
  Description of Artificial Sequence: Synthetic coding sequence
atggtggctacgaacaacgtgacagagatcatattcgtgggatttagccagaactggtccgaacagagggtcatttctgttatgttcctcctcatgtacacagccgtcgtgctagggaacggacttatcgttgtgacaatacttgcgtccaaggtgttaacatccccaatgtatttctttctctcttacctgtcttttgttgagatctgttattgttccgtaatggctcccaagctcatattcgacagcttcattaagagaaaagtgatatctctgaagggatgtttgacacagatgttcagtctgcacttctttggcggcactgaagcattcctgttaatggtcatggcctacgaccgttatgtagccatatgcaagcctctgcactatatggctatcatgaatcagcgtatgtgcgggctgttggttaggatagcctggggtgggggcctgttgcactctgtcggccagacgtttctgatttttcagctgccattctgcggcccaaacataatggatcactatttctgcgacgtgcatccagtgctggaattggcttgcgcagataccttttttatttctctgcttatcataacgaacgggggctcaatctccgttgtgtctttctttgtcttgatggcctcatacttgatcatcctgcatttcctgcgctcccataatctcgaagggcagcataaggccctcagtacctgcgcatctcacgtgaccgttgtagacctctttttcattccctgctctttagtatatattaggccgtgcgttacactgccagcagataagatagtggcggtcttttacaccgtcgtcactcctctattaaaccctgtgatttatagctttaggaatgctgaggtgaaaaatgccatgcgaaggtttattggcggtaaggtgatctag

SEQ ID NO: 28481 - DNA, 912 bp, Artificial Sequence
  Description of Artificial Sequence: Synthetic coding sequence
atgaccgagttcatctttctagtcttgtcccccaatcaggaagtccagcgtgtctgctttgttatatttctgtttctttataccgcaattgtgttgggaaatttcttgatcgtgctgacagtaatgaccagtaggtctctcggttcccccatgtatttcttcctatcctacctgagcttcatggagatatgctatagttcagcaaccgcacccaaactcatctctgacctgctggccgagagaaaggtgattagttggtgggggtgcatggctcagttgttttttttacacttctttgggggcacggagatcttcttacttacagttatggcctacgaccattacgtagctatctgtaaaccactgagctatacaacaataatgaactggcaggtatgcacggtgctggtcggcattgcgtgggtcggcggatttatgcacagcttcgcccagattttgctgatttttcatctgttattttgcgggcctaatgtaattaaccactacttctgcgaccttgtccctctgctaaagttagcctgttcggacaccttcttaattggtcttttgatcgtcgcaaatgggggtacactaagcgtgatctcatttggcgtgctgctcgcgtcatacatggtcatcctgctacatctaagaacctggtcttctgaagggtggtgtaaggcgcttagcacctgtggcagtcactttgccgtcgtgatcctgtttttcggcccttgtgtatttaactccctccgaccttcaacaacacttcccattgacaagatggttgctgtgttttacacagtgattaccgctattctgaatcccgtgatctacagcttgagaaatgcagaaatgaggaaagctatgaagaggctgtggatcaggacactgaggctgaacgaaaaatag

SEQ ID NO: 28482 - DNA, 948 bp, Artificial Sequence
  Description of Artificial Sequence: Synthetic coding sequence
atgtcaattacaaaggcttggaattcctctagcgtgacaatgttcattctcctgggttttactgaccacccagagctgcaggccctcctcttcgtaacctttctcggcatttacttaacgacgctcgcttggaatctcgccctcattttcttgattaggggagacacccacctgcacacacccatgtattttttcttgagcaacctatcctttattgacatctgttactcgagcgctgtggccccaaacatgctaactgacttcttctgggaacagaagactatctcgtttgtgggttgtgcagcccaattttttttcttcgttggcatgggtctgtcagaatgccttctgctaacagcaatggcctacgacaggtacgctgcaatctccagtcctctattgtatcctacgatcatgactcagggcctgtgcaccaggatggttgtgggcgcgtatgtaggtgggttcctctcctcactgatccaagcgtcttccatatttcggctgcacttttgtggtcccaatatcataaaccactttttttgtgatttgccccccgttttagcgctctcatgttcggatacatttctctctcaggtcgtgaacttcctcgttgttgtcaccgtggggggtacgagcttcctccagctgctcatcagttacggttatatcgtgtctgctgtgcttaagatcccaagtgccgaaggtaggtggaaagcttgtaatacctgcgcttcacatttgatggtggtgaccttactgtttggcaccgccttgtttgtgtacctgcggccctcttcgtcctacctcttgggcagggacaaggtggtgtccgtgttctacagcctcgtgattccaatgctcaatcctctgatctactcattaagaaataaggagataaaagacgcgttgtggaaagtgctggaaaggaagaaggtcttttcatag

SEQ ID NO: 28483 - DNA, 975 bp, Artificial Sequence
  Description of Artificial Sequence: Synthetic coding sequence
atggctgtgggaagaaacaatacaatcgttaccaagtttatactgctgggcctatctgaccatccccagatgaagatctttcttttcatgctcttcctggggctctacctcttaacgcttgcctggaatcttagccttatcgctttgataaaaatggattcccacctgcacatgcccatgtacttttttctctcaaatctgagtttcttagacatctgttacgtgagcagcactgccccaaaaatgctgtctgacatcatcacagagcagaagactatcagtttcgtgggttgcgctacacaatacttcgtgttctgtgggatgggattgactgagtgcttcctgctggcagctatggcctacgacagatatgctgccatctgtaaccccttactttacacagtgttgatcagccacaccctttgtctcaaaatggtggttggcgcttacgtggggggttttcttagttcctttatagaaacttattccgtttaccagcacgacttctgtggcccatacatgataaatcacttcttctgtgacctgcctccagtgctggcactgtcttgttcagacaccttcacatcggaagtggtgacatttatcgtcagcgtcgtcgtggggatcgtatctgtgcttgtcgtcctgattagctatggatatatcgtggcagctgtcgttaaaatttcgtccgcaacagggaggacaaaagccttctccacttgcgcctctcacctgacggctgtcactctgttctacgggtccggctttttcatgtatatgcggccctccagcagttactcgctgaacagggataaggttgtgagtatcttttacgccctggtgattcccgttgtgaacccaatcatttattcgtttaggaacaaggagataaagaacgcaatgagaaaggcgatggaacgcgaccccggcataagtcacggcgggccatttatttttatgactttggggtag

SEQ ID NO: 28484 - DNA, 930 bp, Artificial Sequence
  Description of Artificial Sequence: Synthetic coding sequence
atggacatctcagaaggcaacaagactctagtgaccgaattcgtgcttacagggcttacggacagaccctggctgcacgtgctcttctttgtcgtattcctggtcgtgtatctgataacaatggtcggcaacctgggtctgatcgtacttatctggaacgacccccatctccatatgcctatgtacttattcctcggtggattagcattttcagacgcatgtacctcaacaagcatcacccctcggatgttggtgaactttttggacaaaactgccatgatcagcctggccgaatgtattacacagttctatttcttcgcctcatcagcaacaacagaatgcttcctgctggtgatgatggcctatgaccggtacgtggccatttgtaaccctctgctgtatcccgtgatgatgtcaaacaaactgagtgctcaacttctcagcatctcatatgtgattggattcctgcaccccctcgtgcacgtgtccttactgctgagactgactttctgtcggttcaatattattcactatttctactgcgaaatcctccagttgtttaagatttcatgtaacggccctagtatcaacgccctcatgatctttattttcggggcttttatccagattccaaccctgatgactatcattattagctatactcgcgtgctgttcgacattctgaaaaaaaaatctgaaaaagggcgttccaaagccttcagcacgtgtggcgctcacctgttgagcgtgtccttgtattatggcaccctgattttcatgtacgttcgacctgcttcaggtctcgcagaggaccaggataaagtttactcactgttttacacaataattattcccctgctgaacccttttatatatagcttacggaacaagaaagttatgcatgctttgcgacgagtcatacggaaatag

SEQ ID NO: 28485 - DNA, 930 bp, Artificial Sequence
  Description of Artificial Sequence: Synthetic coding sequence
atgacattaggcaactcaactgaggtgacagagttctatctgctcggattcggagcccagcatgaattctggtgtattctgtttattgtgttcctgctcatctacgtgacctctattatgggtaacagcggcatcattttgttaatcaatacagactcccggttccagactctgacttacttctttctccagcatctggcatttgtggacatatgctatacgagcgccatcacccctaaaatgcttcaatcctttacagaggaaaagaatttgatgctctttcagggctgcgtgattcagtttctcgtgtatgccacgtttgctacctcagactgctacttacttgccatgatggcagtcgacccttatgtcgcgatctgtaagccattgcactacaccgttattatgagcagaaccgtctgtattagacttgttgccgggagctacataatgggcagcatcaatgcaagcgtccagactggattcacctgttcactttcattctgtaaaagcaatagtatcaaccacttcttctgtgacgtccccccaattctggccctctcctgtagcaacgtcgacatcaatattatgttgttggtggtattcgtgggcagcaacctcattttcaccggcttggtggtcatcttttcatacatttacataatggccacaattctgaaaatgtcctcaagcgccgggagaaaaaaatctttctccacctgcgcctctcacctgacggccgtgaccatcttctacgggactctgtcttatatgtatttacagagtcatagcaacaactcccaggaaaacatgaaggtcgcattcatcttttatggcactgtgatacccatgctaaatccccttatatacagcctcagaaacaaagaggtgaaagaagcgctgaaagtgattggcaagaagctgttctag

SEQ ID NO: 28486 - DNA, 936 bp, Artificial Sequence
  Description of Artificial Sequence: Synthetic coding sequence
atgacgggcgggggaaacattactgagatcacctactttatcttgctggggttctcggatttccctaggattatcaaggttctgtttacaatcttcctagtgatttacattacaagtcttgcatggaatttgtccctgattgtactgatccggatggacagtcaccttcacactcctatgtatttcttcctttctaatttatcttttatcgatgtctgttacatctcctctacagtgccgaagatgttaagtaacctgctccaagaacaacagactatcactttcgtgggatgcatcatccaatactttatcttttctaccatgggcctgagcgaaagctgtctgatgaccgcaatggcctacgacagatacgccgcgatatgcaatccgctgctctatagcagcatcatgtccccaaccctgtgtgtctggatggtactgggcgcttacatgaccggccttacagcatccctgtttcagatcggagccctgttgcagttacacttctgtggcagcaacgtgattagacattttttctgcgacatgccgcagcttcttatcctgtcgtgcactgacactttctttgtgcaggtgatgacagccattctcacaatgtttttcggcattgcttctgccctggtgatcatgatctcttatggctatatcgggattagcattatgaaaatcacctccgccaaaggacgctctaaagccttcaatacctgtgcctcccacctgacagcggtctctctcttctatacttccgggattttcgtttatctgtcatccagcagcggagggtcgtcatcatttgaccggtttgctagcgtcttctacacggtggtgatacccatgctcaacccgctgatttacagcctcaggaataaggagatcaaagacgctctcaagcgactgcagaagcgcaaatgttgctag

SEQ ID NO: 28487 - DNA, 951 bp, Artificial Sequence
  Description of Artificial Sequence: Synthetic coding sequence
atgaggctgatgaaggaggtgagaggccgcaaccaaaccgaggtgactgagtttctacttctgggactctcggacaaccccgatcttcagggcgtgttgttcgccttattcctgctcatttacatggccaacatggtgggcaacctgggaatgatcgtcctcattaaaattgacctgtgccttcatacccccatgtacttcttccttagctccctcagcttcgtcgacgcctcttacagttcatccgtcactcctaaaatgctggtcaatctgatggcagaaaataaggcaatttcgtttcatggctgtgccgctcagttttacttctttggatccttcctaggtaccgaatgcttcctcctggctatgatggcgtacgataggtatgccgctatctggaatcctctgttgtatccggtgttggtgtcaggacgcatctgttttttactaatcgctacatcttttctggccggctgtggtaatgctgccattcacactgggatgaccttccggttatccttttgcgggtccaataggattaaccatttctattgtgacacacctcctctgctgaaactttcttgttcagacacgcattttaatgggattgtgatcatggctttttctagttttatcgtgatttcttgcgtgatgattgttctcatctcatatttgtgcatcttcattgctgtgttgaaaatgccctcactagagggacgccacaaagcattctcaacctgtgctagctatctgatggctgtaacgattttcttcgggaccattctcttcatgtatctgcgacccaccagcagttattcaatggaacaggacaaagttgtgagcgtgttttacaccgtgatcatccccgtgctgaatcccctgatctactctctgaagaataaagacgttaagaaggccctcaagaagatattgtggaagcacatcttatag

SEQ ID NO: 28488 - DNA, 954 bp, Artificial Sequence
  Description of Artificial Sequence: Synthetic coding sequence
atgatgcgactgatgaaagaggtgagggggcgcaaccagacagaagtgacagaatttctgcttttagggttgtcagataaccctgatctacagggagtgttgttcgcgctcttccttctgatttacatggccaacatggtgggcaacctgggcatgatcgttcttattaagatcgatctgtgtctgcacacgccgatgtactttttcctgtccagcctgtcgttcgtggacgcgtcttatagctcttcagtgaccccaaagatgctggtgaacctaatggccgagaacaaggccatttcatttcacggatgtgcagcccaattttatttctttggaagctttcttggtaccgagtgctttttgttggccatgatggcgtacgataggtacgcagcaatctggaatccgcttctttatccagtactggtatccggccgcatctgttttcttcttatcgctacctcctttctggcagggtgcggcaatgccgcaattcacactggcatgaccttccgactcagtttctgcgggagcaacagaattaaccatttctactgtgataccccacccctcctgaaactgagctgctcagacacacacttcaacggtatcgtgatcatggctttctcatcctttatagttatttcctgcgtaatgattgtgctgatatcttatctttgcatctttatcgcggtgctgaaaatgcctagcctggaagggcgtcacaaagctttttctacttgcgcctcctaccttatggctgttactatcttcttcggtactattctgttcatgtatctgagacccacttcgagttactcgatggaacaggacaaggtggtctccgtcttctatacagtgattatccctgttttgaacccgctgatctacagcctgaagaataaggatgtgaaaaaggccctcaaaaagatcctttggaagcacatcctgtag

SEQ ID NO: 28489 - DNA, 933 bp, Artificial Sequence
  Description of Artificial Sequence: Synthetic coding sequence
atggacaaggaaaattcttccatggtcactgagttcatattcatgggaattactcaggatccccagatggaaataatctttttcgtggtgtttttgatagtgtatttagtgaatgtagttggaaatattggcatgattattctcatcactacagacacccagcttcatacccctatgtacttttttttatgtaacctcagctttgtggacttgggttactcatccgccatagccccacggatgctcgcggactttctcacaaatcacaaggttattagcttctcatcttgtgctacccagttcgcattcttcgtcggttttgttgatgcggagtgctacgtgctggcggcaatggcatacgggcggtttgtcgccatctgccgcccacttcattattctacttttatgtccaaacaggtgtgtctggctctaatgctgggctcctacctggctggtctggtttccctggtggcccacacgaccttgactttcagcctgagttattgcggcagtaatataatcaatcattttttctgtgaaattccaccattgctggccctctcttgtagtgatacgtacatctctgagattttactgtttagtctctgcggcttcattgagtttagcacaatccttatcatatttatctcctatacgttcattttggtggctattattaggatgagatccgccgaggggaggcttaaggccttcagcacatgcggtagccacttgactgggattactttgttttatgggaccgtgatgttcatgtacctgcggcctacttcctcctattctcttgaccaggataagtgggccagcgtcttttacactgtaattatcccaatgttgaatcccctgatctatagcctgcggaacaaggatgttaaagccgctttcaagaagttgatagggaagaaatctcagtag

SEQ ID NO: 28490 - DNA, 975 bp, Artificial Sequence
  Description of Artificial Sequence: Synthetic coding sequence
atgctggagtccaattacactatgccaactgagttcctgtttgtcggattcacagattatctgcctctgagagtgactttgtttctggttttcttgcttgtgtacactctcaccatggtgggcaatatcctgctcataatactggttaatattaattccagcctgcagatccccatgtactacttcctctccaacctgtccttcctagatatcagctgtagtacagccattacgcccaaaatgctggcaaactttctcgcttcccggaagtctataagcccttacggctgcgcgctccagatgttcttcttcgccagctttgcagatgccgagtgtctaattctagcagctatggcttatgatcgctatgctgccatctgcaatccactgctttatactactctgatgtctagacgcgtctgtgtgtgctttatcgtcctggcctatttctctgggtctaccactagtctcgtgcacgtttgtctcaccttccgcctctccttctgcggctcaaatatagtgaaccatttcttctgcgacatcccacccttgctggccctgtcatgcaccgacacccagattaaccaactgttgcttttcgccctatgttcttttatccaaaccagcactttcgttgtgatctttatcagttatttttgcatcctgatcacagtgttgtctatcaaaagcagcggtggaagaagcaagactttctctacatgtgcctcacacctgatagcggtgactttgttttatggggcattgctgttcatgtatctacagccaaccacttcatactcccttgacacggataaggtcgtggcagttttctacacagtcgttttcccaatgttcaatcccatcatctactcattccgaaacaaggacgtgaaaaacgcattaaagaagcttcttgagagaatcggctactccaatgagtggtatcttaacaggttacgcatagtcaacatctag

SEQ ID NO: 28491 - DNA, 1089 bp, Artificial Sequence
  Description of Artificial Sequence: Synthetic coding sequence
atgacagagttccacttgcagagtcagatgccgagcatcaggctgatctttcggaggctcagcctgggtaggattaagccatcacagagccctagatgttcgacaagctttatggttgtaccttccttctccattgccgaacattggcgccgcatgaagggagcaaatctgagccagggaatggaattcgaacttctaggattgactactgatccccagctccagaggctgctgttcgtggtgttcctaggcatgtacactgccacgctccttggcaatctggtgatgttcctgctgatacacgtgagcgccactctccacacccccatgtactctctattaaagtcccttagctttttggacttttgttatagttctacagtagtaccccagacacttgttaattttttggcaaaaagaaaggtgatcagctacttcggatgcatgactcagatgtttttttacgcaggattcgcaactagcgagtgctatctaatagccgcaatggcgtacgatcggtacgccgctatctgcaaccctttgctctactccaccattatgtctcctgaggtttgcgccagcctcatcgtcggttcttactctgctggcttcttaaatagcctcatccacacgggctgcatcttttccctgaagttctgtggcgcccatgtggttacacattttttttgcgatggacctcctattctctcactgtcttgtgttgacaccagcctctgcgaaattctgttgttcatcttcgctggatttaatcttctgtcatgtacactcacaatactgatcagctactttctgatactcaacacgatattaaaaatgagcagtgcgcaaggccgctttaaggcgttttcaacctgtgctagtcacctgaccgcaatctgcctgttcttcggaactactctctttatgtatttacgcccgagaagctcttactctctcacacaagataggactgtggcggttatctataccgttgtcataccagtcctgaaccccctcatgtactccctgcggaacaaggatgtcaagaaagctctgatcaaggtctggggcaggaagacaatggaatag

SEQ ID NO: 28492 - DNA, 945 bp, Artificial Sequence
  Description of Artificial Sequence: Synthetic coding sequence
atggaaaataataccgaagtcacagagtttattttagtaggtctgacagacgatcctgaactccagatcccactctttatcgtttttctattcatatatctgattaccttggtgggcaacttgggaatgatcgaactgatcttgctcgattcttgcctgcatacgccgatgtacttctttctgagtaacctgtccctggtcgacttcgggtactccagtgccgtaacaccaaaagttatggtaggcttcctcaccggggacaagttcatactgtataatgcgtgtgccactcaatttttctttttcgtggccttcatcactgcagagagcttcttgctggcctccatggcatacgaccgctacgcagccctgtgcaaacccttgcactatactacgacaatgacaaccaacgtttgtgcatgtcttgccataggtagctatatctgcgggtttctgaacgcatctatccatactggaaatactttccgtctgtctttctgccggtccaacgttgtagagcatttcttctgcgacgcacctcccctgctcacactatcttgctcagacaattatatatctgagatggtcatcttcttcgttgtggggttcaatgacctcttctcgattttagtgatcttaatttcatacttgtttatttttataaccatcatgaagatgcggagcccagaagggcggcaaaaggccttttctacatgtgcttctcacctgaccgctgtatcaattttttacggaactggcattttcatgtaccttcgaccaaattccagccattttatggggactgataagatggcatcggtcttttacgctatcgtgattcccatgctcaaccccttggtttacagtctgcgaaacaaagaggtgaaatctgcatttaaaaagaccgtgggcaaggcgaaggcctctatcggattcattttctag

SEQ ID NO: 28493 - DNA, 945 bp, Artificial Sequence
  Description of Artificial Sequence: Synthetic coding sequence
atggaaaataacactgaagtctcagagttcattctcctaggactaacgaacgcccctgagctccaggtccccctgtttatcatgttcacactgatttatcttataacactcactggcaatctggggatgatcatactgatccttctggacagtcacctccacacccccatgtatttctttctttcgaaccttagtcttgctggcattggttactctagcgccgtgacgcccaaagtactaactggcctgctgatcgaggataaagcaattagctattctgcctgcgccgcccagatgttcttctgtgcagtgttcgcaacagttgagaactatctgctttcttcaatggcctacgacaggtatgctgccgtctgcaaccctttgcactataccactacaatgaccacccgtgtgtgtgcttgtctagcgattggatgctacgtcatcggctttcttaatgccagcatccagatcggggacacattccgcctctctttctgcatgtccaatgtgatccatcactttttttgcgacaaaccggctgtgataaccctcacctgctctgaaaagcatattagcgagctgattctagtgctcattagcagcttcaacgtgttcttcgccctgcttgtcaccctcatctcatatctctttatcctcatcactattctcaaacgtcataccggcaagggctatcagaaacctctatcgacctgcggttctcaccttattgcgatctttttattttatatcaccgtcatcatcatgtatattcggcccagctcaagtcattcaatggatactgacaagatagcgagcgtgttctacactatgatcattcctatgttgtccccgatcgtctacacactgagaaataaggatgtgaagaacgcgttcatgaaggttgtggaaaaagcaaaatactccctcgactcagtgttttag

SEQ ID NO: 28494 - DNA, 930 bp, Artificial Sequence
  Description of Artificial Sequence: Synthetic coding sequence
atggaaaattgtaccgaggtgacaaaatttattctgcttggcctcacttcagtaccagaactacaaatccctctgttcatcctttttacattcatttatttgcttaccctgtgcggaaatctgggcatgatgctgttaatcctgatggattcctgcttgcacacccccatgtacttcttcctcagcaatctcagtctggtggattttggctacagttccgctgtaaccccgaaggtgatggccgggtttctgagaggggacaaggtcatcagttataatgcatgtgcagtgcaaatgttttttttcgtggccctcgccacagtggagaactatctgctcgcatcaatggcctacgatcgttacgccgccgtctgcaagccactacactacaccacaaccatgacagcatcggtaggggcctgtctcgcgctgggctcttacgtctgcggcttcctaaacgctagctttcacattggaggaatattttctctttctttctgtaaaagtaacttggtccaccattttttctgcgacgtgcctgctgtaatggccctatcatgttctgataagcacacctccgaggtaatccttgttttcatgtcgtcctttaatatcttctttgttcttttggtcatctttataagctaccttttcatctttatcaccattctgaagatgcattcggcaaaggggcatcaaaaagcactaagtacctgtgcatctcatttcacagccgtctcagttttctatggtactgtgatctttatctaccttcaaccatcttcctcccactctatggataccgacaaaatggcgtccgtcttctatgcaatgatcattccaatgctgaaccccgtagtttatagtctccgcaatagggaggtgcagaatgcgttcaagaaggttttgaggcggcaaaagtttctgtag

SEQ ID NO: 28495 - DNA, 945 bp, Artificial Sequence
  Description of Artificial Sequence: Synthetic coding sequence
atggagaacaaaactgaggttacccagttcatcttgctggggctcacaaatgacagcgaactccaggttccgctgttcattaccttccccttcatttacattatcacactggttggcaatttgggcattatcgttttaattttctgggactcctgtttgcacaacccaatgtactttttcctgtcgaatttgtcattggtagacttctgttatagcagcgctgttactccaattgtgatggccggtttcctcatcgaagacaaagtgatctcttataacgcctgcgccgcccagatgtacattttcgtggcctttgctacagtggagaactatctgctcgcttccatggcttacgatcgctacgcagctgtgtgtaaacctctgcattataccaccactatgactaccaccgtgtgtgcccgcctagccatcggcagctatctgtgcgggttcttgaacgcaagcatccacacaggtgacacgttctctctgagcttctgcaaaagtaatgaggtccatcactttttctgtgatattccagctgtcatggtgctgagttgttcagacagacacatctccgagttagtgctcatctatgtggtgtccttcaatatattcatcgctttgctagtcattctgataagctacaccttcattttcattaccatcttgaagatgcattcggcttccgtgtaccaaaaaccccttagtacctgtgcctcacattttatcgccgttgggatattttatgggacaatcatctttatgtatctacagccttcatcttcccatagcatggataccgacaagatggctcctgtcttctacactatggtaattcccatgctcaatcctctggtctattcattacgtaataaggaagtgaaatctgcattcaagaaggttgtggagaaagccaagttatcggtgggctggtccgtatag

SEQ ID NO: 28496 - DNA, 963 bp, Artificial Sequence
  Description of Artificial Sequence: Synthetic coding sequence
atgaacagcgagaatcttaccagagccgccgtggctccagccgagtttgtccttttagggataaccaaccgctgggatcttcgggtcgctctgttcctcacttgcctgcctgtgtacctggtaagcctcctcggaaatatggggatggcgcttctcataagaatggatgcacgtctccataccccaatgtatttcttcctggcaaacctctcattattagacgcctgttactcttcagctattggcccgaaaatgctcgttgatctgctcctgccacgggctaccatcccttacacagcatgcgccctgcagatgtttgtcttcgccgggctagctgacacagagtgttgtctgttagcagctatggcatacgatcggtacgtcgctatccgtaaccccctgctctacacaaccgccatgtcgcagcgcttgtgtctggccctactgggagcatcagggctaggaggtgccgtgtcggcatttgtccacacaaccttgactttccgcctaagtttctgtcgtagcaggaagataaatagctttttctgtgacattcctccattgcttgcaatctcatgcagtgacacttctctgaacgagctcctcctgtttgccatttgtggatttatccagactgcaaccgtgctggcaattaccgtgagttacgggtttatcgctggggccgtaattcacatgcggagcgtagaggggagcagacgcgctgcctccacgggtgggtcacacttaactgccgttgctatgatgtacggcacactcatctttatgtacttgaggcctagctcttcatacgcacttgataccgataagatggcttctgtattttatacacttgtcatcccctccctgaacccgctcatttatagcctgcggaacaaggaagttaaagaggcacttcgccaaacatggagcagatttcattgcccaggacagggatcccaatag

SEQ ID NO: 28497 - DNA, 945 bp, Artificial Sequence
  Description of Artificial Sequence: Synthetic coding sequence
atgatggcttctgagaggaaccagtcatccacgccaacatttatccttctggggttttccgagtaccctgagatccaggtgcctctttttctcgtgtttttgttcgtatacactgtcactgtggtagggaacttgggaatgattatcattattaggctgaacagcaagctccacacgatcatgtgcttctttttgtcacacttatctctgactgacttctgctttagtactgtggttacccctaaattgcttgagaatcttgttgtggaatatcgcacaatcagcttttccggctgcatcatgcagttttgctttgcctgcatctttggagtcaccgagacatttatgctggctgcaatggcctacgacaggttcgtagccgtatgtaagccgttattgtacacaaccataatgagtcaaaagctatgtgctctgctcgttgcaggaagttacacctggggcatcgtttgttccctcattctcacctacttcttactcgatctgagtttttgtgagagcactttcattaacaatttcatctgcgaccatagtgtgattgtctccgcatcctactcggatccatacatatctcagcgcctttgtttcatcatcgcaattttcaacgaagtgagctccctgatcattattctgacaagctacatgctgatcttcacgacgatcatgaagatgagatctgcatctgggcggcaaaagacctttagtacctgcgcttctcacctcacggctatcactattttccacggcaccatcctcttcctgtactgtgtacccaaccccaagacctcctcactgatagtgacagtggcaagcgtgttttatacagtggccattccaatgctcaaccccttgatctactcattgagaaataaagacattaataacatgtttgagaagctcgtggtgactaaactgatataccattag

SEQ ID NO: 28498 - DNA, 945 bp, Artificial Sequence
  Description of Artificial Sequence: Synthetic coding sequence
atgatgatggttctgcgcaatctctccatggaacctactttcgctctgctgggcttcactgactaccctaaactccagattccactatttttggtttttctgttgatgtatgtcattacagttgtcggcaacttaggaatgataataataattaagatcaaccctaaatttcatacccccatgtatttcttcctgtctcatttatcattcgtggatttttgctatagtagtatagtcaccccgaaactgttggaaaatcttgtgatggctgacaagagcatattctacttctcctgcatgatgcagtattttttatcctgcaccgccgtggtgacagagtctttcctcctggcagtcatggcatatgaccggtttgttgcgatctgcaacccgctgctgtataccgtcgctatgtcccagcgactgtgcgcactgctcgtggcaggctcctacctgtggggcatgttcgggccgctggtccttctgtgttacgctctgcgcctaaacttctccggacccaatgtgataaaccatttcttttgtgagtacacagcgttgatttctgtgtcgggctctgatatcctgattccccatctgctgctcttttcgttcgccaccttcaatgagatgtgtactctgttgataattctgacatcatatgttttcatcttcgtcacagtgctgaagattagatcggtctccggccgccataaagcttttagtacctgggcatcccaccttacaagcataacaatcttccacggaaccatactttttctgtactgtgtgcccaactcgaaaaacagtaggcagacagtcaaagtggcgagcgttttttacaccgtcgtgaatcctatgctgaaccccttgatctattctctgcggaacaaggatgttaaagacgcattctggaagcttatccacacgcaggttcccttccactag

SEQ ID NO: 28499 - DNA, 987 bp, Artificial Sequence
  Description of Artificial Sequence: Synthetic coding sequence
atgtttcttaccgaaaggaacactacatcagaagcaactttcactctgctcggtttttccgactacctcgagttgcagataccactctttttcgtattcctagctgtttacggcttcagcgtggtgggcaatctcggcatgattgtgataattaagattaatcccaagctgcacactccgatgtattttttcctgaaccacctgtcttttgttgacttttgctattccagcattatcgcccctatgatgttggtaaatctggtggtggaggacagaactatttcgttttccgggtgtctggtacagttcttctttttttgcaccttcgtggtgaccgagctaattctgttcgctgtaatggcttacgaccattttgttgcgatctgcaatccgctgctatatactgttgccatctcccagaagttgtgtgcaatgctggtcgtggtgctctacgcttggggggtggcatgctccctgaccctcgcctgtagtgctctaaagctttccttccacgggttcaacaccataaatcacttcttctgcgaactgtccagtctcataagtctgtcttatcctgactcctacctgtcacagttgttgctattcaccgtggctacattcaacgagattagcacgttattgattatactaacctcctacgctttcataatcgtcacaacgttaaagatgcccagtgcaagcggccaccgaaaagtattcagtacttgtgctagccatctgacagctataactatctttcatgggactatcctctttctgtattgtgtgccaaatagcaaaaactcgcgacacacagtcaaggttgcctctgtattctatacagttgtgattcctctgctgaacccacttatctacagtctgaggaacaaggacgtgaaggatgctataagaaaaattatcaatacaaaatacttccatatcaaacatagacactggtatccatttaatttcgttatcgaacagtag

SEQ ID NO: 28500 - DNA, 942 bp, Artificial Sequence
  Description of Artificial Sequence: Synthetic coding sequence
atgcttcttacagaccgcaacaccagtgggactacctttactctcctcgggtttagtgactaccccgagctgcaggtacccctgttcctcgttttcctggccatttataatgttaccgtcctgggcaacatcggactaatcgtgataataaaaattaatcccaagctgcatacgcccatgtacttctttctgtctcagctttcattcgtagacttttgttattcaagcattatcgcgcccaagatgctggtcaacctcgtagtaaaagataggaccatctccttcctgggatgcgtcgtgcagttcttcttcttctgcacctttgtcgtgaccgagtcctttctcctggctgtcatggcttacgaccgctttgtggctatttgcaacccgcttctgtatacagtgaatatgagccagaagctgtgtgtcttactggtcgtgggctcttacgcctggggcgtgtcctgcagcctggaacttacctgtagtgccctcaagctttgctttcacgggtttaatacaattaaccacttcttttgcgaattctcgtcccttctgtcattgagctgctccgacacgtatattaatcagtggcttttgttctttctcgctactttcaatgagatttctactctcctcattgtgctcaccagctacgccttcattgtggtgactattcttaaaatgaggtcagtaagtggaagacggaaagctttttctacatgcgcgtcacaccttaccgccattacaatttttcacgggacaatcctgtttctgtattgcgtgcccaatagcaagaacagtcggcataccgttaaagtggcgagtgtgttttatactgtggtcatcccgatgctcaatcctttaatttactccttacgcaacaaggacgttaaagacacagtgacagagattctcgatactaaggttttctcatattag

SEQ ID NO: 28501 - DNA, 945 bp, Artificial Sequence
  Description of Artificial Sequence: Synthetic coding sequence
atgacacgcaaaaactatacttccctgactgaattcgtcctcctgggactcgcagacaccttagagctccagatcatactgtttctgttctttcttgtgatttatactctgacagtgttgggaaatctggggatgattttgttgatccggatagacagccagctgcacacgcccatgtatttcttcttggccaatctctccttcgtcgacgtgtgcaatagcacaactatcactccaaaaatgcttgctgacctcctttcagagaaaaagaccataagctttgcaggctgcttcctgcagatgtactttttcattagcttggcaacaactgagtgcattctttttggtttaatggcttacgaccggtacgcagccatatgtcgtcctctgctgtacagcctaatcatgagcaggaccgtttacctaaagatggctgcgggtgcatttgccgcaggtcttctgaattttatggtgaatacttcccatgtttcttctctttcattttgcgacagtaatgtaatccaccattttttctgtgacagcccccctttgtttaaactgtcatgctccgatactatcttgaaggagagcatctcatctattctggccggggtgaatatagtcggtacattgttggtgatcctgtccagctactcatatgttctcttctccattttcagtatgcactctggcgagggacgtcatagggcatttagtacctgtgccagccacctgactgcaatcatcctcttctacgcaacttgtatctacacgtatttgagaccgtcgtcttcttatagcctgaatcaggacaaggtggctagtgtcttttacacagtagtgatccctatgctcaatcctcttatttatagcctgaggagtaaagaggttaagaaagctctcgcaaacgtaatctcccggaaacgaacgtcgagttttctctag

SEQ ID NO: 28502 - DNA, 933 bp, Artificial Sequence
  Description of Artificial Sequence: Synthetic coding sequence
atggaagaagagaacgccacacttctgacggagttcgtactgaccgggttcctgtatcagccacagtggaagatacctctttttttggctttccttgtcatatacctcatcaccatcatgggcaatcttggccttattgcagttatatggaaggatccacatcttcacattcctatgtatctgctcttgggcaatcttgcgtttgtggacgccttgttatcttcctcggtgaccttgaagatgctgattaatttcctagccaaatctaagatgatttctctgtccgagtgcaaaatccaacttttcagcttcgctatatctgtcactaccgaatgcttcctgctcgcgaccatggcctatgataggtacgtcgcaatttgtaaacctctactgtaccctgcgattatgacaaatggtctctgcatccgcttacttattctctcgtacgtcggagggttactgcacgcccttatacacgagggattcctgttccgactgacattctgcaattccaatattatccagcatttttactgtgatatcatcccattactgaaaatcagttacacagattctagcataaacttcttaatggtgttcatattcgccggttcaatccaggtgtttacaattggcactgtgctcattagctatatttttgtgctctataccattctaaagaaaaaatccgtgaagggaatgaggaaagcgttctctacctgcggggcgcacctgctgagcgtgtctctttattatggccccctggctttcatgtatatgggaagcgcttcccctcaagctgacgaccaggacatgatggagtctttattctataccgtaatagttccactccttaatccgatgatctattcactgaggaataaacaggtcattgcctcctttactaagatgtttaaacgcaacgacgtctag

SEQ ID NO: 28503 - DNA, 945 bp, Artificial Sequence
  Description of Artificial Sequence: Synthetic coding sequence
atgtctaatgaggacatggagcaggataacacaacattgttgaccgagttcgtactgaccgggctcacttaccagcctgagtggaagatgcctctgtttcttgtatttctggtcatttatctgattactattgtgtggaatctgggcctgatcgccctaatctggaatgacccacagctgcacattcccatgtactttttcttggggagtttggcattcgtggatgcctggatctccagtactgtgacccccaaaatgcttgtcaatttcttggcaaagaaccggatgatttccctgtccgaatgcatgatccagtttttctcctttgccttcggcggtacaaccgagtgctttttgctggccaccatggcctatgatcgctatgtggccatctgcaagccccttctctacccagtgataatgaacaattccctgtgcattcgactacttgccttctccttccttgggggtttcctccacgctctgattcacgaggtactgatctttagactgaccttttgtaattcgaatatcatccaccatttctactgtgacattatcccattgtttatgatatcctgtacagaccctagtattaattttctaatggtcttcatcttgagtgggtccattcaagtgttcaccatagtcacagttctgaattcatatactttcgctcttttcactattctgaaaaagaagagtgtcaggggcgttaggaaagcattctctacttgtggagcccacctactatctgtgtccctctactacggccctttgatcttcatgtatttgagacctgccagcccacaggccgatgatcaggacatgattgattccgtcttctacaccatcatcatcccgctgctgaacccaattatttactccctaaggaataagcaggtgatcgattcctttacaaagatggtgaaaagaaatgtgtag

SEQ ID NO: 28504 - DNA, 945 bp, Artificial Sequence
  Description of Artificial Sequence: Synthetic coding sequence
atggagttcacagacagaaattacactctggtaacagagttcattctgttgggctttccaacgaggccagagctccagatcgtactctttctcatgtttcttaccctctacgccatcatccttattgggaatatcggccttatgttgctcatccgtattgaccctcatctccagacaccaatgtacttttttctcagcaacctttccttcgtagatctttgttacttctccgatatcgttccgaaaatgttggtcaattttctatctgagaacaagtctatcagttactatggctgtgcactccagttttactttttctgtacttttgccgacacagagagttttatcctggccgcaatggcatacgaccgctatgtggccatctgcaaccccctgctctacactgtggtaatgtctcggggcatctgcatgcgcctgatcgtgctttcctacctgggggggaatatgagctcacttgtgcatactagcttcgcttttatcctgaagtattgtgacaaaaatgtgattaaccacttcttctgcgacctcccccctcttcttaaacttagttgtacagacacaactattaatgagtggttactgtctacttatggatcgtccgtcgagatcatttgcttcatcattatcattatctcatacttctttattctgctcagcgtgcttaaaatcaggtcctttagtggtagaaagaagacattcagcacctgtgcatcccatctcacgtccgtgaccatttatcagggaacccttctctttatatattcccggcctagttacctctactcccctaacactgataagattatatccgtcttctataccatcttcattcctgtcctgaatcccctgatatacagcctgcggaacaaagacgttaaggatgcagccgaaaaggtgctgagaagcaaggtggattcctcttag

SEQ ID NO: 28505 - DNA, 939 bp, Artificial Sequence
  Description of Artificial Sequence: Synthetic coding sequence
atggctgacgacaacttcacggttgtcacagaatttatcttacttggtctgaccgaccacgcagagttaaaggctgttctgttcgtagtcttcctggtcatctacgccatcaccctactgaggaacttggggatgattctactgattcagattaccagcaaactccataccccgatgtatttcctcttgtcgtgtctctctttcgtcgatgcttgttacagttccgccatagcgcctaaaatgcttgtgaacctgcttgtagtgaaggcaactatttcatttagcgcatgcatggtgcaacatctgtgctttggcgtgttcattaccaccgaaggttttttgctgtctgtaatggcatacgatagatacgtggcaattgtgtctccactgctgtatactgttgctatgtccgaccgcaagtgcgttgagttggtgactgggagttggataggcggcatcgtcaatacactcatccatactatttcccttcgtcgtctatctttctgccgcttgaatgcagtgagtcactttttctgtgatattccatctttactcaaactttcctgctcagacacttcaatgaacgaactcttgctcctgactttcagtggagttatcgctatggcgacatttctgacagtgattatttcgtacatttttatagcctttgcaagccttagaatccattcagcatcggggcgtcaacaagccttttcaacatgtgccagtcacctcactgccgtcacgatcttttatggtaccctgatcttctcttacattcagccatcttcgcagtatttcgtagaacaggagaaggtggtgagcatgttctacacactcggcatcccaatgcttaacctgctgatccactccctcaggaacaaggatgtcaaagaagccgtcaagcgtgcaatcgaaatgaaacattttctgtgctag

SEQ ID NO: 28506 - DNA, 927 bp, Artificial Sequence
  Description of Artificial Sequence: Synthetic coding sequence
atggcagaagagaatcatacaatgaagaatgaatttatacttaccggctttaccgatcacccagagctgaaaacattgctgtttgtggtattctttgccatttatctgataacagtagtaggtaacatttctctggtcgctctgatcttcacacatcggaggcttcacactccaatgtatattttcctgggtaatcttgctctcgtggactcttgttgtgcctgcgcaattacacctaagatgttggagaacttcttttcagagaataagagaatctctctgtacgagtgtgccgtgcagttttacttcctttgcactgtggagaccgctgactgcttcctcctcgccgctatggcatatgaccgctatgtggcaatctgcaatccgctgcagtaccatattatgatgagcaagaagttatgtatccagatgactacaggtgccttcatagcaggtaacctccatagtatgatccacgtgggacttgtctttaggctggtgttttgcggctccaaccacatcaatcacttctattgcgatattcttcccctttaccggctttcttgcgtggatccctatatcaacgagcttgtcctttttattttttcggggagtgtgcaggtgttcaccattgggtctgtgctcatatcttacttatacatcctgctgacgattttcaaaatgaaatctaaagaagggagagccaaggccttctccacgtgcgcctcacatttcctttcagtgtccctgttctatggctccctgttctttatgtatgtgaggccaaacttgctggaagaaggggacaaagatattccggccgccatcctgtttaccattgtcgttccactgttgaatcccttcatatattccctgaggaacagggaggtcattagtgtcctgaggaaaatcttgatgaagaagtag

SEQ ID NO: 28507 - DNA, 951 bp, Artificial Sequence
  Description of Artificial Sequence: Synthetic coding sequence
atggtggaggagaaccatacgatgaaaaacgagtttatccttactgggtttactgatcatccagaactgaaaaccctgctgttcgtcgtgttcttcgctatttacctgatcacagttgtagggaatataagtctggtggctctaatatttacccattgcagactgcatactcccatgtatatctttctcgggaatctggccctggtcgactcttgctgtgcatgtgctataacgcccaagatgcttgagaactttttcagtgagggcaagcggatcagcttgtatgagtgcgcagtccagttctacttcttgtgcactgtagagaccgcagattgctttctcctggcagctgttgcctacgacagatacgtggccatctgcaaccccttgcagtaccacatcatgatgtctaagaagctctgtatccagatgactaccggggccttcatcgctgggaacctgcattccatgatccacgttggtctggtctttcgtctggtattttgtggcttaaaccacattaatcacttctattgtgacacactcccattgtatcgcctctcatgcgtcgaccccttcatcaatgaacttgtcctttttatctttagcgggtccgttcaagtttttaccatcggcagcgtcttaatttcgtacctctatatactgctgacaatctttagaatgaagtccaaagagggccgggcgaaggcgttttccacctgcgcctcacacttcagctccgtaagcctgttctatggctctatcttttttctgtatattcgacccaacctgctcgaggaaggcggcaatgacatccctgctgcgatactgttcaccatcgtggtccctctgttaaatcctttcatatattccctaagaaataaggaagtgatttcagtactacggaagatcctgctcaagatcaagagccaaggttccgtcaacaagtag

SEQ ID NO: 28508 - DNA, 966 bp, Artificial Sequence
  Description of Artificial Sequence: Synthetic coding sequence
atggctcgcgagaaccattcgctggccgcagagtttatccttatcggattcaccaactatcccgaactgaagacattactgttcgtggtcttcagcgcaatatacctcgtgacaatggttggcaatctggggctcgttgctctcatttacgtggaacgtcggctccttacacccatgtatattttcctaggcaacctggcccttatggatagctgttgtagctgcgctgtgactcctaagatgctcgagaacttcttcagcgaggacagaatcatctccttatacgagtgtatggctcagttttacttcctatgtctcgctgagacaaccgactgctttctcctagccacaatggcttacgacagatacgtcgccatttgccatccgctccaatatcacaccatgatgagcaagacgctatgtatccggatgacaaccggcgcctttaaggcgggcaacctgcattccatgatccacgttggccttctcctgaggctgacgttctgccgttcaaacaagattcaccactttttttgtgacatcctgcccttgtataggttgtcttgtacagaccccagcattaatgagttgatgatttatatcttctctattcctatacagatcttcactatcgccacagttcttatatcgtacctttgtatacttctgaccgtattcaagatgaaaagtaaggaggggaggggcaaggctttctccacttgtgctagccacttccttagcgtatcaattttttacatctgtttgctgatgtacattggcccaagcgaggaaggagacaaggatacccccgtggccattttttatgccattgtgatcccattgctcaatccattcatttactcactgcgcaataaggaagtcatcaatgtcttaaaaaaaattatgagaaattacaatattctgaagcagacctgtagcattgccaacttgttcctgatttactag

SEQ ID NO: 28509 - DNA, 936 bp, Artificial Sequence
  Description of Artificial Sequence: Synthetic coding sequence
atggggaaggagaattgcaccactgtggccgagttcattctgctcgggctgagcgatgtgcccgagctgagggtgtgcctctttctgctgttcctcctaatctacggagtcacactgctggcgaacttggggatgatagccctgattcaggtgagcagtaggctgcatacccctatgtatttttttctctcccacctttcaagtgtcgacttctgttattccagtatcatagtacctaagatgctagccaatatatttaataaggacaaggccatcagctttttgggatgcatggtccaattctacctgttctgtacctgcgtggttacagaagtgtttttactagccgtcatggcctatgatcggttcgtggccatttgcaacccactgctctacacagtgactatgagctggaaggtgcgggtggaactagcttcctgttgctatttctgtggaacagtgtgtagcctcattcatctctgcttggccctaaggattccattttatcgctcaaacgtcataaaccacttcttttgcgaccttccacctgtcttaagtctagcttgttctgatattactgtgaatgaaaccctgcttttccttgtggctactctgaacgagtctgtgacgataatgataatcttgacaagttacctcctgattttaacaactattctgaaaatggggtcagccgaagggagacataaggcttttagtacctgtgcctcccatctcacggctatcacggtgttccacggcacagtgttgagcatttattgcaggcctagctcaggcaacagcggagatgccgataaagtcgcaaccgtattctatacagtggtcatcccgatgttaaattcagtgatctacagcctgcgtaataaagatgtcaaggaggctttacgaaaggtgatgggctcgaaaattcactcctag

SEQ ID NO: 28510 - DNA, 936 bp, Artificial Sequence
  Description of Artificial Sequence: Synthetic coding sequence
atgggaaaagagaactgtacaaccgtggccgaattcatcctgttaggactgtctgatgtgcctgagttgcgggtatgcctttttctcttattcctgctcatctatggtgtgacactcctcgcaaacctggggatgaccgctctaatccaggtgtcgtcccggctgcacactcccgtgtacttctttttgtcccacctctcttttgtagacttctgctactcatcaatcatcgtgcctaagatgctagctaacatcttcaataaggacaaagctatatcgtttctgggttgtatggtccagttttatctcttttgtacttgtggggtgactgaggtattcctgctagccgtgatggcttatgacagatttgtagctatttgtaatccgctactgtacatggtgactatgagccagaagctccgcgtggagttgacctcttgctgctatttttgtggcaccgtctgctccttaatccactctagcctggcactgagaattctcttctataggagcaatgtgattaatcactttttctgcgatcttccccctttattgagcttggcctgctcagatgtgaccgtaaatgagactttattattcctggtggcaactctcaacgagtccgttaccattatgatcatccttacctcctatcttctgatccttaccactatcctcaaaatccacagcgctgagtctcggcacaaagcattctcgacgtgcgcttctcatctgacagctataacagtgagtcacggcactatcctatacatatactgcaggcctagctcaggaaattcaggcgatgtagacaaagtcgctactgtgttttatactgtcgtgatacccatgcttaatcctctgatctactccctgagaaacaaggatgtgaataaggctctccgtaaagtcatgggaagcaagattcattcatag

SEQ ID NO: 28511 - DNA, 948 bp, Artificial Sequence
  Description of Artificial Sequence: Synthetic coding sequence
atgttttctcctaaccacacaatcgtgactgaattcatcctgctgggactcactgacgatcctgtccttgagaaaattctatttggcgtgtttctcgccatttacctaatcaccttagccggcaatctttgtatgatcttgctgattagaactaattctcatctgcagacaccaatgtactttttcctcggccacctctcattcgtcgatatctgctacagctctaacgtcacccctaatatgctgcataactttttgagcgagcaaaaaactataagttatgccggttgtttcacacaatgcctgctgtttatcgcacttgtgatcactgagttctatattcttgcgagtatggctctggatagatatgttgctatatgttcaccactccactattccagcaggatgagcaagaatatttgtgtttgtctggtgacaatcccttatatgtatggctttctgagcggctttagccagtcgctcctcacattccacctgagcttctgtggcagcctggaaatcaaccatttctactgtgctgatcccccacttatcatgttagcttgtagtgacacccgcgttaagaagatggctatgttcgtggtggcaggatttaacttaagcagcagtcttttcataatcctgctgtcatacctatttatctttgccgctatcttccggattcgaagcgctgaaggtcgacacaaggcattttctacttgtgcctcccaccttacaatagtgacacttttttacggcaccctcttctgtatgtatgtgcggcctccctctgagaagtcggtggaggaatctaaaatcacagctgtattttacactttcttgtcaccaatgctgaaccccttgatttatagcctgcgaaacactgacgtcatcttagctatgcaacagatgatccgcggaaaaagttttcataaaatcgcagtgtag

SEQ ID NO: 28512 - DNA, 948 bp, Artificial Sequence
  Description of Artificial Sequence: Synthetic coding sequence
atgttatcccccaaccacaccatcgtgaccgagttcattttattagggttaacagatgatcctgttctagagaagatcctgtttggggtgttcttggctatctacttgataactttggcgggcaatctgtgcatgatcttgttgataaggactaattcgcaattgcagacccccatgtatttctttttgggtcatttgagttttgtcgacatctgttattcttctaatgtcaccccaaacatgcttcataatttcctcagcgagcagaaaacgatcagttacgccggatgttttacccagtgcctgctgtttatcgccttggtgatcactgaattttacttcctggcgtctatggcactcgacaggtatgtcgctatctgtagccctttgcattatagtagtcgcatgagcaaaaatatatgtatctccctggtaaccgtgccatacatgtacggattccttaacggcttgagccagacactcctcaccttccacctgagtttctgcgggagtttggaaataaatcacttctactgtgcggacccgcctttgatcatgcttgcgtgtagcgacacaagagttaaaaaaatggcaatgttcgtggtcgccgggtttacgctctcttcctccttgttcatcattctcctgtcgtacctgttcatctttgccgccattttccggatcaggtctgctgaaggccggcataaagccttttccacctgtgcttcacacttaaccattgtgacgttgttctatgggacactgttctgcatgtatgtgcgccctccaagtgaaaaaagcgtggaggagtctaagatcatcgctgtgttctacaccttcctatcacccatgctgaaccctttgatatatagcttgcggaaccgcgacgtgatattggctatccaacagatgataagaggtaaatctttctgtaagatcgctgtgtag

SEQ ID NO: 28513 - DNA, 918 bp, Artificial Sequence
  Description of Artificial Sequence: Synthetic coding sequence
atgagtaatacaaatggctctgcaatcacagagtttattctgctaggcctgaccgactgtccggagctgcagtctctgttgtttgtgttattcctggtcgtttacctcgtcactctcctcggaaatctgggaatgattatgcttatgcgcctggattcaagactgcatacccctatgtactttttcctgacaaacctggcgtttgtcgatctctgctacacaagtaacgctacacctcagatgtcaactaacatcgtgagcgaaaaaaccatttcttttgctgggtgctttacacagtgctacatatttatcgctctgctcctgaccgagttttacatgttagctgccatggcttacgataggtacgtggctatttacgatcctttgcgctacagtgtaaagacatcccgccgggtgtgcatctgcttagccaccttcccttacgtctatggcttcagtgacggcctgtttcaggcgattttgacgttccgattgacgttctgcagatctagcgtcatcaatcacttttactgtgccgaccctcccttaattaaactcagctgctccgacacttatgtaaaagaacacgcaatgttcatctctgctggctttaatttgtcttccagtttgacaatcgtcctggtgtcctatgccttcattctggccgcaatcctgcgaattaagtcagctgagggaaggcacaaagcattctctacttgcgggtcccacatgatggcggtgacgcttttttacggaacactcttttgcatgtatatacggccacctacggacaagaccgttgaagagtctaagattattgctgtgttctacacctttgtttctcccgtcctcaatccattgatctacagtctgaggaacaaggacgtgaaacaggctcttaagaacgttttgagatag

SEQ ID NO: 28514 - DNA, 924 bp, Artificial Sequence
  Description of Artificial Sequence: Synthetic coding sequence
atgctgaacttcaccgacgtgacagaattcatccttctcggcttaacttctagacgggagtggcaggtgttgttttttataatttttctagtggtctacatcattacaatggtaggaaatatcgggatgatggtgttgatcaaagtttccccacagctaaacaacccaatgtacttcttcctcagccacctaagcttcgtggacgtttggttttcttccaacgtgacaccaaagatgctggagaacctgctgagcgataaaaaaaccattacatatgcaggctgtctagtgcagtgctttttttttattgccttggtacatgtcgagatcttcatactagccgctatggccttcgatcgctatatggccatcggtaacccgctactgtacgggagcaagatgtcgcgtgtagtatgcattagactaattaccttcccttacatctacggttttctgacatccctcgctgccacactgtggacctacggcctttacttctgcggaaaaattgagattaatcacttctattgtgctgacccccctctcataaagatggcctgcgccggcacatttgtaaaggagtacaccatgatcatcctggcaggcattaactttacttattccctgacggtaatcattatttcttatttgtttatactgatcgccatcctgcgaatgcgctctgcagagggcagacagaaggccttctccacctgtggaagccacctcactgctgtgatcatcttctacgggaccttaatcttcatgtatcttaggaggccgaccgaggaatctgttgaacagggtaagatggtcgcagttttctacacgactgtgattcccatgttaaatccaatgatctacagcctgcgcaataaagatgtgaaaaaggccatgatgaaagttatttcccgatcgtgctag

SEQ ID NO: 28515 - DNA, 936 bp, Artificial Sequence
  Description of Artificial Sequence: Synthetic coding sequence
atgcggaggaactgtactctcgtgacggagttcatcctactgggcctcactagccgccgggagctccagatcctcctcttcacacttttcctggcaatctatatggtaactgtggctgggaacctggggatgatcgtcttgatccaggccaacgcttggcttcacatgcctatgtatttttttctctctcacctaagctttgtggacctgtgcttctcttccaatgtgacacccaaaatgttagagattttcttatccgagaagaaatccatctcatacccggcgtgtctagtccaatgctacctatttatcgctctggtacacgtggagatttatattctggcagtaatggcttttgaccggtacatggctatctgtaatcctctgctgtatggctcccggatgagcaaatcggtttgttcttttttaattactgtcccatacgtgtatggcgcactgacaggcctgatggaaaccatgtggacttataatcttgctttctgtggaccaaacgaaatcaaccacttttactgtgccgaccctcctttgatcaaactggcctgcagcgatacctataataaggaactgagcatgttcatcgtcgcggggtggaatctgtcgttcagtctcttcatcatatgtatttcctatctgtacattttccccgccattcttaagatccgttctaccgagggaagacagaaggccttttcaacgtgtggcagccacctgactgcggtaacaatcttttacgcaaccttgtttttcatgtatctgagaccacccagcaaggagtcagtggagcaggggaagatggtagcagtgttttatacaactgtgataccaatgctgaatctgatcatttattccctgcgtaacaagaacgttaaagaagccctgatcaaggagttgtctatgaagatatacttttcctag

SEQ ID NO: 28516 - DNA, 933 bp, Artificial Sequence
  Description of Artificial Sequence: Synthetic coding sequence
atgccgaactttacagacgtgacggagtttacactgctgggcctgacctgcaggcaagagctgcaagtcctctttttcgttgtgttcttggccgtgtatatgatcacactgctagggaatattgggatgatcatactcatctctatctccccacagctacagtcaccaatgtactttttcctgagccacctctcctttgctgacgtgtgtttttcctccaacgttacacccaagatgcttgagaatctgttgagcgagaccaaaactatctcttacgtaggctgcttggtgcagtgttatttctttattgctgtggtgcacgtcgaagtctacatcctcgccgtgatggcttttgaccggtatatggccggatgcaaccccttgctctatggcagtaaaatgagtagaacagtgtgtgtcaggttgatttcagtgccctacgtctacggattttccgttagtttgatatgtacgctctggacatacggcctgtacttttgtggaaatttcgagattaaccatttctattgcgcagacccacctttgattcagattgcctgcggtcgggtgcatatcaaggagatcactatgattgtgattgctgggataaacttcacgtactcactctctgtagtgttgatcagctacacattgatcgtcgttgctgtgcttcggatgcgctcggccgatggaagacggaaggctttcagcacgtgcggcagccacctgaccgccgtttccatgttctacgggacccccatcttcatgtacctaaggcgtcctactgaggagtccgtggaacagggcaagatggttgctgtgttctacacaaccgtgatccctatgcttaaccccatgatctattccctgcggaataaagatgtgaaggaagcagtaaacaaggctataacgaaaacatacgtacgacagtag

SEQ ID NO: 28517 - DNA, 969 bp, Artificial Sequence
  Description of Artificial Sequence: Synthetic coding sequence
atgaactctctgaaagacggaaatcatacagcattaactggcttcatactgttaggtctgactgacgacccaattctcagagtgattttgttcatgattatcctttcagggaacctatcaattatcattctgattagaatctcctctcagttacatcatcccatgtacttctttctgtcccatttagcatttgcagatatggcatacagttcctcagtgaccccgaatatgttagtcaatttcttggtcgagcggaataccgttagctacctgggttgtgccatccagctgggaagcgccgccttcttcgcaacagttgagtgcgtgctcttggccgccatggcatatgaccggttcgtggcaatctgttcgcctctgttgtacagcacaaaaatgtcaacccaggtgtcagtccagctgctgctggtggtttatattgctggattcttaatcgccgttagttacaccacatctttctattttctgctattttgcggtccaaaccaagttaatcattttttttgtgatttcgcgcctctcctggaactgagttgctccgatatttcggtaagcactgtggtcctttccttctcctccggatctatcatagttgtcaccgtgtgtgttatcgctgtgtgctacatctacattctgatcacaattttgaagatgcggagtactgagggccaccataaggccttcagcacttgtacaagccatctcacggtggtgactctcttttatggaaccattacctttatttatgtgatgcctaacttctcttacagcaccgaccagaacaaagtggtttccgttctttacactgtggtgattccgatgttaaatccgctaatctactctctccgaaacaaggaaatcaagggagccctcaagcgggagctggtcaggaagattctgtcccacgacgcctgctatttctcacgcacttcgaataatgatatcacatag

SEQ ID NO: 28518 - DNA, 936 bp, Artificial Sequence
  Description of Artificial Sequence: Synthetic coding sequence
atgggcaccggtaacgatactaccgtagtggagttcaccttgttgggactgtctgaagacaccaccgtgtgtgccatattgttcttagtgtttctgggaatctatgtggtgacactgatggggaatattagcattatcgtcttgattagacggagccatcacctccacactcccatgtatattttcttatgccatctcgccttcgttgacattggatatagctccagcgtgacacctgtgatgcttatgtcttttctcaggaaagagacttccctgcctgtggccggctgcgtggctcagctttgtagtgtggtcactttcgggactgccgaatgttttcttctggcagcaatggcatatgacaggtacgtggcaatttgtagcccactgttgtattcgacttgtatgagccctggagtctgcatcattttggtaggaatgagctatctcgggggctgcgtgaatgcctggactttcataggttgcctgttgaggcttagcttttgcgggcctaataaggtgaatcactttttttgcgactattcacccctgttgaaactggcatgctctcatgacttcaccttcgagattatccccgccatctcatccggttcaatcatagttgcaactgtttgtgtcatagccatctcctatatatacatattaattaccattctcaagatgcacagcacaaagggacgtcataaggccttcagcacctgtacatcacacctgacagcagtgacattgttttacggcaccataactttcatatatgtgatgcctaaaagcagctacagcactgaccagaataaagtggtctctgtattctataccgtcgttattcctatgctaaaccccctgatctactcacttcggaataaagagatcaaaggagctctcaagcgcgagctgcgcattaagatcttctcatag

SEQ ID NO: 28519 - DNA, 975 bp, Artificial Sequence
  Description of Artificial Sequence: Synthetic coding sequence
atggctgaggtaaatattatttacgtcacagtgttcattctgaagggcatcacaaatcgtcctgagctgcaagccccttgtttcggggtgttcctggtcatctatctcgtcaccgtgctcgggaatttgggattgattacactgataaagatcgacacccggctgcatactccaatgtactatttcttgtctcatctagccttcgttgatctctgttattccagtgccattactccgaaaatgatggttaattttgtagtggaaaggaatactatacctttccacgcgtgcgccacccagttagggtgttttcttacattcatgatcaccgaatgttttttgctagcaagtatggcctacgactgttatgttgccatctgttctcccttgcactatagtacactgatgagtaggcgagtctgcattcagttagtagccgtaccgtatatctattcttttctagtcgctctgttccacacagtgattacgttcaggcttacttattgcgggccaaacctaataaatcacttctactgtgatgatctaccttttctggccctgagctgctccgatactcacatgaaggagatcttgatctttgcattcgcgggattcgacatgatcagttcaagctccatcgtgctgacgtcatacatttttatcatagcagctatcctgaggatccgttcaactcaggggcagcataaagccattagtacctgtggcagccacatggtcacagtgaccatcttctacggcacacttatattcatgtacctacagcccaaatctaaccactctctggacacggacaagatggcgtcggttttctatacggtggtaattcctatgctgaaccccctaatatacagccttcggaacaaagaagtcaaggacgccagtaagaaagccctggacaaaggatgcgaaaatctgcagatcctgacatttctcaagattaggaagctctattag

SEQ ID NO: 28520 - DNA, 981 bp, Artificial Sequence
  Description of Artificial Sequence: Synthetic coding sequence
atgagcggcctgcccagcgacatggatttgtacaaactccagcttaacaactttaccgaggtaacaatgttcatccttatctcattcacagaggaattcgatgtccaggtcttcttatttctgctgtttctggccatctaccttttcacactcatcggcaacctcggattagtagtacctattattggagatttttggctccattcaccaatgtactattttctcggggtactgtctttcttagacgtctgttatagtacagtggtcacgccaaaaatgctggttaacttcctggctaagaacaagagtatcagttttctcggctgcgccacacagatgttcctggcctgcacatttgggaccacagaatgtttcctgctggctgccatggcctacgacagatacgtggctatctacaaccctctgctttacagcgtatctatgtcgccaagagtttacgtcccgctaataacggcttcttacgttgcgtccattttgcacgccacaatccatactgtggctaccttctccctgtcgttctgtggctctaacgagattcggcatgtgttctgtaacatgcccccgctgcttgctataagctgcagtgatacccatgtgatccaactcctgtttttctactttgtgggctccattgagatcgtgaccatcctcattgtgcttatttcctatggtttcattcttcttgctatcctcaagatgcagagcgcagaaggccggaggaaagttttctcaacatgcggggcgcacctcacaggagtgactatctatcacggcacaattctgttcatgtatgtcaggccctcatcttcttacacatcagacaacgatatgatcgtgtctatcttttatactattgtcatcccaatgctgaacccgatcatctactctctgcggaataaagatgtaaaggaggcgattaagagactgctggttcgaaattggttcattaacaagttgtag

SEQ ID NO: 28521 - DNA, 1080 bp, Artificial Sequence
  Description of Artificial Sequence: Synthetic coding sequence
atgtcctattccatctataaatccacagttaatattcctttgtctcacggtgtcgttcactccttttgccacaatatgaactgtaatttcatgcacatcttcaaattcgtcctcgattttaacatgaagaacgtcaccgaggtgaccctgttcgtactcaaaggattcaccgataacttagagctacaaacaatctttttttttttgtttcttgcgatttacctgtttacgctgatgggtaatctgggtcttatactagtggttattcgcgatagccagctgcataaacccatgtactatttcttgagcatgctgtctagcgttgacgcatgttatagcagtgttattacccctaatatgcttgttgacttcaccaccaagaataaggtgatttccttcctcggctgcgtcgcccaagtgttcctcgcatgctcctttggaactacggagtgcttcttactggctgctatggcctacgaccgatatgtggctatatacaacccccttctgtactcagtgtctatgagcccccgggtgtacatgcccctgatcaatgcctcatacgttgcgggaatactgcatgccacaattcatacagtagcaaccttttctctgagtttctgcggcgcaaatgaaatccgccgtgtattttgcgacattcctcctttgttggccatctcttacagtgacacccacaccaaccagctcttactgttctatttcgtcggcagcattgagctggtgacaatcctaattgttctgatcagctatgggctcattctcctcgctattttaaaaatgtactctgctgaaggtaggagaaaggtgttctctacatgtggggctcatctgaccggcgtctctatctactacggcactattctcttcatgtatgtgcggcctagctcttcctacgctagcgaccacgacatgattgtatcaattttctacacaatcgttattcccttgctgaaccccgtgatctactccctgcggaacaaggacgtgaaagattcaatgaagaaaatgttcggaaagaaccaagtcatcaacaaggtctactttcacacgaagaagtag

SEQ ID NO: 28522 - DNA, 1023 bp, Artificial Sequence
  Description of Artificial Sequence: Synthetic coding sequence
atggattctactttcactggctacaatctgtataatctgcaagtaaaaacggagatggacaagctgtctagtggactggacatttaccgcaacccactgaaaaataaaactgaagtaaccatgttcattctaaccggattcactgacgatttcgagctgcaggtgttcttatttctgttgttctttgccatctacctgtttacattgatcggaaacctgggactcgtggttcttgtaattgaggatagttggctgcacaaccccatgtattactttctgtccgttctgagttttctggatgcatgttactccacagttgtgacccccaaaatgctagttaactttctggccaagaacaaaagcatcagctttatcgggtgcgcgacacagatgttgctcttcgtcacttttggcacaaccgaatgcttcctgcttgctgctatggcctacgaccactatgtcgccatctataatcccctcttgtactcagtgtcgatgagcccccgcgtttatgtcccactcatcacagcctcctacgtggctggcatcttgcatgcaactattcatatagtcgccacctttagtctaagtttttgcggtagtaacgaaatccggcacgtgttctgcgacatgcccccattgctggcaatctcctgcagcgatacccacaccaatcagctgctcctgttttactttgtaggctcaatcgagatcgtcacaatcctgattgtgctaattagctgtgactttattctgctttcaattcttaaaatgcactcagccaaaggcagacagaaggcattttctacatgtgggtcccatcttacaggtgtgaccatttaccacggtactatactggtatcttatatgcgtcctagcagctcctacgcctctgatcatgacattatcgtttcaattttttatactattgtaatccctaagctgaatccgattatctactccttgcgcaataaagaggtgaagaaagcggtaaagaagatgcttaaacttgtctataagtag

SEQ ID NO: 28523 - DNA, 966 bp, Artificial Sequence
  Description of Artificial Sequence: Synthetic coding sequence
atggagcgcaaaaatcagaccgcgatcacagaatttataatactgggattctccaatctaaacgagctccagttcttgctgtttaccatcttcttcctcacctacttttgtacactgggcggcaatatcctgatcatattgacaacagtcacagatccccatctccacacccccatgtattatttcctgggcaatcttgcatttatcgacatctgctatacgaccagcaacgtgccacagatgatggtgcatctattgagcaagaagaagagcatttcctacgtaggatgcgtggtccaactttttgcttttgtgttctttgtggggagtgagtgcttactcctggccgccatggcttatgataggtatatcgcaatctgtaacccgctacgctattctgtcatattaagtaaggtcctctgtaaccagctggccgcctcctgctgggcagccggctttctgaattctgtggtccacaccgtgttgaccttctgcctgcctttttgtggcaacaaccagattaattatttcttctgcgatatccctcccctcctcattctctcatgtggaaacacttccgtgaacgagctggccctcttatctacaggggtgttcattggctggacacctttcctgtgcattgtcctgagctacatttgtattataagcaccattttgcgtatccaatcttctgagggtcggcgcaaggcttttagcacatgcgcgtcccacttggctattgtatttctgttttacgggtcagcgattttcacgtacgtcagacccatctccacctacagtctgaagaaggaccgtctcgtgtcagtactgtacagcgtagtaaccccgatgctgaaccctattatttacacactgaggaacaaggatatcaaggaggctgtgaaaacgatagggtccaagtggcaacctcctattagttctttagacagtaagctgacctactag

SEQ ID NO: 28524 - DNA, 966 bp, Artificial Sequence
  Description of Artificial Sequence: Synthetic coding sequence
atggaacggaaaaatcaaaccgccataacggaatttatcattctgggcttcagcaatcttaacgagttgcagttcctactgtttacaattttcttcctgacctatttttgcacacttggcggcaacatacttataatacttaccaccgtcacggatcctcatctgcacacaccaatgtactacttcctggggaaccttgcttttatcgatatctgctataccacaagcaatgtcccccagatgatggtgcacctgttatcaaagaagaagtctataagttacgttggatgcgtcgtgcaattgtttgcgtttgtgttctttgtcggttccgagtgcctgctccttgcggctatggcctatgacagatacattgccatttgtaatccactccgctacagtgtgattttgtcgaaggtcctgtgcaatcaactggcagcaagctgttgggccgctggattcctgaatagcgtcgtgcacacagtcctgactttttgcctgcccttttgcggcaataaccagatcaattattttttttgtgatatcccccctctccttatcttgagttgcgggaacacttctgtgaacgagcttgccctgctatccacaggggtgttcatcggttggactccctttctttgtatagtcctgtcctatatttgcattattagcacgattcttcgcatccagagcagtgaggggcgccgcaaggccttctctacttgcgcttcgcacttggccatagtgttcctgttctatggcagtgcaatttttacatatgtccggcctatctccacttattcgctcaagaaagatcggctagtctcagtgctttatagtgtcgtcacccccatgctgaaccccatcatctacaccttacgaaacaaggacattaaagaggcagtgaagaccattggctccaagtggcagccacccatctcctctcttgacagcaagttaacttattag

SEQ ID NO: 28525 - DNA, 966 bp, Artificial Sequence
  Description of Artificial Sequence: Synthetic coding sequence
atggaaaggaaaaaccagactgctatcacagagttcattattctcggattttccaatctgaatgagctccaattcctcctgtttaccatttttttcctcacttacttctgtactctaggaggcaatatcctcattatccttaccacagtgacagatccccatctgcataccccaatgtattacttcctggggaatcttgcttttatagatatttgctatacaacatctaacgtgcctcagatgatggtgcatctgctcagtaagaagaagtcaatatcatatgtgggctgcgtcgttcagttgttcgcatttgtgttcttcgtcggctccgagtgcctgctgctggcagccatggcttatgatcgctacatagctatttgcaatcctttgcggtactctgtgattctgtcaaaagttctgtgcaaccagctcgccgcctcctgctgggccgccggtttccttaatagcgtagtgcacactgtcctcaccttttgtcttccattttgtggcaacaatcaaatcaactacttcttttgcgacataccccctctgctaatcctcagttgcggcaacacctctgtaaacgaactggccctcctgtccacaggcgtgttcataggttggacgcctttcctgtgcatcgtcctcagctacatctgcattatcagcacaattctacgtattcaatcgagcgaggggcgcagaaaggcattttctacgtgtgcttcacaccttgccattgtgtttctcttctatggatccgccatcttcacttacgtgcgccccatctctacctactcactcaaaaaggatagattggtgtctgttctgtatagtgtggtcaccccaatgctgaatcctataatttataccctgcgtaacaaggacattaaggaggccgtgaagactattggctctaagtggcagccacccatttccagcctggactccaagctgacctattag

SEQ ID NO: 28526 - DNA, 966 bp, Artificial Sequence
  Description of Artificial Sequence: Synthetic coding sequence
atggagcgaaaaaaccagactgcaattacggaattcattatattgggatttagcaatcttaatgagctgcaattcctgctcttcaccatattcttcttgacatacttctgtacactgggtggcaatattctcatcattctgactaccgtgacggatccacaccttcacaccccgatgtattactttctggggaatctggccttcattgacatctgctacacgacctctaacgtccctcaaatgatggttcacctgctgagcaagaaaaagtccatctcctacgttgggtgtgtggttcaactgttcgcctttgtcttttttgtgggatctgaatgcctgctattagcagccatggcctatgataggtatattgccatctgtaaccccctgaggtattcagtgatcctcagcaaagttctatgcaatcaacttgctgcgagctgttgggccgcaggatttctgaactctgtggtgcacacagtcctgactttctgtttacccttctgtgggaacaaccagattaactattttttctgcgatatcccaccactcctcatcctgtcctgcggcaatacaagcgtgaatgagctggcactactttccactggtgtgtttatcggctggacgcctttcctgtgcattgtgctgagctacatctgtatcatctctacaatccttaggatccagagctccgagggacggcggaaggctttttccacatgtgcatcccatctggcaatagttttcttattttatggttctgccattttcacttacgtgcggcccatttccacttatagtctgaaaaaggaccgccttgtatccgtcctatacagtgtggtcaccccaatgctgaaccccattatatacacactgcgtaacaaagacattaaggaggcagtgaagaccatcggctccaagtggcaaccccctatcagttcgctcgactcaaaactgacatactag

SEQ ID NO: 28527 - DNA, 966 bp, Artificial Sequence
  Description of Artificial Sequence: Synthetic coding sequence
atggagaggaaaaatcagacagccattactgaattcattatactgggtttcagtaacctaaacgagctccaattcctcctgtttacaattttttttctgacatacttttgtaccctcggtggcaatatcctcatcattttgacaactgttaccgacccgcacctgcatacgcccatgtactactttctggggaacctggcttttatagatatttgctacactacctccaacgtccctcaaatgatggtgcacctgctttctaaaaagaagagcatttcctatgttgggtgtgtcgtgcagttgttcgcctttgttttttttgtcggaagtgagtgcctgctgttggccgccatggcctacgatcgctacattgcgatctgcaacccgctgcgctacagcgtgatcttgtcaaaggttttatgtaaccaacttgccgcaagttgctgggctgctggcttcctcaatagcgtggtgcatacagtgctgaccttctgccttccattctgtggtaacaaccagattaactactttttttgtgacattcctccattgctgatccttagctgtgggaataccagcgtcaatgaactggcgctcctgagcactggggtctttattgggtggactccctttctgtgcatcgtgctgtcttatatatgtatcattagcaccattctccggatccaaagttcagaaggccggcggaaggccttctcgacatgcgcttcccacttagctatcgtgttcttattctatggaagtgctatatttacatatgtaaggccgatctctacttacagcctgaagaaagaccggctcgtgagtgtcctctactcagtggtcaccccaatgctgaatcccattatctacaccctccgcaataaggacattaaggaggctgtgaaaaccattggaagcaagtggcagccgcccatatcgagcctggattctaagctgacatattag

SEQ ID NO: 28528 - DNA, 966 bp, Artificial Sequence
  Description of Artificial Sequence: Synthetic coding sequence
atggagcggaagaaccagacagccatcaccgaatttattatcttaggtttctctaatctgaacgaactgcagtttctgcttttcaccattttcttcctgacctatttttgcacacttggcggtaacatattgatcattctgacaacagtgaccgatccacatctccatacgcccatgtactatttcttaggtaatcttgcttttattgacatttgctatacgacatccaacgtgccacaaatgatggtgcatctcctcagtaaaaagaaaagcatttcttacgttgggtgcgtggtccaactcttcgccttcgtgttttttgtaggaagcgagtgtctgctgctggccgccatggcgtacgatcgctatattgcgatttgtaacccactgagatacagtgtgatacttagcaaagtgctgtgcaaccagttggctgcttcctgttgggctgcaggctttttaaatagcgtggtgcacacggtgctgacattttgcttacctttttgtggaaacaatcagatcaactactttttctgcgacatccctccactgctaattttaagttgtggaaacacctcagtgaatgagttagctctgctgagcactggtgtctttattggatggacccctttcctgtgtattgtgctctcctacatttgtatcatcagcaccatcctgcgaatccagtctagtgaggggcggcggaaggccttttctacctgtgcttcgcatttggctatagtgtttctgttttacgggagcgcaattttcacttatgtacgccctatatcaacctatagtttgaagaaagaccgcttggtttctgtgctctattcagtagtaacccccatgctgaatcctattatatacactttgaggaacaaagatataaaggaagctgtaaagactattggtagtaagtggcagccccctatttcttccctcgactccaagctcacctattag

SEQ ID NO: 28529 - DNA, 966 bp, Artificial Sequence
  Description of Artificial Sequence: Synthetic coding sequence
atggagcggaagaaccagaccgccatcaccgaatttattatcctcggttttagcaatcttaatgaacttcagtttttgctgtttaccatcttctttctgacatatttttgcacactggggggaaacatcttgattattctaacaacagtgaccgatccgcatctgcacactccaatgtattactttctgggcaatctcgcattcattgacatctgttacaccactagcaatgtcccacagatgatggtacatctgctctcgaagaaaaaatcaatctcgtatgtgggttgcgttgtgcagctcttcgcctttgtgttttttgtcggctctgagtgtcttctcctcgcagccatggcttacgataggtatatcgcaatttgtaatcccttacggtatagcgtaattctgtcaaaagtcctgtgtaaccagctagccgcaagctgctgggctgctggtttccttaactctgttgttcacactgttctcactttctgcctacctttctgcggcaacaaccagattaactactttttttgcgatatacccccacttctgatcctctcatgtggcaataccagtgtgaatgagctcgccctgctgagtactggcgtgttcatcgggtggaccccctttctttgcattgtcttgtcctacatctgtataatttccacaatcctgcggatccagtcgtccgaaggaagaagaaaggcctttagcacgtgtgcctctcacctggccatagtcttccttttttacggcagtgctatattcacctacgtcagaccaataagcacatactcattgaagaaagatcggctggtctccgtgctttactctgtcgtgaccccaatgttaaatcctattatttacacactgagaaacaaggatataaaggaagcggtaaagaccatcggatccaaatggcagccacctataagttcgctggactcaaagcttacgtattag

SEQ ID NO: 28530 - DNA, 966 bp, Artificial Sequence
  Description of Artificial Sequence: Synthetic coding sequence
atggagcgtaagaatcagaccgctatcactgagtttatcattctagggttcagcaaccttaacgagctacagttcctgctgtttacgatctttttccttacctacttttgcactctcggcggaaacattctcattatcttgaccacagtaactgatcctcatctccatactcctatgtactactttcttggaaatctggctttcatcgatatctgctatacaacttccaacgtgccccagatgatggttcaccttctatccaaaaagaaatccatcagctacgtgggatgcgttgtgcagctttttgcttttgtgttcttcgtcggcagcgagtgtctcttactggctgccatggcctacgatagatacatagcaatttgcaaccccctccggtatagcgtgatcctgagcaaagtcctctgtaaccagctggccgccagctgctgggctgctggattcctcaacagcgtggttcacactgtcctgaccttctgtcttcctttttgcggcaacaatcaaattaactattttttttgcgatatccctccactcttaatcctgtcttgtgggaacacttctgtcaacgagctggcccttctgagcactggcgtgttcatcggctggacacccttcctgtgcatcgttttgtcttacatctgcattatcagtactatcctgagaatccaaagttccgaagggaggagaaaagcattctctacatgcgcctctcatctggctatcgtgtttctgttctacggttccgccatctttacatacgtccgaccaatttccacatattctcttaaaaaagaccggcttgtctcggttctgtactcggtggtaactccaatgctgaatcctatcatctatacgcttcgcaataaagatataaaagaggctgtgaagaccatcggatccaagtggcaaccgcccatcagctcattagatagcaagcttacctattag

SEQ ID NO: 28531 - DNA, 966 bp, Artificial Sequence
  Description of Artificial Sequence: Synthetic coding sequence
atggagaggaagaatcagacagctattaccgagttcatcattttaggattctccaacctcaacgagctgcagtttctgctttttacgatttttttcctgacctacttttgtaccttaggagggaatatcctaattattttgacaaccgtcactgaccctcaccttcacacacctatgtactacttcttgggaaatctggcttttattgacatatgctatacaacttccaacgtgccccagatgatggtgcatctgctctccaaaaagaagagcatctcctatgttggctgcgtggtccagctgttcgcctttgtgttcttcgtagggagtgagtgtctgctccttgccgccatggcatatgaccgctacatcgcaatttgtaatccgctaaggtactccgttatactttcaaaagttctgtgtaatcaactggccgcttcttgctgggcggcaggatttctgaactcagtagtgcatactgttctcacgttctgcctacctttttgcggtaacaaccagatcaactatttcttctgtgacattcctcccctgctgattctgtcttgtggcaacacctccgtcaatgagctggccctgctcagtacaggcgtgttcatcggatggactccattcctgtgtatcgttctaagctatatttgcattatcagtacaattctgagaatacagtcaagcgaaggtagacggaaggccttcagcacttgtgccagccacttggccatcgtgttcctgttctacggttcagcaatctttacatacgtcagaccaattagcacatactccctcaagaaggacagactggtttccgtcctgtatagcgtggtaacccccatgctcaaccctattatctacacacttcgaaacaaagatatcaaagaagcagttaaaaccatcgggtccaagtggcagcctcccatctccagtctggacagtaagctgacttattag

SEQ ID NO: 28532 - DNA, 933 bp, Artificial Sequence
  Description of Artificial Sequence: Synthetic coding sequence
atggactgggaaaattgttcttccctgacagatttctttctgctcgggattacaaataatcctgaaatgaaggtaacactgttcgccgtgttccttgccgtctatatcatcaacttcagcgctaatctggggatgattgttctgatccgtatggactaccaactccacacacctatgtacttcttcctgagccatctgtcattctgtgacctttgctactcaaccgccacgggccctaagatgttagttgacctgctcgccaaaaacaaaagcatacccttctacggctgtgccctgcaatttctggtcttttgcatctttgccgatagcgaatgcctcctgctgtccgtcatggctttcgacaggtacaaagccatcatcaacccactgttatacaccgtgaatatgtcgtcacgcgtttgctatctgctgcttaccggggtttacctcgtcggcatagcagacgcacttatacacatgactctggcttttagactgtgtttttgcgggtcaaatgagataaaccatttcttctgcgatattcccccactgctgctcttgtcgcggtccgacactcaagtcaacgaactggtcctgttcactgtcttcggcttcatagagctcagcacaatctccggtgtgtttatatcatattgctatatcattctctccgttctggagattcactcagcagaaggcaggttcaaggcgctctccacctgcacttctcatctgagcgcagtcgccattttccaaggcaccttgctcttcatgtacttccgcccctcctctagctactccctggatcaggataaaatgacctccctgttttacaccctggtcgttcccatgctaaaccccttgatttatagcctccggaacaaggacgttaaggaggcacttaagaagctgaaaaataaaattttattttag

SEQ ID NO: 28533 - DNA, 942 bp, Artificial Sequence
  Description of Artificial Sequence: Synthetic coding sequence
atgtcaataattaacacatcatacgtcgaaattaccacgttcttcctagtggggatgccaggtctagaatacgctcatatctggatcagtatcccaatctgctccatgtacttaatcgctattctggggaatggaactatcttatttatcattaaaaccgagccatcactgcacgggcccatgtattatttcctttccatgttagctatgtctgacctaggcctttccctctcttcattgcctaccgtgctgagtatcttcctgttcaatgccccggaaactagtagctccgcctgttttgcgcaggagttttttatacatggtttctccgttctggagtcctctgttcttctaatcatgtctttcgacagattcctggccatccataatcccttacggtacacttctatcctgactaccgtacgcgttgcacagatcgggatcgtgttttccttcaagtcaatgttgctggtgctcccatttcccttcaccctgcgctctctcagatattgtaaaaagaaccaactctcacattcatactgcctgcaccaggacgtgatgaaattggcttgctcagacaatagaatagatgttatctacggtttctttggagccttatgcctcatggtggactttattctcatagccgtctcctataccttgattctgaagactgtccccggcattgcttccaagaaagaagaacttaaggccctgaacacatgcgtaagccatatatgcgccgtaatcatcttttacctccctattatcaaccttgcggtggttcaccgctttgccggccatgtcagcccccttatcaatgtcctgatggcaaacgtcctcctgcttgtgcctcccctcatgaaacccatcgtttactgcgtgaaaaccaagcagataagagtgcgagtggtggctaaactgtgtcagtggaagatatag

SEQ ID NO: 28534 - DNA, 942 bp, Artificial Sequence
  Description of Artificial Sequence: Synthetic coding sequence
atgagtattatcaacacctcttacgttgaaataactacttttttcttggtgggaatgcccggcctggaatatgcacatatatggatctctatcccgatttgtagcatgtatctaattgccatattggggaacggtactatattgttcattatcaagacagagccgtctttgcacgagccgatgtattacttccttagtatgcttgcgatgtcagatctgggtctaagtttgtcctctctacctaccgtcttgtctatctttctgttcaatgcaccggagatcagctccaacgcctgttttgcccaggagttctttattcacggatttagcgttctggagtcttcagtgttgctaattatgtcttttgaccgattcctggccatacataacccgcttcggtacacatccatactgacgacggtcagagtcgcccagattggaatagtcttctcattcaagagcatgctcctggtgctgccatttcccttcactctgcggaacctgaggtactgcaagaaaaatcagctgagccactcctactgcctgcaccaggacgtcatgaagctggcctgcagcgataacagaatcgacgtcatctacggtttcttcggcgcgctgtgtcttatggtggacttcattctgatcgcggtgagctacaccctgattttgaaaactgtgctaggcatagcctctaaaaaggagcaactcaaagctctgaacacctgtgtgagccacatctgcgccgtcatcatattttacctgcctataataaacctggctgtggttcacagatttgccagacatgtttctcccctcattaatgttcttatggcgaacgttttgctgctagtcccacccctgaccaaccctatcgtgtactgcgtaaaaacgaagcagatccgtgtccgtgtcgtggccaagctgtgccaacgcaagatttag

SEQ ID NO: 28535 - DNA, 939 bp, Artificial Sequence
  Description of Artificial Sequence: Synthetic coding sequence
atgtctgttcttaataatagcgaggttaaattgttcctcctgatcggcattcctggcctcgagcacgcccatatctggttctcaatccctatctgcctcatgtacttgttagccattatgggcaattgtacgatactctttataatcaaaactgagccctcgcttcacgagccaatgtactattttcttgcaatgctggctgtgtccgacatgggactctctctatcttctcttcctacgatgctgagggtgttcctgttcaacgccatgggaatttctcccaatgcttgtttcgcccaagagtttttcatacacgggtttaccgtaatggaatcctcggtccttctgatcatgagtctcgataggttcctcgctattcataaccccctcaggtactcctctatcttgactagcaacagagtggctaaaatggggttaattctcgcaattaggtcaatcctcctggtgattccctttcccttcacattgagaaggctgaaatactgccagaagaatttgctgagccactcctactgtctccaccaggacaccatgaaactggcatgctcagataacaagactaacgttatttacgggttctttatagccctgtgcactatgctggacctcgctctaatcgttctgagttatgtacttatcctaaaaacaatcctgagcatagcctcccttgcagagcggctgaaggctctgaatacgtgtgtgtcacatatttgtgccgtcctgaccttttatgtgccgatcatcaccctcgctgccatgcatcatttcgccaaacacaagtctcctttagtggtcattctgatagccgacatgtttctgctcgtcccccctctaatgaatccgattgtgtactgtgtgaaaacacgacagatttgggagaagattttggggaagcttctcaatgtctgcggccggtag

SEQ ID NO: 28536 - DNA, 894 bp, Artificial Sequence
  Description of Artificial Sequence: Synthetic coding sequence
ttccttcttatcggaattcccggactcgaacatgcgcacatctggttcagcatcccaatttgtctgatgtacctgctggctattatgggcaactgtaccattttgttcataatcaaaactgagccctccttgcacgaaccgatgtactatttcctggctatgcttgccgttagtgacatgggactgagtctgtcctcacttccgaccatgctgcgagtgttcctgtttaacgcgatgggcatcagccccaatgcctgttttgcgcaggagtttttcatccatggtttcacagtcatggagagcagcgtgctcctcatcatgagcctcgatcgcttcttagctatccataaccctttacgatattcctcaatcctgactagcaaccgtgtagcaaagatggggctgatcctggcaattaggtctatcctgctggtgatccccttcccttttaccctcagacggttgaaatattgtcagaaaaatctcttgagtcattcatattgtcttcaccaggatacaatgaaactagcgtgctcagacaacaagaccaacgtgatatatgggttttttatcgctctttgtaccatgttggacctcgcactgatagtgctgtcctacgtcttgattcttaagaccatcctgtcaattgccagcctggcggaaagactcaaagcattgaatacatgcgttagtcacatttgcgcagtgctaacgttctacgtgccaatcatcacactggcggctatgcaccacttcgcgaagcacaaaagtcccttggtcgtaatccttatcgctgacatgtttttgctggtcccaccattaatgaatccgattgtctattgtgtgaagacacggcaaatctgggagaaaatcctcggaatctactgtcactag

SEQ ID NO: 28537 - DNA, 957 bp, Artificial Sequence
  Description of Artificial Sequence: Synthetic coding sequence
atgagcgtgctcaacaatagcgaggtgaaactgttcctgttgattggaatcccaggactcgaacacgcgcacatttggttcagtattcctatctgcttgatgtacctgctggctataatggggaattgtacaatacttttcattatcaagacggagcccagcctgcacgaacccatgtattatttcctcgcaatgttagctgtgagtgatatgggcctgtcactatcctcccttccgacaatgctacgagtgttcctctttaatgcgatgggcattagtcccaacgcctgttttgcccaggaattcttcattcacgggtttacagtcatggaaagtagcgttttgttgatcatgagtcttgacaggttcctggctattcataatcccctgaggtactctagtatcttaacgtctaatagggtcgcaaagatgggcctgattctggccatcaggtccatcttactggtgattcctttcccttttaccctacgcagactgaaatactgccaaaagaacctgcttagtcactcttactgtctgcatcaggatactatgaagctcgcgtgttcagataataaaacaaatgtaatctacggatttttcatcgcactgtgcaccatgctcgaccttgcgctcatagtgctttcttatgtgctgatcctgaagactatcctttccatcgcctccttagctgagaggctgaaagccttgaacacctgcgtgtcacacatatgtgcagtgctcacgttctacgtgccaattataacactggctgccatgcaccattttgcaaaacataagtcaccacttgtcgttatactgatcgcagatatgttccttctggtgcctcctctgatgaaccctatcgtatattgcgtgaagactcgacaaatttgggagaaaatcctcgttacctttagattcataaaaactgtgaagaaattctggaagagatag

SEQ ID NO: 28538 - DNA, 939 bp, Artificial Sequence
  Description of Artificial Sequence: Synthetic coding sequence
atgtggcctaatattactgcggctcccttcttactgacgggattccccggattagaggccgcccaccactggatctcaattcctttcttcgccgtctacgtgtgcatccttctcggcaacggcatgctgctatacctgattaaacatgaccacagcctgcatgagccaatgtattactttctgacaatgcttgcaggtaccgacctgatggtgacgcttactacaatgcctactgtcatgggcatactgtgggtgaaccaccgcgaaatctcttctgtgggttgtttcttgcaggcctacttcattcactctctgtctgtggtggaaagtggcagcttactagccatggcatacgattgctttatagccatcaggaaccctcttcgctacgcgtcaatactcacaaacactcgggtaatcgcccttggcgtcggtgtgtttttgaggggttttgtgtctatcttgccggtgatcttgagattattttctttctcatactgcaaatcccacgtcatcacacgagccttttgcctgcaccaggagattatgcgcttggcctgtgccgatattacctttaatcgcctgtacccagtgatcctgataagcctaaccatctttctcgattgtctgatcatcctattttcctacatcttgattctgaacactgtgataggaatcgcatctggtgaggagagagcgaaggccttaaatacatgtatctcgcacatctcgtgtgtgttgatcttttatgttactgttatgggactaacttttatctataggttcggtaaaaatgtgcctgaggtggtccacataattatgtcttacatatactttctttttccaccattgatgaaccccgtcatttattcgattaaaacaaaacaaatccagtacgggatcataagactgctgagtaaacaccggttcagttcctag

SEQ ID NO: 28539 - DNA, 933 bp, Artificial Sequence
  Description of Artificial Sequence: Synthetic coding sequence
atgtggtacaacaattcggccggaccatttctgctgaccggctttcttggttctgaggccgttcattaccgcatctctatgtcgtttttcgtcatctattttagcgtgctgttcggaaatggcacccttttggttttgatctggaacgaccacagtctccatgagcctatgtactattttctggcgatgctggctgacaccgacctaggaatgacatttactaccatgcctactgtgctgggtgtactgctgttagaccaaagagagattgctcatgccgcctgttttacccagagctttatccatagtctggccatcgtggagtccggtatcctcctggtactggcctacgactgcttcatcgctattaggactcccctgcggtacaattgtatattaaccaattcccgggttatgaacatcggactgggcgtcctgatgaggggttttatgagcatactgcctataatcttgtcattgtactgctacccttactgcggttctcgagcgcttcttcataccttttgcctccaccaagacgttattaaactcgcatgtgccgatattacgttcaatcatatatatcccattattcagactagtttgacggtgttcctggatgccttgattattattttcagctacatcctgattttaaaaaccgtaatgggtatagcctcgggccaggaggaggcgaaaagtctgaatacgtgcgtgagccacatctcctgtgtcctggtatttcacattactgttatgggtttaagcttcatacaccgatttggcaaacacgccccacacgtggtgcccatcaccatgagctacgtccacttcttgttccctccgttcgtgaatccgatcatctacagcatcaaaaccaagcagatacaaaggagcatcataagactgttctccgggcagtctcgagcctag

SEQ ID NO: 28540 - DNA, 939 bp, Artificial Sequence
  Description of Artificial Sequence: Synthetic coding sequence
atgagttcttcaggctcatctcacccatttctgctgactgggtttcctgggctcgaagaagcccaccattggattagcgtgttctttctcttcatgtacatttctatcttgtttggtaacggcacgcttctcctgcttataaaagaagatcacaatctccatgaacctatgtatttttttctagctatgctggcagctaccgatcttgggctcgcccttacaacaatgccaacagtcctcggcgtgctgtggctagaccatcgcgagataggatctgcagcatgcttctctcaggcttatttcatacacagcctgagtttcctggagagcggcattcttctggccatggcctacgatcgctttattgcaatttgcaacccattgaggtacacatccgtactgaccaatactcgagtggtgaaaattggattaggcgtattgatgcgcggatttgtgtcagttgtccccccaatccggccactttatttcttcctgtactgccacagtcacgtgctgtcacacgctttctgtctgcaccaggacgtgatcaaactggcctgtgcggacacaactttcaaccgcctctacccagccgttctagtagtgtttatatttgtactcgactaccttatcatctttatctcatatgtgctgattttgaaaaccgtcctgtctattgcctccagggaggaacgtgctaaggcattgatcacctgcgtttcccacatttgttgcgtcctcgtgttctacgtgactgtgattggcttgtctcttattcaccgctttggcaaacaagtgccccacatagtccatctgattatgtcctacgcgtatttcctgttccctccattgatgaaccctatcacctactctgtgaaaactaaacagatacagaacgccatattacacctgtttaccacacaccggattgggacctag

SEQ ID NO: 28541 - DNA, 939 bp, Artificial Sequence
  Description of Artificial Sequence: Synthetic coding sequence
atgggcctaaataagagcgcatctacattccagctcaccggcttcccaggtatggagaaggcccaccattggattttcatacctctgctagcagcctacattagtattctactgggaaacggaactttgctctttctgatccggaacgaccacaacctgcacgagcccatgtattacttcctagcaatgctggctgccaccgaccttggagtcacccttactactatgcctaccgtcctcggagtgctgtggctggatcatagagaaattggccatggagcatgctttagccaggcctactttatccacacactgtccgttatggagtccggagtgctgctcgcgatggcatatgactgcttcattacgattagatctccacttaggtacacgtctatcttgaccaacacgcaagtaatgaaaatcggtgtaagggtattgacaagggccggactctctataatgcccatcgttgtccgcctgcactggtttccatactgtaggtcccacgtgctgtcccacgccttctgcctccaccaggatgttattaagctggcttgtgctgatataaccttcaatcgcctgtaccctgtcgtcgtgttgtttgctatggtcctgctcgactttctgatcatcttcttctcctatatcctaatactgaagacagtaatgggtatcggatccggcggagaacgcgccaaggctctgaatacgtgcgtgtcgcacatttgctgcatcctagtgttttacgtaacagtcgtgtgcctgaccttcatccacagatttggtaaacacgtgccacacgttgtgcacatcactatgtcttatattcacttcctgttcccaccattcatgaacccatttatctattcgatcaagactaagcaaatccagagcgggatacttcgtcttttctccctgccacattctagggcttag

SEQ ID NO: 28542 - DNA, 918 bp, Artificial Sequence
  Description of Artificial Sequence: Synthetic coding sequence
gtgtccacatctcagtcgcacgacttcctcttgacaggatttccaggcatggagaaggcccaccactggatttttattccattgctggcagcttatataagcattctccttggcaatggcactttgttgttcctcataaggaacgaccataatctgcatgaacccatgtactacttcctggcaatgctggcagccacagaccttggagtcacacttacaaccatgccaacagtgcttggggtgttatggctggaccatcgagagatcggccatggcgcgtgcttctctcaggcctattttatacacaccctaagcgtgatggagtcaggtgtgctgcttgcaatggcctatgattgctttatcacaattcggtcccctctccggtacacttctattcttactaacacccaggtgatgaaaatcggtgtgcgcgttttgacccgggctggactcagtatcatgcccattgtggtgcggttgcactggttcccctattgcaggtcacacgtgctgtctcacgctttttgccttcaccaagatgtcataaagcttgcttgtgccgatattacgtttaatagactctaccctgtcgtggttctttttgccatggttctgttggactttttgatcattttctttagctacattttgatactcaaaacggtgatgggtattggatctgggggggaacgcgcaaaggccttgaatacctgtgtgagtcacatctgctgcattctggtattttacgttacagttgtgtgtctgaccttcatccaccggttcgggaagcacgtaccccacgtggtccacataaccatgtcctacatccacttcttatttccacccttcatgaatccgttcatctattcaattaagactaagcagatccaatccggcatactgaggctgttcagctag

SEQ ID NO: 28543 - DNA, 939 bp, Artificial Sequence
  Description of Artificial Sequence: Synthetic coding sequence
atgaccaataacatcacatctaccagcatcattttcctcttaaccggggtcccaggactagaagcgtttcatacttggatctccattccattctgttttctgagcgttacagctctgctggggaattctctgattctattcgcaaccataacacagccgtccctccacgagcccatgtattattttctgagcatgttgtcggcaacggacctcggtctgtcaatctcgacccttgtgacaatgcttagtatattttggttcaacgtgcgagaaatttcctttaacgcttgccttagccacatgttttttatcaagttctttacggtgatggaatctagtgtgctcctagccatggctttcgataggtttgtcgccgtttccaaccccttgaggtatgcgatgatcctgactgattcccggattgcccagattggcgtagcctctgtcatccgtggcctactgatgctaactcccatggtagcgctattgatacggttaagctactgccattcccaggtcctgcaccactcctattgttaccacccggacgttatgaagctttcctgtaccgacacccgcattaattcagcagtgggcctgactgctatgttctctaccgtgggtgtggacctgttactgatcttgctgtcctacgttcttattattcgaaccgttctgtccgtcgcctctcccgaagagcgcaaggagaccttctcgacatgcgtctcacacattgtggcttttgccatatactatattcccttaatttccctttccatagttcaccggtttggcaaacaggcccccgcctacgtgcacacgatgatcgcaaacacgtatctgcttatcagccccctgatgaatcctgtcatttatagcgtaaagaccaaacagatacgccgggccgtgataaagatactccactctaaagagacatag

SEQ ID NO: 28544 - DNA, 975 bp, Artificial Sequence
  Description of Artificial Sequence: Synthetic coding sequence
atgcagaagccccagctgctggttcccatcatcgccaccagcaacggcaacttggttcatgcagcatatttccttctggtagggatccctggcttaggcccgaccatccacttttggctggccttcccactgtgtttcatgtatgccctagctactctgggcaatttaaccatcgtcttaataatccgagtagagagaagacttcatgaacctatgtacctgtttctggcaatgttaagcactatcgacttagtgctatcatctatcaccatgcctaagatggcaagcttgtttttaatgggcatccaagagatcgagtttaacatctgcctcgcgcagatgttcctgattcacgctcttagcgcagtggaatcagccgtgttactggctatggccttcgatcgattcgtagctatttgccacccactaaggcatgccagtgtgctgaccggatgcacagttgccaagatcggcctttctgcactgacgcgggggttcgtgtttttttttccacttccctttattttaaagtggctgtcctactgccagacccatactgtcacacactctttttgccttcaccaggatatcatgaaacttagttgtactgacacgagggttaatgtggtttacgggctgtttatcattttgtccgtgatgggggtggattcgctgtttatcggctttagttacattctgatcctctgggccgtgctcgagttgtctagtaggagagccgcactgaaagcgtttaacacctgtatcagccatctctgtgcggtactcgtgttctacgtgccactgattggcttaagcgtggtacaccggttgggcggacccacctccctgttgcatgtggttatggcgaacacctacctgctactgccccccgtggtgaacccgctagtttatggggcaaagacaaaggaaatctgctcgcgcgtgctctgcatgttcagccagggcggcaagtag

SEQ ID NO: 28545 - DNA, 957 bp, Artificial Sequence
  Description of Artificial Sequence: Synthetic coding sequence
atgatggtagaccccaatggcaacgagtctagcgcaacttactttatcttgatcggactgccagggctggaagaagcgcaattctggcttgccttcccgttatgtagtctctacctgatcgctgtcctcggtaatctgacgatcatatacatcgtgcggacagaacattccttacatgagcctatgtacatctttctctgcatgctgagcggtatcgacattctgatcagcacaagctccatgccaaagatgctcgcgattttttggttcaactctaccactatacaatttgacgcctgccttctgcagatgtttgcaatccactcactgtcaggtatggagagcaccgtgcttctggctatggcatttgaccgctacgtggccatttgccaccctctgcgacatgccaccgttctcactttgccgagggtaaccaagatcggtgttgccgctgtggtcagaggagccgcactaatggctcccctgcctgtgtttatcaaacagttgcctttctgcagatcaaatattctgtctcattcatactgcctgcaccaagacgtaatgaaactggcctgtgatgacataagggtaaatgttgtgtacggtcttatcgtgatcatatccgccatcggactcgatagtcttctgatcagcttctcatacctgctaattctcaagaccgtcctcggtcttaccagggaggcccaggctaaagcctttggcacttgcgtgagccacgtgtgcgcggtcttcatattctatgttccatttattggtttaagcatggtgcataggttctccaagcggcgggactcccccctaccagtaattctggccaatatatacttgctagtacctccagtgctgaacccaattgtctacggcgtgaagactaaagaaatcagacaaagaatacttaggctgtttcatgtagccactcacgcgtccgagccttag

SEQ ID NO: 28546 - DNA, 963 bp, Artificial Sequence
  Description of Artificial Sequence: Synthetic coding sequence
atgagtagttgtaacttcacacatgcaacctttgtgctgataggcattcccggcctcgaaaaagctcacttctgggtcggtttccctctgctgagtatgtatgtggttgcgatgttcggtaattgcatagtggtttttatcgtgagaaccgagcggagcctacatgcccctatgtatttatttttatgtatgctggcggccatcgatctcgccctgagtaccagcaccatgcctaagattctggcattattctggtttgactctagagagatttccttcgaggcgtgcctgacacaaatgtttttcatccacgcattgagtgccatcgaatcaacgattcttctggccatggcctttgatcgctatgttgcaatttgtcaccccctgagacatgcggcagttctgaataataccgttacagcacaaatcggcatcgtcgcagtggtgagaggttctctttttttttttcccttaccgctgttgatcaaaaggttagctttctgccacagcaacgttttaagccatagttactgtgtgcaccaggatgtgatgaagctcgcgtatgcagacaccctgcctaacgtggtgtacggcctgactgcaattctgcttgtgatgggagtggatgtgatgtttatcagcttatcctactttctgattatacgcacagtcctgcaactgccttccaagtccgagcgggctaaggcattcgggacgtgtgtctctcatattggggtcgttctggcgttctatgtgccactcatcggactctcagttgtgcatcgcttcggtaacagtctgcatccgatcgtgagagtagttatgggagacatttacctcctgcttccccccgttataaatccaataatctacggggccaaaaccaaacagatacggactcgcgtgttagctatgtttaaaatcagctgcgacaaggacctgcaagccgtgggcggtaagtag

SEQ ID NO: 28547 - DNA, 252 bp, Artificial Sequence
  Description of Artificial Sequence: Synthetic coding sequence
atgagctcctgtaattttacccacgcaactttcgttttgatcgggattccaggtctcgaaaaggcacacttctgggttggattccctcttctaagtatgtacgtcgtcgccatgttcggcaattgtatcgttgtttttatcgtgagaacggaaaggtcactgcacgcgccgatgtatctgttcctctgcatgttggcagccatcgatctggctctgagtacaagcaccatgcccaaaatacttgccctttag

SEQ ID NO: 28548 - DNA, 1029 bp, Artificial Sequence
  Description of Artificial Sequence: Synthetic coding sequence
atgacggagacgagcctcagctctcagtgcttccctatgagcgttctaaacaacaccattgccgagcctctgatatttttgttaatggggatccctggcctaaaagcaacgcaatactggattagtatcccgttttgcctgctgtatgtggtcgccgtcagtggaaatagcatgatactgttcgtcgtcctctgcgagagaagcttacacaaacctatgtactactttctgagtatgttaagtgctaccgatctgagcctttctttgtgcaccctgagcaccacactgggagtgttttggtttgaggccagagagatcaatttgaatgcttgcattgcgcagatgttttttctgcacgggttcacctttatggaaagtggtgtcctgctcgcgatggccttcgatcgttttgtggctatctgttaccctctgcggtacactaccatactaactaatgctcgcatagctaaaatcggcatgagtatgctgatccgaaatgttgccgtgatgctgcccgtaatgctgttcgttaagcgactgagcttttgttcttcaatggttctgagccattcctactgctaccatgtcgacctgatccagctgagttgcaccgacaaccgaatcaactctatactcgggttatttgcgttgctgtcaaccaccggtttcgactgcccttgcatcttgctgagctatattttgatcatccgctccgtgctctcaatagccagtagcgaagaacggcgaaaggctttcaacacctgtaccagtcacatatccgccgttagtattttctacctaccattgatttccctctctctagtgcaccgctatggccatagcgcccccccgtttgtacatatcataatggccaacgttttcctgctgatcccccctgtgctgaacccaattatctactctgtaaaaataaaacagatacaaaaagctatcatcaaagtactaattcaaaagcactccaaatcaaatcatcaactgttcctgattagggacaaagctatttatgaatag

SEQ ID NO: 28549 - DNA, 966 bp, Artificial Sequence
  Description of Artificial Sequence: Synthetic coding sequence
atgaccatactgcttaacagttctctgcagcgcgctacgttctttctgaccggatttcaaggcctggagggcttgcatggctggatcagcatccccttttgtttcatctatctcacggtgatcttaggcaatctgactattctgcacgtgatctgtacagacgctacactccacggccccatgtactactttctgggcatgctggcagtcacggacctcggactgtgtttgtctacactacctactgtgctgggcattttctggtttgatacccgcgagattggaataccggcctgttttactcagcttttttttatccatacactgagcagcatggagagctctgttctcttaagcatgagcattgataggtatgttgccgtgtgcaaccccctgcatgatagcacagtgctcacgcccgcctgtattgtgaaaatgggactttccagcgttctgaggagcgccctgttgattctgccacttccctttctgctgaagcgattccaatactgtcactctcacgtgctggcgcacgcatattgtttacacctggagattatgaaactggcctgctcttcaattatagtgaatcacatttatggtctgttcgtagttgcctgtacagtcggagtagactcactgcttatcttcctgagctatgctctgatcctgagaaccgtattatcaattgcttcacaccaggaacgactgagggccctgaacacctgtgtgtcacatatctgtgccgtgctccttttctacattcctatgatcgggctgtcactggttcatcgattcggagaacatctacccagggtagtgcatttgttcatgagttatgtgtaccttcttgtgccaccgctgatgaaccccattatctactccattaagactaagcagattcggcaaagaatcataaaaaaattccagttcatcaaaagcctgaggtgtttctggaaggactag

SEQ ID NO: 28550 - DNA, 945 bp, Artificial Sequence
  Description of Artificial Sequence: Synthetic coding sequence
atgacactcgggagcctagggaactcctcaagttccgttagcgcaaccttcctgcttagtgggatccctggcctcgaaaggatgcacatttggatctccattcccctttgtttcatgtatcttgtcagcatccccggaaactgtactattttgttcatcatcaagacagagcggtctttgcacgagccaatgtacctttttctgagtatgcttgcattaattgatctgggattatccctgtgcacactgcctactgtactaggcattttttgggttggggcacgcgaaatctctcacgatgcttgcttcgcccagctcttttttatacactgtttctcttttctggaatctagtgtcctcttatctatggcattcgacaggtttgtggccatctgtcatcccctacactacgtctctatcctgaccaacactgtgattggaagaattggattggtgtctttgggcagatctgtggctcttatttttccgttaccattcatgttaaagaggttcccttactgtgggtcacccgtgctcagccactcctactgtctccaccaggaggtgatgaagctggcctgtgccgatatgaaggccaactctatttacggcatgttcgtcattgtgagtacagtcggtatagatagtctgctcatcctgttctcctatgctcttattctccgaactgtgctgtctatcgccagtagagccgagaggttcaaggccctgaatacttgcgtgagtcatatctgcgcggtgctgctcttctatacgccaatgattggcctgagtgtaattcaccgctttggaaagcaggcaccccacctggtgcaggtcgtcatgggcttcatgtatctcctgttccctccagttatgaatcccattgtgtattctgtgaaaacaaagcagatcagagacagggtcacgcacgcattctgctactag

SEQ ID NO: 28551 - DNA, 909 bp, Artificial Sequence
  Description of Artificial Sequence: Synthetic coding sequence
atgactaacctaaatgcaagccaagccaatcacaggaactttatcttaactggcattcctggcactccggacaaaaatccttggttggccttccccctcgggtttctgtatactctgactctgttgggcaacggcacaatcctcgccgtgattaaggtcgagccctccttgcacgaacccacttattattttctgagtatccttgcacttacagatgtctctctgtctatgtccacattgccgtccatgctgtccatttattggtttaacgcacctcagatagtgttcgacgcttgcattatgcagatgttcttcattcacgtgtttggtattgttgaatccggcgttttagtttcgatggctttcgaccgattcgtggccattcgcaatcccctgcattatgtctcaattctaacccacgacgtgattcgcaaaaccgggatcgctgtactgacacgggctgtgtgcgtcgtgttccctgtgccctttttgataaagtgtctccccttctgtcattcgaacgtgctgtcacacagctactgcctacatcaaaacatgatgcggctggcttgtgcctcgactcgcatcaatagcctgtatggactcatcgttgtgatctttaccctgggtctggacgtgcttctcactctgctgtcatacgtcttaaccctgaagacagtcttgggcatcgtgtcacggggggagcgtttaaaaacgctgtctacgtgcctcagtcacatgtccactgtcttacttttttacgttccctttatgggtgctgccagcatgatccataggttttgggagcacctgagtccggttgtgcatatggtaatggccgacatttacttgctcttacccccagttcttaaccccatagtgtactctgtcaaaactaagcagatctag

SEQ ID NO: 28552 - DNA, 894 bp, Artificial Sequence
  Description of Artificial Sequence: Synthetic coding sequence
cttacgggcatcccaggaatccagacgggattgacatgggtggccttaatcttttgtatcttatacatgataagcatcgtggggaacctgagtatcttgacactcgtattttgggagccggcactgcaccagcctatgtactattttctcagcatgttggccttgaatgacctgggggtatcattcagtaccctgccaaccgttatctcaactttctgcttcaactataatcacgtggccttcaatgcttgcttggtgcaaatgttcttcattcacaccttctcgttcatggagtcaggaattctcctcgccatgtcactggacagattcgtcgcaatttgttatccgctgcgctacgtgactgtactcacacacaacagaattctcgcaatgggactgggaatcctgacaaagagtttcaccaccctgttccccttcccgtttgtggtaaagcgtctacctttttgtaaggggaacgttctgcatcacagttactgtttgcaccctgatttaatgaaactgccttgtgcagacacaaagttgaatagtattctcgggctggcaattgtccttgccaattttggcctggacagtttattgatcgtagtgtcttatgtcctgatattgtatacggtgatgggaatcgcctccggagagggacgctggaaggcactgaatacatgtgtgagccacatttgcgcagtgctgatttactacgtgccgatgattggtgtgagcgtaatgcatagggcagctaagcatgcttctcccatcgtgcatacactaatgtcttccatctgtctgttggtgcctcccgtcctcaatcctataatctacagcgtcaagacacaaacgataaggcagggaattctgaccctatttagctgcaaatag

SEQ ID NO: 28553 - DNA, 936 bp, Artificial Sequence
  Description of Artificial Sequence: Synthetic coding sequence
ggattgaggcactcaacgcatccagctaccctccaactgaccggtataccaggcattcagacgggccttacctgggtggcattgattttttgcattctgtacatgattagcatcgttggtaacctgagtattctgaccctagtattttgggaacccgccctgcatcagcctatgtactactttctgtccatgctggcccttaatgacttgggggtctcattcagcaccctgccaacagtaatcagtaccttttgtttcaactacaaccacgtcgccttcaacgcttgcctggtgcagatgttcttcatacacaccttttcattcatggaaagtggcatcctcctagcaatgtcattagatcggttcgtggccatttgctatccgctgaggtacgttactgtactcacacacaacaggatactggccatggggttaggcatcctcaccaaaagctttacaaccctgttcccattccccttcgtcgtgaagcgcctgccgttctgtaaagggaacgtgcttcaccattcctactgtttacacccagaccttatgaaggtggcttgtggagacatccacgtgaacaatatctatggcctacttgtgatcattttcacctacgggatggatagtacgttcattttactctcatatgctcttatcctgagggcaatgcttgtgatcatctcacaggaacagaggctcaaggccttaaacacctgcatgagccatatctgcgcagtgctggccttttacgtgcccatcatcgcagtgtcaatgatacaccggttttggaaaagcgccccacctgtcgtgcatgtaatgatgagcaatgtgtacctcttcgtgccacctatgctgaaccccataatttactctgttaaaaccaaggagatacgcaagggaattctgaagttctttcataagtcccaagcgtag

SEQ ID NO: 28554 - DNA, 945 bp, Artificial Sequence
  Description of Artificial Sequence: Synthetic coding sequence
atgttgggactcaatgggaccccatttcaacctgctactctacaacttaccggaatcccaggaatccagactggtttgacgtgggtggcattaatcttttgtatcctgtatatgatctcaatcgtgggcaatctgtcaattctgaccttagtattttgggagcccgccctgcaccagcccatgtactactttctgagcatgctagctctgaatgatctgggagtgtccttctcaacattaccgacggttatctctaccttttgtttcaactataaccacgttgctttcaacgcatgtctggtacagatgttctttatccacaccttctcattcatggagtccggcatcttacttgcaatgagcttagatcggtttgtggctatctgctatccacttagatacgtgactgtcctcacccacaatcgcatcctagcaatgggactcggaatcttaacaaaatcatttacgaccctgtttcccttccccttcgtggtcaagcgcctccctttctgtaaaggaaatgtcttgcatcactcctattgcttacatccggacctgatgaaagttgcttgtggcgacatacacgtcaataatatatacggtttgcttgtgattatctttacctacggcatggacagtaccttcattttgttgtcctatgcattgatcctcagagctatgcttgtgattatcagccaggaacagagactcaaagccttaaatacttgcatgtcccacatctgcgccgtcctggctttttacgtccccattatcgctgtctcaatgatccataggttttggaagagcgccccccccgttgtccatgtgatgatgtctaacgtatacctgttcgttcctccaatgctgaaccccataatctactctgtcaagactaaagaaatacggaaggggatcctgaaattcttccacaaatcacaggcttag

SEQ ID NO: 28555 - DNA, 939 bp, Artificial Sequence
  Description of Artificial Sequence: Synthetic coding sequence
atgggacttttcaatgtgacacacccagccttctttctactgacaggcatccccggccttgagagttcccacagctggctcagtgggcctttgtgcgtgatgtatgccgtggcacttggcgggaataccgtgatcctgcaggcagtgcgcgttgagccaagcctacacgaaccgatgtactattttctttcgatgctcagtttttccgacgtcgcaatctcaatggctaccctgccaaccgttcttcggaccttctgcctcaacgcccgcaatattacatttgacgcatgtctgatccagatgtttctcatccactttttctccatgatggagagtggtattctattagcaatgagcttcgatcggtatgtggctatatgcgaccctctaaggtatgccaccgtgttgaccacagaggtgatcgctgccatggggctgggggctgccgccaggagctttataaccctctttcccctgccttttctcattaaacgactcccaatctgccgcagcaatgtgctgagccactcctattgcttacaccctgatatgatgcgactcgcttgcgcggacatcagcatcaactctatttacggactttttgtgcttgtgagcacttttggcatggatttgttcttcattttcctgtcttatgttctaatactcaggtccgtgatggctactgcttctagagaggagcggttgaaagccctgaatacctgtgtgagccatatcctcgcagtgcttgccttctacgtgcctatgattggggtctcaacggtccatagattcgggaaacacgtgccctgttatattcacgtgttgatgtctaacgtgtacctttttgttcccccagtcctgaatcccttaatatactccgctaaaaccaaggaaataaggagggccatttttcggatgtttcatcatataaagatctag

SEQ ID NO: 28556 - DNA, 951 bp, Artificial Sequence
  Description of Artificial Sequence: Synthetic coding sequence
atgaagatctcgaacaacagcctgggttttcttcccactacttttatactagtcggcattccggggctggaatcagagcatctgtggatatcggtgccttttagtctcatatacatcattattttccttgggaacgggataattttgcatgtaattcgcactgacattgccctccatcaacctatgtacttgtttctggccatgttggctctcgccgaggtaagagtcagcgcttccactctgcctacagtgctgggcattttccttttcggaaacacagaaatctcacttgaggcctgtctgttccctgacgtgctgcatcccttcttcatacacgatggagcctcctgtgctgctggacacgtgtttgggccattgtactcacatctacagcccacagaactccacagctatccagataccgctcagggactgtggcataggtcatattatcggacagagaaacattatgcccatggtagtgttgctcattctctgatggcaagtgcccttctgtggccccagtgtcctctgactttcttgctttctgccccacagtcttatttgtcatgtggaaatatcagcgtgaacaatatatatggcatttttatcgtgacctccaccttcggcctcgacagtctcctcattgtgatctcgtacggcctgattttgcatacagtgcttgggattgccacgggcgaaggccgaaagaaagcactgaatacatgtggatcacatgtttgcgcagtcctggcatattatgtgcccatgatcgggttaagtatagttcaccggctgggtcaccgagtcagtcccctcttgcaagccatgatggccaacgcttaccttttctttccccccgtggttaatcccatagtctacagcattaaaaccaaggagatccacggtgctatagttaggatgctgctcgaaaaacgccgcagagtttag

SEQ ID NO: 28557 - DNA, 948 bp, Artificial Sequence
  Description of Artificial Sequence: Synthetic coding sequence
atgggtgactggaacaattctgatgcagtggaacctatctttatcctccggggcttccccgggctggaatacgttcattcatggctcagtatcctgttctgcctcgcatacctcgttgccttcatgggaaatgtcacaatcttgagcgtgatatggatagaatcttcgctccatcagcccatgtactatttcatttcaattctggcggttaacgacctggggatgagcctgtcaaccctgcccaccatgctggctgttctttggctcgacgctcccgagatccaggcatccgcctgttacgcgcaactgttcttcatccacaccttcacttttctggagtcgtctgttctgttggcgatggcgttcgataggtttgtcgctatctgtcaccccctccattaccccacaattctcacaaacagcgtgatcggtaagatcggcctggcgtgtctgctgcgtagcttgggtgtcgttctccccaccccgctgctgttgagacactaccattactgtcatggaaacgcactctcacacgccttctgcctgcatcaagacgttttgaggctgagctgtaccgatgcccgcacaaattccatttatggcctgtgtgtggttattgcaaccctaggcgtcgactccatttttatcctgctgtcgtacgtgcttattctcaacactgtcctggacattgcctccagagaggagcaattgaaggctctgaatacctgcgtcagtcacatttgtgtggtgctaatctttttcgtgccagtcatcggcgtgagcatggttcatcgctttggaaaacacctcagcccgattgtccacatattaatggccgatatttacttgttacttccacctgttcttaatcccatagtctacagcgtgcgaaccaagcagataaggttaggaatattgcataaatttgtcctccgacggcgcttctag

SEQ ID NO: 28558 - DNA, 954 bp, Artificial Sequence
  Description of Artificial Sequence: Synthetic coding sequence
atgtctcaggtgactaatacaacccaggaaggaatctacttcattctcactgatattcccggcttcgaggcttcccatatctggattagcatacccgtctgctgcctctatactattagcatcatgggaaatacaacaattttgaccgtgatccggactgaaccgtcagtccaccaaagaatgtatctcttcttgagtatgttagcgctgacagatctgggcctcaccctgacaacactccccaccgtgatgcaattattatggttcaatgttaggaggatttctagtgaggcctgctttgcccagttctttttcctacacggtttctcattcatggaatccagtgtgttgctggccatgagtgtggattgttacgtggcaatctgctgtccactgcattacgcctctatcctgaccaacgaggtaattggccgcacagggctggccatcatatgttgctgcgttctagccgtgctcccatcccttttcctactgaagagattacccttctgtcacagtcacttgttgagtcgcagctattgtctgcatcaggatatgatcagactagtttgcgctgacatccggttgaactcttggtacggattcgcactcgcccttctaataataatcgtagacccactcttaatcgtgatttcatataccctcatcttaaagaacatcctaggaacagcaacctgggctgagcgtctgagggccttgaataactgtctgtcccatatactagccgtgctggtgctgtacattcctatggtgggcgtttctatgactcacagattcgcaaaacacgctagccccctcgtgcatgtgattatggcgaacatatatcttctcgctcccccagttatgaatcctattatttatagtgtcaaaaataagcaaattcagtgggggatgttgaatttcctctcccttaagaacatgcattcacggtag

SEQ ID NO: 28559 - DNA, 972 bp, Artificial Sequence
  Description of Artificial Sequence: Synthetic coding sequence
atgagtacactgcctacccagatagctccgaattctagtaccagtatggcccctacatttctgcttgttggtatgcctggcctcagcggcgccccttcttggtggacgttacctctgatcgccgtctatttgctctccgccctcggaaatggaaccatcctgtggatcatagctctacagcccgctctgcatagacccatgcacttcttcctattcctactctcagtcagtgacatcggccttgttacagccctgatgccaaccctgctcggaattgctctcgccggcgcgcacactgtgccagctagcgcctgcttgctccaaatggtgttcatccatgtgttctccgtgatggagagctccgttcttctcgccatgtctatcgaccgggccctcgctatttgcaggcccctccattatccggccctcctgacaaacggtgtgataagcaagatctcactggctataagcttccgctgcctggggctgcacctgccactgccatttttactggcctacatgccgtattgcctcccccaggtcctgacacacagttattgtctccaccccgacgtcgcacgtcttgcttgcccagaggcctggggcgccgcctactctttgttcgtagtcctgtccgccatgggattagatccactcctcatattctttagctatggacttatcggaaaagtacttcagggcgttgaatccagagaagacaggtggaaggctggacaaacctgtgccgctcatctctccgccgtattgctgttctacatcccaatgatcctcctggctctgatcaatcatcccgaacttccaataacacagcatacccacactctcctgtcgtacgtgcactttctcttgcccccattgatcaatcccatcctgtactcagttaaaatgaaagagattagaaagagaatcctgaaccggctccaaccccggaaagtgggcggcgcacaatag

SEQ ID NO: 28560 - DNA, 984 bp, Artificial Sequence
  Description of Artificial Sequence: Synthetic coding sequence
atggctatctttaataacacaacaagctcttccagtaatttcttgcttacggcatttcctgggttggagtgtgcacatgtctggatttcaattcctgtctgctgtctatacacgattgcactactcggcaacagcatgattttcctggtcatcatcaccaagcggagactccacaagcccatgtattattttctatctatgctcgccgccgtcgacctgtgtttgactatcactacactgcccacagtactgggcgtactatggtttcacgcacgggagatcagcttcaaagcatgcttcattcagatgttctttgtacacgcattctcattgcttgagtcaagtgtgctggtagccatggctttcgatagattcgttgcaatatgtaacccactgaactacgccactatcctcacggatcggatggtgctggtgatcggtctcgtgatctgcattcgtcccgccgtatttctgctcccactcctggtagccattaacaccgtgtcattccatggcgggcacgagctctcccaccccttttgctatcatcctgaagtgattaaatatacctactccaaaccttggatctcatccttctggggcctgttcctgcaactctacctgaacgggacggatgtgctctttatactgtttagttatgtgctcattctgaggacggtcctggggattgtcgctcgtaaaaaacaacagaaggctctttctacgtgtgtctgtcatatttgcgcagttacaatcttctatgtacctttgatcagtctgagtctagcacacaggctgtttcactccactccaagggtgctgtgtagtacactggcaaatatatatctcctccttcctccggtactcaaccccattatctactccctcaagaccaagaccattaggcaggccatgtttcaactccttcagagcaaggggtcttggggctttaatgtgagaggcctacgcggtcggtgggattag

SEQ ID NO: 28561 - DNA, 1065 bp, Artificial Sequence
  Description of Artificial Sequence: Synthetic coding sequence
atgaccaacaagatgtacgctatctatatcaagaacctcaactactttagttttttgattgtgcagtgcctgcagcctaccatggcaattttcaataacactacttcttcatcttccaactttctgctaaccgccttccccggactggagtgtgctcatgtttggatcagcatcccagtttgttgtctgtacactatcgcccttcttgggaattcgatgatttttttagtgattattacgaagcggaggttgcataaacctatgtactacttcttatctatgctggctgcggtggacctttgccttactatcaccacactgcctacggttttgggagtcctctggtttcacgctagagagatcagtttcaaagcctgttttatccagatgttcttcgtgcatgcattctccttactagaaagctccgttctggtggcaatggccttcgatagatttgtcgctatctgcaacccactgaattacgcaacaattctcaccgaccgcatggtgctggtaatcggcctggtgatttgcatccggcccgccgtctttctgctacctctgctcgtggccatcaatacggtttcattccatgggggacatgaactctcccatccgttctgctatcatccggaagtgatcaaatatacatacagtaaaccttggatttcttctttttggggtttatttcttcaattgtatctcaatggcaccgacgtccttttcatcttgttcagctacgtgctgatcctaaggactgtgctgggaatcgttgctaggaagaaacaacaaaaagccctgagtacatgtgtgtgccatatctgcgccgtgacaattttctatgtgcccctgatcagtctgtctctggctcatagacttttccacagcaccccaagggtcctctgcagtactctggccaatatctatctgttgttgccgcctgtcctgaacccaatcatctacagccttaagactaaaactattcgccaggccatgttccagctcctgcagagcaaggggagctgggggtttaacgtgcgcggactccgggggagatgggactag

SEQ ID NO: 28562 - DNA, 966 bp, Artificial Sequence
  Description of Artificial Sequence: Synthetic coding sequence
atgtttctgtcctctcgcatgattacaagtgttagtccttccacctctactaattcaagctttctgctgactggtttctcggggatggagcagcagtatccatggctgtccattcctttctcctccatctacgccatggtgctgctcgggaattgcatggtgctccacgtaatatggacagaacccagccttcatcagcctatgttctacttcttatctatgctcgccctgactgacctctgcatgggcctgagcacggtatacacagttcttggcatcctgtggggcattataagagagatctctttggacagctgtattgctcagtcatacttcatccacggactgagcttcatggagtctagcgtgctccttactatggcttttgaccgttatattgcaatctgtaaccctctgagatatagcagtatcctgaccaattcaaggatcattaaaatcggccttactattatcggacggtcattcttcttcatcacgccacctatcatctgcttgaagttcttcaattattgtcacttccacatactgagccactcattctgcctgcatcaagatcttttgcgacttgcttgctcggatattaggtttaatagctactatgcactcatgttggtgatatgtatcctccttctggatgcgatactgatactattttcctacattttaatcttaaagagtgtcctcgccgtcgcctcccaggaagaaagacacaaactattccagacctgcatttcacacatatgtgccgtgcttgtcttttatatccctatcattagcctgacaatggtgcatagatttgggaaacatctgagtcctgtagcacatgtactcatagggaatatctacattttatttcccccccttatgaaccccataatttacagcgtcaaaacacagcagatccacacccgaatgttgcgcttgttctccctgaaacgttactag

SEQ ID NO: 28563 - DNA, 939 bp, Artificial Sequence
  Description of Artificial Sequence: Synthetic coding sequence
atgtccatctccaacataactgtgtatatgccatcagtactgaccctagtagggatccccgggttggagagtgtgcaatgttggatcggcattcccttctgtgctatatatttaatagccatgattggaaactcactcttactgtcaatcataaagtcagaacggtcgctgcacgagccgctgtatatctttctggggatgttgggcgcaaccgatattgccctggcctcatccatcatgcctaagatgcttggtatcttttggtttaatgtgccagagatctattttgactcttgtctgcttcaaatgtggtttattcacacgttgcaaggaatcgaatcgggcatcctcgtagctatggcccttgatagatacgttgctatttgctaccctctgagacatgccaatatctttacccaccaactcgtgattcagattggcactatggtggtgctgcgcgcagctattctggtggccccatgccttgtactcatcaagtgtcggttccagttctatcacacaaccgtcatttcccatagctactgtgaacatatggccatcgttaagctcgccgcagctaacgtgcaggtgaacaagatttatggactgttcgttgccttcacagtcgctggcttcgatctgaccttcatcacactttcctatatacagattttcatcaccgtattccgcttaccccagaaggaagcccgtttcaaggcattcaatacctgtatagcgcacatctgcgtctttctccagttttacttactcgcattcttttccttctttacacatcggttcggttcgcacatttctccctacatacatatcctgttctcaagcatctatttactggtccctccgttcctcaatcctctggtatatggggcaaagacaactcaaatccggattcatgttgtgaagatgttctgtagctag

SEQ ID NO: 28564 - DNA, 939 bp, Artificial Sequence
  Description of Artificial Sequence: Synthetic coding sequence
atgtctatcagcaacataacggtttacatgccatctgtgctcacactcgtggggattcccgggctcgagagcgtgcagtgttggattggtattcctttctgtgccatctacctgattgccatgatcgggaactccctgttgttaagcattattaagtcagaacgttccttacacgaaccgttgtacattttcctcggtatgctgggcgctaccgatatagctctggccagcagtataatgcctaaaatgctgggtatattttggtttaatgttcccgaaatttattttgactcctgtctgctacagatgtggttcatacatactctgcagggcatcgagtccgggattcttgtagcgatggccctggaccggtatgtggctatttgttatcctctccgtcacgctaatatctttacccaccagctggtaattcaaattggaacaatggttgtcctaagggccgcgattctcgtggctccatgtctagtgcttattaagtgtcgcttccagttctaccatacaacagtgatctcacattcgtactgtgaacacatggccatcgtaaagctcgcagcagcgaacgttcaggtaaataagatctacgggctatttgtggcattcaccgtcgccggctttgacctgacgttcattaccctttcttatatccagattttcataacagtgttccgtctcccccagaaggaagcccgctttaaggcatttaatacatgcatcgcgcacatttgcgtattcctgcagttctatctgctggcttttttttccttttttacacaccgcttcggcagtcatatatcaccatacatccacattttgttttcctcaatctacctgctcgtgccacccttccttaacccgctagtgtacggggccaagaccacacagataagaatccacgtcgtgaaaatgttttgctcctag

SEQ ID NO: 28565 - DNA, 951 bp, Artificial Sequence
  Description of Artificial Sequence: Synthetic coding sequence
atgccgacgttcaatggttccgtctttatgcctagcgccttcatactgatcggcataccaggacttgaatctgttcagtgctggattggcattccattctctgccatgtacctgataggcgtgatcggcaacagcctcatccttgtcataatcaagtacgaaaactctctgcacattcctatgtacatcttcctggccatgctggccgcaacggatatcgctctgaatacatgtatccttccgaagatgttggggatcttttggtttcatctcccagagatttcattcgacgcatgtttattccagatgtggctaattcacagctttcaggccatagaaagtggcatcctcttggccatggcgttggacagatacgttgccatttgcataccgctgagacacgccacaatattttcccagcagtttctcactcacatcggcctcggggtgactctcagagccgcgatcctcatcatcccgtctctgggcttaattaaatgttgtctgaagcattaccgcaccacagtcatcagtcactcctactgtgagcacatggccatcgtgaagctggcaactgaagacatcagggtgaataaaatctacggcctgttcgttgcattcgctatcttgggatttgacatcatattcattactcttagttatgtgcagatttttatcactgtgttccagctcccccagaaggaagctcggtttaaggcatttaatacttgtatcgcacatatctgcgtgtttcttcagttttatttgctggcatttttttctttcttcactcataggtttggaagccacatccccccctatatacatatcttactctctaatttgtacctgcttgtcccaccgtttctgaaccccatagtctacggcgttaagactaagcaaatcagggaccacatcgtgaaggttttctttttcaagaaggtgacctag

SEQ ID NO: 28566 - DNA, 972 bp, Artificial Sequence
  Description of Artificial Sequence: Synthetic coding sequence
atgtcacatactaatgttactatcttccaccctgcggttttcgtgttacccggtatcccaggtttggaagcctaccacatttggttgagcataccgctctgtctgatctacatcaccgccgtcttgggcaacagcattcttattgtagttatcgtcatggaacgaaatcttcatgttcctatgtactttttcctcagcatgttggcagtcatggacatcctgctcagcacaacgactgttcccaaggcgttagccatattttggctgcaggcacataacatcgccttcgatgcgtgcgtcacacaagggttctttgtgcacatgatgttcgttggcgagtctgcaattttgcttgcaatggccttcgatcggttcgtggccatttgcgcccccctgcgttacacaaccgttctcacctggccagtggtcgggcgcatcgcattagccgtgatcaccagatccttctgtattatcttccctgtgattttcctcttaaagagactgccgttctgcttgactaacatcgtgccccactcgtattgcgaacatataggtgtggcacgtctggcatgcgcagacataaccgtgaatatctggtacggtttttccgttccaatcgttatggtgattctcgatgtcattctgattgctgtctcctacagcttgattctgcgcgccgtattccgcctccccagccaggatgcccggcacaaagccctcagtacctgcggatcacacctttgtgtgattctgatgttttatgtgccttccttctttacactgcttacacatcatttcggccgcaatatcccacagcacgtgcatatccttctggcgaacctgtatgtagccgtaccaccaatgctgaatcctattgtatatggcgtgaagactaagcagatcagggagggagtggcccatcgctttttcgacattaagacatggtgttgcacttctccccttggctcttag

SEQ ID NO: 28567 - DNA, 945 bp, Artificial Sequence
  Description of Artificial Sequence: Synthetic coding sequence
atgccaaccgtcaatcattccgggacatctcatactgtgttccacttgttaggtataccaggcctgcaggatcaacacatgtggatctctattccattctttatcagctacgtcacagctctcctagggaattcgctgttgatctttatcatccttactaagagatccctgcatgagcccatgtatttattcctgtgtatgctggcaggagccgacatcgttctctccacttgtaccattccccaggcgctggcaattttttggtttagggccggcgatatttctctggatcgctgtatcacccagcttttttttatccatagtacatttatttctgaatcgggtatattgctggtgatggccttcgatcactatattgccatctgctaccctttaaggtataccacaattcttacaaacgcccttatcaaaaagatctgtgtaactgtgtcgctgaggtcttatggcaccatttttcccattatctttctcttgaaacggttgaccttttgtcaaaacaatatcattccccacacattctgcgagcacatcgggcttgctaaatacgcctgcaatgatattcgtattaacatttggtacgggttttctatcttaatgtctactgtggtgctggatgtggtgttgatatttatctcgtacatgctgatcttgcatgctgtgtttcacatgccttcaccagatgcttgccataaggctctcaatacctttggaagtcacgtgtgcatcataatccttttctacggctccggtatattcaccatcttgacccaaaggttcggacgacacataccaccctgcatccatattcctctcgcaaacgtatgcattcttgcaccacctatgctgaaccctatcatttatggaataaagacaaagcaaattcaagagcaggtggtacaattcttatttatcaagcagaagtag

SEQ ID NO: 28568 - DNA, 1008 bp, Artificial Sequence
  Description of Artificial Sequence: Synthetic coding sequence
atggcgcaagtgcgcgccctccacaaaatcatggctctatttagcgctaacagcatcggagccatgaacaactcagacacgagaattgctggctgctttctgacaggcatccctggactcgagcagctccacatctggctttctattcccttctgtataatgtacattaccgctctcgagggcaacgggattttgatttgtgtgatcttaagccaagctatattgcatgagcccatgtacatctttttgtccatgctcgccagtgcagatgtcctcctctccacgaccaccatgccaaaagcattggcgaacctgtggctcgggtatagtctgatctctttcgatgggtgcctgacccaaatgttctttattcactttctgtttattcattccgccgtgctccttgcaatggcgttcgatcgatatgtggccatatgctctcccctgcgttatgttactattctcactagtaaagtgattggtaaaatagtgactgcggcactctcccacagtttcatcatcatgtttccttcgatatttcttctggagcacctgcactattgccaaataaacataatcgctcacactttttgtgagcatatgggaatcgctcacctgtcctgctcagatatctcaatcaacgtctggtatggccttgcggccgcgttgcttagtactgggttggacatcatgctaatcacggtatcttacatccatatcctacaagccgtgtttagactgctgagccaggatgcccggtcaaaggctctatctacatgcgggagccacatctgcgtgattttactcttctacgtgccggccctgttcagcgtgttcgcttatcgctttggaggcaggagcgtgccctgctacgtccacatattgctggcctcactctatgtcgtcatcccaccaatgttgaaccccgtgatttatggggtgcgtacgaagcccatactggaaggcgctaagcagatgttctctaatttggcgaagggttctaaatag

SEQ ID NO: 28569 - DNA, 957 bp, Artificial Sequence
  Description of Artificial Sequence: Synthetic coding sequence
atgagtgattccaatctgtcagacaatcatctacccgacactttctttttgactggaatccctggtctcgaagctgctcacttttggatcgcaattcccttctgcgcaatgtacctggtggcccttgtcggaaacgctgcgctgatcctggtaatagccatggataacgcactccatgctcccatgtacctcttcctatgccttctgtcattgaccgacttggccctcagctcgaccacagtgcctaagatgctggctatcttgtggctgcacgcaggagaaattagttttggaggttgcttggctcaaatgttctgcgtccactcaatctacgccctggagtccagcatcttgctggctatggcattcgaccgctatgtggcgatctgcaaccccctccgctacaccaccattctcaatcatgccgtcataggcagaatcggatttgtaggtctgttcagatccgttgccatcgtgtcacccttcatttttttactaagacgcttgccatactgtggtcaccgcgtaatgactcatacttactgtgaacacatggggatagcacgtttggcttgtgcaaacataactgtgaatattgtctatggtctgactgtcgcattattggctatgggcctggacagtattctgattgcgataagctatggcttcatcctgcatgccgtgttccatttgccctcacatgatgcccagcataaggccctctcgacttgtggctcgcacattggcattatcctggtgttctacattcccgcattttttagctttctcacccacaggttcggccaccatgaggtaccaaaacacgtgcatatcttcttggccaatctctatgtgctcgtgccaccagtcctcaaccctatcctgtatggagcacgaaccaaggagatccggtctcgattgctcaaactcctacacctgggtaaaactagcatctag

SEQ ID NO: 28570 - DNA, 978 bp, Artificial Sequence
  Description of Artificial Sequence: Synthetic coding sequence
atgttcctgccaaacgatacccagttccacccttcctcgtttctgcttctgggaattcctggccttgaaacactacatatctggatcggtttcccattctgcgctgtctatatgatcgctttgataggcaattttacaatcttgctggtgatcaaaaccgatagttctcttcatcagccaatgttttacttcctcgctatgctggctaccaccgatgtcggactatctaccgccaccatccccaaaatgctggggattttctggatcaatttgcggggtatcatatttgaagcctgccttacccagatgttcttcattcataattttaccctgatggaatccgcagttctcgttgcaatggcgtacgattcctatgttgcaatctgcaaccctctgcaatactccgctatcctaacaaacaaggtagtgagtgtaattggtctgggcgtttttgtcagggccttgatattcgtgattccaagcatcttactgatcctgagactcccattctgcggaaatcatgttattccccacacctactgcgagcacatgggattggcccatctgtcttgtgctagcattaaaatcaacatcatttacggcctctgcgcaatctgcaacctggtattcgacattaccgtaattgccttgtcatacgtgcatatcttgtgcgcggtatttcggctccccactcacgaggcacgcctcaaatccctgtccacctgcggctcccatgtgtgcgtcatactggccttttacactccagctctgtttagttttatgacccacaggttcggaagaaatgtcccacgctacattcatattctgctggctaacttgtacgttgtcgtgccacccatgcttaacccagtcatctatggtgtacgcaccaaacagatatataagtgtgtaaaaaagatcttgctgcaggagcagggaatggagaaagaggagtacttgatccacacacgattctag

SEQ ID NO: 28571 - DNA, 939 bp, Artificial Sequence
  Description of Artificial Sequence: Synthetic coding sequence
atgccgtccatcaacgacactcacttctacccgccattctttctgctgttaggcatccctggactcgacaccctccacatttggatttccttccccttctgcattgtttacctcattgccatcgtgggtaacatgactattttgttcgtcataaagacagaacactcactgcaccagccaatgttttattttttagcaatgctcagcatgattgaccttgggctaagtacctcaacgatccctaagatgttaggcatcttttggttcaacctgcaggagatttctttcgggggctgtctgttacagatgtttttcatacacatgttcactggcatggagaccgtgttgctcgtggtcatggcatacgacagatttgttgcaatctgtaacccattgcaatatacgatgatccttacaaataaaacaatcagcatccttgcaagcgtggtggtgggacgaaatctcgtcctggtgacccccttcgtatttctcattctccgcctcccattctgcggccataatattgtcccccacacatactgcgaacacagaggcctggcaggtctggcctgcgcccctattaagatcaacatcatttacggccttatggtcatcagttatattatcgtggacgtgattctcatcgcatcttcatacgtgttaatcctccgcgctgtgtttagactcccctcacaggacgtgcgcctgaaggccttcaacacatgtgggtcacacgtctgcgtgatgctctgtttctataccccagctttcttcagctttatgacccacagattcggtcagaacattccacattatatccatatcctcctcgcgaacttgtatgtggtggtgccccccgcactgaaccctgtgatatacggggtgcggacaaagcagatcagagagcaaattgtgaaaatcttcgtgcaaaaagagtag

SEQ ID NO: 28572 - DNA, 942 bp, Artificial Sequence
  Description of Artificial Sequence: Synthetic coding sequence
atgcccatagctaatgacactcagttccacacctcctcttttctcttactcggaataccaggtctcgaagatgtgcacatttggattgggttcccattctttagcgtgtatcttatcgcactcctcggcaatgccgctatcttttttgtgatccagaccgagcagtccctacatgaaccgatgtattactgcctggccatgctggactccatcgaccttagcctgagcactgcaacgattcccaagatgctcggcattttctggttcaatatcaaggaaatctcttttggtggttacctttctcaaatgttctttattcacttttttaccgtgatggagtcgattgtcctcgtggccatggccttcgataggtatattgcgatttgtaaacctctgtggtataccatgatcctgacctcaaagataatcagcctcattgccgggattgctgttctccgatccctctacatggtcatacccctggtgttcctcctcttaagacttccattctgtgggcaccgcattatcccacacacctattgtgagcacatgggtatagccagactggcttgtgcatccattaaggtgaacattatgttcgggctggggagcataagcctacttcttttggacgtgcttctgattattctgagccacattaggatcctctacgccgtcttctgcctgccgtcctgggaagcgagactgaaggcacttaacacttgcggttcccacattggagtgattctggccttttcaaccccagcatttttctctttcttcacccactgtttcggacacgacattccgcagtatatccacatttttttggccaatctgtatgtggtggtgccacccaccttgaaccccgtgatttatggagtgcggaccaaacatatccgggaaacagtccttcgcatcttcttcaagaccgatcactag

SEQ ID NO: 28573 - DNA, 954 bp, Artificial Sequence
  Description of Artificial Sequence: Synthetic coding sequence
atggagaaacggatgcctatcgcaaacgatactcagttccatacatctagcttccttctgctcggcattcccggcctcgaggatgtgcacatttggatcggcttcccttttttctcagtctatctgatagctctactaggtaacgccgccattttcttcgttattcagacagagcagtcattgcatgaaccaatgtattactgtctcgccatgctcgactctatcgatcttagcctctcaacagcgaccattccaaagatgctcggcatcttctggttcaacattaaggaaatttccttcggtggatatctttcccagatgttcttcattcatttctttactgtgatggaaagtatcgtgctggtagctatggctttcgaccgatatatcgcaatttgcaaacccctgtggtatactatgattctcacttccaagataatttctctcatcgcaggcattgcagttttacgctcactgtatatggtaatcccactggtgttcctattgctgcggcttccgttctgtgggcacaggatcatcccacatacttattgcgaacatatgggaattgccaggttggcatgtgcttccatcaaggtgaacattatgtttggcctagggtcaattagcctgttgttattagatgtgctcctaatcatactcagtcacattcgtattctgtacgctgtcttctgtttgccaagctgggaggcaaggcttaaagcccttaacacctgtggcagtcatatcggtgtaatcctcgctttttcaacgcccgccttcttcagtttttttacccactgcttcggtcacgacatcccacagtacatccacatcttcctagctaacctctatgtcgttgttcctccaacgttgaaccccgtcatctatggagttcggacgaaacacatcagagagacagtcctccgcattttctttaagactgatcattag

SEQ ID NO: 28574 - DNA, 954 bp, Artificial Sequence
  Description of Artificial Sequence: Synthetic coding sequence
atggctggccggatgagtacttctaaccacactcagtttcatccatccagcttcctgctgcttggaatacccgggttagaggatgttcatatttggattggtgtgcctttcttcttcgtttatttggtggcgctgctcggaaatactgcactgttgtttgtgattcaaacagaacagtctttgcatgagcctatgtactacttcctggcaatgcttgacagcatagatctgggcctcagtaccgccacaatccccaaaatgttaggaattttttggttcaacacgaaggagatttccttcggaggttgcctctcccacatgttcttcattcatttctttaccgcaatggagtcaattgtgcttgtggctatggcattcgatcgctacatcgccatatgtaaacctctccgctacacaatgattcttaccagcaagattattagtcttattgctggcatcgcagtcctgcggtcgttatatatggttgtgccgttggtgtttctgctgctgcgcctgccattttgtggccatcgtatcattccgcacacatattgtgaacatatgggcatcgccagactggcgtgtgccagcattaaggtgaacatccggtttggtctgggcaacataagtctgctactgctcgacgtgattctcatcattctgtcatacgtgcgaatattgtatgctgtgttttgcttgccgagctgggaagccaggctcaaagccctgaatacttgtgggagtcacatcggtgtaatccttgcatttttcacacccgcctttttctcatttctgacccacagattcggacacaacatccctcagtacatccacattatcttggcaaacctatacgtcgtcgtacccccggccctgaatcccgtgatatacggcgtgagaacaaagcagattcgcgaacgcgtcctgcgaattttcttaaaaaccaaccactag

SEQ ID NO: 28575 - DNA, 963 bp, Artificial Sequence
  Description of Artificial Sequence: Synthetic coding sequence
atgccaagcgcgtccgctatgatcattttcaatctatcaagttacaaccccggtccttttattctggtgggcatccccgggctcgagcaattccacgtgtggatcggaattccattctgtatcatctacatcgtagccgtggtggggaattgtatcctgctttacttgattgtggtggagcacagcttgcacgagcccatgtttttcttcctgtctatgcttgctatgacggatctcatcctatccacagccggggtgcctaaagccttgtctattttctggctaggcgctagggaaattacttttccagggtgcttaacccaaatgttcttcttgcattataactttgtgctggacagcgcaatcctgatggcaatggcattcgatcattatgttgctatctgcagcccccttaggtacaccacgatcctgacgccaaaaacgattataaagtccgctatgggtatcagttttcgctcattctgtattattctcccagacgtttttctgttgacgtgccttccattttgtcgaacccggattattccgcacacttactgcgagcacatcggtgtggcccagctcgcttgcgccgatatatctattaacttctggtacggattttgtgtccccatcatgaccgtgattagcgacgtgattctcatcgcagtgtcctacgctcatattttatgcgcagtgtttggcctgcccagccaggacgcctgccagaaggcgctgggaacatgtggctcacatgtctgtgttatcctgatgttctacactccagcctttttcagcatactggctcatcgctttggccacaacgtctcccgtacatttcacatcatgtttgcaaacctgtacatagtgatcccacctgccctcaatccgatggtgtatggagttaagaccaaacagatcagggacaaagtgattctgttgttttcgaaaggaactggatag

SEQ ID NO: 28576 - DNA, 1047 bp, Artificial Sequence
  Description of Artificial Sequence: Synthetic coding sequence
acgcaagtacccaaagactgtacaatcctgctccaccacctctacattaatcggcaggaggtcagtccggtgatgctgggcccagcgtacaaccatactatggaaactcccgcatccttcttgcttgtgggaattcccggcctgcagtcaagtcacttgtggcttgccattagtctgagcgccatgtatatcactgctctgttaggcaacaccctaatcgtgaccgccatctggatggatagcacgagacatgaacctatgtattgctttctgtgtgtgctcgccgcagtagatatcgtcatggcgtcttctgtggttccaaagatggtgagcatcttttgctccggcgatagttctatcagctttagcgcatgttttacccagatgttcttcgtacacctggcaactgccgtagaaactggactcttgttgaccatggcattcgatagatacgtggcaatatgcaaacctttgcattacaagcggatactcactccccaagtgatgctcgggatgagtatggccgtgacgatccgtgccgtcacgttcatgacacccctgagctggatgatgaaccatctccccttttgtgggagtaacgttgttgttcattcatattgtaaacacatagctctggcccgcctcgcttgtgctgacccagtccctagttctttatactcattgattggttcctccttaatggtaggttcagatgtcgctttcatcgctgctagttatatcctgattctgcgagctgtcttcgatttaagttctaaaaccgcacagctgaaggccctgagtacttgtgggtcccatgttggcgtgatggccttgtattatctgcctggcatggcatctatctatgctgcatggctcggtcaggacattgtacctttgcatacccaggttctcctcgcagacctgtacgtgattattccagcaaccctcaaccccatcatatacgggatgcgaaccaagcagctgctggaaggcatttggagctatctcatgcattttctgttcgatcattccaatcttggctcctag

SEQ ID NO: 28577 - DNA, 975 bp, Artificial Sequence
  Description of Artificial Sequence: Synthetic coding sequence
atgctcggccccgcgtacaaccatacgatggagaccccagctagctttttgctggtggggattccagggttgcagtcttcccacctttggcttgccatcagcctgagtgctatgtacatcactgccctactgggtaacaccctcattgttaccgcgatatggatggattccactcggcacgaacccatgtattgcttcctgtgcgtgttagccgccgtggacattgtaatggcgtcttctgtcgtgcctaagatggtctctatcttctgcagcggagatagcagcattagctttagcgcttgtttcacacagatgttctttgtgcatctcgcaacggccgtggaaacaggcctactactgactatggcgtttgatcggtacgtcgcaatctgtaaaccgctgcattacaagcgcatattgactcctcaggtcatgcttgggatgtctatggccgtaactattagggctgtcacattcatgaccccacttagctggatgatgaaccaccttcctttctgcgggagcaacgtcgtcgtgcattcctactgcaaacacatcgctttagctcgcctggcatgcgcagacccagttccgtcaagtctttactccctaattggctcaagcttgatggtaggcagcgacgtagcattcatcgccgccagctatatcctgattctgagagcggtgtttgatctgagttcaaagacggcacagttaaaggctctaagcacatgcgggtcccatgtaggagtaatggcattgtactaccttcctgggatggcttccatctacgctgcttggttaggccaggacatagttccccttcacacacaggttctgctggctgacctgtacgtgattattccggccacgctcaaccccattatttatggtatgcgcaccaaacagttattagaggggatctggtcctatctcatgcactttctgtttgaccactccaaccttgggagttag

SEQ ID NO: 28578 - DNA, 1053 bp, Artificial Sequence
  Description of Artificial Sequence: Synthetic coding sequence
atgtgccaacagattctgcgggactgtattctactgatccatcacctgtgcatcaatcgtaaaaaagtgagtctagtcatgctggggcccgcctacaatcatacaatggagaccccagcttctttcttgttggtcggcatccccggactgcagtcttcccacctatggctagcaataagcctctccgctatgtatatcattgccctgctaggcaacacaatcatcgtcactgccatatggatggactcaactagacatgaaccaatgtactgcttcttgtgtgtgctcgccgctgtggatattgtgatggcttcttcggtggtaccaaaaatggtctctattttctgttccggtgattcctcgatctctttctccgcctgtttcactcagatgttctttgtccatctggccacagctgtggagacaggactgttactcactatggcgttcgataggtacgtcgctatttgcaagcccttgcactacaagcgaatactcactccccaagttatgcttgggatgagtatggcaatcacaattagagctataatagcgattactcccttaagttggatggtgtcacacttgcccttctgcggttccaatgtggtcgtacactcttattgtgaacacatcgccctcgcgagattggcctgtgccgacccggtgccttccagcctatattcactcatcggctcgtctttaatggttgggtccgatgtagccttcatagcagcatcctatatcctgatccttaaagccgtgttcgggttgtctagtaaaactgcccagcttaaggctcttagtacgtgcggcagtcatgtgggtgtaatggcgctgtactacttgcccggcatggccagcatttacgctgcatggctgggacaagatgttgtcccacttcatacccaagtgttactggcagatctttatgtgattatcccagctacgctgaatcctattatctacggaatgcggactaagcagttgagagaaaggatctggagctacctcatgcacgtcctcttcgaccactcgaacttaggcagttag

SEQ ID NO: 28579 - DNA, 936 bp, Artificial Sequence
  Description of Artificial Sequence: Synthetic coding sequence
atgttctatcataacaagagcattttccaccccgtaaccttctttctcatcgggatacccggcctggaggacttccatatgtggattagtggcccattttgctccgtatatcttgttgctctgctgggtaatgcaaccattctcctggtcatcaaggtcgagcagaccttgagggaaccaatgttttacttcctggccattctcagtacgatagacctcgcgttatccaccaccagcgtgcctagaatgctcgggattttttggttcgacgctcacgagatcaactacggcgcctgcgtagcgcaaatgttcctgattcacgcgtttactggcatggaggctgaggtcctccttgctatggctttcgaccggtacgtggcggtgtgtgctccgcttcactacgctaccatactgacaagtcaggtgctggtgggaatcagcatgtgcatagtcataaggcccgtgctattgacactccctatggtttacttgatatacaggttgcccttttgtcaggctcacataattgctcattcgtattgcgagcacatgggcatcgccaagctctcgtgtgggaatattaggattaacggaatatatgggctgtttgttgtgtcctttttcgtcttaaacttagtgttaataggcatttcatacgtgtacattctccgggccgtgtttaggctcccatcacacgatgcccagctgaaagcccttagtacgtgtggcgcccacgtgggggtgatttgcgtcttctacattccttccgtgttctcattcctgacgcatcgctttggtcatcagatcccagggtacatccacattctggttgctaatctgtatttaattatccctccttctctgaaccccatcatctatggcgtcaggacgaaacaaattcgggaaagggttttgtacgtcttcacaaaaaagtag

SEQ ID NO: 28580 - DNA, 945 bp, Artificial Sequence
  Description of Artificial Sequence: Synthetic coding sequence
atgctgccttccaacattacaagcactcaccccgccgtctttctcctggtgggcatccccggtctggaacacctccatgcttggatcagcatcccgttttgttttgcatatacgttggctctcctcgggaactgtaccctcttgttcatcattcaggcagatgccgcactacatgaacctatgtatttgttcctggctatgcttgctacaatagacctggtactttcaagcactacattacccaagatgcttgccatcttctggttcagagatcaggaaataaatttcttcgcttgcctggtccagatgttctttctgcactccttcagcattatggaatcggctgttctgttggcgatggccttcgacaggtacgtcgccatttgtaagcccttacattacactaccgtgctgacaggatcactcatcaccaagatcgggatggccgctgtcgcacgagctgttactctgatgacaccactccctttcttactgagaagatttcactactgcaggggccctgtaattgcacactgctattgtgagcatatggccgtcgtcaggttagcatgcggagacacaagcttcaataatatttacggcattgccgtggccatgttcattgtggtccttgacctgctgtttgtgattctgtcatacgtctttattctgcaagctgtcctgcaattagcttctcaggaagccaggtataaagcttttggtacctgcgtctcccatatcggggcaatcttgagcacctacacacctgtcgtgatttcatctgtgatgcatagggtagctaggcatgcggcccctcgagtgcatattctcctcgctatcttttatttgctgtttcccccgatggtgaacccgatcatctacggcgtaaaaaccaaacaaataagggaatatgtgctgagtctgtttcagcgtaagaacatgtag

SEQ ID NO: 28581 - DNA, 945 bp, Artificial Sequence
  Description of Artificial Sequence: Synthetic coding sequence
atgtcagcttctaacattacgctgacccatcccacagcattccttttagtgggcattcccggacttgagcaccttcacatctggatcagcatacctttctgcctggcgtatacactggcgttgttgggcaattgtaccctgttactcatcatccaagctgatgccgcattacatgaacccatgtatctattcctggctatgctggccgctattgatttggtcctcagttccagcgctcttcccaaaatgttggcaattttctggttcagagatcgcgaaattaacttttttgcctgccttgcacaaatgttcttcctgcacagcttcagtatcatggagagtgccgtgctcctggctatggccttcgaccgctatgtcgctatctgcaagcctctgcactacacaaaggtgctgacagggagcctaataaccaagatcggaatggcagctgttgcacgcgcagtgaccctcatgactcccctgcctttcctgctgagatgcttccactactgcagggggccagtgatcgcccattgttattgcgaacatatggccgtggtgcgactcgcctgtggagacacatccttcaacaatatctatgggatcgctgtggcgatgttcatcgtggtgctggacctgctgttggtgatcctttcctatatctttatcctccaagctgtccttctcctcgcaagtcaggaggccagatacaaggcttttggcacctgcgtcagccatatcggagccattctcgctttctacacaacagtcgtcatcagtagtgtgatgcaccgcgtcgcgcgccacgctgcgccacatgtccatatccttctggcaaacttttatctactgtttccccccatggtcaaccccatcatctatggggttaagacaaagcagatcagggaatcaatcttaggtgtgtttccccgcaaggatatgtag

SEQ ID NO: 28582 - DNA, 990 bp, Artificial Sequence
  Description of Artificial Sequence: Synthetic coding sequence
atgacccttgtgagttttttttccttcctctccaagcccctgattatgctgctttccaactcctcttggagactctcacagccgtcttttctcctggtgggtattcctggtctggaggaaagccagcattggatcgccttacctcttggcatcctttacctattggctctagtgggcaatgtgacgattcttttcatcatatggatggatccctccttgcaccaatctatgtatctgttcctgtccatgctggccgccatcgatttggtattggcatcctccacggctccaaaggcattagcagtgttgctcgtccatgctcatgagatcgggtacatcgtttgcctcattcaaatgttcttcatccatgctttcagctctatggaatccggcgtattggttgctatggcactcgactgttacgtagctatctgtcatccactacaccattctaccattctgcatccgggcgtgataggatgtattggaatggtagttctggtgcgggggcttctgctgctgataccttttcctattctgcttggtaagttgatattttgccaggccacaattattggacatgcatactgcgagcatatggccgtggttaagcttgcttgctccgagaccacggtgaatcgggcctatggactaacgatggcactccttgtcattggacttgacgtcctggccattggcgtgagctacgcacacattctccaagccgtgctgaaagtgcccgggtcggaagctagactcaaggctttcagcacatgtggctcacatatttgcgtgatcttggttttctatgtcccagggatttttagctttttgacacatcgcttcggccaccacgtgccgcatcatgtacatgtgctccttgctacatggtacctgttgatgccacccgccctcaaccctttagtctatggagtcaagactcagcagattagacagagggtactaagagtcttcactcaaaaggattag

SEQ ID NO: 28583 - DNA, 954 bp, Artificial Sequence
  Description of Artificial Sequence: Synthetic coding sequence
atgctcacgttccacaacgtgtgctctgtgccaagtagtttttggttaactggcatacccggccttgagtcactgcacgtctggctgtctattcccttcgggtccatgtacctggttgcagtggtcgggaatgtgaccatcttggccgttgtcaagatagagcgctcactacatcagccaatgtatttcttcctgtgtatgttggccgccatagatctggtactctcaacttcaaccattcctaagctgctggggatattttggtttggggcttgcgacatcggactggacgcctgccttggacagatgtttctcatccactgcttcgcaaccgtcgagtcggggatcttcctggctatggcctttgacaggtatgtggccatttgcaaccccctgcgacacagcatggttctgacctacactgtggtgggccggttggggttagtgtctcttcttaggggcgttctgtacatcgggccactgccactgatgattcggctgaggctgcccctttataaaacccacgttattagtcactcctattgtgaacacatggccgtggtggccctgacgtgcggcgattcacgagttaataatgtgtacgggctgtcgattgggttcttggtcttaatcctcgattctgtggccatcgcggcctcttacgtgatgatcttcagagcggtcatgggtcttgcaaccccggaagccagattgaagaccttgggtacatgtgcctctcacttatgcgctatcttgattttctatgttccgatcgcagtcagttccctgatacaccgttttggccagtgcgttccaccccccgtgcatacgctattggccaatttttatctgcttatcccccccatccttaacccaatcgtttatgccgttagaaccaagcagatccgcgagtcactactacagattccgcggattgaaatgaaaatcaggtag

SEQ ID NO: 28584 - DNA, 963 bp, Artificial Sequence
  Description of Artificial Sequence: Synthetic coding sequence
atgagctttctgaacggaactagcctgactccggccagcttcatactcaacggcatccccggccttgaagacgtgcatctgtggatttcatttccgctgtgtaccatgtactctattgccatcaccgggaatttcgggctgatgtatttaatttactgcgatgaggctcttcacaggcctatgtatgtgttcttggcgctgctgtccttcaccgacgtgctgatgtgtacctcgacactccccaacaccctcttcattctttggttcaacctgaaggaaattgactttaaagcctgtcttgctcagatgtttttcgtccatacttttactggcatggagagcggtgtgctgatgctcatggctttagatcattgcgttgctatatgttttccactgcgctatgcaaccatactgactaattctgtgatcgctaaggcggggtttttgacattcctgcgaggtgtcatgcttgtgattccttccacatttctgaccaaaagacttccctattgtaaaggtaacgtgatcccccatacatactgcgaccatatgtccgtggccaagatatcctgtggtaatgtccgggtgaacgctatctatggactaatagtcgcactgttgatcggggggttcgatatcctctgcattacaataagctacaccatgattctgcaggcagtcgtttctctgagttccgcagacgccagacagaaggcattcagtacttgcacagcacatttctgcgcaatcgtgcttacctacgtccccgctttcttcactttcttcacgcaccatttcggagggcacactattcccttacatattcacatcattatggccaatctctatctgctaatgccccctactatgaaccccatcgtctatggggtaaaaactcgccaggtgcgcgaatcagtgatccggttctttctaaagggcaaggacaactcgcacaatttctag

SEQ ID NO: 28585 - DNA, 966 bp, Artificial Sequence
  Description of Artificial Sequence: Synthetic coding sequence
atgtctggtgataattcctctagtttaactcccgggtttttcatactcaatggggtccccggtctggaggcgactcatatatggattagccttccattctgtttcatgtacatcattgccgttgtagggaactgtggccttatctgtctgataagccatgaagaggcactgcacagacctatgtattatttcttggctctgcttagcttcactgatgtaaccctgtgtaccaccatggtgcctaacatgctctgtatcttttggttcaacctgaaagaaattgattttaacgcatgcttggcacagatgtttttcgtgcatatgctgaccggtatggaaagtggagtgctaatgctcatggctctggatagatacgtggcgatctgttaccccctgcgctatgctactatactgaccaaccctgtgatcgccaaagctggtctggcaacgttcctgcgaaacgttatgttaatcattccgtttaccttactgaccaaaaggcttccatactgtcgaggtaacttcatcccccacacctattgcgaccatatgtctgttgccaaggttagctgtggcaattttaaggtcaacgccatctacggtctgatggttgctctgctcattggtgtctttgatatatgttgtatttctgtgtcctatacaatgatattgcaggctgttatgagcctgtcatccgcagacgctcgtcacaaggccttcagcacttgtacgagtcacatgtgttctatagtcattacctacgttgcagcatttttcactttttttacacatcgcttcgtgggacataacatccccaaccatatccatatcatcgtggccaatctgtacctgctgctccctccgaccatgaacccaatcgtttatggcgtgaaaactaaacagatccaagagggcgtgatcaagttcctactcggggataaagtgagcttcacctacgataaatag

SEQ ID NO: 28586 - DNA, 966 bp, Artificial Sequence
  Description of Artificial Sequence: Synthetic coding sequence
atgctcaccctaaataagacagatctcattcccgcaagttttattcttaacggagtgcccggcttggaggacacgcaactgtggatcagtttccccttttgcagtatgtacgtggtcgctatggtgggtaactgtggcttgttatacctgatccattacgaggatgccctgcataaacctatgtattatttcctggcaatgcttagcttcactgatctggtcatgtgctcaagcacgataccgaaggccctctgcattttttggttccatctgaaagacatcggtttcgatgaatgtttagtgcagatgttcttcacacacaccttcaccggtatggagagcggagtgctgatgctgatggcactggataggtatgtggcgatctgctacccactgcgatatagtaccattttaacaaatcccgtgattgccaaggtgggtactgctaccttcctcagaggagttctgttaattattccatttactttcttgactaaactgctaccctactgcaggggtaacattttgccacatacatactgcgaccacatgtcagtggctaagttgtcatgtggaaatgtgaaggtgaatgcgatctacggattaatggtggcgctgttgatctgggggtttgatatcctgtgtatcaccaacagctataccatgatcctaagggccgttgtttccctcagctccgccgacgcaagacagaaagcctttaatacatgtacagctcatatctgcgcaatcgtcttttcgtacacccctgcttttttttcatttttctcccacagatttggagaacacataattcctccctcttgccatattatcgtggctaacatttatcttcttctgcctcctacaatgaatcccattgtgtatggcgtgaaaactaagcagatccgggactgtgtgattcggattcttagcgggtccaaggacacaaagtcctattcaatgtag

SEQ ID NO: 28587 - DNA, 975 bp, Artificial Sequence
  Description of Artificial Sequence: Synthetic coding sequence
atgccactgttcaattctctgtgctggtttcccactatccacgtgaccccgccatctttcatcctgaacggtataccagggctggaaagagttcatgtatggatcagtctgccgctgtgtactatgtatataatctttctggtgggcaatctcggcctcgtctacctgatttattatgaggagtcactccaccatcctatgtatttcttttttggccacgccctgagccttatagacctgctcacctgcaccactacactccctaatgccctctgcatcttttggttcagcctgaaggagattaattttaacgcatgtctggctcagatgttctttgtgcatggctttaccggcgtcgagtccggcgtgcttatgctgatggccctcgaccgttatgttgccatctgctatccattgcgatatgcgactactctaacgaacccaatcattgccaaggcggaattggccacgtttttaagaggagtgttactcatgattccttttcccttcctggtgaagcgcctgccgttctgtcagtctaacataattagccacacttattgcgatcacatgtccgttgtgaaactaagctgcgcgtcaataaaggtgaatgttatctatggccttatggttgctttactgatcggtgtttttgacatctgttgtataagcctctcctacactttaatcctgaaggccgcaatttccctgtcctcgtctgatgcgcgccagaaggcattttctacctgcactgcccacatctccgcaattattattacctacgtgcctgccttcttcacattctttgcccatagatttggtggccacactatcccgcccagcctgcatataatcgtggctaacctgtatctcctgctaccccctacactgaacccaatagtctacggggttaagaccaaacagattcggaagtccgttataaaattcttccagggcgacaaaggtgctggatag

SEQ ID NO: 28588 - DNA, 948 bp, Artificial Sequence
  Description of Artificial Sequence: Synthetic coding sequence
atggtcctggctagtggcaactccagttcgcacccagtatcttttattttgttaggaattccgggactggagagcttccagctctggatagcctttcccttctgcgccacttatgccgtcgcagtggtcgggaacatcaccctactgcatgtgattagaattgatcacacactgcacgaaccgatgtacctgttccttgcgatgctggctattacggaccttgtgttatcctcttcaacccagcccaagatgctcgccatcttctggttccacgcccacgaaatccagtaccacgcctgcttgatacaggtcttttttatacacgcattcagctcagtcgagagcggcgtgctgatggcaatggcattagactgctatgtcgctatctgctttcctctaagacactcctctattcttactccgtctgtggtgataaaattggggaccatcgtcatgttgagggggcttctgtgggtaagccctttctgttttatggtgagccgaatgccgttttgtcagcaccaggctattccacagagttactgtgagcatatggcggtcctgaaattagtttgcgctgatacctcaatctccagaggaaatgggctttttgtggccttttccgtcgctggcttcgatatgatcgtcatcggaatgtcctatgttatgatcttgcgggcagtcctacagcttcctagcggcgaggccaggctgaaagctttctccactcgtagtagccatatttgtgtgatcctggccctgtatattcccgctctcttctcttttcttacctatcgcttcggccatgatgtgcccagggtcgtgcacattctgttcgcgaatttgtatttgttgatccccccaatgctcaacccgataatatacggggtgaggaccaaacagatcggtgaccgggtgatacaggggtgttgtgggaatatcccctag

SEQ ID NO: 28589 - DNA, 1185 bp, Artificial Sequence
  Description of Artificial Sequence: Synthetic coding sequence
atgttttacccgatcctcaacgatatctccaccaagaataattccaacatcatgagctgttgtaacattttgtttatcaaaacagtggagattattttggtttataaccagacacagtctccctggtatccaatcgtcccatccaagtccctggtttataataacaatacttgtttcgactgctaccacctgcaacgggtggactgcgtccccagcagagaccacataaatcagagtatggtgctggcctctggcaattcctcaagccaccccgtaagttttattctgctgggcatccctggactggaatcttttcagctgtggatcgcttttcccttctgtgctacatatgcagtagcagtggttggaaatatcactctgctccacgttattcgtatcgatcacaccctgcatgagcccatgtacctctttctggcaatgctggcgataacagacctggtgctgtcttctagcacccagcccaagatgcttgctattttttggttccatgcacatgagattcagtaccacgcctgtctgattcaagtcttcttcattcatgcctttagctccgtggagtcgggtgtgctaatggccatggccctagactgttacgtggccatctgcttccctctgcgccattcttcaattctcacgcccagcgtggtcatcaagctggggacgatcgtgatgcttcggggcctcttatgggtatcgccattctgtttcatggtgtctaggatgccattttgtcagcaccaggcaatcccccaatcctactgcgaacacatggcggtcctcaagctggtatgtgctgatacctccattagccggggcaatggactttttgtggcatttagtgtcgccggattcgatatgatcgtgatcggtatgtcctatgttatgattctcagagccgtcttacagctcccaagcggagaagccaggctgaaggccttctccactcgatccagccatatatgtgtcattctcgccctttatataccggcgctcttttctttcctgacctataggtttggccatgatgtcccccgtgtggtacatattctgttcgctaacttatacctcctaatcccgcctatgctgaaccccataatttacggtgtccggactaagcagatcggagatcgcgtcattcaaggatgttgcggcaatattccttag

SEQ ID NO: 28590 - DNA, 963 bp, Artificial Sequence
  Description of Artificial Sequence: Synthetic coding sequence
atggcagaaaccctgcagttgaactcgacctttctgcacccaaacttctttattcttacagggtttcctggactcggaagcgcacaaacgtggctgacgctggtgttcggccccatctacttgctggccctattggggaacggagcccttccggctgtcgtttggattgatagcacgctgcaccagcccatgtttttgctgcttgccatcctggccgctaccgatctcggcttggctacctcaattgcaccaggactcctcgcagtgctttggttgggccccaggtccgtgccttatgctgtgtgtctagtgcagatgttcttcgtgcatgcactgacagctatggagagcggcgtgcttctggcaatggcatgtgacagggccgccgccatcgggaggccattgcattatcccgtcctagtgacaaaggcctgcgtgggatatgccgccctggcactggccctgaaggcagtggccattgttgtcccgtttccactgctggtcgccaagtttgaacattttcaagccaaaaccatcggccacacttactgcgcccacatggctgttgtagagttggttgtggggaacacccaggcgaccaatttgtatggactggccctgtccctcgcaatttctggcatggacatcctgggcatcacaggatcctatggattaattgcccacgctgtgcttcagctgcctacacgcgaggctcacgccaaggcgttcggtacatgctcctcccatatatgtgtgatcctggctttctacatcccaggtttattctcctaccttacccatcgctttgggcaccacacagtgcctaaacccgtgcatattttactaagcaacatttatctccttctgccacctgcattaaaccccctcatctacggagcgcgcaccaagcagatcagggacagactgctcgagacctttaccttccgtaagagtcccttgtag

SEQ ID NO: 28591 - DNA, 957 bp, Artificial Sequence
  Description of Artificial Sequence: Synthetic coding sequence
atgatccaaccgatggcaagtccatccaacagttctactgtcccagtttcggagtttttgttaatctgttttcctaacttccagtcatggcagcactggttgtccctgcccctctctctgttgttcctactagctatgggagctaacactacgcttttgatcacgatccaactggaggcatctctgcaccagccactgtattacctgctctccctgctgtctctgctggatatagttctgtgtctgactgtcattcccaaggtgctcgccattttttggtacgatctgcggagtatatcttttccagcctgcttcctccagatgttcattatgaactccttcctgcctatggagagttgcaccttcatggtgatggcatatgataggtacgtcgccatttgtcacccactcagataccctagcataatcacaaaccagttcgttgccaaggcatccgtgttcatcgtagtaaggaacgccctgcttaccgccccaatccctatcttgacaagcctgctgcactattgtggcgagaacgtcatcgagaattgtatctgtgccaatttgagcgtcagccgcttatcatgcgacaattttaccctcaataggatttatcagttcgtggctgggtggaccctcctgggctccgatttgtttttgatcttccttagctacaccttcattttgagagccgttctgcgcttcaaagcagagggcgcagccgttaaggccctgagtacctgcgggtctcactttatattgatcctgttcttcagcacgatccttctggtggtcgtgctaacaaacgtcgcccgcaaaaaggtgcccatggacatcctgatcctcttaaatgtcctccaccatctgattccccccgctcttaatccgattgtttatggggtgcggactaaagagatcaagcagggcatccaaaaactcctgcagagagggcgatag

SEQ ID NO: 28592 - DNA, 948 bp, Artificial Sequence
  Description of Artificial Sequence: Synthetic coding sequence
atgactacgcacagaaatgacacactgagcactgaagcatcagattttctgctgaactgcttcgtccggagtccttcctggcagcactggctgtcactccctttaagtctcctttttttgcttgcggtgggcgctaacacaacactgttaatgacgatttggctagaggccagtcttcaccagcctctgtactatctgctctccctgttgagcctgctcgacattgtcttgtgcctcacagtgattccgaaggtgctgaccatcttttggtttgacctacgccccatcagcttccctgcttgtttcttgcagatgtacataatgaactgcttcctggccatggaatcttgcacgtttatggtcatggcctacgacaggtatgttgcaatatgccatcccctgagatatccctctatcattacagaccacttcgtggtgaaggccgccatgttcatcttaactaggaatgtgttgatgaccttgccaatcccaatcttgtccgcccaattgcgttactgcgggagaaatgtgattgaaaactgcatatgcgccaatatgagtgtgtcacgtctgagttgtgatgatgtaacaatcaaccacctgtatcagtttgccggaggttggacactcctgggatctgacctcatcctcatattcctgtcttatactttcatcctgagggccgttttgagactgaaggcagagggcgcagtagcaaaagcattgagcacctgtggatcacacttcatgctgatactgttctttagcacgattctgttggtgttcgtgctaacacacgtagcgaagaaaaaagtcagcccagacgttccggtcctcttaaacgtgctgcatcatgtaatccctgccgcccttaaccctattatctacggcgtccgaacccaagaaatcaagcagggaatgcaaaggctcctgaaaaagggctgttag

SEQ ID NO: 28593 - DNA, 1098 bp, Artificial Sequence
  Description of Artificial Sequence: Synthetic coding sequence
atgatgaccgtaattctcaagaccctgttgggacagatacagggactgtcaggtaacccccacagcacgacctctaggatgtactttctctgcttttgtactagccttctccggtttaaggtccactgggtgtctcgtttaatcagaaagctgtacatggcttccccatccaacgactctacagcgccggtgtccgaatttctgcttatctgctttcctaatttccagagctggcagcactggctgtcccttccactcagcctcctctttctgcttgccatgggggctaatactaccttgctgatcaccatccagcttgaagctagtcttcaccagcccctttattacttgctttcactgctttctctgttggacattgtgctgtgcctgactgtgattccgaaggtcctagctattttctggttcgatctgaggtctatcagtttccccgcctgctttctgcaaatgtttatcatgaacagcttccttacaatggaaagttgtacatttatggtgatggcctatgaccgatacgttgcgatctgccacccccttcgatatccctcaatcattacagatcagttcgtcgcaagagccgtcgtgtttgtcatcgcccgcaatgcctttgtaagcctccctgtgcccatgctcagcgctagactgcgctactgtgccggaaacatcatcaaaaactgtatctgttccaacctttcagtgagcaagttatcttgcgacgacattactttcaatcagctctaccagttcgtggctggatggaccttgctcgggtccgacctaatcctaattgtaatctcttacagttttattttgaaggtcgtgctgaggattaaggctgagggcgctgtcgccaaggcactgtcaacctgcggttctcattttatcttgatcctgttcttctccacagtcctcctcgtcctggtcattaccaacttggctcgcaaacggataccacctgacgttcccatcttgctcaatatcctccaccatttaattccccccgctctcaatcccatcgtgtacggcgtgcggacaaaagagataaagcagggtatccagaacttgttgaaacggttatag

SEQ ID NO: 28594 - DNA, 975 bp, Artificial Sequence
  Description of Artificial Sequence: Synthetic coding sequence
atgaatcacatgagcgcctcccttaagattagcaactccagcaaattccaggtgtcagagttcattttactcggatttcctggcatacactcatggcagcactggctgtcactccctctggctcttctgtatctttcggcactagctgctaacacactgatcttaattataatctggcaaaatccttccctgcaacagcctatgtacattttcctagggatcttgtgtatggtggacatgggtctggcaacgaccattattcctaaaattttggcaatcttttggttcgacgccaaagtgatctcgctccccgaatgctttgcccagatttatgcaattcacttctttgtggggatggagtcagggatattgttgtgtatggcctttgatcgttacgttgccatctgccaccccctacgttaccccagcatagttacgagtagcctcatccttaaggccacactctttatggtgctgagaaacggactgtttgtcacccccgtacctgtcctggccgctcagagagactattgttctaaaaacgagatcgagcattgcctatgcagtaaccttggcgttacttcgttggcctgtgatgaccgccggccaaattccatttgtcagttggtgctggcctggcttgggatgggctccgacctttcgttgataattctgagttacatcctgatcctctactccgtacttagactgaacagcgcagaagcagccgctaaggcgctgtcaacctgttcttctcacctgacccttattttattcttctacaccattgtcgtggttatcagtgtcacacatttgaccgaaatgaaggccacacttatcccagtcctccttaatgttctccataatataatccctcccagcctgaacccgaccgtatacgcactgcagacaaaagaactcagagcggctttccaaaaagtcctgttcgcacttaccaaagagattcgatcatag

SEQ ID NO: 28595 - DNA, 960 bp, Artificial Sequence
  Description of Artificial Sequence: Synthetic coding sequence
atggacacgagcactagcgtcacctatgacagtagcctccaaatatcacaatttatactcatgggcctgcctggtattcatgaatggcagcattggctgtcactgcccctgacgctcctatacctgctggctcttggggccaatctgcttataataataacgatccagcatgagaccgttctgcacgaaccgatgtaccacttgctgggcattcttgctgtagtggatataggtcttgccaccaccatcatgccaaaaattctcgccattttctggttcgatgccaaagctattagcctgcccatgtgcttcgcgcagatttacgccatccactgtttcttctgtatcgagtctggcatctttctgtgcatggctgtggacaggtacatcgcaatctgccggcctttgcagtacccatccatcgtcacaaaagcattcgttttcaaggctacaggatttataatgctgcgcaacgggttgttgactatacccgttccaattcttgccgctcagagacactactgttccaggaatgaaatagagcactgcttgtgttccaatctaggcgtaatcagcctagcctgtgatgatatcaccgtgaacaaattttaccagctgatgctggcatgggtcttggtcgggagtgatatggccctcgtgttcagttcatacgccgtaatcctacatagcgtcctgcggctgaattcggccgaggccatgtcgaaggccctatccacctgtagttcccatttaatccttattctctttcacactggcatcattgtgttgagcgtcacccatctggctgagaaaaaaattcccctgatacctgtcttcttgaatgtactccacaatgtgatacctcctgccctcaatcctctggcatgcgctcttcggatgcataagctccggctgggattccaacgtttgctgggtctgggccaggatgtgtccaaatag

SEQ ID NO: 28596 - DNA, 984 bp, Artificial Sequence
  Description of Artificial Sequence: Synthetic coding sequence
atggagtggaggaatcactcaggtcgggtatcagaatttgtgttgctggggttcccagcccccgccccgctgcaggtcctgctgtttgccttgctccttctcgcttacgtcctggtgctgacagagaatacactcataataatggcaatcaggaatcatagcaccctgcataaaccaatgtacttttttctcgcaaacatgtcctttctcgagatatggtacgtcacagttacaatacccaaaatgctggctggctttgtgggatccaaacaggatcatgggcagctgattagtttcgagggctgtatgacccagctgtactttttcctcggcttgggatgtaccgaatgtgtgctcctggcggtgatggcatatgatcggtatatggccatctgttatcctctgcattatccggtgatcgtctccggacgcctgtgcgtgcagatggcggccggctcgtgggccggaggcttcggcatttctatggtaaaggtgtttctgatctccggcttgtcctactgcgggcccaatattatcaaccatttcttttgtgacgttagcccactgcttaacctgtcgtgcaccgacatgagcacggccgaattaactgatttcatcctggcaatcttcatcctcctgggacccctaagcgtaactggcgccagctacgtggccataaccggggcagtgatgcatatccccagcgcggccggacgatataaagcattctccacctgtgcctcgcacctgacagtggtaattatcttctatgcagcgtccatttttatttatgccaggccaaaggccctctcagcttttgatactaacaagcttgtaagcgtcctgtatgcggtgattgtcccacttctgaaccctataatctactgtctcagaaatcaggaagttaagcgggcgctgtgctgcacgttgcacctttaccagcaccaggatccagatcccaaaaaagcttcacgaaatgtttag

SEQ ID NO: 28597 - DNA, 936 bp, Artificial Sequence
  Description of Artificial Sequence: Synthetic coding sequence
atggaactcgaaaatcagacacgcgtaaccaaattcattcttgtgggcttccccggaagtctttcaatgcgagccgctatgttcctgatcttcctagtcgcctacattctcacagttgcggagaatgtgattataattctgctcgtcctccagaaccgccccctgcataaacctatgtattttttccttgcaaacctttcattcttggagacctggtacatttcggtgacagtcccaaagctgttgttcagtttctggagtgtcaacaacagtatttctttcacactctgcatgatccagctgtattttttcatcgcgctgatgtgcacagagtgtgtccttctggccgccatggcctacgaccgttacgtggccatctgtaggcctctgcattaccctactattatgagtcacggactctgctttcggctggcgttgggttcatgggctatcggattcggcatcagcttggctaaaatttactttatttcatgcctgtccttttgtggccctaatgtcatcaaccatttcttttgcgacatttcgcccgtgctgaatttgtcttgtacagatatgagcattaccgaactggttgattttatcctggcactcgttatttttctgttccctttgttcattactgttctgagctacgggtgcatcttagcaactattctttgcatgccaaccgggaaacagaaggccttctctacgtgtgcttcacatctggttgtagtaactatcttctactcagctataatctttatgtacgccagaccaagagtaatccatgcctttaacatgaataaaatcatttcaatcttctatgctatcgtaactcccagcttgaacccgttcatctactgcctgcgaaatagggaagtcaaagaagccctcaaaaagcttgcatattgtcaggcctccaggtccgattag

SEQ ID NO: 28598 - DNA, 939 bp, Artificial Sequence
  Description of Artificial Sequence: Synthetic coding sequence
atgtcaggcgaaaacgttactaaggtgtcaacctttatcctggtgggtctgccaacagcacctggccttcagtatctgcttttccttttatttctcctgacctatctgttcgtcttggtcgaaaatcttgcaataattcttatcgtctggtcatcgacatcactgcacaggcctatgtactattttctgtcatccatgtctttcctggaaatctggtatgtgtctgacatcactcccaagatgcttgagggtttcctgcttcagcagaaaagaatcagttttgttggatgtatgacccagctgtacttcttctcatcgctggtatgtactgaatgcgtcctcctggcatctatggcctatgatcgttatgtggcaatatgtcaccccctgcgatatcatgtcctggtaacccctgggctgtgccttcagctggtgggattctcctttgtttctggcttcaccatctccatgataaaggtctgctttatcagcagcgtcaccttctgcggatctaatgtgcttaaccacttcttctgcgatatctctcccatcctcaaactcgcctgtacagatttctcaaccgccgaactagtggacttcattctggccttcattattctggtgttcccgctgctggccaccattttatcttattggcatattaccctcgcagtactgcgaattccgtctgcaactggctgctggcgcgccttcagcacgtgcgcatcgcatctgacggttgtaaccgttttctacactgccctcctgttcatgtatgtgagacctcaggctatagatagccagtcaagcaacaagctgatcagcgcagtttataccgtcgtaacaccgatcatcaatccgctcatatactgtctgcggaataaggagtttaaagacgcactaaagaaggccctgggactgggccaaacctctcattag

SEQ ID NO: 28599 - DNA, 996 bp, Artificial Sequence
  Description of Artificial Sequence: Synthetic coding sequence
atgtccggggagaatgtgactagggtgggcacatttatcctcgtgggattcccaacggcccctggactgcagtatcttctttttctgctcttcctcttgacctatttgttcgtcctggtggagaacctggcgattattctgactgtgtggagcagtacaagtctacaccgtcctatgtattatttcttgtctagcatgtcatttctcgagatctggtatgtctcagacattacccccaagatgctggaagggtttttgttgcagcagaagaggattagttttgtaggctgcatgacccaactatacttttttagtagtctggtgtgtacagaatgtgttctgctggcctcaatggcgtacgatcggtatgttgcaatatgtcatccgctccggtatcacgtgcttgtcaccccgggcctgtgtttgcagctggttggcttcagttttgtctccggcttcacgatctccatgattaaggtctgcttcatctccagtgtcacattctgcggtagtaacgtgctgaatcattttttctgtgatatctcccctattcttaaactcgcatgtaccgatttcagcaccgcagaacttgtggatttcattttagctttcataatcttggtatttcctttactcgctaccatgttaagttacgctcacatcactctggccgtgttacgtattccctctgccacagggtgctggagagccttcttcacgtgtgctagccatctcaccgtagtgacagtgttctacaccgcacttctttttatgtacgtcaggccccaagctattgattccaggagctcgaataagctgatatccgtgctgtacactgttattacccccattctgaacccgctgatttactgcttacggaataaggagttcaagaacgcactcaaaaaagcttttggcctcacttcctgcgccgttgagggaaggctctcttctctgctcgaattgcaccttcagatccacagccagcctctttag

SEQ ID NO: 28600 - DNA, 939 bp, Artificial Sequence
  Description of Artificial Sequence: Synthetic coding sequence
atgaggaatcacacagagatcacggagtttatactgctgggtcttacagatgacccaaacttccaggtggttatcttcgtgttccttctcataacttacatgctgtcgataacaggtaacctgacccttattactattacactcctggatagtcacctgcagactcctatgtacttcttccttagaaatttctctatcctcgagatttcatttacaacagtgtccattcctaagttcctggggaacatcatctcaggtgataaaacgattagcttcaataattgcattgtgcagctattcttttttattcttctcggcgtgacagagttctacctcctggctgccatgtcgtacgatcgctatgtcgcaatctgcaaacccctgcactgtctgagtattatgaatcgccgtgtctgcacccttctcgtttttaccagttggttggtgagtttccttattattttcccagctttgatgcttctgctgaagctgcactattgccgttcaaacattattgaccacttcacatgcgactatttccccctcctgcagctcgcttgctctgacactaagttcctggaggtgatgggcttctcatgcgctgccttcaccctcatgttcaccctcgccctgatattcctgtcatatatctacatcatccgtaccatcttaaggatcccctccacatcccagaggaccaaagcatttagcacttgtagtagccatatggtggtggtgtcaatctcttacggttcctgcatcttcatgtatattaaaccctccgctaaagaccgagtgtccctgtcaaagggcgtcgcaattctcaacacctccgtggcgcctatgatgaaccccttcatctacagtctgcgcaatcaacaggtgaaacaggctttcatcaacatggcccggaaaactgtcttcttcacgtccacttag

SEQ ID NO: 28601 - DNA, 939 bp, Artificial Sequence
  Description of Artificial Sequence: Synthetic coding sequence
atgaaaaaccacaccgtgataagaaccttcattcttctaggcctcaccggtgatccacatctgcaggttctgttatttatcttcctgttcttgacatacatgttgagtgtaacggggaacctgaccataatcacgttaaccctggttgaccatcatttaaaaacccccatgtatttcttcctgcgcaacttctccttccttgaggtgagtttcactactgtgtgcatcccgcgcttcctgtataatatttcaatgggtgacaacaccataacttataacgcgtgcgcctctcagatattttttgtgatcctttttggtgctaccgagtttttccttctggctgcaatgtcctacgaccgatacgtagcaatatgtaaaccactgcattatgttgtgatcatgaataatcgggtttgtacactgttagtgttatgttgttgggtggccggcctgatgattattgtgccaccgctaagcttaggactccaattggagttctgcgacagcaatgccattgaccattttagttgtgacgcgggccccttgcttaagatctcctgtagtgatacttgggttattgagcagatggtcatcttgatggctgtgtttgccctaattatcaccctggtgtgcgtcatactgtcctatttgtacattgtccggactatactcaaatttccttccgtacagcagagaaaaaaagctttctctacatgctcttcacacatgatcgtagtctctatagcttatggtagctgtatatttatttatataaaaccaagcgccaaggatgaagtggcaatcaacaaaggggtatctgtgcttaccacttctgtcgccccactcctcaacccctttatttacaccctgcggaacaaacaggttaagcaggccttctcagatagtattaagcgaatcgcctttttatccaaaaaatag

SEQ ID NO: 28602 - DNA, 936 bp, Artificial Sequence
  Description of Artificial Sequence: Synthetic coding sequence
atgaaccatactatggtgaccgagtttgttctccttggcctttctgatgatccagacctccaaatcgtgatattcctcttcctttttatcacttatattctgtcagtgacgggtaatttaacaatcattactcttaccttcgtggactctcatttacaaaccccaatgtactttttcctccgaaatttttcctttctcgaaatcagtttcacgactgtgtgcataccgcggtttttaggggccattattacccggaacaagaccattagttacaataactgcgcggctcagcttttcttttttatcttcatgggtgtgacggaattctatattctgactgcaatgagctacgaccggtatgtagccatttgcaagccgctgcattatactagtattatgaaccgaaagctctgcacactcttggtgctgtgcgcttggctgtctggattcctgacaatcttccctcctttaatgcttctgcttcaactggactactgtgcttccaacgtgattgatcactttgcctgcgactatttcccacttctccagctgtcatgcagcgacacctggcttcttgaagtgattggtttttactttgcgctggtgaccctcctctttacccttgccctcgttatccttagctatatgtatatcattcggaccatccttcggattcccagcgcctcacagcgtaagaaggcattcagtacttgtagctcgcacatgatcgtcatcagcatttcgtacggaagttgtatcttcatgtatgccaacccgtccgccaaggagaaagcatcactgactaaggggattgccatcctgaataccagcgtagcccctatgctgaaccccttcatttatacactaagaaatcagcaggtcaagcaagcctttaagaacgtggtacacaaggtcgtcttctacgccaaccagtag

SEQ ID NO: 28603 - DNA, 930 bp, Artificial Sequence
  Description of Artificial Sequence: Synthetic coding sequence
atgaaaaatagaactatgttcggagagttcatacttctcgggctcactaaccagcctgaactccaggttatgattttcatctttttgtttcttacttacatgctaagcatactgggtaacctcacaatcattacgctaacactgttggacccacacctgcagactcccatgtacttttttctgagaaacttctctttcttggaaatctcattcacctccatcttcattcctaggttccttacctcgatgactacgggcaataaggtgataagttttgccggctgcctgacccagtacttttttgccatctttttaggcgctacggaattttacctgcttgctagtatgagctatgacagatacgtggctatttgtaaaccactccactatttgacaatcatgagttcacgagtctgcattcagttggttttttgtagctggctgggtgggttcctggctatattgcctccaattatcctcatgacacaggtggacttttgcgtaagtaacatcctgaaccactactattgtgactacgggcctctggttgaattggcctgtagcgacactagcctcctagaactcatggtcatcctcctagcagtggtcacactgatggtgacactcgtactagtcaccctgagctacacatatatcatccgcactattctgaggatcccttcagcccagcagcgtaccaaagcattctcaacttgcagtagccacatgatcgtgattagcttgtcctacggatcctgcatgttcatgtatattaatccatccgccaaagaaggcggagctttcaacaaaggcattgcagttcttatcacctctgtgacgccactgctgaacccatttatttacaccctgcggaaccaacaggttaaacaggcctttaaggattccgtgaagaaaatcgtcaagctgtag

SEQ ID NO: 28604 - DNA, 939 bp, Artificial Sequence
  Description of Artificial Sequence: Synthetic coding sequence
atgcccaacatgacctcgataagagaattcattttacttggcttcaccgataatcctgagctgcaggtcgtcatttttttcttcatgctgatcacatacttactgagcgtcagcgggaacatgataattataatgctgacactgtccaacatccacttaaagacgccgatgtatttcttcctgcgcaatttttcgtttttggagatttcgttcaccacagtctttatcccacgattcctgatcaatattgccaccggggacacaaccatttcttacaatgcttctatggcccaggtgttcttcctgattctcctgggatctactgaattttttctcctcgcagttatgagttacgacaggtatgtggccatctgcaaaccactccactatacgaccattatgtctaataaggtttgtaattggctggtgattagctcctggctggccgggttcctcatcatttttcctcccgtgatcatgggcttgcagctcgacttctgtgacagctctaccattgaccatttcatctgcgacagctcccctatgttgttgatcgcctgtacggatacccagttcttagaactgatggcatttctcttagccgtttttaccctcatggtgacactcgcacttgtggtcctgagctacaccctgattcttaaaactattcttaagatccctagtgcccaacagcggaaaaaagccttttccacttgtagttcacatatgattgtcgtctcagtttcatacgggagctgtatcttcatgtgcgtgaaaacgtcggctaaggaagggatggctttatcaaagggcgtggccgtgctgaataccagtgtcgcaccaatgctgaacccctttatctacactttgagaaatcaacaggtgaaacaggctctgcgggaatttaccaagaaaatacttagcctgaataagcagtag

SEQ ID NO: 28605 - DNA, 954 bp, Artificial Sequence
  Description of Artificial Sequence: Synthetic coding sequence
atgcaaaaatcagtcatgcgaaagcatacagcgataaccacttttatcctgctgggcttgacagaagaccctcagctgcaggtgctgctattcatgtttctcttcatcacatatatgttatccgttacagggaagttgaccattattgccctcaccatgttagatcctcacctgaaaacccccatgtatttcttcctccagaatctgagttttcttgaaataagcttcacggctacgtgcgtccccagatttctctatagcattagtactgggaataagataataacgtataatgcttgcgtgatacaactgttctttgccgatctctttggcgtcactgagtttttccttctggccactatgtcctacgatcgttacgtggccatttgcaaaccactgcattatatggccattatgtccaacaaagtttgcaaaacaatggtcatttgttgctggatggccgccctcatgattatcctgccccctctgagcctcggattccacctcgagttctgcgactccaacgtgatcaaccactttggatgcgacgcgttaccaatcctgaagatcccctgcagtgatacgtcattgatcgagcagatggtggtggcaagcgccgttctcacctttatcatcacattagtgtgtgtcgttctgtcttacacctacatcattcgcaccatactcaagttcccctccgtgcagcagaagaaaaaggccttctccacttgttcttcccatattaccgtagttagtatcacatacggatcttgcattttcatctatatcaagccaagtgctaaggaggaggtgaatattaacaaaggagttagtgtgctcattagctctatctccccaatgctgaatagcttcatctacaccttgaggaatgaacaggtgaaacaggcctttcatgactccttaaaaaagattgcctttagactgaaaaagtag

SEQ ID NO: 28606 - DNA, 939 bp, Artificial Sequence
  Description of Artificial Sequence: Synthetic coding sequence
atgagaaaacacaccgcaataacgactttcattctgcttggccttaccgaggatccccagctccaggttctcctgtttatgtttttgtttattacctacatgctgagtgtgacaggaaagctgacgatcatcgcgctgacgatgctggatccgcacctgaagacgcctatgtacttttttttgcagaacctgagttttttggagataagcttcacagcaacatgtgtgccacggtttttatactccattagtactggaaacaaaatcattacttataatgcctgtgtaatccagctcttttttgcagacttgttcggcgtgacggagtttttcctgctggcaaccatgagttatgaccggtatgtggccatctgcaagccactgcactacatggctattatgtctaacaaagtctgtaaaaccatggtaatctgttgctggatggcagcgttaatgataattctcccaccattgtccttggggttccacttagaattttgtgattccaatgtgatcaatcacttcggttgcgatgcgctgccaattttgaaaatcccttgttcagataccagccttatcgaacagatggtagtggcctccgccgtgctgactttcattatcaccttggtttgtgtggtcttatcatatacatacattatccggactatcctaaaatttccaagcgtgcaacagaagaagaaggctttcagcacatgttcttcccatattaccgtggtgagcattacgtatgggtcttgcatcttcatttatatcaaaccctctgcgaaggaggaagtcaatatcaacaagggtgtaagcgttctgatttccagtatttctcctatgttaaacagtttcatctatactttacggaatgagcaggtgaagcaggctttccacgattctctaaagaaaattgcctttcggctcaagaaatag

SEQ ID NO: 28607 - DNA, 939 bp, Artificial Sequence
  Description of Artificial Sequence: Synthetic coding sequence
atgaagaaccatacacgccaaattgagtttatactcctggggcttacagacaacagccagctgcagatcgtaatttttctcttcttactgctgaactgtgtgcttagtatgattggtaactttacaattatcgcactaattctgttagactcccagctgaaaactcccatgtacttctttcttcggaactttagttttcttgaaatatccttcaccacagcatgcattccgcggtttctgatcaccatcgtaaccagggagaagaccattagctgtaatggatgtataagccaactttttttctacatttttctgggagtgacggagttcttcctactggccgccctgtcgtacgataggtatgtggctatctgtaagccgctgagatatatgtctatcatgagcaataaagtctgttatcagctggtatttagctcttgggttacagggtttctaatcatcttcacgcctttgattctgggactaaacttggacttctgtgccagtaacattatcgatcatttcatctgtgacatcagtctgattttgcagctgtcatgtagcgatacacatctgctcgagctcattgccttccttctggccgttatgaccttaattgtgactcttttcctcgtaatcctctcatacagctacatcataaagaccatcctcaagttccctagtgcccagcagaagaagaaggcattctccacttgttcatcacacatgatcgtggtgagtattacatacggatcttgcatgttcatctacatcaaacctagcgcaaacgaaagagtggcactatccaagggagtgactgtcctgaacaccagcgttgcccctctgctcaaccctttcatatatacactgcgaaatcagcaggtgaaacaggctttcaaggccgtgttcaggaagatcttcagtgcttccgataaatag

SEQ ID NO: 28608 - DNA, 939 bp, Artificial Sequence
  Description of Artificial Sequence: Synthetic coding sequence
atgcgcaatcatacgactgtcgccaacttcatcctcctgggcctgaccgacgacccacaacttcaagtgatcatattcctgcttcttttctttacgtatatgctgtcgattactggcaacctgacaattataaccctgacactgcttgatctgcatctcaagactcccatgtacttttttttgagaaactttagctttctggaggtgtcttttacgacagtgtatatccccaagttcctcgtcagcatggccaccggcgacaaaaccatttcttacaacgactgcgcggctcagctatttttcactatccttttaggcgcaaccgagttcttcttgctcgctgcgatgtcctatgagcgctacgtcgcaatctgcaaacccctccattatactaccatcatgagtagtcgcgtttgttcactgttggtattcgccagctggatggcgggtttcctcatcatcttcccccctctattaatgggattgcagttggacttttgtgcggccaataccgtagaccacttcttctgcgatgttagcccaattctccagttgagttgtacggacaccgacattattgaactaatgatgttactctctgcaattctcactctgctggtcacactagtgctggtaatactgagttatacgaacattattcgcacaatactaaagataccaagctctcagcagcggaagaaggctttttcaacttgctctagtcacatggtggttgtgtctatttcgtacggcagctgtatcttcatgtacgttaagccctccgccaaggagagagtctcgttgaataagggcatagcactcctgagtaccagcgtagccccaatgctcaacccatttatctataccctgcgaaacaagcaggttaaggacgttttcaaacacacagtcaaaaagatcgagctgttctctatgaaatag

SEQ ID NO: 28609 - DNA, 939 bp, Artificial Sequence
  Description of Artificial Sequence: Synthetic coding sequence
atgagaaactctaccgccgtgacagacttcatactgctgggcctgactagcgatcctcaatggcaggtggttctgtttatattccttctggtcacttacatgctctctgttacagggaatctgattatcatcactctcacgctctctgaccctcacctgcagacaccaatgtatttctttttaaggaatttcagctttcttgagatttccttcaccagcgtgtgtatacctaggtttctagtcaccgttgttacaggcaataggacgatcagttacaacggttgtgttgctcagctgttcttcttcatctttctgggggttaccgaattttatttgctagcagcgatgagttacgatcgatgcatggcaatttgtaagccgctacactacaccatcattatgagtacgcgcgtgtgtacgcttctcgtgttttcaagctggttggccggcttcctgattattttcccgccagtcatgctgcttcttcagcttgacttctgtgcatcaaacgtcattgatcatttcatctgtgactccagcccaatgcttcaactctcctgtaccaacacccatttcctggaattaatggctttctttcttgcagtggttaccctcatggtgactctgaccctggtgatactgagctacacaaacatcatccgcactattcttaaaatcccttcaatgtcgcaacgtaagaaggcgttttcgacatgctcgtcccatatgattgtcgtgtcgatttcatactcctcctgcattttcatgtacataaagacctcagcgcgtgaaagagtgacactgagtaaaggtgtggcggtgctgaatacgagtgtcgccccgttattgaaccctttcatctacacacttcgaaataagcaggttaagcaggcctttaaatccatggtccagaagatgatattctccctcaataaatag

SEQ ID NO: 28610 - DNA, 927 bp, Artificial Sequence
  Description of Artificial Sequence: Synthetic coding sequence
atggacaccggtaacaaaactcttccacaggacttcctactgctcggttttccagggtctcaaaccctacaactgtccctcttcatgttgttcctggtcatgtatattttgacagtgtccgggaacgtggcgattttaatgcttgtctcaacgtcacaccagctgcacactccgatgtatttcttcctgtccaacctctcctttctcgagatctggtacaccacagcagcagtccccaaggccctcgccatattgctgggtcgctctcaaacgatcagtttcacctcatgcctgttgcaaatgtactttgtattcagtctcgggtgcacagaatactttcttttggcagcaatggcgtacgataggtgcttggcaatctgctaccccctccattacggagccataatgagcagtctgctctctgcacaactcgccctgggaagttgggtttgtggtttcgttgccatagctgtacctactgcactgatttctgggttgagcttttgcggacctagggccatcaatcactttttctgtgatatcgccccctggatagctttagcttgcaccaacacccaggctgtagagctggtcgcgtttgtgatcgctgtagtcgttattctctcttcctgtttaataacattcgtgtcatatgtctatatcatatcaaccatcctgcggataccatctgcctccggccggagtaaggcttttagcacatgttccagccatcttacagtagtcctcatatggtacggatcgacagtgtttctgcacgttaggacctccatcaaggatgcactggatctgattaaggcagttcatgtgctcaacactgtggtcacccctgtgctgaatccgttcatatataccctcaggaacaaggaagtgcgcgaaactcttttaaaaaaatggaaaggtaagtag

SEQ ID NO: 28611 - DNA, 1044 bp, Artificial Sequence
  Description of Artificial Sequence: Synthetic coding sequence
atgggcaactggactgctgctgttactgaattcgtgcttctggggttctccctctcacgcgaggtagagttgttgctgctggttctgctattacctaccttcttgctgacactgctgggtaatttactgattatttccacggtgctctcgtgtagcagactgcatacacctatgtacttctttctgtgcaatctgagcattctggatattttatttacgtctgtgattagtcctaaggtactcgccaacttaggaagtcgtgataagacaatttcctttgccggctgtattacgcagtgttatttctattttttcctaggcacagtcgagttcctcctgctcaccgtcatgtcgtatgaccgatacgcaacaatttgttgccctttgcgctatactacaatcatgaggccctccgtttgtatcggcactgtggtgttcagctgggtgggcggcttcctaagcgtgttgtttcccactatcctgatctctcagctgccattctgtgggtcaaatattatcaaccactttttttgcgactcaggccccctgttggctctggcctgcgcagacaccaccgccatcgaactgatggacttcatgctctctagtatggtgattctgtgctgtattgtcttggtagcttactcttatacttacataatacttactatcgtgagaatcccgagcgcctcgggaagaaagaaagcatttaatacatgtgcgtctcatctcaccattgtcatcattccatctggcattaccgtgtttatctatgtaacacccagccagaaagagtatctcgagataaataaaatcccattggtgctgagctctgtggttacgccttttctgaacccttttatctataccctcaggaacgacaccgtacaaggcgtgctccgggatgtgtgggtcagggttagaggcgtgttcgagaaacgcatgcgggctgtgctgcgatctcggctcagctctaacaaagaccaccaaggccgggcctgctcttccccaccttgtgtttatagcgtcaaacttcagtgctag

SEQ ID NO: 28612 - DNA, 975 bp, Artificial Sequence
  Description of Artificial Sequence: Synthetic coding sequence
atggaaagccctaaccgcaccaccatccaggagtttattttttccgccttcccatactcctgggtgaagtcggttgtctgttttgtgccgcttctgttcatttacgccttcattgtagtgggtaatttggtgatcattaccgtggttcaactgaatactcacttgcatacacccatgtatacatttatttctgctctctcatttctggaaatctggtatacaaccgccactatccctaaaatgctgtcttccttactcagcgaacggagcatatctttcaacggttgtcttctccagatgtacttcttccattcaacaggaatatgcgaagtctgtttgctgactgttatggcgtttgaccactatctagctatctgctcacctttgcattacccaagcatcatgacacctaaactatgtacccaactgaccctctcgtgctgcgtctgcggctttattactcccctgccagaaattgcatggatttccacactacccttctgtggaagtaatcaccttgaacacatattttgcgattttcttccggtgttaagactggcatgcactgacacacgtgccatcgtgatgatacaggtggtggacgttattcacgccgtggagattataacagcagttatgctgatcttcatgagctacgatggaatagtggccgtgatccttcggatccacagcgccggcgggagaaggaccgccttttcgacctgtgtgagccatttcattgtgttctccctgttctttgggtctgttaccctgatgtatttgcgcttctctgcgacctatagcctgttctgggacattgccattgcccttgcttttgcagtactgagccccttttttaaccccatcatctactccctgcggaacaaggagatcaaagaagccatcaagaagcatatcggccaggccaaaatttttttttccgtgcgcccaggaactagctctaagattttttag

SEQ ID NO: 28613 - DNA, 948 bp, Artificial Sequence
  Description of Artificial Sequence: Synthetic coding sequence
atggagagtggcaatcagtcaaccgtgaccgagtttatttttaccggctttccacagctgcaggacggtagtctgctttacttctttcctctgctcttcatctataccttcatcattatagacaaccttctgatcttcagcgccgttaggctagacacgcacttacataatccgatgtacaatttcatctcaatcttctcctttctggaaatctggtacactaccgccacgataccaaagatgctttcgaacctgatcagtgaaaagaaagctatctctatgaccgggtgtatccttcagatgtacttcttccattctctcgaaaattccgaggggatactgctcactaccatggctatagatagatatgtggcaatttgtaaccctctgcgatatcagatgattatgacacccaggctgtgtgcccagttgtccgcaggcagttgtctgttcggctttttgattctgcttcccgagattgtcatgatttccacactccctttctgcggacctaatcagattcaccagatcttctgcgatctggtacccgtcctctccctcgcctgcactgacacaagcatgatcttgattgaggatgtgatccatgcagtcactataatcattaccttcctcattatcgctctatcatatgttagaatagttactgttatcctccggattccatcttctgagggacgccagaaagccttctcaacatgtgctggtcacctaatggtgttccccattttctttggctccgtctctcttatgtacctgcggttctccgatacttacccacccgttttggacacagcgattgccctgatgttcacagtgctggctcccttttttaatccgatcatttatagcctacgaaacaaggatatgaataacgccattaagaaactcttttgtctgcagaaagtgctcaataagcctggggggtag

SEQ ID NO: 28614 - DNA, 996 bp, Artificial Sequence
  Description of Artificial Sequence: Synthetic coding sequence
atgtgctggaccatgcccagtccatttaccggctcctctactcgcaacatggaatccgggaaccagtcaactgtaactgagttcatattcaccggatttccgcaactgcaagacggcagtctgttatatttcttccctttgctcttcatctacacatttattatcatcgacaatttactaatttttagtgcagtgcgtcttgatacacatctgcataaccccatgtataacttcatcagtatatttagctttctggaaatttggtacacaactgcgacgatcccaaaaatgctatctaacttgataagcgaaaagaaggcgatctccatgacgggatgcattctgcagatgtacttttttcattctctagaaaattctgagggcatattgctgacgacaatggccatcgacagatatgtggccatttgtaatcctctgaggtaccagatgataatgacacccagactgtgcgcccagttaagcgccggcagctgtctattcggattcctgatactgctgcccgaaattgtaatgatctcaacactcccattctgcggccctaaccagattcaccagatcttttgcgacctcgtgcctgttctgtccttggcctgcaccgacaccagtatgatcttgatcgaggacgtgatccatgccgtgacaatcattatcacatttctgatcatcgcgctctcctacgtccgcatagtgactgtcatcttacgaataccatcaagcgagggcagacagaaagccttttctacatgtgccggacatttaatggtgttcccaatcttctttgggtcggtcagtcttatgtatttgcgcttctccgacacatatccgccagtccttgacactgccatagccctgatgtttacagtgcttgctccattcttcaatccaattatctactccttgcgcaataaagacatgaataatgctattaagaagcttttttgtctgcaaaaagtgctgaataagccaggaggctag

SEQ ID NO: 28615 - DNA, 1032 bp, Artificial Sequence
  Description of Artificial Sequence: Synthetic coding sequence
atgaagcagtatagtgtgggaaaccagcatagcaactacagaagccttttatttccctttttgtgctcacagatgacacagctgaccgcctcagggaatcaaaccatggtcacagaattcctctttagcatgttccctcacgctcatcgcgggggattactgttcttcatcccactgctactgatctacggattcatattgacggggaacctgatcatgtttatcgtgattcaagttggcatggcactacacaccccactctacttcttcatctctgtcctctctttcctcgaaatttgttacacaactactacaatacctaagatgctaagctgtctgatttcagagcagaagagcattagcgtggccgggtgtctgctccagatgtacttcttccattccctgggtattaccgagagttgcgtactcaccgcgatggctatcgatcgctacatcgcaatctgcaaccctcttcgttatccaacaatcatgattcctaaattgtgcattcagttaacagtgggatcatgcttttgtggtttcctgctggtgttgcccgaaatcgcttggatttcgaccttgccattctgtggatcgaatcagattcatcagatattctgtgatttcacccccgtccttagcctggcttgtacggacacatttctggtggtgatagtggacgctatccacgcagctgagattgtcgctagcttcctcgtgatcgccctgtcctatatacggatcattatcgtgatactgggaatgcatagtgccgaaggccaccacaaggcattttcaacctgtgccgctcacctcgccgtctttcttctgttttttggaagcgtggcagttatgtatctccgcttcagtgctacatactcggttttctgggataccgcaattgccgtaactttcgtgatcttagctccatttttcaaccccatcatttactcgctaaaaaacaaagacatgaaagaggccatagggcgcctgttccactaccaaaagagggccggttgggccgggaaatag

SEQ ID NO: 28616 - DNA, 942 bp, Artificial Sequence
  Description of Artificial Sequence: Synthetic coding sequence
atgggtaattggtctacagtaactgaaatcacactgatagccttccccgctctgctggaaatcagaatctccttgttcgtagtgctggtcgttacttacacactcaccgccaccggcaatatcaccattatttcgctgatctggattgaccatagattgcagactcctatgtacttcttcctgtccaatctgtccttccttgatatcctgtacaccacagtaatcacgccaaagctgttggcttgtcttctcggtgaggagaaaacaatttcattcgctggctgtatgatacagacatacttttatttctttttaggcacggtcgagttcattcttttggccgtcatgtcatttgacagatacatggcgatctgtgacccccttcactacacggtgatcatgaactcccgcgcttgcctactcttagttcttgggtgctgggtgggcgccttcctgtccgtgttgttcccgacaattgtagtgacgcggctgccatactgcaggaaagagatcaatcacttcttttgcgatatcgcgcccctgcttcaggtagcatgtattaatactcatctgatcgaaaagataaatttcctgctctccgctttagtcatcctctccagtttggcattcactacaggatcatacgtctatatcatttccactatattgaggatcccctctacccaggggcggcagaaagccttttctacttgtgctagccacatcacagtggtctccatagcgcatggctcaaacattttcgtctacgtgcggcccaaccagaattcctcgttggactatgataaggtagctgccgtgcttatcaccgtcgttacgcccctgctcaacccatttatctacagtttacgcaacgagaaggtgcaagaggttctgagagaaaccgtgaatcgcattatgaccttgattcagcgcaaaacatag

SEQ ID NO: 28617 - DNA, 939 bp, Artificial Sequence
  Description of Artificial Sequence: Synthetic coding sequence
atggacaccggtaattggtcacaggtagctgagttcattattctcggatttccacatctgcagggtgtacagatctatttattcctgctgcttctgctcatatatctcatgacagttctgggtaacctcttgatctttttggtcgtttgtctcgattcacggctccacacacctatgtaccacttcgtgagtatcctgtcctttagtgaactcgggtacaccgccgccaccattccaaaaatgctggccaacctcctatccgaaaagaagacaatttcattctcaggctgcttactccaaatttatttttttcattcccttggcgccaccgaatgctacctgctgaccgcgatggcttacgatcggtatcttgcaatttgtagaccattgcactatcccacccttatgacccctacattgtgtgcagagatcgccattggatgttggctcggtgggctggccgggcctgtcgtcgaaatttcacttatctcccgattacccttttgtggacccaacagaattcaacatgtcttttgtgactttccccccgtattatcactcgcatgcactgacacctccataaacgtactggtggacttcgtgatcaattcatgcaaaattctggccacctttctcctcattctgtgtagttacgtgcagatcatctgcacagtactgcgcataccctcagccgcgggcaaaaggaaagcgatatcaacatgcgctagccactttaccgtcgttctgattttctacggctccattctgtccatgtatgtgcagttaaaaaagtcctactcactcgattacgaccaggctctggcagtagtgtattcagtgttgactccctttctgaatcccttcatctactccctgaggaataaggagatcaaggaggcagtcaggaggcaactgaagagaatagggatcctcgcctag

SEQ ID NO: 28618 - DNA, 954 bp, Artificial Sequence
  Description of Artificial Sequence: Synthetic coding sequence
atggatcagtataaccacagcagcctcgccgagtttgtcttccttggctttgcgtctgtgggctacgtacgcgggtggctgtttgttctcctgctgcttgcctatttatttacgatttgcggcaatatgctgatcttctcggttattcgcctggacgccgctttgcacaccccgatgtaccactttgtcagtgtgctgtctttcttagaattgtggtacacagccacaaccatcccgaagatgctgagcaatattctgtccgaaaaaaaaacaatttcttttgctggttgtcttctccagacatacttcttccattcgcttggagcatctgagtgttatctgctcacggccatggcatatgacagatacctggcgatttgccgccctctccattatccaataataatgactactactctttgtgccaagatggccgccgcctgttggacctgtgggttcctatgcccaatcagtgaagtgatcctggcaagccagctgcccttctgcgcttataacgagatacagcacatcttctgtgattttcctccgctgctcagtttggcttgtaaggacacatcagccaacatcctcgtggacttcgcaattaacgctttcattatcctaattacctttttcttcatcatgattagctacgcccgcatcatcggagccgttttaaagattaagactgcaagtggaagaaaaaaagcatttagcacatgtgcctcccatctggccgtcgtcctgatcttcttcggaagcatcatcttcatgtatgttaggctaaagaaatcttacagccttacactggatcgcaccttagctatcgtgtacagtgtgctgacccccatggtgaaccccattatctattccttaagaaacaaagaaatcatcaaggccattaaaagaaccatctttcaaaagggggataaggcctccctcgcccatctttag

SEQ ID NO: 28619 - DNA, 954 bp, Artificial Sequence
  Description of Artificial Sequence: Synthetic coding sequence
atgagaaacctttccggcggacacgtagaggagtttgtgctggttggcttccccacaacccctcccctccagcttctgctctttgtcttattctttgcaatctatttactcaccctcctggaaaacgcattaatcgtctttaccatctggctggccccttccctgcaccgccccatgtactttttcctggggcacctctcctttctggagttgtggtatattaatgtcaccatacctcgattactggccgcatttttgacacaggacggtcgggtgtcttatgtcggctgtatgacccagctgtacttctttattgcactcgcatgcactgagtgtgtgctcctagccgtgatggcatacgataggtacctcgcgatctgcggcccccttctgtacccttcgctgatgccctcgtccttggccacaagattggctgcagctagttgggggtccggctttttcagcagcatgatgaagctgctttttatctcccaactcagttactgtggacctaatatcatcaaccacttcttttgtgacatcagtccattactgaatctgacttgctccgataaggagcaggctgagctcgtagatttcctgcttgctctggtgatgattttgttgcctctgctggcggttgtgtccagttacactgctataattgccgctatactgagaattccaacttcccgtggccgccataaggctttcagcacttgtgctgcccatttagccgtggtcgtgatatattatagcagcacattgtttacctacgccaggcctcgggccatgtacacctttaaccacaacaaaatcatctcagtcctctatactattattgtgcctttttttaaccctgcaatctactgtcttcggaacaaggaggttaaagaggctttccgtaaaacagtgatggggcggtgccattacccacgagacgtgcaggattag

SEQ ID NO: 28620 - DNA, 954 bp, Artificial Sequence
  Description of Artificial Sequence: Synthetic coding sequence
atgcaaccgtacacaaaaaattggacgcaggttactgagttcgtcatgatgggattcgccggcatccatgaagcccatttactgttctttatcttgttcctgacaatgtatttgtttacgcttgtggagaacctcgcaataatcctggtcgtaggcttagaccaccgcctccggcgccccatgtacttcttccttactcatctgtcttgcctggagatctggtacaccagcgttacagttccgaaaatgcttgccggctttataggcgtggatggcggcaagaacatctcttacgcggactgcttatcccagctgtttattttcacttttcttggtgccacggagtgcttcttgttggccgcaatggcttacgatcggtatgttgcgatttgcatgcctctgcactacggcgcctttgtgtcttggggtacatgtataagattggccgcggcgtgctggcttgtggggtttctgacccccattttacctatctatctcctatctcagcttaccttttacggacctaatgtaattgatcacttcagctgtgatgcttcccccctacttgccctgtcgtgtagcgatgtgacttggaaggagacagttgatttcttagtgagtctcgcagtcctcttggctagtagcatggtcatcgcagtgtcgtacggaaacatcgtgtggaccctgctccacatccgttcggcagccgagaggtggaaggcgtttagcacgtgcgccgcccatctgacagtcgtgagcctgttttatggaacgctgtttttcatgtatgtgcaaactaaggtgacttccagcatcaactttaataaggtagtcagtgtgttttactctgtggtgacgccaatgcttaaccccctgatctattccctgcggaataaggaggtcaagggggccttggggagagtattttctctgaacttctggaaaggccagtag

SEQ ID NO: 28621 - DNA, 996 bp, Artificial Sequence
  Description of Artificial Sequence: Synthetic coding sequence
atgagccctgatggcaaccattcttccgaccccacagaatttgtcctagcaggactgccaaatctgaatagtgccagagtcgagctgttcagtgtatttctgcttgtgtatttgctgaacttgaccggcaacgtgctaatcgtgggggtagtcagagccgacacgcggctgcagactccgatgtattttttcctcggcaacctttcctgcctcgaaatactgcttacttccgtgataatacccaaaatgctgagcaattttctctccagacagcacacaatctcatttgctgcctgtatcactcaattttatttttacttcttcctgggcgccagcgagttcttgttactcgccgtgatgtctgccgacagatatctcgccatctgccaccccctgcgctacccactgctcatgagcggggctgtgtgttttagggttgcattagcttgttgggtcgggggcctggtgccggtgctgggacctacagtggcagttgcgctgctgcctttttgtaagcagggggccgtggtccaacacttcttttgcgattcaggaccattattgcggctcgcctgcaccaatactaagaagttagaggaaactgactttgtgctggcatcgctggttatcgtgagcagcctgctcatcacagctgtgtcgtacggattaatagtcctggctgttctgtccattccctctgcgtccggccgacaaaaggctttctccacatgtacttcacacctgattgtggtaacacttttctacggaagcgcaatcttcctgtatgtcaggccttcccaatctgggagcgtggatacaaactgggccgtcactgttatcaccacctttgtgacacctctgttaaatccctttatatatgctctgcggaatgagcaggttaaagaagcccttaaagacatgtttcgaaaggtggtggctggcgtgcttggtaacctgctcctcgataaatgtctgagtgaaaaagctgtcaaatag

SEQ ID NO: 28622 - DNA, 972 bp, Artificial Sequence
  Description of Artificial Sequence: Synthetic coding sequence
atgaatcccgaaaactggacacaggtcacttctttcgtgctgctcggttttccctcttctcacttgatccagttcctggtctttctcggtctaatggtaacctacatcgttactgccacaggcaagcttctgatcatcgtactgtcttggatcgaccaacggctgcacatccagatgtacttctttctgagaaatttctccttcctcgagttactcttggtcacggttgttgtcccaaagatgctggtagtcattttgactggcgaccacacaattagtttcgtcagttgtatcattcaaagctatttgtacttctttctgggtacaactgactttttcctgctggctgtgatgtccttggacaggtacctggcgatatgccgccccctgagatatgagactctgatgaatggccacgtgtgtagccagttggtgctcgcatcctggttagcaggattcctttgggtgttgtgtcccaccgtgctgatggctagcctgcctttttgcggacccaacggaatcgaccatttcttcagggattcctggccactgctgcgcctctcatgtggggatacacacttgctgaaactggtagcctttatgctctctactcttgtcctcctgggtagcctagccttgacctccgtgtcgtatgcatgcatccttgcgacggtgttgcgagcccccacagctgccgaacgacgcaaagcgttttccacttgtgcaagtcacctcaccgtcgtcgtgataatctacggatccagtatctttctgtacattcgaatgtccgaggctcagtctaagctgctcaataaaggagcctcagtgctctcctgtataatcacccctttactcaaccccttcattttcaccctcaggaacgacaaggtccagcaggctctccgggaagccctggggtggccaagattgacggccgtgatgaagctccgagtcacatcgcagcgaaagtag

SEQ ID NO: 28623 - DNA, 942 bp, Artificial Sequence
  Description of Artificial Sequence: Synthetic coding sequence
atggcaaacctaagccagccaagcgaattcgtgctcctcggctttagttctttcggggagttgcaagctctgctctatggccccttcctgatgctgtatctgctggcatttatgggcaacaccatcatcatcgtgatggtgattgccgacactcatctgcatacacctatgtactttttcctgggaaacttttccctcctcgagattctggtcaccatgacagcggtgccccgtatgttgtctgacttgctcgtgcctcacaaagtcatcacatttacaggatgtatggtgcagttttattttcatttttccctgggtagcacgagttttctgatcctcacagacatggcgcttgaccggtttgtggcgatctgtcatccattgcggtacgggaccctgatgtctagggcaatgtgtgtgcagctggcgggtgcagcatgggccgcccccttcctagccatggtcccaaccgtacttagcagagcccacctggactactgccatggcgacgtaatcaatcacttcttttgcgataatgagccgctgcttcaattgtcatgtagtgacacccgacttttggaattttgggacttcttaatggccctgacctttgtgctgagctcatttctggtgacattgatctcatacgggtacatcgttacaaccgtgctcagaatcccttcggcgtcctcatgccagaaggcatttagtacttgtggttctcatctcacactggtctttatcggatatagctctaccatcttcttatacgtcaggccgggaaaagcccattctgtacaagtccggaaggttgtggcattggtcacaagtgtgctgaccccattcctgaatccgtttattctgactttctgcaaccagaccgtgaagacggtgctgcagggtcagatgcagcggcttaaagggctgtgcaaggcccagtag

SEQ ID NO: 28624 - DNA, 939 bp, Artificial Sequence
  Description of Artificial Sequence: Synthetic coding sequence
atgcgcaatggcaccgtgataactgagttcatcctcttaggctttcctgtgatccagggtctgcagacacccctctttatcgctatcttcttaacctatatattgaccctagcaggcaacggattgattattgcaaccgtgtgggccgaacccaggcttcaaattccgatgtacttttttttgtgtaatctcagcttccttgagatatggtacactacaaccgtgattccaaagcttttgggtacatttgtcgtggcacggacagtcatctgcatgagctgctgtctactccaggcctttttccacttctttgtagggactacggaattcctcattctgaccattatgtcgttcgatcgttaccttacaatctgtaaccccttgcaccatcctacaattatgaccagcaagttatgcctgcagctggcgctaagctcttgggtcgtcggcttcaccattgttttctgtcagaccatgctgctgatccagctgcccttctgtggcaacaatgtgatctcccatttctattgcgatgtagggccgtcccttaaagccgcatgcatagacacttctattctagaattactcggagtgattgcgactatcctcgttatccctggctccttattgttcaacatgatctcatacatctacattctctccgcgattctcaggattccatctgccactggacaccagaaaacttttagcacttgtgcttctcacctcaccgtcgtgtcacttctctacggagccgtcctgtttatgtacttgagaccaacagcacactcgagctttaaaataaacaaagtggtgagtgttctaaatacaatcttgacgcctcttctgaacccattcatttataccatcagaaacaaggaggtgaagggagcacttaggaaagcgatgacatgccctaagaccggacacgccaaatag

SEQ ID NO: 28625 - DNA, 978 bp, Artificial Sequence
  Description of Artificial Sequence: Synthetic coding sequence
atgacaactattattctagaagtggacaatcataccgtgacaacccggtttattttgctgggattcccaacgcggcctgcatttcagctgctcttcttttccatcttcttagctacatatctcctgaccctcctggaaaacctgttgattatcctggccatacatagcgacggacagttacacaagcctatgtatttcttcctgagtcacctgtcgttcctcgaaatgtggtacgttacagtgatcagccccaaaatgctggtcgactttctcagccacgataaaagcatctccttcaacggctgcatgacacaactgtacttctttgtgacattcgtgtgtactgagtatatacttctggctatcatggcctttgatagatatgtcgccatctgcaaccccctgcggtaccctgtcatcatgaccaaccaactctgcggtacattagccggcggatgctggttctgcggcctaatgacggcaatgatcaaaatggtgtttatcgcacagctacactattgcggaatgccacagattaaccactacttctgtgatatctcacctctgcttaacgtgagctgtgaagatgcatcccaggcggagatggtcgatttttttctcgctctaatggtcattgccataccactgtgtgtcgtggtggctagctacgcagcaatcttggccacgatattgcgcattccaagcgcacagggtcgccagaaagcattttcaacgtgcgcctcccacttgaccgtcgttattttgttctacagtatgaccctgttcacttacgcccgcccgaaactgatgtatgcttacaatagcaacaaggtggtatcagtcctttacaccgtaatagtgcctttgctaaacccaataatttactgccttcgtaatcatgaggtaaaggccgccctcaggaagaccattcactgcaggggcagtggcccacaaggaaacggggcttttagctcatag

SEQ ID NO: 28626 - DNA, 930 bp, Artificial Sequence
  Description of Artificial Sequence: Synthetic coding sequence
atgaagagctggaacaatactattatcctggagttcctgctcctgggcatttccgaagagcctgagttgcaggccttcctttttggcttatttttatcaatgtatctggtaactgtgctgggtaacctgctgatcatactcgccacaatttccgatagtcacctgcacacccctatgtattttttcttgagtaacctgagcttcgtggatatctgcttcgtgtctactaccgttcctaagatgctggttaacatccagactcataacaaggtcatcacctacgctgggtgtatcacccagatgtgcttctttctcctctttgtgggattagacaatttcctgcttaccgtgatggcgtacgatagattcgtggcgatttgtcatcctctgcactatatggtgatcatgaacccacagttatgtgggcttctggttcttgctagttggattatgtccgtgctgaattcaatgttgcagtcccttatggttctgcctctccctttttgtacccacatggagatcccgcacttcttctgtgaaatcaaccaggtcgtgcacctggcttgttccgatacatttcttaatgacatcgttatgtacttcgcggttgctctgctggggggagggcctctgaccgggatcctgtactcatacagcaaaatcgtgtctagtatcagggccatcagtagcgctcaggggaaatacaaagcattcagcacctgtgcaagccacctttccgtggtctctttattttacggaacctgcctcggtgtgtaccttagcagcgccgccacccataactctcacaccggtgcagcagcttcggtcatgtatactgtggtcacacctatgctgaatcccttcatttatagtctcagaaacaagcatatcaagggtgccatgaagacattcttccggggcaaacaatag

SEQ ID NO: 28627 - DNA, 930 bp, Artificial Sequence
  Description of Artificial Sequence: Synthetic coding sequence
atggagcctgagaatgatacgggtatctcagaattcgtgttgttaggcctttcagaggaacctgagttacagccattcctatttggcctttttctctcaatgtacctggtgacagtccttggcaacctgcttataattctcgcaacaattagcgattcccacttgcatactccaatgtattttttcctttccaacctctctttcgctgatatctgctttataagtactactatccctaagatgctcatcaatatacagacacagtccagggtaataacttacgctggatgcattacccagatgtgtttttttgtgctgtttggtggccttgactccctattactggccgtcatggcatacgataggttcgtcgccatctgccaccctttgcattatacggtaataatgaaccccagactctgcggcctgttagtattagccagctggatgattgccgccctgaattccttgtcgcagtctctgatggtgctctggctatcattttgcacggacctggagatcccacacttcttttgtgagctgaatcaagtgatacatctcgcatgttcagataccttcctcaacgatatgggtatgtatttcgctgccggtctgctagcaggggggccgctggtcgggatcctctgcagctattccaagattgtcagcagcatacgggctatcagctctgcacagggcaagtataaagcattttcaacgtgcgcatcccacctgtctgtagtgtccctgttttgctgtaccggcctcggtgtgtatttaacaagcgccgccacacacaatagccacacctctgctaccgcctcagtcatgtatacagtcgctacacccatgcttaacccattcatctatagtttgcggaacaaggacatcaagagggccctgaaaatgtccttccgcggcaaacagtag

SEQ ID NO: 28628 - DNA, 930 bp, Artificial Sequence
  Description of Artificial Sequence: Synthetic coding sequence
gtcaaagctgggaatgaaacacaaatctctgagttcctgctgcttggcttttcagaaaagcaagagttgcagcccttcctgtttggactgttcctgagcatgtacctggtgacagttcttgggaacttactgataatattagcagctatcagtgactcatgcttgcacacacccatgtactttttccttagcaatttgagttttgtggatatttgctttgcctctaccatggtacccaaaatgttagtgaatattcagacgcaatcaaaagttattacttacgcgggatgcattacccaaatgtgtttcttcgtgcttttcattgtcttggatagcctgttgcttacagtgatggcctacgatcaattcgtcgctatttgtcacccgctgcattatacggtcattatgtctccacaactgtgtgggctgctggtgcttgtctcttggataatgagtgtgctgaatagcatgctgcagagcttggtcactctgcagctgagtttctgtaccgacttggagattcctcattttttctgcgaattgaacgaaatgatacacctcgcatgctcagatactttcgttaacaacatggtcatgcactttgccgcggtcctcctggatggtggacctctggtcgggatcctgtactcttattgtcggatcgtgagttctatccgggccatctcatcaactcaggggaagtacaaagcactgagtacttgtgcatctcatctgagtgtagtgagcatcttctacggcacgggactcggagtctatttgagctctacaatgacccagaacttgcatagtacagccgtggcctccgtcatgtatactgtggtgacccccatgctgaacccctttatatattcgctcaggaacaaggatataaaaggcgcgctgacccagttttttcgcggtaaacagtag

SEQ ID NO: 28629 - DNA, 960 bp, Artificial Sequence
  Description of Artificial Sequence: Synthetic coding sequence
atggaaccaggaaatgacacacagatatctgagtttttactgctcggtttcagccaagagccggggctgcagccattcttgttcggcctgttcctgtcaatgtatctagtgacagtcctgggtaatctgcttatcatcttggctaccatttctgacagtcacctacacacaccaatgtatttttttttgtcaaacctgagcttcgccgacatctgcgtcacttctaccaccatcccaaagatgcttatgaatattcaaacccagaataaggtaattacttacatcgcatgcctgatgcagatgtatttctttattttatttgctgggttcgaaaacttccttctgagcgtgatggcctacgaccgttttgtggcgatctgccacccgctgcattatatggtcatcatgaaccctcacttgtgcggattgctggtgctggcgagttggactatgtcggccctctattctctcctgcagattctgatggtcgtccggctctctttttgtaccgctctcgagatcccgcacttcttttgcgaactgaaccaggtcatacagctcgcatgtagcgatagcttcctcaaccatatggtaatttatttcactgttgcactgctgggcggtggccccctgaccggaatactttactcctatagcaagattatttccagcatccatgcgatctccagcgctcagggaaagtacaaggcattttctacgtgcgcttcacacctttccgttgtctctctgttctacggtgctattctgggtgtctacctgtcctctgctgctacgaggaattcccactcgagcgccaccgcgagtgtgatgtatacagtcgtgaccccaatgttaaatcctttcatatactcattgcgtaataaggatatcaagcgagccctgggcatccacttgctttgggggaccatgaaaggccagttctttaagaaatgtccttag

SEQ ID NO: 28630 - DNA, 939 bp, Artificial Sequence
  Description of Artificial Sequence: Synthetic coding sequence
atggaggctggcaatcagaccggatttctcgaatttattctgcttggtctgtccgaggatcccgagctgcagccatttatattcggtcttttcctgagcatgtacctggtcacagtgctgggaaacctactcatcattcttgctatctccagcgacagtcacctccatacaccgatgtactttttcctatcgaacctgtcttgggttgacatttgtttctccacctgtattgtccctaaaatgcttgtgaatattcagaccgagaataaagctataagctacatggactgcctgactcaagtctatttttctatgttctttcccattctcgataccttattgttgactgtcatggcatatgatcggtttgtcgccgtttgtcacccattacactatatgatcataatgaatccacatttgtgcggcctgctcgtttttgtgacttggctaatcggtgtaatgacatcattattacatattagtctgatgatgcacctcatattctgtaaagatttcgaaataccacacttcttctgcgaactcacctacatcctccaactggcttgcagtgatacattcctgaacagcacgctaatctacttcatgaccggggtccttggcgtctttcccctcctgggtatcatcttctcttactctcggatagcgtctagcattagaaagatgtctagctcaggcggaaaacaaaaggcactgtccacgtgtggctcgcatctgtccgtcgtctccttgttctacggaacagggataggagtccacttcacgagtgctgtgactcatagttcacagaagatttccgttgcctccgtgatgtataccgtagtcacccccatgctgaatcctttcatctacagcttaagaaataaggacgtaaagggcgctttaggatccctgctgagcagggctgctagctgcctgtag

SEQ ID NO: 28631 - DNA, 1020 bp, Artificial Sequence
  Description of Artificial Sequence: Synthetic coding sequence
atgtcatactttccaatcctgttcttctttttcctaaaacggtgtcccagctataccgagccacaaaatttgaccggcgtgtctgaatttttactcctagggctctcagaggacccagaactgcagccagtgctcgcaggtctgttcctatcaatgtatctggtcactgtgctggggaaccttctgatcattttggctgtgtcatctgactcacacctccacacccccatgtattttttcttgagcaatctgagtctggccgacattggcttcaccagcaccacagtgcctaagatgattgtcgacatgcagactcatagtagagttattagctacgaggggtgtttaacccaaatgagcttttttgttttgttcgcttgtatggatgacatgctgttgagcgttatggcctacgacaggtttgtagcaatttgtcacccactgcactaccgcatcattatgaatcctagactttgtgggttccttatactcctgtcattttttataagcctgctggactcccaactgcacaacttgattatgctacaacttacctgcttcaaagacgtggatatctcaaatttcttttgtgaccccagccagctgctgcatcttagatgtagcgatacattcattaacgagatggtgatttacttcatgggagcaatattcggatgcctgcccatctccgggattctcttcagctattacaaaatagtctcccctatcctgcgggtgccaacctccgacggaaagtataaggcatttagtacatgcgggtcccatctggccgtggtatgtctattctacgggacaggtttagtcggatatctgtcaagcgctgtcctgccctccccaagaaagtctatggtcgcctcagtcatgtacacagtggttacacctatgttaaacccctttatctatagtctccgtaataaggatatccagagtgctctctgtaggctgcatggccgaataatcaagagtcaccacctgcaccccttctgctatatgggctag

SEQ ID NO: 28632 - DNA, 1002 bp, Artificial Sequence
  Description of Artificial Sequence: Synthetic coding sequence
atggggcctcgcaaccagactgctgtctctgaattcctgcttatgaaagtcacggaggatccggaactgaaactgattccgtttagcctctttctgtccatgtatctcgtgacaattttgggcaacctgctgatcctgctagctgtaatttcggattctcatctccatactcctatgtacttcctcctgttcaacttatccttcacagatatctgcttaactactaccacagtccccaaaattcttgtgaacattcaggcccagaatcaaagtattacctataccggatgcctgacccagatctgcttagtcttagtttttgctggcctcgagtcttgtttcttggcagtcatggcttatgatcgatacgtggccatctgtcaccccctgcggtacacggtacttatgaacgtgcacttttggggactcctaatccttctcagtatgtttatgagtaccatggacgctctcgtgcagtcactgatggtgcttcagctgtcattttgtaagaatgtggagatccccttatttttctgcgaagtggtgcaagtgatcaagctagcttgctcggacactctgatcaacaatatcctcatatattttgcaagctctgtatttggggcgattccattaagtggcattatcttctcgtattctcagattgttacctcagtcttgcgcatgccttcagctcgaggcaagtacaaggcgttttccacttgtgggtgccatctgagcgttttcagtctgttttacggcactgcctttggggtgtacataagttcagctgtcgccgagtctagccgcataactgccgtcgccagtgtgatgtatacagtggtgccccagatgatgaatccgtttatctacagtctgaggaataaggagatgaaaaaggctctgagaaaattgattggctggtccacagttgccagatcacgcctgaccgccaattcggctagcagagtgcatgctatcttgctgccccggcctcctgagtag

SEQ ID NO: 28633 - DNA, 936 bp, Artificial Sequence
  Description of Artificial Sequence: Synthetic coding sequence
atgggtccaagaaatcagactgcggtgtctgagttcctgttaatgaaagtgaccgaggatccagagctgaagctgatacctttttccctgttcctcagtatgtatttagtcacaatcctggggaacctgctgatcttgctggctgtcatctctgactctcatttgcacacccctatgtactttctcctgttcaatctgagctttaccgatatatgcttgacaaccactacagttccaaagatattggtgaacatacaggctcagaatcaaagtattacctacactggttgtctgacgcaaatctgcctggtcttggtgttcgctggcctggagtcctgtttcctggctgtcatggcctacgatcgatacgtcgccatctgtcatccgctgcggtacacggtgcttatgaatgttcacttctgggggctcttaattctgctgtccatgtttatgtctaccatggacgccctggtacaatctctaatggtgctgcaactctctttttgtaaaaatgttgagataccactgttcttttgcgaagtcgtgcaagtgatcaagctagcctgttccgacaccctaattaacaacatcctgatatatttcgccagtagcgttttcggagccatccccctgtctgggatcatctttagttacagccagatcgtaacaagtgtgctgcgcatgccctcagcacgagggaagtacaaggctttcagcacttgtggctgtcacttgagcgtattttcactcttctacgggactgccttcggagtttatatttccagtgccgtggctgaatcttcaagaattaccgctgtggcaagcgtaatgtacactgtcgtaccacagatgatgaatcctttcatttactctctgcgcaacaaggaaatgaaaaaagcacttcgaaagcttattggacgcctctttcccttctag

SEQ ID NO: 28634 - DNA, 1038 bp, Artificial Sequence
  Description of Artificial Sequence: Synthetic coding sequence
atgcctatgcagctgctgcttactgatttcattatcttttctatcagatttataataaatagcatggaagctcgaaaccaaaccgccatctccaagtttctgttactcggactgattgaggatcctgagctgcagccagttcttttttcattatttctgagcatgtacttagtaacaatattagggaacttgctgattcttctggctgtaatctcagatagccatctgcatacccccatgtatttctttctaagtaatctgagcttcctggacatctgtctgtctaccactacaattccaaagatgttggttaatatccaggcgcagaaccgctccatcacttactccggatgtctcacgcagatttgctttgttctctttttcgcgggactggaaaactgcctgttggccgccatggcttacgacagatatgttgccatctgtcaccccctgcgatataccgtgatcatgaatccaaggctttgcgggctgttaatcctgctctctctgttgactagcgtggtgaatgcactgctgttgtccttgatggtgcttagactgtcgttctgcaccgatttagaaatcccactgtttttttgcgagctggcacaggtgatccaactcacatgtagcgatacactgatcaacaatattttaatttactttgccgcatgcatttttggtggagtgcccctgagcggcatcatcctcagctacactcaaatcacctcttgtgtgctcagaatgccatcagcctccgggaagcacaaagccgtgtccacatgcgggtcccacctcagcatagtactcctcttttatggcgctgggttgggcgtgtatatttcatcggtcgtaactgattccccgcgcaagactgcggtggcttctgttatgtattccgtgtttccccagatggtgaatccgttcatatacagcctgcggaataaggatatgaagggcaccctgcggaaattcatcggccggatcccttctttgctgtggtgtgctatttgctttggctttaggtttctggagtag

SEQ ID NO: 28635 - DNA, 939 bp, Artificial Sequence
  Description of Artificial Sequence: Synthetic coding sequence
atgaaggcagggaacttcagcgacactccagaattctttctactggggctaagcggagaccccgagttacaaccaattctctttatgctgttcctctctatgtacctcgctacaatgcttggcaacctgctgataattctggcagtgaacagtgactctcatcttcatactccgatgtactttttgttgtcgatcctgagcctggtggacatatgttttacaagcaccactatgccgaagatgcttgtgaatatccaagcccaggcacagagcataaattacaccggttgtctcacccagatttgcttcgtcttagttttcgttggcttagaaaacggaattctggtgatgatggcctacgatagatttgtagctatctgccatcccttgcgctacaacgtcattatgaaccccaaattatgcggtctcctgctgcttcttagtttcattgtatccgtgctggacgcactgcttcatacactgatggtcctgcagcttaccttttgtattgacctcgaaataccgcattttttttgtgaactggcccacatactgaaacttgcatgctcggatgtcctgatcaacaacattctggtgtacctcgtcacttctctgttaggtgtagtccccttatccggcattatcttcagctacacacggattgtgagctccgtcatgaaaatcccatctgccgggggtaaatacaaggctttcagtatatgcggatcccatctgattgtcgtctccctcttttatggaactggattcggagtgtatctgagttccggggccacccattccagtaggaaaggtgccatcgcatccgtgatgtatacagtggtgactcctatgttgaaccccctcatctacagtcttcgtaataaggatatgctgaaagccctgaggaaactcatctcacgtataccttctttccactag

SEQ ID NO: 28636 - DNA, 981 bp, Artificial Sequence
  Description of Artificial Sequence: Synthetic coding sequence
atgggattcctctcccccatgcacccgtgccgaccaccaactcaacggcgaatggcagccggcaatcacagcacggtcactgaatttatattgaagggattgactaaacgtgcagacctgcagctgccgcttttcctgctcttcctaggcatctacctggttaccatcgtggggaacttagggatgatcacactgatatgcctgaacagccagctgcacacacctatgtattattttttatccaatttgtctctcatggatttatgttacagctccgtgattacccccaagatgctggttaatttcgtctccgaaaagaacatcatctcctatgccggctgcatgtcccagctctacttctttttggtgtttgtcatcgctgaatgttatatgcttaccgttatggcttatgacaggtacgtagccatctgtcacccccttctgtataatatcatcatgtcacatcatacctgtttgctacttgtggcagtggtatacgcgattggactcatcggctcaacaattgagacgggacttatgcttaaacttccatactgtgaacacttaatcagccactacttttgtgatatcctcccactgatgaagctgtcttgctcgagcacatacgacgttgaaatgacagtttttttctccgcaggcttcaatattatcgtgacatctctgaccgtgctcgtcagctacacttttattttatcctctatattagggattagtactaccgagggtaggtccaaggctttttctacatgctcctctcacctggcggccgtgggaatgttctacgggagtaccgcattcatgtacctgaagccgagcaccattagctctctgacccaggaaaacgttgccagtgtgttttacaccaccgtcattcctatgttgaaccctttgatctactccttgagaaacaaggaagtgaaagcagccgtgcagaaaacattgcgcggcaagctgttctag

SEQ ID NO: 28637 - DNA, 933 bp, Artificial Sequence
  Description of Artificial Sequence: Synthetic coding sequence
atggctgccaagaactcaagtgtgacggagttcattctagagggccttacccatcaacccggtctgagaattcctttgttttttctgttcctaggcttttatacagtgacagtggtggggaacttgggtcttatcacactaatagggcttaacagtcacctccatacaccgatgtattttttcttattcaacctttcgctcattgatttctgcttctctacaacaattacccccaagatgctcatgtcgttcgtgagcagaaaaaatattatatcttttacaggctgtatgacgcagctcttcttcttctgcttttttgttgtgagcgagagttttatcctgtcggcgatggcttatgacaggtacgttgccatatgtaatcccttgttatacaccgtgactatgtcctgtcaggtttgcctgcttctgctcctcggcgcatatgggatgggctttgcaggagcaatggcccatactggttctatcatgaacctcaccttttgtgccgacaaccttgtgaaccatttcatgtgtgacattctgcctctgctagaacttagctgcaatagcagctacatgaatgaactggtggtcttcatcgtggtcgcagttgacgttgggatgccaatagtgactgtttttatctcttacgctcttattctgtcatcaattcttcacaactcgtctaccgaaggccggtctaaagccttcagtacctgttccagccacatcatagtggtttccctgttctttggttctggagctttcatgtatttgaaaccccttagcatactgcccctggaacaggggaaggtctcctccctgttctatacaattatcgtgcctgtgttgaatcctctcatttactctctgagaaacaaagacgtgaaggtagctctgagaaggaccttgggcagaaagatcttcagttag

SEQ ID NO: 28638 - DNA, 942 bp, Artificial Sequence
  Description of Artificial Sequence: Synthetic coding sequence
atgctggcccgcaacaattcacttgtgaccgagtttatcctggcaggcctcacagaccatccagaatttagacagcccctcttctttctatttttggtcatttacatcgttacgatggtggggaacctcggactcatcacactgtttggattaaactcccacctgcacacacctatgtactacttcttgtttaatctgtcttttatcgacctgtgctactcttctgtttttacccccaaaatgctcatgaactttgtgtctaagaagaatatcatttccaatgtgggctgtatgacccggctgttctttttcctgttcttcgtcatatcagagtgttacatgctgacttcgatggcctacgatcgctacgtggcaatttgtaacccgttgctgtacaaggtaactatgtcccaccaagtatgctccatgcttacattcgctgcttacatcatgggcctggctggtgctaccgcccacacggggtgtatgctgcgtctcactttctgtagcgcgaatatcattaaccactatctgtgtgatattcttccccttctgcagctgagctgtacctccacatatgtgaacgaggtggtagtcctgattgtcgttgggacaaacatcacagtacccagctgtacaatcctaattagctacgtgttcatagtgactagcatccttcatatcaaatctacacaggggaggtccaaagcttttagcacttgctcatcacacgtaattgccctcagtctcttctttgggtctgcggccttcatgtacatcaagtactcttcaggttctatggaacagggaaaggttagctccgtgttttacacgaacgtggtgcccatgctgaatccgctgatctattccctgcgcaataaggatgtcaaggtggccttgaggaaagcactgataaagatccagagacggaacatcttctag

SEQ ID NO: 28639 - DNA, 942 bp, Artificial Sequence
  Description of Artificial Sequence: Synthetic coding sequence
atgcttgcccgtaataactctttggtgactgaattcatccttgccggactgaccgaccatccagagtttcagcagccactgttcttcctttttctggtggtctatattgtgaccatggtcgggaatttagggctgatcattcttttcggcctgaattctcatttacatacccctatgtactatttcctgtttaaccttagcttcattgacttatgctactcgagtgtgtttacaccgaaaatgttaatgaactttgtcagcaaaaagaatatcatttcctacgttggctgtatgacccaattatttttctttctattcttcgttatcagcgagtgctacatgttgacaagcatggcatatgataggtatgttgcaatttgtaatcccttgctgtacaaagttactatgtcacatcaggtgtgttctatgctcaccttcgctgcttatataatgggacttgcaggagctacagcacacactgggtgcatgttacgcctcactttctgtagtgctaacattattaaccattacctgtgcgacattctgcccctgctgcaacttagctgcacttcaacttacgtgaacgaagtggtggtcctgatcgtggtgggaattaatatcatggtgccctcttgtactatcctaatctcttacgtgtttattgtgacctctattctgcacatcaagagcacccaaggaagaagcaaggctttcagtacatgttctagccatgtaatcgctctgtctctgttctttggctctgctgctttcatgtacattaaatattcttcaggcagtatggagcaaggaaaggttagctccgtattttacaccaacgtggtaccaatgctcaatcctctgatctatagcctgcgcaacaaagatgtgaaggttgcattaagaaaagccctgatcaaaatccagcggaggaatatcttttag

SEQ ID NO: 28640 - DNA, 930 bp, Artificial Sequence
  Description of Artificial Sequence: Synthetic coding sequence
atgactttgaggaacagtagcagcgtgacagaattcatcctggtgggcctttccgagcagccggaactgcagctgcctttgttcctgctgtttctgggtatctacgtctttacggtagtggggaacctagggcttatcactctcattggtattaatccctcacttcatactccgatgtatttttttttatttaacttaagtttcattgacctgtgctatagctgcgttttcaccccaaaaatgttgaatgatttcgtgtctgagtccattattagttacgtcggctgtatgactcaactgttttttttctgttttttcgtcaactctgaatgctatgttctggtatctatggcctacgaccggtatgtggccatctgcaatcctctcctgtacatggtcaccatgtccccaagggtttgctttcttctgatgttcgggagctacgtggtggggtttgcaggtgccatggcccatacaggtagcatgctccgcctcacattttgtgactccaacgtaattgaccactacttgtgtgatgtcttgccattgctgcagctcagttgcacatccacccatgtaagcgaactagtcttctttatagtggtcggggtcataactatgctttcaagcatttctatcgtgatttcttatgcactcattctcagcaacattctctgtattccttcggccgaaggcaggagcaaggcttttagtacctgggggtcacacattatcgcggtggccctcttttttggcagcgggaccttcacctatttaactacaagtttccctgggtcgatgaaccacggacggtttgctagcgtcttctacactaacgtcgttcccatgctcaatccctccatctatagtttacggaacaaggatgacaaactcgccctgggtaagaccttgaaaagagtcctgttctag

SEQ ID NO: 28641 - DNA, 936 bp, Artificial Sequence
  Description of Artificial Sequence: Synthetic coding sequence
atggccgctgagaacagcagtttcgtgactcagtttattctggctggcctgaccgaccaaccaggagtgcagattcccctcttctttttatttctcgggttctacgtggtgactgtggtaggaaacctggggctgatcacgctgattcggctcaatagccacttacatactcccatgtacttcttcctgtacaacctcagctttattgatttttgctactcctctgtgatcaccccaaaaatgctaatgagctttgtcttgaagaaaaactctatctcctacgccggctgcatgactcagctgttcttctttttgtttttcgtggtgagcgaatcctttatcctgtccgccatggcctacgacaggtatgtagcgatctgtaatccactgttgtatatggtgaccatgtcccctcaggtttgctttttgctgttgcttggcgtctacggcatgggatttgccggtgcaatggcacacaccgcgtgcatgatgggagttaccttttgcgcgaacaaccttgtaaaccactacatgtgcgatatcctacccctgcttgagtgtgcttgcaccagtacgtacgtgaacgagctggtagtatttgtggttgtagggattgatattggagtgccaacggttacaattttcatcagttatgcactcatcctgtccagtatttttcatattgacagcactgaggggagatctaaggcctttagtacatgttccagccacattatcgcagtaagtctcttttttggcagtggagcattcatgtatctgaagcctttctccctgctggcaatgaatcagggcaaagtgagctcgctgttctacaccactgttgtgcccatgctgaatccactgatctactctttacgcaacaaggacgtcaaggtagcgctgaaaaaaatcctgaacaagaatgccttttcttag

SEQ ID NO: 28642 - DNA, 927 bp, Artificial Sequence
  Description of Artificial Sequence: Synthetic coding sequence
atgacaatggaaaattactccatggctgcgcagtttgtgctggacggactcacccaacaagcagagctccagctcccgctgtttctcctgtttctcggaatttatgtcgttaccgtcgtcggcaatctcggtatgatcctcctgatagcggtgtccccactgctgcacactcccatgtactacttcctgagttctttgagcttcgtcgatttctgctactcatctgtcatcacccccaagatgctcgtcaatttccttggcaagaagaacacaatcctgtattcagagtgcatggtgcagctgttttttttcgtcgtctttgtggttgcagaaggctacctgttaactgcaatggcctatgatcgctatgttgctatttgctctcccctcttgtataacgccataatgagttcatgggtgtgttctcttctcgtgcttgcagctttctttctgggcttcctgtctgccctgacgcataccagcgcgatgatgaagctgtctttttgcaagagccatatcattaatcattatttttgcgacgtcctcccgctgctgaatctgagttgttctaacacccatttgaatgaattactgttgtttattatagctggtttcaacacacttgtacctaccctcgccgttgccgtgtcatacgccttcatcctgtactccattttgcacatccggtcttcggagggacgctccaaggcgtttggaacatgtagttcccatctcatggccgtggtgatttttttcggcagtatcacgttcatgtactttaaaccaccctctagcaattcgctggatcaggagaaagtgtccagcgtgttttataccacagtgatccctatgctgaatcccctgatttactctctgcgaaataaggacgtgaaaaaggcactacgcaaggtcctggtcggtaaatag

SEQ ID NO: 28643 - DNA, 936 bp, Artificial Sequence
  Description of Artificial Sequence: Synthetic coding sequence
atggctacttctaaccatagctctggggccgagttcatcctggccgggttgacacaacgcccagagttgcagcttcccctatttctgctattcctcggtatatatgtcgtgactgtggtgggaaacctgggcatgatttttttgattgcgttgagctcacaactctaccctcccgtttactattttctgtctcatctgtccttcatagatctttgctactccagcgtcatcacccccaagatgctggttaactttgtgcctgaggagaacattattagctttctagagtgcattacacaattatatttttttcttatctttgtgattgctgaaggctacctcctgacggcaatggagtatgataggtatgtagcaatctgtcggccactgctgtacaatatcgtgatgtctcatcgtgtgtgcagcattatgatggccgtagtgtattccctaggattcctgtgggccacggtacatacaacccggatgagtgtgctgtctttctgtcggtctcacaccgtctcccactacttttgcgatatattacctttgctcacactgtcttgttcaagtacacacataaatgagatccttttgttcatcatcggtggggtgaacacattagcaacaaccttagccgtgctgatcagttacgcgtttatattcagcagcattttaggcatccatagtactgagggccagagcaaggccttcgggacttgttcgtctcacctcctggcggtcgggatcttcttcgggagcatcacctttatgtactttaagcctcctagcagtaccacaatggaaaaggaaaaagtgtcctccgtgttctacattactattatccctatgctaaatcccttgatctactccttgcggaacaaggacgtcaagaatgccctgaagaaaatgactagggggaggcaaagctcatag

SEQ ID NO: 28644 - DNA, 945 bp, Artificial Sequence
  Description of Artificial Sequence: Synthetic coding sequence
atgggagttaagaatcacagcacagtgaccgagtttctcctcagtggacttaccgagcaggctgagctgcagcttcccctgttctgcttgttcttaggaatctacacagtgactgtcgttggcaacctgtcaatgatcagcatcatacggcttaacaggcagctccacacccccatgtactacttcctgagctctctctcattcctggacttctgttattctagcgttatcacccctaagatgctgtctggcttcctgtgccgcgaccgatccatctcatactccggttgcatgatccagctgttctttttctgtgtgtgtgtgatcagcgaatgctacatgctggccgctatggcatgcgaccgatacgttgccatctgtagcccactgttatatcgtgtaataatgagccctagggtgtgtagtctgcttgttgccgccgtcttttccgtggggttcaccgacgccgtcatacacggtggatgtatcctccgattatccttttgcgggtcaaatattataaagcactatttttgcgatattgtgcctttgattaaattgtcctgctcttccacctacatcgatgaactcctcatcttcgtgattggcggcttcaatatggtggcaacgagcctcactatcataattagctacgcgttcatcttaaccagcattttgcgaattcatagtaagaagggccggtgcaaagcattctcaacctgcagctcacacttaactgcggtactgatgttttacggctcattaatgtccatgtacctcaagcccgcaagctcctcgagcctaacccaggaaaaggtgtcatccgttttttatacaactgttatcttaatgctaaatccattgatctattcactccgcaacaatgaagtccggaacgccctcatgaaacttctcaggcggaagatctctctgtctccggggtag

SEQ ID NO: 28645 - DNA, 936 bp, Artificial Sequence
  Description of Artificial Sequence: Synthetic coding sequence
atgggccggcgaaataacaccaacgtgcctgattttattctgaccggcctgtctgacagcgaggaagtgcagatggcgctcttcatcttgttcctgttaatctacctgatcaccatgctgggtaacgtcgggatgatcctcattatcaggctggacctccagctccataccccaatgtacttctttctcacgcatttgtcctttatcgacctgtcttatagtaccgtgatcacacctaagacgcttgcaaacttacttacgagcaactatatcagtttcatgggctgctttgcacagatgttcttcttcgtgttccttggcgcagccgaatgctttcttctgagttccatggcctacgatcggtatgtggctatttgtagtcctcttagatatcccgtgatcatgtctaagaggctgtgctgtgcactggtcacaggcccatatgttatttccttcatcaactcatttgtgaatgtcgtgtggatgtcacgacttcatttttgtgattccaatgtggtccggcactttttttgtgacacctcacctatcctggcactatcatgcatggatacctacgatatcgaaattatgatacacattttagcaggatctacccttatggtgtctctcatcacgattagtgcctcgtacgtcagcattctgtctacaattctgaaaattaattcaacatccgggaagcagaaagccctcagtacctgcgcatctcaccttcttggagtgacgatcttctatgggacgatgattttcacttacctgaagcccaggaaaagctactcactgggccgcgatcaggtggcttctgtgttctacacgatagtgattcctatgctcaatccactgatatatagcctgcgcaataaagaggttaagaacgccctgatccgtgtcatgcagcggagacaagacagtcgatag

SEQ ID NO: 28646 - DNA, 930 bp, Artificial Sequence
  Description of Artificial Sequence: Synthetic coding sequence
aataacaccaatgtaccagattttatcctgacaggcctgagcgactcagaggaagtgcagatggctctgtttatcttgtttctgctcatctacctcatcacaatgttggggaatgtggggatgattctgattataaggctcgacctgcaactacacaccccaatgtacttctttttaactcacctctcatttatcgatctctcctacagcaccgtgattactccgaagactttggccaatcttctgacaagtaactacattagttttatgggatgcttcgcccagatgttctttttcgttttccttggagcagcagagtgctttttgctgtcttccatggcttacgaccgatacgtggcaatttgttcacctcttcggtatcctgtcataatgtcaaagcggttgtgctgcgctttagtcactggaccatatgtcattagcttcatcaactcattcgtcaatgtcgtgtggatgtcccgtttgcatttctgtgactcgaacgttgttcggcatttcttctgtgatacctcacctattctcgcccttagttgcatggatacatatgacattgagattatgatccatatcctggccgggtccacgttgatggtgtctttgatcacaatcagcgccagctacgtgtctatcttgtctactatccttaaaatcaactccacttctggcaagcagaaggctctgtctacgtgcgcctctcatctgttgggggttacaatcttctacggcactatgatcttcacatatctgaaaccaagaaagagctattctctggggcgcgatcaggtcgcctctgtattctataccatagtgatcccaatgctcaaccccctaatctattccctcagaaacaaagaggtaaaaaatgccttgataagggtgatgcagcggatctggtacgttcttgggctatag

SEQ ID NO: 28647 - DNA, 939 bp, Artificial Sequence
  Description of Artificial Sequence: Synthetic coding sequence
atgatgggaagaagaaataataccaacgtagctgacttcatcctgatgggcctcacgctgtccgaagaaatccagatggccctgttcatgttgtttctattaatataccttatcactatgctggggaacgttggcatgattctgatcatcaggctggacctacagctgcatacacctatgtattttttcctgacccatcttagctttatagacctgagctacagcaccgtggtcacccccaagaccttagccaacttgctgacttctaactatattagttttaccggatgctttgcacagatgttctttttcgcctttctggggaccgccgagtgctacctgcttagctccatggcacacgacaggtatgccgccatttgcagccccctgcactacactgtgatcatgtcaaaacggttgtgcttagctctcatcaccgggccatacgtcatcggatttatcgattcatttgtcaacgtggtctccatgagcagattgcacttctatgatagtaacgtcatccatcacttcttctgcgacacctcccccattctcgcattgagttgcacggacacatataatacagagatccttattttcataatcgtgggatcaactcttatggttagcctctttaccatcagcgccagctatgtattcatcctgtttactatccttaagatcaatagtacaagtggaaagcagaaggctttcagcacctgcgtttctcacctcttgggcgtcacaatcttctacagtacactcatcttcacatatcttaagccgaggaaatcctactctctggggcgggaccaggttgcaagtgtcttctacacaatcgtgattccagtactgaaccctctcatttatagtctgcgcaataaagaggtcaagaacgccgtgatccgcgtgatgcagagaagacaggacagtagatag

SEQ ID NO: 28648 - DNA, 939 bp, Artificial Sequence
  Description of Artificial Sequence: Synthetic coding sequence
atgatggggaggcggaatgacacaaacgtggccgacttcattctgaccgggctgtctgacagcgaggaagtacaaatggccttattcatgctgttcttgctgatctatctgattacaatgctggggaacgttggtatgcttctcatcattagactggatctgcagcttcatacgcccatgtatttcttcctgacgcacctgagtttcatagatctgtcatactctactgttgtgaccccaaagaccctggctaatctcctcaccagtaattacattagttttacaggctgttttgcccagatgttttgcttcgtgttcttaggcacagcagagtgttacctgctgtccagcatggcctacgaccggtatgccgccatctgttctcctctgcattacaccgtcatcatgccgaagcggctgtgcttggcattaataacaggaccttacgtaattggatttatggattcattcgttaatgtcgtctcaatgtcaaggctccatttttgtgattcaaatataatccaccatttcttttgcgatacatctcctatcctcgcattgtcctgcaccgataccgacaacacagaaatgcttatatttattatcgcaggaagcacgctgatggttagtctgataaccatatctgcctcatatgtgagcatcctgtccaccattctgaagattaatagcacctctggtaaacagaaagcctttagtacatgtgtgtcacatctgttaggggtcactatattttatggcactatgatatttacatatctaaaaccacggaagagctatagtctgggaagagatcaggtggcgcccgtgttctatacgatcgttatccccatgctgaatcccttgatatatagcctgagaaatcgggaggtcaaaaatgctctaattcgggttatgcagaggagacaggacagtcgatag

SEQ ID NO: 28649 - DNA, 933 bp, Artificial Sequence
  Description of Artificial Sequence: Synthetic coding sequence
atggccgggaacaatttcaccgaagttacggtcttcattctctcggggttcgcaaatcacccggaactccaagtgtctttatttcttatgttcctgttcatttacctttttactgtgctgggcaacctgggcctaattaccctcattaggatggacagtcagcttcatactcctatgtacttctttctgtccaatctggcttttattgacattttttattcatcgacagtgacaccaaaggctctggtcaatttccagagcaatagacgcagtatctcctttgtgggctgctttgtccagatgtacttctttgtgggtctggtatgctgcgaatgtttcctattagggagtatggcctacaacaggtatattgccatctgtaatcccctcttgtactctgtggtcatgtcacagaaagtgagcaactggcttggggtaatgccctacgttattggatttacttcatctctaatctctgtgtgggtgatctcttctctcgcgttctgcgatagttctatcaaccatttcttctgcgataccacagccctcctcgcactgtcatgtgtggataccttcgggacagaaatggtttcatttgttcttgccggcttcacattactctcatctctgctcatcataaccgtcacctatatcattatcatttctgcaattttaaggattcagagtgccgccggtcgccagaaggccttcagcacatgtgcgtctcacctgatggccgtgacaattttctatggcagcctgatcttcacttatctccaacctgataacacgtcgtcgctcacccaggctcaggttgcatccgttttttacactatcgtgataccaatgcttaaccccctgatttacagtctgcgcaacaaggatgtgaagaatgcactgctacgcgtcatacataggaaacttttcccttag

SEQ ID NO: 28650 - DNA, 951 bp, Artificial Sequence
  Description of Artificial Sequence: Synthetic coding sequence
atggcccccgagaactttacgagagttacagagtttatcctgaccggagtatccagctgtcctgagctgcagatccccctttttttggtgttcctcgtcctttacgggctgacaatggcgggcaacctcgggatcataacacttacgtctgtggactcccgactgcagaccccaatgtatttcttccttcagcacctggccctaataaatctggggaacagcactgtgatagcgcccaaaatgctgattaatttcttagtaaagaaaaagactaccagcttctatgaatgtgcgacgcagctgggtgggtttctttttttcatcgtcagcgaggtgatcatgttagcgctgatggcctacgaccggtacgttgcaatatgtaatccactactgtatatggtggttgtctcacgcagattatgcctgcttctggtctccctcacttacctctacggattctcaacagccatcgtggtgtcatcttatgttttcagcgtttcttattgctcctccaacataataaaccacttctactgcgataacgtgcctctcctggctctgtcatgttccgatacttacctgcccgagactgtggtcttcatttctgcagccacaaatgttgtgggctcgttgattatcgtgctggtttcctattttaacatcgtgctcagcattttaaagatatgttcctccgagggccgcaagaaagccttctccacttgcgcctcacatatgatggctgtcaccattttctacggcactctgctgtttatgtatgtacagccccggtccaaccacagtttggatacggacgataaaatggccagcgtgttctacacgctggtcataccaatgctgaatccccttatttactcattacggaataaggatgtaaagacagcactccaacgcttcatgaccaacctctgttatagctttaagactatgtag

SEQ ID NO: 28651 - DNA, 948 bp, Artificial Sequence
  Description of Artificial Sequence: Synthetic coding sequence
atggcaccagaaaattttacacgcgtgaccgagttcatactcactggagtatccagctgccctgagctccaaattccactgttcctagtctttttggtgctgtatgtactaacaatggcaggcaatttaggtatcattaccttgaccagcgtggacagcaggctgcagaatcccatgtacttcttcctaaggcacctagcaattataaatcttggcaacagcaccgttatcgccccgaaaatgttaatgaactttctggtcaagaagaaaacgacgtcattctatgagtgcgcaactcagttgggaggttttcttttcttcatagtgtcggaggtgatgatgctggcagttatggcctacgaccggtacgtcgccatctgtaaccctctgctctatatggtggtcgtgtctcgcagactgtgtctcttgctcgtttccctaacatatctatatggcttcagcaccgcgatcgtcgtctccccctgcattttttctgtgagttactgctcttccaatatcatcaatcacttttattgtgacatcgcccctctgcttgcactgtcatgcagcgacacatacatcccagaaaccatcgtcttcattagcgccgctacaaacctcgtgttttctatgattacagttttggtatcttatttcaatattgtgctgtcaatactgcgcatacgctcacccgaagggcgaaagaaggccttctccacttgcgcctctcacatgattgccgtcacggtattttacgggaccatgctcttcatgtacctgcagccacagaccaaccactccctagacaccgacaaaatggcgagtgttttctacacactcgtgatcccaatgttgaacccactgatttattcactcagaaacaacgacgtcaacgttgccctgaagaaatttatggaaaacccctgctatagctttaagagtatgtag

SEQ ID NO: 28652 - DNA, 960 bp, Artificial Sequence
  Description of Artificial Sequence: Synthetic coding sequence
atgaaccatgtagtcaaacataatcacaccgcagttacgaaggtgacagaattcatccttatgggaatcactgacaacccaggcttgcaggcccccctcttcggccttttcctcatcatttatctggtcactgtcattggcaatcttgggatggtcatattgacttacttggactctaaactgcacactccaatgtactttttcctgcggcatctctccattactgatctcggatactctactgtgattgccccaaaaatgttggttaatttcattgttcacaagaacacgatcagctacaattggtatgcaacccagctcgcgttctttgagatcttcatcatctcagagctttttatactttcagctatggcgtatgaccggtacgtggccatatgcaagcctctgctgtatgtaattatcatggccgagaaggtactttgggtgctcgttatcgttccctacctgtattccacttttgtgtcactattcttaacaatcaagctgttcaaactgtctttctgtgggagcaatatcatttcttatttctattgtgattgcataccacttatgagcatactatgcagtgacaccaatgaactggaacttatcatactcattttcagtggatgtaatctgttattctccctgagtatcgtgctgatctcatatatgttcatcctggttgctatcttgaggatgaattctaggaaggggcgctacaaggcattttctacgtgtagcagccacctgactgtcgtgatcatgttctatggaactcttctgttcatttatcttcaaccgaaatcctctcacacactggccattgataagatggcctctgtcttctataccctgctgattccgatgctcaaccctctcatatacagtctgcggaacaaagaggtgaaggatgccctgaaacgaacactaacaaatagattcaagatacctatctag

SEQ ID NO: 28653 - DNA, 939 bp, Artificial Sequence
  Description of Artificial Sequence: Synthetic coding sequence
atggagcagcacaacctcaccacggtgaacgagttcatcctgaccggcattaccgatattgcggaactccaggcgcctctgtttgcattgttcttaatgatttatgttatcagtgttatgggaaacttgggaatgattgtccttaccaaactggactctaggttgcagacgcccatgtacttcttcctgaggcacttggcctttatggacctggggtactcaactacagttgggcccaagatgctagtgaacttcgtggtagataagaacattatctcgtactatttctgtgccacacaactggcgttttttctggtcttcatcggttcggaactgtttatcctgagcgctatgagctacgacctgtatgttgccatttgcaatccccttttatacactgtgatcatgagtcgaagggtctgtcaggttctggtagccatcccctatctctactgtactttcataagcctgttggtaaccataaagatctttaccctatccttctgcggctataatgtgatcagccacttttactgtgattccctgccactcctgcccctcttgtgctccaacacccacgaaatcgagctgataatcctgatctttgctgcaatcgacctgatctcaagccttctgattgtactgttgtcctatctcctgatcctggtagccatactccggatgaatagcgctggacggcagaaggcctttagcacatgcggagcccatctgactgtggtgatagtgttttatggtaccctactctttatgtatgtgcagccaaaaagctcccactccttcgacaccgacaaagtggccagtattttctataccctggtcattcctatgctcaaccctctgatctatagcctgcggaacaaagacgtcaaatacgccctgaggcgtacgtggaataacctttgcaacatatttgtctag

SEQ ID NO: 28654 - DNA, 924 bp, Artificial Sequence
  Description of Artificial Sequence: Synthetic coding sequence
atggggcaacacaacctcacagttcttaccgagttcattttgatggaacttacacgcagacctgaacttcaaatccccctgtttggcgtctttcttgtgatttacttgataacagtggtggggaacctgaccatgataattctgacaaagcttgactcgcacctgcatacacctatgtatttctctataagacatctggccttcgtcgatctaggtaactctaccgtgatttgtcctaaggttctcgcaaactttgttgtcgatcgtaatacgatttcatactatgcgtgcgcagcccaattagcgttctttctcatgttcatcattagtgagttctttatcctgtcagctatggcttacgacaggtatgtcgcgatctgtaatccgttactttactatgtcatcatgtcacagagactgtgccatgttctggtcgggattcagtacctctatagcacttttcaggcactaatgtttaccattaagattttcaccctgacattctgcggtagcaatgtgattagtcacttctattgcgatgatgtgccactcctgccgatgttgtgcagcaacgcccaggagatcgaactacttagcatcctcttttccgtctttaatttgatctcgtcctttctgatagttctggtatcatacatgctgatcttgcttgcaatttgccagatgcatagcgccgaaggccgcaaaaaagcttttagcacatgtggatcccatttaacagtggtggttgtattctacggctcactcctattcatgtacatgcagccaaactctactcattttttcgacaccgacaaaatggcaagcgtgttttatactctcgtcatccccatgctgaacccactcatttattcactgagaaacgaagaggtgaagaatgccttttataagcttttcgaaaactag

SEQ ID NO: 28655 - DNA, 1080 bp, Artificial Sequence
  Description of Artificial Sequence: Synthetic coding sequence
atggccctgggcaatcactcaacaattacagagttccttcttctgggtctgagcgccgatcctaatattcgtgccctcctgtttgtgttattcctcggaatttacctgctgaccatcatggaaaatttgatgctactgcttatgattcgcgctgatagctgtctgcacaagcccatgtattttttcctgtctcacttgtcttttgtagacttatgcttttccagtgtcatcgtgccgaagatgctcgaaaatctcctgtcgcagagaaaaactatctccgtggagggatgcctggcacaggtctttttcgtttttgtgacagccggaacagaagcctgtctgctctctggcatggcctacgacagacacgcggccatttgcaggcctctcctgtacgggcagattatgggaaaacaattgtacatgcatctcgtctggggatcttggggcctgggatttctagacgccctgattaatgttcttttagcggtgaatatggtgttctgcgaggccaagattatccaccactatagttacgagatgcccagtctgcttccactgtcctgctctgacatctccagaagcctgattgctctgctttgcagcacgttgttacacggactcgggaacttcctcctagtgttcctctcatataccaggatcatcagcaccatcctgtccatatcatcgaccagcgggaggtccaaagctttctctacatgttccgcccatttgaccgccgtgacgctgtactacggctcaggtctgctgaggcacctcatgcccaacagcggcagccccattgagcttatattttccgtccagtacactgtagttaccccaatgctgaacagcttgatttacagcctgaaaaataaggaggtcaagggggaaagaagtctgcgggacagctcccacctgccgcagctgcataaaggtcaggcgcggtggaaaagacctgcttttaccgagggcaggcgggaacctggacaccctgagttatcaattcccgtcaccccgcagccgcagggggcgtgcgcatgcagtgccctgagagcagctcccacagccttgccctag

SEQ ID NO: 28656 - DNA, 930 bp, Artificial Sequence
  Description of Artificial Sequence: Synthetic coding sequence
atggcccatattaattgtacccaggccactgaatttatactggtgggccttaccgatcaccaggaactgaagatgccgcttttcgtcttgtttctgagcatctacttgttcaccgtggtaggcaatctaggactcattttactcatccgagctgacactagcctgaacactcctatgtactttttcctgagcaatttggcctttgtagatttttgttactcgagtgttattacccctaaaatgctcggtaacttcttatataagcagaatgtcatttcttttgatgcctgcgccacccagctgggatgcttcttgaccttcatgattagcgaatctctgcttctcgccagtatggcttacgaccggtatgtggccatctgcaatccgctgttgtatatggtggtcatgacgcccggcatttgtattcaactggtcgccgtcccatattcctacagtttcctcatggctttgttccatactatcctgacatttcgcctatcctattgccattctaacatcgtgaatcacttctattgcgacgacatgccactcctgcgcctgacatgttcggacaccagattcaaacaactctggatattcgcgtgtgcaggcattatgttcattagctctctgctgatcgtgttcgtctcatacatgtttattatctccgctatacttaggatgcacagtgctgagggtaggcagaaggcattctcaacgtgcggcagccacatgctcgcagtgaccattttctacggcaccttaatttttatgtatcttcagccaagtagtagccacgctctcgatactgacaaaatggcaagcgtcttctatacagtgataatcccgatgctgaatccactgatatacagtctgcagaacaaggaggttaaggaggccctcaagaagatcataattaacaagaattag

SEQ ID NO: 28657 - DNA, 933 bp, Artificial Sequence
  Description of Artificial Sequence: Synthetic coding sequence
atgatggacaatcacagcagtgctaccgaatttcacctcctgggctttcccggtagccagggtctgcatcacatactctttgccattttcttctttttttatttggtgacactgatggggaacaccgtaatcatagtcatcgtctgtgtggataaaaggttgcagtcaccaatgtacttctttctctcgcatctcagcacactggaaatcttggtaaccacgattattgtccccatgatgctgtggggcctgttgttcctcggctgtagacaatacctatccctacacgtttctctgaacttcagctgtggaaccatggagtttgcactccttggggtgatggctgtggacaggtatgtggccgtctgtaaccccttgcgttataatatcatcatgaactccagtacatgcatctgggttgttatcgtttcatgggtctttgggtttctatctgaaatctggcctatatatgccacattccagttcacctttaggaagtctaattccctagatcacttttactgtgacagaggtcagctgttaaaactcagctgtgacaacactctgttaaccgaattcatcctattcctaatggccgtgtttatattgataggctccctaatacctacgattgttagctacacttacattatctctaccatcttgaagattccctctgcatctgggaggcgtaaggcatttagcacattcgcaagccactttacgtgcgttgttatcggatatggctcttgtctcttcctgtatgtgaaaccaaaacagacacagggggtagagtacaataaaatcgtctcccttcttgtatcagttcttactcctttcctgaatcctttcatattcacactccgtaacgacaaggtgaaagaggccctgcgggacggcatgaaacggtgttgccagttactgaaggactag

SEQ ID NO: 28658 - DNA, 945 bp, Artificial Sequence
  Description of Artificial Sequence: Synthetic coding sequence
atgctcatgaattactcctccgcgaccgagttttacttgctgggcttccccggaagcgaggagctgcaccacatactgtttgctattttctttttcttttatttggtgacattgatggggaatacagtgatcatcatgatcgtatgcgtggacaagagactccagagtccaatgtacttcttcctcggtcatttgtcagcattggaaatattggtaaccactattatagtgccggtcatgctgtggggtctcctacttcccggaatgcagacaatctatttgagtgcttgcgtggttcagctgtttctctatctggccgtaggaaccacggagtttgctctcttaggagctatggctgtcgatagatacgtcgccgtgtgcaaccctctgcggtataacatcattatgaacaggcatacatgtaatttcgtcgtgctcgtgtcctgggtatttggctttctattccaaatatggccagtatatgtcatgttccagctcacctattgtaagagcaacgtggttaataacttcttctgcgatcgcggacagttgctcaaactttcctgtaacaacaccctgttcaccgaattcatcctttttctgatggccgtttttgtgctcttcggatccttaattcctaccatagtgtcaaatgcatatatcatttcaactattttaaagatcccaagcagctccggaagaaggaagtctttttctacctgcgcatcgcatttcacttgtgtggttattgggtatggatcttgtctctttctgtatgttaaacccaaacaaacacaagctgccgattataactgggtagtgagcctgatggtgagtgtggtgacgccatttttgaaccctttcatcttcacactgcgcaacgacaaagtgattgaagccctgcgggacggcgtgaaaaggtgttgccaactgttcaggaattag

SEQ ID NO: 28659 - DNA, 918 bp, Artificial Sequence
  Description of Artificial Sequence: Synthetic coding sequence
atgcaacgctccaaccacaccgtgacagaattcatcctgctcggctttacaacagaccctgggatgcagctgggcttatttgtggtgttcctgggggtttactctcttaccgtcgttgggaacagcacacttatcgtgctcatctgcaatgatagttgcctacacactcccatgtacttttttactggcaacctgtctttcctcgacctctggtactcatcagtgtataccccaaaaatactggtcacatgtattagcgaggataagagcatttcctttgcaggttgtctctgtcaattttttttcagtgcaggcctcgcttatagtgagtgctaccttcttgctgctgtggcctatgaccgttatgtcgccatttcaaagcctcttctgtacgcccaggcaatgagtatcaaactctgcgcacttcttgtagccgtgtcctactgtggtggattcatcaatagtagtattataacaaagaaaacgttttcatttaatttttgccgtgagaacatcatcgatgattttttttgtgatctcctgccgctcgtagaactggcctgtggcgaaaaaggaggctataagattatgatgtatttcctactggcaagtaacgttatatgcccagcagttctgatattggcctcatacctatttatcattacctccgtacttcggatctccagctccaagggctacctgaaagcattctccacatgtagttctcatctgacctccgtgaccctttactacggctccatcttgtacatctacgcgctgcctcgcagctcctattcatttgacatggacaaaatcgttagcaccttttacaccgtggtgttccccatgctgaacttgatgatttattctttgagaaacaaagacgtcaaggaggctctcaagaaactcctcccatag

SEQ ID NO: 28660 - DNA, 984 bp, Artificial Sequence
  Description of Artificial Sequence: Synthetic coding sequence
atgatatttccctcgcacgatagtcaagcgtttaccagcgtcgatatggaagtgggcaattgtaccatcctgaccgaattcattctcctagggttcagtgctgactcccaatggcagccaattctgttcggtgtctttcttatgttatatctgatcacgttatctggaaatatgacacttgtgatcctcattcgaactgacagccacctccatacccccatgtacttctttattggtaatctgagttttctcgatttttggtacacatctgtgtacaccccgaagatcctggccagctgcgtaagcgaggataaacgcatcagtctggccggatgtggggcgcagctgttcttctcatgcgttgtcgcttacaccgagtgttacctgctggcggccatggcatatgaccggcacgcggcaatctgtaaccccctcctgtacagtggcaccatgtctacagccctttgtaccggactggtggctggcagctatatcgggggttttctgaatgccattgctcacactgccaacacattcaggcttcacttttgtggaaaaaatattattgatcacttcttttgtgatgccccgcccctagtcaaaatgtcttgcacaaacaccagagtgtacgagaaagttctgctgggcgtcgtaggttttactgtgctaagttcaattcttgcaatcctgatatcctacgtgaacattctgctcgccattcttagaatccattctgcatctgggaggcacaaggccttctccacatgcgcttcccacctgatatcagtgatgttgttctatgggagcctgcttttcatgtatagcagacctagtagcacatacagcctggaacgggacaaggtggcggccctgttttatactgtgataaacccactgttaaacccactcatctacagcctgcgcaataaggacattaaggaggcttttagaaaggcgacccagaccattcagccccaaacctag

SEQ ID NO: 28661 - DNA, 945 bp, Artificial Sequence
  Description of Artificial Sequence: Synthetic coding sequence
atggccaaaaataatttaacaagagtgacggagttcatcttgatgggtttcatggatcacccaaagctcgaaatccctctgtttctcgtgttcctatctttctacctggtcactttattgggcaacgtgggaatgatcatgctgatacaagttgatgtaaaactctatactccgatgtactttttcctttctcatctgtctctgttggatgcctgttatacaagtgtgataacaccacaaatcttagccaccctggcaacaggtaaaactgtgatcagttatggtcactgcgcggcgcagttctttctcttcacaatctgtgcaggcaccgagtgctttctccttgccgttatggcctatgacaggtacgctgcaatccgcaatcctctgttgtatacagtggccatgaatcccaggctgtgctggtcccttgtggttggagcttatgtgtgcggcgtgagtggcgccatcttgaggacgacctgtacctttacactgtcgttttgtaaagacaaccaaataaatttctttttctgtgacctccccccacttctcaagctcgcatgcagtgacaccgcgaacatcgaaatcgtgatcattttcttcggcaacttcgtgatacttgcaaacgcctccgtgattctgatcagctatctactgatcatcaagaccatcctgaaagtgaaaagtagtggggggagggctaagaccttttcgacttgtgcctctcatatcacagccgtcgctcttttcttcggcgccctgatattcatgtacctgcagagcggctccggcaagtccctggaggaggataaagtggtgagtgtgttttacactgtggtcattcccatgttaaacccattgatctactcgctgcgaaacaaggacgtaaaggatgcttttcgaaaagtggctagacgccttcaggttagtctctctatgtag

SEQ ID NO: 28662 - DNA, 1008 bp, Artificial Sequence
  Description of Artificial Sequence: Synthetic coding sequence
atgcttggcagcaaaccaagagtccacctctatattctcccatgtgcctctcagcaggtgtctactatgggggatcgcggaacatccaaccactccgagatgactgacttcatattggctggttttcgagtgaggcccgagttgcatatactcctctttctcctcttcttattcgtgtatgctatgattttgctgggtaacgtaggcatgatgactatcatcatgactgacccaaggctgaacacacccatgtatttcttcttgggcaacctgtcctttatagaccttttctattcttctgtaatagaaccgaaagcaatgatcaatttttggagtgagaacaagtccatctctttcgccggctgcgttgctcagttatttctcttcgctcttctgattgtgacagagggcttcctcctcgccgctatggcatatgaccggtttattgccatatgtaatcccctgttatattcagtccagatgagtacaagactgtgcactcaactggtagctggctcttacttctgcgggtgcattagcagcgttatccagacctctatgacgtttacattgagcttctgcgccagccgggccgtggatcacttttattgtgatagccggccattacaaagattatcctgtagtgacttgttcatacacagaatgatttcctttagtctgtcctgcatcatcatattacccacaattattgtcattattgtctcctacatgtacatagtttccaccgtcctaaaaatccatagtacggaaggacacaagaaggcattctctacatgctctagccatctgggggtggtcagcgttctgtatggcgctgtgttctttatgtatctgacacccgacaggtttccagaactcagtaaagttgcctctttatgttactcactggtaaccccaatgctgaacccgctgatctattcactacgcaacaaggacgtgcaggaggccttgaagaaatttctcgaaaagaagaacattatcttatag

SEQ ID NO: 28663 - DNA, 933 bp, Artificial Sequence
  Description of Artificial Sequence: Synthetic coding sequence
atggctgagatgaacctcacactggttactgagtttttgctgattgcctttaccgagtatccagagtgggcgttgccactgttcctcctttttctgttcatgtacctcatcactgttttaggaaatctcgagatgatcatcctgatactgatggatcaccagctccacgcgccaatgtacttcctcctgtctcatctggccttcatggatgtctgctactctagcataactgtccctcaaatgctggcggtgctcctggagcacggtgccgctctcagttatacgcgctgtgcggcccaattttttctgttcacttttttcggctccatagactgctatctgttggccctaatggcctacgacagatatctcgccgtctgtcagccccttttgtatgttacgatactgacccagcaggcacgcctgagcctggtggctggagcttatgtggctgggctcatctctgctctcgtgcgcacagtctctgcctttaccctgtctttctgtggaacgagtgaaatcgactttattttctgcgatttgccgcccctgttgaagctaacgtgtggcgaatcgtacactcaggaggttcttataattatgttcgctatattcgtgattcccgcctctatggtagtgatcctggtgtcttacctgttcattatcgtggctatcatggggatacctgccggctcgcaggccaagacattttcaacatgtaccagtcacctgaccgccgtcagtctgttcttcggaactcttatatttatgtacctgcgggggaactcagaccagagtagcgaaaaaaatcgcgttgtgagtgtgctgtacacagaggtgatcccaatgctgaaccccttaatctacagtctccggaataaagaagtgaaggaggcattgcggaaaatccttaatcgtgccaagctgagttag

SEQ ID NO: 28664 - DNA, 945 bp, Artificial Sequence
  Description of Artificial Sequence: Synthetic coding sequence
atggccgaaagaaactataccgtggtgactgagttttttctgaccgctttcactgagcacctgcagtggagggtgcctctattcctgatcttcctttcattttacttggccaccatgctggggaacaccggaatgatcctgctcatcaggggggaccgtagactgcatacccctatgtatttctttctgagccatctgtcccttgtggacatctgctattcctctgccatcatcccccagatgctcgctgtgctgtgggagcacgggaccacaataagccaggcccgctgcgcagcccagtttttcctgtttacattcttcgctagcattgattgctatctgttagcaatcatggcctatgaccgctatactgccgtctgccaaccgctgctttacgtcacaattatcacagaaaaagccaggtggggcctcgtcacgggtgcctatgtggctgggttcttctctgcctttgtaaggacagtgactgcatttacactgtccttttgcggcaataacgaaatcaactttattttttgcgacctgcctccactgctgaagctgtcttgtggcgattcttatacacaagaggttgtgatcatcgtgtttgccctattcgtaatgcctgcctgtatcttggtgattttggtctcatatctgttcataattgtggccatcttgcagatccacagcgcgggtgggcgcgctaagacattcagcacatgcgcgagtcacttaacagccgttgcactattctttgggacgctcatcttcatgtatctgcgcgacaataccgggcagtcaagcgagggcgatcgggtggtgagcgtcttgtacaccgtggtgacccccatgctaaaccccctaatatacagcctgcgaaataaggaggtaaaagaggcgaccaggaaggctctttcaaaatctaagcccgctcgcagaccttag

SEQ ID NO: 28665 - DNA, 426 bp, Artificial Sequence
  Description of Artificial Sequence: Synthetic coding sequence
atgagcttctcacttaacttcacactaccagcaaacacgacttctagtcctgtgacaggtggtaaagagaccgactgtggtccttccttgggactagctgccggaatccccttgctggtagcgacggctctgctcgttgccctcctgttcaccctcattcaccgtcgacggtcctccattgaggcaatggaggagtccgatagaccttgcgagatttccgaaatcgatgataacccaaagatctctgagaaccctcgaagatccccaactcatgagaaaaacacaatgggagcccaggaggcgcacatctatgttaagacagtggccgggtctgaagagccagtgcatgaccgctataggcccacaatcgagatggagagacgtcggggcttgtggtggctcgtgccaaggctgtcgctggaatag

SEQ ID NO: 28666 - DNA, 393 bp, Artificial Sequence
  Description of Artificial Sequence: Synthetic coding sequence
atgagcttcagtcttaacttcactctgccagcaaacacggactgcgggccaagtctcggacttgccgcgggtattcccttgcttgtcgcaaccgctctgctggttgctctgctgtttaccctcattcatagaagaaggtctagcatagaggccatggaggagtccgaccggccttgtgagatcagtgaaatcgacgataaccctaagataagcgagaacccccgcaggtctcctacccatgaaaagaacactatgggggcacaggaggcccacatctacgtgaagactgtcgctggctcagaggagccagtacacgaccggtacagacctacgatcgaaatggaacggagacgcggtctgtggtggcttgtgccccgattgtcacttgaatag

SEQ ID NO: 28667 - DNA, 357 bp, Artificial Sequence
  Description of Artificial Sequence: Synthetic coding sequence
atggattgcggcccatccctgggcctcgccgcaggcattccactcctggttgccacagcccttctcgtggcgcttctttttactctcatccaccggcgtaggagtagtatcgaggctatggaagagtccgatagaccctgcgagatctccgagatcgacgacaatcccaagataagtgagaatccccgacgatcacctacacacgaaaaaaataccatgggtgcccaggaggcccatatttacgtgaaaaccgttgccggcagtgaggagccagtacacgatcgttacagacctaccatcgaaatggagcgcagaagaggactgtggtggctcgtgcccaggctctcacttgaatag

SEQ ID NO: 28668 - DNA, 396 bp, Artificial Sequence
  Description of Artificial Sequence: Synthetic coding sequence
atgaggatgacgtcgtcccctgttactggcggcaaagaaaccgactgtgggccctccctgggccttgcagctggcatccccctccttgtggctacggcactgctcgtggccctgctgtttaccttaatccaccggcggcgtagctcaattgaggctatggaagagtctgaccgaccgtgcgaaattagtgaaatcgatgataatcccaaaatcagcgagaatccccgccgctccccaactcacgaaaaaaacacaatgggtgcccaggaggctcatatctacgttaagacagtcgctgggtcggaagagcctgttcatgaccgatatcggcccaccattgaaatggagaggagacgcggtttgtggtggctagtgccacggctctctcttgagtag

SEQ ID NO: 28669 - DNA, 396 bp, Artificial Sequence
  Description of Artificial Sequence: Synthetic coding sequence
atgcggatgacatccagcccggtgactggcggcaaagaaaccgactgtggcccctccctggggctggctgcggggatcccactgctggtggcaaccgccttgctggtggcactgcttttcacgctgatccaccggagaaggagctcgattgaggctatggaagagtctgacagaccgtgcgagattagcgagatcgacgataacccgaagattagcgagaaccccaggcgcagccctacccacgagaaaaatacaatgggggcacaggaagcccacatttacgtcaaaactgtagctgggagcgaagaacccgtgcacgatagatacaggccaacaatagaaatggagcggagacgaggactttggtggctggtcccgaggctttccctggaatag

SEQ ID NO: 28670 - DNA, 450 bp, Artificial Sequence
  Description of Artificial Sequence: Synthetic coding sequence
atggaaaccctgtatagggtgcctttcctggtgcttgaatgccccaatttaaagttgaagaaaccgccatggttgcatatgccctccgctatgactgtgtacgctctcgtcgtcgtctcttactttctgatcacaggtggcataatatatgacgttatcgttgagcctccttccgtcgggtctatgaccgatgagcacgggcatcagaggcctgtggctttcctcgcttacagggtgaacggacagtacatcatggaaggcctggccagttcattcctcttcactatgggcggcttaggtttcattatcttggatcggagcaacgctccgaatatccccaagctcaacagattcttactgttgtttataggctttgtgtgtgtgctgctgtcatttttcatggccagagtgttcatgcgcatgaagttgcccgggtatctgatgggatag

SEQ ID NO: 28671 - DNA, 516 bp, Artificial Sequence
  Description of Artificial Sequence: Synthetic coding sequence
atggaaacactgtatcgtgtgccctttttggtcctcgagtgtcccaatttaaagcttaagaaacctccttggctccacatgccttcagccatgacagtttatgctctggttgtcgtaagttacttcctgattaccggtgggatcatctacgacgtaatcgtggaaccaccttcagtcggctctatgaccgatgagcatggacaccagagaccagtcgcttttcttgcctacagagtaaacggtcaatatataatggaagggctggccagttcttttctgtttacaatgggcgggctcggattcattattctcgataggtctaacgcccctaatataccaaaacttaaccgcttcctcttgcttttcatcggattcgtttgcgtcttgctctctttttttatggcaagggtcttcatgagaatgaaattgcctcgctccttggccttgcttccacgactcgagtgcagtggggtgatttctgctcactacaagctgtgcctccccggggccatttag

SEQ ID NO: 28672 - DNA, 1461 bp, Artificial Sequence
  Description of Artificial Sequence: Synthetic coding sequence
atgtcgttcatctgtgggcttcaaagcgcagccagaaatcacgtcttcttccggtttaatagcctgagtaactggagaaaatgtaacaccttggcgtccacaagccgtggctgccaccaggtacaggttaaccatatcgttaataagtaccagggtttgggggtcaaccagtgcgatcggtggagttttctacctggcaactttcacttctacagtacattcaataataaaagaacgggggggctttcctctaccaagagcaaggaaatatggagaattaccagcaaatgtactgtgtggaatgacgcattttctagacagttgttgataaaggaagtcaccgctgtgccctcgctgtcggtgctccatcccctgagtcccgccagcattagggccatccgtaacttccacacatctcctcggtttcaggccgctcctgtacctctgctgttgatgatcctgaaaccggtccaaaagctctttgcgataatagtcggtaggggcatccgtaagtggtggcaggctctgccacccaataaaaaggaggtagtgaaagaaaatattcgcaagaacaagtggaaactgttcctcggattgtcatcatttggacttcttttcgtggtgttttattttacccacttggaggtatcccctataaccggccgtagcaaattattgctcttgggaaaagaacaatttcgcctgctcagtgaactggaatacgaggcctggatggaggaattcaaaaacgacatgctgacggaaaaggatgcacgctatctggccgtaaaagaagtgctttgtcatctcatagaatgcaacaaggatgtaccgggcatctcacagatcaattgggttatccatgtagttgattccccaatcatcaacgcattcgtactcccaaatgggcagatgttcgtgtttacgggcttcttgaattcagtaactgatattcatcagttatcctttctactgggccatgaaatcgcccatgctgtcttgggacacgcagctgaaaaggccgggatggtgcacttactggactttctcggcatgatttttttgactatgatatgggcaatttgtccccgggattccctggccctcctgtgtcagtggatccagtcgaagttacaagagtacatgttcaatagaccctactctcggaaattggaagccgaggccgataaaatcggactgcttcttgctgcaaaagcttgcgccgacatccgggcctcgtctgtgttctggcagcagatggagttcgtcgactccctgcatggacagcccaaaatgcctgagtggctgtccacccacccatcacacggcaacagagtggagtatctcgatcgcctcatcccccaacttgttcgggaagaaaaattcatagagcaacccgagcagatagctgagctcacactcaattcgttcattcagaatacagaaatctgccgctcttag

SEQ ID NO: 28673 - DNA, 1575 bp, Artificial Sequence
  Description of Artificial Sequence: Synthetic coding sequence
atgtcctttatttgtggcctgcagtcagctgctcgaaatcacgtgttcttcagattcaattcgttgagtaactggcgtaagtgcaacacactggccagcacctcacgtggatgtcaccaggtacaggtcaaccacatcgttaacaaataccagggcctgggcgtgaatcagtgcgaccggtggagttttctgcctggcaattttcacttttactcaacctttaacaacaaacgcacagggggccttagctccacgaaaagcaaggaaatatggcggattacttccaaatgcactgtatggaatgacgcgtttagcaggcagcttttgattaaggaggtgacagctgttcctagtttaagtgtgttacatccactttctcctgcaagcattagagccatccgaaactttcacacttctccgcggtttcaagcagcacctgtgcctttgctactgatgattttgaaacctgtccaaaagcttttcgcaattatagtagggcgcggcattcggaagtggtggcaagctctgcctccgaataagaaggaagtggtgaaggagaatatccggaaaaacaaatggaagctctttctcggactcagtagctttgggctgctgtttgttgtattttattttactcatctagaggtgagtcctatcaccgggcgttctaaattgctgctgcttggaaaggaacagttcaggctgttatcggagctggagtacgaagcgtggatggaggagttcaaaaacgacatgctgacagaaaaagacgctcgctacctggctgtgaaagaggttctttgccacttaatcgaatgcaacaaggatgtgccaggaatttctcagatcaactgggtgattcatgtggtggatagtcctatcatcaacgctttcgtgctcccaaatggacagatgttcgtgttcaccggttttctgaacagcgtcactgacattcaccagctgtcattccttctcggtcatgagattgcccatgcagtgctcggccacgcagccgagaaggccggcatggtgcatctgctcgactttctgggaatgatcttcttgacgatgatttgggctatctgtccaagagactcactggcactcctatgccagtggatacagtctaagctgcaggaatacatgttcaatcgcccttattcacggaagctggaagcagaggccgacaagattgggctgctcttagccgctaaggcatgcgccgatatcagagctagtagtgtgttttggcaacagatggaattcgtagattccttacacggccaacccaaaatgcccgaatggctgagtacacacccaagtcatggcaatagagtagagtacctggatagactaatcccacaggcactgaaaatcagagaaatgtgcaattgcccacccttgtccaatcctgatccacgactcctgttcaaacttagtaccaagcactttctagaagagtctgagaaggaggaccttaatatcaccaagaagcagaagatggataccctgccaatacagaagcaggagcaaattcctctcacttacattgtggaaaagagaacgggcagctag

SEQ ID NO: 28674 - DNA, 768 bp, Artificial Sequence
  Description of Artificial Sequence: Synthetic coding sequence
atgagcttcatatgcggcctgcagtcggctgcgcgcaatcacgtattttttaggttcaacagcctgagcaattggaggaaatgtaacaccctggcatctacctcccggggctgtcaccaagtgcaggttaaccatatagttaataagtatcagggtcttggagtgaatcagtgtgaccggtggagctttctacccggcaacttccatttttatagcacctttaacaacaagaggaccggtgggctgagtagcacgaaatccaaagaaatctggcgtatcacctcgaagtgtacggtatggaacgacgcctttagtcgtcagctactgattaaagaggtgaccgctgtgcccagtttgagcgtgttgcatccactgtctccagcaagtatccgcgctattcgtaattttcacactagcccccgattccaagccgctccagtgcccttgctgctgatgattcttaagcccgtccagaagttgttcgccatcatcgtgggacgggggattaggaaatggtggcaggcgttgcctcctaacaagaaggaggtggtcaaagagaatattcgaaaaaacaagtggaagctttttctagggctgagctcctttgggctactattcgtggttttctactttacccacctcgaggtctcacccatcaccggacgatccaagctgcttctgcttggcaaggagcaattcaggctcttgtctgagctggagtacgaagcttggatggaggagttcaaaaacgatatgcttactgagtag

SEQ ID NO: 28675 - DNA, 987 bp, Artificial Sequence
  Description of Artificial Sequence: Synthetic coding sequence
taattgttcgcaatcattgtagggaggggaattagaaagtggtggcaggccctacccccgaataagaaagaggttgtgaaagaaaacattagaaagaacaaatggaaactgtttttggggctgagctccttcggtcttctcttcgtggtcttctacttcacccacttggaagtttcgccgatcactggtagatcaaaacttttgttgttgggcaaggaacagtttcggctgttgagcgagctggagtacgaagcatggatggaggagtttaagaacgatatgttaaccgagaaggacgcccggtatcttgctgttaaagaggtcctgtgccatctcatcgaatgtaacaaggacgtaccaggcattagccagattaactgggtgatccatgtcgttgactcgccaattatcaatgccttcgtactgccaaatgggcagatgttcgtatttacaggcttcctcaacagtgtgactgatattcatcagctgtcattccttttgggccatgagatagcccacgcagtcctgggtcatgccgcagagaaggccggtatggtccatttgctagacttccttggaatgatatttctgactatgatctgggccatttgtccgcgcgactcactcgcccttctgtgccaatggatacagtccaaactccaggagtacatgttcaatcgcccgtactctagaaagctagaagctgaggcagacaagatcggcttgctgctcgccgcaaaggcctgtgccgacattcgcgcgagcagcgttttctggcaacagatggagttcgtcgattccctgcacgggcaaccaaaaatgcctgagtggctaagcacacacccgtcacatgggaacagagtcgagtacctggataggcttattccacagcttgtccgcgaggaaaaatttatcgaacagcccgagcagatagctgaactgaccctcaatagcttcatacagaacacagaaatttgtcggtcttag

SEQ ID NO: 28676 - DNA, 762 bp, Artificial Sequence
  Description of Artificial Sequence: Synthetic coding sequence
atgagcttcatctgcggcctacaatcagccgccaggaatcacgtttttttcaggttcaatagtctgtcgaactggcgaaaatgcaacaccctagcttccacgtcccgcgggtgccaccaggtgcaagtgaaccatatcgttaacaaatatcagggtctcggggtgaatcagtgcgacagatggtctttcctccccgggaattttcacttctatagtactttcaacaacaaacgcactggcgggctttcctcaactaaatctaaggagatctggcggataacctcaaagtgcactgtctggaatgacgccttttcaaggcagctgctgataaaagaggtgactgctgtaccatctttgtcagtcttgcatcccttatcgcctgcctctatccgagccatccgaaactttcatacatcaccacgatttcaagcggcaccagtcccccttttgctgatgattctaaaacccgttcagaaacttttcgcgatcattgttggaagaggtattcggaagtggtggcaggccctccctcccaacaaaaaagaggtggttaaagagaatataagaaagaataagtggaagctgtttctggggttgtcctcctttggactcttgtttgttgtcttctattttacccacctggaagtcagcccgattacaggcaggtctaaactcctactgttgggcaaggagcagttcaggctattatctgagctggaatatgaggcctggatggaggagtttaagaacgatatgctttag

SEQ ID NO: 28677 - DNA, 555 bp, Artificial Sequence
  Description of Artificial Sequence: Synthetic coding sequence
atgtcatttatttgcggccttcaaagcgcagcgagaaatcatgtttttttcagattcaattcactttccaattggagaaaatgtaacaccctcgcaagcacatctcggggctgccatcaggttcaggtgaaccacattgtgaacaagtatcagggcttgggggtcaaccagtgtgacagatggtcattccttccaggcaatttccacttctactctaccttcaataacaagaggacaggcggcctgtcgtctaccaagtctaaggagatttggcggatcaccagtaagtgtaccgtctggaatgacgccttttcccggcagttgttaattaaggaggtgacggctgtgccatctctgagcgtactccaccccctgtcaccagcctcgataagagccatccgcaactttcacacatccccgaggtttcaggcagcccccgtgccgctgctcctgatgatcctgaagcccgtccaaaaactgttcgcaattattgtggggcgtggaattcgcaaatggtggcaggcccttccacccaataagaaggaagtcgtctag

SEQ ID NO: 28678 - DNA, 981 bp, Artificial Sequence
  Description of Artificial Sequence: Synthetic coding sequence
atgtcctttatctgtggactccagtctgccgccaggaaccacgtattcttcaggttcaacagtctcagcaattggaggaaatgcaacacactagcaagcactagccgcgggtgccatcaggtgcaggtcaatcatatcgtgaataagtaccaaggacttggcgttaatcagtgtgacaggtggtcgttcctgccgggtaatttccatttttatagtacattcaataataaacggacaggggggctgtccagtaccaaaagtaaggagatatggaggattacatctaagtgcacggtgtggaatgatgccttttcaagacaattactgattaaggaagtcactgcagtccctagtctatcggtcctgcatccactttctcccgcttccatccgcgccatcaggaattttcacacaagccccaggttccaggctgctccagtacccctgctgctgatgattctcaagcctgtgcagaaactctttgcaatcatagttggcaggggcattcggaaatggtggcaggccctccccccgaacaagaaggaggtggtgaaggaaaatatacggaaaaacaaatggaaactgtttctcgggttgtccagtttcggactgctctttgtggtattctacttcacccatctggaagtgagtcccatcaccggacggagcaagttattactcttgggaaaagagcagtttagactactatccgagcttgagtacgaggcatggatggaagaattcaagaatgacatgctcaccgaaaaagacgctcgatacctcgccgttaaagaggtgctgtgtcacctgatagagtgtaacaaagatgtcccaggcatatcccagataaactgggtaatccacgtggtggactcccctatcattaacgccttcgttctgcctaacggtcaaatgttcgtgttcacaggcttccttaactccgtaactgatatccatcagctgtctttcctgctgggttag

SEQ ID NO: 28679 - DNA, 1086 bp, Artificial Sequence
  Description of Artificial Sequence: Synthetic coding sequence
atgagtcctgagtgtgcacgtgccgccggcgacgcgccactccgctcactggaacaagcaaatcgcactcgcttcccctttttctccgatgttaagggcgatcacaggctcgtcctagccgccgtggagaccactgtccttgttctcatattcgctgtgagtctcctgggcaatgtgtgtgcactggttctggtagccaggcgcagacggagaggtgcaaccgcttgtttggtgcttaacctcttctgcgccgaccttttgttcatatcggccatcccactggtgctggcagtgcgctggacagaagcctggcttttgggtcctgttgcgtgtcacctgctattttacgtaatgacactctcaggatctgtgactatcctcacccttgcagccgtgagtcttgaacgaatggtatgtattgtgcatctccagaggggcgtgcggggtcctgggcggagagctcgagccgtattgttagcactgatatggggctattcagccgtggccgctctgcctctctgtgtattcttcagagtggtgccccaacgcctccctggcgcagatcaggaaatatcaatttgtaccctcatctggcccactatcccaggcgaaatttcctgggatgtgtcttttgtgactctgaatttcctcgttcccggactggttatcgtgatttcctattcaaaaattctgcagatcaccaaggctagccgcaaaagactcacggtgtcactcgcctactctgagagccaccaaatcagagtgtcgcagcaggactttcgcctgtttcgaactctctttttactgatggtaagcttctttattatgtggtcacctatcatcatcacaatcttactaattcttatccagaactttaagcaggacctggttatatggccgagtctttttttttgggtagtggcattcacctttgctaattccgccctcaaccccattctgtacaacatgactctttgtagaaacgaatggaaaaagatcttctgttgtttctggttccccgaaaagggcgccatcctgaccgacacgtccgtgaagaggaacgatttgtctataatctccggctag

SEQ ID NO: 28680 - DNA, 1134 bp, Artificial Sequence
  Description of Artificial Sequence: Synthetic coding sequence
atgtccccagagtgcgcacgggctgctggggacgcccccctgagaagcctggagcaggccaaccggacccgttttccctttttctctgacgtaaagggtgaccacaggctggtgctggcagctgtagagacaactgtacttgtgctcatattcgcagtcagcctgcttggcaacgtctgtgccctggtcttggtggccaggcgacgtcggagaggtgccacagcatgcttggtgttaaatttattctgcgcggacctactgttcataagtgctatccctctggtgttagctgtgagatggactgaagcctggctgttaggacccgtggcttgccacctccttttttatgtgatgacactgtccgggtctgtgaccatactcacccttgcagccgtgtctcttgagagaatggtatgtatcgtgcacctccagagaggagtcagggggccggggcggagggctcgtgccgtactgctggccctgatctggggttactcagcagtggctgccctgcccttgtgtgtgttttttagggtggtcccccaaagattgccaggcgctgaccaggaaatctccatctgcaccctgatctggcccacaatcccaggtgaaatcagctgggacgtgagtttcgtgacccttaatttcctcgtgcccgggcttgtcatcgtgatctcctactccaagattctccagacctcagaacacctgctggatgctagggcagttgtgacccacagtgagattaccaaggcatcccgcaaaaggttgacggtatccttggcgtatagcgagtcacatcagatccgcgtgagccagcaagacttcaggctgtttcgtaccctgttcctgctgatggtctcttttttcatcatgtggtcgcccattattattacgatcctgctgattctgatacagaatttcaagcaggatttagttatctggcccagtctcttcttctgggtggtggcatttacattcgctaactctgccctgaatcccatcttgtataatatgacactgtgccgtaatgagtggaagaagattttctgctgcttttggtttcctgagaagggagcgatattgacagacacaagtgtgaagcgtaatgatcttagtatcatttccggatag

SEQ ID NO: 28681 - DNA, 1113 bp, Artificial Sequence
  Description of Artificial Sequence: Synthetic coding sequence
atggagccactcttccctgctcccttttgggaggttatttacggatcacaccttcaaggtaacttgtccctgctgtctcccaatcattcattgctgcctccccacctgcttttgaacgcaagtcacggtgccttcttaccactggggttgaaagtgactatcgtgggcttatacctggctgtatgcgtaggcggtctgctgggcaactgtctcgtaatgtacgttattttgcggcataccaaaatgaaaaccgcaaccaacatttatattttcaacctggccctcgcggataccctggtcctgctgactctgcccttccaggggacggacatcctgttagggttctggccgttcggcaacgcactgtgtaagacagtgatcgcaatagattactataatatgttcactagcacctttacgctgaccgctatgagcgtggaccgatatgttgctatttgccaccccatccgggccctggatgtgaggactagcagcaaggcccaagccgttaacgtcgctatttgggccctcgcttccgtcgtgggagtgcccgtggcaatcatgggctcggcccaggttgaagatgaagagatcgaatgcctggtcgaaatccccactccacaggattactggggaccggtttttgcaatctgcatctttctgttctcttttattgtacccgtactcgtcatcagcgtgtgctattctttgatgatccgacgattacggggggtaagactgctcagcggctctagggaaaaagacagaaatctacggaggatcactcgcctggtcttggtggttgtggccgtgttcgtgggctgttggacacctgtccaggtgttcgtcctggcccagggactcggggttcagccatccagtgaaaccgctgtcgcaattctgcgattctgcacggccctcggctatgtgaacagctgtctgaatcctattctttacgccttcctcgatgagaactttaaggcctgcttccgcaaattctgctgtgctagcgccttgcgcagagacgtacaggtgtcggacagggttcggagcattgctaaggatgtggccctggcttgcaaaacctctgagaccgtgccaagaccagcttag

SEQ ID NO: 28682 - DNA, 1113 bp, Artificial Sequence
  Description of Artificial Sequence: Synthetic coding sequence
atggagcccctgttccccgcgccattttgggaggtgatctatggctctcacctacaggggaacctcagcttactgagccctaatcactccctcctcccaccacacctgttgcttaatgcctctcatggtgcatttctccctttggggctgaaggttacaatagtgggactctacctagctgtttgcgttgggggcctcttgggcaactgtctggtgatgtacgttatcctgcgtcatactaagatgaagaccgccaccaacatatatatattcaatctcgccctggccgacaccctcgtcctactgactttaccctttcagggcactgacatccttcttggtttctggccattcggcaacgcactgtgtaaaacagtcatagctatagattattacaacatgtttacctccacgtttacactcactgcgatgtcagttgacaggtatgtggcgatatgccatccaattagagctttagatgtgaggacctcctcgaaggcccaggcagttaatgtggccatatgggctctggcgtctgtagtgggtgtcccagtcgctattatgggaagtgcacaggtcgaggacgaagaaattgagtgtctcgtggaaatacccaccccgcaggactattggggccctgtgttcgccatctgcatttttcttttctccttcatcgttccagtccttgttatctctgtatgttacagccttatgatcagacggctgcgtggcgtcaggttgctgtcgggctcaagagagaaagacaggaacctgcgaaggatcactaggctcgtgttggtggtggtcgccgtctttgttggttgttggacccctgtccaagttttcgtgctggcccagggactgggggtgcagccatcttcggaaactgccgtggccatcctaaggttttgcaccgcgttgggctacgtcaacagctgtctgaatccaatcctatatgctttcctcgatgagaattttaaggcctgcttcagaaaattctgctgtgcatctgctctgcgcagggacgttcaggttagtgatcgcgtgcggagcattgcaaaggacgtggctctggcctgtaagacaagcgaaaccgtcccccggcccgcctag

SEQ ID NO: 28683 - DNA, 1113 bp, Artificial Sequence
  Description of Artificial Sequence: Synthetic coding sequence
atggagcccctgttccccgctccattttgggaggtcatctatggaagccacctgcaaggcaacctgtctctcctttcccccaaccactctttgcttccgccccatctgttgctcaatgccagccacggggcatttttacccctaggattgaaggtgacaattgtcggactttatctcgccgtttgcgttggcggactgctcggaaactgtctcgtcatgtacgtaattctccgtcatacgaagatgaagacagcaactaacatttatatatttaatctggccctggccgatacgttggtgctattgaccctaccgttccagggaactgacatactgctcggtttctggccttttggtaacgctttgtgcaagaccgttattgcgatcgattactacaacatgtttacttccaccttcacgctgaccgccatgtccgtggacaggtatgtggcaatttgtcacccaattcgagctctggacgttagaacttcttcaaaggcacaggccgttaacgtggcaatatgggcactggcaagcgtggtcggagtccccgtggccatcatgggctctgcccaggttgaagacgaggagattgagtgcctcgtggaaattcctacacctcaggattactgggggccagtctttgctatctgcatattcttgtttagcttcatcgtgccagtgcttgtgatatcggtgtgctattctctaatgataaggcgcttgagaggcgttagactgctgagcggctcccgtgaaaaagatcggaatctgaggagaattacgcgcctggtcctggtggtcgtagctgtgtttgtcgggtgttggacccccgtgcaggttttcgttttagcgcagggactgggggtgcagccatcttccgagaccgcggtggcaatcctgcgcttttgcaccgccttgggttatgtgaacagttgcctcaaccctatcttgtacgcctttctcgacgagaacttcaaagcctgcttccgtaaattctgctgcgcatccgcgcttagaagagacgtgcaggtgtccgatagagtcagatcaatcgcgaaggatgtcgctcttgcctgtaagacctccgaaacagtgcctaggcctgcttag

SEQ ID NO: 28684 - DNA, 495 bp, Artificial Sequence
  Description of Artificial Sequence: Synthetic coding sequence
atcaccggactgtggagcctcgccatcatttcatgggaacggtggctggtggtgtgcaagcccttcgggaatgttcggtttgacgctaaattagccatagtggggatcgcatttagttggatatggtctgcagtgtggactgccccccccattttcggttggagccgttactggccccacggactgaaaacgagctgcgggccagatgtgttctctggtagctcatatccaggggtgcaaagctacatgattgtgttgatggtgacctgctgtatcattccactggccataatcatgttatgctatctgcaggtgtggctcgcgattcgagccgtggcaaaacagcaaaaggagtcagaaagcactcaaaaggctgaaaaagagttccgcaattgcatcttacagctctttggcaagaaggttgacgacgggtctgaactcagctctgctagtaagactgaagtttcgagcgtatcatcagtctccccagcctag

SEQ ID NO: 28685 - DNA, 1095 bp, Artificial Sequence
  Description of Artificial Sequence: Synthetic coding sequence
atggcacaacagtggtccttgcagaggcttgcagggagacacccccaagacagctatgaggactcaactcagtcaagtatctttacctatacaaattcaaatagtacccgaggacctttcgagggaccaaactaccacattgcgccaagatgggtctaccacctgacaagcgtgtggatgattttcgtggtaattgcctcagtgttcacaaacggactcgtgcttgcagccaccatgaaattcaaaaaactgcgccaccctttgaactggattctagtcaatcttgcagtcgctgatctggcggaaactgtcattgctagcaccatttctgtggtcaaccaggtgtacggatactttgtgctggggcacccaatgtgcgttctagagggctacaccgtgtctttgtgcgggattacaggcctctggagtctggccatcatctcctgggaaagatggatggtggtgtgcaagcccttcgggaatgtaagattcgacgcgaaattggctattgttggtattgcgttctcctggatttgggcagcagtttggacagcaccacccatatttggttggtcgagatactggcctcacggactcaaaacctcttgtgggccagatgttttctcagggagtagttatcccggcgtacaaagctatatgatagtgctaatggtcacctgctgcattacccctctcagtattatcgttctgtgctacttacaggtatggctcgccatccgagctgtggcgaagcaacagaaagaatccgaatctactcagaaggccgaaaaagaggtgacacgcatggtggtggtgatggtacttgcattctgcttttgctggggcccatacgctttcttcgcttgttttgccgccgcaaaccccggctatccctttcatccattgatggctgcactgcccgcgttttttgccaagagcgccactatctataatccagtcatctacgtattcatgaacaggcagttccgaaattgcatcctccaactcttcggcaagaaggtcgatgatggatcagagttatccagtgcaagcaaaacagaggtaagtagtgtttctagtgtctcgccggcgtag

SEQ ID NO: 28686 - DNA, 1437 bp, Artificial Sequence
  Description of Artificial Sequence: Synthetic coding sequence
atgaatccaccgtcaggaccacgggtgccaccaagtcccacccaggagccaagttgtatggctacacctgcacccccttcttggtgggactcttcccagagttctatctccagtcttgggcgcttgcccagtatctcaccgacagctcctggaacttgggcagccgcctgggtcccactgccaaccgtggacgttccggatcatgcccactatacgctgggtacagttatcctcctcgtaggcctcaccggcatgctgggcaacctgacagtgatctacacattttgtaggtctagaagcctacgcacccccgccaacatgttcattatcaacctggccgtctctgactttctcatgtccttcactcaggccccagttttttttacttccagtttgtacaaacaatggctgtttggtgaaaccggctgcgaattttatgccttttgtggagccctgtttggaatctcgtctatgataactctgactgccatcgctctggacagatacctcgttatcacccggccactcgctaccttcggggtcgctagcaagaggcgtgccgcctttgtgctgctcggggtgtggctgtacgccctggcctggtctctccccccattcttcgggtggtccgcctatgtgccagagggactcctgacctcatgttcgtgggactatatgtccttcacaccagcagtgcgggcctatacgatgctcttatgttgcttcgtattcttcctgccccttctgatcattatatattgttacatcttcatatttagggctataagagaaaccggccgtgccctgcaaaccttcggggcctgtaaagggaacggcgaaagcctgtggcagagacagcgtttacaatcagaatgcaaaatggcaaaaattatgctgctggtgattctcctctttgtcctttcctgggccccatattccgccgtagctttagtggcatttgcgggatacgcccacgtgttaaccccatacatgagctctgtacccgcggtgatagccaaggcatctgctattcataatcccataatttacgctattacccaccctaagtatagggttgccattgctcagcatcttccctgtctgggggtcctcttgggtgtctcacgccggcattcacgtccctatccatcttatcgatctacccaccgcagcaccctgacttcacacaccagtaacctttcctggatttcaattcgccggcgtcaggaatcacttggaagcgagagtgaagttggctggacccatatggaagctgccgctgtttggggcgctgcccagcaggcgaacggacgatctctctacgggcagggcctcgaagacttggaagcaaaggcccctccccgacctcaggggcatgaggcggagacccctggtaagactaagggacttataccctctcaggacccacgcatgtag

SEQ ID NO: 28687 - DNA, 1470 bp, Artificial Sequence
  Description of Artificial Sequence: Synthetic coding sequence
atgaaccctccctcagggcccagggtccccccctcccccacccaggagccatcctgcatggccacccccgcaccaccctcatggtgggacagcagccagtcctcaatcagctctctgggtcgcttgcctagcattagccctaccgcacctgggacatgggccgccgcttgggtccctttgcctacagttgacgttcctgatcacgcacactacactcttgggaccgtgattttactggtaggtctaacagggatgctcgggaacctgacagttatctacacgttctgcagggctgtgctgagaggcgtgactgtgatgatgcagtcgcgatcactcagaacacctgcaaatatgtttattattaaccttgcagtatccgattttctaatgtcttttactcaagccccagtgttctttacgagctcactgtacaaacaatggctgttcggcgaaacaggctgcgagttttacgccttttgtggtgctctgtttggcatctcaagcatgatcactcttaccgcgattgctcttgatagatatcttgttatcacccgccccctcgccacatttggcgtagctagcaaacgacgtgcagcgtttgtcttgttgggagtgtggctttacgccctggcctggtctctgcctcctttctttggttggtctgcctatgtcccagagggactgttaacgtcctgtagctgggactatatgtctttcaccccagcggtgcgtgcatataccatgctgctctgttgctttgtattctttcttccgctactgatcatcatttattgctacatattcatctttagggcaatcagagagactggtcgcgctctgcagacatttggagcctgcaagggcaacggggagagcttatggcagcgacagcggctgcagagcgagtgtaaaatggccaaaattatgctgttggtaattctgctctttgtgttgtcctgggctccatactcagccgtcgccctagtggccttcgctgggtacgcgcacgttctcacaccatatatgagcagcgttcctgccgtaatagccaaagcgtccgctatacacaatcccattatctacgctatcacccatcccaagtacagggtagccattgcccaacacctgccatgcctcggcgtcctgctgggggtgtctcggaggcactctcgaccttacccttcctacaggagcacccaccggagtacactgaccagccacacgtccaacctgtcttggatcagtattagaaggagacaagaatcactcggcagcgaatctgaggtcggctggacacacatggaggccgccgccgtatggggcgctgctcagcaagccaatggccgttctttgtacgggcaaggcctggaagatctggaggccaaagccccacctagaccccagggacacgaagcagaaacacctgggaagacaaaaggactgattccttcccaggatccccgaatgtag

SEQ ID NO: 28688 - DNA, 1488 bp, Artificial Sequence
  Description of Artificial Sequence: Synthetic coding sequence
atgaaccccccaagtggcccacgggttccaccttctccgacccaggagcccagctgtatggctactcctgctccaccatcctggtgggacagttcgcagtctagcatttcttcgctgggtcggctgccaagcatctcaccaacagcacccggcacatgggctgccgcatgggtacctctcccaacagttgatgttcctgaccacgcgcactacactctaggcaccgtgatcctgcttgtgggcttgaccggcatgttaggaaacctgaccgtgatatacaccttctgtagagccgtgctcagaggagtaaccgtgatgatgcagagccgcagcttacgcacgccggctaatatgtttattattaatctggccgtaagcgactttctaatgtcattcacccaggccccggtcttcttcacatctagtctgtataaacagtggctgttcggagagacggggtgcgaattttatgccttctgcggagcgctctttgggatatcctcaatgataacgctgaccgcaattgctctagataggtacctcgtaattacgaggcctttggcaactttcggcgtcgcatctaagagacgggccgcgtttgtactgctcggtgtctggctctatgcactggcatggagcctgccacctttcttcggctggtctgcttatgtacctgaggggttactaacatcctgttcttgggactacatgtcattcacacctgccgtccgggcttacactatgctgctgtgctgcttcgtattctttctgcctctgctgatcataatttattgttatatttttatttttcgagccatacgcgaaactggacgtgctctgcagacattcggcgcctgtaagggtaatggagagtccctttggcagaggcagaggctgcagtctgagtgcaagatggccaagatcatgttgttagtaattcttctctttgtgctgtcttgggccccatactcagcagtcgctctagtagcatttgcaggttacgctcacgtactcacaccatatatgtcaagcgtgccagccgtgattgccaaggcctccgctatacacaaccctattatctatgccattactcacccgaaatacagggttgcgatcgcccagcacctgccttgtctaggtgtgctgctgggtgtttcacggcgtcactctcgtccataccctagttaccgctccacccaccggtctacccttacctctcacacaagtaatctgtcctggatatcaatccgtcgtagacaggagtccctcggctctgagagcgaagtggggtggacacacatggaggccgctgctgtttggggagcagctcaacaggccaacgggcggtctttgtatggtcaggggctcgaggacctagaagcgaaggctcctccacgcccccaggggcacgaggccgaaactcctggtaagcggcgcgccagttcgggccgaagccagcggccggaaaggcaacgggccgccccttag

SEQ ID NO: 28689 - DNA, 1065 bp, Artificial Sequence
  Description of Artificial Sequence: Synthetic coding sequence
atggcactgaaccatactgctctcccccaggatgaaaggttgcctcattacctgcgcgatggcgacccttttgcctctaagctctcttgggaggccgatctcgtggcaggtttctaccttactatcatcggtatactgtcaacctttgggaatggttacgtgttgtatatgagttcgcgtcgtaaaaaaaagctccgacctgcagaaataatgaccatcaatcttgcagtttgcgacctgggcatctccgtggtcgggaagccttttaccataatttcatgtttctgccaccgttgggtgttcggttggattggctgtaggtggtacgggtgggccgggtttttctttggctgcggaagcctgattactatgactgcagtatcgctcgatcgctacttaaagatatgttacctgtcttacggcgtgtggttgaagcgaaagcatgcttatatttgtttagcggccatatgggcttacgcatcattttggacaacaatgccactcgtcgggctgggcgactacgttccagaaccatttgggacttcatgcaccctcgactggtggttagcccaggcaagtgtgggcgggcaggtattcattctaaacattctattcttctgtctgctgcttcccactgcagtgattgtcttctcttacgtgaagattattgctaaggttaagtcctccagcaaggaagttgctcactttgactcaagaattcattcctctcatgtgctggagatgaaactgaccaaggtggctatgctcatctgcgctggcttcctcatcgcgtggatcccgtatgcagtagttagcgtatggagcgccttcggtaggcccgacagcatccctatccagctgtcagttgtgcccacgctcctcgctaagtctgccgcaatgtacaacccgataatctatcaggtcatcgactacaagttcgcatgttgtcaaactggcggactgaaggctacaaaaaaaaagagcctggagggattccggctacacactgtgactactgtaagaaaaagcagcgctgtcctggaaatccacgaagaatgggagtag

SEQ ID NO: 28690 - DNA, 1140 bp, Artificial Sequence
  Description of Artificial Sequence: Synthetic coding sequence
atgtctgtcagaaccctaccgctccttttcctgaatctgggcggggagatgctctacattctggaccagaggctacgcgcgcaaaacataccaggggataaagcccggaaagtgctcaacgatatcattagcacaatgttcaaccgaaagttcatggaggagctatttaagccccaagaactgtatagcaagaaggctctacggacagtatacgagaggctggcccatgcctccataatgaagctgaaccaggctagtatggataagctttatgatctgatgacaatggcctttaagtatcaggtccttctatgcccacgtcccaaggacgtgctcctcgtgacatttaatcacttggacaccatcaagggctttatcagggactcacctacaatcttacagcaggtcgacgagaccctccgccagctaacggagatttatggagggctatcagctggcgaattccagctgatcaggcagacccttcttattttcttccaggatctccatattcgggttagtatgtttttgaaagacaaggtacagaataacaacggcagattcgtgctacccgtctcaggccctgtgccctgggggaccgaagtcccgggactgatccggatgttcaacaacaagggagaggaagtgaagagaattgagtttaagcacggaggtaattacgtgccggcccccaaagaaggctctttcgaactgtacggtgatcgagtactgaagctaggaacgaatatgtactccgtgaaccagccggtggaaacgcacgtgagcggctcctctaaaaatctggcgagttggacccaggaatctatcgcccctaaccccctggccaaggaggagctgaattttctggctcggttgatgggcggcatggaaataaaaaaacccagtggacccgagcccggttttaggctgaatctgtttaccactgatgaggaagaggaacaggccgcacttacccggccagaagaactgagttatgaagtcatcaacatccaggcaacgcaggaccagcagagatctgaagagcttgccaggattatgggggaattcgaaattacagagcagcctagactgagcacgagcaagggggatgatcttttggccatgatggacgaactttag

SEQ ID NO: 28691 - DNA, 1020 bp, Artificial Sequence
  Description of Artificial Sequence: Synthetic coding sequence
atgtcggtgcggactctgccccttctgtttttaaacttgggcggggagatgttgtatatcttggaccagagactgcgcgcacagaatatccctggagataaagcacggaaggatgagtggacagaggtggaccggaagagggtgctgaatgacattatatcgacaatgttcaaccgcaaattcatggaggaactgttcaagccccaggagctgtatagcaaaaaagcccttcgaacagtctacgagaggttagcacacgcctctatcatgaagctcaaccaggcatcaatggacaagctgtacgatctcatgacaatggctttcaaataccaggtgttgctgtgccctcgccctaaggacgtcctgctcgtgaccttcaatcacctcgacacaatcaaaggattcatcagggacagtcctacgatcctccagcaggttgacgagacactgcgtcaactgacggagatctatggcggtctaagcgccggagagttccagctgatacggcaaacattgctgatcttttttcaggatttacacatcagggtgtcaatgttcctgaaggataaagtccaaaataataacgggcggttcgtactgccagtctccggccccgtcccttggggtacagaggtgcctggtctcattcgcatgtttaacaataaaggtgaagaagtgaaaagaatagagtttaagcacggaggaaactatgttccagcccctaaggagggttcttttgaactatacggtgatagagtgttgaaactgggtactaacatgtacagcgtgaaccaacctgtcgagacccatgtgtcaggcagctccaagaacctggcaagttggacccaggagagcattgcccccaacccactcgctaaggaagaattaaactttttagcacgcctgatgggcgggatggaaattaagaagccatccggacctgaaccgggctttaggctcaatctcttcactacagacgaagagggggacgacctacttgcgatgatggacgaactgtag

SEQ ID NO: 28692 - DNA, 672 bp, Artificial Sequence
  Description of Artificial Sequence: Synthetic coding sequence
atgagtgtgcgcaccttgcccctcctgttcctgaatttggggggcgagatgctttacattctggatcagcgcctgcgagcccagaatatccccggcgacaaagcccgcaaggtcctgaacgatatcatatcaactatgttcaaccgcaagtttatggaagagctgttcaaaccccaggaactctatagcaaaaaggcgctccgaactgtctacgaaaggctggcccatgcatccatcatgaagctaaaccaagcctccatggacaagctgtacgatctcatgaccatggcctttaagtaccaggtgctactatgtccacggcctaaagatgtgctattggtgaccttcaatcatctcgatacaattaaggggtttatcagagacagcccaaccatcctgcagcaagtggacgaaacgctgagacaactcaccgagatttacggagggttatctgctggcgagtttcagctgatacgtcagaccttgctcatttttttccaggatctacacatccggcgagagtgcttctggaagcacatgcaagaaacagtgcatagcgcacagtgttgtctcccgggggtcggaaactatatggaggacaggagaagaagactgacatttcattatgtatacccatttgagaacttcgaattctgcacttgggctaaatag

SEQ ID NO: 28693 - DNA, 1170 bp, Artificial Sequence
  Description of Artificial Sequence: Synthetic coding sequence
atgagcgtgcgtacccttccactgctgtttttgaacttggggggcgagatgctgtacatcctcgatcagaggctgcgtgcacagaatatcccaggtgataaagcacggaaggacgagtggactgaggtggatagaaaacgcgtgttgaatgatatcatttccactatgttcaataggaaatttatggaggagctgtttaaaccgcaagagttatactccaagaaggccctccggacagtttacgaaaggcttgcccatgctagtattatgaagctgaaccaggcatcgatggataagttatacgacttgatgaccatggcattcaaataccaggtgctcctgtgtcccagacctaaggatgtgctgctagtgaccttcaatcatttggatactatcaaaggatttattagagactcacccaccatcctacagcaggtggacgaaaccctgagacagctcacggagatctatggcggcctgtctgccggcgaattccagctaatcagacagaccctgttgatattctttcaggacttgcacattagggtgagcatgtttctgaaggataaggtccagaacaataacggccgattcgtgctgcccgtctctggtcccgtgccctgggggacagaagttccaggactaattcgtatgttcaacaataagggcgaagaagtaaaacggatcgagttcaagcatgggggaaactatgtccctgctccaaaggagggcagcttcgagctgtatggggaccgagtgctcaaactgggaacaaacatgtattccgtgaaccagccggtggaaacgcatgtctcaggcagcagcaagaatctggcaagctggacacaggaatcaatcgcccccaaccccctggccaaagaagagttgaactttctggccaggctgatggggggaatggaaataaagaaacctagtgggcctgaacctggatttcgcctcaacctgttcaccaccgatgaagaggaagagcaagccgcgcttactcggccggaagagctgagctacgaagttatcaatattcaagcaacccaggatcagcagaggagcgaggagctggctagaatcatgggcgagtttgagataactgagcagccgaggttgtccactagcaagggggacgatctactcgccatgatggacgagttgtag

SEQ ID NO: 28694 - DNA, 1023 bp, Artificial Sequence
  Description of Artificial Sequence: Synthetic coding sequence
atggaacccggaaggacccaaataaaactcgatccccgatatacagcagacctgcttgaagtgctcaagacaaactatgggatcccttccgcctgtttcagccagccaccaacggcagctcagctcctccgagcattggggcccgtggagcttgccctgactagtatcttgacactgctggcactgggctccattgccatattcctggaagacgcggtgtatttgtataagaacaccctgtgccccataaagaggcgcactttactttggaaatcctccgcccctactgtggtgtcagtgttgtgctgctttggcctctggatcccgaggtctctggttctcgtggagatgaccattacttctttctacgccgtgtgcttctatcttcttatgctggtcatggtggaggggttcgggggaaaagaagcagtcttacggacgcttagagatacacctatgatggttcacaccggcccatgttgttgttgctgcccctgttgccctaggctattgctcacccgtaagaagctgcaactgctgatgctcggtcccttccagtacgcctttcttaagattacccttacactcgtgggcctttttttggtgcccgatggcatctatgaccctgcagacatttctgaaggtagcactgccttgtggatcaacacctttttgggggtgtcaaccctcctcgccttgtggaccctggggatcatttccaggcaggctcggctacatttaggcgaacagaacatgggggcgaagttcgccctgttccaggtattattgatactcacagcactgcaaccgagcattttcagtgtgctggccaatggaggccagattgcctgctccccgccatacagcagcaagaccagatcacaggtcatgaactgtcatctactaatactggaaacatttctgatgacagtgctcacacgtatgtactatagaagaaaggaccacaaagtgggatatgaaaccttcagctctccggacttggatttaaatctgaaagcatag

SEQ ID NO: 28695 - DNA, 387 bp, Artificial Sequence
  Description of Artificial Sequence: Synthetic coding sequence
atggagcactctgagggagctcccggcgacccagccggcaccgtggtgccccaggaacttttggaagaaatgctgtggttcttcagagtggaggatgcatcgccctggaaccatagcatcctggctctggccgcagtcgtggtcatcattagcatggttctgctcggcagaagtattcaggcttccaggaaagagaaaatgcagcccccagaaaaggagacccctgaggtgctgcacctcgatgaggctaaagaccacaatagcctgaataatctccgggagaccctgctatcggaaaagccaaaccttgctcaggttgagctcgaactgaaagagagagacgtactctcagtttttttgcccgacgttcctgaaacagaatcatag

SEQ ID NO: 28696 - DNA, 1245 bp, Artificial Sequence
  Description of Artificial Sequence: Synthetic coding sequence
atgttaatattgaccaagactgctggagtttttttcaaaccgtccaagcgcaaagtttatgagttcctgcgatcctttaactttcatcctgggacgttatttctacacaaaattgtgctgggcatcgagacctcctgtgacgacacagcagctgccgtggtagatgagactggcaatgtcctgggcgaggccatccactctcagactgaggtgcatcttaagactggtggaatagtgccccccgccgctcaacaactgcacagggagaacattcagcgcattgtgcaggaggccctctccgctagcggcgtttccccctccgatctctctgccattgctactacaatcaaaccaggcttggccctttccctgggggtgggattgtctttttcactgcagctggttggccagctgaaaaagccattcatacctatacatcacatggaggcacatgctctgaccatacgattaactaataaggtcgagttcccctttcttgtacttctgatatctgggggccattgcctcctcgcactcgttcagggagtcagcgactttctgctgctgggcaagagtctcgacattgctcctggtgacatgttagataaggtcgctcgcaggctgtcactcatcaaacacccagaatgttccacaatgtccggaggcaaggctatcgagcacctggctaagcaaggcaacaggtttcacttcgacatcaagccccctctgcaccatgccaaaaattgcgacttttctttcaccgggttacagcatgtgacggacaagatcattatgaaaaaagagaaagaggaaggcatcgagaaagggcagatcctctcttcagctgctgacatcgccgccaccgtgcagcacacaatggcctgccatttagtgaaacgcacacatcgtgctatattgttttgcaagcagagagacctattaccccagaacaacgcagttctggtggcatctggcggggttgcctccaacttttacattcgccgagcactggaaatcctcacaaatgccactcagtgcaccctgctgtgtcccccgccccgactgtgtacagataatggcataatgattgcctggaacgggattgaacgtctgcgtgccgggctgggcattctgcacgacatcgagggcatccgatacgagcccaagtgtcccctgggggttgatatctccaaggaagtcggcgaggcatcaattaaagtgccacagcttaaaatggagatatag

SEQ ID NO: 28697 - DNA, 669 bp, Artificial Sequence
  Description of Artificial Sequence: Synthetic coding sequence
atgttgattctgactaaaaccgctggcgtgttcttcaaaccatccaagcgtaaagtctacgaattcctccgaagcttcaatttccaccccgggactctgttcctgcataaaatcgtcctgggcatcgagactagctgcgatgacacagccgccgccgtggtggacgagaccggcaacgtgctcggtgaggctattcacagtcaaacggaagtgcatctgaaaacaggaggcattgtcccccctgccgctcagcagttgcacagggagaatatccagcgaatcgtgcaggaagctctgtcagcttccggggttagtcccagtgatctctccgccatcgcaacaacgatcaagcccggtcttgccctcagtttgggagtcggactgagtttttccctgcagctggtgggacagctcaaaaaaccttttatacctatccatcatatggaagctcacgcgctcacaattagactgactaacaaggtagagtttccatttctagtgctccttatcagcggggggcattgtctgctcgcattggttcagggcgtgtcagatttcctcctgttgggcaaatcactggacattgccccaggcgacatgctggacaaagtagcccggcgactgtctctgatcaaacacccagagtgtagtacgatgtccggcggctag

SEQ ID NO: 28698 - DNA, 612 bp, Artificial Sequence
  Description of Artificial Sequence: Synthetic coding sequence
atgctgatcttaaccaaaaccgcaggcgtcttttttaaaccctccaagcggaaagtgtacgagtttcttcggagctttaatttccatccgggaaccctgttcctacataagatagtgctgggtatcgagacaagctgcgatgatacggctgccgcagtggtcgatgagacgggaaatgttctaggggaggccattcacagtcagacagaggtccaccttaaaaccggtggaatagttccgccagccgctcaacaattacaccgggagaatatccagcgcatagttcaagaagccctgagcgcgtccggagtcagcccctctgatctttccgcaattgccaccaccattaagcccggtctcgccttgtcgctcggcgtgggcctgtctttttcacttcaactcgtggggcagctaaaaaaaccttttattcccatccatcatatggaagcccacgccttgaccattcgtttaacgaacaaggtagaatttccgttcctcgtacttcttatcagcggtgggcactgccttctggcccttgtgcagggagtaagcgacttcctgctgctggggaagtccctggatatcgcgcccggcgacatgctggataaatag

SEQ ID NO: 28699 - DNA, 1245 bp, Artificial Sequence
  Description of Artificial Sequence: Synthetic coding sequence
atgctgattctcacaaagacggctggcgtattcttcaagccttccaaacgcaaagtgtacgagttcttgaggagtttcaattttcaccctggcacactgtttctccacaagatcgtgctcggcatcgagaccagctgtgacgacacagctgccgcagtggtagacgagaccggcaatgtgttaggagaagccatccatagccagacggaggtgcacctaaaaacaggcggaattgtcccgcctgctgctcagcagttgcaccgggagaacattcagcgtatcgtgcaggaagccttgagtgccagcggcgtgtcaccgtcggacctgtcagccatcgcaacaacgatcaagcccggtctcgctttgtccctcggcgttggtctctctttctcactgcagctggtggggcagctgaagaagccgttcattcctattcaccacatggaggcccatgccctgacaattcgtttgaccaataaagtcgaatttccatttttggtcttgctgatcagcggtgggcactgtttactggctctggtccagggcgttagcgattttctccttctgggcaagtctcttgacattgccccaggcgatatgctggacaaggtcgccaggaggctcagcttgatcaaacaccccgagtgttcgactatgtctggcgggaaagctatcgaacacctggctaagcagggcaatagattccattttgatataaaacctccgctgcatcacgccaagaactgcgacttcagtttcaccgggctccagcacgtcacggacaagattattatgaaaaaggagaaagaagagggtatagagaaaggccaaattctgagttctgctgctgacattgctgctaccgtgcaacacacaatggcttgccatctcgttaaaagaacgcacagggctattctgttctgcaaacagcgggatctcctgccacagaataacgccgtgttagtggcctctgggggggtggcctcgaatttctacatccgcagagccctggaaattctgaccaatgcaactcagtgcacccttctgtgccccccccctagattgtgcaccgacaatggaattatgattgcttggaatgggattgagaggcttcgggctggactggggatcctgcacgatatcgagggcataagatatgaaccaaagtgcccattaggtgtcgacatctccaaagaagtgggggaagcaagtattaaagtgccacagttaaagatggaaatctag

SEQ ID NO: 28700 - DNA, 1689 bp, Artificial Sequence
  Description of Artificial Sequence: Synthetic coding sequence
atgagtgaggaactggctcagggcccaaaggagtctcctccagcgcccagagccggacctcgggaggtgtggaagaagggcgggcggctcctcagcgtactgctggccgtgaatgtgttactcctggcgtgcacactaatctctgggggagccttcaataaggtagccgtctacgacaccgacgtcttcgccctgctcacagcaatgatgcttctggcgacattgtggatactcttttatctattgagaaccgtccgatgtccatgtgccgtgccatatagggatgcacacgcgggaccaatctggctgcgtgggggtctggttctgtttggaatttgtactctgataatggacgtgttcaaaacggggtactactccagcttttttgagtgtcaaagcgccattaagattctgcacccactgattcaggccgtttttgtgatcatccaaacatattttttgtgggtgagtgcaaaggactgcgttcatgtccacctggatttgacttggtgcggtcttatgtttaccttgaccactaacctggctatttggatggctgctgtggttgatgaatccgtccaccagtcccattcatacagcagtagccactcaaatgcaagtcatgctcgccttatctcagaccaacacgccgacaatccagttgggggggactcttgcttgtgttcaaccgcggtctgtcaaattttccagcagggatatttttacctgtatccctttaatatagagtattccctctttgccagcacgatgctgtatgtgatgtggaaaaatgttggacggttcttggcaagtacccctggccacagtcacacacccacacctgtctctctgtttagagagacgttcttcgctggccccgtgctgggtttgttacttttcgtggtcggcctcgctgtgttcatcatttatgaagtccaggtgtcaggtgatgggtctcgcactagacaagcactagttatctattactctttcaacattgtttgtctggggttgacgaccttagtgtctctttctgggagcataatctacagattcgacaggagagcaatggatcatcacaagaacccgacgcgtaccctcgacgttgctcttctgatgggagctgcattggggcagtatgcaataagctactatagcatagtggcggtggtcgctgggacccctcaggatctcctggcaggattaaatctaacccatgccctcctgatgatagctcaacatacttttcagaatatgttcataatagaatccctgcaccggggacctcccggagccgaaccgcattccacgcatcccaaagagccttgccaggacctcacattcacgaacctcgacgccctgcatacattgtcagcctgtccgcccaatccagggttggtctcccctagcccctcagaccagcgcgaagcagtggccatcgtgagcacacccagaagccagtggcgcagacagtgtctgaaagatatctcacttttccttctgttgtgcaatgtgattttatggatcatgcctgcgttcggggcaagaccccacttctctaacactgttgaggtagacttttatggctactcactgtgggcggtgatcgtaaatatctgtctcccgtttggaatcttttaccgaatgcacgcagtatcctcactactggaagtgtacgtgttaagctag

SEQ ID NO: 28701 - DNA, 1791 bp, Artificial Sequence
  Description of Artificial Sequence: Synthetic coding sequence
atggggaggggggccagagcggcagctgctcagtccaggtggggtagagcttcgagggcgtccgtttctcctgggagaaccattaggagcgcgccagctgtgggagaagcccaagaaaccgaagccgcccccgagaaggaaaacagggtcgatgtaggagcagaagaacgtgccgccgccaccaggccacgtcagaagtcatggctggtgagacacttcagcttattactaagacgagatcgacaggcccagaaagcaggccaacttttctcaggactcctggcgctcaatgtggtcttccttggaggcgcattcatctgttcaatgatattcaataaggtggcagtgacactcggcgacgtttggatccttctcgctacactgaaagtcctctcactgctgtggcttctttattacgtcgccagcacaacacggagaccacacgctgtactgtatcaggatccccacgctgggcctttgtgggtacgagggtcattggtcctattcggttcctgcaccttttgcctgaatatctttcgggttggctacgatgtgtcacacatcagatgcaagagccagctggatctggtcttttcagtgatcgagatggtatttattggagttcagacatgggtgctctggaagcattgcaaggattgtgtcagggtacagacgaattttactcgctgtggtctgatgttgaccctcgcaaccaacttactgctctgggtgctggccgtcacaaatgattcaatgcacagggagatcgaggctgagttggggatcctcatggaaaagtcaacaggcaacgagaccaatacctgcctgtgtttgaacgctactgcttgcgaggcttttaggcggggatttcttatgctttacccattttccaccgagtattgtcttatctgctgcgccgtgctgttcgttatgtggaagaacgttggccgtcacgtcgcaccacacatgggcgcgcaccctgccaccgccccctttcacctgcatggggcgatttttgggccactcctcggcctcctggttctgctggccggcgtgtgtgttttcgtgctcttccaaatcgaggccagcggtcctgctatagcttgtcagtatttcaccctgtattatgccttttacgttgctgtcctcccaactatgagcctcgcttgcttggcaggaacagccatccacggcctcgaggaacgggagctcgatactgttaagaatccaactcggtccctggacgtagtcctgctgatgggcgccgccctcggccagatggggatcgcatactttagcattgtcgccatcgttgcgaagcggccacacgagctcctgaacaggctgatcctcgcctactccctgctgttgattttgcaacacattgcccaaaatctgtttattatcgaggggctccaccggagacccctgtgggaaactgttcccgagggactggccggaaaacaagaggccgagcctccgagacgcggctcactgctcgaactgggccaaggacttcagagggcatcactggcttacatacattcttattcacacctgaattggaagcgcagagcactaaaggagatctctctgtttctaattctctgcaacatcacactgtggatgatgcctgcctttggtatccaccccgagtttgaaaacggtctagaaaaggacttctatggctaccagatctggtttgctatcgtcaacttcgggctgcccctgggggtgttctatagaatgcactccgtgggcggtctggttgaagtgtatctgggggcctag

SEQ ID NO: 28702 - DNA, 939 bp, Artificial Sequence
  Description of Artificial Sequence: Synthetic coding sequence
atggcctgcgccgcggtgatgatccctggactgctgcggtgtagcgtcggggccattaggatcgaagctgccagcctccggctcacactgtcaactctcaggcacttaacactgacttccatcatgaaaagcaagaggaagacagatcacatggaaaggactgcaagcgtcttacggagggaaattgtttcagccgctaaggtgtgcggcgcagccagtgaatcaccgagtgtaaagagcctgcgccttctggtggccgaccaggatttttccttcaaagccggccagtgggtagatttcttcattccgggcgtgtcagtagtgggcggtttcagtatctgcagttcgcccagactgctggaacaggagagggtcattgaactggccgtcaaatacacgaatcacccacctgcactttgggtacacaacacgtgcaccttggattgtgaagttgcggtgcgggttggaggagaattctttttcgacccccagccagccgatgcttcaagaaacctggtactcatcgcaggcggtgtaggtattaatccccttctaagcatcctgagacacgctgccgacctcctgagagagcaggccaacaaaaggaacggatacgaaattggaacaatcaagttgttctactccgccaaaaacacttccgaactcctttttaaaaaaaacattttggatttggtgaacgagtttcctgaaaagatcgcctgttctctgcacgtgaccaagcagacaacccaaattaacgctgaattgaagccttatattacagagggtcgcatcactgagaaagagatccgcgaccatatctcgaaggagacactattttacatctgtgggccgccccccatgacagatttttttagtaaacagctggagaacaaccatgtgccgaaagagcatatctgcttcgagaaatggtggtag

SEQ ID NO: 28703 - DNA, 486 bp, Artificial Sequence
  Description of Artificial Sequence: Synthetic coding sequence
atggcctgcgccgccgtgatgatcccagggctcctgcgttgctcagttggcgctattaggatcgaggccgcaagtctccgtctgaccttgtccaccctcaggcatctgactctcacctcaatcatgaaatcgaaacgcaagaccgaccacatggagcgtacggccagtgtgctgagacgcgaaatagtgagtgccgcaaaggtatgcggagcggccagcgaaagcccaagcgtaaagtcactgagacttctcgtagcagatcaggacttttcatttaaagccggtcagtgggtcgactttttcatcccgggggtgtcggtcgtgggaggctttagcatctgtagcagcccacgtctgctggagcaggagcgggtcatagaactcgctgttaagtataccaaccaccctccagccctgtgggtccacaacacatgcactctggattgtgaggtggcagtacgggtgggaggtgagttcttcttttag

SEQ ID NO: 28704 - DNA, 993 bp, Artificial Sequence
  Description of Artificial Sequence: Synthetic coding sequence
atgaccccaaagatcagttggacatctaaattctctgtctgcccagagtctgccatggcttgcgctgctgtcatgatcccaggcctgctgcgctgctcagtgggggcaataaggattgaggcggcaagcctacgactcaccctgagcaccctaagacatctaacactcacctccattatgaaatctaagcggaagaccgatcatatggaacggaccgccagcgtgctccgtagagagatagtatccgctgctaaagtctgcggcgccgcttcagagagcccctccgtgaaatcattgaggctacttgtcgccgaccaagatttttcttttaaggctgggcaatgggttgacttttttatacctggtgtctctgtagtgggaggcttctcaatctgctctagcccacgcttactggagcaagaacgcgtgatcgagcttgccgtcaaatatacaaatcatccacccgctctttgggtgcataacacatgcaccttagactgtgaagtcgcagtcagggtgggcggagaattctttttcgacccacaaccggcagatgcttccaggaacctggtactgatcgccggaggtgtaggcattaacccccttctctctattcttagacatgccgctgaccttctgcgggagcaggcgaataaaaggaatggctacgagatcggcacaattaagctgttttattctgctaaaaacacctctgagcttctctttaagaagaatatcttagaccttgtgaatgaatttcctgagaaaatagcctgttcacttcacgtgactaagcagaccactcagatcaacgcagagctgaagccatacataacagaaggcagaattacggaaaaggagattagggatcacatatccaaggagacactgttttacatttgcgggccccctcctatgacagactttttcagcaaacagctggaaaacaaccacgtgcctaaagaacacatatgttttgaaaaatggtggtag

SEQ ID NO: 28705 - DNA, 1272 bp, Artificial Sequence
  Description of Artificial Sequence: Synthetic coding sequence
atgctgtgccacagggggggccaactgatcgtcccgataattccactttgccccgaacattcctgccgaggacggcgcctccagaatctcctttcaggcccatggcctaaacagccgatggagctccataacctttcgtccccctctccttcgctctccagctccgttctccctccatccttcagcccctcgcctagctctgcaccatctgcattcacgacggtgggaggctcttccggcgggccctgtcaccccacgtcttcctctttggtaagcgcattcctggctcccatcctggcccttgagtttgttctcggattagttggtaactccctggctctcttcattttttgcattcacactcggccttggacgagcaacacggtgtttttggtaagcttggtggctgccgacttcctcttgatctccaacctgccgctccgagttgactactaccttctgcacgaaacttggcggttcggagccgccgcctgtaaagtgaacctgttcatgctatccacaaacaggactgctagcgtggtctttctgactgccatcgccctgaatagatacctcaaggtggtccaacctcaccatgtgctgtcacgggccagcgtgggcgccgccgccagagtggctggtggcctgtgggtgggaatcctgctgctgaatggtcatttactgctttctactttttctggtccttcatgcctatcatatcgggtgggaaccaagccttctgcttcactaagatggcatcaggccctttatttgttggaatttttcttgccccttgccttaatactgtttgccatcgtcagcatcggtctgaccattaggaaccgaggtctgggaggacaggccggcccccaacgcgccatgcgagtgctggcaatggtcgttgctgtctatactatatgctttctaccctcaattatttttgggatggccagcatggtggctttttggctgagcgcatgcaggtctctagatctctgcactcaattgtttcatggttctctcgcgttcacatatttgaacagtgtcttagatcccgttctgtactgcttcagtagtccaaactttctgcaccaatcaagggcgctcctgggcctcacgaggggtaggcagggccctgtcagtgatgagagcagctatcagccctcgcgccaatggcggtatcgggaagctagccgtaaagcagaggctatcggtaagctgaaggtgcagggggaagtatccttagaaaaggaaggctcctcacagggttag

SEQ ID NO: 28706 - DNA, 1014 bp, Artificial Sequence
  Description of Artificial Sequence: Synthetic coding sequence
atgaatgagcctcttgattatctggctaatgccagcgactttcccgactacgcagcggcattcggcaattgtactgacgagaacattcctctgaagatgcactaccttccagtgatttacgggatcatttttctggtggggtttcccggtaatgcggtggttatttccacttacatcttcaagatgcggccctggaaatcgtcgaccatcatcatgttgaacctggcttgtactgacctattgtaccttacatcgttgccttttcttatccactactatgcctccggcgaaaattggatctttggggattttatgtgtaaattcatccgtttttctttccattttaacctttattccagcattctttttctcacttgcttctcaatcttccgttactgtgtgatcatacacccaatgtcttgtttctcgattcataagacccgctgcgccgtggtggcctgcgctgtcgtgtggattatatcactggtagcggtcatccccatgacttttttgataacttctaccaatcgaacaaacagatcggcgtgcctggatcttactagcagtgatgagttgaacaccatcaaatggtataacctgattctcacagcaacgaccttctgcctcccattagtcatagtgacgttgtgctacacgacgataattcacactctgacccatggcctgcagactgattcatgtctaaagcaaaaggccaggcgacttaccattctgctgctgctggccttctatgtgtgtttcctgccttttcatatactcagagtgatcagaattgagagccggctgttatcaatctcatgtagcatcgaaaaccaaattcacgaggcttatatcgtctctaggcccctcgcagcactcaacacttttggaaatttgctcctgtatgttgtagtgtccgataacttccaacaggcggtgtgcagcactgtccgatgtaaggtatcaggcaatctcgaacaagccaagaagatttcctattccaacaacccatag

SEQ ID NO: 28707 - DNA, 189 bp, Artificial Sequence
  Description of Artificial Sequence: Synthetic coding sequence
atgaatgagcctctggactacctggcaaacgcatccgacttccccgattacgcggcagcctttgggaattgcactgatgaaaatatccctctgaaaatgcactacttgccagtgatttacggcattatattcctggtgggcttccctggaaatgcggtagtcatttcaacttatatttttaaaatgtag

SEQ ID NO: 28708 - DNA, 210 bp, Artificial Sequence
  Description of Artificial Sequence: Synthetic coding sequence
atgaacgagccacttgactatctagcgaacgcttccgatttcccagattatgctgctgctttcggcaattgtactgacgaaaacattccactgaaaatgcactacctgcctgtgatttatggcatcatatttctggtaggctttccagggaatgccgttgttatttctacatatattttcaaaatgcgcccatggaagtcaagcacgtag

SEQ ID NO: 28709 - DNA, 1014 bp, Artificial Sequence
  Description of Artificial Sequence: Synthetic coding sequence
atgaacgaacccctggactatctggctaatgcctccgacttcccagattacgcagcggcattcgggaattgtacggacgagaatatccctttgaagatgcactaccttccagtaatttacgggattatttttctcgtcgggtttccaggcaatgccgtagttatcagcacctatatcttcaagatgagaccatggaaatctagcactattatcatgctcaatctcgcctgcaccgatctcctttatcttaccagcctaccgttcctaatacactattacgcttccggggaaaactggattttcggcgacttcatgtgcaaattcatccgcttctcattccactttaatctgtactcttccatcctgtttcttacctgttttagcatctttagatactgcgtgataatccacccgatgtcttgcttctcaattcataagacacggtgtgcagtggtcgcctgcgctgtagtgtggatcattagccttgtcgctgtgataccaatgactttcctgattacctcaaccaatcgaacaaatcgctctgcctgcctagatctcacgagcagtgatgagctgaatactattaagtggtataatttgatactgaccgcgacaacattctgtctgcctctcgtaattgttactctctgctatacaacaataatccacacactgacccatggactgcagacagattcgtgtctgaagcagaaggcaagaaggctgaccatcctattactacttgccttctatgtctgtttcctcccatttcatatcctgagggttatccggatagagtcccgactgctctcaatctcttgtagcatcgaaaatcaaatccacgaggcctatattgtttctaggcccctcgctgctctcaatacattcggcaatctcctgctctacgtcgtggtctcagataatttccagcaggccgtgtgctccaccgtgcgatgcaaggtttctggaaatctcgagcaggccaaaaaaatttcatacagcaacaatccttag

SEQ ID NO: 28710 - DNA, 3033 bp, Artificial Sequence
  Description of Artificial Sequence: Synthetic coding sequence
atgtcccagcttaggctgcttccctcacgactcggcgtccaagccgctcggttactcgctgctcatgacgtccccgtctttgggtggcggagtcgctcctctggcccacctgcgacattccccagttccaagggggggggcgggtcttcatacatggaggaaatgtactttgcctggctagagaacccacagtctgtccacaaaagctgggattccttcttccgggaagcatcagaggaagctttttctggctccgcccaacctcggccaccttcagtggtgcatgagtctcgctctgctgtttcctctcggaccaaaaccagtaagctcgtggaggaccacttggccgtgcaatcactcatccgcgcttaccagataagggggcaccacgtcgcacagctggatccactgggaattctggacgctgacctcgattcatttgtcccatccgaccttataaccactattgataagctggcattttatgatctccaagaggctgacctggacaaagaatttcaacttcctactacgacattcattggaggctcagaaaatacgctgtctctccgcgagatcatccggcgactcgaaaatacctactgtcagcatataggcctcgaattcatgttcattaatgatgtggagcagtgtcagtggatccgacagaaatttgagacacctggtgttatgcagttttcttctgaggagaaaagaactctactggcccgcctggtacgatctatgcgcttcgaggatttcttagctcgcaagtggtccagtgagaagcggtttggcttggaggggtgtgaagtcatgattccagctctgaaaaccatcatagacaagagcagtgaaatgggcatcgaaaatgtgatactgggcatgccccaccgcggaagactcaatgtgctggcgaacgttattcgcaaggatcttgagcagattttttgtcaatttgacccaaaactggaagccgctgacgagggctctggcgatgtgaaatatcacctggggatgtatcatgaacgcattaatcgtgttaccaacagaaacataacccttagcttggtggcaaatccaagtcacctggaagcggttgacccagttgtccagggcaaaacaaaggctgagcaattctatcgaggcgacgctcaagggaagaaggtaatgagtatactggtgcatggagacgccgccttcgccggccagggcgttgtatacgagacattccacttgtccgacctgccctcttatacaacgaatgggaccgtgcacgtcgtggtcaataaccagataggattcaccaccgaccccagaatggccaggagcagcccatacccgaccgacgtagcaagggtcgtgaacgctccaatcttccacgtgaatgccgacgacccggaggccgtaatttacgtgtgttcagtggcagctgagtggcgaaacacgtttaataaagatgtggttgtggatctggtgtgttatcggcgaagaggccacaacgagatggacgaaccgatgttcacacaacccctaatgtacaaacagatacaccgccaggtgcctgttctgaagaagtacgcagataagctgattgccgaaggcaccgtgacgctgcaggagttcgaagaagaaattgccaagtacgatagaatctgcgaggaggcctatggacgcagcaaagataaaaaaatactccacatcaagcactggctagactccccatggccagggttcttcaatgttgatggcgagcctaagagcatgacgtgtccagccactggcatcccagaggatatgttaactcatataggttccgtagcctcatcggtccccctggaggactttaagatccacacggggttgtcgcgaattctgagaggccgcgctgacatgaccaagaataggacagtggactgggcgctggccgagtacatggccttcgggtccctgctgaaggaaggtatccacgtgcgcctgagcggtcaagatgtggagagagggaccttttcacaccggcaccacgtgttgcatgaccaggaagttgatagacgcacatgcgttccgatgaatcatctctggcctgaccaggcaccatacaccgtgtgcaactcatccctctcggagtatggagtgctgggcttcgaactaggatacgctatggcctcacccaacgccttagtcctgtgggaggctcagttcggagacttccacaacactgcccaatgcatcatcgatcaatttatttctacagggcaagctaagtgggtgcggcataatggcatcgtcctgctgctgcctcacggaatggaggggatgggacccgaacactcctctgctagaccagagcgctttctgcaaatgtccaatgacgattctgatgcatacccagcctttacaaaagattttgaggtgtcacagttgtacgactgtaactggatagtggttaactgttcaacccctgcaaactattttcacgttctgagacgccagatcctcctccctttcaggaaacccttaattatattcacacctaaaagtctccttagacatcctgaggccaaatcatcattcgatcagatggtatctgggaccagtttccaaagggttatacccgaggatggggcggcagctcgtgccccagagcaggttcagaggcttattttctgcacaggcaaggtgtattacgacctcgtgaaagagcgatcaagtcaggatcttgaagagaaagttgctattacgcggttagaacagatctcccccttcccttttgatctcatcaagcaggaagcagaaaaatacccaggtgccgaactggcttggtgccaggaggaacataagaatatgggttactatgactacatatcaccccggttcatgactattcttcgccgggcgcggccgatttggtacgtcgggagagatccagccgccgctcctgctaccggcaacaggaacacccatctcgtatctctgaaaaagtttttagatacagccttcaatttgcaagcattcgagggaaagacattctag

SEQ ID NO: 28711 - DNA, 2862 bp, Artificial Sequence
  Description of Artificial Sequence: Synthetic coding sequence
atgtctcagctgagactgttaccaagccgtctcggggtccaggctgcacgactgctcgctgctcatgatgtgcccgtcttcggatggcgcagtagatctagcggcccacccgcaacctttccgagtagtaaaggagggggcggcagcagttatatggaggagatgtacttcgcatggctcgaaaatcctcagtccgttcataagatccgtggtcaccatgtggcccagttagaccctctgggaatactggacgcagaccttgattcatttgtaccaagcgatctgatcacaactattgataagctggctttttacgatctgcaggaggccgatctcgataaagagttccagctgcccactacaacttttatcggcggaagcgaaaacacactatccctccgagagatcatacgaagattagaaaatacgtattgccagcatattggactagaattcatgttcattaatgatgtggagcagtgccaatggatcaggcagaaattcgagacaccaggcgtgatgcaattcagtagcgaagagaaacgaacactcttggctaggttagtgcggagtatgcgctttgaagacttcctggctagaaagtggtcctctgaaaagcgatttggtttggaagggtgcgaggtaatgatccccgcattaaaaacaatcattgataagtcttccgaaatgggaatcgagaacgtgatcttaggtatgccccatagagggcgcctcaatgtattagccaacgtgattcgcaaggacctcgaacagatattctgtcaattcgaccccaagttggaggccgctgatgagggtagtggagacgttaaataccacctcggtatgtaccatgaaagaattaaccgagtcaccaatcgtaacatcactttatcactcgtggctaaccccagtcatctggaggccgtggatcccgttgtgcagggaaagacaaaggcagaacagttctaccgcggcgacgcccaaggcaagaaagtaatgagcatccttgtgcacggtgacgccgcgttcgctggtcagggagttgtgtacgaaaccttccatctctccgatctcccctcctatacaaccaatggcactgtgcatgtggtggttaacaaccagatcggatttactacagaccccagaatggctcgttcctcaccttatcctacagacgtggctcgcgtggttaatgctcccattttccatgttaatgctgacgaccctgaagctgtgatctatgtgtgttccgtagctgccgagtggcggaacacattcaataaggacgtcgtggtggatctggtctgctacagaagacgtggtcacaatgagatggacgaaccaatgtttacccagccgttaatgtacaagcaaatacatcgacaggtcccagtcctcaaaaagtacgctgataagctgatcgccgaaggaacagtgactttgcaggaatttgaggaggagattgctaagtacgatcggatctgcgaggaggcatatggcaggtccaaggataagaagatcttgcacattaaacactggctcgacagcccttggcctggcttcttcaacgtggatggtgagcctaaatctatgacctgccctgcaacagggattcctgaggatatgttgactcacataggcagtgtagcttcgtccgtccccctggaagactttaagatccacaccggcctgtccagaatacttcgtgggagagctgacatgaccaagaataggacggtggattgggctttagctgagtacatggccttcggcagtttactcaaggagggcattcacgttcggctgagcggtcaagacgtggaacgcggaacgttttctcataggcaccatgtgttacacgaccaagaggtcgatagacggacatgtgtgcctatgaatcacctgtggccagaccaggcaccctacaccgtgtgtaactcttcactgagcgagtatggagttctgggcttcgaactgggctacgcgatggccagtcccaacgcactggtcctttgggaagcccaatttggggatttccataatactgcccaatgcattatagaccagttcatatcaacaggtcaggcaaagtgggtgcgccataatgggatagttctgctactgccccatggcatggaaggcatgggccctgagcactcctcagctaggcccgaaaggtttctacaaatgtcaaatgatgacagtgacgcttaccctgcattcaccaaggactttgaagtctctcagctgtacgactgcaactggatagtcgtgaactgtagtacacctgcaaattatttccacgtgcttagacggcaaattctcctcccatttagaaagccccttataatcttcaccccaaaaagcttactcagacaccccgaggccaaaagtagctttgaccagatggtgtctggcacgagtttccaacgggtgattcctgaggacggtgctgcagctcgggctcctgagcaggttcaaagattgatcttctgcacaggtaaggtgtattatgaccttgtgaaggagaggtcctcccaggatttggaagaaaaggttgccattacaagattagagcagatatctcccttcccgtttgacctcatcaagcaggaggcagaaaagtacccaggtgcagagctcgcatggtgccaggaggagcacaaaaatatgggctactacgactacatctcaccgcgcttcatgaccattctgcgacgcgcaagacccatctggtatgtgggcagggacccagcagctgcacctgctacaggcaaccggaatacgcacctggtgtccttgaagaagtttttggatactgcattcaatttgcaagcctttgaggggaaaaccttctag

SEQ ID NO: 28712 - DNA, 2406 bp, Artificial Sequence
  Description of Artificial Sequence: Synthetic coding sequence
atgtttattaatgacgtggaacagtgtcagtggataaggcaaaagttcgagacacccggggttatgcagtttagcagtgaggaaaagcggacgcttctggctagactggtacggagcatgagattcgaagatttcctcgctcgtaagtggtcctccgaaaagcgatttggtttggaaggatgtgaggtcatgatcccagcgctgaaaaccatcatagataagagttccgaaatggggattgagaacgtgatattaggtatgccgcaccgcgggcggctgaatgtgctagcaaacgtcataaggaaagatctagagcagatattctgccagttcgaccccaaactcgaggcagcagatgaaggcagcggcgatgtgaagtaccacctgggtatgtaccatgagagaatcaacagggttacaaataggaatattacactctctcttgtcgccaatccctcacaccttgaagcagtcgatcccgtcgtccagggaaagacaaaggccgagcaattttataggggggacgcgcaggggaaaaaggtgatgtctatcctggtgcatggcgatgctgcctttgcaggacaaggtgttgtctacgaaacatttcacctctccgatttgccttcctataccacaaacggaactgtccacgtggtcgttaataaccaaattggctttactacggaccccaggatggcccggagctcgccatatccaactgatgtagctcgtgtagtgaatgcgccaatctttcacgttaacgcagatgatccagaagcagtaatctacgtttgtagcgtggctgcagagtggcgtaacacttttaataaggacgtagtcgtcgacctcgtgtgttaccgacggcgcggacacaacgagatggatgagcccatgttcacacagcccttgatgtataagcagatccaccgacaggttcctgttctgaagaaatatgctgacaagctgatcgcggaggggacagtgacgctccaggagttcgaggaagagatagctaagtatgacaggatctgcgaagaagcttacggcagatcgaaggacaagaaaatcctgcatatcaagcattggctggacagcccttggcctgggttttttaatgtcgatggagagcccaagagcatgacatgccctgccacaggtattccagaggatatgttaacccatattggatccgtggcctcatctgtgcctctagaggattttaagattcatactggactgtccaggattctgaggggacgcgcagatatgactaagaacaggaccgttgattgggccctggcagagtatatggctttcgggtctctgttgaaggagggtatacacgtcagactctcagggcaggacgtagaacggggcactttcagccaccgacatcatgtgctacatgaccaagaagtagatcggagaacctgtgtccccatgaatcacctttggcctgaccaagccccgtatacagtctgcaactctagcttgagcgagtacggagtgctgggcttcgagttagggtacgccatggccagtcccaacgctctagtgctgtgggaggcccagttcggcgattttcataatacagcccagtgtatcattgaccagttcatcagtaccggccaagccaagtgggtgcgccataatggcattgttctactactgccccatggtatggaggggatgggccctgagcactccagcgcccgcccagaaagattccttcagatgtccaacgacgatagtgacgcttacccagctttcaccaaagactttgaggtgtctcagctgtatgattgcaactggatcgtcgtgaactgttcaaccccggcgaactacttccatgtgctcagacgccagatcttgctcccatttcgcaaaccacttattattttcactcccaagtcactcctgcgacaccctgaggctaaatcttctttcgaccagatggtgtccggcacatcttttcagcgcgtaatcccagaagatggcgcagccgcaagagcccctgaacaggtccaacgactgatcttctgcaccggcaaagtgtactatgacctcgtgaaggagcgatccagccaggacctcgaggagaaggttgcaatcacaagattagagcagatctccccctttcccttcgatcttatcaaacaggaggcagaaaaatacccgggagctgagctggcatggtgccaggaggagcataaaaacatggggtattacgactatataagtccgagatttatgacaatcttacgacgggcacggcccatttggtacgtggggagggacccagccgcagcacccgctaccggcaataggaacactcatttagtgagtttgaaaaagttcctagacaccgcctttaatctccaggcatttgaaggcaaaactttttag

SEQ ID NO: 28713 - DNA, 2160 bp, Artificial Sequence
  Description of Artificial Sequence: Synthetic coding sequence
atgtttggtaagaagaaaaaaaaaatagagatctccggtccttcaaacttcgagcaccgcgttcacacgggattcgacccacaggagcagaagtttacaggcttgccccagcagtggcatagcctgctggcggacactgccaatagacctaagcccatggtcgacccatcctgcatcacccctatccagcttgcccctatgaagaccatcgttcgcggaaacaagccttgcaaggagacgagcataaatggactgctggaggactttgataatatctctgtgactaggtccaacagcctccggaaggaatcacctcctacacctgaccagggcgcatcttctcacgggcccgggcacgccgaggagaatgggttcatcacattctcacagtatagttccgaatcggataccactgccgattacacaaccgagaaataccgggagaagtctctgtacggcgacgacctggatccttattatcggggaagccacgctgcgaaacagaacggccacgtcatgaagatgaagcacggagaggcatactatagtgaagtgaaacctctcaaatctgacttcgcccgtttttccgctgattaccactcacacctggatagcctgagtaaaccttctgaatacagcgatcttaaatgggagtatcaacgagccagctcaagctcccctctcgattatagtttccagtttaccccctctcggaccgcaggcacaagcggctgtagcaaggagagcctcgcctactcggagtcagagtggggcccatccttggacgattacgataggaggcccaaaagttcctacttgaaccagacgagcccacagcctacaatgagacaacgaagcagatccggctcagggctgcaggaacccatgatgcctttcggagcttctgccttcaaaacacatccccagggccatagctataacagctacacgtaccctcgcctgtctgagcccacaatgtgcatccccaaggtggattacgacagggcacagatggtgctgagccctccattgtccggaagtgacacctacccgcgtggtcccgcaaagctgccccagagtcagtccaaatctggttactcctctagttcccatcaatacccttcaggctaccacaaggccacactgtaccaccatccttccctgcagagcagtagccagtatatatcaactgcttcatacttgtcctccctttccctctcctcttccacctaccccccaccctcctggggctccagcagcgaccagcaaccatccagggtgagtcacgagcagtttagggccgcgctgcagctggtcgtttctccaggcgatccacgggaatacctcgcgaatttcatcaaaataggcgagggcagcacgggtatcgtatgcatcgccactgaaaagcatacaggcaagcaagtagccgtaaagaagatggacctgcgcaagcaacaacgccgcgagctgctttttaacgaagtggttatcatgcgcgactatcatcacgataacgttgtggatatgtatagttcatacctggttggcgacgagctgtgggtggtgatggagttcctcgagggaggggctctgactgatattgttacacacactagaatgaacgaagagcagatcgccacagtgtgcctgtccgttcttcgtgccttaagctacctccacaaccaaggggtgatccatagagatatcaaatctgactccattctcttaacttccgatggaaggattaagttgagcgattttggtttctgcgcacaggtatcaaaggaagtcccaaagcgtaaatcgctcgtagggacaccctactggatggctcccgaagtgatttcaagactgccctatgggactgaggtcgacatatggagcctgggcattatggtgatcgagatgatagacggtgagcccccctacttcaacgagccccctctgcaggcaatgaggcgcatccgtgacagcttgccaccgagagtaaaagatttacataaagtctcctctgtactacggggcttcctagatttgatgctggtgcgcgaaccttctcaacgcgctacagcacaagaactgctgggccacccgttcctgaagctggccggacctccctcgtgcattgtgccactgatgcgacaataccgccaccactag

SEQ ID NO: 28714 - DNA, 2160 bp, Artificial Sequence
  Description of Artificial Sequence: Synthetic coding sequence
atgtttggcaagaagaagaaaaagatcgagattagtggccctagtaatttcgagcaccgggtgcacactggatttgatccacaggaacagaagttcaccggcctgccacagcagtggcacagcttactggctgataccgcgaaccgcccaaaacccatggtagatcctagttgcataaccccaatccagttggcacccatgaagaccatcgtccggggcaataagccttgcaaagaaacgtccataaacggtctgctggaggactttgacaatatcagtgtcacccggagcaatagcttgcgcaaggagtcgccacctacccccgaccaaggagcgagttctcacgggcccggccacgctgaagagaatggatttattactttctcacaatatagcagtgagtcagacacgaccgccgattacactacagaaaagtatcgggagaaatcgctctatggggacgatctggacccatactacagaggtagtcatgccgctaaacagaacggacatgtgatgaaaatgaagcatggcgaggcttactacagcgaggtgaagcctctgaaatcggattttgctcgatttagcgcggattaccactctcacctggactccctcagtaagccctcagaatactctgacctgaagtgggagtatcaacgcgcctcctcctcttctccactggactatagctttcagtttaccccgtcacggacggcaggcacgtccggctgcagtaaggagagccttgcctactcagagagcgaatggggaccttcactggacgactatgacaggcgaccgaagtcttcctatctgaatcagacttccccacagcctacaatgaggcagagaagtcgttccggaagtggcctgcaggagcccatgatgcctttcggggctagcgcattcaagacacacccacagggacactcatacaacagctatacgtacccccgcttgtcagagcccaccatgtgtatacccaaggttgactacgacagggcccaaatggtcctctcgcctccactgtcaggcagtgacacatacccacgcgggcctgctaagttgccccagagccaaagcaagagtggatactccagctccagccaccaatacccttcaggatatcacaaagcgacattgtatcaccacccgtctcttcagagttcctcacagtatatctccaccgccagctacctgagcagtctgtcactgtcatcctctacctacccacctccttcctgggggtccagttctgaccagcagccaagtagagtaagtcacgagcagtttagagccgccctccagttggtggtttcgcctggggaccctcgcgagtaccttgccaattttattaagattggggagggaagtacaggaatcgtatgtatcgcaactgagaaacataccggaaaacaggtcgccgtcaagaagatggacctgcgcaagcagcagaggcgggagctcctgttcaacgaagttgtgattatgcgcgattatcaccacgacaatgtggtggatatgtattcatcctatctggtgggtgacgaactgtgggtcgtcatggagtttctggaggggggtgcgctgacagatatcgttacgcacacacgcatgaacgaagaacagattgctaccgtgtgtttatccgtcctgcgggccctgtcgtatctccataaccagggggtgattcacagggacatcaaaagcgattccatcttactgacaagcgacggtcgcattaagttaagtgacttcgggttctgcgcacaagtttccaaggaagtccccaaaagaaagagcctcgtcggtacaccatattggatggcgccagaggtaatctcccggctgccatatggaaccgaagtggatatctggtccctgggtattatggtcatcgagatgatcgacggggaacccccctacttcaatgagccccctctgcaggcaatgcgcaggataagggatagtttgcccccacgcgtgaaagatctccacaaagtctccagtgtgctcagaggcttcctcgacctgatgctcgtacgggaacctagtcagagggctaccgcgcaggaactcttagggcaccccttccttaaactggccggtccccctagttgcatcgttcccctcatgcgccagtacagacaccattag

SEQ ID NO: 28715 - DNA, 2160 bp, Artificial Sequence
  Description of Artificial Sequence: Synthetic coding sequence
atgtttggcaagaaaaaaaagaagatcgaaatctcaggtccaagtaactttgagcaccgagtccataccggtttcgacccgcaggaacagaagttcaccggtctgccacagcagtggcactccctcctggctgatactgcaaaccgaccgaaacccatggtggacccgagctgcataactcccatccagctggcacctatgaaaacaattgttcgcggcaacaaaccttgcaaggagacttccatcaatgggttgctggaggactttgataatattagtgtgacccggtcaaattcactcaggaaggaaagtccaccaacaccagaccagggcgcaagcagtcatggacctggacatgctgaggagaacggctttatcacgttttcccaatacagttccgaaagtgatacaacagccgactacactacggagaagtaccgagagaagtcactctacggcgatgacctggatccttactacagaggcagccacgcggctaaacagaacggtcatgtcatgaaaatgaaacacggagaggcctattactctgaagtcaagcctctcaaaagtgactttgcccgcttctctgcggactaccactcgcacttggactccctctcaaagcctagcgagtattccgatctcaaatgggagtaccagagggcctcctctagtagtccactggactattctttccagttcactccttcccgcacagcaggcactagtgggtgtagcaaggagtctttggcgtattccgaatccgaatggggcccctccttggatgactacgaccggagacctaagtcttcgtatctgaaccaaacctcgccccaacctaccatgaggcagagaagccgttcaggatccggcctgcaggagcctatgatgcccttcggagcttccgcctttaagacgcatcctcagggccattcctataacagttatacctaccccagactgtcggaaccaaccatgtgcattcctaaggttgattatgatagggcgcagatggttctctcacccccgttaagcggttcggatacgtacccaagagggcccgccaaacttccacagtcccagtctaagtcaggctattcttctagctcccaccagtacccttcgggctaccataaggcaaccctgtaccaccatccatccctgcagagttcttcccaatacatttctacggcctcctacctaagctctctcagcctgagtagtagcacctatcctcccccatcctgggggtcatcttccgatcagcaaccctccagagtatcacatgaacagtttagggcagctctccaacttgtggttagccctggggatccaagagagtatctggccaacttcattaagattggcgaaggctccactggtatcgtctgcatagctacagagaagcatacagggaaacaggtcgctgtgaagaagatggacctccgcaagcagcagcggcgagaactcctgtttaacgaggtcgtgataatgagggattaccaccatgacaacgtggtggacatgtatagcagttaccttgtgggcgatgaattgtgggtcgtgatggagttcctggagggcggagcactaactgacattgtgacccataccagaatgaacgaggaacagatcgctacagtgtgcctcagcgttcttcgggcactgtcctacctccacaatcaaggtgtcattcatcgggacattaagtctgactccatattgttgacttcagacggcaggattaaactttctgacttcggattttgtgctcaggtctctaaagaagtgcccaagagaaagtccctggtaggcacaccttattggatggccccggaggtgatctcgcggcttccctacggcaccgaggtggacatttggtccctggggataatggttattgaaatgattgacggcgaacctccttactttaacgaacccccccttcaggccatgcgacgcattcgcgattctctgcctccccgagttaaagacctgcataaggtttccagtgtacttagaggtttcttagatctcatgctagtccgtgagccgtcccagagagccactgcccaagaattgctgggccacccattcctcaaacttgcaggaccaccctcatgtatagtgcccctgatgcggcaataccggcaccactag

SEQ ID NO: 28716 - DNA, 1743 bp, Artificial Sequence
  Description of Artificial Sequence: Synthetic coding sequence
atggtcgacccatcatgcatcacacccatccagctagcccctatgaaaaccattgtgagaggcaataagccctgcaaagaaacctccatcaatgggctgctagaggacttcgacaatatttcggttacacggagcaactccttgcggaaggagtcccctcctactcccgaccagggcgccagcagtcatggacccggacacgcagaagaaaatgggtttattaccttttctcagtatagctccgagtcagacacaactgctgactataccacagaaaaataccgtgagaaatcgctctatggggacgacctcgacccatactacagagggtcgcatgcggccaaacaaaacggccatgtcatgaagatgaagcatggtgaagcatattacagcgaggtgaagccactgaaatctgattttgcaaggttctcagccgattaccattcccatctggactccttgagtaagccttcggaatattccgatttgaaatgggaatatcagagggcctcttcctcttctccgctggactactccttccaattcactcctagccggactgccggcacttccgggtgctctaaagagtcactggcctactctgagtctgaatggggaccatccctggatgattacgacagaaggcccaagagcagctacctcaatcagacctctccccagccgacaatgcggcagcgatctagatctggctccggcttgcaggagccaatgatgccattcggtgccagtgcgtttaaaacgcaccctcaagggcactcctacaattcgtatacttatccgcgtctgtcagagcccactatgtgcattcctaaggtcgactatgacagagctcagatggtgctgtctcccccactgtctggtagtgacacgtaccctagaggacccgccaaactaccccagagtcaatctaaatcgggctactcctccagttctcaccaataccctagcggctaccataaggccacattataccaccaccccagccttcaatcatccagtcagtatatctcaaccgcctcataccttagctctctgtccctgtctagcagtacctaccctccaccctcctggggctctagctcagaccagcagcctagtcgcgtgagtcatgagcagttcagggctgctctgcagctggtcgttagtccaggggacccccgcgaatatctggccaattttataaagatcggggaggggagcaccggaatagtgtgcatagctacggagaaacataccgggaagcaggtcgccgtcaagaagatggatcttcggaaacagcagaggagggagctgctatttaatgaagtcgtgattatgagggactatcaccatgacaacgtagttgacatgtacagctcttacttggtcggggatgaactgtgggtcgttatggaattcctcgagggcggggctctgaccgacatcgtgacacatacacggatgaacgaagaacagatcgcgacagtttgcctgagcgtcctccgggctctcagctacttgcataaccagggggtcatacacagagatatcaaatcagattctatactcttaaccagcgatggacgtgtgagctcagtgctgagggggttcctggatctgatgttagtacgcgagccgtctcagcgcgcgacagcacaagagctgctgggccacccctttctgaaactcgcaggtccgccctcctgcatcgttcccctcatgcgccagtaccggcatcattag

SEQ ID NO: 28717 - DNA, 366 bp, Artificial Sequence
  Description of Artificial Sequence: Synthetic coding sequence
atgtccaccctctttccatccttattcccccgtgtgaccgagaccttgtggttcaacctggaccgaccctgcgttgaagagacggaattgcagcagcaggagcagcagcaccaggcatggctacagagcatcgccgagaaggataataatctggtgcctatagggaaaccagctagcgagcattatgacgacgaggaagaagaggacgatgaggatgacgaggactcagaggaagacagtgaggatgacgaagacatgcaggatatggatgagatgaacgactacaacgagtcccctgatgacggtgaggttaatgaagtagatatggagggcaacgaacaggaccaggatcagtggatgatttag

SEQ ID NO: 28718 - DNA, 1269 bp, Artificial Sequence
  Description of Artificial Sequence: Synthetic coding sequence
atggccatcgcacagctggccactgagtacgtgttcagtgattttttgttgaaggagcccaccgagcctaaatttaaaggactgcggttagaactggctgtggataagatggttacttgtatagctgttgggctgccactgctgctcatctctctggcattcgcccaggagatctcaatcggaacacagatatcctgcttttcgccgtccagcttctcatggcgtcaggcggcatttgtggactcatattgctgggcggccgtacagcagaaaaattctctgcagagtgagtctggcaatctgcctctttggttacacaagttttttccttacatactgttgctatttgcgatcctgttataccttccaccgcttttttggaggtttgctgccgccccccatatctgctccgaccttaaattcatcatggaggagctggataaggtctacaaccgtgccattaaggcggccaaatccgcacgggaccttgacatgagggatggcgcttgctccgtgcctggagtcactgagaacctcggacagagcttgtgggaagtgagtgaaagccacttcaagtaccctattgtggaacagtacctgaaaacgaaaaaaaatagcaacaatttgattataaaatatatcagctgcaggctcctgaccctcattataatcctactggcctgcatttacctaggatattatttctccctttccagcctgagcgatgagtttgtgtgttcaatcaaatccggcatattaaggaatgactctactgtgccggaccagttccagtgcaaactgatagcagtgggaatctttcaacttctctcagttatcaacctcgtggtttacgttctgcttgctccggtcgtggtttacaccctgttcgttccctttcgccaaaagacggatgtgctcaaagtctatgagattttgccaacgtttgacgtgcttcacttcaagtcggaaggctacaacgatctgagcctatacaatctctttctcgaagaaaatatttctgaagtgaaatcttacaagtgtcttaaggtgctcgagaatattaagagttctggccaggggatcgatcctatgttactcctcaccaatctaggcatgataaagatggatgttgtcgacggcaaaactcctatgtcagctgagatgagagaagagcaaggaaatcagacagcagagctgcaggactcagagactaaggccaacaacggcgaaaagaacgctcgccaaagactcctggatagcagttgttag

SEQ ID NO: 28719 - DNA, 2034 bp, Artificial Sequence
  Description of Artificial Sequence: Synthetic coding sequence
atgcatcatttactggagcagtctgccgatatggctactgccctgctcgcgggcgagaagttaagggagttaatcctgccaggcgcccaggatgacaaagcaggagcactcgcggcgctcctgctgcaactaaagttggagctcccattcgacagagtcgtcacaattggcacagtacttgtcccaattctactggtgacacttgtattcacaaagaattttgcagaggaaccaatatattgttatacaccccacaactttacacgagaccaggcactctacgctcgcgggtactgttggacagaactacgagatgcgttacccggggtggatgccagcctctggccaagtctgttcgaacacaagttcctcccatatgccttactggcttttgccgctatcatgtatgttccagccctcggatgggagttccttgcatctacaaggctaactagcgagttgaacttcctgttgcaggaaatcgacaactgctatcatcgcgctgcagagggtagggctccgaaaattgaaaaacagatacagtctaaagggccaggcatcaccgagcgggaaaagcgagaaattatcgagaacgccgagaaagagaaatcccctgaacaaaacctgttcgagaagtatttagagcgccgcggtcgatcgaattttctggcaaagctgtatctggctcgccacgtgctgatattactccttagtgcagttccaattagttacctgtgtacctactatgctacacagaagcagaatgaattcacctgcgctctaggcgccagcccagatggcgccgcgggtgccggccccgcagtgcgggtaagctgcaagctgccttccgtacagttgcagcggattatcgctggcgtcgatattgtcctcctgtgcgttatgaaccttatcattttggtgaatctgattcacctgttcatcttcaggaagtctaactttatctttgataagctgcataaggtgggcatcaagacccgcagacagtggcgtagatcgcaattttgcgatatcaatattctcgccatgttttgtaatgagaatcgcgatcacataaagtctctgaatcgtctggacttcattacgaatgaatctgacctcatgtatgacaatgttgttagacaactcttagctgcactggcccagtccaatcatgatgccacaccgacagtccgggactctggggtgcagacggtcgacccaagcgccaatcccgccgagcccgatggagcggccgagcccccagtcgtgaaaagaccgcgcaaaaagatgaagtggatacccacttctaatccacttccacagccctttaaggagccccttgccatcatgcgtgtggaaaacagcaaagccgagaaacctaagcccgctcgccgcaaaacggcaaccgacacactcatcgcgcccctgctggacaggtctgcccaccactataagggaggcggtggagatcctgggccagggcccgcacccgcccccgcgccccctcctgcccccgataaaaaacatgccagacacttctcactcgatgtgcacccctatatccttggcactaaaaaagcaaaagcagaagctgtccccgccgcacttcccgccagtaggtctcaagagggaggctttttatcacaggcggaagactgtggcttggggttggccccagccccgattaaagatgctccattaccagaaaaggaaataccgtatcctaccgaacccgcgagagccgggttgccaagtgggggccctttccacgtgaggagccctcctgccgcccccgctgtggcgcctctgactcctgctagccttgggaaagccgaaccgcttaccatattgagtagaaacgcgacccatcccctgctgcatatcaataccctgtacgaggctcgagaggaggaagatggaggcccgagactgccgcaggatgtcggagacctcatcgctatccctgccccccagcagatcctcatcgccaccttcgatgagccgaggacagtggtgtctactgtcgagttctag

SEQ ID NO: 28720 - DNA, 1065 bp, Artificial Sequence
  Description of Artificial Sequence: Synthetic coding sequence
atgaacctgatcatcctggtaaaccttattcacctgtttatattcagaaaatcgaacttcattttcgataagctgcacaaagtaggcattaagacccgacggcagtggaggcgtagccagttttgtgatatcaacattctggccatgttttgcaatgagaacagagaccacattaaaagcctcaatagactagatttcattaccaacgagtccgatttaatgtacgacaacgtagtgcgacagctactagcagctctagctcagagtaaccatgatgccacccccaccgtgcgggattccggcgtgcagacagttgacccatccgcgaatccggctgagccggacggagcggctgaaccgcctgtagttaagcggccacgcaagaaaatgaagtggattcctaccagcaatccattgcctcagcccttcaaggagcctttggccataatgcgagtggagaattccaaggccgagaagcctaagcctgccaggcgcaaaacggctacagacactctcattgccccgttgcttgatcgatccgcgcccgacaaaaagcacgctcgacattttagcctcgatgtccatccctacatcctcggtactaaaaaagccaaagctgaagccgtgccagctgctctgcctgccagccgctcacaggaaggcggattcctttcccaggccgaagactgcggtctggggctcgccccggcaccaatcaaagatgcacctctgccagagaaggagataccgtaccccacagaacccgcacgcgccggccttcctagtggaggccctttccacgtccgctccccccccgctgctcccgccgtcgcccctttgacaccagcgagcctaggtaaggcggagcccctcaccatcctgagcaggaacgccactcaccctctgctgcatattaacactctgtacgaggcacgcgaggaagaagacggcggaccaaggctgccgcaggacgttggcgacttgattgcaattccagccccacagcagattctgattgcaactttcgatgaaccccggaccgtcgtctctactgtggagttctag

SEQ ID NO: 28721 - DNA, 1179 bp, Artificial Sequence
  Description of Artificial Sequence: Synthetic coding sequence
atgagcttggcccacaccgcagctgagtacatgctaagcgacgcactgttaccagaccgccgcggcccccgcctgaaagggcttagactggagctcccccttgatcgcatcgtcaaatttgtggcggtggggagcccactcctgttaatgagcttggcgtttgcccaggaattctcaagcggtagcccgatttcgtgtttctcaccctctaatttttccatacgccaggccgcttacgttgatagctcttgctgggatagtctgctacaccacaagcaggatgggccaggccaggacaaaatgaaatcgttgtggccacacaaagcccttccatacagccttctcgcgctcgccctgctcatgtatctccctgtcttgctttggcagtacgccgcggtgcccgcactgtcctcggatcttctgtttatcatctccgaactggataaatcctataataggtccattagacttgttcagcacatgctcaagatccgtcagaagagctcggacccatacgttttctggaatgagctggagaaagccagaaaggagcggtatttcgaatttcctttgctggagaggtaccttgcatgtaagcagaggtcccacagcctggtagctacttatctgctgcggaacagccttctgttaatattcacctccgccacttatttatacctaggacactttcacctggacgtattctttcaggaggagttttcctgtagcattaaaacaggcctacttagcgatgagacccatgtaccaaatctgatcacctgcagactgactagcttaagcatctttcagattgttagtctttcatctgtggccatctataccatcttagtccctgttattatatataatctcacaaggctttgcagatgggataagcgcctcttatcagtgtacgagatgctgccagccttcgatctcctgagcagaaaaatgctcggatgccccatcaatgatctgaatgtgatcctactttttctgagagccaacatcagtgagttgatatctttttcttggctgtccgtgctgtgcgtgctgaaggacacaactactcagaagcataatattgatactgtggtagactttatgaccctgctcgcaggcctggagccatctaagccgaagcacctgaccaatagtgcctgtgatgaacacccgtag

SEQ ID NO: 28722 - DNA, 309 bp, Artificial Sequence
  Description of Artificial Sequence: Synthetic coding sequence
atgaggtatggattcgttcgaaagaagcataggggactgttccttaccaccgtggctgccctgcctatctggaatccgatatccgaatttgtcaaatggtacaagagccacaagctaagtcagcactgcatccgcatctgtggtcacctgtgtcagaagcatcttgatatgttcctcagtgttatagggcagaggtggcccattgatgtattctcctccgtgtttgatcaccaagtgtcagccataggcagtgacatcatctggtggttcctgaagctgtttttggtttcctttttctttttcttctag

SEQ ID NO: 28723 - DNA, 3315 bp, Artificial Sequence
  Description of Artificial Sequence: Synthetic coding sequence
atgaaagtgaccgtgtgctttggacggacaggaatcgtggttccttgtaaggagggacagctcagagtgggggaacttacacaacaggctctacaacgttatctcaagacaagagagaaaggaccgggctattgggtcaagattcaccacttggagtacaccgacgggggtattctggaccctgatgacgtcttagcagacgtggttgaggataaagacaagcttatcgccgtctttgaggagcaggagccattacataagatcgaatccccctcaggaaaccctgctgatcgccagtcaccagacgcgttcgagacggaagtggccgcccagctggctgcttttaaaccaatcggcggcgaaatagaggtaacaccctcagccttgaagctgggaactcctctgttggtgcggcgttcttctgatccagtccccgggcccccagccgatacccaacccagcgccagtcacccaggcggccagtctctcaagttggtcgtgcccgattccacccagaacctggaggaccgcgaagttttaaacggagtccagacagagctgttgactagtcctagaacaaaagataccttgtctgacatgacccgaaccgtagagatttctggagagggcgggccacttgggatccacgtcgtccccttcttttctagcctgagcggaaggatactgggacttttcatcaggggaattgaagacaattctaggagcaagagagaagggctgtttcacgagaacgagtgcatcgttaaaatcaataacgtggatctcgttgataagacgttcgcccaggctcaggacgtctttagacaggccatgaaaagtcctagcgttctgttgcacgtgcttccaccacagaatcgcgagcagtacgaaaagtccgtcattggttctttgaacatttttgggaataatgacggggttctgaaaactaaggtgcctccaccggtccacgggaagtctggtttgaagaccgcgaacttaacagggaccgactcacccgaaactgatgccagcgcttcccttcagcaaaacaagtcacccagggtgccccggctcgggggaaagccatcttcaccatctcttagcccactcatgggcttcggctctaataagaatgccaagaagattaaaattgacctcaagaaaggacccgaggggctgggctttaccgttgttacccgcgattcatcaatacatggccctggtcctatttttgtcaaaaacatccttcctaagggagcagccattaaggatggaaggctccagagtggagaccgtattttggaggttaacggaagggacgtcactggtagaacccaagaggagcttgttgccatgttacgcagcacaaagcagggagagaccgcttctctggtgatagcccgccaagaaggtcacttcctccctcgagagcttaaaggagagccagactgctgcgccctttcactggaaacatcagagcaactgaccttcgaaataccactcaatgattccggctcggcaggtttgggtgtctcactgaaaggcaacaaaagccgggagacgggaacagatctcggcatctttattaaatctattatccacggcggtgccgctttcaaagacggcaggctccgcatgaacgaccagctgatcgcagtgaatggggagtctctgctgggtaaatctaaccacgaagcaatggagaccctcagaaggagtatgtcgatggagggcaacattagagggatgattcagttggtgatcttgagaagaccagaacgtcctatggaggatcctgctgaatgtggcgcattttcaaagccctgtttcgaaaattgccagaatgctgtgaccacgtcaagacgtaacgataattcaatcctgcacccactaggcacttgtagtccacaggacaaacaaaaggggttgttactccccaatgacggatgggccgagtcagaggtaccaccaagtcccacacctcactctgccctgggtttaggtctggaggattattcccatagttccggggttgatagcgcagtgtactttccagaccagcatatcaacttccgaagcgtgaccccagcccgtcagccggagtccattaatttgaaagcttcaaagtctatggatctggtgcccgacgaaagtaaggtgcattctctggcaggtcagaaatccgaatctccttcgaaggacttcgggcctaccttgggattaaagaagagtagtagtctggaaagtcttcagacagctgttgcggaagttagaaaaaatgacctgccatttcaccgtccaagaccccacatggtccgaggacgggggtgtaatgaatccttccgggctgctatagacaagagttacgacggtcccgaagaaatagaggccgatggtctctcagataaatcatcccacagcggccagggtgctttgaattgcgaatccgcccctcagggcaactccgaactcgaggacatggagaataaggcacgaaaagtgaagaagacaaaagagaaggagaagaaaaaggagaagggtaagctgaaagtgaaagaaaaaaaaaggaaggaagaaaacgaggacccagaacgcaagatcaagaagaagggctttggcgcgatgctgagattcggtaaaaaaaaagaggacaaaggcgggaaggcggagcagaagggcacactcaagcatggaggtctacgcgaggaggagctcgagaaaatgaaagaagagcgagagagtgggcggcccaccggcggcagcaccgaccggatccagaagctgcgcaaggagtactatcaggccaggcgggaggggttccccttatacgaggatgatgaagggcgcgcccggcctagcgagtacgacttactgtgggtgcctggaaggggccccgacggaaatgcccataaccttaggtttgaagggatggagcggcagtacgctagtctcccccgcggaggcccagctgaccctgtcgactatctacccgcagccccacgaggcctgtataaggaacgcgagctgccctattatccaggggcccaccccatgcaccctccgaagggcagttaccctagacctactgagctgagagtggccgatctccgatatccacaacactatcctccacccccggccccacagcataaaggcccattcaggcaagatgtgcctccaagccctccacagcaccagaggatgccagcttaccaggagacgggccgccccggacccaggggtgggagtcccgaccagtatccctataggacccaggacagccggcagaagaatcctatgaccgccgcagtgtag

SEQ ID NO: 28724 - DNA, 3411 bp, Artificial Sequence
  Description of Artificial Sequence: Synthetic coding sequence
atgaaggtcactgtttgctttgggcgcactggaatagtggttccatgtaaagaaggtcagctcagagtcggggagctcacccagcaggctcttcaaaggtacttgaagaccagagagaagggccccggatattgggtcaagattcaccatctggagtacacagatggcggtatccttgaccctgatgacgttctggcagatgtggttgaggacaaagataaactgatcgctgtgtttgaggagcaagaacccctgcacaaaatcgagtctccctctggcaaccctgccgaccgtcagtctccagatgccttcgagactgaggtagcagcccaactcgccgctttcaaaccaataggcggtgagatcgaagtcaccccgtcagctctgaagctgggcacacccctgctggtccggcgcagttcagaccccgtgcccgggccaccggccgatacacagccatctgcaagtcatcctggcggccagtcgctgaagctagtggtccctgacagtacccagaatctcgaggatagggaggtcttgaatggggtgcagaccgaactcctgacgtcccctcggactaaggataccctgtccgacatgacccgcaccgtggagatttcaggagaagggggtcccctgggaattcacgtggtgcccttcttctcctccctttctggaagaattctgggcctgttcatcagagggatcgaggacaactctagatccaagagagagggcctgtttcacgagaatgaatgcattgttaaaataaataacgtcgacttggtggataagacatttgctcaagcccaagatgtgttcaggcaggcaatgaagtccccgtccgtcctgctccatgtcctgcccccccagaatagagagcagtatgaaaagtccgtcatcggaagccttaacatctttgggaacaatgacggagttctgaagaccaaagttcctccccccgtgcacgggaagagcggcttgaaaacggccaatctgaccggaacagactctcccgaaacagacgcgtctgcctctttgcagcagaataaatctcccagggttcccagactcgggggcaaaccctcctcccccagcctttcccccttaatgggtttcgggtctaacaaaaacgctaagaagatcaaaattgacttgaagaaaggcccggagggattaggatttacagtcgttactcgggattcaagtatacatggacccggccctatttttgtcaagaacatcctaccaaagggcgcagcaataaaagatgggaggctccaaagcggtgaccggatacttgaggtcaatggtagagacgtcactggtcgcacacaggaggagctcgttgccatgctgcgatcaaccaagcaaggcgagaccgcctcgttggtcatcgcccgccaggaagggcactttttaccaagagagctgaaaggggaacctgattgctgtgcccttagcctagaaacatcagagcaattgacattcgaaatccccctgaacgattccggttccgctgggctaggcgtttctctgaaaggcaacaagagccgagaaaccggcaccgacctgggcatcttcatcaaatccattatccacggaggtgccgcgttcaaggatggtagattgcggatgaatgatcagctgatagcagttaacggtgaaagcttgttagggaaaagcaaccatgaagccatggaaactctccgaagatccatgtccatggaaggcaatattcggggcatgattcagttggtgatcctgcgaagaccagagcgccccatggaagatcccgcggaatgcggcgccttcagcaaaccgtgttttgaaaattgccaaaacgctgtgaccacctctcgtaggaatgataactcgatcctgcatccgctgggtacctgtagtccacaggataaacagaaaggcctgttgctacctaacgatggctgggctgaaagtgaggttcctccctcgcctaccccccatagcgcgctcggcctgggtttggaggactactcacattccagtggcgttgattccgccgtgtactttcctgaccaacatattaatttcaggagcgtgacccctgctaggcagcctgagtcaataaatctgaaggcctctaagtctatggatctggtgccagatgagtctaaggtgcattctcttgccggccaaaagtctgatggactgagtgataaaagcagtcacagtggacaaggagctctgaattgcgaaagtgccccacagggcaacagcgagttggaggatatggaaaacaaggccagaaaggtgaagaagaccaaggagaaggaaaaaaagaaggaaaaggggaagctgaaagtgaaggagaagaagcggaaagaggaaaatgaagaccctgaaagaaagatcaagaagaagggcttcggtgctatgctccgtttcggcaagaaaaaagaggataagggtggcaaagcggagcagaagggcacattaaaacacggcggcttacgagaggaggagctggagaagatgaaagaagaaagggaaaggattggcgcaaaacaccaggaactgagagaaaaacaagctcgtggactgctggactatgccacaggggctattgggtctgtgtacgacatggatgacgacgaaatggatcccaactatgcccgtgttaaccattttcgcgaaccatgcacctctgcgaacgtgttccgatccccctcacctcctcgggctggcccattcggctacccaagagacggccaccccttgtcgcctgagagagatcatctggaaggcctgtacgccaaggtaaataagccatatcatcccctggtgccagcagactccgggaggcccacaggtggatctaccgaccggattcaaaagttaagaaaggaatactatcaagcccgaagggaagggttccccctgtatgaagatgatgagggtcgtgcacgcccttctgagtacgatctgttgtgggtgcctggaaggggccccgacgggaatgcccacaacctgagattcgagggcatggaacgtcagtacgcctctttgccccgcggcggaccagctgatccagtggattacctaccagccgcgccccgcggcttgtataaagagagggagctgccttactaccccggcgcccaccctatgcatccccccaaagggtcatacccgaggcctacagagttgagggtggctgacctgcgatatcctcagcactaccctccaccaccagccccacagcataaaggcccgttcagacaagatgtgccccctagccctccacagcaccaacgcatgccggcgtatcaggagacaggccgacccggccctcggggcggcagtccagaccaatacccttataggactcaagattctagacagaaaaaccctatgacagcagcggtatag

SEQ ID NO: 28725 - DNA, 3432 bp, Artificial Sequence
  Description of Artificial Sequence: Synthetic coding sequence
atgaaggtaacagtatgcttcggcaggaccggcattgttgttccttgtaaggagggtcagcttagggtgggggagctcacgcagcaggccctgcaaaggtatttgaagacccgagagaagggcccaggatattgggtgaaaatacaccatctcgagtatacagacggcgggatcctggacccggacgatgtgctggctgacgtggtggaggataaggacaagctcatcgccgtatttgaggagcaggagccgcttcacaagattgagtcaccgagcggaaaccccgcagataggcagagccctgacgcattcgagactgaagtggctgctcaactggctgccttcaaacccatcggtggtgagatagaggtcactccatcagctctgaaactgggcacacccctcctcgtccgacggagctctgaccccgttcctgggccgcccgctgatacacagccttctgcgtcacacccagggggtcagtccctgaagttggtcgtgccagattctacacagaacctggaagacagagaggttttgaacggagtgcaaaccgagctgcttacatcacctagaaccaaagataccctgagtgatatgacgaggacagtagagatatccggagagggaggtcctctggggatccatgtggtcccattcttttcttctctaagcgggcggatcctgggactgtttatcaggggaattgaagataactctcgctctaaaagagagggcctgtttcatgagaatgagtgcatcgtgaagatcaataacgtcgacttggtggataagacgtttgcgcaggctcaagatgtatttcgtcaagcaatgaaatcaccaagtgtcttgctgcatgtgctgccaccacagaatcgagagcagtacgaaaaatcggttattggcagcctaaacatatttgggaataacgatggtgtcctgaagactaaagttcctcctcccgtccatggaaaatccggcctcaagacagccaacctcacaggtacagacagccccgaaaccgacgccagcgcttccttgcagcagaacaaaagtccacgcgtcccacggctcggggggaaaccttcgtccccatcattaagtccgctaatgggattcgggtcgaataagaatgctaaaaaaattaagatcgacctcaagaagggacctgaagggctcggcttcacagtcgtgaccagagacagcagtatacatgggcctggaccgatctttgtgaaaaatatattgccaaaaggcgcagccatcaaagacggccggctgcagagcggcgaccgcatcttggaagtgaacggtcgtgacgtcaccgggcggacgcaggaagagctggttgcaatgctgcggagcacaaaacagggagaaacagcgagcctggtaattgctcgccaggaggggcacttcttgcctcgcgaattggacggcaggctcagaatgaatgaccagctcattgcagtgaacggggagtccctcttgggaaaatcaaaccacgaagccatggagactctgcggcggtccatgtctatggagggaaatattcgtggtatgatacagttagtgatccttcgcaggcccgagcgtcctatggaggacccggctgagtgtggcgccttctccaagccctgtttcgagaactgtcagaatgcggtaaccacctccagacgaaacgacaattcgatcctgcacccattgggcacttgttcaccacaggacaaacagaagggcctgctgctccccaacgacggctgggcggaaagtgaagtgcctccttcccctacaccccatagtgctctgggtctcgggctggaagactattcacatagttcgggtgtggattctgccgtatactttccagaccagcatataaattttcgttctgttacgccagcacggcagccggagtcgatcaacctgaaggcgtctaagagcatggatctcgtccccgacgaatccaaggtccattccctggctggacaaaagtctgaatcccccagcaaagattttggtcccacgctgggtctgaagaagagcagcagtctcgagtcgctccagactgctgtggctgaagtacgcaagaacgacttgcctttccaccgcccgaggcctcatatggtacgcggccgcggttgcaatgagtcttttagggctgctattgacaagtcctacgacggccccgaagagatcgaagctgatggcttatctgacaagtcttcacacagcgggcagggggctcttaattgcgaaagtgccccacagggcaactcagaattagaggatatggaaaacaaggcccgaaaagtcaaaaaaactaaagaaaaagagaagaagaaggagaagggtaaacttaaggtgaaggaaaagaagcgcaaagaggaaaatgaagaccccgagcgaaaaattaagaaaaagggcttcggggcgatgctgagatttggtaagaagaaggaggacaaggggggcaaggctgagcagaagggaactctaaaacacggaggcctgagagaggaggaattagaaaagatgaaagaggagagagagagaataggtgccaagcaccaagagctccgggaaaagcaggccagagggctgctggactacgcgaccggcgctatcgggtccgtctacgatatggacgacgatgagatggacccaaattacgcccgggtgaatcatttcagggagccatgcactagcgcgaacgttttccggtcaccttcccccccacgcgccggacccttcgggtaccctagagacggtcatcccctgagccctgagcgagatcacttagaaggcctgtatgccaaggtgaataagccataccatcccctggtgcctgccgacagcggccggcccacaggtggatcgacagatcgcattcagaagctgaggaaggagtattatcaggctcggcgggagggcttcccattgtacgaggatgatgaaggcagggcaagaccatctgaatacgacctcctgtgggtgccaggaagaggccccgatggtaatgctcacaatctgagatttgaaggaatggagagacagtatgcctctctgccaagggggggcccagcagatcctgttgattatctgcccgccgccccacgaggtctgtataaggaaagggaactcccctactatcctggagctcaccccatgcatcctcctaagggttcctatccccgcccaaccgaactgcgcgttgccgacttgcgctaccctcagcactatccccccccccccgctccacaacacaaaggccccttccgccaggacgtgcctccaagccctcctcaacaccaaagaatgccagcttaccaggagaccgggcgcccagggccccggggggggtctcccgatcagtatccctaccgcacccaggacagcagacagaaaaaccctatgacggcagcagtgtag

SEQ ID NO: 28726 - DNA, 3618 bp, Artificial Sequence
  Description of Artificial Sequence: Synthetic coding sequence
atgaaggtcacagtctgcttcggccgcaccggcattgtggtgccctgtaaagaagggcagctccgcgtgggcgagctgactcaacaggcacttcagcgttacttgaaaacacgggagaaaggccccggctattgggtgaagatacaccacttagagtatacggacggaggtattctggatcccgacgatgttctagcagatgtggttgaagacaaagacaaactgattgctgttttcgaggaacaagaacccctccataagatcgagtccccgagcgggaatcctgccgatcgccaaagccctgacgcctttgaaaccgaagtagccgctcagctagccgcgttcaaacctattggcggggagatcgaggtaacaccaagtgcactgaagctgggcaccccgctgctcgtgcgacggtcctccgatcccgtcccaggtccccccgctgacacacagccttcagcttcacatccgggtgggcaatccctcaaactggtggttcctgattcaactcagaatctggaggatagggaggtgctgaacggggtgcaaacagagctgttaacatccccccggaccaaagacactctgtctgatatgacaaggacagtagagatctccggtgaaggagggccactgggcatccatgtggtcccattcttttcatcactctctgggagaatcctgggactcttcatccggggcattgaagacaattccaggtctaagcgagagggactgttccatgagaatgagtgcatagtcaaaatcaataacgtcgacctggtcgataagaccttcgctcaggctcaagatgtgtttcgccaggccatgaagtctccttctgtgcttctgcacgtgttaccaccccagaaccgcgagcagtacgagaaaagtgtcatagggagccttaacattttcggaaacaatgatggagtcctcaaaactaaagtccctcctccggtgcatggtaagtctgggttgaagacggcaaacctgacgggcacagactctccggagacagacgccagcgctagcctacagcagaataagtccccgcgggtccccaggttgggtggtaagccatcaagcccatctctttcaccattaatgggattcggtagtaacaagaacgctaagaagattaagattgatctgaaaaaagggcctgagggactaggatttacagtcgtcacacgcgattccagcattcatggaccaggaccaattttcgtgaaaaatattttgccaaaaggtgcagccattaaagacgggcgtcttcagtcaggcgatagaattctcgaggttaacggacgtgatgtgactgggcgtacccaggaagagctcgtagccatgctgaggagcacgaagcagggggagaccgcctccttggttatcgccaggcaggagggacatttccttccccgagagctaaaaggggagcccgattgctgcgctcttagcctggagacctcagagcagcttaccttcgagatcccgctgaatgatagtggttcagccgggctgggagtgtctctcaaaggtaacaagagtcgggagaccggaactgacttgggaatattcatcaagtcaattatccacgggggcgcagcctttaaggacggaaggctcaggatgaatgatcagttaattgctgtcaatggcgaaagcctactgggtaaatctaatcatgaggcaatggaaaccctgaggcgatccatgagcatggaaggcaatatccgcggcatgatacagctagtgatactgcggagacctgagagacctatggaagaccctgcagagtgcggggccttctctaaaccctgtttcgagaattgtcagaacgcagtcaccacatcacgccgtaatgacaattcaatcttgcaccccctcggcacttgctccccgcaggataaacagaaaggccttctgcttcctaacgacgggtgggctgagtccgaggtgccccccagccctactccgcattcggccctcgggctgggcctcgaggactattcccattcctctggagtcgactccgccgtgtactttccagaccaacatatcaacttccgcagcgtgacgcccgcacgacagccagagtccatcaacttaaaggccagcaaatccatggacctggtgcccgacgagtccaaggtacattctcttgctggacagaaatcagagagcccctctaaggacttcgggccaactctggggctgaagaagtccagtagcctggagtccttgcagaccgcggtagccgaggtgaggaagaacgacctgccattccaccggcccagacctcatatggtgcgcggacgcggctgtaacgagagctttcgggccgctattgataaaagctacgacggccctgaggagattgaggccgatgggcttagcgacaagtcaagtcatagtggtcagggagctcttaattgtgagtctgctccccaggggaattccgaactggaagatatggaaaataaggcgagaaaagtaaagaagaccaaggagaaagaaaaaaagaaagaaaagggaaaattaaaggtgaaagagaagaagcggaaagaggaaaacgaggatccagagcgaaagatcaagaaaaagggcttcggcgcgatgttgcggtttggcaaaaaaaaggaagacaaggggggaaaggcagagcagaaaggaactttgaaacacggggggctgagagaagaggaacttgaaaagatgaaggaggagcgagaacggatcggagctaagcaccaggagctgcgggagaagcaggcacgcggacttttggattacgctaccggagccatcggcagcgtgtacgatatggacgacgatgagatggatcccaactacgccagggtgaatcactttcgggagccatgcacttctgcaaatgtctttagatctcctagtcctcccagggcgggccctttcgggtatccccgggatggacaccccctgtcacctgagagagaccatttagaggggctgtatgccaaagttaacaagccataccatcccctggtgccagctgactctgggcggccaactggaggctccacagatcgcatccagaaactcagaaaggagtattaccaggctcggagagaggggttcccgctgtatgaagatgacgaggggcgggcaagaccatccgagtacgacctcctgtgggtgccaggtcggggacccgatggcaacgcgcacaatctgcgcttcgaagggatggagagacaatatgctagtctgcctcgtggcgggccagctgatcccgtggactacttgcccgcggccccacgcgggctctataaggaacgggagctcccgtattatccaggggcacatcccatgcatccgcctaaggggtcttacccgcgccccaccgaattgagggtggcggatctgcggtacccacagcattacccccccccgcccgcacctcaacataagggaccttttcgccaggacgttcccccctctcctccacagcatcaaaggatgcccgcataccaggagaccgggaggcccggcccacggggtggtagcccagaccagtacccgtacagaacccaagactccagacagaagaatccaatgaccgcagcggtgtag

SEQ ID NO: 28727 - DNA, 828 bp, Artificial Sequence
  Description of Artificial Sequence: Synthetic coding sequence
atgccgtatgcaaaccagcccacagtgaggattacagaacttactgatgagaacgtgaaatttattatagaaaatactgacctggctgttgctaacagcattcggagagtgttcattgcagaggtgcccataatagcaattgactgggttcagatcgacgctaatagcagtgtcttacacgacgaatttatcgctcacagactggggctgatacctcttatatctgatgatatcgtcgacaaattgcagtacagccgtgattgtacatgcgaggagttctgcccagagtgcagcgtggaattcacattagacgtgaggtgcaatgaagaccagacaagacatgttacctcccgggacctgatctcaaactccccaagagtgattcccgtcacgagtcggaatagggacaatgacccgaacgattatgtcgagcaggacgatatcctgattgtcaagctccgtaaagggcaagagttgagactgcgggcttacgccaagaaaggttttggaaaagagcatgctaagtggaaccctacagccggagtcgcctttgagtacgacccagacaatgcactgaggcacaccgtgtaccctaagccagaagaatggccaaaatcagaatatagcgaactcgatgaggacgaatcccaagccccatacgatccgaacggcaaaccggagcggttttactataacgtcgagtcctgcggctctctcaggcccgaaacaatcgtgctctccgcgctctctggacttaaaaagaagctgagcgacctacagacacaactctcccacgaaattcagagcgacgtgctgacaattaactag

SEQ ID NO: 28728 - DNA, 1038 bp, Artificial Sequence
  Description of Artificial Sequence: Synthetic coding sequence
atggcccgcccccaaaggacacctgcacgctccccagactctatagtcgaggtgaagagtaaatttgacgccgaatttaggagattcgccctgcccagggcaagtgtaagtggattccaggagttcagcaggttgttgcgggcagtccaccagatacccggattggacgtgctgctcggctatactgatgctcacggagatctgctcccactgactaacgatgatagcctacaccgggctttagcatctggtccccctcccctccgcctcctggtccagaaaagagaggctgactcgtcagggttggcgtttgctagtaacagtctgcaacgtcgtaaaaaaggactcctgcttaggcccgtggccccactacgcactaggcccccactcctgatcagtctcccccaggacttcaggcaggtttcaagtgtgatagacgtggatttgctgcccgagactcaccgcagggttagactccacaagcacggatccgaccggcccctcggcttctacattcgggacggtatgagtgtacgcgtggccccgcagggtcttgaacgggtccccggtatcttcatcagccggctggtcaggggggggctggccgaatcaactggcctactggccgtgtctgacgagattttagaggtgaatgggatcgaagtagccggcaagacattggaccaggtgacggatatgatggtcgccaactcccataacttaattgtcacagttaaacctgcaaatcagcggaataatgtagtcaggggggcctccgggcgactaaccgggcctccctccgctggccccggtccagcagaacctgattcagacgacgattcatctgacctggtgattgaaaatagacagcccccctctagcaatgggctctcccaaggtcctccatgttgggacttgcatcccggctgtcgtcacccaggaacccggtccagccttcccagccttgacgatcaggaacaggcttccagtggctggggaagtcggatccggggggacggaagcggcttctcgctttag

SEQ ID NO: 28729 - DNA, 1032 bp, Artificial Sequence
  Description of Artificial Sequence: Synthetic coding sequence
atggaggtgttggccgcggaaacaacaagtcagcaggaacggcttcaagccatcgctgagaaacggaagcgtcaggcggagatcgaaaacaagcgcagacaactggaggatgagcgccggcagctgcagcatttgaagtccaaagcgttgagggagcgttggttacttgagggtacccccagctcggctagcgaaggggacgaagatctccgccgtcagatgcaggatgacgaacagaagactagactgctggaagactccgtatcgcgactagaaaaggagatcgaggttttggagcggggggactcagcgcctgctacagccaaggagaacgcagcagcgccaagcccagtgcgcgcgcctgccccaagcccggctaaagaggagcgaaagactgaggtggtgatgaatagccagcagacacccgtcggcactccgaaggacaagagagtgtccaatacgcctttgcggacggtggatggaagtccgatgatgaaagccgtggtacacgctgtcgatggtaccgctgaaaatgggattcatcccttatcgagcagcgaggtggatgaattgatccacaaggcagacgaggtgaccttatcggaggccggctctacagccggcgcagcagaaactcgtggtgctgtggaaggtgccgcgcgaaccactccaagccgtcgcgagataacaggggtacaggctcaacccggagaggccaccagcgggcctcctggcatccagcccgggcaggagccccctgtaaccatgatttttatgggatatcagaatgtggaagatgaagccgagacaaaaaaagtcctggggctccaggacaccatcacagccgagctcgtggtcatcgaggacgccgccgaaccaaaggagccagcaccaccgaatggtagcgccgctgagccaccaacggaagcagcttctcgggaagaaaaccaggctgggccagaagcaaccacctctgatccacaagacttggacatgaaaaaacatcggtgcaaatgctgctctatcatgtag

SEQ ID NO: 28730 - DNA, 1164 bp, Artificial Sequence
  Description of Artificial Sequence: Synthetic coding sequence
atggaagttttagcagcagaaactacttcacaacaggagcggctgcaggctatcgccgagaaaagaaaacgacaggcggagatagagaataagaggcgtcagctcgaagacgaaagaaggcagctgcagcacttgaagtctaaagccttgagagagcggtggctgctggaaggaactccctccagtgcgagcgagggggatgaggacttgagacgtcagatgcaagatgacgagcagaaaacacgcctgctcgaggacagcgttagtaggcttgagaaggagattgaggttctagaaagaggcgattccgctccagccaccgccaaggagaatgcagctgccccttcccccgttcgggcccctgcccccagccccgccaaagaggagaggaaaaccgaagtggttatgaactcccagcagacccctgtgggcaccccgaaggacaaacgcgtctccaatacacccttgcggactgtcgacgggagtcccatgatgaaggccgcaatgtactctgtcgagattaccgtggaaaaggacaaagtgacgggagaaacgagggtgctgtctagcaccacgctgttgccccgtcaacccctgccgctgggaattaaagtctacgaggacgagaccaaagtggtgcacgctgtggatggaactgccgagaacggaatccaccccctgtcaagttccgaggtggatgagctgattcataaggcagatgaggtgacactttccgaagccgggtctactgccggggccgccgaaactaggggagcagtcgagggggcagcccgcaccactcccagcagacgggaaattaccggagtccaagcccaaccaggggaggccacatcgggaccgcctggtatacagcccgggcaggagccgcctgtgaccatgatatttatgggctatcaaaacgtcgaagacgaagccgagaccaaaaaggtgctcggcctccaggacaccatcactgcagaactggttgtgatcgaggacgccgccgagcccaaggaaccggcgccacctaatggtagcgccgccgaacctcccactgaggctgctagtagggaggaaaaccaagcagggcctgaggctactacgtccgatcctcaggatctagacatgaagaagcaccgatgcaaatgctgctctattatgtag

SEQ ID NO: 28731 - DNA, 759 bp, Artificial Sequence
  Description of Artificial Sequence: Synthetic coding sequence
atgaacagtcaacaaacacccgtgggcacccctaaggacaaaagagtgagcaacacccctcttcggacagtggacggctctcctatgatgaaagctgccatgtatagtgtggaaatcaccgtggaaaaagacaaggtgacaggcgaaacccgagtgctgtcatctaccacactattacctagacaacctttacccttaggaatcaaggtgtacgaagatgaaaccaaggtggtacatgctgtagatggcacagctgagaacggaatacaccctttaagtagcagcgaagtcgacgagctcatacataaagctgatgaggtaacattgagcgaagcaggaagcaccgccggggccgctgagactaggggcgctgtggaaggggctgcccgcactactccaagtagacgggaaatcaccggcgtccaggcccagcccggcgaggcgacttccgggcctcccggcatacagcccggacaagagccacccgtgacaatgattttcatggggtaccagaatgtcgaggatgaggcagagactaagaaagtcctgggattgcaagataccataacagccgagctcgtcgtcatcgaggacgctgccgaaccaaaggaacccgccccaccgaatggatcggcagctgagccacctactgaggctgcgtccagagaggagaatcaggcaggaccggaagcaacgacatcagatccgcaagatcttgacatgaaaaagcaccgttgcaaatgctgctcaattatgtag

SEQ ID NO: 28732 - DNA, 1062 bp, Artificial Sequence
  Description of Artificial Sequence: Synthetic coding sequence
atggcaatgacactcctggaagattggtgtcgcggcatggatgttaacagccaacgtgcgcttctagtttggggaattcccgttaattgcgacgaagctgagatcgaagagaccctgcaggccgccatgccgcaggtgtcctaccgcatgctggggaggatgttctggagggaagagaacgcaaaagctgcgctgctggagctgaccggagccgtagattatgccgcaatcccaagagaaatgcccggaaaggggggggtgtggaaggtgctcttcaagcctccaacctctgacgccgagtttctggagaggctgcatctgtttttggcacgggaagggtggacagtccaggacgtcgcacgtgtgttgggttttcagaacccgacccctacaccgggacccgagatgcctgccgaaatgctgaattatattctcgacaatgtcattcagccactagtggagagtatttggtataaacgcctgacattattttcggggagggatatccccggccccggagaagaaaccttcgacccgtggctggagcacacaaacgaggtcctggaggagtggcaggtctcagacgttgaaaagcgcaggagactgatggaatctcttcggggccctgccgccgatgttatcaggatactaaaatccaataatcccgctatcacgactgctgaatgtctcaaggcgctggagcaagttttcggctctgtggagtcttcccgcgacgcccaaataaagttcttaaacacatatcagaatccaggagagaagctcagcgcttacgtgatcaggctggagccattgcttcagaaagtcgtagagaagggtgcaatcgacaaggataacgtgaaccaggctcgattagaacaggtgattgctggagccaaccactcaggggcaatccgcaggcagctgtggttgaccggggctggtgaggggccagctcctaacctgttccaattgctggtgcagatacgggaggaagaggcaaaggaagaagaggaggaggctgaggcaactttgctccagctgggcttagagggccatttctag

SEQ ID NO: 28733 - DNA, 1782 bp, Artificial Sequence
  Description of Artificial Sequence: Synthetic coding sequence
atgggaactgcccggatagcacccggcttggcactgctgctgtgctgtcccgttttgtcaagtgcctacgcactggtggatgccgacgatgtaatgacaaaagaggagcaaatcttccttctccaccgtgcccaggctcagtgtgagaagaggttgaaggaggtgctacagaggcctgcctccatcatggaatctgataaaggctggacctccgcaagcacatccggcaagcctagaaaggacaaggcctccggcaaactctatcctgaaagcgaagaggataaggaggcccccaccggttccagataccgagggcgtccatgcctacccgaatgggaccacatactgtgctggccactgggcgcacccggggaagtggtcgcagtgccttgcccagattatatttatgatttcaatcataaggggcatgcctacaggaggtgtgacaggaacggaagctgggagttagtcccagggcataaccgcacctgggctaactattccgagtgcgttaagttcctgactaacgaaactcgcgaaagggaagtatttgacagattgggcatgatctacaccgtcggctacagcgtgagtctggcctccctaaccgtggccgtgctgatcttggcctacttcagacgactgcattgcacgagaaactatatacacatgcatctttttctgtccttcatgcttcgggccgtcagcatctttgttaaggatgctgtgctatactcgggcgcaacgctggacgaggccgaacgtcttactgaagaagaactaagagcaatcgcccaagccccacccccgcccgctacggccgccgccggctatgcaggttgcagggtagcagtcacattttttctgtacttcttggcaactaattactactggatcttggttgagggtctgtacttgcattctttgatcttcatggccttcttcagcgagaagaaatatttatgggggtttacagtgttcggatggggtttgccagcggtatttgtggccgtgtgggtttccgtgcgggccaccctagccaacacagggtgctgggatctttcctcgggcaacaaaaaatggatcattcaggttcctatactcgccagtatcgtcctgaactttattctgtttattaacatcgtgcgagtcctggcaacaaagctgcgcgagactaacgccggcagatgcgacacaagacagcagtatagaaaactgttgaaaagtactcttgtgctgatgcctcttttcggggttcactacatcgtatttatggccacgccctataccgaagtcagcggcacactgtggcaagtgcagatgcactacgaaatgttgttcaactcctttcagggattttttgtggccatcatatattgcttctgcaatggagaggtccaggccgagataaagaagtcctggtcccgttggacactagcactggactttaaaagaaaagcccgctcaggtagtagctcatacagctacggacctatggtgtcacatacgtcagtgactaatgtcggcccacgggtaggactggggctgcccctgtccccgaggcttctgcccaccgcgacgactaatggccaccctcagctgcccggacatgctaaacctggaacgcccgcactggagaccctggagaccactcctcctgccatggccgcacccaaagatgatggatttcttaacgggagctgctcagggctcgatgaggaagcctccggaccggaacgtcctccggcgctgctgcaggaggagtgggagactgtgatgtag

SEQ ID NO: 28734 - DNA, 1782 bp, Artificial Sequence
  Description of Artificial Sequence: Synthetic coding sequence
atgggcactgctaggattgcacctggactggccttgttgctttgttgcccagtattatcttcagcctacgcgttagtggatgcggacgacgtaatgacaaaggaagagcagatcttcttgctgcatcgtgcccaagctcagtgcgagaagaggctcaaagaggtgctgcagcgcccggcctccatcatggagtcggacaaaggctggacaagtgcatctacaagtggtaagccaaggaaagataaggcgtcaggcaaactgtaccccgagtctgaagaggacaaggaggctcccaccgggtcccgatacagaggccggccttgcctcccagagtgggaccatatactttgctggccgctgggagcaccaggcgaggttgtagcagtgccgtgccctgactatatttatgatttcaaccataagggtcatgcctataggcggtgtgaccgcaacgggtcctgggagctggtgcccgggcataaccgcacctgggctaactactcagaatgcgtcaagtttctcactaacgaaacccgagagagagaggtgtttgacaggctgggtatgatatatactgttggttatagtgtgagcctggcaagccttacagtcgcagtcctgatactagcttattttagacggcttcattgtacacgcaactacattcacatgcatctgtttctgtccttcatgctacgggcggtgagcatttttgtgaaagatgcagtcttgtattctggggccaccctggatgaagccgagcggctcacagaagaagagctgagagccattgcccaggccccaccccccccagcgactgcagctgccggatatgccgggtgccgcgttgccgtaaccttctttttatacttcctagcgacaaattactactggatcctcgttgaaggcctatacctccattcacttatctttatggccttcttcagcgagaagaaatacctctgggggtttacagtctttggatggggacttcccgctgtcttcgtcgcagtttgggtctctgtccgcgccaccttggccaacacaggctgctgggacctttcctccgggaataagaaatggattattcaggtgcctatcctcgcctccattgtcttaaactttatactcttcattaacatcgtccgcgtgcttgccaccaagctccgtgaaaccaacgccggacgctgcgatactaggcaacaatatcgcaaactgctcaaaagcactctggtgcttatgcctttgttcggggtccattacatagtcttcatggccaccccatatacagaagtctcagggaccttatggcaggttcagatgcattatgagatgctctttaattcctttcagggctttttcgtagcaatcatttactgtttctgcaacggggaggtgcaggctgagatcaaaaagtcctggtctcgatggacgcttgccctagatttcaagcgcaaggctcgctcaggctcttcatcttatagctatgggcctatggtgtcgcacaccagcgtgacgaacgtgggcccccgggttggcctgggactccctttgagtccccggctgctcccgacagcaaccactaacggccatccccagctcccaggccacgccaaacctggaaccccagcccttgaaacactcgaaaccacacctcctgccatggctgcgcccaaggatgacggtttcctgaacggcagctgctctggtttggatgaagaggcatccggaccggagcgccctccggcccttcttcaggaggaatgggaaaccgtgatgtag

SEQ ID NO: 28735 - DNA, 1584 bp, Artificial Sequence
  Description of Artificial Sequence: Synthetic coding sequence
atgggcactgccaggatcgcacctggcctggctctgctgctgtgctgcccagtcttatctagcgcctacgccctcgtcgatgccgacgatgttatgacgaaggaagaacagatatttctgctgcatcgagcccaggcccaatgcgagaaaaggctgaaggaggtgctgcagcgtcccgcttcgatcatggagtcggacaagggatggacttccgcctctaccagtggaaaaccgaggaaagataaagccagtgggaagctgtaccccgaaagtgaagaagacaaagaggctcccactgggagccgctatcgcggtagaccttgtctgccagagtgggaccacatattgtgctggccgttgggcgcccctggtgaagtggtggccgtgccatgccctgattatatctacgatttcaaccacaaaggtcacgcctatcggcgctgcgataggaacgggtcgtgggagctcgttcctgggcacaaccggacttgggccaactattccgagtgcgtcaaatttcttaccaacgagactcgcgaaagagaggtgttcgatcggctcggcatgatttacactgtaggttactctgtatcattagcgtccttaacagtggcggtgctgatcctggcctactttagacgtctgcattgcactcgcaactacattcacatgcacctgtttttgagcttcatgctccgcgctgtgagtattttcgtaaaggatgctgtgctgtattcaggagccacccttgatgaagccgaacggctgacggaggaggaacttagagcaattgcccaggctccccctcctcccgccacagcggcagccggctacgctgggtgccgcgtagccgtcacctttttcctttacttcctggccactaactactattggattctggtggagggactctaccttcactctttgatcttcatggctttttttagcgagaaaaagtatttgtggggcttcacagtgtttggctgggggctcccggccgtgtttgttgctgtctgggtctcagttcgggcaacattggctaacaccggttgttgggacctgagtagcggaaataagaaatggattatccaagttcccattcttgcaagcatagtattgaatttcatcctgtttattaacattgttagggtactggccacaaagctccgggaaactaacgcgggtcgttgtgacacacgccaacaataccgaaaactcctgaagtccaccctggtgctgatgccgctgtttggcgtacactatattgtcttcatggccaccccttacacggaggtcagcgggactctgtggcaggtgcagatgcactacgaaatgctgttcaactcctttcagggctttttcgttgccataatatattgtttctgcaatggtgaggtgcaggcagagattaagaagtcctggtcaagatggaccctcgccctggatttcaaacggaaggctcgaagcggttcttctagctactcctacggcccaatggtatctcacacttccgtcactaacgtgggaccacgggttggactaggcctgcctctatcacctagactgctgcccacggcaacctag

SEQ ID NO: 28736 - DNA, 1002 bp, Artificial Sequence
  Description of Artificial Sequence: Synthetic coding sequence
atgggaacagcacgaattgctcccggcctcgcattacttctatgctgcccggtcttatctagcgcctacgcactcgtggacgccgacgatgtgatgactaaggaggagcagatctttctacttcatagggctcaggcccagtgcgaaaagcggctgaaggaagtcttgcagcgacccgccagtatcatggagagcgacaagggttggacctccgcttccacatccgggaagcccagaaaggataaggccagcggcaagctctatccagaaagtgaagaagacaaggaggcgccaaccggctctcggtaccgcggacgcccctgcttgcctgaatgggaccatatactttgctggccgctaggagcgccaggagaggtggtcgctgtcccatgcccagactacatttacgatttcaaccacaaagggcatgcttaccgtcgatgcgacagaaatgggagttgggagctcgtccccgggcacaatcggacatgggctaactatagcgaatgtgtaaaattcctgactaatgaaacacgcgagcgggaggttttcgacagattgggcatgatttatacagtgggttacagtgtcagcttagctagtcttaccgtggcagtcctgatacttgcctacttccggagactgcactgcactagaaactacatacacatgcacctgttcctctcatttatgttacgcgcagtcagcatttttgtaaaggacgctgtgttgtacagcggggccacattggatgaggcggaacgcttgaccgaggaagaattgcgggccattgcccaggcacctcctcctccggccacagctgccgccggatatgctgggtgcagggtggcggtaacgtttttcttgtacttcctcgccaccaactattactggattcttgttgagggtctgtacctgcactctctcattttcatggcgtttttttctgagaaaaaatatctttggggattcaccgtttttggatggggagccggaacttag

SEQ ID NO: 28737 - DNA, 1782 bp, Artificial Sequence
  Description of Artificial Sequence: Synthetic coding sequence
atgggtacagcccgaatcgcccccggccttgcactcctgctgtgctgtccagtcctgtcctccgcgtacgccctggtcgacgctgatgatgttatgacaaaggaggagcaaattttcctgctgcaccgcgctcaggcgcagtgcgagaaacgcctgaaggaggtactccagaggcccgccagcattatggaaagtgacaagggatggacttcagcttcgacaagcggcaaaccgcgcaaggacaaagcctccgggaagctgtatcccgagtccgaggaggacaaggaggctccaaccggatctaggtatcgcgggagaccctgcctgcctgagtgggaccacattctgtgttggcctctgggagccccaggcgaagtggttgctgtgccttgtcccgattatatttatgatttcaatcacaaaggccacgcttatcgccgctgtgatagaaatggctcatgggaactcgtgcctggtcataaccgcacctgggccaactactctgaatgcgtgaagttcctaaccaatgagacccgcgagcgcgaagtctttgataggctgggcatgatttacacagtgggctattctgtgagcctggcaagtttaaccgtggctgtcctgatcctcgcatacttccgtaggttacactgtacaagaaattacattcacatgcatttattcctctcattcatgcttagagctgtcagtatattcgtgaaggacgccgtgctgtactcaggcgctaccttggacgaagccgaacgactaaccgaagaagagctgagggccatcgcccaggcccctcctccccctgctaccgcagcggcgggttacgccggctgccgggttgccgtgaccttttttctgtacttcctcgccactaattattactggatcttggtcgaggggctttacttgcacagcctcatcttcatggccttctttagcgagaaaaagtatctgtgggggtttactgttttcggctggggtctgcctgctgtgtttgtcgcagtctgggtgagcgtccgggccaccctggcgaataccggttgctgggatctgagcagcggcaacaaaaaatggattattcaggtgcccatattagcctccatagtactgaactttattctctttatcaatatagtgcgagtgctggccacaaagctgagggaaaccaatgcaggccggtgcgatactagacagcaatacagaaagcttctgaaatcaaccctcgtcctaatgccccttttcggggtacattatatagtcttcatggccactccttacacagaagtgtcaggaacattgtggcaggtccagatgcattacgagatgctctttaacagctttcaggggttcttcgtggccattatatactgtttttgcaatggtgaagtgcaggctgagattaaaaagagctggagccggtggaccctggccctggattttaaaaggaaggctcggagcggttcgtcatcttactcatacgggccgatggtgagccatacaagtgttaccaatgtcgggcctagggtgggtctgggactccctctaagcccccgactgcttcccacggcaaccacaaacggtcatccccaattacctggacatgcaaaacccgggacaccggccttggaaacgctggagactacgccgcctgcaatggcagccccaaaggatgatggcttcctgaatgggtcctgctctggccttgatgaggaagcatccggccccgaacggcctcccgcacttcttcaggaggagtgggaaactgtcatgtag

SEQ ID NO: 28738 - DNA, 1782 bp, Artificial Sequence
  Description of Artificial Sequence: Synthetic coding sequence
atgggtaccgccagaatagcacctggtttggccctacttctctgctgtcctgtgctttcatctgcatatgccctcgtagacgctgacgatgtgatgaccaaggaagagcagatatttctgctgcatagagctcaggcgcaatgcgaaaagagactcaaggaagttctccagcgccctgcttcgattatggaatccgataaagggtggactagtgccagcacatccggtaagccacgtaaggataaagcctctgggaagctgtaccccgaaagcgaggaggacaaagaagcccctacaggctctcgctacagagggagaccttgtctgcctgaatgggatcatatcttgtgttggcccctcggtgcccctggcgaggtcgtggccgtaccatgcccagactatatctacgatttcaaccataagggccacgcctatcggagatgcgaccgcaacggaagctgggagctggtgcccggacacaacagaacctgggccaactactcagaatgcgtcaagttcttaacaaacgaaaccagggaaagggaagttttcgataggttgggcatgatatacaccgtgggatacagcgtttctttggcatccctaacggtggcagttctgattcttgcatacttcagaagactgcattgtacacggaattacattcatatgcacctttttctgagctttatgcttcgagctgtttccatatttgtcaaagacgccgtactttatagtggagctactctcgatgaggctgaacggctgaccgaggaggagctccgggccatcgcgcaagcgcctccacctcccgcaactgccgccgcgggttacgctggatgtagggttgcagtcaccttttttttgtactttctggccacgaattattactggatcctagttgaaggtctgtatcttcactcattgatcttcatggcgttctttagcgagaaaaagtacctttggggctttacagtcttcgggtgggggttacctgctgtgttcgttgcagtgtgggtgtctgttcgtgcgacgctggccaacaccgggtgctgggacctcagctctgggaacaagaaatggattatccaggtgcctatcctggcaagcatagtgctgaatttcatactgttcatcaatatcgtgcgggtactggcgactaaacttagagagactaatgcaggcagatgcgacacgaggcagcagtacagaaagctcctgaaaagtaccttggtactcatgccccttttcggagtccactacatcgttttcatggccactccctacactgaagtatccggcaccctttggcaagtgcagatgcactacgaaatgctctttaattccttccagggtttcttcgtagctataatctattgcttctgtaacggtgaggtgcaagccgaaatcaaaaagtcctggtctaggtggactcttgcactggactttaagcggaaggcaagatcagggagttctagttactcgtacgggccaatggtgtctcacaccagcgtcactaacgtcggaccacgggttgggctgggccttcccttaagccccaggcttttgccaaccgccactaccaatggccaccctcagctccccggccacgcaaaaccaggcactccagctctggagacactggaaacaacaccgcccgccatggccgcccctaaggacgatggattcctgaacgggtcgtgtagtggcctagacgaggaagcatcgggtcctgagaggcctcctgccctgctgcaggaagagtgggagaccgtgatgtag

SEQ ID NO: 28739 - DNA, 1653 bp, Artificial Sequence
  Description of Artificial Sequence: Synthetic coding sequence
atggcagggctcggagccagcttacacgtgtggggttggctgatgctgggatcatgcctgttggcacgggcacaactcgattcggacggtacgatcactatcgaggaacagatagtactggtactaaaagcaaaggtgcaatgcgagctgaatattacagcccagctccaagaaggtgaggggaattgcttccctgagtgggacggtctcatttgttggccgaggggcaccgtggggaagatcagcgcagtgccttgccccccgtatatttacgacttcaatcataaaggcgtggcattccggcactgtaatccgaacggaacatgggactttatgcattcattgaacaaaacctgggccaattacagcgactgtttaaggttcctacagcctgacatatccattggtaaacaagagttcttcgagcgactctacgtgatgtacactgtggggtacagcatcagcttcggctcattagctgtggctatattgataatcggatacttcaggcggctccattgtaccaggaactatattcatatgcacttgttcgttagcttcatgctgcgcgctaccagcatcttcgttaaagatagagtagtccacgcacacattggcgttaaggagctcgagagcttaatcatgcaggatgatccgcagaactccattgaggccacgtccgtggataagtcacagtacatcggttgtaagatcgccgtagtaatgttcatttatttcctcgcaaccaactattattggatcctcgtggagggtctatatctccacaacctcattttcgtcgccttcttttcagacactaaatatttgtgggggttcattctgattggctggggttttcccgccgccttcgtggccgcatgggccgtagccagagccactctggccgacgccagatgttgggagctatccgctggcgacatcaaatggatttaccaggccccaattttggctgctattgggctaaactttattctatttctgaacacagttcgcgtgctcgccacaaagatctgggagacgaacgctgtaggccatgatacacgaaagcagtatcggaaattggccaaatcaactcttgtattagtcttggtgtttggagtccattacatcgtcttcgtgtgtctgccccattcatttacaggactagggtgggagatccgcatgcactgtgagctgttctttaattcctttcaggggttttttgtaagtatcatctattgttactgcaacggggaggtgcaggctgaggttaaaaagatgtggagcagatggaacctgagcgtagactggaagcgtactcccccatgtggctctcggaggtgcggcagcgtgctgaccacagtgacccattcaacctcttcgcagtctcaggttgctgcgagcacccggatggtgttgattagtggaaaggctgctaagattgccagtcgacagccagatagccatatcactctgcccggctatgtgtggagcaatagtgaacaagactgccttcctcatagcttccatgaagaaacaaaagaggactctggccgacagggcgatgacatccttatggaaaagccatcaaggccaatggagtcaaatcccgacactgagggctgccaaggtgaaacagaggacgtcctgtag

SEQ ID NO: 28740 - DNA, 345 bp, Artificial Sequence
  Description of Artificial Sequence: Synthetic coding sequence
atgtccgcactctccctcctgatcttgggtcttctgacagccgtgcctccagcctcgtgccagcaggggctcggtaacctccagccatggatgcagggactgattgcagtggccgtgttcttagttcttgtagccattgccttcgccgtgaaccatttctggtgccaggaggaacccgaacctgcacacatgattttgactgtgggcaataaggccgatggcgtgctggtaggcaccgatggacgctattccagcatggcagcatcttttcggtccagtgagcatgagaacgcttatgaaaacgttccagaggaggagggcaaggtgcgatctactcccatgtag

SEQ ID NO: 28741 - DNA, 345 bp, Artificial Sequence
  Description of Artificial Sequence: Synthetic coding sequence
atgtcagccctgtccctcctgatactaggcctcctcacggcggtgcctcccgcttcgtgtcagcaaggacttggaaatttgcaaccctggatgcagggtctcattgctgtcgcggtatttcttgtgctggtagccattgccttcgccgtaaaccatttctggtgtcaggaggagcccgaacccgcccacatgatcctcaccgtgggaaataaagccgatggtgtactcgtcggtacggacggccgatattcgtcaatggccgcaagctttcgcagctctgagcacgaaaatgcctacgagaacgtaccagaagaggagggcaaagtgcgctctaccccaatgtag

SEQ ID NO: 28742 - DNA, 6810 bp, Artificial Sequence
  Description of Artificial Sequence: Synthetic coding sequence
atgggcagccagacattacaaattctgcgccagggcgtgtgggccgccctgtccggtggctggtactatgatccccaccaagcaacttttgtgaatgcacttcacctttacttatggctgttcttgctcggtctgcccttcactctgtatatggcattgccctccaccatgatcatagtcgctgtgtactgtccggtcattgccgccgtattcattgtgttgaagatggtgaattacagacttcatcgggctctcgacgctggagaagtagtggaccgtaccgccaacgaattcacagaccaacggaccaaggccgaacaggggaattgttctacacgccgtaaggactctaatggaccatctgatcctggtgggggaatcgagatgagcgagtttatacgagaggctacaccacccgttggatgttcaagccgcaactcttacgctggtctcgacccaagtaatcagataggatctgggtcttcacgcctggggaccgccgccacgattaagggagatacggacactgccaaaacatctgacgacatttctctcagtctcggtcagtccagttctctttgcaaggagggaagcgaggagcaggatctggccgccgatcgaaagctgttcaggcttgtgagtaatgactcctttatttccatccaaccgtcactttcctcatgcgggcaggacctgcctcgggatttcagcgataaagtaaacctgccaagccataaccaccatcaccatgtggatcaaagcctgtcctcagcctgcgatactgaagtcgccagcctcgttcctctgcatagccacagctaccggaaggaccaccggcctcggggggtgcctagaaccagtagttccgcggtggccttcccggatacttcccttaacgacttccccttgtaccaacagagaagaggcctggatccggtctcagagctagagagctctaagcctttatcggggagcaaggagtcactggtggaaaattcgggcttgtccggcgaatttcaattagctggagacctgaagattaatacttcgcagccgccaactaagtccggaaaatccaaaccccttaaggcagaaaagagcatggactcactcagatcgttatcgacgagatcttccggtagcacagaaagttattgtagtggcacagatagagatactaactcaaccgtatcttcttataagtccgagcagacaagctccacgcacatcgaaagcatcctatcagagcacgaagaaagccccaaggctggtaccaagtctggcagaaagaaggagtgctgtgccgggcccgaagaaaagaactcttgcgccagcgacaagaggacctccagcgagaagatagcaatggaagcctccaccaatagcggtgttcacgaagccaaagacccgactccctcagacgagatgcataaccagcgggggttatcaacttccgctagcgaagaggctaataaaaacccacatgccaacgagttcacgtcccagggtgacagaccacccggaaacacggcagagaacaaagaagagaagagtgacaagtcggcagtgtcagtcgatagcaaggtacggaaggacgtaggcgggaagcaaaaagaaggcgacgtgagaccaaagagcagcagcgtgatccacaggactgcatccgcacacaaaagtggccgacggaggacagggaaaaaaagggcttcttctttcgatagtagccgtcacagggattacgtctgtttccggggagtcagcggtaccaaaccccattctgccattttttgccatgacgaggactcatcggaccagtccgatctttctagggcatccagcgtccagagtgcccaccagttttcaagtgatagctcttccagcaccacctcgcactcctgtcagagtcctgaaggtcgctattctgccctgaagactaaacacactcataaagaacggggaacagattcggagcacacacataaagctcatctggtaccggaaggcacttcaaagaaaagagccacgcgtaggaccagcagtacaaacagcgctaaaacgcgggccagggtcctgtcactggatagtggtactgtggcctgtctgaacgactcaaaccggttgatggcccctgaatcaatcaagccactgactacctcaaaatcagatcttgaggcgaaggaaggagaagttcttgatgaactcagcctgcttggaagagcatcacagttggaaaccgtgactcggagtcggaacagcctgcccaaccaggttgctttccctgaaggagaggagcaagatgcagtctcaggtgccgcgcaagccagtgaagaggcagtttcctttcgacgtgagagaagtacgttcagaaggcaggcggtgaggcgcaggcataacgcagggtccaatccgacaccaccaacacttctgatcgggtcacctttgtccttgcaggacgggcagcaggggcagcagagcactgcccaggttaaagtgcagagccggcctcctagccaggccgccgtgctgtcagccagtgcctcgctgctggtaagaaacggttcagttcatctggaagccagtcatgacaatgcttccgcagtgggtggctccagtctgcatgacgagctggggaagttctcgtcgaccctgtacgagacaggcggctgcgacatgtcactcgttaattttgagcccgccgcacggcgagcgagtaacatatgcgataccgatagtcacgtgagcagcagcacaagtgtcagattctaccctcatgatgtgctttccctgccgcagatccggcttaacagactgctgacaatcgacacagatttgctagagcagcaggacattgatttgtccccggatctagctgccacttacggccctaccgaagaagctgctcagaaggtgaagcactactaccggttttggatactgcctcagctttggatcggaattaacttcgacagattaacacttttggcactctttgatcgcaacagagagatcctcgagaatgtgttggccgtcattttggccattctcgtggcgtttctgggatccattctattgattcagggtttttttcgggacatctgggtctttcaattctgcctggtgatcgcctcctgccagtattcccttctgaagagcgtgcaacctgatagctcctccccacgtcacggacataacaggattatcgcatattctagaccagtctacttttgtatctgctgcggcctgatatggttgctggactatggctctcggaacctaacagcgaccaagtttaaactgtatgggattaccttcactaacccactcgtatttattagtgctcgagacttggttatcgtctttacattgtgttttccaatagtgttctttattggtttgctgccgcaggtcaacaccttcgtcatgtacctgtgcgagcagctcgacattcatatatttgggggcaacgccactacgagtctgcttgccgcactgtacagctttatttgctctattgtggctgtagctctgctgtatggcttgtgctatggggcacttaaagattcctgggacggccagcacattcccgttctgttctctatcttttgtggcttactagtcgccgtgagctatcatctgtcgcggcagagtagtgacccttcagtactgttttccttggtacagtctaaaatcttccctaaaacagaggaaaagaatcctgaagatccactgtcagaggttaaagaccccctgcccgagaaactgaggaacagcgtgagcgaacggctgcaaagcgacctcgtggtctgtatagtgattggtgtgctctatttcgctatccatgtttctactgtctttactgtacttcagcctgcactgaagtatgtcctttataccctcgtgggattcgtgggattcgtgacacactatgtgcttcctcaggttagaaaacaattgccatggcactgtttcagtcaccctctgttgaaaacactggaatacaaccagtacgaagtcaggaacgccgctacaatgatgtggttcgaaaaactgcatgtttggctgctgtttgttgagaagaatattatctaccctctaatcgttctgaatgaactctccagtagcgctgaaacgatcgcgtctccaaaaaagctgaacaccgagctgggggcgctgatgattactgttgctggcctgaagctgttaagatcgagcttctcatcccccacgtatcaatacgtgaccgtaatattcacagtcttgtttttcaagtttgattacgaagctttcagcgaaaccatgctgctggacctcttcttcatgagcatactctttaacaagctctgggaactgctctacaagctgcagtttgtctacacctacattgccccttggcagataacatggggctcagcctttcacgcatttgctcagcctttcgctgttccccactcagccatgctgtttatccaggccgccgtgagcgccttcttctcaaccccactcaatcccttcctgggctcagctattttcataacatcgtacgtacgcccagtcaaattctgggaaagagattacaacaccaaacgggtggatcactccaatacgagactagcctctcagctggaccgaaatcccgggacatactgccagcagcgggaggtggaggccataactgagggtgtagaggaggatgagggattttgctgttgtgaaccagggcacataccgcacatgctctccttcaatgccgccttctcccagcggtggcttgcctgggaggtcatcgtcactaagtacatccttgaaggatactccataactgataattcagccgctagcatgcttcaggtctttgacctgaggaaggtactcaccacctactatgtcaagggtattatttactatgtgacaacctctagcaagctcgaagaatggctggccaacgagacgatgcaggaaggtttgaggctatgcgcagataggaattatgtcgacgtggatccaacattcaatcccaatatcgacgaagattacgaccacaggctggccggcataagtcgcgagagcttttgtgtcatttacttaaattggattgaatactgctcatccaggcgggctaagcccgtcgacgtcgacaaagactcgtccctcgttacattatgctatggcttgtgcgtgctcggaagacgggccttaggcacagccagtcaccacatgtcctccaacctggagtcattcctgtacggcctgcacgccctgtttaaaggtgactttcggatctcatctatcagggacgaatggatctttgccgacatggagctgttacgcaaagtggttgtccctggcatccggatgagcatcaaactccatcaagatcactttacttcccctgatgagtatgacgacccgacggttctatatgaggcaatcgtgagtcatgagaaaaacttagtgatcgcccacgaaggagacccagcttggaggtcagccgtgctggctaactctccctccctactcgccttgcgccacgtcatggacgatgggacaaacgaatacaaaataattatgctgaacaggcgatacctctcgttccgcgtgatcaaagttaacaaggagtgcgtgcggggcttatgggctggacagcagcaggaattggttttcctgaggaatcgcaatcccgaaaggggctccatccaaaatgccaaacaggctctcaggaacatgattaactcatcctgtgaccaaccaatcggctatcccatatttgtgtccccgctgactactagctactctgatagtcacgagcagttaaaagatatcctgggcggccccatttccctggggaacattagaaatttcatcgtgtccacctggcaccggctaaggaagggttgcggcgccggatgcaacagcggaggaaatatcgaggacagtgacactgggggggggacatcatgcacgggaaataatgctactacggccaacaacccccacagcaatgttacccagggcagtattggcaacccgggacagggcagcggaacgggcttgcaccctccggttaccagctatcccccaactctgggcaccagtcattctagccatagtgtgcagagtggtctggtgcgtcaaagtccagccagagcctccgttgcgtctcagagtagctactgttattctagccggcattccagcttgcgtatgtcaacaacaggcttcgttccatgtcggcggtctagcacgtcccagatctccttgagaaacctgcccagcagcatccagagcaggctaagcatggtcaatcagatggagccaagcggtcagtccggcttggcctgtgtgcagcacggcctgccgtcttctagtagctctagtcagagtatccccgcgtgtaagcaccatactcttgttggctttctggccactgagggaggacagagctctgccaccgatgcacagccaggcaacactctatcaccagccaacaattctcactctcggaaggccgaggttatttaccgtgtacaaattgtggatcccagccaaattctggaaggaattaatctgtccaagaggaaagagttgcagtggcccgacgagggaatacggctcaaagctggaagaaatagttggaaggactggagccctcaggaagggatggaaggccacgtgatccaccgctgggtcccctgcagccgcgatccagggacgaggtcgcacattgacaaagccgtattattagtccagatcgacgataaatatgtgactgtgatcgagacaggtgttttagaactcggagcagaggtatag

SEQ ID NO: 28743 - DNA, 7026 bp, Artificial Sequence
  Description of Artificial Sequence: Synthetic coding sequence
atgggcagtcagaccctacagatactgcggcagggtgtgtgggccgctttgagcggaggttggtattatgatcctcatcaagcaacatttgtcaacgcactccatctgtacttgtggctttttttgttgggccttccttttaccctctatatggcccttccctccacaatgataatcgttgcagtctattgcccagtcatcgctgctgtgttcatcgtcctgaagatggtcaattatcgcttacatcgggcactagacgcaggtgaagtggtcgacagaacagcaaacgagttcactgaccagcggacaaaggcagaacaaggaaattgctcgacacgcagaaaggatagtaatggcccatctgatcctggcggggggatcgagatgtccgaattcattcgagaagccaccccccctgtgggatgcagcagccggaacagttacgctggactggacccctctaaccaaatcggatccgggagctctcggctcggcacagcggccaccattaagggagacactgacaccgctaaaaccagtgacgacatttccctgtccttaggccagtcttcctctctgtgtaaggagggatctgaggagcaggacctcgctgccgaccgcaagctgttccggctagtgtcaaatgacagctttatctcaattcagccttcactgtcctcttgcgggcaagaccttccacgcgacttctccgataaagttaacctgccatcccataatcatcatcatcacgtggatcaatccctctctagcgcatgtgacaccgaggtcgccagcctggttcccctgcacagccactcttacaggaaggaccatcgacctcgaggtgtgccccgcaccagctcgtctgcagtggcatttccagatacctccctcaacgattttccgctttaccagcagaggcgagggctagatccagtgtccgagctggagagtagcaagccactgtctggaagcaaggagtcactggtagagaacagcggcctgagcggagaatttcagctagccggggacttgaaaataaatacatcccagcctcctaccaaaagcggtaagagtaagccacttaaggcggagaaatcgatggactctttgaggtcactttcaacaaggtccagcggctctactgaatcctattgctctgggaccgaccgcgatacaaattccaccgtctccagttacaagtctgaacagactagcagcacccacattgagtcgattttatccgaacatgaggaatctcccaaggcgggcacgaaaagtggccgcaagaaggagtgttgcgccgggcctgaggagaaaaacagttgcgcgtcagacaagaggacttcatcagagaagatcgccatggaagcttccacaaattccggagtccatgaagcgaaggatcccacaccatcagacgaaatgcacaatcagagagggttaagcacctcagctagtgaggaggcaaacaaaaatcctcatgccaacgaattcacatcgcagggggaccgcccacccggcaatacagccgagaataaagaagagaaatctgataaatcagccgtgtcagtcgacagtaaggtgcgcaaagacgtcggcggcaaacagaaagaaggcgatgttcgtccgaagagttcaagtgtcatacacaggaccgcctctgcccacaagagtggccgaaggagaactggaaaaaaaagagcttcttcatttgacagttctcggcatcgcgattatgtctgcttccgcggtgtgtccggcactaagcctcatagcgccatcttctgtcacgatgaggattcatccgaccaatccgacttgagtagagcatcttctgtgcaatctgcccaccagttctcttcagactcttctagctctacgacatcccattcctgtcaatcacccgaaggaagatactcagccctgaagactaagcatacccacaaggagagaggcacagattccgaacatacccacaaagctcacctggttccagagggtacaagtaaaaaacgagccacacgccgcacctcttcaacgaatagcgcaaaaacacgggctcgtgtgctaagccttgattccggaacggttgcctgcttgaatgatagcaatcgcctgatggccccagaaagcatcaagcctctgactacgtccaagtctgatctagaggccaaggaaggcgaagtactggatgagttatcactgttaggccgggcatctcagcttgagactgtcactaggtcgcggaactcccttcccaatcaagtcgcgtttccagaaggcgaggagcaggacgccgtgtctggtgctgctcaagcctcagaggaagccgtgagttttcggagagagcggtccactttccggcgacaggcggtgcgccgccggcacaacgccggtagcaacccaacaccccccactctcctcatcggctcacctttgtccctacaagacggccaacaaggacaacagagtactgcccaggtaaaagtgcagagcagaccgccaagccaggctgctgtgctctctgcctcagcttctttgctcgttaggaacggtagcgttcacctggaagccagccatgataacgcctcggctgtgggaggatcttccctgcatgacgaattgggcaagtttagttcaacactttacgagaccgggggttgtgacatgagccttgtgaatttcgagccagcagctcggcgagcttccaatatatgcgataccgacagtcatgttagttctagcactagcgtaaggttctatcctcacgacgtcctctctctgccacagatcaggctaaatcggctgctaacgatcgacactgatctgcttgagcaacaggacatcgacctctctcccgatctggccgccacgtacggacccacagaagaagccgcccagaaggtgaaacactactatcggttttggatcctgccccagttatggatcgggattaactttgaccgcctaactctgttagctctcttcgatcggaatagggaaatactcgagaatgtgctcgccgtcattctggccatactggtcgcattcctgggtagcattctgctgattcagggcttctttagggacatctgggtgtttcagttctgcttggttatcgctagctgccagtattccctgctgaagagcgtgcagccagactcttcttccccccgacacggccacaaccgcattattgcctattcccgccccgtgtatttctgcatatgttgtggcctcatttggctattggattatggatccagaaatctgactgcaaccaagttcaagctttatggaattacctttaccaatcctttggtatttatatccgcccgagacctggtcattgtatttaccctgtgttttcccatcgttttttttatcggactccttcctcaagtgaacacattcgttatgtatctctgcgagcagctggatatccatatttttggaggcaacgccacaacttccttgcttgctgccctgtatagcttcatctgtagcatcgtggctgtcgctctactttacggcctctgttatggagcattgaaggattcgtgggacggtcaacacatcccagtacttttttctatcttttgcggacttttggttgcagtgtcttaccatctgagccggcagtcctcggacccaagcgtgctcttcagtctagttcaatctaagatttttcccaaaaccgaagagaaaaaccccgaggacccactctcagaggttaaggaccccttgccagagaagttgaggaattcagtcagtgagcgtctgcaatcagacctggttgtatgcattgtcatcggggtactctatttcgcgatccacgttagcaccgtcttcacagtcctccagcccgcattaaagtatgtgctatatacactggttggcttcgtgggctttgttacgcattacgtgctgccccaggtgcggaagcagttaccctggcattgtttttctcatcccctgctgaaaaccttggaatacaaccagtacgaagttcgaaatgcagccaccatgatgtggtttgagaaactgcacgtgtggctcttgttcgtggagaagaatatcatctatccattaatcgtgttgaatgagttgtcttcttctgctgagaccatcgccagccccaagaaactcaacaccgaacttggcgcccttatgatcactgttgctggactgaagctgcttcggtcaagtttttcctcacctacttatcaatacgttacagtgatcttcactgtgttatttttcaagtttgattacgaggccttttcagaaaccatgcttctagatctctttttcatgtccatcctgttcaataaactctgggaattattgtataaacttcagttcgtttatacatacatcgccccatggcaaataacttggggttcagccttccacgcgttcgctcaaccgttcgccgtgccacacagtgccatgttgttcattcaggccgctgtctccgcattcttctctacacctcttaacccattcctgggcagtgcaatctttataacctcttatgtgaggcctgtcaagttttgggagagagattacaatacaaagcgcgtggatcactcaaatacgcgattagcctcccagttagatagaaatcctggcagcgacgacaacaacctcaactctatcttctacgagcatttaacaagatctttgcagcactccctgtgtggggacctgttgctgggacgatgggggaattactcaactggagattgcttcatcctagctagtgactatcttaacgccctcgtgcatctcatcgaaattggtaatgggcttgtcacttttcagctgcgagggctggagtttaggggcacatattgccagcagagggaggtggaggcaataaccgagggggtggaggaagatgagggtttttgttgctgcgaacctgggcatatacctcacatgctgtcattcaatgccgccttttcccagcgatggctggcatgggaagtcattgtgaccaagtatattctcgaaggctattctattactgacaactccgccgcctccatgcttcaagtgtttgatctcagaaaggtgctgaccacatattatgttaaaggaattatttattatgtaacgacctcctctaaactcgaagaatggctggctaatgagacaatgcaggagggcctccgcctatgcgcggacaggaactacgtagatgttgatcctacctttaaccccaatatagatgaagattacgatcataggctcgcgggcatttcacgtgaatctttttgcgtgatttatctgaactggatcgagtactgtagctctcgccgggccaaacccgttgatgtagacaaagatagttctctggttaccttatgctacggactatgtgtcctgggacggagggccctgggcaccgcttcccaccatatgtcatctaacctggaatcctttctgtacggcctgcacgctctatttaagggcgattttcgcattagctccatcagagatgagtggattttcgcggacatggagcttctgcggaaagttgtcgtaccgggaattcggatgtcaattaagctgcaccaagatcatttcaccagccctgatgaatacgacgacccaaccgtgctgtatgaggccatcgtgtctcatgaaaagaacctggtgatcgctcacgagggagacccagcttggcgctccgccgtgctggcaaattcaccctcactcttggcactccgccatgttatggatgatggaactaacgaatataaaatcattatgctcaatcgacgatacttaagtttcagagtaattaaagtaaataaggaatgcgtccgaggcctctgggctggtcaacaacaggaattggttttccttcgcaacagaaatcctgaaaggggaagtattcaaaatgccaagcaggccctccgcaacatgattaacagttcttgcgatcaacctatcggatacccgatatttgtgagccccttaacgacctcttattccgactctcatgaacagttaaaggacatactgggcggccccattagcctgggcaatatacgaaactttattgtgagcacctggcatcggcttaggaaagggtgtggagctggctgtaattccggaggcaatatagaggattcagataccggcggaggcacgtcatgcacaggtaataacgccaccacagccaacaatccccacagtaatgtgacacagggcagcattggcaaccccggtcagggatcaggcaccggactgcatcctccagtgacttcttaccctcctacccttgggacttcgcattctagccactcagtgcaatccggcctggtgcgacaaagtccagcccgagcatcagtggcttctcagagttcttactgctattcctctaggcactcgagtttgcgcatgtcaacaactggcttcgtgccctgcagacgcagttcaacctctcaaattagtctcagaaacctccctagttcgattcagtcaagattgtctatggtgaatcagatggagcctagcggacaaagcggattggcatgcgtacaacacggtctaccctcttcaagcagcagttcgcagagcatccccgcttgtaagcaccacacattggtggggtttttagctaccgaaggtgggcagtcctcggcaaccgacgcgcagccaggcaatacgctgtctccagcgaacaactctcactctaggaaagccgaagttatctatcgcgtccagatcgtggacccttctcagattcttgagggcatcaacctttccaaaagaaaagagcttcagtggcccgatgaaggaatcagactcaaagcaggtaggaattcctggaaagattggtctccccaggaaggcatggaagggcacgtcattcacagatgggtgccatgtagcagagacccaggcactcgctcccacatcgacaaggcagtccttctggttcagatcgatgataagtacgtgaccgttatcgagacgggagtgctggagctcggcgctgaagtgtag

SEQ ID NO: 28744 - DNA, 6693 bp, Artificial Sequence
  Description of Artificial Sequence: Synthetic coding sequence
atggggtctcaaaccctacagatactaagacagggcgtgtgggctgctcttagtggaggctggtactatgacccacaccaggccaccttcgttaacgcgctgcacttgtacctctggttatttcttctcggactacctttcacactgtacatggctctcccatccaccatgattatcgtggctgtgtactgtcccgtaattgcggctgtgtttatcgtactcaaaatggtaaactaccgcctccaccgtgccctcgatgccggcgaggtcgtggacaggaccgcgaatgaattcaccgatcaaaggaccaaagctgagcaggggaactgttctaccaggcggaaagactcaaacggaccctccgacccaggcggtggtatagagatgtccgaatttatccgcgaggcaactccccccgtgggctgcagtagccgtaacagttatgccggtctggatccttcaaatcagataggatctggaagcagtcggttgggtacagctgcaacaataaagggtgacactgatactgccaaaactagcgacgacatctccctgtcgcttggccagtccagctcattatgtaaagaggggagcgaggagcaggacctggctgctgataggaaactgtttcggctggtcagtaacgattcttttattagtatacagccaagtcttagctcttgtggacaggacctgccccgtgacttttccgacaaagtgaacctgccgtcacacaaccatcatcaccacgtagaccagtctctgagctctgcttgcgacactgaggtggccagcttggtccctttacattcccatagttaccgcaaggaccacaggccccgcggcgtgcctcgcacctcatcgagtgcggttgctttccccgatacctcattaaatgactttcctctttatcaacaacggcggggcttggacccggtgagcgagctggagagctcaaagcccttgagcgggagtaaagagagcttagtagagaattctggactttctggcgagtttcagctggcaggggacctgaagatcaatacgtctcagcctcctacaaaaagtgggaagtctaaacctttgaaggccgaaaaatccatggattctttgcgcagcttaagcacacgttcatcagggtccactgagagctactgtagcggaaccgaccgagacacaaactctactgtgagcagttacaagagtgagcagaccagcagcacccatatcgaatccatcttgtccgaacatgaggaatcaccgaaggctggcacgaagtccggcagaaagaaagagtgctgcgctggtcctgaagagaagaattcatgtgcatcggataaacggacctctagcgaaaaaattgccatggaggcaagtacaaacagcggtgtccacgaggctaaagaccccacaccttctgatgaaatgcacaatcaaagaggcctgagtacgtccgcttccgaagaagcaaataaaaatccccacgccaacgagtttacttcccagggcgatagacctccaggaaacaccgccgagaataaggaagagaaaagtgataaatctgcggtgtctgtggactccaaggtgaggaaggatgtgggcggaaaacagaaagagggtgacgtaaggccaaagagttcatcggtgatccaccgaactgcttctgctcacaaatctggtagacgacgaactgggaaaaaacgcgcttcaagctttgattcctctaggcatcgggattatgtttgttttaggggtgtgagcggtactaagccacacagtgctattttctgccacgatgaggattcctctgaccagagtgacctctccagagctagcagtgtccaatcagctcatcaatttagcagcgacagttcgtcttccaccacatcacatagttgtcaatctcccgaaggaaggtactctgccctgaagaccaagcatactcacaaggaacgcgggactgatagtgaacatacccacaaggcacatctcgtgcccgaagggacgtcgaagaagcgggctactcggcgaacctcatctactaatagtgccaagacaagagcgcgagtattgtcccttgacagtggcaccgtcgcctgcctcaatgacagtaatcgtctgatggcgccagaatccattaaacccctgaccacctctaaaagcgaccttgaagctaaggaaggcgaagtcctggatgagttgagcttgctgggcagagcatcccagcttgaaaccgtaaccaggtctcgcaatagtctgcccaatcaggtggccttcccggagggggaggagcaggacgcagtcagtgggggtaaattttcatcaacactgtacgagaccggcggctgtgatatgagcctcgtcaattttgagcctgcagcaagacgcgcctccaacatctgcgataccgactcgcacgttagttcttccacctccgtgaggttctacccacacgacgtcataaggcttaaccggctcttaactatcgataccgacttactggagcagcaggacatagatctcagtcccgatctggccgcaacctacggaccaacagaggaagctgctcagaaagttaaacactactacaggttctggattctgccacaactgtggattgggattaatttcgatagacttacgcttctggccttgtttgaccgcaatcgcgagatcctggagaacgtgctggccgtgattctggcgatccttgtcgcctttctgggatccattctcctgattcaggggttcttcagggacatctgggtatttcaattttgcctggtcatcgcatcatgccagtacagtttgttaaagtccgtccaaccagatagctcctccccacgccatggccacaatcggattatagcatattctcggcctgtgtatttctgtatctgctgtggtctgatctggcttctcgactacgggagtcgtaacttaactgccacaaagttcaagctgtacggcatcacattcacgaaccccttggtcttcatctcagcgagggatttagtgatcgtatttacgttgtgctttccaatcgtcttcttcataggactcctaccacaggtaaacacatttgtgatgtatctctgcgagcagctagatattcatatcttcggcggcaatgctaccacgtccctgctggccgccctttactcatttatctgcagtattgttgcggttgcattgctgtatggactctgctacggcgccctgaaggactcctgggatggccaacatatacctgtgttgtttagcattttctgtggtctgctggtagccgtctcctatcatctatcccgccaatccagcgatccttccgtgctgttctctttggtgcagtccaagatttttccgaagaccgaagaaaaaaatcccgaagatcccttgtcagaagttaaggaccctctgccagagaaacttcgtaatagcgtgtctgaacgtctgcagagcgacctggtggtgtgcatcgtcatcggcgtgctttactttgccatacacgtatcaacagtttttaccgtgcttcagcctgcgttaaagtatgtactgtatacgttggtcggcttcgtgggttttgtgacacactatgtcctccctcaagtcaggaagcagttaccctggcattgtttttcacacccgctgctcaaaacgctggagtacaatcagtatgaggtccgcaatgccgccaccatgatgtggttcgaaaaacttcacgtgtggctcctcttcgtggagaagaatatcatctacccgctgattgtgctcaacgaattatcctctagtgctgaaactattgccagcccaaaaaagctcaacacagagctgggcgcattgatgatcactgtggccggcttaaagctgctgagaagttcctttagtagccctacctaccagtacgtaaccgtgatcttcaccgtgttgttctttaaatttgattatgaggctttttctgagactatgctccttgacttgttcttcatgagcattctcttcaataaattatgggagctgttgtataaactacagtttgtgtacacctatatagccccgtggcaaattacatggggctctgcttttcacgcattcgctcagcctttcgcagttcctcactccgcaatgctgtttatacaggccgctgtatctgctttttttagcacgcctctgaatccgttcctgggaagtgccatttttatcacgagttacgtgcggcccgtcaagttttgggagagagattataacacaaagcgtgtagatcacagcaatactaggctggcatcgcagctcgataggaatccagggtccgacgacaacaacctcaactccattttttacgagcacctgacccggagcttgcaacactctttatgcggcgacctccttctcggccgctgggggaactactccacaggagactgctttattctcgcatcagactacttaaacgcactcgtgcacttgatcgagatcggtaatggactggtaacattccagctaaggggcctggaattcagagggacctactgccaacagcgcgaggtcgaggcaatcactgaaggcgtagaagaggacgagggtttttgttgttgcgaacctggtcatataccacatatgttgagcttcaacgcagcgttttctcaaagatggctcgcgtgggaggtgatcgtgacaaagtacattctcgagggttatagtataaccgataatagcgcagcctccatgctgcaggtattcgatctgagaaaggtgcttactacttattacgtgaaagggattatctactacgtaactaccagtagcaagctcgaagaatggctcgcgaacgaaacaatgcaggaaggcctgaggctgtgcgctgatcgcaattatgtcgatgttgatcccacatttaaccctaatatcgacgaggactacgatcataggctggccgggatttcgcgcgagagcttttgcgtgatttatctgaattggatcgaatactgctcttctaggcgggccaaaccggtcgacgtcgataaggattcaagcctggtgactctttgctacgggctgtgtgtgctgggccggcgggctctggggacggcatcccatcacatgtcatcaaacctggagtcttttctgtacggcctccatgccctgtttaagggtgattttagaatttcttctatacgcgacgagtggatatttgctgacatggagctcctccgaaaagtggtcgtgccaggaatcagaatgagcattaagctgcaccaggatcacttcaccagtccagatgagtatgatgatccgaccgtgctgtacgaagccattgtttcccacgagaagaatctggtgatcgcacacgaaggcgacccagcatggcgtagcgctgtgctcgcgaacagtccatccctgttggcccttcggcacgtgatggatgacggtaccaatgagtacaagattatcatgctgaaccggaggtaccttagctttagagtgatcaaggtaaataaagagtgcgtgaggggactgtgggctggacaacaacaggaactagtattcttacggaatagaaatcctgagcgggggagcattcagaacgccaagcaggctcttcggaatatgatcaatagcagctgtgatcagcccattggataccccatctttgtgagcccactgactacaagctatagtgattcgcatgaacagttaaaagacattctaggcgggccaatctctctagggaatatccgcaactttattgtgtccacctggcatagactgagaaagggctgtggcgccggatgtaactctggcgggaatatcgaagactctgacacaggtggggggacatcttgtaccggaaacaatgctacaaccgcaaataacccccatagcaatgtgactcagggatccatcgggaatccagggcagggttcaggaaccgggctgcatcccccagtcacttcttatccccccacactgggaacttctcattccagtcattctgttcaaagcggcttggtacgtcagtctccggcccgagcctctgtagccagtcaatcctcttactgctacagcagcaggcactcaagcctcagaatgtccactaccggtttcgtcccgtgtcgccgatcctccacgtcacagataagtctgcgcaatctccctagttccatccaaagccgactgtcaatggtgaatcagatggagccaagcggccagagtggactggcctgcgtccaacatggacttcctagcagttctagttcatctcagtcaatccctgcctgtaagcatcacacgcttgtaggttttctagcaacagaaggcggacagagcagcgctaccgacgctcaacctggcaacaccctgagccccgccaataattcacactctcgcaaagccgaagttatttacagggtacagattgtggatccttcccagatcctggagggaatcaacctgtccaagcgcaaggagctgcaatggcccgacgaaggcatccgcctgaaagcaggcaggaattcatggaaggattggtcacctcaggaaggcatggaaggacatgtgatccacaggtgggtaccctgttcccgcgatcctggcacccggagccacattgacaaggctgtgttgctcgtgcaaatcgacgataagtacgtcacagtgatcgagaccggcgtccttgagctcggcgccgaagtgtag

SEQ ID NO: 28745 - DNA, 3987 bp, Artificial Sequence
  Description of Artificial Sequence: Synthetic coding sequence
taggacctgttggagcagcaagatatcgacctatctccagatctcgccgcaacttatggccctaccgaagaggctgcacaaaaggtgaagcattactatcgcttctggattcttcctcaactgtggataggaatcaactttgataggctcaccctgcttgccctgtttgataggaacagagagatcttggagaacgtgctggcagtgatcctggcaattttggtagctttcctggggagcatccttctgattcagggttttttcagagacatctgggtatttcagttctgtttggtgattgccagctgtcaatattccctcctaaaatcagtacagccagactcttcgtctcctcggcacggccataacaggatcatcgcatattctaggcccgtctacttttgtatatgttgtggtttgatctggttgctcgattacggctctaggaacttgaccgctaccaagttcaaactgtatgggatcacgttcacaaatcccctggtgttcatcagcgctcgcgatctcgtgattgtttttactctgtgtttcccaatcgtgttttttattgggctgctccctcaggttaatactttcgtgatgtatctgtgcgaacagctcgacattcacatctttggagggaacgcaacgacctcacttctcgcagctctgtactccttcatttgctccattgttgctgttgcactgctctacggcctgtgttacggcgccctaaaggactcttgggatgggcagcacatccccgtcctcttttccatcttttgtgggctgttagtcgccgtctcctatcatctgagtcggcagagtagtgacccctcagtcctgttctctctggtacagtcaaaaattttccccaagacagaggagaagaatcccgaagatcccctttccgaagtcaaggatcctctgcccgagaagcttcggaacagtgtgagtgagagactgcagagtgatcttgttgtgtgcatcgtcatcggggttctgtacttcgcgatccacgtgtctaccgtgttcaccgtgctgcagccggcccttaaatatgtactttacaccctagtggggttcgtaggctttgtaacccattatgtcctgccccaggtgagaaagcagctgccttggcactgtttttcccatcctcttctgaagaccctggaatacaatcaatatgaggtccgaaacgcagccactatgatgtggtttgagaaactccacgtgtggctgctgttcgtcgagaagaatattatctacccccttatcgtacttaacgagctgtcttcttctgcagaaaccatcgcatcgccaaagaagctgaataccgaactgggggccctaatgataaccgtggccggtctaaaactgctgcggtctagcttttcttcccctacatatcaatacgtcaccgtgatatttactgtcctctttttcaagtttgattatgaggcattcagtgagacgatgttgttggatctttttttcatgtctatcctgtttaacaagctgtgggagctactctacaagttgcagttcgtgtatacgtacatcgccccgtggcaaataacctggggaagtgcattccatgccttcgctcagccctttgcagtccctcattctgccatgctcttcattcaggccgccgtgtcagcttttttctcgacaccgctgaacccttttctggggagcgctattttcatcacaagttacgtcagacccgtgaaattctgggaacgcgattataacacaaagcgagtagaccacagcaatacccggctggcatcccagcttgaccggaacccggggacctattgtcagcagcgggaggtagaagcgatcacggagggcgtggaggaggatgagggattttgctgctgcgagcctggccacattccgcatatgctgagtttcaacgctgcattttcgcaaagatggcttgcgtgggaagtgattgtgaccaaatacatacttgaaggctatagtattaccgacaatagcgccgcttcaatgctgcaggtgtttgacctgaggaaggtgctgactacttattacgtcaaaggaatcatctactatgtgacgactagttccaagctggaagagtggctcgcaaacgaaaccatgcaggaaggcttgaggctgtgcgccgaccgtaactacgtggacgttgatcctacctttaaccccaatatcgatgaagattatgaccaccgcctcgctggaatctcgagggaatctttctgtgtcatttatctgaactggatcgagtactgcagtagcagacgagccaagcctgtggatgtcgacaaggattcctccctggttaccctgtgttacggcctttgtgtcctggggagacgggctttgggaactgcatctcatcatatgtcttctaatctcgagagctttctttacggcctgcatgctctctttaaaggcgattttagaatatcatcaatccgggacgagtggatttttgctgacatggagctgttgagaaaggttgtggtgcccgggattcggatgagcatcaagcttcaccaagaccacttcacttcacccgacgagtatgatgatccaaccgtgctttacgaggccattgtctctcacgagaagaatttggtgatagctcacgagggcgatcccgcttggcgatctgcagtgttagccaacagtcccagtcttctggcactgagacatgtcatggatgacggcacgaatgaatataaaattattatgctgaaccgtcggtacctctcctttcgggtgatcaaagtgaataaagaatgtgttcgcggcctatgggccgggcagcagcaggagctcgtattcttgcggaatcgcaatcccgaacgaggatctattcagaacgcaaaacaggcccttaggaacatgattaattcttcttgcgaccagcctataggataccctatctttgtgtcaccgctgactacgtcatacagtgacagccatgaacaattgaaggacatcctggggggtccaatttctcttggcaatatacggaactttattgtgagtacctggcacaggctcagaaaggggtgcggcgcggggtgtaatagtggagggaatatcgaagatagtgatacagggggcggaacatcttgtacaggaaacaacgctactacagcaaacaatcctcacagcaacgttacccaaggttctatcgggaatcctgggcagggctcgggaactggcctccaccctcctgtcaccagctatcctcccactctgggtacatcccattctagccactcagtgcaaagcggtctcgttcggcagagtcctgcacgcgcgtccgtggcgtcccagagtagttattgttatagttctcgccacagttcgttgcggatgagcaccaccgggttcgtaccgtgtagaaggagttcgacaagccagattagtcttcgcaaccttccttcatccattcaaagtcgcttgagcatggtgaatcagatggagccatcaggtcagagcggactggcgtgcgtgcagcacgggctgccctcgtcctcctcttcgtctcagtccattcctgcgtgtaaacatcacacactggtgggctttctggcaacagagggaggacagtcatccgctaccgacgcccagcctgggaatactctgtcacccgcaaacaatagccacagcagaaaggccgaagttatctaccgcgttcagatagtggatccatctcagatattggaggggatcaatctaagcaaacgtaaggagctgcaatggccggatgagggaatccgtttaaaggctgggcgcaattcttggaaagactggtcacctcaggaggggatggagggtcatgtgatacacaggtgggtaccgtgttcgcgagatcctggcacccggtcacacattgataaagctgtgctcctcgtgcagatcgacgataagtacgtgactgtgatcgaaaccggggtgttggagctgggcgcagaggtctag

SEQ ID NO: 28746 - DNA, 6414 bp, Artificial Sequence
  Description of Artificial Sequence: Synthetic coding sequence
atggtttctcaagtgttacagctcctccgtcagggcgtctgggcggctctgacaggcggctggtaccacgacccagaacagtccaagtttacaaacagctgtcacctgtacctgtggctgttcttgctgctgctcccactcgcattgcacctagcttttccacctaatgccatcatagtgtttttctattgcagtgctgtgacaattttcttcacgattattaagctggtgtcataccggttacatttgatgtttgacaagggagaagtgatccagcagaaaccctcccggaaggaagagaagccaaataaagataaggaggcaaagggcgaacacatcaccaatcatcgcaatccctccaacaaccggcagatccataacggcaaaaaagaagaagccagtcgcaacctgtctaccccccccctgcgctgtagtagcagaggccagtcgattacctctcatcattcttccggtcctctagaactgagcgcacaagaaactgtggaggaccttaagggtgtcatcctcttagaagaccatcccatagctccagtctcgtccacaagccctggaattaaggtcgagagcctgccagcatcgcaggctcacatgctggaaacaaccaccaagagtgtgatcccagtcaaacctgtggcaaccgaaaccctgataaatggaaaaggcaaggagagggggggcaaaggccaacccccactgagacaccggagcgaggggggtctagtcgacaagggacccctcaaaaagttgccccacctctccctgagccaatacgacttgcttgagaccgatgtgtcttttcagccctggggttccgagaactcagtgttgatacctgaaccagtttcatgcccacggggatctattagagagcgtgtgcagagtaagtctccacaggattccttgtcatctagctgcccccaatgcgacacaatcgtggcaaagcctgtggaggagcccgccgatacttcttgtcaggtggatacaagttgtcaaggtgacctgccgctacatcaagaggtggactcctccgacagcgaagtagcggtcaccctcattgatacatctcagccgggcgacccactgtctctgcacgagccaatcaagatagtgatcacaatgtcgtcaacgcctaactctatgacagacctggagtcttctctccatctgagggttgtaggtacggagaagacctccgtcaagagcgatgccgaacccaccaatcctggtgcagcaggttctcccaacgctgaacagattagtatccctgtaatcaccctcgacctgcccgaaggaggcggaggaggtgtgccctgcccagagggaaacggctctgaacgcacaccagaaaggctaaagactagagtctctactaatcagtgtagcggctatggctctggcgaaggtggcaatgcaatcaaggaccactcttcaagcagcagggagccctgggagtcagtgtccaggctgacacccgataccggttctgagtcgaaggttgggaaggagggacagacgaatctggatccgtcatcctgtaaatcctcacacgagaagcggcacgctcgggtgctctctgtcgatagtggcacagacgttttcctcagcaagtcaagtgcggagatcgtcaacgacactgagaagacaatgcccacatccaaaagcgacttggaagccaaagagggccagatgccaaacgaaagtaacttcctggagttcgtctcgttgctggagtctataaacaccagcaaaatgacagcatcctcccagcttaatggcagcgcagagcagaacgaggagagcggactactgcgcgataactgttcacaggagaagaaggaggaaatattagagaatgaaaaaccatcagggcactcctcaaagcagggaaagccagacctacagtctcaggaccatacttctacagggcctgcctgtacccagccagccaagactactgccttcttccaggggaacaggcagcggcagatcatctatcgcgtgacctctcaacaggattccagtgtgctgcaagtgatctctggaccggaaaccagcgtgcaggaggaaattagcgtggatgctatgcacgtctttattgatgagcacggcgagatcagaagttgctatctgaaatcaggaaatcaaaaggaggggcctttgcagcccctgccaagcaacaatgactgtctgtcccaggctagggaaatgcaagtttcctcaagcagcacgaccacttccgaatcccaggatccctcgtcaggcgacccggccgtcagtgcgctgcagcaacaactcttactgatggtcgctagacgcactcaaagcgaaacaccaagacacgtgtcccaagacctcgaggcaagcagctgctcctccacccaggggaaatttaaccgggagcaattttacaagtttatcatcttcccaggcaaatggattaaggtttggtacgaccgtctgaccttgctggcccttctcgataggaccgaagacatcaaagaaaatgtcttggccatcctcctcatcgtgctggtcagcctactaggctttctaacgctttctcaggggttttgcaaggacatgtgggttctgctgttctgtttggtcatggctagttgccaatactctctgctgaagtccgttcagccagaccctgccagcccaatacatgggcacaatcaaatcatcacgtattcacggcccatctacttctgtgttctgtgcggattaattctgctgttggatacaggcgccaaggcacgccatccgcccagttacgtagtttatggactgaaacttttctctccggtgtttctccagtccgccagagattacctcatcgtgtttttatactgcttccctgctatcagcctgctcggcctgtttccacagataaacaccttttgcacttatctcttagaacaaatcgatatgttattcttcgggggctcagcagttagcggaattacgtcggcagtctatagcgtagccaggtcagtgctagctgccgcactgctgcacgctgtatgcttctccgccgtgaaagaaccctggagcatgcagcacattccagctctgttttctgctttctgtggtttactggtcgctctaagctaccatctgtcacgccaaagcagcgatcctagcgtgctcatgagctttattcaatgcagactcttcccgaagttcttgcatcaaaacctcgcagaatccgccgccgaccctcttcctaagaagatgaaggattcagtgaccgacgtgttgaagtgggatctgatcgtgtgcgctgttgtcgcagtattgagttttgctgtcagcgcctccaccgttttcctgagtctgagaccatttctgtccattgttttgttcgccttagctggagcagtcgggtttgtgacccactacgtacttccccagttgagaaaacatcatccctggatgtggataagccacccgatcctaaagaataaggaatatcatcagcgcgaggttagggacgtagcacacttgatgtggttcgaacgtctttatgtgtggctgcagtgtttcgagaagtatatcctgtaccccgccctcatcctgaacgccctcacgatagacgcattccttataagtaaccacagaaggctgggtacccattgggatatttttctgatgatcatcgcgggtatgaagctgctgaggacgagcttctgcaaccccgtgtaccaattcatcaacctgtcattcacggtgattttcttccacttcgactataaagacatatctgagtcgttcctgcttgacttcttcatggtgagtatattatttagtaagctgggggatctcctccataagctccagttcgttctgacttatgttgcaccttggcagatggcgtggggatcctcattccatgtgtttgcccaactgttcgctatacctcattctgccatgcttttcttccagaccattgccacctccattttcagcaccccattaagtccatttctcgggtcggtcattttcataaccagctatgttcgaccagtcaagttctgggaaaagaattacaacacccgcagagtggacaattctaatacaaggttagccgtccagattgagagagatccaggcaacgacgataacaatctgaacagcatcttctacgaacaccttacgcgcacactccaggagtcactttgcggggacctggtgctaggcagatggggcaactatagttccggcgactgttttattcttgcctccgatgacctgaatgcattcgtgcatttaattgaaatcggtaacggcttggtcactttccagctgcgcggtctcgagttccgggggacatactgtcagcagagggaagttgaggctattatggaaggagacgaggaagaccgaggctgctgctgttgtaaaccaggccacctgccacacctcctttcttgcaacgccgcgttccacttaagatggctaacttgggagattactcagacacagtacatactggagggctattctatcttggacaataacgccgcaacaatgttacaagtgttcgatctcagacgcatactgattcggtactatattaagagcatcatctactacatggtcacaagtccgaagctgctgagctggatcaaaaatgaaagcctgcttaagagcctgcagccctttgccaaatggcattacatcgagcgcgacctggccatgttcaatataaatatcgatgacgactatgtgccttgtttgcaggggatcactagagcttctttctgtaacgtctacctcgagtggattcagcactgcgcccgaaagagacaggaaccgtccacaacccttgacagcgatgaggacagccctttggtcaccctttccttcgcattgtgtaccctgggccgccgcgcactggggactgcagcccacaacatggccataagtctggattcttttttgtacggactccacgttctgttcaagggagatttcaggattacagctagggatgagtgggtgtttgctgatatggacctgctccataaggtggtggcgcccgcaatccgtatgagcctgaaactccatcaggatcagttcacttgccccgacgaatatgaagaccccgccgtgctgtacgaggccattcagagtttcgaaaagaaagtggtgatttgccatgaaggtgacccagcatggagaggcgcagtgctgtccaacaaagaggaactgctgaccctgcggcacgtggtcgatgaaggggccgacgagtataaggtgataatgttgcaccgtagttttctgagcttcaaggttattaaggtgaacaaggaatgcgtgcgaggcttatgggccgggcagcagcaggagttgatattcctcaggaacagaaatcccgagaggggatccattcagaacaataagcaggttctgagaaacttaatcaattcctcatgcgaccagcctctcggctatcccatgtacgtgtcccccctcaccacaagctaccttggcactcatcgtcaacttaaaaatatatggggaggccctataaccctcgatcgaatccgaacatggttctggacaaaatgggtgcgaatgcgcaaggattgtaatgctcggcagcacagtggggggaacattgaggacgtagacggagggggcgccccaaccactggcggcaataacgccccgtcaggaggctcccaggagtcctctgctgaacagcctagaaagggcggcgctcagcatggcgtaagtagttgcgagggaactcagaggaccggacgccgaaaggggaggtcccagtcagtgcaggcacactccgccctcagccagcggccgccaatgctctcttcctcaggccccattctcgaatcccgacaaacatttctccagacgtctacatctgtccatgaactcgcgcagagattatcaggttccaggttgagccttcacgcctccgcgacaagcctgcattcccagcctccgccagtgaccacaaccggccatctgagtgtacgtgagagagcagaagctctgatcaggtcaagccttggcagctctaccagctcgaccctatccttcctgtttgggaaacgatctttctcctcagcccttgtcatctcgggcctgtccgccgctgagggggggaacacttcagacacccaatccagctcatcagtgaacattgtgatgggaccttcagcaagggctgcatctcaagccactaggcacttatccgaaccatgcgagcccccggatgccacagaacaagggcagctgcatgatcggtgcctggccgaagctgttgctgatacacttggagtggtatgtagacgggcttctcaggaagacatggggttagacgacaccgctagccagcaaagtgtcagtgacgaacaatag

SEQ ID NO: 28747 - DNA, 2334 bp, Artificial Sequence
  Description of Artificial Sequence: Synthetic coding sequence
atgaccttctatcccttcgtggcgagctcctccaccagacgcgtggacaattcaaatacccggttagcagtgcagatcgagcgggatcccggcaatgatgataacaacttaaattctattttctatgaacaccttacccggacactccaagagagcctctgtggagacctggtcttgggtaggtgggggaattactcctcaggcgactgctttatcctcgccagtgatgacctgaatgcctttgtgcacctgattgaaataggtaacggtcttgtgacattccagctgcgcggcttagaattccgtggaacatattgtcagcagagagaagtcgaggctataatggagggcgatgaggaggaccgcggttgctgttgctgtaaacccggtcatctgcctcacctgctaagctgcaatgctgcttttcacctgaggtggctgacctgggaaattacacagacacagtacatccttgaaggttattcaattctggacaacaatgccgctaccatgctccaggtgtttgatttgcgtagaattctgatcagatactacatcaaaagcatcatttattatatggttacatcgcccaaactattgagttggatcaagaacgagtcccttctgaagtccctacaaccctttgctaagtggcactatattgagcgtgacttggccatgtttaacatcaatatcgacgatgactatgtgccctgccttcaaggcattacccgagcgtccttttgcaacgtctacctggaatggattcaacactgtgctaggaaacgccaggagccatcaacaactttggattccgacgaggactcacccctggtgaccctgtcattcgctctttgcacgcttggcagacgcgctctaggcaccgcggcgcataacatggcaatatccctggactctttcctgtacggtcttcatgtgctgtttaagggagatttccggataactgcccgggacgagtgggtattcgctgacatggacctcctgcacaaggtcgtcgctccagccatcaggatgtccttgaaactgcatcaggaccaatttacttgtcctgatgaatatgaagacccagccgtgttgtacgaggcgattcaatcatttgagaagaaggtggtcatctgccatgagggcgatcctgcctggcgtggagcggtgctttctaacaaggaggaactgttgaccctgaggcacgttgtggacgaaggcgccgacgaatataaggtcatcatgctgcaccgctcattcctgagttttaaggtcattaaagtcaacaaagaatgtgtcagaggtctctgggccggacagcaacaggagcttatcttcttaagaaatcggaacccagagagaggctcaattcagaataataagcaagtgttgcgcaatctgataaatagcagttgtgaccagccattaggctaccctatgtacgtatcaccattaacgacgtcttacttgggcacgcatcggcaactaaagaacatctggggcgggcccattaccttggatcgtatccgtacttggttctggaccaagtgggtgagaatgcggaaagattgcaatgcgagacagcatagtggtggtaacatcgaggacgtggacgggggaggtgcccccaccactggcggcaataacgctccatctggcggctcccaagagtccagcgccgagcagccacggaagggcggagcccaacacggagtcagctcttgcgaaggcacccaaaggacagggagacggaagggaaggtctcaatctgtccaagcccatagcgccctgtcgcagcgtccaccgatgttgtcatcatcaggcccaatcttagaaagccggcaaacctttctgcagacctccacaagcgtgcacgagttagctcagagacttagcggaagccgcctgtccttacatgctagtgccacttcactacacagccagcccccaccagtgacgacaacaggccatttgtcagttagagaaagagccgaagcattaatcagatcatcactgggctccagcacatccagcaccttaagtttcttgtttggaaaacgctccttcagttccgcgctggtgatctcaggtctatctgccgctgagggggggaacacatctgatacgcagtcaagttcaagtgtaaacattgtcatgggcccttcagcccgggccgctagtcaggctaccagggttcgcggatgggccggcttgaccaggacgggctgggacggcggcaccgggagctggccagaacggggaacatgtctggcatttccgccattttgcctgcagaaccctatcccgttcagcatgggcttgccggagtag

SEQ ID NO: 28748 - DNA, 861 bp, Artificial Sequence
  Description of Artificial Sequence: Synthetic coding sequence
atgcacgtcttcattgacgagcatggcgaaattcggagctgttatttaaagagcggcaaccaaaaggaaggacccttacagcctttaccaagcaacaatgattgcctaagtcaggcccgcgagatgcaggtcagctccagttctactacaactagcgagtcccaggacccttctagtggcgatcccgccgtgtctgcactgcagcagcaactactcctgatggtggctcggcggactcaaagcgaaacgcctagacacgtctcacaggacttggaagcttctagttgctcgtccacccagggtaagttcaaccgagagcagttctataagtttataatcttccctggtaagtggatcaaggtgtggtatgataggcttacactgctcgcccttttggaccggacagaggatattaaggaaaacgtgctggccatactgctgatcgttcttgtgtccttgctgggtttcctgacattgagccagggcttttgtaaagacatgtgggtgctcctcttctgcctagtgatggcaagctgccagtatagcctgctgaaatcagttcagcctgatcccgcctcccctatccatggccacaatcagataatcacctacagccgacccatttatttctgtgtgttgtgtggcctaattcttcttctagataccggtgctaaggctcgacaccccccctcctatgttgtctacggcctaaagctcttctctcccgtgtttctgcagtccgcccgcgactacttgatcggaaaaataatgaattcacacaaagattttttcaccagtgaaaagaaaaaagacaaaataatctcagctatctcatctgttatctttctgaagtcttggtag

SEQ ID NO: 28749 - DNA, 6105 bp, Artificial Sequence
  Description of Artificial Sequence: Synthetic coding sequence
atgggttcacaggtgttgcagatcttgagacaaggagtctgggcaagcctgaccggcgggtggtttttcgacccacatcagtcaactttctccaattgttttcacttgtacgtctggattttcctgctgatcttcccctttctactatacatggtccttcccccctctcttatggtcgccggcgtttattgccttgttgtggcggtgatcttcgccacaattaagacagtgaattaccgtctccacgccatgttcgatcagggtgagattgtggaaaagcggtcatctaccatgggggagcttgaggaagagcccgcacaaggcgatagtaatcctcctagggatccaggtgtggaaatgaccgtgttccgcaaagtgagctcaaccccccctgtgaggtgctctagtcagcatagcgtgtttggttttaatcaggtatctgaactgctgcctcggatggaggatagcggacctctcagagatatcaaagaactagtgcgagaacaaggcagcaacaacgtgatcgtgaccagcgctgacagggaaatgctgaaactgagtagtcaggaaaaactgatcggggacttgccgcagactcccccaggtgcggtgcctgatcccagcttggcgtctaccgattcctctgaaccctcacctctggcgggcgacggggccccctggagcggctcatctatggctgatactccaatgtctccactgttgaaaggatcattgagccaggagctgagtaaatccttcctgactctgacacagcccgatcgcgctcttgtgagaacgtcttcaagacgggaacagaggcgtggagcggggggttatcaaccattagatagaagagggtccggggagccaacaccccagaaggccggatcctccgatagctgcttctcgggcaccgatagagaaacattatccagttttaagtccgagaagaccaatagcactcatctcgatagcccacctgggggtcccgcccccgagggatccgatacagaccctccatctgaggctgagcttccagctagtcccgacgccggcgtgccctccgacgataccctgcggtcttttgacacggtcattggcgccgggacaccgccaggcctggccgaaccccttctggtggttaggcccaaagacctggccctgctcagaccatcaaagcggcagcctcccttaaggcgtcattccccgccagggcgggcgccccgcagacccctgttggagggtggcggctttttcgaggatgaggacactagcgaggggtcggagctcagccccgccagttcactacggtcacagaggcgctatagtaccgatagctcttcatccacgtcgtgctattcacctgaatcgtccagaggggcggccggaggcccacgaaaacgaagggcaccgcacggcgccgaggagggtacagccgttccccccaaaaggccctacgggacccagcgtaccccctctacggcatctgctaaaacacatgctcgcgtgttatccatggacggtgccgggggggatgtccttcgcccgcccctggcaggttgcaaagcagagttagaggcacaagtgggggtggaacaggcagcctcagaaccagtggtgcttcctgccgaggcccgccggggccccgctgccaaccaacctggatggcgaggcgagctgcaggaggaaggtgctgtcgggggagccgccgaagaaaccggtcgccgcgatcgttcttcaagcgttcggcggacacaagcaattagaaggcgccataatgccgggtcaaacccaacccccccagcttcagtgatggggtcacctccttctagcctccaggaggcccaaagaggccgggccgcctcccattcccgtgctcttactctcccaagcgctttacactttgcttcttccttgctcctgactcgtgcgggcgctaacgtgcacgaggcatgcacttttgacgacacatctgaaggggctgttcactacttctacgatgaaagcggtgttcgccggtcgtatacttttgggctggccggaggaggatatgagaacccagtggggcagcaaggagagcagacagcaaatggggcctgggataggcactcacacagcagttccttccatagtgcagatgtgcctgaagccacaggcggactgaaccttctccagccaagacccgtggttctgcagggcatgcaagtgcggagagttcccctcgagattcctgaggaacagaccctcatggaagaggcaccccctagagctcagcactcatacaagtattggctgctcccaggtagatggactagcgtgcgctatgagagactggctctattagctctgctggataggacaaggggcgtgctggagaatattttcggagtgggcctatcatccctggttgcgtttttaggctacctgttgctgcttaaaggattttttacagacatctgggtttttcagttctgtctggtcatcgcttcctgccaatattcactgttaaagagtgttcagcctgatgccgcgtccccgatgcacgggcacaactgggttatcgcttattcacgaccagtgtacttctgtatctgttgcctcctgatctggctgctggacgccctggggtctgcacagcctttccccccagtgagcctttatggccttacactgttttcggcctctttctttttttgtgcgcgtgacgtggccacagtgttcacactgtgcttccccttcgtgttcctcctggggttgttgcctcaggttaatacctgccttatgtatttgctggagcagatcgacatgcatggatttggtggtaccgcagccacctcaccgctgacagcagttttctcattgagcagatccctgttggcagccgcattactgtatgggttttgcctgggtgctatcaagacgccatggccagaacagcacgtccctgttctcttcagtgttttctgcggcctacttgtggctctttcctaccacctgtctcgccagtcatcggacccaaccgttctgtggagcttaattaggtctaagctgtttcctgagttggaagaacgatccctggagacagcccgggcggagccccccgatccactgccagataagatgaggcagtctgtccgggaggtgcttcacagcgatttagtaatgtgtgtggtgattgccgtgctgacctttgccataagcgcatccacagtgttcatcgcgctgaaatcagtgcttggctttgtcttgtatgcattagctggagccgtcggatttttcacccactatctgctgcctcagctccggaaacaactgccatggttttgtctttctcaacccgttctgaaaccccttgaatactctcagtacgaagtgcggggcgccgctcaggtcatgtggttcgaaaagctctatgccggcctgcaatgtgtagaaaagtatctcatttaccccgccgttgtcttaaacgctctgaccgtggatgctcatacagtcgtgtcccaccctgacaagtattgcttctactgccgggcactgctgatgactgtcgcaggccttaagctcttacggagtgctttctgctgccctcctcagcagtacttaacattggcctttaccgtgctgctcttccattttgattaccctaggctctcccagggattcctgcttgactattttctgatgagcttgctgtgtagcaagttgtgggacctgctctacaagcttcgattcgtgttaacctatattgccccctggcaaatcacatggggatcggcgttccatgcttttgcccaaccattcgccgttccgcacagtgctatgctgttcgtgcaagcgttgctgtcaggcctgttttccacgcctcttaaccccctgctcggctctgcggtctttatcatgagctatgctcgacctctcaaattctgggagagagactacaatacgaaaagggttgaccattccaacacacgactcgtgacacaactcgataggaatccaggcgcagatgacaacaatctgaattcaatcttttacgaacacctgacaaggagcctccaacacaccctgtgtggcgacctggtcctggggagatggggtaattatgggccaggcgactgctttgtgctggcttcggattaccttaatgctctagtgcaccttatcgaggtaggtaacgggttggttaccttccagcttcgtgggctggaatttaggggcacctattgccagcagagagaagtcgaagcaataacggaaggtgtcgaagaggatgaaggttgttgctgctgcgaacccggccacctcccacgtgtgttgtccttcaatgcagcatttggacagaggtggctcgcatgggaggtgacagcctctaagtacgtgctagaaggttactccatctccgacaataatgcagctagcatgttgcaggtgtttgacctacgtaagattcttattacctactatgtgaagtccataatatattacgtatccagaagtccaaaactcgaagtatggctgagccacgagggcataacagcagccctcaggccagtgcgcgtgcctggctacgccgattccgatcctaccttcagtctgtcagtggacgaggattatgatttgcgtttgagtgggctctcgcttccatctttttgcgcagtccacttagaatggatccaatactgtgcttcacggcgtagccagccagttgatcaggattggaactctccgcttgtcacactgtgtttcggcctgtgtgtcctgggcaggcgggctttggggacggcttcccactcaatgtccgcaagcctcgaacctttcctgtatggcctgcatgccctcttcaagggggattttcggataacttcccctcgcgatgaatgggtgtttgctgacatggacctactccaccgcgttgtggctccaggtgtacgaatggccctgaaactgcatcaggaccacttcacatcacctgatgaatacgaggagccggcggccctgtacgatgccatcgctgccaacgaagaaaggctcgttatctctcacgaaggtgacccagcatggagatccgctatcctgagcaataccccctccttgctagctctgcgccatgtgctagacgatgccagcgacgagtacaaaattattatgcttaaccggcgtcatctgtcgtttcgtgtcattaaggtgaaccgcgaatgcgtgaggggactctgggctggacagcaacaggagttggtgttcctgcggaatcggaatcccgagcgggggtcaatccagaacgccaagcaggccctaagaaacatgattaactccagctgtgaccagcccctcggttaccccatatatgtgtctccgctcacgacatctcttgcaggatctcaccctcagcttagagctctttggggagggcctatttctctgggtgcgatcgctcactggctgctgagaacatgggaacgtctgcataagggttgtggcgccgggtgtaactccggagggaatgtagatgacagtgactgtagtgggggcggggggctcacgtctctttctaataatcccccagtggcccaccctacacctgagaacaccgctggtaatggtgatcagccactccccccgggtccgggatggggccctaggagcagcctgtccggaagtggcgacgggaggccaccacctctgttacagtggcctccacctcggctgcccggcccaccgccagcctctcctattcctacagagggaccacggacatccaggccaccaggtccaggcctgctttctagcgaaggtccttccgggaagtggtcactcggaggccggaagggattgggcggttcagacggcgagcctgctagcggttccccaaagggaggaacaccgaagtctcaggcccctctggatcttagcctttccctgtcactgtcattgagccctgatgtgagtacagaagccagcccgccacgcgcctcacaggacatcccttgtttggattcttctgcccccgaaagtggaacccctatgggtgcactgggcgattggcccgctccaatagaggagagagagagtcctgccgcccaaccactactggaacaccaatactag

SEQ ID NO: 28750 - DNA, 1167 bp, Artificial Sequence
  Description of Artificial Sequence: Synthetic coding sequence
atggtgcgggacagcatggctgcagcttttaggcctagcaacagagtactcctgcaggcccttcagattctcgtctaccctggcgtgggcggcagcggttccgtgtcttgtcggtgccctctcggcgccaaaaggtatctgcttactgataatgtggtgaaactgaaagagttccaacagaagaaggttgctgtcgcatgtaacctgtcaggaaccaaggaaacgtatttcagaaatctgaaaaaaaaattgactcaaaacaagcttatccttaagggggaactcattaccctcctgcacctttgcgaaagccgggaccatgttgagcttgccaagaacgtgatctatcgataccatgcggaaaataagaattttacccttggcgaatataagtttggccctctcttcgtaaggttatgctatgaacttgatcttgaggaatctgcagtggagctgatgaaagatcagcacttaagaggatttttctcagatagcacatccttcaatatcctgatggacatgttatttattaaaggtaaatataagagcgcactgcaggtgctaatcgagatgaagaaccaggacgtcaagttcacgaaggatacatatgtgctggccttcgcgatttgctacaagctaaacagtcccgaatcattcaagatatgcaccacgctgagggaggaggctctgctaaaaggcgaaatcctgtctcggcgcgcttcctgcttcgcagttgctcttgcacttaaccaaaatgaaatggctaaagcagtcagtattttcagccagattatgaatccggagtccattgcctgtatcaacctgaacatcattatccacatccaaagtaacatgctggaaaacttgatcaagacgttaaaaaatgcggccgagggcaatttgtccaagtttgtgaaacgacacgtgttttccgaggaagtgcttgccaaagtccgcgagaaagtgaaagacgtgccggccttagtggcaaagtttgacgagatatacggaacactccatatcactggacaggtcacaacagattcactggatgccgttttgtgtcatacacctcgtgacagaaagtctcacacccttcttcttaacaagcgaatggtgtcccgaaggacgtttcagcctttatcgcaaagcctcctagcagaatag

SEQ ID NO: 28751 - DNA, 1167 bp, Artificial Sequence
  Description of Artificial Sequence: Synthetic coding sequence
atggtacgcgacagtatggctgctgcattcaggccttctaatcgtgtgctcttacaagcccttcagattcttgtgtaccccggagtaggagggagcggctctgtcagctgtcggtgccctctgggggcaaagcgctacctgttaaccgacaacgttgtgaaacttaaagaattccagcagaagaaggtggctgtagcttgcaatctatcaggtaccaaagagacatacttccgcaacctgaagaagaagctcacccagaacaaactgatactcaagggagagttgataaccctgttgcatctctgcgagtcgcgcgatcatgtggagctcgccaagaacgtgatttaccgttaccacgccgagaataagaattttaccttaggagaatataaatttggtcctttgtttgtcagactgtgctacgaactcgatctggaggagtccgctgtggagctgatgaaggaccagcacctgcggggtttttttagcgactctacctcgttcaacatcttgatggatatgctgtttattaagggaaagtataagtcagctctacaggtgcttatagaaatgaagaaccaggacgtgaagtttactaaagatacatacgtgctcgcgttcgctatttgttacaagttaaactctccagaaagttttaaaatctgcactacacttcgtgaagaggccctgctgaagggcgaaatactgagccgtagggctagctgttttgccgtggctttagctctaaaccaaaatgagatggccaaggccgtgtccatcttttcccagatcatgaacccagagtcaatcgcttgtatcaatttaaacataattattcacatccagtccaacatgctggaaaatctgatcaaaactctcaagaacgctgccgaaggtaatctgagcaagtttgttaagaggcacgtcttcagtgaagaggtgttagccaaagtgcgagagaaggtaaaagacgttcccgctcttgtcgcgaaatttgacgagatttatggcacacttcacattaccgggcaggtgacaactgacagtctggatgcagtcctgtgccatacacctagagatcgtaaaagccataccttgttactgaacaaaaggatggtttcaaggaggacctttcaaccccttagccagagtttacttgcagagtag

SEQ ID NO: 28752 - DNA, 651 bp, Artificial Sequence
  Description of Artificial Sequence: Synthetic coding sequence
atgtggaattggctgaagatgtctttcactggggccttacaggtacttatcgagatgaaaaaccaggatgtgaagttcacaaaagatacatacgtgctcgctttcgccatctgctacaagctgaattcccccgagagtttcaagatatgcactacactgcgcgaggaggccttgctgaagggagaaatccttagccgaagagccagctgcttcgctgtcgccctggctcttaaccaaaatgagatggctaaggctgtgtctatcttctcccaaatcatgaacccggagtcaatcgcttgcattaacctgaacatcataattcacatccagagcaacatgctggagaacctgatcaaaacccttaagaacgccgcggaaggcaacctctcaaagtttgtgaagagacacgtcttcagcgaggaggttctggccaaggtgcgggaaaaagtcaaggatgtcccagccctggtcgccaagtttgacgagatctatggaactcttcatataacaggtcaagtgactacagacagtctagatgcagttttatgtcacacccctcgagaccgcaagagccatactctgctgctgaataaaagaatggtctcgcggagaacatttcagcctctgagccagagcctgttggccgaatag

SEQ ID NO: 28753 - DNA, 486 bp, Artificial Sequence
  Description of Artificial Sequence: Synthetic coding sequence
atggttcgggatagtatggcggctgctttccgtccttctaatcgtgtgctgctccaggcattgcagattctagtttatcctggagttggcggtagcggcagtgtatcctgccgatgtccactgggtgcaaaacgctacctgctgactgataatgtcgtcaaattgaaggagtttcagcagaagaaagtggctgtggcatgcaacctgagcgggactaaggagacctacttcaggaacctgaagaaaaaactgacccagaataagctcattctcaaaggcgagcttattaccttacttcatctgtgcgaatcacgagatcacgtggaattggcgaaaaacgtcatatatcggtatcatgccgagaataaaaactttactctgggcgagtacaagttcggccccttgtttgtgagactctgctacgagctcgacctcgaagagagcgccgtggagctgatgaaggatcaggtgctgtgcaagtattag

SEQ ID NO: 28754 - DNA, 2070 bp, Artificial Sequence
  Description of Artificial Sequence: Synthetic coding sequence
atggcagtggtgtccgccgtaagatggctcgggttgcggagcaggctgggccagccacttacgggtcggcgtgccgggctgtgcgagcaggccaggtcctgcagattttattccgggtccgctacattgagtaaggtagaagggaccgatgtgaccggaatagaagaggtggtgatcccgaagaagaagacctgggataaagtggctgtgttgcaagccctggcgagtactgtgaaccgggacaccacagcagtcccctatgtctttcaggacgatccatacctgatgcccgcctccagtctggagtcccgatccttcctcctcgcaaaaaagagcggcgaaaacgttgcaaagttcattatcaatagctaccctaagtactttcaaaaggatattgccgagcctcatataccttgcctgatgccagaatatttcgaaccgcaaattaaggacatcagcgaagctgcgctgaaggaacgaattgagttacgaaaggtgaaggcaagcgtagatatgtttgatcagctgctgcaagctggaactaccgtctcactcgagaccacaaattccctcctagacctcttgtgctattacggggatcaggagccctctacagactaccactttcaacagacaggtcagtctgaggccctcgaagaagaaaacgatgaaacatctcgacgaaaagcaggacatcagtttggtgtgacctggcgggctaagaacaacgcagaacgcattttctccctgatgcctgagaaaaacgagcacagttactgtactatgatacggggcatggttaaacaccgggcctacgaacaggccctcaacttgtataccgaattgctgaacaatagactccacgctgatgtgtacacatttaatgctttgatcgaggctacagtttgtgccatcaacgagaagttcgaggaaaaatggagcaaaatcctggaactgctcaggcatatggtagcgcagaaagtgaagcccaacctccagacctttaataccatcctgaagtgcctccgcaggttccacgtattcgccagatcacccgcccttcaggtgcttagagaaatgaaagccattggcatagagcccagtctagccacatatcaccacataattcgcctcttcgaccagccgggggatccactcaaacgttcctccttcatcatctatgatattatgaatgaactgatgggtaagaggtttagccctaaggacccagatgacgataagttcttccagtcagccatgtccatctgctcttctctcagggacctggagctggcttaccaggtacacggcctgctgaaaaccggagacaattggaaatttatcggccccgatcagcatcgcaatttttattactccaagttctttgaccttatctgcctcatggaacaaatagatgtcaccctgaaatggtacgaggatctgattcctagtgcttacttcccgcactcccaaaccatgattcacctgctccaggccttagacgtggctaaccgcctagaagtgattccgaaaatatggaaggactccaaggagtatggccatactttcaggtctgacttgcgcgaagaaatattgatgctaatggctagagataagcatcccccagaactccaggttgcgtttgccgactgcgcagctgatatcaaatctgcatatgaatcgcagccaatacgacaaaccgcccaggactggcctgccacgtccctcaactgcatcgctatccttttcttgagggctggacggacacaagaagcatggaagatgctgggcctttttcgcaaacacaataagatccctaggtccgagctattgaacgaacttatggactctgcgaaagtgtccaattcaccatcccaggctatcgaggtagtagaactggcgagtgccttttccctgccaatctgtgaagggctgacccagagggtaatgagcgactttgctataaaccaggaacagaaggaggcactgtcaaatttgactgcccttactagtgacagcgacacagacagcagctcagacagcgactccgatacctccgaggggaaatag

SEQ ID NO: 28755 - DNA, 627 bp, Artificial Sequence
  Description of Artificial Sequence: Synthetic coding sequence
atggccgtggtgagtgccgttagatggctggggctgcgcagccggctggggcagcctctgaccggcaggagggcaggtttgtgcgagcaggctcggagctgccggttttattctggctctgctacactgtcgaaagttgaaggtactgacgtaaccggcattgaagaggtggtgatccccaagaaaaagacctgggataaagtggcagtactccaggcccttgcaagtacggtgaatcgggataccacagcggtaccttatgtgttccaggacgacccctatcttatgcccgcgtcctcactcgaatctcggtcttttttactagctaagaaaagcggagaaaacgtcgcgaaattcattatcaactcatatcccaaatacttccaaaaggatatcgcagagccacacatccccgaacccttgtgtctgctcaagcagcagatagtttcctggatctactgtgttacaatggtgacgcggtcaccacagctgatcaccatattcaataagctcgacagccagaagcactggaaacgaaagatgatgcggcatctggggggaaagctggtcatatctctcgaattgcacggagaacaaaaaactacattgcgggaatcatttctgtag

SEQ ID NO: 28756 - DNA, 1470 bp, Artificial Sequence
  Description of Artificial Sequence: Synthetic coding sequence
atggctgcagccgccgcccgagtagtactctcgtcagctgcccgccgccgcttgtggggattctccgaatctttattaataagaggggctgcgggaagatcactctatttcggagagaatagactcagaagtacacaggcagctactcaggttgtactgaacgtaccagagacccgtgtgacctgcctggagagtgggttgcgagttgcaagtgaagacagtggcctgtcgacttgcactgtcggactgtggatcgatgcaggctcccgctacgaaaacgagaagaacaacggaacagcacacttcctagaacacatggcgttcaaaggtacaaaaaagcggagccagctggacctggaactagagatcgaaaatatgggggcccatctgaatgcatatacctcacgtgagcagaccgtatactatgcaaaggccttctcgaaagacctacccagggcagtggagatccttgctgacattatacaaaactctactctgggggaagcggaaatcgaacgggagcgaggcgtgatcctcagggagatgcaggaggtcgagactaacctccaggaagtggtatttgattatctccatgctacggcatatcagaacacagccctcggcaggaccattctaggaccaaccgaaaacatcaaatctattagccgcaaagatctggtggattatattactacccactacaaagggccaagaatcgtgctcgcggccgccggtggggtgagtcacgatgaactactggacctggccaagtttcacttcggagattcactatgcacccataagggagagattcccgcattgccgccatgcaaattcaccggttccgagattcgcgtgcgggacgacaaaatgcccctcgctcatctagccatcgccgtcgaggctgtgggttgggcccacccggatacaatttgccttatggtggccaatactctcatcggaaactgggatcggagtttcggaggtggtatgaacttgtccagcaagcttgcccaacttacctgtcatggaaatctctgtcacagcttccaatctttcaatacttcctacactgacactggcctgtggggtctttatatggtctgtgaatccagtacagtagccgacatgttgcatgttgtgcagaaggaatggatgcgactgtgcacctccgtgaccgaatcagaggttgccagagccagaaacttgctgaagacaaacatgctgctgcaattggacggttcaactcccatctgtgaggatattgggcgccaaatgctatgttacaatcgaaggattccgatcccagaacttgaggctagaattgacgctgtaaacgcggaaacaataagggaagtgtgcacaaaatatatctataaccgcagccccgctattgcagctgtgggaccgattaaacagctgcctgacttcaagcagattcggtccaacatgtgttggctccgggactag

SEQ ID NO: 28757 - DNA, 1212 bp, Artificial Sequence
  Description of Artificial Sequence: Synthetic coding sequence
atggctttcaaggggacaaagaaacgatctcaattagacctggagctcgagatagagaacatgggggcccatttaaacgcctacacttcaagggagcagactgtatactacgctaaggctttcagcaaagatctcccccgcgcagttgagattctcgctgatatcatccagaattctacattaggcgaggccgaaatcgagcgcgaacggggcgtcattctaagggagatgcaggaggttgagacaaacctccaggaagtggtgttcgattacctgcacgccaccgcctaccagaatacagcattgggccgtaccatcctcggacccaccgaaaatatcaagtccatctcaaggaaggacctggtggattatataaccactcactataaggggccccgaatagtgcttgctgccgctggcggggtgtctcacgacgagttgctggacttggccaagttccactttggagatagtttgtgtacccataaaggcgaaattcctgcgctccctccttgcaagttcaccggcagcgagatcagggtgcgcgatgacaagatgcccctggctcacctcgctatagctgtggaagctgtcggctgggctcacccagacaccatctgcctgatggttgccaatacattgattggaaattgggataggagcttcggtggcggcatgaatctgtcttctaagctcgcccagctgacatgtcatgggaatctctgtcactctttccagtctttcaatacatcatataccgatactgggctgtggggcctctacatggtgtgtgagtccagcaccgtggctgacatgttgcacgtggtccagaaggagtggatgcgcctctgtacctcagtgaccgaatccgaggtcgctcgtgccagaaacttgctgaagacaaacatgctgctccagctggacgggtccacacccatctgtgaggatattgggaggcagatgctttgctacaataggcgaatcccaatccccgagctggaggcacgaattgatgccgtgaatgcagaaactattcgagaggtgtgcactaaatacatctacaatcgatcacccgccattgccgctgttggatataaccatagaagtgaactccacgagtggaagtggaataagctgttctccaagcgtcaaactatcagctattcatacgtgaatattctgttaccccaacctcagccccaatacgtctag

SEQ ID NO: 28758 - DNA, 645 bp, Artificial Sequence
  Description of Artificial Sequence: Synthetic coding sequence
atgaggccaggcgggtttcttggtgcaggccagcgcctgagccgggcaatgtcccgctgtgtgctggaaccaaggcctcccggcaagcgatggatggtggcggggttagggaacccaggcttacccggaacacgacactcagtcggaatggctgtgttgggccagctggcacgtaggctgggggtagctgagtcttggactagagatcgacattgcgcggccgacctagccctcgctcccttgggtgatgcccagcttgtcctgctgcgtccacggcgcctaatgaacgcaaatgggcgctctgtggcacgcgccgcagaattgttcggcctgaccgccgaagaagtttacctggtccatgacgagttggacaagcctttgggcaggcttgctctcaagctgggtggttccgcacgcggacataacggcgtacgttcatgcattagctgcctgaacagcaatgccatgccacggctgcgagtcgggattggaagacccgcacatccagaagcagtccaggcccacgtgttgggctgtttttctcccgccgagcaggagctgcttcccctcctcctggatcgagctacggatttgattctggatcacatcagggagcggtctcagggcccatcgctgggaccatag

SEQ ID NO: 28759 - DNA, 645 bp, Artificial Sequence
  Description of Artificial Sequence: Synthetic coding sequence
atgcgaccaggaggcttcttgggggccggacaacgcctgagtcgcgctatgtcaagatgcgtgctggagccccggccacccggtaagaggtggatggtggcagggctggggaacccaggcttgcctgggacccggcactcggtgggcatggctgtgctggggcagctcgctcggcggctgggagtcgcagaatcttggacccgggacagacattgtgcagccgacctggccctcgctcctctcggtgacgcgcagctggtactgctgagaccaaggcgccttatgaatgccaatggccggagtgtcgctcgcgccgctgagctgtttggacttacggcggaggaggtgtacctggttcatgacgaactggacaaacctctgggcagacttgcacttaagttgggaggcagtgctcggggacacaatggagtgagatcatgcatctcctgccttaacagtaacgccatgccacgactgcgtgtcggcattggcagaccggctcaccccgaggccgtgcaagctcacgtactggggtgcttctctccagccgaacaggaattgcttcccctgctcctcgatagggccacagatctgatcctcgaccacatccgcgagaggtcacaaggccctagtctgggaccttag

SEQ ID NO: 28760 - DNA, 4074 bp, Artificial Sequence
  Description of Artificial Sequence: Synthetic coding sequence
atgcaaacgctgggctcattctttggatcactgcccggcttctctagcgcgaggaacctggtcgctaatgcacacagcagtgcgagggcccggccagctgctgaccccacaggagcaccagcggctgaggcagctcagccccaggcacaggtggccgctcaccccgagcagaccgcaccttggaccgaaaaggagttgcagccatctgagaagcagatggtgtctggggctaaggacctagtgtgttccaagatgtcacgcgctaaggacgccgtttcctccggagtggcaagcgtggtggacgtggccaagggggtggtccaaggcggtctcgacaccactcggtccgccctaaccggcaccaaggaagtcgtttccagtggggttaccggcgcaatggacatggctaagggagccgtgcaaggtgggctagacacctctaaggcggtcctgactggaactaaagataccgtgtccaccgggctgacgggagcagttaacgttgccaaggggactgtacaggctggagtcgataccaccaagaccgtgctgaccggtaccaaggacacagtgacgactggggtcatgggcgcagtcaacctcgcaaaggggaccgtgcagactggcgtggagacatcaaaagctgttctgacaggcacaaaagatgccgtttcaactggcctcaccggggctgtcaatgtggcgcggggcagtatccagacaggcgtcgacaccagcaaaactgtcctcacaggcacgaaggatactgtctgctcaggcgtcacaggtgcaatgaatgtagccaagggcacaattcagacgggggtggacacctctaagactgtgctgaccggtacaaaggacacagtgtgcagtggcgttaccggcgccatgaacgtggctaaagggacaatccagaccggggtcgacacatcgaaaacagtgctcaccggcactaaagacactgtatgcagtggcgtaaccggcgcgatgaatgttgctaaagggaccatccaaactggggtcgatacaactaagaccgtcctgacaggaactaaaaacacggtttgcagtggggttacaggtgctgttaatctggccaaggaagctattcaaggcgggctggacacgactaaaagtatggtgatgggcaccaaggacaccatgtccacaggcctcaccggcgccgctaatgtagctaagggtgctatgcaaaccgggctgaacacaacgcagaacatagccaccggtaccaaagacaccgtttgcagcggtgtaaccggagccatgaatcttgcaagaggtaccatccagacaggagtggacactacaaaaatcgtgctcaccggcaccaaggatactgtttgcagtggggtaactggcgcagccaacgtggccaaaggcgccgtccagggaggtctggatactacaaagtctgttttaacagggactaaggacgccgtctctacgggcttgaccggggccgtgaatgtcgccaagggtactgtccaaaccggcgtggacacgacgaagaccgtgctgaccgggacaaaagatacagtttgctcaggggtgaccagcgcagtgaacgtggcgaagggggctgtccaggggggtttggatactaccaaaagtgtggtgatcggcaccaaagatacaatgtcgaccggcttaacgggtgccgccaacgttgctaagggggccgtccagacaggcgttgatactgcaaagacagtcctgacagggactaaggacacagtgaccaccgggcttgtaggggctgtgaacgtggctaagggaacagtgcaaacaggcatggataccactaaaactgtgctgacagggactaaggacaccatttattccggcgttacttccgctgtcaatgtggccaagggcgccgtccaaactggcctgaaaaccacccaaaatatcgctacgggtacgaagaacactttcggttccggtgtaacatctgctgttaacgtggctaagggagctgctcagactggagtggatacagcaaagactgtgctaacagggactaaagacaccgtgaccacggggctaatgggggccgtgaacgtcgccaaaggaaccgtgcaaaccagtgtggacaccaccaagaccgtcctcaccgggacgaaggacacagtctgcagtggggtcacaggagccgctaatgtcgccaagggagccattcagggaggcctcgatacaacgaaaagtgtcctgaccgggactaaggacgctgtttcaacaggactgaccggggcagtgaaactggcaaaaggtactgtacagacaggaatggacaccacaaaaaccgttcttacaggtacgaaagatgctgtttgttcgggcgtgacaggcgccgctaacgtggccaagggggccgttcagatgggagttgacacagccaagactgtactaaccggcacaaaagacaccgtgtgttcaggagtcactggcgcggctaatgtggccaagggggcagtccagactggactcaagacgacacagaacatcgcgactggtaccaagaacaccttgggctccggagtcactggagccgcaaaagtagccaagggagccgtgcaggggggcctggacacaactaagtctgtgcttacaggcaccaaagatgccgtaagtacaggattaactggcgcagtgaacctagccaaaggtaccgtgcagactggggttgacacttccaaaactgtgctgactgggacaaaggacacggtatgctcaggcgtcaccggtgccgtcaacgtagccaaaggaacagttcagactggtgtggatactgccaagactgtcctttctggtgctaaagacgcagttactacaggcgtgactggcgccgttaatgttgccaaaggaacggttcagacaggcgtagatgcctcaaaagcggtcctcatgggcactaaggatacagttttttctggcgtgacgggcgctatgtccatggctaaaggtgcagtacagggagggctcgatacaacaaagaccgttctgactgggaccaaggatgcagtgagtgccggcctgatggggagcggcaacgtcgccaccggcgctacccacaccggactttcgacttttcagaactggcttccctctacacctgcaactagctggggcggcctaaccagctctcgcaccaccgataatggcggcgaacagacagctctgagcccccaggaagcaccatttagtggcatctctaccccgccagatgtcctcagtgtgggtccggagccggcttgggaagccgcggctacgacgaagggactggccactgacgtggccacttttacacagggggccgcgccagggagagaagacacggggctgctcgccaccacgcacggtcctgaagaggctccccgcttggctatgctgcagaatgagcttgaaggactgggtgacatctttcatccgatgaatgccgaggaacaggctcaacttgctgcctcacagcccggccccaaagttctcagcgccgaacagggctcatatttcgtacggttgggggatcttggacctagttttagacaacgggcatttgaacacgccgtcagccatctccagcatggccagttccaagctcgagatactcttgcccaactgcaggactgttttcggctgatcgagaaagcccaacaggcccccgaggggcagccaagactggatcaagggagtggcgcctcagccgaggacgccgccgtgcaggaagagagagatgcaggtgtgctgagcagggtgtgcggactactgaggcagctgcataccgcatactccgggctggtaagtagcttgcagggactgcccgcggaactgcagcagcctgtcggacgcgctagacacagcttgtgcgagctctacggaatcgttgcctctgcggggtccgtagaggagcttcccgctgagagacttgtccagagcagagagggggtgcaccaagcttggcaggggctcgagcagctgctagaagggttgcaacacaatcccccgctaagttggctggtaggaccgttcgctctgcctgccggcggtcagtag

SEQ ID NO: 28761 - DNA, 780 bp, Artificial Sequence
  Description of Artificial Sequence: Synthetic coding sequence
atggatgcttgggtgagatttagcgctcaatcccaagccagagaacgcctgtgtagggcggctcagtacgcctgcagccttctcggccatgccctgcagcgtcacggcgcttcgcccgagctccaaaagcaaattcgccaactggagtcccacttgtctctggggagaaagctactgcggctaggcaacagcgctgacgccctggagagcgccaagagggccgtgcacctgagcgatgttgtccttcggttctgtataactgtgtcccacctcaacagagccctttacttcgcttgtgataacgtgctgtgggccgggaagtccgggctggcaccaagagttgaccaagaaaaatgggctcagcgtagtttccggtattacttgtttagtctgatcatgaatctctcgcgggatgcctatgagatacgactcctcatggaacaggagtccagcgcttgttccagacggctgaagggaagcggagggggtgtcccaggcggctccgagacaggcggcctgggaggcccgggaactcctggggggggccttcctcagttggccctgaaacttagactgcaggtgcttctcctcgcccgagtcctgagagggcaccccccactgcttcttgatgtggtgcgcaacgcgtgcgatctctttataccactggataagctcggcctgtggcgctgcgggccagggattgtgggtttgtgcgggctcgtgagcagtatcttaagtatcctgaccctaatctacccctggcttcgacttaagccatag

SEQ ID NO: 28762 - DNA, 246 bp, Artificial Sequence
  Description of Artificial Sequence: Synthetic coding sequence
cctggtggagggcttccacagctggcacttaagctccggctccaggtgcttctcctcgcccgagtgctgcggggacaccctccactgctcctagatgtggtacgtaatgcctgtgatttgttcattcccctggacaagctgggtctctggagatgcgggccaggcattgtgggcttgtgtggcctggtttcctcaattctttcgattctcaccctgatctacccgtggttgaggttgaagccatag

SEQ ID NO: 28763 - DNA, 738 bp, Artificial Sequence
  Description of Artificial Sequence: Synthetic coding sequence
atgggaaagctgcgcgctgcccagtatgcttgctccctcctcggacatgctctacagcggcatggtgcctccccggagctgcaaaagcagatccgtcagttggagtcccatctttccctggggcgaaaactgctcagactaggcaacagtgccgacgcacttgagtcagccaagagggctgtgcatctgtcagatgtagtcttgcggttttgtattacagtgagccacttgaaccgggctctatatttcgcttgtgataatgtgctgtgggctggaaaatcagggctggcaccgcgtgtcgaccaagaaaaatgggcccagaggtcattcagatactatctcttttctttgattatgaatctgtccagagacgcatatgagataagactgctgatggaacaagaaagttcagcctgctcccgacgattgaagggaagtggtggtggggtccccggtggatctgaaaccggaggtcttggcgggccaggcaccccaggtgggggacttccacagctggctcttaaattgcgcctgcaggtcctgttactggcgagggtgctacgcgggcacccgcccctgctattggacgtggtgaggaacgcctgcgatttgttcattccactggataagctgggcctttggcgctgtggaccaggcatcgtgggactctgtggcttagtgtcctccatactgtcaatactcacgctaatctacccctggcttcgtttaaagccttag

SEQ ID NO: 28764 - DNA, 297 bp, Artificial Sequence
  Description of Artificial Sequence: Synthetic coding sequence
atgaaggtcagtgcagtgctcctgtgtctgctcctgatgactgcggctttcaacccccagggccttgcacagccagatgccctgaatgtgcctagcacatgttgttttacattcagctcaaagaaaataagcctccagcggcttaaatcctatgtgatcaccaccagccggtgtccccaaaaagcagtgatcttccgcaccaagctcggtaaagaaatctgcgcggaccctaaggagaaatgggtgcaaaactacatgaagcatctcgggagaaaggctcacactctgaaaacatag

SEQ ID NO: 28765 - DNA, 975 bp, Artificial Sequence
  Description of Artificial Sequence: Synthetic coding sequence
atggctgaacatggagcacatttcaccgcagccagtgtggctgatgaccagcccagcattttcgaggtcgttgctcaggattcgctgatgaccgcagtgcggccagcccttcagcatgttgtgaaggttctggctgagtctaacccaacccattacggctttctgtggcgatggtttgacgagatcttcactctcttagacctgctgctccagcagcactacctgagtagaacatccgcatcattctcagagaacttttacgggttgaaaagaattgtcatgggtgacacacacaagagtcagcgactggcttctgcaggcttaccaaagcaacaactgtggaagagcatcatgtttctggtcctgctgccatacctgaaggtaaagctggaaaaactagtgtcgtcactgagggaagaagacgagtactccatacaccccccctcttcccgctggaagcggttttatagagccttcctagctgcgtatccatttgtgaacatggcgtgggagggttggttcctggtgcaacaactgagatatattctgggcaaagcacaacatcactcccccctccttcggcttgctggcgtgcagctagggcgcctcacggttcaagatatccaagcccttgaacataagcccgccaaggcaagcatgatgcagcagccggcccgctctgtaagtgagaagataaattctgccttgaagaaggctgtgggaggggtcgctctatcattgtctacggggctgagtgttggcgttttttttctgcaattcctggactggtggtactcctcagagaatcaggagaccattaagagcctgacggcacttcctactccgcctcccccagtccatctagactacaatagcgactcccccttgctcccaaagatgaaaacagtgtgccctaagaaaaagaaaaaaaaggagagaaaaaagaaaaaggagaggaagaaagaacggcgctag

SEQ ID NO: 28766 - DNA, 588 bp, Artificial Sequence
  Description of Artificial Sequence: Synthetic coding sequence
atggcacctgcagcctcccggctgcgggctgaggccggcctcggagccttaccccgtagagccttggcgcagtacttacttttcctccgactctacccagtcctcacgaaagcagctacctctggaatcctctccgcactggggaactttttggcccagatgattgagaaaaaaagaaagaaggagaacagcagaagccttgacgtgggggggccgctaagatacgcagtgtacggattttttttcacaggccccttgtctcacttcttctatttctttatggagcactggatccctccggaggtgcctctggcgggccttcgacggctactgttggaccgcctggtgtttgcaccggcctttctgatgctcttcttcttgataatgaacttcctggaggggaaagatgcctctgcctttgcagccaagatgaggggcggattctggcccgctttgaggatgaactggagggtgtggactcctcttcaattcattaacatcaattatgttccactcaagttccgtgtcctgttcgctaatttggccgctttgttctggtatgcgtacctggctagcctgggcaagtag

SEQ ID NO: 28767 - DNA, 504 bp, Artificial Sequence
  Description of Artificial Sequence: Synthetic coding sequence
atgccctttactggagaaagaagactttctttacggcgtcaggacgaaggcggactacttgccggagcagaggacgagctggccggtgtggacgcaactactgtccaccagcatcagctcagaccttctgaggtcccaggagcccttcgtcagcccgggagctccgttttggtatgcctgcccgggctgctgggcgaagtgacaaccgcaggacgtaccagcggcgcgctatggacgtgggtgtggggttcccatccaccgtctgaaagccgtaccaacccagtaaggatgtctctgactctgaatcaggccagaacaaccgtctctgatcagcgcgcggaggaagaaagaggcatctggggccgccgcgccggcgtgcaagcagggcctctgcagtctcaaggccatgcagcccacctgccccatcaggcctttcctgtgccacgcggttggctgcctggggagggcccccatagcgatcctgccggaagtggggccggctag

SEQ ID NO: 28768 - DNA, 216 bp, Artificial Sequence
  Description of Artificial Sequence: Synthetic coding sequence
atggccgcgcccccccagctccgggctcttctggtcgtggtgaatgctctccttaggaagagacgatatcatgccgcactagccgtactcaaaggcttccggaatggcgcggtctatggagctaagattagagcaccacatgctctagtgatgacttttctattccgaaacggaagaagtacttgcacctgctgccacgccagttgtcttccttag

SEQ ID NO: 28769 - DNA, 639 bp, Artificial Sequence
  Description of Artificial Sequence: Synthetic coding sequence
atggccgcccctcctcaactgcgggccctgcttgtggtcgtgaacgcgttactgcggaaaaggcggtaccacgctgctctggctgttctaaagggcttccgtaacggggccgtctatggggccaagatacgtgctcctcacgccctggtgatgacgtttttgttcaggaatggtagccttcaggaaaagctgtgggctattcttcaggcgacgtacattcactcctggaatttggctagatttgtgttcacgtacaaggggctgagagccttacagtcgtatattcaggggaaaacttatccggcccacgcattcctggcagcattcctcgggggaattctggtttttggcgaaaataacaacatcaatagccagatcaacatgtacctgttgagtcgagtgctgtttgccctgtctcggctcgctgtggagaaaggatacattcccgaaccccgctgggatccatttccactgctgaccgcggtggtgtggggcctggttctgtggctgtttgagtatcacagatcaacactgcagccaagcctgcaaagctcaatgacatatctgtatgaagactctaatgtgtggcacgacatcagtgacttcttggtgtacaataagtcccgcccctctaattag

SEQ ID NO: 28770 - DNA, 528 bp, Artificial Sequence
  Description of Artificial Sequence: Synthetic coding sequence
atgattagatgtgggttggcctgtgaacgttgccgttggattctccctctgctcctgctatccgatcatggccagaccagcagcctatggtggaaatgctctcaggaaggagggggctctggttcttatgaagagggttgccaatctcttatggagtacgcgtggggtcgggcggcagccgccatgctgttctgcggatttatcattcttgtgatctgttttatccttagcttcttcgcactttgcgggccccaaatgctggtcttccttcgtgtgattggagggctcttagccttggccgccgtgttccagattatttcgctcgtgatttaccccgtgaaatacacgcagaccttcaccctgcacgccaacccagctgttacatatatatataactgggcctacggctttggctgggccgcgacaattattctcataggctgtgccttcttcttttgttgtcttccaaactatgaggacgaccttctagggaacgccaaaccgcgctacttctatactagcgcctag

SEQ ID NO: 28771 - DNA, 582 bp, Artificial Sequence
  Description of Artificial Sequence: Synthetic coding sequence
atgatccgctgcggcctcgcctgcgaacggtgcagatggatcttgccactgctacttctttctgccatcgcatttgatatcattgccttggccgggcgcgggtggctacagtccagtgatcacggccagacttccagcctgtggtggaagtgctcgcaggagggcgggggttctgggagctacgaggaggggtgccaaagccttatggaatacgcctggggcagggccgccgcagccatgctgttctgtggcttcataatccttgtcatctgtttcatcctgtcattttttgcactgtgtggcccccagatgctggtgtttctgagagtgatcggcggcctgctggctctggcagcggtgtttcaaattattagcctggtgatctaccccgttaagtacactcaaacctttaccctccacgccaatcccgctgtgacttatatatacaactgggcctatgggttcggctgggccgccacaattatccttattggatgcgccttcttcttttgctgcttgcctaactacgaagatgacctgcttggcaacgcgaagcctagatacttttacaccagcgcctag

SEQ ID NO: 28772 - DNA, 1674 bp, Artificial Sequence
  Description of Artificial Sequence: Synthetic coding sequence
atggctgcgccgatgttgcgctggggctgtagagggaggaggtgggcttttgcaagggtcgacggcggtagttgtcacagacgcggcgcgccgaccggaagcaccagcaatcaaatcaggggagagtcttccgtggcccaacagcctctgcacaccgcccagaaaacaaggaaaggcgaacacaaatgggcagcagtcgtcggcttggagatccacgcccagatcagctcgaatagcaaactgttctccggaagccaggtgaggttttcagcccctcccaattccctcgtgtctttttttgatgcatccctgcctggcacacttcctgtgcttaaccggcgctgcgtagaggccgcggtaatgaccggcctcgcactcaactgtcacatcaataaaaaaagcctctttgatcgcaagcactatttttatgcagatctgcctgctggctatcaaataacccagcagcggctaccgatagctgtgaatgggtcactgatctacggcgtttgcgcaggcaaaaagcaatcccaggtgattccaaagaccgttagaataaaacagattcagctggaacaggatagtggaaaatccttgcacgataacctccggtcccaaaccctgattgacctaaatagagcgggcgtgggtctgctggaggtggtcctcgagccagatatgagctgcggcgaagaggctgcaaccgccgtgagagagctgcaactcattctccaggcacttggcacttcgcaggcaaacatggcagagggacagcttcgggtagatgccaacatttccgtgcatcacccgggcgagccgctgggagtgcggacggaggtgaagaatcttaactctatccgattcctggccaaagccattgactatgagattcagcgccagatcaacgagctcgagaatgggggtgagattctgaacgagaccaggtcctttcaccataagctggggtgtactatgagcatgagggacaaagaagggaaacaggactaccgttttatgcctgaacccaatctcccccctctcgtgctgtatgacgcaacttccctgcccgcaggagccgatccccagcaggtcattaacatagatcaaatccgcgaaaccctgccggaattgccatcagtcacccgcgagaaactggtgcagcaatacggcatgctcctggagcatagcttcactctgctgaacgaggttggcctactagagtttttccagaacgtcattaaggaaaccagggccgagcccaagaaagtgacctcctgggttctgaataccttccttgggtacttgaagcagcagaatctcgccgtttccgaatctccggttaccccatctgcgcttgctgagctattagacctgctggatagccgtacgataagttcctctgccgccaagcaagttttcgaagaactgtggaagcgagaggggaaaacacctggacaaatcgttagtgagaaacagttggagttgatgcaggaccaaggcgccctcgagcaactgtgccatagcgttatggaagctcacccgcaggtggtcatggacgtgaaaaataggaacccaagagctattaataaactgatcgggctggtacgcaaagccacccagtcccgcgctgaccccgttatgataaaggagatcctcgaaaaaaaactcagcctctag

SEQ ID NO: 28773 - DNA, 786 bp, Artificial Sequence
  Description of Artificial Sequence: Synthetic coding sequence
atgcatggcatcgggccctctggatctttcactgaattcctcgaccccttccagcgcgttatccaaccagaagagatctggctgtataaaaatccactggtgcaatccgataacatacctaccaggttgatgttcgccatctcgttccttacccccttggctgtgatctgtgtggttaagataatcagacgcaccgacaagactgaaattaaggaagcatttctcgccgtgtcattagcattggccctgaacggagtgtgtactaacaccatcaaattgatcgtcggacgccctcgacccgactttttctatcgctgcttccctgatggtgtaatgaattccgagatgcactgtacgggggatccagatcttgtttcagaagggcggaagtcatttcccagcattcatagcagcttcgccttttctggcctaggattcacgaccttctacctggctggaaagttgcattgctttacggagagcggaagaggtaagtcttggcgcctgtgcgccgctattctgcctctgtactgcgccatgatgattgctttgtcacggatgtgtgattacaaacaccactggcaggattcattcgtgggtggcgtgattgggctgatttttgcctatatctgctatagacaacactatccacctcttgcaaataccgcctgtcacaaaccctatgtctccctccgcgtccccgcttccttgaaaaaggaagaacggcctacagccgattcagcaccgtccttgccgctggaggggatcaccgaggggcctgtgtag

SEQ ID NO: 28774 - DNA, 291 bp, Artificial Sequence
  Description of Artificial Sequence: Synthetic coding sequence
atgcgggagttggccatagagattggggtacgcgccctgttgtttggtgtgtttgtgtttaccgaattcctagatccttttcaacgtgttattcagccagaggaaatttggttgtacaagaatcctcttgtgcagagcgacaatatcccgacccgtctgatgtttataccactatgggtcgagtcctcagcttcgttcctgcacacatttgctacggattcgactatattgctctggccgacccagctggccattaacccaacacttgtctgcgaaagccaaccgcattag

SEQ ID NO: 28775 - DNA, 816 bp, Artificial Sequence
  Description of Artificial Sequence: Synthetic coding sequence
atgagagaactggcaatcgaaataggagtcagagctctcttgttcggagtgtttgtgtttaccgagttcctcgaccctttccagagagtgatccagcccgaggaaatctggctctataagaaccccctcgtccagtcagacaatattcccacccgactgatgttcgctatttctttcctgacaccactcgccgtcatctgtgttgtcaagattatcagaaggactgacaagaccgaaatcaaagaggctttcttagcagtgagcctggccctggcccttaacggcgtgtgcaccaatacaattaagttgatcgtaggccggcctcgtccggacttcttttaccgctgcttcccagatggagtcatgaattccgagatgcattgtactggggaccccgatttggtctctgagggccgtaaaagttttccatccatacatagcagttttgctttctcaggactgggctttacaacgttttatctggccgggaaactccattgttttacggagtccggaagaggaaagagttggcgcctatgcgcagctatcttaccactgtattgcgctatgatgattgccctgagccgcatgtgtgactacaagcaccactggcaggactccttcgtggggggagttatcggccttatattcgcctacatctgctaccgccaacattacccccctttggccaatacagcctgccacaaaccctacgtctctctccgcgttccagccagcctcaaaaaggaagagaggcctaccgcagattctgctccaagcctgccgcttgaaggcataactgagggacccgtgtag

SEQ ID NO: 28776 - DNA, 804 bp, Artificial Sequence
  Description of Artificial Sequence: Synthetic coding sequence
atgagggaactggcgatcgagattggcgttcgagctcttctattcggcgtctttgtattcactgaatttcttgatccattccagagggtgatccagcctgaggagatttggttgtataaaaatcccctagtgcagtccgataacatccctactagactgatgttcgctatcagctttctcaccccacttgccgtgatctgtgtggtaaagatcattcggaggactgacaaaaccgagatcaaggaagcctttctggcggtgtctctcgcccttgctcttaacggagtctgtacaaataccataaaattgatcgtggggcgtcctagacctgacttcttctaccgatgctttccagacggcgtcatgaactcagaaatgcactgcaccggcgacccagatctcgtgagcgagggccgcaagtctttccccagtatccactcctcgtttgccttttccgggttgggctttactacattttatctggcaggtaagcttcactgctttaccgagagtggccgggggaaatcatggagactctgcgctgccatcctgccactttactgcgccatgatgattgctctgtcccggatgtgtgattacaaacaccactggcaggatagttttgtgggcggcgtcattggcctgatttttgcttatatctgctaccggcagcattacccaccactggcaaatactgcctgtcataaaccttacgtgagtcttagggtgccagcttccctgaagaaggaggagcggccgacggccgactcggctccttccctccccttggaaggcatcacttag

SEQ ID NO: 28777 - DNA, 627 bp, Artificial Sequence
  Description of Artificial Sequence: Synthetic coding sequence
atgagggaactggccatcgagataggggttagagccctgctgtttggggtgtttgtctttaccgaattccttgacccttttcaacgggttatacagccagaagaaatttggctttataagaatcccctggtccaatctgataacattccaactcggttaatgtttgccattagcttcctgacccctctcgctgttatttgtgtggtcaagatcatcagaaggacagacaagactgagattaaggaagctttcttagtggcttttagtggattgggctttactacattctacttggccggaaagctgcattgctttaccgagtctggccgcggtaagtcatggcgtctgtgtgccgcaattttacctctctattgcgctatgatgatcgctctcagtcgcatgtgtgactacaaacatcactggcaagacagcttcgtgggcggcgtgatcggccttatttttgcgtacatttgctacaggcagcattaccctccgctggcgaacaccgcctgtcacaagccttacgtctccctccgcgtgccggccagcttaaagaaagaggagcgcccgaccgccgactccgccccctccttgcccctagaggggatcacagagggacctgtgtag

SEQ ID NO: 28778 - DNA, 702 bp, Artificial Sequence
  Description of Artificial Sequence: Synthetic coding sequence
atgcgcgaactggcaattgagatcggcgtgcgcgcgttactgttcggcgtgttcgttttcacagagttcctcgacccttttcagagggtcatacagccagaagaaatctggttatacaaaaatcccctcgtccagagcgataacatacctactaggttgatgtttgccatcagctttttgacgcctctggctgtaatttgtgttgtaaagattatacgcaggactgataaaaccgaaatcaaagaagcgtttctggcagttagcttggcattagcccttaacggcgtctgcactaataccatcaagctgatcgtggggcgccctcgcccggactttttctatagatgcttccccgatggcgtaatgaactcagagatgcattgtactggggatccagatctggtgagtgaggggcggaaaagcttcccctccattcattcctctttcgcattctctggattgggtttcacgaccttttacctggcaggtaagctgcactgttttacagaatctggaagaggaaagtcctggcgattatgcgcagctatactgccactatattgtgccatgatgatagccttgtcgcggatgtgcgactacaagcaccactggcaggtgggatgctgcgtgtggcagggtccacaatctcatctcccctcggctgcgaacccccgcctgtgtctggggacaagcgagccctag

SEQ ID NO: 28779 - DNA, 456 bp, Artificial Sequence
  Description of Artificial Sequence: Synthetic coding sequence
atgccggctagccaaagccgagcccgggcaagagacaggaacaatgttctgaatagggctgaatttctcagtctgaaccaacccccaaaagggggaccggaacctaggtcgtcgggccgcaaggcctctgggccctctgctcagccaccgccagcgggggatggggccagggaaaggagacagagtcagcaactgcctgaagaggactgcatgcagttaaatccttccttcaaaggtatcgcctttaattcccttctggccatcgacatctgcatgtcgaaacgactgggggtctgcgcgggcagagccgccagttgggccagcgctcgctccatggttaagttgattggcatcacaggacacggaatcccctggatcggaggaactatcctttgtctggtgaagagctctacgcttgccggacaggaagtgctcatgaacctcttgttggactag

SEQ ID NO: 28780 - DNA, 816 bp, Artificial Sequence
  Description of Artificial Sequence: Synthetic coding sequence
atgcctgcatcccaatcacgagctagagcccgggaccgcaataatgtgctgaaccgcgccgagtttctgtctctcaaccagcctcctaagggggggcccgagccgagaagctcaggacgcaaggctagtggcccatcagcccagccaccgccagcaggcgatggggccagagagcgaaggcagtctcagcaattgcccgaggaagattgtatgcagctcaatcccagtttcaaaggaatcgcttttaattcactgttagctatcgacatctgcatgtcgaaacgtctcggtgtgtgcgctggccgagccgcctcatgggccagcgctcgctcaatggtgaagctgatcggtatcacagggcacgggatcccatggattggagggacaatactttgcctggtgaaaagttctactctggctgggcaagaggtgctcatgaatctgctgctggcactgttgctcgacataatgaccgtggccggagtgcagaaactgatcaagaggcgaggcccctatgagacctcaccatcacttctggactacctgactatggatatctacgctttcccggcgggccatgcttctcgggctgctatggtgtccaaattctttttgtcgcatctcgtccttgccgtgcctctgagagttctgcttgtgctgtgggctttgtgtgtcggtctgagcagagtgatgataggccggcatcacgtgacagacgtactgtccggattcgtgattgggtacttacaattccgcttagtcgagctggtttggatgccgtcctctacctgccagatgctgatctcagcatggtag

SEQ ID NO: 28781 - DNA, 858 bp, Artificial Sequence
  Description of Artificial Sequence: Synthetic coding sequence
atgttcgacaaaacccgcctgccctatgtggctctcgatgtcttgtgcgttttgcttgcgagcatgccaatggccgttctgaagctcggacagatatatccattccagagaggtttcttctgtaaagataactcaataaattacccttatcatgactccactgtgaccagcaccgtcctcatccttgtcggcgtcggcctccccatatcctctattattctgggtgagacgctcagcgtctactgtaacctgcttcactcaaatagtttcataagaaataattacatagcaaccatttacaaagcgataggtactttcctctttggggcagccgccagtcagtctctgacagacattgctaagtactccattggtaggctaagaccccacttcctagatgtgtgtgacccggactggtccaaaattaattgctccgatggatacatcgagtactatatatgtcggggcaatgcagaaagggtaaaagaaggtcgcctgtctttctattccggccacagctcattctctatgtactgcatgctattcgtcgcactctaccttcaggcccgtatgaagggggattgggccagactcctgagaccaaccctgcaattcgggctggtcgcagtcagcatctacgttggtctcagccgcgtgtcggattacaagcatcactggtccgacgttttaacaggcttaatccagggggcgctggtggcaatcctagtcgctgtctatgtctctgatttcttcaaagaaaggactagcttcaaagagagaaaggaggaggactcccacacaaccctacatgagacacccacaaccggcaaccattacccatcaaatcaccagccctag

SEQ ID NO: 28782 - DNA, 855 bp, Artificial Sequence
  Description of Artificial Sequence: Synthetic coding sequence
atgtttgataaaactcgattaccttatgtggcccttgacgtgttgtgcgtgctcctcgccgggttaccgttcgcaatcctgacaagcagacacacccccttccagaggggcgtgttctgcaacgatgaaagtatcaaatacccctataaagaggataccatcccgtacgccctccttgggggtatcatcatcccattcagtattatagtcattatccttggcgaaactctttccgtatactgcaacctactgcacagcaattcttttataagaaacaactatattgccactatttataaggccataggcacattcctgttcggcgcagcagcctctcagtcactaacagacatagctaagtatagtattggcagactcaggccccatttcctggacgtgtgtgacccagactggtctaagataaactgttcagacggctacatcgagtactatatctgtcggggcaatgcagagcgggtcaaagagggccgactcagcttctattccggccacagctctttttctatgtactgtatgttatttgtggccctttacctacaggcaaggatgaaaggagattgggccagacttttaagaccgaccttgcaattcgggcttgtagcggtgtcaatctacgtaggactgtcccgtgtcagcgactacaaacatcattggagcgatgtgctgacgggcttgatccaaggcgccctggttgctattctggtggccgtgtatgttagcgatttcttcaaggaacggaccagctttaaggaacgcaaggaggaggattcacacacaacccttcacgagactccaaccaccgggaatcattatccttccaatcaccagccatag

SEQ ID NO: 28783 - DNA, 936 bp, Artificial Sequence
  Description of Artificial Sequence: Synthetic coding sequence
atgcagaattacaaatatgacaaagccattgtgcccgagtctaagaatggcggctcccctgcgttgaataataaccccagaagatctggatcaaagagggtgctgttaatttgtcttgacttgttctgcctcttcatggctggtctaccctttctgatcatcgagacaagtaccattaaaccctaccaccgaggtttctattgtaatgacgagtccatcaaatatccactcaaaaccggcgaaacgatcaatgacgctgtgctttgcgctgtgggaatcgtgatcgccatcctggccatcatcactggtgaattttaccgcatctactacttgaaaaagtcacgctcaacaatccaaaacccctatgttgcagctctgtacaagcaggtcgggtgcttcctgtttggttgtgccatctctcagtctttcactgatattgcaaaagtgagcatcggacggctccgcccacactttctgtccgtatgtaatccggacttcagccagataaattgctcagagggatatatccagaattacaggtgcagaggcgatgattccaaggtgcaggaagccaggaagagtttttttagtggccatgcatctttctctatgtatacaatgctgtatctggtactgtacctgcaggccagatttacgtggaggggagcaagactgcttagaccactgctgcagtttactctgattatgatggcattttatactggattatccagggttagcgaccacaagcaccatccatccgacgtcctcgctggctttgcccagggcgccctggtggcctgctgtatcgtctttttcgtgtcagatcttttcaagaccaagacaactttatcactaccggctcccgccatcagaaaggaaatcttatcaccggtggacattatcgaccggaacaaccatcataatatgatgtag

SEQ ID NO: 28784 - DNA, 867 bp, Artificial Sequence
  Description of Artificial Sequence: Synthetic coding sequence
atgcaaagacgctgggtgttcgttctccttgatgttctgtgcctgttggtggctagtttgccatttgcaattctgaccctagtgaacgcaccgtacaaacggggcttctattgtggggatgattccatacgctacccctatcgacccgatactatcacgcatggcctcatggccggagttacaataacggcgactgtgatcctggtctcggctggggaggcttacctcgtgtatactgatagactgtactccaggagcgacttcaacaattacgtcgccgcggtgtacaaagtcctgggcactttcctgtttggagcggctgtctctcagagtctcactgacctggccaaatacatgattggccggttacggccgaattttctcgccgtgtgtgatccggattggtcacgagtaaactgctcggtgtatgttcagttggaaaaggtgtgtaggggcaatccagcagatgtgacagaggcacgcctgtctttctactccggccatagttcttttggaatgtactgtatggtgtttcttgccttatacgtccaggctcgactctgctggaagtgggcgcggcttctgaggccaacagtgcagttctttcttgtggcttttgcactttatgtgggttacacacgtgtgtctgactacaagcaccattggtctgacgtgcttgttggactcctgcagggagccctggtcgccgccctgaccgtgtgctatatatctgacttttttaaagctcgtcctcctcagcattgtctgaaggaagaggagcttgaacggaaaccttcactcagccttacactgaccctcggggaagcagaccataaccattacgggtatccacatagttcctcctag

SEQ ID NO: 28785 - DNA, 930 bp, Artificial Sequence
  Description of Artificial Sequence: Synthetic coding sequence
atgggagttgcccggggtcccgggtctcgcggacaacacccccctcccaggcagcaggaggtgtgcgccgaggggccccgtgccagactgcaccccgccccacctggcctcggggcctccctgccctttgccattctgaccctggtgaacgccccctacaagcggggcttttattgcggcgatgactccatacgctacccgtatcgacccgacaccattacacatggactgatggcaggagtaacaatcaccgcaaccgttatcctggtgtccgctggtgaagcatatttagtgtatactgaccgactgtatagtcggagcgactttaacaattatgtcgctgccgtttataaggtcctgggcaccttcctgtttggagctgctgtgtcgcagagcttaacagatctcgccaagtatatgatcggaaggcttagacctaacttcctggctgtctgcgatccagactggagtcgcgtcaattgcagtgtgtatgtccaattggaaaaagtgtgccgaggcaaccccgccgatgtaacagaagcccgtttatccttttatagcggccacagttctttcggcatgtattgcatggtctttctggctttgtatgttcaggcccgcctctgttggaagtgggcaaggctcctgcgcccaactgtccaatttttcctggtcgctttcgcattatatgtcggctacactcgtgtaagtgactataaacatcactggagtgatgtcctggtcgggttgctgcaaggcgcccttgtcgcagccctgacggtctgttatatcagtgatttcttcaaagctaggccaccccagcattgccttaaggaagaagaattagagcggaaaccatccctttcactgacgttgaccctgggggaggccgatcataatcactatgggtaccctcacagttcaagctag

SEQ ID NO: 28786 - DNA, 699 bp, Artificial Sequence
  Description of Artificial Sequence: Synthetic coding sequence
atggcgggggtcacgatcaccgctacagtgatcttagtgtccgccggagaagcttacctggtgtacaccgacagactatactctcgaagcgactttaacaattatgttgctgctgtctacaaggtactagggacctttctttttggcgcagctgtatcacagagcctcaccgatctggctaagtacatgatcggtcgcctcagacctaatttcttagctgtgtgtgaccctgattggagccgcgtgaattgctctgtgtatgtacagctcgaaaaggtctgccgaggtaatcccgcagacgttacagaggcccggctatcattctattccggacatagttcatttggaatgtattgtatggtgttccttgctttgtacgttcaggcccgcctttgctggaaatgggccagactgctccgaccaaccgtccaattttttctagtcgctttcgcgctgtatgttggttacacaagagtcagcgactacaaacaccactggagtgatgtgctggtcggtctgctccaaggcgcactcgtggcggcattgaccgtctgttatatctccgatttctttaaggcaaggcctccccagcactgcttgaaggaggaggagcttgagcggaaaccctccctctctctgaccttgactcttggagaggcggaccacaaccactatgggtatccccacagttcttcttag

SEQ ID NO: 28787 - DNA, 711 bp, Artificial Sequence
  Description of Artificial Sequence: Synthetic coding sequence
atgaagcgcagcggcaatcccggtgcagaagtcaccaattcatctgttgccggtcctgattgttgtggcggtcttggcaacattgactttcgacaggcagatttttgtgttatgactagactgttaggatatgtggaccctctggaccctagctttgtggcagcagtgattacaattactttcaatcctctgtactggaacgtggtggcccgctgggagcacaagacccgcaagctgtccagagctttcggatcaccttatttggcgtgttactccttatctgtgacaatactgctcttaaatttcctccggtcgcactgtttcacccaggctatgttatcccagccccgtatggaatccctggatacaccagccgcttacagcttagggctggccctgcttggactaggcgtggtgctggtgctctccagtttttttgcgctgggctttgccggtacattcctaggagattactttgggatcctaaaggaggctcgcgttacagtgttccccttcaacattctggacaatccaatgtattggggtagcacagccaattatctggggtgggcaatcatgcacgccagccctactggactgctgctgacggttttggtagccctcacatatatcgtcgccctgctgtatgaagaaccgtttaccgctgagatctacagacagaaggcttccggctcacacaagaggtcttag

SEQ ID NO: 28788 - DNA, 699 bp, Artificial Sequence
  Description of Artificial Sequence: Synthetic coding sequence
atgaagagaagcgggaatccaggtgctgaggtgactaatagctccgtggccggcccggattgctgcggcggcctcggcaacatcgacttcaggcaggccgacttttgcgttatgactcgacttctgggctacgtcgatccactggatcctagcttcgtggccgcagtgataactattactttcaatccactctactggaacgtggtcgcccgttgggagcacaaaacaaggaaactgtctagggctttcggttccccatacttggcctgttattccttgtccgttaccatcctactgttgaattttctgcgcagtcattgcttcacccaggccatgctatcccagcctcgaatggagagcctggacactcccgcagcctatagcctgggtctagctctcctgggcttgggcgtggtgctggtactgtcttccttctttgccttgggcttcgcgggaacgttcctgggcgattatttcggcatcctaaaggaagcccgggtgacggtgttcccattcaatattctggataacccaatgtattggggatctacagcgaattatctcgggtgggctatcattcctgcccccgccggcgccgtaggctccgaggctcggcagccacatggcccagcccccgatggggcggggggaccgcatctacacagcggttcgccgattcggagagccctgcaccgatag

SEQ ID NO: 28789 - DNA, 600 bp, Artificial Sequence
  Description of Artificial Sequence: Synthetic coding sequence
atgaccaggctgctgggctacgtagaccctctggatccctctttcgtggccgctgtgatcacgattacgtttaatcccctctattggaatgtcgttgcaaggtgggagcacaagacacggaaactgtcacgagcctttgggtccccttatctcgcatgctattcactctctgttactattctcctcctcaatttccttcgctctcactgctttacgcaggcaatgctatcccagcctcggatggagtccctagataccccagcagcttattctctgggcctcgctttacttggactaggcgttgtcttggtgttgagttccttcttcgccctgggatttgctggaacgttcctcggagattactttggtatcctgaaggaggcccgcgtaacggtgtttccattcaacatccttgataaccccatgtactggggatccacggccaactacctcggatgggccatcatgcacgcctctccaacgggcctccttctgactgtccttgttgcactgacttacattgtagccctgctctacgaggagccgttcactgccgagatttaccgccagaaagcatccggatctcataaacgatcctag

SEQ ID NO: 28790 - DNA, 600 bp, Artificial Sequence
  Description of Artificial Sequence: Synthetic coding sequence
atgactcgcttgcttggatatgtcgacccgctggacccatctttcgtggctgcggtgataaccattactttcaacccactctactggaacgtcgtcgcgcgctgggaacacaaaacaagaaagcttagcagggctttcggttctccctacttagcttgttacagtttatctgtcactatactactgctaaatttcctgaggtctcactgctttacgcaggccatgctgtctcaaccccggatggagtcactggacactccagcagcttactcgctcgggctggcactgctggggctcggggtggtgttggttctttcatcttttttcgccttggggttcgccggtacatttttgggagactacttcggcatcctgaaggaggctagagtcactgtattcccttttaatatcctcgacaatcctatgtactgggggtccactgcaaattacttgggctgggctataatgcatgcttctcctaccggccttctcctgactgtcctggtggcactgacctacatcgtggcccttctgtacgaggaaccatttacagccgagatctacaggcaaaaggcatcggggtctcataagagatcctag

SEQ ID NO: 28791 - DNA, 642 bp, Artificial Sequence
  Description of Artificial Sequence: Synthetic coding sequence
atgaagaggtccggcaatcccggcgcagaggtgacgaatagtagcgtggctggaccagactgctgtggaggacttggaaacatagacttccgtcaagccgacttttgcgttatgactagattactggggtatgttgaccctctcgacccttcattcgtcgccgcagtgattaccattacctttaatcccctgtactggaatgtagtggcaagatgggagcataagaccaggaagctttcgagggcttttgggagtccctacctggcctgttactccttgagcgtgactattctgctcctgaacttcctccgcagccactgctttacacaggcaatgctgagtcaaccaagaatggagtctctggacacacccgccgcctattctttgggactggccttattgggcctcggagtcgtgctggttctctcctctttttttgctctggggtttgccggcacctttctgggggattattttgggatactaaaggaggcgagagtgactgtctttccattcaacatccttgacaaccccatgtactggggatccacagctaactatctcgggtgggcaataatactctgcccatgcgggcgctatccattcccacaacgcggacccagggccatgcgggaagcgtag

SEQ ID NO: 28792 - DNA, 636 bp, Artificial Sequence
  Description of Artificial Sequence: Synthetic coding sequence
atgaaaagatcggggaaccccggagcggaggccgacttttgcgtcatgaccagactgttgggatacgtagatcccctggacccatcattcgtagccgcagttatcacaatcacattcaatcccttgtattggaatgtggttgcccgctgggaacataaaaccagaaaactctccagagctttcgggtccccctatctggcctgctactctctgagcgtgactattttgctgctcaatttccttcgctcccactgcttcacacaggccatgctgtcccagcctcggatggagtctttagataccccagccgcttattctctcggactcgccctgttaggcctgggcgttgttcttgtgctttcttcattcttcgcactgggatttgctggcaccttcctcggggactatttcggcattctcaaagaagctcgcgtcactgttttcccctttaatatactcgacaacccaatgtactggggttcaaccgccaattatttaggatgggccataatctcaccagcacctgcaggcgcagttggctccgaggctaggcagccccatggccctgcccctgatggcgccggtggcccacacctacatagcgggagtcctatcagacgggccttgcatcggtag

SEQ ID NO: 28793 - DNA, 684 bp, Artificial Sequence
  Description of Artificial Sequence: Synthetic coding sequence
atgggttggacaatgcgtctggtcaccgcagcactgctgctcggactgatgatggtggttacgggcgatgaggacgagaacagcccttgcgcgcacgaggctcttctggacgaggacacactcttttgccagggcctcgaagtcttctatccggagctcggcaacattggttgtaaagtggtccccgactgcaacaattacagacaaaagatcacctcgtggatggagcctattgtgaagtttcctggagccgtagatggcgctacttacatattagttatggtggatcctgatgctccaagcagggctgagcctagacaacggttttggcggcattggctggtgacggatataaaaggtgctgatctaaagaagggcaagattcaggggcaagagctctcagcttaccaggcccctagcccaccagcccacagtggattccatagatatcagttctttgtatatctacaggaggggaaggtcatctcactgcttccaaaggaaaacaagactcggggatcttggaagatggatagatttctaaaccgtttccacctgggagaacccgaggcttcaactcagttcatgacacagaattaccaggacagtcctacgctgcaggccccccgagaacgtgcgtccgaaccgaaacacaagaaccaggcagagatcgccgcctgctag

SEQ ID NO: 28794 - DNA, 1671 bp, Artificial Sequence
  Description of Artificial Sequence: Synthetic coding sequence
atggcagtcgccgctgccgccgccgccggcccggttttctggcgtaggctcctgggcttgctccccggcaggcccggcctggctgccttactcggacgactcagcgacaggctcggacgcaaccgtgatcggcagcgtcgacgctctccatggctcctgttagcaccactgctaagcccggccgtgccccaagtcactagcccaccatgctgcctgtgccctgaaggcgtacacagatttcagtggatccggaacctggtcccagaattcggagtgtcttctagtcatgtgagagtgctcagctctcctgccgagttctttgagctcatgaagggacagattcgagtcgcaaaaaggagagttgtaatggccagtttatatctcgggacagggcccctcgagcaggaactcgtcgactgtttggagtctacattggagaaaagcctgcaggcgaagttcccctccaacctcaaagtgagcatcctcctggatttcactaggggcagccgggggcgcaagaactcacgaaccatgttactcccgttgcttcgccgattcccagaacaggttcgggttagtctgtttcatacaccacatctgcgcggactgctgaggctcttgatccctgagcgattcaatgaaaccattggcctgcagcacattaaggtctatctctttgacaattccgtaattctgtctggcgctaatctctctgactcctacttcacaaaccggcaggaccggtatgttttcttacaggattgtgctgagatcgccgactttttcacggaactcgtggatgcagtcggcgacgtatctctgcaactgcagggcgacgataccgtgcaagtggttgatgggatggtccatccatacaagggagaccgcgccgagtactgcaaagctgccaacaagagagttatggacgttattaacagcgctcggacaagacaacagatgctgcatgctcagactttccacagcaacagtcttttgacccaggaggacgccgcggcagctggcgatagaagacccgctcctgatacttggatttatccacttattcagatgaagcccttcgaaatccaaattgacgagatcgtgaccgaaacactcctcaccgaagctgaacgaggcgccaaggtttacctcactaccggctacttcaaccttacacaggcatacatggatttggtgctggggacacgcgcggaataccagatccttctggcaagtcccgaggtgaacggcttttttggcgctaaaggagttgcaggcgccataccggcagcctacgtccatatcgagagacagtttttttctgaggtgtgttctttaggccagcaggaacgagtgcagctccaggagtactggagaagaggctggacatttcacgcaaaaggactctggctctacctggcagggagctctttgccatgtctgacactgattggctctccaaatttcggctaccgcagtgttcatcgtgacctggaggcccaaattgcaatcgtcaccgaaaaccaggccttacagcagcagctgcaccaggaacaagaacagttgtatctccggtccggtgtggtttcttccgcgacttttgaacagccctctaggcaagtcaagctctgggtgaagatggtgactccgctgattaaaaatttcttctag

SEQ ID NO: 28795 - DNA, 1266 bp, Artificial Sequence
  Description of Artificial Sequence: Synthetic coding sequence
atgaaagtggactgcctcgaatcgacactagaaaaatcacttcaggctaaattccctagcaacttaaaggtctccatactgcttgattttacccgcgggtcccggggccggaagaactcccgcactatgcttctccccctgcttcggcgcttcccagagcaggtacgcgtgtccttgttccataccccacacctgaggggccttctgcggttactcattccagagagatttaatgaaaccatcggacttcagcacatcaaggtatatctgttcgacaactctgtgatcttgtcaggagcaaacctatccgatagttacttcaccaataggcaggatcgctatgtatttctgcaggactgtgccgaaatagctgacttctttaccgaactcgtggacgctgtgggagacgtgtctctgcagctccaaggagatgacaccgtccaggtcgtggacggcatggtacatccctataagggcgaccgcgccgagtactgtaaggctgccaacaaaagagtgatggatgtgattaactctgcgcggacgaggcagcagatgctgcacgcccagaccttccatagtaactccctgctcacccaagaggacgctgctgcagccggagaccggcgtcctgcgcccgacacatggatctatccccttattcaaatgaaaccgtttgaaatccagatcgacgagattgtgacggaaacgttactgactgaggctgaaaggggcgctaaggtgtacctcacaaccggatacttcaacttaactcaggcatatatggatttagtgttaggaacacgtgccgagtaccagattttgctagcctcacctgaggtgaatggattcttcggcgctaaaggtgtggcgggagccatccctgccgcctatgttcacattgaacgccagtttttcagcgaggtttgtagcctgggtcagcaagaacgggtgcagctccaagagtattggcggcggggatggacctttcacgctaaaggattgtggttatacctggctggatcctctctgccttgcctgaccctgattgggtccccgaactttggctacagatccgttcatcgcgatctggaggcccaaatcgcgatcgttactgagaatcaagctcttcaacagcagctgcatcaggaacaggaacagctttatctgcgctctggtgtggtgagctctgcaacctttgagcaaccaagcaggcaggtgaaactttgggtaaagatggtcacccctctcatcaaaaattttttctag

SEQ ID NO: 28796 - DNA, 807 bp, Artificial Sequence
  Description of Artificial Sequence: Synthetic coding sequence
atgaaggtcgactgcttagagtctactctggaaaaatcgctgcaggcaaagttcccgtctaatttaaaagtatcaatcctcctagacttcacccgagggtctcgggggcggaagaattctaggaccatgttgctgcctttgttgcggcgcttcccagagcaggtcagggtttctttattccacacaccccatctgaggggtctcctcaggcttttaataccagagcgttttaacgagaccattggtctgcaacacatcaaagtctatctgttcgacaatagtgtgatcctgtccggggccaatctgtcagattcctactttacgaatcggcaggatcggtacgtgtttctgcaggactgcgccgagattgccgactttttcactgaactggttgatgcggtcggtgacgttagcctgcagctgcagggcgatgacactgtgcaggttgttgacggtatggtgcacccctataagggggatcgcgcggagtactgcaaggccgccaacaaacgtgtgatggacgtgatcaacagtgctcggacaaggcagcagatgttgcatgcccagaccttccacagcaactccttgctcactcaagaggacgctgcggccgctggagatcggagacccgcccccgatacatggatatatcccctgatacagatgaagcctttcgaaattcagatcgatgagatcgttaccgaaaccctcctgacggaggccgagcggggcgcaaaggtatacctcactaccgggtatttcaatctaacccaggcctatatgccagggctggggcattcgggctag

SEQ ID NO: 28797 - DNA, 900 bp, Artificial Sequence
  Description of Artificial Sequence: Synthetic coding sequence
atgccttataccacttacctcgtagagaagggcgcatcacactccttcgttgcggaggcaaagccaccaacggtgactatgccccgcattaaggcccttatgacggggtctcttcctggatttgttgacgtcatccgcaacctcaactcccccgccttgctggaggattctgttatcagacaagccaaagcggcaggtaaaaggattgtattctacggtgacgaaacctgggtgaaactgttccccaaacacttcgtggaatatgatggcaccacctccttctttgtcagcgactatacagaggtagataataacgtgacacggcacctggataaggtactcaaacggggagattgggatatcctgattctacactatctggggctcgaccacataggacatatatctggacccaatagcccactgatcggacagaaactttctgaaatggattctgtgctgatgaagatccatacttcccttcagtccaaagaacgcgaaacccccctgcctaatttgctggtgctgtgcggggatcacggaatgagcgagacaggctcacacggcgccagttcgactgaagaagtaaatactcctctcatcctgatctcttccgccttcgagcgtaagccaggcgatatccgacatcccaaacatgtacagcagactgacgttgcagccacattagcaatcgccctgggtctccctatccctaaggattccgtgggcagcctcttgttcccggtggtagagggtcgacctatgagggaacagcttcggttcctgcacctgaatacggttcagctaagtaagcttttacaagagaatgtgcctagctatgaaaagggtagccaccccgccccagcccaacgcccaaccggcactgcacagaaaggatag

SEQ ID NO: 28798 - DNA, 2928 bp, Artificial Sequence
  Description of Artificial Sequence: Synthetic coding sequence
atgagacttggctcaggtaccttcgctacttgttgcgttgcgatcgaagtcctgggaatcgcagtgttcttaagaggcttcttccctgccccagtgcggtcatctgctcgggccgaacacggggcggagccgcctgctcccgaaccgagcgcaggagcctcctcaaattggacaacgctcccacctcctctcttctctaaggtggtgatagtcctgatcgatgccctgcgggacgatttcgtgtttggcagtaagggtgtgaaattcatgccctacacgacttatctagtggagaagggggcaagccattcctttgtggcagaggccaaacctccgacagtaactatgccccggataaaggctctgatgactggatccttacccggctttgttgatgtgatacgcaacttgaactccccggccctgcttgaagacagcgtgattcggcaggctaaggctgctggcaaacggatagtgttctatggggatgaaacctgggtgaaattgttcccaaagcatttcgtggagtatgatggaacaacctcctttttcgtctctgactacaccgaggttgacaataatgtgacccgacaccttgacaaagtcctgaaacgcggggattgggatatcctgatcctccattatcttggccttgatcacattggacatattagcggcccaaatagccctctgatcgggcaaaaacttagtgagatggatagcgtgctgatgaagattcacacaagcctacagagtaaagaacgcgagacccccctccctaacctgcttgtgctgtgtggagatcatggtatgtctgagactggcagccatggagcctcctccacagaggaggttaacacaccactgatcctcatctcctcagcctttgagaggaagcccggtgacattcggcatccaaaacacgtgcaacagaccgatgtggccgctaccctggccattgccctggggctgccaattcccaaagattctgtcgggtctttacttttccctgtggtcgaagggaggcccatgcgggagcagcttcgtttcctgcacttgaacacagtgcagctgtccaagcttctgcaggagaacgtcccttcctatgagaaagatcctggttttgagcagtttaagatgagtgaacggctccacgggaattggataagactgtatctggaggagaaacactccgaggtactgttcaacctgggatcaaaagtgttgaggcaatatctggatgcactaaaaacactgtcattaagcctttctgcccaggtagctcagtatgatatctactcaatgatggtgcttaccctgctgctgctgtctgtcccccaagcgctccgacgaaaagctgagctggaggttcccttgtcttcccccggtttttcactcttgttttacttggttatactcgtcctatccgctgttcatgtgatagtctgcacctcagcagagagtagctgctatttttgtggactctcctggctggctgccggcggcgttatggtgctggcatccgctctgttatgtgtgatcgtcagtgtgctgactaacgtcctggtgggggggaacacgcccagaaagaaccctatgcacccaagtagcagatggtcagaattagatttgctgatattgcttggaactgcgggtcatgtactgtctctcggagcaagtagcttcgtggaggaagagcaccagacctggtatttcctggtgaatacactgtgcctcgccctgtcacaggaaacgtataggaattactttttgggagacgatggcgaaccaccatgtggtctatgtgtggaacaaggccacgatggagcaacagccgcttggcaggacggcccaggctgcgacgtgctagaaagggacaaggggcacggaagtccatccacaagcgaggtgctgcgcgggcgtgagaagtggatggtactcgccagcccatggcttatcctcgcctgctgtcggttgcttagatccctgaaccagaccggagtacagtgggctcacagaccggacctgggccattggctgacaagttcggatcataaagccgagctgtcagttctggctgcactatccctgttggtggtattcgtgctggtgcagcgcggatgctcaccagtgtctaaggccgcattggctctgggcctgctaggcgtgtattgctaccgtgcagcaatcggcagtgtgagattcccatggcgccctgactctaaggatattagtaagggaatcattgaagcccggtttgtttacgtcttcgtcttgggcatactcttcactgggactaaagatttgttgaagtcacaagtcatcgcggcggattttaagcttaagaccgtgggtctctgggaaatttattctggcttagtcctgctggccgctctgctttttaggcctcacaacttacccgttctcgcctttagcctgctgatccagacgctcatgaccaaatttatttggaagcctttgagacacgacgccgctgagattaccgttatgcattactggttcggacaggccttcttttatttccaaggtaattccaacaacattgccaccgtagacatcagcgccggatttgtggggttggatacctacgtggagatccctgctgtgttactcaccgcatttggtacctacgctggccctgttctctgggccagtcacctcgtgcatttcctgtcatcagaaacacggtccggttccgctctgagccatgcttgtttttgctacgcactgatctgttccattcctgtcttcacatatattgtactagtgactagcctgaggtatcatcttttcatttggtctgtgttttcccccaagctgctgtacgaaggcatgcatttactcattacggccgccgtctgcgtgttctttaccgcgatggatcagacacggttgactcaaagttag

SEQ ID NO: 28799 - DNA, 2553 bp, Artificial Sequence
  Description of Artificial Sequence: Synthetic coding sequence
atgcgcctcggttctgggacattcgcaacttgctgcgtggcgattgaagtgttaggtattgctgtttttctaagagggttcttccccgccccggtgaggtcctctgctcgggccgagcatggcgcagaaccacctgcccccgaacccagcgctggggcaagtagcaattggaccaccctgcccccaccacttttcagcaaggtagttatcgtgcttattgatgcattgagagacgattttgtgttcggcagtaaaggtgtcaagttcatgccatacactacctacctggtggaaaaaggcgcatctcatagtttcgtggctgaagccaaaccccccaccgtgaccatgccccgtatcaaggagcgtgaaacaccactcccaaacttgctagtgctgtgcggcgaccacgggatgtctgaaaccggcagtcacggagcttcgtcaacagaggaggtaaacacacctctgattttgatctcttcagcctttgaacgaaagcctggggatattagacacccgaaacacgtccagcagacagatgtggcagcgacactggcgatcgctcttggtcttcccatccccaaggactcagtgggaagcttgctgtttcctgtggtggagggacggcccatgcgagaacaactgcgattcctgcatttgaacaccgttcagctcagtaagctgctgcaagaaaacgtgccatcctatgagaaggatccaggcttcgagcagttcaaaatgtccgaaagacttcatggcaattggatccgactgtacctcgaggagaagcactcagaggtcctatttaatctcggatcaaaggtactccggcagtatctggacgccctgaaaacattgtctctgtcgctcagtgcccaggtagcccagtacgacatctattcaatgatggtgggtactgttgttgtgctagaggtgcttacgctgctgctgctgagcgtaccacaagcactgcgccgaaaagccgaactcgaggtgcctctcagttctcccggtttctccctgctgttctacctggttattctggtgctctccgcggtgcacgttatagtatgtacctccgctgagtcttcctgttatttttgtggcctatcatggctagccgccggcggagtgatggtactggccagcgcgttgctgtgcgtgattgtctctgtgctgactaatgttttagttggcgggaatacacctcgaaaaaaccccatgcatccttctagccgatggtccgaactcgacctgctcatcctgctggggaccgccgggcatgtcctttcactgggcgcgtcaagctttgtcgaagaagaacatcagacctggtattttctggtcaacaccctgtgtctggcactgtcccaggagacctaccgcaactacttcctgggggatgatggggagcccccgtgtggcctttgcgtagagcagggccatgatggggctaccgctgcttggcaggacggtcccggatgcgacgtgcttgagagggataagggccacggctcaccttcaacttccgaagtactccgcggccgagagaagtggatggtgctcgcctccccttggctcatactagcctgctgtcgtcttctccgcagccttaatcagaccggcgttcagtgggcccacagacctgatctgggacattggttaaccagcagcgatcacaaagctgagctaagcgttttggccgcactgtccctgctagtggtgtttgtccttgtgcaacgtgggtgttcacccgtaagcaaggcggcattagccctaggccttttaggagtttattgctacagggccgcaatcggtagcgtgcgttttccttggaggcccgacagcaaggatatttccaagggcattatcgaggccaggttcgtttacgtgtttgtcctcgggattttattcaccgggaccaaggatcttctgaaaagtcaagtgatcgcggccgattttaagctgaaaacagtagggctctgggagatttattcaggtttggttttgctggctgcacttctgtttcgcccgcacaatttgcccgtgctggctttcagtctgctgatacagacactgatgaccaaatttatttggaagcccctgcgacacgatgccgccgagattaccgtgatgcactattggtttggtcaggcattcttctacttccaaggcaactccaataatatcgctacagttgatatctcagccggtttcgttggcctcgacacctatgttgagattcccgcggttctgctcaccgctttcgggacttatgcagggcccgtgttgtgggcctcacatcttgtgcactttctgagcagcgaaacacgcagcgggagtgccctgagccatgcctgtttctgttacgctctcatctgctccattcctgtctttacatatatcgttctggtgaccagcctgcgataccatctctttatttggtcagtgttctcccccaagctgttatacgaaggcatgcacctgttaattaccgcagccgtttgtgtgtttttcactgccatggatcagacgcgcctgacccagtcatag

SEQ ID NO: 28800 - DNA, 2952 bp, Artificial Sequence
  Description of Artificial Sequence: Synthetic coding sequence
atgagactaggctccggaacatttgctacctgctgtgtggccatcgaagttttaggtatcgccgtctttttgaggggcttcttcccagcgccagtccgaagttcagcacgcgcagagcacggggccgagcccccagctcccgagccgagcgcaggtgccagctccaactggactaccttacctccgccactcttctcaaaagtagtgatcgtattaatcgatgctcttcgagacgattttgttttcggctctaaaggggtcaagttcatgccttacaccacttacctagtcgagaaaggagcttcccattctttcgtcgcggaggccaaaccgcccaccgtgaccatgcctcggataaaggctctgatgaccggtagcctgcctgggtttgttgatgtgatcaggaacctcaatagtccggctctgctggaagatagcgtgatacggcaggcgaaagcagccggtaagcgtatcgtgttttacggagacgaaacttgggttaagctgtttccaaaacatttcgtcgagtatgatggaaccacgtccttctttgtctctgattacacagaagtggacaacaatgttacaagacatctagataaagttttaaagcggggcgactgggatatcctgattttacactatctgggtctggaccacattgggcacattagtggaccgaatagcccgctcatcgggcaaaagttaagtgagatggatagcgtgctgatgaaaatccatacaagcttgcaaagcaaggaaagggaaacgccactgccaaacctgctggtgctgtgtggggaccatggcatgtcagaaaccgggagtcacggcgcatcttctactgaggaggtaaacacccctctaattttgatttcttccgcctttgagaggaagccaggggacattcggcatccaaagcatgtgcagcagaccgatgtggccgcaacactagctatcgcactggggctccccatccccaaagattccgtgggttctctcttattccctgtggtggaaggcagaccaatgagagagcaactgaggtttctccacttgaacacggtacagctgtccaaactgcttcaagagaatgtgccgtcatacgagaaagatcctggatttgaacagttcaaaatgtccgagaggctgcacgggaattggattcgcctttatcttgaggaaaaacactcggaggttttattcaacctgggaagcaaggtgctgcggcagtacctggatgctctgaaaactctcagcttgtccttgtccgcccaggtcgctcaatatgacatatactctatgatggtcggaaccgtcgtcgttctggaggtcttaacactgctgttactatcggtgccccaagccctcagaaggaaggctgagttggaagtgccgttatcctctcctggctttagtctgctgttctatctcgtgattctagtgcttagtgccgtgcatgtgatagtttgtaccagcgcagagagctcttgttacttttgtggactgtcatggctagcagcaggtggggtcatggtcctggccagtgcccttctgtgcgtcatagttagcgtacttaccaatgtgctggtgggggggaataccccacgcaagaatcccatgcatccctcttccagatggtctgaattggatctcttgatcctcttgggaacagctggccatgtcctttccttgggggcctcctcctttgtggaagaggaacaccaaacctggtatttcctggtgaataccttgtgcctcgccctgtctcaggagacataccggaattacttcttgggggacgatggagaacctccttgcggcctgtgcgtggagcaaggacatgacggcgcaacggctgcttggcaggatggtccaggatgcgacgtgttggagcgggacaagggtcacggtagcccatcaacctctgaggtgctcagaggacgtgagaagtggatggtgctggcttccccttggttgattctggcatgttgccggcttctcaggtctttaaatcagacaggggttcagtgggcccacagacccgacctgggccactggctgacctcgtctgatcacaaggccgagctctcagtcctggccgctctttccctccttgtcgtctttgttctggtccagcgcggttgcagccccgtgtccaaggcagccctagctctaggccttctgggggtgtattgctacagggccgcaattggttcagttcgctttccgtggcgccccgatagcaaagacatcagcaaaggaattattgaggcaagattcgtctatgtctttgtactgggcatcttgttcactgggacaaaagatctcctgaagtctcaagtcatagctgccgactttaagctaaagaccgtcggcctctgggaaatctactctggtctggtgctcctggctgctctcctgttcaggccccacaacctgcctgtcctggccttttctctgttgatccaaacattgatgacaaaatttatttggaagccactgcggcacgacgccgccgaaatcacagtgatgcattactggtttggccaagcatttttctacttccaaggtaactcaaataatatcgcaacggtagacatctcagcaggttttgtgggactggacacctacgtggagataccagccgtcctcctgactgctttcggcacctacgcaggaccggttttatgggctagccacctggtccatttcctttcgtccgagacacgcagcggctccgccctatctcatgcctgcttttgctatgccctcatttgctccatcccggtgtttacctacatcgtgctggtgacatcgctgcgttatcacctctttatttggagcgtcttcagcccaaagttactctatgaagggatgcatctcctaatcactgcagctgtctgcgtgtttttcaccgcaatggatcaaactcgccttactcagagttag

SEQ ID NO: 28801 - DNA, 426 bp, Artificial Sequence
  Description of Artificial Sequence: Synthetic coding sequence
atgcactactggtttggtcaggccttcttctacttccaaggaaattccaacaacatagcaaccgttgatattagcgccgggtttgtcggactcgacacttatgtagagattccagctgtcttgctcactgctttcggaacatacgcagggccagtcttatgggccagtcatctggtgcacttcctgagctccgagacgaggtcaggttcagccctgtcccatgcttgtttctgttacgccctgatctgcagcatacccgtgttcacctatattgttctggtcacctccctacggtatcatctgtttatttggtcagtcttcagcccgaagctgctatacgaggggatgcacctcctgataactgctgcagtctgcgtcttcttcacttggattaagcccgacagccactctctgcgcttgagctag

SEQ ID NO: 28802 - DNA, 900 bp, Artificial Sequence
  Description of Artificial Sequence: Synthetic coding sequence
atgccgtacacgacatatcttgtggaaaagggagccagtcactcattcgtagccgaggccaagccacccaccgtgacaatgccccgcatcaaggccctcatgacagggagtcttccgggcttcgtagatgtcataagaaacttaaattcgcctgctctgttggaggatagtgtgatcagacaggccaaagctgccggtaaacggattgtgttttatggcgatgagacctgggttaaattatttcccaaacattttgttgagtatgatgggactacttctttttttgtgagcgactatacggaggtcgataacaatgtgacacggcatttggacaaagtcttgaagcgaggcgattgggacattttgattctgcattacctgggccttgatcacattggccatatttccggtcctaactctcccctgattggtcagaagttgtctgaaatggatagtgtacttatgaaaattcatacctccctgcagtctaaagagcgtgagactcctctgcctaatttgttggtactttgtggggatcacggcatgagtgagacgggatcccacggagcctcctcaacggaagaggtaaatacacccctaatcctgatttctagcgccttcgaaagaaagcctggcgacattaggcacccaaagcacgtccagcagaccgacgtggctgccaccctggccattgctcttggtttgcccatccctaaggacagtgtgggctccttattattcccggtagtggaaggaaggccaatgcgcgaacagctacgctttttgcacttgaacacagtgcagctcagcaaactgctgcaggaaaatgttccctcttatgagaaaggaagccacccggctccagcacagcggcccacagggacggcccagaaggggtag

SEQ ID NO: 28803 - DNA, 1026 bp, Artificial Sequence
  Description of Artificial Sequence: Synthetic coding sequence
atgaccgggtctctccccgggttcgtggatgtcattaggaacctgaattctccggcgctgcttgaagactccgtgatcagacaggcaaaagcagccggaaagcgcattgtgttttacggagatgaaacctgggtcaagctgttcccgaagcactttgtggaatatgacggaactacatcttttttcgtcagcgactacactgaggtggacaacaatgtgacccgccatctggacaaggtcctgaagcggggggattgggatatcctgatcctgcactacctcggcctggaccacattggacatataagtgggccaaacagtcccctgatcggccagaagctgtctgaaatggactccgtccttatgaagattcacacgagcttgcaatctaaggagagggagacccccctgcccaatctgctggtgttatgcggcgatcacggaatgagcgagactggcagccacggcgcttcctccaccgaggaggtaaacacccccctgattctcattagttcagcattcgagaggaaacctggcgatattaggcatcccaaacatgtccagcagaccgacgtagctgccaccttagctatcgcactgggcctgcccattcctaaggacagtgtcgggagtctgttgttcccagtggtggaaggtcgtcctatgcgggagcagttacggtttctccatcttaacactgtgcagctgtccaaactgctgcaagagaacgttcctagctatgagaaggaccctggcttcgaacagttcaagatgtcagaaaggttgcatggaaattggattaggctctacctggaggaaaaacactctgaggtgctctttaacttaggcagcaaggtgctgagacagtaccttgatgctttgaagaccctgtccctgtccctgagcgcccaagttgcccagttctctccatgcagctgttctgccagccaccgtcactgtgcggaacgcttgtcatggaagagtcactgtcaccttctcggttttttatgcagctttatctggtag

SEQ ID NO: 28804 - DNA, 2019 bp, Artificial Sequence
  Description of Artificial Sequence: Synthetic coding sequence
atgcagaaagcctccgttttgctgttcctggcatgggtgtgctttttattctatgctggaatcgccctttttacctccggatttttgctgaccagactggagctgaccaaccattctagttgccaagagcctcctggcccaggctcgcttccttgggggagccaggggaaaccgggagcctgttggatggcgtctagattttccagggtggtcttggtgctgatcgatgcacttcgattcgatttcgctcagcctcagcatagccatgtgcccagggaaccacctgtctcattgcctttcctaggcaaactgtcctcgctgcaaaggatcttagaaattcaaccccaccatgcacggctgtatcggagccaggtggaccctcctacaacaactatgcagaggctgaaggcccttacaactggctctctgccaacatttattgatgccggctcgaatttcgcatcacatgccatcgtcgaggataatctaatcaaacaactcaccagcgccgggaggcgggtggtcttcatgggcgatgatacttggaaggatctctttcctggagcattcagcaaagcatttttctttccatcctttaatgtaagggatcttgatactgtagacaacgggatactcgaacatttgtatccaaccatggactctggcgaatgggacgtgcttatcgcccacttcctcggtgtggaccactgtggacataagcatgggccccatcatcccgaaatggctaagaagctctcccagatggaccaggtgatccagggtctggttgaacggctagaaaacgacacactactagtcgtcgccggcgatcacggcatgacaaccaacggtgatcacggaggcgattccgagctggaggtttctgccgctctgtttctgtatagtcctaccgcagttttcccaagtactcccccggaggaaccggaggtgattcctcaggtttcccttgtgccaacgctggccttacttctgggtctgcccattccctttggaaatattggagaagtgatggccgagctgttcagcggcggcgaagactctcagccccatagctccgccctggcacaggcatccgccttacacctgaacgcacagcaggtcagcaggtttctccatacgtattccgccgccacccaggacctccaggccaaagagctccatcagctacagaaccttttttctaaagcctccgccgattatcagtggctgctccagtctcctaagggcgcagaggccactctgcctacagtcattgccgaactgcagcagtttctcaggggagcacgggccatgtgcatcgaatcctgggcaaggtttagtctaagcttcctcttactgcatcttctcgccgccggcatccccgtcactacccccggaccctttacagttccctggcaggcagttagtgcctgggcacttatggccacccagacattctattctaccggtcaccagccagtgttccctgctatccactggcatgccgccttcgtgggttttcccgagggtcacggaagttgcacttggctccccgcgttgttagtaggggcgaatactttcgcgtctcatctgctattcgcagtcgggtgcccactgctcctgctgtggcccttcctgtgtgagtcgcaagggttgaggaaaagacagcagcccccgggtaatgaagccgatgccagggttcgcccggaggaggaagaggaaccacttatggagatgcggctgagggatgcccctcagcatttctatgccgctctactacagctaggtctcaaatacctgtttattctgggcatccagatcctggcctgtgccctcgcagccagcattctaaggagacacctcatggtgtggaaggttttcgcccccaaattcatcttcgaggcagtggggttcatcgtcagctcagtgggattactgttgggcattgctctcgtcatgagggtagacggtgccgtgtcctcttggtttcgacagctattccttgctcaacagcgctag

SEQ ID NO: 28805 - DNA, 3270 bp, Artificial Sequence
  Description of Artificial Sequence: Synthetic coding sequence
atgcagaaagcatccgtcctgcttttcctcgcctgggtgtgcttcctgttttacgccgggatcgctttattcacttccgggtttctcctgactagacttgaactgactaaccattcatcttgccaggagcccccaggacctgggtcactgccctggggcagccagggaaaaccaggggcttgctggatggcttcacgcttttctcgggtggtgctggtgctaatcgatgcactgagattcgattttgcccagccccagcacagtcacgtgccccgggagccacctgttagccttcctttcctaggtaagctctcaagcctccagcggattctggagatccagccacaccatgccagattgtatcgcagtcaggttgatccccccacgaccaccatgcaaaggctcaaagccttaaccaccggttccttgcccacatttatcgacgctgggagcaattttgcatcccacgccattgttgaagataatctcattaaacaactgacgtccgcaggccgcagagtggtttttatgggagacgacacgtggaaggatcttttcccgggggccttcagcaaagcattctttttcccaagcttcaatgtgcgggacctggacactgtggataacgggattctcgaacacttgtacccgacaatggactcaggcgagtgggatgttctcatcgcccatttcttaggggttgaccattgtgggcacaagcatggccctcaccatccggagatggcaaaaaaactgagccaaatggaccaggtcatccagggactggtggagagattggagaatgacaccttgctggtggtcgctggggatcacggaatgacaaccaacggggatcatggcggtgatagcgaacttgaggtctcagctgctctgtttctgtacagccctacagcggtgttcccttccacgcctcccgaggagcctgaagtgatacctcaggtgtctctggttccgaccctggccctcctgttaggcttgccgataccttttggtaacattggagaggtaatggcagagttattttccgggggggaagactctcagccacacagttccgcgcttgcgcaagcctctgcgctgcacttgaacgcccagcaggtgagcaggtttctccacacatactcagccgcgacccaggatctacaggcaaaagaactccatcagctgcagaatttgtttagcaaggctagcgccgattaccagtggctgctccagagtcccaaaggggcggaggccacacttcccaccgtgatcgccgaactgcaacagtttttgcgcggggcaagagcaatgtgtatcgagagctgggctcgtttctccctggtgcggatggccggtgggactgctctactagccgcttcttgctttatctgcctcctagcctctcagtgggccatatcccccggttttcctttctgtcccctgttactaacgcctgtcgcatggggcctggtaggagccattgcgtatgctgggcttctcggcactatcgagctcaaattggacctggtactgctcggcgctgtggctgcagtcagctccttcttgccattcctgtggaaggcatgggcggggtggggttccaagaggcctttagccaccttgttcccaatcccgggccccgtcctgctcctcctactgttccgtctggcagtatttttctctgacagttttgtggtggctgaggccagagctaccccttttctgttggggtcattcatcctgctgcttgtagttcagctgcattgggagggccagctgctccctcccaagctcctgaccatgcctcgcctaggtacgtccgccacgacaaaccctccaaggcataacggtgcctatgcactacggctgggcattgggcttttgctctgtacccgtttggccggcttgtttcatagatgccccgaggagacgcctgtctgtcattcgagcccttggctatcccccctggcttctatggtcgggggcagagcgaaaaatctgtggtacggcgcctgtgtggccgccttggtggcactactggccgccgtgcgactatggttacgcagatacggcaacctcaagtcccccgaaccaccgatgctatttgtacgatggggactaccccttatggccctcggcacggctgcctactgggctctggcttccggggcggatgaggctcctccccgcttgagggtgctggttagtggggcctcaatggtactgccacgagctgtggcagggcttgctgcatcggggctggcgctcctcttatggaagcccgtgaccgtcttggtcaaggccggggcaggggcaccccggacacgaaccgttttgactccgttttccggtccccccacttctcaggctgacttggactacgtcgtcccacaaatttaccgtcacatgcaggaggagtttcggggcagactggagcgcacgaagtcccagggccccctcacagtggcagcataccagctgggctcggtgtattccgccgcgatggttaccgcattgacacttcttgcttttccactcctcttgctgcacgccgagcgcatctcactcgtgtttcttttactcttccttcaatcatttctgttgctgcaccttcttgccgctggaatccccgtgaccacacccggcccgttcaccgtgccatggcaggcagtgtctgcttgggctttaatggcaacacagaccttctacagcacaggtcatcaacccgtgtttcccgccattcattggcacgccgccttcgtcggattccctgaaggccacggctcttgcacctggctcccagcccttctagtgggtgccaatacctttgcaagtcatttgttgtttgcggtgggttgccctctgctgctgctgtggccgtttctctgcgagagccagggacttcggaagcggcagcagccccctgggaacgaggccgacgctcgggtgcgtcctgaggaggaagaggagcccttgatggaaatgagattgagagacgccccacagcatttttacgcagccctgcttcagctgggcctgaaatatctgttcatcttggggatccaaatcctggcatgcgcattagctgccagcatcctcagacggcacctcatggtgtggaaagtgtttgccccaaagttcatctttgaggccgtgggctttattgtatccagcgttgggctcttgctgggtattgctctcgtgatgagagtggatggggctgttagttcctggtttcggcagctctttctagcccagcagcgatag

SEQ ID NO: 28806 - DNA, 2019 bp, Artificial Sequence
  Description of Artificial Sequence: Synthetic coding sequence
atgcagaaagcctctgtcttacttttcctcgcctgggtttgttttttattttatgccggcatcgccctgtttacatcgggcttcctgctgactcgcttggagctaaccaatcactcctcatgccaggagccacccggaccagggtcactgccatgggggtcccagggcaaaccgggggcctgctggatggcctcacggttttcccgcgtggtgcttgtacttattgatgccctgcgttttgatttcgctcagccccagcactctcacgtgcccagggagccacctgtgagcctcccttttctaggcaaactgagctccctgcagaggatacttgaaatacagcctcatcatgctcgtctttaccggtcacaggtggacccaccaaccacaactatgcagagactgaaagccctgactaccggaagcctgccaacttttatagacgcagggagtaatttcgcctcccatgccattgttgaggacaatctgataaagcagctgaccagcgcgggacgcagggtggtttttatgggtgatgatacatggaaagacttatttcccggggcattttcaaaggccttctttttccccagcttcaacgtgcgtgatctcgacacggtcgataacgggatcttggagcacctttatcccactatggactcgggagagtgggacgtgttaattgcacattttttgggtgtcgatcactgcgggcacaagcatgggccacatcatccggagatggctaagaagctgtctcagatggaccaagttatacaggggctagtggaaaggcttgagaatgatacacttctggtggtggccggcgatcacggcatgacgacgaacggcgaccatgggggggactccgaactggaagtgtccgcagcgttgttcctttacagcccaaccgctgtttttccaagtacgccacctgaggagcccgaggtgatccctcaagtgtccctggtgcccaccctcgctttattgctgggactgcctatcccctttggaaacatcggagaggtcatggctgaactattttccggcggcgaagacagtcagccacacagcagtgctctggcccaggcttccgctctgcacttgaacgcgcaacaggtttctagatttctgcacacttacagtgccgcaacccaggatctgcaagctaaagagctgcaccagctgcagaacttattcagcaaggcctctgctgattatcaatggctgcttcagtctcctaagggagctgaggccacgttaccaaccgtgatcgctgagctgcagcagtttctgcggggagccagggctatgtgcatcgagtcctgggccagatttagcttgagttttctactccttcacctgctggctgcggggataccagttacgacacctggaccattcaccgtcccttggcaggccgtgtccgcatgggcactgatggccactcagacattctactccaccggacaccagcctgtctttccagcgattcactggcacgcagccttcgtggggtttccagaaggtcacgggtcttgtacatggctgccagcactgctagttggcgcaaacacattcgcctctcatcttctcttcgccgttggatgtcccctgctcctcctttggccctttttgtgcgagagccaggggcttcgtaaacgacagcagcctcccggcaacgaggcggatgctcgtgtgaggcccgaagaagaggaggagccgttaatggagatgcgcttaagggatgctccacagcacttctacgctgcgctgttgcaattgggtttgaagtacctgttcatcctggggatccagatcctagcgtgcgccctggcagctagtatcctccggagacacctaatggtgtggaaagtttttgctccaaagtttatttttgaggcggtgggattcattgttagtagcgttgggctcctccttggcatagccctggtgatgcgcgtggacggggccgtcagctcttggtttaggcagctgtttcttgcacagcaaagatag

SEQ ID NO: 28807 - DNA, 3270 bp, Artificial Sequence
  Description of Artificial Sequence: Synthetic coding sequence
atgcagaaggcatccgttcttctattcctcgcatgggtttgtttcctattttatgcgggcattgccctgttcactagtggatttcttctgacgcgcttagagctgacgaatcactcttcttgccaggagccgcccggtccaggcagcctgccttggggatctcagggcaaaccaggcgcgtgttggatggcttccagatttagccgtgtggttctcgtcctcattgatgcactcagattcgactttgcccagccccagcattctcacgttccgcgtgagccacccgtgtccctgcctttcttgggtaaactgagttctctccagcgcatacttgaaatacagccccaccacgcaagactctacagaagtcaggtggatccgcccaccacaaccatgcagagactgaaggcactcacaaccgggtcgttacccaccttcattgacgcaggatccaactttgcaagccatgcaatcgtcgaggacaacctaataaagcagttgacttcagctggcagacgggtggtgttcatgggcgacgatacgtggaaggacctgtttcccggtgcattcagcaaggctttcttcttccccagcttcaatgtccgcgacttagacacggtagataatggtatcttggagcacttataccctactatggattctggcgagtgggatgttctgattgcacatttccttggggtcgaccattgcggacacaaacacgggccacaccatcccgaaatggccaaaaaacttagtcagatggaccaagtgatccagggcctggtggagcgactggagaatgacacactgctggtggtagccggggatcacggaatgaccactaatggagaccatgggggtgacagtgaacttgaggttagcgccgccttgttcctatactctcccacagccgtgttcccttcgactcctcctgaagaacctgaggtcatccctcaggtcagcctggtgcctacattggccctgcttcttggcctgccaatcccattcggaaacattggggaagtgatggctgaattgttctctggcggggaagattcacaaccacactcttctgctctcgcccaggcatcggcgctgcatcttaatgcccagcaggtcagccggttcctgcacacctattctgcagctacacaggatctgcaggctaaggagcttcaccagcttcagaacctgttcagcaaggcttccgcggattaccagtggttgctccagagccccaaaggggccgaggctaccctgccaactgtgatagcggagcttcagcagtttctgcggggcgcgcgggccatgtgtatcgaaagctgggcacgctttagcctggtcagaatggccggtggcacagccctccttgccgctagctgctttatctgtcttctcgcttcgcagtgggcaataagtcctggttttcccttttgccctttgctgctgacaccagtggcatgggggttggttggagcaattgcttatgccggtctgctcggaacaattgagctgaagctggacctggtgctactcggggcagtcgcggctgtgtcaagtttcctgccattcctttggaaagcatgggcgggctggggctccaagcgtcctcttgccacactgttcccgattccgggacctgtcctgctgctactcctgtttcggctcgccgtgttctttagtgactccttcgttgtggcggaggcccgcgcgactccttttctgctggggtcatttatcctgcttcttgtggttcagctgcactgggaaggccagctgctgccccctaagctactcaccatgccaagattgggaacctctgcgactaccaacccccccaggcacaacggcgcttatgctctgagactcggaattggattgttactttgcacccggctggccggactctttcatcggtgcccagaagaaactcctgtgtgtcatagcagcccctggctgtctcctctggcctccatggtcggcgggagagcaaaaaatctttggtacggcgcgtgcgtcgctgctttagtggctctgctcgccgccgtgcgtttgtggctccggcgatacggaaatctgaagagccccgaaccacctatgcttttcgtgcgttggggattaccattgatggccctgggtaccgctgcgtattgggcccttgctagtggcgccgacgaagccccgccacgattgagagtacttgtcagcggcgcctcaatggtactgccccgggccgtcgctggacttgccgcgtccggattggcactgttgctctggaaaccagtaacagtattggttaaggccggcgcaggagccccgagaactaggacagttcttactcccttctctgggccacccaccagccaagctgacctggattatgtagtgccacaaatataccgtcacatgcaagaagagttccggggtcgtctggagaggacaaagagtcagggacctctcacagttgccgcttatcaactgggctcggtatatagcgccgccatggtcactgctctcacactgctcgccttcccactgctgttgctgcatgcagaaagaattagtcttgtctttctgctccttttccttcaaagctttcttttacttcacctgctggccgctgggattcccgtcacaactccgggcccgtttaccgtcccgtggcaggctgtctcagcctgggcgctcatggccacacaaaccttttactcaaccggacatcagcctgtattcccggcaatccactggcacgccgccttcgtggggtttcctgagggtcacggcagctgtacctggctgcctgccctccttgtgggggccaataccttcgcaagtcatctgctctttgccgtcggctgccctcttctcttgttatggccattcctgtgcgagagccagggactgcgaaagcgtcagcaacctcccggaaacgaggctgacgcacgggtacggccagaggaggaagaggaacctcttatggaaatgcggcttagagacgcccctcagcatttttatgcagcacttctgcaactgggtctaaagtacctgtttatcctcgggatccaaattcttgcctgcgcccttgctgccagcatactgcggcgacaccttatggtgtggaaagtgtttgcacccaagttcatctttgaagccgtagggtttatcgttagtagtgtcggactgctgctcggcattgcattagtcatgagagttgatggcgccgtatcaagctggttcagacagctgttcctggcccagcagcggtag

SEQ ID NO: 28808 - DNA, 2283 bp, Artificial Sequence
  Description of Artificial Sequence: Synthetic coding sequence
atggttctgaaggctttttttcctacctgttgcgtgagtacagactccgggctactagtcgggaggtgggtccctgaacagtccagtgcagtggtgcttgctgtgcttcattttccgttcataccgattcaggtaaagcaactgcttgcccaggtaaggcaagcaagccaggtgggagttgccgtgctcgggacttggtgccattgtcggcaggagccagaggaaagtctgggtcggttcctggagtctttaggtgcagtgttccctcacgagccgtggctgcgcctctgccgcgagaggggcggaaccttttggtcttgcgaggccacacatcgacaggcacctaccgcaccaggcgctcccggagaagaccaggtgatgctgatcttttacgaccagcgccaggtcctactgtcccaactgcacttgcccactgtcttaccagacagacaggctggcgcgacaaccgcaagtacaggcggactggccgctgtttttgataccgtagcgaggagcgaggtgcttttccgttcagaccgattcgatgagggaccagtgcgcctatcccactggcagagtgagggtgttgaggctagtatcctagctgagttagcccgtagggcctccggcccgatctgtttgctgctggcctcgcttctttccctcgtgagcgccgtcagtgcgtgtagggtttttaagctctggccactcagcttcctgggaagtaagctatccacgtgcgagcagctaagacacagactggagcacttaacacttattttttccaccagaaaagcggagaatccagctcagctcatgagaaaggccaataccgttgcctccgtcctgctggacgtggctttgggactgatgctgctttcatggctgcacggtaggtctagaatcggtcacttggctgacgcccttgtccccgtcgctgatcacgtggctgaggagctgcagcacttgctgcagtggttgatgggagcaccagccggactgaagatgaacagggcacttgaccaagtccttgggagatttttcctgtaccacatccatctgtggatctcgtacatacacctcatgagcccattcgtcgagcacatcctgtggcacgtaggtctctctgcttgcctgggtcttacagttgccctttcattattgagcgatattattgcgctgctgacattccacatctactgtttttacgtgtatggtgctcgcctttactgcttaaagattcatggactctcttccctttggaggctgtttagaggcaagaagtggaacgtgttgcggcagagggtagactcttgctcatacgatttggatcagctctttatcggtaccctcctgtttaccatcctcctgttcctgttaccgactacagctctctactacttggtttttactctgctgcggctgctggtcgtcgccgttcagggactgattcatctgctcgtggacctcattaattcccttccactctactcactcggactcaggctttgtcgaccttaccgcttggctgataaaccaacagccttgcagcctcggggggcgcatcttcccccgcctcaattgtggcttccaccccaggccttgctggggcgcccagtgcctcaggctgtgccatggggcgctcatctgccactggaggctgagagagggcaggctgggctgagggagcttcttgctcggcttgcccccccacacggtcattcacagccatccgccctgcccggctggcatcagctatcctggaggatgtcatgcgctctctggaccttattatgcgcgccagaacacgggcgaccttgttatcataccctgggtttggaggtcatcgggagcgagcaaatgtggggatggccagcaaggctggccgcccttcaccactggcactgtttgccgtgggaccctctgcccacctgctgtgggcatcacggtggcgaacactcgaatccacgctgtccagagcactgtcccatgcccaccctctgcacgcaagtacaacgggtgcgcccaccgcaacagccacaggtggagggttggtccccgtgggggctaccatctggaagcgcactcgctgtcggcgtcgaaggtccgtgtcaagacgaaccgccttcccctcggcatcctctcgcaccttctgctgagcagcaccccgccagcggagggctcaagcagagcttgaccccagtaccctcaggacccgggccatctctgcccgagcctcatggcgtctatctgcgcatgtttccaggcgaagtcgccctatag

SEQ ID NO: 28809 - DNA, 447 bp, Artificial Sequence
  Description of Artificial Sequence: Synthetic coding sequence
atggtgctaaaggctttttttcccacatgctgtgtgtccacagattccggcctactcgtgggccgctgggtccccgaacaatcatctgccgtggttctggcggtactgcacttccctttcatccccattcaagtgaaacagctgctcgctcaagtcagacaggcatcccaggtcggggtagccgtgctaggaacctggtgccactgcagacaagagcccgaggaatcactgggaaggttcctggagagtctcggcgccgtgtttccgcacgaaccctggctccggctctgccgcgagcggggaggcactttctggtcctgtgaagccactcacagacaagcccccacagctcccggcgcccccggggaagatcaggtgatgctgatcttttacgaccaaaggcaggttctgcttagtcaactccacctccctaccgtgctgccatag

SEQ ID NO: 28810 - DNA, 1746 bp, Artificial Sequence
  Description of Artificial Sequence: Synthetic coding sequence
atggtgctcaaggcattctttcccacctgttgcgttagtacggacagcggtctgctagtgggccgctgggtgcctgagcaatcctctgcagtcgttttagccgtgctgcattttccgttcatcccaattcaggtgaagcagctacttgcccaggtgcgccaggcgagtcaggtcggagtagccgtgctgggaacctggtgtcactgtcggcaggaacctgaggaaagccttggaagatttctggaaagtctaggcgccgtgtttccacacgagccatggctgcgcttatgccgcgaaagaggcggtaccttctggagttgcgaggcgactcatcggcaggctcctaccgcgcctggagccccaggcgaggaccaggtcatgctgatcttttacgaccagcggcaggtgcttctgagccagttacacctgcccacggtattgcctgatagacaagctggcgccacaacggcctccacgggtggactggcggctgttttcgataccgttgccagaagtgaagtgctgttcaggagcgaccggtttgacgaaggccctgtgcgcctgagccattggcagtccgaaggcgtggaagccagtatcctggccgagctcgctagacgggcaagcggccccatttgccttttactcgcctccctcttatctttggttagcgctgtttctgcctgtagggtttttaagctttggccccttagtttcttaggaagtaagttaagtacatgtgagcaactcaggcaccggctcgaacatcttacgttgatattttcgacaagaaaagcagagaatcctgcccaattgatgaggaaggcaaacactgtagccagtgtgctcctcgatgtcgcgctgggcctgatgctgctttcatggctgcatggcagatctcgcatcggccacttggccgacgctctcgttcctgtggccgatcacgtggccgaagaactccagcaccttctgcaatggctcatgggcgcacccgctggtctaaagatgaatagggccctcgatcaagtgctggggcggttcttcctctatcacattcatttgtggatttcctatatccacttaatgtcccccttcgtggagcacattctctggcatgtcggcctttctgcctgtctggggttgactgtggcgctgtccctgttgtccgatatcatagcactgctgacttttcatatttactgtttttacgtgtacggcgcaagactctactgcctgaaaattcatggactaagcagcctctggcgtctgttccgaggcaaaaagtggaatgtgctgcggcagagagtcgattcatgtagttacgatctcgaccaattgttcattggcacacttctcttcaccatcctcctgtttcttctgcctacaactgccctctactatcttgtgtttaccctgctgagactccttgttgtggctgtccaaggattaattcaccttctagtggacctgatcaactcactgcccctatatagtctgggattaagactgtgtcgtccctatcggttggctgctggtgtcaagtttcgcgtgttacgtcacgaagcaggtcgaccccttcgacttctgatgcagattaatcctttgccctactcacgtgtggtccacacgtaccgcctgccttcatgtggatgccaccccaaacatagctggggcgcgctatgcagaaagttgttcctgggcgaacttatctacccatggcggcagaggggggataagcaggactag

SEQ ID NO: 28811 - DNA, 756 bp, Artificial Sequence
  Description of Artificial Sequence: Synthetic coding sequence
atggtgttgaaagcgttcttccctacatgctgcgtgtcaacggactcaggactcctggtcggccgatgggtcccagagcagagttcagcagtggtactggccgtcctccattttccctttataccaatccaggtaaaacaactcctagcccaagtaaggcaggcctctcaggtgggtgtggctgtgctgggcacctggtgtcattgcaggcaggaaccagaagagtccctgggacggtttctggagtcattaggtgccgtattcccccatgagccctggctcagactttgccgcgagcggggtgggaccttttggtcgtgcgaggctacgcaccgccaagcacctactgccccgggtgcgccgggggaagatcaggtgatgctgatattctacgaccagcgtcaggtcctgctctcacagctgcacctgccaacagtgctgcctgaccgacaggccggcgcgacaaccgcaagtacgggcggtctggcagccgtgtttgacacagttgcgcggtcggaggtccttttcaggagtgatcgcttcgatgaaggccccgtgcgcttgtcccattggcagagtgagggcgtggaggcaagtattctcgccgagctggcaagaagggcatccggccctatttgcctgttactggcgtctttgctctccttggtctccgccgtaagtgcatgcagagtgtttaagttgtggcccctgtcttttctgggctccaagcttagtacttgcgagcagctcaggtag

SEQ ID NO: 28812 - DNA, 1746 bp, Artificial Sequence
  Description of Artificial Sequence: Synthetic coding sequence
atggtgctcaaagcgtttttcccgacttgctgtgtgtccactgacagtgggctgcttgtgggcagatgggtcccggagcaatcctccgctgtggtcctcgccgtccttcacttccccttcatccccatccaagtgaaacagttactggctcaggtgaggcaggcaagtcaggttggggtggccgtactggggacatggtgccattgtagacaggagccagaggagagtctggggagatttttagaaagcctgggcgctgtcttccctcacgaaccctggctgcggctgtgtcgcgagcggggaggcactttttggtcctgtgaagcgacacaccgacaggcccccaccgcacccggggcacctggcgaggaccaggtgatgcttatcttctatgatcagagacaggtccttctctcccagctccatctgccaactgtgctgcctgaccgtcaggccggcgcaactaccgcatcaacgggtggacttgcagccgtgtttgacactgtggctcggtccgaagttctctttagatcagacaggttcgatgaaggccctgttaggcttagccactggcagtcagagggtgtcgaggctagtattctcgccgaacttgcacgtagagcctctggtcccatctgcctgcttctagcgtccctgctgtcccttgtatcagccgtcagcgcatgccgagtattcaagttgtggcccctcagcttcctcgggtctaagctgtccacgtgtgaacagctgcggcacagactggaacatttaaccctgattttcagcactcgaaaggcggagaacccagcacaacttatgcgcaaagctaataccgtcgcctccgttctcttggacgtcgccttgggcttgatgctgctaagctggctccacggaagatctcgcatcggccatttggccgatgccctggtgcctgtggccgaccacgtggcagaggagctgcaacacctgctgcagtggctaatgggggcacctgctgggctgaagatgaatcgggccttggaccaggtgcttggacggttctttctataccatattcacctttggatttcttatattcacctgatgtccccctttgtggaacatattctatggcacgtcgggttgagtgcgtgtctcggcctgaccgtggccttgagtttattgtctgatattatcgctcttctaacattccacatatattgcttctacgtctacggcgctcgtttatactgcctgaaaatacacgggctgagctcattatggcggctcttcagaggtaaaaagtggaatgtcctgcgccagagggtggatagctgtagctacgacttggatcaactgtttatcggaaccctgcttttcacaatcctgttgttccttcttcccacaacggccctgtattaccttgtcttcactctgcttaggctgttagtcgtagcagttcaaggactgattcatttgctcgttgacttaataaattccttgccgctctactccctgggactccgcctgtgccggccataccggttagcggcgggcgtgaagtttcgcgtcctgagacatgaagcgggaaggcccttgcgcctgctgatgcagatcaacccactgccctacagtcgggtggtacacacctatagactgccctcatgcggatgccaccctaaacattcctggggggccctatgccgaaaactgttcctgggggagctgatctacccttggcggcaaagaggtgataagcaggattag

SEQ ID NO: 28813 - DNA, 945 bp, Artificial Sequence
  Description of Artificial Sequence: Synthetic coding sequence
atggtcttaaaggccttcttccccacatgttgtgtaagtaccgactctgggctgctggtaggtcgctgggtgccagaacagagtagcgccgtcgtactggccgttttgcactttcctttcattccgatccaggtcaagcagctcttggcacaggttaggcaggcttcccaggttggagtggctgtcctcgggacatggtgtcactgccggcaggagccagaagaaagcctcggtcgtttccttgagtcactaggcgccgtctttccacatgagccctggctccgcctgtgtcgggagcggggaggaacgttctggagttgtgaggctacacatagacaagcaccaaccgcccctggcgcacctggggaagatcaggtcatgctcattttttatgaccaaagacaagtactcctcagccagttgcaccttcccacagtgctgccagataggcaggccggcgcaacgacagccagcacggggggcctggctgcggtgttcgacacggttgctcggtcggaagtgctgtttcgttctgaccggtttgatgagggcccggtcaggctgtctcactggcaatccgagggagtggaggcctctatcctggccgagctagctaggcgtgctagtgggccaatctgcttgctgctggcttctctgttaagcctggtgtccgctgtttctgcatgccgcgtctttaagttatggccactaagcttcttagggtctaaattgtctacttgtgaacagcttcgccacaggttggagcatttgaccctcatcttttccactcgcaaagcagagaacccagcacaactgatgcgcaaagccaatacagtggcgtctgttctgctggacgtggccttggggctgatgttactgtcttggttgcacggcaggtcaaggatcgggcacctggccgatgccttggtccctgtggctgattag

SEQ ID NO: 28814 - DNA, 339 bp, Artificial Sequence
  Description of Artificial Sequence: Synthetic coding sequence
atggtgttgaaggccttctttccaacgtgctgtgtcagtactgactcaggcctactggtgggtcgttgggtccccgaacagtcctccgccgtcgtgctcgctgttctgcactttcccttcatccccattcaggtcaagcagttgctcgcccaggtcagacaggcctcacaagtcggcgttgcagtgctcggtacttggtgtcattgtagacaagagcctgaggagtcattagggcggttcctcgaaagtcttggcgcagttttccctcatgaaccttggcttcggctgtgtcgcgaacgcggcggaacattctggtcctgcgaggcaacccatcgttag

SEQ ID NO: 28815 - DNA, 1725 bp, Artificial Sequence
  Description of Artificial Sequence: Synthetic coding sequence
atgtggtgggccctgcgtccaccaggtatcctgcctccaggcatggtgctgaaggccttctttcccacgtgctgtgtctccacggattcgggacttttggtgggcagatgggtgcccgaacagtcctcggccgtggtactcgccgtgctgcacttcccatttattccaattcaggtgaagcagctccttgcccaagtccggcaggcttcccaggtgggcgttgccgtgttaggaacatggtgtcattgtcgccaggaaccagaagagagcttaggaaggttcctcgagtctcttggcgcggtgtttccacacgagccgtggctgaggctctgtagggagcggggtggaacattctggtcatgcgaggccactcaccggcaagctccgactgctcccggagcccccggggaggaccaggtgatgctgatattttatgaccagcgccaagtgttgctttcccaactgcatctgcccacggttctccctgaccgacaggctggggccaccaccgcttctacaggagggcttgctgccgtctttgacacggtggctcgcagcgaggtactgttcagatccgatagattcgacgagggtcctgtacgcctttcacattggcagtcagagggggtcgaggcctctatcctcgcagaactcgccagacgagcctctggtccaatctgtctcctcctggccagcctcctgtccctggtgtctgcagtatccgcctgcagggtctttaagctgtggccactctccttcctcgggtcaaagctgagtacttgcgaacagctgcgacaccgcctagaacatctaaccctgattttcagtacacgcaaggccgagaatccagctcagcttatgagaaaggccaacaccgtggccagcgttctcctcgacgtcgccttgggattgatgttgctcagctggctacacgggcgcagcagaattggccacttggctgacgcccttgttcccgtagccgatcacgtcgcggaggaactgcagcatctgctgcaatggctcatgggtgctccagccggccttaaaatgaatagggctctggatcaggtgcttggaagattttttctgtatcatatccacctctggatctcctatatccatctcatgtccccatttgtcgaacatatcctgtggcacgtgggattgtccgcctgtcttggactgaccgttgctttatctctgctttctgatatcatagccttgcttactttccatatctactgtttttatgtgtatggcgcacgactgtactgcctgaaaatccacggcctgtcttccctctggaggctctttcgtggcaagaaatggaacgtccttcggcagagggtggatagctgtagctacgatctcgatcaactctttattgggactttgttgtttacaatattactgtttctcctgccaaccacggctctctactacttggtctttacgctgctccgcctgttggtcgtggccgtccagggcctgattcacttgctagtggatctaattaacagccttccactctacagcttgggtctgcgcctatgcagaccataccgcctggccgggagcgagccatggagacctgaggctacaggtctgtgcagcagcgcattaggattctcaggtctgggctctctgaattgtcgccccggagcaaagagaggtaaagttaggggaacacggtctcagcagggcgggcatcacccattagcttag

SEQ ID NO: 28816 - DNA, 900 bp, Artificial Sequence
  Description of Artificial Sequence: Synthetic coding sequence
atggttcttaaggctttcttccctacctgctgtgtgtccacagacagcggcctgctggtggggcgctgggtgcccgagcaaagcagtgctgttgtgctggccgtcttacatttcccgttcatccctattcaggtcaagcagctgctggcccaggtccgacaagcctcacaggtaggcgtagcagtgctgggtacgtggtgccattgtaggcaggagccagaggagtcactcggtagatttctcgagagcctcggcgccgttttccctcacgaaccctggctgaggctttgcagagaacgtggaggaacattctggtcttgtgaggctactcatagacaagcccctacagcaccaggcgccccgggagaagatcaggtcatgctgatcttttacgatcagagacaggtgctgctcagccagttacacctgccaacagttctccccgatcggcaggccggggctacgaccgcttctacaggcggcctggcggcagtgtttgataccgtggctagaagcgaggtgctgttccgctctgaccggtttgatgagggccccgtcagactatctcactggcaatctgagggagtggaggccagtatcctggccgagctggcccgccgagcaagcggccccatctgcctactacttgcttccctgttatctctcgtttccgccgtgagtgcttgtagagttttcaagctgtggcctctgagtttcctgggctctaagctcagcacgtgcgagcagttaagacatagactcgaacacctcacgttgattttttcaacaaggaaggcagagaaccctgcgcagttaatgaggtgcggaccggctctggttagcgcggggctgggcgcatgtcctctggcaccgagcccatctccctctgctccccggtag

SEQ ID NO: 28817 - DNA, 480 bp, Artificial Sequence
  Description of Artificial Sequence: Synthetic coding sequence
caaccctttcttaacgcccttggggcggccttactgtgtggcttatccgacagtctgctgtgcaacgtgggcggcgaaagtcccctaactcaactgccccctgctacaatttggacttgcactgcatctccaatgagctccacgcagtggagccccggttgggacccagtattacccccttgcaccctttgctctacgttctactcaacatgtctgtctctgcacacacaccgctgtacctttcggactagaatggcactacagtggcctcctatgccatctatagttcctgccggtgtggggagcctggtgtataacgtggattcaaaaacttataacgcatcggtgctcccagtgagagtggaggtggatatggtgagatggaggtgctcctggcactcctgtggctgtagtttgggcctgttgagcccaagctgtctgcagaatgcgtgttttcaggggctgcgcgtaaaagggtag

SEQ ID NO: 28818 - DNA, 1668 bp, Artificial Sequence
  Description of Artificial Sequence: Synthetic coding sequence
atggccgccgccggtgcagcggccacccacctcgaagtggccagggggaaacgggccgccctgttcttcgccgccgtggcgattgtgttggggctgcccctttggtggaaaacaacagaaacttaccgggccagtctgccatatagtcagataagcggcctgaatgcattgcagttacgcctgatggttcctgtgaccgtggtttttacgagagagtcagtgcccctcgacgatcaggagaagctgccatttacggtcgtgcacgaacgagagatccccctaaaatataagatgaagattaagtgcagatttcaaaaagcgtatcggcgggctctggaccatgaagaggaggccctgagctccggctccgtccaagaagcggaagcaatgctcgatgaaccacaggagcaggccgaaggaagtctgacagtgtacgtcatttcagagcacagctcactcttaccacaggatatgatgtcttacattggaccaaaaaggacagcagtagtgaggggaattatgcatagggaggcctttaatataataggccgccgcatcgtgcaggtggcacaggccatgagcttgactgaggatgtgctggccgcagcactggccgatcacctgcccgaggacaaatggagcgccgagaagcggcgccctttgaagtcaagtcttggttacgaaatcaccttctctctgcttaacccagatcccaagtcccatgacgtctattgggatatcgaaggtgccgtccgaaggtatgttcagccctttctcaacgcactgggagctgccgggaacttctctgtggattcgcagattttatactacgccatgctcggggttaatccaagatttgatagtgccagcagcagctattacctcgacatgcactctcttcctcacgtcattaatcctgtcgaatctcgcttagggtcttcggcagcctcactgtacccagtgttgaattttctgctctatgtccccgagctggcacactctcccttgtacatccaagataaggacggagctccagtcgccaccaatgccttccacagccccagatggggggggattatggtgtataacgtggacagcaaaacctataatgccagcgtgttgccggtgcgcgtggaggtcgacatggtgcgtgtcatggaggtgttcttagcacaacttagactgctcttcggaattgcccagccgcagcttccacctaagtgtcttctctccggcccgacttccgaagggctcatgacatgggagctggatagattgctttgggcccgctctgtggaaaaccttgcaaccgccaccacaaccctgacctccctggcccagctgttagggaaaatcagcaacattgtcataaaggatgacgtcgcttccgaagtatacaaggccgttgctgccgtccagaagtcagctgaagaattggcctcaggccatctggcctctgctttcgtggctagccaagaggcagttacttctagcgaacttgcattttttgacccgtcacttctccatctgctttattttcccgatgatcaaaaatttgcaatctatattcccctattcctgccgatggcggtgcctatccttctgagcttagttaagatatttctggaaaccagaaagagctggcggaaacccgaaaaaaccgactag

SEQ ID NO: 28819 - DNA, 1644 bp, Artificial Sequence
  Description of Artificial Sequence: Synthetic coding sequence
atgccgtccgaagtggcccggggcaagagagcagctttgtttttcgctgccgtggcaattgtgctcgggctgccgctgtggtggaagaccaccgaaacctacagggcatcattaccatattcacaaatttctggtttaaacgcccttcagctgaggcttatggtgcccgtcaccgttgttttcacgagagaatcagtgcccctggacgaccaagagaagttgccatttacagtggtgcatgaaagggagattcccctcaagtataagatgaaaatcaagtgccgcttccagaaagcctatagaagagccctcgaccatgaggaagaagctctgtcctctggctctgtccaagaggccgaggccatgcttgatgagcctcaggagcaggctgaaggaagccttaccgtctacgtgattagcgaacatagctcattactgccccaggacatgatgtcatacatcggaccgaaacgcaccgcggtagtccggggcattatgcatcgagaggcattcaacataatcggaagaaggatcgttcaggtcgcccaggcaatgtcactgacagaggacgtgcttgctgccgccctggctgaccatcttccagaagataagtggagcgctgaaaagcggagacctctgaaatcctcgctagggtacgagatcaccttttctctcctgaaccctgaccccaagagccacgatgtatactgggacattgaaggggctgtgcgaaggtacgtccagccattcctgaatgcgctcggtgccgctggaaatttctccgtggactcgcaaatcctgtactacgctatgttgggcgttaacccccgctttgacagtgcatcaagcagttactatctggatatgcatagtctgccccacgtgattaaccccgtagaatctcgactcggttcctctgctgcaagcctgtacccagtcctgaatttcctgctatatgttcctgaactagcacatagtccactgtatatccaagataaggatggagctccggttgccaccaacgcgtttcactctccaagatgggggggaatcatggtgtataatgttgacagcaagacgtataacgccagcgtattaccagtgcgagtggaggttgacatggttcgtgtcatggaggtgttcctggcccagctgaggctgctctttggcatcgcgcaaccgcagttaccaccgaaatgcctcctgtctggtccgacctcagagggtcttatgacctgggagctggaccggttgctttgggcccgcagtgtcgagaatctcgcaacagctactactacattgacttctctcgcccagttgctgggaaagatttccaatatcgtcataaaagacgatgttgcctctgaggtttacaaagctgtagcggcagtgcagaagagtgccgaggaactggcatccggtcacctggcatctgctttcgtggcctcccaagaggctgtcacctcgtctgagttagccttcttcgacccgtctctgcttcatctcctgtactttcctgacgatcagaaatttgcaatttacattccactatttctgccgatggcggttccaattctgctgagtcttgtgaagatcttcttggagacgcgcaagtcgtggcggaagcccgaaaaaacggactag

SEQ ID NO: 28820 - DNA, 1485 bp, Artificial Sequence
  Description of Artificial Sequence: Synthetic coding sequence
atggtgcccgtcacagttgttttcacacgagaatccgtcccactggacgatcaggaaaagttgccattcaccgttgttcatgagcgcgagatccctctgaagtacaagatgaaaattaagtgccgcttccagaaggcatatcgtagggctctcgaccatgaggaggaggccttatcttctgggtcagtgcaggaggccgaagcgatgctagatgagccccaggaacaagcagaaggatccttgactgtttatgtcatttcagagcactcttctttacttccccaggatatgatgtcatacattgggccaaagaggaccgccgtggtaagaggtatcatgcacagggaggccttcaatattataggacgtaggatcgtacaggtggcacaggcaatgtcattgacagaggacgtgctggctgccgctctggccgaccaccttcccgaagacaaatggtctgccgagaagcggcggccgcttaaatctagcctcggatacgagattacctttagccttcttaatcctgatccaaaatctcacgatgtctattgggacatagagggcgctgtgcggcggtatgtgcagccctttttgaacgctctgggcgcggctggcaatttttccgttgactcccagattctgtactatgccatgctcggggtgaacccccgctttgattcagcaagcagcagctattacctggacatgcacagccttccccatgttatcaaccctgtcgagtcaaggctgggaagttccgcggcttctctgtaccctgtgctgaatttccttctttacgtcccagaactggctcatagtccactctacatccaggacaaggatggggctccggtcgccacaaacgcatttcattcacctagatggggcgggattatggtgtacaatgtggattccaagacctacaacgcttcagtgctccctgtgagagtggaggtggacatggtgagagtcatggaggtttttcttgcacaacttcggttgctgttcggaatcgctcagcctcagctaccacccaaatgtctgttatcaggccctacaagcgaaggtctgatgacctgggaattggataggctcctgtgggcacggtcagttgaaaacctggcaactgcaaccaccactcttacctcccttgcccagctacttgggaagatttcaaatattgtaataaaggacgacgtggcatcagaggtgtataaagccgtggccgccgtacagaaaagtgccgaggaactggcctcggggcacctggccagcgctttcgttgcctctcaagaggccgtgaccagcagcgagctggccttcttcgatcctagcctgctgcacctgctgtacttcccagatgaccagaagtttgccatttatatccccctatttttgcctatggctgtgccaattctgctgtctttggtgaagattttcctagagacccggaagagctggcgaaagcctgaaaagactgattag

SEQ ID NO: 28821 - DNA, 1431 bp, Artificial Sequence
  Description of Artificial Sequence: Synthetic coding sequence
atggcagcggcaatgcccctagctctgctcgtgttattgctactggggccggggggctggtgcctcgccgaacctccccgggacagtttgcgagaggaacttgtgataacacccctgcctagtggggatgtggccgccacctttcaatttaggacccgttgggattctgagctgcagagagagggggatactgatcactactttctccgctatgccgtcctgcctagggaagtcgtctgtactgagaacctgaccccttggaaaaagctgcttccctgctcgagcaaggctggcctgagcgtactgctgaaggctgaccgcctcttccatacttcttaccattcccaagctgtgcatatcagaccagtgtgtcggaacgcgagatgcaccagcatttcctgggaactgaggcagaccctgtctgtggtcttcgatgcattcatcacaggccagggtaagaaagactggagcctcttccgaatgttcagtcgaaccctgacagaaccttgccccttggcctcggaaagtcgcgtgtacgtggatattactacttataatcaagataacgaaactctagaggtgcatccgcctccgactacaacttatcaggatgtgattttaggcacaaggaagacctacgcaatatacgacttgttggataccgcgatgattaacaacagccgcaacttgaatatacaactcaaatggaagaggcctccagaaaatgaggccccacccgtacctttcctgcacgcacagcgctacgtgtcgggctatggcctccagaaaggggagcttagcaccttgctctacaatacacacccgtacagggctttccccgtgctattattggacacggttccctggtatctgaggctctacgtccataccctaaccatcacttcgaaaggcaaggagaataagccctcctacattcattaccaacctgctcaggacagactgcagcctcatttacttgagatgctgattcagctgcccgccaattcagttacaaaagtcagcatccagttcgaacgggctctattgaagtggacggaatatacaccggaccctaatcacggtttttacgtgtcccccagtgtgttgtctgccttagttccaagtatggtggctgccaaaccagttgactgggaagaatctcctctgttcaactcactctttccagtaagcgacgggagcaactatttcgtccgactttatacagagcctctgctggttaatttgcccactccagacttttctatgccttataacgtcatctgcctgacatgcaccgtggtggcggtgtgttatggcagtttctacaatcttcttacccggacctttcatatagaggaaccgagaactggcggcctggctaaaaggcttgcgaatctcatccgcagggcaagaggcgttccgccgttgtag

SEQ ID NO: 28822 - DNA, 1737 bp, Artificial Sequence
  Description of Artificial Sequence: Synthetic coding sequence
atggcggccgccatgccacttgctcttctggtgctgctgttgctagggccgggcgggtggtgcctggcagaaccccctcgtgatagtctccgcgaagagctggttatcactcctttgccatcaggcgacgtggctgccaccttccagttccgcacacgttgggatagcgagctgcaaagagagggggtgtctcattacaggctctttcctaaggcgttaggacaactgattagcaaatactccctcagggaattgcacctgagcttcacacagggcttctggcggacccgttactgggggcctcctttcctacaggctccctctggtgctgagctttgggtctggtttcaagataccgtgactgatgtcgacaaaagttggaaggagctgtcaaacgtcctctctggcattttttgcgcttcactgaactttatcgacagtaccaacacagtgaccccaacagcttcatttaagccccttggcctggccaacgacacagatcattacttccttcgctatgctgtgctgcccagggaggtcgtctgcactgagaacctcacaccctggaagaaactgttgccctgctcttccaaagccggcctgtccgtgctgctaaaggctgaccgtctgttccatactagctaccattcacaagcagtgcatattcgcccggtgtgcaggaacgcccgctgcacatccatttcttgggaattgcggcaaaccctttctgtggtgttcgatgcttttattacaggtcagggcaagaaggattggagtctttttcgaatgttctcacgcaccctgaccgaaccctgcccgcttgcttccgagagtagggtgtacgtagatatcacaacctataatcaggacaatgaaacactggaggtgcacccaccgccaacaaccacataccaagacgtgatcttgggaaccaggaagacctacgccatttatgacctgctagatacagcgatgatcaataatagccgaaatcttaatatccagcttaagtggaagagaccacctgagaatgaagcgcctccagtaccttttctccatgctcagagatatgtgagcggatacggacttcaaaaaggcgaactttccaccttattatataatacacatccgtatcgtgcctttcccgtgctcttgctcgacacagtgccatggtatctgcggctgtacgtgcatactcttactattacctcgaaaggcaaagagaacaagccctcttacatccattaccagcccgcacaggataggttgcaaccgcacctgcttgagatgctgattcaactccctgctaatagtgttacaaaggtgtcgatccaattcgagcgggctctgttgaagtggactgagtatactccagaccccaaccatggcttttatgtgtccccttcagttctgagtgcccttgtcccaagcatggtggcggccaagcccgttgactgggaggagtcccctctatttaactccttgttccccgtaagtgacggaagcaactacttcgtgaggttgtataccgagcccttgcttgttaacctaccaaccccggacttcagcatgccatacaacgtcatctgtttaacttgcaccgtggtggccgtgtgctacggatcattttacaacttgctgacccggacatttcatatcgaagagccacgtacaggtgggctggcaaagaggctagctaacctgatcagacgcgccaggggcgtcccccctctgtag

SEQ ID NO: 28823 - DNA, 1155 bp, Artificial Sequence
  Description of Artificial Sequence: Synthetic coding sequence
atggccgccgcaatgcctctggcacttctcgtcttgttgttattgggaccaggagggtggtgcctggcagaaccccccagagattcgttgagggaggaacttgtcatcacccctctgccgtctggggatgtggcagcaaccttccagttccgcacccgatgggattccgagctccaacgggagggggactggagcttattccgcatgttctcacgaacactcaccgagccctgtccactcgcctcagaatcgcgtgtgtatgtggacatcactacctataaccaggataatgagaccttagaggtccaccctccacccacgaccacctatcaagacgttattctgggaaccagaaagacttacgcaatttacgacctgttggacacagccatgataaataacagcagaaacttgaatatccagctaaagtggaaaaggcctccagaaaatgaggcaccccccgtcccattcctgcacgcacaacggtacgtgagtggatatgggctccagaagggcgagctctctacgttgttgtacaacactcacccatatagagcctttccagtactgcttctagacaccgtgccctggtatttgcgcctgtacgtccacaccctcacaatcacttctaagggaaaagaaaacaagccctcatatatccactaccagccagcccaggaccgattgcagcctcatttattggagatgctcatccagctccctgccaacagtgttacaaaggtgagtatacagttcgaacgcgcgctgctgaaatggaccgaatacaccccggatccgaatcacggcttctatgtgtctccctctgttctttccgcgctggtgcccagtatggtcgccgccaagcccgttgactgggaggagagccctttgtttaatagcctgtttcctgtcagcgacggctctaactatttcgtgcggctctacaccgaacccctccttgtgaacttgccaacccccgatttctcaatgccgtataatgtgatatgcctgacatgtacggtcgtcgctgtctgctatgggtccttttacaatctgttgactcgcacttttcacatagaagagccaagaactggcggtctggcgaaacgcctggccaacttaataagacgagccaggggcgtccccccactctag

SEQ ID NO: 28824 - DNA, 1536 bp, Artificial Sequence
  Description of Artificial Sequence: Synthetic coding sequence
atggccgcagctatgccgctcgccctgttggtcctgctactgctggggcccggagggtggtgtctcgcggaaccaccaagggacagcttgcgagaagagcttgtgatcaccccgctgccctcaggcgacgtggctgcaacttttcagttccggactcggtgggactccgaattgcagagagaaggagtgagtcattatcgcctttttccgaaggctctgggtcagctgatatctaagtacagcttaagggagctacacctgtcattcacgcaaggcttctggcgcacgcgttactggggccctccatttcttcaggctccctccggtgccgagctctgggtctggttccaggacactgtcactgatgtggataagtcatggaaagaactgtcaaatgtcctgagcgggatattctgcgcatccttgaattttattgactcaacaaacactgttacaccgacagccagctttaaacctctggggctggcaaatgacacagaccactatttcctgcgctacgcagtgctgcccagagaagtggtgtgcaccgaaaacctcactccctggaaaaaactgctgccttgctcctcaaaggctggccttagcgtgttgcttaaggctgataggctgtttcatacttcgtaccacagccaagcagtgcacattaggccggtatgcaggaacgctcgctgcacatccatctcctgggagttgcggcaaacccttagtgtcgtgtttgacgcttttatcacaggtcaggggaaaaaagactggagcctctttagaatgttctcaagaacactcacagagccttgccctcttgccagcgagagtagggtatatgtggatatcaccacttataatcaggataacgagacattagaggtgcatccgccccctacaactacttaccaggatgttattctgggtacgcgcaaaacatatgccatttacgacctcctcgacacagcaatgattaataacagccggaatctgaatatccagctgaagtggaagcgtccacccgaaaatggctacatacactatcagcccgcccaggatagattgcaacctcatctcctcgagatgctgatacagctcccagccaattccgtcactaaggtttctattcagttcgagcgtgccttgctcaaatggacggagtatacccccgaccccaatcacggcttctatgtgtcaccgtccgtgttatcggccctggtgccatctatggtcgccgctaagcccgtggactgggaggaatcccccctctttaactcactttttcccgtgagtgacgggtccaattactttgttagactgtacactgagcctctactggtgaatctaccgacgcctgattttagcatgccttacaacgtgatatgcctgacttgcacagtagtggcagtctgttatggttctttttacaatcttttgacccgaactttccacatcgaagagcccagaacaggtgggctagctaaacgccttgctaacctgatccggagggcccggggagtgcccccgctgtag

SEQ ID NO: 28825 - DNA, 1272 bp, Artificial Sequence
  Description of Artificial Sequence: Synthetic coding sequence
atgtggataaacctgggacgttccagtgtgatgagcagccagggctccagcgcccccttgagtacaagctccactccccccactcaaagcctcccattacctccatccaacccatgggtctggcccatggccggtcttagcgtactccttaaggcagaccgactctttcacacctcctaccactctcaggctgtgcatatcagaccggtgtgccgaaacgcaaggtgcacatccatctcatgggaattgcggcagaccctgagcgtggtcttcgacgcattcataacaggccagggcaagaaagattggagtctcttccggatgttctccaggaccctgactgagccttgtcccctcgctagtgagagtagagtatacgtggacatcactacttataatcaggataatgagactcttgaggtccaccctccgcctactacaacatatcaggatgtcatactgggcacccgaaaaacatacgctatatacgacctgctagataccgccatgatcaataattcccgcaatctgaatattcagctgaagtggaaaagaccacccgaaaacgaggcccctcctgttcccttcctacacgctcagcggtacgtaagcggctacgggctccagaaaggggagctcagcactctgctgtacaatactcacccttatagggcatttcccgtgctgttgttggacaccgtgccttggtatctgcggctgtatgtccacaccctgactataaccagcaagggaaaggaaaacaaacccagctatatccactatcagcccgcccaggaccgactgcagccccatttacttgagatgctcatccaactacccgctaattctgtgacaaaggtaagcatccaattcgagcgggccctgctgaagtggactgagtacactcccgatcccaaccacggcttctacgtgagcccttccgtgttgtctgccctcgtgccctcaatggtcgccgctaagcctgtggattgggaggaatctccactgtttaactctctgtttcctgtctccgacgggagtaactatttcgtacggctgtacaccgaacctctgctggttaaccttccaaccccagatttctctatgccctacaacgtcatttgccttacttgcaccgtagttgccgtctgttatgggtccttctacaacctcctcaccaggacatttcacatagaggagcctagaacggggggcctggctaagcgcctggctaatctgattagacgagcgagaggcgtgccccctttgtag

SEQ ID NO: 28826 - DNA, 1569 bp, Artificial Sequence
  Description of Artificial Sequence: Synthetic coding sequence
atggccgccgccatgcctctagctctgttggtgctgctgctcctaggaccaggagggtggtgtttggcagaaccaccaagggattcacttcgggaagagctggtgatcaccccactacctagcggagatgttgccgccacatttcaatttcgcacacggtgggactctgagctccaaagagagggcgtgtcccactacagacttttcccaaaagcgctgggtcagctcatatctaaatacagcttacgggagcttcatctttcttttacccagggattttggagaactaggtactgggggcctccttttctacaggcacccagtgatacggatcattactttctgcgttacgctgttctgcctagggaagtggtgtgcaccgaaaacctgactccatggaaaaaactccttccatgttcatccaaggctggactttccgtgctcctgaaggccgatcggttattccatacatcttaccactctcaagcggtacatatcagaccagtgtgcagaaatgccaggtgcaccagcatctcatgggaactacgtcaaactctttcagttgttttcgacgcctttatcaccggtcagggtaaaaaagattggtccctgtttaggatgttttcccggacgctgactgaaccatgtccactcgcaagtgagtcccgggtgtacgtggatattactacctataaccaagacaacgagactctggaggtgcatcctcctcctacgacaacttatcaggacgtgattctgggcacgcgaaagacgtacgctatttatgatctgctggacactgcaatgattaacaatagccgaaatctgaacatccagttgaaatggaagagaccacctgaaaatgaggcccctcccgtgccgtttttacacgcacaaagatacgtctccggctacggactgcagaagggggaactgagcactctcttgtacaatactcatccttaccgggcttttcctgtcctgctcttggacacagtgccttggtacctcagactgtacgtccatactcttacaattacttccaaaggcaaggagaataagccctcctacatccactaccagccagcacaggatcgcctccaaccacacctgctggagatgcttattcagctgccggctaatagcgttaccaaagtaagtatccagttcgagagagctctcctgaagtggaccgaatatacccctgacccaaatcacgggttttacgtgtctccttctgtgttgtccgccctggtacccagcatggtagccgccaagcccgtggattgggaggagagcccgttgtttaacagtctttttcctgtgtcagacgggagcaactactttgtacgcttatacacagagccgctcctcgtgaatcttccaactcccgacttttctatgccttacaacgtgatttgtctgacatgcacggtcgtagcagtgtgttatgggagcttctacaacctgcttacaaggaccttccacatagaagaaccccgcaccggaggactggcaaagcggttggcaaaccttatccgtagagccaggggtgtgcctccattatag

SEQ ID NO: 28827 - DNA, 951 bp, Artificial Sequence
  Description of Artificial Sequence: Synthetic coding sequence
atgttctcccggacgctgaccgaaccctgccctctggcttccgagtctcgagtgtacgtagatattactacctacaatcaagacaacgaaaccctcgaggtgcaccctccgcctacaaccacttaccaggacgtgatcttgggcacgcggaagacctatgcaatctatgatcttcttgatacagctatgatcaacaacagcaggaatttaaacatccagctgaaatggaagcgcccccccgaaaacgaggccccacctgtaccatttcttcatgcccagcgctacgtaagcggatatggcttgcaaaaaggcgagctcagtaccctgctgtataacacccatccatatcgggccttccccgtgctcctgctcgacacagtgccgtggtatctcagactgtatgtacacacattgaccataacttctaaagggaaggaaaacaaaccctcgtatatccattaccaaccagcacaagacaggctgcaaccccacctgctggagatgttgattcagctgcccgccaacagtgtaaccaaggtaagcatccagttcgagcgtgcattattaaagtggacagaatacacccctgacccaaatcacggcttctatgtctcaccttctgtgcttagcgctctggtgcccagtatggttgccgccaaacccgtcgattgggaggagagtccactctttaacagcttgttcccagtctccgatggctccaattactttgtgagactatacacagagccgttgcttgtgaacctgccgaccccagactttagcatgccctataacgttatttgtctgacctgcactgtggtagcggtttgttacgggagcttctacaaccttcttacgagaacatttcacatagaggagcctagaacaggagggctcgccaaaaggcttgctaatttgatcaggcgggcccggggcgtgccacctttgtag

SEQ ID NO: 28828 - DNA, 345 bp, Artificial Sequence
  Description of Artificial Sequence: Synthetic coding sequence
atgctcagcggggccagatgccgcctggcatccgccctacgaggcacgcgagccccaccaagcgccgtggcgcgtcggtgtctacatgctagtgggagtcgccccttggcggacagaggaaagaaaaccgaggaaccccctagagactttgatcccgcactgctggaattcctggtctgccccttgtcaaagaagccactgcggtatgaggcttctacaaatgaattgatcaacgaggaattggggattgcttatcctattatcgacggtatacccaacatgatcccccaggcagcccggatgaccaggcagtctaagaagcaggaagaagtggagcaacggtag

SEQ ID NO: 28829 - DNA, 216 bp, Artificial Sequence
  Description of Artificial Sequence: Synthetic coding sequence
atgtttctgtcactgcccactctgacagtgctgatccccctcgtgagcctggccggcctgttctacagcgcgtctgttgaagaaaactttccccaggggtgcacgtcgacagccagtctttgtttttattcactgctgctgcctattactattcccgtgtatgtgttcttccatttatggacttggatggggatcaagctcttccgccataattag

SEQ ID NO: 28830 - DNA, 4032 bp, Artificial Sequence
  Description of Artificial Sequence: Synthetic coding sequence
atgatcatcaaagaataccgcatcccattgcctatgacggttgaggagtataggatcgcccagctttatatgatccagaagaagagccgtaacgagacttacggcgagggcagcggcgtggagatcttggaaaaccggccctatacggacgggcccggaggaagtggccaatatacccataaggtatatcacgttggaatgcacattccctcttggtttcggtccatcctgccaaaggccgcgctacgcgtcgttgaggaaagttggaacgcgtatccgtacaccaggaccagattcacctgtccatttgtcgaaaaattctccatcgacattgagacattctataaaaccgatgctggagaaaacccggacgtctttaatcttagccctgtcgagaagaatcagctaaccatcgatttcattgacatcgtgaaggatcccgtacctcacaatgagtataagaccgaggaagaccccaagctgtttcagagcacaaagacccaacgcggccctctttccgagaactggattgaagagtacaaaaagcaggtttttcctattatgtgtgcgtacaagctatgtaaagttgagttccgctactggggcatgcaatctaagattgaaagatttattcatgacacaggacttagacgggtgatggttagagcccatagacaggcttggtgctggcaggacgagtggtacggcctttctatggagaatatccgcgaactggaaaaagaggctcagttgatgctttctcgcaagatggcccagtttaatgaagatggtgaagaggccacagagctggtcaagcatgaggcagtatctgatcagacatccggggagcctccagagccatcttcctccaacggagagcccctggttggcaggggcctgaaaaagcaatggagtacatctagtaagtcgagccgttcgtccaaacggggcgctagcccttctaggcattccatctccgaatggcgcatgcagagtatcgcacgggattctgatgagagctccgacgacgaattcttcgacgctcacgaggacctgtccgatacggaagagatgttccccaaagacatcacaaagtggagcagtaacgatctgatggacaagatcgagtcacccgaaccagaggatacacaggatggcctttaccgccagggggcgccagaattccgagttgctagtagcgtcgaacaactcaacatcatagaagatgaggtgagccagcctctggccgccccgccatccaagatacatgtgctgttgctggtcctgcacggcgggacgatactggataccggagccggcgatccctcttcaaagaaaggcgatgctaacaccatagccaacgtattcgatacggtaatgcgagtccattacccatctgctctgggccgcctggctatcaggctggtgccatgcccgcctgtttgctctgacgcgttcgccctcgtgagcaatctgagcccgtatagccatgacgagggttgcctgtcttcctcccaggatcatatacctctggcggcactaccgttgctggccaccagttccccccaataccaagaggccgtggccacagttatccagcgggcaaacctagcctacggcgattttatcaagagtcaagagggcatgaccttcaacggccaggtgtgtctgattggcgattgcgtcggaggcatcctggctttcgatgccctgtgctacagcaatcaaccggtcagcgagtcacagagttcatctcgaagagggagtgttgttagcatgcaagataacgatcttttgtcaccgggcattctcatgaacgcagcacactgttgcggcgggggcggtggagggggcggtgggggcggatcctcaggtggtgggggatcaagcggcggttcatccttggaatcctcgcgccacctgtccagatcaaacgttgatatcccgcgttctaatggtactgaggaccctaaacgtcagctgcctcgtaagaggtctgatagcagcacttacgaactggataccatccaacaacaccaggccttcctgagttctctacacgcatccgtgttaaggaccgagccatgcagcaggcatagcagcagttctacaatgttggacggaaccggtgccctggggaggtttgactttgagattactgacttattcctctttggttgtcccctgggtctggtcctggcactgagaaaaacagtgatcccggccctggatgtctttcagcttcggcccgcctgccagcaggtttacaacttgttccatcctgcagacccgagcgcgtcccgcctggagcccctgctggaaaggcgctttcacgccttaccacctttttctgtgccacgctatcaaagatatcctctgggggacggatgttctaccttgttagtggagacagtccagcgtaacccggagctggttctggaagggggccccttagcgcccttgccccatggcgacggctttctggaaaccagcatgcccgtccctgcacctacatggcaggacggtcctcgccccggttgtgctgagtccgacgttctgcagacccataatgcagccttccaggaacatggggctcccagcagccccggaaccgcgcctgcttcacggggttttcgtcgtgcttccgaaatctctatagcaagccaagttagcgggatggccgagtcatatactgccagtagcatagcccagattgctgcaaagtggtgggggcagaagaggatcgactatgccctctactgtccagatgcgctcactgctttcccgacggtggcattgccccatctattccacgccagttattgggagtcaacggacgtagtatcctttctgcttcgccaagtgatgcgacacgataactcgagcatccttgagcttgatgggaaagaagtatctgtgttcactcctagcaaacctagggagaagtggcagagaaaacgtactcatgtgaagcttagaaatgttaccgccaatcatcggattaatgatgcacttgcaaatgaggatggcccacaggtgttaaccgggcgtttcatgtacggccccttggatatggtaaccttaaccggggagaaggtggatgtgcacatcatgacacaaccgccgtctggagagtggctctacctggacaccctcgttactaataactccgggagagtgagctacacgatcccagagagtcataggttgggtgtgggcgtgtaccccatcaagatggtggtgcggggcgaccatactttcgccgactcatatatcacagtgttgccaaaagggaccgaatttgttgtgttttctattgatgggagctttgccgcaagcgtcagcatcatgggatcggatccaaaggttcgcgcgggggccgtcgacgtcgtgcggcactggcaggatctcggctacctcattatatacgtcacagggcggcccgatatgcaaaaacagagagtggtcgcttggctagcacaacataactttccgcacggtgttgtttccttctgtgatggcctagtacatgaccccctgagacataaagccaactttctgaagctgctaatcagcgagttgcaccttagagtgcacgccgcctacggatctactaaagacgtggccgtttactcagccatctctctcagcccaatgcagatttatatcgtcgggaggcccactaaaaagttgcagcagcagtgccagttcataacagatgggtatgcggctcacctggcccaactgaagtactcgcaccgggccaggccagccaggaatactgccactcgtatggctctgaggaaggggtcattcggccttccagggcagggggactttcttagaagccgcaatcatctcttgcgtaccatctccgctcaaccgtcaggcccttcgcacagacacgaacggacccagtcccaagccgacggtgaacaaagaggccagcgaagtatgagcgttgcggcaggttgttggggtagagccatgactgggcgcttagaacccggcgctgcagccggaccgaagtag

SEQ ID NO: 28831 - DNA, 4050 bp, Artificial Sequence
  Description of Artificial Sequence: Synthetic coding sequence
atgatcataaaggagtataggatccccttacccatgaccgtcgaagagtaccgcatcgctcaactgtatatgatccagaagaaatcgaggaatgagacgtatggagaaggttctggcgtggagatcctggaaaatcgtccctatacagatggccctggcggcagcggtcagtatacccataaggtgtatcacgtgggtatgcacatcccctcttggtttaggagtattttgcccaaggcggcactgcgcgttgtggaagagagctggaacgcttacccgtataccaggacgcggtttacatgcccttttgtcgagaaattttctatcgatatagaaaccttctataagacagacgcaggagaaaatccagacgtttttaatctcagtccggtggagaaaaaccaattaacaatagactttatagacatcgtgaaggacccggtgccacataatgagtataaaactgaagaggatccgaagttgtttcagagcactaagactcagaggggtcctctgtctgagaactggatagaagaatacaaaaagcaagtttttcccattatgtgtgcatataaactttgtaaggtggaatttcgatattggggtatgcagagtaaaatcgagagattcattcacgacaccggacttcgccgtgttatggtgcgcgctcatagacaagcttggtgctggcaggatgaatggtatgggctgtctatggagaacattcgcgagttagaaaaggaagctcaactcatgctgagccggaaaatggctcagttcaatgaagatggcgaggaggcaaccgaacttgtaaaacacgaagcagtgtccgaccagaccagtggagagccccccgaaccctcctccagcaatggggaacctttggtggggagggggcttaagaagcaatggtcgacttcaagtaagtcttctcgctccagcaagaggggggcctcaccgagtcgacatagcatatctgaatggaggatgcagtctatcgccagagactctgacgagagcagcgatgatgaattcttcgatgctcacgaggatctgagtgacacagaagagatgtttccgaaggatattacaaagtggtcaagcaacgatcttatggacaagatcgagtcaccagaacccgaggacactcaggatggtctgtatcggcagggtgcccctgagtttagggtggccagttccgtggaacagttgaatattatagaagatgaagtctcacagccactggccgctccaccatcaaaaatccacgttctcttgctcgtgctccacggagggaccatcctggacactggggctggggacccttcctccaagaaaggggacgccaatacaatcgcgaacgtgtttgacaccgtgatgcgcgtccactacccatccgccttaggcagactcgctattcgtctggtgccgtgcccccccgtgtgttccgatgcctttgcgctggtgtcaaatcttagcccatatagccatgatgagggctgtctgtctagcagccaagaccacattccactcgctgcactccctctacttgcaacttcttcccctcaataccaagaagctgtagccactgtcatccagcgcgcaaacctggcctatggagattttatcaagagccaagaggggatgacctttaatggtcaggtatgcttaattggagactgcgttggagggatattggcgttcgacgctctgtgctattccaatcagcccgtctccgaatcacagagcagcagtcgacgtggatctgtggtcagcatgcaagataacgacctgctaagccccggaatcctgatgaatgcagcccattgctgcggaggaggcggtggtggcgggggcgggggcggatctagcggaggcgggggatcttcaggcggcagttctctggagtcttcaaggcaccttagccggagcaacgtcgacatcccccgcagcaacggcacggaagacccgaagagacagctcccacgcaaaagatcagattcctctacttatgaactagataccatccagcagcaccaagcgtttctatcttctctccatgcatctgtcctgcgtaccgaaccctgcagccgacactcttcaagctccacaatgctggacggaactggggccctgggcagatttgattttgaaatcaccgacttgttcctctttgggtgtcctctggggctggttctggcactgagaaagactgttatccctgccctggacgtattccagttgcggccagcttgtcagcaagtctataatctctttcacccagccgatccgagcgcaagccgcctagagcccttgctcgagcgccgattccatgcactcccccccttcagtgtgcctcggtatcagaggtatccgcttggagatggttgtagtaccttactagccgacgtccttcagacccataatgctgctttccaggagcatggtgctccatccagcccaggcactgccccggccagcaggggttttaggcgggcttctgagatttccattgcgtcccaggtaagcggaatggcagagagttataccgcttcctcgatcgcccaaaaggcccccgatgcattgtcacacacacccagcgtacgtagattatctcttctcgccctgcccgctcctagtccaacaacgcctggcccacaccctcctgcccggaaggctagcccggggctcgagcgtgcacccgggctgccagaactggacatcggagaggtcgcagctaaatggtggggtcagaaacggatcgattatgctctctactgccctgacgccctaactgcatttcctaccgtagcgttaccccacctgttccacgcgtcatactgggaatcgacagatgtcgtgagctttctactgaggcaagtgatgaggcacgataattccagcatcttggagctggatggcaaagaagtgtcggtgtttactccttccaaaccccgagaaaaatggcagcggaaacggacgcatgtcaaacttcgcaacgtcacagccaaccatagaattaacgatgccctcgccaatgaggacggcccacaggttctcactggacggtttatgtatgggcccttagatatggtgacgctgaccggggagaaagtggacgtccatatcatgacccagcccccttccggagagtggctatatttagacacactggttacaaacaattctggacgggtgtcttatactattccggaaagccataggctgggcgtgggagtctaccccatcaaaatggttgtgcggggcgatcatacattcgctgattcctacatcactgtgctgccgaagggcacagagttcgtagtgttctccattgatgggtcttttgcagctagcgtgagtattatgggctcagatccaaaggtccgggctggagccgtggacgtggtgcgtcattggcaggacctgggttatctcattatctatgttactggtaggccagatatgcagaaacagagagtcgtggcgtggctcgcccagcacaacttcccacacggcgtagtttccttttgtgacggcttggtacacgatcccctgcgccacaaagcgaattttctgaagctgcttatttctgagctacacctccgagtgcacgccgcctacggctctaccaaggatgtcgcagtatactctgcaataagcctgagtcctatgcaaatttatatcgtgggtaggccaaccaagaagttgcagcagcaatgtcagttcatcacagatgggtacgccgctcaccttgcacagctcaaatatagtcacagagcacggcctgcccggaacacagcgacaaggatggcattgcgaaaggggagctttggtctcccgggacagggcgattttcttaggagtcggaaccatctgctccgcacaatcagtgctcagcccagcggcccgtctcataggcatgaacgaacacagtcacaggcagatggcgaacaacggggtcagaggagtatgagcgtggcagctggctgctgggggcgggccatgaccggccgacttgaaccaggggcggccgccggccccaaatag

SEQ ID NO: 28832 - DNA, 3213 bp, Artificial Sequence
  Description of Artificial Sequence: Synthetic coding sequence
atgataatcaaagagtacagaatccccctcccaatgacagtcgaggaatatcgtattgcacagctctatatgatccagaagaagtctaggaacgagacttatggagaaggtagcggcgtggagatactcgaaaaccgtcctttttggcggatgcagagtatagcacgagatagcgatgaatcatccgatgatgagtttttcgacgcacacgaggacttatctgataccgaagaaatgtttccaaaagatattaccaaatggagcagcaatgatctgatggataagatcgagtccccagagccagaggatacccaggatggtttgtatagacagggagccccagagtttcgcgtggccagttctgtggagcaactgaacattatcgaagatgaggtttctcagcccctggctgctccacccagcaagattcacgtgttactgctggtgcttcacggcggtactattttagacactggagcaggtgatccttcttccaaaaagggggacgctaatacaatagcgaatgtcttcgataccgtgatgagagttcactacccaagcgcgctgggcagactggccatcagactggtaccttgtcctccagtgtgtagtgatgcattcgccctcgtcagcaatttaagcccatattctcacgacgagggatgcctcagtagcagtcaagatcacattcccctggccgctctcccattattggccacgtccagtccgcaataccaggaagcagttgccacggtgattcaacgcgccaacctcgcctacggtgacttcatcaagagccaggagggcatgactttcaatggccaggtctgcttgataggcgactgcgtagggggcatcctggcgtttgatgcgctttgctacagtaaccagcctgtgagtgagagtcagtcgtcctctcgccggggttccgttgtgagtatgcaggacaacgacttgcttagtcccggcatcctgatgaatgcagctcattgttgcggcggtggcggagggggaggtggcggaggggggagcagcggggggggtggaagcagtggtgggtcaagcttggagtcatcacgacatctttctcggtccaacgtggatataccgcggagcaatggtaccgaggacccaaagcggcaactgcctcggaagagaagcgactctagcacgtatgagctggataccattcagcaacatcaagcttttttaagcagcctgcatgccagtgtgcttaggacagagccatgctccaggcactcttcttcttcaaccatgctggatggtaccggggccctcggtcgctttgatttcgaaataaccgatctgtttctgttcgggtgtccattgggacttgttcttgcccttcgcaagacggtcatacctgcacttgacgtcttccagctgaggcctgcctgccaacaagtgtacaacttgtttcaccccgcagatcctagcgcaagtcgcctggagcctcttctggaaaggagatttcacgcactccctcccttctcagttccaaggtaccagcgctatcctctgggagacggctgcagcacactcctggccgatgtgctccaaacccacaatgcggcattccaagagcatggcgcccccagttccccgggaaccgcccctgcaagcaggggctttagacgcgcatccgaaatcagcattgcttcgcaagtatcaggaatggccgaatcatacaccgccagttcaatcgcgcagaaggccccagacgctctgagtcacacaccgagcgttagaagactctctctcctcgccctccccgctcctagcccaacgactccgggaccccaccctcccgccagaaaggcttcccctggactggaaagagcaccaggcctgcccgaactcgacatcggcgaagtggccgccaaatggtggggccagaaacgaatcgattacgcactgtattgtccagacgcgctcacagcgttccccacggtcgcactcccccacctgttccacgctagctattgggagtccaccgatgtggtgtcatttctgttgcgacaggtgatgcgtcacgacaattcctcaatcctggagctcgatggaaaggaagtgtccgtgttcactccttctaaacccagagagaagtggcagagaaagcgaacccacgtgaaactcaggaatgtgaccgctaatcacaggatcaatgatgcgttagcgaatgaggacggaccacaagtgctaacaggacggtttatgtatggacctctggacatggtaaccctaacaggagaaaaagtggatgtacacatcatgacccaaccacctagcggtgaatggctctatctggatacgctggttaccaacaactcagggcgcgtgtcttataccatccctgaaagtcatcgcctgggcgtaggtgtgtaccccattaaaatggtggtgagaggtgatcatacttttgcagattcctacatcaccgtgctgcccaagggcaccgagtttgttgtgttttctatcgacggaagcttcgcagcttcagtgtctatcatggggtccgaccctaaggtcagggcaggagccgtggatgttgtgcgacactggcaagacctcggatatcttatcatctacgtgaccggccgtcccgacatgcagaagcagcgggtggttgcctggctcgcacagcacaattttccacatggggtggtcagtttctgcgacgggcttgtacacgaccccctgcggcataaagccaacttcctgaagttgctcatatccgaattgcacctccgggtgcacgcagcctacggctcaacaaaggatgtcgcagtttattctgcaatatcccttagcccaatgcagatctatatagtcggccgcccaactaagaagttgcagcaacaatgtcaatttataactgacggctatgcagcccatttggcccagctcaagtattcccatcgtgccaggccagctagaaataccgcaacaagaatggcactccgaaaaggttcctttggattaccagggcagggagatttccttagatctaggaatcacctcctgcgcacaatctctgcacagccctcaggaccatctcatcggcacgagcgcacccagtcacaggccgatggcgagcagcggggccagcgttctatgagtgtggccgcgggttgttggggccgggctatgaccggacggctggaaccaggtgcagccgcaggaccaaagtag

SEQ ID NO: 28833 - DNA, 48 bp, Artificial Sequence
  Description of Artificial Sequence: Synthetic coding sequence
atgattattaaggagtataggatccctcttcccatgacagtcgagtag

SEQ ID NO: 28834 - DNA, 126 bp, Artificial Sequence
  Description of Artificial Sequence: Synthetic coding sequence
atgattatcaaagagtaccgcatcccactcccaatgaccgtggaggagtaccgtattgcgcagctatatatgatccagaaaaagtcccggaatgagacttacggagaggggtccggagtggaatag

SEQ ID NO: 28835 - DNA, 4050 bp, Artificial Sequence
  Description of Artificial Sequence: Synthetic coding sequence
atgattattaaagaatatcgcattcccctgcccatgaccgtggaggaataccgcatcgctcaactctatatgatccagaagaagtcccggaacgagacatacggcgaaggcagcggagtcgaaatactagaaaacagaccatataccgacggtcccgggggatccgggcaatacacgcacaaggtgtatcacgtgggaatgcacataccaagttggttcaggtcgattctgcctaaagccgcgctgagggtggtagaggagtcatggaacgcctatccctatactaggacaaggtttacatgcccctttgttgagaaattcagcatagatatcgagactttttacaaaacagacgcgggcgaaaatcccgatgtcttcaatttatcgcccgtagaaaaaaaccaattaaccatcgattttatcgatatcgtcaaagacccggtgccacataatgaatacaaaacggaagaggacccgaagctattccagagtacgaaaacacaaaggggtcccctaagcgaaaactggatcgaggaatacaagaaacaggtgttccccattatgtgcgcctacaagttgtgcaaggtggaatttcggtattggggtatgcagtctaaaatcgaaagattcatccacgatacaggcctaaggagggtgatggtgagagcacatcggcaggcctggtgttggcaggacgagtggtacgggctgagcatggaaaatatccgggaactggagaaggaggcccaattgatgctgtccaggaagatggcccaattcaatgaagacggcgaggaagccacagaacttgttaagcacgaagccgttagtgatcaaacctctggagagccacccgaaccctcctctagcaatggtgagcccttggtgggccgagggctaaagaaacagtggagtacctctagtaagtcttccaggtcttccaagaggggtgcttcaccgtcgaggcatagtatctctgagtggaggatgcagtccatcgctcgtgatagtgatgaatcaagtgacgacgagtttttcgatgcacatgaagacttgagtgacactgaggagatgttccctaaggatatcaccaagtggtcctctaatgacctcatggacaaaatcgaatcacctgaacctgaagacacacaggacggactatatcggcagggcgccccagagtttcgggtggctagctccgtggaacagctcaatatcatagaggatgaagtttcccagcccctggctgccccgccaagcaaaattcacgtcctgttactggttctacacgggggcaccattttggacactggggcaggagatcctagtagtaaaaagggggatgctaacacaattgccaatgtttttgatactgtgatgcgcgtgcactacccgagcgccctcggcaggctcgccatcaggctcgtgccctgcccacccgtgtgtagtgacgcattcgccctggtgtcgaatttgagcccctattctcacgacgagggctgtctgagtagcagccaggatcacatacccctggccgcactgcctttgctagcaacttctagcccccaataccaggaagccgtcgccaccgtgatccaacgggccaacctcgcttatggcgatttcattaaatctcaagaaggaatgacatttaacggtcaggtctgtcttatcggcgactgcgtcggggggatcctcgcctttgatgctctgtgttactctaatcaaccagtgtctgaaagccagtccagctcaaggagaggttccgtggttagcatgcaggacaatgacttactgagccccggaattttgatgaatgctgcccattgctgtggtggcggtggcggcgggggcggagggggtgggtcttccggaggcggcggctcctcaggggggagtagtcttgaatcctcacgtcatttaagtcgttctaatgtcgacattccgcgcagtaacgggaccgaggaccccaagcgacaattaccacgcaagcggtctgacagctccacctacgaactcgatacaatccaacagcaccaggccttcctgtcatcccttcatgccagcgtgctgcgaacagaaccctgctcaagacacagtagtagttccactatgcttgacggaaccggtgccctcggtagattcgatttcgaaatcactgatctgtttctgttcgggtgcccgcttggcctggtgttggcgctgcgcaagactgtcattccggcccttgacgtctttcagctgagaccggcatgccaacaggtgtataatctgtttcatcccgccgatcccagcgcgagtagactggaacccctcctggagagaagatttcacgccctaccacctttcagcgtgcccagataccagagatatccgctcggggatgggtgcagcactctcctcgctgatgttctccagacacacaatgccgccttccaagagcatggtgctcccagcagcccaggtacagctcccgcctcgcgcgggtttagacgtgcgtctgagataagtatcgcaagtcaagtgtccggaatggcagagagttacactgcctcttcaattgcccagaaagcccccgacgcactgagccatacaccgagtgtgcggcgcctgtcactgttagctttacctgcaccgagcccaacgacgcccggtcctcatccccccgctagaaaggcatcgcctggacttgagagagcccccgggctccccgagttagatattggagaggtagccgccaagtggtgggggcagaaacggatcgattacgccctctactgtccagacgctctgaccgccttcccgacagtggccctcccccacctctttcacgccagttactgggaaagcacagacgttgtgagcttccttctgaggcaggttatgcgccatgacaacagttccattttggagctggacggcaaggaggtgtctgtctttaccccaagcaagccccgggagaaatggcagaggaagaggactcatgttaaactccgaaacgtgacagccaaccaccgtataaacgatgccctagcgaacgaggacggcccacaggtcctgactggccggttcatgtacgggcccctggatatggtaacattaaccggagagaaggtcgacgtccacataatgactcagccaccatccggtgagtggctgtatctggacaccctggttactaataactcaggcagagtttcttatacaataccggaatcccatcgcttgggagtgggggtatatcctatcaagatggtggtccgaggagaccataccttcgccgactcgtacattactgtgctccccaagggcacagaattcgtggtattctcaatagacggctccttcgcggcttcagtttcaattatggggtctgatcccaaagttcgagccggtgctgtggacgttgttcggcactggcaggatctcgggtatctgattatttacgtaactggtaggcccgacatgcaaaagcagagagtcgtggcttggttggcccaacacaatttcccccacggcgtcgtgagcttttgcgacggcctggtgcatgatcccctgcggcacaaggctaactttcttaagctcttaatatccgagcttcacttgagagtgcacgccgcatacgggagcacaaaggacgtcgcagtgtattctgccatttcactgagcccgatgcagatctacattgtggggaggccaacgaagaaattacagcaacagtgtcagttcattactgacggatatgccgctcatttagcccagttgaagtactctcatcgcgccagacctgcaaggaacaccgcgacacggatggcgcttaggaagggctcattcgggctgcctggacaaggcgatttcctgagaagtagaaaccacctcctgagaacaatttcggcccagccctctggccctagccacagacacgaacgcacacaatcccaggcagatggcgagcagcgaggacagcgcagcatgtctgtggcggcgggatgctggggaagagcaatgactggccgcttagaaccaggcgccgccgccgggccaaagtag

SEQ ID NO: 28836 - DNA, 1251 bp, Artificial Sequence
  Description of Artificial Sequence: Synthetic coding sequence
atgagcagcaactgtacttcaaccacagcagttgcagttgctcctctttctgcctctaagactaagacgaagaagaagcatttcgtatgccagaaggtaaagctgttcagagcttctgaacctatcctgagtgtgttgatgtggggtgtgaaccacactattaatgaactgtccaatgttccagtccccgtaatgctaatgcccgatgactttaaagcctacagcaagataaaggtggacaaccatctgttcaacaaggagaacttaccgtcacgctttaaattcaaagaatactgtcctatggtgtttagaaaccttcgggaacggttcggaattgatgatcaggactaccaaaatagcgtcacacggtcagcacctatcaactctgacagccagggtcgctgcggcaccaggttccttaccacgtacgatcgccggtttgtgattaagactgtaagctctgaggacgtagccgagatgcacaacattctgaaaaaatatcaccagtttatcgtggagtgccacgggaacacactattaccccagttcctcggaatgtacagacttaccgtggatggggtcgagacttatatggtggttactagaaacgtgttctcccatcgactgaccgtgcacaggaaatatgatttgaagggttccaccgttgcacgggaggcctcagacaaagagaaggctaaggacctccccacatttaaggataatgactttttgaatgaaggccagaaacttcacgtgggagaagaatctaagaaaaattttctggaaaaactcaaaagagatgttgaatttttagcacagctgaagatcatggattactctttgttggtcggtatccatgacgtagacagggcagaacaggaagaaatggaggtggaggagcgggccgaggacgaggagtgtgaaaatgacggggtggggggaaaccttttgtgtagctacgggacccccccggacagccctgggaacctgttgagctttcccaggttctttggacctggggagtttgacccctcggtggatgtgtacgcaatgaagtcacatgagtcctccccaaagaaagaggtgtatttcatggccatcatagacattcttaccccctatgacaccaagaagaaggccgcacatgccgcaaaaacggttaaacacggggctggggccgagatctcaacagtgaacccagagcagtatagcaagcgctttaacgaattcatgagtaacatccttacctag

SEQ ID NO: 28837 - DNA, 834 bp, Artificial Sequence
  Description of Artificial Sequence: Synthetic coding sequence
atgtcatcgaattgcacaagtaccacagcagtggccgtcgctcctttgtctgcctcaaaaaccaaaaccaaaaagaagcactttgtctgtcagaaagtgaagctcttccgcgcatcagagcccattttgagtgtgctcatgtggggggtgaatcataccattaatgagctgtcaaacgtccccgtacctgtgatgctgatgccggatgatttcaaagcctattctaagataaaggtggacaaccaccttttcaataaggagaacctaccttctaggttcaaatttaaggagtattgcccaatggtcttccgaaatctcagggagaggttcggcatcgatgaccaagattatcaaaactctgttacaaggagtgcacctatcaactcagacagtcagggccgctgtggtactcgttttcttacgacatatgatcggcgattcgtaatcaagactgtcagctcagaggacgtcgcagaaatgcacaacattctgaagaaatatcaccaattcatcgtggaatgtcacggcaacaccctcctgccacaatttcttgggatgtaccgcctaacagttgatggtgtagagacctatatggtcgttactagaaacgtctttagccaccgcctcaccgtccaccgcaaatatgacctcaaaggaagcacagtggcccgcgaggccagcgataaagagaaagccaaggatctgcctaccttcaaggataatgactttttgaatgaaggccagaagctgcacgtcggcgaagagtctaaaaagaactttctcgaaaagttgaagagagacgtcgaggaaatcctggttttgtcgcctgggtag

SEQ ID NO: 28838 - DNA, 1830 bp, Artificial Sequence
  Description of Artificial Sequence: Synthetic coding sequence
atgtggagacttcctggtgcgagggccgccctcagagtgattcggaccgccgttgaaaaactaagtagagcagaagccggctcgcaaaccgctgctggagctatggagcgggcagttgtgcgctgtgtgccatcggaacctaaactctctctctcttttgcgttagctgatgggtctcataagaatatgcaacgcgatcagagcgagcctttgggacgagtgctatcaaggattgccacaaacgctctgaagggtcacgcaaaagctgctgccgctaagaagtcccgtaaaagccgccccaacgcctcaggaggagccgcctgttccggacctggccccgagccagctgttttttgcgaaccagtcgtcaagctgtattatcgagaagaggccgtggctgaagatgtactgaatgtagacgcctggcaggacggggcggtgctgcagattggggatgtaaaatacaaagtcgagcgcaatccaccagcttttacagagctgcaactaccacgctacatcatggcgggatttcctgtctgccccaagctttccctggagttcggagatccagcgtcctccctattcagatggtataaagaagctaaacccggcgcagcagagccggaggtaggtgtgccctcttccctgtctccttctagcccaagcagctcatggaccgaaactgatgtagaggagcgggtgtacacaccaagtaacgcagatatagggcttagactaaaacttcactgcacccctggggacggccagagattcggtcattccagggagctcgaaagtgtgtgtgtggttgaggcagggcccggcacatgcacctttgatcacaggcacctgtacaccaaaaaggtcaccgaagatgctcttattcgaacggtgtcttataatatcctcgctgatacatacgcacagacagagttttcccgtactgtgctgtacccatattgcgccccctatgcattagaactggactatcgccaaaacctgattcagaaggaactgactggctataatgctgacgtcatctgcttgcaggaggtggatcgggctgtgtttagcgatagcctggtgccggctctggaagccttcggcctggagggagtgttcagaattaaacaacacgaaggcctcgcgacattctacagaaagtctaagttcagtctgttgtctcaacacgacataagcttctacgaggccctcgagagcgatcctcttcacaaggagctgctcgagaagttggtcctttacccctctgcccaggagaaggtcctccaacgttccagcgttcttcaggttagcgtcctccagtccacaaaagattcaagtaagcggatatgtgtggcgaatacgcatctgtactggcaccccaaaggtggatacattagattaatccagatggctgtcgctctggcgcacatcagacatgtgagttgcgatctatacccgggcatccccgtcatcttctgcggggattttaacagcacaccatcaacaggcatgtaccactttgtgattaatggcagcattcctgaggaccatgaggactgggctagcaacggtgaagaggaacggtgcaatatgtccctcacacacttttttaagctgaagtcagcctgtggcgaacctgcttacactaattatgttggcggatttcatggttgcctcgattatatcttcatagacctcaacgcgctagaggtcgagcaagtgattccattgccatcccacgaggaggttacaacccatcaggccctgcccagtgtgtctcatcctagtgatcatatcgccttggtgtgcgatttgaaatggaagtag

SEQ ID NO: 28839 - DNA, 1419 bp, Artificial Sequence
  Description of Artificial Sequence: Synthetic coding sequence
atgtggcgactccctggcgccagagccgccttgagggttatacgcactgctgtcgaaaagctatctcgcgccgaggcagggtcccagactgccgccggggccatggagagagctgtagtgcgctgtgtcccctcggaaccgaagctgtccttatcctttgcgctggccgatgggagccataagaatatgcagcgagatcagtcagagcccctgggccgcgtattgtcccggattgctaccaatgcactgaagggccacgcaaaggctgccgccgccaaaaagtcgcgtaaaagtcgcccgaatgcctcagggggagcggcctgctccggtcccggtcctgagcccgccgtgttctgtgaacccgtggtgaaattgtattaccgggaagaagcggtggcagaggacgtcctcaacgtcgatgcttggcaggatggcgctgtattacagattggcgacgtgaagtataaagttgagcggaaccctcctgcattcactgagctccagttgcctcgctatattatggctggcttccctgtctgccccaagcttagtctagagtttggtgatcccgccagttccctgttccgatggtacaaggaagcaaagcctggagctgcagagcccgaagtcggagtgcctagttccctgtctccttccagtccatctagctcttggactgagactgacgtagaagagcgagtgtatactcccagtaacgctgacataggtctacgcctgaaattgcactgtactccaggggacggccaacgcttcggccattccagggagctagaaagtgtgtgcgtcgtggaggcagggcccggcacttgtacttttgaccacaggcacctgtacactaagaaagttaccgaggacgccctgataagaaccgtgtcttataacatcctggcagatacttatgcacagacagaattctcccgcaccgtcctctatccttattgcgccccttacgccctggagttggattaccgtcagaatttaattcagaaagagctgactgggtacaatgctgatgtgatttgtttgcaggaggtggatcgggccgttttctctgattccctggttcctgccctggaggcctttggattagaaggagtcttccgcatcaagcagcacgaaggtctggcaaccttctatcgcaaatcaaagttcagcctgctgtcacagcacgatatttcgttctatgaagccttggagagtgaccctcttcacaaagagctgctggagaagctggtgctgtatcccagcgcccaggaaaaggtgcttcagagaagctccgtcttgcaggtttctgtgctgcagtccaccaaggacagctcgaaaagaatttgcgtggcgaatacccacctttattggcatccgaaagggaggttctatctggtcagtcaggtaacgtag

SEQ ID NO: 28840 - DNA, 2826 bp, Artificial Sequence
  Description of Artificial Sequence: Synthetic coding sequence
atggggcaagcttgcggacactctattctctgtaggtcccagcagtacccggccgctaggccagcggagccacgggggcagcaggtgttcctgaaacctgacgagcctccccccccccctcagccatgcgcagacagtctccaggacgccctgctcagtttgggatctgtgatcgatatctctgggctgcaaagagccgttaaagaagcccttagcgctgttttgcctagagtcgaaacagtgtacacataccttctggacggcgaatcacaactggtatgtgaggatccccctcacgaactcccgcaagagggcaaggtgcgggaagctattattagtcagaagagacttggttgtaatggcctgggattctccgatttgccaggcaagccattggcgcggctcgtggcacctctggctcctgatactcaggtgctcgtaatgccattggcagataaagaggctggagccgtggctgcagtgattctggtacactgcggccagctgtccgacaatgaagagtggtccctacaggccgtggagaaacacactttggtcgccttgaggagagtacaggtgttacaacagcgcggtcccagagaggcccccagagcggtgcagaatccacccgaaggtacagccgaggaccagaagggaggcgctgcctatactgaccgtgaccgcaaaattctccagttgtgcggcgaactgtacgacctggacgcttcctcacttcagctgaaggtgctgcagtatctgcaacaggagacccgagccagccgttgctgcctgctcctggtttctgaggataatttgcagctttcttgcaaggtcataggcgacaaggtgctcggcgaggaagtcagcttccctctgaccggatgcctggggcaggtcgtcgaggataaaaagtcaatacagctgaaagaccttaccagtgaggacgtgcaacagctgcagtccatgctcgggtgcgaactccaggccatgctgtgtgtgccagtaatctcacgcgcgactgatcaggtggtggctttggcctgcgcgtttaacaagcttgaaggggacctgttcaccgatgaggatgagcatgtcatccaacactgtttccattatacatcaacggtcctgactagcaccctggccttccagaaggaacagaaattgaagtgcgagtgtcaagcgttgctgcaggttgcgaagaatctcttcacacatctggacgacgtcagcgtgctactgcaggaaatcatcactgaggcgcgaaatctgtccaatgcagagatttgcagcgtctttctcctggatcagaacgaactcgttgcaaaggtgttcgatggtggggtcgttgatgatgaatcttatgaaatacgcatcccggctgatcagggaattgccggccatgtggccaccactggccagatcctcaatatccccgacgcatatgctcacccactgttctatagaggcgtggatgactccaccggattccggacccgtaacatactctgctttcctattaaaaatgagaatcaggaggtgatcggcgttgcagaacttgtgaataaaataaatgggccttggttcagtaagtttgacgaagacctggcgaccgcctttagcatctactgcggtatctccattgctcactcccttttgtacaaaaaagtcaacgaagcccagtaccgctcacacctagccaacgagatgatgatgtatcatatgaaggtcagtgatgatgagtacaccaaactgctacacgacggcattcagccggtcgctgcaatagactccaactttgcctcatttacatatactccccgcagcctgccagaagatgatacgagcatggccatcctgtctatgctgcaggacatgaacttcataaataattataaaatcgattgccctactctagctcgcttctgtttaatggtcaaaaagggatatcgggacccaccatatcataactggatgcacgccttctccgtgtcccacttttgttacctcctgtacaagaatctggaactaaccaattaccttgaggacatagagattttcgccctgttcatctcgtgcatgtgccacgacttggaccaccgtggcactaataacagtttccaggtcgccagcaagagcgtcttagccgctctgtacagcagcgagggcagcgtgatggagaggcatcactttgcccaggctatcgctatactcaacacacacgggtgtaacatcttcgatcactttagccgcaaggattaccaaaggatgcttgacctgatgcgggacattatcctcgccaccgacctggctcaccacctgagaatctttaaggacctccagaaaatggcggaagtggggtatgataggaacaataaacagcaccatcggctgcttctgtgcctgttgatgactagctgcgacttgtcagaccagaccaaaggctggaagactacccgtaaaatcgcagagctgatatataaggagtttttttcacagggggacctggagaaggctatgggaaacaggccgatggaaatgatggatcgagagaaggcatatatcccggaacttcagatcagcttcatggagcacattgccatgccgatatacaagctcttacaggaccttttcccaaaagcagccgaattgtacgaaagagtagccagtaaccgggaacattggaccaaagtatcccacaagttcacaatcaggggattaccctcaaataactccctagacttcctcgacgaggaatatgaggtgcctgaccttgacggaaccagggcgcccatcaacggctgctgttccctcgatgccgaatag

SEQ ID NO: 28841 - DNA, 2058 bp, Artificial Sequence
  Description of Artificial Sequence: Synthetic coding sequence
atggttctggtacttcaccatatactgatcgccgtggtgcagtttcttagaagaggccagcaggtttttttaaagcctgacgagcccccccctcccccccagccgtgcgccgattccctgcaggatgcccttttgtccctcggcagtgtgattgatatttccgggctgcagcgcgccgtaaaagaggcactgtcagctgtcttacctagagtcgaaaccgtctatacctacctgcttgacggggagagtcagcttgtctgtgaggatcccccacacgagctgcctcaggaagggaaggtgcgctttactgacgaggatgagcacgtgattcagcattgcttccactacactagcaccgtgctgacatcgaccctcgccttccagaaggagcaaaagctgaaatgcgaatgtcaggccctgcttcaagtggccaagaacctgttcactcacctcgatgacgtttccgtattgctgcaggagataattaccgaagcacgaaatctctccaacgctgagatctgttcagtgttcctgctggaccagaacgagttggttgcaaaggttttcgacggcggggtcgtggatgatgagtcatacgaaattaggatccctgcagatcagggaattgcaggtcacgtcgctaccacaggacagatcctcaatatccccgatgcttacgcccaccctcttttctacagaggggtcgatgattccactggctttcgcaccagaaacattttgtgttttcccattaagaacgagaaccaggaggtcattggtgtggctgagctcgtgaataagatcaatggcccctggttttctaagttcgacgaggatctggccactgcgttctcgatttactgcggcattagcatagctcatagcctgttgtataagaaagtgaatgaagcacagtacagatcacatctggccaatgagatgatgatgtaccacatgaaggtgtccgacgatgaatacacaaagctgctgcatgacggcatacagcccgtagctgctatcgattccaactttgctagcttcacatacactccacggtcacttccggaagatgatacgtccatggcgatcctctcaatgttgcaggacatgaacttcatcaacaactacaagatagattgtcctacgcttgcaaggttctgtctgatggtgaaaaaaggctatcgggaccccccataccataattggatgcatgccttcagcgtcagccatttctgctaccttctctacaagaacctggagcttactaattatttagaagacatagagatcttcgctctcttcatttcctgcatgtgtcacgatctggaccaccgggggacaaacaattcatttcaggttgcctcaaagagtgtactggcggcactgtatagttcggaaggctccgtcatggaacgccatcatttcgcacaggctatagctatcttgaacacccatggctgcaatatattcgaccatttctctcgcaaggactatcagaggatgctggatttaatgagagacatcattctggccactgacctggcccaccatcttcgaatcttcaaggatttgcagaagatggctgaagtgggctacgatcggaacaacaaacagcatcacaggctccttttgtgcctcctgatgacatcttgtgatcttagcgaccagacaaaaggctggaaaaccacacggaaaatcgccgagctgatatataaggagtttttcagccaaggcgacctggaaaaggcgatgggaaacagacccatggagatgatggatcgcgagaaggcatatatacccgagctccagatttctttcatggaacacatcgccatgcccatctacaagcttctgcaagatctgttccccaaagccgcggagctctatgagagggtggctagcaacagagaacattggaccaaggtgtcccacaagttcacaattcggggtctgccgtcaaacaactctctggattttctggatgaggagtacgaagtcccagacttggatgggactcgagcacctattaacggttgctgctcactcgatgcggagtag

SEQ ID NO: 28842 - DNA, 2853 bp, Artificial Sequence
  Description of Artificial Sequence: Synthetic coding sequence
atgagctatatcctgaagatgccaggcacatgcttacccggggaagggacaacctacgaactgccgccgtcctctctacatcccagttccgctccggtaaccagtggcggcacttgcccagctttactgacagaagcaggctgggaggcaccaattatggcctttacagaagccgccagcgcagtgggaccttcctggacacacagcagagctagcgttagcagtacggtcaaaacagaacgtcgacgtcgtgtccttcaggcctgcggcatggtacgtcggggacaacaggtttttctgaagccggatgaaccccccccacccccacagccctgtgccgattctttacaagatgctctgcttagcctaggatcagtcattgatatttctggtctgcagagggccgtgaaagaggcactgtccgcagtcctgccacgggtggaaacagtgtatacatatctccttgatggagagtcccagctggtgtgtgaggacccacctcacgagttacctcaggaagggaaggtgcgagaagccatcattagtcagaagaggctcggttgcaacggcctcggtttttcggacctgcctggtaagccactcgcccggttggtggccccactggcccccgatacccaggtgctggtcatgcctttagcagacaaggaggctggcgcagtggccgctgttattttggtgcattgtggacagttgtcagataatgaggaatggtcattgcaagcagtcgaaaaacataccctagttgccctgaggcgcgtccaggtcctgcagcaacgcggtcctagagaagccccccgcgctgtgcagaacccaccagaaggaacggcagaagaccagaagggaggggcagcatacaccgaccgcgatagaaaaattctgcaactttgcggcgaactgtacgacctggacgcctctagtctacagttaaaagtgctccagtacttgcagcaagagacgagagcaagcaggtgttgtctgctgctcgtctcggaagataacctgcaactctcttgtaaggtaattggcgataaagtgctgggggaagaggtcagcttccccctgactggctgtcttggccaggtagtggaggacaaaaagtcaatccagttaaaagacttgacctctgaggacgtgcagcagttacagtcgatgctgggttgcgagctacaggctatgctatgcgttcctgtcattagccgggctactgaccaggtggtcgcccttgcctgcgcattcaataaactggaaggagacctcttcactgatgaggacgagcacgtcattcaacactgctttcactacacgagtacagtcctgacctctacccttgcctttcaaaaggagcagaagctgaagtgcgaatgccaggccctgctccaagtcgcgaagaatctttttacccatttggacgatgtgtcagttctgctgcaggagattattactgaagcccggaatttgtctaatgccgaaatttgctcagtcttcttgctcgatcagaatgagctagtggccaaagtgtttgacggcggtgtcgtggatgatgaaagctacgaaattcggattcctgccgatcagggaattgcggggcacgtggcaacaacgggacagatcctgaatattcctgatgcttatgctcatcccctgttctatagaggtgtagatgactccacgggcttccggactcgaaacattctgtgcttccccatcaagaacgagaaccaggaggttatcggagtggctgagctggtgaataagataaatgggccttggttttctaagtttgatgaggatttggcaactgccttctcaatatactgtggtatatcaatcgcccatagcttgctgtataaaaaggtaaacgaagctcagtacaggtcacacctggcgaacgaaatgatgatgtaccatatgaaggtaagtgatgacgaatataccaaattactccacgacggcattcagccggtggctgctatcgattctaacttcgcgtctttcacgtatacaccaaggtcattaccggaggatgatactagcatggctattctgtccatgctgcaggacatgaatttcataaacaattataagattgactgccctactctggctcggttttgcctcatggttaagaagggataccgcgacccgccctatcacaattggatgcatgccttttctgtttcccatttctgttacctcttgtataagaacctggagcttacaaattatctcgaggatatcgaaatctttgccctttttataagttgcatgtgtcacgacctggatcataggggaacaaataactcctttcaggtggcctcaaagagcgtgctggccgcattgtacagcagcgaaggaagtgtgatggaacgacatcatttcgcccaggcaattgccatactcaatacgcatgggtgtaacattttcgatcacttctcgcgcaaagactatcagagaatgctcgacctgatgcgggacatcattctggcgacagatctggcccaccatttgagaattttcaaggatttgcaaaaaatggctgaagtgggatatgaccgcaacaacaagcagcaccatcgcctcttgctgtgcctgttaatgacatcctgtgaccttagcgatcaaactaaaggatggaagaccactcgcaaaattgccgagttgatttacaaggagttttttagccagggcgatctcgagaaggccatggggaaccggccaatggaaatgatggatcgggagaaggcatatatcccagaactgcagatctcctttatggagcacatcgccatgcccatttacaagcttcttcaggacctatttcctaaagcgtag

SEQ ID NO: 28843 - DNA, 2799 bp, Artificial Sequence
  Description of Artificial Sequence: Synthetic coding sequence
atgaaaaagcagagaattcaggagggcaaatcccttgctcatcgcaggggacagcaggtgttcctgaaacccgatgagccccctccacccccccaaccctgcgccgatagtctgcaggatgcactgctgtccttagggtccgttatcgatatttctggcctgcaacgggcagtgaaggaggcactctctgctgtgttgccccgagtcgagaccgtgtatacatacctgttagacggcgagagtcaactcgtgtgtgaggaccctccacatgaactaccacaggagggtaaggttcgggaagccataatatcccagaagagactgggatgtaacgggctgggcttctctgacttgccaggcaagccattggccaggctggtggcacctctggcccccgatactcaggtgctggtgatgccactggccgacaaagaagcaggggctgtggccgcggttattctagtgcactgcggccaattgtctgacaatgaggaatggagcttgcaggcggtggagaagcatacgttggtcgccttaaggagggtgcaggtgctacagcaacgcgggcccagagaagctcctagggccgtacagaaccccccggagggaacggctgaggatcaaaagggcggtgccgcatatactgaccgtgaccgaaaaattcttcagctttgtggggagctgtatgacctggacgcctcctctctacagcttaaagtgctgcagtacctccaacaagaaacaagggcatctaggtgttgtctgttactggtgtctgaggataatctacaactgagctgcaaggtgatcggcgacaaggtgttgggcgaggaggtctcatttcccctcacagggtgtttggggcaggtcgtggaggacaagaagtccatacagctgaaagatcttacgtccgaagatgtacagcaactgcagagtatgctggggtgcgaactccaagctatgttatgcgtccctgtgataagccgggctactgatcaggtggtggccctcgcctgtgcttttaacaagctagaaggcgatcttttcaccgacgaagacgagcacgtgatccagcattgtttccactacacttccacagtcttgacctccacgcttgcgtttcagaaagagcaaaagctgaagtgcgaatgtcaggctctgttacaggtggccaagaatctattcacccatctcgacgacgtgtcagtacttcttcaggagattatcacagaagctaggaacttgagcaacgcggaaatctgctccgtttttctgctggatcaaaatgagctggtagcgaaggtgtttgatggtggggttgtcgacgatgaatcttacgagatccggatcccagctgaccaaggaatcgccggtcatgtcgccacaaccggccagatactgaacatccccgatgcctatgcccatcccctcttctaccggggagtggacgattctacaggttttaggacaaggaatattctttgttttccaattaaaaatgagaaccaagaggtcattggagttgcagagctcgtaaacaaaatcaacggcccatggttcagcaagtttgacgaggatttagccacagccttttctatctactgcggcatctcgatcgcacactcacttttgtacaagaaggttaatgaagcccaatataggtcacacttagcaaacgaaatgatgatgtatcacatgaaggtgtcagacgacgagtacaccaaactactacacgatggaatccagccagtcgcagctattgattctaactttgcttcatttacttacacccccaggtcactgcccgaggacgacacttcgatggccatactgagtatgttgcaggatatgaactttattaataattataagatcgattgccccactctggccaggttctgcctcatggttaaaaaggggtaccgggatcctccttatcacaattggatgcatgccttttcagtctctcacttttgctatttgctgtataaaaaccttgagttgactaactatttagaagacatcgagatctttgctctgtttataagttgtatgtgtcatgacctcgaccacagaggcactaataacagctttcaggttgcctccaagtccgtccttgcggctctgtactcatccgaaggctccgtcatggagaggcaccatttcgcacaggctattgcaattctcaatactcacgggtgtaatatattcgaccacttctctcgcaaagactaccaaagaatgctggacctgatgcgtgacattatcttagcgactgaccttgcccatcacctgcggatattcaaagatttacaaaaaatggcggaggtgggatatgaccgcaataataaacagcatcatcgtctactgctctgtcttctgatgacatcttgcgacttatctgaccagactaaggggtggaagacaacacggaaaatcgctgagctcatctacaaggagttcttctcacagggagaccttgagaaggccatgggcaatcgccccatggagatgatggatagggagaaagcctacatcccagagctgcagatctctttcatggagcatattgcaatgcccatttacaagctactgcaagatctgtttcctaaggctgctgaactttacgagagggtcgcctctaatagagagcattggaccaaagtgtctcataaatttactataagaggcctgccgtcaaataatagcttagacttcttggatgaagagtacgaggtaccagacttagatggaactagagcacccattaacggatgttgctcgctggacgccgaatag

SEQ ID NO: 28844 - DNA, 2805 bp, Artificial Sequence
  Description of Artificial Sequence: Synthetic coding sequence
atggtgctggtactgcatcacattctcattgcggtggtccagtttttacggagagggcagcaggtttttctgaaacccgacgagcccccccccccgccccaaccctgtgctgatagtcttcaggacgccctgctgtctctgggctccgtaatcgacatcagtggattgcagagggctgtcaaggaagctctctcagctgtacttccaagagtggagaccgtttatacctaccttctggatggagagagtcagctggtgtgtgaggatcctccccacgaactaccacaagaaggaaaagttcgcgaggctattataagccagaaacggctggggtgcaacggactgggtttcagcgacctacccggtaaaccactggcccgattggtggccccattggcacctgacactcaagtccttgttatgcctctggctgataaggaggcaggtgcagtggctgcggtcatcctcgtccactgtggccaactcagcgataatgaggaatggagcctccaagccgtggaaaaacacactctggtcgccctgcggagggttcaggtcctgcagcagcgcggacccagagaggccccaagggcagtgcagaaccccccggagggtactgccgaagatcagaagggtggggccgcgtataccgaccgcgacagaaaaattctgcagctttgcggtgagctctacgacctggatgctagctcccttcagctgaaagtcttgcagtacctgcagcaggaaactcgcgcgtctcgctgctgcctgcttctcgtttccgaggacaacttgcaactgagttgtaaggttattggcgacaaagttttaggggaggaagtcagctttcccttaaccggctgtctggggcaggtggttgaggacaaaaaaagcatccagctgaaagacctgacctcagaggatgttcagcaactgcagagcatgctgggttgcgagctccaagccatgctgtgtgtcccggtgataagccgggccacagatcaagtagtggcgcttgcctgcgcatttaacaaactggagggggatctttttactgacgaagacgagcacgttattcagcattgttttcattacactagtactgtcttgacctcaaccctggcattccagaaagaacagaaactgaagtgtgagtgccaagcccttctgcaggtcgccaagaacttgttcacccacctcgatgatgtgagcgtcttactccaggagattatcaccgaagcgcggaacctgtctaacgccgagatctgttctgttttcctgcttgaccagaatgaacttgtagccaaggtgttcgacggcggcgtggtggacgacgaaagttacgaaatcaggatccctgctgaccaagggatagcaggacacgtggcgactactggccaaatcttgaacatcccagacgcctatgctcatcctttgttctacaggggggttgacgacagtaccggatttcgaacccgaaacattctgtgctttcccatcaagaatgagaaccaggaggttattggggtcgccgagttggtaaacaagattaacggcccctggtttagcaagtttgatgaggacctggcgaccgctttttccatatattgtggaatatctatcgcccactccctcctgtacaagaaggtgaacgaggcccagtacaggtctcatctggctaatgagatgatgatgtaccacatgaaggtttctgacgacgagtatacaaaattgctccacgatggcattcaaccagtcgcagccattgattccaacttcgcaagctttacatacactccaaggagcttgcccgaagatgacaccagtatggcaattctgtccatgctgcaggatatgaatttcattaataactataagattgattgtccgactctcgcacgtttctgcctgatggtgaaaaagggataccgggatccaccataccacaactggatgcacgctttcagcgttagccacttctgttatctgctatacaagaatctggaattaacaaattacttggaagatatcgaaatatttgcgttgttcatatcttgcatgtgccatgacttggaccatcggggaacaaacaactcattccaggtggcatcgaagagtgtgttagcagctctgtattcctcagaaggatccgtgatggagcgccaccactttgcccaggctatcgctattttgaatacccatgggtgtaacatttttgatcacttctcgagaaaagattaccaacgtatgctggatctgatgagggacatcatacttgccaccgacttggctcatcatctgcggatttttaaagatctccagaagatggccgaggttgggtatgatcggaataacaaacaacaccaccgccttctactatgtctgttaatgacctcatgcgatctgtccgaccagactaaagggtggaaaacaactagaaagatcgctgaactgatctacaaagagttctttagccagggagatttggagaaggccatggggaacaggcctatggagatgatggatcgggaaaaggcatacatcccagagttgcaaatatcttttatggaacacatagccatgcccatttacaaactattgcaggatcttttccccaaagccgccgagttatatgagagagtcgcgagcaaccgggaacactggactaaggtgtcacataaattcactatacggggtttgcccagcaataatagcttagactttttggatgaggagtacgaggtcccagatctggacggtacacgtgcacctattaatggctgttgctctttggacgcagagtag

SEQ ID NO: 28845 - DNA, 3426 bp, Artificial Sequence
  Description of Artificial Sequence: Synthetic coding sequence
atggcagtcccaggcgatgctgcacgagtgagggataagcctgtgcattcgggggtctcacaggctccaacagcagggcgggattgtcaccaccgggctgacccagcatcccctcgggactcgggttgcaggggctgttggggagatctcgtactccagcctttacgtagcagtagaaagctgtcaagcgcgctgtgcgcagggtcactttcatttctcttggcgcttcttgtccggttagttagaggggaggtggggtgcgatttagagcagtgcaaggaggctgccgccgcagaggaagaagaagccgctccaggggccgagggaggagtgttcccaggcccaaggggaggtgctcccggaggaggagccaggctctcaccctggctgcaacccagtgccctgctcttctcgcttctctgcgcctttttctggatgggcctctatcttctgagggcaggcgtgaggcttcctctggctgtggccttgcttgctgcatgttgcggcggagaagccctggtccagattgggttgggtgtgggagaggatcacttgctaagcctccccgcagctggagtggttctctcttgcttagcagcggccacatggctggtcctacggctcagactgggtgtcctcatgatcgcacttaccagcgccgtccgaacggtctctttaatcagcctggagagatttaaggtggcgtggcgcccatacctggcttacctcgcgggcgtgctggggattctgcttgctcggtatgttgagcagattctgccccagagtgctgaggcagcccctcgtgagcacttaggctctcaactgattgccggcacaaaagaagacattccagtgttcaagagaaggcggaggtcttctagtgttgttagcgctgaaatgtccggatgctcaagcaagtcccacagacgcacatcattgccctgtattcctcgggagcagctgatgggacattcggaatgggatcacaagagaggaccgcgtggcagtcagtcgtcaggcacgtccataaccgtggatattgccgtgatgggtgaggcacacggactcataaccgacctgctggccgaccccagcctcccacccaacgtgtgcacctccctcagggctgtatccaatctgctgtccacccagcttactttccaggctatccataaaccaagggtaaatccagtcacgtccctgagtgaaaactacacctgctcggattccgaggagagcagcgagaaggataaactagcaatcccaaaaagacttcggcgcagcttacccccgggactgttgaggagggtgagcagtacctggaccaccacaacttctgcaacagggctccccaccctcgagcctgcccctgtcagacgcgatcggtctacatcaattaaactccaagaagctcccagctcttcacctgattcttggaacaatcctgttatgatgacattgacaaaaagccggtccttcacatcgtcctacgcaatctcagcagcaaaccatgttaaagccaaaaagcaatcccgccccggggctttagcaaaaatctcacctctctcatccccctgctccagcccgttgcaagggacgccagcctcatccctggtcagtaagataagcgccgtgcaatttccagagtctgccgacaccacggcgaaacaatccctgggcagccatcgagccttaacctatacgcagtcggcacctgatctgtccccacagattttgacgcctccggtgatctgcagttcctgcggcagaccgtatagccaggggaatcctgcagacgagccgcttgaacgcagcggcgtggccacccgcacgccttcacggaccgatgacacagcccaggtgactagtgattatgaaacaaacaacaactcggactcttcagacatagtacagaatgaggatgagacagaatgtcttagggaaccactcaggaaggcaagcgcatgctctacttacgcgcctgaaacaatgatgtttttggacaaacctatcctggcccccgagcctcttgtaatggataatctggacagcataatggagcaactgaatacctggaatttcccgatctttgatctggttgagaatatcggcaggaagtgcgggagaatactgagccaagtgtcttaccgactctttgaagacatgggcctttttgaggcatttaagatcccgataagagagtttatgaattactttcacgcgcttgaaatcggatacagagacataccttatcacaataggattcacgccaccgatgttcttcacgccgtatggtacctaacaacacaacccattccagggctgtccaccgtgatcaacgaccacggttccacatcagactctgattccgacagcgggttcacacacggccacatgggatatgtgttctcaaagacttataatgtgacggacgataaatacggctgcctgagtggaaatattcccgcgctagaactgatggccttgtacgtcgcagctgcaatgcacgattatgaccacccagggagaaccaatgcgttcctggtggcaacatcagctccccaagctgtgctatacaatgacaggtcggtgttagaaaaccatcatgctgccgccgcgtggaatctattcatgagcaggcctgagtacaatttcctcataaatctagaccatgtcgagttcaagcacttccggtttcttgtaattgaggcaattttggctacagatctgaaaaagcactttgatttcgtggctaaatttaatgggaaagttaatgatgacgtgggtatcgactggactaacgaaaatgataggctcttggtttgtcagatgtgtatcaaactggctgatatcaacggccctgccaagtgtaaagagttgcatctccagtggaccgatgggatcgtgaacgaattctatgaacagggtgatgaagaggcctccctaggactgccaatatccccctttatggaccgcagcgctccccaattagcaaatttgcaggagtcctttatctctcacatcgtgggccctctgtgcaactcatacgactccgcagggttaatgcccggcaagtgggtggaggactcagatgaaagcggagacacagacgatcctgaggaagaggaggaggaagctccagcccccaacgaggaagagacttgtgaaaataacgaatctccaaaaaaaaagactttcaagcgccggaaaatttactgccagatcacacagcacctgctgcagaaccacaagatgtggaaaaaggtgattgaggaggagcagcgactcgcaggaattgagaaccagtccctggaccagacaccgcaaagtcacagctccgagcaaatacaggcaatcaaagaagaggaggaagagaagggcaaaccccgcggagaggaaatccctacgcagaagcctgatcagtag

SEQ ID NO: 28846 - DNA, 2670 bp, Artificial Sequence
  Description of Artificial Sequence: Synthetic coding sequence
atggctgagcgcggaaggttaggattgcccggggcacccggcgccctgaacacacccgtccccatgaatctcttcgctacatgggaggttgacgggtccagcccgagctgtgtgccccgcctgtgctccctcacactgaaaaaactggtagtcttcaaggagcttgagaaagaattgatcagtgtggtgattgcagtgaagatgcagggctccaaaaggatactgcgcagccacgaaattgtcctgccgccatccgggcaggtagagacggatctcgcgctgacgttcagtctgcagtatccccatttcctcaagcgtgaggggaacaagctgcagattatgcttcagcgcaggaaacggtacaaaaatcgtacaatacttggttataaaactctggcggctgggagtatctctatggccgaggtgatgcagcacccgagcgaagggggtcaggttctctcactgtgctcaagtatcaaagaggctcccgtgaaggccgccgaaatctggatcgctagtctttcctcacagccaatcgatcacgaggatagcacaatgcaggctggtccaaaggcaaagtctactgacaattacagtgaggaagaatacgagtctttcagctccgaacaagaagcctcagacgatgccgttcagggacaggatcttgatgaggacgatttcgacgtagggaagcccaaaaaacagcgcagatccatcgtcaggaccacatccatgacgcgccaacagaactttaaacagaaagtggtggctttgcttaggcgattcaaagtgagcgatgaggtgttggacagcgagcaagacccagctgaacacataccagaggcagaggaggacttagatttgctgtatgacacactggacatggagcaccctagcgattctgggcccgacatggaggatgacgactctgtcctctccacgcccaagcctaagcttagaccctacttcgaaggcttgtcgcacagctcaagtcagacagagattggaagcattcacagcgcccggagtcacaaggagccaccttccccagccgacgtgccggagaagactaggtctctcggaggcagacagcctagtgactctgtctcggatactgtagcccttggggtgcccggtccgcgggagcacccaggacaaccagaagattctcccgaggctgaagcgtccaccttggacgtgttcaccgagcggctccccccttctgggcgcattaccaagaccgaatccctggtgattccatccacaaggtctgagggtaaacaggctggccgacgagggagaagtacgagtctgaaagaacggcaggccgctaggccccagaacgagagagcaaacagcttggacaatgaaagatgtcccgacgccaggtcgcagctgcagatccctcgtaaaaccgtgtatgatcagctcaaccacatattgatatccgatgatcagttgcccgagaacatcattctcgtgaacacgtcagattggcagggacagttcctttccgacgtgttacagcggcatactctgccagtggtgtgtacttgcagccctgctgatgttcaagccgccttcagcacgattgtgtccaggatccaacgctattgtaattgtaattcccagccccctaccccggttaaaatcgccgtggccggcgcccagcactacctctcagccatacttaggctatttgtggaacagttgtctcataaaacacccgactggcttgggtatatgaggtttctggtcatacctttaggcagccatcccgtggcacgctacctcggatccgtggattatcggtataataatttctttcaggaccttgcatggcgggacctcttcaacaaactggaggcacagtcagcagtgcaagatacccctgacatagtatcccgaatcacgcagtacatcgctggagctaattgcgcccatcagctgcccatcgcagaagcgatgcttacctacaaacagaaaagccccgacgaggagtcgtcccaaaagtttatccccttcgtgggtgtggtaaaagttggcatcgtagagccttcctccgccaccagtggcgactcggacgatgctgcgccttctggctctggcaccctgagtagcaccccgccatccgcgtccccagctgctaaggaggctagtcccactccgccatcgtcgccgagcgtgtctggagggctgtctagtccaagccaaggcgtgggagcagagctgatgggtctccaggttgactattggactgctgctcagcctgccgatcggaagcgggatgctgagaaaaaagacctcccagtgactaaaaataccctcaaatgtactttcagatctctccaggtcagccgtttaccttctagcggggaggctgcagcgactcctacgatgtctatgactgtggttaccaaagagaaaaacaaaaaggtaatgttcctgccaaagaaggcaaaagacaaagatgttgagtccaagagccaatgtatcgaaggcattagccgccttatctgcacggctaggcagcagcagaatatgcttagggttttgatcgacggagtggagtgttcagatgttaaatttttccagcttgccgcacaatggtcctcccacgttaaacacttcccaatctgtatctttgggcatagcaaggccacattttag

SEQ ID NO: 28847 - DNA, 2682 bp, Artificial Sequence
  Description of Artificial Sequence: Synthetic coding sequence
atggcagagaggggtcggttaggtttgcccggtgcacctggagcactgaacactcccgttcccatgaatctttttgctacttgggaggtggatggatcctcccctagttgcgttcctaggctttgttcattgaccttgaagaagcttgtggtgttcaaggaactggaaaaggagctcatctcggtggtgatagccgtcaagatgcagggcagcaagaggatcctgcggagtcatgaaatagtgttgccccctagtgggcaggtggagacagatctcgctctgactttttccctccagtacccccatttcctgaagcgggaaggcaacaagctacaaattatgctccagcgcagaaagcgttataagaacaggacgatactgggttataaaacgcttgccgctggaagcattagtatggcggaggtgatgcaacatcctagtgagggggggcaggttctctcactgtgcagttcaatcaaggaagctcccgtcaaggcagctgaaatttggatcgcctctctttcaagccagcctatcgatcatgaagactccactatgcaggcagggcccaaagcaaagtccaccgacaactattctgaagaagaatacgaatcattctcgtctgagcaagaggcctccgatgacgccgtacaggggcaagatctggacgaggacgactttgacgtcgggaaacccaagaagcagcgcaggagcatcgtgagaactaccagcatgactcggcagcagaattttaagcagaaggtggtggcactcctcagacgattcaaagtatcggatgaagtcctggacagtgagcaagacccagccgaacacattcctgaggcagaggaagatttggacctgctctacgacaccctcgacatggagcacccctcagactcaggacccgatatggaggacgatgacagtgtgttgtctacccccaaacccaagctgcggccctactttgaggggcttagccactctagctcccagaccgaaatcgggtccattcatagtgccagatcccataaggaaccaccttcccctgccgatgtccccgagaaaacaagatccctgggcgggcgccagccttcggattctgtgtcagatactgtcgccctgggcgtccccggacccagggaacaccccggccagccggaggatagtccagaagccgaagcgagcaccctggacgtcttcaccgagcgtctgcccccctcgggacgcatcaccaagactgaaagtttggtgattccgtcaactagaagcgaggggaaacaagcaggtagacggggtaggtcaacttccctgaaagagaggcaagcggcgcgtccccagaacgagcgcgccaactcactggataatgaacggtgtccagatgcgcggagtcagctacaggtgcagctgcagattccaagaaagacggtttacgaccagctcaatcacattctgatctctgacgaccagttacctgaaaacatcattttagtaaacacttctgactggcaggggcagttcctgtcagacgtgctccagaggcatacccttccagtcgtttgtacatgctccccagctgacgtccaggcagccttctcaaccatcgttagcagaatccagaggtactgcaactgcaacagccaaccccccacacccgtcaagattgccgtggctggggcacagcactacctgtctgctattctgaggctttttgtcgagcagctgagccacaaaacacccgattggttggggtacatgagattcctagttattccgctaggctcccatcccgtggctagatacctgggaagtgttgattaccgctacaataatttctttcaggatctggcctggcgggatctctttaataagttggaggctcagtctgctgtgcaggataccccagacatcgtgtcccgcatcacccagtatatagccggcgctaattgtgcccaccagctgcccattgccgaggctatgcttacatataagcagaaatctcctgacgaggagtcttcccagaaattcattccctttgtaggagtggtaaaggtcggcattgtagagcctagtagcgcgacctctggagattcggatgacgctgcccccagcggcagtggaactttgtctagcaccccacccagcgctagccctgccgccaaagaggcgtcgcctaccccaccctctagtccctcagttagcggaggacttagcagcccgtctcaaggggtgggggcagaattgatgggcctgcaggttgactactggaccgccgcgcagccggcggaccgtaaaagagacgccgagaaaaaggatctccccgtcaccaagaacacactcaagtgcaccttccgcagcttacaggtgtccagactgccttcctccggggaggctgccgcaacacctaccatgagcatgactgttgtgacgaaagaaaaaaacaagaaggttatgtttctacccaagaaggctaaggacaaagacgttgaatccaagtctcagtgcatcgaggggatatcgagactaatttgcacagcccgacaacaacagaatatgctcagggtcctcatcgacggcgtagagtgctcagatgttaaattctttcaactcgctgcccaatggagtagccatgttaagcacttccccatttgcatatttggacactctaaagctactttctag

SEQ ID NO: 28848 - DNA, 2715 bp, Artificial Sequence
  Description of Artificial Sequence: Synthetic coding sequence
atggccgagcgggggcggctggggcttccgggcgcacccggtgcactgaatacgcccgtgcccatgaacctttttgcaacatgggaggtggacggttcctccccatcctgcgtcccaagactttgcagcctgacactgaagaaacttgtggtgtttaaagagttagagaaagaactcataagtgtggtgatcgctgtgaagatgcaaggctcgaagcgaattctgcgttctcatgagatagttttgcctccttccggccaggtggagacagacctagccttgactttcagccttcagtatccacacttcctaaagcgagaggggaacaaactgcagattatgttgcaacgtcgtaaacggtacaaaaatcggaccatcctcgggtataagactctcgctgctggatccatctctatggctgaggtgatgcagcaccccagcgagggcggacaggtcctctcgctatgcagctcgattaaagaagccccagttaaggccgccgaaatctggatcgcctccctgagtagccagcccattgaccatgaggattccacaatgcaggccgggcccaaggctaagtcaacagacaactatagcgaagaagagtacgagagcttttctagcgaacaggaggccagcgacgacgcagttcagggtcaggatttggatgaagatgattttgacgtgggcaagcccaagaaacaaagaaggagtattgttagaactacctcaatgactaggcagcaaaattttaagcaaaaagttgtcgccctgcttcggcgattcaaagtttctgacgaggtcttagattcagagcaggaccccgctgaacacatcccggaggctgaggaggacctggatctgctgtatgatacgctcgacatggagcacccaagtgatagcggacccgatatggaagatgacgacagtgtgctgtctacaccgaaacctaaactgagaccgtatttcgaaggtcttagccactcctccagccaaacagagatcgggtctatccacagcgcaaggagccacaaagaaccaccaagtcctgctgacgtgccagaaaagacacgaagcctcggaggtcgtcagccctctgactcagtctcggacacagtggcactcggggtccccggccctagggaacaccctggtcaaccagaagacagccccgaggcagaggcttctaccctcgacgtgttcaccgaaagactgcctccgagcggacggataacaaaaacagagagtttggtgattcccagcacaaggagcgaaggcaagcaggcaggcagacggggtcggagcacttcacttaaggaacgtcaggccgctcgtccccaaaatgagcgggccaattccctggataacgaaaggtgcccagatgctagatctcagctacaggtgcagctgcaaatcccacgtaaaacagtgtacgatcagctgaatcacatcctcatatccgacgatcaactaccagagaatatcattttggtcaacacttccgactggcaagggcagtttttgagcgacgtgctccagaggcacacgctgccagtggtttgtacctgttctcccgcagacgtgcaggctgctttttccacaatcgtttcaagaattcagagatactgtaactgcaatagtcagccacccacacccgttaaaattgcggttgcaggagcccagcactatttaagcgcaatcctgagattgtttgtggagcagctgtctcataaaaccccagattggctgggctacatgagattcctggtgatcccactggggtcccaccctgtagcccgctacttaggcagcgtcgactaccgctataacaacttcttccaggaccttgcatggcgggacctattcaacaagctggaagcccagtctgctgtgcaggatactccggatattgtgtcccggatcactcagtatatagctggggcaaactgcgcccaccaactccctatagccgaagccatgctgacatataaacagaaaagaaaaaaacattttcatttcgattttacattatcaccggatgaggagtcttcccagaaattcatcccttttgtgggtgtcgtgaaggtgggcattgtggagccgagcagcgcaacgtctggggatagcgacgacgccgcgccttcaggaagcggtactctgtcatctacccctccctctgctagtcccgctgccaaggaagcaagtccgacaccccctagttctcccagtgtgagcggcggtcttagtagcccgagtcagggagttggagcagagctcatgggcctccaagtggactactggactgccgcacaaccagctgacaggaagagagatgctgagaagaaggatctgcctgttactaagaataccctgaaatgtacattcaggagtttacaggtgtcccgactcccaagcagcggagaggccgccgccacaccaactatgagtatgacggtggttacgaaggagaagaacaagaaggttatgtttctgccgaaaaaagccaaagacaaagatgtcgagagcaaatcacagtgcatagaagggatatcgcggttaatttgtaccgcccgtcagcagcagaacatgttgagagtcctcatcgatggagtcgagtgtagcgatgtcaaatttttccaactggccgctcagtggagttcccacgtgaagcacttccccatttgcatctttggtcattccaaagccaccttttag

SEQ ID NO: 28849 - DNA, 768 bp, Artificial Sequence
  Description of Artificial Sequence: Synthetic coding sequence
atggctttcagacaggcgctacagttggcagcctgtggacttgccgggggatcggccgccgttctgttctcagccgttgcggttggtaaaccacgggctgggggcgatgccgagccacggcctgcagaaccaccagcctgggctggtggtgctaggccaggtccaggagtgtgggatcctaactgggaccgaagggagccgctgagcttgatcaacgttcgcaaacggaacgtagaatcgggagaggaggagctggcctccaaacttgaccattacaaggctaaagctactcgccatattttcctcatacgccacagccaataccatgtcgatggcagtttagagaaggaccgcactctgacgccactcggccgggaacaggctgagttgactggcctgcgactcgctagcttaggtcttaagtttaacaaaatcgtgcactcctctatgacccgcgccatcgaaaccaccgatattattagccgacatctccccggagtctgcaaggtgagcacagatctgttaagggagggggccccaattgagccagatccaccagtgagccattggaagcctgaggcggtgcagtattatgaggacggtgccagaatcgaggctgcatttagaaattacatacaccgtgccgacgcacggcaagaagaggattcttacgaaatctttatttgtcacgctaacgtaataaggtatatcgtgtgctctatccccccactcctctcagccggggacttcgtgctgcttggaagctag

SEQ ID NO: 28850 - DNA, 870 bp, Artificial Sequence
  Description of Artificial Sequence: Synthetic coding sequence
atggcgtttcgccaagcgcttcagctggcggcctgtgggctggcaggcggttccgcagccgttctgttttccgcagtcgcggtggggaaaccccgggcagggggggatgccgagccaaggcccgctgagcctcctgcctgggccggcggtgctcgtcccgggcccggggtatgggatcccaactgggacagaagagaacccctctccctgattaatgtccgcaagcgaaacgttgagagtggtgaagaggagcttgcttctaagctggaccactataaggccaaagcaacacgccatatcttccttatcaggcatagccagtaccacgtggacggatcactcgagaaagatcgaaccctaacacccctcgggcgagagcaggccgaactgacgggcttgcgtctggcctccctaggcttgaaatttaacaagatcgtgcactcctccatgacgcgtgccattgagacaactgacattatttctcggcacttgcctggtgtgtgcaaggtaagcaccgacttgttacgggaaggtgctccaatcgagccagacccacctgtttcgcactggaagcctgaggctgtgcaatactacgaagatggcgctagaatagaggccgcctttaggaattatatccatagggcggatgcgcgccaggaggaggattcatacgaaatcttcatttgccacgctaacgtgattcgatacatcgtctgccgggcgctgcaatttcccccagaaggctggttgcgcctgagcttgaacaacgggtccattacccatcttgtgattcgacccaacggccgggtagccctgcggacactcggggatacagggttcatgccaccggataagattactcggtcctag

SEQ ID NO: 28851 - DNA, 2418 bp, Artificial Sequence
  Description of Artificial Sequence: Synthetic coding sequence
atggctgctagcggcgtccctagaggctgcgacattttaatcgtctactcacccgatgctgaagaatggtgccaatacttgcaaactctttttctgagttctagacaagttcgctcacaaaagatcctgacccaccgcctaggacccgaggcaagcttttccgccgaagatctctcactgtttttgtcgacaaggtgcgttgtggtgcttttgagtgccgagctggtccaacattttcacaagccggctctgctccccttactgcagagagcctttcacccccctcacagggtcgtgcgcctgttgtgcggggtacgtgacagtgaagagttcttggatttctttcccgattgggcacactggcaagaactgacctgtgacgatgagccggagacatacgtcgctgccgttaaaaaagcaattagtgaagacagtggatgcgattcagttacagatactgaacctgaggacgaaaaggttgttagttattccaaacaacagaatctgccgaccgtgacaagtcccggtaacctcatggtagtgcagcctgacagaatacggtgcggagccgaaaccaccgtctatgtgatcgtccggtgcaagctagacgacagggtggccaccgaggccgagttttcacctgaagatagccctagtgtccgaatggaagcaaaagttgagaatgagtacaccatctcggtgaaagcccccaacctcagttctgggaacgtgtcccttaaaatttattctggagacctcgtcgtgtgtgaaacggtcatttcctactacaccgatatggaggagattggtaacttactgtcaaacgccgccaatcctgtggaattcatgtgccaagcattcaagattgtgccttacaacaccgagaccttggataaactgctcacagagtcactgaagaataatattcccgcttctgggctgcatcttttcgggatcaatcagctcgaggaagaggacatgatgaccaaccaaagggacgaggagttaccgactttgctgcacttcgccgccaagtacggcctgaagaacctcaccgctttgctgctgacctgtcctggggccttgcaggcttattctgtcgcaaataagcacgggcactacccaaatacaatcgctgaaaagcatggcttccgggacttgagacagttcatcgatgaatatgtagaaacggtggacatgctcaagtcacacatcaaggaggagctcatgcatggcgaagaagccgatgcggtgtacgaatccatggcccatttaagtacagatctcctgatgaaatgttctctgaatccaggctgtgacgaggatctttatgagtcaatggcggcgtttgtccccgccgccaccgaggacctgtacgttgagatgttacaggctagcacatctaatccaatccctggggatgggttctccagggccaccaaggacagtatgatccgaaaattcttagagggaaacagcatgggtatgacgaatcttgagcgtgatcagtgccacctaggacaggaagaagatgtataccatacagtcgatgatgacgaggcattcagcgtcgacttagccagccgtccccctgtacctgtgccacgacccgaaacaactgctcctggagcccatcagcttccagacaatgaaccatatatctttaaggtgtttgctgagaaatcgcaggagagaccaggcaacttctatgtctcatcggagagcatccgaaagggccctcctgtgcgaccttggcgcgatcgcccgcagtcaagcatttacgacccgtttgcggggatgaagactccgggtcagaggcagctcataacgctgcaagaacaggtaaagctcggcattgtcaatgtggacgaggctgttctccacttcaaagaatggcagttgaaccagaagaaacgcagcgaatcatttcggtttcagcaggagaacctgaagaggttgagagatagcataacccgtaggcagcgagagaaacaaaaaagtggcaagcaaaccgatcttgaaataactgtcccaattagacatagtcagcatctgccagcaaaggtggaatttggagtgtatgagagtggaccgagaaagagtgtgatcccacctagaaccgagttgcgacggggtgactggaaaaccgatagcacatcttcaacggcaagctctaccagtaaccgatccagcacccggagtctgctatcggtgtcctccgggatggaaggcgataacgaagataacgaagtccctgaggttactaggtctcgttccccaggaccaccacaggtcgacggtactcccacaatgtcgctcgaacgtcccccacgcgtgccaccccgagctgcttctcagcgacctcctacaagggagaccttccacccacctcctcctgtgccccctcgaggcagatag

SEQ ID NO: 28852 - DNA, 1215 bp, Artificial Sequence
  Description of Artificial Sequence: Synthetic coding sequence
atgcggtttttcacctcagtagcatgttatggatcatgcctatttgcgtcagaacttctgattaggtgcaaggactggcttaaggggcgcccagctcttttcaccgcattgctggcatgcgtcctgtacctgtgcgaatggactggcgccaagcatgtgccaggcagttcctacgtcgagatgctacaggcatctacttccaatcctattccaggggatggattctcccgcgctacaaaggacagtatgattaggaagttccttgaggggaattccatggggatgacgaacctagaaagagaccagtgccatctcgggcaggaagaggatgtctaccacactgtggatgacgacgaggccttttctgtggatctggcctctcgaccgcctgttcctgtcccgaggcctgagaccacagcccccggcgcccatcagctgccagataacgaaccatacatcttcaaagtgtttgccgaaaaatcacaggaaagacccggcaatttttacgtttcgtccgagagtatcaggaagggaccccccgtgagaccttggcgcgatcgcccacagtccagcatctacgacccattcgccggcatgaaaaccccaggacagagacagctgatcacccttcaggagcaagtcaagctaggcatcgttaacgtggacgaggccgtcctccattttaaggagtggcagcttaaccagaagaaacgtagtgagtcctttagatttcaacaagagaatctcaagagacttagggattctataactcgtaggcaacgggaaaagcagaagagtgggaaacagaccgacttggaaattactgtgcccattagacactctcagcacctgcccgcaaaagtggagttcggagtttacgagagcgggccccggaagagcgtgattccacctaggaccgaactgcggagaggtgactggaaaaccgactccacgtcttcgacagcatcctccaccagcaataggagttctacccgaagcctcctatcagtgagctctggaatggagggcgacaacgaggacaatgaagtgcctgaagtaacccggtcaaggtcccctggccctccccaggtcgacggaacacctactatgagcctggaacgaccccctcgcgtccccccgcgcgccgcttctcagcgtcccccgaccagagaaacatttcatcccccgccccccgttccgccacgggggcgttag

SEQ ID NO: 28853 - DNA, 1884 bp, Artificial Sequence
  Description of Artificial Sequence: Synthetic coding sequence
atggtagtgcagcctgaccggatccgctgcggtgccgaaacaaccgtctacgtgatagtcagatgcaaactcgatgatcgcgtagctaccgaggctgagtttagtccagaggactccccatccgtcagaatggaagctaaagtcgagaacgagtacaccatctctgtgaaggctcctaacctctcctccggcaacgtcagcctcaaaatctactcaggggatcttgtcgtctgcgaaaccgtcatttcttactacactgatatggaggagattgggaaccttctgtccaacgctgccaatcccgttgagtttatgtgtcaggcgttcaagattgtaccctacaacacagaaacgctggataagttgctgacagaatctctcaagaataacatcccagctagcgggttacacctgttcggtatcaaccagcttgaggaagaagatatgatgaccaaccagagagatgaggaactgccaactctcttacacttcgcagccaaatacggactcaagaatcttaccgctctgctgttgacttgcccgggcgctctgcaggcctatagtgtggccaacaaacatgggcattatccaaatactattgcagagaaacatgggtttcgggatttaagacagttcatagacgaatacgttgaaaccgtagatatgctgaagtcgcacatcaaagaagaactcatgcatggcgaggaggccgacgcagtctatgagtctatggcacacctctctacagacctgctaatgaagtgcagccttaaccctgggtgcgatgaagatttatatgagtccatggccgcattcgtgccagctgccaccgaagacctgtacgtggagatgctccaggcttccactagcaaccccatcccaggagacggtttttcccgagcaacaaaagactcaatgatccggaaatttctggagggcaatagtatggggatgacaaacctggagagagatcagtgccaccttggacaggaagaggatgtctaccacaccgtcgacgatgatgaggccttttcggtggacctcgcatccagaccacctgttcccgtcccccgacccgagactacagctcctggagctcaccagctgcccgataatgagccatacattttcaaggtatttgcagagaagagccaggagcgccctggcaatttttacgtgagcagtgagtccataagaaaggggccgccagtccgcccttggagagatcggccacaaagttctatttatgatccattcgcggggatgaaaacacctggacaacgccagctcattacccttcaagaacaggtgaagcttggaattgtgaacgttgatgaggctgtccttcattttaaagaatggcaactgaatcagaagaagcggtcagagtctttcagatttcagcaagagaacctgaagcgtctgcgggatagtatcaccaggaggcagagggagaaacaaaagtccgggaaacagacggatctggagatcaccgtccccattagacattcccagcatctgcctgctaaggttgagttcggagtgtatgaaagcgggccccgcaagagtgtgattcccccccggactgagcttcgtcggggggattggaagaccgatagtacatcatccacggcgtcttctactagcaatcgcagctcaacccggtcattactgagcgtctcaagtggcatggagggggacaacgaggacaacgaggtgccagaggtgacaagaagcaggtcgcctggacctccccaggttgacggtacacccaccatgtctctggagagacccccccgcgttccaccacgtgccgcatcccaacgacccccaacacgcgagacctttcatcccccgccaccagtgccaccacgcgggagatag

SEQ ID NO: 28854 - DNA, 408 bp, Artificial Sequence
  Description of Artificial Sequence: Synthetic coding sequence
atggcctgcggcctagtggcctcaaacttaaacttgaagccaggtgagtgtctgcgggtccgcggggaggtagcccccgatgccaaaagcttcgtactcaatctgggaaaagacagtaataacctttgcctgcattttaatcctcgtttcaacgctcacggggacgcaaatactatcgtatgtaattccaaagatgggggcgcctgggggactgagcagcgggaggcagtgttccctttccaacctggcagcgtcgcagaagtgtgcattacatttgaccaagccaatctgacggtgaaactccctgacggatatgagttcaagttccccaataggctgaacctggaagcaattaattatatggctgcagacggtgatttcaagatcaagtgcgtggcttttgattag

SEQ ID NO: 28855 - DNA, 705 bp, Artificial Sequence
  Description of Artificial Sequence: Synthetic coding sequence
atgctcctcgcatgggtccaggcttttttggtctcaaatatgttgctcgcagaggcatacggcagcggagggtgtttttgggataacggccacttgtatcgggaggatcagacgtccccagcccctggtttaaggtgtctgaactggctggatgctcaatccggactggcgtctgcccccgtgtcgggcgctggtaaccacagctattgcaggaacccagacgaggaccccagagggccgtggtgctatgtttcgggggaagccggtgtgccagaaaaacgcccctgcgaggacctgaggtgtccagagaccaccagtcaggccctgccagcgttcactacagagatacaggaggcgtccgagggccctggtgccgatgaagttcaagtcttcgcacctgccaatgccttgccagcgagatcagaggcagccgctgtgcagcctgtgatcgggatctctcagcgcgtgaggatgaacagcaaggagaagaaggatctcggcactctcggctatgttctaggcatcactatgatggtcataattattgccatcggagctggcattatactcggatacagctataagagaagcgtggcatcgctccttggccccctgcggaggcggggtggtcgctacactaagagtaattttgtggcctttctcccaaaaaggaaacaggacgtggaaaatcagctcaaaatgtag

SEQ ID NO: 28856 - DNA, 726 bp, Artificial Sequence
  Description of Artificial Sequence: Synthetic coding sequence
atgctcctagcttgggtgcaggcgtttttggtcagtaatatgctacttgccgaggcatatggcagcggcgggtgtttctgggataacggccacctgtaccgcgaggaccagacctcccctgcgcccggtctgagatgtctgaattggttggatgcccaatcaggccttgctagtgcccccgtctccggtgcaggcaatcactcatattgcaggaatcctggcgaggatctgcgctgccctgaaaccacgtctcaggcactgccagcttttacaacagagatccaggaagcatctgaaggtcctggcgccgacgaagttcaggtgtttgcccctgccaacgccctgccagcccgctccgaggcggctgctgtgcaacctgtcatcgggatttcacagagggtgaggatgaacagtaaagagaaaaaagatctcggaaccctcggttacgttctcggtattaccatgatggtaattatcatcgccattggtgccgggattatccttggttattcatacaagagaggaaaagatttgaaagaacagcacgaccaaaaggtgtgtgaaagggaaatgcagcgcatcaccctccccctcagcgccttcactaaccccacgtgtgagatcgttgacgagaagaccgtggtcgtgcatacctcccagactcccgtagatcctcaggaggggacaacacccctaatggggcaagccggaacaccaggtgcatag

SEQ ID NO: 28857 - DNA, 522 bp, Artificial Sequence
  Description of Artificial Sequence: Synthetic coding sequence
atgctgctggcatgggtccaggcttttttagtatcaaatatgttattggctgaggcctatggttctggtggctgtttctgggacaacggccacctgtacagagaggatcagacgtcccccgcccccggacttcgctgtctgaattggctggacgctcagagtggtttggcctccgcccctgtctcgggagctggaaaccacagttactgcagaaaccctgatgaggacccaaggggaccttggtgctacgtgtctggcgaggccggggtcccggagaaaaggccctgcgaggatctcaggtgccctgaaacaaccagtcaggcccttccagcatttactaccgaaatccaggaggcttcagaaggacccggtgctgacgaagttcaggttttcgcaccagctaatgccctaccggctcggtcggaggcagccgcagtacagccagtgatcgggattagccagagggtccggatgaattccaaggaaaagaaagatttaggcaccctcggaggacggatctag

SEQ ID NO: 28858 - DNA, 555 bp, Artificial Sequence
  Description of Artificial Sequence: Synthetic coding sequence
atgttgctggcatgggtccaggccttcctcgtaagcaatatgctcctggctgaggcgtatgggtccggtgagactacatctcaggcgctgccagccttcaccacagaaatccaagaggcctctgagggacctggggccgatgaagtgcaggtgtttgcccccgccaatgctcttccggcacgcagcgaggctgcagctgttcagcccgttattggaatctctcaacgcgtcaggatgaacagtaaggaaaagaaggacttgggaaccctggggtacgtcctcggtatcactatgatggtgatcatcattgccatcggcgccggcattatcctagggtactcctataaacgcggcaaggaccttaaggagcaacacgaccagaaggtttgtgaaagggaaatgcagcgtatcaccttaccgttatctgcattcactaatcctacctgcgagatcgtagacgagaaaaccgtggttgtgcatacctcacaaacacccgtggacccccaagaaggcacaactcctttgatgggacaagcaggtacgccaggcgcatag

SEQ ID NO: 28859 - DNA, 2538 bp, Artificial Sequence
  Description of Artificial Sequence: Synthetic coding sequence
caattcgttcaaccagaagagcgtagacaaggcagtctcctaggccccggacttccgagtcatgcacttggcacactcgctaaagtggcagggcgtcaagatgccgcgcctccggggggctccgccgcttctgaagagcgagaggagggacccagcgtggaagcattagcagtctctaaagccgactgttatgtgcagctttggttaccaacagcatccccttccccagcccaaacacgcattgtggccaactgctcagaccctgaatggaacgagacattccactaccagattcacggggctgttaagaacgtcctcgaactaaccctctatgacaaagacattctgggcagtgaccagctgtctcttctgctattcgatctccggtccctgaagtgtggccagccacataaacatacgttcccacttaatcaccaagacagccaggaattacaagttgaatttgtgttagagaagtcccaagtgcccgcatctgaagtcattaccaacggggtgctggtcgctcacccttgcctacggattcagggtaccctcaggggtgatgggaccgctcctcgtgaagagtatggatctagacagctgcagctagccgtgcctggcgcttacgaaaaaccccagctcctccccttgcagcctcctactgaaccagggcttccaccgacatttaccttccacgtgaatcctgtcttgagcagccgactgcatgtggaacttatggaactgttagcagctgttcagagcggaccctctgccgagctggaggcccagacaagtaagttgggcgaggggggcattctgctctcctctcttcctctgggtcaagaggagcagtgtagcgtggcattgggtgagggtcaggaagttgctctgtcaatgaaggtggagatgtcctctggcgacctggatcttcgactgggtttcgacctctctgatggggaacaggagttcctcgaccgccgaaaacaggtggtttcgaaggctctccaacaagtcttgggcctgagtgaagctctagacagcggccaggtaccagtcgtggcggtcttggggagcggaggtggaacaagagccatgtcatccctgtacgggtccctggctgggttacaggaattaggcctcctggacaccgttacttatctgtccggagtctccggctctacctggtgcatcagtacattgtaccgtgatcctgcctggagccaggttgcactgcagggtcccattgagcgggctcaagtgcatgtttgcagcagcaagatgggggccctctcaacggaaaggttgcagtactatacccaagagttgggggtgcgggaacggtctggccattcagtctcactcatagatctttgggggctcctggtggagtacttattgtaccaggaagaaaacccagctaagctgagcgaccagcaggaggctgtgcggcagggtcagaacccctatcccatctacacaagtgtcaacgtgagaaccaacttgtcaggcgaggactttgccgagtggtgcgagtttaccccatacgaagtaggattccccaaatacggcgcttatgtccctacagagttgttcggttccgaacttttcatgggtagactgctccagctgcagcctgaacctcgcatctgttatttgcaggggatgtgggggtccgcattcgcaacctcacttgacgaaatctttctgaagaccgccggaagtggcctctcattcctcgagtggtacaggggtagtgttaatatcacggacgattgccaaaagccccaactgcacaacccgtccaggttgcgcacacggctgctgactccacagggcccttttagccaggccgtgcttgatatctttacctcaaggttcacatccgcccagtcattcaatttcactcgcggcttgtgcctccataaagattacgttgccggccgggagttcgtggcttggaaagacactcatccagacgccttcccaaatcagctgactccaatgcgcgattgtctatatctcgtcgatgggggcttcgctataaattcacccttcccactggcactgctgcctcagcgcgccgtggacctcatcctgagctttgattacagtctggaagcacctttcgaagtactgaaaatgaccgaaaaatattgtctggatagaggcatccctttccccagcattgaagtcggaccggaagacatggaggaggctagggaatgttatctctttgcaaaagctgaggatcccagaagccctatcgtactacactttccactagtgaaccggactttccgcacacacctcgcccccggcgttgaaagacagaccgccgaggagaaggcttttggtgatttcgtgatcaaccggccggatacgccttacggcatgatgaactttacttacgaaccacaggacttctatcggttagtggctttgtctcgttacaacgtcctgaataacgtcgagacgctcaaatgcgctctccagctggctcttgatagacatcaggcccgagagagggctggtgcatag

SEQ ID NO: 28860 - DNA, 1365 bp, Artificial Sequence
  Description of Artificial Sequence: Synthetic coding sequence
atgctgtgggccctatggccacgttggctcgcagacaagatgttgcctctgctgggcgccgtgctattgcagaagcgtgaaaaaagaggccccctgtggagacattggcggagggagacttacccctattacgacttacaggtgaaggtgttgagagccaccaacatcaggggcacagatctccttagcaaagctgattgttacgtgcagctctggctgcccactgcttctccttcaccggcgcaaacccgtattgtggctaattgctccgacccagagtggaacgaaacatttcactaccaaatccacggcgccgtgaagaatgtcttggagctcaccctgtatgacaaggacatactaggttctgatcagctatctctgttgttgtttgaccttaggtccctgaagtgtggccaaccacacaagcacacctttcccttgaaccaccaggatagtcaggagctccaggtggagtttgtgcttgaaaaatcgcaagtgcccgcctctgaggttattacgaatggggtactggtcgctcacccctgtctgaggatccagggaaccttacggggggatgggaccgcacccagagaggaatacggcagccgtcagctgcagctagcagttcctggcgcctatgaaaagcctcagctcctgcctctacagcctcccactgagccaggtctgccgcctacctttacatttcacgtgaatccagtcttgtcctctcgcctacacgttgagctgatggaactgctggccgccgtacagagtgggccaagcgcagaattggaagcacagacaagcaaacttggtgaaggaggaattctgttaagctcactgccactcgggcaggaggaacagtgctccgtggcactcggagagggccaagaagtcgcactgtctatgaaagtggaaatgagctccggcgacctggatctgcggctgggctttgatctgtcggacggggagcaagaatttctcgatagacgaaagcaggtggtttccaaagccctccagcaggtgcttggattatctgaggcccttgacagtgggcaagttccagtagtcgccgttttaggctcagggggtggcactagagctatgtcatcactgtatggatcactcgctggacttcaggagttaggcttgctcgacaccgtgacttacctttctggagtaagtgggtcaacatggtgtatctccacactatatcgggatccagcgtggagtcaagtggccttgcagggtcctatcgagcgcgcccaagtccatgtgtgctcttccaaggtcggcgacgtgcgcgtgtctccttgtcagttgccccgcttgcactcttctaacctggatcattccctgtggtag

SEQ ID NO: 28861 - DNA, 2550 bp, Artificial Sequence
  Description of Artificial Sequence: Synthetic coding sequence
atgttgtgggctctgtggcccaggtggctggccgataagatgttaccattactcggagctgtcctgcttcaaaaacgagagaagcggggccccttatggcgccactggcgacgtgagacttatccttactacgatttgcaggtcaaggttctccgggctactaatatccgggggaccgacctgttatctaaagcagactgctacgtgcagctttggttgcccactgcctccccaagtccagcccagacgagaatcgtagctaattgttccgatccagagtggaatgagacgttccactaccagatccacggggccgtcaagaatgtgttggagctcacactctatgataaggatatcttgggaagcgaccaactgtctctgttactatttgatctgcggtctctgaaatgtggccaaccacacaagcataccttccccttaaatcatcaggactcacaagagctgcaggtagagttcgtgctggaaaaatcccaggtgcccgctagcgaggtcattactaatggcgtcctagtagcacacccttgcctcagaattcagggaactttacggggggacggcacggccccacgtgaggaatatggctccaggcagctgcagttagccgtccccggagcctatgaaaagccacagctgcttccattacagcctcccacggagcccgggcttcctcccaccttcacattccatgtgaatccggtgttgagttcccgccttcacgttgaactcatggagctattggccgctgtccaatccgggccatcagcggagctggaagctcagacgtccaagcttggtgagggcggcatcttgttgtcctcgttgccattggggcaggaggaacaatgtagcgttgcactgggggaaggccaggaagtggccctttcgatgaaagtggagatgtcttctggcgacctggatctgcggttgggcttcgacctgtctgatggggagcaggagtttttggaccgccgtaaacaggttgtgagtaaggcactgcaacaagtcctaggcctttccgaagccctggattcaggccaagtccccgtggtggccgtcctaggctccgggggaggaacacgcgcgatgagcagcctgtatggaagtctggccggtctacaggaactcggcctcctagacaccgtgacctatcttagtggagttagtgggtcaacatggtgtatcagtaccctttatcgggatcctgcatggtcccaggttgctttacagggtcctattgagcgagcccaggtgcacgtttgctcttccaaaatgggagcactgtctacagagagactgcagtactacacgcaggaactcggcgtgagagagcgcagcggacactcagtgtccctcatagatctgtggggtcttcttgtagaatatctgctctatcaggaagagaatcctgccaaattgtctgaccaacaagaagccgttaggcaaggacagaacccctatcccatctacacttctgtgaatgtgcgtaccaacctctccggagaggacttcgctgagtggtgcgagtttactccttatgaggttgggtttcccaagtacggtgcctatgttcctaccgaactgttcggatctgaactgtttatgggacgtctcctacagttacagccagagccacgcatatgttatctacagggtatgtggggttccgcctttgctacctctttggacgagatatttttgaagactgcaggatcaggattgagtttcctggagtggtatagagggagcgtgaacattaccgacgactgtcagaagcctcagctgcacaacccaagccgccttcgtacccggctgcttaccccgcaaggcccattctcacaggctgtgttggacatcttcaccagccgattcacttctgcacagtctttcaacttcacacgcggcttatgtctgcacaaagattacgtcgccgggcgagagtttgtggcctggaaagatacccacccagatgcgttcccaaaccagttaacccctatgagagactgcctgtatctggtggacggcggttttgctattaatagtccatttcctcttgccttgctgccgcagagggccgtggacctgattttatcattcgattacagtctggaggcaccatttgaggtgctcaagatgaccgagaagtactgtctcgatagagggattccctttcctagtattgaggtcgggcccgaagacatggaagaagcacgagagtgctacctgttcgctaaggccgaagacccacgaagcccaatcgtgttacatttcccgctggtgaatcgtacctttcgcacccacctcgcccccggggtggaacgacagaccgccgaagagaaagcattcggagattttgtcattaatcggcccgatactccttacggaatgatgaactttacctacgagccgcaggacttttatcgactggtagctctaagtcgctataacgtgttaaataacgtggaaaccctgaaatgcgctctgcagctggctctagacaggcaccaggccagagagcgcgccggtgcctag

SEQ ID NO: 28862 - DNA, 2556 bp, Artificial Sequence
  Description of Artificial Sequence: Synthetic coding sequence
atgctgtgggcgctgtggcctcggtggttggcagacaagatgttgcctctcctaggcgccgtactgttgcagaagcgcgagaagcgcggcccactctggaggcattggcgacgggagacctacccctactatgatttgcaagtgaaggtgttaagagccacaaacatccggggcacagacctgctgtccaaggctgactgttacgtacagttatggctcccaaccgctagcccctcaccagctcagaccagaattgtcgcaaactgttcagaccctgagtggaacgagactttccattaccagattcacggggccgtgaagaatgtcctggagctgacgctgtatgacaaggatatcctcggaagcgaccagctcagcctcttgttatttgatctacggagtctaaaatgcgggcagccgcacaaacacacattccccctcaatcaccaggacagccaggagctccaggtggaattcgtcctggagaagtcgcaagtgcctgccagcgaggttattaccaacggagtgttggttgctcatccgtgtttaagaatccaaggcacattgaggggagatggcacagccccccgcgaggagtacggatcaagacagctgcagcttgccgtgccaggtgcttacgagaaacctcagctactgcccctacagccgccaaccgagcctgggctgccacccacttttaccttccacgtgaatcccgttctatcatcgcggctccatgtggagctgatggaattgctggccgccgtccagtctggcccgtctgcggagctggaggcacagacatctaaactgggagagggtggaattcttctgtctagcctccccctcggacaggaggaacaatgcagcgtggctctgggagagggtcaggaagtcgccctgtccatgaaagtggagatgagcagtggcgaccttgacctccgcctggggttcgatttgtccgacggggagcaagagttcctggatcggcggaagcaggtggtgtctaaggctctgcagcaggtactgggcctcagcgaggcccttgatagtggacagacccaagtaccggtcgtggcagtgctcggttccggtgggggtacccgcgcaatgtcctccctatacggctccctggcaggactgcaagagctcggactgcttgataccgtaacttatctgtcaggagtctccggttctacctggtgtatatccaccttataccgagatccggcctggtcacaggttgctcttcaggggcccattgaaagggcacaggttcacgtctgttcatcaaagatgggtgcacttagcaccgagagactgcagtactacactcaggagctcggggtgcgggaaaggtcagggcacagtgtgagcctgattgacttgtggggtctgctggtggagtacttattgtaccaggaggaaaacccggctaagttgtccgatcagcaggaggcagtgaggcaaggtcagaacccgtacccaatctatacatcggtcaatgtccggaccaacctgagtggcgaggacttcgctgagtggtgcgaattcacgccatacgaagtagggtttccaaagtacggcgcttacgtgcctacagagctgttcgggtcagaactcttcatgggtcgactcctgcagctacagcctgagcctcgcatctgctatttacagggtatgtgggggtcggcctttgcgacctcacttgatgagatcttcctcaagactgcaggttctggtctatcgtttttggaatggtacagaggcagcgttaacataactgacgactgtcagaagccccagctccacaatccaagtaggctacgcactcggctgctaacacctcaggggcccttttcccaagccgtgctcgacattttcacgtctcgctttacctctgcccagtcttttaacttcacccgagggctttgcctgcacaaagattatgtggctgggcgggaattcgtagcctggaaggatactcacccagatgcttttcccaaccagcttaccccaatgagggactgcctttatttggtggacggagggttcgcaattaacagcccgttcccccttgcactgctgcctcagcgcgctgttgatctcatcctgtccttcgactatagcctggaggcgccgtttgaggttctcaagatgaccgagaagtactgtcttgacaggggaatccctttcccgtcgatcgaggtggggcctgaggatatggaggaagcgagagagtgttaccttttcgccaaagcggaagacccccgttcccctatcgttctgcacttcccactcgtgaataggaccttcaggacccacctagcccctggtgtggagaggcagactgccgaggagaaggctttcggcgacttcgtgataaaccgccccgacaccccttatggaatgatgaatttcacttatgagccccaggacttctatagactggttgccttatccaggtacaacgtccttaacaacgtggaaacacttaagtgcgctctccagctagcacttgataggcaccaggcccgcgaaagagcaggggcttag

SEQ ID NO: 28863 - DNA, 2598 bp, Artificial Sequence
  Description of Artificial Sequence: Synthetic coding sequence
atgctctgggccctctggccccgttggctggctgataagatgctgcctctattgggagccgtgcttttgcaaaagagagaaaagcgggggcccttatggcggcactggcgacgggagacctatccatactatgacctgcaggtgaaggtactgagggccactaacattcgcggaacggacctattgagcaaggcagactgttacgtgcaactttggttgcccactgcctcaccctctcctgcacaaaccaggatcgtcgcaaactgttctgatcccgaatggaatgaaaccttccattatcagatccatggagccgtgaaaaatgtgctcgaattgaccctctatgataaagacattctaggatctgatcagctatccttgttgctgtttgatctgcgctcactgaagtgcggacagccgcataaacatactttccctttaaaccatcaagatagccaggaattgcaagttgagtttgtcctcgaaaagtcccaggttccagcctctgaggtcataaccaatggcgtgctggtcgcccatccttgtctgcgtattcaagggactctccgtggcgatggcacagctcctagagaagaatacgggtctcgtcagcttcagttagccgtgcctggagcatacgaaaagccccagctcttgccactgcagccaccaactgaacccggccttcccccaacctttacgttccacgtgaacccagttctgtcgtcgcgattacatgtcgagctgatggagctgttggcggcagtccagtccgggccgtcagcggagctcgaagctcagacaagtaagctaggtgaagggggaatcctgctgtctagtctgccacttggacaggaagaacaatgcagtgtggctctgggagaagggcaggaggtggccctgtccatgaaggtagaaatgagttcaggagatctggacctgaggctgggctttgatcttagcgacggcgaacaggaattcctggaccgtcgtaagcaggtggtttccaaggccttgcagcaagtgttggggttgtccgaggcgctagacagtgggcaggttcctgttgtcgctgtgctaggcagcggaggcggaacgcgagctatgtcaagtctctatggcagtctggcaggcctccaagaactggggctcttggacacagtgacgtatctcagcggcgtctccggaagtacatggtgcatcagtacgttgtaccgggacccggcctggagccaagtcgccctgcagggacccattgaaagggcacaggtgcacgtgtgcagctcgaagatgggcgccctgtccaccgaacgcctacagtactatacacaggagttaggcgtgagggagcgatccggacactccgtcagtctcatcgatctatggggtttgttggtggaatacttgctgtaccaagaagaaaatccggcgaagctaagtgatcagcaggaggcagtccgtcaagggcaaaatccttaccctatctatacatcagtgaatgtgagaacgaatctcagcggcgaagatttcgctgagtggtgtgaatttactccatacgaggtgggctttcctaaatacggagcctatgtcccaacggagctgttcgggagtgaactctttatgggaagattattacagctgcagcctgagcctcgaatttgttacttacagggaatgtggggcagcgcctttgctacttcactggatgaaattttcctcaagactgcgggatcaggtctgtcatttctcgagtggtaccgcggctcagtcaatattactgacgattgtcagaagccacagctccataaccctagccgtctcaggactcggcttctgactccccaggggcctttctctcaagccgttctcgatatatttactagccgctttacaagcgcccagagtttcaattttactaggggattatgtctgcacaaggactatgtggctggccgcgagttcgtagcatggaaagatacgcatcccgatgccttccctaaccaactgactccgatgagggattgcttgtatctggtcgacggtggcttcgctattaattcccccttccctctggctctgctgccgcagcgcgctgtggacctcattttatccttcgattactcacttgaggcgccattcgaagtgcttaagatgacagagaaatactgcttggaccgtggaatcccatttcccagcatagaagttggacccgaagatatggaagaggcgcgggagtgttatttatttgctaaggccgaggaccccaggtcccccatcgtgttacactttcccctcgttaataggaccttcagaacccacctcgcccctggagtggagaggcagacagctgaggagaaggcctttggggattttgtcattaacagacccgacaccccttacgggatgatgaatttcacatacgaaccccaggatttctataggctcgtggctttaagcagatataatgttctaaataatgtagaaactttaaagtgcgcccacccccggcatcggaggacgtcagaggggccatctcctcagacacacactgaacagggactcagagctttgcgcagtcagctgtcatccctgcactag

SEQ ID NO: 28864 - DNA, 1770 bp, Artificial Sequence
  Description of Artificial Sequence: Synthetic coding sequence
atggtgggtcagatgtactgctacccgggtagtcacttggcacgggccctgacaagggccctcgccctggcgcttgttctcgctctactagtagggccttttctcagtggcctggcaggtgctatacctgctccaggaggtaggtgggcgcgggacggccaagtacctccagcatcccgctcaagatctgttctgcttgatgtctctgccggtcagctcctgatggtggacggacggcacccagatgcagtcgcatgggctaatcttaccaacgcaatccgagaaacaggttgggccttcctcgagctggggacaagtggacagtataatgatagtctacaggcgtacgccgctggtgtcgtggaggccgccgtcagtgaggaactgatttacatgcactggatgaacaccgttgtcaattactgcggaccattcgaatacgaggtgggctattgcgagcgcctgaagtcattcctggaagctaaccttgaatggatgcaggaagaaatggagtccaacccggattcaccttactggcaccaggtccgtctcaccttgttgcagctgaagggactggaggattcctacgaaggcagggttagttttcccgcagggaaatttactattaagccattaggcttcctgctgctgcagctgtctggcgatctggaagatctcgagctcgctctgaacaaaacaaaaatcaaacccagcctgggaagcggcagctgttccgctttgatcaagctgcttcccgggcagagcgacttgttggtggctcacaacacctggaacaattatcagcatatgctgagggtgattaagaagtactggctacagtttagagaaggcccttggggcgactatccgctcgtgcccggcaacaaactagtgttttcttcgtatcccgggaccatcttcagttgtgacgatttttacattctcgggagcggtctagtgactcttgagacaaccattggcaataaaaatccggctttgtggaaatatgtccgacctaggggatgtgtgctggagtgggtgcgtaatattgttgctaatcgtctggcgagcgatggggccacttgggccgatatcttcaaacggtttaacagcggcacttataataaccaatggatgattgtcgactacaaggcattcatccccgggggacctagccctggcagcagagttctgaccatcctcgagcagattcccggaatggtggtcgtggccgacaagacatctgaactctatcagaagacttactgggcctcatacaacatcccaagctttgaaacagtttttaatgccagtggcctacaggctctggttgctcagtatggtgattggttctcatacgacggctcccctagagcccagatcttccgtcgcaatcagagcttagtccaagatatggattcaatggtgcgattaatgcgctataatgactttctgcacgatccactgtctctgtgcaaagcatgtaatccacaaccgaacggggagaatgcaatttcggcaaggtccgacttaaatcccgcaaatggtagttacccgtttcaggccctgaggcagcgttcccatggcggaattgacgtcaaagtaaccagtatgagcttagctcgaatcctgtcgttactggccgcatccggcccgacttgggaccaggttccaccattccagtggagcacatccccgttttcagggctgctgcatatggggcaaccggacctgtggaagtttgccccggtcaaagtgtcatgggactag

SEQ ID NO: 28865 - DNA, 1674 bp, Artificial Sequence
  Description of Artificial Sequence: Synthetic coding sequence
atggtgggccagatgtattgttaccccgggagccacctggctcgcgctctgactcgagctctggccctggctctggtgcttgcattactcgtaggcccttttctgtcgggactcgcaggggccatccccgcccctggaggccggtgggctcgggatggacaggtcccacccgcttctcggtcccgatctgtgcttctggacgtgtcagctgggcagttgctaatggtggatggtcggcaccccgatgccgttgcttgggccaatctcacgaacgccattcgtgaaacaggctgggctttcctggagctgggcacgtctggtcaatataacgactcgctgcaggcttacgcagccggggtcgtcgaggcagccgtttcagaggaattaatttatatgcactggatgaacacagtggtgaactattgcggcccatttgagtatgaggtgggttactgcgaacgactcaaaagcttcctggaagctaatctggagtggatgcaagaagaaatggagtctaacccagatagtccttattggcatcaagtgaggctgacattgctgcaactgaagggtttagaggactcttacgaaggccgggtgagttttccggccggaaagttcaccatcaagccgctcgggttcttgctgctgcagctctccggggacttagaggacctggaacttgccctcaataaaacgaagatcaagccttcattagggtcgggaagctgcagcgcactcataaagttgttacctggacagtctgacttgctggtcgcgcacaatacgtggaacaactaccagcacatgttacgcgtgataaaaaagtactggctgcagttcagagagggtccttggggagactaccccttggttcctgggaataagctggttttcagttcttatccggggacgatatttagctgcgacgatttttacatactcggctccggactggtgactctggaaacaactatcgggaacaagaatcccgctctctggaaatacgtacggccaagaggctgtgttcttgaatgggtcagaaatatcgttgcgaatcgattggcttccgacggcgctacatgggccgacatcttcaagaggttcaactcaggaaccggaatggtggtggtggcggacaaaactagtgaactgtatcaaaaaacctactgggcaagttacaatatccccagtttcgagaccgtattcaacgctagtggcctccaagcgttggtggcacagtatggcgattggttctcctatgatggatctccacgcgcccagatttttcgccggaaccaaagtctggttcaggacatggacagcatggtgcgactgatgaggtacaatgacttcctccatgacccgttgagcctctgcaaggcttgcaatccccagcctaacggcgagaatgcaatctctgctaggtccgacctgaaccccgcaaacggttcctaccctttccaggcactccggcaacgctcccatggaggaatcgacgtcaaggttacttcaatgtccctggcccgcattctgagcctcctcgcggcaagcggaccaacttgggaccaggtcccccctttccagtggtccacatcgccattttcaggtcttctgcatatggggcagcctgatctgtggaaatttgctcctgtgaaggtttcatgggattag

SEQ ID NO: 28866 - DNA, 1473 bp, Artificial Sequence
  Description of Artificial Sequence: Synthetic coding sequence
atgaaaccaaagctgatgtatcaagaacttaaggtgccagcggaggaaccagccaacgagcttccaatgaacgagatcgaggcttggaaggccgctgaaaaaaaagcaaggtgggtgctgctggtgttgatcctggctgtcgtcggatttggtgccttaatgacacagttgttcctgtgggaatacggcgacttgcacctgttcggacctaaccagcgccccgccccttgctacgacccttgtgaagctgtgctggtggagtccatccccgaaggattggactttcccaacgcatccactggtaatcccagtacgagccaggcatggctgggcttgctggccggagcccacagcagcctcgatatcgcttcgttttattggaccttaacaaataacgacacacacacacaggagcctagcgcccagcagggcgaagaggtgttgcgacagttgcagacgttggcacccaaaggggtcaacgtgcgtatcgctgtctccaaaccgtccggaccccagcctcaggcagatcttcaggctctcttgcagagcggtgctcaggttagaatggtggatatgcagaagctgacacatggtgtgctccatacaaaattctgggttgtggaccaaacccatttttacttaggatcggcaaacatggactggaggtccctaacccaggtgaaggagctgggggtggtgatgtataactgttcgtgtctggcccgggaccttacaaagatctttgaggcttactggttcctggggcaggccggctccagtatcccatcaacttggcctagattctacgataccaggtataatcaggagactcctatggagatctgcctcaatgggactccagctctggcctacctggcatccgccccgccacctttatgtccctcaggccgaactcccgaccttaaagccctgctgaatgtggtggacaatgcgagatcctttatctacgtggctgttatgaactacctgcccaccctggaatttagtcatcctcatagattctggcccgctattgatgacggcttgcgacgggcaacctacgagcggggggtgaaggtgcgactcctgatatcatgttggggccacagcgagccctcaatgagggcctttttgctgtcactcgcagccttacgcgataatcatactcactctgacattcaggtcaaattattcgtggtgcctgcggacgaggcccaagcccgcataccttacgctcgcgtgaatcacaacaaatacatggtcactgagcgcgccacttacataggaactagtaactggtctgggaattacttcacggagacagcaggcacctcactgctggtgacacaaaatggaaggggaggcctacggtcacagctcgaagctatcttcctccgagactgggattctccctatagtcacgatctggatacctccgcagattccgtggggaacgcctgcaggttgctctag

SEQ ID NO: 28867 - DNA, 534 bp, Artificial Sequence
  Description of Artificial Sequence: Synthetic coding sequence
atgaaaccaaaattgatgtaccaggagcttaaggttcccgccgaggagcccgcgaacgaactccctatgaacgagattgaggcctggaaggctgcggagaagaaagctaggtgggtcctgctggtactcatactggcggtggtgggttttggggccctgatgactcagctgttcctttgggagtatggggacctgcatctgtttggcccaaatcaacggcctgccccctgttatgacccctgcgaagccgtgctcgtagagagcattccagaaggactggattttcctaacgcttccacaggaaatccttctacgtcgcaggcttggctgggactcttagccggagctcactcctccctggatatcgccagcttctattggactcttaccaataacgacacccacacccaggagccatcagcacaacaaggggaggaggtgttgcgacagctgcagactcttgctcctaaaggagtcaacgtgaggatcgctgtctctaagccgtccggtcctcagccacaggcagacctatag

SEQ ID NO: 28868 - DNA, 390 bp, Artificial Sequence
  Description of Artificial Sequence: Synthetic coding sequence
atgaaaccaaagctgatgtaccaagagttaaaggtgccagcagaagaaccggcaaacgaactgccaatgaacgaaatcgaagcatggaaggctgcagaaaagaaggcccggtgggtactacttgtacttattttagctgtggtcggtttcggggccctgatgacacagctcttcctgtgggagtatggagacctgcacctgttcggacccaaccagaggccagctccctgctatgacccatgtgaggcagtcctcgtggaatctattcccgagggtctggacttccccaacgcgagcaccggcaaccctagcacctcacaggcctggctggggttgttggcaggtgcacactcatctcttgatatcgcatctttctattggactctgtag

SEQ ID NO: 28869 - DNA, 1473 bp, Artificial Sequence
  Description of Artificial Sequence: Synthetic coding sequence
atgaaacctaagttgatgtatcaggagcttaaggtccctgctgaagaaccagctaacgaactccccatgaacgaaatcgaggcctggaaggcagccgaaaaaaaagctcgatgggtgctcttggtgctgatccttgcagttgttggtttcggggccctgatgacacagctgtttctctgggagtatggagacctgcacctttttggtcccaaccagcgacctgctccctgttatgatccgtgtgaggctgtgctggtagagtcaatccccgaaggattggattttcctaacgcatccactggaaacccgtcaacctctcaggcatggctgggactgctggccggagctcatagcagcttggacatcgcctctttttactggacactgactaataacgatacacatacacaggagcctagcgcccagcagggggaggaagttctgcggcagttacagaccttagcgccaaaaggggtcaatgtgcggattgcagtctcaaagccctccggaccccagccacaggccgacctccaggccctgcttcagagcggggctcaggtgcggatggtcgatatgcaaaaactgacccatggcgtgcttcacacaaagttctgggtcgtcgaccagacccacttttacctgggcagcgcaaacatggactggcggtcgctcacccaggtcaaagaactgggggtggtaatgtacaactgtagttgcctggcgcgcgacttgacaaagatcttcgaggcatactggttcctcggccaggcgggaagctctatcccatcaacgtggccccgattttatgatacaaggtacaaccaggagactccaatggagatctgccttaatggtacccctgccctcgcatatctggctagtgcgccccctccactttgcccttctggccgcacacccgacttaaaagcactgctgaacgtagtcgataacgcccgctcttttatctatgtcgcagtcatgaactatctgcctaccttggaatttagtcatcctcacagattttggcctgcgatagacgacggtctgcgtcgcgccacctacgagcggggcgtgaaagtccgactgttgattagttgctggggacactccgaacccagcatgcgtgcatttctgcttagccttgccgcactgagagataaccacacgcattccgacatccaggtgaaacttttcgtggtccccgctgatgaagcccaggcacggatcccttatgcccgtgtgaaccacaacaagtacatggtgactgagcgagccacctacattgggaccagcaattggagtggtaactactttacagaaaccgccggaacttccctgctggttacacagaacggccgagggggcctgcgaagccaactggaagctatttttctcagagactgggattccccatattctcacgatctagatacctccgcagattccgtgggcaacgcgtgtcgactgctctag

SEQ ID NO: 28870 - DNA, 1473 bp, Artificial Sequence
  Description of Artificial Sequence: Synthetic coding sequence
atgaaacctaaactgatgtatcaggaactgaaagtgcccgctgaagaacccgccaatgaactccccatgaatgagattgaggcttggaaagcagctgagaagaaagcacggtgggtcctgctggtgctcattcttgccgtggttggcttcggcgccctgatgactcagcttttcctgtgggagtacggagacctgcacctttttgggcctaatcagcgccccgcaccctgctacgatccatgcgaagccgtgctcgttgaatcaatccccgaagggctggacttccctaatgcctcgactggcaaccctagcacatctcaagcatggctgggcctccttgccggcgctcactcttccctcgacattgcctccttctattggactctgactaataacgatacccatacgcaagagcctagcgcacagcaaggcgaagaagtgctgcgccagctacagacactggcacctaagggcgtaaacgtgcgtattgctgtcagcaagccatccggtcctcaaccccaagccgacctgcaggccctcttacagagcggcgcacaagtaaggatggtcgacatgcaaaaactgacacacggagttctccacaccaaattttgggtcgtggatcagacccatttctatttaggcagtgccaacatggattggaggtccttgacgcaggtgaaagaactgggggtcgttatgtataactgttcctgcttagctcgagacctgacgaaaatcttcgaagcctactggttcctaggtcaggcagggagctctattccctcgacatggcccaggttctatgatacccgttacaatcaggaaactccgatggagatctgtctgaacgggacccccgccctagcctacctggcatctgctcctcctccgctgtgtccttccggacggactcccgacctgaaagccctgttaaacgttgtggataacgcgagatcattcatatacgtcgccgtgatgaactacctgcctaccttagagttcagtcacccccaccggttctggccagccatcgacgatggtctgagaagggctacctatgagaggggagtaaaggtccggttactcatcagctgctggggccactcagaaccaagcatgcgcgccttcttgttgagtttggccgcgctgagggataatcacacccactccgacatacaggtgaagttgtttgtggtgccagccgatgaggcgcaggctcgaatcccctacgcaagagtcaaccataacaaatatatggtcaccgaaagggccacgtatatcggaacaagcaactggagcggaaattattttaccgagaccgcgggtacatctctgcttgttacacaaaacgggcgcggagggctgcggagccagttggaggcaatctttttgcgggactgggactccccatatagtcacgatctggacacttccgccgattctgtcgggaacgcatgcagactactttag

SEQ ID NO: 28871 - DNA, 1473 bp, Artificial Sequence
  Description of Artificial Sequence: Synthetic coding sequence
atgaaacccaaactgatgtaccaggagttgaaggtccctgctgaggagccagctaacgaattacctatgaacgagatcgaggcttggaaggcagcagagaagaaggctaggtgggttttgcttgttcttattctcgcggttgtgggattcggcgcactgatgacccagttattcttgtgggaatacggcgatctccatttgttcggccctaaccagaggcccgccccttgttatgacccctgtgaagccgtcctggtggaatccatcccagagggactagactttcccaatgcttctacggggaacccttcgacttcccaggcctggctaggactgttggccggagctcattccagtctcgacattgcatcgttctattggaccttaaccaataatgatacccatacccaagaaccatctgcacagcagggcgaggaagtgctgcgtcaactgcagaccctggcacctaaaggcgtgaacgttagaatcgcagtgtctaaaccaagcggcccccaacctcaagctgatctgcaggccctgctccagagtggggcgcaggtacggatggtggacatgcagaagctaacccacggagtgctacacacgaagttctgggttgtggatcaaacacatttctatctcggcagcgcgaacatggattggagatcgctgactcaggtgaaggagcttggggtcgtgatgtataactgcagttgcctggctagggacttgacaaagatctttgaagcgtattggtttcttggccaggctggctcttccatccccagcacctggcctcggttctacgacacacggtacaatcaggaaacgccaatggaaatatgtttgaatggtacccccgccctggcatatctcgctagtgcgccacctcctttgtgcccatccggcaggaccccggatctgaaagcgctgctgaatgttgtggataacgcaagaagctttatctatgtggctgtgatgaactaccttcccactctcgaattcagtcatccccatagattctggcccgccatcgatgacggcctccgtagagctacctacgaaagaggtgtaaaagtgcgcctgctgatcagctgctggggccacagcgaaccgagcatgcgagctttcttactatcattagccgccctcagggacaatcacactcattcagatatccaagtgaaactatttgtagtgcctgctgacgaggcacaagctcggatcccatatgcccgggtcaatcacaacaaatatatggtgacagaaagggcaacctatattggcacgagcaactggtctggtaactacttcacggaaacagccgggacaagcctcctggtgacccagaacggtcgtgggggcctcaggagtcagttggaggctatctttctcagggactgggatagcccctactcgcacgatttggatacctccgccgacagtgtaggaaacgcatgcaggcttctgtag

SEQ ID NO: 28872 - DNA, 1473 bp, Artificial Sequence
  Description of Artificial Sequence: Synthetic coding sequence
atgaagcctaaactgatgtatcaggagcttaaagttccagcagaagaacctgccaacgaactgcctatgaacgagatagaagcctggaaagcagccgagaagaaggcccgttgggtgttactggtgcttatcctcgctgttgtgggttttggtgcattgatgacacaactcttcctctgggagtatggagatctccacctgttcggtcccaaccagagacctgctccctgctacgacccatgcgaagctgtcttggtcgagtcaatacccgagggcctcgacttcccaaatgcttcaacaggcaacccttccacctcccaagcgtggctggggctactggccggagctcacagttctctggatatagcatccttttactggaccctgaccaataacgacacccatacccaggaaccctcagcccagcaaggagaggaggtcttgcgacaactccagactctggcccccaaaggagtaaacgtgagaatcgcagtgtctaaaccttcggggccacagccacaagccgacctgcaggctctgttgcagtccggagcacaagtcaggatggtggacatgcagaagctcacacatggggtcctccacaccaagttttgggtggtggaccaaacccacttctatcttggcagcgctaacatggattggagaagcctgacgcaggtgaaagagctgggggtggttatgtataactgctcctgtcttgcaagggatttgacaaagatctttgaagcatattggttcctcgggcaagccggcagctctataccatccacatggcccagattttacgacacgaggtacaaccaggagacccccatggaaatttgcctgaacggcacacccgccctggcttatttggcttcagctccccctcccctctgcccttctggaaggacccccgatcttaaggcactgctcaacgttgtagacaatgcgaggagctttatatatgttgccgtcatgaactatctacctaccttggagttctcacacccacacaggttctggcctgctatagacgatggactccggcgagctacttacgagagaggtgtgaaagtccgacttctcatttcgtgctgggggcacagcgagccaagcatgcgggccttcctactgtctctcgccgcgctgcgcgataatcatacccacagcgatatacaggttaaactatttgttgtccccgctgacgaagctcaggcccgcatcccatacgctagggtgaaccacaataaatacatggttaccgaaagggcgacctacatagggaccagtaactggtcgggcaactatttcactgaaactgccgggaccagccttctagtcacccagaatggtcgcggcgggctgaggtcccagttggaagccatatttttaagggattgggatagcccatatagccatgatttagacacttctgctgattcggtgggtaacgcctgtcggttgctctag

SEQ ID NO: 28873 - DNA, 1209 bp, Artificial Sequence
  Description of Artificial Sequence: Synthetic coding sequence
atgaaaccaaagctgatgtaccaggaactgaaggtccctgccgaggagcccgctaacgaactgcctatgaacgagatcgaggcttggaaggctgccgaaaagaaggcacggtgggtgctgcttgtcctaattctagccgtggtcggattcggagccttgatgacacaactgtttctgtgggaatacggggatctccacctctttggcccaaaccaacgtcccgctccctgttatgacccgtgcgaggccgtgctggtggagtctattcccgagggactcctggccggcgctcattcttcattagatattgcctcattttactggacccttaccaataacgatacccacacccaggaaccaagtgcccagcaaggagaggaggtccttagacagctccagaccctcgcgcccaaaggcgtgaatgtacggattgctgtctcaaagcccagcggcccacagccacaagctgacttgcaggctctgctgcagagtggggcacaggtacgcatggttgatatgcagaaactgacgcacggcgtgttacatactaagttttgggttgttgaccagacgcacttttacctcggtagcgctaacatggattggagatctctgactcaggtgaaagagctgggagtcgttatgtacaactgttcatgcttagctagggatcttaccaagatcttcgaggcctattggtttctgggtcaggcaggatcttctataccgagcacttggcctaggttctacgatacacggtacaatcaagaaacccccatggaaatctgtttgaacggcacacctgcgctggcctacctggctagcgctccgccaccactgtgtccctccggtcggacccccgacttgaaagctctgttaaatgtggtggataacgcgaggtctttcatctatgtggctgttatgaactacctgcccaccctggaattttcccatccacataggttctggccggccatcgatgacgggctgcgacgggcaacatacgaaagaggtgtgaaggtacggctattaatctcatgttggggacattccgaaccttcaatgagagcattcctgctgagccttgcggccctgagagataatcatactcacagcgacatccaggtcaaactgttcgtggtccccgccgacgaagcccaggccctgagtcccgccctgcccccccttcccccaccacctccggcctag

SEQ ID NO: 28874 - DNA, 1521 bp, Artificial Sequence
  Description of Artificial Sequence: Synthetic coding sequence
atgttaaagcccttatggaaagcagccgtggcccccacttggccatgctccatgcctccgaggaggccatgggatagggaggcaggaacccttcaggtgctgggcgctctggctgttctttggctgggctccgtcgccctgatctgcttgttgtggcaggtgccaagacccccgacttgggggcaggttcagcccaaagacgtcccacgctcttgggagcacgggtcctccccagcttgggaacccctggaggccgaggcaaggcagcagcgcgattcgtgtcagttagtcctagtcgaatctataccacaggaccttccgtccgctgcaggcagcccctcagcccaaccactgggccaggcttggcttcagctgctggacacagcccaggaaagtgttcatgtggcctcatactattggtctctcactggacctgacatcggagtgaacgattcttctagccagctcggggaggccctgctgcagaagctgcagcaactgctcggacgcaacatatctctggcagtcgctacctcttctcctactctggcccgtacatctacagatctgcaggtgctcgctgcccggggggctcacgtgcggcaagtgcccatgggccgtttgacaaggggagtgctgcacagtaaattctgggtagtagatggccgccatatttacatggggagcgctaatatggattggcgatctcttacccaggttaaggaactgggggccgtgatctacaactgcagccacctggcacaggatcttgaaaaaacgtttcagacctactgggtgctgggggtacctaaagcagtgctgccgaaaacctggccacagaacttttcatctcatttcaaccgtttccagccattccatgggctctttgatggagtgcctactaccgcatacttttctgcatcacctccagctctctgtccgcagggacgaacgcgtgatcttgaggctctccttgcagtgatgggttcagcacaagaattcatctatgcatccgtgatggaatacttccctaccacgcgattctcccacccaccacgatattggccagtgctcgacaacgcccttcgtgccgccgcttttggcaagggggtacgggttagactattagtcggatgtggtcttaatacggaccccactatgttcccgtatctgagaagccttcaggcattgtcgaaccccgccgccaacgtgtccgtggatgtcaaagttttcatcgtgcctgtgggcaatcattccaacatccctttctctagggtgaaccattctaagtttatggtgacggaaaaagcagcatatattggcacatccaattggagtgaggactactttagcagtaccgctggcgttgggctggttgttacacagtccccaggcgcgcaaccagctggggctaccgtgcaggagcagctaagacaattgttcgaacgcgactggtcttcccgttatgccgtcggtttggatgggcaggccccggggcaggattgcgtctggcagggctag

SEQ ID NO: 28875 - DNA, 1542 bp, Artificial Sequence
  Description of Artificial Sequence: Synthetic coding sequence
atgcccgggtgtcccgtgcagatgcttaagcctctctggaaagcagcggtagctccgacatggccttgcagtatgccaccccggagaccatgggacagggaagcggggacattgcaggtcctgggcgctttagcagtgctatggctgggttctgtagcactgatctgtttgttgtggcaggttccccggccacctacttgggggcaggttcagccaaaggatgtccctagatcttgggagcatggctcttcccctgcgtgggagcctttggaagcagaggccaggcaacagcgcgattcttgccaactggtgctcgtcgagtctatccctcaggatctaccttccgcagctggctcacctagcgcacagccactgggccaggcttggcttcagcttctggacacagcccaagagagtgtgcatgtcgcttcttattactggtctctgaccggacccgacattggagttaacgacagctctagtcagctgggagaggccttgctgcagaagctgcagcaactgcttgggcgaaacatctccttagccgtggcgacaagctcaccaaccctggcccgcacctcgaccgatctgcaagtgcttgccgcgcgtggagcccatgtgcgccaggtgcccatgggaagactgacccgcggcgtgctccatagcaaattctgggtcgtcgatggccgccacatctatatgggcagtgccaatatggattggagatcccttacccaggtcaaggagctgggagccgtcatttataattgttctcacttagctcaagacctggagaaaacgtttcaaacctattgggtgctgggggtgccaaaggcagttctaccaaaaacctggccacagaatttcagctcccatttcaacagattccagcctttccacgggttgttcgacggagtaccaaccacggcctacttcagcgcatctccacccgccttgtgccctcagggccgaacccgcgacctagaggcgctgttggccgtcatgggatcagctcaagagttcatctatgcctccgtgatggaatactttcccaccacacggttttctcaccctcctcggtactggcctgtgctggataatgccctgcgcgctgcagcctttggcaagggagttcgagtgcggctgcttgtgggctgcggactgaacaccgacccaactatgtttccctacttgcggtccctgcaggcactttccaaccctgcagccaacgtgagcgttgacgttaaagtgtttattgtcccagttgggaatcactccaacatccccttctcacgcgtgaaccattccaagtttatggtaaccgagaaggcagcatacatcgggacatccaattggagcgaggattactttagctcaaccgccggggttgggttagtcgttacccagagccctggcgctcagccagctggggccacagtccaggaacagttgaggcagttgtttgaacgggactggtcgtctcgatacgcagttggactcgacgggcaagcacccggccaggattgcgtgtggcaagggtag

SEQ ID NO: 28876 - DNA, 1425 bp, Artificial Sequence
  Description of Artificial Sequence: Synthetic coding sequence
atgagtcaacagaagtgtattgttatatttgctctggtttgctgcttcgctatcctagtggctctgatctttagcgctgttgatattatgggggaagatgaggacggcctctcagagaaaaattgtcagaacaagtgcagaattgccttggtcgagaacatccctgaaggcctgaattatagtgaaaatgcccccttccatttgtccctctttcagggctggatgaatctcctgaacatggctaaaaagagcgttgacattgtgagtagtcactgggatttaaatcacacacaccccagcgcctgtcagggccagcggctgtttgaaaaactgttgcagttgacgtcccagaacatcgagatcaaactcgtctctgatgtcacagcggacagcaaagttctcgaggctttgaagctgaaaggagccgaggtgacctacatgaacatgactgcttataacaaggggaggttgcaatcgtcattctggattgtggataaacagcatgtttacataggttccgctgggctcgattggcagagcctcggccaaatgaaggagctaggggtaattttttacaactgtagctgcctcgtgctagatctccagcggatcttcgcattatactccagcctgaagtttaagagcagagtgccacaaacctggtcaaaacgtttgtatggcgtgtacgacaacgagaagaagttgcagttacagctcaatgaaacaaagtcccaggcttttgtatctaacagcccaaagttgttctgccccaaaaataggtccttcgatatagacgccatatattccgttatcgatgacgccaagcaatacgtttatatcgccgtaatggactatctccccatctctagtactagtacaaaacggacttactggccagatctggacgcaaagattcgcgaggctctggttctaagatctgttagagtgagactactcttatctttttggaaggagacagaccccctcaccttcaatttcattagctcactgaaggcaatatgtaccgaaatcgctaattgttccctgaaggtgaagttcttcgatctggagcgagaaaacgcgtgcgccaccaaagagcagaagaatcacacttttccaaggctgaaccgcaataaatatatggttacagacggtgctgcctacatcggaaattttgactgggttggaaacgactttacgcagaacgccgggactggattggtcatcaatcaggccgacgtccgaaataaccgctccattattaaacagctgaaggacgtgttcgagcgggattggtactctccatacgccaaaactctccagccaacaaaacagccaaactgctcttcactgttcaagctcaagcctctcagcaacaaaaccgcgactgacgataccggagggaaagacccccggaacgtgtag

SEQ ID NO: 28877 - DNA, 1335 bp, Artificial Sequence
  Description of Artificial Sequence: Synthetic coding sequence
atgcgcatggatagtcaaaaaaaaatagcaaagattaatgtaggcaagcggattgcactggtcgagaacattccagagggtctcaattattcggagaatgccccctttcatctgtccctgtttcaggggtggatgaacctacttaatatggccaagaagtccgtagatatcgtgagcagccactgggaccttaaccatacccatcccagtgcttgtcaagggcaaagactgtttgagaagctgctccaactcacctcccagaatattgaaatcaagctggttagcgatgttaccgcggactccaaggtgctcgaagcccttaaactcaagggtgcggaggtgacatacatgaatatgactgcttacaataaggggcgactgcagagttcattctggatagtcgataaacagcacgtgtacataggaagcgcgggcctcgactggcagtcactagggcagatgaaagagttaggggtcatcttctataactgctcttgcttggtgctggatcttcagcgcatctttgccctctactcttccctgaaattcaagtcgcgggtcccccagacttggtccaaaaggctttatggagtgtacgacaacgagaaaaaactgcagttgcagctgaacgagaccaagagccaagcattcgtgtccaattcccctaagttattttgccctaagaatcgctcattcgatattgatgctatctattcagtgattgacgacgcaaagcagtacgtctacatagccgtgatggactatcttccaatctcgtctacctcaacaaagcggacctattggcctgacctggatgccaagatcagggaggctcttgtgctgaggagcgttagggtacgactgcttctgtcgttctggaaggaaaccgaccccctgaccttcaactttatctcttcattaaaggctatttgtaccgaaatcgccaactgtagcttgaaggtgaaattcttcgacctggagcgagagaacgcttgcgctacaaaggagcagaaaaaccacacattcccacggttaaacagaaacaaatacatggtcaccgacggcgcagcctacatcggaaactttgattgggttgggaatgatttcacacaaaacgctgggacgggtctggttattaaccaggcagatgttaggaacaatcggagcatcatcaaacagcttaaagacgtctttgaaagagattggtattctccatacgccaaaaccctgcaaccgactaagcagcccaactgcagtagcctgttcaaattgaagccattatctaataagaccgctaccgatgataccggcggaaaggacccaaggaacgtgtag

SEQ ID NO: 28878 - DNA, 1611 bp, Artificial Sequence
  Description of Artificial Sequence: Synthetic coding sequence
atggagatccgccagcacgaatggctttccgcctctccccacgagggcttcgagcagatgaggctaaagagtcgcccaaaggagccttcacctagtttgacacgggttggtgctaacttttactcaagtgtgaaacagcaggactattccgcttcggtctggttgcggcggaaagataagcttgagcacagccagcaaaaatgtattgttatcttcgcgttggtttgctgtttcgctatacttgtcgccctcattttttcagctgtggacattatgggggaagatgaggatgggctaagtgagaagaactgccaaaataagtgtcggatcgcgctggtagagaatatcccagaaggattgaattatagcgaaaacgcgccgttccatctgtcactgttccagggctggatgaatttgctcaacatggcaaagaaatcagtggacatcgtctccagtcactgggatctaaaccacacacacccgtctgcatgccaggggcagaggttgtttgaaaaacttctgcagcttacaagtcagaacatcgagatcaagttagtgtcagacgtgactgcagacagcaaggtcctggaagccttgaagctcaagggagctgaagtgacttatatgaacatgaccgcctacaacaaaggtcgcttacagtcctctttctggattgtggacaaacaacacgtctatatcgggagcgctggactggactggcagtcactcggacaaatgaaggagctgggagtgatcttctataattgctcttgcctcgtgctggatctccagcgcattttcgccttgtacagttcccttaagttcaaatctagggtgcctcagacatggtctaagcgactgtatggggtttacgacaacgagaaaaaactgcagctgcagttgaacgaaacaaagtctcaggcattcgtgagtaatagcccgaagttattctgcccaaaaaaccggtctttcgacattgatgcaatttatagcgtcatagacgacgcaaaacagtacgtgtacatagcagtcatggattatctgcccatctcatccacaagtacaaagagaacgtactggcccgatctggacgccaaaattcgggaagctctggtactcagatcagtccgggtgcgtctactcttgtccttttggaaggaaacggaccccctgaccttcaatttcatttcaagcctaaaggcaatctgtacggaaatcgccaactgcagcctcaaggttaaatttttcgaccttgagcgagagaacgcctgcgccactaaggagcagaagaaccatacattcccccgcctgaataggaataagtacatggtcacagatggagctgcttacattggaaacttcgactgggtaggaaacgactttacccagaatgccggaaccggacttgtcatcaaccaagctgatgtgagaaataatcgctcgatcattaagcagctgaaggatgtgtttgaaagagactggtactctccttacgcaaagaccctgcaacctacgaagcagcctaactgttcaagtctcttcaagttaaagccactgtctaacaaaacagcaactgacgacaccggagggaaggatccgagaaatgtgtag

SEQ ID NO: 28879 - DNA, 759 bp, Artificial Sequence
  Description of Artificial Sequence: Synthetic coding sequence
atggggcggctgtcctggcaggtggcagctgcggcagccgtgggactcgctcttacactcgaggcgctgccgtgggtcctgagatggctgcgatcaaggcgacggaggccgcgtcgagaggccttgtttttccctagtcaggtgacttgtacagaggccttgctaagggccccaggcgctgaattagctgaattaccggaaggctgcccgtgtggcctccctcacggcgagagcgcactgtcaaggttgctgcgcgctctcctggccgccagagccagtttggatctctgtctgttcgctttcagttccccccagcttggacgggccgtgcagcttttacaccagcggggagtgagagtacgtgtagtgaccgactgtgattacatggctcttaatgggtcccagataggcctcctgcggaaggctggaatccaagtgcggcacgatcaggacccggggtacatgcaccacaagttcgctatcgtggataagcgggtactgatcacaggatctttgaactggactacccaggccatccagaacaatagagagaatgttctcataaccgaagacgatgagtatgtaagactgtttctggaggaattcgagaggatttgggagcagttcaaccccacaaaatacacatttttccccccaaagaagagtcacggctcctgcgctcctcctgtatctagggctgggggacgcctattgtcttggcatagaacatgcggaacttcgtccgagtcccagacttag

SEQ ID NO: 28880 - DNA, 528 bp, Artificial Sequence
  Description of Artificial Sequence: Synthetic coding sequence
atgggacggctctcatggcaggttgcagccgcagccagaggggccgtgttaccggtgtccggcgatctatatagagggcctgccgcaggaagtggcagaggggctggccgggccccaagaggcttgccggtacgccccgctcctcgtagggagcgtgctaaaccccccgccgcttgccctgctggccgccctagacagcccggatcactcccggtgcggctgctgcagccagctgccgggccaaggcgcgcagtggcggctcctgcatggggggcctcggctgggcgacaccggctgagattacatggcccccaacgactggccaatcgctctgcagcccagggcagggaccccggacctgctagaagccgtccaagattgcatgctagtcaggtatgccatcgagggcaggaaggcgctcatcactggttggcccagcttgatcacgcgtcccatcccgagcagcagggagaatgtagccaccatggggggaggcgagtgcgcgcagccttctccgggaggatttag

SEQ ID NO: 28881 - DNA, 678 bp, Artificial Sequence
  Description of Artificial Sequence: Synthetic coding sequence
atggtgtcacatagcgagctccgcaagttgttttattctgctgacgcagtctgctttgatgttgactctaccgttatccgagaagaaggcatcgatgaactcgcgaaaatctgtggagtggaggatgccgtttctgaaatgacgcgacgagccatgggcggcgcagtgccctttaaggccgcactcaccgaacgccttgctcttattcagccctctcgggagcaggtccaacgcctgattgcagagcagcctccacatctcacacccggcatccgcgaactggtgtccaggctgcaggaacggaatgtccaagtgttcctgatctccggcggtttccggagtatcgtcgaacatgtagcttcgaagctgaatattcctgcgacaaacgtgttcgctaacagactcaagttctacttcaatggagaatatgcagggtttgacgagacacagcctacagcagaatccggcggcaagggtaaagtgataaaacttctaaaggagaagttccatttcaagaaaattataatgattggagacggagcaacagacatggaggcatgccccccagccgacgctttcatcggctttggggggaacgtgatccgccaacaagtcaaagataatgctaaatggtacatcactgattttgttgagcttctaggggagctggaggagtag

SEQ ID NO: 28882 - DNA, 678 bp, Artificial Sequence
  Description of Artificial Sequence: Synthetic coding sequence
atggtgtcccactccgagctccgcaagctgttttatagtgcagacgccgtgtgctttgatgtggacagcaccgtcattagagaagaggggattgatgaattggcgaaaatctgcggcgtcgaggacgcggtcagcgagatgacccgcagagccatggggggcgctgtgccattcaaagcggcactcactgaacggctcgctctcattcaaccaagtagagaacaggtgcagcgacttatagccgagcagcctcctcacttgacccccggtatcagggagttagtcagccgcctgcaagagcggaacgtgcaagtttttctgatctctggcgggtttcggagcatcgtcgagcacgtggccagcaagctaaacatcccagccaccaacgtgttcgctaaccggctgaaattctatttcaacggtgaatatgcaggtttcgacgagactcaacccacagcagagtccggtggcaaagggaaagtaattaagttactgaaggagaaatttcatttcaagaaaataatcatgatcggtgatggagccacagatatggaagcttgccctcccgcagatgcctttattggctttggcggaaacgtcattcggcagcaggttaaggacaatgccaagtggtacataactgactttgtcgaattgttgggcgaactagaagagtag

SEQ ID NO: 28883 - DNA, 9 bp, Artificial Sequence
  Description of Artificial Sequence: Synthetic coding sequence
atggtgtag

SEQ ID NO: 28884 - DNA, 9 bp, Artificial Sequence
  Description of Artificial Sequence: Synthetic coding sequence
atggtttag

SEQ ID NO: 28885 - DNA, 141 bp, Artificial Sequence
  Description of Artificial Sequence: Synthetic coding sequence
atggtatctcatagcgaactgcggaagcttttctactccgccgacgctgtatgtttcgatgttgatagcacagtcatccgtgaagaaggcatcgatgagctagccaaaatctgtggggtcgaagacgctgtctctgagtag

SEQ ID NO: 28886 - DNA, 141 bp, Artificial Sequence
  Description of Artificial Sequence: Synthetic coding sequence
atggtatcgcatagtgagctccggaaacttttctactctgcagatgcagtctgcttcgacgtggatagcacagtcattcgcgaagagggcatcgatgaacttgcgaaaatctgtggtgttgaggatgctgtttcagagtag

SEQ ID NO: 28887 - DNA, 564 bp, Artificial Sequence
  Description of Artificial Sequence: Synthetic coding sequence
atggtcagccattcagaactgcggaagctcttctactctgctgatgcagtgtgctttgatgtggactctaccgtgatccgagaagaaggaatcgatgagctggccaaaatttgtggagtggaagatgccgtgtccgagatgacacggagagccatgggcggggccgtgccgtttaaggccgccctgaccgaaagacttgcccttattcagccttcacgagagcaggtgcagcgcttaatcgccgagcagccaccacatctaactcccgggattagagaacttgtatctcggctgcaggagcgtaacgtgcaggtttttttgatttccggaggttttaggtctatagtcgagcatgtggcatcaaagcttaacattccagcgacaaatgttttcgccaatagactcaagttttacttcaatggggaatacgcaggatttgacgaaactcagcccaccgcggaaagtggagggaaaggaaaggtaattaaacttcttaaagaaaaatttcacttcaagaaaattatcatgatcggggatggcgcaacagatatggaggcatgttag

SEQ ID NO: 28888 - DNA, 33 bp, Artificial Sequence
  Description of Artificial Sequence: Synthetic coding sequence
atggtgagccattctgagttgagaaagctctag

SEQ ID NO: 28889 - DNA, 678 bp, Artificial Sequence
  Description of Artificial Sequence: Synthetic coding sequence
atggtgtcccacagcgaactgcggaaactcttctactcagcggacgcagtctgtttcgacgttgactcaacagtaatcagagaagaaggcatcgatgaattagcgaaaatctgcggtgtcgaggatgccgtttcagagatgacgagacgcgctatgggaggagcagttccgttcaaggccgcactgaccgagaggctggccctgatccagccgtcccgcgaacaggtgcagaggttgatcgcagaacagccgccccatctgacgcctggcatccgggaattggtgtccaggctgcaggagcgaaacgttcaggtattccttatctctggtgggttcaggtctatcgtcgagcacgttgcctcaaagcttaatatccctgccacgaatgtgtttgcaaatcggttgaagttctatttcaatggcgagtacgcaggcttcgacgaaactcagccaactgccgaatcaggagggaagggcaaggttatcaagctccttaaggagaaattccactttaaaaagatcatcatgattggggatggagctacagatatggaagcatgcccaccagccgacgccttcataggctttggcggcaacgttattaggcagcaggtgaaagataacgcgaaatggtatatcacagactttgtagaattattgggggagctggaagaatag

SEQ ID NO: 28890 - DNA, 1047 bp, Artificial Sequence
  Description of Artificial Sequence: Synthetic coding sequence
atgaagaccgcggaaaacatcagaggcacaggctcagacggtcctcgtaaacgaggactgtgtgtcctttgtggcctccctgctgccgggaagtcgacattcgctcgggcactggcccacagattgcaacaggagcagggctgggctataggggtcgtggcctacgacgatgttatgcccgatgcctttctggcaggtgctcgggcaagacccgctcccagccagtggaaactgctgaggcaggagctgctgaaatacctcgaatattttctcatggccgtcattaacggatgtcagatgtcagttcctcccaataggaccgaagccatgtgggaagactttatcacttgtctcaaggatcaagaccttatcttctccgccgcattcgaggcccagagttgctatctgttgacaaagaccgcagtgagtaggcctcttttcctggtgctggatgacaacttttattaccagtcaatgcgttatgaggtgtaccagctggccagaaagtactcgctggggttctgccagttatttcttgattgtcctttggagacctgccttcagcgcaacggacagcgcccacaagctctgcccccagaaactatacacctgatgggccgtaagctggaaaagccaaatcctgagaagaacgcctgggaacacaattcccttactatcccatctcctgcgtgcgctagtgaagccagtctggaggttacagatctcctcctcacggccctggagaatcctgtgaagtatgcagaagacaacatggagcagaaggacacagaccgcataatctgtagtacgaacattcttcataagactgatcagaccttacgccgcattgtttctcagacaatgaaagaagccaaaggcaatcaggaggccttctctgaaatgaccttcaagcaaagatgggtccgcgcgaaccatgctgctatctggcgtattatattagggaacgagcacatcaagtgtaggtccgccaaggtgggctggctgcagtgctgccgcatagaaaaacggcccttatccactggatag

SEQ ID NO: 28891 - DNA, 870 bp, Artificial Sequence
  Description of Artificial Sequence: Synthetic coding sequence
atgaaaaccgcagaaaatattcgaggcactggaagcgacggtccacgcaagagaggcctctgcgtattgtgtgggctccctgctgcaggcaaatctactttcgcccgcgctctggcacatcgccttcagcaggagcagggatgggcaattggtgtcgtcgcttacgacgacgtaatgcccgatgcttttctggcaggcgccagagcacggccagcaccaagtcagtggaagttgctaaggcaggaattactcaagtacttggagtactttctaatggcggtcatcaatggttgtcaaatgtcggtcccccctaatcggacagaagccatgtgggaagattttataacctgtctcaaagatcaggaccttatattctctgccgccttcgaagcccaaagttgctacctgctgaccaagactgccgtgtctcggcccctgttcctcgtgttagatgacaacttctactatcagtccatgcggtacgaagtttaccagttggccaggaagtactccctgggtttctgccagttgttcttggactgtcctctggaaacatgtctgcaacggaacgggcaacgaccccaagccttgccccctgagactattcacctgatgggcaggaaactggaaaagcccaatcctgagaagaacgcatgggaacacaattcattaaccattccctctcctgcgtgcgcctccgaagcctctctcgaagttacggacctgctgctgacggccctggaaaatcccgtaaagtacgctgaagataacatggagcaaaaagtaaacttccagtgtaagtttaatgtgaatgaaaaagagcagctattcgtgggcagaagtttcgagccaaatatcaaatgcgagtag

SEQ ID NO: 28892 - DNA, 1080 bp, Artificial Sequence
  Description of Artificial Sequence: Synthetic coding sequence
taaatgaaaacagcggaaaatattaggggcacggggtcagacgggcctaggaagcgaggactgtgcgtgctctgtggtttaccggccgctggcaagtcaacattcgccagggcgctcgcacatagattgcagcaggagcaggggtgggccatcggagtggtcgcctacgacgatgtaatgccagatgcattcctggcaggcgcccgcgcccggcccgccccgtctcagtggaaacttcttagacaggaattactcaaatacctggagtacttcctgatggcggttattaacggctgtcaaatgagcgttcctcccaaccggacggaggctatgtgggaagactttattacttgccttaaagaccaggacctgattttctctgccgcttttgaagctcagtcttgctatttactcacaaagactgccgtgagccgccccctcttcctggtgttggacgacaacttctattaccaaagtatgagatatgaggtttaccagctggctcgtaagtattctctgggattctgccagttgtttctggactgccccttagagacatgcctgcaacgcaacggccagagaccacaagccctgcctcccgagaccatccatcttatgggaagaaaattggaaaagccaaaccccgagaagaatgcctgggagcataatagcctaactatccccagccccgcatgtgcgagcgaggcctccctggaagtaactgacctactgcttacagcactcgaaaaccccgtcaagtatgctgaggacaatatggagcagaaggacaccgaccgaatcatttgcagtacgaacatcctgcataagaccgaccagacactcagacgcattgtcagccagaccatgaaagaggccaaggacgagcaggtactgcctcataacctcaagctgctggctgaagaacttaacaagctaaaggccgaattcctggaggacttaaaacagggtaataaaaagtatctctgtttccagcagaccatcgacattcccgatgttatatccttttttcactacgagaaagacaatattgtccaaaagtatttttctaagcagcactag

SEQ ID NO: 28893 - DNA, 7566 bp, Artificial Sequence
  Description of Artificial Sequence: Synthetic coding sequence
atggaacctcatgtcttgggagccgtgctgtactggctcttacttccctgtgccttgctggcagcttgtctgctcagattctccgggctatcactagtatacttactgttcttgctgctcctgccgtggtttcccgggcccactagatgcggccttcaaggtcacacgggccgacttctgagagctctcctcggcttaagtctcctttttctggtggcacaccttgcgctacagatctgcctgcacatcgtgcctagattggatcagctgctcgggccttcatgttcccgctgggagaccttgagcaggcacataggtgttacgcgtctggacctgaaagacataccgaacgcaattcggttagttgctccagatctggggatcctggtcgtttcctcggtctgcctcgggatctgcggtcggctggcgcgaaatactcgacagagcccccatcccagagagcttgacgatgacgagagagacgtggatgcctcgcccacggctggactgcaggaggccgcaaccttggcccctacacgtcgatcaagactggccgcccggttcagagtcacagcccattggctgcttgtcgccgccggccgggttttagctgtgactctcctcgcactcgcaggtattgcgcatccctccgcactgtccagcgtttatctgcttctattccttgccctgtgcacatggtgggcgtgccatttccccatctcgacacgagggttttcccggctgtgtgtggctgtggggtgctttggagcgggccatctgatctgtctctattgctaccaaatgcctctggcacaggccttactgccgccagctggtatctgggcgcgggtcctgggccttaaagacttcgttggcccaacgaattgctccagcccccacgcactcgttctcaataccgggcttgactggcctgtatatgcctcccccggcgtgttgctgctgctgtgttacgctacggccagtctccgcaaattgcgcgcttatagacccagtgggcagaggaaggaagcagcaaaggggtatgaggcacgggaattggaactcgctgagctggatcagtggccacaggagagagagtctgatcagcacgttgtccctacagctccggacaccgaagcagacaactgcatcgtgcacgagctcacggggcagtcttctgtactgagaaggcccgtgagacctaagcgagctgaaccacgagaagcttcccccctccacagcctcggccatcttattatggatcagtcctatgtatgcgcgctgatcgccatgatggtgtggtcgataacttatcacagctggcttactttcgtcctgctgctgtgggcttgccttatttggaccgtgagatcgagacaccagctcgctatgctgtgctctccatgcatcctgctgtacggcatgaccctttgctgtctgaggtacgtttgggccatggacttgagacccgagctgcctacaaccctaggtccagtgagcctgaggcagctggggttagaacacaccaggtacccctgcttagatcttggggccatgttgctctacacactgaccttttggctgctcttgaggcaattcgtgaaggaaaaactcctcaaatgggcagagagtccggccgcactgaccgaggtgaccgtggctgatacagaacccactcgaacccagaccctcttacagagcctgggcgagcttgtgaaaggggtgtacgctaaatattggatttacgtatgcgcgggaatgttcatcgtagtgtcattcgccggccgtttggtggtgtacaagattgtgtatatgttcctctttctgctttgtctgacattatttcaggtgtattacagcctgtggcgtaaactcttgaaagccttttggtggctcgtcgtggcttacaccatgctggtcctaatcgctgtgtataccttccaatttcaggacttcccagcttactggcgtaacttgactggattcaccgacgaacagcttggggatttgggcctggagcagtttagcgtgtctgaactgttttcttccattttggtgccaggattcttcctgttggcctgtatcctgcaactgcactactttcacagacctttcatgcagctcactgacatggagcatgtttcgctgcctggcacacgacttccgaggtgggcacaccggcaagatgccgtttccgggaccccactgctcagggaggagcagcaggaacaccaacaacagcagcaggaagaggaagaggaagaagaagattcccgagatgagggcttgggcgtggctaccccccaccaggctacccaggtacccgagggagcagccaaatggggcctagtggccgagcgactcctggagctggctgccgggttctctgatgttctgagcagggtccaagtgttcctgcggcgcctgcttgagctccacgtcttcaaattggtggccctttacaccgtgtgggtcgccctgaaagaagtgtctgttatgaaccttctcctcgttgtcctgtgggcattcgcattgccttacccacgtttcagacccatggcaagttgtcttagcacggtatggacatgtgtgataatcgtttgcaagatgctctaccagcttaaagtggttaatcctcaggagtattcaagcaactgcacagagccctttccgaattctaccaacctgctcccaactgaaatatctcagtctttactgtatcgcggcccagtggacccggccaattggttcggggtgcgaaaaggctttcccaatctgggctatatccaaaaccatctccaggtgctgctgctcctggtgtttgaagctattgtctacagaagacaggaacattacagacgacagcaccagcttgctcccctgcctgcccaggcggtgtttgcctctggcacgcggcagcagctggatcaagacctgctcggatgcctgaagtactttatcaatttctttttctacaaatttggcttagaaatctgctttttgatggctgtcaacgtgattgggcagcgtatgaactttctggtgactctccatggctgctggctggtggccatacttacccggcgccaccgccaggctatcgcgaggctttggccaaactactgcttattcctagctctgttcctgctataccagtatctgctgtgcctgggaatgcccccagctctgtgcattgattatccatggaggtggtccagggccgttcccatgaattccgcgttaatcaagtggctctaccttcctgatttcttcagagcgcccaatagcactaatctgattagcgatttcctactgctgctctgcgcctctcaacagtggcaggtgttctcagccgagcgcactgaagaatggcagagaatggcaggagttaacactgaccgcttagagcccctccgtggcgagcccaatcccgtaccgaacttcattcattgccggagttacctggacatgttgaaggtggctgtgttcaggtatctgttttggttggtcttggtagtggtgttcgtaacaggagccactcgcatctccatatttgggcttgggtaccttcttgcttgtttttacctgctgctgttcggaaccgcattgctgcagcgtgatactagagcgagactcgttctgtgggattgtcttatcctatacaatgtgacagtgatcatctccaaaaatatgctatctctcctggcatgcgtcttcgttgaacagatgcagacagggttctgttgggtaattcaactgttctccctggtttgcaccgtcaaggggtactacgaccccaaggagatgatggatagagaccaagattgcctgctgccagttgaggaagctggcattatatgggactctgtctgcttctttttcctcctgctgcagcgacgagttttccttagtcactattatttgcacgtgagggctgacctccaagcgactgcactgctggccagccgaggattcgccttgtataacgctgctaacctgaagagcatcgattttcatcgtcggatcgaagagaagagcctggcccaacttaaacgacaaatggagcggatcagagccaagcaggagaagcatagacaaggaagagtagaccggtctcggcctcaggataccctgggccccaaggatcccgggctggagcccggccccgatagccctggtggctctagtccaccacggcgtcagtggtggaggccatggctcgaccacgctactgtgattcattctggggattactttctgttcgaatccgactccgaggaggaggaggaagcagtgcccgaggacccacgcccaagcgcccaatcggctttccagctggcataccaggcatgggtgaccaacgctcaggctgtgctgcgcaggcggcagcaggaacaggagcaggctagacaggaacaggctgggcagctcccaacaggcggtggccccagccaggaagtcgagcccgccgaagggccagaggaggctgccgccgggcggagccacgtggtgcagcgcgtgctgtccacggcccagtttctgtggatgctgggccaggcgctggtcgatgaattaacccgttggttgcaggagtttaccagacatcacggtactatgtccgacgtactaagagccgagcgatatttgctcacccaagagctgctccagggcggcgaggtccaccgcggagtgctggaccagttatacacttcccaagccgaagcaacactccccggcccaaccgaagcacctaacgctccttccaccgtttctagtggcctgggcgcagaggagccgctgagttctatgacggacgatatgggctctcccctctccactggttaccatacgcgctccggcagcgaagaagccgtgactgatccaggtgagagagaagctggggcaagcctgtaccagggcctaatgagaaccgcaagcgagctgttattggataggcgcctaagaattccagaactggaagaagctgaactgtttgcggaggggcagggaagggctttgcgcttactgagggcagtgtatcagtgcgttgcagcgcatagtgaactcttgtgctacttcatcatcatcctgaatcacatggtcaccgcttccgccgggtcgcttgtgctgcccgtactggtgtttctttgggccatgctatcgatccctaggccctcgaagagattttggatgactgcaatcgtttttacggagattgccgtggtcgtcaagtacttgttccaatttggcttctttccatggaactcccacgtggtgctacgccgatacgagaacaagccctactttcccccccgaatcctggggctggagaagaccgatggctatatcaaatacgatctggtgcagcttatggccctcttcttccatcgctcccagctattgtgctacggactgtgggaccacgaggaggacagccctagtaaggagcatgacaagagcggcgaagaggaacagggagcagaagaagggcctggtgtgcctgccgcgaccaccgaagatcacatccaggtcgaagcaagggtgggacccacggacggaactccggagccccaggtagagctccgtcctagggatactcgccgcatatccctgcgcttccgacgtcgcaagaaggaagggccagcccggaagggcgccgccgctattgaagctgaagatagagaggaagaggagggcgaggaagagaaggaggcccctaccggcagggagaagaggccaagtagaagcgggggccgggtacgagcagccgggaggaggctccaaggattttgcctttcactcgcccaaggcacctatcgccctctccgtcgcttctttcatgacattttacatacgaaatacagagccgccacagacgtgtacgccttgatgtttctcgcagatgtcgtcgactttataataataatttttggattttgggcttttggaaaacatagcgccgctaccgatatcacgtccagtctgagtgatgatcaggtgccagaagccttcttagtgatgctgctgattcagttctcaaccatggtggtggatagggccctgtacctccggaagacagtactcgggaagttggcttttcaagtggctttagtcctcgcaatacatttgtggatgttctttatattgccagccgtcactgagagaatgtttaaccagaacgtcgtggcacagctctggtactttgtaaagtgtatctacttcgccctaagcgcatatcagatccggtgtgggtaccccacgcgcattctgggcaacttccttaccaaaaagtacaatcacctgaacttattccttttccaagggttccggctggtcccttttctggtagaactgagggccgttatggactgggtatggactgacaccaccctaagtcttagtagctggatgtgcgtggaggacatctatgccaacattttcattattaagtgctctcgggaaacagaaaagaaataccctcagcccaagggacagaagaagaaaaaaattgtcaagtatggtatgggaggtttgatcatactgtttctgatcgccatcatatggtttcctctcttattcatgagtctggtgaggtctgtggtgggcgtcgtgaaccagcccatagatgtcaccgtcacacttaagttgggaggctacgagcccctctttacgatgagtgcacagcagccatctatcattccttttactgcccaggcctacgaggaattgagccgccagttcgaccctcagccactggctatgcaattcattagccagtattctccagaggatatcgtcactgctcagattgaaggctccagcggggctttgtggcggatcagtccaccatccagagcccagatgaaaagggagctttacaatggcaccgccgacattactctccggtttacttggaacttccaaagggatttagcaaaaggcgggacagtcgaatatgcgaacgaaaaacatatgttggctctcgcacccaacagcacagcccgccgtcagctggccagtttgctggagggaacaagcgatcagtccgtggttattcctaatctatttccaaagtatatccgagcccctaacgggcccgaggcaaacccggtgaagcagctgcagccaaacgaagaggcagattatctgggggtgcggattcagctacgtagggaacagggcgccggagctactggattcctcgaatggtgggttatagaattgcaggaatgtcgaaccgattgtaatttactcccgatggtgatcttctcggacaaagtgagtcctccttccctcggcttcttagccggatatggcatcatgggactttatgtgagcatagttctcgttattggaaaattcgttcgtgggtttttttccgaaatctcccactctattatgttcgaagagttgccgtgtgtggataggattctgaaactgtgccaagatatatttttagtacgggagactagagaactggaacttgaggaagagctgtacgcgaagctgatcttcctctatagatcccctgagaccatgattaagtggactagggaaaaagaatag

SEQ ID NO: 28894 - DNA, 1122 bp, Artificial Sequence
  Description of Artificial Sequence: Synthetic coding sequence
atgaaaatctgtcctttttcatcaaagagtagcattgtgctcgcccttaagttcaggtccctcattcacttcgagaaatacccacagcccaaggggcagaagaaaaaaaaaatagtgaaatatggaatggggggcctgattattctattcctgatcgctattatttggttccctctgctttttatgtccctcgttagatccgttgtgggagtggtaaaccagccgatcgacgtgaccgttacactgaaactgggaggctatgaaccactgttcacaatgagcgctcagcagccttcgatcatcccttttacggcgcaggcctatgaggagctcagcagacagttcgatccccagcccctcgctatgcagttcatttcacagtacagccctgaggatatcgttactgcacagatagagggctcttcaggtgccttatggcgtattagtccaccatccagggctcaaatgaaacgggaactctataacggcactgcagatattacccttaggttcacatggaacttccagagggatctggcaaagggtggcactgtggaatatgccaacgaaaagcatatgctggctttggccccaaactcaactgcccgaaggcaactcgcaagcttgctggaaggtacctccgatcagagcgtcgtcataccgaatctgttccctaaatatatccgtgctcctaatgggcctgaggccaatccagtgaagcaactccaacccaacgaggaggccgattatttgggggtgcgtatacaactgcgccgcgagcagggagccggagcaaccgggttcctcgagtggtgggtgatcgaactgcaggagtgccgcacagattgcaacctcctgccaatggttatttttagcgacaaacaccatggggcagtgagagttcatagagctggacacagacaggtccgagctagaatccttcagagggatctcgctctacactacgtcagaggggccgcagtccgaggaccacatccccaggcgctaccgggccacctacccggtgcaggggacagcggtgccggcgccggggggggtgtggtgcgccaggcccacttgcctcttcccctgacaggcgatcacgaccaagtggactcctag

SEQ ID NO: 28895 - DNA, 7404 bp, Artificial Sequence
  Description of Artificial Sequence: Synthetic coding sequence
tgaaccggacggcttttgcgcgctctgcttgggctgagtcttttatttctggttgctcacttagctctgcagatttgtttgcacatcgttccccggctggaccaactgcttggccccagttgtagtcgctgggagacactgtctcgccacatcggggtcacccgcctggatctgaaagacatccctaacgccatcaggctggtggcccccgatctgggcatcctggtcgtcagcagtgtgtgtctcggcatctgtggccgactggcgaggaatactaggcaatccccacaccctcgagaactggatgacgacgagcgagatgtggatgccagccccacagcagggttgcaagaagctgccacgttagctccaacccggcgtagcagactggctgcgaggttccgagtcactgcccattggctcctcgtcgccgccggtcgagttctggcagtaactctgctggccctggcaggaatagctcacccgagcgcactttccagtgtttatttactcctcttcttggccctctgcacctggtgggcgtgtcactttcccatctctacgcgcggattttcacgcctgtgcgtggctgtcggatgcttcggtgccggtcatctcatctgtctgtattgttaccagatgccattggctcaggctctgctgcctcccgccggaatctgggcaagggttcttggcctaaaagacttcgtcggtcccacgaattgcagctctccgcacgcccttgtcttgaacacaggtttggattggcctgtttatgcgagcccaggggtgttgttgttactatgttacgctactgccagcttacggaagctccgggcctatcggccctcaggccagaggaaggaggccgctaagggttatgaagccagagaattggaactcgcagagctggaccagtggcctcaggaacgcgagagcgaccagcacgtggtccccacagctcctgacacggaggctgataactgtatcgtgcacgaactgaccggacaatcaagtgtgctgagacgccccgtgagacctaagagagctgaacctcgcgaagcctcgccacttcacagcctaggccacctcatcatggaccagtcctatgtctgtgccctgatcgccatgatggtatggtccattacataccatagttggttgacattcgtgctgttattatgggcgtgcctaatttggacagtccggagccgacatcaactggcaatgctctgttctccatgcatcttgctctatgggatgactctatgttgtctgcgatacgtatgggcaatggatctgcgacctgaactgcctaccaccttggggcccgtgtcactccggcagctgggccttgaacacacccgatatccatgcttagaccttggggctatgcttctctacacactgactttttggcttttgctaaggcaatttgtgaaagaaaagctgttaaaatgggctgaatctccggccgcgctcaccgaagtcacagtggccgacacagaacctacacgcactcaaaccctcctgcaatcactcggagaacttgtgaaaggagtctatgcaaaatactggatctatgtgtgcgctggaatgtttatcgtggtgtcttttgccgggcggctggtggtttacaagatcgtctatatgtttctcttcttactctgcttgactttattccaggtatattacagcctttggagaaagctgctgaaagcattctggtggcttgtggtggcctacacgatgttggtgttaattgcggtgtacacattccagtttcaggattttccagcttactggcggaatctcacgggatttacggatgaacagcttggggacctgggactggagcagttttccgtctctgaactgttctccagcatcctggtgccaggattcttcttgctagcctgcattctccagcttcattacttccatagaccttttatgcagttaactgacatggagcacgtttcattgccaggaacccgactgcctcgatgggcccatcgacaggatgccgttagcggcacaccactcctgagggaagagcagcaggaacatcaacaacaacagcaggaggaagaggaagaagaagaggattccagggacgagggtttaggggtggctacaccacaccaggcgactcaagtgcctgaaggggcagctaagtggggtcttgtggccgagaggctcctagaactcgctgcggggttctccgacgtgctgtctcgcgtccaggtctttttgcgcagactactggaattgcatgttttcaaactagtcgccttatatactgtatgggtggcgctcaaagaagtgtcagttatgaacttgctgctagtggtactgtgggcatttgctctgccttatcctagattcaggcctatggccagttgtctttcaaccgtctggacatgtgttatcatcgtctgtaaaatgctataccagcttaaagtggttaacccacaggaatactcatctaattgcaccgagccattccctaattccaccaatcttctgccaactgaaatcagtcagtcactgctatatagaggtcctgttgaccccgctaattggttcggggtgagaaaaggatttcctaacctggggtatattcagaatcaccttcaggtgctgttgctcttagtttttgaggctatagtgtaccgccgtcaggagcactacagacggcaacatcaacttgcccccctgcccgcccaggcagtcttcgcctcggggaccaggcaacagctggaccaggacctgctggggtgtcttaagtattttattaacttttttttctacaaatttgggctggaaatctgctttttaatggctgtgaatgtgatcggtcagcgtatgaatttcttggtgactctccatggctgttggctggtggccatactcacaagacgccaccgccaggcaattgcacgcctgtggccgaactactgtctgttccttgccctctttctgctttatcagtacctattgtgtctgggcatgccaccagctctttgcatagattatccatggcgctggagcagagcagtgcctatgaactccgccctgattaagtggctgtacctacccgattttttcagggcacctaactccaccaacctcatctcagattttcttctcttactgtgcgcatctcagcagtggcaagttttctccgccgagcgaacggaagaatggcagaggatggccggagttaacactgacaggctggagccacttaggggcgaacccaacccagtgccgaactttatacattgccggagctatctggacatgcttaaagtagcagtcttccgctatcttttctggcttgtgctggttgtcgtcttcgtcacgggcgcaacccggatcagcatatttggacttggatacttactggcctgtttctacttactgctctttggaactgctttgttgcaaagggataccagagccagacttgtgctctgggattgcttgattttgtacaacgtgacagtcataatcagcaaaaacatgctgagtctactggcctgcgtgttcgtggagcaaatgcaaacaggattttgttgggtgattcagttgttctcgttggtttgcaccgttaagggctactacgatcctaaagaaatgatggaccgcgaccaggattgcctgctgccagttgaggaggcaggaataatctgggacagcgtctgtttcttcttcctcctattacagcgccgggtgttcctgtctcactattacctccatgtgagggccgacctgcaggcaacagctttacttgcctctcggggatttgctctgtataacgccgcgaaccttaagagcatcgatttccatcgacggatagaggaaaagagcctggcgcagctgaagcgccagatggagaggatcagagcaaagcaggagaaacatcgccaagggcgggttgatcggagtcggccccaggacactctgggcccaaaggacccaggtctggaacccggacccgattcaccaggcggcagctccccaccccgtcggcagtggtggaggccctggctggaccacgccacagtgatccatagcggcgactactttctgttcgaatctgacagcgaggaggaagaagaggccgtccctgaggacccaaggccttctgcacagtctgcgttccaacttgcataccaggcgtgggttaccaacgcacaagctgtgctgaggaggaggcaacaggaacaagaacaggcacgtcaggagcaggccggccagttgcctaccggcgggggcccaagccaggaagtggagccggcagaggggccagaagaggccgcggcggggcgctctcacgtggtacagagagttctttccactgcccagttcttgtggatgctgggtcaggccctcgtggacgaattaaccaggtggctccaggagtttacgcgacatcacgggaccatgtccgacgtgctgcgtgctgagcggtatttgctgacacaagaattgctgcagggaggggaagtgcatcgtggcgttctcgaccagctttacacgtctcaggcagaagcaaccttaccagggcctaccgaggctcccaatgctccgagcacagtaagcagcggactcggagcagaggagcccctatcaagcatgaccgacgacatgggcagtcctctgtcaaccgggtatcacacccggtccgggtcggaggaagcagtgacggatcctggagaacgggaggcaggagcttcactttaccaagggctgatgcggacagcgtctgaacttctgctcgatcgcagacttaggatacccgagctggaggaagctgaattatttgctgaggggcagggacgggccctgcggttgcttcgcgcagtctaccagtgtgtggcagcccattccgagctcttgtgttatttcattattattctaaaccacatggttactgccagtgccggtagcctggtactgccagtgttagtgttcctctgggctatgctaagcattcctaggccatcaaaacgcttttggatgactgctatcgtgtttacagagatcgctgtagttgtcaagtacctgtttcagtttgggttcttcccttggaacagccacgtggtcctgcgcagatatgaaaacaagccttatttccccccccggatcctggggcttgagaaaactgacgggtatatcaagtacgatcttgtacagctgatggccttgtttttccacagatcccaattgctttgctatgggttgtgggatcacgaggaagatagcccatctaaggagcatgacaagtcaggagaggaggagcagggtgccgaggaaggccccggcgttcccgccgctacaacggaagaccatatccaagtagaagcgagggtcgggccaactgatggaaccccggagccacaagtggagctccgcccaagagatacacggaggatttcccttcgatttcggcgtagaaagaaggagggtccagcgcgcaagggagctgccgctatcgaggcagaggatagagaggaggaggaaggcgaggaagaaaaagaggcccccacagggagggagaaacgcccctcaagaagtggcggcagggtgagagccgcaggtaggcgcctgcagggtttctgcctaagtctggcacagggaacctaccgcccactgaggcgcttttttcatgatatcctccacaccaaataccgcgcagctacagacgtgtacgccctcatgtttctggcggatgtggtggacttcatcataattattttcggcttctgggctttcgggaagcatagcgcagccacggatattacatcatcactctcggacgaccaggttccagaggctttccttgtcatgctgcttattcagttctccacgatggtcgtcgaccgagccctctacctacggaagaccgtcttaggaaagctggccttccaagtggccctcgtcttagcgattcatctgtggatgttcttcattctgcctgctgtaaccgagaggatgtttaaccagaacgttgtggcacagctgtggtactttgtcaagtgtatctattttgcactttcagcttaccaaatcaggtgcggctatccaacccggattttagggaacttcttgacaaaaaaatataaccacctgaatcttttcctgtttcagggttttcggttggttccctttctggtggagctgagagccgtgatggactgggtttggaccgatactacgttgtctctgtcatcatggatgtgcgttgaagatatctacgccaacatttttatcataaaatgtagccgggaaaccgagaagaagtaccctcagcctaaaggtcagaagaagaagaagatagtgaagtatggtatgggaggactgatcatacttttcctgatcgccattatttggtttccactgctgttcatgtcattggtaaggagcgtggtgggcgttgtcaaccagcccatcgacgtgaccgtgaccctgaaattaggtggatatgagccgctcttcactatgtcagctcagcaaccttccatcattcctttcacggctcaggcatatgaggagttgtcccgccaattcgatccgcaacctttggctatgcaattcatctctcagtactctcccgaagatattgtgactgcccagatcgagggatcatccggcgccttgtggcgcatatctcctccctccagggcccaaatgaagagggagctgtataacggcaccgccgatataaccctgcggttcacctggaatttccagagggatcttgccaagggaggcacggtggagtacgccaatgaaaaacacatgttggcgttggccccgaatagtacggcccggcggcagctggcttcattgttagaaggaacctcagaccagtctgttgttattcctaatctgttccctaaatatattagggcccccaacggccccgaagccaatcccgttaaacaactccagcccaacgaggaggccgattatctcggtgtccgcatccagctcagacgggagcaaggagctggggccaccggattcctcgagtggtgggtcatcgagttacaggaatgtagaaccgactgtaatttgctaccaatggtgattttctccgataaggtctcccccccttccctggggtttctggctgggtacggcatcatggggctttacgttagcattgtgttggtaattggtaagttcgtcaggggcttctttagcgagatctcgcatagcattatgtttgaagagctgccatgtgtagatcgaatccttaagctgtgccaggatatttttctcgtccgggaaacacgcgagctggaactcgaagaagaactgtacgccaagctgatattcctatacaggtccccagagacgatgatcaaatggaccagagagaaggagtag

SEQ ID NO: 28896 - DNA, 1665 bp, Artificial Sequence
  Description of Artificial Sequence: Synthetic coding sequence
atgcctgattataggacacgcgccctcttcgtgcagtccacactgggtgactccgcaggcccagaactacagttactctccatagtgcctggaagagacctccagccatctgattcctttactgctagctcatccccacccccatccgtttggtccgaactggagcacatcagaggtaaaagcgaggccaccacagaattgaagcgcccgtcattgcctgggtctattcactcttgcctatgcggagtgtggtgcggcgtgggtaaaaggaccccatctagtcttgtgtcatcgttgcaggacttagagctcttgggtcagcgacagcggcaattgtggatggaaagcactcctcggccgccctacaacccgttcttggtgccatgcaccccggtcggtaaactttccgctgagcatggtgggccaacgaggaaaatgccgccctccgccagtgccgtggacttttttcagctgtttgtgcccgataacgtgctgaaaaacatggtcgtgcaaacaaacatgtacgctaagaaattccaggaacgattcggaagtgacggagcttgggtcgaggtcaccttgaccgaaatgaaggcatttttgggatacatgatttctaccagtatctctcattgtgagagcgttctgtctatttggagtggcgggttctattcaaaccggagcctggctttggtaatgagtcaggcacgctttgaaaagattctcaagtacttccatgttgtggcctttaggagctcccagactactcatgggctttataaagtacagccgtttctcgactctttgcagaatagttttgattcagctttcaggcccagccaaacccaggtgctgcacgagccattaattgacgaggatcccgtcttcatagcgacctgcacagagcgcgagcttcggaagcggaaaaaacgaaagttctctctgtgggtgcggcagtgctcttctactgggtttataatccaaatctatgtgcacttgaaagaagggggggggcctgacggcctcgacgccctcaaaaacaagcctcagctgcattctatggtagcgaggtccttatgcaggaatgcggccggcaagaactatataatctttaccgggcctagcatcacatcgctgacacttttcgaagaatttgagaagcagggcatttactgttgtgggctcttacgagcaaggaaaagcgactgtactggcctcccgctgagcatgctgacaaatcctgctacaccaccggctcgcggccaataccaaataaagatgaaaggcaatatgtctcttatttgctggtataataaggggcacttccgattcttgactaatgcctatagccccgtgcagcagggggtgatcatcaagcgaaaatcaggcgaaattccttgccctctggcggtggaggcttttgccgcacacctttcttacatatgtcgatacgatgataaatactctaaatactttatctcccacaaaccaaataagacatggcagcaggtattttggttcgcgatcagtatcgccatcaacaacgcatacattctgtataaaatgagcgacgcctaccatgttaaacgatacagccgcgcccagttcggtgaaaggctggttcgggagctgctgggccttgaggatgcttctcctacccattag

SEQ ID NO: 28897 - DNA, 1368 bp, Artificial Sequence
  Description of Artificial Sequence: Synthetic coding sequence
atgcccgactaccgcaccagagctctcttcgtgcagtccaccctcggggattctgccggcccagagctccagctgttaagtatcgtgcccggtcgagatcttcaaccgagcgacagcttcactggtccaactcgcaaaatgcccccctccgcctccgcagtagacttcttccagctgttcgtgccagacaacgtgctcaaaaacatggtggtccaaacgaacatgtatgcaaaaaagttccaggaacggttcgggagcgatggtgcctgggtggaggttaccttaacggaaatgaaggcttttctgggttacatgatttcaacttctatctcgcactgcgagagcgtgctgagcatttggtccggcggtttttatagtaatcggagtctcgcactggtgatgtcgcaagcacgcttcgaaaaaattctgaaatacttccacgttgtggcatttcgatcaagccagaccacacatggcctgtataaggtgcagcctttcttggacagtctccagaacagcttcgactctgcttttcgcccatcccagacacaggtcctgcacgaaccacttatcgacgaagatcccgtctttatcgcaacatgcaccgagcgggaacttaggaagagaaaaaaacgcaaattcagcctgtgggtgaggcaatgtagctcaacgggatttattattcagatatatgtacatctcaaagagggcggcgggccagacgggctggacgccttgaagaacaagccacagttgcacagtatggtggccaggtcattatgcagaaatgccgctggaaaaaactacattatctttaccggaccatctatcaccagtcttactctttttgaggagtttgaaaagcagggcatttactgctgtggcttgctgagagccagaaagagtgactgtaccggcctgcctttgagcatgctgacgaaccctgccacaccaccggctcgtggtcagtaccaaattaaaatgaagggcaacatgagcttgatttgctggtataataaaggccattttcgcttcctgacgaacgcttactcaccagttcagcagggggtaattataaaacgtaagtcaggtgagattccgtgtcccttagccgtggaggcttttgctgcccatctaagctatatatgtcggtatgatgataagtacagcaagtattttatttctcacaaacccaataagacatggcaacaagtgttttggtttgctatctcaatagcgatcaataacgcttacatcctttataaaatgagcgacgcataccacgtgaagaggtacagccgagctcaattcggggaacgtttagtgcgggaattgctaggactggaagatgcctcccctacccattag

SEQ ID NO: 28898 - DNA, 3114 bp, Artificial Sequence
  Description of Artificial Sequence: Synthetic coding sequence
atgtccccacccctgtgcccactcttacttttggcggtgggccttcgcctagccggtaccctgaatccaagtgatcctaacacatgttctttctgggaaagctttacgactacgaccaaggaaagccacagtcgccccttcagtctgctgccctcggaaccgtgtgaaaggccatgggagggtccacatacgtgcccacagccaactgtcgtgtaccggacggtgtacaggcaggtagtcaagactgaccatcgccagaggctgcagtgctgccacggattttatgagtctcgcggtttttgcgtacctctgtgcgcccaggaatgtgtgcacggaaggtgcgttgcgcctaatcagtgtcagtgcgtgcccgggtggcgcggcgatgactgttcatccgagtgtgcaccaggtatgtggggaccacagtgcgataaaccgtgcagctgcgggaataacagctcctgtgatcccaagtctggcgtatgcagttgtccctctggcctgcaaccaccgaattgcctgcagccatgtacacccggttactacggccccgcctgccagtttcgttgtcagtgccatggtgcaccatgtgatccccagacgggggcctgtttctgccctgctgaaagaactggcccatcttgcgacgtgtcctgcagccagggcacttcgggtttcttctgtcccagtacccacagttgtcagaacggaggcgtatttcagacccctcagggtagctgctcatgtccacctggctggatgggaactatctgctctcttccatgcccggaaggctttcatggccccaattgctcacaagaatgtaggtgtcacaacggggggctctgcgaccgatttaccggacagtgcaggtgtgctcctgggtataccggcgacagatgtcgtgaggagtgccctgttggtcgattcggccaggactgcgcagagacctgcgattgtgcccccgatgcgcggtgcttccctgctaatggggcttgtttgtgcgaacacgggttcacaggggaccggtgtaccgaccgcctttgtcccgacggtttctatggactgagctgtcaggcgccttgcacttgcgacagggagcactctctgtcatgccatcccatgaacggcgagtgcagctgtctgcccggatgggccggtttacattgtaacgaatcctgcccccaagacacacacggacctggttgccaggagcattgtttgtgcttgcatggaggcgtatgccaggctacttctggcctgtgtcagtgtgcgccgggatacactggccctcattgcgcctccttatgcccgcctgacacttacggtgtgaactgttccgccagatgctcatgcgaaaacgcaatcgcttgctccccaattgacggggaatgcgtgtgtaaggaaggctggcaaaggggcaattgctccgtgccatgccccccaggaacttgggggtttagctgtaacgccagctgccagtgcgcccacgaagccgtgtgttctccacagactggagcctgcacatgcacccccgggtggcatggggctcactgtcagctgccttgccctaagggccagttcggagaaggctgtgcctcacggtgtgactgtgaccactccgatggttgtgatccagtgcacgggagatgtcaatgtcaggccggttggatgggcgccagatgccacctgagttgtccagaaggactgtggggcgttaattgcagtaacacgtgtacttgcaaaaacggaggaacttgcttgcctgaaaacggaaactgtgtttgcgccccaggattcaggggcccaagctgccagaggtcatgtcagcccggccgctatggtaagcgctgcgtgccatgtaaatgcgccaatcactctttctgtcacccctctaacggaacctgttattgccttgccggctggaccggccccgactgttcacagccatgtccccccggacattggggagaaaattgcgcccagacatgccaatgtcaccacggagggacatgccacccacaggatggctcttgtatatgcccactgggttggacgggccaccactgcctggagggctgccccttggggacctttggcgcaaattgctcacagccctgtcagtgcgggccaggcgagaagtgtcaccccgaaacaggggcctgcgtatgcccaccgggccattcgggcgcaccctgccggataggcattcaggaaccattcacagtcatgccaactacacctgtcgcgtacaacagcctgggtgccgtcatcggaatcgccgttttgggatcgctggttgtggcactagtggcacttttcataggctataggcactggcagaaggggaaagaacaccatcatctggccgtggcctacagctcgggccggctcgacggaagcgagtatgtgatgcccgatgtccctccttcctactctcactactatagtaatccatcataccacacactgagccagtgtagcccaaatccccccccccctaataaggtacccggacctttgttcgcatctctccagaaccctgagagacccggcggagcccaggggcatgataatcatacaactttgcctgctgactggaagcaccgccgtgagcctccccctggccccctggaccgcggctctagccgcttggacaggtcctacagctatagttattccaacggcccaggcccattttacaataaggggctcatctctgaggaggaattgggggcaagtgtagcgagcctgtcctcggaaaacccctacgcaaccatcagggatctgccgagccttcccggcggcccaagagaaagctcatatatggagatgaagggaccccccagcgggtctcctcctcggcaacctcctcagttttgggactcacagcggagacggcaaccccagcctcagagggacagcggaacttatgaacagccttcccctctgatccatgaccgggactccgttggtagccagccgccactgcctcctggactaccccctggacattacgacagccccaaaaactctcacatcccaggccactacgacctgccccctgttcgccaccccccctccccccccctgcggcggcaagaccgctag

SEQ ID NO: 28899 - DNA, 3114 bp, Artificial Sequence
  Description of Artificial Sequence: Synthetic coding sequence
atgagtcccccattatgcccactcctgctcctggctgtgggccttagactggcaggaactctgaacccttctgatcctaacacttgctctttctgggagtctttcaccactactactaaggaatcacacagcaggcctttctctttattgcccagtgagccctgcgaaagaccctgggaaggcccccacacgtgcccccagccgacagtggtgtaccgcacggtgtaccgacaggtcgtgaagactgatcaccgtcagcggctgcagtgttgtcacggcttctacgaatctcgcgggttttgcgtcccactctgtgcacaggagtgcgtccacgggagatgcgttgctcccaatcagtgccaatgtgtgcccggatggaggggagacgactgctcatccgaatgcgcccctggcatgtggggtcctcagtgcgataagccctgcagctgcggcaataattcctcctgcgaccccaaaagcggcgtgtgtagttgcccttctgggttacagccccccaattgcctgcagccttgcacgcctggctattatggtcctgcgtgccagttcagatgccagtgtcacggtgccccatgtgatccacaaacaggcgcatgcttctgccctgctgagagaaccggtccctcttgtgacgtcagttgcagccagggaacttccggcttcttctgtccttctacccattcttgccaaaatgggggcgtctttcaaaccccacagggaagctgcagctgtccccccgggtggatggggacaatctgctctttgccttgccctgaaggcttccatggtccaaactgtagccaggaatgtcgttgccacaatggagggctgtgtgaccggttcacgggccagtgtcgctgcgcccccgggtatacaggggataggtgtcgggaagagtgtcccgtgggtaggttcggtcaagactgcgcggaaacatgcgattgcgcaccagatgcacgttgctttcccgctaacggcgcctgtctgtgcgaacacggatttaccggcgatcggtgtaccgacagattgtgtcccgatggcttctatggtctcagctgtcaagcaccatgtacctgcgatagggagcattcactctcttgccaccccatgaacggtgagtgctcttgtttgcccggttgggccgggttacactgcaacgaatcgtgtcctcaggatacgcatggtcctgggtgtcaggagcactgtctctgcctgcatgggggagtttgccaggcgacctcaggcctctgccagtgcgcacctggatataccggcccccactgcgccagcctctgtccacctgatacttacggagtcaactgctcagctaggtgctcttgcgagaatgccattgcttgttcgcccatagatggtgagtgcgtgtgcaaggaagggtggcagaggggcaattgcagcgttccatgtccacctggcacctgggggttcagctgcaacgcaagctgtcagtgcgcccatgaagccgtgtgctccccacagacaggggcctgcacttgcacacccggctggcatggagcccactgtcagctaccttgccccaaaggccaatttggagaggggtgcgcaagcagatgtgactgcgatcacagtgacggatgtgaccccgtgcatggtcggtgtcagtgccaggcaggatggatgggagcacggtgccacttatcttgccctgaaggactgtggggtgttaactgctccaacacttgtacatgcaagaatggggggacatgcctcccagagaatggaaattgcgtctgtgccccaggctttcggggaccgagttgccagcggtcctgccaaccaggaagatacggcaagcgctgtgtcccatgcaagtgtgctaaccatagcttctgccatccgtcgaacgggacatgttattgcctcgccggatggacgggtccggattgcagtcagccatgtcctcccgggcactggggagagaactgcgcgcagacatgccagtgccatcacggcggaacttgtcatccacaggatggtagctgcatttgtcctctggggtggacaggtcatcactgccttgaaggttgcccactggggacctttggcgctaattgttcgcaaccatgccagtgtgggcctggggagaagtgccatcctgagaccggcgcttgtgtgtgtcccccagggcattcaggagccccttgccggatcggaatccaagaaccatttactgtgatgcctaccaccccagtcgcttataactcattgggcgccgtcatcgggatagcagtattgggcagtctggtggtcgccctggtagcgctcttcattgggtatcggcactggcagaagggcaaagagcaccatcacctcgcagtggcctactcgtcaggaagactcgacggatctgaatacgttatgccggatgttcctccatcctactcacattactacagcaatcccagctaccacaccctatctcagtgctcaccaaatccacctcccccaaacaaagtgcctggtccacttttcgcttccttacagaatcccgagagacccgggggggcgcagggccacgataatcataccaccttgccagccgactggaaacaccgccgggaaccccccccaggtccgctggatagggggtcttcaagactggataggtcatactcctattcttattccaacggacccggcccattttacaacaagggactaatctcagaagaggagctgggcgcctctgttgcctccttaagttccgagaacccttatgccactatccgggatctcccttcacttcctggaggcccccgggagtccagttacatggagatgaaaggccccccgagcggaagcccaccacgacaacctccacagttctgggatagccagcgccggagacaaccccaacctcaaagggatagcggcacctatgaacagccctcacccctgatacatgatcgggattccgtcggtagtcaaccgcctcttcctcccggactcccacctggtcattacgacagtcccaagaactcccacataccaggtcattatgaccttcctcccgtgcgacatccaccttcgcctccactgcgtaggcaggacagatag

SEQ ID NO: 28900 - DNA, 522 bp, Artificial Sequence
  Description of Artificial Sequence: Synthetic coding sequence
atgagtcccccactttgcccactcctcctcctggctgttggactacgactcgcgggcaccctgaacccaagcgatcctaacacttgtagcttttgggagtcattcacgactaccacaaaggagagtcactcaaggcccttctcactgctgccatctgagccgtgcgaacgcccttgggaaggaccacatacttgtcctcagcctaccgtggtataccgcaccgtctacaggcaggtggtgaaaaccgatcataggcagagactgcaatgctgccacggattctacgaaagcagaggcttctgtgtgcccctgtgcgcacaggaatgcgtacatggaagatgtgtggccccgaaccaatgccagtgcgtccccggctggcggggcgacgattgttcctccgagtgtgctcccggaatgtggggaccccagtgtgataagccttgcagttgtggtaataatagttcgtgtgaccccaagtccggtgtttgctcctgtccctctggtctgcaaccaccaaactag

SEQ ID NO: 28901 - DNA, 2316 bp, Artificial Sequence
  Description of Artificial Sequence: Synthetic coding sequence
atggaggaagataagctgctctctgcagtacctgaggagggggatgcaactcgtgatccgggcccagagccagaggaagagcccggcgtgagaaatggaatggcctctgagggcctgaattcttccctgtgttctccaggtcatgaaaggagaggcacacccgccgataccgaggagcccacaaaagaccctgacgtcgcattccacggcctgtctctggggctgagccttaccaacggtctcgccctcgggcctgatctgaatatcttggaggactcggcagaatccaggccttggagggcgggcgtgcttgctgaaggcgacaacgcatcccggtctctctaccctgatgctgaggatccccagcttggccttgacggacccggcgaaccggatgtgcgcgatggattctctgccacgttcgagaagatactagaaagcgagcttctaagggggacgcagtatagttctctggatagtctcgatggcctcagccttacggatgaatcggactcatgcgtgtcttttgaagcaccactgactcccctcattcagcagagggctcgggattcccccgagccaggtgctgggctgggaatcggagatatggcgtttgagggagacatgggagccgctgggggggatggggagctggggtctccgctgcggaggagtatttccagcagtaggagcgaaaacgttttgagccggctgtccctgatggccatgcccaatggcttccatgaagacgggccgcagggaccggggggagacgaagatgacgatgaggaggacacagataagctgctgaattctgcttctgacccctcactaaaagacggcttatctgattccgatagcgagctgagtagtagcgagggactggagccaggatcagccgaccccctggccaatggctgtcagggggtcagtgaggccgcccatcgactggctaggcggctttaccacctggaaggctttcagcggtgtgatgtcgccagacagttggggaagaacaatgagttttctaggcttgtggctggcgaatatctctcattttttgatttcagtggtctcacgctcgatggtgccctgcgcacatttctgaaagccttccctctaatgggggagacccaagagcgcgagcgcgtgttgacacacttctctcgtcggtactgtcaatgtaatccggatgactccacgtctgaggacgggatccatacactgacctgtgcactgatgctgctcaacactgatctgcacggccataatataggaaagaagatgtcttgccagcaattcattgctaacttggaccaactgaatgacggccaggactttgcaaaggatctcctgaagacgttatataattccatcaaaaatgaaaagctggaatgggcgatcgatgaagacgaactgaggaaatcactgtcagaactggttgatgataaattcggaacagggaccaagaaagtgactaggattttggacggtggcaacccgttcctggatgtccctcaagctctctcggcaacgacatataaacacggcgtccttactcgcaagacccatgcagatatggacggaaagagaaccccacgcggacgcagggggtggaagaagttttacgccgttttgaaaggaacaatactgtatcttcaaaaagacgaatataggcccgacaaggccctgtctgagggggatctgaagaatgctatccgtgtgcaccacgctctggccacccgagccagcgactattcaaagaaaagcaatgtgttgaaacttaagaccgctgattggcgcgtgtttttattccaggcaccatcgaaggaggaaatgctctcctggatcctgagaatcaatttagtggccgcaatcttctccgcacctgcattccccgcagcagtgagctctatgaaaaaattttgtcgccctctgctgccgagttgtaccacccggttgtgtcaggaggagcagttacgaagccacgagaacaaactccggcagctgaccgccgaactcgccgaacatagatgtcaccctgtggagagaggaattaaaagcaaggaagccgaggagtaccgcctgaaggagcattacctcacttttgaaaagagtcgttatgaaacctatattcacctgctcgcaatgaagatcaaagtgggcagtgacgatctggaaaggattgaggcccggctagcaacccttgagggcgatgacccttcgttgcgaaagactcattcttcccccgccctcagccagggtcacgtaaccggtagcaaaacaaccaaggatgcaacgggtcccgacacttag

SEQ ID NO: 28902 - DNA, 2601 bp, Artificial Sequence
  Description of Artificial Sequence: Synthetic coding sequence
atggaagaggaggacacaaagagagaggtgcccaaggaagacggggtgggcgacgtccagcactttgattcctctaagatcatggaggaacactcatatattcaaaaggagctggatctgcaaaatggaagcctggaggaagactctgtggtgcactcagtcgaaaacgattctcaaaatatgatggagagcctcagccccaaaaagtattccagctccctgagattcaaagcgaacggtgattacagcggatcatacctaacactttcccagcctgttccggctaagagaagtccatcacccctcggcaccagtgtgaggtcatcaccatcgctcgctaagatccagggctcgaagcaattttcttacgatggcacagataagaatatacccatgaagccccctactccactcttaaataccacctcttccctgtccggctatccccttggtagagccgactttgaccactatactggtagggactcagagagggcattaagactctctgagaagcccccctacagcaagtattcatctaggcacaagagccatgataatgtctacagtctgggtggcctcgaaggacgaaaggcttctggtagtcttcttgctatgtggaatgggagcagcctgagcgatgccggaccgcccccaatcagtagaagcggcgcagccagtatgccctcatcgccaaagcaggccaggaaaatgtccattcaggactccttagccctgcaacccaagctgacaaggcataaagagctcgcctcagagaatattaatctgcgcactcgtaagtactcctcctcatcattgtcacatatgggcgcctactctaggtcactacctaggctatatagggcaacagaaaatcagttaactcccctgtccctgccgcctcgcaactctttgggcaactcgaagcggacgaaactgggcgaaaaagacctcccccacagcgtcatagacaacgacaattaccttaacttttcaagtttgagttctggagcacttccctataaaacttccgcatcagagggtaacccctacgtcagtagtacattgagcgtacctgcatcaccccgggttgcccgcaaaatgttgctcgcctcaacctccagttgtgcttccgacgacttcgaccaggcaagctatgtcggaacgaatccttctcatagtcttctggcaggagagagtgatcgcgtcttcgccacccggcgcaacttctcttgcgggagcgtggagttcgacgaggcagacctggagtccctgcggcaggccagcggtactccccagccagcccttagggagagaaagtcttcaattagttccattagcgggcgcgatgatctcatggactaccacagacgacagagagaggagcgattgcgagaacaggagatggagcgcctggagagacagcgtctcgagactatcctcagtctctgcgctgagtacaccaagccggacagccgcttatctactggtactactgtggaggacgttcagaaaatcaataaggagctggagaagctgcagctgagtgatgaggagtccgtgtttgaagaggccctgatgagccccgacacgcggtatagatgccatagaaaggactctcttcctgatgcagatttggcctcttgcggcagcttgtctcaatcttcggctagcttcttcactccacgatccacacgaaacgatgaactgctctctgatctgaccaggactccacctccaccttcctccactttccccaaggcaagcagcgagtcttcgtacttgtccattctgccaaaaacacccgaaggcatttctgaagagcagcgttcacaggagttagccgccatggaggaaacccgcatagtcatccttaataacctggaggagcttaaacagaagatcaaggatattaatgaccagatggatgaatcattccgggagctcgacatggaatgtgccctgctcgatggagagcaaaagagcgaaactactgagctgatgaaggagaaagaaatccttgatcacctgaatcgaaaaattgccgaacttgagaaaaacattgtgggcgagaaaactaaggacgcagatctactggacgtcgagtctaagcactttgaggacttggagtttcagcagctcgaacatgagtctcgactggacgaggaaaaagagaacttgacgcagcaattactgagagaggtggccgagtatcagcggaatattgtatcaagaaaggagaagatctctgcactgaagaaacaggccaatcacatagtgcagcaggcacagagggagcaggatcacttcgtgaaggagaaaaacaatctcatcatgatgcttcagcgagaaaaggagaatttgtgcaatctggaaaaaaagtactcctctctgtccgggggaaagggattccccgtcaatcccaacaccttaaaagaaggctacattagcgtgaacgagataaatgagccttgcggaaattcaactaacctgagtccttccactcagttccctgcagatgccgatgccgttgccaccgagcctgccacagccgtgttggctagccagccccagagtaaggaacacttccagggcccctag

SEQ ID NO: 28903 - DNA, 3714 bp, Artificial Sequence
  Description of Artificial Sequence: Synthetic coding sequence
atggaggaagaggacaccaagcgcgaggttcccaaggaggacggggtaggggacgtacagcattttgactccagtaagattatggaagagcacagttacatccagaaggaacttgacctccagaatggatcccttgaggaggacagcgtagtacattccgtggaaaatgattcacagaacatgatggagtctttgtcaccaaagaaatatagctcctcactgaggtttaaggcgaacggagactactccggatcctacctcacactgtcccagcccgtgcctgcgaaacggagtccatctcctcttggcacctcagtcaggagctccccctccttagcgaagattcagggctcgaagcaattctcgtatgatggcactgataagaatatcccaatgaagccccccaccccactgctcaatactacctcaagcctgagcggataccccctgggcagggctgattttgatcactacaccggtcgggattctgaaagagcccttagattgagtgagaaacctccatacagcaaatacagttcacggcacaaatctcacgataatgtgtacagtttaggtggactagagggcaggaaggccagcgggtcattactggcaatgtggaacggcagcagtttgtccgacgccgggccaccaccaatctcaaggtcaggggctgcctcgatgccctccagtcctaaacaggcccggaagatgtctatacaagactctctggctctgcagccgaagttaacccgtcacaaggaactcgcatctgagaatattaacctgagaacgaggaaatattcttcgtcctctctatcccacatgggcgcttattcccggtctcttcccagactgtatcgcgcgacagaaaatcaactcactccactgagccttcctccacgcaattcacttgggaactctaagagaacaaaactcggggagaaggacctgccccattccgtaatcgataacgataactacctgaatttttcaagccttagtagcggtgctctaccgtacaaaactagcgctagcgaagggaacccttacgtctcatctactcttagtgtacctgccagtccccgggtggctcgcaagatgttactcgcctctacgtcgtcctgtgcaagcgatgactttgaccaggctagctatgttggcactaacccatctcacagtctcctggcaggggaatccgaccgggtgtttgctacacgccgaaacttcagttgtgggtcagttgagtttgatgaggcggaccttgaatcgctccggcaagcttccggtactccccagcctgcacttagggagcgaaagagcagtattagctccataagtggcagagacgatcttatggactaccacaggcgtcaacgcgaggaacgccttagagagcaggaaatggagcggctggaaaggcaaaggttagagaccattctcagtctatgcgctgaatacaccaagcccgattcgagactgtccacaggcaccacagtggaggatgtgcagaagattaataaggagctggaaaagctgcagctgagcgacgaggagagcgtgtttgaagaggcgctgatgtctccagacaccaggtatcggtgtcaccgtaaggacagtctgcctgatgctgacctcgcttcctgcgggagcttatcacagtcgtcggcctcattcttcaccccacgctccaccaggaatgatgagctgctttctgatctgacccggactccaccaccaccctcttcaacctttccaaaagctagtagcgagagtagttacctctcgattctccctaaaactccagagggtataagcgaggagcagagatctcaggagttggccgctatggaggagacccgcatagtgattcttaataatcttgaggagctgaagcagaaaattaaagatattaatgaccagatggatgagtctttcagagaactggatatggaatgtgcgctgctggatggcgagcagaaaagcgagacaaccgaactaatgaaggagaaagaaatattggaccatcttaatcggaagattgcggaactggaaaaaaatatcgtcggagagaaaaccaaggacgctgacttactggacgttgagtccaagcacttcgaggacctggagtttcagcagctggaacacgagtcccgtctggacgaagagaaggaaaatttaacccagcaactcctcagagaggtagccgaataccagcgtaacatcgtgtcacggaaggaaaagattagcgctcttaaaaagcaggccaaccacatagttcagcaagctcagagggagcaggaccacttcgtaaaggaaaagaacaatctgattatgatgttgcaacgcgaaaaagagaacttgtgcaatctagaaaaaaagtacagcagtttgtccggcggcaaaggtttccctgtcaatcccaatactctgaaggaggggtatataagcgttaacgagattaatgaaccttgcgggaactctacaaatttaagcccatcaacgcaattcccggccgatgcggacgcggtggcaacagaaccagcaacagctgtgttggcatctcagccacaatctaaagagcactttagaagtttggaagaaaggaaaaagcagcataaggaaggtctctatctgagtgacacactcccccgaaaaaaaacaacctcaagcatttctccccacttcagcagcgctactatgggtagatcaatcacgccaaaggctcatctgcccctgggtcagtcaaattcatgcgggtccgtcctccctccgagcctggcggctatggcaaaggactccgaaagtcgtcgtatgctgaggggctataaccatcagcagatgtctgagggacatagacaaaaatccgagttctacaatcgtacggcctccgaatccaacgtgtacctgaactcatttcactatcctgatcacagctacaaggatcaggcattcgacacactcagtctcgacagcagcgattccatggaaacctctatctcagcctgttcccctgataacatttcttctgcctcaacctcaaatattgcaaggattgaagagatggagagactgctgaaacaggcccacgccgaaaagacgaggctgctcgaaagcagagagagagaaatggaagccaagaaaagagccttggaggaggagaagaggcggcgggaaattcttgagaagcgcttgcaggaagaaacgagccagcggcagaagctaatcgagaaagaagttaagatccgcgagcgccagcgagcccaagctaggccgctgacaagatacctcccagtcagaaaggaagatttcgaccttcgatcccacgtggagacagcaggtcacaacatagacacttgctatcacgtgagtatcactgaaaaaacctgccggggtttcctgattaaaatgggaggcaaaattaaaacatggaagaaacgctggtttgttttcgacaggaataaaagaaccttcagttactatgcagacaaacacgaaaccaaacttaaaggagtcatatactttcaggcaattgaagaggtgtattatgaccacctgaagaatgcaaataaatcacccaacccccttttaactttcagcgtcaagacccatgaccgcatctattatatggtcgccccatctcccgaagctatgaggatctggatggatgtgatcgtcacaggcgccgagggctacacccacttcctgctctag

SEQ ID NO: 28904 - DNA, 3762 bp, Artificial Sequence
  Description of Artificial Sequence: Synthetic coding sequence
atggaggagcactcatatatccagaaagaactggacttgcaaaatggttccctagaggaagacagtgttgtgcacagcgtagagaatgatagtcagaacatgatggaatccttgagccccaaaaagtattcctctagtctcaggttcaaggcaaacggcgactactctgggtcctatttgacactgtcacaaccagtgccggcgaaaaggagtccaagtcctctcggaaccagcgtgcgcagttcgccctccttggctaaaatccagggaagcaaacagttctcttacgacggaaccgataaaaatatcccaatgaagccaccgacccccttactgaacactacgagcagcttgtctgggtaccctctaggcagagccgatttcgaccactacaccggacgtgatagcgagcgggctctgaggctcagcgaaaagcccccttattcaaagtactccagtagacacaagagtcacgacaacgtctactcgctcggcggactcgagggccgcaaagcgagcggatccctgctcgcaatgtggaatggctcaagtctgagtgatgcggggcccccacccatctccagaagtggcgccgccagtatgcctagcagtcccaaacaagcccgtaaaatgtccatccaggactccttagctctgcagccaaagcttacccggcataaagaactagcttccgagaatatcaaccttcggactaggaaatactcttctagttccctgtctcacatgggcgcgtatagcaggagcctgccccgcttgtatagggcgactgaaaaccaattaacccccttgtcccttccgcccagaaattcattaggaaacagcaagcgtaccaaacttggcgagaaagaccttcctcatagcgtgattgataacgataactacttaaatttctcatcgttgtcctcaggcgccttgccatacaagacctctgcgtccgaagggaacccctacgtgtcttccacgctgagcgtgcccgctagtcctagagtggcccgcaaaatgctgctggctagtaccagctcttgcgcatcagatgatttcgaccaggcttcttatgtcggcaccaatcccagtcactctctacttgccggcgagagcgaccgcgtcttcgctactagacggaatttcagttgcggatcagtggagtttgatgaggccgacctggaaagcctgagacaagcatctgggacccctcagcctgccctgcgggaaaggaaaagttctatctcaagtatctctgggcgggacgatcttatggactaccacagaaggcagcgggaagaacgactgagagagcaggaaatggagcgcctagaaaggcagaggcttgagacgattttgtcactctgtgccgagtacacgaaacccgacagcaggctttccaccggcactactgtggaagacgttcagaagatcaacaaagagttggaaaaattgcagctgagcgacgaggagtcagtcttcgaggaggccctaatgtctccagatacaagatacagatgccacagaaaggattctttacccgacgccgatctggcctcatgcgggtcactgagccagagcagtgcatccttctttactccacggtctactcgaaacgatgagctgttgtccgacctgaccagaacaccaccgcccccttcttctacatttcccaaggcttcctcagagtcttcttacctaagcatattaccaaagacaccagaaggaatctccgaggaacagcgctcacaggagctggcagcaatggaggagacgagaatagtcatactgaataacctcgaggagctgaaacagaaaattaaagatatcaacgaccagatggatgagtctttccgagagttggatatggagtgcgcattgctggacggcgaacagaagtccgagactaccgagctcatgaaggagaaagagattctggatcacctcaaccgaaaaatagcagaacttgaaaaaaatattgttggagagaaaactaaagaaaaagtcaaactggatgcagaaagggagaagctggagcggctacaggagttatacagcgaacaaaaaacacaactcgacaattgtccagagagcatgagagagcaactacaacagcagttaaagcgcgatgccgacttgttggatgtggagtcgaagcatttcgaggacctcgaattccagcagctcgagcacgagagcagattggacgaggagaaagagaatctgacccagcagctcctgagagaggttgcagaatatcaacggaacatagtaagccggaaggagaagatctcagctctcaagaaacaggctaatcacattgtgcagcaagcccagcgagagcaggatcatttcgtgaaggagaaaaataacctgattatgatgttgcaacgggaaaaggagaacctctgcaatctcgagaaaaagtattcctccctctccggcgggaaaggtttcccagttaatccaaacaccctgaaagagggctatattagcgtgaatgagataaatgagccgtgcgggaattcaacaaatttgtccccctctacacagttccctgcagacgccgatgctgtggctactgagcccgcaactgccgtgctggctagtcagccccaaagtaaagaacacttcagaagtctcgaagagcgaaagaagcagcacaaggagggtctctatctgagcgacaccctgccacgcaaaaagaccaccagctcgatttctccacatttttcctcggccactatggggcggtcaattacacccaaagcacacctaccacttggacaaagcaacagctgcggttctgtacttcctccgtctctggctgcgatggctaaggacagcgagagccggcgaatgctgaggggttataaccaccagcagatgtccgaagggcacaggcaaaagagcgagttctataaccgcacggccagcgagagtaacgtatatctgaactcttttcattacccagaccatagctacaaggaccaggcctttgacactctgtcattagacagttctgatagcatggaaacttccatttctgcttgttcaccagacaatatctcctccgccagcacatccaatatcgctagaatcgaagagatggaaaggctgctgaaacaggctcacgcagagaagactcggctgctcgaaagccgggaacgggaaatggaggccaagaaacgagcattagaggaggagaagaggcggagggagattctggagaagaggctacaggaggaaactagccagaggcagaagctcattgagaaagaagttaagatacgggagagacaacgcgcgcaagccaggcctctcacaagatacctgccagtgcggaaggaggatttcgacctgcggagccatgtcgagaccgccggccacaacattgatacgtgttatcatgtttcaatcaccgaaaagacttgtagagggtttctcatcaagatgggaggcaaaattaaaacttggaagaagcgatggtttgtattcgacagaaataagagaactttctcctattatgctgataaacatgagaccaagctgaaaggagtgatctactttcaggctattgaggaggtgtactacgatcacctgaaaaacgcaaacaagtcaccgaatccgctgttaactttctctgttaaaacacatgataggatctactatatggtagctcccagcccggaagccatgagaatttggatggacgtgatcgtaaccggagctgaggggtacacacacttcctcctatag

SEQ ID NO: 28905 - DNA, 3633 bp, Artificial Sequence
  Description of Artificial Sequence: Synthetic coding sequence
atggaagagcattcttacattcagaaagaacttgatctgcagaatggttcgcttgaagaggacagtgtggtccacagtgttgaaaacgactcacagaacatgatggagtcgttaagccccaaaaagtattcttcctccctacggttcaaagcgaatggagattacagcggttcttatctgaccctatcccagcccgtccccgcaaaaaggagtccgtcccccttaggtacatcggtacggtcttccccctccttggccaaaatccaaggatcaaagcagttctcgtacgacgggacagataagaatatccccatgaaacctcccacaccgttacttaatacaacatcctctctgtcaggctatcccctcggccgggcagacttcgaccattacacagggcgagactcagagcgcgccttgagactgtcagaaaagccaccctattcaaaatattccagccgacacaagtcccatgataacgtctacagtcttggtggtctcgaaggccgcaaggccagcggcagcctcctagccatgtggaacggctccagtctctccgacgccggcccaccccccatctcaaggagtggggcggccagtatgcctagttctcccaagcaagcacgaaagatgtcaattcaggacagcctggcccttcagcccaagctcacccgtcacaaggaattggccagtgaaaatattaatctcaggacaagaaaatacagcagtagcagtttaagccacatgggtgcttatagccgaagtctgccccgtctgtacagggccaccgaaaaccagcttacccctctgagtctccctccgcggaactccctggggaacagcaagcggactaaacttggagagaaagaccttcctcactccgtgattgacaacgataattatctgaactttagctccctctcttcaggcgccctgccatataagacaagtgctagcgaaggtaatccatatgtgtcttcaaccctctcagtccccgcttcaccccgtgttgcgcgaaaaatgttactcgcgtccacaagttcctgcgcaagtgacgatttcgaccaggccagctatgttggaaccaacccctcacactctcttctggccggggagtcggatcgggtgtttgcgactcggcgaaactttagctgtggcagcgtggagtttgacgaggccgatctggagtcactgcgccaagcctccgggacaccacagccagccttacgcgagcggaaaagttctatttcaagcattagcggcagagatgacctgatggattaccacaggaggcagcgggaagaacggttacgggaacaagagatggagagactcgagagacagaggctcgagacgatcttgagcctctgcgccgagtatacaaaacccgatagccgcctttccaccggaacaacagttgaggacgttcagaagattaacaaagaactcgagaagctgcaactgtccgacgaggaaagcgtgttcgaagaggcactgatgtcaccagataccagatatcggtgccacagaaaggactccttgcccgacgccgacctcgcatcctgtggctccctcagccaatcctctgcttcattttttaccccgagaagtacacggaatgacgaactgctgtctgacttgacccgaactccgccccccccaagtagtactttcccaaaggcttcgtcagagagtagctatctgagtattttgccgaaaactcccgaggggatttctgaggagcagcggtcacaggaactggccgccatggaagaaacacgcattgtgatcctgaataatctggaagagttgaaacagaagatcaaggatataaacgatcagatggatgagagctttagagagttggatatggagtgcgctcttctcgacggtgaacagaagagcgagacaaccgaacttatgaaggagaaagaaatcctggaccacctgaatagaaagatcgctgagctggagaaaaacattgtgggggaaaagaccaaggacgccgatctcctggatgtcgaatctaagcatttcgaagatttggagttccagcagcttgaacatgagagccgcttggacgaagagaaggaaaaccttacccagcaactcctaagggaggtcgccgaataccaaaggaacatcgtctcacgcaaggaaaagatctctgccttaaagaaacaggcgaatcacatcgttcagcaggctcagagagagcaggaccactttgtgaaggagaagaataacttgatcatgatgcttcagagggagaaggagaacctttgcaacctggagaaaaagtactccagcctgtctggggggaagggatttcccgttaaccctaataccttgaaagaagggtacatttccgttaatgagatcaatgagccttgcggcaattctacaaacctttcaccatcaacccaattccctgctgatgcagacgctgtggccacggagccagccaccgcagtgcttgcctcccagccccaatccaaggagcattttcgaagcctggaggagcgcaaaaagcagcacaaggagggcctgtatctgagcgatacgctgcctcgcaagaagaccacatcttctatttcaccacacttcagcagcgctacaatggggcgctcaataactcccaaggctcatctgcctctgggtcagtccaactcctgcgggagcgtgctgcctcccagtttggccgctatggccaaagattccgagtcaagaaggatgctgagagggtacaaccaccagcaaatgtccgagggccatcgccagaagtcagaattctacaaccgcacggcctccgagagcaatgtgtacctgaatagctttcactatcccgatcattcctacaaggatcaggcatttgatactctgtccctcgactccagcgattctatggagacctccatctccgcatgttccccggacaatatctcctctgcttctacctctaatatagcccgaattgaggagatggagcggctgctgaaacaggcccacgcagagaagacccggctgttggaaagcagggagcgggaaatggaggcgaaaaaaagagccttggaagaggaaaaaagacgcagggagatcctggaaaagcggcttcaggaggaaacctcccagcggcagaagctcatagagaaggaggttaagatccgggagaggcagcgcgcccaagctcggcctctcactagatacttgccagtgcgtaaggaggactttgacctgcgctcccacgtggaaaccgccggccacaacatcgatacttgctatcacgtctcaattactgaaaagacttgccggggctttcttatcaagatgggtggtaagataaagacatggaaaaagcggtggtttgtgtttgatcgtaataagcggacattcagctattacgctgataagcatgaaacgaaactcaagggagtgatttactttcaggctattgaggaagtgtactacgatcacctgaagaacgccaataaatcgccaaatccactgctgacatttagtgtaaaaacacacgatcggatttattatatggtagccccctccccagaagccatgcgaatttggatggatgttatcgtcacgggagcggagggctacacacatttcttactctag

SEQ ID NO: 28906 - DNA, 3762 bp, Artificial Sequence
  Description of Artificial Sequence: Synthetic coding sequence
atggaagagcactcttacatccagaaggagcttgacctccagaatggatcactggaggaagattctgtggtccactcagtcgagaacgactctcagaacatgatggagtcgctgagtcccaagaaatatagtagtagtttaagatttaaagccaatggggattactcagggagctatttaaccctgtcccagccagttccagcaaagcggagtcctagtccattggggactagcgttcggtcatctccaagcttagccaaaattcagggctccaagcagtttagctacgacgggactgataagaacatccctatgaagccacccactcccttattaaacactacgtcctcactcagcggctatcctctagggcgagctgatttcgaccactacacggggcgtgactcagagcgggcgctccggctctcagagaaaccaccatactcgaaatactcctcacgccacaagtcccacgacaacgtgtacagtctgggcgggttagaaggcaggaaggccagcgggagtcttcttgctatgtggaacggttcttccctgtccgatgccggcccccctcctataagccgttcaggcgcggccagcatgccttccagcccaaagcaggcccgcaaaatgagtattcaggatagcctggctctgcagcctaaattgaccaggcacaaagagctggcaagtgaaaatattaacctgaggacccgcaaatatagttcatcaagtctgagccacatgggagcctatagtcgatctctaccaagactctatcgggcaactgaaaatcagctgacacctctctctctgccccctcgaaatagcctgggaaacagcaaaagaactaaattaggcgaaaaggatcttccacactcagttatcgataatgacaattacctcaatttcagtagcctgagtagcggcgccctgccatacaagacatctgcatccgaggggaacccgtacgtcagttcgactctatcagttcccgcctccccccgcgtggccagaaagatgctgctggcgagtacatcctcctgtgcaagcgatgacttcgaccaggccagttacgtggggaccaacccctcccactcactgctggctggagaatccgatcgtgtgttcgccacacgacggaatttttcctgcgggagcgtggagtttgacgaggctgatctggaaagcctgcggcaggcaagcggaaccccgcagccagctcttcgcgagcgcaaaagctccatttctagcatcagcggccgagatgacctgatggactaccacaggcggcagagagaggaacggctgcgcgagcaagagatggaaaggctagagcgccaaaggctggagacaatcctgtccctttgcgcggaatacaccaagcccgacagccggctgagcaccggtacaacggtggaagacgtacaaaaaattaacaaagagctggaaaaactgcaactatctgatgaagagagcgtttttgaagaagctctgatgagccccgacactcgttatagatgccaccgaaaagactctctgccagatgcagatctcgcctcgtgtggatctctgtctcaatcaagcgcctcatttttcacgccaagatccacacgcaacgatgagcttttatcagatctgacacggacgcccccaccccccagctctacattcccgaaagccagcagtgaatcctcatacttgtcaatcctgcctaagacaccagaagggatctctgaggagcagcgctcccaagaactggctgcaatggaagaaacaagaatcgttatcttgaacaatctggaagagctaaaacaaaaaattaaggacataaacgaccagatggacgaaagttttagagaactggacatggaatgtgccctgctggacggtgagcagaagtctgagactacagaattaatgaaagaaaaggagatcctcgatcatctgaatcgaaagatagccgaattggagaagaacatcgttggagagaagacaaaggagaaggtcaaactggatgccgaaagagagaagctggaaaggctccaggagttatattctgagcaaaagactcagctcgataactgcccagagtcgatgcgcgaacaacttcagcagcagctgaagcgcgacgccgacctgctggacgtggaaagcaaacattttgaggatttagagttccagcaactggagcatgagtcaaggctagatgaagaaaaggaaaacctgactcagcagctgctacgtgaggtggctgaatatcagcggaatatcgtgtctagaaaggaaaaaatctccgctctcaaaaagcaggctaaccatatcgtgcagcaggctcagcgcgaacaggatcacttcgtcaaagagaaaaataacctcattatgatgctgcaacgcgagaaagaaaatctgtgcaacttagaaaagaaatattcatccttgtctggaggcaagggcttccccgtaaaccccaacactctgaaggaaggctacatctcagtgaatgagatcaacgagccatgtgggaactcaaccaacttaagcccctcaacgcagttcccggcagatgccgacgcagtcgctaccgagcccgccacggctgtactggccagtcagccacagagtaaggagcacttcaggagtttagaagaaaggaagaaacagcataaagaggggctgtatctaagcgacacactgcccagaaaaaaaacaacctcctcaatcagtccccacttttcatccgcaacgatgggacggtctattacaccgaaggctcacctgcccctggggcagagtaatagctgcggcagtgtgctccctccatctctggccgcaatggctaaggactccgagtcccgccgaatgctcagaggctacaaccaccagcagatgagtgagggccataggcaaaagagcgagttttacaacaggacggcgtcggagtcgaatgtctacctgaactcatttcattatccggatcactcatataaagatcaggccttcgatactctatctttggattcatccgactccatggagaccagcatctcggcttgtagtccggataacatttcatcagcaagcacctctaacattgcacgcattgaagagatggagaggttattgaagcaggcacacgcggaaaaaaccaggctgctggagtcacgcgagcgcgaaatggaggcgaaaaaaagggcactggaggaagaaaagcggcgaagggagattctggagaagcgccttcaagaggaaaccagccaacggcagaaactcattgagaaagaggtcaaaatcagagagcggcaacgcgcccaggctaggcccctcacacggtatctcccagtgcgcaaagaggatttcgatctgagaagtcacgtagaaacagctggccataacatagatacctgttatcacgtgtctatcacggaaaaaacatgccgtggtttcctgattaagatggggggtaaaatcaagacctggaaaaaacggtggttcgtcttcgaccggaacaaacgtacattcagttactatgccgataagcacgaaacaaagctcaaaggagtgatctactttcaagcaatcgaggaggtttattacgaccaccttaaaaatgcaaataagtcccctaacccattattgacgttttcagtgaagacccatgatcggatctactatatggttgcgccctcccctgaggcaatgcgaatctggatggacgttattgttaccggcgccgagggctacacccacttcctcctgtag

SEQ ID NO: 28907 - DNA, 3633 bp, Artificial Sequence
  Description of Artificial Sequence: Synthetic coding sequence
atggaagagcactcatacatacagaaagagttagatttgcagaacgggtcattggaggaggacagcgtggttcacagcgtggagaacgatagtcaaaacatgatggagtccctgtctcccaagaagtacagttcttccctgagattcaaagccaacggggattatagcggcagttatcttaccctgagtcagccagttcctgcaaaacggtccccttcacccctggggacaagcgtgcggtctagcccaagcctggcaaaaatccaaggctccaagcagttcagctacgacggcaccgacaagaacataccaatgaagccccccaccccactcttaaacaccacaagctctctgagtggataccccctgggacgtgctgactttgatcactacacgggccgcgactcagagagggcactgcgactctctgaaaaaccaccttatagcaagtattcatcccgacataagtcccacgacaacgtatactccctgggggggctggaggggcgcaaggcgagcggatctctcctcgccatgtggaacgggtcctcattatctgatgccgggcctccgcctatctcaaggagtggcgctgcctccatgccctcttctccgaagcaagcccggaaaatgtctattcaggatagcctcgccctgcagccgaaactgacccgacataaggagctcgcatccgaaaatatcaacctccgcacgcggaaatactcatcctcatcactgtctcacatgggtgcctactcacgctccctgcctcgcctgtaccgggcgactgaaaatcagcttacccctctgagcctgccacctaggaattcacttgggaatagcaagcggaccaagttgggggaaaaggaccttccgcactcagtgatagacaatgacaactacctgaacttctcttccctgagttctggagctctcccttataagacttctgcttctgagggaaacccatacgtttcttctaccctgagcgtacctgcaagccctagggtggctagaaagatgctccttgcctccacatcctcgtgtgcctctgacgactttgatcaggccagttacgtgggtactaaccccagccatagcttgcttgccggcgaatccgatagggtgttcgctacaaggaggaattttagctgcgggagtgtcgaattcgacgaggccgatttggagtccctgcgccaggcctctggcaccccccagccggcgctgcgcgagcggaagtcatctatcagcagcattagtggtagagatgatctgatggattatcaccggcgacagagggaggaaaggctccgagaacaagagatggagcgcctggagcgccagagactagaaacaattctgtcattatgtgccgaatatactaaacccgatagcagactcagcaccggaaccacggtggaagacgtccagaaaattaacaaagagctggagaagttacaattgtccgacgaagagtccgtgttcgaagaagcgctcatgtcccccgacacacgttatcgttgccatcgaaaggacagccttccagatgccgatctggcttcatgtgggagcctatcacaaagttccgccagctttttcaccccccgatctacaaggaatgatgagttgctctcagatttgacaaggacaccccctccgccaagcagcacctttccaaaagcatcttccgagtccagctacttatccattctcccaaagaccccagaggggatctctgaagagcagcggagccaggaactcgctgcaatggaagaaacgcgcatcgtgatactcaacaacctggaggagttgaagcagaagataaaagatatcaacgatcagatggatgagtccttccgcgagctggacatggaatgtgcactattagatggcgagcaaaagagcgaaaccactgagctgatgaaagaaaaagaaatcctcgaccatttaaacagaaagattgctgaactggagaagaatatcgtcggtgagaaaactaaagatgccgatctgttagatgtggagagtaaacactttgaagaccttgagtttcagcaactggagcatgagtctcgcctcgatgaggagaaggagaacctcactcagcagctgctgagggaagtcgccgagtaccaaagaaatatagtgagtagaaaggagaaaatatccgcactcaagaagcaagcgaatcatatagtgcaacaggcccagcgggaacaagaccactttgtgaaagagaagaacaaccttatcatgatgctccagagagagaaggagaatctgtgcaacctggagaagaagtactcctcactgtctgggggcaaaggtttcccagttaatcccaatacgcttaaggaagggtacattagcgttaacgagatcaacgaaccttgcggtaacagcaccaatttgtcccccagcacccaatttccagccgatgcggatgcagtggcaacagaaccagccacagcagtgctggctagccagccgcagtcaaaggaacactttcgatccctagaggagcggaagaaacagcataaagaagggctttacttgtctgataccctccccagaaagaagacgacatcttctatttcacctcatttctcttccgccacaatgggtaggtctatcactccaaaagcccatctccctctgggtcaatccaactcatgtggcagcgtgctgcctccatcattggcagctatggcaaaagatagcgaatcccgacgaatgcttaggggatataatcaccagcagatgagcgaaggtcataggcagaaatcagaattctataataggacggcatcagagagcaacgtttacctgaacagtttccactatcctgatcattcatacaaggatcaggccttcgataccctcagcctggactcctctgattcaatggagacatcaattagtgcctgttcccctgacaacataagcagcgcttccacttcaaatatagcaagaatagaggaaatggagaggctcctgaagcaggcacacgctgagaaaacccgcttactggaatctagagagagggagatggaggccaaaaaacgcgccctggaggaggaaaagcggcggagggagatcctggaaaagcgactacaggaggaaactagtcagagacaaaagctgattgaaaaggaagtaaagatcagagagcgacaacgcgcacaggcccgccctctgacccgttatctgccagtgagaaaggaagactttgatttacgttcgcatgtcgagaccgccggccataatatcgacacctgctatcatgtttcaattaccgaaaagacctgccggggcttcctcatcaaaatgggggggaagatcaaaacgtggaagaaacgttggtttgtctttgatcgaaataagcgcactttctcttattacgcggacaagcacgagacaaagttgaagggtgtgatttactttcaggctatcgaggaagtctactatgatcatctaaagaatgctaataaatcgcctaatcctctgcttaccttcagtgtcaagacgcatgatcggatttattacatggtcgccccctcccccgaagcgatgaggatatggatggacgtcatcgttaccggggccgagggttatactcactttctgttatag

SEQ ID NO: 28908 - DNA, 3348 bp, Artificial Sequence
  Description of Artificial Sequence: Synthetic coding sequence
atggaagagcatagctacatccagaaagaactggacctgcaaaatggctccttagaagaggactccgtcgtccatagtgtggagaatgattcccaaaacatgatggaaagtctgtcaccaaaaaagtactcgagctccttaagattcaaggccaacggtgactactcgggatcataccttaccctttcacagcctgtccctgcaaagcgttccccctcccctctggggacctccgtgcggagctcccccagcctggcgaagatccaagggagtaaacagttttcttacgacggaaccgataagaacatcccgatgaagccaccaaccccgttattgaataccactagctcactgtccgggtacccgttgggtcgtgctgactttgatcattatacaggtcgcgattccgaacgggctctacggctgagtgagaagcccccatactccaaatactcttctagacataagagccatgacaacgtctatagcctgggagggctggagggacggaaggccagcggatctctgctcgcaatgtggaacggttcctccctgagtgacgcgggacctccaccaatcagtcggtccggagctgcatccatgcctagttcccctaaacaagccagaaagatgtccatccaggatagcctggcactgcagccaaagttaacgcgccacaaggaactagccagtgaaaatattaacttgaggactcggaagtacagctcatcttccttatctcacatgggagcctatagccggagtttacccaggttgtaccgagctactgagaatcaactaactcccttatcactgccccccagaaacagccttgggaactctaagaggaccaagctgggagaaaaggacctcccacacagtgttattgataatgacaattatctgaatttctctagcctctccagcggcgctctaccgtataagacctctgcatccgagggtaatccttacgtgagctccactctgtccgtcccagcgtcgccccgtgtcgctagaaaaatgctactggcttccactagcagctgcgcctctgacgattttgatcaggcttcttacgtgggcacaaacccctcccactcactcctggccggggaaagtgacagggtgtttgccacgcggcgcaacttctcctgcggaagcgtggaatttgacgaagccgacctggagtcacttcggcaggcctccggaaccccccaaccagcgctgcgagagcggaagtcttccatcagctctatctcaggccgggatgatctgatggattatcatcggcggcagagagaagagagactgagagagcaagaaatggaaaggctggagcggcagaggctggagacaattctgagtctgtgtgccgagtacacgaagcccgatagccggttgagcacaggcacaacagtggaggacgtgcagaagatcaacaaggagttagagaagctgcagctaagcgacgaagagtctgtctttgaggaagcgctgatgtcccctgataccagatacagatgccatcgcaaggatagcctgccagatgccgacctggctagctgcggatctttgtctcagagtagcgccagcttcttcacgccccgttctaccaggaatgatgaactcctcagcgatctgacacgaactccgccaccaccgagcagtacttttcccaaagcgagttccgagtctagctacttatcgattctgcctaagacacctgaaggtatctccgaagagcagaggtcgcaagagctggctgccatggaagaaaccaggatcgtgatcctcaacaacctggaggaattgaaacaaaagattaaggatataaatgatcagatggacgaatcctttcgagagctggacatggaatgtgcccttctggacggagagcagaagtcagagaccactgagctgatgaaggagaaagagatccttgaccacttgaacagaaagatcgctgaactggagaagaacatagttggtgagaagactaaagacgcagacttactagacgtcgaatctaaacacttcgaggacttggagtttcagcagcttgagcatgagtctagattggacgaggagaaagagaatttgacccaacagctcctgagagaggtcgctgagtatcaacggaatattgtctctcgtaaggagaaaataagtgctctcaagaagcaggccaaccatattgtgcaacaggcccagagggagcaggatcacttcgttaaagagaagaacaatcttattatgatgctgcaacgggagaaggagaacttgtgtaacctcgagaaaaagtattccagtctctctggagggaaggggttcccagttaaccctaacacattgaaagaaggatatatctcagtcaatgagataaacgaaccatgcgggaactcaacaaacctgtccccctccacccagttcccagccgacgctgacgctgtggccacagagcccgctaccgccgtgcttgctagccaaccccagtcaaaggaacattttagatcactagaagagcggaagaagcagcataaagagggcttgtacctgtctgatacactccctcgaaagaagaccacgagcagcatttctccgcattttagttccgccacgatgggtagaagcatcactcctaaggcacatcttccgctgggccaaagcaacagttgcggcagtgtgctgcctccatccctcgccgccatggctaaggactcagaaagccggagaatgctccgcggctacaaccaccagcaaatgtctgagggccatagacaaaagagcgaattctacaaccgaactgccagcgaatccaatgtgtacctcaacagttttcactatcctgaccacagttataaggaccaagcctttgacaccctgtccctggattccagcgacagcatggagacctccatatcggcatgttcccccgataatatcagttccgcatcaacgtccaacattgccaggatcgaggagatggagcggcttctaaagcaagctcacgctgagaagacacgcttgttggagagccgagagcgtgaaatggaggcgaaaaagcgtgcactggaggaggagaagcgccggcgcgagattctagagaagaggctacaagaagagaccagtcagcgccaaaagttaatagaaaaggaagtaaagatccgtgagcggcagagggctcaggcacgtccgcttacaaggtatttacccgtgaggaaagaagatttcgatctcaggtcccatgttgagacagccggacataacatcgacacctgttaccatgtgagtatcactgaaaaaacatgccgcggcttcttgattaaaatgggaggaaaaattaaatag

SEQ ID NO: 28909 - DNA, 5616 bp, Artificial Sequence
  Description of Artificial Sequence: Synthetic coding sequence
atgccttctgtgtgcctgctgctgctgctctttctagcagttgggggagctctcggaaataggcccttccgggcctttgtcgtgaccgacacgacccttacccatttggcagtgcacagagtgaccggggaagtgttcgtgggagcagtgaatagagtgttcaagctcgcgcctaatctgaccgagctcagagcccatgttaccggacctgtcgaagacaacgctcgttgttaccctcctccgagtatgcgggtttgcgcccatagactggcccctgttgacaatatcaacaagttactgctgatcgactacgccgccaggcgattggtggcgtgcggctctatttggcagggcatctgccaattcttgagattagatgacctcttcaagttgggcgagcctcaccatcgaaaagaacactatctgtccggcgcccaagaaccagacagcatggctggggtgattgtggaacaaggacagggaccttctaagctgtttgtgggcactgctgtggacggcaaatctgaatactttcccactttgtcatcaagaaaacttattagcgacgaggattctgccgatatgttcagcctggtgtaccaggacgagtttgtgagttcccaaatcaaaataccctccgataccttgtcactgtaccccgccttcgacatatactacatatacggatttgtctctgcctcattcgtatatttccttaccctacagttagatacgcagcagacactccttgacactgccggggagaaattttttacgtcgaaaatagtgcgcatgtgtgctggtgatagtgaattttattcatacgtggaattccccatagggtgtagctggcgcggagtagaataccgactggtccagagcgctcacctggcgaagcctggcctgctgctcgctcaggccctaggcgtacctgcagatgaggatgtcctgtttaccattttctctcaaggtcagaagaatcgggcatctccaccacggcagactatcctgtgcctgttcactttatccaatatcaacgctcacattcgcagacgcatccagtcttgttataggggtgagggcaccctcgctcttccttggcttctgaacaaggaactgccttgcatcaatacacctatgcaaataaacgggaatttctgtggactcgtgcttaatcaacctctcggcggactgcatgtaatcgaagggctgccactcctcgccgactcgactgacgggatggcgagcgttgccgcctacacatacagacagcattccgtggtgttcataggtacgcgctctggttccctcaaaaaagtgagggtggacggatttcaggacgcgcatttgtacgagaccgtccccgtggtagatggctcacctattctacgtgatctcttgtttagccccgaccacagacacatctacctcttatcagagaagcaggtctcccagctgcccgtagaaacttgcgaacagtatcagtcttgcgccgcatgtctgggatctggggaccctcattgtggctggtgcgtactccggcacaggtgctgtagggagggggcctgcctaggagcttctgctccccacggatttgcagaggaattatcaaagtgtgtacaagtccgggtccgtccaaacaacgtttctgtgaccagccccggggtgcagcttacagtaacgctgcataacgttcctgatctttctgcaggggtaagttgcgccttcgaagcagccgccgagaacgaggccgttctgttgccgagcggggagttactgtgtccctctccaagccttcaggagctccgggccctgacacgaggtcacggagcgactcgaactgtgaggctgcaactgttgtccaaggagactggagtccggtttgccggtgccgactttgtgttttacaattgtagtgtcctgcaatcatgtatgtcctgtgtgggttctccctacccttgccattggtgcaagtataggcatacttgcacgtcacgcccacatgagtgcagcttccaagagggacgtgttcacagtcccgaaggctgccccgaaatactgccaagtggtgacctccttatcccagtcggtgtgatgcagcccttgaccctgagagctaaaaacctcccacagcctcagagcggtcaaaaaaactatgagtgtgtcgtgcgcgtccaaggcagacagcaacgggtgcctgctgttagattcaactctagctccgtacagtgccagaacgcatcatacagttacgaaggggacgagcatggcgacaccgagctggatttctctgtagtgtgggacggggactttcccatcgacaagcccccatcgtttagagcgttgctgtataaatgctgggctcaaagaccttcctgcggactgtgcctgaaagcggacccacgctttaactgcgggtggtgcatctctgagcatcgatgtcagctaagaacccactgccctgcacctaaaaccaattggatgcacctgtcccagaaagggacaaggtgctcccaccctcgcatcactcaaattcaccctttggtcggaccaaaggaaggaggcactcgcgtaactatcgtgggcgacaatctcggcctccttagcagggaggtggggctcagagtggccggcgtgcgatgcaatagcattcctgctgagtacatctccgctgaaagaatcgtatgcgagatggaggaatctcttgtgccctcgcccccaccaggaccagttgagctctgtgtgggggactgcagcgcagacttccggacacagagtgaacaggtttacagtttcgtaaccccaacgttcgatcaggtgagcccttccaggggaccggcctcaggtggaaccagactaaccatatcgggttcttctctggacgctggatctcgggttaccgttactgtcagggattccgagtgccagtttgtgagacgggacgctaaagccattgtctgcatttctccactgagtaccttgggtccctctcaggcccctattactcttgccatcgacagagccaatatatctagtcccgggttgatttatacgtacacccaagacccaacggtcacacggctggagcctacgtggtccataattaatgggtctacagccatcacggtgtctggaacacatctgctgacagtccaggaaccacgggtcagagcaaaatatagaggtatcgagactactaacacttgtcaggtcattaatgatactgctatgttatgtaaggctcctggcatatttctcgggcgaccccagccacgtgcccagggcgaacaccccgatgagttcggattcctacttgaccatgtgcagaccgcacggagcctgaatagatcatcattcacttattacccagatccttcttttgagccattaggcccatccggggtattggacgtgaagcccgggtcacacgtggttctgaaaggcaagaacctcatcccggctgccgctggctcgtctagactcaactataccgtgctgattggtgggcagccatgctcacttactgtctcagacacgcagctgctctgcgactcccctagccagactggccggcagcctgtgatggttttagtgggcggtttagagttttggctggggacgctccacatatctgccgagagagcactgacgctgcccgcaatgatggggctagccgccggcggagggctgctgctcttggcaattactgcggtactggtcgcatacaagagaaagactcaggatgcagaccgaactctgaaacgactgcagctgcaaatggacaatctcgaatcacgagtggccctagagtgcaaagaagccttcgccgaactacagaccgatatcaatgaattaacaaaccatatggatgaggttcaaatcccattcctagattatcgcacctacgccgtacgggttttattcccaggtatagaggcccatcccgtgttgaaggaactggacacacccccaaacgtggagaaagctctgagacttttcggacagttattgcattcaagagcttttgtcctgacttttatccatactctggaggctcagagctccttcagcatgagggatagggggactgtcgcaagcctgaccatggtggccctccagagtcggctggattacgctacaggattacttaaacagctgctcgccgacttaatcgagaagaacctagagtctaagaaccaccccaaacttctgttgcggagaaccgagtccgtagcagaaaagatgctgaccaattggttcacttttctactgcacaaattcttgaaagaatgcgccggcgagccgctgtttctgctgtactgcgcaattaagcagcagatggagaaaggaccgatagatgctatcacgggcgaagctcgatacagcttgtcagaggataaattgataaggcagcaaatcgactacaagacccttaccttgcactgcgtgtgccccgagaatgaggggtcagcccaagtgccagtgaaagtcctaaactgtgattctattacgcaagccaaggacaaactgttggatacagtttataaaggtattccttattcccaaaggcccaaggccgaggatatggacctcgagtggcgacaggggcgaatgactcgtattatcctacaagatgaggatgtaacaacaaaaatcgaatgtgattggaagcgactcaatagtctcgcacattaccaggttacggatgggtccttagttgcccttgtcccaaagcaggtgagcgcgtacaatatggccaacagcttcacatttacccggtccctttctcgttatgaatctctactgagaactgcctcttcgcctgactctctgcgctctcgcgccccaatgatcactccagaccaggagaccgggactaagttgtggcatttggtgaaaaatcatgatcatgccgaccatcgggagggcgaccgcggcagtaagatggtgagcgagatctatctcacaagactcctcgcaacgaaaggtaccttgcagaagtttgtggacgaccttttcgaaacagtattctccacggctcaccggggatcagcgttacccctagccatcaaatatatgtttgactttttggacgagcaagcagatcagcgccagatctcagatcccgatgttagacacacatggaagagtaactgtctgccactacgcttttgggtaaacgtcatcaagaaccctcagttcgttttcgatatccataaaaattcaataacagacgcttgcttgtcggtggtcgcccagacttttatggacagctgtagcacttcagaacatcgccttggaaaggactccccctccaacaagctgctttatgccaaagacattcccaactacaagtcttgggtcgagaggtactatcgcgacatcgctaaaatggcctctatttctgatcaggatatggacgcctatttagtcgagcagtcaaggcttcacgccagcgacttttcggtgctatcagcgctgaacgaattatatttttatgtcactaaatacaggcaggagattctgaccgcgctggatcgggatgccagttgcagaaagcacaagctgagacagaagctggagcagattatctcccttgtctccagtgactcctag

SEQ ID NO: 28910 - DNA, 4707 bp, Artificial Sequence
  Description of Artificial Sequence: Synthetic coding sequence
atggaagtgtcccggaggaaagccccaccccggccaccgaggccggctgcgccactgcccttattggcctacttactcgccctcgccgccccaggccgcggagccgacgagcctgtgtggcgatctgaacaggcaataggcgctatcgccgcctctcaggaggacggggtgttcgtcgcatcgggctcctgcctagaccagttggattatagcctggaacatagtctgtccaggctgtatagggatcaggctggaaactgtaccgagcctgtctcactcgccccacctgctcggcctcggcccgggagttcttttagcaagctccttctgccttatagagagggcgcagccgggctcgggggtctcctgctgacaggctggacattcgatcggggcgcttgtgaggttagacctctcgggaatctgtcccgaaattctcttcggaatggcacagaggttgtatcttgtcacccacagggcagcaccgccggagtggtttacagggcggggcgcaacaaccgctggtatctcgccgtggccgccacgtatgttctgcccgaacccgagactgcctctaggtgtaaccccgctgccagtgaccacgacaccgctatcgcactcaaggatacggagggcagaagcctggcaacacaggagttgggcagattgaaactgtgtgagggcgctggaagcctccacttcgtggacgcatttttgtggaacgggtctatatacttcccctattacccatataactacaccagcggcgcagccactggctggccctccatggcacggatcgctcaatctaccgaggtgctgtttcaaggccaggcttcactcgattgcggacatggccatcccgacggcagacgacttctattgtcttctagtctggtcgaagcgctagacgtgtgggcgggagtgttctcagcagctgccggtgagggacaggaaaggcgctcccccactacgactgcactatgtcttttcagaatgtctgagattcaggccagggcaaaaagagtgagctgggatttcaaaacagccgagtcccattgcaaagagggcgaccaacctgaacgagtccagcccatcgcttcctctactcttattcactccgatttgacctccgtctatgggactgtggtcatgaaccggactgtgctcttcctgggaaccggtgacggacaactgctgaaagttatcttgggcgagaatctcacttcaaactgccccgaagtgatctacgagattaaagaggagacacccgtcttttataagctggtgcctgacccagtgaagaacatttacatctatctaacagctggaaaagaggttcgcagaatccgcgtcgccaactgtaacaagcataaatcgtgtagtgaatgtctgacagctaccgacccacactgcggatggtgccactcccttcagcgctgtacatttcagggagactgcgtgcactcagaaaacctggagaattggctcgatattagctcaggtgcaaaaaagtgcccgaagatccaaataattcgatcctctaaggaaaaaacaactgtcacgatggttgggtctttcagccccaggcacagtaaatgcatggtgaagaacgtggacagttctagagagctctgccaaaacaagtctcagcctaaccgcacatgtacttgcagtatacccacccgggccacatacaaggacgtaagtgttgtcaatgtaatgttttctttcggctcctggaatctgagtgaccgtttcaattttaccaactgcagtagtctgaaggaatgcccagcttgcgtcgagaccggctgtgcatggtgcaagagtgcccgaaggtgtatccatccctttacggcctgcgaccctagtgactacgagcggaatcaagagcagtgccccgtggctgtggaaaaaacatccggtgggggcagacccaaagagaacaaaggcaacagaacaaatcaggccctgcaggtcttctacatcaagtcaatcgagcctcaaaaggtaagcacactggggaaatcaaacgtgatcgtgacaggcgcaaacttcacccgtgcttcaaacatcacaatgatcttgaagggaacgtccacatgcgacaaggatgtcattcaggtctctcatgtactgaatgacacacacatgaagttcagtttgccatcaagtagaaaggagatgaaggacgtgtgcattcagttcgacggggggaattgttctagcgtgggctcactttcttacatagcgctgccacactgtagtctgatctttcctgcaactacctggatctccggagggcaaaacatcacaatgatgggaagaaacttcgacgtgatcgacaatctgatcatcagtcacgaattgaagggcaacataaatgtgtcggaatactgcgtggcaacttattgcggcttcttggccccttcactgaagagcagtaaggtgaggacaaatgtgaccgtcaagttgcgcgtgcaggatacatatttagattgcggtactctgcagtacagagaggatcctaggttcaccggttaccgggttgagagtgaggtggacacagaattggaagttaagattcagaaggagaatgacaacttcaatatatccaagaaagacattgaaatcaccctgttccacggggagaatggacaactgaattgctcattcgaaaacattaccagaaaccaggatttgaccaccatcctatgtaaaattaagggcatcaaaacagcaagcaccatcgccaattcatcaaaaaaggtgcgtgtgaaactcggcaacctggagctgtatgtagagcaggagtcagtgcccagcacttggtattttctcattgtgctgcctgtgctcttggtcatcgtgatctttgccgcggtcggggtgaccagacataagtccaaagagctgagcaggaagcagagccagcaactggagctgctggagtcagagcttcggaaagagataagggatgggttcgccgaattgcagatggataaactcgacgttgtggactctttcggcactgtccctttcctcgattacaagcacttcgcccttagaacattttttcccgagtcaggcgggtttacacacattttcaccgaggacatgcataaccgggatgccaacgataaaaatgagtcactgactgctctcgacgcacttatctgcaataagtccttcttagttaccgtgattcacaccctcgaaaaacagaagaacttttccgttaaggatcggtgtctgtttgcttcatttctcaccatagctttgcaaacaaagctcgtttacctgacaagtatattagaggtactgacacgagacctgatggagcagtgctcgaacatgcagcctaaattgatgctgcgtcgcaccgagagcgtggtggagaaacttttaaccaactggatgtccgtctgcctctctggatttctcagggagaccgttggggagcccttctacctgttagttactacgctgaatcagaaaatcaataaaggccccgtcgacgttataacttgtaaggcactttatacgctaaacgaggactggcttttgtggcaagtgccagagttttcaaccgtggccctcaacgtcgtgttcgagaagattcctgagaacgaaagtgctgacgtatgtaggaatatttcagtgaacgtgctagattgcgataccatcggtcaggcaaaggagaagatctttcaggctttcctcagtaagaatgggtcaccttacggcttgcagctcaacgagattggtctcgagctccagatgggcacaagacagaaggagttgctggacattgacagctctagtgtgatacttgaggatggcattacaaagcttaatacaatcggccactacgagatctccaatggatctacaattaaggtgttcaagaaaattgccaacttcacctccgacgtagagtactctgacgatcattgtcaccttatcctccccgacagcgaggcttttcaagacgttcaaggtaaacgacaccggggcaaacacaagtttaaggtcaaggaaatgtatctgacaaagctcctgagtaccaaggtggcaattcactctgtcctggagaagcttttcaggagtatctggagtttgcccaactcgagagcccccttcgcaattaagtactttttcgacttccttgatgcccaggcagagaacaagaaaattactgaccccgacgtagtgcacatctggaaaaccaatagcttgcccttgcggttctgggtcaacattctgaagaatcctcagttcgtgtttgatatcaagaagacacctcacattgatggatgtcttagcgtgattgctcaagcctttatggatgcattctccctgacagaacagcagctgggcaaggaggctcctacgaataaacttctgtatgccaaagacattcccacctacaaggaggaggtgaaatcctactataaggcgatccgagacctcccacccctctcatccagcgaaatggaggagtttcttacacaggaatctaagaagcatgagaatgaattcaacgaggaggtggcgctcacagaaatctacaaatacattgtgaagtacttcgatgagatattaaataaactggaacgggagaggggcttggaagaagcccaaaaacaactgcttcacgtcaaggtgctgtttgatgagaagaaaaaatgcaaatggatgtag

SEQ ID NO: 28911 - DNA, 1848 bp, Artificial Sequence
  Description of Artificial Sequence: Synthetic coding sequence
atgcaacacctctgccttctagctgccgtcggggttacccgacacaaaagcaaagagctgagccgcaaacagtcacagcagcttgagcttttagaatctgaactaaggaaggagatcagagatggctttgctgaattgcagatggataagttagacgtagtggattcatttggaacagtaccctttctcgattataaacacttcgctctgagaacattttttccagagtctggaggattcactcacattttcacggaggacatgcacaaccgagacgctaacgataaaaatgagtcgctcacagccctggacgctttgatctgcaacaagtcattcctggttacagtcatccatacgctggagaaacagaagaatttctccgttaaggatcgatgtttatttgcttcttttttaaccatcgcgttgcagacaaagctggtgtacttgacgtccattctcgaagtgcttactcgcgaccttatggagcagtgtagcaacatgcagcctaaattgatgttgcgtagaactgagtccgtggtggagaagttgttgaccaattggatgtccgtatgtttgtccggcttcctgagggaaacagtcggagagcctttctaccttcttgtcacaactttgaatcagaagatcaacaaggggccagttgatgttatcacgtgtaaagccctctatacactcaacgaagattggttgctgtggcaagtgccagaattctctacagtggccttgaatgtcgtgtttgagaaaattcccgagaacgaaagcgccgatgtgtgtagaaatatcagcgtgaacgtgctagactgcgatacaataggacaggctaaagaaaagattttccaagcatttctctctaaaaacggctccccctacggactccagctcaacgaaatagggctggagctgcagatgggcacccgtcagaaggagcttctggacatcgacagctcgagtgtgattctagaggacggcattactaagctcaacacaatagggcattacgagataagtaatggctcgactattaaggtctttaaaaagatcgccaattttacgtccgacgtggaatactcagacgaccactgtcatctcatcctgcctgattcagaagccttccaggatgtgcagggcaaacggcaccgagggaagcataagttcaaagttaaggagatgtatctgacaaaactcctaagcacgaaagtagccatacacagcgtgcttgaaaagttgttcagatcaatttggagcctcccaaatagtcgcgcaccatttgcaatcaagtatttttttgactttctggacgctcaggccgagaacaagaaaataacggaccccgatgtcgtgcacatatggaagacgaactcgctgccactgcgcttctgggtgaacatccttaaaaatcctcaattcgtattcgacatcaagaagactcctcatattgacggctgcctgtcagtgattgcccaggcatttatggacgccttcagtcttaccgagcaacaactgggaaaagaggcaccaactaataaactgctgtatgctaaggacattcccacctacaaagaggaagttaagtcatactacaaggcaatccgggatctgccacctttatctagttctgagatggaagagtttctcacacaagagagtaaaaagcatgaaaatgaattcaatgaggaggtggctctgactgaaatttataagtatattgtgaagtacttcgacgagatcctgaataaactggaacgtgaacgtgggttagaggaggcgcagaagcagctcctccatgttaaggtcttattcgatgagaagaaaaaatgtaaatggatgtag

SEQ ID NO: 28912 - DNA, 1593 bp, Artificial Sequence
  Description of Artificial Sequence: Synthetic coding sequence
atgggacggttacttagagcggcgcggttaccgcctctgctgagccccctcctgctgcttcttgttgggggagccttcttaggggcctgcgtggccggttctgatgagcccgggccagagggcctgacaagcacctcactgctggatctgctgcttcctacaggcctcgagcctcttgattctgaggagccttctgagacaatgggcctgggggccgggttgggcgcccccggatccggtttcccctccgaggaaaacgaggaaagtagaatcctccagcccccacaatacttttgggaggaagaagaggagctgaatgattcatccctggacttaggccccaccgcggattatgtcttccccgatctcacggaaaaagcaggatctattgaagacacaagtcaggctcaagaactaccaaatttgccttccccactgccgaagatgaaccttgtagagccaccatggcacatgccgcctcgcgaagaggaagaagaggaggaggaggaggaagagcgcgagaaggaagaggtggagaagcaagaagaagaggaggaagaggaactcctgccagtaaacgggagtcaagaagaagctaagccccaggtacgggatttctctctgacttcttcatcccagaccccgggcgcaactaaatcaagacacgaagattcgggggatcaggcgtcaagtggcgtcgaggttgagagctccatgggtccatcactgctgcttccttctgtcacaccaacaactgtcactcccggtgatcaggacagcacctcccaagaggctgaagcgacagtgttgcctgctgccggactaggtgtggagttcgaagcgccccaggaggctagtgaggaggccactgccggggccgctggcctgtctgggcagcacgaagaggtgccagcgctaccaagctttcctcagacaacagccccaagcggggctgagcatccggatgaggacccgctgggtagtcgcacctcagcgtccagtcctccccagttgctggccctggttgaggaggtactgccccgacacggatccgggcatcatggagcctggcacatctccctgtccaagccgagcgagaaggagcaacatttattgatgacactggttggtgaacaaggggtcgtgcccacacaggacgtcctatcgatgctgggagatatccgccgatccttggaggagatcggcattcagaattactcaacaacctcaagctgccaagcccgcgcctcacaagtgcggagtgactatggcacattgttcgtagttcttgtcgtgattggcgcaatatgcattattattattgccctcggtctgctgtataactgttggcagaggcggctgccaaaacttaagcatgtgtctcacggggaggaactgagattcgtggaaaatggttgtcacgacaatccgaccctggatgttgccagcgatagccaaagtgagatgcaggagaagcacccaagcttgaacggcggaggtgctttaaatggtcctggttcctggggagccctgatgggtggcaaacgggaccccgaggatagcgacgttttcgaggaagacacacatttatag

SEQ ID NO: 28913 - DNA, 1818 bp, Artificial Sequence
  Description of Artificial Sequence: Synthetic coding sequence
atggggcgcctcctacgggcggcccggctgcccccactcctttcgccactcctgctgctcctggtgggaggcgcttttctgggcgcgtgcgtagcaggaagcgatgagcccgggcctgaaggtcttacgtccacctcacttctggacctgctcctgcccacagggctcgagcctctggattcagaagagcctagcgaaacaatgggactgggcgctggcctaggcgcacctggcagtgggttccctagcgaagagaatgaggagtccaggattttacagcccccacagtacttttgggaagaggaagaggaactgaatgacagttccctcgatctcggacctacggccgactatgtcttcccagatctcactgagaaggcaggcagcattgaagatactagccaggcacaggagcttcccaacttgccgagtcccttgcctaagatgaacttggtcgaaccaccatggcatatgccacctcgggaagaagaggaggaggaagaagaggaagaagagcgggagaaagaagaagtggaaaagcaggaagaggaggaggaggaagagctgctgccagttaatggatcacaagaagaagctaagccacaggtgcgggacttttctcttacctcctcaagccagacaccaggtgctaccaagagcaggcacgaggattccggagatcaggcctcaagcggagtcgaggtggagtccagcatgggcccttcccttttgcttccgtcagttactcccactacggtgacccccggcgaccaggacagtacctcccaagaagccgaagctaccgtgctcccggcagccggcctcggagtggaatttgaggccccccaggaagcttctgaagaagccaccgccggcgccgccgggctcagcggccagcacgaggaagtgccagccctgccctccttcccgcagacaactgctccttcgggggcagagcatcctgacgaagatccactcggtagtcggacctctgccagctcaccactggccccaggcgacatggagctgacaccatcatcagctacactgggtcaggaagacctgaaccagcagctactggaaggtcaggcagcggaagcccagagcagaatcccatgggactccacacaggtaatatgtaaagactggtcgaacctggcaggaaagaattacatcatcctcaacatgacagagaacattgattgcgaagtcttccggcagcacagaggcccccagctgcttgcactggtagaagaggtgctccccaggcatggcagcggacaccatggagcctggcacatctcattgagtaaaccttcagagaaagagcagcatttgctgatgacattggtgggtgaacaaggcgtagtccccacacaagatgtacttagtatgttgggggacatcagaaggtccctggaggagattggaatccagaactacagcacgacctctagttgtcaggcaagggcctcccaggtgagatcagattacggcaccctgttcgtggtgctcgtcgtgattggcgctatctgtatcattattatcgccctgggcctgctgtacaattgttggcagagacgattgcctaagcttaaacacgtcagtcatggcgaagaactgcggtttgtcgaaaacggctgtcatgacaaccctactctggacgtagcgagcgattcgcagagtgaaatgcaggaaaagcatccgtctctgaacggcggcggtgccctaaacggtcccggaagttggggcgccttgatgggtggaaagcgtgaccccgaagacagcgacgtatttgaggaagacacccatctttag

SEQ ID NO: 28914 - DNA, 717 bp, Artificial Sequence
  Description of Artificial Sequence: Synthetic coding sequence
atgctcacccctttgggcaagttttccacagctaaattcgccgtccgcctgccccgcgtgtgggaggcccgcgccccctccctgtctggcgcacccgccccaactccgccagcacctcccccctctagaagctctagacttggtctttggcctaggtgctttctgatattcccccagcttcgcattctcctcttaggtccgcaggagtcgaacaactctacagggacaatgtggaaagtttccgctttgctcttcgtcctgggctcagctagtttgtgggtcctcgccgaaggggcctctaccgggcaaccagaggatgataccgagactacaggactggaggggggtgtggcaatgcccggcgccgaggatgacgtagtcacgcctggcacaagtgaagatcggtacaagtccggcttgaccacgcttgtcgccacaagtgtcaacagcgttacaggaatcagaattgaagacctgccaacttctgaaagtaccgtgcacgcacaggaacagtccccatctgccacagcatctaatgtggccacatcccatagtaccgagaaggtggatggcgacactcagacaactgtggaaaaagacggactgtcaaccgtgaccttggtcggaattatcgtgggggtccttctggctattggcttcataggcgctatcatagtggtcgtgatgagaaagatgtctggtcggtattctccttag

SEQ ID NO: 28915 - DNA, 711 bp, Artificial Sequence
  Description of Artificial Sequence: Synthetic coding sequence
atgcttactccactggggaagttctcgacagctaaattcgctgttaggctcccccgggtatgggaggccagggcaccatctctgagtggggcccctgcgcccactcctccggccccccctccaagccgaagcagccgcctcggcctttggccacgctgtttcctcattttcccccagctacgcattttgctgctgggcccccaagaatccaataactcaacaggaaccatgtggaaggtgagcgcccttctgtttgtcctgggatctgcttcactgtgggtgttggctgagggggcttcaaccgggcagcctgaggacgacacagagaccacaggattagaaggaggcgtggctatgccgggggcagaggacgatgtggtaacacctggcactagcgaggataggtataagagcggcttgaccacactggtggctacaagcgtgaactccgtgacaggcatccgaattgaggacttgcctacctctgagtccacggtacatgcccaagaacagagcccatcagctactgcatctaatgtcgctacttcccactccactgaaaaggtggatggggatacccagactacggtggagaaagacggcctttctacggtgacattggtggggattatcgtcggcgtccttctggctatcggatttattggcgcaataattgtggtcgtgatgagaaagatgagcggccgtccctag

SEQ ID NO: 28916 - DNA, 363 bp, Artificial Sequence
  Description of Artificial Sequence: Synthetic coding sequence
atgcctggcgctgaagacgacgtggtgactcctggaacctcagaagacagatacaagtccggtctgactacacttgtggccactagcgtcaactcagtaaccgggatcaggattgaggaccttcctactagcgaatctacggtccatgctcaggagcagtccccctcagcaaccgcctccaacgtcgcaacgtcacactcgactgaaaaagttgacggggatactcagactacagtagagaaagacggcttatcaaccgtgactcttgtaggaatcatcgtaggggttcttctggccataggctttatcggcgctataatcgtggtggtgatgagaaagatgagtgggcggtactctccatag

SEQ ID NO: 28917 - DNA, 357 bp, Artificial Sequence
  Description of Artificial Sequence: Synthetic coding sequence
atgccaggagccgaggacgacgttgtaacgcccgggacttctgaagacagatacaagagcgggctaactacactagtcgctactagcgttaactcagtgacgggaattaggatcgaggacctgccaacaagtgaatccacagtccacgcccaagaacagagcccatccgctaccgcgagcaacgtcgccaccagtcacagtactgaaaaagtcgacggggacacacagaccactgtggaaaaagatggcctcagcactgtgacgctggtcggcataatcgttggcgttctgctggcaatcgggttcatcggggctatcattgtggtcgtaatgaggaagatgagcggaaggccatag

SEQ ID NO: 28918 - DNA, 363 bp, Artificial Sequence
  Description of Artificial Sequence: Synthetic coding sequence
atgcccggcgctgaagacgatgtggtgacacccgggacatcggaggataggtacaagtccgggctaacaacattagttgcgacaagcgtgaattctgtgacaggaataaggatcgaagacctcccaactagcgagagcaccgtacacgcgcaggagcagtcgcctagtgcgacagccagtaatgttgcaacttcccactcaacagagaaggtggatggggatacccagacaacagtcgaaaaggatgggttatccaccgtcacattggtgggtatcattgtcggggtgctgttagctattgggttcataggagccataatcgttgtagtaatgcgcaagatgagcggtcgatatagtccgtag

SEQ ID NO: 28919 - DNA, 363 bp, Artificial Sequence
  Description of Artificial Sequence: Synthetic coding sequence
atgcctggagctgaggacgacgtagtaacaccaggtacctcagaggatagatacaagtcggggctgaccactctggtggctactagcgtgaattcagtaactggcatccgaattgaagatctaccgactagtgagtccacagtgcacgcccaggagcagtccccctccgcaactgcctcaaacgtagcaacatcacactcaaccgaaaaggtcgacggcgacacccagacgacagttgagaaagacggattaagtactgtgacccttgtaggaataatcgtgggcgtactgctggccatcgggtttattggcgcaattatagtggtagtgatgagaaagatgtcagggcggtattctccttag

SEQ ID NO: 28920 - DNA, 981 bp, Artificial Sequence
  Description of Artificial Sequence: Synthetic coding sequence
atgaggactgaagcacaggttcccgccttgcagccaccagagccaggactggagggggcaatgggtcatagaaccctggtactcccatgggttttattgaccctctgtgtgacagccggcacccctgaggtctgggttcaggtaagaatggaggcaaccgagttgtcgtcctttaccatccgttgtggcttcctgggatcaggttccatctcactagtcacagtctcttgggggggtcccaacggagccggtggcacgacgctagctgtgttacacccagaaaggggtattcgacagtgggcccccgcacggcaggcacgttgggagacccaaagcagcatttccctcattttggaaggaagcggagcgtcaagcccatgtgccaatacaacattctgttgcaaattcgcctccttccctgaagggagctgggaagcatgtggctccctccccccgtcaagcgatccagggctcagcgcaccccctactccagcacccattctcagggccgatttagcaggcattctaggcgtcagtggggtgctgctatttggatgcgtttatttgctgcacctcctgcgccgccataagcaccgacctgctccaagactacagccgagcagaacatcccctcaggctcctagggctagggcttgggctccttctcaggcgtctcaggccgcactgcatgttccttatgcaacgattaatacatcatgcagaccagccaccttggatactgctcacccgcatgggggcccatcttggtgggccagcctgcccactcacgcagcacacagacctcaggggcccgccgcttgggcctcaacacctatccccgctcgagggagtttcgtgtctgtagagaacggtctgtacgcccaagctggcgagaggcctccccacacaggcccgggcctaacgcttttccccgacccgcgaggacccagggcgatggagggccctctgggtgtccgttag

SEQ ID NO: 28921 - DNA, 972 bp, Artificial Sequence
  Description of Artificial Sequence: Synthetic coding sequence
atgcagcctagtggctgggctgccgctagagaggccgctggccgcgatatgctggcagctgatctgcgctgcagtttattcgcttccgctctccaatcctataaaagagacagcgtgctgcggccatttcccgcgtcttacgcgcggggagattgtaaggacttcgaggcattgctcgccgatgccagcaagcttccaaatctgaaggaactcctgcagtcctctggggacaaccacaagcgtgcatgggacctagtgtcctggattctgtctagcaaggtcttgacgatccacagcgcagggaaggcagagtttgaaaagatccagaaactcaccggggccccccacactcctgtgcctgccccagatttcctgtttgagatcgaatactttgatccggccaacgcgaaattctatgaaactaagggggaaagggacttgatctacgcattccatggctcacggcttgaaaatttccactcaatcatccataatgggctgcactgtcacctgaacaagacgagtctcttcggggaaggaacctatttgacctccgacctttcacttgccttgatttactcccctcacggtcacggctggcagcacagtctgttaggccctattctcagctgtgtagccgtgtgcgaagtcattgaccaccctgacgtgaagtgtcagacaaaaaaaaaagatagtaaagaaatcgacaggcgccgggctcgtatcaagcattctgaaggcggggacatcccacccaagtatttcgtggttaccaacaaccagctactaagagtaaaatacttgctggtgtattcacagaagccgccaaaaagtcgggcctcctctcagttaagctggttctcctcccactggtttactgtgatgatatcactataccttctgctcctactaatcgtgtccgtgattaatagttcagcattccagcacttttggaatagggccaagcgatag

SEQ ID NO: 28922 - DNA, 1563 bp, Artificial Sequence
  Description of Artificial Sequence: Synthetic coding sequence
atgttttgcacccgcggcctgttgtttttcgctttcctcgcggggctcgacatcgagttcacaggcctgcggtccaacctgtctggaccacagcaaatctctctgttcgacctcccttctgaatggtacttaaaaaccaggcaatctgttcaacagttcaccgtatgccagatcggtctgtcagtatttagcgccattgagggtgaagccaacaaatatatagcacacagttgtaacttttacttattcccaaccactttcggaatcctcgattctgaattttcattccaggctagcagtgtccagtttctgaaccagtatgggttcaactacaataaattcttaaaaaatggtatcccttatatgaatgaggagcaggaaaaaaaaatccgccacgacatcctgaccgggaattggcgcgttagatccagcccagacaaagaccagataaaagttgtcatcgacgaggtcacccggtggttggagctcgcaaaagagggagactggatgaccctcccgggcatcacaggatttcaggctttcgaagtccagctggtgctccggcaggccctacctaacatttggaccgtcctgaaagacgagggagtagtggtgaaaaaagtctccaaacagcatcggtggtacctgcagaatactagttgcgatagggaaagctgctggaaagagaacatcctgttaagcgctcggggcttctctgtgttttttcagatgctggtgaaggctcagaagcctcttgtcggccacaatatgatgatggatttattgcacctccacgagaagtttttccgtcctctgcccgagtcatacgatcagttcaagcagaacattcattccctctttcctgttctcatcgacacgaaaagcgtgactaaggacatttggaaggaaatgaactttccacgcgtgtccaacctctccgaagtctatgaggtactgaatagcgatctgaatcccacaaaaaatagcggcccagagatcgtgcacgcgagtagatgtgaaaagtatgtggaaacaaaatgcccgcatgaggcggcctacgacgctttcttgtgtggtagcgtgctgctcaaggtggcacacctcctcctgcagaagatctatcacattgacccagtgccagaatcttcgtttccgcaatacctcgacgtgcttgccccctacgtcaatcaggtaaatctgatcagggccggcgttcccaagatcaattttagcggaccggattatccctctataagaccccccatactgattctgtccgtcaaacgctggcccggggtcagcgaacagcaagtttatcacaaattccagaatctgtgcaagtttgacgtgcggcgactgactcggagtcagtttctgctactcacaaacaagtttaaggatgcccgaaatatccttaaagagtatagagaccaccccactctctgtataagcctgtacagatactggcggcacagtcccaacgttaattgccttttacaggtctgcggcatagtgactgcatgggccctcctggctttcattctgggacgctcaggcacatag

SEQ ID NO: 28923 - DNA, 792 bp, Artificial Sequence
  Description of Artificial Sequence: Synthetic coding sequence
atggataactcctggcggctcgggcccgccatcggcttaagcgctggccagtctcagttgctggtgagcctgctgcttcttttaactcgcgtacagcccggcaccgacgtggccgcaccagagcatatcagttatgtccctcagctgtctaacgacacattagctggccgcctcaccctgagcacattcacccttgaacaaccactagggcagttcagctcgcacaacatatcagacttggataccatctggctagtggtggcactctccaacgcaacacaaagcttcaccgcacctcgtacaaaccaggatatccctgctcccgcaaatttttcccagagagggtactacctcaccctgcgcgcaaatcgggttctttaccagaccaggggccagctacacgtccttagggtgggcaatgatacacattgtcagcccaccaaaatcggttgcaatcaccccctgccgggcccaggaccttatagggtaaaattcctggtcatgaacgacgaggggcccgtggcagagaccaaatggagctcagataccagactgcagcaggcgcaagccctccgcgcagtgcctggtccacagtcccccggaacagtggtgattatagctatcttaagcattctgctggcagtgctgctgacagtcctgctggccgtgctcatctacacttgctttaacagctgccggtccaccagtctgagcggcccggaggaagccggttctgtgagacggtatacgacccacctggcttttagcactccagccgagggcgcatcttag

SEQ ID NO: 28924 - DNA, 2352 bp, Artificial Sequence
  Description of Artificial Sequence: Synthetic coding sequence
atggcggcatgcaggtactgctgtagctgcctccgcctccgccccctgagtgacggcccctttctgctgccaagacgtgatagagctctgacccaactgcaagtcagagcactgtggtcaagtgccgggagccgagcagtcgcagtggacctcggaaatcggaagctggagatttcttccggtaagctggcacggttcgcagacggctcagctgttgttcagtccggagacaccgcggtgatggtgacagccgtgtccaagactaagcccagtccaagccagttcatgcctttggtggtcgactatagacagaaagccgctgcagccggacgcatacctaccaactacctgcggcgcgaaatcggtaccagcgataaagagatcctgacttcccgcatcattgatcgttctatcaggccactgttccccgcgggatacttctacgacacacaagtcctgtgcaaccttttggccgtcgacggcgttaatgaacctgacgtgttggccatcaacggggccagcgtcgctctctctttatcagacattccctggaatggcccagttggcgccgttcgaatcgggattattgacggtgaatacgtggtcaacccgacgagaaaagaaatgtccagctctacactgaatctcgtggtcgcaggggctccgaagagccaaattgtgatgcttgaggctagcgcggaaaacattcttcagcaggacttttgtcacgctattaaggttggtgtgaaatatacacagcagatcatccaaggtatccagcagctagttaaagagactggcgtgaccaagaggactcctcagaaactgttcacgccaagtcccgagatcgttaaatatacccataagctggctatggagcgactgtacgccgtatttactgactacgagcacgataaagtgtcacgggacgaggccgtcaacaaaatacgcctcgacacagaggagcagttaaaggaaaagtttcccgaagccgacccttacgaaataattgaatccttcaatgtggtggccaaggaagtgttcagatctatcgtacttaatgaatataaaagatgtgacgggcgggatctgacttcactgcggaatgtctcatgtgaggtagacatgttcaagacactgcacggctccgccctctttcagcgtggtcagacccaggttctctgcaccgttacgtttgatagcctggaaagcggaatcaagtctgaccaggtcataacagctattaacggcattaaggacaaaaactttatgctgcattatgaattccccccctatgccaccaacgagatcggcaaggtcaccggccttaacaggagggaactgggccatggtgcgcttgcagagaaagcactttaccccgtgatccccagagactttcctttcacaatcagggtaacctccgaggtgctagagagcaacgggtcttcaagcatggcatccgcttgcgggggctccctcgcccttatggactcaggcgtccccattagtagtgccgtggccggagtggccatcggcctcgtcaccaagaccgaccccgagaagggcgagatcgaggactacagacttctaacggatatcctggggattgaggattacaacggggacatggacttcaagatcgctgggacaaacaagggaatcacagctttgcaggcagacatcaagctgccaggtattccaatcaaaatcgtgatggaagctatacagcaggcctcagtggccaagaaggagatcctgcagattatgaataaaacaattagcaagcctagggcatccaggaaggagaacgggcctgtggtggagacagtgcaggttccgctctccaaaagggcaaaattcgtcggcccagggggatataacctgaaaaagcttcaggccgagactggtgtcactatctctcaggtggatgaggagaccttttctgtgtttgccccgacaccatccgcgatgcatgaagcacgtgactttatcaccgagatttgtaaggatgatcaggagcagcagcttgaatttggcgccgtgtacactgcaactattacagaaatacgcgacaccggggtgatggtaaaactgtacccaaacatgaccgccgtgctactgcataatacccagctggatcagcgaaagataaagcaccccaccgcactgggactcgaggtgggccaggagatccaggtaaaatacttcggccgggatcccgccgacgggcgcatgcgattaagtagaaaagtgctgcagtcacccgccaccacagtggtgagaactcttaacgataggtccagtatagtgatgggggaacccattagccaatcgtcctctaactcacagtag

SEQ ID NO: 28925 - DNA, 2352 bp, Artificial Sequence
  Description of Artificial Sequence: Synthetic coding sequence
atggcggcctgccggtactgttgcagctgcttacgcctgaggcccttatctgacggcccgtttctcctgcctcgacgcgacagagcccttacccagcttcaagtccgcgccctctggtcctcagctggttcccgcgctgttgccgtcgacttgggaaatagaaagcttgaaatctcgtccgggaaactggcccgcttcgcggatggatctgccgtagtacagtcgggggatactgcggtcatggtgactgccgtgtcgaagacaaaaccatccccttctcaatttatgccactggtggtggactacaggcagaaggctgccgccgctggccgcatccccactaattatcttaggagggagatcggcacttctgataaagagatacttacttcacgaatcattgatcgatcaataaggccattgtttcctgccggctatttttacgatacccaagtattatgcaatctgctcgctgtagacggggtcaacgagccagatgttctcgccataaatggagcctctgtcgcacttagcctgtcagatattccttggaacgggcccgtcggggcagtgaggattgggatcatagacggggaatatgtggttaacccgacaaggaaggagatgtccagttccacgctgaatctcgtcgtggcaggagctcctaagtcccagattgtcatgttagaggcctcggccgagaatatcctccagcaggatttttgccacgctatcaaggtcggggttaagtatacccagcagataatccagggcatacagcagttagtcaaggagaccggcgtgacaaagcgtactccccagaaactatttacgcccagtcccgagatcgtaaagtacacacacaagctggcaatggagaggctgtacgccgtctttaccgattatgaacacgataaagttagtagggatgaagcagttaataagattcgcctggacacggaagaacagctgaaagaaaagttcccggaagcagatccctacgaaatcattgaatcgttcaacgtggtcgctaaggaagtattcagaagcattgtgctcaatgaatataagaggtgcgacggcagagacctgacaagcctgaggaatgttagttgcgaagtggacatgtttaaaaccctccacggttcggcactgtttcagcgtggccagacccaagtgttatgcacagtaacgttcgactcactggagagtggtattaaatccgaccaggttatcactgcaattaatggcattaaggacaaaaacttcatgctgcactatgaattccctccttatgccaccaacgaaatcggcaaggtgaccgggctcaaccgccgcgagctcggtcatggagcactggcggaaaaggccctgtatccagtgatccccagggacttccctttcaccatccgcgtaacatcagaggtgctggagagcaatggatctagcagcatggcatccgcctgcggaggaagcctggccctcatggactcgggggtcccaatatcctctgcagtggcgggcgtcgccatcggcctggtaacgaagaccgatcccgagaaaggtgaaatagaagactaccgattgcttacggatattcttggcatcgaggattacaatggggatatggacttcaaaatcgcgggcacaaacaagggcatcactgcgctgcaagctgatataaagctgcccggaatccccataaaaattgtgatggaagcaatccagcaggcttctgttgcaaaaaaagagatcctgcagattatgaataagacgatttcaaaacccagggcctctagaaaggaaaatggaccggtggtggagaccgtccaggtgcccctctcaaagcgggcaaaattcgtaggtccgggcggatacaacttgaagaaactgcaggccgagactggggtgactattagtcaggtcgatgaagaaaccttctccgtctttgctccaactccgtccgcgatgcacgaggctagggatttcatcactgagatctgcaaagatgatcaggaacagcagctcgagttcggggccgtctacaccgccaccattaccgagatcagagataccggggtgatggtcaaactgtaccctaacatgacggctgtgcttctgcataatacccagctggaccagcgtaaaattaaacatcccacggctctcggtcttgaggtgggccaggagattcaggtcaagtatttcggacgtgatccagcagatggccgcatgagactgtctagaaaggtgctgcagagtcccgctaccacagtcgtgagaacactgaacgaccggagttcaatcgtcatgggggaacccattagccagagctcttctaactctcagtag

SEQ ID NO: 28926 - DNA, 2955 bp, Artificial Sequence
  Description of Artificial Sequence: Synthetic coding sequence
atggtatgctccccagtcaccgtgcgcatcgcgccaccggacaggagattttctagatcggccattcccgagcaaatcatctcaagcacactgagcagtccgagcagtaatgcgcctgacccatgtgcaaaggagaccgttttatctgccttaaaggaaaaagagaagaagagaactgttgaagaagaagaccagatctttctcgacggccaagagaacaaacgtcgcaggcatgatagtagcggatctgggcatagcgcctttgaaccactcgtggctaacggagtgcccgccagttttgtgcccaagcctgggtcactgaaacgtggtctgaatagccagagcagcgacgatcacctgaataaacgctccagatcaagtagcatgtccagcctgaccggcgcctacgcttctgggattccaagcagctcaagaaacgcgattacgagcagttacagttcgacacgcgggatatcccagctctggaaacggaatggcccctcctctagcccttttagcagcccagcctccagccgaagccagacacccgagcgaccagctaagaagattcgcgaggaagaactgtgtcatcactcatcttctagtaccccattggccgccgaccgggaaagccagggggagaaggccgcagatactacaccaaggaagaaacagaacagcaattctcagagtacacccggatccagtgggcaacggaagcggaaagttcaactgctgccttctcgaaggggcgaacaattgaccctgccccctcctccccagctcggttatagcatcaccgcagaagatttggacctagaaaagaaggccagcttacagtggtttaaccaagctctagaggataagagcgatgcagctagtaatagcgtgactgagacgccccccatcacacagccatcctttaccttcactctgcctgccgcagcccccgcatcacctcctaccagcctccttgcaccatcgacaaacccactcttggaatctctaaaaaagatgcagacccccccatccttgccaccttgtccagagtcggcaggcgcagctacaactgaggctttatcacctcccaagacaccttccctcctcccacccctggggttatctcagtcaggcccaccaggactgctgccttctccctcatttgacagcaaacctcccacaactctgcttgggctgattcctgctccaagcatggtgccggcgaccgacactaaggctcctcccacactgcaggcggagacagccacgaagccacaggcgaccagcgctccatcccctgctccaaaacagtccttcttgttcggtacacagaacacatctccttcgagcccagcagcccctgctgcttcatcagctccaccaatgttcaaaccaatattcacggcgccaccgaaatcagagaaggaagggcctacaccacctggaccctcggtgacagcaactgctccctcctcatcctccctgcccacaacaacaagcactacggctcctactttccagcctgtattttcttccatgggaccgccagcaagcgtgcctttgccagctcctttctttaaacagacgactaccccagcaaccgcccccaccaccacagccccactcttcaccggcctggctagtgctacatctgcagtcgcaccgattactagcgcttctccgagcactgacagtgctagcaaaccggccttcggatttggcatcaatagcgtgtcctcttccagcgtgtctaccaccacgagtacagctacggctgctagccagccctttctgtttggagctcctcaggctagcgccgcctccttcactcctgctatgggatctatcttccagtttggaaaaccccctgcactccccaccaccacaaccgtgacgacgttctcccagagcctgcacacggcggtgccaacagcgacgagttcatcggctgcagactttagtggatttgggtcaaccctggccaccagtgccccagcaaccagcagccagcctaccctgacattttctaacacaagcacacccacgtttaacattcctttcgggtcatccgctaagagcccactgccctcatacccaggggccaatccccagcccgcctttggggccgcggaaggacaaccaccgggcgcagctaaacccgcattagctccctcgtttggcagctcattcaccttcgggaactctgctgctccagctgcagcccctacaccagcacccccctcgatgattaaggttgttcccgcatacgtacctacaccaatccatcccatcttcgggggggccacccattctgcatttggcctcaaggccacagcaagtgctttcggcgcccctgcaagctcacagcctgcgtttggcggaagtacagctgttttttttggtgccgctaccagctccggattcggagcaactacacaaacagcaagctctggctcctcatcatccgtgtttggcagcaccaccccctccccattcacatttggtgggtcggccgcgcccgcaggtagtgggtcctttggtatcaatgttgcaacaccgggttcttctaccactaccggcgccttcagctttggtgcaggacaatcaggttctaccgcaacatccacgccattcgcagggggtctcggacagaatgcacttggcaccacgggtcaaagtacaccatttgccttcaatgtctcaagtacaaccgaatccaaacccgtgtttggtggcacagccactcctacttttggtctcaatacacctgcacctggcgttggaacaagcgggagttccctgtccttcggcgcaagctcagcccccgcccagggatttgtcggagtggctccttttggtagtgctgccctgagcttttctattggagccgggtctaagactcccggagcgcgccagcgcctgcaggctcggcggcagcacacacgtaagaagtag

SEQ ID NO: 28927 - DNA, 2955 bp, Artificial Sequence
  Description of Artificial Sequence: Synthetic coding sequence
atggtgtgctcacccgtaacagtcaggatcgcacctcccgataggaggttcagccgatctgccattcctgagcagattatttcttctactctctctagtcctagttcaaatgcccccgatccttgcgccaaggaaaccgtgctgagtgcgctcaaggaaaaggagaagaagcggacggtcgaagaagaggaccagatctttctggacggccaggagaataaacgtcgcagacacgactcatccggatctggtcacagtgcatttgaacccctggtggctaacggcgtccctgcctcgttcgtgcccaagcccgggagtctaaaacggggcctcaacagtcagagcagcgacgaccatctgaacaaacggtcaagatccagcagtatgtcctctttgactggcgcctatgcttctggtataccatctagttctagaaacgcaatcaccagtagctacagctccacaagaggaatcagccagctctggaaaaggaatgggccttcttcctcgcccttcagctcccccgccagctcacgctcgcagactcccgagcgaccggccaagaaaattagggaggaggaattgtgccaccattcaagctcgtcaacgcctctcgctgctgatcgtgaaagtcagggagaaaaggcggcagacactacccctcggaagaagcagaacagtaactctcaatcgaccccgggttcctctggtcaacggaagcggaaggtacagcttctgccttcccgaagaggcgagcagctgactctgccaccacccccccaactcggctactcaattactgctgaagacctggacctggagaaaaaggcttcactgcagtggttcaaccaggccctggaggataagagcgacgccgcttcaaattcagtaaccgaaactcctcccatcacccagccctcatttactttcacactgccagctgccgccccggcctcacctccgacctcgctgttggctccgtccacaaatccacttttggaatccctcaaaaagatgcagactccccccagccttccgccttgcccggaatccgccggcgctgcaacaacggaggccctgtcaccaccaaagactccctcccttctacctcctctgggattaagtcaatctggccctcccggactgttaccctcacctagttttgatagtaagccgccgactacactgctgggtctgattccagctccctccatggtgcctgcaaccgataccaaagctccaccaacgcttcaggccgagactgccacgaagccccaagccacctcagcacccagccccgccccaaaacagtcatttttgtttggaacccaaaatacctctccctctagtcccgctgctcctgcagcctcctctgctccccccatgttcaaacccatattcaccgcaccccccaaaagcgaaaaggaaggccctacaccgcctggtcccagcgtcacagcaacggcccccagttcatcaagtttgccgacaacaacttctacaacggcaccaacatttcaaccggtgtttagctctatggggcctcctgctagtgtgcctttacccgctccattctttaaacagaccaccaccccagctaccgcaccaactaccactgcccctctgtttaccggcctagctagcgcaactagtgctgttgcgcctatcaccagcgcaagcccaagcactgacagcgccagcaagcccgccttcgggttcgggattaatagcgtatcatctagtagtgtgtctactaccacgtccactgccacggccgcttcacaacctttcctctttggggcccctcaggcctctgcggccagcttcacgcctgcgatgggatctatttttcagtttggtaaaccccccgcgcttccaactactacaacagtgacaacattctcacagagcctccatacggctgttcccaccgccacctccagttcagcagctgactttagcggttttggaagtacactggcaacctcagcccctgcgacctcttctcagcctacattgaccttcagtaataccagtactccaacgttcaatatcccttttggcagtagcgctaagagtcctcttccgtcctatccaggcgcaaatcctcagcctgctttcggcgctgccgaagggcagcctccaggggcagccaagccggcactcgccccctccttcggctcctccttcacctttggcaacagcgccgctcccgctgctgctcccacaccggcccccccctccatgattaaagtggtcccagcctatgtgccaacacctatccacccaatctttggcggcgccactcactccgcttttggactgaaagcaactgccagcgcgttcggtgccccagccagtagtcagccagctttcggtggatccactgctgtgtttttcggagccgcaacctctagcgggtttggcgccacaacgcagaccgccagtagcggctcgtctagctcagtgtttggcagcactacgccttccccatttacgtttggcggctccgctgctcccgcggggagcggctcttttggaattaacgtcgccacaccagggtcatccaccactacaggagcctttagctttggtgcaggccagagcggatcgacagccacgtccacgccctttgccggcgggttagggcagaatgctctgggcaccacaggccagtctaccccttttgcatttaacgttagcagtacaacagagtccaaacccgtatttgggggaaccgccacacctacatttggtctcaacacacccgctccgggagtgggaaccagcggatccagtctgagttttggggcttctagcgctcccgcccagggctttgtgggcgtcgcccccttcggctctgccgcgctctcgtttagcatcggcgcggggagcaagacaccaggggctcgccagcgactccaggccaggcgccagcacacaagaaagaagtag

SEQ ID NO: 28928 - DNA, 3000 bp, Artificial Sequence
  Description of Artificial Sequence: Synthetic coding sequence
atggtatgttcacctgtgaccgtgaggattgcccctcctgatcgtcgattttcgagatctgctatccccgagcagataataagcagtaccctctctagtcccagctctaacgcccccgatccctgcgccaaggagaccgtcctaagcgctctgaaagaaaaagagaagaagcgcaccgtagaagaagaagatcagatattcttggacggccaggagaataaaagaagacggcacgactcatccggatctggacactctgcttttgagcctctggtggccaacggcgtgcccgcctcatttgtgccaaaacccggatccttgaagcgaggactgaattctcagtcttccgatgatcatcttaacaagcgtagccgctcttctagtatgtcctccctgaccggcgcatacgcaagtggaatcccctcctcaagtcggaatgccattacctcaagttacagtagtacccggggcataagtcagctttggaagcgaaatggcccaagtagctcacctttttctagccctgccagcagcagatcccagacccccgagcgcccagccaaaaaaattcgtgaggaagagctgtgccatcactcctcgtccagcactcccctggctgccgatcgtgaatctcagggcgaaaaggcggcagataccacccccagaaagaagcagaactctaactcgcagtcaacccctgggagcagcggccagcgcaagagaaaagtccagctgctgccttcccggcgtggcgaacagttgacactgcctccaccgcctcagctgggttactccattactgcagaagatctggatctggagaaaaaagcgtccttgcaatggtttaatcaggccctggaagataaatctgatgcggcttccaactctgtcacggagacaccccccataacgcagccgtctttcacgttcacactccccgccgcggctccagcttctcctccaacttccctattggctccctcaaccaaccctttgctagagtcactgaagaagatgcagacacctccaagtctgcctccatgtcctgagtcggctggagccgccacgacagaggcactctccccccccaagacaccgtctcttctgcctcctctgggcttaagccagtccggaccccccggccttctcccctccccttcatttgacagcaaaccgcctactaccctgctgggactgatccccgcacctagcatggttcctgcaaccgatacgaaggcgcctccaaccttacaggcagaaacggccacaaagccacaggcgacttccgccccatcgccagcacccaagcaaagctttcttttcggaacacaaaacacaagcccgtcttccccagctgctccagctgcgagttccgcacccccaatgtttaagccaatttttaccgcgccacctaaatcggagaaagaggggcccaccccgccggggccttctgtcactgccacggcaccgtccagcagttcgctacctaccactacaagcactactgctccaacatttcagcctgtgttttccagcatgggaccccctgcctcagtgcccctgcccgcgccatttttcaaacagacaactacgccggcgaccgcacccacaacaacggcaccattattcaccggccttgctagtgccactagcgctgttgctcccatcacttcggcctcgccatccacggactcagcatcaaagccagcttttggctttggaattaatagcgtgagctccagctctgtgagtactacaacctctactgccactgctgcaagccagccctttctgttcggcgcgccacaggcgagcgccgctagtttcacaccggctatgggcagcattttccagttcggaaagccccccgccttgcctacaaccaccaccgtgactacatttagccaatcactccacaccgcggtgcctacagcaacctcatctagcgcggccgatttttcagggtttggaagcaccctcgcgaccagcgcacccgctacaagctcccagccaaccttgacgttctctaacaccagtacacctacatttaacattccctttgggtccagtgctaagagccctctcccatcctaccccggggcgaatccccagccggcatttggcgccgcagaaggacaacctcctggtgccgctaaaccagccctggcgcccagctttggaagcagttttacatttggtaactcagccgctcccgcagcagcacccacccccgcacccccttccatgatcaaggtggtacctgcctacgtacccacacccatccaccccatttttggaggtgctacccacagtgcgtttgggttgaaggcgactgcttccgcctttggcgctccagcaagctcccagcccgcctttgggggcagcaccgctgtgtttttcggagctgccacttccagcggcttcggtgccaccacccagacagcatccagcgggtcatcctcctccgtctttggaagtacaacaccctcacccttcacgttcggcgggagtgccgcgccagccggaagcggcagctttgggattaacgtggccactcctggcagctctaccactacaggcgcgttcagtttcggcgctggccagtctggatcaacagccacctccactcctttcgccggcggacttgggcaaaacgccttgggaactacaggacagtcaacaccctttgcttttaacgtgagctctactaccgagagcaagcccgtgttcggaggaaccgctactcccacattcggcctcaacactcccgcacccggcgttggcacgtccgggtctagtttgagtttcggcgctagctctgctccagcacaggggtttgtcggtgttgcaccatttggtaatacgttcgcccaccagcaagagcatagccctcgcaagggtcctaacaacttgtcaaagcgcaaactcctcccagcagtgagggcacaagggcttcccaggagagggcaagcctccagtttcccaacgaggaaagagtag

SEQ ID NO: 28929 - DNA, 3750 bp, Artificial Sequence
  Description of Artificial Sequence: Synthetic coding sequence
atgtctcctgccgccgcggccgcaggcgccggcgaacgccgcaggccgattgccagtgtgagagatgggaggggccgcggctgtggaggacccgcccgcgccgtcctgctgggtctctccctggtggggttactgctctacttggtgccggctgcggcggctctcgcttggctgacggtgggggccacggcagcctggtggggactgtcccgagaaccccggggttcacgaccgttatcctcattcgtcagaaaggctcgccacagaagaccattgtccagttttgtcaggaaagccagacatcggcgcacccttttcgcttcacccctggctaagtcaaccgccaatggcaacctgctggagccccgcacactcctagaaggacctgatcctgctgaattgctgctaatggggagttatctcggtaaacctgggcctcctcagcctgctgcggctccagaggggcaggaccttagggatcgccccggaagaagaccacccgcacgccctgcaccacggtccccacctccccgaagtcccccaccacgtagcccgcctccttctcctccaacacaccgagcccaccacgtctaccccagcctgcctacaccccttctgcgcccttcaagacgaccttcccccagggattgcgggacactgcccaaccgatttgtgattacgccgcgaaggcgctatcctattcatcaggctcagtatagctgcttgggagtactgcctacggtgtgttggaacggttaccacaagaaggctgtgcttagcccccggaactctcgaatggtgtgcagccccgttactgtcagaattgctcccccggaccgtagattctcgcgctctgccatacccgaacagatcatctcctctactctttcttctcccagttctaacgctcccgatccgtgtgctaaagagacggtgctgagcgcgttgaaggaaaaggaaaagaagcgtaccgtggaggaggaggatcaaatttttttggatggccaagagaacaagcggcggcgccacgactccagcggatcaggccattctgcgttcgagcctctggtggcaaatggagtaccagcttcctttgtgcctaaaccaggtagtctgaagcgggggttgaattcccagtcatcagatgaccatctgaataagcgctccagaagctcaagcatgagtagcctaaccggggcctatgcttctggcataccgtcttcctcccggaatgctataacgtcctcctattcgagcacacgggggatcagccagctctggaaacgaaacgggcccagctctagcccattctccagccccgcctcatcccgatcacaaactcccgagagaccagctaaaaagatccgagaggaggaactttgtcaccactctagctcaagtacccctctggctgctgatagagaaagccagggtgagaaagcggccgatacaacaccaagaaaaaaacagaattctaactcccagtccaccccagggagcagcggccaacgcaaaagaaaggtacaacttctgccctcccggagaggtgaacagcttacgctgccccctccacctcagttagggtactccatcactgccgaggacctcgatctcgaaaagaaggccagcctccagtggtttaatcaggcacttgaggacaaaagcgacgctgctagcaactctgtcaccgagacaccccctattacacagccaagcttcacgttcacactgccagccgctgctccagcctctccccccacttcactgctagcaccttccactaatccactgctggaaagcctcaagaagatgcagacaccgccaagcctaccgccttgccccgaatccgccggcgccgccacaactgaagcgctcagtccaccaaagaccccgtcgctgctcccccctctaggcctctcccaaagcggccctcccggattgcttccaagccctagttttgactccaaaccaccaacaaccctccttggattgattcccgccccgagcatggtgcccgccactgacaccaaggcaccaccaactctgcaggctgagactgccacaaagcctcaggctacttcggccccatcacccgctcctaagcagtctttcctgtttggaacccagaataccagcccctcctctcctgccgcccccgccgcctcctccgctccacccatgtttaagccgattttcactgcccctcctaagtccgaaaaggaagggcctaccccacccggtccctccgtgactgcaacagccccctccagctcaagtctgcctacaaccacctccacaaccgcacccactttccagcccgtgttctctagcatgggtcccccagcttcagtccctctccccgctccgttcttcaagcagaccactacacccgccacagcacctacgaccacggctccactctttactggactggcctccgcgacatccgcagtggccccaattaccagtgcaagcccctctactgactcagctagtaagcccgcatttggatttggaattaactcagtctcttcttcaagcgtcagcacgaccacctcgacggcgaccgctgcatcccaaccctttttgttcggggccccgcaggcgagcgctgcctcttttacacctgccatgggctctatctttcagttcggcaagccacccgcacttcccaccaccacgaccgtgactaccttctcgcagagtctgcataccgccgtccccaccgctacctcttcctctgccgctgacttctcagggtttgggtcaaccctcgcaacatccgcccctgccacatcctcccagcccacgctgacattcagcaacacctccacaccaaccttcaatatcccttttggaagttccgctaagagtcctctgccttcatacccaggtgccaaccctcaacctgcatttggcgctgctgaaggacagccaccaggggccgctaaaccggcgctggccccaagtttcggatcctcattcacttttggcaactctgcagctcctgccgccgctcccacacccgctcccccctcaatgattaaagtggtacctgcctatgtaccaactcccattcatccgattttcgggggagctacacattcagccttcggtctgaaagcaactgctagcgcctttggcgccccggccagctcccagcccgcatttggtggcagcactgcggtttttttcggtgctgcaacttctagcggctttggagcgaccactcagaccgctagctctggctcttctagctcggtattcgggtctaccaccccatccccctttacctttggtggatccgccgctcctgccggctcgggtagcttcgggataaacgtggccacaccaggatcgtccaccaccacgggtgcgttctcctttggggccggccagagcggctcaacagccacttctacccctttcgctggaggccttgggcagaacgcgcttggaacaacgggacagtctactccattcgcctttaatgtgagttcaacaaccgaaagcaaacctgtgttcggaggcaccgctacaccgaccttcggactgaatacgccggctcctggcgtgggtacgtcgggctcttcgttgagcttcggagcatcgtctgcaccagcccaaggattcgtaggggtggcccccttcggctccgctgcacttagcttctcgattggagccggcagcaaaaccccaggtgctagacaacgcctccaggcaaggaggcagcatacacgaaagaagtag

SEQ ID NO: 28930 - DNA, 3000 bp, Artificial Sequence
  Description of Artificial Sequence: Synthetic coding sequence
atggtttgcagccccgtcactgtgcggatcgcgcccccagaccgtagattctcccgcagcgcgatccccgagcagattatcagctcaaccctaagcagccctagcagcaacgccccggacccctgcgccaaggagactgtcctgtccgctcttaaggaaaaagaaaagaagagaactgttgaggaggaagatcagattttccttgatggccaggagaacaaacgtcgcagacatgatagctccggctccgggcactccgcgttcgagcctctggtagccaacggagttcccgcgagttttgtgcccaaacccggctcactgaaacgcggcttgaacagccagtcatctgatgaccacctcaacaaacgcagtagaagctcatcaatgtcatccttaaccggtgcttatgccagcgggataccttcctcttctagaaatgccatcacttcatcctattctagcactagagggattagtcagctctggaagaggaatgggccctcctctagcccattttccagccctgcttctagcagaagtcaaactcccgagcggccggccaagaaaataagggaagaagaattatgccatcactccagctcgagtacgccactcgcggcagatagggaatcacagggcgaaaaggcggcagatactacgcctaggaaaaaacagaacagcaattcacaaagtactcccggctcaagtgggcagaggaaaaggaaagtccagctgctcccttcacggaggggggagcagctgaccctaccccctccgccacagcttgggtattccatcaccgcagaagatttggacctggagaagaaagcatcactgcagtggtttaatcaggccttggaggacaaatcagacgccgcgagtaactcagtgacagaaaccccaccgattacccaaccctctttcacattcacgctgccagcggcggcgccagcatcacccccgacttcgctgctcgccccttccacaaacccactgctggaatcccttaaaaagatgcagacaccccccagtctgcccccatgccctgaaagcgctggagcagcgactactgaggcactcagtcccccaaagacacctagtttgctccctcccctcgggcttagccagtctgggcccccaggtttgttgccaagtccctcatttgattctaagccccctacaaccttgctcggattaattcccgccccttcaatggtgcctgccacagacaccaaggcaccgcctacactacaggccgaaacagctacaaagccacaagccacctccgcaccaagccccgcacccaaacagtcctttctgtttggcacacaaaacacgtctccgtcttcaccggcggcccccgctgcatcttccgcacctccaatgtttaaaccaattttcactgctccaccaaaatcagagaaggagggacccacaccccccggaccaagcgtcaccgccaccgctccttctagtagctctctgcccacaactacttccaccacagcacctaccttccagccagtgttcagcagtatgggaccgccagcgtcagtgcccctccccgcgccattcttcaaacagaccaccactccagctactgctcctaccaccaccgctcctctctttacggggctggcatccgcaacatcggcggtagcccctataacctcagcaagcccttccaccgattctgcctctaaacctgcatttggcttcgggattaactccgtctcgtcgtcaagcgtttccacaaccaccagtacggccaccgctgcatctcagccattcctcttcggcgcaccacaagcatctgccgcctcgtttacgcccgcaatgggaagtatctttcagttcgggaagccccccgccttacctacaacaacaacggtcaccaccttctctcagtcgttgcacacggccgtgcccacagccacgtcttcaagtgccgccgatttctccgggtttggcagtaccttggctacatccgccccggcaacatctagtcagcctacactcactttttcaaatacgtccacaccaacctttaatatcccctttgggtccagcgcaaagtctccactaccctcttatccgggagccaacccccagcccgcctttggcgcagcagaggggcagccacccggcgcagccaaaccagctttggctccctcattcgggagctcgttcactttcgggaacagtgctgctcctgcggcggctcccactccagcccctccatccatgatcaaggtggtcccggcttatgttccaactccaattcacccgatttttggaggagccacgcactctgcgttcggcctgaaggcaaccgcttctgcgttcggagcacccgcatcttcccagcccgctttcggcgggtcaacggccgtgttcttcggcgccgcaacttcttctgggttcggtgccactacacagaccgccagctcaggtagctcttcatccgtcttcggaagtaccaccccgagtcccttcacatttgggggcagtgccgccccggctgggagtggctcattcgggatcaacgtggctacacccggcagctctacaactacgggcgccttctctttcggcgcagggcaaagtggatcaacagctacatcaactccttttgcaggcggcctgggacagaacgctcttgggactacaggacagtcaactccttttgccttcaacgtttcttccacaactgagtccaaaccagtctttgggggcacagctactccaactttcggcctgaataccccggcgccgggagttggaacatccggatccagcctctcatttggggcttccagcgcacctgctcagggcttcgttggagtggcccccttcggcaacacttttgcccatcagcaggaacatagtccaagaaagggacccaataatctgtccaaacggaagttgctgccggccgtgagagctcagggtcttcctaggagagggcaggcctcatcgttcccaacacggaaggagtag

SEQ ID NO: 28931 - DNA, 3690 bp, Artificial Sequence
  Description of Artificial Sequence: Synthetic coding sequence
atgtcccccgcagcagccgccgctggcgccggtgaaagaaggcgacctatcgcctccgtgcgggatggtcggggtcgcggttgtgggggacctgctggagccgctctgctcggactcagcctggtcggtctgctgctctacctcgtcccagccgccgccgcccttgcctggctcgcagtcggtacaacagcagcgtggtggggcctctcccgcgagccacgtgggtccaggccactgtccagtttcgtccagaaggctcggcatcggcggacactgttcgcgtcaccacccgctaagtccacagctaatggaaatcttcttgagcccaggaccttgctggaagggccagatccggctgagctactactgatgggctcctatctcgggaaacccggccctccacaacctgctcctgcccctgagggacaagaccttcgtaatcggccagggaggaggcctccagctcgaccagcccccaggtccaccccgccgtcaccgcccacccaccgcgtacaccacttttacccctctttaccaacacccctactgaggccatcaggtcgcccttcaccacgggatcgcggaactctgccagacaggtttgtgataacaccccgaaggcgatacccaatccatcagactcagtatagctgcccaggcgtcctgcccaccgtttgttggaacggctaccacaaaaaggcagttctctcgccacgcaattcgcgtatggtgtgctcacccgtgaccgtgaggatcgcgcccccagatagacggttttcgcgctctgctatccctgaacaaatcatcagttctaccttgtctagccccagctcaaacgcccctgacccctgcgctaaagagactgtcctgtctgctctgaaagagaaaaaaaagaaacggactgtagaggaggaagaccagatatttctcgacggccaggaaaacaagcgaagaaggcacgactccagcgggagcggccactccgctttcgaaccccttgtagcctcaggagtgcccgcttcattcgttccaaaacccggaagcctcaaacgggggcttaattcccagtcttctgatgaccatctcaacaagaggagtcgttcgtccagtatgtccagcctgacgggagcctatacgtctggcattccatccagctcgcgtaacgcaattacatcctcttattcttcaacgcgcggcatctcccagctttggaagaggaatggtccaagctctagtcccttttcatcacccgctagctctcggtcacagacacccgaacgacctgccaaaaaaatcagggaagaagagttatgtcatcactcaagttcatccaccccacttgccgccgataaagaaagccagggtgagaaggccgccgacactacccccaggaaaaaacagaactctaatagccagagcacccctggatctagtgggcagcgtaaacggaaagtgcagctcctgccgtcacgtcggggagaacagcttacactgccgccacccccacagctgggttactccatcaccgccgaggatttggaccttgagaagaaagccagtcttcagtggttcaaccaggcactggaggacaagagtgatgccgcatctaactccgtgaccgagaccccgcctacaacacaaccctcttttactttcacgctccctgctgcagctactgcctccccccccacgtctctgctggcccccagcaccaaccctctgttggagtccctcaaaaaaatgcagaccccaccaagcctgccgccgtgcccagagtctgccggtgccgcgaccaccgaggctcttagcccacccaagacaccatccttgctgcctccactcggcctgtctcagtctggaccgcccggcttgttgcctagccctagttttgattctaaaccccccacgaccctgttgggccttattccagccccttcgatggttccagcaaccgacacgaaagctcctcccacactacaagccgaaaccgctactaagccccaggctacaagcgcaccaagtccagcacctaaacagtccttcctcttcggtactcaaaatacatctccttcatccccagccgcccccgccgcgtcctctgcgtcacctatgtttaagcctatcttcactgcgcctcccaagtcagaaaaagagggcccaaccccaccgggaccaagcgtgactgcaactgccccatcttcctcatctctgcccaccaccacttctaccacagctcccacttttcagccggtcttctcttccatgggaccacccgcaagtgtgccactcccggctccgttttttaaacagactacaacacctgcaacagctcctacaactacagccccgcttttcactgggctggctagtgctacgtccgccgtggcacctatcacttccgcatcgccctcgaccgatagtgcatctaagccggcatttggattcggtattaattcagtatccagctcctccgtcagcacaaccactagcacggcgactgctgctagccagcccttcttgtttggggctccacaggccagtgctgcctcgtttacccctgccatgggtagcatcttccagttcggtaagccgcctgcactacccactaccaccaccgtcactaccttctcccaatccctaccaacagccgtgcccaccgcgacctcgtcgtctgctgctgacttcagcggcttcggatctaccctcgcaacttctgctcctgccactagttcacagccaaccttgactttttccaacacatctacaccaaccttcaatatccccttcgggagcagtgctaaatccccgctccccagctaccccggcgctaacccccagccagcttttggagctgcagagggtcagccccccggagccgctaaaccggccctcacaccttcattcgggtcttcctttactttcggtaattctgccgctcccgcaccagccaccgcccctacccccgcgccagcgagcacaatcaagatcgttcctgcacatgttcctacaccaatccaacctacctttgggggtgctacccatagcgcattcggcctgaaagctactgcctcggctttcggtgcgccggcgtcgtcacagcctgcatttggcggaagcacagcagtattttcttttggagcagcgactagctcagggtttggggcgaccacacaaaccgcaagttccgggtcaagctcctcggttttcggctccactacgccttcaccctttactttcggaggtagtgctgcccccgcgggaagcgggagttttgggatcaacgtggctacaccaggtagcagtgctactacaggcgcgttcagtttcggagccgggcagtctgggtcaaccgccacttccacccccttcaccggaggactcgggcagaacgctctgggcacgactgggcagagcaccccctttgcctttaacgtgggcagcaccactgagtccaagcctgtattcggtggcacggccacccccaccttcggacagaacactcccgcccccggtgtcggaacatctggatctagcctcagctttggcgcatcctctgcaccggcccaagggtttgtcggcgtcggcccctttgggtctgctgctcccagcttttccatcggcgctggttccaagacaccaggcgcaaggcagcgactgcaggccagacgccagcatactcgaaaaaagtag

SEQ ID NO: 28932 - DNA, 129 bp, Artificial Sequence
  Description of Artificial Sequence: Synthetic coding sequence
atggtgtgttcccccgtcactgttcgtatagcgccacctgatagaaggttcagtaggtctgccattcctgaacagattattagttcaaccttgtcctcaccttcgagcaatgcaccagacccctgctag

SEQ ID NO: 28933 - DNA, 2964 bp, Artificial Sequence
  Description of Artificial Sequence: Synthetic coding sequence
atggtctgctcccctgtaaccgtgagaatcgctccacccgaccgccgattttcacgctcagcgattcctgaacagattatcagtagcacgctgtccagcccttcaagcaacgcccccgacccttgcgctaaggagacagtgctgagcgctcttaaagagaagaaaaaaaagaggactgtggaagaggaggatcaaattttccttgatggccaggaaaataaaaggcggcggcacgacagctctggcagtggccattctgccttcgagccactggtggctagcggagtgccggcgtcattcgtcccaaagccaggtagtctgaaaaggggccttaattcgcaaagctcagatgaccacttgaataaacgatcacgctccagctcaatgtcttccctaactggcgcctatacttcaggcatcccatcgtcttcccgcaacgccattacttccagctacagttctacccgcggcatctctcagctttggaaaagaaacggccccagctccagtccattttcttcacctgcctcttcacggtcacagactcccgagcggcccgctaagaaaatcagagaagaggagctatgccaccactcatccagcagcactccactagccgctgataaagagtctcagggcgagaaggccgccgacacaaccccacgaaagaaacagaactcaaactcacagagcacccccggatcatcaggtcagaggaagaggaaagtccagttactaccttcaagacgcggggagcaactcacactcccacctccccctcaactgggatacagcatcacagctgaggacctcgatttggaaaaaaaagctagtctgcaatggttcaatcaggctctggaagataaatccgacgccgctagcaactccgtgaccgaaacccccccaactacccagccatcttttactttcaccttgccagccgctgcgactgcaagccctcctactagtcttttggctccttccactaatcccctgctggagtcattgaagaagatgcaaaccccaccgagcctccctccatgcccagaatccgcaggggcagccaccacagaagccctgtctccgcccaaaacaccatccctcctcccacctctgggcctgagccagtctgggccacctgggctgttacccagccccagctttgacagcaagccccccacaacactcttaggcctgatccctgcaccaagcatggtgcccgccaccgataccaaagctccgcccaccctacaggctgagaccgcaacgaagccccaagccacatcagctccatctcctgcacccaagcagagcttcctgttcggtactcagaacacgtctcccagttcccccgccgctccagccgcttcgagcgctagtcccatgtttaaacccatcttcaccgctccacctaaatctgagaaggaaggcccaaccccacccggaccatccgtcaccgcaactgcccctagctcttccagtctgcctacgacaaccagtactactgcacctaccttccaacccgtgtttagctccatggggccccccgcctctgtgccccttccagccccattctttaaacagactacaactcctgcgaccgcccccaccacaacagccccactcttcacgggactagcctcagctacctcggctgtggcccccatcacatccgcaagcccatccactgatagcgcgagcaaacctgccttcggtttcggaattaattctgtcagttcttcctcggtctctacaactacttcaacagcaacagccgcatctcagccctttctatttggggcaccccaggcgtcagccgcctcttttacccccgctatgggttccatcttccagttcggaaagccccctgcactgccgacaactacaactgtcactacgttctctcagagcctgcctacagctgtgcccaccgcaacaagtagctcagccgccgacttcagtgggttcggcagtactctggctacaagcgccccagccacctcatcccaaccaacattaacttttagcaatacgagcactcccacctttaacatacctttcggcagttctgcaaaaagccccttgccctcgtaccccggagcaaacccacaacctgccttcggcgccgctgagggccagccccccggagcagccaagcccgccctcacgccctcttttggtagtagcttcactttcggcaattccgcggccccagctcccgctaccgcccctacaccagctcccgcttccacaatcaagatcgtgcctgcccatgtgccaacccccattcagcccacgttcgggggagccacccactctgcattcggccttaaagccaccgcttccgcctttggggctcccgcatcatcacagcccgcttttggtggttccaccgctgtgttctctttcggggccgccacatcatcaggctttggtgccacaacgcagacagcaagcagcggatctagcagctcagttttcggctccacaaccccctccccattcacatttgggggctcagctgcccccgcagggagtggctcatttggcattaacgtcgcaacaccgggcagcagcgcgacaaccggcgcttttagtttcggggccggacagtccggaagtaccgccacttccactccatttacaggagggctaggccagaacgcccttgggacgaccggccagtctacacccttcgctttcaacgtggggtcaacaaccgaaagtaagcctgtctttggcggaacggcaacaccaacatttgggcagaacacccccgcccccggtgtgggaaccagcggcagtagccttagcttcggggctagcagtgcgccagcccagggtttcgtgggtgttgggcccttcggttccgctgcaccaagctttagcatcggagctggtagtaaaacacccggcgcccgacagagattgcaggctcgaaggcagcatactcgcaaaaagtag

SEQ ID NO: 28934 - DNA, 948 bp, Artificial Sequence
  Description of Artificial Sequence: Synthetic coding sequence
atgtatcaggtccccttgcccctggaccgggacggcactctcgttcgcctcagattcactatggtggccctcgttacagtatgttgtcccttagtagctttcctgttttgtatactttggtcccttctcttccattttaaagagactactgccacacactgtggtgctaccccatgtaggatgttcagcgctgccagtcagccactcgatcctgacggaacactgtttaggctcagattcaccgccatggtgtggtgggcgattaccttcccggtctttggcttttttttctgtatcatttggagtctggtctttcacttcgagtacacagtggccactgattgcggagtgcccaattacctgcctagcgtctcaagtgctataggaggcgaagtcccccagcgctatgtatggcgattttgtatcggtctccactcagcccctagattcttggttgccttcgcatactggaatcactacttatcttgtacttctccttgcagctgttaccgcccactctgtcgactcaatttcgggctcaacgtcgtggagaaccttgccttgcttgtgctgacctacgtgagttccagcgaggacttcacaatccatgagaatgcatttatagtcttcattgctagctcactgggccacatgctgctgacatgtatcctgtggaggcttacgaagaaacatacagtgtcacaggaggatcgaaaaagttactcttggaaacagcgtctattcatcatcaactttattagtttcttttctgcactcgctgtgtattttcggcacaatatgtactgtgaagcaggcgtctacaccatctttgccattctcgagtataccgtcgtgttaaccaatatggccttccatatgaccgcttggtgggatttcggaaataaggagctgttgatcacaagtcaaccagaagaaaaaaggttctag

SEQ ID NO: 28935 - DNA, 924 bp, Artificial Sequence
  Description of Artificial Sequence: Synthetic coding sequence
atggcaagactcggatcgactggaggcgtgagcggccgagtagtaacccagcatagggactctgctccattcctgggcgcgcctcgcctggggctgagagaacttggcccaatcagagggaccgcccctgagtggcacgggagatggaatgcagctgaaagatccgacaaaatgtaccaagttccattgcctcttgatcgggatggaaccctggtacgtcttcgtttcaccatggtggctctggtgaccgtgtgctgccctctggtcgccttcctgttctgcatcctctggagtctactttttcacttcaaggagactaccgcaacccattgtggagtgcccaactatttgccttcagtgagtagcgccataggcggagaagtgccacagaggtacgtctggcggttctgtatcggcctgcacagcgctcctcggttcttggtcgcttttgcctactggaaccactatctttcctgcaccagtccatgttcctgctatagaccactgtgccgccttaattttgggctaaacgtcgttgaaaacttagccttactcgtccttacatatgtcagcagtagtgaggactttaccatccacgagaatgcattcatcgtctttatcgcttccagcctggggcacatgctgctgacctgcattctgtggcggctgacaaagaagcacaccgatagaaaatcctacagctggaagcagcggctgttcattattaatttcatatcgttcttcagtgctctagccgtctacttccgccacaacatgtactgtgaggcaggagtgtatactatctttgctattttagagtatacagtcgtactgacaaacatggctttccacatgaccgcctggtgggatttcggcaacaaggaattactgatcacctctcagcccgaggagaaaagattctag

SEQ ID NO: 28936 - DNA, 948 bp, Artificial Sequence
  Description of Artificial Sequence: Synthetic coding sequence
atgtaccaggttcctcttcctctggatcgagatgggaccctggtgagactgagatttaccatggtggccctggtgactgtatgctgtccccttgttgccttcctgttctgcattctgtggtcactgctctttcactttaaggaaaccacagctacgcactgcggcgccactccgtgcaggatgttctccgccgcaagccaaccgttagaccccgacggtacactgttcaggctgcgatttactgctatggtttggtgggctattacatttccggtctttgggttctttttctgcatcatttggagtctcgtattccactttgaatacacagtagctactgattgtggcgttcccaattatctcccttctgtgagcagcgctattggaggtgaggtgccccaaaggtacgtctggaggttttgtatcgggctgcacagtgcacctcgttttctggtggcattcgcttattggaaccattacctttcctgtacgtccccctgctcatgctaccggccactatgcaggctgaattttggactgaatgtggtagagaacctggccttgcttgtgctcacctacgtctcctcatccgaggactttaccattcatgagaatgcattcatcgtctttattgcctcgtccctgggacacatgctcctcacctgcatcctctggaggctgaccaaaaagcatactgtgtctcaggaggaccgcaagtcctactcttggaagcagcgcctgtttattataaactttatcagctttttttcagcattagctgtctattttcgacacaacatgtattgcgaggccggagtttacacaatctttgcaatcctggagtatacagtagtgctgactaacatggcttttcatatgacagcatggtgggattttgggaacaaagaactgctcatcacctcacaacccgaggagaaacgcttctag

SEQ ID NO: 28937 - DNA, 486 bp, Artificial Sequence
  Description of Artificial Sequence: Synthetic coding sequence
atggtggacgggacccagttacgcggagctcagctaccagccttaggcgagctaagccacagacgggggggggcccctgcccttcgtgtcgctttcctgcataggccagctctaggggcatcattgctaggcgggttgaggctgctggaacccctgccgcaacttcatctccctgtttttttgctgagccccgctttacccccacagttacgcccacagtgtcgtggggaaccgagagtggcttcagcccacctatgcctgctccttcggggcctacatcatcctcgaaaatgctttcattgtgtgcattgtctcatcccacgcgcgcacgcacctcatctgcacagcttagctgttgatcaagaggcgcatagtaagagtgggggtagccaggttctacagctcgaaacagcggccctccatcatcaactgcacctcctgcttctgggtgccggctgcttgttgtctgcccagcacgtgctgtag

SEQ ID NO: 28938 - DNA, 765 bp, Artificial Sequence
  Description of Artificial Sequence: Synthetic coding sequence
atgtaccaggtccctttgccactggatagagatggaacactcgtgcggttgcggttcactatggtcgcattggtgaccgtgtgttgtccattggtggccttcctcttctgcattctgtggagcctacttttccactttaaagagacgacagcaacccactgcggtgtcccaaactatttgcccagcgtgtcctcagccattggcggggaagtgccccaacgttatgtctggagattctgcatcggtttacactctgcgccccgcttcctagtggcgttcgcgtattggaatcactatttaagctgcacaagtccatgctcatgttatcggcccctgtgccgtttgaatttcgggcttaatgtggtcgaaaaccttgcacttttagtccttacctatgtatcttcttccgaggatttcaccatacatgagaatgcatttatcgtgttcatcgcctcctctttgggccacatgctcctgacctgcatcttgtggcggctcactaagaagcacacggtgtcgcaggaagaccgcaaatcatatagctggaaacagagactctttataatcaatttcatctccttcttttcggcgctggcggtctactttagacacaatatgtattgcgaggcaggcgtatacacaatttttgctattctggaatacacagtcgtgttaacaaatatggcctttcatatgacggcctggtgggactttggtaacaaggagcttctgatcacctcacagcccgaagagaagagattttag

SEQ ID NO: 28939 - DNA, 1038 bp, Artificial Sequence
  Description of Artificial Sequence: Synthetic coding sequence
tgaagactggggctgagagagctgggccccatacgagggaccgcacccgagtggcatggcaggtggaacgccgccgaacggagtgataaaatgtatcaggtgcctcttcccctcgatagggatggtactctagtgcgcctgcggttcaccatggtggcactggtgactgtctgctgtcctctggttgcttttctgttctgcatcctgtggtccctgctgtttcatttcaaggagactacagccacgcactgcggggcaaccccatgtcgcatgttctccgctgcctctcaacccttggaccccgacgggacactctttagactccgcttcactgctatggtttggtgggctatcaccttccccgtgttcggtttcttcttttgcataatatggtccttagttttccacttcgaatacaccgttgcgactgattgcggagtacctaactacctcccttccgtgtcttccgctatcggaggggaggtccctcagcgttatgtgtggaggttttgcatcggattgcattccgctccacgatttctggtggcttttgcctattggaatcactacctcagttgtacctcaccttgttcttgctacaggccactgtgccgactcaactttggtctcaacgtcgtggagaatttggcactgcttgtcctcacttacgtcagcagctccgaggattttaccatacatgaaaatgctttcatcgtgtttatcgcctctagtttaggacatatgctgttgacctgcattctctggcggttgaccaagaagcacaccgtgtcccaagaggacaggaagtcctattcatggaaacaacgcttgttcataattaactttatatccttcttttctgctctcgctgtatactttcgacataatatgtattgtgaagccggcgtgtatactatcttcgctatccttgaatacacagtcgtgctgacaaacatggccttccacatgacggcctggtgggacttcgggaacaaggaacttctgatcacatcgcaacccgaggagaaaaggttttag

SEQ ID NO: 28940 - DNA, 624 bp, Artificial Sequence
  Description of Artificial Sequence: Synthetic coding sequence
atgttctccgcagcaagccagcctcttgacccagacggaactctattccgccttagattcacagccatggtgtggtgggccattacgttcccggtgttcggtttttttttttgcattatttggagtttggtgttccacttcgagtacactgtagccacagattgcggagtttcagcctcttcccctgcacctgggtctggaccgggacaagaagtagcagtgcgggttgagctggactctggggaagaggtggaggaccagagggaaggcaagggtcagggagacggaggcagagtggggaaatcagaaagcgagatcatacacgggggacgtctgagagaaaacagaatcaccgtattacccgagctggaggacgatgatagaaacgcacgggagatgacaggggcagtcgctcatacatgcaatctctccacatcgggcggcaggagccagtggatcacacgggtgcagttcgagacatcactgggtaatatggtcaaaccaagactgtataaaaaatgcaaaaaaatttcttgggtgccatggcatgcccctgtcgtgcctgcgacctgggaagctaaggcaggggagctactggaagcaggcagatggactttccaatag

SEQ ID NO: 28941 - DNA, 936 bp, Artificial Sequence
  Description of Artificial Sequence: Synthetic coding sequence
atggctagactggggagtaccggaggggtgagcggcagggtggttacccagcatcgggacagtgctccttttctcggagcgccgaggctgggactcagggagcttgggcccatccggggcaccgctcccgagtggcatggccggtggaacgcagctgaacgatcagacaaaatgtaccaggtgcctctgccacttgacagagacggcaccttggtccgattgaggtttaccatggtggccctggtcacagtgtgctgccctctggttgcttttctgttttgcattttgtggagcctgctctttcacttcaaggagaccacagccacacattgtggcgtgcctaattatctgccctctgtttcttcagccataggcggggaggttccgcaaagatatgtgtggaggttttgcatcggcctgcactcagctccacgcttcctggtggcctttgcatactggaatcattatctgtcttgcacctccccgtgttcatgttatagacccctgtgcagactgaatttcggtctgaacgttgtggagaacctggctttactcgtgctgacatatgtatcgtctagcgaggatttcacgatccacgagaatgcttttatcgtgttcattgcgtccagtcttggccacatgttgctgacatgcatcctctggcgcctgactaagaagcataccgtatcacaggaggaccgaaagtcctatagctggaaacagagactgttcattatcaatttcatctcgtttttctcggcgctggcagtgtatttcagacacaacatgtactgcgaggctggcgtgtatacaatatttgccattctggaatacaccgtcgtgttgaccaacatggcatttcatatgaccgcttggtgggactttggcaacaaggagctgctcatcacctctcagcccgaggagaagagattctag

SEQ ID NO: 28942 - DNA, 699 bp, Artificial Sequence
  Description of Artificial Sequence: Synthetic coding sequence
atgtatcaggtgcccttgccactggaccgagatggcaccttagtgcggctaaggtttactatggttgcgctcgtgacagtgtgctgtccattggtggcctttctgttctgcatcctctggagtctcctgttccatttcaaggagaccacagccacgcactgcggagtcccaaattatcttccatcagtgtccagcgccatcggtggggaagtaccccaaaggtacgtgtggagattttgcattgggcttcatagcgcacccaggtttctcgtagcctttgcctattggaaccactacctgtcctgcacctctccttgtagctgttaccgtccattatgtagattgaacttcgggctcaatgttgttgaaaatctggcgttactggtgttaacatacgtgtcatctagcgaagactttaccattcacgagaacgcctttattgtctttattgcatcatctctggggcacatgcttctgacttgtatcctgtggcgcctaactaagaaacatacggtgagtcaagaggtaaggagtataccatctggggggagcaaggcagcccaaaagaagattaaggatatttgtccacaggacagcgggagtcaggtgctgcagctggagactgctgcactgcaccatcagctgcacctgctcctcctgggcgccggctgtcttctgtccgcccagcacgtcctctag

SEQ ID NO: 28943 - DNA, 171 bp, Artificial Sequence
  Description of Artificial Sequence: Synthetic coding sequence
atgtaccaggttcctcttcctctggatcgggatgggactctcgtccgactaaggttcacaatggtggcactggttaccgtctgctgtccactggtcgcattcttgttttgtatcttgtggagtctgctgttccactttaaagagacgacagctacacactgcggtgattag

SEQ ID NO: 28944 - DNA, 963 bp, Artificial Sequence
  Description of Artificial Sequence: Synthetic coding sequence
atggctgggctagcggcccggttggtcctcctcgccggagccgcagcgctcgcatccggcagccaaggagaccgagaaccagtgtatcgtgattgcgtacttcagtgcgaggagcagaattgttccggaggggccctcaaccattttcggagcagacaacccatctatatgtccctggccggctggacctgccgagacgattgcaagtatgaatgtatgtgggtaactgtgggattgtacctgcaggagggccacaaggtgccccagttccatggaaagtggcccttttcaaggtttttgttcttccaggaacccgcaagcgctgtggcctctttcttgaacggcctcgccagcctggtgatgctgtgccgctacagaacatttgtgcctgcaagttctcccatgtaccatacgtgcgtggccttcgcctgggtctcactgaatgcgtggttctggtccacagtcttccacactagagacaccgatctcactgagaagatggattacttttgcgccagtaccgtcattctccactcaatctacttgtgttgcgtccggacagttggactgcaacatcctgctgtggtaagcgcctttagagccttactcctgttgatgctcaccgtgcacgtaagctatctgagtcttattaggtttgactatggttacaacctggttgctaacgtcgctatcgggctggtcaacgtggtgtggtggctcgcttggtgtctgtggaaccagaggcgcttgccgcacgtgcgaaaatgcgtggttgtggtactcctgttgcagggactcagcctgttggagcttctggacttcccgcctttgttctgggtcttagatgcacacgctatctggcacatatcaacaattccagtccatgtgctgttctttagtttcttggaggatgacagcttgtacctgcttaaggaaagcgaggacaaattcaaactggactag

SEQ ID NO: 28945 - DNA, 795 bp, Artificial Sequence
  Description of Artificial Sequence: Synthetic coding sequence
atgtcgctggctggttggacttgcagggacgactgtaagtacgagtgcatgtgggtgaccgtcggcctgtatttgcaggagggacataaggtgccccaattccatgggaagtggccattcagtaggtttttgtttttccaggagcccgccagcgccgtcgctagttttttgaacggactagcgtcattagtgatgctgtgtcgctaccgcacattcgtgcccgccagcagtccaatgtaccacacctgcgtagcatttgcctgggtctctttgaatgcttggttctggtcaaccgtgtttcatacgcgtgacacggatttgactgagaagatggattatttctgcgcgtcaaccgtgatcttgcatagcatttacctgtgctgcgtccggactgtcggcctgcagcaccctgccgttgtttctgccttcagggctcttttgctgctcatgttgactgtgcacgttagctacctctccctgattagattcgactacggatacaacctggtggctaacgtggcaattgggctggtgaacgtcgtatggtggctggcgtggtgcctgtggaaccagcgaaggcttccccatgtgcgtaagtgcgtagtcgtagtcctcctactccaggggctgagtctcctggagctgctggactttcctcccctgttttgggtgctggacgctcatgcaatatggcacatatcgaccattccagtccacgtactgttcttttcctttcttgaggacgatagtttatacctgctgaaagagtccgaggacaagtttaaactcgattag

SEQ ID NO: 28946 - DNA, 810 bp, Artificial Sequence
  Description of Artificial Sequence: Synthetic coding sequence
atggcaggactcgcagccagacttgtcctgctcgccggcgccgccgctctcgcgtccgggagtcagggcgatagagagcctgtgtacagggactgtgtgctccagtgtgaagagcagaactgctctgggggagctctgaaccactttaggagccgacagcccatctatatgagtttagctggctggacatgtagggacgattgcaagtatgagtgcatgtgggtaaccgttggcttgtatctgcaagagggacacaaagtaccccagtttcatgggaaagtgtcacttaatgcctggttctggagtactgtattccatactcgtgacaccgacctgacagaaaagatggactacttttgtgcctcgaccgtgatcctccattccatttacttatgctgtgtccggactgtgggcctccagcaccccgccgtcgtgtccgcgtttagagctctcctcttacttatgctcactgtgcatgttagttacctgtccctgatccggtttgactatgggtacaatttggtcgcaaacgtagctatcggtctggtgaatgtagtgtggtggctggcgtggtgtctgtggaatcagagacggcttccgcatgtcagaaagtgcgtggtcgttgtattgctcctgcaggggctgtcactgctggagctcctggactttcctccactattctgggtgctggatgcccatgctatttggcacatcagtaccattcctgtccatgtcctgtttttttcctttcttgaggatgactccctctacctcctgaaagagtccgaagacaaattcaaattagactag

SEQ ID NO: 28947 - DNA, 900 bp, Artificial Sequence
  Description of Artificial Sequence: Synthetic coding sequence
atggccgggttagccgctaggttggtattgctggcaggtgccgccgctctggcctcagggtcacagggggaccgcgaacctgtctaccgggactgtgtgctgcagtgcgaagaacaaaactgtagtggcggcgctctgaatcactttcggagtcgacagcccatctacatgagcttggctgggtggacttgtagggacgactgtaagtatgaatgtatgtgggtaactgtggggctgtacctccaagaggggcacaaggtgccacagttccacggcaagtggccattttctcggtttctgttcttccaagaaccagctagcgccgtggctagttttctgaacgggttagcctccctggtgatgttgtgtaggtacaggacgttcgtgcctgcatctagtcctatgtaccatacatgtgtcgcctttgcctggaagatggattacttctgcgcctcgacggtaatcctccactctatctacttgtgctgtgtgagaacagtggggttacagcatcctgccgtcgtcagcgcctttcgagcacttctgctcctaatgctgacagtacatgtgtcttatctgagccttattaggtttgattatggttataatctcgtggccaacgtggcgattggcctggttaatgtcgtgtggtggttggcgtggtgcttgtggaaccagcgacgtctgccgcatgtgagaaagtgtgtcgttgttgtgttgttgttgcagggcctcagcttgctggagctgctggacttcccacccctgttctgggtcctagatgcccacgctatttggcatatttccaccatcccagttcatgtgttattcttctcattcttagaggacgacagtttgtacttactaaaggagagcgaagacaagtttaagttagactag

SEQ ID NO: 28948 - DNA, 819 bp, Artificial Sequence
  Description of Artificial Sequence: Synthetic coding sequence
atgtcatctcaagaactcgtcactttgaacgtgggtggaaagattttcacaacacgattttccacaattaagcagttccctgcttctagactggcacgcatgctggatggtcgcgatcaggagtttaagatggtgggtgggcagatctttgttgacagagatggagatctgttctcatttatattggatttcctccgcacccatcagctgctgctccccactgaattcagcgactacctgcgactgcagcgcgaagctctattctatgagcttcgcagtctggtggacctgctcaacccatatttgttgcagcctagacctgcgctcgttgaagtgcactttctatcccgtaacacccaagccttctttagggttttcggctcgtgctctaaaaccatcgagatgttgaccgggcgtataaccgtcttcaccgagcaacccagtgccccgacctggaacggcaacttctttcccccgcaaatgacactgctccctctaccgccccaaagaccatcctaccacgacttggtctttcagtgcggcagcgattcaaccactgacaaccagacaggggtgagatatgttagcataaaacctgacaaccgaaagctggctaatggtacaaacgtcctgggactgctcatcgataccctgctgaaagaagggtttcacctcgtgagcactcgcacagtgtcaagcgaagacaagactgaatgttattcatttgagaggataaagagcccagaagttttaataaccaacgagactcccaagcctgagacaattatcattcccgagcagagccaaataaagaaatag

SEQ ID NO: 28949 - DNA, 690 bp, Artificial Sequence
  Description of Artificial Sequence: Synthetic coding sequence
atgtctagccaggagctggtgacgttgaacgtcggtggaaaaattttcacaactaggttcagcaccatcaaacagttcccagcctctcgattggcacgcatgttggacggacgagaccaggagttcaaaatggtggggggccagatctttgtcgaccgtgacggcgatctgttcagctttattctcgacttcctgaggacccaccagctgctgctgcctaccgaattcagcgactacctgaggcttcagcgcgaggctctattctatgagttaagatccctagtcgacttgctcaacccttatttgctgcagccaagaccagcgttggtggaggtgcactttttgagtcgtaacacccaagccttctttagagtttttggaagttgttcgaagacaatcgagatgttgactggacggattaccgttttcactgagcagccttccgccccaacctggaatggaaatttttttccaccgcaaatgaccctactgcctctgccacctcaaagaccgtcataccatgacttagtgtttcagtgcggatctgactctaccaccgataatcagacaggtgtgcgcctcgtatgcaacggggtgatttcagctcaccataatttaagactgtggggatctagcgactcacccgcctccgcgtcaagagtggcaggaatcactgggatgttcttgtag

SEQ ID NO: 28950 - DNA, 978 bp, Artificial Sequence
  Description of Artificial Sequence: Synthetic coding sequence
atggctctggctgactcaacccggggccttccaaatggtgggggaggtggcggaggcagcgggtcatccagcagtagcgcagagccgcccctgtttccggacattgttgaactgaatgtcgggggacaagtctatgttaccagaagatgtacagttgtgagcgtcccagattccctcttgtggcgcatgtttacccagcagcaaccccaggagttggcccgtgactcaaagggacggtttttcctcgaccgcgacggcttcctgtttcgctatattttagattacctccgcgacctgcaactcgtactgcctgattattttcctgagcgctcccgattgcagagggaagcagaatacttcgaattgcccgaattggtgcggagattgggggccccacagcagcctggacctgggccaccccccagccgccgcggggtgcataaggaggggtccctcggcgatgagctgctccccctggggtactctgagcctgaacagcaggagggagcaagtgccggcgcccctagcccgactctggagctcgcctcacggagtccatctggcggtgccgctggccccctgctcacccccagtcagtctctggacgggtcgcgcaggagtgggtatattacaatcgggtatcggggcagttacacaatcggcagggatgcccaggccgatgcaaaatttcgccgggttgcccggatcacagtctgcgggaagacgagccttgctaaggaagtctttggggacacgttaaatgagtccagggatcccgacagaccgccagagaggtacacctctcgctactacctgaaatttaacttcctcgagcaagcctttgataagttaagtgaaagtggattccatatggtggcttgctcgtccacgggtacttgtgccttcgcctcttccacagatcagagtgaagacaagatctggacgtcctacacagagtacgtcttctgcagggagtag

SEQ ID NO: 28951 - DNA, 978 bp, Artificial Sequence
  Description of Artificial Sequence: Synthetic coding sequence
atggcccttgccgatagcacaagagggctcccgaacggagggggcggagggggaggttccggctctagttctagctctgccgagcccccgctgttccccgatatagtcgagctgaatgtgggcgggcaggtctatgttactcgacggtgtacggtggtgtccgttcctgactccctgctctggcgcatgttcacgcagcagcagcctcaggagctggcaagggactccaagggaaggttctttcttgaccgggacggatttctcttcaggtatatcctggattacctgagagacctgcagctcgtgttaccagattatttccctgagaggagcagattgcaacgcgaagctgagtatttcgagctaccggaactcgtacgccgtctcggtgcaccccagcaacctggtccaggccctccacccagcaggaggggcgtccacaaagaggggtcattgggcgatgaattgcttcctctgggatactctgaacccgaacagcaagagggcgcctccgccggggcaccctccccaactctagaattagcttcacggtctccgagcggtggggctgcaggcccattgctaactccgtctcaatcactggatggaagcagacgttctggctatatcacaattggataccgcggctcctataccatcgggcgcgatgcgcaggctgatgccaagtttcgcagagtggcaaggattacggtttgtgggaagaccagtctggcaaaggaggtatttggagacacgctgaatgaatccagggatccagaccgcccacccgaaagatatacctctaggtactacctgaaatttaatttcctagagcaggcgtttgataaactgagcgagtccggctttcatatggttgcttgttccagcacaggcacgtgtgcttttgccagcagcaccgaccagtccgaggacaagatctggacgtcctacacagaatacgtgttttgccgggaatag

SEQ ID NO: 28952 - DNA, 768 bp, Artificial Sequence
  Description of Artificial Sequence: Synthetic coding sequence
atgtggcagggatgtgccgtggagcgcccagtgggcagaatgactagccagacgccactcccgcaaagcccccgaccgaggcgtcccaccatgtccaccgttgtcgagctaaacgtggggggagagtttcataccacaacgctgggcacattgcggaagttccctggatctaagctggctgagatgttctcttcgttggccaaagcttcaaccgatgctgaaggtcgttttttcatcgaccgtccctcaacctactttcggcctatcctagattacctcagaaccggtcaggtgcccactcaacatatacccgaagtctaccgggaggctcaattctacgagattaagcccctggtgaagcttctggaggatatgcctcagatttttggagaacaggtatcccgcaagcagttcctgttgcaggtccctggatatagcgagaatctggagctcatggttcgtctggctcgagcagaggccatcacagctaggaaaagcagcgtgctcgtgtgcttagtggagactgaagaacaggatgcctactacagcgaggtactgtgttttctgcaagataagaaaatgttcaaatccgtggttaagttcggtccttggaaggctgtgctggataacagcgacctcatgcattgcctagagatggatatcaaagcccaagggtacaaagtattttcgaaattttatctgacctaccctaccaaacgcaacgaatttcattttaatatctactcctttacgttcacctggtggtag

SEQ ID NO: 28953 - DNA, 678 bp, Artificial Sequence
  Description of Artificial Sequence: Synthetic coding sequence
atgagcacagtggtggaactcaacgtgggcggagagtttcacactaccaccctgggaacgcttcgcaagttccccggatctaaacttgctgaaatgttttcatctctagccaaggcatccacagatgctgaaggacggttcttcatcgatagacctagcacgtacttccggcctatcctagactacctgaggacaggtcaggtacccacgcagcacattccagaagtctaccgggaggcacagttttatgagattaagcctctggtgaagctgctggaagatatgccgcagatattcggagagcaggtcagccgtaagcaattcctgctgcaggtccccggctatagtgaaaaccttgagctgatggtgcgactggcgagagccgaggcaatcacagctcgtaagtccagcgtgctcgtttgtctcgtcgaaactgaagaacaagacgcatactatagtgaagtcctttgttttctccaggacaaaaagatgtttaaatccgtggtaaagttcggcccttggaaagccgtcttggataatagtgatctcatgcactgtttggagatggacataaaagcccagggctacaaagtgtttagtaagttctacctgacctacccaaccaagaggaacgagttccattttaatatctatagtttcacctttacttggtggtag

SEQ ID NO: 28954 - DNA, 861 bp, Artificial Sequence
  Description of Artificial Sequence: Synthetic coding sequence
gacgcccagatgccacatcggaaagaacgacccagtggttcttctttacatactcatggatccactggaaccgcggaaggcggaaacatgagcaggctgtcccttacccggagcccagtgtcacctctcgctgcacagggaatccctctcccagcccagttgactaagtcaaacgcacctgtgcacattgatgtgggcggtcacatgtatacatcctctctcgcaacccttactaagtaccctgactctcggatatctcggctattcaatggtactgagcctatagtattggactccttaaaacagcactacttcatcgatcgcgacggagagatctttcgttatgtgttgagcttcctgcgaactagcaagctgctgctgcccgacgatttcaaggattttagcctcttgtatgaagaagcaaggtattatcagttgcagcccatggtacgagagcttgagcgatggcagcaggagcaggagcagcggcggaggagtagagcctgtgactgtctggtcgtgcgagtgacaccagatctgggggagaggatcgccctatccggagagaaagccctcatcgaggaggtgtttcctgagacgggagatgtgatgtgtaattctgttaacgcagggtggaaccaggaccccacccatgtaatcaggttcccactcaacggttattgcagacttaactccgtgcaggttctggaacggctgttccagcggggcttttcagtggccgcctcctgcggcggcggcgtggactcctcgcagttcagcgagtacgtgttgtgtcgcgaagaacggaggccgcagcccacccctacagctgtgaggatcaagcaggaacctctggactag

SEQ ID NO: 28955 - DNA, 852 bp, Artificial Sequence
  Description of Artificial Sequence: Synthetic coding sequence
atgccccacaggaaggaaagaccttccggttcatctcttcatacccacggctccactggtaccgcagaagggggcaatatgtcccgtctgtctctgactagaagccccgtgtccccgctcgccgctcagggcatccccctccccgcccagctgacaaagagcaacgctcccgtgcacattgatgttggcggtcatatgtacacgtcttccctggccaccctaaccaagtacccagactcgcgaatcagtcgactgtttaacggcaccgagccaattgtcctggattccctgaaacagcactacttcatagaccgggacggagaaatctttcgttatgtgctgagttttctaaggacttctaagttgcttctccctgacgactttaaagattttagcctgctgtatgaagaagctaggtattaccaactccagccaatggttagagaacttgaacggtggcagcaggaacaggaacagcggcgtaggagccgcgcctgtgactgtctagtcgtcagggtgacacctgacctgggagaaaggatagcactgtctggtgagaaggccttgattgaggaagtctttccagaaactggcgacgtgatgtgtaacagcgtcaatgccggttggaatcaggatccgactcacgttattagatttcctcttaatggatactgcaggttgaattccgtacaggtgctcgagagactgtttcaacgtgggttctctgtcgcggcatcttgtggaggaggggtggactcaagtcagttcagcgaatatgtgctgtgtagggaggagcggagacctcagcctaccccaacagccgtgaggattaagcaggagcccctggattag

SEQ ID NO: 28956 - DNA, 894 bp, Artificial Sequence
  Description of Artificial Sequence: Synthetic coding sequence
atgcagacccccaggcccgccatgagaatggaagctggagaggccgccccgcccgccggagctggtggccgcgctgctggcggctggggcaagtgggtccgtctgaacgtgggggggactgtatttcttacaactagacagaccctttgcagagagcagaagtctttcctatctagactttgtcagggggaggagctacagtcagatagagatgaaaccggagcatatctaattgatcgggatcctacctacttcggtccaatcctcaactttctgcgacatggcaagctagtgctcgataaggacatggctgaggagggggttttggaggaggcagagttttacaacatagggccactgatccgaatcattaaggatcgaatggaagaaaaggactacactgttacacaggtccccccgaaacatgtttaccgggtgctgcaatgtcaggaagaagagctgacacaaatggtaagtactatgagcgatggctggcggttcgagcagcttgtgaacattgggtctagctacaactacggctcagaggaccaggccgagtttctgtgtgtagtctccaaagagctccactccaccccgaacggactgtcttcagagtcttcacggaagacaaaaagcaccgaagaacagcttgaagaacagcagcaacaggaggaggaggttgaagaggtggaggtggagcaggtccaggtcgaagccgacgctcaggagaaaggcagccgccctcacccactgaggcctgaagccgagttagcagtgcgggcctctccacgcccgctcgcaagaccacagtcttgccacccatgctgttacaagcctgaggcccctggttgcgaggcacctgaccatctccaaggtcttggcgtgcctatttag

SEQ ID NO: 28957 - DNA, 966 bp, Artificial Sequence
  Description of Artificial Sequence: Synthetic coding sequence
atgcaaacgccgcggcccgctatgaggatggaggctggggaggccgcgcctccggccggggccgggggccgtgctgcgggaggctggggtaagtgggtgcgactgaatgttggagggacagtctttctcactacgagacagaccttgtgcagagagcagaaaagctttctgagccggctctgtcagggcgaagaactgcagagcgatagagatgagacaggtgcctatctcatcgatcgtgaccctacctacttcggacctattctgaatttcttacgacacggtaaactggtgctcgacaaagacatggccgaagagggggtgttggaggaggccgaattttacaatatcggcccattaattagaatcatcaaagatcggatggaggagaaagactacaccgtgacgcaggttcccccaaagcatgtatatcgggtcctgcaatgccaggaagaagaactaacacagatggtcagcacaatgtccgacggatggcgtttcgaacagctggtgaatatcggctcttcctataattatggaagcgaggatcaagctgaatttctgtgcgttgtgtccaaggaacttcacagcaccccgaacggtctcagctccgagtcgagccgaaagacaaaatcaaccgaagaacagctggaagagcagcaacagcaggaggaagaggtagaagaagtggaagtggaacaggtacaggtggaagctgacgctcaggagaaggcccagtcaagccaggacccagcgaacctatttagtctgcctccactcccccccccaccgctgcccgcaggcggaagccgaccccaccccttaaggccggaggcagaacttgcggtacgggcttccccccggcccctggctcgcccccagtcctgtcacccttgctgctacaagcccgaggcgcctgggtgtgaagccccggatcacttgcagggcctcggcgtgcctatttag

SEQ ID NO: 28958 - DNA, 192 bp, Artificial Sequence
  Description of Artificial Sequence: Synthetic coding sequence
atgacctctaaagtgtcttgtccgccaagcgtaacccttcgatgctgtgggctatggcaggtggcctcacctcttaatgtgagtgacctcagtgacgaaacgggcgcgtatctcattgacagagaccccacatattttggccctatattgaattttctcagacatggcaagctcgtgttagacaaggactag

SEQ ID NO: 28959 - DNA, 543 bp, Artificial Sequence
  Description of Artificial Sequence: Synthetic coding sequence
tagcaaaccttgtgtagggagcagaaaagctttttgtcccgcttatgtcaaggtgaggagctgcagtctgaccgagacgaaacgggcgcatatctaatagatagagatcctacatacttcggacccattcttaacttcctgcggcatggcaaattagtattggataaggatatggctgaggagggggtgttggaggaagctgagttttacaatatcgggcctctgatcaggatcatcaaagacaggatggaagagaaagactatacagtgacccaggtaccgccgaaacacgtctaccgtgtactgcaatgtcaggaggaggagctgacacaaatggtgtcaacgatgtccgatggttggcggtttgagcaactagtgaacatagggtcttcctataattatggatctgaagaccaagccgaatttctgtgtgtggtgtccaaagagttacatagcacccccaacggcctttctagcgagagttccaggaaaaccaaagtcccagttaggacgctatcagacctgaggctcagtttgcaatag

SEQ ID NO: 28960 - DNA, 1281 bp, Artificial Sequence
  Description of Artificial Sequence: Synthetic coding sequence
atggagggtcataaagcagaagaggaagtccttgatgtgctccggctaaacgtcggtggctgtatttatacagcgcgacgagagtccctgtgtaggttcaaagacagcatgcttgcctccatgttctccgggcggttccctctgaaaacggatgaatcaggcgcgtgcgttatcgatcgggatgggcgcctctttaaatatctcctagattacctacatggggaagtgcagatccccacagacgagcagacccggatcgctcttcaggaagaggccgattatttcgggataccttacccatactccctgagtgaccacctggccaatgagatggagacctattcgctgcgctctaacattgagcttaagaaagccctaacagatttctgtgactcttatggccttgtctgtaacaaaccaacagtgtgggtccttcattacctcaatactagcggggcctcctgcgaatcccgaatcatcggggtgtacgccacaaaaaccgacggaacggacgcaatagaaaagcagttgggtggacgcatccattcaaaaggcatttttaagcgggaggcgggcaacaacgtccagtatatctggtcttattatagcgtggccgagcttaaaaagatgatggatgccttcgatgcctgggaaggtaagggggtctcatattggcgagtcccccacgaactaattgagtgctggactctggaagaacgccctctactgggcagccttcgacatatggcccctatccgcaagagaagactgataacgtttaacgaggccgacgaatccgtaaattacaaaacaggcccaaagcccgtgcgcttcctgggcccaagcacttctacacagatcaaagtgaagaactctgcctctgtaactgtctcaccagcaagcgccattcagactagcgcaggtgctaccgccaaccggttccagagcgggtcaagacggaaggccgctcagagaagcgccccttctcgcgccaccgcactggtcggaactggggctccaggacacccccaggcatccccaggcgctgcatcagccgagaatggaggtacgcatctccctccagccaaagtgctactttccgataaaaagcctacaccccagagggttatcaaactgaaacggaccccactctgcgccaccgctccctgccttccaagccctacagccacacgacaggcgaattcactgaaaccactgccaggcgaggctgcccgcgcccttggggtccgaactgagaacggaaagaataaaggaaattag

SEQ ID NO: 28961 - DNA, 1281 bp, Artificial Sequence
  Description of Artificial Sequence: Synthetic coding sequence
atggagggccacaaggcagaagaggaggtgctcgacgtgctgcgcctaaacgtcggcgggtgcatttacacggcaaggcgcgagtctctgtgccgctttaaggactcgatgctggcaagcatgtttagtgggcggtttcctctaaagacagatgagtccggcgcttgcgtgattgaccgcgatggccggttgttcaaatacttactcgattacctgcacggcgaggtacaaatcccaacagacgagcagactaggatcgcactccaggaagaagcggattattttggaatcccatacccatactctctctcagatcatttggcaaatgagatggaaacctactctttgagatcgaacattgaactaaagaaggccctcaccgatttttgcgattcttacggcctggtctgtaacaagccaaccgtctgggtgctccattacctaaacactagcggcgcctcttgtgaatctcggattatcggagtttatgccaccaagacggatggaactgacgcaatcgaaaaacaattaggcggcaggattcattcaaaaggtatcttcaaaagagaggcaggaaacaatgtgcaatatatatggtcatattactcggtcgccgaactgaagaagatgatggacgccttcgacgcttgggaggggaagggggtgagttattggagagttccccatgaacttattgagtgttggactcttgaggaacgtccccttctaggcagccttcgccatatggcacctattagaaagcgcagattgataacatttaatgaggcagatgagtccgtgaactacaaaacagggccaaagcccgtgcgctttctggggccttctaccagcacccaaatcaaggtcaaaaacagtgctagcgtgacagtgtccccggcttccgctatacaaacctcggcaggggccacagccaaccggtttcagagtggtagccggcggaaagcggcccagcgctccgctccatcaagagctactgctctggtcggtactggagcgcccggccacccccaggctagtccaggcgctgcatcggccgaaaatggaggtactcatctgccaccagctaaggtcctgttgagtgacaaaaagcctaccccacagagggtcatcaagttgaaacgcacccccctctgcgctaccgcaccctgtctccccagcccaactgctacaaggcaagcaaatagcctaaagccactgcccggcgaagctgccagagcacttggcgtgcgcaccgagaacggtaagaataaggggaattag

SEQ ID NO: 28962 - DNA, 2781 bp, Artificial Sequence
  Description of Artificial Sequence: Synthetic coding sequence
atggaggagagcggcatggcgcatgagagcgccgaggacttgttccacttcaacgtcggaggctggcatttcagcgtgccccggagcaaattaagccagtttccagactctctcttgtggaaggaggcaagtgcactgacaagctctgagtctcagcggctattcatagatagagacgggagcaccttcaggcatgttcactactatctgtatacgagcaaattgagcttcagtagctgcgccgaacttaatttgttatatgagcaggcgctcggccttcaacttatgcccctgctccagacgctggacaatctgaaagagggaaagcaccatttgagagtgcggcctgcggatctccctgtggcagaacgcgcgtcactcaactactggcgcacttggaagtgcattagcaaaccctcagagttccccatcaaatctcccgccttcaccggcctccacgataaggcacccctgggcctaatggatacccccctgctggacacagaagaggaggtccattattgctttctgcccctggacttggtggccaagtacccatccctcgtgacagaggataatctcctgtggctcgctgagacagttgcactgatcgaatgtgaatgttccgaattccggtttattgtgaattttctgcgtagccagaagattctgcttccagataacttctctaatatcgacgtgctggaggcagaagttgagatattggaaattccagctctcactgaggcagtaaggtggtaccggatgaatatgggcggatgctcacctacgacatgttcccctctgagtcccggaaagggtgctagaaccgcctccctggagagcgtaaagcctctgtatacaatggctttaggtttactggtgaagtaccccgattccgccttagggcagcttcggattgagtccaccctcgatggaagtaggctatacataacaggtaatggagtccttttccagcatgttaagaattggctcggtacctgcagacttccgctgactgaaaccatctccgaagtgtatgaactgtgtgcttttctcgataagagggatatcacttacgaacctatcaaggtagctctaaagactcacctagagcccaggaccctggcgcctatggatgtccttaacgaatggactgcggagatcaccgtctatagcccccagcaaattattaaggtctacgttggcagccactggtatgcgaccactctgcagacgctgctgaagtacccagaacttctgtcaaaccctcaaagagtgtattggatcacatatggacagactctcttaattcatggcgacggacagatgttcagacacattctgaacttcctgcggctgggtaagttgttccttccttcagagtttaaggaatggccgctgttctgtcaggaagtagaagagtaccacattcctagtctgagtgaggccttagctcagtgtgaagcctacaagagctggacacaggagaaggagagtgagaatgaggaggcttttagcattcggcggttgcatgtcgtcactgagggacctggcagccttgtggaattttccagagacactaaggaaacgactgcttatatgcccgtggattttgaggactgttcagacagaactccatggaacaaagcgaagggaaacttggtgcgtagtaatcagatggacgaagcggaacaatacactcggcccatacaagtttctctgtgccgtaacgcaaagcgcgcggggaatccctccacttacagccattgtcgcggactgtgtacgaaccccgggcactggggctctcatccagagtctcctcctaaaaaaaaatgcactacaattaatctgacgcagaagagtgagacaaaggacccaccagctacccctatgcaaaagctcataagtctggttcgagaatgggatatggttaattgtaagcagtgggagtttcagcccctgactgcgacaagatcttccccattagaggaagcgacattacagcttccgcttggaagcgaagccgcatcacaaccatccacgtccgcggcctggaaggcccattctactgccagtgagaaagacccaggcccccaggctggtgctggcgcaggggctaaggataagggaccagaacctacatttaaaccttatctgccaccgaaacgtgcaggtactctgaaggattggagcaaacagaggacaaaagagcgtgagtcaccagcccctgaacagcctctgcctgaggcctctgaggtcgattcattgggagtgatcttgaaggtcacccacccccctgttgtgggttccgatggattttgcatgttctttgaggactccatcatatataccactgaaatggataatctgcgacatactactcccacagcttccccccaaccccaggaggttacttttctctcttttagtctgagttgggaagaaatgttttatgctcagaaatgtcattgcttcctggccgacattattatggacagcattcgacagaaagaccctaaggctatcacagccaaagtggtcagcctcgccaatcggttgtggaccctgcacatttcccccaagcagtttgtcgtggacttactggctatcaccgggtttaaagacgatcgtcatactcaggaacgactatatagctgggtggagctaaccctgccatttgcaagaaaatacggacgatgtatggacttactgatccagagaggcctgtcccgatctgtttcttatagcatccttgggaaatacttacaggaggattag

SEQ ID NO: 28963 - DNA, 1260 bp, Artificial Sequence
  Description of Artificial Sequence: Synthetic coding sequence
atgaacgtccatcgcggctcagactccgatcgattgctgaggcaggaagcatcttgccttgtggatgacaccttggcagtcgctcaggaaaaagaagcgaacagcctcgcgtcatctggaccccataatctgacctacccattaggcccacgtaacgaggatttgagcctcgactacgcctcccagcccgccaatttgcagttcccacacatcatgcccctggcagaggatattaaaggaagttgttttcagagtggcaataagcggaaccacgagccattcatcgcacctgagcgcttcggaaacagcagcgtagggttcggctccaatagccattcccaagctcctgagaaggtgacgttgcttgttgacggcaccaggtttgtggtgaacccccaaatatttaccgctcaccccgatacaatgctgggcaggatgttcggtcctggcagggagtacaactttacccgacctaacgaaaagggcgaatatgagatagcggaaggcatcagcgccacggtgtttagaactgtgctcgactattacaagaccggtataattaactgtcccgatggaatctctattcccgatttacgtgatacgtgcgattatctgtgtattaactttgactttaataccattaggtgtcaggatctttcagccttactccatgaactctcaaatgacggcgcccacaaacaatttgaccactatctcgaagaactcattctccctatcatggtgggctgcgccaaaaaaggagagagggagtgtcacatagtagtgctaaccgacgaggactccgtggactgggatgaggaccatcctccacccatgggcgaggaatattcacagatcttatatagtagcaaactttatcgctttttcaagtatatcgaaaatagagacgtggccaagactgttctgaaagaacgtgggttgaaaaatattcggatagggatagagggctatcctacttgtaaggaaaagataaagagacgcccaggggggcgttccgaggtcatttacaactatgtccagcgaccctttattcagatgagttgggaaaaagaagagggaaagagccgccacgtcgactttcagtgcgtgcggtccaaatctcttacaaacttggtggccgccggggacgacgtacttgaagatcaggaaattttgatgcaccatcccccacaggtggatgagctggatcgtttaaacgcccccctttcgcaaatggcttccaatgattttcaggactag

SEQ ID NO: 28964 - DNA, 762 bp, Artificial Sequence
  Description of Artificial Sequence: Synthetic coding sequence
atgaacgtgcacaggggtagcgactccgaccgcctgctgagacaagaggcatcctgcttggtggacgacacactggctgtggcgcaggagaaagaagccaattccctagcgagcagcggcccccacaacctgacatacccgctcggaccccggaacgagggcgctcttttgcatgagctatctaacgacggggcacacaagcagttcgatcactatctcgaggagttaattctacccatcatggtcggctgcgccaagaaaggcgagcgtgaatgccatatagtggttctgaccgacgaagactctgttgattgggacgaggatcatcctccgccaatgggggaggagtactcgcaaattctctattcatccaagctgtatcggtttttcaagtacattgaaaacagggatgtggccaagacggttctaaaagagaggggactgaaaaatatcaggatcggtatcgagggctatcccacttgtaaggagaagataaagaggagacccggcgggcgttctgaagtcatttataactatgtgcagaggccgtttattcagatgtcttgggagaaggaagaaggaaagtccagacatgtcgacttccagtgtgttcgaagtaagagcctgacaaacctggtggctgcgggagatgatgtcttggaggaccaggagatcctgatgcaccatccaccccaggtggacgagcttgaccggttgaacgcaccactgtctcagatggcgtccaatgattttcaggactag

SEQ ID NO: 28965 - DNA, 264 bp, Artificial Sequence
  Description of Artificial Sequence: Synthetic coding sequence
atgaatgtgcaccgcgggtcggactccgataggctgctccggcaggaagcatcgtgcctagttgatgataccctggccgtggcccaagaaaaagaggctaactccttagcctcctctggtccccacaacctgacctatcctctagggccaaggaacgaggacctgtctttggattacgcgtctcagccagcgaacttgcaatttccacacataatgcctttagcagaggatattaagggtagttgttttcagtctggcaactag

SEQ ID NO: 28966 - DNA, 330 bp, Artificial Sequence
  Description of Artificial Sequence: Synthetic coding sequence
atgaacgtgcatcggggcagcgactctgatcgcttactgaggcaggaggcaagttgccttgtcgacgacaccttggccgtagcccaggaaaaggaagcaaattctctcgcgtccagtggtccccacaacctgacgtatcccctgggacccagaaatgaggatttatcgctcgactatgcatctcaaccagctaacctgcagttccctcatattatgccactggccgaggacatcaaagggagttgtttccagtccggcaacaaacggaatcatgagccattcatcgctcctgaacgttttgggaactcatccgttggcttcggatcttag

SEQ ID NO: 28967 - DNA, 294 bp, Artificial Sequence
  Description of Artificial Sequence: Synthetic coding sequence
atgaacgtccatcgaggatctgatagcgatagacttctgcgccaggaagccagctgcttggttgacgacacactggcagttgcccaggaaaaagaagctaatagtctcgcttcctccggcccccacaacctgacttacccactcgggccacgcaacgaggatctcagccttgactacgcgtcccagcctgcaaacctccagttcccccacataatgccccttgccgaagatattaaaggatcgtgtttccaatccggcaacaaaagaaatcatgaaccatttatcgctccatag

SEQ ID NO: 28968 - DNA, 825 bp, Artificial Sequence
  Description of Artificial Sequence: Synthetic coding sequence
atgttcggccctgggcgggagtacaatttcactaggcccaacgagaagggtgaatatgagatcgccgagggaatctcggctaccgttttccgcacagtgctggattactacaagactggaatcatcaactgccctgacggaatctcaatccctgaccttcgtgacacttgcgactatctatgtattaattttgacttcaatacaataagatgccaagatctctcagctctgctgcacgagctctctaatgatggggctcataagcagttcgaccactacctggaagagcttatcttgccaattatggttggttgtgccaagaaaggagagcgcgaatgtcatattgtcgtcctgaccgatgaagatagtgtagattgggatgaggatcatccacccccgatgggagaagaatactcacaaatactgtactcttccaagctgtacagatttttcaagtacatagagaatcgcgacgtggctaaaacagtgctaaaggagagagggctaaaaaatatccggatagggatcgaagggtatcccacttgtaaagagaaaattaagcggcgccccgggggtcggtccgaggtcatctacaattacgtgcaacgacccttcatccagatgagttgggaaaaggaagagggcaagagccggcacgtggactttcagtgtgtccgctctaaaagcctgaccaacctggtcgctgctggagatgacgtgttagaggatcaggaaattttgatgcaccaccctccgcaggtggatgagctcgatcgcctgaatgccccccttagtcagatggcgtcaaatgatttccaggattag

SEQ ID NO: 28969 - DNA, 522 bp, Artificial Sequence
  Description of Artificial Sequence: Synthetic coding sequence
atggtcggatgcgccaaaaaaggagaaagagaatgtcatatcgtggttttaacagacgaagattccgtggattgggacgaggaccatccccctcctatgggggaggagtatagccagatcctgtacagctctaagttatatcgcttcttcaaatacattgagaatcgagacgtcgcgaagacagttttaaaagagcgaggacttaaaaacatccggatcgggatcgagggctaccccacctgcaaagaaaaaatcaaacggcgacccgggggtcgaagcgaagtgatctacaactacgtgcagcgaccctttatccagatgagctgggaaaaggaggagggcaaatctcggcatgtggatttccagtgtgtcagatccaagagtctcacaaacctcgttgcagctggcgatgacgtcctggaggaccaggagatcctaatgcatcaccccccacaagtcgatgagctcgataggcttaacgctcccttaagccagatggcatccaacgactttcaggattag

SEQ ID NO: 28970 - DNA, 783 bp, Artificial Sequence
  Description of Artificial Sequence: Synthetic coding sequence
atgtccgaccctattacactgaacgtcgggggaaagttgtacacaacctccctggcaacccttacatctttcccagactccatgcttggcgcaatgttctctggcaagatgccaaccaagcgagattctcagggcaattgcttcatcgatcgggacggaaaggtcttccggtatattctgaattttctcagaacctctcatttggatcttcctgaagactttcaagagatgggactcttgcgaagggaagcagacttctatcaggtccaaccattaatcgaggccctccaagagaaggaagtcgagctgtctaaagcagagaaaaacgcaatgcttaacattactttaaatcagcgggtgcaaacggtgcacttcactgtgcgcgaagcaccccagatttattcactgtccagttcgtctatggaagtgttcaatgccaacattttcagtacgtcatgtctgttcctaaaactgttgggatccaaattattctattgcagcaatggtaacttgagttctattacaagccatctccaggatccaaaccatttaactcttgattgggtggctaacgtggaaggcctgccggaggaggaatacactaaacaaaacctgaaacgcctgtgggtcgttcctgccaataaacagattaacagcttccaggtgttcgtggaagaagtcctcaagatcgcgttgagtgacgggttttgtattgacagctcgcatccgcacgctctggacttcatgaacaataagattattaggctcatacgataccgatag

SEQ ID NO: 28971 - DNA, 423 bp, Artificial Sequence
  Description of Artificial Sequence: Synthetic coding sequence
atgtctgatcccatcaccttgaacgttggaggtaaattatatacaaccagcttggcgacgctgactagctttcccgactcgatgcttggcgccatgttttccgggaagatgcccacaaagagagatagccagggaaactgcttcatagatcgcgatggcaaagtcttcaggtacatattgaatttcctgaggactagccacttggatctcccagaagatttccaggaaatggggctgctacgaagagaggcagacttttaccaggtgcagcctttaatcgaggcccttcaggagaaggaagtggaactcagcaaggccgaaaagaacgcgatgctcaatatcaccctcaaccagagggtacaaactgtacacttcactgtacgggaggctccgcagatctacagtctgtctagtagtagttag

SEQ ID NO: 28972 - DNA, 780 bp, Artificial Sequence
  Description of Artificial Sequence: Synthetic coding sequence
atggaaagaaaaataaaccggcgcgagaaggagaaggagtacgagggtaagcataattccctcgaggataccgaccaagggaaaaattgtaaatcaaccctcatgaccctgaacgtaggtggttatctgtacataacccagaagcagaccctcaccaaatatccggacaccttccttgaggggatcgtgaacggaaagattctgtgccccttcgatgccgatggacactatttcattgatcgggacggactgctgttccgacacgtcctgaatttcctgaggaatggcgaacttcttctgcccgaaggcttccgcgaaaaccagctgctggctcaagaggctgagttctttcagctgaaaggcttggcggaggaggtcaaaagccgctgggagaaggaacagttgacacctagggaaacaaccttcctggaaataacagataatcacgaccgcagccagggacttagaattttttgcaacgcaccagactttatttctaagatcaaatctaggattgtgttagtgagcaagtcacggctagatggatttcctgaagaatttagcatctctagtaatattattcaatttaagtacttcatcaaaagtgaaaatggcacgcgattggtgcttaaagaggacaatacatttgtgtgcaccctagagactttgaaattcgaggccattatgatggctctcaaatgcggctttcgattattaacaagcctcgactgctctaagggctctattgtgcactccgacgctcttcacttcataaagtag

SEQ ID NO: 28973 - DNA, 780 bp, Artificial Sequence
  Description of Artificial Sequence: Synthetic coding sequence
atggaacgcaagattaatcggagagaaaaggaaaaagagtacgaagggaaacacaacagcctggaagatacagatcagggcaaaaattgcaagtccaccctgatgacactgaacgtcggtgggtacctctacatcactcaaaaacaaacactgaccaagtaccccgataccttccttgagggcattgttaatggaaagattttgtgcccctttgatgccgacggacactattttatcgatcgcgacgggttgctgtttcgacacgtccttaacttcctgcgcaatggagagcttctcctccctgaaggcttccgggagaatcagctgcttgcacaggaagcagaattctttcaacttaagggactggcagaggaggtcaagtctcgctgggaaaaagaacagctcactcctcgcgaaacaacctttctggagatcacagacaatcacgatcgatctcagggcctgcgtattttttgtaatgccccggacttcataagtaaaattaagtctagaatcgtcctggtcagcaaatccaggctcgatgggttccctgaggagtttagtatctcctctaacataatccagttcaagtacttcatcaagtctgaaaatgggacaaggttggtgcttaaggaagacaacacgtttgtatgtacgttggaaacgctgaagttcgaggctatcatgatggccctcaaatgtggtttccggttgctcaccagtctcgattgcagcaagggttccatcgtgcacagcgacgctcttcacttcataaagtag

SEQ ID NO: 28974 - DNA, 705 bp, Artificial Sequence
  Description of Artificial Sequence: Synthetic coding sequence
atggcagagaaccactgcgaactgctgtctcctgccaggggtggcattggagccggtcttggcggcggcctgtgtagaagatgctctgcaggtttgggtgccctggctcagcgcccgggatcagtttctaaatgggtcagactcaacgtcggcgggacttatttcctgaccactcggcaaacgctgtgtcgggaccccaaatcatttctgtataggttgtgtcaagctgaccccgatctagacagcgacaaagacgagactggcgcctacctgatcgaccgagaccctacctacttcggcccagttttgaattacctgaggcacggaaaacttgttatcaacaaggatcttgcggaggaaggcgtactcgaggaggctgagttctacaatatcacgtcactgataaaactggtgaaggataagatccgcgaacgggattctaagactagtcaagtacccgtgaaacacgtgtaccgggtgctgcagtgtcaagaagaggaactaacccagatggtgagtaccatgagcgacggctggaaattcgaacagctggtgagtatcggaagtagttacaattatggaaacgaagatcaagctgagtttctgtgtgtggtgtctaaagagctgcacaatacgccgtacggtacggcctcagaaccatctgaaaaagctaagatcctgcaagaacgggggtctagaatgtag

SEQ ID NO: 28975 - DNA, 714 bp, Artificial Sequence
  Description of Artificial Sequence: Synthetic coding sequence
atggataacggagattgggggtacatgatgactgaccccgtcactctgaatgttgggggccatctctacaccactagtctcacaactctgactagataccctgactcaatgctgggagccatgttcgggggtgatttcccaacggccagggacccccagggaaactatttcatcgacagggatggacctttgtttaggtacgtgctgaattttctgcggacttccgagctgaccctccctctggatttcaaagagttcgatctgctccgaaaggaagcagacttttaccagatcgaacccctgattcagtgcttgaacgatcctaagccactgtacccgatggacacatttgaagaggtggtggagttatcctccacccggaagctgagtaagtatagcaaccccgttgccgtgataattacacagcttacgatcactacaaaggtccactctctgcttgagggaattagcaactacttcactaagtggaacaaacacatgatggacaccagggactgccaggtatcttttactttcggaccatgcgattatcaccaagaagtcagcctgcgggttcacctgatggagtacataaccaaacaggggttcacgatccggaacacacgggtgcaccacatgagtgagcgggcaaacgagaacaccgttgagcacaattggactttctgtcgcctggcaagaaagactgacgattag

SEQ ID NO: 28976 - DNA, 714 bp, Artificial Sequence
  Description of Artificial Sequence: Synthetic coding sequence
atggacaatggcgactggggatatatgatgactgatcccgtgacacttaatgttggagggcatctttataccaccagccttaccaccctcactcgttacccagattctatgctgggagccatgtttggaggagattttccgacagcccgcgacccccaagggaactacttcatcgaccgggacgggcctctcttcagatatgttttgaacttcttgaggacttctgaattgaccctgccactggactttaaggagttcgacctcctacggaaggaggctgacttctaccagatcgaacctctgattcaatgtctgaacgaccccaagcctctgtaccctatggatactttcgaggaagtagtggagctatcctctacacgcaaactgtcaaaatactcaaaccccgtggccgttatcatcacacagctcaccatcaccactaaggtccacagccttctcgaaggcatctccaactattttacaaaatggaataaacatatgatggacacacgggactgccaagtgtctttcacattcgggccctgcgactaccaccaggaggtttcattacgcgttcacctcatggagtacatcacaaagcaaggcttcacgatccgcaacactagggtccatcatatgagcgagagggccaatgagaatactgtagagcacaactggacgttttgccggctggctaggaagacagatgattag

SEQ ID NO: 28977 - DNA, 30 bp, Artificial Sequence
  Description of Artificial Sequence: Synthetic coding sequence
atggacaatggcgattggggatacatgtag

SEQ ID NO: 28978 - DNA, 714 bp, Artificial Sequence
  Description of Artificial Sequence: Synthetic coding sequence
atggacaacggtgattgggggtatatgatgactgatcccgtgacactaaacgtgggcggccacctctataccacctcattgactaccctgactcgataccccgattcaatgctcggagcgatgttcggcggggacttcccgaccgctagggacccccaggggaattattttatcgatcgcgacggaccattattccggtacgtgctgaattttcttcgcactagtgagcttacccttccactggacttcaaggaatttgatctgctgcggaaggaagcagatttttaccagatcgaaccattaattcagtgcttaaatgatccgaaaccactctatcccatggatactttcgaggaagttgtcgaattatcctcgactcgaaaactttccaagtactctaaccctgtggctgtaatcattactcaactaacaatcactactaaagtgcacagcttgctggaggggatctccaattatttcacgaaatggaataaacatatgatggacacccgcgactgtcaggtgtcgttcaccttcggaccatgtgactaccatcaggaggtcagcttacgcgtgcacttgatggagtacatcaccaaacaggggttcaccatacgaaacacaagggtgcaccatatgtcggaaagggctaacgagaacaccgtggaacacaattggaccttctgtaggctggcaaggaagacggatgattag

SEQ ID NO: 28979 - DNA, 1422 bp, Artificial Sequence
  Description of Artificial Sequence: Synthetic coding sequence
atggctctgaaagacaccggctctgggggttctacaattctgcctatatcggaaatggtaagctcaagctccagtcccggcgcatctgcagcagccgcgcctgggccttgcgcccccagcccattccccgaagtggtggaattgaatgtcggcggccaggtttacgtgaccaagcactcaactctccttagtgtaccagattcaactttagccagcatgttttccccgagctcgcctagggggggagcccgccggcgtggtgagctgccacgagactctagagcccggttctttattgatagagacgggttcctctttcgatacgttctagactaccttcgtgacaagcagcttgcattgccagagcacttccctgaaaaagagagactactgcgcgaggcagaatactttcagctgactgacttggttaagctgttatcccccaaggtgactaagcaaaatagtctcaacgatgagggatgtcaaagcgacctggaagacaacgtgtcccagggttcttctgacgcactgcttctgcgtggagctgcggccgctgtgccctccggtccaggggcacatggcggcggtggcggagggggcgcccaggataagcggagtggattcctgacattgggctacagaggctcttatactactgttagagacaatcaggctgatgctaagttccggagggttgctcgaatcatggtttgtggacgaatcgccttggccaaggaggtgttcggggacactctgaatgaaagccgcgacccagaccgacagccagaaaagtatacatctagattctacctgaagtttacgtatttggaacaggcgtttgaccgactgtcggaggctggcttccacatggtggcctgcaactccagcgggaccgctgcctttgtcaaccaatacagagacgataaaatctggtcttcatacaccgaatacatcttcttccggccacctcagaaaattgttagccctaaacaggagcacgaagataggaaacatgacaaagttaccgacaaaggttcggagagtgggacatcatgtaatgagctctccacctcctcatgcgatagtcattccgaagcctctacgccccaggataaccccagtagtgctcagcaggccactgcacatcagcccaataccttgacattggatagaccaagcaaaaaggctccagtgcagtggattccaccgccagacaagcgaagaaacagcgagttgttccagaccctcatctcaaagtctagagaaactaatctctccaagaaaaaggtgtgcgagaagctgagcgtagaggaagagatgaaaaagtgcattcaggactttaagaaaatccatatacccgactactttcccgaacgcaaacgccagtggcagagcgaacttctgcagaagtatgggctctag

SEQ ID NO: 28980 - DNA, 2751 bp, Artificial Sequence
  Description of Artificial Sequence: Synthetic coding sequence
atgagttacactttggatagcctggggaacccgtcggcctatagaagggttacggaaactcgatccagcttcagtagagtgagcggatccccttccagcggtttccgaagtcagtcatggtctcgggggtcgcctagcactgtgagtagctcctacaaacgctccatgctggcgcctcggctggcctatagctccgcaatgctctccagcgcagaaagcagtctagattttagccagagctcatccctactcaatggggggtcaggaccaggcggagactataaactcagcaggagcaacgagaaagagcagctccaaggcctgaatgaccgattcgcggggtacatcgaaaaggtgcactatctcgaacagcagaataaggagattgaggcggaaatccaggctctaagacaaaagcaggctagccacgcccagctcggcgacgcctatgaccaggaaatacgggagctccgcgccactcttgaaatggtgaatcacgaaaaggcccaagtacagctggacagtgatcatctggaggaggatatccaccggctcaaggagcgtttcgaagaggaggctcgccttagagatgataccgaggccgctatccgggcactaagaaaggatatcgaggaagctagtctcgtgaaagttgagctagacaagaaggtgcagtcgttacaggacgaggttgccttcctgagaagcaaccacgaggaggaggtagccgatttgttggcacagatccaggcctctcacattactgtggagcgaaaggactatctcaagaccgacatttccaccgccctgaaggagatcagaagtcagctcgagtcccatagtgatcagaatatgcaccaagccgaagagtggtttaaatgtaggtatgccaagttgaccgaagcagccgagcagaacaaagaggcaataaggagcgcaaaggaagaaatcgccgagtacagacgccaacttcagagcaagagtattgagcttgagagtgtccggggaacaaaagaatcactggaaaggcaactgtcagacatagaggagcgtcacaaccacgatctgtcaagttatcaggacacaatccagcagctcgagaatgagctcagagggactaagtgggaaatggccaggcacctgcgcgaataccaagaccttctcaatgtaaagatggctctggatatcgagattgccgcctaccggaagctcctagaaggagaagagacaagattttcaaccttcgcaggctccattaccgggcccttgtatactcacaggccccccattacaataagctcaaagatccagaagccgaaggtcgaagctccgaaacttaaggtccagcacaagttcgtggaggagatcatcgaggagacgaaggtggaggatgagaagtccgagatggaagaggctttgactgctatcactgaggagcttgctgtcagtatgaaggaagaaaaaaaagaagctgctgaagagaaagaggaggaaccagaggcagaagaagaggaggttgctgccaaaaaatctccagtgaaggcaacagcgcccgaggtgaaagaggaagaaggtgagaaggaggaagaagagggccaagaggaagaagaagaggaggatgagggcgccaagtccgatcaggcggaagaaggagggagtgagaaagaaggctcctcagaaaaggaggagggcgaacaggaagaaggagaaactgaggctgaggcagaaggtgaggaagcagaggccaaagaagagaagaaagtggaggagaagagcgaagaggtcgctacgaaggaagagctggttgccgatgctaaggtagaaaagccagagaaggcaaaaagtcctgtaccaaagagtcccgtggaggaaaaaggcaagagtcctgtccctaagtctccagtagaggagaagggtaagtccccggttcctaaatcccccgttgaagagaaaggcaagagcccagttccaaagtccccagtggaggagaagggaaagagtccagtgagcaagagtcctgtggaagagaaagccaagtccccagtgccaaagagtccggtggaagaggccaagagtaaagccgaggtcggcaaaggggaacagaaagaggaggaagagaaagaagtgaaggaagctccaaaagaagaaaaagttgaaaaaaaggaagaaaagcctaaggatgtccccgagaagaagaaggccgaatcacccgtgaaggaggaggccgtcgctgaagtcgttaccatcacgaaatctgtgaaagtacacctggaaaaagagacaaaggaggaggggaagcccctgcaacaggaaaaagagaaagaaaaggccggaggcgagggtgggagtgaggaagaaggatcagataagggggccaagggttcccgcaaggaggacattgccgtcaacggcgaagtggagggaaaggaagaagtggaacaggaaacaaaggagaaggggtctggccgggaggaggaaaaaggagtggttactaatggcctcgacctttcgccagctgacgagaaaaagggtggcgacaagagtgaagagaaggttgtggttactaaaaccgtggagaagatcacctcagagggaggggatggggccaccaagtatatcaccaaaagtgttacagttacacagaaagtcgaagaacacgaggaaacgttcgaagagaagctggttagcacaaaaaaggtggagaaggtcactagccatgccattgtgaaagaggtgacacagtcagactag

SEQ ID NO: 28981 - DNA, 1932 bp, Artificial Sequence
  Description of Artificial Sequence: Synthetic coding sequence
atggaggctgtcgagaccggcgaacgccctacgtttggagcctgggattacggagtattcgccctgatgttacttgtgagcaccggaatcggcctctgggtgggattggctcgcggtggccagagatcggctgaggatttcttcacgggaggccgtaggctcgctgctctacccgtcggcttgtctcttagtgctagcttcatgtctgcagtgcaagttctgggggtcccttccgaggcataccgatacggcctgaaattcctgtggatgtgtctgggccaattattaaactctgtgttgactgcactactctttatgccagttttctaccgcctgggtcttacatctacctacgaatacctcgaaatgcgttttagtcgggcggtgcggttatgtggaacattgcagtatattgtcgccaccatgctttacacaggaatcgtcatatacgccccggccttaattttaaatcaggtcacaggtctggacatctgggcaagcctattatctacaggaatcatttgcacattctatacagcggtcggtggcatgaaggccgtggtgtggacagacgtattccaggttgttgtgatgctgtccggattttgggtcgtgttggcccggggcgtgatgctcgtcggcggcccacgccaggtgctgaccctggcccaaaatcattctaggattaatcttatggattttaatccagacccaaggagtagatatacattttggacctttgtcgtgggcggcaccctggtgtggctgtccatgtacggggtgaatcaggcccaggtccagcgatacgtggcttgccggacggagaaacaggccaagctcgcacttctgatcaaccaagtgggcctgttccttatcgtgagctctgctgcctgctgtggcattgtcatgtttgtattctatacagattgtgaccctcttcttctcggtagaatctccgctccagatcagtacatgcctctcttggtgctcgacattttcgaagatcttccgggtgtcccagggctgtttctcgcttgcgcctatagtgggaccctgagtactgcatcaacgagtataaacgcaatggccgctgttaccgtggaggatctgattaagccccggttacgatctctcgctccaagaaagctggtgattatcagtaaggggttgtctctgatctatggaagtgcttgcctgaccgtcgccgctcttagctcacttttgggtggaggcgtgctccaggggtcattcaccgtgatgggtgtcataagcgggccgttgttgggtgcctttatattaggaatgtttctgccggcttgcaacacgcccggggtactagcaggtctgggcgccggacttgctcttagtctgtgggtggcgctcggggctacattgtatccccccagcgagcagactatgcgagtattgccaagtagcgctgcaagatgtgttgccctcagtgtgaacgcctcagggctgcttgacccagccttgctgcccgcgaatgatagcagccgggccccaagctcagggatggatgcgtctcgacccgcactcgcagatagtttttacgcgatctcttatctctactatggcgcacttggaacgctcaccactgtcctgtgcggtgcactgatcagttgcctaacaggccccacaaaacgctcaacactcgcgccaggactcctttggtgggatctggccagacagactgcatcagtggccccaaaggaggaagtggcaatattggatgacaacctcgtaaaaggacccgaagagctgccgacaggcaataaaaagcctcctgggtttttacccaccaacgaggaccgtctttttttcctcggccagaaggaactggagggggcgggatcctggacaccgtgcgtgggacatgatggtggcagagatcagcaggaaacaaatctgtag

SEQ ID NO: 28982 - DNA, 1230 bp, Artificial Sequence
  Description of Artificial Sequence: Synthetic coding sequence
atgaactcccactcttacaatggctccgtgggaagacccctgggtagcggtcctggtgctctcggcagggacccccctgacccggaggccggacacccccctcagccaccacatagcccgggactccaggtggtggtggctaaatccgaacccgctagacctagtcccggctcaccccggggacagccgcaggatcaagatgatgacgaggatgacgaagaagacgaggcggggaggcagcgcgcgtccggtaaaccttctaacgttggccaccgtctgggccaccgcagggcccttttcgaaaaaagaaaacggctctccgattacgctttgatctttggcatgtttggtatcgttgtcatggttactgaaactgagctttcatggggcgtgtataccaaagagtccttgtatagcttcgccctcaagtgcctcatatcactaagtaccgccattctccttggactagtggtgctctatcacgccagggagattcagctctttatggttgacaacggtgcagacgattggaggatcgccatgacatgtgagcgggtgtttctgatttcccttgagctcgctgtgtgcgccatccacccagtgcctggccactaccgatttacatggaccgcccggctggcgttcacgtacgctccatcggtggctgaagctgacgtggatgtactgctctcaatacccatgttccttcgactctacctacttggacgggtcatgcttctgcactcgaaaatttttaccgatgcttcctcccgaagcattggcgctttaaacaaaattactttcaatacaaggtttgtcatgaaaactctaatgacaatatgtcctggcacagtccttctcgttttttcaatttcctcttggatcatcgccgcatggaccgtccgtgtctgtgagagataccacgataaacaagaagtgacatctaactttctgggtgctatgtggttgatttcaataaccttccttagcataggctatggggacatggttcctcatacttactgtggcaaaggtgtgtgtctcttgaccggcattatgggagccggttgcactgcgctggtggtcgccgttgtggctcgcaagctggagctgaccaaagcagagaagcacgtgcacaactttatgatggacacacagctgacaaagcgcgtgaaaaacgcggctgcgaatgtgctgagagaaacctggctgatatgtaagatgggctag

SEQ ID NO: 28983 - DNA, 1311 bp, Artificial Sequence
  Description of Artificial Sequence: Synthetic coding sequence
atgggccttgctcgcgcactgcgtcgcctaagcggcgctcttgattctggggatagcagagccggtgatgaggaggaggctggaccaggactttgccggaatgggtgggcccctgcccccgttcagtccccagtcggccgccgcagaggtaggttcgtgaagaaagacggccattgcaacgtgcgattcgtgaacttgggcgggcaaggcgcacgctatctgagcgacctatttactacctgtgtcgacgtcaggtggcggtggatgtgcctccttttcagttgcagcttcctcgcttcgtggctcctctttggcctcgctttttggctcatagcctcactccacggagaccttgctgctcctcctcctccagccccgtgcttcagccatgtcgctagctttctggcagccttcctcttcgctcttgagactcagacatctattggctacggggtccggtctgtcaccgaggagtgcccagctgcggttgctgccgtggtcctgcagtgcatcgccggttgcgtgctggatgcattcgtggtgggtgctgtgatggccaaaatggctaagccgaagaaacgcaacgagacactggtcttttcagaaaacgcagttgtcgcccttcgagaccacagactgtgccttatgtggagagtcggtaatcttaggcgttcccacctggttgaagcgcatgtcagggcccagctgctgcagccaagggtgacccccgagggggagtacatcccactggatcaccaggacgtggatgttgggtttgacggcggaacggatagaatcttcctcgtgagcccgattactattgtccacgagatagacagtgccagccccctctacgaactgggaagagccgagcttgctcgggcagattttgagctggtggtcatcctggagggaatggtggaagcaaccgctatgaccacacagtgccggtcttcctacctccctggcgaactactgtggggtcacaggttcgagcccgtgctctttcagagggggtcccagtacgaggtcgactataggcacttccacaggacgtacgaagttccgggaacacctgtttgcagcgcaaaggaactcgatgagcgggccgagcaggccagccactccttgaagtcgagtttccccggatcccttactgctttttgctatgaaaacgagctggcattgtcatgctgccaggaagaggacgaagacgacgagacagaggaaggtaatggggtcgagactgaggacggagccgcgtccccgcgggtgttgaccccaaccctagcactaacgctgcctccctag

SEQ ID NO: 28984 - DNA, 1311 bp, Artificial Sequence
  Description of Artificial Sequence: Synthetic coding sequence
atggggctcgcgcgtgcactgcgacggctcagcggggccttggatagcggggattcacgagctggagacgaagaagaggccggtcccggactatgtcgaaatggttgggcacccgcacccgtgcagagccctgtcggcagaagacgcggtcgcttcgttaaaaaagatggtcattgtaatgtccggtttgttaacctgggcggccagggagctaggtatctttctgacctcttcacaacctgcgtggacgtgaggtggcgatggatgtgtcttctgttttcatgttcttttctcgcttcatggctcctgtttggcctggctttttggctgattgcgtctttacacggggacctggctgcccctccccctcccgcgccatgctttagccacgttgcttcctttttggctgcgttcctgtttgctctggagacccagacttctatagggtatggagtcaggtctgtcaccgaagaatgcccagcagcggttgccgcagtcgtcttacagtgcattgctggctgcgtgctggatgcatttgtggtgggggctgtgatggccaaaatggccaaacctaagaaaagaaatgaaacactggtcttctcggagaacgccgttgtggctctgcgtgatcacagactgtgcctcatgtggagggttgggaatctgcggcggagtcatctggtggaagcccatgtgcgggcgcagttgctccagccccgggttacacctgaaggagagtatataccactggaccaccaagatgtagacgtcggatttgatggtgggacagataggatttttctggtttctcccatcacaattgtccatgagatcgactccgcaagccccctttacgagttgggacgtgcagagctggcaagggctgacttcgagctggttgtgatcctggagggaatggtggaagccaccgctatgactacacaatgtcgatcttcatacctgccaggagaactgttgtgggggcaccgttttgaacccgtgttattccaacgtgggtcacagtatgaggttgattaccgacactttcaccgaacatacgaggtgccagggacacccgtctgtagcgctaaagaattagatgaaagagctgagcaggcctcgcactccttgaaatccagctttcccggatcattgaccgccttctgttacgaaaacgaactggcgctgtcctgttgtcaagaggaagatgaagacgatgagaccgaggagggcaatggtgtggaaacagaagacggcgccgcctcaccccgcgtgctgaccccaactctggccttgaccctccctccttag

SEQ ID NO: 28985 - DNA, 1182 bp, Artificial Sequence
  Description of Artificial Sequence: Synthetic coding sequence
atggctcaagaaaatgccgcattcagccccgggcaggaagagcccccaaggagacggggtagacaacgatacgttgagaaagacgggcgatgtaacgtgcaacagggcaatgtgcgagaaacttatagatatctgactgatttgttcacgacactcgtggacctccagtggcgactatccctgctgttcttcgtcctggcttacgcccttacgtggttgttcttcggagccatttggtggttaatcgcctatggcaggggcgatctggagcacctcgaagacactgcctggactccttgcgtgaataacctgaatggttttgtagcggcctttttgttcagtatcgaaactgagaccaccatcggatacggccaccgcgtcattacggaccagtgtcctgaggggattgtcctgctcctgctgcaagcaatcctaggttcgatggtgaacgcattcatggtcggctgcatgttcgtgaaaatctcccagccaaacaagcgtgcagctactctggtgttcagctctcacgccgtggttagcttgagggacggccggctctgtcttatgttccgcgtgggagatttgcggagctctcacattgtggaagcctccatccgagcaaagctgatccgttcaaggcagacattagaaggtgaattcattcccctgcaccagacagatttaagtgttggatttgatacaggcgacgatagactcttcctagtctcccctctggtgattagccatgaaatcgacgccgcaagtcctttctgggaagcatccagaagagcactcgaacgggatgattttgagattgtggtgattctcgagggcatggtcgaggccaccggcatgacttgtcaggccaggagttcctatctggttgatgaagttctgtggggccatcgctttacatctgtgctgacgctagaagacggcttttatgaggtggactacgcctcttttcacgagaccttcgaagttcccacaccgagctgtagtgctagagagctagccgaggctgcagcaagactggacgctcatctgtactggtctattcctagtcgccttgacgaaaaagtggaagaagagggagcaggcgaaggtgccggcggtgaagcgggggctgacaaggagcaaaacgggtgcttgcctccaccggaaagcgagtccaaggtatag

SEQ ID NO: 28986 - DNA, 708 bp, Artificial Sequence
  Description of Artificial Sequence: Synthetic coding sequence
atgtttatctggacatccggaagaacatcatccagctaccggcacgacgagaaacggaacatttatcagaaaattcgggatcacgatctgctggacaagcgaaagacagtcaccgcgctgaaagctggagaggatagggcaatcctgttaggattggcgatgatggtctgctctatcatgatgtattttctattgggaattaccttgttacggtcttacatgcagtctgtgtggacggaggaatcccagtgcacactgttgaatgccagcattactgaaacgtttaactgttctttcagctgtggcccggactgttggaagttaagccagtatccctgcttgcaggtgtacgttaacctaacaagttccggagagaaattgctcttataccatacagaagagacaataaagatcaatcagaagtgctcgtatatcccgaagtgcggcaaaaacttcgaggaatcgatgtccctcgttaatgtggtgatggagaactttcggaaataccagcacttctcttgttatagtgacccagagggcaatcaaaaaagcgtgattctgacaaagctttactcgtccaacgtgctgttccatagcctgttttggccaacatgcatgatggcggggggtgtggctattgtcgcgatggtgaagcttacacaataccttagcctgttgtgtgaaaggatccaaagaatcaatcgctag

SEQ ID NO: 28987 - DNA, 708 bp, Artificial Sequence
  Description of Artificial Sequence: Synthetic coding sequence
atgttcatctggacgtccgggcgaactagctccagttaccgacacgatgagaaaaggaacatttaccaaaagattagagatcacgacctgcttgacaaacggaagaccgtaaccgccctgaaggctggcgaagacagggcaatcctcctcggactggcaatgatggtgtgctctatcatgatgtactttctccttggaattaccttgctgagatcatacatgcagagcgtttggaccgaagagagccagtgtaccctcctgaacgcctcgatcaccgaaacctttaactgcagcttttcctgtggccccgattgctggaaactcagtcaatatccatgcctccaggtgtacgtgaatctgacttcttctggcgaaaagctgctcctctatcacactgaggaaaccattaagatcaaccagaagtgttcttacattcctaagtgcggtaaaaactttgaagagagcatgagcctggtgaacgtggttatggaaaactttcggaaatatcagcacttcagctgctactccgatccagagggtaaccagaagagtgttatcctcacaaagctgtacagcagtaacgtgctttttcactcactattctggcccacctgtatgatggccgggggggtagcgatcgtcgccatggtcaagttaacccaatatctttcacttctgtgtgagcggattcaacgcatcaacaggtag

SEQ ID NO: 28988 - DNA, 708 bp, Artificial Sequence
  Description of Artificial Sequence: Synthetic coding sequence
atgtttatttggactagtggacgcactagtagctcctacaggcatgacgaaaagcgaaacatctaccagaagatcagagaccacgatcttctggacaaaaggaagaccgtcaccgctctcaaagctggggaggatcgtgccatccttctgggactcgcgatgatggtgtgcagcatcatgatgtacttcctgttaggcattaccctgctgagatcctacatgcagtccgtgtggaccgaagaaagccagtgcacactgttgaatgccagtatcaccgagacctttaactgtagtttttcatgtggaccagattgctggaaactgtcgcaatatccctgcctgcaggtttacgttaacctgaccagtagtggcgagaagctgcttctgtaccatactgaggagaccataaagattaatcagaaatgttcatatatcccaaagtgcgggaaaaacttcgaggagtccatgtcgctggtgaacgtggtgatggagaacttcagaaaataccaacactttagttgttacagtgatcccgagggaaatcaaaagagcgtcattctgactaaattgtacagctccaatgtcctttttcactcccttttctggccaacctgcatgatggctgggggtgtggccatcgtggccatggtgaagctgacccagtacttgagcctgctttgtgagcgtatccagagaatcaaccgctag

SEQ ID NO: 28989 - DNA, 414 bp, Artificial Sequence
  Description of Artificial Sequence: Synthetic coding sequence
atgttcatatggacctctggacggaccagctcatcgtaccgccatgacgaaaaaagaaatatctatcagaagattagagaccacgacctgctagacaaaagaaaaactgtgacagctctgaaggctggggaggatcgggcgatactgctgggcctggccatgatggtatgtagcataatgatgtatttcctcttgggcatcacactgctcaggtcatatatgcagagcgtctggacggaagagtcccagtgtaccctccttaacgcctcaatcacagagacatttaactgcagtttttcttgtggcccagactgttggaaactctcacaatacccttgcctacaggtgtatgtgaatctgacttctagcggtgaaaagctgctactgtatcacacggaggagacaattaagtag

SEQ ID NO: 28990 - DNA, 708 bp, Artificial Sequence
  Description of Artificial Sequence: Synthetic coding sequence
atgttcatatggacgagcggacggacctccagttcctaccgccatgacgagaaaaggaatatctaccagaaaatacgcgatcatgatctcctggataaacggaaaaccgtcactgccttaaaagcaggggaggacagggcaatacttcttggattggccatgatggtgtgtagtatcatgatgtactttctgttaggcatcaccctgttgagaagctacatgcagagcgtgtggaccgaggagtctcagtgtacactcctgaatgctagtattacggagactttcaactgttctttctcatgcggaccggattgctggaagctgtcgcagtacccatgtctgcaggtgtacgtgaacctgacaagcagcggtgaaaagctcctcttgtatcacactgaggagacgataaaaataaatcagaagtgttcttatattcctaaatgtgggaagaattttgaggagtccatgtcactggtcaacgttgtgatggagaacttccggaagtaccagcacttctcctgctactctgatcccgaggggaatcagaaatctgtgattcttaccaagctctactcaagcaatgtgctgttccattccttgttctggcctacatgcatgatggctggcggggtggctatcgtagcgatggtaaagttgactcaatacctctcattactttgtgaaagaatccagcggataaatcggtag

SEQ ID NO: 28991 - DNA, 303 bp, Artificial Sequence
  Description of Artificial Sequence: Synthetic coding sequence
atgtttatctggacctcaggacggacctcaagtagctatcgccacgatgagaagcggaacatctatcaaaagatacgcgatcacgacctgctggacaagcgcaagaccgtgaccgcactcaaggctggggaagacagagctattctgttaggactggccatgatggtctgctccattatgatgtattttctcctgggcattacactgcttcgtagttatatgcaaagcgtgtggacggaagagagccagtgcactctcctgaacgcctcaattaccgaaaccttcaattgttccttctcatag

SEQ ID NO: 28992 - DNA, 651 bp, Artificial Sequence
  Description of Artificial Sequence: Synthetic coding sequence
atgtttatctggacaagtggccgcacatccagcagttatcgacatgacgaaaagagaaatatttatcagaaaattagagaccatgatctcttgggccttgctatgatggtgtgttctatcatgatgtacttcttgctgggcataacattactccggtcttacatgcaaagtgtctggacagaggaaagccaatgtactctgcttaacgcttccatcactgagacttttaactgtagctttagttgcggacccgactgctggaagctttctcagtatccttgcctgcaagtgtacgtcaatcttacttccagcggtgagaaacttctgttatatcatactgaggaaacgatcaagattaaccagaaatgcagctacatacccaagtgtggcaaaaatttcgaagagagtatgagtctcgtgaacgttgtcatggaaaacttccggaagtatcagcatttcagctgctattccgatcccgaggggaaccagaagtccgtcatcctcacgaagctctattcctcaaacgtcctctttcatagcctattctggcccacttgcatgatggctggtggcgtggctatagtcgccatggtgaaacttacgcagtacctgagcttactctgtgaaagaatccaacgcattaaccgctag

SEQ ID NO: 28993 - DNA, 2718 bp, Artificial Sequence
  Description of Artificial Sequence: Synthetic coding sequence
atgcccgtgcggcgcgggcacgtcgccccacagaacacataccttgatactattattcgcaaattcgagggacagagcagaaagttcctcatcgccaacgcccagatggaaaattgtgctataatttactgcaatgacgggttctgcgaactgttcggatactctagggtagaagttatgcagcaaccatgcacctgtgatttcttaaccgggccaaataccccttctagcgcggtctccagattagctcaagccctgctgggcgcagaggaatgtaaagttgacatcctgtactacaggaaggacgctagttctttcaggtgcttagttgacgttgttcctgtgaaaaacgaggacggagctgtcatcatgtttatccttaacttcgaggatctggcacagttgttagctaagtgttcttcccgctcgctatcccaacgactgctgtcccagagttttcttggtagcgaaggttctcacggcaggccagggggccctggtccagggacaggtagaggcaaatatcgtactattagccagatcccacagttcacgctgaattttgtggaatttaatctggagaaacaccggtcatctagtactactgagattgagattatcgccccacataaagtggtggagagaactcaaaatgtcacagagaaggttacacaagttctttccctaggggctgacgttctcccagaatacaaacttcaagcaccccgaatccatcgatggaccatcctccattattctccatttaaggctgtgtgggattggctaatcttactcctggtgatatacactgctgtcttcacgccctatagcgcggcctttcttctcagcgatcaggatgaatcacggcgcggggcgtgttcttatacatgctcccctcttaccgttgtggatctgattgtggatatcatgttcgtcgttgatatcgttataaactttcgtactacttacgtaaacactaacgatgaggtggtctctcacccccgacggatcgcggtccattatttcaaaggctggttcctgatcgacatggtagccgccattccctttgacctgctgatttttagaactggctcagacgagaccaccactctgatagggttgcttaaaactgctcgtctgctgcggttggtgcgagttgcaaggaagttggatagatattcagagtatggcgcagcagtgctgtttctgcttatgtgtacgttcgccctgatcgctcattggctcgcttgcatttgttcactcacctccgtaggattcggcaacgtgtcaccgaacactaatagtgaaaaagtcttctctatctgtgtcatgctgatcggtagcctcatgtatgcctcgatctttggcaatgtcagcgcaattattcagagattgtactcaggtaccgctcgctatcatacccagatgctccgcgtaaaagagttcatccggtttcatcagatccccaatcccttacgccaacggttggaggagtacttccagcacgcttggtcctacacaaacggaatcgatatgaacgcagtgctgaaagggttcccagagtgccttcaagctgatatctgtctgcacctccacagggccctcctgcagcattgccctgctttctcaggagctgggaaaggatgcttaagggctttggccgtcaagttcaaaacaacccatgctcctcctggcgataccctcgtacatctgggcgatgtgctgagcaccctctatttcatctcccgcggctccattgaaatcctccgtgatgacgttgtggtggctattctcggaaaaaatgatatttttggcgagcccgtgagcttgcacgcccagcccgggaagtcaagcgctgatgtccgcgcgctgacttactgtgatctgcataaaatccagcgagcagacctcctggaagtcctagacatgtatccagccttcgccgagagtttctggagcaagctcgaagtcacattcaaccttagggatgccgcaggcgggctccacagctccccccggcaggcccccggtagtcaggaccaccagggcttttttctaagcgacaatcaaagcgacgctgcacctcccctctcgatctctgatgcctcaggattgtggcctgagctccttcaggagatgcccccgcgccactcgccacaatccccacaggaggatccggactgctggccactgaagctgggctcacgcttagagcagctgcaagcacagatgaatagactggagtcaagagtgagctcagacttgtctcgcatcctccaacttttgcaaaagccaatgcctcaaggccatgctagctacatcctggaggcgccagcctccaatgacctcgctctggtgcccatcgccagcgagaccacttcacccggacctagacttcctcaggggtttctcccgcccgcgcagactccctcctatggtgatctggatgattgcagtcccaaacacaggaattctagtcctagaatgcctcacttggctgtggccactgacaagaccttggccccatcttctgagcaggaacaaccagaagggttgtggccccctctcgcatcccccttgcaccctctggaggtgcagggactcatctgcggcccctgtttctcttcacttcccgagcacctgggttcagttccaaaacagctggactttcagaggcacgggtctgatcccgggttcgcgggatcttgggggcattag

SEQ ID NO: 28994 - DNA, 2985 bp, Artificial Sequence
  Description of Artificial Sequence: Synthetic coding sequence
atgccggttagaaggggtcatgtggcaccccaaaatacatacctggacaccataattcgaaaatttgagggacagtcacgcaaatttttgattgctaatgctcagatggaaaactgtgctatcatttactgtaatgatggcttttgtgaactgttcggatactctagggttgaggtcatgcagcagccctgtacctgtgactttctcacaggaccaaacacccctagctccgctgtttcccgcttggcacaagccttattaggggctgaggaatgtaaggtggacattctgtactataggaaggacgcttcctccttccggtgtctggtggacgtggtgcccgtaaaaaatgaagatggcgcagttatcatgtttatattaaacttcgaagaccttgcccagttactggccaagtgttcttccagatctctgagtcagcgccttttgtcgcagtcctttctgggtagtgagggatcccatgggaggcctggaggccccggccctggaacagggcgcggcaagtataggaccatcagccaaataccccaattcaccctgaatttcgtcgagtttaatctcgagaaacaccggtcttcatcaaccaccgagatagagatcatcgcgccacataaagtcgtggaacgaactcagaacgtcaccgagaaagtaactcaggttttgagtctgggcgccgacgtcctcccggagtataagctacaggcaccaagaattcataggtggacaatattgcactattcacctttcaaggccgtatgggactggctgattctgctcctcgtgatatacactgccgttttcacgccatattctgcagccttcctcctctcagaccaggacgagagcagaagaggcgcctgctcatatacctgctctccgctgacagtggtcgatctaattgtagacattatgttcgtagtggacatcgtgatcaacttcagaactacttacgtcaacacaaatgatgaggtggtgtcacaccctcggaggatcgccgtgcattattttaaagggtggttcttaattgacatggtggccgccattccgtttgatctgttgatattcagaacggggagcgatgaaaccaccactcttattggccttctgaagacagccagactcctgagactcgtgcgtgttgcgaggaaattagatcgctactctgagtacggtgccgcggtgctcttcctgcttatgtgtacattcgcactaattgctcattggctggcctgcatctggtatgcaatcggaaacgttgagcgcccatacctggagcacaagattggatggttggactccctcggtgttcagctgggcaagcggtataacggctctgacccagcatcaggtccatcggtacaagacaagtatgttactgcactatacttcacgtttagttctttgaccagcgtgggttttggcaacgtcagcccaaacacaaactccgaaaaggtgttcagcatttgcgtgatgttgatcgggagtctgatgtatgcttcaattttcggaaacgtctctgccatcatacagagactttattctgggacagcacgctaccatacgcagatgctgagggtcaaggaattcattcggtttcatcagatccctaacccactaaggcagagactggaggaatatttccagcatgcgtggtcctatacgaacggcatcgatatgaatgcggtgctgaagggattccctgaatgcctccaggcggatatctgtctgcatttgcatcgcgccttactgcaacattgccctgccttctcgggcgctggcaaaggatgcctaagagcactggccgttaaatttaagaccacccatgcccctcctggggacacactggtgcacttaggcgacgtgctcagcacattgtacttcatttcacgcggctccatcgaaattctccgtgatgacgtggtggtggctattttgggtaagaacgatattttcggcgagcctgtgtccttgcacgcccagccggggaaaagtagtgctgatgtgagagcgctaacctattgcgatctccataaaatccagagagcagatcttctggaagtactcgacatgtatccagcctttgcagagagtttctggtcaaaactcgaggtgaccttcaacctcagagacgcggccgggggcctgcattccagcccccgtcaggcccccggcagccaggaccatcaggggttctttctgtccgataaccagagcggttccccgcatgagctcggacctcagttcccaagcaaaggttactcactgctcggacctgggtcccaaaactctatgggagcaggaccttgcgcacccggtcacccagacgctgcgcccccactgtcaatctcggatgcctctggactttggcctgaactcttgcaagagatgcctccccggcatagtccccagagccctcaggaagaccctgactgctggccactgaaactgggtagtcgactagaacagctccaagcccagatgaaccggttagaatcccgcgttagctcggacctgagcaggatcctgcagttactccagaaaccgatgccccaggggcacgccagctacatcctggaagcccctgcctccaatgacctggctttggtcccaattgcctctgagaccacttcccccggaccacgcctcccacagggcttcctcccacctgcacagacccccagctatggggatttagacgattgcagccccaaacatcgcaactcctctcctaggatgcctcacctggccgtagcaacagacaaaactctggcaccgagcagcgaacaggagcagccggaaggtctatggccgccgctcgctagccccctacatcccttggaggtgcaaggattaatttgcggcccatgcttctcaagcctcccagaacacctaggcagcgttcccaagcagctagatttccaacgacatgggagcgaccccgggttcgcgggctcttggggacactag

SEQ ID NO: 28995 - DNA, 1581 bp, Artificial Sequence
  Description of Artificial Sequence: Synthetic coding sequence
atgcttatgctcctggtgcggggcacgcactacgagaacctccggtccaaggtggttctcccaacacctctgggcggtcggtccaccgagacattcgtctctgagtttccgggtcccgataccggaattcgctggcggcgttctgacgaggccctgcgagttaatgtgggtggagtgaggagacagctctccgcccgggcccttgccagatttccagggacccgacttgggaggctgcaagcggccgcctctgaggagcaggcacgaagactgtgtgacgattacgacgaagccgccagagagttttactttgaccgacatcctggttttttccttagcctcctgcatttttatcgcactggccatctccatgttctggatgagttatgtgtgtttgcctttggtcaagaagccgactattggggtctgggggaaaatgcgctagccgcatgctgccgcgcaaggtacctggaaaggcgcttaacgcaaccacatgcttgggatgaagatagtgatactccttcctccgttgacccctgccccgacgagatttccgacgttcagagagaactggcaaggtacggggctgcacgctgcggccgactgcggcggcggctgtggttaaccatggagaaccctgggtatagcctgccctcgaagctcttcagctgtgtcagcatctcggtggtgttggcctcaatagccgcaatgtgcatacacagcctgccagaataccaggcccgggaggccgctgctgctgttgccgccgtggccgctgggcgttcacccgaaggagtcagagacgaccccgttctcagaagacttgagtacttctgtatagcatggttttccttcgaggtgagctcccgattgctcctagcaccgagcactcgcaatttcttctgtcacccactaaatcttatcgatatagtcagcgtcctgcccttttatttgacactgctggcaggtgtggccctgggggatcagggagggaaggagttcgggcatttaggcaaagtagtccaagtatttcggttaatgcgtatcttcagagttttgaagctcgccaggcactctacagggctcagatcattgggcgctaccttgaaacatagctacagggaagtgggcatcctgttgctctatcttgcggtgggcgtgtccgtgttctccggggttgcttacactgccgaaaaagaagaggatgtgggctttaatacgatcccagcgtgttggtggtgggggaccgttagtatgacaacagtgggctacggtgatgtggtgccagtgaccgtggctggaaaactggccgcaagtggctgtatattaggaggcatcctcgtcgtggcgctgccaatcaccatcatcttcaacaaattcagccatttctatcgcagacagaaagctctcgaagcggccgtgcgtaattcaaaccaccaggaatttgaagatctgctttcatctattgatggagtcagtgaggcaagccttgagaccagcagagaaaccagccaagaaggtcaatcggctgacctcgaatcacaagcacccagcgaacctccccatccccaaatgtattag

SEQ ID NO: 28996 - DNA, 1581 bp, Artificial Sequence
  Description of Artificial Sequence: Synthetic coding sequence
atgctcatgttgctcgtcagggggactcactatgaaaacctacgctcaaaggtggttcttccgactccccttgggggccgcagtaccgagacattcgtgtcggaattcccgggtcctgatactggcatccggtggaggaggtccgatgaagccctccgtgtaaacgtcggcggagttcgtcgccagctgtccgcccgtgccctggcaagatttcccggaacacggcttggcaggctgcaggccgcggcctcagaagagcaggctcggaggctgtgcgatgactacgatgaggcagctagggagttttatttcgatagacaccccggcttttttctctctttacttcatttttataggaccggccacttgcatgtgctggatgagctctgtgtctttgcttttggacaggaggcagactactggggcctgggagaaaacgcacttgcagcatgctgtagagcacgttacctcgaaaggaggctgacacagccccacgcctgggatgaggactctgataccccatcatcagtggatccgtgccccgacgagatatccgacgtgcagagagagttggcacgatatggggccgcgcggtgcgggagactgaggagacgcctgtggctgactatggaaaatccagggtatagcttgcccagtaaactgtttagttgcgtgagtatttctgtcgttctcgcgtccatcgctgctatgtgtatacattcactgccagaatatcaggccagagaggcagctgccgctgtggccgccgtcgctgctggacgcagtccagaaggtgttagggatgaccccgttttaagacggcttgagtatttttgtattgcctggttctccttcgaagtctcaagccggctcctactcgctccttccaccagaaactttttttgtcaccccttaaaccttatcgacatagtcagcgtgttgcctttctacctaacgctgctggctggggttgccctgggtgatcagggaggtaaggagttcggacaccttgggaaggtggtgcaagtctttaggctgatgcggatattccgagttctcaagctggccagacacagtactggactcagaagcctgggtgcaactttaaagcactcctacagggaagtcggtatattgctgctttatttggcagtgggtgtgagtgttttctcaggagtggcctacacagcagagaaggaggaggatgtcggtttcaacactatacctgcgtgctggtggtggggcactgtgtccatgacgacagttggatacggtgacgttgtgcccgtcaccgtggcaggcaagttggcagcgtcagggtgcattttgggtggcatcctggttgtggctctgcctattacaataatcttcaataagtttagtcacttctaccgcaggcaaaaagctctggaagccgccgtcaggaactccaatcatcaagagttcgaggatcttctgagtagcatagatggcgtttctgaagcctctttggagacttcgagagagacatctcaagagggccaatccgccgatctcgaaagtcaggctccatctgaacccccacacccccagatgtactag

SEQ ID NO: 28997 - DNA, 1500 bp, Artificial Sequence
  Description of Artificial Sequence: Synthetic coding sequence
atgactgtggccacaggcgatccagccgacgaggcggcagccctgccggggcacccgcaggacacttacgatcccgaagccgaccacgagtgttgtgaacgcgttgtgataaatatttctggcttacggtttgagacgcagcttaaaacacttgcccagttcccggagaccctacttggtgaccctaagaagcggatgcggtacttcgatcccctccgtaacgagtacttcttcgacagaaacagacccagctttgacgccatactttactattatcagtccggcggtcgactccggcgcccagttaatgtccctttggacattttctctgaggagattaggttttacgagctcggcgaggaagcaatggaaatgtttcgcgaggacgaaggttatattaaagaagaagagaggcctctgcctgagaacgaattccagcggcaggtttggctcctgtttgagtacccagagtcctcaggccccgcccgcatcatcgccatcgtgagtgtcatggtgatcctgatatccattgtttccttttgcctggagaccctgcccatttttcgcgacgagaatgaagacatgcacggctctggcgttaccttccatacatattccaactccaccattggttaccagcagagcactagtttcacagaccctttcttcatagttgagacgctatgcatcatatggttctcattcgagtttctggtgcgcttttttgcctgtccttctaaagccggattctttacgaacatcatgaatattatcgatattgtagccatcattccatacttcatcacactcgggaccgaactggctgagaagccggaagacgctcagcaggggcagcaggctatgtctttggccatccttagagtgatccgcctagtccgggtttttagaatcttcaaattatctagacactctaagggcctccaaattctcggacagactctgaaggcatcaatgagggagttaggtttgctgatcttcttcctgtttattggcgtgatactcttttcgtcagccgtctatttcgcagaagccgacgaacgggagagccagtttcctagcattccggatgcgttctggtgggccgtcgtctcaatgactaccgtgggctacggtgatatggtcccgaccacaatcggcgggaagattgtcggcagcttgtgcgcaattgccggtgtcttgacaattgctctgccggttcccgtcattgtgtccaactttaactacttctaccatagagaaactgaaggcgaggaacaggcacagtatctccaggtgacatcctgtcctaagatcccaagctccccggacctcaagaaaagccgctctgcctccaccatctcaaagagtgactatatggagatccaggagggagtcaataacagtaatgaggatttcagagaggaaaatcttaagaccgcaaactgcacccttgcaaatactaattacgtgaacattaccaagatgcttacagacgtctag

SEQ ID NO: 28998 - DNA, 1071 bp, Artificial Sequence
  Description of Artificial Sequence: Synthetic coding sequence
atgactgtggcaactggcgaccctgcggacgaagccgccgctctaccgggtcacccgcaggatacttatgatccggaagctgatcacgagtgttgcgagagggtagttattaatatctccggcttacggtttgaaactcaattaaaaacactagcccagtttcctgagacactgcttggtgatccaaagaagcgcatgcggtactttgaccctcttaggaatgaatatttctttgatcgcaacaggccttctttcgacgcaatcttgtattactatcagtccgggggaaggctgcgaaggcccgtcaatgtccccctggatattttttctgaggagatacgattttatgaactgggagaggaggcgatggaaatgttccgggaggacgagggctacattaaagaagaggaacggcctctacctgaaaacgaattccagcggcaggtgtggctgctgttcgaatatccagagtcttccggtccagctagaattattgctatcgtgagcgtaatggtcatcctcatatcaatcgtgagcttctgccttgagactctgcctattttccgcgacgaaaatgaagacatgcacgggagtggcgtcaccttccacacatattcgaacagtacaatcggctaccaacagtccacctcattcaccgaccctttttttatcgtggagaccctgtgtattatttggttttctttcgagttcctggtgcgtttctttgcatgtccttcaaaggccggattctttactaacattatgaacatcatcgacattgttgctatcattccctacttcattacactcggcaccgagctggctgagaagcctgaggacgcccagcagggccaacaggcgatgagtttagccattctgcgcgtaatcaggttggaacgaagacccttacaaagccaaaagagtaaaagaggcaggcaacacctcaataccagccacgattgtaccctcggcatcaatctggtggctggcatgaccgtccaatggactcgggcatccggacccgatgacaggcagacacctgcggtcacgactctacacaggatgtattag

SEQ ID NO: 28999 - DNA, 1500 bp, Artificial Sequence
  Description of Artificial Sequence: Synthetic coding sequence
atgacggtggccactggggatccggctgatgaagcagctgccctgccaggtcatccccaggacacgtatgatcctgaagccgaccacgagtgttgtgagagggtcgtaataaatattagcgggctccggtttgaaactcagttgaagacccttgcccagttcccggagactcttctcggcgaccctaaaaaacgcatgagatacttcgatcccttgagaaatgaatactttttcgacagaaataggcctagctttgatgccatcctgtattactaccagtctggcggtcgattacgaagacctgttaacgtgcctctcgatatcttttctgaagagatcagattctatgaactgggagaggaagctatggagatgtttcgcgaggatgaggggtatatcaaagaagaggaacggcccctccccgaaaacgagttccagcggcaggtctggctcctgttcgagtatccggagagcagcggaccagcccggatcattgctatcgtaagcgtgatggtgatcttgatttcaatcgtgtcgttttgtctggagaccctgcccatctttcgcgacgagaacgaagatatgcatggctctggcgtgacatttcacacctacagtaactcaacaattgggtatcagcaatctacctccttcactgaccctttctttattgtagagaccctttgcattatttggtttagctttgagttccttgtccggttttttgcttgccctagtaaggccggcttttttaccaatatcatgaatatcatagacattgtagccatcattccgtatttcattacgctggggactgagttggccgagaagccagaggacgcgcagcagggccagcaggcaatgtccttggccattctccgggttatcagactggttcgcgttttccgcattttcaagctctccagacattcaaagggccttcagatcctcggacaaaccctgaaggcatccatgcgagaattgggactgttaatcttttttctgttcattggggtgatcctgttctcaagcgctgtatactttgctgaggctgacgagagggaatctcaatttcccagcatcccagatgccttctggtgggctgtcgtgagtatgacaaccgtagggtatggcgacatggtccctacaacaattggaggtaagattgtaggcagcctgtgcgccattgcaggggtccttacaattgccctccctgtgcccgtaatcgtctccaatttcaattatttctatcacagggagacagaaggtgaagagcaggcccagtacctccaggtgactagctgtccgaaaattcccagctctcctgatcttaagaaaagtaggtccgcgtctaccatctccaaaagtgactatatggaaatacaggagggcgtaaataacagtaacgaagattttcgcgaggagaatctgaaaaccgctaactgcaccctggccaatactaactatgtaaatattacaaaaatgttgacagatgtttag

SEQ ID NO: 29000 - DNA, 1500 bp, Artificial Sequence
  Description of Artificial Sequence: Synthetic coding sequence
atgaccgtagccactggggaccctgccgatgaagcggctgcgcttccgggtcatccgcaagatacatacgatcccgaggcagatcatgagtgctgcgagcgggtcgtgattaatatcagtggcttaagatttgaaacacagttgaagactctggctcaatttcccgagactctcttaggcgatcccaaaaaacggatgcgctattttgatccgttgcgtaacgagtatttcttcgaccgtaatcgccctagtttcgatgctatcttatactattatcagtctggtgggcgactacggaggccggtgaatgtgccactagatattttttcagaggagatcaggttttacgagctgggggaggaggctatggagatgttcagagaggacgaagggtacattaaagaagaagaacgtcctctccctgagaatgagtttcagagacaggtctggctactgtttgaatatccagaaagctcaggccccgccaggattatcgccattgtcagcgtgatggtgattctgattagtatcgtgtccttctgtctcgaaacactaccgatctttagagacgagaacgaggatatgcatgggagcggagttacatttcatacctattctaatagcacaatcggataccagcagagtacaagctttacagatcccttttttattgtagagaccctctgtattatctggttctcattcgaatttctggtacggtttttcgcttgcccttctaaagcaggcttttttactaacattatgaatatcatcgacattgtcgccattatcccatacttcatcaccctgggaaccgagttggccgaaaaacccgaagatgcccagcagggccagcaggccatgtctctggctatcctgagggttattagactcgtcagggtgttccggattttcaagctctcccgacacagcaaaggacttcaaatcctgggtcaaaccctcaaggccagcatgagagagcttggcctcttaatttttttcctgttcataggtgtgattctgttcagttctgcggtttacttcgctgaagccgatgagagggagagccagtttcctagcatacctgacgcattttggtgggctgtcgtctccatgaccactgtcgggtatggtgatatggtaccaaccaccatcggaggtaagattgtcggctccctatgtgctattgcaggggtgctgactatcgccttacccgtcccagtgatagtgtccaactttaactacttctaccatcgggaaactgaaggggaagaacaagcccagtatctgcaggttactagttgccccaaaataccctcttcccccgatctcaagaagtctcgttcagccagcaccataagcaaatcggattacatggagatccaggagggggtgaacaattctaatgaagactttcgggaggagaacttgaaaaccgccaactgtacgctcgcaaacactaactacgtaaacatcacaaaaatgttgactgacgtctag

SEQ ID NO: 29001 - DNA, 1590 bp, Artificial Sequence
  Description of Artificial Sequence: Synthetic coding sequence
atgcggtctgaaaagagcctgacactcgccgctcctggggaggtgcggggccccgagggagagcagcaggatgctggtgacttccccgaggctgggggcggcggtgggtgctgcagttcggagcgcctggtgattaatatcagtggcttgagattcgagacacagctccgaactctctcactgttccccgacactctcttgggtgatccaggacgccgagtgcggttctttgaccctctgcggaacgagtacttcttcgatcgcaatcgccctagcttcgatgcaatcctgtactattaccagagcggcggccggctgaggaggcctgtgaatgtccccctggacatcttcttggaagagatccgcttttatcagctaggcgacgaggcattggccgccttccgggaggatgaaggctgcctccctgaaggaggcgaagatgaaaagcccctgccttcccagcccttccagcgccaagtgtggttattatttgagtacccggaaagtagcgggccagctagaggaattgctatcgtttcagtactggtgatcctgatttcaatcgtcatcttctgcctggagaccctgcctcagttccgggtggacggtcgcggtgggaacaacggtggggttagccgggtgtcacctgtgagtcgtggatcccaggaggaggaagaagatgaggatgacagctacacctttcaccacgggatcactcctggtgagatgggcactgggggaagctccagcctgagcactctgggaggaagttttttcacagatcccttttttctcgttgagaccctttgtatcgtttggtttacgttcgaattgttggtaagattctctgcatgtccctccaagcccgcctttttccggaacatcatgaatatcatcgaccttgtggctattttcccttatttcatcacattagggaccgagttagtccagcagcaggaacagcagcccgctagtggtggcggcggacaaaacgggcagcaggccatgtctctggccatcctgcgcgtgattcgcctggtccgggtctttagaatctttaaactgagtcggcattccaagggccttcaaatattgggaaaaacattgcaggcttctatgcgggagctggggttgctcatcttctttctatttatcggagtcatcctgttctccagtgccgtctacttcgccgaggccgacgatgatgatagcctgtttccatctataccggatgccttctggtgggccgtcgtcaccatgacaacggttggatacggcgacatgtaccctatgactgtgggggggaaaattgttggctccctctgcgcgatcgcaggggtgctgacaatcgcgctccccgttccagtgatcgtctcaaactttaactacttttaccatcgggagacagaacaggaggagcagggacaatacacccacgtgacttgtggacagccagcccccgatctgagagctacagacaatggcctgggtaagcctgatttcccagaagctaaccgcgaaagaagacccagttacctcccgactcctcatcgtgcttatgccgaaaagcgaatgctgacagaggtgtag

SEQ ID NO: 29002 - DNA, 1590 bp, Artificial Sequence
  Description of Artificial Sequence: Synthetic coding sequence
atgcggtccgaaaagagcttgactctcgccgcacctggggaagtaagaggacctgaaggcgagcagcaagacgccggtgacttcccagaagctggcggtggaggaggatgttgtagcagcgagcggttggttataaatattagcggattacggtttgaaacacagttgaggacgctgtctctgtttcccgatacactgctgggcgaccccggacgacgtgtgaggttttttgatcctctacgcaatgagtatttttttgatcgcaacaggcccagcttcgatgcaatcctctactactaccagtctggggggagactgcgtagacctgtcaatgtccccttagacatatttcttgaggagattcgtttctatcagctcggagacgaggccctggccgcatttcgggaggatgagggatgcttgcccgagggaggggaggacgagaaaccacttccaagtcagcccttccagagacaagtatggctgttgttcgaataccctgaaagctctgggcctgctagggggatcgcaattgtgtcagtgctggtgatcctgatttccatcgtgatcttctgtctcgaaaccctaccacagttcagggtcgacggacggggcggcaacaatggcggcgtgtcgagagtatcacctgtatctcgaggcagccaggaggaagaagaagacgaagatgactcatacacttttcaccatggcattactcctggggaaatgggaaccggcggtagctctagcctatcaacgttgggaggcagcttctttactgacccattcttcctcgtggaaaccctctgcatcgtgtggttcacttttgagttgctggtgagattcagcgcatgtccttcaaagcccgcgttcttcaggaatatcatgaatatcatcgatctggtggctatcttcccttattttatcaccctagggacggaactcgttcagcaacaggagcagcaacctgcctccggcggcggtggccagaacggtcagcaggcaatgtcattagccattctgagagttatcagactagtgagggtcttccggatattcaagttgagccggcatagcaagggcctgcagattctaggcaagacactacaggcaagcatgcgcgaacttggtctcctgatcttctttttgttcatcggagtgattctctttagctctgcggtctattttgctgaggccgatgacgatgactccttgttcccatcgattcctgacgcgttctggtgggccgtggtgacaatgacaaccgtcggttatggcgacatgtatcccatgacagtgggcggcaagattgtgggctccctgtgcgctatcgcaggggtgctaaccatagctcttcccgtaccggttatcgtgtccaacttcaactacttttatcatagggaaaccgagcaagaagagcagggccagtacactcatgtgacttgtggccaacctgctcctgatctacgagccactgacaacggtttaggcaagcccgatttccccgaggctaatagggaacggcggccaagttatttacctacacctcaccgggcctatgccgaaaagcggatgttaaccgaagtgtag

SEQ ID NO: 29003 - DNA, 2319 bp, Artificial Sequence
  Description of Artificial Sequence: Synthetic coding sequence
atggagaagagtgcttctaaggaggagaagcaacagccaaaacaggactcgaccgaacagggcaacgccgactccgaggaatggatgagctctgagagcgacccagaacagatttcactcaaatcctccgacaacagcaagtcatgtcaacctcgcgatggccaacttaagaagaaggaaatgcacagcaaaccacaccgtcagttatgcagaagcccctgtttggataggccttcattctcccagaaccacctgctgatgatgtattggcagagtctgagcgacttgggtacaaaggtgatccaaaaggggtcatctcgcgagatcgcgtccccagaactctcccttgaagatgagatcgataactctgacaacttgcgacctgtggtgatcgacggatctaatgtggccatgagtcacggcaataaagaagaattcagctgcagaggaatccagttggctgttgattggttcttggataaggggcacaaggacataacggtgtttgttccagcatggagaaaggaacagagccggccagacgcccccatcacagaccaggatattctgagaaagttggaaaaggaaaagatcctcgtgtttactccgtcgcgccgggttcagggccgaagagtggtgtgctatgacgacaggttcatcgtgaagctggcattcgattcagatggcatcatagtgagcaacgacaattacagagatcttcaggtcgagaagcctgaatggaaaaagtttattgaagagcgcctgctaatgtactccttcgtgaatgacaagtttatgcctccagatgaccctctgggccggcacggaccctccttggagaatttcctgaggaaacggcccatagtaccagaacataagaagcagccgtgtccctatggcaaaaaatgtacatatgggcacaaatgcaagtactaccacccagaacgggcaaatcagccgcagcgctcagtggccgacgaactgaggattagcgccaagctgtctacagttaaaaccatgtctgaaggaacattggccaaatgtggaacaggaatgtcaagtgcgaagggggagattacttccgaagttaaacgtgtcgcccccaaacgccagtccgatcccagtatcagaagtgttgcaatggagccagaagagtggttatctattgccagaaagcctgaagcaagctctgtgcctagtcttgtgactgccctgtccgtacccactatccccccgccaaagtcccatgctgtgggggccctgaatactcgtagcgcgagcagccccgtcccaggctccagtcattttcctcaccagaaagcctcccttgagcacatggccagtatgcaatacccaccgattctggttacaaattcccatggcacccccatctcttacgctgagcagtaccctaaattcgaatctatgggcgaccatggttactactctatgctcggggactttagtaaactcaacattaattctatgcacaacagggaatattacatggcggaagtggatcggggcgtctacgcccggaaccctaatctgtgtagtgacagcagggtgtctcatactcggaacgacaactatagctcctacaataacgtatatctagccgtggcagacacacaccccgagggcaatctgaaactccaccggtccgctagtcagaacaggttacagccttttccccacgggtaccacgaagcactcactcgggtgcagagctatgggcctgaagatagtaaacaggggccccacaagcagtcggtgccgcatctggctctacacgcgcaacacccatccactggtactagatcttcatgccccgccgattatcccatgcctccaaacatccatcccggagctactccacagcccggcagagccctggtcatgacccggatggatagcatctccgattcacgcctatatgagtcaaatcctgttagacagcgtaggcctccgctctgccgcgaacagcacgcaagttgggatcctctaccttgtaccactgattcttatggatatcattcctatcctctgagtaactccttgatgcaaccatgttatgagcccgttatggtgcggtctgttcctgagaaaatggagcagctatggcgtaatccctgggtggggatgtgcaatgattccagagagcatatgatcccagaacatcagtatcagacgtataagaatttgtgtaacatatttccaagcaacatcgtgctcgctgtcatggaaaagaatccacatacagctgatgctcagcaattggcagctctgatagttgctaagcttagagccgcccggtag

SEQ ID NO: 29004 - DNA, 813 bp, Artificial Sequence
  Description of Artificial Sequence: Synthetic coding sequence
atggtgccatcaacgatcgcagggaagatcttcggcagcatctgctctctgtccggggtattagttatcgcccttccagtgccagtcatagttagcaacttcagcaggatataccaccagaaccaacgagccgacaagaggagagcacagcagaaggtgcgtctagctcggattcgcttggctaagagcgggaccacaaacgcatttctccagtataagcagaacggtggtctggaagattccggtagtggcgaggaacaggccctgtgcgtcagaaatcgatcagcatttgagcaacagcatcaccacctcttgcactgtctggaaaaaaccacctgccacgagtttactgatgagcttaccttcagtgaagcactgggcgccgtgagcccggggggccgaacctccagaagcacttccgtatctagtcagccagtaggccctggcagcctgctctccagctgctgcccccgaagggctaagaggagagccatccgtcttgcaaattcaacagcttctgtcagtagagggagcatgcaggagcttgacatgctcgcgggattgcgtcgctctcacgcgccccagtctaggagtagtttaaacgctaaaccccatgactcccttgatctgaactgcgattcgcgggattttgtggccgccattatctccatacccactccgcccgctaatacacctgacgaatctcagccttcttctccaggtggggggggtcgagccggttcaaccctaagaaacagcagcctgggcacaccttgcctctttcctgagactgtgaaaatcagtagtctctag

SEQ ID NO: 29005 - DNA, 402 bp, Artificial Sequence
  Description of Artificial Sequence: Synthetic coding sequence
tagggcagaggacttgatcgggttggcgttagccacaatggggaagaaggcgccgccctcattgctctccttcatcttttacaggatagtggttcaggcgaagaacaagctctgtgtgtgaggaaccggagcgccttcgaacagcagcaccatcacctgcttcattgcctcgagaagactacctgccatgaattcacggacgaactaaccttctctgaggcattgggcgctgtgtctccaggcgggagaacgagcagaagcacatctgtgagctctcaaccagtcgggcccggttctcttctaagctcgtgttgccctaggagagctaaacgacgggctattcgtcttgctaatagcactgcctctgtgtcgcggggatcaatgcaggagctggacatgtag

SEQ ID NO: 29006 - DNA, 1401 bp, Artificial Sequence
  Description of Artificial Sequence: Synthetic coding sequence
atggaaccctggccatgttctcctggcggcggaggaggaacacgagcacgccacgttatcatcaacgtcggtgggtgtcgcgtacgcttggcctgggctgcactcgcccgttgcccgctggcaagactggagagattgagagcctgccggggccatgatgatctgctccgggtttgcgatgactacgatgtctcacgcgacgaattcttttttgatagaagcccctgtgcctttcgcgcgatcgtggctctgctacgggcaggcaagctcaggttgctgaggggaccctgcgctttggctttcagggatgagctggcatattggggaattgatgaggcacggttggaaaggtgttgcctgcggagacttcggagaagggaggaggaagccgcggaggctcgggcggggcctactgagaggggtgcgcaggggtcacccgctagagcactgggccccaggggcaggttgcagcggggacgcagacgcttaagggacgtcgttgataatccacactctggacttgcagggaaactgtttgcctgtgtttcagtgagtttcgtggcagtcactgcagttggcctctgtttgagcaccatgcctgatatcagagcggaggaggagaggggtgaatgctctcccaaatgcaggagcttgtttgtactggagactgtctgcgtggcatggttttccttcgagtttctgttacgaagtcttcaagccgagagcaagtgtgccttcttacgggctcccttgaatatcattgacatcctggctctgcttcctttttatgtgtcccttcttttgggattggctgctggcccaggtgggactaagttattagagagggcgggcctggtgctaaggctgctgcgggcgctacgcgtattatacgttatgagactggctaggcattctctgggactgaggagtctcggtcttacaatgagaaggtgtgcccgagagtttggactgcttttgttattcctctgcgtggccatggctctttttgctcctctggttcacctggcagagagagagctgggggcacgcagagacttctcttcggtccctgctagctactggtgggccgtgatctctatgactactgtgggctatggggacatggttccccggagcctgcctgggcaagtcgtggccctgagttccattctttcaggtatcctcctcatggcgttccccgtgacttcaatctttcacacattttcccgttcatatagtgagctcaaagaacaacagcagcgtgctgcgtcacctgaacccgctttacaggaagatagcacacatagtgccacggcaacagaggactcttcacagggcccagattcagcagggcttgccgatgattctgccgatgctctgtgggttagagccgggagatag

SEQ ID NO: 29007 - DNA, 3054 bp, Artificial Sequence
  Description of Artificial Sequence: Synthetic coding sequence
atgccagtgatgaaggggctcctggccccgcagaacacctttctggatacgatagctactagatttgacggaacccactccaacttcctccttgccaacgcccagggtaccagaggttttcctattgtttactgcagcgatgggttttgcgagttaacaggatacgggcggacagaggtaatgcagaagacatgttcctgccggtttctttatgggcctgagaccagcgaaccagcactccagcgattacacaaggctctggagggccaccaagagcacagagcagaaatctgcttttacagaaaggatggatccgccttctggtgtctcctcgatatgatgcctattaaaaatgaaatgggcgaagtggttctgtttctgttcagcttcaaggacatcacccagagcggctcgcccgggctcgggcctcagggggggcgtggcgactctaaccatgaaaactctctgggtcgccgtggcgctacatggaaatttaggtcggcgcggcggagatcccgtacggtcctacataggcttacgggacacttcggtaggagaggacaagggggaatgaaagcaaataataacgtgttcgagcccaaacccagcgttcccgagtacaaagtggccagcgtgggaggctcccgctgcctgctgttacactactcggtgtcaaaagccatatgggacggactgatattattagctacattttatgtcgctgtgactgtcccctataacgtttgctttagtggagatgatgatactccaattacttctcgccataccctggtatcagatattgcggtggaaatgttattcatcttggacataattctgaacttccgtaccacctacgtttctcagtccggacaagttatctctgctcccagatcgatcgggcttcactatctggccacctggttttttatcgatttgattgcagcccttccatttgatcttctgtatatcttcaatattaccgtgacctctcttgttcacctgctcaagaccgtcaggctcctgagacttctgcgattgctccagaagttggagcgatattcacaatgttccgcagtggttctgaccctcctcatgtcggtcttcgctctcctggcccattggatggcttgcatctggtacgtgataggacgccgtgagatggaagcaaacgacccactgctttgggacatcggatggctgcacgagcttggcaaaaggctcgaggttccgtacgttaacggatccgttggcggtccaagtcgaaggtctgcgtatattgctgccctctacttcactttgtcaagcctgacctccgtgggcttcggcaacgtctgcgctaatacagacgccgagaagatcttttccatctgcacaatgctcataggcgcattgatgcacgcagtggtctttggcaacgtgactgctatcattcaacgaatgtatagcaggaggagcctgtaccacagcaggatgaaagatctgaaagacttcatccgcgtgcaccgcctgccacggcctctaaagcagagaatgctcgagtacttccagaccacctgggccgtaaattcgggtattgatgctaacgagctgctccgggacttccccgacgaactgagagccgacattgcaatgcatctgaacagggaaatccttcagctcccattgtttggtgcagccagccggggctgtctgcgcgcgctaagcctgcatatcaagacctctttctgtgcacctggagaatatttgctccggaggggagatgcgcttcaggcacattattatgtttgctccggtagtttggaggttctccgagataacatggtgctcgccatcctgggaaagggtgaccttatcggagccgacatacctgagcctggccaagagcccggcttgggagctgacccaaacttcgtcctcaaaacatctgccgacgtgaaagcacttacctactgtggtctccagcaactgtcttcccggggactggccgaagttctgagactctatcctgaatatggggcagcattcagggccggccttcccagagatctcaccttcaatctgcggcagggctccgatacgtcaggactgagccgcttttctaggtcccccagactgagtcagcctcgctctgaatcccttgggtcctcctccgacaagacactgccctccatcaccgaagccgagagcggagcagagcctgggggaggccctcggcctaggcggccattacttctccccaacctttcaccagcacgcccacgtggttctctggtgtctctgctaggagaggagctgccgcctttttccgccctcgtttcatctcccagtctttctccgagccttagccccgccctggctggccaggggcactcagcctccccccacgggcctccgcgctgtagcgctgcgtggaagccaccccagctgttaattccaccactgggcacctttggaccgcctgacctctctcctcggatagttgacggcatagaggattctggctccaccgcagaggcaccctcctttcgtttcagccgcagacccgaactgcctcggccaaggtcccaagcccccccgaccgggacgcgcccctcgccagaactcgcttccgaagcagaagaagtgaaggagaaggtttgccgtctcaatcaggaaatcagccggctcaaccaggaggtgagccagctgagccgtgaactgcggcacatcatggggctgctccaggctagattgggccccccaggacaccctgctggaagtgcctggacgcccgatcccccatgccctcagctgcgtcctccatgcctctccccttgcgcctcccggccccctccctcattgcaagacaccacactggcggaagtccactgcccagcatcagtcggtacaatggaaacaggaactgccctgctcgacctccgaccctctatactccctccgtatccctctgaacctgatccgctggggccttcccccgtgcctgaagcatctcctcccacaccttctttgttaaggcacagttttcaatcccggtccgacaccttccactag

SEQ ID NO: 29008 - DNA, 2985 bp, Artificial Sequence
  Description of Artificial Sequence: Synthetic coding sequence
atgccagtgcggcggggacatgtagctccccagaacacctacctcgataccatcatcaggaaattcgaggggcagagtagaaagtttctcattgccaacgctcaaatggaaaactgtgctattatctactgtaacgatggtttctgcgaactgttcggatactctcgggtcgaggtgatgcaacagccatgcacatgcgacttcctaactggcccaaacaccccatcgagcgctgtcagccgtctcgcacaggcgctgctgggtgcagaggagtgcaaggtcgacatcctctactacagaaaggatgcttcctcatttagatgtctggtggatgtcgtgccagtgaagaacgaagacggtgcggtcatcatgtttatactgaactttgaggatttggcacagttactggccaaatgtagttctcgctctctgtcccaaagattactcagccagagcttcctgggctccgaaggctcacacggccgacccgggggcccaggcccagggacagggcggggcaaatatcgtacaatcagtcagatcccacagtttactctaaacttcgtggaatttaacttagagaagcaccggagcagttcaacaactgagattgaaataatcgctccacacaaggtggtcgaacggacacagaatgtgacagagaaagtgacgcaggtattgtccctgggcgctgacgtgctgcccgagtacaagttgcaggcacctagaatacaccggtggaccattctacactacagccccttcaaggccgtttgggattggctcatcctgctcctggtgatatatactgcagtttttacgccctactcagccgcctttttgctgtctgaccaggatgaatcacggcggggcgcctgcagttatacttgctcgccactgaccgtggtggacttaatcgttgatatcatgttcgtggtggatatcgtcattaatttcaggactacatacgtcaatacaaatgacgaagttgtgtctcaccccaggagaatagcagtccactatttcaagggctggttcttgatcgacatggtggctgccatcccgttcgacctgttaatttttaggactggatctgatgagacaactacgcttatcggcctgcttaaaactgcacgtcttctccgtctagtccgcgttgctaggaagctagaccggtattctgaatatggcgccgcagtacttttcctgctcatgtgcacgttcgcactgatcgctcattggcttgcgtgcatctggtatgccatcggtaacgtggaaagaccctatctggaacacaagattgggtggcttgatagcctcggggtgcagctggggaaaagatacaatggctctgatcctgcatccggcccatctgtccaagacaaatacgtgacagcactgtactttacattttcttccttgacctcagtgggcttcgggaacgtttccccgaataccaactcggaaaaagtcttctctatctgcgtgatgctcatcggttcgttaatgtacgcctctatcttcgggaacgtgtcagccattattcaacggttgtattccggtactgcacgctatcacactcagatgctcagagtaaaagagttcatccgtttccatcagatccctaatcctttgaggcagagactggaggaatatttccagcatgcctggagctatacaaacggcatagatatgaacgcagtcttgaaggggttcccagagtgcctgcaggctgatatttgtctacacttacaccgagcacttctgcagcactgccctgcatttagcggggcgggcaagggctgcctacgggccttggctgttaagttcaagaccacccatgcaccccctggtgacacactggttcatctcggcgacgtcctttccacactgtacttcatttcccgcgggtctatcgagattttacgagacgacgtggtagtggctattctgggcaagaatgacatattcggggaacctgtctctctgcacgcccagcccgggaaatcatccgccgatgtgagggccctcacttattgcgatctgcataagattcagagggctgacctgcttgaggtgctggatatgtatcctgccttcgcggagagtttttggtcgaaactggaggtgactttcaacctgcgcgacgctgctggtggtttgcacagttcaccccgtcaagcgcccggatcacaagaccatcagggcttttttctttcagacaatcagtccggatctccccacgaattagggccccagtttccgtccaaaggttacagcctgttaggacctggttcccagaattccatgggtgccggcccctgtgccccaggacaccccgatgctgcgcctccactgtctatctctgatgcctcagggctgtggcccgagctactgcaggaaatgccacctcggcattctccacagtcccctcaggaagaccccgattgttggccactgaagttgggatcacgtctcgagcagctccaggcgcagatgaaccgacttgaatccagagtgagtagcgacctgtctagaatcctccagttacttcagaagccaatgccccaagggcacgcttcctatatccttgaggcaccagccagtaacgacttggcactggtgcctatcgcatcagagacaaccagcccaggaccgcgattgccacagggtttcttgcctcctgcacaaacaccctcttacggtgacttggacgactgttcaccgaagcacaggaacagttctcctcggatgccccatctggccgtggctactgataaaactctcgccccaagctcagaacaagagcagccagaggggctttggcctccactcgccagtccgctccatccactcgaggtgcagggtctgatttgtggcccttgcttcagctccctgcccgaacatctggggagtgtgccaaaacagcttgacttccagcgacacggttccgatccagggtttgccggttcttggggacattag

SEQ ID NO: 29009 - DNA, 2718 bp, Artificial Sequence
  Description of Artificial Sequence: Synthetic coding sequence
atgcctgtacggcgaggtcacgtggctcctcagaatacatatctggacactattatcaggaaattcgagggccaatcaaggaagtttctgattgccaatgcccaaatggagaattgtgcaattatctactgtaatgatggcttctgcgaactcttcgggtattcaagagttgaagtcatgcaacagccctgcacttgtgactttctcaccggccccaacactccaagcagtgctgtatcgagactggcccaggccttgcttggagcagaagaatgtaaagtggatattttatactacaggaaagatgcctcttcctttagatgcttggttgatgtggtgcccgtcaaaaacgaagatggggccgtgattatgtttatcctgaatttcgaagaccttgctcagttgctcgcaaagtgctccagtcgaagcctgtctcaacgcctgctgtcacagtccttcttggggtccgaaggctcgcatggccgcccaggcggccccggacctggcaccgggcggggtaaatatcggaccatcagccagatcccccagtttactctgaatttcgtagagttcaatctggaaaagcatcggtcatcaagcactacagaaatcgagattatcgctccccacaaggtggtggaaaggactcagaacgtcacagagaaagtgacccaagtgctctctctgggcgccgacgtgttaccggaatacaagctccaggcgccgagaatccatcgctggaccatccttcattactcaccatttaaggctgtatgggattggctgatactcctattagtaatttatacagcagtgtttactccctattccgcagcctttctgttatccgaccaagacgagtcccgaaggggtgcttgttcttacacctgcagtcctctcacagtggtggatttaattgtagacattatgtttgtcgtggacatcgtgatcaactttcgcactacttacgtgaacacaaacgatgaagtggtgtctcatcccagacggatcgcagtccactattttaaggggtggtttttgattgatatggtggcagccatcccatttgacctcctgatatttagaacaggcagtgatgaaactaccactttgatcggcctcctgaagaccgccaggctgctgagactagtccgggtggcgaggaagctagatcgatactccgagtatggagccgcggtgctgttcctcctgatgtgcacctttgcactcatcgcacactggctggcgtgcatttgttctctaaccagtgtgggctttggcaacgtgagtcctaatactaattctgaaaaagttttctctatctgcgtcatgctgattggcagtctaatgtatgcaagcatctttggaaacgtgtccgctatcatccagaggctgtacagcgggaccgccaggtaccacacacagatgctgagagtcaaagagtttataaggtttcatcagattcctaacccactccgccaacgtctggaggagtactttcagcatgcatggtcctatacaaacgggatcgatatgaatgcagttctgaaggggtttcccgagtgcctgcaggccgacatatgtctccatctacatcgcgcactgctacagcattgtcctgctttcagcggcgccgggaaagggtgcctccgcgctctagcagtgaaatttaaaaccacgcacgctccaccaggggacactctggtacacctcggagacgtcttgtccacactgtatttcatctcacggggctctatagagatactgcgggacgacgtcgtggttgcaatccttggaaagaacgatatattcggcgaacccgtgtctcttcatgcccagccaggaaaatcgtctgctgacgtcagagctttgacctattgcgacctccacaagatccagagagctgacctcttagaggtacttgatatgtatcccgctttcgccgagagtttctggtcaaagttagaagtgacttttaacctccgcgatgcagcaggaggactccattcatcaccgaggcaggctcccggttctcaggatcaccagggattttttctgagcgataatcagtctgacgccgcccctccactgtcaatatcagatgcaagtgggctgtggccagagctactgcaggagatgcctccgaggcatagcccacagtctccccaagaagatcccgactgttggcctctcaagctgggctcccggcttgagcagctccaggcccagatgaatcgcctggagtcgcgcgtctcttccgacctctcacgcatccttcaactgcttcagaaacctatgccacagggtcatgcctcctatattctcgaggctcccgcatcaaatgacctggccctggtgcctatagccagcgaaacaacaagccccggcccgagattgccacagggtttcctcccacctgcccagaccccgtcttacggtgacttagacgattgttcacccaagcaccgcaactccagcccccgcatgccacatcttgctgtggctacagataaaactttagccccgtccagtgaacaggaacaacccgaaggcctttggcctccactggctagcccactgcatccattggaggtgcagggcctgatatgtggcccatgctttagctcactgcccgaacaccttggaagcgtccctaaacaactggatttccaaagacacggttccgatccagggttcgcaggatcttggggccattag

SEQ ID NO: 29010 - DNA, 3324 bp, Artificial Sequence
  Description of Artificial Sequence: Synthetic coding sequence
atgcctgtgatgaaagggttgcttgcccctcagaacaccttcctcgacacaatcgctacgcgattcgacggcacccacagcaactttattctggcaaatgctcaagtcgccaagggcttccctattgtgtactgttccgatggtttctgcgagctcgcaggattcgccaggaccgaggtgatgcagaagagctgctcttgtaagtttctgttcggagtcgagacgaatgaacagttaatgctccaaatcgagaaatccctagaggaaaagaccgagtttaagggagagattatgttttacaagaagaatggctcacctttctggtgcctgttggatattgtccccattaagaacgagaaaggcgacgtggtgttgttcctcgcttcctttaaggacatcaccgacaccaaagttaaaattaccccagaggataaaaaggaagataaggtcaaggggcgctcccgggcgggaactcatttcgattcagcaagacgccgcagccgagctgtattgtaccatattagcggtcatctgcaacgtcgtgaaaaaaataagcttaaaattaataacaacgttttcgtggataagcccgcatttcccgaatacaaagtgagcgacgccaaaaagtctaagttcatcttgctccacttcagtactttcaaggcaggttgggattggctgatattgctggccacgttctatgtcgcagtgaccgttccctataacgtttgctttatcggcaatgatgacttgtcgacaaccagatccaccaccgtgtcagatattgccgtggaaatcctctttataatcgatatcattttaaactttcggactacttatgtttctaagtctggtcaggtaatctttgaagccagatccatttgcattcattacgttaccacctggtttatcatagatctgatcgctgctctgcccttcgaccttctttatgcttttaatgtcacagtcgtgagccttgttcatcttctcaaaaccgtgcgattgctgcgtcttctgcggcttctacaaaaactcgatcgatattcacagcacagcacaattgtcttgaccctcctgatgtctatgttcgccctcttggcccactggatggcatgcatttggtacgtgataggcaagatggaacgcgaagataactcattactgaagtgggaagtaggctggctgcacgaactcggaaagcgcttagagtccccgtactatgggaacaatacgctcggtggacccagtattcgaagtgcttatatagcagccctgtatttcaccctcagttcactgaccagcgtggggtttggcaatgtgtcagcaaataccgatgctgaaaagattttcagtatttgtacaatgttaattggcgctcttatgcatgccttagtcttcggtaacgtgactgccattatccaacggatgtattccaggtggagtctgtatcacacacgcacgaaggacctgaaggactttattagggtgcaccacctccctcagcagcttaagcagagaatgcttgaatatttccagacgacgtggagcgtgaataatggaattgacagcaacgaactgctgaaggacttccccgatgaactcaggtcagacatcactatgcatctgaacaaggaaatcctacagctttctttgtttgaatgtgctagccgagggtgtctgcgatcgctgtctttacacatcaaaacttcattttgtgccccaggtgaatatctcttacgccaaggcgatgctttacaggccatttacttcgtatgctcaggtagtatggaggtgctcaaagattccatggtgctggcaattcttggcaaaggcgacttaatcggtgccaacttgtctattaaagaccaggttattaaaaccaacgccgatgtaaaggcccttacttactgcgacttacaatgcattattctaaagggcttattcgaggtgctggatctgtatccagagtacgctcataagtttgttgaggacatccagcacgatctgacgtataaccttagggaaggccacgaatcagacgtgatatcaagactgtccaataagagcatggtgagccagagcgaacctaaaggaaacggcaacattaataagcgtcttccctccattgtcgaggacgaggaggaagaagaggaaggggaggaggaggaggcagtgtccttatctcccatttgcactaggggaagctccagccgaaataaaaaagttggtagtaacaaggcttatcttggcctgtctttaaagcaacttgcatctggcactgtcccatttcactcccctatccgggtgtccaggagcaactcaccaaaaaccaaacaggagattgatcctccgaaccacaataagagaaaggaaaagaacctgaaacttcaactctctacattgaataatgctggcccgcccgacctttccccccgcatcgtcgacggcattgaagatgggaatagtagcgaggaaagtcagacatttgatttcgggagcgagcgaatcagaagcgagcccagaattagcccaccactgggggatccagagatcggcgccgccgtcctctttatcaaagccgaagagaccaaacagcagatcaacaaattaaacagcgaagtgacgacccttactcaggaggtgtcccaactcggcaaggatatgcgcaacgttatacagcttctcgagaacgtactctccccacagcagccttcgcgattctgctccctgcactcaacctctgtgtgcccgtcccgggagagcctccagacaaggacttcttggtcggctcaccagccttgcctccatctgcagacaggaggggcagcatatacccaggctcaattatgctcatcaaacatcacaagcgacatatggtccgtcgatccctcttccgttgggtcctctccacagcgtaccggtgcccacgagcagaaccctgctgacagcgaattatatcacagccccagcctggattactcccctagtcactaccaggtggtacaggaggggcatttgcaatttctgcggtgcatctctccacacagcgacagcactcttactcctctgcagagcatctcggctaccctgtctagctccgtctgttcctcttcagagacaagcttgcacctggtcctgccctcgcgctccgaagaggggtctttttctcaaggtacagtttcttccttctctctagaaaacctgcctgggtcttggaaccaggaaggaatggctagtgctagtaccaagccgctggagaatctgcccctggaggttgtcacctcgacagccgaagtgaaggataataaagccataaatgtttag

SEQ ID NO: 29011 - DNA, 558 bp, Artificial Sequence
  Description of Artificial Sequence: Synthetic coding sequence
atgtcaatgttcgcgctgcttgcacactggatggcatgtatctggtacgtgattggcaaaatggagagagaggacaatagtctactgaagtgggaggtgggatggttacatgagcttggtaagcgattagaaagcccctattacggtaacaacacactaggaggaccctcgatcaggagtgcttatatcgcagctctctattttaccctcagcagcctgacaagcgtgggatttggcaacgtctcagcaaatactgacgccgagaagatcttttctatttgtaccatgcttattggggtctcccagtttcaggtgtgccccaggccttcttggattatatgttggttccggaaccattttggctttattctgctgatgaccacactgatgcacgcactggttttcggcaacgttaccgccattattcagcggatgtacagccgttggtccctgtaccatactcggaccaaagatctcaaggatttcatacgagtgcaccatcttccacagcagctgaaacaaagaatgctcgaatatttccaaacgacatgcttctag

SEQ ID NO: 29012 - DNA, 399 bp, Artificial Sequence
  Description of Artificial Sequence: Synthetic coding sequence
atggaagctgaggggcttgactggttgctggtgcctctgcaccaattggttagttggggcgcagctgccgctatggtgttcggcggggtagtgccctatgtcccgcagtatcgcgatataagacgcacacagaacgccgatggtttttccacttatgtgtgtcttgtgcttctggtcgctaatatactcagaatcctgttttggttcggcaggagatttgagagcccacttttgtggcagtctgccatcatgatactgactatgctattgatgctgaagctgtgcaccgaagtccgggtggcgaacgagctcaacgcccgtcgtcggtcgtttaccgctagtaggtggtgttcgtgcgggcctgtagtcacaccaagcagaaggcctacttcctgctag

SEQ ID NO: 29013 - DNA, 762 bp, Artificial Sequence
  Description of Artificial Sequence: Synthetic coding sequence
atggaggccgagggtctcgattggctgctcgtcccgctgcaccagctggtgtcctggggtgccgcagcagccatggtattcgggggggtggtcccatacgtcccacaataccgggacatcagacgcacccagaatgcagatggcttttccacctacgtttgcctagtgctgctcgtagccaacatccttcgcatcctgttttggtttgggcggcggttcgaatcacccctactctggcagagcgctattatgattctgaccatgctgctgatgctcaaactgtgcacggaagtgagagtggccaatgaactgaacgcaaggagacgtagttttacggattttgatccccaccacttctggcagtggagctcattctccgattacgtgcagtgtgttcttgcatttacaggtgtggccggctacattacctatctgtcaattgacagtgcgcttttcgtcgagaccttggggtttctggcagtgctcactgaggcgatgctcggggttccccagctgtacaggaatcacagacaccagagtacagagggcatgtccatcaaaatggttctgatgtggacgagcggagatgcatttaagacagcgtattttctgttgaaaggggcacctcttcaattcagcgtgtgtggactgctgcaggtgctggtggatctggccatcctagggcaagcctatgccttcgcacggcaccctcagaaacccgctccccacgccgtccaccctactggaacaaaggcactgtag

SEQ ID NO: 29014 - DNA, 816 bp, Artificial Sequence
  Description of Artificial Sequence: Synthetic coding sequence
atggaggctgaggggctggactggttgcttgtcccactacaccaattggtgagttggggagccgccgctgccatggtgttcgggggggtggtgccgtacgttccacaataccgggacatccgacgcacccagaacgcggatggctttagcacatatgtttgcttggtgcttctagtagctaacatactcaggatattgttctggtttggtaggagattcgaatccccactgttgtggcagtctgccataatgatcttaaccatgctcctaatgctcaagctgtgtactgaggtgagggtggccaacgagctgaacgcgcgcagacggtcctttacagcggctgatagtaaagacgaggaggtgaaagttgcgccaaggagatccttcctagatttcgatccccaccacttctggcagtggtcatcattctcagactacgtgcagtgtgttcttgcgttcaccggcgtagccgggtacataacttatctttctattgattctgcattatttgtcgaaaccctgggcttcctcgcagtgctgacagaggccatgctgggggttccacagctgtaccgcaaccaccgccatcagagcaccgaggggatgtctatcaagatggtgctcatgtggacctctggagacgcatttaaaacagcttatttcctccttaaaggagccccactccagtttagcgtgtgcggtctgctccaggtgttagttgatctcgccattttgggccaggcatacgcttttgccagacacccacagaagcccgcccctcacgcagttcaccctacagggaccaaagctctgtag

SEQ ID NO: 29015 - DNA, 399 bp, Artificial Sequence
  Description of Artificial Sequence: Synthetic coding sequence
atggaagctgaaggcttggactggcttctggtccccttgcatcagttagtttcttggggggctgctgctgccatggtctttgggggcgtggtgccttatgtgccacagtatagggacatccggcgcacccagaatgccgacggcttctctacttacgtgtgtctcgtgctgctggtcgccaacatactacgcatcctattttggttcgggagacgatttgaatctcctctgctctggcagtctgccatcatgatattaactatgctcctcatgctaaagctttgtaccgaagtccgtgtagcgaacgaactgaatgcccgacgtcgctcttttaccgcttcccgctggtgttcctgtggtccagttgtgaccccctcccggaggcccacctcttgctag

SEQ ID NO: 29016 - DNA, 876 bp, Artificial Sequence
  Description of Artificial Sequence: Synthetic coding sequence
atggtctggaagaaactcggctcaagaaatttttcctcctgtccttccgggtcgatccagtggatttgggacgttctcggagaatgtgctcaagatggatgggacgaggcttccgtaggcctgggactaatttctattctgtgcttcgccgcctctaccttccctcagtttattaaagcatacaagaccggcaacatggaccaggctctaagtctttggtttctgctcgggtggattgggggggattcatgcaacttgatcggtagtttcctagctgaccaactgcccctgcagacatacacggctgtgtattatgttcttgctgacctagtaatgctgaccttgtatttttactataagttcaggactcgtccatcccttcttagcgccccaattaattccgttttacttttcctcatgggtatggcatgcgccacgccgcttctttctgctgccggccccgtcgccgcgccgagagaggcctttcggggtcgcgcattgctctcggtcgaaagcggctctaaacctttcacgcgccaggaagtgataggctttgtgataggctcaatttcatctgtactctacctgctcagccgtctcccccagatccgaaccaattttttgcgaaaatccacccagggcatctcatatagccttttcgccctcgtgatgttaggaaatacgctgtatggactgagcgtgctccttaagaaccccgaggaaggtcagtctgaaggtagctatttactgcaccacctgccgtggctcgttgggtcactgggagttctgctgcttgacaccattatctctattcaattcctggtataccgaaggtctactgctgcatccgaattggagcccctcttaccaagctag

SEQ ID NO: 29017 - DNA, 876 bp, Artificial Sequence
  Description of Artificial Sequence: Synthetic coding sequence
atggtgtggaaaaagctgggctcccggaatttctcgtcctgtccatctgggtcgattcaatggatctgggacgtgcttggagagtgcgctcaggatggttgggacgaggcgtctgtcggcctgggattaataagcatcctgtgtttcgcggccagtacctttccgcaatttattaaagcatataagacaggcaacatggatcaggccctaagcctgtggttcttattgggctggataggcggtgattcctgcaatctgatcgggtcatttcttgccgatcagctccctttgcagacatacaccgctgtctactacgtgttggctgacctcgtgatgctgactctgtacttctactacaaattcaggacaagacctagcctgctgagtgctcctatcaactctgtgctgctgtttctaatgggcatggcctgcgcgactcccctcctcagcgctgccggccctgtggccgcgccccgggaagcatttcgcggccgagccctgctttcggtggagtctggcagcaagccgttcactagacaggaagtcataggtttcgtgatcggcagcatatcaagcgtactttatttactgtctcggctcccacagattcggacaaatttcctgcggaagtctacgcagggcatttcatatagcctgttcgcattagtgatgctgggaaataccctatatggcctgagcgttcttctgaaaaatcccgaggagggccagtcagagggttcctacttgctccaccacctgccttggttggtcggctcacttggtgtgctgctcctggatacaatcatctctatccagttcttggtgtaccgcagatccacagctgcgtctgagctcgagccgctcctcccgtcctag

SEQ ID NO: 29018 - DNA, 681 bp, Artificial Sequence
  Description of Artificial Sequence: Synthetic coding sequence
atggaccaagcgctgtctttgtggtttttgctgggatggatcggtggagattcctgtaatcttattggatctttcttagcagatcagttgcccttgcagacatatacagcagtgtattacgtgctggctgatctggtgatgttaacactctacttctattacaagtttcggacaagaccttcactgctgtcggcacccatcaattccgttctattattccttatgggcatggcttgcgctacccccctgctgagtgctgctggacccgtggcagcaccccgggaagcctttagaggaagggccctattatcagttgagagcgggtcgaagccattcaccagacaagaggtgataggtttcgtgatcggatctatctcttctgtgctctatttgctaagtcgactcccacaaatacgtacgaattttctgagaaagtccactcagggcataagctacagtctttttgccttagttatgctgggaaacacattgtacggcttgtcggtgttgctaaaaaaccccgaggagggtcagtcggaaggctcatacctgctgcaccacctgccctggttagtggggtccctcggggtcctgcttctcgataccatcattagtattcagttcctggtgtacaggaggtctacggcagccagcgaattggaacctcttcttccttcatag

SEQ ID NO: 29019 - DNA, 609 bp, Artificial Sequence
  Description of Artificial Sequence: Synthetic coding sequence
atggaagctgccctgctggggctgtgtaactggtccacccttggcgtatgcgctgcactgaagctcccgcagatcagcgccgtcctggctgccaggtctgccagggggcttagcctaccctcattgctcctggagctcgctggatttttagtgttcttgcggtaccaatgctactatggttaccccccactgacttacctcgagtacccaatcctgatcgcccaggacgttatcctgttgttatgtatctttcatttcaatggcaacgtcaagcaggccacaccgtatatcgcagtgctggtgtcgtcttggtttatcctcgccctgcagaagtggataatcgatctggccatgaatctctgcacctttatatccgcggcctcgaagttcgcgcaactgcagtgcctgtggaagactcgtgactccggaacagtgtccgcccttacctggtccctgtcatcctatacatgtgccactcgcattatcactaccctcatgacaacaaatgatttcaccatcctgctccgatttgttatcatgctagcgctaaatatctgggtgacggtcacggtgcttcgctacagaaagaccgccattaaggctgagtag

SEQ ID NO: 29020 - DNA, 567 bp, Artificial Sequence
  Description of Artificial Sequence: Synthetic coding sequence
atggaagctgcccttttggggctgtgtaactggagcacattgggggtgtgtgcggcacttaagttaccgcaaatctccgcagtccttgccgcgcgcagcgcgcgggggctgagtcttccttctctgttgcttgaattggcaggatttctggtgttcctccgatatcagtgttattacggatatcccccactcacctacctcgagtaccccattttaattgcgcaggatgtcattcttctgttgtgcatcttccattttaatggaaatgttaagcaggccaccccctacattgccgtcctggtgtccagctggtttatactcgcactgcaaaagtggataatcgacctcgcaatgaatctctgtacttttatcagcgcggcatccaagtttgcacagctccagtgcctgtggaagacgagagacagcggaaccgtgagcgcgctcacatggagtctgagctcttatacttgcgctatcctgcttcgctttgttatcatgttggccctgaatatctgggtaacagtgactgtcctccgttaccgcaagacagcgataaaagctgaatag

SEQ ID NO: 29021 - DNA, 2127 bp, Artificial Sequence
  Description of Artificial Sequence: Synthetic coding sequence
atgtctcagtacacggagaaggagccagccgccatggatcaggagtctggaaaagcagtgtggccaaaacccgctggcggataccaaaccataacagggaggcggtatggaagacgccatgcttatgtttccttcaagccgtgtatgacccggcatgagcgctcgctgggccgggccggcgacgattatgaggtgttggaacttgatgacgtgcctaaggagaactcatccgggtcaagtcctttggaccaagtggattcatcacttccttccgagccaattttcgagaagagcgagaccgaaattccgacctgcggctccgcgctaaaccaaaccacggagtcctcgcaaagttttgtggcagttcaccattcagaagagggtcgcgatactttgggttcctccaccaaccttcataatcactccgagggagagtatatacccggggcctgcagcgcatcttctgtacagaatggaattgctctcgtgcacacagactcatacgatccagacggcaagcacggcgaagataatgatcatcttcagctgtctgctgaagttgtggaaggatcgcgttatcaagaatcattagggaataccgtattcgaacttgagaaccgagaggctgaagcttacacaggcctgtccccccccgttccttctttcaattgtgaagtccgcgacgaatttgaagaactcgatagcgtccctttagtgaaaagcagcgctggggatactgaattcgtacaccagaactcgcaggagatccagcgatcctcacaggacgaaatggtgagcaccaaacagcaaaataacaccagtcaggagagacagacagagcatagtcccgaagacgccgcttgtggcccgggacatatttgctcggaacagaacacaaatgacagagaaaagaaccacgggtcctcccccgagcaagttgtccggccgaaggtgaggaagctgatctcaagcagtcaagttgaccaagagactggatttaatagacatgaagccaagcagcgtagtgtacaaagatggcgggaggctctagaagtggaggagtctgggtcagatgacctcctaatcaaatgcgaggaatacgatggagagcatgactgcatgttcctggatcctccttactcacgggtgatcactcagagagagacagagaataatcagatgacctcagaaagcggtgccactgctgggcggcaagaagtagacaataccttttggaacggctgtggcgactactaccagctatatgacaaggacgaagacagttctgagtgctctgatggggaatggagtgccagccttccacatcggttctcaggaacggagaaggaccagtcctcgtccgatgagagttgggagaccctccccggcaaagacgaaaatgagccagaattacaatctgattccagtggccccgaggaggagaatcaggagctaagcctgcaggaaggagagcagacgtccctcgaggagggagagataccctggctccagtataatgaggtgaatgaaagtagctctgatgagggcaacgagccagccaacgagtttgcgcaacctgcgtttatgctggatggcaacaataacttggaggacgattcatccgtgtccgaggacctcgacgttgactggtccctcttcgatggcttcgccgacggccttggagtggctgaagctatcagctacgtggacccccagttccttacctacatggccctagaggaacggctggcccaagcaatggaaaccgccttagcacatctggagtccctagccgtagacgttgaggtggccaatccgccagcgtccaaagaatccattgacggtctacccgaaaccctggttctcgaggaccataccgctatcggacaggaacaatgttgtcccatctgctgctcggagtacatcaaagatgacatcgctaccgagctgccatgccaccacttttttcacaagccttgcgtgtccatatggctgcaaaaatccggtacttgtccagtgtgcaggagacacttccctccagctgtcattgaggcgtcggctgcccccagttcagagccagatccagatgcgcctccttcaaatgactccattgcagaggctccctag

SEQ ID NO: 29022 - DNA, 2127 bp, Artificial Sequence
  Description of Artificial Sequence: Synthetic coding sequence
atgtcgcagtacactgagaaagagccagcagcaatggaccaggagtctgggaaagctgtctggcctaaaccagccggtggctatcagaccattaccggacgccgatatggccgccgtcacgcctatgtgtcgttcaaaccatgtatgactaggcatgagaggagtctgggcagagccggtgacgattacgaggtgcttgagttagacgatgttcctaaggagaacagctcaggctcttctcccctggatcaggtagatagttctctgcccagcgaacccatcttcgagaaatcagaaactgagattcctacatgtggtagcgcacttaatcagaccacagagtcctctcaaagctttgtggccgttcatcactcagaagagggaagagatacactaggcagctctactaatctacataaccattccgaaggagaatacatccccggggcctgctcagcctcttctgtacagaacggaatcgctctcgtgcacactgattcctacgaccccgacggaaagcacggcgaagacaacgatcacctgcagctgagtgctgaggttgttgagggatctcgatatcaggagagtcttggtaacaccgtttttgagttggagaaccgcgaggctgaggcctacaccgggttgagtcctcccgtgccgtcattcaactgtgaggtgcgggacgagttcgaggaactagacagcgtccccctggttaagagctccgccggcgacactgagttcgtgcaccaaaactcacaggaaatccaacggtcctctcaggatgaaatggtctccaccaagcagcaaaataatacctcacaggagcgccagacagaacacagcccggaggatgcggcctgcgggcctggccatatctgcagcgaacagaacactaatgaccgcgagaaaaaccacggaagttccccagagcaggtggtcaggcctaaggtccgtaaattgatcagcagtagtcaggtcgaccaggaaaccgggtttaaccgtcacgaggccaagcagcgcagcgtgcagcggtggcgggaagcgctggaagtcgaggaaagtgggagcgatgacttgctaataaagtgtgaggagtatgacggggagcacgattgtatgttcctggaccctccctactccagggtgatcactcaaagagaaacagagaacaaccagatgacttctgaatctggtgctaccgccggccgccaggaggttgataatacattttggaacggttgcggagactattaccagctctatgacaaggatgaagattcctctgaatgttctgacggtgaatggagcgcctctctcccccatcgcttctctggtacagagaaggaccagagtagctccgatgaatcgtgggagacattacccggcaaggacgagaacgaaccagagctccagtcagatagttcaggacctgaagaggagaaccaggagttatcactgcaagagggtgagcaaacatctctcgaagagggggagattccctggcttcagtacaacgaggttaatgaatcctcttcagacgagggcaacgagccagccaacgaatttgcgcagccggccttcatgctggacggaaataataacttagaagacgattcgagcgtgtctgaagacctggacgttgattggagcctctttgacggatttgctgatggccttggagtagctgaggccatctcctatgtagatcctcagttcctgacttatatggccctggaagagcgcctcgctcaggcgatggagactgccctggcacacctggagtccctcgctgtggacgttgaggtcgcaaacccccccgcatccaaggagagtattgatggcctgcctgagaccttagtgcttgaggaccacactgccattgggcaagagcagtgctgtccgatatgctgttccgagtacatcaaagatgacattgcaacagaactgccatgtcaccacttttttcacaaaccatgcgtgagcatctggctgcagaagtctgggacatgccccgtgtgtagaagacacttccctcccgcggtgatagaggcttcagcagcaccttcttccgagcctgaccccgatgctccccctagtaacgattctatcgccgaggccccgtag

SEQ ID NO: 29023 - DNA, 570 bp, Artificial Sequence
  Description of Artificial Sequence: Synthetic coding sequence
atgggagtgtctgtggatgtccatcaggtctacaaatatcccttcgagcaggttgttgccagcttcttaaggaagtacccgaatcctatggataaaaacgtgatcagtgtgaaaatcatggaggaaaaaagagatgagtctacaggagtgatctaccgtaagcggatcgctatctgtcagaatgtggtgcctgagattctcaggaaatctctgtcaaccctggtcattctttgttggaagaaggtctccatcctcaaagtgcccaatatacagttagaggaagagagttggctgaacccacgcgaacggaacatggcaattcgttcccactgcctgacttggacacagtatgcttctatgaaagaggagagcgtgtttcgcgagtctatggaaaaccccaactggacagaatttatccagcgaggacggatctccatcaccggcgtcgggtttctgaattgtgtacttgaaaccttcgcaagtacttttctgcgtcagggtgcacagaagggaatccggattatggagatgttgcttaaagaacagtgtggcgctcccttggcagagtag

SEQ ID NO: 29024 - DNA, 534 bp, Artificial Sequence
  Description of Artificial Sequence: Synthetic coding sequence
atgggagtgtctgtggatgtccatcaggtctacaaatacccattcgaacaggtcgtggcctctttccttcgcaagtatccaaatccgatggacaaaaacgtaatctccgtcaaaatcatggaagagaagcgggatgaatccaccggcgtcatatacaggaagcgcattgcaatatgtcaaaacgtggtacctgaaattttgagaaaagtttccattttgaaagtgcctaatatccaactggaggaggagtcctggctaaatccacgcgaacgcaacatggcaattaggtcccattgcctgacatggacgcagtatgcttccatgaaagaggagtcggtatttagggaatccatggagaatcctaattggacggagttcatacagagaggccgcatcagtataaccggagtgggtttcctcaattgcgtgcttgaaacatttgcttccacctttctcaggcagggggcccagaagggcattagaattatggagatgcttttgaaggagcagtgtggagcaccactggccgaatag

SEQ ID NO: 29025 - DNA, 447 bp, Artificial Sequence
  Description of Artificial Sequence: Synthetic coding sequence
atggataaaaacgtgatctccgtgaaaataatggaggaaaagcgtgacgaatcaaccggcgtcatctacaggaagcgcattgcgatttgtcagaatgtagtacccgagatcctgcgcaaggtctcgattctcaaggttccaaatatccagctggaagaagaatcttggctcaatcccagggaacggaatatggctatccggtcgcattgcctgacttggactcagtacgccagcatgaaggaggaatcggtctttagagaaagcatggaaaacccaaactggacagagttcatccaacgggggaggatttccattaccggcgtagggtttctgaattgcgtattagaaacattcgcctctacgttcctgaggcagggggctcagaaagggatcaggatcatggaaatgctgttgaaggagcagtgcggtgcgccgctggccgagtag

SEQ ID NO: 29026 - DNA, 267 bp, Artificial Sequence
  Description of Artificial Sequence: Synthetic coding sequence
atgcaccaaaagttgcttaagtcagctcattacattgaattaggaagctatcagtattggccagtgcttgttccaagaggaatcagactgtacacgtacgagcaaatacccggcagcctgaaggacaatccctatatcacagatgggtacagggcctaccttccgtctcgtttatgtattaagagaagtgtctgctttgccctgtgggcgatcatcttctttccagcgattggccagaagaagcacgtcgaagatggatggcattag

SEQ ID NO: 29027 - DNA, 876 bp, Artificial Sequence
  Description of Artificial Sequence: Synthetic coding sequence
atgcaccagaagctgttaaaatcagcacactacatcgagttaggcagttatcagtactggcctgtgctagttcctaggggcatccggctgtacacatatgaacaaattccaggatccttgaaggacaacccctacataactgacggctatcgggcttaccttcctagcagactgtgtattaagagcctctttatattgagtaacgagacagtgaacatttggtctcacttgttaggtttcttcctgttctttactttaggcatttacgacatgacctctgttttgcccagtgcatcagctagtagagaggacttcgtgatctgctccatctgtctcttttgcttccaggtttgtatgctttgttcagtcgggtatcacctgttctcatgtcaccgctctgaaaagacatgtagaaggtggatggcactcgactacgccggtatcagtatcggcatcttaggctgctacgtctccggtgtattctacgcattttactgcaataactactggcggcaggtgtacctgataaccgttcttgccatgatcctcgcagtgttttttgcacagatacatccaaattacctcactcagcagtggcagcgcctgcggagcatcatattttgctcagtgagcggttatggagtgataccgaccctgcactgggtctggctgaacgggggtatcggcgctccgattgtccaggatttcgccccccgtgtgattgttatgtacatgatcgcactgttagcattcctcttctatatttcgaaggtgcctgaacgctattttccagagaacatttttcgatggaagattacaaagcgcaccttgggcggcgtgaacaactctcttcagaacctgtaccttctggtctag

SEQ ID NO: 29028 - DNA, 936 bp, Artificial Sequence
  Description of Artificial Sequence: Synthetic coding sequence
atgcaccagaagctgttgaaatcagctcactatattgagttggggtcttatcaatactggccggttctggtgccacgcggaatccggctgtacacatacgaacaaatcccagggagcctcaaagacaacccatacatcactgatggataccgggcatatctcccgtcccgactttgtatcaagagcttattcatcctgagcaacgagaccgtgaacatatggtcacaccttttgggcttttttctgttcttcacattgggaatttatgatatgacttcggttctgccgtccgcgagtgcttcaagggaggactttgtaatttgtagtatctgcctcttttgtttccaggtatgcatgctttgctcggtgggctatcacctgttttcttgtcatagatccgaaaaaacgtgtcggcggtggatggcactggactacgctggcatttctataggaatccttggctgctacgtatcaggagtgttttatgccttctattgtaataattattggcgccaggtgtatcttattactgtgttggctatgatccttgcagttttcttcgcccaaatacacccaaactatttaacacagcagtggcagcggctccgcagcataattttctgttcagtttccgggtatggggtcattccaactttgcattgggtgtggctcaatggcggaattggtgcgcccattgtccaggactttgcccccagagtgattgtgatgtatatgatcgccctcttggctttccttttttatatctccaaagtgccagagaggtattttccgggccagctcaattatctgggatcgagtcatcagatatggcacattctcgcagtggtgatgctctactggtggcatcagtcaacggtgtacgttatgcaatatagacattcaaagccgtgccctgactacgtctcccatttatag

SEQ ID NO: 29029 - DNA, 936 bp, Artificial Sequence
  Description of Artificial Sequence: Synthetic coding sequence
atgcaccagaagctcctcaagagcgcccattacattgagcttggaagttatcaatactggccggttctggtcccaaggggtatacgactgtacacgtacgagcagattccgggtagtctcaaagataacccctacattacagacggatatcgagcgtacctgcccagtagactatgtatcaaatccctgttcatacttagtaatgaaacagtgaatatatggtcccacctgctggggttctttctgttcttcactctggggatctacgatatgacatccgttttgccgagtgcctctgccagccgagaggattttgtcatctgttctatctgtctgttctgttttcaggtctgcatgctgtgcagcgtggggtatcatctcttctcttgccacagaagcgagaaaacttgccgccggtggatggccctagactatgcaggcatcagtattggaatattaggttgctacgtctctggggttttctatgccttttattgcaacaactactggagacaagtttatctgatcaccgtcttggcgatgatactggccgttttcttcgcacaaatacacccaaattacttaacgcagcagtggcagcggctgagatctattattttttgttctgtaagtggctacggcgtcatccctactcttcattgggtgtggctcaatggaggtataggcgcaccgatcgttcaggactttgcacccagggttatcgtgatgtatatgatagcactgttggcctttctgttctatatctctaaagtgcctgagaggtatttccctggtcaactaaactatctgggtagcagtcatcagatttggcacatcttggctgttgtgatgctttactggtggcatcaatcaacagtatatgtgatgcaataccggcactccaagccatgtccggactatgtctcacatttatag

SEQ ID NO: 29030 - DNA, 600 bp, Artificial Sequence
  Description of Artificial Sequence: Synthetic coding sequence
atggcctttctggccggaccgcgtcttctggattgggcctcttctcctccacacctccaatttaacaagttcgtactaactgggtacagacccgcgagctctggatccggctgtctgcggtccctgttttacttgcataacgaactcggaaacatctacactcacggtgcactccccatcattcactgtaccctggcctgtcggccctggttgcggcccgctgcgctggttggatatacagtcctgtcaggagtggcaggatggcgggccttgactgcgcctagtacctccgctcgactgagggctttcggttggcaggccgccgcacgccttcttgtcttcggtgctcgcggagtcggattgggttcaggggcacctggctcactgccttgctatctgcggatggatgctttagcactgctgggaggactggtgaatgtcgctcgtctgccggagcgctgggggccaggtaggtttgactattggggtaacagtcatcagattatgcatctgctgtccgtgggaagtattctccaactgcacgcgggagtcgtgcccgacctactgtgggcagcacatcacgcctgtcctcgagactag

SEQ ID NO: 29031 - DNA, 822 bp, Artificial Sequence
  Description of Artificial Sequence: Synthetic coding sequence
atggcatttttggccggccctaggctgctggattgggccagttcgcctccacacctgcaattcaataagttcgtgttaacgggctatcgaccggcctctagcggctctggttgtcttcggtcattattctacctgcacaatgagctcgggaatatttatactcatggacttgctctgttgggattcctggtgcttgttcccatgaccatgccatgggggcagctgggcaaggatggatggctgggcggcacccactgtgtggcctgtctggcccctccagccgggagcgtactgtaccacctattcatgtgccatcagggcggctctgccgtgtacgcccgcctgctggccttagatatgtgcggagtatgcctcgtgaacacactgggcgccctgcccatcatccattgtacgctagcctgccgcccgtggctgagacctgctgcattggtcggatatacagtcctgtccggagtggccggctggcgtgctctgacagcaccctccacatccgcacgactcagagctttcgggtggcaagccgcagcgagactgctggttttcggagcaagaggcgtgggtctcgggtcaggagctcccggatctctgccctgttacctccggatggacgcgctcgccctgctcggcggcctggttaatgtcgccaggctcccagagcggtggggacccggccggtttgattattggggcaactcccaccagatcatgcacctgctgtcagtgggcagcatcttacagttgcacgcgggtgtcgtgcccgaccttctgtgggctgctcatcacgcatgccccagagactag

SEQ ID NO: 29032 - DNA, 1134 bp, Artificial Sequence
  Description of Artificial Sequence: Synthetic coding sequence
atgcctcgccggctgcagccccgtggcgccggaaccaagggcccacctgccccagctcccgcggccagcggtgctgctcgtaattctcactccgcagccagtcgcgatccacccgcgtcagcaaaaccactcctgcgctgggacgaggttcccgatgacttcgttgaatgcttcattcttagcggatacagaagactgccttgcaccgctcaggagtgtctggccagcgtgttgaagcccacgaacgaaactctgaacttttggacccatttcattcccctcctgcttttccttagtaagttctgcaggctgttttttctatcaggaggggatgtgccttttcatcacccttggttactgcccctttggtgttatgcctctggcgtgctccttacttttgccatgagctgcacggcccacgtgttttcctgcctgtcattacggctgagagcagctttcttctatctggattacgcaagcatatcatactacggattcggtagtaccgtggcctactactactatttacttcccggtctctctttgctggacgctagagttatgacaccctaccttcagcagcggttggggtggcatgtagattgcacccggctcattgctgcataccgggccctggtgctgccagtggccttcgtgttggctgttgcttgtacggtcgcctgctgtaaatccaggactgactggtgcacctacccttttgccctacggacattcgtgtttgtgatgcccctgagcatggcctgccccattatgcttgagtcttggctgtttgacctgaggggggaaaatcctacattatttgtgcacttttaccgtcggtatttttggcttgtcgtggccgcattcttcaacgtgagtaagatccctgaacggatacagccggggctattcgatataattggacacagccaccagttgttccacatctttacttttctctctatttatgaccaggtctactacgtcgaggagggactgcgtcagttcctccaggctccaccagcggctcccacgtttagcggcaccgtgggctacatgctactcctggtcgtatgtctggggctggtaatccgcaagtttctgaactcctccgaattttgtagtaaaaagtag

SEQ ID NO: 29033 - DNA, 993 bp, Artificial Sequence
  Description of Artificial Sequence: Synthetic coding sequence
atgctgtctcttaagttgccccggctgttcagcattgaccagatccctcaggtctttcacgaacagggcatcctattcggctataggcatccccaatcttccgctacggcttgcatactgtcactgtttcagatgaccaatgagacgcttaacatctggacacacctccttccgttttggttcttcgcttggcgcttcgttacggcattatacatgaccgacatcaagaacgactcatattcatggcccatgttggtatacatgtgtacgtcctgcgtctaccctctggtgtcatcctgcgctcacaccttttcctctatgtcaaagaatgctagacacatatgttatttccttgattatggagcggtgaatttatttagtttgggtagtgcgattgcctactcagcatataccttcccagatgccttgatgtgcacgacgtttcatgattattacgtcgcgctggcggtcttgaacaccattttatcaaccggtcttagttgttactcgaggttcctggaaatacaaaagcccaggctttgcaaggtcattcgcgtgctggcatttgcgtacccgtacacctgggatagccttccaatcttttataggttgttcctctttcccggggagtcggctcagaacgaggcaacctcctatcatcagaaacacatgattatgacactgctggcatcctttttatattccgctcacctgccagaaagactggcccccggcaggttcgattacattggacattcacaccagttatttcacgtgtgcgtaatactcgccacgcacatgcagatggaagcaattctgctcgacaagacactgaggaaagagtggctgctggccacctcaaaacctttcagcttttcccagatcgctggcgctattctcttgtgcatcatcttcagcctctccaatataatttacttctctgccgctctgtacagaattccaaagcccgagttgcataagaaagagacatag

SEQ ID NO: 29034 - DNA, 993 bp, Artificial Sequence
  Description of Artificial Sequence: Synthetic coding sequence
atgctttccctgaagcttccacgattgttttcaatcgatcagattcctcaggtgtttcatgagcagggaatcctatttggctatagacaccctcagtcatctgcaaccgcctgcatattgagtctgtttcagatgactaacgagactcttaacatctggacacacctgttgcccttctggttcttcgcttggagattcgtcacggccctgtacatgacggatattaagaacgactcgtactcttggcctatgcttgtctacatgtgcacctcttgcgtgtatcccctggtgagttcatgtgcccatacattttcatctatgagcaagaatgctcggcacatttgttatttcttagactatggcgccgttaatctgttttctctaggctctgccatcgcatatagtgcatatacatttcccgatgctctcatgtgcacaaccttccacgactattacgtcgcactcgccgtcctgaacaccatcttatccaccggactgtcatgctattcacggttcctagagattcagaaacctagactctgcaaggtgatcagagtacttgcgtttgcttacccgtacacgtgggactccttgcctatcttttaccgcctgttcctgtttccaggagagagtgcacagaacgaggctacctcctaccaccagaagcatatgatcatgacgctgttggccagtttcctctattccgcccacctaccagaaagattggcgccgggccgatttgattatatcggacactcacatcaactcttccacgtgtgcgtcatcttagccacacacatgcagatggaggccatcctgcttgataaaactctgcgtaaggaatggttgctggccacatctaaacccttttctttttcacagatagcaggcgctattctcctgtgcataatctttagcctgtccaacatcatctactttagcgcggccttgtataggatacctaaaccggagttgcacaaaaaagaaacctag

SEQ ID NO: 29035 - DNA, 993 bp, Artificial Sequence
  Description of Artificial Sequence: Synthetic coding sequence
atgctgtccttaaagctgcctcggctattttctattgatcagatcccccaggtgttccacgagcaaggaattctgtttggataccggcatccccagtctagtgcaacagcctgtattctgtcactgtttcagatgacaaatgagacgctgaatatttggacccatctgttgcctttctggttttttgcctggaggttcgtcacagccctgtacatgaccgacattaaaaatgatagctacagttggcctatgctggtctacatgtgtactagctgcgtctacccgctagtgtcctcctgtgcgcacacgtttagtagtatgagcaagaatgccaggcacatttgctacttcctcgattacggagccgtaaaccttttttctctgggatccgcaatcgcctacagcgcctataccttcccagatgctctgatgtgtacaacgtttcatgattactatgtggccttggccgtgctcaataccatcctatccacgggcctttcctgttacagccgtttcctcgagatacagaaaccgagactgtgtaaggtcataagagtgctggcttttgcttatccatatacatgggactccctccctattttctacagactctttctcttcccaggggagtcagcccaaaacgaggccaccagttaccatcagaaacacatgatcatgacgcttttggcatcctttttatatagcgcgcatctgccagagagactggcacccggcagattcgactacataggccacagccatcagctcttccatgtatgcgtaattcttgctactcatatgcagatggaggctatcttgctcgataagacactgcgcaaggagtggctccttgcgacatctaagccattctccttttcacagatcgctggggcaattctcctttgcattatttttagcctgagcaatattatttacttctcagctgcactctatcggatcccaaagcccgaattacataagaaggagacttag

SEQ ID NO: 29036 - DNA, 1035 bp, Artificial Sequence
  Description of Artificial Sequence: Synthetic coding sequence
atgctgtcattgaaactgcctcagttactccaggtgcaccaggtgccccgcgttttctgggaggacgggattatgagcggataccgccgccccacctcctctgcgctggactgtgttctatcatccttccagatgaccaatgagacggtcaatatttggacccacttcctgcccacatggtatttcctctggaggctgttggccctcgctgggggcccaggtttcagggcagaaccatatcattggcccttgcttgtgttcctcctccccgcttgtctgtaccctttcgcttcctgctgtgcacatacgttctctagtatgagccccagaatgagacatatttgttacttcctcgattatggcgcgctcagcctttactctctggggtgcgctttcccttacgcagcgtacagcatgcccgcttcctggcttcacggacatcttcaccagttcttcgtaccagctgccgctttgaattcgtttctgtgtaccggcctgtcctgttacagtagatttctagaacttgagtccccgggcctgtccaaggtgctcagaaccggcgcctttgcgtatcccttccttttcgacaacttaccactcttttatcggctcggcctttgttgggggcgcggacacggctgcgggcaagaggctctctctaccagccatggataccatctgttctgtgctctccttactggattcctcttcgccagccatctgcccgagaggttggcacccggtagattcgactacatcggccactctcatcagctgtttcatatttgtgctgtcctggggacccatttccagctcgaagcagtactcgccgacatgggtagtagacgcgcctggctggctacccaagagcctgcactgggattggcagggaccgtggctacacttgtgctggccgccgcggggaacctactcatcattgctgcatttactgccaccctgctccgtgccccctcaacctgcccgctcctgcaagggggacccctcgagggtggaacgcaggctaagcagcaatag

SEQ ID NO: 29037 - DNA, 1056 bp, Artificial Sequence
  Description of Artificial Sequence: Synthetic coding sequence
atgtctccacgcatgaggcacatttgctatttcctagattacggtgctctgtctctctacagtttggggtgcgccttcccgtacgcagcttactcaatgccagctagctggcttcatggacacctgcatcagttctttgtccctgccgctgcactgaactcattcctctgcaccggcctatcctgctattctcgcttccttgagctggaatccccaggtctgtctaaggtgcttcgcaccggcgcctttgcttacccctttctctttgataatctcccactcttctatagattaggtctctgctggggcagaggccacggatgtggccaggaagccctgtcgacctctcacggctatcacctcttttgcgctcttttgacaggtttcctgttcgcgtcccatctgccagagcggttagctcccggccgctttgattacattggggagggcactcctgggcctgcacgcgaagaggccggcgcggatgcattccctgagcatcgaatgaattgggctacggccacgagctactcaacgtcagtacagtgttgggcacctacctcttcttggagacagtgttggcttatctgggatcacgctgaacctggatggccccatagaaatttaccttgggcctggcaagctcaatggccgcattggagctggctgcagctcggaacctactccctactcctccttagccagcctccctgctttggaccgccagtgcacgcgctctgctgtagagtcgcccactggcgcggcgtgccacggcctaataatagcgaggctcccagtctgaccttgtcgtggagggggcagcggcctggcccctctgctgacgaggagccccgttttggacctaaccaggtcggaactcacctctccctggaacccactggtgccgaagagcggggccaccggcgtgaagggcgggaggaggaaggctgcctgggtggacttgctgagtgcgaaagggatcgcgagggcgcactggatgggtctggccgctccgcggaaggccttagaggagagatgcacgcctgccctggctag

SEQ ID NO: 29038 - DNA, 1092 bp, Artificial Sequence
  Description of Artificial Sequence: Synthetic coding sequence
actttgcccccttccgcttggctcgccgcagcgttagacagcgctcgcggcgctttagggctactcacacatcagctgcgaagcacacaccaggctctcggagtgctaggcagatggcaccacgtgtggctgccaccccctcaccagttagggtttggcctgtgtccacaactgctaccggacgatcagagggatggacagcatttagactccctcccagcacacctcgtccgtggcggatccgcccccggccggggtctcgagttaaggggcgggactcaggccgggagggacaggcccggccctcgggctgctgccgctgtggcaggggtgcgcgggggcttatcaacccggccacctcaagtcctccctgtcgcagccccgggtgctgggggacggccccgtcttccctgcggggctgttccattagcagcagccggactacccgcagcacgactgccactccctctccgcgtagtactgcgagcacacctccaactccatgtggccccccatgccccacacctactgctcccacgactcaggagggcacagccactgcagtccggttttctggagcttgaaagccctggattgagtaaggtgttgcggacgggcgcattcgcctacccattcttgtttgacaacctgccactgttttaccgactggggctgtgttggggccgaggacacggctgcggacaggaggcccttagcacttcccatgggtaccatctgttctgtgcactcttgaccggctttctctttgcatctcaccttccagaaaggcttgcacccggacgatttgactacattgggcacagccaccagctctttcacatctgcgctgtgctgggcacgcactttcagcttgaggcagtgctagcagacatgggaagtaggagagcctggctggctacacaggagcctgccctcgggttggcaggtaccgtggccacacttgtcttggctgctgccggcaatcttctgattatagccgcttttaccgctacactgctccgagctccgtcaacctgccccctcctccaaggggggcctctcgaggggggaactcaggcaaagcagcagtag

SEQ ID NO: 29039 - DNA, 1056 bp, Artificial Sequence
  Description of Artificial Sequence: Synthetic coding sequence
atgagccctcgcatgcggcacatctgttacttcctggactatggcgcgttgtccctttactctctggggtgcgcctttccatatgctgcttactccatgccggctagctggttacatgggcatcttcatcagttcttcgtgcccgccgcggccctgaactcatttctctgtactggcctcagctgttactcccgcttcctggaactggagtcacccggcttgagcaaggtgctgcgcaccggcgccttcgcatacccgttcttgttcgacaatttacctctattttacagattgggtctttgctggggtcggggacatggttgcgggcaagaagccctgagcacaagtcacggctatcatctcttctgtgccctcctgactggatttttgtttgcctcacacctgccagagcgtctggcccctgggcggtttgattacattggtgagggcactcctggacccgccagggaagaggccggcgcggatgccttccccgagcatcggatgaactgggcaaccgccactagttattccaccagtgtacagtgttgggcccccacctccagctggaggcaatgctggctcatctgggaccatgcggagcccggatggccgcacaggaacctcccatgggcatggcaggctcaatggccccactggtcctggctgcagcttggtacatacagcctcctgctattgtctcaacctccttgcttcggccccccagtgcacgccttgtgctgtagggtggcccactggagaggagtcccacggcccaataactcagaggctccaagcctaactttgagttggagaggccagcgtcctggaccctcggccgatgaagagccgcgtttcggccccaatcaggtgggcacacatttgagtctggaaccaaccggagccgaagaaagaggccatagaagggaagggagggaggaggaaggatgtctgggagggctggccgaatgcgagagggatagggaaggcgcactggacggctccggaaggagcgcagaagggctaagaggagaaatgcatgcatgcccaggctag

SEQ ID NO: 29040 - DNA, 1056 bp, Artificial Sequence
  Description of Artificial Sequence: Synthetic coding sequence
atgtccccccgcatgaggcatatctgttatttcttggattatggggctctttctctttactcgctcggctgcgctttcccttatgcagcgtactctatgcctgcttcttggctgcacggacacttgcatcagttcttcgtgcctgccgccgccctaaatagttttctgtgtacggggctctcatgctattccagatttctcgagctggagtctccaggcctgtctaaggtccttcggaccggggctttcgcttatcccttcctgtttgataaccttcccctgttttaccgtctcggtttgtgctgggggagggggcatggttgtggccaggaagccctatctacttctcacggttaccacctgttctgtgcacttctcacaggctttctcttcgcatctcatctccctgagaggctggccccaggaagatttgactatattggggaaggaacccccggccctgcacgcgaggaggctggcgccgatgctttcccagaacatcgtatgaactgggctacggcaacttcgtacagcacaagcgtccagtgctgggcgcccacttcctcgtggaggcagtgttggctcatctgggatcacgcagaacctggttggccccataggaatttgccttgggcatggcaggctcaatggcctcattggtcctggttgcagctaggaacctacagcctgcttttactcagtcagccgccctgtttcggcccgcccgtgcacgctctttgttgccgcgtggcacattggcgcggagtcccacggcccaacaacagcgaggctccgtcactgactttatcctggcgtggacagagacccgggccctcggctgacgaagagccaagattcgggcccaatcaggtgggcacacacctttctctggaacctacaggtgccgaagagcgtggacaccggcgggaaggacgggaagaagagggttgtttaggagggctggcagaatgcgaacgagaccgggagggggcacttgatggctctgggaggtctgccgaggggctgcggggggaaatgcatgcttgccccgggtag

SEQ ID NO: 29041 - DNA, 963 bp, Artificial Sequence
  Description of Artificial Sequence: Synthetic coding sequence
atgagcggttacagacggcccacttccagcgccctggactgtgtactctcatcattccagatgacaaacgagactgtgaatatctggacccactttcttccaacatggtatttcctttggcgtttattggctttagcgggcggcccaggcttcagggctgaaccctaccactggccactcctggtcttcctgttgcctgcatgcctgtacccctttgcgagctgctgcgctcacaccttctcttcgatgtctcctcgcatgcggcacatttgctactttcttgattacggggccctttcactctacagcttaggatgtgcatttccgtacgccgcctacagcatgcccgcctcttggctgcacggtcacctgcaccaattttttgtgcccgcagccgcgctgaatagttttctgtgcactggcctatcctgttacagcagattcctggaactagagagccccggcctgagcaaggtgctgaggacaggggctttcgcgtacccttttctcttcgacaatctcccgctcttctatcgcttgggactctgttggggaaggggccatggctgcgggcaagaggccctttcaacttctcatggctaccatttgttctgtgcactcctcaccgggttcttattcgcttcccacctgcccgagaggctggcaccaggtcgcttcgattacattgggcatagtcaccagctatttcatatttgcgcagtactgggcacccacttccagctggaggcagttctcgctgatatgggaagccgaagagcctggttggccacccaggaaccagctctgggcttagccggcactgtggcaacgctcgtgctggccgccgccgggaaccttctgatcattgccgcctttacggctaccctcctgagagcgccctcgacatgtccactcctccagggcggacccctggagggagggacccaagcgaagcaacagtag

SEQ ID NO: 29042 - DNA, 381 bp, Artificial Sequence
  Description of Artificial Sequence: Synthetic coding sequence
ctgcctctccccttgcgggtggttctgcgcgcccatctgcagctgcatgtggccccccatgctccccacctgcttctgccccgactaaggcggttcgactacatcggacactcacatcagcttttccacatttgcgcggtgcttgggacccacttccagctggaggcggtgctggccgacatgggctcaaggagggcttggctggcaactcaggaaccggccctggggttggctggaaccgtggctacgctggtgctggcagccgccggaaatctgctgattatcgccgctttcactgccacactcctgcgtgctccgtcaacctgtccacttctccaaggcggtcccctggaggggggaacacaagccaaacagcagtag

SEQ ID NO: 29043 - DNA, 1026 bp, Artificial Sequence
  Description of Artificial Sequence: Synthetic coding sequence
atgttatccctgaagctcccccagctactgcaggtgcatcaagttttctgggaggatggaatcatgtctggataccgcagaccaacgagcagtgctcttgattgcgttctatccagctttcagatgacaaatgaaaccgtgaatatttggactcatttcttacccacatggtattttctgtggaggctgctcgccctagccggcgggccaggcttccgcgcggagccctaccactggccactgctggtgttccttctgcctgcctgcctgtacccattcgctagctgctgtgcacacactttttccagtatgtccccaaggatgaggcacatttgctacttcctagattatggagccctgagcttgtatagtttaggatgtgcctttccttatgcagcctactctatgcccgccagctggctgcatggacatttacaccaattctttgtgccggccgcagccctcaatagtttcctttgcacaggcctaagctgttatagtcggttcctggagcttgagagcccaggacttagtaaggtgctgaggactggcgcattcgcgtacccatttctgttcgacaatctgcctctcttctaccggcttgggttgtgctgggggcgcggacacggttgcgggcaggaggcattatctacttctcatggttatcacttattttgtgctctgctaactgggtttctgttcgccagccatctcccggagcgcctcgccccgggcagattcgactatattgggcactctcatcagctattccatatctgtgcggtgttgggcactcacttccagctagaggctgttctcgcagacatgggctctcgccgcgcctggttggcaactcaagaacctgcactcggccttgccggcacagtggccacactcgtactggcagctgccggaaatctcctcataatcgcggcatttaccgctaccctgctgagagctcccagtacatgtccgctactccagggagggccgcttgagggcgggacccaggcgaagcagcaatag

SEQ ID NO: 29044 - DNA, 1065 bp, Artificial Sequence
  Description of Artificial Sequence: Synthetic coding sequence
atgaccaccgctattctcgaacggctgtcaaccttaagcgtgagcggtcaacagttacgaagactgcctaaaattctagaagacggcctaccaaaaatgccgtgtaccgtgcccgagaccgacgtcccccaactgttcagagagccttatattagaacaggataccgtcccaccgggcacgaatggcgctactacttctttagtctgttccaaaagcacaacgaggtcgtgaacgtctggactcacttgttagcggccctcgccgtcctgctgaggttttgggcctttgccgaagccgaagccttgccctgggcctctacacactcactgccattgctgctgtttattctgagctccattacctatctgacatgctcactactggcccatctactgcaatccaaatctgagctttcacactacacgttctatttcgtagattacgtcggtgtctctgtttaccaatacggttcagccctggcccacttcttctatagctccgatcaggcatggtatgatagattctggcttttcttcctcccagcagctgcattttgcggctggctgagctgtgctggttgttgctatgccaagtaccggtatcgtcggccttatcctgtgatgaggaaaatctgtcaagttgtgccggctggactagctttcattctggacattagccccgtggcccaccgtgttgcactgtgccacctcgccggttgtcaagagcaggcggcgtggtatcacacactgcagattctctttttcctcgtgagcgcatatttcttctcctgtcccgtcccggagaaatacttccctgggagttgtgatatcgttggccacggtcaccagatctttcacgccttcctaagtatctgtacattatcacagctcgaggctatcctgctggactatcagggtagacaggaaatctttctgcagcgacacggcccactatctgtccatatggcatgtctgtctttcttctttttagccgcctgcagcgccgctaccgctgcgcttttaaggcataaggtgaaggcccgactcaccaagaaggatagctag

SEQ ID NO: 29045 - DNA, 1065 bp, Artificial Sequence
  Description of Artificial Sequence: Synthetic coding sequence
atgaccacagcaatcctggaacgcctgtccacgttatctgtctcagggcaacagctgagaagattgccaaagattttagaggatgggctcccaaagatgccttgcaccgttccagaaaccgatgttccccagttgttcagggagccctacatccgcactggttaccggcctaccggacatgagtggagatactattttttttcactgttccagaagcacaacgaagtcgttaacgtgtggacacaccttctagcggctctggccgttctgcttcgattctgggcgttcgctgaggctgaagcactcccttgggcttctacccatagtctgccccttcttctgttcatcctcagttctatcacatacctaacctgtagcctgttagctcatctgcttcagagtaaatccgagctgtcccactataccttctacttcgtggattatgtgggggtgagtgtctaccagtatggaagcgccctggctcattttttctactcctccgaccaagcatggtacgacagattctggctctttttcctgccggctgctgccttttgtggctggctctcttgtgccggttgttgctacgccaaatatcggtatcgacgaccctatccagtgatgcgtaagatttgccaggtcgtgcccgctggattggccttcatactcgatatttctccagtcgcccacagagtggcgctgtgccatctggccggctgccaggagcaggccgcatggtaccataccctgcagattctgttcttcctggtctcagcttacttcttctcatgcccagtgcctgagaagtacttccctggcagttgtgacatcgtcggccatggacaccagatattccacgctttcctgagcatctgtaccctgtcccagctggaagccatcctcctcgactaccaggggagacaggagatctttcttcagcgtcatgggcccctatccgtccacatggcctgtctgtcattttttttcttggccgcttgtagcgctgctactgcagcactcctgagacataaagtcaaagcacgtctgacgaaaaaagattcttag

SEQ ID NO: 29046 - DNA, 339 bp, Artificial Sequence
  Description of Artificial Sequence: Synthetic coding sequence
atgactactgccatattagagcgcctgagcaccctatccgtcagcggccagcagctgcgtagattgccaaaaatcctggaggacgggcttccaaaaatgccttgtacagtgccagaaacggacgtgccacagttattcagagaaccttacatccgaaccggttacagaccaacgggccatgagtggcggtactatttcttttctctgttccagaagcacaacgaagtcgttaacgtctggacccaccttctcgccgccttagccgtgctgcttagattctgggccttcgccgaagcagaggccctcccttgggcgagcacccactcactgccattgtag

SEQ ID NO: 29047 - DNA, 576 bp, Artificial Sequence
  Description of Artificial Sequence: Synthetic coding sequence
atggctgcttactcttaccggcccggccctggagccggcccaggacctgcagcaggagctgcacttccagaccagtccttcctgtggaatgtattccaaagggttgacaaagatcggtctggtgtaatcagtgatactgaactacagcaggcactttctaatggcacatggacacctttcaacccggtgacggtgcggtctattatcagcatgttcgacagggagaacaaggccggcgtcaactttagtgagtttaccggagtgtggaagtacatcaccgattggcagaacgtgtttagaacctatgatcgcgataacagtgggatgattgataagaatgaactgaaacaagccctcagtggattcggatatcgactgtctgatcagtttcatgatatccttatcaggaagtttgaccggcagggaaggggtcaaatcgcgttcgacgatttcatacagggatgcattgtgctccagagactcacagatatcttcaggagatatgatactgatcaggacggttggattcaggtctcttacgagcagtacttgtctatggtcttctccatcgtgtag

SEQ ID NO: 29048 - DNA, 210 bp, Artificial Sequence
  Description of Artificial Sequence: Synthetic coding sequence
atggctgcatattcctatcgaccaggacctggggccggacccgggcctgctgccggcgcagcgctgcctgaccaatcttttctttggaatgtcttccagcgagtggacaaagacagaagtggggtcattagcgatacagagctgcaacaggctctttcaaatggaacttggactccctttaatccggtcacggtgcgcagtatcatatag

SEQ ID NO: 29049 - DNA, 222 bp, Artificial Sequence
  Description of Artificial Sequence: Synthetic coding sequence
atggccgcctacagctaccgacctggtcctggcgccggtccgggccccgcggcaggagctgctctgccagaccagtctttcctatggaacgtctttcagagagtcgataaagaccgctccggggtcatctctgatacagaattgcagcaggcactctcaaatgggacctggacccccttcaacccagtgacggtccggagcatcatctgtcgagggcgatag

SEQ ID NO: 29050 - DNA, 570 bp, Artificial Sequence
  Description of Artificial Sequence: Synthetic coding sequence
atggccgcatactcatacaggcccggtcccggagcgggccctggcccggcagccggagcagctctgcccgaccaatcattcttgtggaacgtattccagagggtggacaaagacagatctggcgttatttctgatacagaactgcagcaggccttgagtaatggtacatggacgccatttaaccctgtgacagtgcgcagcatcatttcaatgttcgaccgggagaacaaggccggtgtgaatttcagtgagtttactggagtatggaagtatatcaccgattggcagaacgtgttcaggacctatgaccgagataattcgggaatgatcgataagaatgagctgaagcaagccctttctggttaccggttgtccgaccagtttcacgacatcctgatcaggaaattcgataggcagggcagaggccagattgcgtttgacgactttatccaggggtgtattgtactgcagcggctgacagacatcttcagacgctacgataccgatcaggacggctggatccaggtgagttacgagcagtatctgagcatggtgttctcaattgtctag

SEQ ID NO: 29051 - DNA, 168 bp, Artificial Sequence
  Description of Artificial Sequence: Synthetic coding sequence
atggcggcctacagttaccgaccggggcctggcgccggtcccggaccagctgccggcgccgctctccctgatcagtctttcctctggaacgtgttccagcgtgtcgacaaagacaggtcgggggtgatcagcgatacggagctgcagcaggctttatcaaatgggtag

SEQ ID NO: 29052 - DNA, 1182 bp, Artificial Sequence
  Description of Artificial Sequence: Synthetic coding sequence
atggagacaaccatgggatttatggatgacaatgccacgaataccagtacaagctttctttccgtgctgaatccgcacggagctcacgcaacttcatttccattcaattttagctacagcgactatgatatgcccctggatgaagatgaagacgttaccaattccagaacatttttcgccgctaaaatcgtaattggtatggctctggtgggaatcatgttggtttgcggtatcggaaatttcatcttcatagctgcactcgtgaggtataagaaactccggaatttgacaaatttgcttattgccaacttagccatttccgatttcctggtggccattgtgtgctgccctttcgagatggactactacgtagtaagacaactctcttgggagcacggacacgtgctctgtacatccgtgaattatctacgaaccgtctccctatacgtctcgactaatgctctcctcgctatagcaatagataggtacctcgcgattgttcacccacttcgcccgcgaatgaaatgccaaacggcgacgggactgatcgctctggtgtggactgtgtccattctcatcgctattcccagcgcttactttacaacagaaacggtattagtcatcgtcaaaagccaagaaaagatattttgtggacaaatctggccagtggaccaacagctctattacaagagctattttctcttcattttcggcatcgagtttgtgggcccagtggtgacaatgactttgtgttatgcccgcatcagtcgcgagctctggtttaaggccgtgcctgggttccagactgagcagatccgaaagcggcttcgatgtaggcgcaaaactgtgcttgttctcatgtgcatcctcactgcatacgtgttatgctgggctcctttctacgggttcacgatcgttagagacttcttcccaacagtgttcgttaaggagaagcattatctgacagccttctacattgtcgagtgtattgcaatgagcaatagtatgatcaatacactttgttttgtgactgtgaaaaatgacaccgttaagtactttaaaaagatcatgctgctgcactggaaggcttcctacaacggtggtaaatcgtcagctgacctggacttgaagaccattgggatgccagccacggaggaagtggattgtatcagactgaaatag

SEQ ID NO: 29053 - DNA, 1182 bp, Artificial Sequence
  Description of Artificial Sequence: Synthetic coding sequence
atggaaacaactatggggttcatggatgataacgcaacaaataccagcacgtcttttttaagcgtcctgaaccctcacggggcacatgccactagttttccattcaactttagctacagtgactatgatatgccacttgacgaagatgaagacgtcacgaactccaggaccttttttgccgctaagatcgtgattggcatggcactcgtgggcattatgctggtttgcggaatcgggaacttcatttttatcgcagccctggtgcggtacaagaaactgaggaatctcactaatctgctgatcgctaaccttgccatctcagattttctcgtagccattgtgtgttgtccctttgaaatggattactatgtcgtgagacagttgtcatgggagcatggccatgttttgtgtacatccgtcaattacttgcggaccgtctccctgtatgtctcaacaaatgctctgctggcaatcgccatcgataggtatttggccattgtccatcccctgcgtccaagaatgaagtgtcagaccgctaccggactgattgcgctggtgtggactgtgagcatcctaatcgccataccttcagcctatttcaccaccgaaacagtcctggtcatagtgaaaagtcaggaaaaaatcttctgcgggcagatctggcccgtggatcagcagctctattataaatcctattttctatttatttttggaatcgagttcgtaggacccgtggtcaccatgaccctctgttacgccagaatcagcagagaactctggtttaaagctgtgccgggcttccagaccgagcagattcggaagagactgcgctgtagacgcaagactgtgctcgtgttgatgtgtattctgaccgcctacgttctgtgttgggcacctttctacggattcacaatagtgcgggattttttcccgaccgtgtttgtgaaagagaaacattacctgaccgcgttctacatcgtggagtgcattgcaatgtccaactccatgatcaacacgctctgtttcgtgacagtcaagaatgacactgtgaagtatttcaagaagattatgttactgcactggaaggcctcttataatggcgggaagtcctccgccgatctggatctgaagaccatcggtatgcccgcaactgaagaagtggattgtattagactgaagtag

SEQ ID NO: 29054 - DNA, 1113 bp, Artificial Sequence
  Description of Artificial Sequence: Synthetic coding sequence
atggctagttccaccactagaggaccccgtgtgtcagatctcttctcagggttaccaccggcagttaccacccctgccaaccagtccgcagaggcgtcagcaggcaatggatcagtggctggagctgacgcccctgcagttactccttttcaaagcctccagctcgtacatcagcttaaaggcctcatcgtgctgttgtactcagtggtcgtggtcgtcggactggtgggtaattgtctcctcgtcctggtgatagctcgagtgagaagacttcacaacgtcaccaattttctaatcgggaatctggcactctcggacgtcctgatgtgtacagcctgcgtgcccctcacgcttgcatacgctttcgagccacggggctgggtctttggaggtggtctgtgtcatctggtttttttcctccagcccgtcacagtgtacgttagcgtgtttacactcactacgattgcagtggatagatatgtggttctggttcaccccctaaggcgtcgaatatctcttcgcctctctgcctacgctgttttagccatctgggccctcagtgcagtcctggctctgccagccgcagtgcacacatatcacgtcgaacttaagccccatgacgtgcgcctgtgcgaagaattttgggggtcacaggaacggcagaggcagctatacgcctggggacttcttttagtgacgtacttgctgcccctcctcgttattctgctcagttacgtccgagtttccgttaagcttcgcaaccgagtggtgccaggttgcgtcacacagagccaggctgattgggatcgcgccagacggcggcgaacattctgcctgttagttgtgatcgtcgttgtatttgctgtctgttggttacctcttcacgtattcaatctgctccgagacttagatccacacgcgattgatccctacgccttcggcctggtgcagctgctgtgccactggctggccatgagctcagcctgctacaacccatttatctacgcatggctgcacgactcgttccgggaagagctgcgcaagctgctggttgcgtggccgagaaagattgcaccgcacggtcagaacatgactgtctcagtggttatttag

SEQ ID NO: 29055 - DNA, 1113 bp, Artificial Sequence
  Description of Artificial Sequence: Synthetic coding sequence
atggcctcgtcaaccaccagagggccaagagtgtccgatctgttttcagggctgccacccgcggtcacgacccctgcgaatcagtctgccgaggcttcggctggtaacggatcagttgctggggcagatgcccctgctgtgacccctttccagagccttcagttagtgcaccaactgaaaggtctgatcgtcctgctctactccgtggtcgtggtggtgggcctggtcggcaattgtcttcttgtccttgtgattgcccgggttagaagactccataatgtcaccaatttcctcattggtaatctggctctgagcgacgttctgatgtgcacggcctgcgtgcccctgactctggcgtacgccttcgaaccgcggggctgggtcttcggagggggtctctgtcacttggtctttttcctccagccagtgactgtctacgtgtcagtgttcactctgaccactatcgcggtcgatcggtatgtagtcctggtgcatcctttaaggcgacgcatcagtttgcggttatctgcctatgctgtgttggccatctgggccctctcagccgtgctagcgcttcccgcagccgtgcatacataccacgtcgagctgaaacctcacgacgtgcgcttgtgcgaggagttctggggatcccaggagagacaaaggcaactgtatgcgtggggcttactgttggttacatacttgctcccactactggtcatactgctgagctacgtccgggtatcagtgaaactgcgtaacagagttgtccctggctgtgtgacacaaagccaggcagattgggacagagcccgccggcgccggaccttttgcctcttagttgtgatagtcgtggtctttgccgtgtgttggcttccactgcacgtgttcaatctacttagagatctcgatcctcatgctattgacccatacgcctttggcctggtgcagcttctttgccattggttggcaatgtccagtgcctgctacaacccctttatttacgcttggctgcatgacagctttcgcgaagaattgagaaaactgcttgtggcctggccccgtaagattgcaccccatggacagaacatgacagtttccgtggtcatctag

SEQ ID NO: 29056 - DNA, 888 bp, Artificial Sequence
  Description of Artificial Sequence: Synthetic coding sequence
atgcccttcccgcccatgcctccccccccagcccctgcgcctggcgctcaggcagccagacaactccccaggcgcccttgcgcagccggggacaagaagaaaaggccgccccagcgccccgaaggattattgagctccagctggccatcagctaccttaaagaggcctccagcccggaggggacccggcctggaccgtactcagccaccagcaccacccggggttagcccgcaggcattgccgagccgggccagggcaccagccacctgtgcacccccaagacctgcagggagtggacacagccccgcacgcacgacgtacgccgccaccagtgctggtactggcactactgccgcaggaacatcaagcggggctggtccatgccctgacagtgccgcccgtttttgtctgaacctgactcccgaggcagtgctggtgatacagaaacgccatctggaaaagcagctgctggcacggcccagacgccccttcccgtccccttctgccgagcctagaagattgctggctccctgcctgcccgctcgggcagccggacctagaagaggcggccccgcgtctgatcctgatgcacctcccaccgccggtcagggacgccgggctcctccgccgggagcccagctgctccacggcgggctccaggtgccgcagctgtcccccagacccggggcattgagacccatgttaaaagtttcactgctaaacgagcgtcacagatacgacgatgtggaatacgaggaggagccagaggcagtggatgaagggctcgtgaggaagtgtaccgagtggctacgaggcgtcgagagcgccgcagccgcccgcggtagagcaggcgcgcttgattcacgacgccacttaagcacactgtag

SEQ ID NO: 29057 - DNA, 354 bp, Artificial Sequence
  Description of Artificial Sequence: Synthetic coding sequence
atgccattcccacctatgccacccccaccagcaccggcgcctggcgcccaggctgcacgtcagctgcccagaaggccttgcgccgccggggataagaagaagaggccgccacagcgaccagaagggctgcttagctcctcatggccctcagcaactctcaagcgacctccagcccgaagaggccccggtcttgaccgtacccagcctcctgctccgcctggggtcagcccacaggccttgccctctcgggctcgggcacccgccacctgcgcgcctcctcgccccgctggatctggccactcaccagcacgtacaacatatgctgctacatccgccgggacaggaaccacttag

SEQ ID NO: 29058 - DNA, 888 bp, Artificial Sequence
  Description of Artificial Sequence: Synthetic coding sequence
atgtcaagtcccgttttgtccgacctcccccgatttcaggccgcccgtcaggcactgcagctctctagttcttccgcctggaactctgtgcagaccgcggtgatcaacgtctttaaaggaggcggacttcagagtaatgagctctacgccctcaatgaaaatatacggcgactgctgaagtccgagttggggtcatttatcacagattactttcaaaaccaactgttagcaaagggtctgttcttcgtggaggagaaaattaagctttgcgaaggcgaaaatcgcatcgaggttctagccgaggtatgggaccactttttcacagagaccttacctacattgcaggccatcttttatcccgtacaatctgtacacgagcctaccggcccctctgaatcatacttgcagcttgaggagcttgtaaagcaggtagtgtcgccattcctgggcatcagtggcgatagaagtttttcgggccccacctataccctggcaaggaggcacagcagagtccgcccaaaagtaaccgtgctgaattatgccagccccatcacggccgtgtcccgaccattgaacgagatggtactcactccgctcacggaacaggaaggagaagcctatttggaaaaatgtggttctgtgcgaaggcataccgttgcaaacgcccattctgacattcagcttttggcaatggcgaccatgatgcactctggcctcggagaagaggctagctcagagaacaagtgtctcctgttaccaccttcgttcccaccaccacacagacagtgcagtagcgaacctaatatcacggataacccggacggtctggaggaaggtgctcgtggtagccaagaggggtctgagctgaactgcgccagtctgagctag

SEQ ID NO: 29059 - DNA, 1107 bp, Artificial Sequence
  Description of Artificial Sequence: Synthetic coding sequence
atgacgagagggttcgctcccatactcccggttgagttccacaagatgggaagcttcagaagacccaggccgcggttcatgtctagcccggtgctgtcagatctacctaggttccaggcggcaaggcaagctcttcagctcagttcatcctcagcttggaactccgtgcaaaccgcagtcattaacgtgttcaaaggcgggggcctccagtcaaacgagctctatgccctgaatgaaaacattaggcgcctgctcaagagcgaacttggctcctttattacagattattttcagaatcaattgctcgccaaaggtctattttttgtggaggaaaagatcaaactctgtgagggcgaaaaccgcattgaggtcctcgccgaggtgtgggaccatttcttcactgagaccctgccgacactgcaggctatcttttacccagtacagggacaggaactgaccatccggcagattagcctgctgggatttcgggacctcgttctcctcaaggtgaaattgggagacctgctcctactggcgcagagcaagctgccaagcagcattgtacagatgctgctcatcctgcagagcgtgcatgagccaactggtccaagcgaatcatatctgcaacttgaggagctggtcaagcaggtggtttcacccttccttgggatcagcggcgacagatcattttctggacccacctacaccctggcaaggaggcacagccgtgtcagaccgaaggtcaccgttctcaattatgccagccctatcaccgccgtgagccggcccttaaatgaaatggtcctgacacccctgactgagcaggagggcgaggcctacctggagaagtgcgggtcagtgcgccgccataccgtcgcaaacgcacactctgatattcaactactggccatggctacgatgatgcactccggcttaggggaggaggcctcttcagagaataaatgtctgcttctcccccctagcttcccacctccccacaggcaatgttcttctgaaccgaacattaccgataaccccgatgggctggaggagggagcgagaggttcacaagaaggaagtgaacttaactgcgctagtctttcttag

SEQ ID NO: 29060 - DNA, 147 bp, Artificial Sequence
  Description of Artificial Sequence: Synthetic coding sequence
atgacacggggcttcgccccaatactcccagtagaatttcataaaatgggatctttcaggaggcctcggccccgcttcatgagcagtccggttctgagcgatctgccacgtttccaagcggccagacaggcccttcaactcagttag

SEQ ID NO: 29061 - DNA, 243 bp, Artificial Sequence
  Description of Artificial Sequence: Synthetic coding sequence
atgacaagaggctttgctccgattctgccggtcgaattccacaaaatggggtcctttagacggccccggccccgttttatgtcctctcccgtcctgtctgacttaccgcggtttcaggcagctagacaggccctacaactgagctcaagcagtgcatggaacagcgtgcaaactgccgtgataaacgtgttcaagggtgggggactccaatctaacgaactttacgccctgaacgagaattag

SEQ ID NO: 29062 - DNA, 192 bp, Artificial Sequence
  Description of Artificial Sequence: Synthetic coding sequence
atgacccggggctttgctcccatcctgcctgtggagtttcacaagatgggtagcttccgacgcccaagaccgcgctttatgtcgtctccagtgttatccgacctgcctaggttccaggccgccaggcaggcacttcagctgtccagtagcagtgcctggaacagcgtacagactgcggtgatcaatgtctag

SEQ ID NO: 29063 - DNA, 231 bp, Artificial Sequence
  Description of Artificial Sequence: Synthetic coding sequence
atgacaagaggttttgctccgattcttcccgttgagttccacaaaatgggcagtttccgacggccgcggccaaggttcatgtcgtccccagtgctttccgacttaccgcggttccaggccgccaggcaagctctgcaactatcctcatcaagcgcctggaactccgtgcagaccgctgttattaacgttttcaaggggggcggcctgcagagcaacgaactctatgcatag

SEQ ID NO: 29064 - DNA, 144 bp, Artificial Sequence
  Description of Artificial Sequence: Synthetic coding sequence
atgacacgggggttcgcccccattttaccagtcgaattccacaagatggggtccttcagacgccctcgcccaaggttcatgtcctctcccgtgctcagcgacctgcctcggtttcaggcagcacgccaagcccttcagctgtag

SEQ ID NO: 29065 - DNA, 228 bp, Artificial Sequence
  Description of Artificial Sequence: Synthetic coding sequence
atgacacggggtttcgccccaatcctacctgtcgagttccacaagatggggagcttccgccgacccagaccacgattcatgtcttccccagtcctgagtgatctgcctagattccaggccgcacggcaggccctgcagctgtcgagttcctcagcctggaactcggtgcagacagccgtcatcaacgtgttcaagggaggaggtctccagagtaacgagttatactag

SEQ ID NO: 29066 - DNA, 150 bp, Artificial Sequence
  Description of Artificial Sequence: Synthetic coding sequence
atgacccgaggattcgctcccatcttaccagtggaatttcacaaaatggggagttttcgacgacctagacccagattcatgtcatccccagtactatcagacctgccacgctttcaggccgctaggcaggcattgcagttgtcttcctag

SEQ ID NO: 29067 - DNA, 1107 bp, Artificial Sequence
  Description of Artificial Sequence: Synthetic coding sequence
atgacccgcggtttcgctccgatcctcccagtggaatttcacaaaatggggagcttcagacgaccccgcccccgctttatgagctctccagtcctgtcggaccttcctcggtttcaggctgcgagacaggcgctacagttatcgtcctcttccgcttggaactcagtgcagaccgcagtaatcaacgtgttcaagggaggtggactgcaatcaaacgaactctacgctctgaacgagaatatcaggagactgctgaagagcgaactgggttcattcatcactgattattttcaaaaccagctgctggctaaaggcctgttcttcgtggaagagaaaatcaagctctgcgagggagagaatcgaatcgaggtgctggctgaggtttgggatcatttcttcacagagacactaccgaccttgcaggccattttttaccccgttcagggtcaggagctgacgatcagacagatctccctgttgggctttcgggatcttgtgctgctgaaagtgaaactgggggatctgctgttgctggcgcagagtaagctgcctagtagcatcgtgcagatgctgctgattttgcagtctgtgcacgagccaacaggacccagcgaatcctacctgcaattggaggagcttgtgaaacaggtggtgtcgcctttcctgggcatttctggagaccgttctttcagcggacccacgtatacccttgcacgccggcattcaagagtccggcctaaggttactgtcttaaactacgctagtcctattaccgccgtgagtagacctctcaacgagatggtgctgacacctctgaccgagcaagagggcgaagcttacctggagaagtgcggaagtgtccgccgccacaccgttgcaaacgctcacagcgatatccagctccttgccatggcgacaatgatgcacagtgggttgggcgaagaggcatcatcagagaataaatgtttgctgttaccacctagttttccacctcctcaccgacagtgttcttcagagccaaatatcacggataatcccgacggcctagaggaaggtgctagagggtcccaggaaggatcggaactcaactgtgcctccctcagctag

SEQ ID NO: 29068 - DNA, 252 bp, Artificial Sequence
  Description of Artificial Sequence: Synthetic coding sequence
atgactaggggctttgcgcccatcctgccagtcgagtttcacaaaatggggtcattcagaagaccaagaccaaggttcatgtcttctccggtgttaagtgacctgcccaggtttcaagcagctcgccaagccttgcagctttcctcctcctcagcctggaacagcgtgcaaactgctgtgatcaacgtgtttaagggaggcggactgcagtcaaatgagctgtatgctttgaacgagaacatcaggcgttag

SEQ ID NO: 29069 - DNA, 618 bp, Artificial Sequence
  Description of Artificial Sequence: Synthetic coding sequence
atgacaaggggctttgcccctatcttgccggttgaatttcataaaatggggtccttcagacgcccccgcccacggttcatgtcctccccggtgctttccgacctgccacgatttcaggcagcacggcaggcgctgcagttgtccagcagtagtgcttggaattcagtgcagacagccgtcatcaacgttttcaagggcggaggacttcagtcaaacgaactctacgccctgaatgagaacatccgcagacttctcaaatcggagctggggtcattcattaccgactatttccagaatcaactgcttgccaagggtctttttttcgtcgaggagaagatcaagctgtgtgagggtgagaatcgaatagaggtgcttgcagaggtttgggaccatttctttacggaaacattgcctacactccaggccatcttttatccggtacaaggccaagagctgaccatccgacaaattagtctcctcggcttcagggatctcgtgctgttaaaggttaagctcggagatcttctcctgctggctcagagcaaattgccaagcagcatcgttcaaatgctgctgattctgcaaccaggcggtacacccggctctggcccgaggtag

SEQ ID NO: 29070 - DNA, 825 bp, Artificial Sequence
  Description of Artificial Sequence: Synthetic coding sequence
atggtgatgtcacaaggaacgtacacctttttgacctgcttcgcaggtttctggctgatttggggattaatagtgctgctctgttgcttttgcagtttcctgagacggcggctcaagcggcggcaggaggagaggctcagagagcagaacttgcgcgcactagaacttgaacctctggaactagaaggatctctggcaggttcccccccgggtctcgccccaccccagcctcccccacacagatcacgcctcgaggcacccgcacacgcccacagccatccacacgtgcacgtgcacccattactgcatcacggaccggctcaaccccatgctcacgcccatccccaccctcatcaccatgctttgccccacccaccccccactcatctaagtgtgccaccgcggccttggagttatcctagacaagcagagtctgatatgtcaaaacctccatgctatgaggaagccgtgctaatggctgaaccacctccaccttattccgaagttctgacggacacaagaggcctttatcgcaagatcgtcacaccgttcttgagtcggcgggacagcgccgagaaacaagagcagccccccccaagctacaagcccctcttcctcgaccgtggatatactagcgcactgcacctgccctctgctccccgacctgctcctccgtgcccggccttgtgcctgcaggccgatcgggggcggcgagtcttcccctcatggactgactctgagcttagcagccgcgagccactggagcacggggcttggcggctccccgtcagcattcctctttttggccgtacaaccgctgtgtag

SEQ ID NO: 29071 - DNA, 765 bp, Artificial Sequence
  Description of Artificial Sequence: Synthetic coding sequence
atggtgatgtcccaaggtacttacaccttcctgacttgctttgcgggattctggcttatttgggggttaatagtactcctttgttgtttttgttccttcttgcggagaagattgaagaggcgccaagaggagaggctgcgtgaacagaacctgcgcgccctcgagttagagccacttgagctagaaggaagcttggcagggtctcctccagggttggctcctccccaaccacctcctcaccggagccggttagaagcccccgcacaccatgcccatgcgcacccacatccccatcaccatgccctccctcacccaccacctacacatctcagcgtgccaccccgcccctggtcttaccctagacaggcggagtccgatatgtcgaagccgccttgttacgaggaggccgtcctgatggccgagccaccacccccttactctgaggttttgaccgataccaggggtctatatcggaaaatcgtgaccccgttcttgagccggagggatagtgctgaaaagcaggaacaacctccgccttcctataagccattgttcttggacaggggctacaccagcgccttgcacctgccatccgcaccccgccccgcacctccctgtcccgcgttgtgccttcaggccgatagagggaggcgcgttttcccctcttggactgatagcgaactcagcagtcgagagcctctggaacacggcgcctggcgattgcccgtgagtattccacttttcggtcggacaaccgcagtttag

SEQ ID NO: 29072 - DNA, 825 bp, Artificial Sequence
  Description of Artificial Sequence: Synthetic coding sequence
atggtaatgtctcaggggacctataccttcttgacttgtttcgcggggttctggctgatttggggcctgattgtactactgtgctgtttttgtagtttcttgagaaggagattgaaacggaggcaggaggagcgactgcgcgagcagaatcttagggcactggagctagagcccctcgaattggagggatcactggccggttcgccaccaggcttagcacctccacaaccccctccacacaggagtaggctggaagctccggctcacgcccattcacacccccatgttcatgtacatccgttgttacatcatgggcccgctcagccccacgcccacgcccatccgcatccgcaccatcacgcgctgccccatcccccccctacacatctcagcgtgcccccaagaccctggagctatcctagacaggctgagagcgatatgtctaagcctccttgttacgaggaggcggtactgatggcggaacctcctccaccttatagcgaggtgttgactgatacccggggcctgtatcggaaaatagttactcccttcttgagccgacgtgattccgctgagaaacaggaacagcctcccccatcctacaaaccactgtttttagaccgaggttatacctcagctctacacctcccctccgcaccgaggccggcccccccttgccccgcactatgcctacaggcggaccggggccggcgcgtgttcccttcttggactgacagcgaacttagttctcgggaaccgctggagcatggcgcttggcgactccccgtgtcgattcccctgttcggtcgtaccacagcagtctag

SEQ ID NO: 29073 - DNA, 537 bp, Artificial Sequence
  Description of Artificial Sequence: Synthetic coding sequence
atggtcatgagtcaaggtacctacacgtttctcacgtgctttgccggattttggcttatttgggggcttatagtgctgctctgttgcttctgcagcttccttcgccgtaggctgaaaagacgtcaggaggaacgactaagagaacagaatctccgggcattagagctggaacctttggagctggagggtagcctggctggctctcctccaggcctggcgccacctcagcctccaccacatcggtctcgcctcgaagctcctgcccacgcccactcacaccctcatgtacacgtccacccccttttacatcatggtcccgcccagcctcatgcccacgcacacccacatccacatcaccatgccctcccccatccgccacctacccacctctccgtaccgcctcgtccctggtcctaccctaggcaagctgagtccgacatgagcaaaccaccctgttacgaggaggctgtcctgatggcagagcctccccctccatactccgaagtgctgaccgatactagaggtctctaccgctag

SEQ ID NO: 29074 - DNA, 825 bp, Artificial Sequence
  Description of Artificial Sequence: Synthetic coding sequence
atggttatgtctcagggcacgtacacgtttttaacttgcttcgccgggttctggctgatctggggattgatcgtgcttctgtgttgcttctgctcattcctacgcaggcgcctgaagagacggcaggaggagcgcctacgcgaacagaacctgcgcgctcttgagctggagcccctagagctggaagggagcctggcgggatccccacccggcttagccccccctcagcccccaccccataggtcaagactggaagcccccgctcacgcccattcccaccctcacgtgcatgtacatcctctattgcaccacggccccgcccagcctcatgcacatgcccatcctcacccacaccatcacgccctgccacaccccccaccaactcacctgagcgtaccaccacgtccgtggtcctaccctcgacaggccgagtccgacatgagcaagcctccttgttacgaggaagccgtgcttatggcagagcctcccccaccatatagtgaagtgctgacagatacaaggggattgtaccggaagatcgttactcccttcctgagtaggagggattccgccgagaaacaggagcaacccccaccaagctacaaaccattattcttggaccgtgggtatacttctgccttgcacctcccctcagcccctaggcctgcacccccttgtcctgccctctgcctacaggccgaccgaggacgccgggtttttcctagttggacagatagtgaactgtctagcagagaacccctggagcacggcgcctggcgccttcccgtctccattcccttgtttgggagaaccaccgctgtgtag

SEQ ID NO: 29075 - DNA, 1338 bp, Artificial Sequence
  Description of Artificial Sequence: Synthetic coding sequence
atgatggaggagtctggaatcgagacaacaccaccggggacccctccccccaacccggccggtctggccgctactgccatgtcatctaccccagtaccccttgctgcaacctccagttttagctctcccaatgtgagctctatggagtccttcccccctcttgcctattctacaccgcagccacccctgccaccagtgagaccgtctgctcctctcccatttgttccaccacccgcagtgccctcggtaccacctttggtgactagtatgcccccgcccgtaagtcctagtaccgctgcagcatttggaaatccgcccgttagccattttcccccttctactagtgccccgaacacactgctgccagcccccccatccggccctcccatctccggattttcagtgggtagtacatatgatatcacgcgcgggcacgcgggcagagctccccagacaccgcttatgccttctttctcagcccctagcggtacaggccttctgccaaccccgattacgcagcaagcatctcttacttcattagctcagggtactggtaccacaagcgctatcacattcccagaagagcaagaggaccctcgaattactaggggccaggatgaagccagcgccggtggaatatggggattcatcaaaggcgtcgctggcaacccaatggttaaatcagtgctcgataaaacaaagcacagtgtagagagcatgatcaccaccctcgatccagggatggctccatatatcaagtcagggggagagctcgatattgtagtgacgtctaataaggaggtaaaagtggctgcggtacgcgacgccttccaggaggtttttggtttagcagtggtcgttggagaagccggccagagcaacatcgccccgcagccagtcggttatgctgccggcctaaagggcgcccaagaaagaatcgattctttaaggcggacgggagtcatccatgagaagcagaccgccgtaagcgttgagaacttcattgccgagttgcttcctgataagtggttcgacattgggtgcctcgtggtcgaggatcccgtgcacggcatccacttggagaccttcactcaggccactcctgtgcccctagagttcgttcaacaagctcagtcactgaccccacaagattacaacttacgctggagtggattgctcgtcaccgtgggcgaggtcctcgaaaaaagcctgttaaatgtctctagaaccgattggcacatggcctttactggcatgagccgtagacagatgatttacagcgcagcccgcgccatagccgggatgtacaaacagcggctgccccctcgcactgtgtag

SEQ ID NO: 29076 - DNA, 1395 bp, Artificial Sequence
  Description of Artificial Sequence: Synthetic coding sequence
atgatggaggaaagcggcatcgaaacgacccctccaggtaccccaccccccaacccggctgggctggctgccacagctatgagtagtactcctgtgcctctagcggctacctcaagcttctcctccccaaacgtgagctccatggagtcttttccccctctggcctacagcaccccccagccaccactcccgcctgtacgacccagcgccccactcccttttgttccacccccagcggtcccatccgtgccgcctctggtcacctctatgcctccccccgtttctccatccaccgccgctgctttcggaaatccccctgtgtctcactttcctcccagtacgagcgccccgaacacacttctccctgcaccgccaagcggcccccccatctccggtttctccgtcgggagcacttacgacatcaccagaggtcacgcaggtagggccccacagactcccctgatgccatctttttcagcgccatcgggcacaggcttgctgccgacacccataacccagcaggccagcctgaccagtttggcccagggtacaggcaccacatccgcaatcacattccctgaggagcaagaagatccaaggattacacgggggcaggacgaggccagcgcagggggaatttgggggttcatcaagggtgtggcaggaaatcccatggtgaagagtgttctggataaaacaaaacacagcgtagaatcgatgataacaactctggaccccgggatggcgccgtacatcaaaagcggaggagagctggacatcgtggtgacctccaacaaggaggtgaaggtcgcggcggtcagagacgcatttcaagaagtgtttggccttgccgttgtggtcggcgaagcaggccaatccaatatcgccccacagccagtaggttatgcggccggcctgaaaggagcccaggaaagaattgattctcttaggaggaccggagtcatccatgaaaagcagactgccgtgtctgttgaaaattttatcgctgaactcctccctgataagtggttcgacattggatgcctggtggtcgaagacccggtgcatggcatacatctggagaccttcacacaggccacccccgtgcctctggaattcgtgcagcaggcccagagcctgacgccacaggactacaatctgcggtggtccggtttactcgtcaccgtgggggaggttttggagaagagcctacttaatgtttctcgaaccgactggcacatggccttcactggcatgagtagaagacagatgatctattctgccgctcgcgcaatcgctaacccgcaacgtgcagtcgcggtgcacggcctcgtggaggcccgtaacttcccagcacctggggatctcgtgagtctcctgctgggaactgtctag

SEQ ID NO: 29077 - DNA, 936 bp, Artificial Sequence
  Description of Artificial Sequence: Synthetic coding sequence
atgatggaagaatctgggatcgagactacacccccaggcactccacctccaaatcctgccggacttgctgcgactgccatgagctccacacctgttcccctcgcagctacttcctcctttagctccccaaacgtgtcttctatggaatccttccctcctttagcctacagcactccgcagcccccactgccacctgttcgtccttctgcccccctcccattcgtacccccccctgcagttcctagcgtcccacctcttgtaacaagcatgccgcctccagtttcaccttcgacggctgccgcctttggtaaccctccagtcagtcatttcccaccatcaacatctgcacctaataccctcctgccggcccccccgtctgggcctcccatatctggcttctccgtggggagcacttacgacatcactcgaggccacgcggggcgtgctcctcagactcctctgatgccgagttttagcgccccaagcggtacaggattgctgccgacacctatcacacagcaagctagcctgacctcccttgcccaggggacaggcacaacctccgctatcaccttccccgaagaacaggaggacccccggatcacacgaggtcaggacgaggccagtgccggcggcatctgggggttcatcaagggcgtagcaggtaacccaatggtgaaatccgtgcttgataagaccaaacactctgtggaatcaatgatcacaacccttgatccggggatggccccatacatcaagtcaggtggcgaactggatatcgtggtcacatctaataaagaggtcaaagttgctgctgtgcgcgatgcgtttcaggaggtgttcggcctggccgttgtggtgggcgaagccggacagtctaatattgctccccagcccgtgggatacgctgcaggtctgaagggcgccaatcgctag

SEQ ID NO: 29078 - DNA, 1257 bp, Artificial Sequence
  Description of Artificial Sequence: Synthetic coding sequence
atgatggaggagtcgggaatagaaactacgccgcccggtacgcctccccccaatcccgcgggcctagcggccacggccatgagctccaccccggtgcccctagctgccactagctctttctctagcccgaacgtgtcttccatggaaagtttccctccgttagcatattcgacaccacaaccccccctgcctcctgtacggccatctgccccactaccattcgtacctccccccgcggtgccttctgtacctcctctagtgaccagcatgcctccccctgtctcaccttccactgcagccgcttttggaaatccaccagtgagccactttccaccttcaacgagcgccccaaataccctccttcccgcgcctccatctgggccccctatcagcggattttccgtcgggagcacctatgatatcactcggggccatgctgggcgggcaccccagactcctctcatgccatcattctctgcccccagtgggaccggactgctccccactccgatcactcagcaagcatctctgacatcactcgcccaggggacagggactactagcgcgatcacattccctgaagaacaggaagatcccagaatcactcgaggccaggacgaggcctctgctggcggcatttggggatttatcaagggagttgcaggtaatcccatggtgaaaagtgtgcttgataagactaagcattccgttgagtccatgattactaccttggatcccggcatggccccctatatcaagtctggcggggagctggacattgtcgtcacttccaataaggaagtgaaagtggctgcggttagagacgctttccaggaagtttttgggttggcagtagtggtgggggaggccgggcagagcaacattgctccccagcctgtggggtatgccgctggactcaaaggcgcgcaggaacgaatcgattcgttgagaagaaccggcgtaatacatgagaaacagacggcggtctcggttgaaaattttatcgccgaattactgcctgacaaatggtttgacatcggttgtctcgtcgttgaggatccagtccacggcatccaccttgaaacattcacccaagctacccccgtgcccctggagttcgtccagcaggtgggctttcttctctgcttttttattatgctgcagaggaatttgcattactgcttccagaacaaaaatttgtttggtttcttcgtaaggaacatgttccttattctcttccaatctttttttttttag

SEQ ID NO: 29079 - DNA, 1338 bp, Artificial Sequence
  Description of Artificial Sequence: Synthetic coding sequence
atgatggaggagagcggaatagagacaaccccacccggcacccctccacctaaccctgcggggttagccgccacggccatgtcatctaccccagtgcctcttgccgcaacaagcagtttttcatcaccaaacgtctcttcaatggaatcctttcctccactggcctactccacaccccagccaccattgcccccagtgaggccttcagcccccctgccatttgtaccacctcccgcagtgcctagcgtgcccccgctggtgacaagcatgcccccgccagtgagcccaagtaccgccgctgcctttggcaatccccccgtcagccatttcccccctagtacatctgcccccaatactcttctcccagcccccccgagcgggccgccaataagtgggttttccgtagggtctacatacgacatcaccagagggcatgccggacgggccccacagacccctctaatgcctagtttctccgcgccctctggcaccgggctgctgcccactccaataacccagcaggcaagtctgacaagtctggcccagggaaccgggaccacttccgctatcacctttccggaagagcaagaggaccctcgaattacacggggacaggacgaggcctcagcgggggggatatgggggtttattaaaggggtcgcaggcaacccaatggtcaagtccgtgctggataaaactaagcacagcgtcgagtccatgatcaccactttagaccccggcatggcaccatatattaagtcaggtggggaacttgatatagtggtcacatcaaacaaagaggtcaaggtggccgccgttcgcgacgcattccaagaggtgttcggcctagctgtagtagtgggagaggcgggccagtctaatattgcccctcagcccgtcggctatgctgcaggcctaaaaggtgcccaggagcggatcgattccctgcgccgcaccggtgtgatccacgagaagcagacagccgtgtctgttgagaattttatcgccgaactactgcccgataagtggttcgatattggctgtcttgttgtggaggacccagtgcacggcatacatctagagacatttacccaggcaacccccgtgcctttggagttcgtgcagcaggctcaaagtcttacccctcaagactataacctgcgatggagcgggcttcttgtcacagtcggggaggtgttagagaagtctttgctgaatgtgagtcgcactgattggcatatggcatttaccgggatgtcccgtaggcagatgatttacagcgcagcccgcgcaatagctgagtctccaaagtcttcaggtagtccttggcttggctag

SEQ ID NO: 29080 - DNA, 1389 bp, Artificial Sequence
  Description of Artificial Sequence: Synthetic coding sequence
atgatggaggaatctggaattgagaccacaccccctgggacacccccaccaaaccctgcaggcttggcagctacagccatgtcttctactccagtgcccctagccgccacatcaagctttagtagccctaatgtgtcctcaatggaaagcttcccaccactggcgtatagcaccccccagccaccgcttcctcctgtgcggcctagcgcgccactgccctttgtcccaccgcccgccgtcccgagcgtgccaccactggtaactagcatgcccccacccgtgtctccaagcacagccgccgctttcggcaacccaccagttagtcatttccccccttctacatcagctcctaataccctgctgcccgcgcctccatctggaccgcccatttccggattctccgtaggctcaacttatgatatcacccgcggacacgcaggaagagccccacagactcctcttatgcctagcttcagtgccccatcaggcaccgggctgctcccgaccccaattactcagcaggcctcacttacctctttggcccaagggactgggacaactagtgccattacattccctgaggaacaggaggatccacgtatcacaagagggcaagatgaggcctccgctgggggcatctggggcttcataaagggtgtggctggaaaccccatggtgaaaagtgtgctggataagacgaaacactcggtggaaagcatgatcacaacactggatccaggcatggcgccatatattaagtcaggcggagaactggacattgtggttacctccaataaagaagtcaaagtggcagcggttcgcgatgctttccaggaagtgttcggattggccgttgtggtgggcgaggctgggcaaagtaacatagcaccacagcctgtaggctacgcagccggactaaagggagctcaagagcgcattgatagcctgcggcgcacaggcgtcatccacgagaaacagacagccgtgtctgttgaaaactttattgccgaattgctgcccgataagtggtttgatatcggatgtttggtggtcgaggatcctgttcacggtatacatctggaaaccttcacgcaggccacacctgttccccttgagtttgtgcagcaggcacagtctctcactccacaggactataacctcaggtggtcaggcctgctggtgaccgtgggcgaggtacttgagaaatcactgttgaatgtttctaggaccgactggcacatggctttcactggtatgagcagaaggcagatgatctactcagctgccagggccattgccgacgactacttcccaaggattccaaaggagcagtggcagtcaatggcatggctgaagctcgagatttttttacctctggtgacatggtag

SEQ ID NO: 29081 - DNA, 3795 bp, Artificial Sequence
  Description of Artificial Sequence: Synthetic coding sequence
atgagtacgctgtacgtgagcccccatcctgacgccttccctagtctccgagccctgatcgcggcgcggtacggggaagccggcgaaggacccggctggggcggcgctcacccacggatttgtctccagcctcctcctactagtaggacccccttcccaccgcccagattacccgcactggagcaaggaccaggtgggctctgggtctggggcgccaccgcagtggcccagctgctttggcccgctggactgggcggccctgggggttccagggccgccgtgttggtccagcagtgggtgtcatacgctgacactgagctgatccccgcagcttgtggtgccaccttaccagcgttgggtctgagatcgtccgcgcaagacccacaggcggttctgggagcccttggcagagccttaagtcccttggaggagtggctgcgcctgcatacatatctggccggcgaggctcctaccctggccgatctggcagcggttaccgcactgttgctcccatttcgctacgttctggacccacctgccagacgtatttggaataatgtcacaaggtggtttgtgacatgtgtgagacaacctgagtttcgtgcagtgctgggagaggtcgttctgtatagcggtgctcgacctctttctcaccaacccggccctgaagcccccgcactccccaaaacagctgctcagctgaaaaaagaggcgaagaagagagaaaagcttgaaaaattccaacagaagcagaagattcagcagcagcagcccccacccggcgagaagaagcccaagccagagaaacgcgagaaaagagaccccggcgtgatcacatacgatctgcctacaccgccgggtgagaaaaaagacgtgtccggcccaatgccggattcttactccccaaggtacgtggaagcggcctggtacccatggtgggagcaacaaggattttttaagcccgagtatggccgccctaacgtgagcgcagccaaccccagaggagtgttcatgatgtgcatcccgccccctaatgtgactgggagcttacatttggggcatgctctgaccaacgctatacaagacagcttgacgcggtggcaccggatgcggggagagactacgctgtggaatccgggatgcgaccacgctgggatcgcaacccaagtggtcgtcgagaagaagctgtggcgagagcaagggctcagccgacaccaactagggagagaagctttcctgcaagaagtatggaaatggaaagaagaaaagggggataggatttaccaccagctcaaaaagctcggctcttctctcgattgggaccgggcttgtttcaccatggaccccaagctgtccgcagccgttactgaggcttttgtccgtctacacgaagagggcataatttataggagcaccagactggtgaattggagttgcaccctgaatagcgcaatttccgatatcgaggtggacaagaaagagttaacggggcgtacccttctatcagtgccaggatacaaagaaaaggttgaatttggagtgctggtatcatttgcctataaggtgcaagggagcgattccgacgaggaggttgttgtggcaacaacacgaatcgaaactatgttgggtgacgttgctgtggcggtgcaccctaaagacacaaggtaccagcacctcaaaggtaagaatgttatccatcctttcttgtcgcgctcccttcccatcgtgtttgacgaattcgtcgatatggacttcggcaccggggccgtaaagattaccccagctcacgaccagaacgactatgaagttggccagcggcatggcctggaggccatcagtataatggactctaggggtgccctaatcaatgtgccacccccattcctgggcctccctagatttgaggcgcgcaaggctgtcttggtcgccttgaaggagaggggcttgttccgcggtattgaagacaaccctatggtggtgcctctttgcaatcgatcaaaggacgtggtggaaccactgttgcgaccccagtggtatgtccggtgcggggagatggcacaagccgccagcgccgctgttacaagaggtgaccttcgcatcctgccagaagcccatcaacgtacctggcatgcttggatggataacattcgggagtggtgcatatccagacaactgtggtgggggcataggatcccagcctactttgtaacagtgtcagacccagcggtacccccaggtgaagatcctgacggaaggtattgggtcagcggccggaatgaagctgaggcccgggaaaaggccgccaaggagtttggagtctcacctgataaaatttctctccagcaggacgaagatgtcctagacacctggttttcatctgggctgttcccgctgtccatattgggatggcccaaccagagtgaagatctcagcgtgttctacccagggaccttgttggagactgggcacgatatattattcttttgggttgcccggatggtgatgctgggactgaagctgaccgggcggttgccatttagggaagtatacttgcacgctatcgtacgagacgcccatggacgaaagatgagcaaaagcctgggtaatgtgatcgaccctcttgatgtgatatacgggatcagtcttcaaggactccataaccaacttctcaattcaaatctggaccccagtgaggtggagaaggctaaggagggccagaaggccgacttcccagccggaatccctgagtgcgggactgatgccctgcggtttgggctgtgtgcgtatatgagccagggcagagacatcaacttggacgtgaacaggattttgggttatcgacacttttgcaataagttatggaatgcaacaaagtttgccctgagagggctcggtaaagggttcgtgccctcgcccacttcccagccgggaggccacgagtccctagtcgatcgttggattagatccagactcacagaagccgtgagactgagtaaccaggggttccaggcctatgactttcccgccgtaaccacagcacagtattccttctggctgtacgagctgtgtgatgtgtacctagagtgcctcaaaccagtgttaaacggcgtggatcaagtagcggctgagtgcgccagacagacattatatacatgcctcgatgtgggcctgaggctgctctctcccttcatgccctttgtgacagaggagctctttcagcggttgccaaggaggatgccccaagccccacccagcctctgtgtgacaccttatcctgagccatccgaatgctcatggaaggacccagaagcagaggcagccttggagttggctctttccatcactagagccgtgaggtcgcttcgcgcagactataacttgaccaggatccgaccagactgcttcctcgaggtggcggatgaggccacgggggcacttgctagcgctgtgagcgggtatgttcaggcattagcaagtgctggcgttgtcgctgttctagccctcggcgctccagccccccagggctgcgccgtggccttagccagcgaccggtgctctattcacctccagctgcagggacttgtggatcctgctagggagcttgggaagttgcaagcaaaacgcgtggaggcgcaacggcaggcacaacgcctgcgggaaagacgcgcggccagcggttatcctgtgaaagttcccttggaggtgcaggaagccgacgaagcaaagcttcaacagactgaggcagaactcagaaaggttgacgaggctatcgctttgttccagaaaatgctgtag

SEQ ID NO: 29082 - DNA, 678 bp, Artificial Sequence
  Description of Artificial Sequence: Synthetic coding sequence
atgcccggaacacaaactcccgcacccgctgaagatccacactccggctgccgagatcctgtgccagcccgccctcaggcatgtcacccgaaaagccaggagacccggttcgaaggtccactcccacctccccctcctgcagccgccgctccaccgccacccgctcccgcccagaccgcccaggcgccaggtttcgttgtgcctactcacgccgggacggtggggactctgcccctcggcgggtatgttgctccagggtacccactgcaactgcagccatgtacagcatatgtccctgtgtaccctgtgggaactccttacgctggagggacgcctggtggcaccggcgtcacaagcacactgccacctcctccacagggcccgggcctcgcactcttggaacctagacgccctccccatgactacatgccaattgcagtcctgaccacaatctgctgtttctggcctaccggaattatcgctatcttcaaggctgtgcaggtgcgaaccgccttagccagaggagacatggtgagtgcagagatcgcctctagagaagccaggaattttagctttatatcgcttgctgtggggattgccgctatggtgctctgtaccatactgaccgtggtcatcatcatcgctgctcagcaccatgagaactactgggacccatag

SEQ ID NO: 29083 - DNA, 678 bp, Artificial Sequence
  Description of Artificial Sequence: Synthetic coding sequence
atgccgggaacccagacccccgcccccgcagaggatccccatagcggatgcagagatcctgtgccagcacgtcctcaggcttgccaccccaaaagccaggagactagatttgaagggcctttgccacccccaccgccagctgctgccgctcctccaccccctgcccccgcccagaccgcgcaggcccctgggttcgtcgtgccaacccatgcaggcaccgtcggcacactccctctcggggggtatgtggctcctggataccctcttcaactgcagccatgcacagcctatgtgcctgtgtaccccgtgggtactccatatgcaggggggactccgggcgggaccggggtgactagtacactcccaccgccacctcagggtccggggttggcgctcctagagcctaggaggcccccccacgactatatgccgattgccgtgctgaccaccatatgttgcttttggcccaccgggattattgccatcttcaaggcagtgcaggtccgcaccgcactcgccagaggcgacatggtaagcgcagagatcgcatctcgagaggcacgcaatttctcctttatttcactagctgtcggtattgctgccatggtcctttgtactatcctcacagtcgtaatcattatcgctgcccaacatcatgagaactactgggacccttag

SEQ ID NO: 29084 - DNA, 678 bp, Artificial Sequence
  Description of Artificial Sequence: Synthetic coding sequence
atgcctggtactcagacaccagcccctgctgaggacccacattctggctgtagggatcctgtgcccgccagaccccaggcatgccaccccaagtctcaggaaacgcggtttgaaggccccctaccaccccctcccccagccgcagccgccccgcccccgcctgcacctgcccagacagcccaggccccgggatttgtggtgcccacccatgctggtactgtgggtacacttcctttaggtggttacgttgcccccggctaccccctacagcttcaaccatgtacagcttatgtgcccgtctaccccgtgggaacgccttatgctggcggaacccctggcgggacaggagtcacttccactcttcccccacctccgcagggacccggattggcgttattggagccccggagacctccccacgattatatgccaattgccgtgcttaccacgatttgctgcttctggccaacgggaattattgcaatcttcaaagccgtgcaggtgaggacagccctagccagaggggatatggtgtccgccgaaattgcaagcagggaagcccgcaacttctcatttatctccctggctgtgggtatcgctgccatggtcctgtgcactattctgacagttgtcatcataattgctgcacagcatcatgaaaactactgggacccttag

SEQ ID NO: 29085 - DNA, 921 bp, Artificial Sequence
  Description of Artificial Sequence: Synthetic coding sequence
atgagcagtgaaaaaagcgggctgcctgatagtgtgccccacaccagccccccgccatataatgctccacagcctcctgcagagcccccggctccaccccctcaggcagctccttcctctcatcaccaccaccatcaccactatcaccagtccggtaccgctaccctgcctaggttaggtgccggcgggctggcatcaagcgcggctactgcccagagaggtccctcgtcctctgcaacactgcccagacccccgcaccatgctccaccaggtcctgctgccggtgcacctccccccggctgcgccaccttgcccagaatgcctccagacccttacctgcaggaaaccaggtttgaaggcccgttacctccaccaccgccagcagcggctgcccctccccctccggcacccgcccagaccgctcaggcacctggtttcgtggttcctactcacgccggcaccgttggcactctgcccctgggagggtacgtggcgcctggctaccccctgcagttacagccttgcacagcctatgtccccgtctaccctgtgggaacgccttacgcaggagggactcccgggggtacaggcgttacgagcactctccctcccccccctcaggggccaggcttagccttactggaaccgagacgaccccctcacgactatatgccaatcgccgtgttgaccaccatatgctgcttctggcccacgggtataattgccattttcaaagctgtgcaggttaggactgccctggctcgtggtgatatggtgtctgccgagatcgcctcgcgagaggcacgtaactttagtttcatctctttggcagtgggcatagcggccatggttctgtgtaccatactaacggtcgtgatcatcatcgctgcccaacaccacgaaaattactgggatccttag

SEQ ID NO: 29086 - DNA, 678 bp, Artificial Sequence
  Description of Artificial Sequence: Synthetic coding sequence
atgcctggtactcagacccccgcacccgcagaggatccccattccggctgccgcgacccagtcccggcgaggccgcaagcctgccaccctaagtcacaggaaaccagattcgagggaccactgccaccaccaccacccgcggccgccgccccacctcctccagcgcccgcccagactgctcaggccccaggttttgtggtccccacccacgctgggactgttggtactttaccactgggcggctatgttgcacccggttatccccttcaactccaaccatgcaccgcctatgtgccagtgtatcctgtcggtacgccatatgctggcggtacgccaggaggaaccggagtgacctccacattacctccaccacctcagggacctggactcgcattgctggagcctcgcagaccaccccacgattatatgccaatcgcagtgttaacaaccatttgttgtttctggcctacgggaatcatagccatttttaaggcagtgcaggtcagaacagctctggcccgcggcgatatggtgtctgccgaaattgcatcccgcgaggccaggaatttcagcttcataagcctggcggttggtatagctgccatggtgctctgtacaattctcaccgtcgtgattatcattgccgcacagcaccacgagaactattgggacccatag

SEQ ID NO: 29087 - DNA, 921 bp, Artificial Sequence
  Description of Artificial Sequence: Synthetic coding sequence
atgtcaagtgagaagagtggcttgccagattccgttcctcacacttcccctcctccatataacgcaccccagccccccgctgaaccacccgccccccctccacaggctgcccctagcagtcatcatcaccaccaccatcattaccatcagagtggaactgccacactgccccgcctgggcgcaggcggtttggcgagtagtgcagccacagcccaacgaggtccctcctctagtgctacacttccacgcccaccgcatcacgccccccctggcccagcggcgggagctcccccccccggatgtgcgacactgccgcgtatgccacccgacccatacctgcaggagacgcggtttgagggccccctgcctccaccaccacccgccgcagccgcacctcccccccccgcacccgctcagaccgcacaggcacctgggttcgtcgtgcctacacatgcgggcactgtgggcacgctgcctttggggggctacgttgcccccggctaccctctgcagctgcaaccctgcaccgcctacgtccccgtgtaccccgtgggcacaccttacgcaggagggacacccggcggcacaggcgtcacctccacactgcccccccctcctcaggggccaggtcttgctctgctggagcctcgcagaccaccacacgattacatgcctatcgccgtgttgactactatttgctgtttctggcccactggtattattgctatcttcaaagcagtgcaagtgaggacagctctggcccggggtgacatggtgtccgcggagatagcttccagggaagcaagaaatttttccttcatcagtttggcagttgggatagcagccatggttctctgcacaatcttaactgtagtcataataattgccgcccagcaccatgaaaattattgggatccgtag

SEQ ID NO: 29088 - DNA, 192 bp, Artificial Sequence
  Description of Artificial Sequence: Synthetic coding sequence
atgccaggcacccagacgcctgcacccgctgaggatccccattccggatgccgggacccagtgcctgccagaccccaggcatgccatcctaaatcccaggagaccagattcgaaggtccgctgccaccccccccacccgcggctgcggcgccccctccgcccgcaccagcacagacagctcaggccccttag

SEQ ID NO: 29089 - DNA, 192 bp, Artificial Sequence
  Description of Artificial Sequence: Synthetic coding sequence
atgccaggaacacagaccccagctcccgctgaagacccgcacagtggctgcagggatcccgtgcccgcacggccacaggcttgtcatcccaagagtcaagaaacgcgtttcgagggtccacttccccccccccccccagctgcagcagctccacctcctccagctcctgctcagacagcccaggccccatag

SEQ ID NO: 29090 - DNA, 678 bp, Artificial Sequence
  Description of Artificial Sequence: Synthetic coding sequence
atgcctggaacacagacccctgccccagcggaggatccccattccgggtgccgcgaccctgtcccagctcggccccaggcttgtcacccgaaatcacaggagacacggttcgagggcccactgccaccaccccccccggccgccgctgctcctccacctcctgcccctgcacagactgcacaagctcccgggttcgtggtacctacgcacgccggtactgtgggcacactccccctcggaggttatgtggctccaggttacccgcttcagttgcaaccttgtaccgcatacgttcccgtgtatcccgtcggcaccccttatgccggaggtacacccggggggacgggggtgacatccaccctgccgccaccaccccagggccctgggttggctctcctggagcctcgaagaccaccgcatgattatatgccaatcgctgtactcacaacaatctgttgtttctggcctaccggaatcattgccatttttaaggcagtccaggtccggaccgcattagctagaggcgatatggtttccgcagaaatcgcaagccgagaagcccggaacttttccttcatttcgttagccgttggtatagcggcaatggttctctgcaccatcctcaccgtggtgatcatcatagccgcccagcatcacgagaactattgggatccctag

SEQ ID NO: 29091 - DNA, 192 bp, Artificial Sequence
  Description of Artificial Sequence: Synthetic coding sequence
atgccagggacgcaaacacccgctcctgctgaggacccgcattctggctgtcgagaccccgtcccggcacggccacaggcgtgccacccaaaatcacaagagacccgtttcgagggcccactgccaccaccccccccagctgctgcagccccccccccccccgccccagctcagactgcccaggccccatag

SEQ ID NO: 29092 - DNA, 678 bp, Artificial Sequence
  Description of Artificial Sequence: Synthetic coding sequence
atgccaggaactcagactcccgctcctgcagaagatccacactccgggtgccgagaccctgttcccgcccgaccgcaggcatgccacccaaagtctcaagagacacgattcgagggtcccttgccacctcctcccccagctgcagccgctcctccacctcccgctccagcgcagactgctcaggcacccggattcgtggtgccaactcacgcgggaacagtgggcaccctgcctctcggaggatatgtcgctcctgggtaccctctccagctgcagccatgtaccgcctatgtgcccgtctatccagtgggtactccttacgctggcgggacacccggcggcacgggcgtgaccagcacactgccaccccctcctcaaggcccaggactcgctctgctggagcctcgcagacctccacatgactatatgcccattgctgtcttaaccaccatctgttgtttctggccgactggcatcatagctatttttaaagctgtccaggtgcgcacagctctggcacggggcgacatggtgtcagccgaaatcgcttctcgagaggcacggaatttctctttcatctctttggctgtagggatcgccgccatggtcctgtgcaccattctgactgttgtaattatcattgcagcacagcaccatgagaattactgggacccctag

SEQ ID NO: 29093 - DNA, 192 bp, Artificial Sequence
  Description of Artificial Sequence: Synthetic coding sequence
atgcctggcactcagacgccagccccagccgaggatccacactccggctgccgcgatccagtccccgcccggcctcaggcctgtcaccccaaaagtcaagagacgaggtttgaaggcccactgcctcctccaccgcctgcagccgcagctcctccgccccctgcgccagctcagactgcccaggcgccctag

SEQ ID NO: 29094 - DNA, 192 bp, Artificial Sequence
  Description of Artificial Sequence: Synthetic coding sequence
atgcctggtactcagacccctgcccccgccgaggacccgcattcagggtgtcgcgatcctgtcccggcccgtccgcaggcgtgccatccaaagtcacaagaaaccagatttgaggggcctttacccccacctcctcctgctgcggccgctcccccaccaccagccccagctcagaccgcccaagctccctag

SEQ ID NO: 29095 - DNA, 192 bp, Artificial Sequence
  Description of Artificial Sequence: Synthetic coding sequence
atgcccggaacgcagacgcccgctccggctgaagatcctcatagcggttgccgggacccagtacctgccagaccccaggcctgccacccaaaatcacaggagacaagatttgaaggccctctcccgccgcctcctccagcggctgctgcacccccgcctcccgctcctgcccagacggcccaggcgccctag

SEQ ID NO: 29096 - DNA, 678 bp, Artificial Sequence
  Description of Artificial Sequence: Synthetic coding sequence
atgccgggaacccagacgccagctccagccgaagacccccactctggatgccgtgacccagtgccagcccgccctcaggcctgccacccaaaatctcaggaaacaagatttgagggtcccctgcccccacctcctcccgccgctgcagcccctcctccacccgcacctgcccagactgcacaggcacctgggttcgtcgtaccaacccacgcaggcaccgtggggacccttccccttgggggctatgtggcccctggttacccactacagctgcagccctgcacggcttatgtgcccgtgtatcctgttggtaccccttacgcaggcgggactcctggcggaactggggtaactagcaccctgccgccaccgcctcagggaccaggactggctctcttggagcctcgaaggcctccacatgactacatgccgattgcagttctgaccaccatttgctgcttttggcctaccgggatcatagctatcttcaaagccgtccaggtgagaaccgctctcgcccgaggagatatggtgagcgcagagatcgcaagcagggaggcccggaatttctcattcataagcctggctgtgggtatcgcggctatggtactttgcacaatcctgacggtcgtgataatcatcgctgcacagcatcatgagaactattgggatccttag

SEQ ID NO: 29097 - DNA, 192 bp, Artificial Sequence
  Description of Artificial Sequence: Synthetic coding sequence
atgcctggcacacagactccagctcccgccgaagacccgcattcaggttgtcgcgacccagtccccgcacgaccacaggcatgtcaccccaaaagccaagaaacaaggttcgagggaccactacccccacctccaccagccgctgctgctcctccccctcctgccccggcacagactgcgcaggcgccttag

SEQ ID NO: 29098 - DNA, 921 bp, Artificial Sequence
  Description of Artificial Sequence: Synthetic coding sequence
atgtctagcgaaaaatcaggtttacctgattccgtccctcatacgagcccaccaccatacaacgctccccagcctccagccgaaccccctgctcccccaccgcaggccgccccatcatctcatcaccatcaccaccaccactaccaccagagtgggacagctaccttaccacgcttaggcgccggtggactggcatccagcgccgcgacagcccagcggggaccaagcagtagcgctactctgcctagaccaccgcaccacgctccccctggacccgccgctggagctcccccgccagggtgcgcaaccctgccgcgaatgccacctgacccgtacctccaggaaacgagatttgagggtccactacccccgcccccgcccgccgccgctgcccccccgccacccgccccagcacaaacagcccaggctccgggctttgtcgtccctactcatgccggaaccgtgggtacactcccattaggtggttatgtggcccctgggtacccattgcaactccagccctgtacagcctatgtacccgtgtaccccgtggggaccccttacgcaggcgggaccccaggaggcactggtgtgaccagcactctgccccccccgccacagggcccagggctagcccttctggaaccccgaaggcctccccatgattacatgcccattgcagtcctaaccacaatctgttgtttttggcccaccggtatcatcgcaatcttcaaagccgtgcaagtgcgcacagccctcgcaaggggcgacatggtcagtgccgagattgccagccgggaggcaaggaatttttcattcatcagtttggccgtgggaatcgcagcaatggtgctgtgcacaatcctcacagtagtcatcataatcgccgcccagcaccacgaaaattattgggacccatag

SEQ ID NO: 29099 - DNA, 678 bp, Artificial Sequence
  Description of Artificial Sequence: Synthetic coding sequence
atgcccggaactcagacgcctgccccagccgaggatccacactcgggttgccgggatccagttcccgcccgtccgcaggcatgtcatcccaaatctcaggagacacgctttgaaggtccgctcccacctcccccaccagccgcggccgccccacccccaccggctcccgcgcagactgcccaggcacccggcttcgtggtccccactcacgctggtaccgtcggcaccttaccccttggtggatacgtggcaccaggttaccccctgcagctgcagccatgcactgcttacgtgcccgtgtatccagtgggaactccctacgcaggaggcactcccggaggcaccggcgttacatcgaccctgcctcctcctccccaaggacccgggctggccttgctcgagccgcggaggcctccacacgactatatgccaattgctgtcctgaccactatttgctgtttttggcctacgggcataatcgcgatttttaaagcagtgcaggttcggacagccctggctcgaggcgacatggtcagtgccgagatagcaagccgcgaggcccggaatttcagctttattagcctagccgtcgggattgccgccatggtcctgtgcaccatccttaccgtcgttattataatcgccgcccagcaccatgagaattattgggatccctag

SEQ ID NO: 29100 - DNA, 921 bp, Artificial Sequence
  Description of Artificial Sequence: Synthetic coding sequence
atgagcagtgaaaagtcaggattgccagattctgtgccacacactagtcccccgccctataacgcgcctcagccacccgcagagccccccgccccacccccccaggccgcgccaagcagtcatcatcatcaccatcatcactatcatcaatcgggaaccgccacgctcccacggttaggggcaggtggcctagcttcgagtgccgctacagctcagcggggccctagcagttctgcgactcttcctcgtccaccccaccacgcacctccaggaccagccgcaggcgcaccccctcctggatgtgccactttacctcgcatgccccccgacccttacctccaggagacccgtttcgagggccccttgcctccccctccacccgcggccgccgcccctcctcctcccgcccccgctcagacggcccaagccccagggtttgttgtgcctactcatgcagggacagtgggtaccctccccctcgggggatacgtggcccccgggtacccgctccagttgcagccctgcacagcctacgtgccagtttatccggtgggtacgccatacgcaggaggaacgcccgggggaaccggtgtgacatctaccctgcccccacctccacaagggccgggcctcgctttgctggagccaagacgcccacctcacgactatatgccgatcgcagtcctgactactatctgctgcttctggcctaccggcataatagctatcttcaaggccgtccaggtgagaaccgctctagcacgtggggatatggtcagcgcagagatcgccagccgagaggctaggaatttttctttcatcagtctggctgtgggaatcgcagcaatggtcctgtgtacgattcttacggtggtgattatcattgctgcacagcaccatgagaactattgggacccttag

SEQ ID NO: 29101 - DNA, 678 bp, Artificial Sequence
  Description of Artificial Sequence: Synthetic coding sequence
atgcccgggacccaaacacccgccccagccgaggatccccatagtggctgtcgagatccagtgccagctcggccgcaggcctgccacccaaagtcccaggagaccagatttgagggtcctctgccccctcctccgccggccgcggccgcaccccctccacccgctcctgcccagacagcccaggccccggggtttgttgtcccaacccacgcgggcactgtcgggacactccctttgggtggatacgtcgccccgggttatcccctgcagcttcaaccatgcaccgcttacgtccctgtgtaccctgtgggaactccctacgccggcggaacaccagggggtaccggtgttacttcaactctcccccctcctccccaggggccgggtttagctttacttgagcctaggcgaccacctcatgattatatgccgatcgccgtcctcactaccatttgttgtttctggccaacagggattatcgccattttcaaggctgttcaggtgagaacagccctggcgaggggcgacatggtatctgctgaaatcgcttcgagagaagccaggaattttagtttcatcagtcttgccgtgggaattgccgctatggtcctgtgcacaatcctcaccgtggttatcattatcgcggcccagcatcatgaaaactattgggatccatag

SEQ ID NO: 29102 - DNA, 921 bp, Artificial Sequence
  Description of Artificial Sequence: Synthetic coding sequence
atgtcctccgaaaagtcgggcctgcccgacagtgtgccgcacacatcccctccaccctataacgccccacaacccccagcggagccccctgcaccaccccctcaagccgccccttccagtcaccaccaccatcatcaccactatcatcagtccggtaccgcgacgctcccaagactgggcgctggaggtttggcatcttctgctgccactgctcagcggggcccaagcagctccgccactctaccccggcccccacaccacgctcctcctggtccagctgccggggcccctcctccagggtgcgctactctgccacgcatgcctcccgacccatatctgcaggagacaaggttcgaaggacccctgccccctcctccgccagcagctgccgcacccccaccgccagccccagcccagacagctcaggccccaggattcgtggtacccactcatgcaggcactgtgggcaccctcccgttgggcgggtatgtcgcccccggatatcctcttcaattacagccatgcacggcttacgtacccgtgtatcccgtcggcacgccctacgcagggggaactccggggggcacaggggtaacgtccactctgccaccacctccacagggcccagggctggccttgctggaacctcgaagaccaccccatgactacatgccaatagcagtgctgactactatttgctgcttttggccaaccgggattatagccattttcaaggcagttcaggtgcgaaccgccttggctagaggagatatggtgtcggcagagatcgcatctcgcgaagcacggaacttctccttcatctcactagcagtcggaatcgccgccatggtcctctgcaccatcctgactgtcgtgatcatcatagccgctcaacaccacgagaattactgggatccttag

SEQ ID NO: 29103 - DNA, 921 bp, Artificial Sequence
  Description of Artificial Sequence: Synthetic coding sequence
atgagcagcgagaagagtggtttgcctgattcggtgccacacacgagccccccgccgtacaacgcaccccagcctccagctgagccccccgctccaccccctcaggcagcgccctccagtcaccatcaccatcaccaccactatcaccagagtggaacagccactctccctcggctgggcgccggggggttggcctcaagcgccgcaacagcgcagcgtgggcctagttcaagcgccacactgccacgtccaccgcaccacgctccacccggccccgccgcaggcgcgcctcctcctggctgcgccacactcccccgaatgccacccgacccttatctgcaggagaccaggttcgaaggacccttaccaccgcctccgcctgccgctgcagcccctccaccacccgcacctgcccagacggcgcaagcgcccggattcgtggtgccgactcacgccggaaccgttggaactctgcccctaggcggatacgtggcccccggatatccactgcagcttcagccttgtacggcctacgtgccagtctaccctgtgggtacgccctatgcaggtggtacgccaggaggaactggcgttacatccacactgccaccaccgccacagggcccgggcctggccctgctggagccacggcgacccccacacgactacatgcctattgctgttcttaccacaatatgttgcttttggcccaccggaatcatagcaatctttaaggctgtccaggtgagaactgctctggctcggggagatatggtctcagctgagatcgccagcagagaggccaggaatttcagcttcatctcattggccgtcgggattgccgcaatggttctttgtactatccttaccgtcgtgataattatagctgcccaacatcacgagaactactgggatccatag

SEQ ID NO: 29104 - DNA, 192 bp, Artificial Sequence
  Description of Artificial Sequence: Synthetic coding sequence
atgccaggaactcaaacccctgcacccgccgaagatcctcatagcggatgcagggatccagtgcccgccaggccccaggcttgtcaccccaaatcccaggaaactagatttgagggtcctctcccaccgcccccgcctgccgccgccgccccaccacccccagctcccgcacagaccgctcaggcaccttag

SEQ ID NO: 29105 - DNA, 921 bp, Artificial Sequence
  Description of Artificial Sequence: Synthetic coding sequence
atgtcttcagaaaaatctggactccccgactccgtgcctcatacctccccaccaccctataacgcaccccagccccctgctgagccccctgcccccccaccacaggccgccccgagctcacaccaccaccaccaccaccactaccatcagtccggaaccgcaactctgcccagactgggagccggtgggttggcaagcagcgccgccaccgctcagaggggtcccagctctagcgccaccctacccaggcccccacatcacgctccccccggccctgcggccggagcaccaccccccggatgcgccacgctgcccaggatgccaccagatccctacctccaggagactaggttcgagggtcccttgcccccaccaccgccagccgcagcagctccgccaccacccgctccggcccagacggcccaggcgccaggattcgtagtgccaactcatgcaggaactgttggaactctaccgctgggaggctacgtcgcaccaggatacccactccagttgcagccatgcactgcctatgtgcctgtctaccccgtcggaacaccttatgccgggggtacacccggaggcaccggcgtcacgtctacactgccacccccgccgcagggcccaggacttgcactcctggagcctagacggccacctcacgattatatgccaatagccgtgttgactaccatttgctgcttctggccaacaggcattattgctatctttaaagctgtacaagtgaggactgccttggctcggggagatatggtcagtgctgagattgcttcacgagaggctcgcaacttctcttttatctccctcgccgttggaatagccgcaatggtgctgtgcactattttaaccgtggtgatcataatagccgcccaacaccatgagaattattgggatccgtag

SEQ ID NO: 29106 - DNA, 678 bp, Artificial Sequence
  Description of Artificial Sequence: Synthetic coding sequence
atgcccggcacccagacaccggccccagcagaagatccccattcaggctgtcgagatccagtccccgcccggcctcaggcttgtcatcctaaaagccaagagactcgcttcgaaggtcccctgcccccccccccccctgccgctgcagctcccccaccccctgcccctgcccagacagcccaggctccaggatttgttgttccaacacacgctggtactgtgggcactctgcctctgggcgggtacgtcgccccgggctaccccctgcagctccagccttgcaccgcgtatgttcccgtgtaccctgtcgggaccccctatgccggcggaacaccgggaggcaccggcgtgaccagtacgcttccccctcctccacagggacctggactggctttactcgagccaagaaggcccccccatgactatatgcctattgccgtgttaaccacgatttgctgtttttggcctacaggcatcattgccatttttaaggctgtgcaggtccgtacagccctggcccgcggggatatggtgtccgccgaaatcgcatcgcgagaggctcgtaatttttctttcatctctctggctgtggggatcgccgcaatggttctttgcacaattctcactgtggttatcatcattgcagcccagcatcacgaaaattattgggatccatag

SEQ ID NO: 29107 - DNA, 678 bp, Artificial Sequence
  Description of Artificial Sequence: Synthetic coding sequence
atgcccgggacacagactccggctcctgctgaagaccctcactctgggtgtagagaccctgtcccggctcggccgcaagcctgtcaccccaaatctcaagagaccaggttcgagggccctttgccaccgccaccccccgctgccgcagcccccccaccacctgcacccgctcaaaccgctcaagcacctgggttcgtggtgcccacccacgcgggaaccgtcggcactcttcctctgggggggtatgtcgctcccgggtaccccttgcagctacagccttgcacagcttacgtgcccgtgtatcctgtcggaactccatacgcagggggaactccggggggcaccggagtaacaagcacgttgcctccaccacctcaaggacccggccttgccctcctcgagcctcgacgcccgccccatgactatatgcctattgcagtcctgactacgatctgttgcttctggccgactgggattattgctatttttaaagcggtgcaggttcgaactgctctcgcccgcggagacatggtgagcgccgagattgcaagtagggaggcaagaaatttttcattcattagcctagctgttggcatcgccgctatggtgctgtgcactatactgaccgtcgttataataatcgccgcccagcaccacgagaattactgggacccgtag

SEQ ID NO: 29108 - DNA, 678 bp, Artificial Sequence
  Description of Artificial Sequence: Synthetic coding sequence
atgccaggcactcagacgcccgcaccagctgaggatccacatagtggatgccgggatcctgtgcctgcccggccccaagcttgccacccaaaatcacaggagacaagattcgaaggtcccttgcctccacctccgcctgctgccgctgcgccgccacccccagccccggcacagactgcacaggccccaggattcgtcgttcccacccatgccggaactgtcggaactctccctctcggaggatatgtggctcctgggtatcccctccagctccagccatgtaccgcgtacgttccggtgtatcctgtcgggacaccctatgctggtggcacacccggcgggaccggagtcacaagtaccctcccgcctcccccgcagggtccaggtttagcccttcttgaacctcggaggcccccccatgactacatgccgatcgccgttctaaccactatctgctgtttttggcccacaggaatcatcgctatctttaaggccgttcaggtcaggactgccctcgctagaggtgatatggtttctgctgagattgcttcccgcgaggcaaggaattttagctttatttcactggccgtgggtatcgcagcaatggttctgtgtacaatcctcaccgtggtgattatcatcgcagcacagcaccatgaaaattattgggatccctag

SEQ ID NO: 29109 - DNA, 678 bp, Artificial Sequence
  Description of Artificial Sequence: Synthetic coding sequence
atgccgggaacacaaactccggcccctgcggaggacccgcactctggctgcagggatcccgtgcctgcccggccccaggcgtgccaccctaagagccaggagaccagatttgaggggcccctcccgccaccacccccggccgctgcagctcccccccctcccgcccctgcccaaaccgctcaggctccaggattcgtggtgcccacacacgccggaacagtaggtactctccctctgggaggatatgtggcccctggctaccctctacaactgcagccctgcactgcttatgtgcctgtgtaccccgtgggaaccccctatgccggtgggacacccggaggcaccggagtcacctctactctgccgccccccccacagggaccagggctggcgcttctggagccacggagaccaccccacgactacatgccaattgcagttttaactacgatatgctgcttctggcccacgggtattatcgccatatttaaagcggtccaggtgcgcacagccctggcccgaggcgacatggtctcggccgagatcgcatccagagaggcccggaatttcagtttcatatcactggccgtgggaatcgctgctatggtgctctgtaccatcctgactgtagttatcatcatcgctgcccagcatcacgaaaactactgggacccctag

SEQ ID NO: 29110 - DNA, 678 bp, Artificial Sequence
  Description of Artificial Sequence: Synthetic coding sequence
atgccgggaacccagacaccagctccggctgaagatcctcactcaggctgtcgggatcccgtccctgcaaggccacaggcatgccacccgaaatcccaagagacacgcttcgaaggtcccctgccccccccccccccggccgctgctgcaccccctcctccggcaccggcccagacagcgcaggcccccgggttcgttgtgcctacacatgctggcaccgtaggtacactgccacttggcggctacgttgcaccgggatacccactacaactgcagccctgtacagcttacgttcccgtctaccccgtcggtacaccttatgctggcggcacgccaggtgggactggagttacaagtactctgccgccacccccccagggaccaggcctggccctgctggaacctagacgccctccccatgactatatgcccatcgctgttctgaccaccatttgctgcttctggccaaccggaattattgccatcttcaaagcagttcaggtgaggacagctttggctcggggagacatggtaagtgccgaaatcgctagccgcgaggcccgaaacttctcgtttatctccctcgctgtcggaattgctgcaatggtgctgtgcaccatcttgactgtggtcatcattattgccgcgcaacaccatgagaattactgggatccctag

SEQ ID NO: 29111 - DNA, 678 bp, Artificial Sequence
  Description of Artificial Sequence: Synthetic coding sequence
atgcccggaactcagacgccagcgcccgcagaagacccacattctggctgccgagacccagtacccgctcggccacaggcttgccacccgaagtcgcaggaaacccgctttgaagggccactgccgccaccccctccagctgccgctgctccgccccctcccgctccggctcaaactgcccaggccccaggcttcgtggtgcctacacacgctggaaccgtgggcaccctacccctgggcggctacgtggcccccgggtatcccctgcagctgcagccatgtacggcctatgtaccagtataccctgtcggcacgccttatgccggcggcacaccgggcgggactggtgtaacctccactctgccacccccacctcagggaccggggctcgctttattggagccaagacggccccctcatgactacatgccaatcgcggtcctgaccaccatatgctgcttttggcccactgggattatcgccatattcaaagcagtgcaggttagaaccgccttggcacgaggtgatatggtaagtgccgagattgcgagccgagaagctagaaatttcagctttatcagtctcgccgtgggcatcgcagccatggtgctgtgtacgatcctcaccgtggtgataattattgccgcgcagcatcacgaaaactactgggacccttag

SEQ ID NO: 29112 - DNA, 678 bp, Artificial Sequence
  Description of Artificial Sequence: Synthetic coding sequence
atgccaggcacacagacgccagcgcccgccgaggatccacacagcggctgcagagacccagtgccagcccggccccaagcctgccatccaaaatcccaggagacacgctttgaaggacctcttccacccccaccaccggccgctgcggcccctccgccacccgctcctgcacagaccgcgcaggcacccggttttgtcgttcctacccatgcaggaacagtgggtacccttcctctgggagggtatgtcgcacccggctacccgttacagctgcagccttgcacagcatatgtccccgtctatccagttggaacaccatacgcgggcggcacgcctggagggaccggcgtgactagtacattgcccccaccacctcaaggaccagggctcgccctgctagagccaagacggccccctcacgattacatgcctatagccgtgctcactactatttgctgcttctggcctacggggattatcgcaatatttaaggctgtgcaggttcgcacagccctcgcccgcggcgacatggtaagcgcagagatagcttcccgagaggctaggaatttttcttttatcagtctggctgttggaatcgccgcgatggttctctgtactatcctcaccgtcgtgatcattattgcggcccagcaccacgagaattattgggatccgtag

SEQ ID NO: 29113 - DNA, 2946 bp, Artificial Sequence
  Description of Artificial Sequence: Synthetic coding sequence
atggcctcaagcccatggggatgtgtgtgcggtctgctgcttctgcttcttccacttttgggtaccggtccagctcttggccgcgggtttccacgccctttggaaaactccgagattccgatgattcccggagctcaccctaaggggtccgtcggttctgagccccaagcctttgacgtcttcccggagaatccaagagccgactcacaccggaacagcgacgttcggcacgcaccagctgaagaaatgcctgaaaagcctgtggcgtctcctctcggccccgccctgtatggcccaaaggccgctcagggcgcccagagggagcggctgcctgtgactgacgatctgcaaatggcccaaggcccgtcctctcacggctggactggtcctctggattctcaagagctgctgcagcaggaagctgttgctccacaccctgtgggacaccctcacttgacattcattccaacaaccccacgaagacagcttagagtggctaccgttcccccatccctgcagcatgaaggtcaagagggccaatggcccccccgggacgaagggctgaaggctaagaccaaaagcagagtacccccaacctcaccctccgaccaccagggccctcctcacactctggtttcacacagcgggaccgtcaaacgaccagtgctggagggccagggaggttttgaggagcacctgcaagaggccgcacaaggcccgcacttcacacaacaggatcctgctgctcccgacgtggggtcagtccccccagtggaagttgtatattctcaggagcccggtgcccagcctgatctggcactcgcacgctctctccctcctgctgaggaactcccagttgagactcctaaacgagccggtgccgaggttagttgggaagtgagttcgcctggcccaccacccaagcaagccgatctgccagatgccaaagattcccctgggccacagccaactgatccaccagcttccgaagccccagacagaccgtctaaaccagagcgggccgccatgaatggtgccgatccaatcagcccccagagagtgcgtggtgccgtggaggccccaggcacccccaaatccctgatcccaggacccagtgacccgggtcccgctgttaatcgcacggaaagtccgatgggggccctgcagcctgacgaggcagaagagtggcccggcagaccacagagtcaccctcccgcgccccctgtccaggccccttcaaccagtagacgggggcttattagagtgaccacccagcgagccctgggtcagccgcccccccctgagcccactgctagcagtatggcctctgctccagcctcttcacctcctgctaacgccactgcaccccccttgcgttggggcccactacggagagtgctcagtttctcatgggagcttcacgtgtatggcgtgggcgttctgtttctcctgccggctcttctggcattggccgcactcgccgccgcccctgccggcccacgcctcgctttagtggcagcggtacttgtgttggtggcatccgctctccggtcagcctacatgctaacagatccatacggctcccaggcccggctgggcgtgcgcgggggactggtgctgtacaacctgccttttcctctgctcttgacagctctcgcggccctcacgttactcgggctgggggcaggactgccaccccccctgcagaatccgttactgttaggggccgtggccctcgtgcatggggtagggctgcttgctactgatctcctttcaacatggagtgtgctcaacctgctaacccaaggcctatcatgcgcttggggcgccgccgtcgcactcggcacactttgcctgtgtcggcggagactgctggatgggcctcgcgggtgggacgcgagccccggccctcggctgttggcagtcgccggagccctgggcctgctggccagcggcctccagctggccgccgctctgtggctatatccgggcccagggagggtgggaagattttcttgggcatggtggggagtccatttctggttgagactgctggaactcacttgggctctggccttagctctggccgcggtcgccgctgcaagaccgcggcctcctactgagcatgcatgttgggccaagctgatgagattggcgtgccccgcgccaagcggcaaatccgaggtgcccgagaggcccaataattgctatgcgggcccatccaacgtgggcgccgggtccctcgatattagtaagtcacttataaggaatcctgccgagtctggacagctggcaactccctcttctggcgcctgggggtctgccgcttccctgggccgaggaccccaggggggccccggtctgtcacgtaatggagttggccctgctccctccctgagtgagcttgatctgcggccaccgtccccaatcaacctgtctaggagcattgatgccgctctgtttcgcgagcacctggtgagggattctgtgtttcaaaggtgtggcctccgaggactggcttctccccctcccggcggagccctgagaccgaggcgaggaagccaccctaaggcagaactggatgatgctggttcaagtctgctgcgggggagatgccggagcctgtcagacgtgcgcgtaaggggaccggtaccccaacatgtggtggaggcacctgacggagccgccgctgctgcatctggatcttccctggatagttttagccgcggtagcctgaaaatatcatggaacccttggaggcacgggctgtcatctgtggattcattgcctctggacgaacttccctctacggtacagttacttcccgcccccacccctgctcccgacagcactgctgctaggcagggcgatgggcagggtgaggttcagccaaggggaaaaccaggagaatctcgctccgctagcagtgacactatcgagttgtag

SEQ ID NO: 29114 - DNA, 2946 bp, Artificial Sequence
  Description of Artificial Sequence: Synthetic coding sequence
atggcttctagcccctggggttgcgtttgcgggttgctactactcctgctgcctttgctgggcacgggcccagccctagggcgcgggtttccaagaccacttgagaacagcgaaatccctatgataccaggggcacaccccaaagggagcgtggggtcagagccccaggccttcgatgtattccctgaaaatccgcgcgcagactcgcatagaaattcagatgtgcgtcacgccccagctgaggagatgcccgagaaacccgtagccagtcccctgggcccagcactctatggtccaaaagcagcccagggtgcgcaacgagagaggctccccgtcactgatgatctgcaaatggctcaaggcccttcatctcacggctggactgggccactggattcccaggagctgctgcagcaggaggccgtggccccacatcccgtaggacatcctcatctgacatttataccgactacccccagacgccagttaagggttgccacagttccaccatccttgcagcatgaggggcaggaagggcaatggcctccgcgagatgaggggttgaaagccaaaaccaagagcagagtacccccgacttctcctagcgatcaccaaggccctcctcacacacttgtgtcccatagtggcaccgttaaaagaccagtcctggaaggacagggaggatttgaggaacacctgcaggaggccgcacagggcccccactttacccaacaggacccagctgcccctgacgtgggatctgtgcctcccgtagaagttgtgtactcacaagagccaggggctcagcctgacctggccctggcgagatccctcccacctgccgaggagttaccagtagagacacctaagcgagccggcgctgaagtctcatgggaggttagttcaccaggcccgccacccaaacaggccgacttgcctgacgccaaagacagcccaggtccacagcccaccgatccaccagcctcagaggcacccgacaggccatccaagcccgagcgggctgctatgaatggggcagaccctatctccccacaacgcgtacggggagccgtcgaagcccccggtaccccaaaatccttaatccccggaccaagtgatccaggcccagccgtcaaccgaacagagagtcctatgggcgccttgcagccagatgaagcagaggagtggcctggaaggccacagagccatccgcctgctcctccagtgcaagcaccctccacgtccaggcgaggcctgatacgcgtgaccactcagagagcactcgggcagccaccacctcctgaaccaaccgcctcttctatggcaagtgcccccgcaagttccccccccgccaatgccaccgcaccaccactcaggtggggccctctgcggcgggtcctgtccttttcctgggaactgcacgtgtacggcgttggagtcctctttctcctgccagcccttttagctttggctgctcttgcggccgcgcctgctggcccccggctggccctagtggccgctgtgttggtgctggtggcgtctgctctgcggtctgcctatatgttaaccgacccatatggatcccaggcaagactcggcgtgcggggcggcctggtgctctataatcttccatttcccctccttctgacagccctcgcggcacttaccctgctcgggctgggcgctgggctcccaccaccactgcagaatcctctgctgctgggggcggtggccctggttcacggagtgggcctcctcgccactgacctactctctacgtggagcgtgttgaatctactcacacagggactgtcttgtgcttggggagcagctgtggcattgggtactctgtgtctgtgtaggcgcagactgcttgacggtcctcgtggatgggacgcttctccaggacccagattgctcgcagtggccggggccttgggcctgcttgcatctggccttcagctggccgcagctctgtggctgtatcccggccccggccgggtcggcaggttttcctgggcatggtggggcgtgcacttctggctgaggctccttgaactgacctgggcactcgcgcttgcactggctgccgttgccgccgcccgccctaggccccctactgaacacgcctgttgggctaagctaatgcggctcgcctgccctgccccgtcgggaaaatccgaggttccagagcgtccgaacaattgctacgctggcccctccaacgttggtgcgggatcgctagacatctccaaatctctgatccgcaaccccgccgagtcaggacagctggctactccttcttcaggagcctggggctccgccgcatctctgggccggggtcctcagggcggaccaggtctaagcaggaacggcgtgggtccagctccaagcctctctgagctggacttgagaccaccgtccccaattaacctgagccgctctattgatgccgctttgtttcgcgaacacctggtgcgagacagtgtgttccagcggtgcggactgaggggcctcgctagccccccgcccggcggcgctctgcgccctagacggggcagccatcctaaggccgaattggatgatgccggcagttcgctgctgcgcgggcggtgtcggtctctgtccgacgtgagagtgcgtggacctgtaccacagcatgtcgtcgaagcgccagatggagccgctgctgccgcctctggatctagcttagactctttctcccgcggttctcttaagatttcttggaacccctggcgacatggcctgtcctccgtggactccctgcctctggatgaactgccctccaccgttcagctgcttccagctcccacgcctgcaccagattccaccgctgcccgccaaggcgatggccagggggaggtccaaccgcggggcaagccgggagaatccaggtcagcaagctccgacacaattgagctttag

SEQ ID NO: 29115 - DNA, 2082 bp, Artificial Sequence
  Description of Artificial Sequence: Synthetic coding sequence
atggcaaggcacggctgcctgggtctgggtctgttttgctgcgtgttgtttgcagccacggttggaccgcaacccacacccagcatacctggtgcccctgcaaccacactgacccctgtgcctcaatctgaggccagtatgctgtcactgaacctgggactgaactttaaattccacctgcgtggccccgcagccgtctggggaagtcctgtcaccgagacccaacccctgagtctgggccctggccaggagccgggggaggaggttgctagtgggctaaggacggaccccctctgggagcttctggtaggcagctcggggaatagcctcaccgaatggggttcgacagagggggggtccaagccgagggccagctccctcctccctgagtctacctctcggcgtagcggacccagtgatggacccaccgccccttaccagccccgtcggagcactgtgacatgggatacagcgttgatggtgacagccttaccgtcttccgctccaagacctcaccagtccgagttggagctgaaatttgatatggcgttaagagctggtgccgcccctacgttggggcaccgaaccctccccctccttccctctctgagggcttctttggccgagattgcgggaagactcggaccttttggcttcttcggcacaaccttgagcccactgagaaacttctccgggttgagtcctcctggtgagacaaccagtaccagctcagcatccggggtgagcgggtcccttgggtttctaggaaccactctgtcgctgccaccctattcactagaaagaaaactgagcagcccatcccccctggaccccgcagcatcgctctctttcgcaagcatcgccacgacatctctggatccaaccgttccaatcagtgggcctgacgacctgagtcccccagcctccctcggaaacccttcgggacaacctgaatgcggaccaggctcatgctcggttggtgagttacctgaacgggagggacagcccccggaagcccctagaccattattcttcttaacactggaggccgactgggcagaagcccgcgcacggtgggggctggcctgggaggcgcacgtttatggagggtacgaggttttgcacgccctgggctatggaggacagtcagggctagaaggaccgtggccttggtgggcctttcagcttggcctccgtctgggggaagtgggtgttgctctcccccttgctttgctggggctctaccctgctctgtgtagccctagggtacctccccgatgctgggccaagctgtttcgcctgtcccccggacacgctgccccgctactacccggggggtgggtgactggcccccctgataaggaacctcttggtagcgccatagctcggggtgatgccgaacttctgcagctgtgcgcactcgccggcccgggcccagacctgctgctacagggaggaggatgtaggggctttgagggagctgctgccaacccagcaccttctcccgcctcatcgccatgtagcgactatactgtggactttaggccgccaagtcctatcaacctgcgcaggtctatcgaggaggccctttgtagcgaggcattgttggccccaggactcttccagggaccagctttcgaagacgctctgcccggcctaggactctacaggaccgcatctctcgggactgggggccgggccagcgagcgctctggggaggcctccggacccgcagcacctccagagctgccctcccctggcgcctggccggccggatccagcgtctcttccggctccttctgtggcctgagccgagatagcagcagtatgctgctgtgcagcagcccagacagaccacctcgctgccctctcgtgtgcgtgctgtccccacctcgaccctctggcagcagcccttcactcccggctagtgggtcctaccaggccctgtcaccaccctcaagagacagccctgaaccggcaagcgagttacaggcggaggaggcgctcctgcaggagcagtttctcgacgcctgccgccagatcgacgaactgtctgtcggatccgacacaatcgacttgtag

SEQ ID NO: 29116 - DNA, 2700 bp, Artificial Sequence
  Description of Artificial Sequence: Synthetic coding sequence
atggcccgccatggttgtcttggtctgggcctgttttgttgcgtgctgttcgcagctacagttggtccccagccaacaccaagcatcccaggcgctcccgcaacgaccctgactccagtgccgcaatccgaggctagtatgctgagtctgaatttaggactgaactttaaatttcatttgcggggaccagctgccgtgtggggctctccggtgacagagactcagccactttccctcggcccaggccaggaaccgggcgaggaggttgccagtgggctcaggaccgatcctctctgggaactcctggtgggcagcagcgggaactcacttaccgaatggggctccaccgagggcgggtccaagccacgtgccagctctctgctcccagaaagtacatcacgcagaagcggtccatctgatggcccaaccgccccttaccagccccgtcgcagcacagtcacatgggatacggccctaatggtgactgcactgccgtcttcagcaccacggccccaccagagtgagctggagctgaaatttgacatggccctgcgagcaggggctgcccctacgttgggtcacaggactttaccgcttcttccaagtctcagagcgagcctggcagaaattgccggacgactggggccgttcggattcttcggtactacactgagtccactgcggaactttagcggactgtctccccctggagaaaccacctcaacttcatcagcttccggggtgagcggcagtctggggttccttggtacaacactgagtttaccaccttactcattagagagaaagctgagctcgccctccccgctagatccggcagctagcctttccttcgcttcgatagcgactacctcactggaccctactgttcccatatctggaccagatgacctttcacctcctgctagcttgggtaatccatctgggcagccagaatgtgggcccggatcctgttcggtcggggagctccctgagcgagaggggcagcctcccgaagcgcctagacctctattctttttaacgctcgaagctgattgggccgaggctagagctcggtgggggctagcctgggaggctcacgtgtatggtgttggagccctgtttggcctcgttgctctactcgccctgctggctttagccctgctgccatggcggtgtcctcccggtgccccttgtcttgcccttttggacctgctgcttcttagtgccgggaccacccgggcctttcctctcttctacgacgcctacggccaccgggaccggctgccagctctggcttggttgctattgcaggacttaccattgccgtgcctggcagcaggcctggggctcgcatgtctcctgcttgctcggccaagacctccacgttgtccaacagggctggcagcgctccttctgctggggctcgggttggcggctgcggctgcactcggtagcgcagcacataggccgctgagaccgcttcgattagcatcgagaggactgcacgccttcctggcagcttttttaagcggtctgctgcttgcgttatcgtgttgggggggcaggcgccgccgagctggcgccccactggggggatccggttttaagggggccacgccactgccccagggccgcagtcccttcgctccgcgggaaagttggcggcgtgcagcaagaaccgcacccgtggcgggaaccttcggtttactgtccggagcgcttcagggatatgaggttctgcatgctctggggtacgggggccagtcagggttggaaggtccctggccctggtgggccttccagctagggctcagacttggcgaagtcggggtcgcactccccttggctctgttaggattgtaccctgccttgtgcagcccacgcgtccccccacggtgttgggccaaactcttcagactgtcacctgggcacgcagcccctctgcttcctggaggatgggtgaccggaccgccggataaagagccactgggcagtgcaatcgccagaggtgacgctgagcttcttcagctgtgcgccttggccggacctggtcccgaccttcttctacagggaggaggctgtagggggtttgagggtgcagcagcgaaccccgctcctagccctgcctcttctccttgcagcgattatactgtagattttcggcctcctagccccattaatctgaggcggtctattgaggaggctctatgttccgaagccctcctcgcccctggattgttccagggtccagcattcgaggatgcgctaccgggtctgggactgtatcgcaccgcgtcactcggcaccggcggacgcgcgagcgagcgctctggcgaggcgtccggacctgccgcacccccggagctaccctcgcccggcgcatggccggcggggtcatccgtgtcctcgggatccttctgtggcctgtccagagattccagtagcatgctgctctgctcttcgccagacaggccccctcgatgtccactcgtatgcgtgttgagcccaccacgtcctagcggaagctcccctagcctgcccgcatcggggtcttaccaggccctaagtccgccctccagagactcgccagaaccggcaagtgagctgcaggccgaggaggctctgctgcaggagcagtttctggatgcttgtagacagatcgatgagttgtcagttggctcggacaccatcgacctgtag

SEQ ID NO: 29117 - DNA, 2700 bp, Artificial Sequence
  Description of Artificial Sequence: Synthetic coding sequence
atggcccgccatgggtgtctggggctcggattattctgctgcgtgctgttcgccgcaacagtggggcctcagcccacaccctccatccccggcgcgcctgcgacaacactaacaccagttccccagagcgaggcatctatgttatctttgaacctgggtctcaacttcaaattccatctgcggggtccggctgcggtgtgggggtcacccgtgacagaaacacagccactctcacttgggcccgggcaggagccaggggaagaagtggccagcgggctcagaactgacccactttgggagttgctggtcggatcctcagggaattccctgaccgagtggggctcaacagagggtggaagtaagccgcgagcaagctcgctactgccagaaagcacaagtcgcagaagcggtcccagtgatggcccgactgccccttatcagcccaggcgaagtaccgtgacgtgggataccgcgttgatggtgaccgccttgccctcttcagctcccaggccacatcagtctgagctcgaactaaagttcgatatggctctccgtgccggtgctgctccaaccctcggccacagaactctgcctttgttgccctctctgcgtgcttctctagccgaaattgccggcaggctgggcccgttcggtttctttggcactacactgtcccctttacggaattttagtggactgtccccacctggggaaacaacaagtacaagctccgcttcaggtgtgtccggcagccttggtttcctcggcaccactctatccctccctccatatagccttgagaggaagctatctagtccaagtcctctggaccccgccgctagcctgagttttgcctctatcgccaccacatccctagatcccacagtgcccatttcaggtccggatgatctttccccacctgccagcttgggtaatccgtcaggacagcctgaatgtggacctggctcatgtagcgtgggagaacttccggagcgcgaaggacaacccccggaagcccccaggcctctgttttttcttacgttagaggctgactgggccgaggcccgcgcccgctggggactggcatgggaagctcatgtctacggtgttggggccctttttggactggtggcactcctcgccttgctggcactcgctctgctgccgtggagatgtccacccggagctccttgtctggcgctgctcgatttgctcctgctgtccgccgggaccacacgcgcttttccgctgttctacgatgcttatgggcaccgagataggctgcctgccctcgcatggctactcctgcaggatctgcccttaccctgtttagccgctggcctgggactggcctgccttctgctggctcgccctcggccccccaggtgtcccacaggcctcgcggccttactgcttttggggttgggcctagcagcggctgccgctctcgggtctgctgcacaccgacccctgagacctctgcggctggcctcccgcgggcttcacgcctttctcgcagccttcctcagcggcttgctgctcgcgctttcctgttggggcggccggcgaagacgggcgggcgctcctctaggagggtcggggttcaaaggcgccacccctctgccgcagggcaggagccccttcgctcctcgcgaatcctggcgtcgcgcagcacgcactgcaccagttgccggcacgttcggcctgctctccggcgcactgcaaggatatgaagtgctacacgcacttggatacggcggacagtcgggactggagggcccttggccatggtgggcgtttcagctgggcctgagactcggggaggttggtgtggctctgccactagcactgttgggactgtatccggccctgtgtagtcctcgcgtcccaccaagatgctgggccaagctgtttaggctgtctcccggccacgccgctcccctcttgccggggggatgggtgactgggccacctgacaaggagccactgggtagtgcaattgcaagaggggacgccgagctattgcagctatgtgccttggccggaccaggaccggacctactactccagggcggggggtgtcgtggcttcgaaggagctgcggcaaatcctgcaccgtctccagcatcgagcccatgcagcgactatactgtggattttcgcccaccgtcgccaatcaatctcagaagatctattgaggaagccctctgctccgaagctctcctggccccaggcctctttcagggtcctgccttcgaggacgctctgcctggccttggcctgtaccggacggcctccctgggcacgggcggccgagctagcgaacgaagcggggaggcttcgggcccagcagctccccctgagctcccctcacccggtgcatggcctgcaggtagctccgtgtcaagcgggagcttttgcggcctcagccgggactcatcaagtatgttgctgtgctccagtcccgaccgaccccctaggtgtcccttggtttgcgttttatccccccctcgcccctccggtagttccccatccctccccgcgagcgggtcttatcaggcactgtcccctccaagccgggatagtcctgaacccgcctcagaacttcaggcagaggaggccttgctacaggagcagtttttggatgcatgccgacaaatcgacgaattatcagtggggtccgatactatcgatctctag

SEQ ID NO: 29118 - DNA, 1290 bp, Artificial Sequence
  Description of Artificial Sequence: Synthetic coding sequence
atggcccgtcatggttgcttgggacttggactcttttgctgcgtgctgttcgccgctactgttggccctcaaccaacccctagtatccccggtgctcccgcaacaaccctgactcctgttccccagtcggaggcatccatgctgagcctgaacttgggtcttaattttaaattccatctaagggggcccgctgctgtgtggggatctccggtgaccgagacccaacctctctctctgggccccgggcaggaacctggagaggaagtggcatctgggctccggacggacccgctgtgggagctgctggtgggcagctcaggcaacagcttgacagagtgggggtctaccgaaggaggcagcaaacctagagccagttcccttctgcccgagagcacctcacggagatccggtccatccgacgggccaacagctccgtaccagcccagacgaagcactgttacttgggataccgccctcatggtaactgccctgcccagcagtgcccccaggccacaccagtccgagctcgagctgaaatttgatatggctctccgtgctggcgctgcccccaccctgggccacaggactcttccactgctgcccagcctgagagcttctttagctgaaatagcgggccgcctgggcccgttcggcttttttgggaccacgctctcaccgctccgaaatttctcaggactgtcacccccaggagagacaacctcaacgtccagtgcgtcaggtgtcagtggttccctcgggttcctcggaactacactctccctgcccccctattcacttgaacggaagctgtcttcaccaagcccactggatcctgccgcctctctatctttcgcaagcatcgcaacaaccagcctggaccccaccgtgcctatttcaggtcccgacgacctgagcccgcccgcttcactgggtaatccttctggtcagcccgaatgtggtcccggatcttgcagcgtgggggagcttccagaacgcgaaggtcagccacccgaggcgccacgtccgctgtttttcctgactctggaggctgactgggccgaggcccgcgcccgttgggggttggcctgggaggctcacgtctatggcagactgcacagaggtctgccacccgccctccctaaccagccagcgactcaacaccgcggcggcccgcttcaacgcgggcccgcttgcgcctggccattacccggcccttgcctcagagggcggagtgcgtgggcgagaaccctgcctcatcgcctcgctggcgatcgtggccaaggccagtag

SEQ ID NO: 29119 - DNA, 1692 bp, Artificial Sequence
  Description of Artificial Sequence: Synthetic coding sequence
atggctgccgcagctgtcactgggcaacggcccgaaaccgccgccgctgaggaggcctctcgccctcagtgggcaccacccgatcactgtcaggcacaggctgctgctgggttgggcgatggcgaggatgctcctgtacggcccttgtgtaagccgagagggatctgtagcagagcctactttctggtgctaatggtattcgtccacctttacctcggcaacgttctggctctcctgttatttgttcattactccaacggtgacgagagtagtgaccctggtccccagcaccgcgcacagggtccgggcccggagccgaccctgggcccactgaccagattggaaggaattaaggtcgggcacgaacgaaaagtgcagctcgttactgaccgagaccactttatacggacgctgtctttgaagcccctgctcttcgaaatccccggatttttaactgacgaggaatgtagacttatcatacacctagcccagatgaaggggctccagcggagtcaaatactccctacagaggagtacgaagaggccatgtctacaatgcaggtgagccaactcgatctttttagactgttggatcagaatcgggacggacatcttcagttacgagaagtgttggctcagacccggctgggcaatgggtggtggatgaccccggagtctatccaggaaatgtacgccgccatcaaggccgaccctgacggcgacggtgtgctgtctctgcaggagttttcaaacatggacctgcgagatttccacaagtatatgagaagccacaaggctgaaagtagtgaattggtgcgcaactcacaccatacgtggctgtaccagggagaaggcgctcatcacattatgagagcaatccgccagagagtactgagactcactcggttgtcacccgaaatcgttgagctttctgagccactccaggtagtccggtatggcgagggcgggcactaccacgctcacgtggatagcggcccagtgtatccagagactatctgctcccataccaagcttgtggcaaacgaaagtgtgccattcgagaccagttgtagacaagtgtcccccaactggggactgccatccatcctcaggccgggcactcctatgacacaagcacagccttgcaccgtaggagtgcctcttggaatggggccaggtgaccactgggtgatcccagttagtccttgggaacacccacaactggggacatgcagtgtgccccctctaccatactcatacatgaccgtgctcttctacttaaacaacgtgacaggtggaggcgaaacagtgtttcctgtggctgacaaccggacatacgatgagatgtctcttatccaggatgacgttgatctcagggatacgagaaggcactgcgacaaggggaaccttagagtgaaaccgcagcaggggacagctgtcttctggtataattacctgcctgatggtcagggctgggtaggcgatgtggacgattatagcctacacggggggtgtctcgtcacccgtggcacaaaatggatcgctaacaactggattaacgtcgatccaagccgggctaggcaggccctgttccaacaggaaatggcccgcctcgcccgcgaggggggtaccgatagccaaccggagtgggcccttgatagagcctaccgcgatgcacgagtcgagctatag

SEQ ID NO: 29120 - DNA, 1509 bp, Artificial Sequence
  Description of Artificial Sequence: Synthetic coding sequence
atggcagccgccgccgtaactgggcaaagacctgaaacagccgccgcagaggaggccagcaggccacaatgggctccgcccgatcattgccaagctcaagctgcagctggcttgggtgatggcgaagatgcccccgtacgacctctgtgtaaaccaagaggtatctgttcacgggcgtattttctggtgcttatggtcttcgttcacctctatcttgggaatgtcttggcactcttacttttcgttcattattcaaacggggacgaaagctccgatcctggccctcagcatcgagcgcagggccccggcccagaacccactctaggaccactaacacgactggagggcattaaagtcggtcacgaacggaaggtgcagctcgtgacggacagagatcatttcattaggaccttaagtttgaagcccctattgttcgagattcctggctttctgactgacgaggagtgccgcctcatcatccatctggcccagatgaagggcctgcagcggagccagattcttccaaccgaagaatacgaagaggctatgagcaccatgcaggtgtcccaactagatcttttccgactgctggaccaaaacagggacgggcatttgcagctacgcgaggtgttggcgcagacgaggctaggtaatggttggtggatgaccccagaatccattcaggagatgtatgcagcaatcaaagccgatccagacggagacggtgttctctccctgcaggaatttagcaatatggacttacgagatttccataaatatatgaggtcccacaaagctgaatcaagcgagctagtacggaactcacaccatacttggttgtaccaaggggagggggcccatcacatcatgagagcaatccgccagcgcgtgttgaggctgacaagactctcacctgaaattgtggaactgtctgagccgctccaggtggtgcgatatggtgaaggaggccactaccatgcacacgtcgatagtggtcctgtgtaccccgaaacaatttgttcccataccaaactcgtggccaacgagtccgtgccttttgagacatcttgtaggtatatgactgtgcttttctacctgaacaatgtgactgggggcggcgagaccgtgtttccagtggccgacaacaggacctatgatgagatgtcactcattcaggacgatgtcgatctgcgtgacacaaggagacactgtgacaaggggaatttgagagtcaaaccacaacagggcacggccgttttttggtacaattacctaccagatgggcaagggtgggtaggcgatgtagacgactatagtttgcacggtggctgcttggtgacgagaggcacgaaatggatagctaataactggatcaatgttgacccctcacgcgcccgccaggcgttatttcaacaggaaatggcccgtctcgcgcgcgagggaggcacagacagccaacccgaatgggctctagatagggcatatcgcgatgctcgtgtcgagctgtag

SEQ ID NO: 29121 - DNA, 2358 bp, Artificial Sequence
  Description of Artificial Sequence: Synthetic coding sequence
atgcccaaaggtcggcagaaggttccccatctcgatgcccctctcggcctgccaacatgtctctggctggaactggccgggctttttcttctggtgccatgggttatgggcctggccggcacaggcggccccgatggacagggcactggcggtccgtcttgggccgttcacttggagagcctggagggagatggggaagaagagaccttagaacagcaggctgatgcccttgcccaggcagctggattggttaacgccggtcgtattggggaactgcagggccattatctattcgtccaaccagcaggtcacagacccgctctcgaggtagaggctattcggcagcaggtcgaggccgtccttgctggccatgaggcagttaggtggcactcagagcaacgtctcctaagacgggccaaacggagcgtgcatttcaacgatcccaagtacccgcagcaatggcatctgaataatcgtcggagccccggtcgcgatattaatgtaacaggcgtgtgggaacggaacgtgaccgggcgaggcgtaacagtcgttgtggtggatgacggcgttgaacataccatacaggacatagcgcctaattattctccggaaggcagctatgacctgaattcaaatgacccggacccaatgccacatccagatgtggaaaacgggaaccatcatgggacaaggtgtgctggtgaaatcgccgccgttccgaacaacagcttttgcgctgtgggagtggcctatggatccagaatcgcagggattagggtgctggacggcccactcacggatagcatggaagccgtggctttcaataaacactaccagattaacgatatttacagctgctcttggggacccgatgatgacggaaaaaccgtggacggacctcaccagctcggcaaagccgcactgcagcacggcgttattgctgggcggcaagggtttggatcaattttcgtggtggccagcggtaacggtggtcagcacaacgataactgcaattacgatggctatgctaactctatttataccgtgactattggtgccgtggatgaagagggccggatgccattctacgccgaggagtgcgctagtatgttggccgtgacttttagcggcggagacaaaatgcttaggtcaattgtaacaacggactgggatctgcaaaagggcactgggtgcaccgagggacacaccggtacctctgccgcagcaccactggcagccggcatgattgctttgatgttgcaggtcagaccatgtctgacttggagggatgtgcagcatataatcgtgttcaccgctacccgttatgaggatcgccgggccgaatgggtgacaaacgaagcaggattctctcacagccaccagcacggctttggactgctgaacgcgtggcgcctggtgaacgccgccaagatctggacaagcgtgccatacttggcctcatacgtgagtccagtcctgaaggagaacaaagccatcccccaatcaccacggtctctggaggtgctgtggaatgtatctcgtatggaccttgaaatgtcaggattgaaaacactagagcacgtggcagtcaccgtctccattacccatccaaggaggggaagcctcgaactgaagctcttttgccctagcggtatgatgagcctcatcggggccccgcgctccatggactctgatcccaacggattcaacgattggacattttcaacagtacgatgctggggagagcgagcgaggggcacctaccgcctggttattcgggacgtgggggatgaatcttttcaggttggtatcctccgacagtggcagctgactctttatggttccgtttggagcgccgtggacatacgggaccgtcagcggctccttgaatcagccatgtctggtaaataccttcacgatgatttcgctctgccgtgcccccctggccttaagatcccggaggaggacgggtatacgatcaccccaaacaccctgaaaacactcgttctcgtgggatgctttacagtcttctggaccgtctactatatgctggaagtgtacctgagccaaagaaatgtggcaagtaaccaggtttgcagatccggcccctgccattggccacatcgcagcaggaaagcaaaggaagaagggaccgaactggaatcagtcccactgtgtagctccaaggatcctgacgaagtcgagactgagagcaggggccccccaaccacgagcgacctgctggcccccgacctacttgagcaaggcgattggtcactctctcagaacaagtctgcattggactgcccacaccagcacctcgatgtgccccacggaaaagaagaacagatctgctag

SEQ ID NO: 29122 - DNA, 342 bp, Artificial Sequence
  Description of Artificial Sequence: Synthetic coding sequence
atgcctaaaggaagacagaaagtaccgcacctggacgcaccactcgggctgcctacctgtctgtggcttgaactggccggtctgttcctcctggtgccttgggtgatggggctagctggaacaggcggccccgatggccaggggaccgggggaccatcatgggccgtccaccttgagagtctggaaggggacggggaggaggagaccctggagcagcaagccgacgcactggcccaggcggctggcctcgtaaacgcaggtaggattggagagctgcaggggcattatttattcgtgcagccagccggccatcgcccggcactcgaggtggaagcaatctag

SEQ ID NO: 29123 - DNA, 279 bp, Artificial Sequence
  Description of Artificial Sequence: Synthetic coding sequence
atgcccaaaggacgtcaaaaagtgccacatctggatgcccctttaggcctcccaacttgcctttggctcgaacttgccggcctgtttttattagtgccatgggtgatgggcctggctggtactggcggacctgatggccaggggaccggcgggccatcctgggcagtccacctggagtctctggagggcgatggggaagaggaaacgctggagcagcaggcggatgccctcgcccaggccgccggcctggttaacgccggcaggatcggggaactatag

SEQ ID NO: 29124 - DNA, 279 bp, Artificial Sequence
  Description of Artificial Sequence: Synthetic coding sequence
atgcctaagggaagacaaaaagtcccccacctggacgctccacttgggctgcccacttgtctgtggctcgagctggccggactctttttgctggttccatgggttatgggcctggctggcaccggcgggcccgatgggcagggcactggcggcccctcgtgggccgtccatctggaaagcctcgagggcgatggtgaggaggaaactttagaacagcaggccgacgcgctggcccaggccgccggcttagtgaatgccgggcgtataggcgaattatag

SEQ ID NO: 29125 - DNA, 714 bp, Artificial Sequence
  Description of Artificial Sequence: Synthetic coding sequence
atgcccttctacgccgaagagtgtgcttcaatgctggccgtcacgttcagcggcggcgataaaatgttaaggtctatcgtgacgacagattgggatctccagaagggaaccgggtgtacagaaggacacacagggacatctgctgctgcaccgctggctgcgggcatgatcgcactaatgctgcaggtgcggccttgtctaacatggcgagatgtccaacacatcatcgttttcactgccacccgctacgaggacaggcgcgccgagtgggtgacaaatgaggctggcttttcgcactcgcatcaacatggatttggcctgcttaacgcgtggcgtctggtcaatgccgccaagatatggacctccgttccctacctcgcttcatacgtaagccccgtcttgaaagaaaataaagccatcccacagtcccctagaagcttggaggtgctctggaatgtcagccgcatggatctcgaaatgtcagggttaaagacattggagcatgtcgccgtcactgtgagcatcactcatccgcgacgcggtagtctggaattgaagctcttttgtccatcaggaatgatgagtctgattggggccccccggagcatggactcggatcctaatggtttcaatgattggaccttcagcactgtgcggtgttggggcgaacgggcccgtggcacctatcgcttagtgattagagatgtaggctag

SEQ ID NO: 29126 - DNA, 1776 bp, Artificial Sequence
  Description of Artificial Sequence: Synthetic coding sequence
atgccgaagggcagacaaaaggtcccacaccttgatgctcccctcggcttgccgacatgcttgtggctcgagctggctggactctttctgttagtgccctgggtgatgggactagccggaaccggtggaccagatggacaggggaccggagggccatcttgggctgtgcacttggagagtctggagggggacggtgaagaagagaccctggaacagcaggccgatgccctggcccaagctgccggcctggttaatgccggccggatcggggagctgcagggccactatctgttcgttcagcctgccggccacaggcctgctttagaagtcgaagccatcaggcaacaggtggaggctgtactggcgggccacgaggctgtgcgatggcactctgaacagcgattgctgcgtagggccaaaaggtcagttcactttaatgatcccaagtatccccagcagtggcaccttaataacagaaggagccctgggcgggatatcaatgttaccggagtgtgggagcgtaatgttacagggagaggcgttacagtcgttgttgtggacgatggggttgagcataccatccaggacattgcaccaaactattcccctgaaggaagttatgacttgaactctaacgatccagacccgatgccccacccagacgttgagaatgggaatcatcacgggacgaggtgtgccggagagatagccgccgtaccgaacaacagcttctgcgccgtgggcgtggcgtacgggagccgtatagctggcatcagggtactggacggcccacttacagacagcatggaggcggttgcgtttaacaaacactaccagataaacgacatctattcttgctcctgggggcctgacgacgacggaaagactgtagacggtcctcaccagctagggaaggccgcccttcaacacggagttattgccggcagacagggttttgggtccattttcgtagtcgcctctggtaacggcggacagcataacgacaattgtaactacgatggatacgcaaactcaatctataccgttactatcggtgccgttgatgaggagggtcgtatgccattttatgccgaggagtgtgcatccatgctagcggtgacttttagcggcggtgacaagatgctacgaagtattgttactacagattgggacctccagaagggtactggctgtacagaagggcataccggaacttcagccgccgcccctttggcagctggtatgatcgccctcatgcttcaagtgagaccctgtctgacctggcgtgacgtccagcacatcattgtattcactgccacccgctacgaagatcggcgcgccgagtgggtgacgaatgaagctgggttcagccatagtcatcagcacggcttcggcctcctgaatgcgtggagactcgttaatgctgccaagatctggacttctgttccttatctggcctcctatgtgtcccctgtgctgaaggagaacaaagccatcccacagtcgcctcgcagtctggaagtgttgtggaatgtatcgcggatggacctggaaatgagcggcctgaaaacactcgaacacgtggccgtgactgttagtattacacaccctagacgaggaagcctggagctgaagctattctgtccatctgggatgatgtcgttgattggagcgccccggagtatggacagctggctgtgtgtggagtgtagccgccatcaaggacagacaaaagccgttagggagtgtcacgagtggaagataccagcgagatag

SEQ ID NO: 29127 - DNA, 2022 bp, Artificial Sequence
  Description of Artificial Sequence: Synthetic coding sequence
atggcaaaactggaaacactgccagtgcgggctgaccccggtcgagatccgctccttgcatttgcccctcggccctcggagctgggacccccagatcccaggctcgccatgggttcagtggggtcaggagttgcgcacgcacaggaattcgctatgaaatctgtggggactcgaactgggggaggcggctcccaggggagttttcctggccccaggggatcggggtccggtgcctcacgagagcgtcccggccggtacccatccgaggataaagggttagcaaacagcttatatctgaacggagaactgagaggctctgaccacaccgatgtttgtggcaatgtcgtgggctcatcggggggatcttcaagctctgggggttccgacaaggctccccctcaataccgcgaaccctcacatcctccgaaactgctcgccacttccggcaaactggaccaatgcagcgagccgctcgtgcgcccatcggccttcaagccagtggtgcccaaaaactttcacagcatgcagaatctgtgccccccccagacgaacggcacacccgaggggcggcaggggcctggtgggctcaaaggcggattggataaatcaaggacaatgaccccagcaggagggtcaggatcaggtttaagcgacagcggacgcaattccctaacttctctgcctacctattcatcatcttactctcagcacctggcccctctgagcgctagcacttctcatattaacaggattggcaccgcctcttatgggagcggaagcggtggatcaagcggtggtggatcaggctaccaggacctcggcacatccgactctggtcgcgcaagctcgaaaagtggctcgtcttcctccatgggccggccggggcacctgggatccggtgagggcggcggagggggccttccttttgcggcctgttctccccccagcccgtccgctctcattcaggagcttgaggagcgattgtgggaaaaagagcaagaagtagccgccctacgccgctctcttgaacaatctgaagctgcagtcgcccaggtgctcgaagagcgacaaaaagcctgggagcgcgaacttgccgagctgagacaggggtgctccggtaagttacagcaggtcgcccgcagagcccagcgggcacagcaagggctgcagctgcaagtgctcaggctgcaacaggataagaagcagctgcaggaggaagctgcacgcctgatgcggcagagggaagaactggaggataaggtggctgcttgccagaaggaacaggccgattttctgcccagaatcgaagagacaaaatgggaggtgtgccagaaagctggcgagatatcactgctgaaacaacaactgaaggactctcaggcggatgtaagtcagaaattgtcggaaatcgtgggactccggagtcagctccgagagggccgggcatcactgagagaaaaagaggagcagctcctcagtctgcgagattcgttcagcagcaaacaagcctcgcttgaattgggcgaaggcgagttgccagcggcctgcttgaagccagcactgactcccgtggacccagcagagccacaggacgctctggccacctgcgaatctgacgaggctaagatgaggaggcaagccggggtcgcggccgccgcatccctggtttcagtggatggagaagccgaggcggggggcgagagcggcactcgtgccctgcgcagggaggtcggcagactccaggccgaactggctgccgaaaggcgcgcacgggagcggcaaggcgcgtcttttgctgaggagcgacgagtgtggctcgaggaaaaagagaaagtgatcgagtaccagaaacaactgcagctttcgtatgtggagatgtaccagcgtaatcagcagctcgagaggcgtcttcgggaaagaggggctgcaggcggggcatctacaccaacaccccaacacggcgaggagaaaaaagcctggactccaagccgcctggaaagaatcgaatctacagagatctag

SEQ ID NO: 29128 - DNA, 1884 bp, Artificial Sequence
  Description of Artificial Sequence: Synthetic coding sequence
atggcgaaattagagacattgccagtgagagccgatcctggtagggacccactgctggcatttgcccctaggccttcagagctcgggccaccagaccctaggctggcaatgggttcagttggttctggcgtagcccatgctcaggagttcgctatgaagagtgtcggtacccgcacaggcgggggcggctcccaagggtccttccctggccccagaggcagcgggtcaggggcatctagggagcggcctggtcgctacccgtctgaggataaaggactggcaaacagcctttaccttaacggcgaacttaggggcagcgaccacaccgacgtctgtgggaacgtggtagggtctagcggcggcagttcttcatctggtggctccgacaaagcgccaccccagtatagagaacctagtcatcctcccaaattgttagctacaagcgggaagcttgaccaatgctctgagcccctcgttagacccagtgcgttcaagccagtggtacccaaaaactttcactctatgcaaaacctgtgccccccccagaccaatggtacccctgaaggcaggcaaggtcctggcggcctcaagggagggcttgataagtctcggaccatgacaccagccggggggagtggcagcggcctctctgacagcggccggaactctcttacgtcactgcctacttattctagttcctactctcagcacctcgcccctctgtccgccagtacctcacatattaacagaattgggaccgcttcttacggcagcggtagcggaggaagcagtggcggcgggtcaggctatcaggacctcgggacaagcgacagcggacgcgcctcctcaaaaagcggttcatccagctcaatgggaaggcccgggcacctgggaagcggagaaggaggcggcggcggcctgcccttcgccgcctgctcacctccatcacccagcgccttgattcaggagctggaggaacggttgtgggagaaggagcaggaggtggcggccttacgcaggtcacttgaacagtccgaagcagccgtggcccagcaggacaaaaaacagctgcaggaggaggcagcaaggcttatgagacagcgtgaggaactcgaagacaaggtcgccgcttgtcagaaagagcaggcagactttttgcctcgtatcgaggagacgaaatgggaagtgtgccagaaggcaggggagatcagtttgttgaagcagcaactaaaagattcccaggccgacgtgagtcagaagctcagtgagatcgtaggactgaggtctcagttgagggagggacgggcatcactgagagaaaaggaggagcagctgctgtctcttcgggattctttctctagtaaacaggcaagcctggagcttggcgaaggggagttgcctgcggcatgcctaaaacctgccctgacccccgtcgaccccgcggaaccacaggacgcgctggctacgtgcgaatctgacgaagcaaagatgcggaggcaggctggagtggctgccgctgcctcactggtgagtgtggatggcgaggcggaggccggaggagagagtggaactcgcgctttaaggcgagaagtggggaggttgcaggccgagctggccgcagagcgccgggctagagagagacagggcgcttctttcgcagaggagaggagagtgtggctcgaggagaaggagaaggtgattgaataccagaagcagctgcagttgagctatgtggaaatgtatcagaggaatcaacaactggaacgtagactcagggaacgcggcgcagccggaggtgcttcaacgcccacgcctcagcacggtgaggaaaagaaagcctggacgccaagcaggctcgagaggatcgagagcactgagatctag

SEQ ID NO: 29129 - DNA, 1884 bp, Artificial Sequence
  Description of Artificial Sequence: Synthetic coding sequence
atggctaaattggaaacactgcctgtgcgcgccgatcctggcagggaccctctgttggcgtttgccccccggccatccgaactggggccacccgacccgcgactggctatggggagcgtgggaagtggcgtcgcccacgcacaagaattcgccatgaaaagcgtcggcacacggacgggcggaggggggtcccagggctccttcccaggaccgcgtgggtccggatctggagctagccgggagcggccaggacgctatccttccgaggataaagggctggcaaactcgctgtatctgaatggcgagctccgcgggtccgatcacactgatgtgtgcggcaatgtcgtgggctcctccggcggttcaagttctagcggggggtccgacaaggcaccaccccagtatagagaacctagtcatccacccaagttgctggccacgtcaggaaaattggaccagtgctctgagccattggtacgcccttctgcgttcaagccagtggtgcccaaaaacttccacagcatgcagaacctgtgtcctccacagacgaacggcacgcctgaagggcgacagggtccagggggtctgaagggcggcctcgacaagagtcggacgatgacgcccgctggcggtagcgggtctgggctcagtgactccggccgcaacagcctgacgtctctgccgacatacagttcctcttattcacagcacctggcaccattatcagcctctacttctcacatcaatcgcataggaacagcaagctacgggtctggctctggcggcagtagcggcggcggctccggctaccaggacctgggcacgagtgactccggaagagcctcctcaaaaagtggatcctcatcttcaatggggagacctggccacctcgggtctggagaggggggcgggggcggccttccctttgccgcctgtagccccccctcccctagtgccctcatccaagagctggaagagagactgtgggagaaggaacaggaggtggccgctttgcgccggtccttagagcagtcggaggccgccgttgcccagcaggataagaaacagctgcaagaagaggccgccaggctcatgcggcagagggaggagctggaggacaaggtggctgcctgccaaaaagaacaggcagatttcctaccaagaatcgaagaaacaaagtgggaagtgtgtcaaaaagctggagaaataagcctgctgaaacagcaacttaaagacagtcaagccgacgtgtcacagaagctttccgaaattgtgggattgcgctcacagctgcgagaggggcgtgcatctcttcgagaaaaggaggagcaactgttgagcttgcgcgatagcttttcctctaagcaggcttccctcgagctgggagaaggcgagctgcccgccgcctgccttaaaccagcactcacaccggtggacccagcggaacctcaagacgctctcgctacatgtgaaagcgacgaggctaaaatgcggaggcaggctggggttgccgctgccgcttctttggttagcgtcgatggcgaggctgaggcaggtggtgagtctggaacgagagccctccggcgagaggtgggtaggctgcaggccgagctcgcagccgaaagaagagcccgggaacggcaaggtgcctccttcgccgaagaaagacgagtgtggttggaggaaaaagaaaaggtgatcgagtaccagaagcaactccagttgagctatgtggaaatgtatcagcgcaatcagcagctcgaacgaaggctaagggagcgcggtgccgcaggcggagcatctacacccacaccccagcacggcgaagagaagaaggcctggactccgagcagactggaacggatcgagagcactgagatctag

SEQ ID NO: 29130 - DNA, 1188 bp, Artificial Sequence
  Description of Artificial Sequence: Synthetic coding sequence
atgtctgcgaacgcgactttgaagcccttgtgtcctatcctggagcaaatgagtagactgcagagtcacagtaatacctcgatcaggtatatcgaccacgctgccgttctcctgcacggcctggccagcttgttagggctagtggaaaatggagtgatcttatttgtagttggttgtcgcatgaggcaaacagtagtaacaacctgggtgcttcatctcgccttgagtgatctgctagcctccgccagtttgcccttttttacctactttttggctgtaggccattcttgggaactgggaacaacgttttgcaagctgcacagctccatctttttccttaacatgtttgcaagcggatttttgctctcagcaatttcgctggatagatgccttcaggttgtgcggccagtatgggcccaaaaccaccgcactgtggcggccgcacataaggtatgcttagtactttgggcgttggcagtgctcaacacggtcccgtattttgtgtttcgcgacacgattagccgcctcgacggtcgcatcatgtgttattataatgtgttactcctgaaccctggacccgacagggatgccacctgcaactctaggcaagtggcacttgctgtcagcaagttcctcctcgccttcctggtacccctcgccatcatcgcatcttctcacgccgctgtcagtctgaggctgcagcatcgcggcaggcggcggccaggccggtttgtcaggctggtggctgctgtggtagctgccttcgcgctgtgctggggaccgtatcacgtattctcgctcctggaagctagagcacacgcaaatcctgggcttcgtcctctcgtctggagaggcctccctttcgtcacttcactcgccttttttaactcagttgctaatcccgtactgtatgtcttaacatgccccgacatgcttaggaaacttcgcagaagcttacgtactgtactggagagcgtgttggtggacgactccgaacttggcggcgctggctcttcacgcaggagacgcacatcttccacagcacgctccgcttctcccttggccctgtgctcacgacccgaagagccccggggacctgcccgacttctgggctggttgctgggtagctgcgctgcaagcccacagacaggtccactcaacagagccctttccagcacttcctcatag

SEQ ID NO: 29131 - DNA, 933 bp, Artificial Sequence
  Description of Artificial Sequence: Synthetic coding sequence
atggtgtataaaacactgttcgcactgtgcatactaactgccggttggcgcgttcaatcactgcctacgtcagctccgctgtctgtaagccttccaactaacatagttcctccaacaaccatatggacctcatctccccaaaacacagatgccgataccgcctcaccttccaacggaacacacaataactcagtgttaccagtgactgccagtgcaccaaccagcctgctgccaaaaaacataagtatcgagtccagggaggaggagattacatcccccggctctaattgggagggcactaacacagatccgtccccttccggcttttcctctacttcagggggcgtccacttgacaacgactttagaagagcactcaagcggcactcccgaggccggggtagcagcaaccctgtctcaatccgcagcagagccgcccacactgatttcgccgcaggcccctgctagcagtccctccagcctttccacatccccacccgaggtgttctctgccagcgtgacaaccaatcactcatctactgtcaccagcacgcagcctacaggcgcgcctacggcccccgagtccccgacagaggagagcagctctgaccataccccaacctcccacgcaacagctgagcctgtgcctcaggagaagaccccccctacaaccgttagtggaaaggtgatgtgcgagctgattgatatggaaaccacgacaacgtttccaagagttatcatgcaagaagttgaacatgctctgtcatctggtagcattgctgccattactgtgaccgtaatcgctgttgtgctgctcgtgttcggagttgccgcctacttgaaaatccgacatagttcttacggccgcttgctagacgaccacgattatggctcctggggcaactataacaacccactgtacgatgactcatag

SEQ ID NO: 29132 - DNA, 1191 bp, Artificial Sequence
  Description of Artificial Sequence: Synthetic coding sequence
atgggtgaacgaaaaggggtcaacaaatactatccacccgattttaacccagaaaagcacggcagcctaaaccgctaccacaatagccacccactgagagagcgtgccagaaagctgagccaggggattctgattattcggttcgagatgccctataatatatggtgtgacggatgcaaaaatcacattggtatgggggtcaggtataatgccgaaaaaaagaaagtggggaattattatactacacctatctaccggtttcggatgaagtgtcacctgtgtgttaattacatcgaaatgcagactgaccctgctaattgcgactatgtgattgtctctggggcccagcgcaaagaggaaagatgggatatggcagacaacgaacaggtcctcactacagagcacgagaagaaacagaagttggaaacagatgctatgttccggctggaacatggagaagcagatagaagcacattaaagaaagcactaccgactctgagccacatccaggaagcccagtctgcatggaaggacgatttcgccctcaactccatgctccgccgccgctttcgcgagaaaaagaaagccatccaggaggaagaggaacgggatcaagccctacaggccaaagcttcactcacgatcccactggtgcccgagaccgaggatgaccggaaactcgcagcattgctaaaattccacacattagattcctatgaggataagcagaagctgaaacgtaccgagatcatttctcgtagctggttcccctctgctccaggctcagcatcgtcatccaaagtgtccggtgtcctcaaaaagctggcccagagcagaaggacagcattggccacttccccgattactgtcggtgatctcggtattgtaagacgtcgttcgcgggatgttccagagagccctcagcacgccgccgacacccctaaatccggcgaacctcgcgtccccgaagaagccgctcaagacagaccaatgtctcctggtgactgccctccagagacaacagagacgccaaaatgctccagtcccagaggacaggagggatctcggcaagataaaccactgtctcctgccgggagcagtcaggaggctgctgatacaccagatacacgccacccatgctcacttgggagctctctagtcgccgattattcagattccgagtcagaatag

SEQ ID NO: 29133 - DNA, 1251 bp, Artificial Sequence
  Description of Artificial Sequence: Synthetic coding sequence
atggtgagaccacgtcgggctccttaccggagcggtgctggaggtcctttgggtggacggggcagacctccaagacccctggtggttcgagctgtgaggagtcgcagttggcccgcctcccctcgcggaccacaacccccacggattcgagctagatccgcccccccaatggagggggcgagagtcttcggggcactgggccctatcggcccgagctcacccggcctgacactcggcggcctagctgtgtcagagcaccggctgtcaaacaagttattagcttggagcggtgtgctggagtggcaagaaaagcggcgcccatactccgactccacagcaaaactcaagaggacactgccatgtcaggcgtacgtgaatcagggagagaacctcgaaactgatcaatggcctcaaaagctaataatgcagttgatccctcagcagcttctaaccacgttgggccctttgttccggaacagccagctcgcccaattccatttcactaatcgggattgtgattccctcaagggcctgtgtagaattatgggtaatggcttcgcgggatgcatgctcttcccccacatcagcccatgcgaagttagggttctaatgcttctttattcctctaagaagaagatctttatgggactcattccttatgatcagagcggtttcgtgagtgctattcgacaggttattactacacggaaacaagccgtcgggcctggcggcgtgaatagtggacctgtccaaatcgtgaataacaagttcctcgcatggagcggcgtaatggagtggcaagaaccacgtcctgaaccgaacagtcgctcaaaacgatggctgcccagccacgtctacgtgaaccagggggagatactgcggactgaacagtggcctagaaaactgtatatgcagctgattccgcagcagcttctgacaaccctggtgcccctgtttaggaattctcgtttagtacagtttcacttcaccaaggatttggagacccttaagtcattgtgtaggatcatggataacggctttgcgggttgcgtccacttctcttataaagcctcgtgtgaaatacgggtgctgatgctcctgtacagtagtgagaagaagatctttattgggctcatccctcatgaccagggaaactttgtcaacggcatcaggcgcgtgatagctaaccagcagcaggtgctccagcgaaatctggaacaagagcaacagcagagagggatgggcggctag

SEQ ID NO: 29134 - DNA, 831 bp, Artificial Sequence
  Description of Artificial Sequence: Synthetic coding sequence
atgctcctgtttagcgtcctcctgctgctgtcactggtgaccggcacacagctaggcccccgcacccctctgccggaagcaggcgtagctattctggggagggcgaggggagcccacagacctcagcccccacatcctccaagtcccgtgtctgagtgtggagatcggagcattttcgagggcaggacacgctactcacgtatcacaggtggcatggaggcggaagttggtgagttcccgtggcaggttagtattcaggccaggtcagagccattttgtggcggcagtatactcaacaagtggtggattctgactgcggcccattgcctttactctgaggaactttttcccgaagagctttcagtggtccttggcacaaacgatttaacatccccttcaatggagatcaaggaggtggcatccataattcttcacaaggatttcaagcgagccaatatggataatgacattgccttattattgctggctagccccatcaagctggatgacctgaaggtccctatctgtctcccgacgcaacccgggcctgccacatggcgcgagtgttgggtcgccggctggggtcagaccaacgcagccgacaagaactcagttaaaacagatctgatgaaagcacccatggtcatcatggactgggaggagtgcagcaagatgttcccgaaactgacaaaaaatatgctttgcgctggttacaagaacgaatcctacgatgcatgcaagcaatcttacttccctaccctccagcggatgaataccggttcttcacaaactaagcctcctggctctcacacgttccacttgcagaactag

SEQ ID NO: 29135 - DNA, 1059 bp, Artificial Sequence
  Description of Artificial Sequence: Synthetic coding sequence
atgctcctgttctctgtcttgctcctgctctcactcgtcacaggaactcagctgggcccaagaactcccttgcccgaagcaggcgtggctattttgggtagagcacggggggcacaccgtccgcagccccctcatccaccttcacccgtgtccgaatgcggagatcggtccatctttgagggacggacgagatattctaggatcactgggggaatggaggccgaagtcggtgaatttccatggcaggtgtccattcaggccagatcagaacccttctgtggaggatccattttgaacaaatggtggattctcacagccgcccactgtttatactcagaggaactgttcccagaggagctctcagtcgtgctgggaactaacgacctgacctcacccagtatggaaattaaagaagtcgcttctattattttgcacaaggacttcaagagggccaacatggacaatgacatcgccctgctcctgttagccagcccaataaagctggacgacctaaaggtcccaatttgcctgccaactcaaccgggtcccgccacatggcgggaatgttgggttgctggctggggccagactaatgccgcagacaaaaactccgttaaaactgatttgatgaaagcccctatggtaatcatggattgggaagagtgctcaaaaatgtttccgaaactgactaaaaatatgctgtgtgcaggctacaagaatgagagctatgatgcgtgtaagggagacagcggtggacctttagtgtgcaccccagagcccggagagaaatggtaccaggtgggtatcatcagctgggggaagtcttgtggcgagaagaacactcccggaatatacacatccttggtgaactataacctctggattgaaaaggttacacagctggaggggcgaccattcaacgctgaaaaacgcaggacttcagtgaagcaaaaacctatgggctctccggtgagcggcgttcccgaacccgggtcaccaagatcatggctgctcctgtgtccactttcccacgtactctttagagctattctctactag

SEQ ID NO: 29136 - DNA, 1185 bp, Artificial Sequence
  Description of Artificial Sequence: Synthetic coding sequence
atgggtatgaagcatagtagcaggtgcttgctgctccgtagaaagatggcggaaaacgcggcagagagcactgaggtcaatagtcccccctctcagcctccacaacccgtggtgcccgctaagccggtgcagtgcgtacaccacgtctctactcagcctagctgccctggccgagggaagatgtccaaactgctcaatccagaggagatgacgtctcgcgactactatttcgattcttacgctcacttcgggatccacgaggagatgctcaaagacgaggttaggactctcacatatcgaaatagcatgtatcacaataaacatgtgttcaaagacaaagtggttctcgatgttggttccggaacaggaatcctgtcaatgttcgccgccaaggccggggctaaaaaggtctttgggatcgagtgttcgtctatctctgactattcagaaaagattattaaagcaaatcacttggataatattattaccatttttaaggggaaagttgaagaagtggaattgccagtggaaaaggtagatatcatcatatccgagtggatgggctactgcctgttctatgagagcatgttgaacaccgtgattttcgcaagggacaagtggctaaagcctggcggactgatgttcccggatagggccgccctgtacgtggtggccatcgaagatagacagtataaggacttcaagatacactggtgggaaaacgtctacggattcgacatgacttgcattagggatgtggccatgaaagaacccctcgtcgatatcgtcgacccaaaacaggttgtgacgaatgcgtgcctcattaaggaagttgacatctacactgtgaaaacggaggagctgagctttacgtccgccttctgtctgcagatccagagaaacgattatgtacacgccttggttacctactttaacattgagttcacaaaatgtcataagaaaatggggtttagcacggcacccgatgcaccctacactcactggaagcagacagtgttctacttggaggactacctgaccgtcaggagaggagaggagatatacggcaccatatccatgaagccaaatgcaaaaaacgtccgggatctggattttacagttgatttagactttaaggggcagctgtgcgagacgagcgtgtccaatgattataaaatgcgttag

SEQ ID NO: 29137 - DNA, 1158 bp, Artificial Sequence
  Description of Artificial Sequence: Synthetic coding sequence
atggagtccctggcaagcgatgggttcaaattaaaggaagtctctagcgtgaactctccaccctcacagccacctcagcccgtcgtaccggcaaagccagttcagtgtgtgcatcacgtctccactcagccaagctgcccaggccgaggaaagatgtccaagttactcaatcctgaagagatgacctccagagattattacttcgactcctatgcccacttcggaatccatgaggagatgctgaaggatgaggtcagaacattaacctatcggaacagtatgtaccacaataaacacgtttttaaggacaaggtggtgctggacgtcggcagtggaaccggaattctgagtatgtttgccgccaaggcaggtgcgaagaaagtcttcggaatagagtgcagttccatatctgattactctgagaagatcatcaaagccaaccacctggacaatatcataacaatattcaagggtaaagtggaagaagtagaactgcccgttgagaaggtggacattataatctcagagtggatgggatattgcctcttctacgaatctatgttaaacaccgtgatctttgccagggacaaatggttgaagcctgggggcctaatgttcccagatcgggccgctctgtacgtggtggctattgaggatagacagtacaaggattttaaaattcattggtgggaaaacgtttatggcttcgacatgacttgcattagagatgtggcgatgaaggaacccctcgtggatattgttgatcccaaacaggtggtaaccaatgcatgccttataaaagaggttgatatatataccgtgaaaacagaggaacttagcttcacctctgccttttgcctccaaattcagcggaacgactacgtgcatgcactggtgacctacttcaacatcgaattcaccaagtgccacaagaaaatgggcttcagtaccgcccctgacgcaccctacacccactggaaacaaacagtcttctatctggaggactacctgacggtccggcgaggtgaggagatatacggaactatcagcatgaagcctaatgctaagaatgtgagggatctggacttcactgtcgacctggatttcaagggacagctgtgtgagaccagcgtgagcaatgactataaaatgcgttag

SEQ ID NO: 29138 - DNA, 3498 bp, Artificial Sequence
  Description of Artificial Sequence: Synthetic coding sequence
atgtatttcctgtccgggtggcctaagcggcttctgtgcccactaggatcgcccgccgaagccccttttcacgtccagtcagacccccagagggcctttttcgccgttcttgcagccgcacgactttccatttggtactcccgcccctctgtgctcattgttacttacaaagagcctgccaagagttccactcaattcggctcatacaagcaagccgagtggcggccagattccactatgatcgcggtaagcacagccaacggctatatcctgttttttcatatcacatccacccggggcgataagtacttatatgaaccagtttatcctaaaggctccccccaaatgaaaggaaccccccacttcaaagaggaacagtgtgcaccagccctgaatcttgagatgaggaagatcctggacttgcaggctcccattatgagcctccagagtgtgctggaagacctgcttgttgctacatccgacgggctcctccatctgattcactgggagggaatgaccaacggacgaaaagctatcaacctctgtacagttccgtttagtgtggatttacaatccagccgcgtcggaagttttctggggttcaccgatgtgcatattagggatatggaatactgtgccaccttggacgggtttgctgttgtctttaatgacgggaaggttgggttcattactcctgtttcctctcggtttacagctgaacaacttcacggggtgtggccccaggatgtggtcgacggtacctgcgtcgcggtgaataacaagtaccggctgatggcctttggctgtgtatcaggatctgtgcaagtctatacgatcgacaatagcactggcgccatgttgcttagtcacaaacttgagctaactgccaaacagtatcctgacatttggaataaaaccggggccgtcaagctgatgcgctggtcaccagataattctgtggtgatcgtcacctgggagtacggcggactttcgctctggagcgtgttcggggctcagctgatttgcaccctgggtggtgattttgcctacagaagtgatgggacaaaaaaggaccctctgaaaatcaactccatgtcttggggtgccgaggggtatcacctgtgggtgatctccgggttcggctctcagaacacagagatcgagtcagacttgagaagcgtcgtaaagcagcccagcatcctactcttccagttcattaagtcagtgcttaccgtcaacccttgcatgagcaaccaggaacaggttctcctccagggcgaagatagactttatctcaactgtggagaagcttctcagacacagaaccctcggagcagttctacacacagcgagcataagccgtcccgtgagaaatcccccttcgcagatggagggcttgagagccaaggcctgtccactttgctgggccatcgtcattggcatgtcgtgcagatttcatccacctatttggagtctaattggccaatccggttctcagcgattgacaagttgggccagaatatcgccgtagtggggaaattcggcttcgcacattatagtctgctgacaaagaaatggaaattgtttggcaatattacccaggagcagaatatgatcgtcaccggtggactcgcatggtggaatgatttcatggtacttgcctgttacaatattaatgataggcaagaggagctcagggtctatctccgaaccagtaatctggataacgcctttgcccacgtgaccaaagcgcaggctgaaacactgcttctgtcggtgtttcaggatatggtcatcgtgttccgggctgattgttcaatctgtctgtattctatcgaaagaaagtcagacggtccgaatacgactgccggaattcaagttcttcaggaggtcagcatgagccggtatataccccaccctttcctcgtcgtgtccgtgaccctgaccagcgtgtctactgagaacggcataaccctaaaaatgcctcagcaagcccgcggggccgagtccattatgctgaatttggctggccaactgattatgatgcagcgcgaccggagcgggcctcagataagggaaaaagactccaatcccaacaatcagcggaagctgctccccttttgcccacctgtggtactcgcccagagtgtggagaacgtgtggactacctgtcgtgccaacaaacagaaacgacatttgctggaagcgctgtggctcagctgtggaggggccgggatgaaagtgtggttgcccctgttcccacgggatcaccggaaacctcacagctttcttagtcagagaatcatgctgccgttccacattaacatttatcctttggctgttctgttcgaggatgccctcgtcctgggggccgtgaacgatactctgctgtacgatagtctttatacaagaaacaatgcacgcgaacagcttgaagtgctgttcccattttgcgtggtggaaagaacaagccaaatctatctgcaccacatcctccggcaactgcttgtacgcaatctgggtgaacaggccctactgcttgcgcaatcatgtgctaccctgccatactttccacatgtcctggagctcatgctgcacgaagttctcgaagaggaggcaacctcccgcgaacctatcccagacccacttctccctaccgttgccaaattcattaccgaatttcccctgttcctacagacagtagtgcactgtgctaggaagacagagtatgccctctggaattatttatttgctgcagtgggcaaccccaaggatctgtttgaagagtgcctcatggctcaagacctggacactgccgcatcctacctgattatcttgcaaaacatggaagtaccagcagtcagccgacaacacgccactttattatttaataccgcacttgaacagggcaagtgggatctatgcagacacatgattcggtttcttaaagccattggttcaggggagtctgaaactcctcctagcacccctaccgctcaggagccttcatcctctggcggtttcgaattctttcggaatagatcaatctctttgtctcagagtgccgaaaatgtgcccgcttctaagttcagcttgcagaagacactgagcatgcccagcgggccatctggtaagagatggagcaaggatagcgactgtgcggagaacatgtatatagacatgatgttgtggaggcacgccagaagattactggaggatgtacgccttaaagacctgggatgcttcgccgcacagctgggatttgaactgatcagctggctgtgtaaagagaggactagggcagcccgggtagacaactttgtaattgctctgaagaggttgcacaaggattttttatggccactccctatcatcccagccagttccatcagcagccccttcaagaacgggaagtatcggacaggcaatgtcgactttatgtcactcgttcaaggggaattatattttacaccttgcatttacacgttctgttattag

SEQ ID NO: 29139 - DNA, 2043 bp, Artificial Sequence
  Description of Artificial Sequence: Synthetic coding sequence
atgtacacttttctgcccgacaatttcagccccgccaaacctaagcccagcaaggatttgaaacccttattgggatcggctgtcctcggtctgttactagtcctggccgctgtggtggcctggtgctactattcagtcagcctgcggaaggccgaacgactgagagctgaactgcttgatctcaaagcaggcggctttagcattcgcaatcaaaaaggcgaacaggtattccgccttgcctttaggagtggagcactggatttggattcctgcagcagggatggcgcattactcggctgttcacttaccgcggacggtctcccgcttcacttttttattcagacggttagaccgaaagacacagtgatgtgctaccgcgtgcggtgggaggaagccgccccgggtcgggcagttgagcacgccatgttcctcggcgacgccgcggcccattggtatggaggcgccgagatgagaactcagcactggcccattcgcctggatggtcaacaggaaccgcaaccctttgttacctcggacgtttacagctccgacgcagcctttgggggtatactcgagcgatactggttgtcctcgcgtgccgccgcaatcaaagtgaacgactctgtccctttccatctgggatggaatagtacagaaagaagtttacggttgcaggctaggtaccacgacaccccatacaaacctcctgctggcagggctgctgcccccgaactatcctaccgggtgtgtgtcggctctgatgtgacatcaattcataaatacatggtgagacggtactttaataaacccagtagagtacccgctcccgaagctttccgcgatccaatttggtccacctgggctttatatggccgcgccgtggatcaagacaaggtgctgaggtttgctcagcaaattcggctgcaccacttcaacagcagtcaccttgagatcgacgacatgtacaccccggcttatggtgacttcgattttgacgaggttaaatttcctaacgcatccgacatgttcaggaggctgagagatgccggcttcagagtgactttgtgggtgcacccattcgtgaattataatagcagtagatttggcgaaggcgtcgaacgagaactgttcgtccgcgagcccaccggaagacttccagctctggtcaggtggtggaatgggatcggtgcagtattggactttacccacccaaaggcgagggactggttccaaggacacttgcgcaggctgcggtcgagatactcagtggcttctttcaaattcgatgctggtgaggtgtcttatttacctcgtgattttagcacctataggcctctaccggatccgtctgtttggagtcgtcgttacaccgagatggcccttcccttctttagtctggccgaagtcagggtgggttaccaatcccagaatatttcttgcttttttcgactggtggatcgcgactcagtctggggctatgatttgggtttgagaagccttatacccgctgtacttacagtgagcatgctcggctacccctttatcctgcccgacatggtgggaggcaacgccgtgcctcagagaacggcaggcggggacgttccggagagagagttatacatccgatggttggaggttgccgccttcatgcccgcaatgcagtttagtattccaccatggaggtatgatgctgaagtcgtggccattgcgcaaaaattcgctgccctccgagcgagtctggtcgcccctctgcttctggagttagccggggaagttactgacacaggcgatcctatcgtgcggcctctctggtggatcgccccaggcgatgagacagcccacagaattgacagccagtttctcataggggataccttgctggtggcccctgtgctcgaacctggcaaacaggagagggacgtctatctcccagctggaaagtggcgttcatacaagggcgaactattcgataaaacaccagttctgctgaccgattatccagtagacctggacgaaatcgcatactttacgtgggcttcctag

SEQ ID NO: 29140 - DNA, 228 bp, Artificial Sequence
  Description of Artificial Sequence: Synthetic coding sequence
atggcggctgagtgggcctcccggttctggctctgggccaccctccttattccggctgccgctgtgtacgaggaccaggtcggcaagtttgactggcgtcagcagtacgtcgggaaagtgaagtttgcgtccctggaattcagtccaggaagcaaaaaactcgtggttgcaaccgaaaagaacgttattgctgctctcaacagtcgtactggcgagatatgtgagtag

SEQ ID NO: 29141 - DNA, 1665 bp, Artificial Sequence
  Description of Artificial Sequence: Synthetic coding sequence
gcccctacaggcagagctgatctgagtggcaaccaaggtaacgccgcaggcagactggccaccgtgcacgagccagtggtgacgcagtgggctgtccacccaccggccccagcacacccaagtctgctggataaaatggagaaggcaccgccccagccccaacacgagggcctcaagtccaaagagcatcttccacagcagcccgctgagggcaaaaccgcgtcaaggcgtgtcccaaggctgcgagctgtcgtagagagccaagctttcaaaaatatcctggtagatgaaatggacatgatgcacgcccgagccgccacattaatacaggccaactggagggggtattggcttcgacagaagctgatttctcagatgatggccgctaaggcaatccaagaggcttggcgcaggtttaacaagaggcatattctccacagctccaagtccctggtaaaaaagacaagagctgaggaaggagacatcccctaccacgctccacagcaggtaaggttccaacatccagaagagaataggctcctgagcccccctattatggtcaacaaagagacccagttcccaagctgtgataatctggtgctctgtagaccccaaagctctccactgctgcaacccccagccgcccagggcaccccggagccatgcgtgcaaggaccacatgctgcacgggttagaggactggcatttctgccccatcaaaccgtcactatccggttcccctgtcctgttagcctggatgccaaatgccagccctgccttttaacacgcaccatccgcagcacatgcctcgtgcacatcgaaggcgactcagtgaaaacgaagcgagtgagtgctaggactaataaggcacgggccccagagactccactatccagacgctacgaccaggccgtgactaggccctcaagggctcagacacagggtcccgttaaggcagagactcctaaggcacctttccagatttgccccggtccgatgattacaaagacactgctccagacataccctgtcgtcagtgtgacgctaccacagacctacccagcatcgaccatgaccaccacaccccctaaaactagccccgtgccaaaggtgactatcatcaagacccctgcacagatgtatccaggcccaacagtgactaagaccgccccccacacctgtcccatgcctactatgacaaaaattcaagtgcacccaaccgcatcccgaacagggactcctagacagacatgtcctgctaccataactgctaagaaccgcccacaggtgtcactgctagcctctataatgaagtctcctccttcagttgtcatgctggtcggcagctccccaagaacttgtcacacatgtggtcggactcagcccaccagagtggttcaggggatggggcaaggcaccgagggtcccggcgcagtgtcctgggcttcagcttaccagttggctgccttgtccccgcgccagccgcatagacaggataaagccgccacagcaatccaatctgcctggaggggattcaaaattagacaacaaatgaggcagcagcagatggctgcaaaaatcgtccaggccacatggtggcatctgggaccctggctgcccgccgtaggaacttcgtgggaggcgctaatggcactatgggtgtag

SEQ ID NO: 29142 - DNA, 657 bp, Artificial Sequence
  Description of Artificial Sequence: Synthetic coding sequence
caagtgaaaaaggttcttttcgaggacgacgaaagatcgacagattcgtctcaacagtgctcctctgaagacgaagacatcttcgaggaaactgcacaggtcagtcctcctcggggtaaggaaaaacgccagtggcgcgccaggatgcctttactgtcagtgcagcccgtctccaacgccgattgggtctggctcgtgaaaagactccacaaactctgtatggagctgtgtaataactatatccagatgcacttggatctggaaaactgcatggaggagcctccaattttcaagggggacccattctttatcctgccaagttttcagtccgaaagttccactccttccacaggagggttctccggcaaggaaacccctagcgaagatgaccgttcacaacctagaagcgggtctacagggtctagcttgtctgtcagcgtcagagacgccgaggctcaaatccaggcatggaccaatatggttctgactgtgcttaaccagatccagattctaccggatcagacctttaccgcacttcaaccggcagtattcccatgcatctctcagttgacttgtcatgtgacagatatcagagtcagacaggcagtaagagaatggctcggccgagtgggtcgcgtatacgatatcattgtctag

SEQ ID NO: 29143 - DNA, 1035 bp, Artificial Sequence
  Description of Artificial Sequence: Synthetic coding sequence
atggagaagcggcttggagtgaagcccaacccagctagctggatcctgagcgggtactattggcagacatccgcgaagtggcttagatctctatacctattctatacctgcttttgtttttccgtgttgtggttgagtacggatgccagcgagagtcgctgccagcagggcaaaacccagttcggagttgggctgcggtctggcggagaaaatcacctgtggctgctcgagggcactccctcactgcagtcatgttgggccgcctgttgccaggattccgcctgccatgtgttctggtggcttgaaggaatgtgtattcaggctgattgttcaaggccccaatcttgccgggcttttcgtacacactcttcgaattcgatgcttgtgttcttgaaaaaatttcagaccgcggacgatctcggattccttccggaagatgacgtacctcatctgctgggcttggggtggaattgggcttcttggcggcaaagccctcctagagcagctctgcgcccggctgtttcctcatccgatcaacagagtcttatccgaaagctgcagaaaaggggcagcccttcggatgttgtgactcccatagttacacagcactcaaaagttaatgactccaacgagctcggtggacttacgacgagcgggtccgctgaagtccataaggcgatcaccatctctagccccctgacgacagatttgaccgccgaactcagtggcgggccaaagaacgtctccgtgcagcccgaaattagcgaggggctggcgaccacgccctctacacaacaagtgaagtcctcagagaagacacagattgcggtcccccagcccgtggccccatcatattcttacgccactcctacgccgcaagcatcatttcagagcacaagcgccccctatccagtaatcaaagagctggtcgtcagcgctggcgaaagcgttcagatcacgctgccaaagaacgaggtgcagctgaatgcatacgtgttgcaggagcccccaaaagcccactcccggccagtttag

SEQ ID NO: 29144 - DNA, 2979 bp, Artificial Sequence
  Description of Artificial Sequence: Synthetic coding sequence
atggccgctgagtgggcgagccggttctggctctgggcaaccctgttgattccagctgctgccgtctatgaagatcaggtcggaaagttcgattggcgtcagcagtacgtgggcaaagtcaaattcgcaagcctggagttttctcccggcagcaagaagttggttgtggcgacagagaaaaacgttattgcagccctgaatagtcgaacgggtgaaatcttatggcgccatgtggacaaaggcactgccgaaggagctgtggatgcgatgcttttgcacgggcaggatgttatcactgtttcaaacggagggcgaattatgcgctcttgggagactaatattgggggtctaaactgggaaatcactctcgactctggatctttccaggctcttggattggtgggactgcaggagagcgtgaggtatattgccgtgttaaaaaagactaccttggcccttcaccacctgtccagcggacacctgaaatgggtggaacacttacctgaaagtgactcaatacattatcagatggtctacagttacgggtcaggcgttgtttgggctttgggcgtcgtgcccttctcccacgtgaacatcgtgaagtttaatgtagaggacggggagatcgtacagcaggtccgagtcagtaccccttggctccagcatttgtccggagcctgtggagtggtagacgaagctgtgctggtctgtccagatccaagcagcagatccctgcagacgctggccctggaaactgaatgggagctgcggcagataccactgcaatccctagacctggagtttgggtccggtttccagccacgcgtcttgcccacacagcctaatcccgtggatgcatcccgcgcgcagttcttccttcacctgagtcctagccattatgccctgttgcaataccactacgggacgctgtcactgctcaagaactttcctcagaccgcactcgtatcatttgccacgactggcgagaagacagttgctgccgtaatggcctgcaggaatgaagtgaagtctagtagtagtgaggacggttctatggggtccttttccgaaaagagttcttctaaggattccctggcgtgtttcaatcagacctatactattaatttgtatctggtggaaactggccgtagattgctcgataccactattactttcagccttgagcaatcaggaacaagacctgaacggttgtatatccaggtgtttctgaagaaggacgattctgtgggttacagggctctggtgcagaccgaagatcatctgcttcttttccttcagcagcttgcaggcaaggtagttctctggagccgagaagagagcctggcggaagtcgtgtgtctcgaaatggttgacctcccactgaccggcgctcaagccgagcttgagggggaattcggcaagaaagctgatggactcctaggcatgttccttaaaaggctgtcttcacagcttatattgctgcaggcctggacttctcacctctggaagatgttctacgatgcgcggaaacccagatctcagattaaaaacgaaatcaatattgacacactggccagggacgaattcaatctgcagaagatgatggtcatggtaactgcttcaggcaaattatttggtattgagagctcaagcggaacaattttgtggaaacaatacttgcccaacgttaagcctgatagcagtttcaagttgatggtgcagagaacgaccgctcattttccgcaccccccacagtgcacactcttagttaaggacaaagagagtggcatgagcagcctgtacgtttttaaccccatctttggcaaatggtcccaggtcgccccccccgtactgaagcgccctatattgcagagcctactgttacccgtgatggaccaggattacgcaaaagtgttgctgctcatcgacgacgaatataaagtgactgccttcccagccacaagaaatgtgctccgccagctacacgagctagctccaagcatctttttttacttagtcgacgcagaacaaggacgactctgtgggtataggcttaggaaggacctcaccaccgaactcagctgggaactcactattcctccagaggtccaacgcattgtgaaggtgaaggggaagagaagttccgagcacgttcactcccagggccgcgtgatgggggatcggtcagttctgtacaagtcgctgaatcccaatctcctggctgtcgtcacggaatctactgacgcgcatcacgaaaggaccttcattggcatttttctgattgacggagtcacagggaggatcatccattcaagtgtgcagaaaaaagcgaagggcccagtacacatagtccactctgaaaactgggtggtctaccaatactggaatacaaaggccagacggaacgagtttactgtacttgagctgtatgaaggaactgagcagtacaacgctaccgcattttcctccctggatcgtcctcagctgccccaggttcttcagcagagttacatcttccccagcagcatatccgcaatggaagcaaccattactgagaggggcattacatctagacacttactgatcggactcccttcaggggctatcctgtccctccccaaagcactgcttgacccgagacgcccggaaataccaacggaacagagtagagaagaaaatttgataccctattcacctgatgttcagatccatgccgagcgctttattaattataaccagactgtgtcccggatgagaggaatatacaccgccccgagtggtctcgagtcaacttgtctggtggtggcgtacggcttggacatctaccagacccgggtctatccatctaaacagttcgatgtcttgaaggacgactatgattacgttctgatctcttccgtcctgttcggtctggtgtttgcaacaatgataaccaaaaggctcgcacaagtaaaacttctaaatcgggcgtggaggtag

SEQ ID NO: 29145 - DNA, 2916 bp, Artificial Sequence
  Description of Artificial Sequence: Synthetic coding sequence
atggctgccgagtgggctagtcgcttctggttatgggctaccttgctaattcccgccgcggcggtttatgaagatcaagtcgggaaatttgattggcgacagcagtatgtgggcaaagttaaatttgcttcactggagtttagccctggctctaagaagctagtagtcgctacagagaaaaatgtgatagcagccctgaattcacgtactggtgagatttacgtgatcaccgtctctaatggcggaaggatcatgcgcagctgggaaaccaacattggcggactgaactgggagattaccctggacagtggttcgttccaggccctgggcctcgttggcctacaggagtcagtgaggtatatcgcagtccttaaaaagaccaccctggcattacaccacttgtccagcggacacctcaagtgggttgagcatctacctgaaagtgacagcattcactatcagatggtatactcttacgggtctggcgttgtgtgggccttaggcgtcgtgccgttctctcatgtgaatatcgtgaaatttaatgtggaggacggggagatagtacagcaggttcgcgtgagtacgccatggctgcagcacttgtccggtgcttgcggggtggtggacgaagcggttctggtctgccctgatccgtctagcagaagcctccaaacgctcgcactcgagacagaatgggagctgcggcagattcctcttcagtccctggatctggagtttgggtcaggctttcagccccgagtgctgccaacacagcccaaccccgttgacgcctctcgggcacagttcttcctgcacctcagccccagccattacgccctcctccagtaccactacggcacgctgagtctgcttaaaaactttccccagacggcattggttagcttcgcgactacaggtgagaagacagtggccgcggtgatggcctgtcggaatgaagttcagaaatcatcgtctagcgaagacggatcaatgggaagcttcagtgaaaagagcagttccaaagatagtcttgcttgttttaaccaaacatacacgataaatctgtatctcgttgagacaggtcgacgactgcttgacaccaccatcactttctccctggagcaaagtgggacccggccagagaggctttacatacaggtttttctgaaaaaggacgactcagtgggatatcgagccctcgttcagacagaggaccacttactcctttttctgcaacagctcgcagggaaggtagttctctggtcccgcgaagagtcattagccgaggtcgtgtgtttggagatggttgacttgcccttgacgggcgcacaggccgagcttgaaggcgagttcggcaagaaagccgatgggctactgggaatgtttctcaaacggcttagcagccagctgatcctactgcaggcatggacaagtcacctttggaaaatgttttatgacgcccggaagcctcgatcacagattaaaaacgagatcaacatagacaccctagctcgcgacgagttcaatctgcagaagatgatggtgatggtgaccgcatccggtaagctgttcgggattgagtcaagctctggaaccattttatggaaacagtacttacctaacgtaaaaccggactcgtcctttaagctgatggtccagcgcaccactgctcacttcccccacccgccacaatgtacactgctggtgaaagacaaggagtccgggatgagcagcctctatgtcttcaacccaatcttcggaaagtggtcgcaggttgcaccgcccgttctgaaacggcctatactgcagtcactgctgctccctgtgatggatcaggattatgccaaagtgctgctgcttattgatgacgagtacaaggtgaccgcttttcccgccactagaaatgtcttaaggcagctgcatgagctggcacctagcatctttttctatcttgtggatgccgagcaaggcagactgtgcggctaccggctccgaaaagacctgacaactgaactgtcctgggagttgaccatcccccccgaggtacagcgcatcgtaaaggtgaagggcaagcgcagttcggagcatgtccattctcagggccgggtgatgggcgaccggagcgtgttgtataagtctctcaatcccaacctgttagctgtggtgactgagtctacagacgctcatcacgaaaggacgttcataggaatctttctgatcgatggtgtgactggcagaattatacactcatcagtgcagaagaaagccaaagggccagtccatatcgtgcattccgagaactgggtggtctaccagtactggaataccaaagctcggagaaatgaatttacggtgttggaactttacgagggcaccgaacaatacaatgccacagccttctccagcctcgacaggccacaactgccgcaggtgctgcagcagagttatattttcccaagcagcattagcgccatggaggctacgattactgaaaggggaatcacatcaagacatttgttaattgggctgccctctggagctatactttccctgcctaaggccctcctcgatcccaggcgccctgagatacccacggaacagtcccgggaggagaacctgatcccatatagccccgatgtccaaattcacgctgagaggtttatcaactacaaccaaaccgtcagcagaatgcggggaatctacacagccccaagcggtctggaaagcacgtgtctagtagtggcatacggactggatatctaccagactcgagtatacccaagcaaacagttcgacgtcttaaaggacgattatgactacgtgctgatttcctcagtattgtttggcctggtcttcgcaaccatgatcaccaaacggctcgcccaggtgaagctcctgaaccgggcatggcgctag

SEQ ID NO: 29146 - DNA, 4101 bp, Artificial Sequence
  Description of Artificial Sequence: Synthetic coding sequence
atgctgtttaagcaggcagagctttggatgccccaccagggtaagggtaataagggcgagccacctagtgctcttggcctgtcaacaagaaaggctctgagcgtccttaaagaacagctggaggccgttctggaggggcacctgcgggaacgcaaaaaatgccttacctggaaagaagtttggcggtcctcctttctccaccacagtaatcgctgttcatgttttcactggccaggcgcctctttaatgctgctcgctgtgctgctgctgctgggttgctgcgggggacagcccgcaggatctcggggagtgggccttgtgaacgccagtgctctgttccttttgctgctcttgaatcttgtcctgatagggcggcaggacagactaaagcgacgggaggtagagaggcggctccgtggtattatcgatcagatccaggatgcattgcgcgacggcagagagattcagtggccttctgcaatgtatcccgatctgcacatgccatttgcccctagctggagcctgcattgggcttatagggatggtcaccttgtgaaccttcccgtgtccctcttggtcgagggagacataattgctttgcgcccagggcaggaatcttttgcatcccttcgcggcataaaagatgacgagcatatagttttagagcccggtgatctgttcccaccgttcagcccaccaccctccccacggggcgaagtggaaaggggccctcagagcccgcagcaacaccggctcttcagggtgttagaaacccccgtgattgataacatcagatggtgtctggatatggccttgtctaggccggtgaccgccttggataatgagaggttcacagtccaaagtgtgatgctccattacgcggttcctgtcgtgctggccggattcctgataaccaacgcgctgagatttattttttccgcccccggtgtaaccagctggcagtatactctactgcagctgcaggtcaatggagttttgcctatcctgcctctgttgttccccgtgctctgggtgctggcaaccgcctgtggtgaagcaagggtccttgcccagatgagcaaagcctcaccctcaagcctgctcgccaagtttagcgaggacactctaagttcctataccgaggccgtttcaagccaggaaatgctgcgttgtatatgggggcattttttgcgagtcttggggggaacgtccccaacattatcacatagttccagcctactccacagtctgggatctgtgacagtactgtgttgtgtggataaacagggaattctatcgtggcccaatcccagccccgagaccgtgctgtttttctctggcaaagtcgagccgccccacagctctcatgaagatctcacagatgggctgagtactaggtccttttgccatcccgagccacacgagagagacgcgttgttagccggaagtctcaataatactctgcacctgtccaacgagcaggagagaggggactggcctggggaggcccctaagcctccggaaccatactcgcaccataaggctcacggacgcagcaaacacccaagcggatctaacgtgtctttttctcgtgacactgaaggcggcgaagaagaacccagcaagacacagcccggaatggagagtgatccatacgaagccgaggattttgtctgtgattaccatctggaaatgctcagcctgtcacaagaccagcaaaacccgagctgcattcagtttgacgactctaactggcagttacaccttacatcgctaaaacctctcggactgaatgtgttgctgaacctgtgtgatgcctcagttaccgagcggctgtgtaggttttccgatcacctctgcaacatagcgctccaggaatcccactcagcagtactcccagtgcatgttccctgggggctctgcgagttagctagattgatcggtttcacacccggtgccaaggaattgttcaagcaagagaatcatctggcactgtacaggctgccctccgcagaaactatgaaggagacatcactcgggcggctctcctgcgtgacgaaacgtcgccctccactgagccacatgatcagcttgtttatcaaagacacaactacctccaccgagcaaatgctcagccatggcactgccgatgttgtcctggaggcctgtacagacttttgggatggtgccgatatctaccctctttccgggagcgacaggaagaaggttttggatttttatcagagagcatgtttgagtggctattgcagcgcattcgcgtacaaaccaatgaactgtgcgctgagttcacaactcaatggaaagtgcattgaacttgtgcaagtccccgggcagtcttcgatattcaccatgtgcgaactgccttctaccattcctattaagcagaacgcaaggcggagcagctggtcttccgacgaggggatcggcgaggtgctggagaaggaggactgcatgcaggcgctaagcggtcagatattcatggggatggtgagctcgcaataccaagccaggctggacatcgtccgcctgatagatggactggttaatgcttgtattaggtttgtctatttcagtctcgaagacgagctcaagtccaaggtcttcgccgaaaaaatgggtctggagacagggtggaactgtcacatcagtctgacaccgaacggggatatgccagggagtgagatccctcctagctccccatcccacgctggctcactacatgatgatctgaaccaggtaagcagggacgacgccgaaggacttctgctgatggaagaggaggggcactccgatctgatttctttccaacctactgattcggatataccgagctttctggaggactcgaatagggctaagctgcctcgcggcattcatcaggtccggcctcatctccagaacatcgacaatgtcccgctcttggtgcccttgtttaccgattgcactccagagacaatgtgcgaaatgattaaaattatgcaggagtacggcgaagtgacatgctgcctcggctcttcggccaatttaaggaattcatgtctatttttacaatccgacatctctatagccctggatcccctgtaccctagccgctgcagctgggagacatttggctacgccaccagcatcagtatggcccaggcctcagatggcctaagtccactgcagctgtcagggcaattgaactccttgccatgctctttgaccttcagacaggaggaaaccatatctatcatccgcttgatcgagcaggccagacatgctacttatggtatccgcaagtgcttcttatttttactgcagtgtcagttaactctggtagtcatccagttcctgagctgccttgtccagttgcctccattactgtcaacaaccgacatcctatggctttcatgcttttgctatccacttctgagcatctccctgctgggcaagcccccccacagtagtataatgtctatggcaaccgggaaaaacttacagtcaattccgaagaaaactcagcattatttcctcctctgttttttgttgaagttttctctaaccatcagcagctgcctcatttgctttggtttcacactgcagtccttttgtgacagttcaagagatcgtaacctgacaaactgttcctcagtgatgctgccctcaaacgacgatcgcgctcccgcctggttcgaggactttgctaatggactcctttccgcccagaagttgacggctgccctcattgttttacataccgtgtttataagtataacccatgtacatcggaccaagcctctgtggaggaaatcccctctgacgaatctgtggtgggccgtcaccgtccctgtggtgctcctggggcaggttgtgcaaacagcagtggatcttcagttatggacacacagggattcccatgtgcactttggcctggaggatgtgccattgctgacctggctcttgggatgcctctcactggtgcttgttgtggtcaccaacgagatcgtcaagcttcatgaaattcgggtgcgggtgcggtatcagaaacgccagaaactgcagtttgagacaaaattagggatgaactctcctttctag

SEQ ID NO: 29147 - DNA, 2004 bp, Artificial Sequence
  Description of Artificial Sequence: Synthetic coding sequence
atgtggctgcagcaacggcttaagggtttgcccggattactctccagttcttgggctagacgattgttatgtctcctggggttactcctgctcttgttgtggtttggagggtcgggtgctcggagagccgccggggggctgcacctccttccatggtctagaggtgagcccggtgccgctgagcccagcgcttgtctcgaagccgccacccgggcatggagagggctacgggaacggggggaggttgttccgctggggccaggcgtaccagccctggtcgccaacggtttcctcgcactcgatgtggctgctaacagactttgggtgaccccaggagaacgcgagcccgctgtggctcctgactttgtgccgtttgtgcagctcaggccactttccgcactggctgaagctggcgaagcagttctgctgcttagggaagggctgctccgaagggtgcggtgcttacagttagggtcgcccgggcccggtcctgtcgccgccggccccggcccagcctctgtctctggcctggccgcaggaagtgggagggactgcgtcctgttacaggaggacttcctggcccatcggggtcgccctcacgtgtatctccagaggatccagctcaataatcccacagagagagtagcggcactccaaaccgtgggtcctaccgccggcccagcacccaaagctttcacgtccaccctggagaaagtcggggaccatcaattcttattatactctggccggagtccaccaactccaactggcttggtgcacctcgtggttgtggccgcgaaaaaattggtcaatcgcctgcaagtggctcccaagacacagttagatgaaaccgtactctgggtggtccacgtgagtggccccataaatcctcaggtcctaaagagtaaggccgcaaaagaactgaaagccttacaggacctagcccggaaggagatgctagaattgttggatatgccagccgccgaactactgcaggaccatcagcttctgtgggctcaattattcagtccgggcgtggaaatgaagaagattaccgacacacacacacccagcggcctcaccgtaaatctgacactctactacatgctcagctgttcgcctgcaccactgctctccccaagcctgagccaccgcgagagggatcagatggaatccactctcaattacgaagatcattgctttagtggccatgctacaatgcacgcagagaatctttggccagggagactctcatctgtccagcaaattcttcagctgagcgatttgtggcgcctgaccttacagaaaaggggttgtaagggattggtgaaagttggtgcccctggaatactgcagggaatggttctgagctttggcggcctgcagtttactgaaaatcacctgcagtttcaggctgacccagacgtcctgcataattcttatgcacttcatggcatccgctataaaaacgaccatatcaatctggcggtactcgccgacgccgagggtaagccatatctgcacgtctccgtcgaaagccgaggccaaccagtgaagatttatgcttgcaaagctggttgtcttgacgagcccgttgaactcacctccgccccaactggacataccttctccgtaatggtgacgcagcctatcacccctctgctgtacatcagcactgatctgactcatttgcaggatctgcggcacactctgcacctgaaggcgatactcgcacacgatgagcacatggcacagcaggacccagggctcccttttctcttctggttctcagttgcctccctgatcactctttttcacctgtttctctttaaactgatctataatgagtactgtggtccaggagcgaagcctctgtttcggagcaaagtcggctctcggcacctggtcgaaaccaggggcctgggactcgccctgagcccagtgtcgcgcaaagggcttgcgtggagggggggggtacgcccgggtcaggaatgggtatcatag

SEQ ID NO: 29148 - DNA, 483 bp, Artificial Sequence
  Description of Artificial Sequence: Synthetic coding sequence
tttcttcctgataacttttcacccgctaagccaaagccttcaaaggaccttaaacctctgttgggttctgctgtgctgggactgctgctggtgcttgccgcggtagtggcgtggtgttactacagcgtgtccttaaggaaggctgaacgactcagggccgaactcctggatttgaaagcgggcgggttttcaatacggaaccagaagggggagcaggaacctcagccgttcgtgacgagcgacgtgtacagctcggacgcggccttcggggggatcctcgagagatactggctgtctagtcgggcagccgctataaaagtgaatgacagcgtccccttccatctgggatggaacagcactgagagatccctcaggttacaggctagatatcatgataccccgtacaagccccctgccggccgagccgcagctcctgagctcagttacagagtgtgcgtgggatctgacgttacatctatctag

SEQ ID NO: 29149 - DNA, 3261 bp, Artificial Sequence
  Description of Artificial Sequence: Synthetic coding sequence
atgatagccgtgagcacagctaacggctacatcctcttctttcacatcacatctactcgcggagacaagtacctgtacgaaccggtataccccaaaggctcccctcaaatgaagggcacccctcactttaaggaggagcagtgcgcccccgccctcaacctagagatgaggaagattctggatctgcaggctcctattatgtcactgcagtcagtcctcgaagacctgctggtggcaactagcgacggtctgctccatcttattcactgggaaggcatgaccaacggaagaaaagccatcaacttgtgtactgttcccttttcagttgatctccagtcttcgcgtgtgggctcctttctggggtttacagacgtgcacatccgagatatggaatactgtgctaccctcgatggatttgccgttgtcttcaacgatggaaaggtcgggttcataacccccgtgtccagtcgcttcacagcagaacagcttcatggggtttggccccaagacgtcgtggatggaacttgtgttgccgtgaataacaaataccgcctcatggcttttgggtgcgtgtctggcagcgtacaggtgtacactatagacaattccacaggtgccatgctgctgtcccacaagctggaacttactgcgaagcagtatcccgatatttggaataagaccggcgccgttaagctgatgcgctggagtcctgacaacagcgtagtgattgtgacgtgggagtatggtggcctctcactgtggagtgtgtttggtgcgcagctaatctgtacactcggcggcgatttcgcctacagatctgatggcaccaagaaagatcccctcaaaatcaactcgatgagctggggagctgagggctaccatctatgggtgatttcaggcttcgggtcccagaacaccgagatcgaatccgacctcagaagtgtcgtcaagcagccctcaatcctgctgtttcagtttatcaagagcgttctgaccgtgaatccctgcatgagtaatcaggagcaggtcttgctccagggcgaggatcgtttgtacctaaactgcggcgaggcaagccagacacaaaaccctcggtcgtcgagtactcacagtgagcacaaaccaagcagggagaagagcccgttcgccgatgggggactcgagtcacagggcctctccacactgctgggccaccggcactggcacgtcgtgcagattagttctacctatctggagtctaattggccaattaggtttagcgctatagataaactgggtcagaatatagccgtggtgggtaagttcggctttgctcactacagtctgttgacaaagaagtggaagctgtttgggaatataacccaggagcagaatatgattgtaacgggaggcttagcttggtggaatgatttcatggtgttggcttgctacaatatcaatgatcggcaagaagaactgcgggtgtacctgcggacttccaatctggacaatgctttcgctcatgtcaccaaggcccaggccgagactctcctgctgagtgtattccaagatatggtgattgtgtttcgagcagattgctcaatttgtctatactcaattgagcgcaagtctgatgggccaaacaccactgccggcatccaggtgctgcaagaggtaagcatgtcccgctacattcctcatccttttttggtggtcagcgtaacgctgacttcggtatccacggagaatggtataacacttaaaatgccacagcaagctagaggagccgagtcaataatgctaaatcttgcaggtcagctgataatgatgcagcgtgaccgcagcggtccacagatccgggagaaggattccaatcccaacaatcaaagaaaactgctgcccttttgccctccagttgtcctggcccaatcggtggagaacgtgtggaccacctgtcgagctaataaacagaagcgccatctgctcgaggctctctggctgtcttgcggcggggctggcatgaaggtctggctccctctgttcccacgcgaccataggaagcctcattccttcctgtcgcaacgaataatgctgccattccatattaatatataccctttagccgttttgttcgaagatgccctggtgctgggggccgttaatgataccctcctctatgactctctctataccagaaataatgctagggaacagcttgaggtactgtttccattctgtgtagtggagcgcacttcccagatctacctccatcatattctcaggcagcttctggtgcggaacctgggcgagcaggctttactgcttgctcagtcctgcgccacgttaccatacttccctcatgttctggagctgatgctgcatgaagtgcttgaagaagaggccacttccagggagcctatcccggatcctctattaccgacagttgccaaatttattactgagttccctttattcctgcagaccgttgtccactgtgctagaaaaacagaatatgccctatggaattacctattcgctgccgttggtaatcccaaggaccttttcgaggaatgcctaatggcacaggatttagatacagctgccagctatctgatcattttacaaaacatggaggtgcccgccgtgtctaggcagcatgccaccctgttattcaataccgcgctggagcagggcaagtgggacttatgtaggcacatgatccggtttctcaaagccattggctccggggagagcgagacccctcccagtaccccgaccgcccaggaaccgagctcttccggcgggtttgaattcttccgtaaccggagtatttcactatctcagagtgcagaaaatgtacccgcttctaagttctctcttcagaaaacactgtccatgccctccgggccctccggcaaacggtggtcaaaggacagcgactgtgccgaaaacatgtatattgacatgatgttgtggagacatgcacggagattacttgaagatgtccggctgaaggacctgggatgttttgcggctcaactgggctttgagctgatcagttggctgtgtaaggagcgcacccgcgcagcccgggtggacaacttcgttatcgccctgaagcggttgcataaggattttttatggccacttcccatcattcccgcatctagcatctcaagtcccttcaagaatgggaaataccgcaccggtaacgtagactttatgtccttggtgcaaggagagctctactttacaccttgcatttacaccttttgctactag

SEQ ID NO: 29150 - DNA, 1335 bp, Artificial Sequence
  Description of Artificial Sequence: Synthetic coding sequence
atggcaccttccagtcgatgggacgctatgggccccaagaatagctacagatcagtccacgggagaatcgtgccggagctactggaatcctccgtcgccagggtgcgacctctgcagtacgtgcagcggcaaccaagccaagctagcgcccgcagtggggccaatcccactcatcgcccatcagctgaggtgcggccagtgattagaacgggcgaaatgactcactctagtgtgatccccccactggcccctggtgttcgtagggtgagtctgggttacgaatctagtccctctggctcacttccaccactatttaaccaggaaagtccatggaggaggcaggactcttattcaccacagaatcccgctgttagccacaaagctagcctgaactctacaatactgcaggggcccgcagatgccggggttgtcggaggccagtcttggaacagagcgtgggagcctgcacgcggcgccgccagctgggacacctggaggaacaaggccgtcgtgccccctcgtcggagtggagaacctatggtatcaatgcaagcagcagaagagatccggatcttggccgtgatcactatccaggcaggtgtcaggggctacctggcgcgacgtagaatccgcctctggcaccgtggggcaatggtgattcaggcaacgtggagggggtacagagtgagacgcaaccttgcccacttatgtagggcaacaacaacgattcagagtgcttggaggggctatagtactcgaagagaccaggctcgacattggcaaatgctccatccagttacttgggtagaactcggatccagggctggcgtgatgagcgaccggagctggttccaagatgggcgtgcgcgcactgtgagcgatcacaggtgcttccaatcatgtcaggcccacgcatgctctgtatgccacagtctgtcctcacgcattgggtcccctccttctgtggtcatgctagtgggcagctcaccacgaacatgccatacctgcgggcgaacgcaaccaactcgggtggtacagggtatggggcagggcactgagggtccaggcgcagtgtcctgggcctcagcctaccaacttgccgccctcagccccaggcagccccatcgccaagacaaggcagcaaccgcgatccaatccgcctggcggggattcaagattagacaacagatgaggcagcagcagatggccgctaaaatcgtgcaagctacatggaggggccatcacacacgcagctgtctaaagaacactgaagctctgctgggtcccgctgatcccagcgcgtctagccggcatatgcactggccaggcatctag

SEQ ID NO: 29151 - DNA, 4104 bp, Artificial Sequence
  Description of Artificial Sequence: Synthetic coding sequence
atgacactacagggacgcgccgacctgagcggcaatcaaggcaatgccgccggcaggttggccacagtgcacgagccagtcgtcacgcagtgggcggtgcacccgccagcgccagctcatccctcacttctggacaagatggagaaggctcctccccagcctcaacacgagggattaaagagcaaagagcacctgccacagcaacctgcggagggcaagactgcatctcggcgagtgccgcggctccgggccgtggtggaaagccaggccttcaaaaatatcctggtggatgaaatggatatgatgcacgctagggccgcgacactgattcaagccaactggagaggctactggctgcggcagaagctcatcagtcaaatgatggcagcaaaggctatacaagaggcatggcggcgtttcaacaagcgccatatactacatagctccaaatctctcgtgaaaaaaacccgggcagaagagggggatatcccttatcacgccccacagcaggtacgatttcagcatcccgaggaaaataggctgctgtcaccccctatcatggtcaataaggaaacacagttcccttcatgcgacaatctggtgctttgccgcccccaatcttcgcctttattacaacctcccgccgcgcagggaacacctgaaccctgcgtgcaaggcccacacgccgcacgggtgcgcggcctagcatttctcccccaccaaacagtcactattaggttcccctgccccgtgtcattagatgccaagtgccagccatgtctgcttacccggaccatcagaagcacgtgcctggtgcacatagagggtgacagcgtgaagacaaagcgggtgtctgcccgcacgaacaaggctagagcccccgaaacccccctgtcccgacggtatgaccaggctgtgactcggcctagcagagcacagacgcagggaccagtgaaagccgaaacacccaaggctcctttccaaatttgccctggacctatgatcactaagacacttctccaaacgtatcccgtcgtatccgtcacccttccacagacctatccagcctcgacaatgactactactcccccaaagacttctccggtacccaaagtcaccatcatcaaaactcccgcgcaaatgtatcccggacctaccgtgaccaagaccgcaccgcacacgtgtcctatgcccacaatgaccaagatccaggtgcaccccaccgcaagtaggactggcaccccaagacagacctgtcccgcaactatcacggcaaagaaccgaccgcaggtgtcgctgcttgcttcgatcatgaaatccctgccccaagtttgtcccggccccgctatggcaaaaactcctccacaaatgcatcccgtcactacaccagccaagaatccattgcaaacgtgtctgagcgccactatgtctaagacgagtagtcaacggtcccccgtgggtgtcaccaaaccttcacctcagactaggttgcctgcaatgattacaaagaccccagcacaactcagaagtgtggccacaatcctgaaaactctctgtctggcctcccctacagtcgcaaacgtaaaagcgcccccccaggtggcagtagctgcaggcactccaaacactagcggctcaatccatgaaaatcctcccaaggctaaggccaccgttaatgtcaagcaggcggcaaaagtcgtgaaggctagctctccttcctatttggccgagggaaaaatccgctgtcttgcccagccccatccaggcaccggcgtgcctagggcggccgcagagctgccccttgaggccgagaagatcaaaaccggaacccagaaacaggcaaagacggatatggcgtttaagacatccgtcgccgtggagatggctggtgctccaagctggaccaaagtggccgaggaaggggataaacctccccacgtgtacgtgccagtcgatatggcagttaccctgcctcgcggacagctcgctgctccactgacaaacgcgtcatcacaacgtcatcctccatgccttagccaaagacctctggctgcaccactgacaaaagcatcaagccaaggccacctgccaaccgagctgactaagactcctagccttgcacatctggatacctgtctgtctaaaatgcacagtcagacacacctggccactggagcagtgaaggtgcaatcgcaagcacccctcgccacgtgtctgacaaaaacccaatctcgggggcagccaattacagacatcaccacttgcctcatcccagcgcatcaggcagccgacctgtcttcaaatactcattcccaggtgcttctgactgggtccaaagtgagcaaccacgcctgtcagaggctggggggcctatctgccccaccttgggctaagccagaagatcgccaaacacagccccagccccatgggcacgttccaggaaagacaactcaaggcggtccttgtcccgctgcctgcgaagtacagggaatgctcgtgccgccaatggcgcccacaggacatagtacctgcaatgtcgagtcctggggagataacggcgcgactcgtgcgcaaccgtctatgcccgggcaggcagtgccgtgccaagaggacactgttggctccctgttggcaagtctgtgtgctgaggtagccggcgttctggcatcccaggaagatctcaggacactgttggcaaaggctctgagccaaggggaagtatgggcggctcttaaccaggcgctgagcaaggaagtcttaggggccacagtcacgaaggcactcccacagtccatgctgtccatggcattggttaaggctcttagctggtccgagctcagactgaccttaagcagagcattgtctcgcggagaattacgggccgagctaacaaaggtgatgcagggcaaacttgctgaagtgctgtcaaaagctctgaccgaagaggagtgggtggccctgtcccaggctttatgccagggtgagctgggagcgctgctcagccagagctggtgtagggtggccttaaggacaggtactatccttcctaaagctgcatcaaagtcgactgggtctggtgtgactaagacacctgccctagtgaaagtggcctgtaggaggagcccgtccgcagcctgggggccaagtctcgggcccgtgagaccgcagactagcaaaggccccgccgatgctggcgtggtcggcggccagtcatggaatcgtgcctgggagcccgcaagaggcgccgctagctgggatacatggcgtaacaaggctgtagtcccacctcgacggtccggggagccaatggtgtctatgcaggctgctgaagagatacgaattctcgccgtgatcactattcaagccggcgtaagaggttacttggcccggcggcgcattcgtctgtggcatcgcggtgctatggtcattcaggccacatggagagggtatagggtgcgaaggaatctggcccacctgtgcagggccacaaccaccatacagagtgcttggaggggctactctaccagacgggaccaagcaagacactggcagatgcttcatccagtgacatgggttgagctcggatctagggccggtgtgatgtctgatagatcgtggttccaggacggtagggctagaacggtgagcgaccacaggtgttttcagagttgccaggcccatgcctgctcagtctgtcattccctgtcctcacggatcggttcaccgcctagcgtcgtgatgctcgtcggctcaagcccacgcacttgtcatacctgcggccggacccagcctacgagagtcgtgcagggtatggggcagggaaccgaaggcccgggagccgtctcctgggcgagcgcttatcaactcgcggcactcagtccccgccagccccacagacaggataaagcggcgacagctattcagtcagcctggcggggctttaaaattcgacaacaaatgaggcagcagcagatggccgctaaaatcgtgcaggcaacttggaggggccaccacacccggagttgtctaaaaaacaccgaagctctgctgggacctgccgacccttccgcaagttctagacacatgcactggccaggcatctag

SEQ ID NO: 29152 - DNA, 4833 bp, Artificial Sequence
  Description of Artificial Sequence: Synthetic coding sequence
atggcggggctccggcggcctcagcctggctgctactgccgcaccgccgcagccgtaaacctgcttttaggagtcttccaggttctgttaccatgctgtcgacctggaggagcacaaggccaggctatagagccactgccaaacgtcgtggagttgtggcaggcagaagaaggggaactcttgttacctacacaaggggatagcgaggaaggactcgaggagccatcccaggaacagagcttttcagataaactgtttagtggcaagggcttgcactttcagccatccgtgctggactttggcatccagttcttggggcaccccgtggccaagatactgcatgcatacaatcctagcagagatagcgaagtcgtcgtgaattcagtgtttgctgctgctggacattttcacgttcctccggtcccgtgtcgagtaatccctgcaatgggtaagacctcctttcggatcatcttcttacctaccgaggaaggaagtatcgaaagttccctgttcatcaatacatcatcctacggggtgcttagctaccacgtgtcaggtatagggactaggaggatctcgaccgaagggagcgcaaagcaactccccaatgcatacttcctgctacctaaggtccagagcatacagctgtcccaaatgcaagccgaaaccactaatacgagcctcctgcaagtgcaactagagtgttcgctgcataataaagtgtgtcaacaactgaaagggtgttaccttgagtcagacgacgtattaaggctccagatgagcatcatggtgacaatggaaaacttcagcaaggagttcgaggagaatacacaacacctgttggaccacctctcgatagtttacgtcgccactgacgaaagcgagacctccgacgatagcgccgtcaatatgtatatcctgcacagtgggaattctcttatctggatccaggatattcgtcacttttcccaacgcgacgctttgtcactgcaattcgagccggtcctcctacctaccagcactacaaattttaccaaaatcgccagctttacttgcaaggctgcaactagttgcgactctgggatcattgaagacgtgaagaagacaacccacaccccgacattaaaggcttgccttttttccagcgttgcccagggatatttcaggatggacagtagcgctacgcagttccacatagagacacacgaaaatacctcgggcttatggtcaatttggtaccgcaatcatttcgatagaagcgttgtgctgaacgacgtattcctgtctaaggagaccaagcacatgctgaagatcctaaactttacagggccactctttctccctcccggctgttggaatatcttctcgctaaaactagcagtgaaggacatcgcaatcaatctattcacaaatgtgttcctgactactaacatcggtgcgatctttgccatcccccttcagatttacagtgctccaaccaaagaagggtctctgggttttgaggtgattgcacattgcggaatgcactactttatgggtaagtccaaggccggaaatcctaactggaacggctccttgtctctggaccagtcgacatggaatgtggactccgaactagccaataaactgtatgagaggtggaagaaatacaagaacggtgatgtctgcaagagaaatgttctcggaacaactcgctttgcccacctgaaaaagagtaaggagtcagagagttttgtgttttttctcccccgattaatcgccgagcccgggctgatgttgaacttttctgccaccgcactgcggtccagaatgattaagtacttcgtcgtccaaaacccctcgagctggcctgtgtctctgcagctccttcccctctctctttatcctaagccagaagcgctagtgcacctcctgcataggtggttcgggaccgatatgcagatgattaattttactaccggcgaatttcagctgaccgaagcctgcccttacctgggcactcacagtgaagaaagtagatttggaattctccatttgcatctgcagcctctcgagatgaagagagtcggagtagtgtttacaccggcagattatggtaaggtgactagcctcattctgatccgcaacaacctgaccgttatcgatatgattggtgtggagggatttggggcaagagagctcctcaaggtggggggccgcctccccggagctggcggatcgctgcggtttaaagtcccagagtcgaccctgatggactgccgtcgccagcttaaggattcgaaacaaatactatccattaccaagaacttcaaagtggagaatattgggcctcttcctatcactgtgtctagcctgaagataaacggctacaattgtcaggggtatggctttgaggtgctcgattgtcaccagttttcgctggatcccaacacgtcccgggacatcagcatcgtattcactccggatttcacaagcagctgggtgatcagggatttgagcctagtgactgcggccgatctagagttccgctttactctcaacgtgaccctacctcaccacctgctaccattgtgtgcggatgtagtgccaggtccatcctgggaagaatcattctggaggttgactgtcttcttcgtaagcctttctctcctgggtgtgatcctcatcgcatttcagcaagcccagtacatactgatggaattcatgaaaactcgtcagcggcagaacgcttcatcctcctcccagcagaataacggccctatggatgttatctccccacacagctataaatcaaactgcaaaaatttcctggacacctacggtcctagcgacaagggccgcggaaagaactgtctgcctgtgaataccccacagagtaggatacagaacgccgctaaaagaagccctgccacatacgggcattcccagaaaaagcacaagtgctctgtttattattccaaacacaagacttccactgccgctgcctctagcacaagcacaacaacagaggaaaaacagactagcccgctagggagctcactccctgcagccaaagaggacatttgtaccgacgcgatgagagagaattggatctctctccgctatgcctctgggataaacgttaacctacaaaaaaaccttaccctcccgaaaaatctgcttaataaggaggagaacactctgaaaaacaccatcgtattcagtaacccgagctcagaatgtagtatgaaagagggaatacaaacttgcatgttccctaaggagacagacataaagacctctgagaataccgcagaattcaaagagagagagttgtgccccctcaagacttccaaaaagctgcccgaaaaccaccttcctagaaattccccgcaatatcatcagccggatctgcctgagatcagccgtaagaacaatggcaacaaccagcaggtcccagttaagaacgaggtggatcattgtgagaatctgaagaaagtggacacgaagcccagttccgagaagaagatccataagacttcacgggaggatatgttttccgaaaaacaggatatcccttttgtcgagcaggaggacccttacagaaagaaaaagctgcaggagaagcgagaaggaaacctccaaaatctaaactggtcaaaatcgcgtacctgtagaaagaacaagaaaaggggagtggcccctgtttcgcgaccccctgagcaatcagatctaaagctggtgtgttccgacttcgagcgaagcgagctcagttccgatattaatgtgcggtcatggtgcattcaggagtccacaagggaggtgtgcaaggctgacgccgaaattgcttcgagtctgccggccgcccagcgtgaggctgagggctattaccagaaacccgaaaagaagtgcgtagacaaattttgctcagactcctcctcagactgcggaagcagctccgggtctgtcagagcgagccggggttcatggggttcttggtctagcacgagtagcagtgacggggataagaaacccatggtcgacgcacaacacttcctgccagctggggactcagtgtcacagaatgactttccttcggaggctccaatcagcctgaatctgagtcacaatatctgcaaccctatgaccgtgaactctttacctcagtatgccgagccttcgtgtcccagtctgccggctgggcccacgggtgtggaagaggacaaggggctctactcccctggcgacctgtggcctaccccaccagtctgtgtcacaagctctctcaattgcactctggagaatggtgtaccgtgtgtcatccaggaaagcgcacctgttcacaatagtttcattgattggtccgcgacctgtgaggggcagtttagctccgcttactgccctctagagctgaacgattataatgcatttccggaggagaatatgaattatgccaacggcttcccttgccccgcagatgtccagaccgactttatagatcataacagccagtcaacctggaataccccaccgaatatgcctgccgcctggggccacgctagctttatttcttctcccccctatcttacctctactcggtcattgtcccccatgagtgggctatttggatccatttgggcaccccagagtgacgtttacgagaattgctgccccatcaatcctacaaccgaacactcaacacatatggagaaccaggccgtggtctgtaaggaatattaccccggtttcaatccatttcgagcttacatgaaccttgatatatggactacaaccgccaacaggaacgccaactttcccctgagcagggattcatcttattgcggtaatgtgtag

SEQ ID NO: 29153 - DNA, 2385 bp, Artificial Sequence
  Description of Artificial Sequence: Synthetic coding sequence
atgaccttgcaaggccgagctgatctctctggtaatcagggtaacgcagctggccgcttggcgacagtccatgagccagtagtgacacagtgggctgtgcatccccccgcccctgcccatccttcattattagacaaaatggaaaaagcgccccctcagcctcaacatgaaggtctgaaaagcaaggaacacctcccccagcaacctgccgaaggtaagactgcctctcggcgggtgccgcgtctgcgcgccgtggtggaaagccaggcgttcaaaaacatactggttgatgagatggacatgatgcacgcacgcgctgccaccctgatccaagctaactggagggggtattggcttcggcagaaactgatcagccagatgatggcagccaaagctatccaggaggcctggcggcgcttcaataaacgccatatcctccactcctccaagtcacttgtgaaaaagactcgggccgaagaaggcgatatcccataccacgcacctcaacaggtgcgttttcagcaccccgaggagaataggctcttgagtccgccaattatggtcaataaggaaactcaatttccctcctgtgacaatcttgtactgtgcagacctcaatctagcccccttctgcagccccccgctgctcagggcaccccagagccctgtgtgcagggcccgcatgctgccagagtgcgaggcctggcttttttaccacaccagactgtgactattcgattcccctgtccagtctccctggatgcaaaatgtcagccctgtctcttgaccagaaccattcggagcacatgcttggtgcacatagaaggagattccgtcaaaacaaacgccagtagtcagcgtcaccctccctgtctgagccagcggccgctggccgctccactgacaaaggcaagtagccagggtcatctgcctacggagctgaccaagacaccgtccctggcccatctggacacctgtctatccaaaatgcactcccagacacacctggcgacgggtgctgttaaggtgcagagtcaggcaccattggctacttgtcttactaaaactcagagtcggggacagcctatcaccgatataaccacctgcctcatccctgcacaccaggccgccgatcttagttcaaatacccattctcaggtactcctgaccggatctaaagtaagtaaccatgcgtgccaacggctaggaggcctttccgctccaccctgggccaaaccagaagatcgacagacccagcctcaaccacacggtcacgtccccggtaagaccacccagggcgggccatgtcctgccgcctgcgaggttcaaggaatgctcgtgccacctatggcgcctactggacactccacctgtaatgtagagtcatggggagataacggagccacaagggcccagcccagcatgcccggccaagctgtgccgtgtcaagaggacactggacctgcagatgctggcgtggtgggcggccaaagctggaaccgagcttgggagcccgcacgaggtgcagctagctgggatacctggaggaataaggctgtcgtgccgccgaggcgctccggcgaacccatggtgtcgatgcaggctgctgaagagatcaggatcctggccgtcattaccattcaggcaggcgtgcgcggctacctggcccgacggcgcatccgactctggcacaggggagccatggtgatccaggccacctggaggggttatagggtgaggagaaaccttgcacacctctgtcgcgccactacaacaatccaatcggcctggcgcggttactcgaccagaagagatcaagcaaggcactggcagatgctgcacccagtaacttgggtcgagctgggatctagggcaggcgtgatgtcagatagatcttggttccaggacggcagagctaggaccgtatccgaccatagatgctttcagtcatgccaagcccatgcttgttcagtgtgccactcgctttcatcccggattggatcccccccaagtgttgtgatgctggtgggttcaagcccccggacttgccacacttgcggtcggacgcagccgacccgggtggtgcaggggatgggacagggaactgagggtcccggggcggtaagttgggcttcggcttatcagctggcagcactaagcccaagacagccccacagacaagacaaagctgcaacagcaattcagtccgcctggcggggatttaagattaggcagcagatgagacaacagcaaatggccgctaaaattgtacaggccacttggcgtggacaccacacacgctcctgtctgaagaacaccgaagctctgctgggtcctgctgacccctccgcctcctctaggcacatgcattggcctggcatttag

SEQ ID NO: 29154 - DNA, 4272 bp, Artificial Sequence
  Description of Artificial Sequence: Synthetic coding sequence
atgtactttctctcaggatggcccaaaagactgctctgccctctgggaagcccggctgaggcccctttccacgtccagtccgatccccagcgggcattctttgccgtcctagcagcagctaggttgagcatatggtacagccggccgtcggtcctgatcgtgacctacaaggaaccggcaaagagctcaacccagttcgggagttacaaacaggcggagtggcgccctgatagcactatgatagccgtatccacagctaatggttacattctcttcttccacatcaccagcacccgcggtgacaaatatctgtacgagcctgtgtatcccaaggggtcccctcagatgaaaggcactccccatttcaaggaagaacagtgcgcaccagccctgaacctggagatgcgtaaaatactagatctgcaggctcctatcatgtctctacaatccgtactggaggacctgctagtcgccacgtctgacggcttgctgcatctcatccactgggaaggaatgactaatggcaggaaagcaataaacctgtgcacagttcctttttcagtagacttgcagagttcaagggttggctccttcctaggttttacggatgtgcatatccgagatatggaatattgcgcaacgctcgatggcttcgccgtagtgtttaatgatggcaaagtcggcttcatcactcccgtttctagtcgcttcacagctgaacaactgcatggtgtgtggccacaggatgtggtagacgggacctgtgtcgccgtcaataataagtataggttgatggccttcggatgcgtgtctggcagtgtacaggtgtacaccatagataacagcacaggtgccatgctactcagtcacaagcttgagttaactgctaagcagtaccccgatatctggaataagaccggtgcggttaaacttatgcgttggtccccggataattcagtggtgatcgtaacttgggaatacggtggcttaagcctgtggagcgtattcggtgcacagctgatctgtacactggggggcgattttgcttaccgctctgatggtactaagaaggacccactgaaaattaattctatgtcttggggagcggaagggtaccacctttgggtaatctcaggatttgggtctcagaatacagagatagagtctgacctcagatccgtcgtgaaacagccatctatcctcctgttccagttcatcaagagtgtcctgacggtgaacccctgcatgtcaaatcaggaacaggtgctcctgcagggcgaggatagactttacctcaattgtggcgaggcctcccagactcagaaccctaggtcaagctcaacacactctgaacataaaccttcacgcgagaaatctcccttcgccgacggggggctggagtcccagggactttccacgctgctgggccatcgacactggcatgtggtgcagattagcagcacctacctggagtccaattggcccatcagattttctgcgattgacaaattgggtcagaatattgccgttgtgggtaaattcggattcgcccattactccctcctgacaaagaaatggaaactgttcggcaacattacacaggagcagaatatgattgtgacgggaggactcgcctggtggaatgatttcatggtgttggcctgctacaacataaacgatagacaggaggagctgcgcgtctacctgagaacttccaatcttgataatgcatttgcccatgtgactaaggcccaggctgagaccctcttgctaagcgtgttccaggacatggtaattgtgttccgcgccgactgcagtatttgtctgtattctatcgagaggaaaagcgatgggccaaatactaccgccggtattcaagttcttcaggaggtgtcaatgagtcggtatattcctcaccccttcctggtggtgtccgtgaccctgacgtccgtctccaccgagaatggaattacattgaagatgccacagcaggccaggggtgctgagagcatcatgctaaatcttgctggtcagttgattatgatgcagagggacagatctggtccccaaattagagaaaaggattctaacccgaataatcagcgcaaacttcttccattttgcccccctgtcgttctggcccagtccgtggagaacgtctggaccacttgtagagctaataagcaaaaacgccacctgcttgaggcactgtggctcagctgtggaggtgccggcatgaaagtgtggctgcctctgtttcctcgagaccataggaagccacacagcttcctttctcagcgcataatgctcccattccacatcaatatttatcccctggccgtgttgttcgaggatgccctggtactgggcgccgttaacgacaccctgctgtacgacagcctctacactcgtaacaacgcccgggagcaactcgaagtcctgtttcccttctgcgtcgtggaacgtaccagccagatatatttgcaccacatcctgcggcagctcctggtccgaaacctcggtgagcaggcccttttgctcgctcagtcatgcgcaaccctgccctacttcccccacgtgctggaactaatgctgcacgaggtcctcgaggaggaagcaactagccgggagccaattccagaccctcttttacccaccgtggctaagtttattactgagtttcctctttttttgcagactgtagttcattgtgcccgcaagaccgaatatgccctctggaattacctcttcgccgccgttgggaacccaaaggacctgttcgaagagtgtcttatggcgcaggacctggacactgctgcctcctatctgataattttacagaacatggaggttcccgccgttagcagacagcatgccaccctcctgttcaatacagctttagaacagggtaaatgggatttgtgtaggcacatgatccgctttctcaaagctattggcagcggggagtctgagacacctccttccacacctactgctcaggaaccaagctccagcggcggttttgagttctttagaaatagaagcatctctctcagccagtctgcagagaatgtgcccgcaagcaaattcagcttacaaaagacactgtcaatgccgagtggccccagcgggaaacggtggagcaaggactcagattgcgccgagaacatgtacatcgatatgatgctttggcgccatgcacggcggcttcttgaggacgttcgtctcaaggacctgggctgtttcgcggcgcagctgggattcgagctgattagctggctgtgtaaggagaggacccgagcagccagggttgataatttcgtcatcgccctgaagcgtcttcacaaggacttcctgtggccattgccaattatacctgcctcctctatatcatctccgttcaagaatggtaagtacagaaccgtaggggaacaacttctgaagagtcaatcggccgatcctttcctcaatctcgaaatggatgccggaatctctaacattcaacgctctcaatcatggctgtctaacattggacccacccaccacgaaatcgacacggcatcttctcacgggcctcagatgcaggacgcattcttatcgcccctaagcaataagggagatgaatgcagcatcggcagcgccactgatctgacggaaagctcgagcatggtggacggagattggaccatggtggacgagaatttcagtacactgtcgctgacccagagtgagctggaacatatttccatggagttagcctcaaagggccctcacaagtcacaagtgcagctgcggtatctactgcatattttcatggaagccggctgcctggactggtgcatcgtaataggtctcatcctccgggaaagctccataataaatcagattctagttattacccagagttcggaagtggatggggagatgctgcagaacatcaagaccggacttcacgccgttgatagatgggccagcaccgattgccccggctataaacctttccttaacatcattaagccgcagctacaaaagctgtcagagatcaccgaggagcaggtccagcctgatgcattccaacctattacgatgggcaaaactccagaacaaaccagtccaagagcggaagaatcccgaggatcatcctcccacggctccattccacagggcgaggtgggaagttcgaacatggtgtcacggaaagaggaggatactgcccaggcggaagaggaagaacctttccaggatggaacatacgattgctcagtgtcatag

SEQ ID NO: 29155 - DNA, 4035 bp, Artificial Sequence
  Description of Artificial Sequence: Synthetic coding sequence
atgatcgccgtgtcgactgccaatggctacattttgtttttccatattacctcaacgcggggcgataagtatctctacgagccagtctatcccaagggaagccctcagatgaagggaactccccacttcaaggaggagcagtgtgcccctgccctgaacttggaaatgaggaagatactggacctgcaggctcctattatgtccctccagagcgtcctcgaggacctgctcgttgctacatctgatggcttgctacatttgattcattgggagggtatgacgaacggaaggaaggcaatcaatttgtgcactgttcccttcagtgtcgacctccagagtagcagagtgggaagcttcctgggttttaccgatgttcacatccgggatatggagtactgtgccacactggacggattcgccgttgtgttcaacgacggaaaagtcgggttcattacaccagtaagttctcgatttaccgccgagcagctgcacggcgtttggcctcaggacgtcgtcgatggcacatgcgtggccgtcaacaacaagtaccgcctcatggccttcggatgcgtgagtgggagtgtccaagtctacacaatcgataattcaaccggtgcgatgctcctcagccacaagcttgaactgacagctaaacagtatcccgacatctggaataaaacaggcgccgtcaaactgatgcgatggtcaccagataactctgtggtgatagtgacgtgggaatacggcgggctgtcgctctggtctgtgttcggcgctcagttgatttgcactctagggggggacttcgcatacagaagcgacggaacgaagaaagacccactcaaaattaactccatgtcatggggtgcagaaggctaccatttgtgggtgatcagtggatttggctctcaaaacaccgaaattgaaagcgacctgcgcagtgtggtgaagcagcctagcattctcttgtttcagtttattaagagcgtgctaaccgtgaacccctgcatgtctaatcaagaacaagttctgctgcagggagaggacagactgtacttgaactgcggggaggcaagccagacccagaatcctagaagcagctcaacccactctgagcacaaaccatcgagggaaaagagtccgtttgccgatggcgggttggaaagccagggtctctccaccctgctgggccacagacattggcatgttgtgcagatctcatctacctatctcgaaagcaactggccaatacggttcagcgctatcgataagctgggacagaacattgcagtcgtgggcaagttcgggttcgcccattactccttactgacaaaaaaatggaagctgttcggcaacatcactcaagagcaaaatatgattgtgacaggcggactggcttggtggaatgatttcatggttctcgcctgttacaacatcaacgaccgccaggaagaattgcgggtatatctgcgcacttccaacctggacaatgcatttgcacacgtcacaaaggcacaggcagagacgcttctgttatcagtgtttcaggacatggtgattgtgttcagagctgactgctctatttgtctgtactcaatcgaacgaaagagcgatgggccaaacactactgccggtatccaggtgcttcaggaagtgtccatgtcccgttacatccctcatcctttcctggtcgtgtccgtgacactcactagtgtgtctacagaaaacggcattaccctcaaaatgccccaacaagctaggggtgctgagtctatcatgttaaatctcgcgggtcagttaataatgatgcagagggaccgaagcggaccgcagattagggagaaggatagtaatcccaataatcagagaaaattgctgccattttgccccccagtggtgctggcccagagcgtcgagaacgtctggacgacgtgtcgcgccaataaacagaagagacacctactggaagctctgtggcttagctgcggcggtgcagggatgaaagtttggctgcctctgttccctagagaccatcgcaaacctcattcgttcctgtcacagcgcattatgctgccctttcacataaacatttatcctttggcagttctgttcgaggatgcattggtcctaggggccgtgaacgacactctgctgtatgacagcctgtacacgagaaataatgcacgcgagcaacttgaggtactttttccgttttgtgtggtcgagcggacaagccaaatctatctgcatcacattctgcggcagcttttagtgagaaatctcggagagcaggccctgctcctggctcaaagttgcgccacacttccgtatttccctcacgtattggaactgatgttgcacgaggtgctggaagaagaagctacatcccgtgagccaatacccgatccactactgcccacagtggctaagtttatcaccgaatttcccctgttccttcaaacagtggtgcattgcgcgaggaagaccgagtacgcgttatggaactatctatttgcggcagttgggaacccaaaggacctgtttgaggaatgcctgatggcacaggacttggacacagccgcgagttacctcattatccttcagaacatggaagtgcctgccgtgtcacgccaacatgccacgctgctctttaatacagccctggagcaaggcaaatgggacctgtgtagacacatgattcggtttcttaaggctattggcagcggagaatctgaaacccctccatcaacgcccacagcgcaggaaccaagttcatccggtggatttgaatttttccggaatcgcagtatctctctgtcgcaatcagcagagaacgtgcccgctagcaagtttagcctgcagaaaacccttagcatgcccagcggtccttccggcaaacgttggtctaaggactctgattgtgcagagaacatgtacatcgacatgatgctgtggcggcatgctcgacgcttactggaggacgtgcggctcaaagacctggggtgctttgctgcccagctgggattcgaactcatctcctggttatgcaaagaaaggactcgcgccgccagggtagataattttgttatcgccctcaaaagattgcataaggatttcctttggccactgcccatcatacccgcttcaagcatctcatcccccttcaaaaatggcaaatatagaacggttggagagcaactcctcaagtcccagtctgctgatccgttcctcaacctggaaatggacgccggtatctctaacattcaaagatcccagagctggttatccaatataggtcccactcaccacgagatcgataccgcatccagccacggaccgcaaatgcaggacgctttcctgtcacccctcagtaacaaaggcgatgaatgtagcatagggagtgccacagatctcacagaaagttctagtatggtggatggtgactggactatggtggatgaaaatttctcgacattgagtttaacacaatctgaactggagcacatcagcatggaactagcgtcgaaaggaccacacaagtctcaagtgcagctcaggtatttgttgcacatttttatggaggccggctgtctcgactggtgcattgtgatcggactgatcctccgggaatcaagcatcatcaatcagatcctggtgattactcagagcagtgaggtggatggcgagatgctgcagaacatcaaaaccggtctgcacgcagtcgacagatgggccagcaccgattgcccaggctataagccctttctgaatatcattaagccacagctacagaagttgtctgaaatcacagaagagcaggtgcagcccgatgcctttcagccgataacgatgggcaaaactcccgagcagacgtctccccgcgcagaggagtctcgcggttcatcatcccacgggtcaatcccccaaggggaagtggggtctagtaacatggtgtctcggaaagaggaggacacagctcaggccgaagaggaggagccattccaggatggcacatatgactgctctgtgagctag

SEQ ID NO: 29156 - DNA, 3081 bp, Artificial Sequence
  Description of Artificial Sequence: Synthetic coding sequence
atggagaagcgcctgggggtgaaacctaacccagcgtcatggatattgtctgggtactattggcagacgagcgcaaaatggctaaggagtctgtatctcttctatacctgcttttgcttcagcgtattgtggctgagcacagacgcgtccgaaagtagatgtcagcagggaaagacccaattcggcgtcggactaagaagtgggggcgaaaatcacctttggcttttggaaggtaccccatcactccagtcttgctgggccgcatgttgccaggattcagcctgtcacgtgttttggtggttggagggcatgtgtatccaggcagactgttctaggccacagagctgtagagcatttagaacacatagttcaaactcaatgcttgttttcttgaaaaaatttcagaccgctgacgatctcggctttctccccgaggacgatgtcccgcacctcctaggccttggttggaactgggcttcctggcgacagtcgccaccacgagcagctttgagaccagctgttagttcaagcgatcagcaaagcttaatcaggaagctccaaaagcgaggcagcccatctgacgtggttactcccatcgtgacacaacatagtaaggtgaatgactctaacgagctgggcggcctaactacttccggcagtgctgaagtgcataaagcaatcactatatcctctcccctgactacagaccttactgccgaacttagcggcggcccgaaaaatgtgtcagtgcagccagagatctccgagggcttagcaacaaccccctcgacacagcaggtgaaatccagcgagaaaacacagatcgcggttccacaacctgtggccccatcctatagctacgctactccaacacctcaagctagtttccaaagcacttccgcaccttaccccgtgataaaggagttggtagtgtcagcaggggagtccgttcagattactctccccaaaaacgaggtccagctcaatgcttacgtactacaggagccccctaaaggagaaacatacacatacgactggcagttgatcacgcatccacgggactattccggcgagatggaggggaaacattcacaaatcctcaaactgtctaagctcacacccgggctgtacgaatttaaagttattgtggagggccagaatgcacacggagagggctatgttaacgtgacagttaagcccgaaccaagaaaaaacaggcctcctattgcaatcgtttcaccacagtttcaagagatttctctacccaccacctctactgtcatcgatggctcccagagcacagatgatgataagattgtccagtatcactgggaagaacttaagggtcctctgagggaggaaaaaattagcgaggatacagctatcctgaaactcagcaaactcgtgcccgggaattacaccttctcgctaacagtcgtcgattcagatggtgcaaccaattccacaacagccaatctgactgtcaacaaggctgtggattacccccctgtcgccaacgctggccccaatcaggtgattaccctgccacaaaatagcatcacgctattcggtaatcagtctacggatgaccatggcataacaagctatgaatggtctctgtcaccctcctcaaaggggaaggtcgttgaaatgcagggcgtaaggactccaactctacagctgagcgccatgcaggagggggattacacttaccagttgaccgtcacagacaccatcggacaacaggcaaccgctcaggtcaccgtcatcgttcagcccgagaataacaagcctccccaagcagacgctggtcccgacaaagaactgacattgccagtggatagcacgaccctcgacgggtctaaaagttcagacgaccaaaaaatcattagctacctctgggaaaaaacccagggacctgatggggttcagctggagaatgctaattcctccgtcgccaccgtgacgggtctgcaagttggcacttacgtgtttacgttgaccgttaaggatgagagaaacctgcagtcacaaagtagcgtcaatgtcatcgtcaaagaagaaatcaacaagccaccaatagccaaaataacgggtaacgtggtgatcactctcccaacatcaacagcagagctcgatggcagtaagagctctgacgataaaggcattgtctcatatctttggacacgggacgaggggagccccgctgctggcgaggtgcttaaccatagcgatcatcatcccattctgtttctgtcgaaccttgtggaagggacctacacgttccatctgaaggtgacggacgccaagggggaatccgacacagatcgcacaactgtggaggtgaagcccgacccacgtaagaacaaccttgtggagatcattcttgacattaacgtctcgcagctgaccgagcgtttgaaaggcatgttcatcagacagattggagtgctcttaggcgtgctcgacagcgacatcattgtgcagaaaatccagccctacaccgagcagagcacaaagatggtgttttttgtgcagaatgagccaccacatcaaatattcaaaggccacgaggtcgcggccatgttgaaaagcgagttaaggaagcagaaagccgactttctcatcttcagagcattagaggtaaacaccgtgacatgtcagctgaactgctctgaccacggtcattgcgattctttcactaagagatgtatttgtgatccattctggatggagaactttatcaaagtgcagctgagggatggggacagtaactgtgagtggagtgtcttgtatgtcattatcgcaacttttgtcatagtggtggctctcggtatcttatcctggacagtcatatgttgctgtaaacgtcaaaagggcaagcctaagcgaaagtcaaagtataaaatcctcgatgctacggaccaagaatctctggaactgaagcccaccagccgggccggaatcaagcagaaaggccttttgcttagcagcagtctgatgcacagcgagagtgagctcgactcggatgatgcaattttcacatggcctgacagagagaagggtaaactgttgcactag

SEQ ID NO: 29157 - DNA, 3405 bp, Artificial Sequence
  Description of Artificial Sequence: Synthetic coding sequence
atggaaaaggcccccccacagcctcagcatgagggtctaaaaagtaaagagcacctccctcagcagcctgcagagggtaagacagcctcaagaagagtgcctcgactgcgcgccgtggtggaaagccaggcttttaaaaacattctggtagatgaaatggatatgatgcacgcgcgggccgctaccctcattcaggcaaactggcgcggttactggttgcgccagaagctgatatcacagatgatggccgccaaggcaattcaggaagcgtggcgccgattcaataagcgccatatcctccattcatctaagagtctcgtgaaaaagactcgggccgaagaaggcgacattccataccacgctccacaacaagtgcggtttcagcaccccgaagagaacagacttctgtcaccacctatcatggttaacaaagagacacagttccccagctgtgacaaccttgtcctttgccgaccacagagtagccccctgctgcagccacccgccgcacaggggacacccgagccctgtgtccaaggacctcatgccgcacgagtgagaggtctcgctttcctcccacaccaaacggtaacaatccgattcccctgcccagtttctctggacgcaaaatgtcaaccctgtctgctgacgcggacaattcggtcaacctgtctggtgcatattgaaggggacagcgtgaaaaccaaaagggtgtctgcccgaactaataaggcaagagctcccgaaacaccgctctctagacgatatgaccaggcagtgacacggccgtcccgcgcacagactcagggacctgtgaaggccgaaactccgaaagcaccatttcagatttgtcccggcccaatgattacgaaaacgctgctgcagacttatcctgttgttagcgtgaccctccctcagacatacccagcctccacaatgaccacaacgccgccgaagacctcccccgtcccaaaagtgacaattattaaaactcctgcccagatgtatcctggcccaacagtgactaaaacggcaccacatacttgcccgatgcccaccatgacgaagatccaagtacaccccaccgccagtagaacaggcaccccccgacaaacatgcccagctacaattacagccaagaatcggcctcaagtgtctctgctggcgagcattatgaagtctcttcctcaggtttgtcccggcccagccatggccaaaacaccccctcagatgcaccctgtcacgacacccgcgaagaaccctctgcagacatgtctgagcgcaacgatgtctaagacttcatcacagcggtcgccagtcggtgtgactaaaccatctccccagacgaggctgcctgccatgatcacaaagactccagcccaactgagatcagtggctacaattctgaagacgttgtgtctcgcaagccccacagtcgctaatgtgaaggcaccgcctcaagtagctgtggccgctggaacaccaaacacgagcggatcgatccacgaaaacccacctaaggccaaagctactgtcaatgtaaagcaggccgcgaaagtcgtgaaggccagtagcccctcctatctggctgaaggtaaaatcagatgcctggcccagcctcaccccggaacaggggtgccgagggcagcagctgaactcccactggaagcagaaaaaataaagacagggacacagaagcaggccaaaaccgatatggcgttcaagacaagtgtggcagtggagatggccggggcccccagctggaccaaggttgccgaagagggggataaaccaccccacgtgtatgtgccagtggatatggcagtgaccttaccccgtggacaactagccgctccactcacaaacgcctctagtcagcgccatcccccgtgcctgtcgcagaggccacttgcggctccattgacgaaggcctctagtcagggccacttgccgacagagctgaccaaaacaccaagcttagcgcacttagatacttgcctttctaagatgcatagtcagacccatctcgccactggcgccgtgaaggtgcaatctcaagcacctttagccacatgtcttaccaagacccagtcacgcgggcagcccatcactgatatcaccacctgccttattccggcgcatcaagctgccgatctgagttccaacacgcacagccaggtgctcctgactggaagcaaggtgagtaatcatgcatgccagaggctgggtggcctttcagctccaccttgggccaagccagaggataggcagacacagcctcaaccccatgggcatgtgccgggcaaaacgacacagggaggcccttgtcccgccgcgtgtgaagttcaagggatgctggttcctcccatggctcctaccggacatagcacatgtaacgtcgagagctggggagacaacggggctactcgagcacaacctagcatgcccggacaggcagtcccatgccaggaggacaccggacccgccgacgcaggggttgtcgggggtcaatcctggaaccgggcgtgggagccggcacgcggtgctgcatcatgggacacctggcgtaataaggcagtagtgcctcctagaaggagtggcgagccaatggtcagcatgcaagccgccgaggaaattcgaattctagctgtaatcactattcaggccggtgtacgcggatatcttgcccgcaggcggattaggctctggcacaggggggctatggtgattcaggccacatggaggggatatagagtcagacgcaatctggcccatttatgtcgggctactacaacgattcagtcggcttggcgggggtattcgacgagacgagatcaagcaaggcactggcaaatgcttcatcctgtcacatgggtggaactaggcagccgcgctggtgtcatgagtgaccgctcttggttccaagacggtagagcccgcaccgtgtctgatcatcgttgttttcaatcatgtcaggctcacgcctgcagtgtctgtcattcactaagttctagaattggctcacccccatctgtagttatgctcgtcggatcaagccccagaacatgtcacacgtgcggccgcacccagcccacaagagtggtgcaggggatgggacagggtaccgagggccctggcgcagtctcttgggcttccgcgtaccagctagccgcattgagccctagacagccccaccgacaggataaagcagctacggccatccagtctgcatggcgagggttcaagatccggcagcagatgaggcagcagcagatggcagccaaaatagtccaagccacctggcgcggacatcatacccgctcctgtcttaaaaatactgaggcactgctagggccagccgaccccagtgcctcctcaaggcacatgcattggccaggaatttag

SEQ ID NO: 29158 - DNA, 2058 bp, Artificial Sequence
  Description of Artificial Sequence: Synthetic coding sequence
atggagaagcggctgggagtcaagcctaatcctgcctcttggatacttagcggttactactggcagacatccgccaaatggcttaggtccttatatctattctatacctgtttctgtttcagcgtgctgtggctaagcactgacgcaagcgaatctagatgccagcaggggaagactcagttcggggtgggattgagatcagggggtgagaatcatctctggctgctcgaagggacaccatcgcttcagagttgttgggctgcatgctgccaggacagcgcatgtcacgtgttctggtggttggaagggatgtgtatccaggcggactgctctcgtccccaaagttgcagggctttcaggactcactcttccaactccatgcttgttttcctcaagaaatttcagacagccgatgatctgggctttctcccagaggatgatgtaccacacctcctaggattgggctggaactgggcctcgtggaggcagtccccaccccgcgcagctctgagacctgccgtttccagttcagatcagcagtcactgatccgaaaacttcagaagagagggtcccctagcgacgtggtcactccaattgtaacccagcactctaaagtgaacgacagcaatgagttgggcggccttaccaccagtggcagtgctgaggtccacaaggcgattacaatcagctcccccctgacaactgatttaaccgcagagctcagtggagggcctaagaacgtatccgtccagccagagatttctgagggcctggccaccacacctagcacccaacaggtgaagagttcagagaaaacccagattgctgtgccccagcccgttgccccctcatattcttacgccacacccacaccacaggccagctttcagtcaacaagcgccccataccccgtcatcaaggaacttgttgtctctgcaggagaatcagtccagatcactctgcctaaaaacgaagtccaactgaacgcttatgtcttgcaggaaccccccaagggtgaaacgtacacctacgactggcagctgataacacacccccgggattactctggcgagatggagggcaagcactcccaaatcttgaagctgagtaaactcacgcccgggttatacgagtttaaagttattgtggaggggcagaacgcgcacggagaaggttatgtaaatgttaccgtcaaacccgagcctcggaaaaatcgacccccgatcgctatagttagcccccagtttcaggagatcagcctgcccaccacatctaccgttattgacggaagccaatctacagatgatgataagatcgtgcagtaccactgggaagagctcaagggacctctgagagaagaaaagatttctgaggacacagccattctcaagctgtccaaactggtgccaggaaattacaccttttccttgactgtcgtggactctgacggggccaccaattctacaaccgcgaatctgaccgtgaataaggctgttgattaccctcctgtcgcaaacgccggacccaaccaggtgataacgctgccccagaattctatcacactgttcggaaaccagtcaactgacgatcacggcatcacatcatacgagtggtctctgtctccctcatctaagggcaaagtggtcgagatgcaaggagtcagaactccgacgttacagctgagtgcaatgcaggagggagactatacctaccagttgaccgtaactgacaccatcgggcagcaggcaaccgcgcaggttaccgtgattgtgcagcccgagaacaataaacctccccaggccgatgccgggccggataaagaactcacgctgccagtggactcaaccacacttgatgggtccaagagctcggatgaccaaaagattattagctacctttgggaaaagacccaggggccagacggggtgcaactggaaaacgcaaacagttccgtggccactgttaccgggcttcaggttgggacctacgtgtttacactcactgtgaaagacgaacgtaacctgcagtcccaatcctctgttaacgttatcgtgtag

SEQ ID NO: 29159 - DNA, 4581 bp, Artificial Sequence
  Description of Artificial Sequence: Synthetic coding sequence
atggctgggctgcgcagacctcagccagggtgctactgtcgtactgccgctgccgtcaacttgctgctcggcgtgtttcaggttctgctgccctgctgccgacccggcggtgctcaaggccaagctatcgagccccttccgaacgttgtggagctgtggcaggccgaagaaggcgagcttctgctccctacccaaggtgacagtgaagagggcctggaggaaccctctcaggagcagagtttcagcgataaactgttcagcggcaaagggctacactttcagccaagtgttcttgacttcggcatccaattcctcgggcatcctgttgctaagattcttcatgcatacaatcccagtagggatagcgaagtggtcgtgaatagtgtttttgccgcagccggccattttcatgtgccgcctgtaccttgtagagtcatcccagctatgggtaagacctccttccgaatcatcttcctccccacagaagaaggctctatcgagtcctcactgtttatcaacacctccagctatggagtgttgagctatcatgtgtccgggataggcacacgcaggatttctactgagggcagtgccaagcaactccccaatgcctatttcctgcttcccaaagtgcagtctatccagctgtcccaaatgcaggccgaaacaacgaatacaagccttttacaggtccagctagagtgcagtctgcacaacaaggtttgtcaacagctgaagggctgctacttggaaagcgatgacgtgctccgattgcaaatgtccatcatggtaaccatggaaaatttctccaaagagtttgaggagaacacccaacatctgctcgatcacctctccatagtttacgtcgcaacagatgagtccgagacaagcgacgactcagctgttaacatgtatattctgcactctggaaatagcctgatttggattcaggatatcaggcatttttcgcagagagatgccttgtcattacaatttgagcctgtgctgctcccgactagcaccacaaacttcactaagatcgcatcattcacatgtaaagcagccacaagctgtgattccggtattatcgaggatgtcaagaaaaccacacacacacctaccctgaaggcatgtcttttttctagcgtcgcccaaggttatttccgtatggacagcagtgcaacccagtttcacattgagactcacgagaacacttctggattatggtctatttggtatcggaaccactttgatcggagcgtcgtgctcaacgacgtgtttctgtccaaggagaccaagcacatgttgaagattctgaatttcacaggccctctcttcttgccacccggctgttggaatatcttctcacttaaactggccgtaaaagacattgctataaacctttttacaaacgtatttttaactactaacatcggcgcgatattcgcaatacctctgcagatatattcagcacctactaaagaagggtccctcggttttgaggttattgcacactgcggcatgcactattttatgggcaaatccaaggcaggaaaccctaattggaatgggagtctgtcactggaccagagcacgtggaacgtggactctgaattggcgaacaagctctatgaacgttggaaaaaatacaagaacggtgacgtgtgcaagtttggtaccgacatgcagatgataaactttaccacgggcgaattccaattaacagaggcttgtccttatctcggaactcactctgaggagagtcgttttggcatactgcatctccacttgcagccccttgagatgaagcgggtcggcgtggtgttcactcctgccgattacggcaaggttacctctcttattttgatccgcaataatctgacagtgatagatatgattggagttgaggggtttggggcacgcgaactattaaaagtaggcggccgattgccaggagccggggggtccctgcgcttcaaggtccctgaatccacgctgatggactgtagacggcagctgaaagactccaaacagatactcagcattacaaagaattttaaggtggaaaatattggcccactgccaattacagtaagttcacttaagatcaatggatacaactgccaaggatacggcttcgaagtactcgactgtcatcagttctcacttgatccaaatacttcccgtgacatttctatagtgttcactcccgatttcacatcttcgtgggtaatcagagatctctcactggtcacagcggcagatctagaatttagattcaccttgaatgtgacactgccccatcacctgttgcccctctgtgccgacgtggtcccggggccttcttgggaagaatccttttggagactcacggtgttctttgtcagtttatctctgctgggcgtcatcctaattgccttccagcaggcccaatacatcctgatggaattcatgaagaccagacagcgtcagaacgccagctcatcatcccagcaaaacaacgggcccatggatgtgattagtccacatagctataagagtaactgcaaaaactttctcgacacatatggtccatcagacaaggggcgcggaaaaaattgcttgcctgtgaatacaccccagtctcgcattcagaatgccgccaagcggtcccccgccacctacggtcatagtcaaaagaaacacaagtgcagcgtctactattccaagcataagacttcaactgcagctgcaagtagtacctctacaactacagaagaaaagcagacgtcccccctggggagttctctccctgccgctaaagaggacatatgcacagacgcgatgcgggagaattggatcagcttgcgatatgccagcggcattaacgtcaacctgcaaaaaaatctcaccctacccaaaaatctgctgaataaggaggaaaacacactaaaaaacactatcgttttttctaatccttctagcgagtgctccatgaaggagggtatacagacgtgcatgtttcccaaggagactgatatcaagacctcagagaacaccgcagagttcaaagaacgcgagttatgccccctcaagacgagcaagaagctgccagaaaaccatctacctcgcaactcgccacagtatcatcagccagaccttcctgaaatctctagaaaaaataacggaaacaatcagcaggtacccgttaaaaatgaagtggaccattgcgaaaacctgaagaaggtggatacgaagccctccagcgagaaaaagattcataagacctccagagaggatatgtttagcgagaagcaggatattccttttgtggaacaagaggatccatacaggaagaagaagctacaagaaaagcgtgaaggtaacctccagaatctaaactggtctaaatctagaacctgcagaaagaataagaagcggggcgtagccccagtcagccgccctcctgaacagtccgatttgaagctggtctgtagcgatttcgaaagatccgaactgtccagcgatatcaacgtaagatcttggtgcatccaggaatccacgcgcgaagtgtgtaaagccgatgccgaaattgctagctctctaccagccgcccagcgtgaggccgaaggatactaccagaagcccgagaaaaagtgcgtggacaaattctgtagcgacagctccagcgattgtggatccagctcgggaagcgttcgcgcttccagggggagttggggatcatggtcatccacatcttcttcggacggagacaagaaaccaatggttgacgcccagcacttcctccccgccggcgatagtgtgtcacagaatgacttcccctctgaagccccaatctctctgaacctgagtcacaatatctgtaaccccatgaccgtcaacagtttgccgcaatatgccgagccatcttgccctagcctgcctgccggccctacgggggtcgaagaggataaggggctttatagccccggtgacctttggccaacaccacccgtatgcgtgacttccagtcttaactgcacactcgagaacggagtaccgtgtgtgatccaagagagtgccccagttcataatagctttattgactggagtgctacatgcgagggccagttttcttccgcctactgtccccttgaactcaacgactacaacgctttcccggaggaaaacatgaattacgccaacgggtttccgtgtccagcagatgtccagaccgactttatcgatcacaactctcagagcacgtggaacacccccccaaacatgccggcggcctgggggcacgcaagtttcataagcagccctccctatctcacttccacccgatctctctcaccaatgtctggactcttcgggagtatctgggccccccagagtgacgtgtacgaaaactgctgtcccataaacccgacgacagagcatagtactcacatggagaaccaggcagtcgtctgtaaggaatattatcccgggttcaacccttttagggcctatatgaacctagatatctggacaaccacagctaaccgcaacgctaactttccactgagcagagacagttcgtactgcggaaacgtttag

SEQ ID NO: 29160 - DNA, 3924 bp, Artificial Sequence
  Description of Artificial Sequence: Synthetic coding sequence
atgatcgccgtctctaccgccaacggctacatactattctttcacattaccagcacaaggggcgacaaatatctgtacgagcccgtgtatccgaaagggagcccacagatgaagggcacgccacactttaaagaagagcagtgcgcacccgccttgaacctggagatgcgcaagatactggatctgcaggctcctatcatgtctctgcagtcagtgctggaagaccttctggtggctacttccgacggtctccttcacctcattcactgggaggggatgaccaacggacgtaaagctattaatttatgcacggtccccttctctgtcgacctccagagcagccgcgtcggcagcttcctcgggttcacagacgtccatattagagatatggagtattgtgcgaccttagatggatttgcagtagtgtttaacgatggcaaagtgggatttattacgccagtctcctcacgctttaccgcagagcagctgcacggcgtgtggccacaggacgtagtggacggcacctgtgtcgccgtcaataacaaatatcggctgatggccttcggatgtgtctctggaagcgttcaggtgtacaccattgataactccactggggctatgctcctgagccataagttagagctcactgctaagcaatacccggacatttggaacaagaccggcgccgtaaagttgatgcgttggtctccagataattcagttgtgattgtgacgtgggagtacgggggactgagcttatggagcgtgttcggtgcccagttgatctgtaccttaggaggagatttcgcatataggtccgacggcactaagaaggatcctttgaagataaactctatgtcatggggcgctgaaggctaccatctgtgggtgattagtggttttggctcccagaatactgaaatcgaatccgatctgcgctccgtggttaaacagccaagtattctcctgtttcagtttatcaaaagtgtcctcactgtcaatccttgtatgagtaaccaggaacaggtgctccttcagggcgaagataggctctatctgaattgcggcgaagccagtcagactcaaaacccccgctcctcctctactcatagtgagcacaagccttcacgagagaagagcccattcgcagacggcggactcgagtcacagggcctttccaccctgctgggacatcggcactggcacgttgtacagatatcttcaacttaccttgaatctaactggcccattagagagcaaaatatgatcgtgacgggcggactggcatggtggaacgactttatggtgcttgcgtgttacaacatcaatgacagacaggaggagctcagagtctacctgagaacatccaacttagacaatgcattcgcacacgtgaccaaggcccaggccgaaactctactgttgtccgtttttcaagatatggttattgtgtttagggctgactgtagtatctgcctatatagtattgaaaggaagtcggacggtccaaataccactgccgggattcaggtgcttcaagaggtctcgatgtctcgctacattccacacccctttcttgtagttagcgtgacactgacaagcgtgtcgaccgaaaatggaatcacactgaagatgccgcaacaggcaagaggagctgaatctataatgctgaatctggccggacagctgattatgatgcaacgggacaggtcgggcccacagatacgcgagaaggactctaatcccaataaccaaagaaaattgctgcctttttgcccacccgtggtcttagcccagtcagtagagaacgtatggacaacctgcagagctaacaagcagaagaggcatctgctcgaagcattgtggctgtcctgcggtggggcaggtatgaaggtgtggctcccgctctttcctcgagaccacagaaagccacatagcttccttagccagcggatcatgctccctttccatatcaatatctatcccctggccgttctgtttgaagacgcactggtactgggcgccgtgaatgataccctactgtacgactccttgtatacgcgcaataacgcacgagagcaactagaagtcttgttccctttctgcgtggtggagcgaactagccaaatctaccttcaccacattctgcgtcaactgctggtgaggaaccttggtgagcaagctctcctgctggctcagtcatgtgctactttgccctactttccccacgtacttgagcttatgctccacgaggtcttggaggaagaggcgacatcccgcgaacccatccccgatcctcttcttccaaccgtagctaagtttatcacggagttcccattattcctgcaaactgtggtccactgtgctcgaaagacagaatatgccctgtggaattacctctttgcagcagtgggtaatccaaaggacctattcgaggaatgtcttatggcacaggatctggacactgctgctagttacctcattatcttacagaatatggaagtgcccgcggtatctcgccagcacgctaccctgctcttcaatacagccctcgaacaggggaagtgggatctttgtagacatatgatcaggtttctgaaagctataggcagcggcgagagcgagacacctcccagtacccccacagcacaggaaccttcttcctctggcgggttcgagtttttcagaaacaggagcatatcccttagccagtccgctgagaatgtccccgccagcaaattcagcttgcagaagactctgagcatgccttccgggccatccggcaaaaggtggtccaaagatagcgactgcgctgagaatatgtacatagatatgatgctgtggaggcacgccagaaggttactggaggatgtcaggttgaaagacctgggctgcttcgccgctcaactgggtttcgagttaattagctggctgtgcaaagagaggaccagagcagccagggtagataactttgttatagctctgaaacgcttacacaaagactttctgtggccgctgcctataatcccggcctcttctattagctcaccatttaagaacggcaagtaccggactgtgggcgagcagctgctaaagtcacagtctgcggacccattcctgaatctggagatggacgccggcatatccaacattcagcggagccagagctggttgtccaacatagggcccactcaccacgagatagacacagcctcgtcccatgggccacagatgcaggacgcatttttatcacctttgtctaataagggagatgagtgtagcataggctcagccacggatttgacagagagctcaagcatggtggacggggactggaccatggtggatgagaacttcagcacactgagcctgacccagtccgaactggaacacatttcaatggagctggcatctaagggacctcacaaatcccaggtgcaacttcgttatcttctgcatatatttatggaagctggctgccttgactggtgcatcgttatcggtctgattttgcgagaatctagcatcattaaccagattttggtgattacgcagagttccgaggtggacggagaaatgctgcagaacattaagactgggctgcacgccgtggaccggtgggcctccaccgattgtccaggctacaagcccttcctgaatattataaaacctcaacttcagaaactgtccgaaatcaccgaagagcaggtacagcccgacgccttccagcccatcaccatgggaaagactcccgagcaaacctccccaagggccgaagagagccgcgggtcttccagccatggctccattcctcagggtgaagtgggctcctcgaatatggtatcaagaaaggaagaagacaccgctcaggccgaagaggaggagccgtttcaggacggtacatacgactgtagcgtgtcctag

SEQ ID NO: 29161 - DNA, 822 bp, Artificial Sequence
  Description of Artificial Sequence: Synthetic coding sequence
atggagaagcgtctgggggtgaaacccaacccggcatcctggatcctctccgggtattattggcagacctctgcaaagtggctgaggtctctctatcttttttacacatgcttctgtttctctgtcctttggttgtcgaccgacgcatcagaatcccggtgtcagcagggaaagacgcagttcggggtggggcttcggagcggcggagaaaatcatctgtggcttttggagggaacgccatcccttcaatcgtgttgggcggcctgttgccaggacagcgcatgtcatgttttctggtggctggaaggtatgtgtatacaggcagactgcagccgcccccagtcatgcagagcttttaggacccactcaagcaattccatgctcgtatttttaaagaaattccagacagcggacgatctggggtttttaccagaggacgatgtacctcacttgctggggttgggctggaactgggccagctggagacagtccccccctcgtgcggccttgcggcccgccgtctcttccagcgatcaacaatctttgatacgcaagctacaaaaaaggggatcaccaagcgacgtggtgactcctatcgtgacccaacactctaaagtgaacgattcaaacgagctgggaggcctgactacatctggatcagcggaagttcacaaagcgataaccatttcaagtccactgactacggacctcacagctgagttgtcaggcggcccaaagaacgtctctgtccagccagaaatttctgaggggctggctactacacctagtactcaacaggtaaaaagttcagaaaaaacctag

SEQ ID NO: 29162 - DNA, 540 bp, Artificial Sequence
  Description of Artificial Sequence: Synthetic coding sequence
atggagaaacggctgggagttaagccgaatccagcaagctggatcttgtcagggtactactggcaaacaagtgccaaatggctgagaagcctgtaccttttttacacgtgcttttgtttcagtgtcctgtggctttcaacagatgccagtgaaagccgatgtcagcagggaaagactcagtttggggtgggcctgaggagcgggggagaaaaccatctgtggttattggagggcacccccagcctgcaatcgtgttgggccgcatgctgtcaggatagtgcctgtcatgtgttttggtggttggaaggaatgtgtatccaggccgattgttcccggcctcagtcctgccgggcattcagaacacacagtagcaacagcatgctggtgtttcttaagaaatttcaaacagctgatgatctgggcttcctaccagaagacgatgtgccccacctgctgggactcgggtggaactgggccagctggagacagtccccaccacgggcggccttacgaccagctgtgagctcatccgaccagtag

SEQ ID NO: 29163 - DNA, 471 bp, Artificial Sequence
  Description of Artificial Sequence: Synthetic coding sequence
atggctgaaccgggtcattcgcatcacctgtccgcacgtgtacgggggagaacagaacggaggataccgaggctgtggcggcttcttctgtgggcagggactgccttccaggtgacccagggcactgggccagaactacatgcgtgcaaggaatcagaatatcactatgagtataccgcttgtgactctactggtagcaggtggcgtgtggctgtcccccacacacccggtctgtgcaccagcttgccagatcccattaagggtactgagtgctccttttcatgcaatgcaggtgagtttctggatatgaaagaccaatcatgtaaaccatgcgcagaaggcaggtacagtctgggtaccggcattagattcgacgagtgggatgaacttcctcacggcttcgcatccctctcagcaaatatggagttggatgactctgccgctgaatctactgggaattgcacgagttag

SEQ ID NO: 29164 - DNA, 2781 bp, Artificial Sequence
  Description of Artificial Sequence: Synthetic coding sequence
atggcagagcccggccactctcaccatctgtccgctcgggtgcgtggtcgcacagaacgtagaataccccgactctggaggttgctcctatgggcaggaacagctttccaggtcacccagggcaccggaccagaattgcacgcctgcaaggagagtgagtatcactatgaatacacagcatgcgatagcacgggcagccgatggcgcgtggcggtcccgcacacaccaggcctttgtaccagcctccccgaccctatcaaaggaactgaatgttcattcagctgtaatgccggagagttcctggatatgaaggaccagagctgtaaaccctgcgccgaaggaaggtattccctcggcactggcatcagatttgatgaatgggatgaactgccccacggattcgcctccctcagcgccaatatggagctggacgactcggctgctgaatcaacaggcaattgcacctcctcaaaatgggtgcccagaggcgactacatagccagtaacactgacgagtgcactgccacgctgatgtacgctgtcaatcttaagcagtcagggaccgtgaatttcgagtactattaccccgacagcagtattatttttgaattcttcgttcaaaatgatcaatgccagcccaacgctgacgactcccgctggatgaaaaccaccgaaaaaggttgggagttccatagtgtcgaactaaatcgaggaaacaacgtgctctactggcggaccacagcattctccgtgtggaccaaagtcccgaagccggttctcacccagctaatgtacaaatgggctaaaccaaaaatttgctcagaagatctggaaggcgccgtaaagctccccgcttccggcgtcaagacacattgtcctccctgtaacccaggcttttttaagactaataactccacatgccagccttgtccctatgggagctacagcaatgggagcgattgcacccgctgtccagccggcacagaacccgccgtgggatttgagtataagtggtggaatacgctgcctaccaacatggagacaactgttttgtccggaattaactttgagtataaaggcatgaccggttgggaggtagccggcgaccacatctacacagctgccggcgcctctgataacgacttcatgatcttaacactggtggtccccggtttcaggccaccccagtctgtcatggctgacactgaaaataaggaagtggctaggattaccttcgtgttcgagacactgtgtagtgtcaattgtgagctttattttatggtgggcgtgaactcgcgtacaaatactcctgtcgagacttggaaaggctcaaagggaaaacagagctacacatacataattgaagagaacacgaccacgtcatttacgtgggcatttcaacgaaccaccttccatgaggccagccgaaaatacactaatgatgtggccaagatctacagcattaatgtcaccaatgtcatgaacggtgttgcgagctactgccgcccatgtgctctggaagcatcagatgtgggcagttcctgcacctcctgtcctgcagggtattatatcgatcgggattcaggaacatgccatagttgccctaccaacaccattctgaaagcccaccagccatatggagtacaggcctgcgtgccctgtgggcccgggactaagaacaataaaatacatagcctttgctacaatgattgtactttctccaggaatacacccaccaggacttttaactataactttagtgccctggctaatacagtgactctggccggcggccctagttttacatccaaggggttgaagtacttccaccacttcactctgtctctatgcggaaatcagggcaggaaaatgtccgtctgcaccgataacgtcacagacctgcggatccccgagggggaaagcggctttagcaaatctataactgcatacgtgtgccaggcagtaataatcccccccgaagtgacaggctacaaagccggtgttagctcccagcctgtgagcctcgcagaccgcctgattggagtcaccacggatatgaccctggacggtatcacctcacccgctgaactttttcacctcgaatctctcggcatcccagacgttattttcttctaccgttccaacgacgtaactcaatcatgttcgagcgggcggtcaacaactattagagtacggtgtagcccacagaaaaccgtgccaggctctcttttacttccaggaacttgctcagatggcacttgcgacggatgcaatttccatttcctctgggaaagcgccgctgcctgtcctctctgctcagtggccgactaccacgccattgtttccagctgtgtcgccggtatccagaaaaccacttacgtttggagagagcctaagctgtgcagcggcggaatttcactgccagagcaacgtgtcaccatctgtaagaccattgatttctggctgaaggtgggtatcagcgctggaacatgcacagcaatcttgctcactgtgcttacctgttacttttggaagaagaaccagaaattggagtacaagtactcaaagctcgtgatgaatgcgacactaaaggactgcgacctcccagcagctgacagttgcgccattatggagggcgaagacgtggaggacgatttaattttcacttccaaaaaaagcctgtttggaaaaattaagtctttcacttcaaagcgtacgccggacggatttgatagcgtccccttgaagacctcaagcggcggcctagacatggacctatag

SEQ ID NO: 29165 - DNA, 618 bp, Artificial Sequence
  Description of Artificial Sequence: Synthetic coding sequence
atggccgaacctggccatagtcaccacctgtccgcgcgcgtgagaggtagaaccgaacgaagaatccctcgtctttggaggctcctgctatgggcagggactgcatttcaagttacacaggggactggacctgagctgcacgcctgcaaagaatctgagtatcattatgaatatactgcatgcgatagcacgggcagcagatggagagtagcagtcccacatacccccggcttgtgtacctctctgccagatcctattaaggggactgaatgctctttttcttgcaacgctggggagtttttggatatgaaggatcagtcttgcaagccatgtgcggaggggcgctacagcctgggcacggggatcaggttcgacgagtgggatgagctgcctcatgggtttgcaagtctgagcgcaaatatggaacttgatgacagcgctgcagagtctacaggaaattgcaccagctccaaatgggtgccccgaggagattacatcgcaagtaataccgacgaatgtaccgcgacattaatgtatgccgttaacttaaaacagtctgggaccgttaacttcgagtattactatcccgactcttccatcatctttgagttcttctag

SEQ ID NO: 29166 - DNA, 276 bp, Artificial Sequence
  Description of Artificial Sequence: Synthetic coding sequence
atggctgagcctggacactcccaccatctgagcgcacgcgtccggggccggaccgagcgccggattccccgactatggaggctgcttctgtgggcaggcacagcgttccaagtgacccaaggcaccgggcccgaactacatgcatgtaaggagagtgagtatcactatgaatacacagcctgtgacagtacaggcagccgctggcgggtagctgtgccccacaccccggggctttgtactagcctgccagatcccatcaaaggcaccgaatgttag

SEQ ID NO: 29167 - DNA, 459 bp, Artificial Sequence
  Description of Artificial Sequence: Synthetic coding sequence
atggccgagccaggccattcgcatcatctgtctgcgagagttcggggccggaccgaacgaaggattcctcgcctgtggagactgctgctgtgggctggaacagccttccaggtgacccaggggaccgggcctgaattgcatgcttgtaaggaaagcgagtaccactacgagtacacggcctgcgactcaaccggatctcggtggagagtcgctgtgccccatactcctgggctctgcacaagcctgcccgatccaataaagggcacggagtgcagttttagctgcaacgctggggaatttctggacatgaaagaccagtcctgtaagccttgcgccgagggcagatacagcctgggaaccggaatccggttcgacgagtgggatgagctgccacacggattcgcctccctgagcgccaatatggagctggacgactctgctgccgagagcactggatag

SEQ ID NO: 29168 - DNA, 1923 bp, Artificial Sequence
  Description of Artificial Sequence: Synthetic coding sequence
atggttgtaccctccaagaccaaaattgtgtgccattttagcactctcgtgctcacgtgtgggcagccccacacactccagattgtaccgcgcgatgaatatgacaacccgaccaacaattccatgtccctgcgagacgaacataattatacactgagtattcacgaactcggtccgcaggaagaagagtctacaggcgtgagcttcgagaagagcgtgacttccaatcgtcagacattccaagtcttcttgcggttgaccctgcattcacgtgggtgtttccacgcatgcattagctaccagaatcagcctatcaacaatggagaatttgacatcatcgtgctctctgaggatgaaaaaaacattgtagagagaaacgtgagcacaagtggtgtgagcatttatttcgaggcttacctttacaacgcaaccaattgttcctcaacaccgtggcatctaccgccaatgcacatgacttcatctcagaggagaccttctacagctgtggacgaggaggatgaagacagccccagcgaatgtcacaccccagagaaggtgaagaagcctaaaaaggtgtactgctatgtgtcacccaaacagttctccgtgaaagaattctacctgaaaatcatcccctggcgtctgtacaccttcagggtctgccccggtaccaaattttcatacctcgggcctgatcccgtgcataaactgctgaccctggtcgtggatgatggaatccaacctccagtggaactgtcctgcaaggaacggaatatactcgccgcaacattcatcagaagtctgcataaaaacatcggaggttctgagactttccaggacaaggtgaatttcttccaacgggagctcaggcaagtgcacatgaaacgaccacattctaaagttacgctgaaagtcagccggcatgcactgctggagtcttcgctaaaggcaacgcgaaacttcagtatctcagactggtccaaaaatttcgaggtggtattccaggatgaagaggctcttgactggggagggcccaggcgggagtggttcgagctgatttgcaaagctctgtttgatacaaccaaccagctcttcacacggttcagtgacaataatcaggcattggtccatccaaaccccaaccgcccggctcatttaaggctgaagatgtatgaattcgctgggagacttgtcggaaaatgcctgtacgaatcatcattgggcggggcctacaagcaactcgtgagagcaagatttactaggagctttctggcccagatcataggattgcgaatgcactacaagtactttgagactgatgatccagagttctataagtccaaggtgtgttttatactcaacaacgatatgtccgaaatggagctcgtgtttgcggaagaaaaatataacaagtccggccagctggataaggtcgtggagttaatgacgggcggggcccaaaccccagtgaccaatgcgaataagattttttatctgaatcttctggctcagtatagactagccagccaggtgaaggaagaggtcgaacacttcctaaagggactcaatgagctggtgccagagaatctgctggcaatctttgatgagaatgagctcgagctcctgatgtgcggtacgggcgacatttccgtgtcagactttaaagcacatgccgtggtcgtgggcggtagttggcattttagggagaaggttatgagatggttttggacagtggtctccagcttgacacaggaagagcttgcacgacttctacagtttactaccggatcatctcagctcccacctggtggtttcgctgccctatgtccttctttccagattatagctgcacctacacacagtacactacctactgctcatacttgcttcaatcaggttaagggccctggaagctgcagctag

SEQ ID NO: 29169 - DNA, 390 bp, Artificial Sequence
  Description of Artificial Sequence: Synthetic coding sequence
atgttttacgtaatcggcggtatcacagtcagcgtggtggcattcttctttactatcaaatttttgtttgagctggctgcccgggtggtgtcgtttctccaaaacgaggacagggaacgccggggagaccgcaccatttacgactatgtgcgtggaaattatctggacccgcggagttgtaaagtttcgtgggattggaaggacccttacgaggttggacattcaatggccttcagagtacacctgttttataagaacgggcagcctttcccagctcacaggcccgtaggtctaagggtacatattagtcatgtggagctcgctgtcgaaatacccgtgacccaggaggtcctgcaggagccaaactccaatgtcgtaaaagtggcttag

SEQ ID NO: 29170 - DNA, 1548 bp, Artificial Sequence
  Description of Artificial Sequence: Synthetic coding sequence
atgtggaggctgcccggtctcctggggagagctctccctcgcaccctcgggccctcattgtggcgggtgaccccaaagtccacatcacctgacggcccccagaccaccagcagtaccctactggtccctgtccccaatttggacagaagcgggccacatggacctggcactagtggcggtcctagatctcacggatggaaggatgcattccagtggatgtcgtccagggtgtctcccaatacattatgggacgccatctcatggggcacgcttgccgttttggctctgcagctcgctcggcaaatccacttccaggcctccctgcctgccggcccacagcgggttgaacattgctcatggcactcacctctcgaccggttctttagtagcccgctttggcatccatgttcctcactgaggcagcacatcctgccctctcccgatggacccgcaccgaggcataccgggctgcgcgagcctaggctaggccaagaggaagcatcagctcagcctaggaatttcagtcacaacagtttaagaggggctagaccgcaggatccttccgaagaaggaccgggcgactttggcttcctccacgcctcatcgagcattgagagcgaggctaaaccagcccagccccagcccacaggcgagaaagaacaagacaaatcaaagacactgtcgctggaggaggccgtcacttccatccagcagctcttccagctgtccgtcagtatcgcattcaacttcctggggacagagaatatgaagagcggagaccacacagctgccttttcctattttcagaaggccgccgccagaggatactccaaggcacagtacaatgctggcttgtgccacgaacacggtcggggcacacccagagatatcagtaaagctgttttgtattatcagctcgctgccagtcaagggcactctctggcccagtatagatacgccaggtgcttactgcgggaccccgcatccagttggaacccggagcggcaacgagcagtgtccctcctgaaacaggctgccgattctggcttacgggaggctcaagctttcctgggcgtgctgttcaccaaggagccctatcttgatgagcagcgcgccgtgaaatacctttggctcgcagccaacaatggcgattcacaatctcgttatcatctcggcatttgctacgaaaagggattaggtgtgcagcgaaacttgggcgaggcccttcgctgctaccagcagagcgccgccctgggtaacgaggcagcgcaggagcgactacgggctctgttctctatgggtgccgctgctcctggcccaagcgacctgaccgtcaccgggctgaaaagcttttcatctccaagtctctgctcccttaacacgttactggctggtacctcgaggctgcctcatgcatcttcaaccggcaatctcgggctgctgtgcagatcagggcacttaggggcctctctggaggcttctagccgcgccataccacctcatccatacccgctggagcgttcggtggtccggttaggctttggatag

SEQ ID NO: 29171 - DNA, 1548 bp, Artificial Sequence
  Description of Artificial Sequence: Synthetic coding sequence
atgtggcgtctgccaggcctactaggcagagctctcccccggactctcgggccttccctttggcgcgtcactccaaaatccacatcgcctgatggacctcagacaaccagttcaaccttgctggtacccgtgcccaacctagatcgttccgggccacatggaccagggacatccggtggccccaggtcacacgggtggaaggacgcctttcagtggatgtcctcacgggtgagtcccaacactctctgggatgccatctcctggggtaccctggccgtgttagctctgcagctggcccggcagatacacttccaggccagcttgccagccggaccgcagagggttgagcattgtagctggcacagtcctctcgataggttcttcagctctcccctgtggcatccgtgctcatctctgcgccagcacattcttccaagcccagatggaccagccccccgccatacaggcctgagagaaccaagacttggccaagaagaagcatctgcccaaccaagaaatttctcacacaacagtttacgcggagccagaccgcaggatccaagcgaggagggccccggagattttggtttcctacacgctagcagctccattgagtcagaagctaagcctgcccagcctcagccaaccggcgagaaggagcaggacaaaagtaagaccctgtccctggaagaagctgtgacctcgatccaacagctgttccaactcagcgtgtctatcgcctttaactttttaggtaccgagaatatgaaaagtggagaccacaccgccgctttctcctactttcaaaaagccgccgcacgcggctacagtaaggcccaatataacgccggtctttgtcacgaacacggaagaggcacaccacgggatatatctaaggccgtattgtattaccagctggctgccagtcagggccacagcctggcccagtaccgctacgcccgttgcttgctgagagatcctgcatcctcatggaaccctgagcgccagcgggcagtgagtctgttaaaacaggccgccgacagtgggctgcgtgaagcccaagctttcctgggcgtgctgttcacaaaagagccgtacttggacgagcaacgtgcggtgaagtatctctggttagcagcaaacaatggtgacagtcagtctaggtatcacctcgggatctgctatgagaaaggtttgggagtccagcgcaatctcggggaggcgttgaggtgctatcagcagtcagctgcactgggcaacgaggccgcacaagaaagactgcgggctctctttagcatgggtgcagcggcaccaggtccatccgatcttacggtcaccgggctgaagagtttcagctccccatccctgtgcagcctaaacacgctcctcgcaggcacatctagactgccacatgcgagtagcactggcaatctgggcctgctgtgtcgcagtggccatctgggcgccagcctggaagctagcagtcgcgctattcccccacacccataccctttggagagatctgtggttagacttgggtttggatag

SEQ ID NO: 29172 - DNA, 654 bp, Artificial Sequence
  Description of Artificial Sequence: Synthetic coding sequence
taggcagtgctctactatcagcttgccgctagccagggccattccttggctcagtaccgatatgctagatgtctccttcgtgatcctgcctcttcatggaacccagagcgtcaaagagccgtgagtctcctcaaacaggccgctgactccggcctgcgcgaggcccaggcattcttgggagtgctgtttacaaaggagccgtacctcgatgaacagcgggctgttaagtatctgtggctggcagctaataacggtgattcccagagcagatatcatctgggcatctgttacgagaaggggctaggcgtccagaggaatctaggcgaggcattgcgatgttaccagcagagcgcggccctcggaaatgaggctgcccaggaaagactgagagcgcttttttccatgggtgcagccgctcccggcccctctgatctcacagtaacaggcctgaagtcattttcgagcccaagcctctgttcgctgaacacacttctcgccgggactagtcggctaccgcacgccagctctaccggcaacctcggcttattatgtcgcagtgggcacctaggcgccagtctcgaggcaagcagccgggcaattccccctcacccataccccctggaaaggagcgtggtgagacttggcttcggttag

SEQ ID NO: 29173 - DNA, 1560 bp, Artificial Sequence
  Description of Artificial Sequence: Synthetic coding sequence
atggcccgcgcgggtcccgcctggctgcttttggctatttgggtggtgttgcccagctggctctctagcgccaaagttagcagcctgatcgagcggattagtgatcccaaagatttgaagaagcttttacggactcggaacaacgttctagtcctgtatagtaaatctgaggtagcagccgagaatcaccttagactgctcagcaccgtggcacaggccgtaaaaggacagggcactatctgttgggtggactgtggtgacgctgagtcgcgcaagctgtgcaagaagatgaaggtggatctgagccctaaagataaaaaggtggaacttttccattatcaggatggagcattccatacagagtataaccgggcagttacatttaaaagtatcgtggcctttctaaaggaccctaaaggccccccactgtgggaggaggatccaggtgcgaaggacgtggtgcacctggactccgaaaaggactttaggaggctacttaagaaagaggagaaaccactgctgataatgttctatgcaccctggtgcagcatgtgtaagcgcatgatgccccactttcagaaggccgcaacacaattgaggggacatgctgtcttggctggcatgaatgtttacagctccgagttcgaaaatatcaaggaagagtacagtgtgcgggggttccccaccatatgttacttcgagaagggaaggttcttgttccaatatgacaattacgggagcacggccgaagatatcgtcgagtggcttaagaaccctcagccccctcaaccacaggtgccggagaccccatgggccgacgaaggcgggtcagtctaccatttgacagacgaggacttcgaccagtttgtgaaggaacatagtagtgtgttagtgatgttccacgccccctggtgcggccactgcaaaaaaatgaaacctgaattcgagaaagccgcagaggccttacatggcgaggccgactccagcggagtgctcgctgcagtagatgctacagtaaacaaggcgctcgccgagcggtttcacatctccgagttcccgacattgaagtacttcaaaaacggcgagaaatacgcagtgcctgtgttgcgcacaaagaagaaatttttggagtggatgcaaaaccccgaagcccctccgccacctgagcccacgtgggaagaacagcaaacatcagtgctgcacctggtgggagataattttagggaaacattgaaaaagaagaaacacacactcgtaatgttttatgcgccatggtgtccccactgtaagaaggtgatcccccactttacggcaacagctgacgctttcaaggatgatcgtaagattgcatgtgctgccgttgactgcgtcaaggacaaaaatcaagatctctgccagcaggaggcggtcaagggatatccaacgtttcattactaccattatggcaagttcgccgaaaaatacgattctgacagaacagagctgggttttactaattacatcagagcccttcgggagggtgaccatgagcgcctgggaaagaaaaaagaggagctgtag

SEQ ID NO: 29174 - DNA, 1755 bp, Artificial Sequence
  Description of Artificial Sequence: Synthetic coding sequence
atggatctgctctggatgcccctgctcctcgtggccgcgtgcgtctctgcagtgcacagttcgcctgaagtgaatgccggggtctcatccatacacataacaaaaccagttcatattctggaagaacgatcccttctcgtgctgaccccggctgggttaacccagatgttaaatcagactaggttcctaatggtgttgttccacaacccctcctccaagcagtctcgtaacctggccgaggaacttggaaaggccgtggaaattatgggcaagggcaagaacgggatcggattcggcaaagtggatatcaccatcgagaaggaactgcagcaggaatttgggattactaaggccccggagctgaaattgttcttcgaaggaaatcgctctgaacctataagttgcaaaggggtggttgagtctgcagccctggtggtgtggctgcgacggcaaataagtcagaaggcctttcttttcaactcaagtgagcaggtagccgaatttgttatctcacgcccgcttgttatagtgggctttttccaggatttggaagaagaggttgcagaactcttctatgacgtgattaaggactttcccgagctaacattcggagttataaccattggcaacgtcattggaaggtttcacgtgaccctggattcagtgcttgtcttcaagaagggtaagattgtgaacagacagaaactgatcaacgacagtaccaacaagcaggaactgaaccgcgttattaagcagcatctaactgacttcgttattgaatacaatacagaaaacaaggatctgatcagcgaactgcacattatgtcccacatgctactgttcgtgtctaaatcctcagagtcttacggcattattattcaacactataagctggcatctaaagaattccaaaataaaatcctattcatcctcgtggatgccgatgagccgaggaacgggagggttttcaaatattttagggtgacggaagtagacatccctagcgtccagatccttaatctctcatctgacgcaagatataaaatgccttctgatgacatcacctacgaaagcctcaagaaattcggtaggtcatttctttcgaagaatgccaccaaacaccagagtagtgaggaaattccaaagtactgggaccaaggcctggttaagcagctggtcggaaagaactttaatgtggtcgtgttcgacaaggagaaggacgtattcgtaatgttttacgcaccttggagcaaaaaatgcaaaatgctgttcccactactcgaggagctgggcagaaagtatcagaatcacagcaccataatcatcgcaaaaattgacgtgacagctaacgatatccagctcatgtaccttgacagatacccattcttccggctctttccttccgggtcccaacaggctgtgctgtataagggtgaacacacactgaaaggcttttcagattttcttgagtcccatatcaaaaccaagattgaagatgaagacgagctgttgtctgtggaacaaaatgaagtgatagaggaggaggtgctcgccgaggaaaaagaagtcccgatgatgagaaaaggtttacccgagcagcaatctcccgagttggagaacatgacaaaatatgttagtaagctcgaggagccggccggtaaaaagaaaaccagcgaagaggttgtggtggttgttgctaagccaaagggaccaccagtgcagaaaaaaaaaccgaaggtaaaagaggagctctag

SEQ ID NO: 29175 - DNA, 819 bp, Artificial Sequence
  Description of Artificial Sequence: Synthetic coding sequence
atggggaataccaccagcgatagggtgtccggggaaaggcacggcgctaaggccgcccgatcagagggcgccggcggccacgctccaggcaaagagcacaagattatggtgggctccaccgatgatccgtcggtgtttagcctaccagacagcaagttaccgggcgataaggagttcgtgtcatggcagcaagatctcgaggacagcgtaaagcctactcagcaggcccgcccgaccgtcattcggtggagtgaggggggtaaagaggtcttcatcagcggttctttcaataactggagcactaagatcccactcatcaagagccataacgattttgttgctatcctggatctgcccgaaggcgagcaccagtacaagttcttcgtggatggccagtgggtgcatgaccccagcgagcccgttgtaacttcgcagctgggcacgatcaacaacctcatccatgtcaagaagtctgacttcgaagttttcgatgcgctaaagctagacagtatggagtcatccgagacatcatgcagggacttatcatccagccctcctggcccctatgggcaggagatgtacgcattccgaagcgaggaaagatttaaaagtccacccatactcccaccccatctgctccaggtgattctgaataaggacacaaacatttcctgcgatcctgcgttattgccggaacccaaccacgtgatgctgaatcacctttacgccctctccattaaggatagtgtgatggtcctctcagctactcatcggtataaaaagaagtatgttacgaccctgttgtacaagccaatctag

SEQ ID NO: 29176 - DNA, 573 bp, Artificial Sequence
  Description of Artificial Sequence: Synthetic coding sequence
atgccaaggggccgctctacccgttcttggtggggcgtcaggacaactccggcatgcagcgcctcgctgaccccttctcacaatgacttcgtagccatcttggatttgcccgaaggcgaacatcagtacaagttcttcgtcgatggtcagtgggtccacgatccgagcgagcccgtagtgaccagccagctagggaccattaacaatctcatacacgtcaaaaagtctgacttcgaggtgtttgatgccctgaagttggattccatggaatctagcgaaacatcatgcagagacctgtcatcaagccctcctggaccttacggccaagaaatgtatgcctttaggtcagaagagcgttttaagtctcctcctatcctccctccccacctgctccaagtgatattaaataaagatacaaatatcagttgcgacccagccctcctcccagagcccaaccacgtgatgctcaaccacctgtatgctctgtctatcaaagattctgtgatggtcttatctgccacccaccgctataaaaaaaagtatgtgacgacattgctgtataagccaatttag

SEQ ID NO: 29177 - DNA, 1053 bp, Artificial Sequence
  Description of Artificial Sequence: Synthetic coding sequence
atggagaagcagccacagaactccagacgcgggctggccccgcgggaggtgccacctgcagtgggcctgctgctaatcatggcgctcatgaacaccctgctctatctctgcttggaccactttttcatcgccccccggcagtctacagtggacccaactcactgcccctatggccactttcgaatcggtcaaatgaaaaattgttctccttggctgagttgcgaggaactcaggaccgaggtgcggcagttgaagcgggttggagaaggcgcggtcaaacgggtattcctatccgagtggaaggagcacaaggtggccctctcccagctaacatctctggagatgaaggacgatttcctacacggcctgcaaatgctgaagtccctgcaagggacgcacgtagtcacccttctgggatattgcgaagacgataacactatgctgacagaatatcaccctttaggaagcctttctaacctggaagagaccctcaatctgtccaagtaccagaatgtgaacacttggcaacatcgcctggagcttgctatggattatgtttccataatcaactaccttcatcactctcctgtgggcacccgggtgatgtgtgactctaatgacctccctaaaactctgagccaatacctcttgacctctaattttagcattctggccaatgatctggatgccctccccctggtcaaccattcaagcgggatgctggtcaaatgcggccatcgggagctccacggggactttgttgcccctgagcagctgtggccgtacggcgaagacgttccttttcacgacgatctgatgcccagctatgacgagaaaatagatatatggaagatacctgacatcagttcctttctcttgggccatatcgaaggaagtgatatggtccggttccatttgttcgacatccacaaggcttgcaagagccagaccccctccgaacgccctaccgctcaagacgttctggagacctaccagaaggtcctcgataccctgcgtgatgccatgatgagccaggcaagagagatgctgtag

SEQ ID NO: 29178 - DNA, 585 bp, Artificial Sequence
  Description of Artificial Sequence: Synthetic coding sequence
atgggcgccgcagcttgggcccggcccctgtccgtgtcttttctgctcctgctgttacccctccccggaatgccagccggcagttgggacccggcgggctacctgctttactgtccctgtatgggcaggttcggcaatcaggctgaccactttttagggtctttagcctttgcaaagcttttgaatagaacattggccgttcccccctggattgagtaccagcatcacaaacccccctttacaaatctgcatgttagttaccagaagtattttaaactggagccactccaggcttatcatagagtcatttcactggaggacttcatggagaagttggctcctacacactggccgccagaaaaacgcgttgcctactgcttcgaagtcgcggcccagcgctccccggataaaaagacctgtcctatgaaagaaggaaacccgttcggtcctttttgggatcagttccacgtgtcttttaacaagagcgaactgttcacaggtatttccttttcggctagttatagggagcagtggtcacagcgccgcgaaaatcactcctgcgtaaccctcctgtttcctagatag

SEQ ID NO: 29179 - DNA, 1167 bp, Artificial Sequence
  Description of Artificial Sequence: Synthetic coding sequence
atgggagcggctgcatgggccaggcccctttctgtgagctttctcctgcttctgctgccactaccaggcatgcccgctggatcatgggaccctgcgggttaccttctatactgtccttgcatgggcagatttggcaaccaagcagaccattttcttggaagcctagcattcgcaaaacttcttaacaggaccctcgcagttcccccttggatcgagtaccagcaccataagccaccattcaccaatctgcatgtgtcctatcagaagtactttaaactggagccactccaggcatatcatcgtgtaatttcactggaagacttcatggaaaagctggctcctacccactggcctccagagaaacgtgttgcatattgctttgaagtggcagctcaacggagtcctgataagaagacttgtcccatgaaagagggtaaccctttcggccccttttgggaccagttccatgtgagcttcaataagagcgaactttttaccggcatctctttcagcgccagctacagagaacagtggagtcagagattcagccccaaagagcaccccgttctcgctctgcccggagcaccagcccagtttccagtcctggaggaacacagacccctgcagaagtacatggtatggtccgacgagatggtcaaaaccggcgaggcccaaatacatgcgcatctggtgaggccctacgtcgggatccaccttcgcataggttccgactggaagaatgcctgtgccatgctgaaagacggcacagcagggtctcattttatggcgagcccccagtgtgtgggctactccagatccaccgccgcccccctaacaatgactatgtgcctacctgacctcaaggaaatccagcgggcagtgaagctgtgggtaagatccctcgatgcccaatccgtgtacgtggcaacggattctgagtcctatgtcccagagctccagcagctctttaaaggaaaggtgaaagttgtctccttgaagcccgaggtggctcaggtggatctttatatcctgggccaagctgaccattttattggaaactgcgtgtcgagctttaccgcttttgtgaaacgggagagagacctacaagggcgaccctcaagttttttcggtatggatcgcccccctaagctgcgcgatgaattctag

SEQ ID NO: 29180 - DNA, 534 bp, Artificial Sequence
  Description of Artificial Sequence: Synthetic coding sequence
atggtgtggtcggatgaaatggtaaagaccggagaggcccagatacacgcccacttggtaaggccttacgtggggattcatctcaggatcggcagtgattggaaaaatgcctgtgcgatgctgaaagacgggactgctgggtcacattttatggccagccctcaatgtgtcgggtattctcggagcacagccgcccccctgacgatgacgatgtgtctacccgacttaaaggagatacagcgcgctgtcaaactgtgggtgaggtcactggatgctcaatccgtatacgtcgccacggactccgagtcttatgtacccgaattgcagcagttgttcaagggaaaagtgaaggttgtatccctcaaaccagaggtagcacaggtggacttatacattctgggtcaggctgatcattttattggtaattgtgtttccagcttcactgctttcgtgaaaagggaacgggatctccagggtagaccgtcttccttcttcggaatggacaggcctccaaaactcagggacgagttttag

SEQ ID NO: 29181 - DNA, 1275 bp, Artificial Sequence
  Description of Artificial Sequence: Synthetic coding sequence
atggcaactctgtcgtttgtctttctcctcctgggagcagttagctggccacctgcctccgcctctgggcaggaattctggcctggtcagtccgcggctgacatcctctccggagcagcatcccgtcgccggtacctactgtacgacgtcaatccccccgaaggattcaacctgagacgagacgtctatatacgaatcgcgtccctgctgaaaactttactaaaaaccgaggaatgggttctcgtgttgcccccttgggggagactctaccactggcagagccccgatatacaccaggtgcgcattccctggtccgagttctttgatttaccttctctgaacaaaaacataccagtgatcgaatacgaacagttcatcgcagagagtggcggcccatttatcgatcaagtatacgtactgcagagctacgccgaggggtggaaagaggggacttgggaggagaaggtcgacgagcgtccctgtatcgaccagctcctgtactctcaggacaaacatgagtattaccgaggttggttttggggatatgaggaaacgagggggttgaatgtgtcctgcctgtccgtccaaggctctgccagcatcgtggctcccttactgctgagaaacactagtgctcggtccgtgatgctggatagagctgaaaacctgttgcacgaccattacggggggaaggaatactgggataccaggaggtctatggtcttcgctaggcacctcagagaagtgggggatgaattccggagtaggcatctcaattctacggacgacgctgatagaatccccttccaggaagactggatgaagatgaaggtgaagctaggaagcgcgttaggtggcccatacctgggggtccacctgcgcagaaaagattttatttggggacatcggcaggatgtgcccagtctagaaggggccgttcgcaaaattcgatcactgatgaagacccatcggttggataaagtgtttgtggccacagacgctgtcaggaaggagtatgaggagctgaaaaagctgctccctgagatggtgagattcgaaccaacctgggaggagctggagctgtacaaagacgggggggtggccattattgatcagtggatctgcgcccatgcccggtgtttgcccacgtctctgtctgctgagtcagggtcaggcgggtttcagcgatttttctgccctaaatattctgtttcagaacagatggtggcatgcgtacactccggtcatttccatacggtctgcctccttgtatag

SEQ ID NO: 29182 - DNA, 1290 bp, Artificial Sequence
  Description of Artificial Sequence: Synthetic coding sequence
atggccaccctgtcgttcgtcttcctactgctcggagctgtcagttggccgccggcctcagccagtggccaggagttttggccaggccaaagcgccgctgatattctgagcggggcagcgagcaggcgtcgctatcttctatacgatgtgaatcctcccgaaggatttaatctccgccgagatgtttacataagaattgcgtccctgttgaaaacgctgctgaaaactgaggaatgggttttggtcctcccaccctggggccgcctgtaccactggcagagccctgacatacatcaagtacgcatcccttggagcgagttctttgacctgccgtccctcaataagaatatacctgttatcgagtatgagcagtttatagctgagagtggtggcccttttatcgatcaggtgtatgttctgcaatcttatgcagaaggatggaaagagggaacctgggaggagaaagttgacgaacgaccgtgcatcgatcagttgttgtacagccaggacaaacatgagtattatagaggctggttctggggttatgaggagaccagagggctcaacgtaagttgcctctctgttcaaggatcagccagtatcgtagctcctctgcttcttcgcaacacatcggcaagatccgtgatgctcgatagggccgaaaacttgctccatgatcattatggaggcaaggaatactgggatactcggcggtcgatggtgtttgcccgtcatctaagagaagttggcgacgagttcagaagtcggcaccttaactccacagacgacgctgatagaatcccattccaagaagattggatgaagatgaaagttaagcttggctctgcactggggggcccttacttgggcgtgcacctgcgccgtaaagactttatctgggggcacaggcaggatgtcccttctctcgagggggctgtgcggaagattcgcagtctgatgaaaactcataggttagataaggtttttgtagccactgatgccgttagaaaagagtacgaagaactgaagaaactcctacccgagatggtgagatttgagccaacctgggaggaattggagctgtataaagacggcggagtcgcaattattgatcaatggatttgtgcgcacgcaaggttcttcatcgggacttctgtgtcaacattcagctttcgtatacatgaggaacgcgaaatactagggctcgatcccaaaactacatataatcgcttctgcggggaccaggagaaagcctgtgaacagccaacacattggaagattacatactag

SEQ ID NO: 29183 - DNA, 1179 bp, Artificial Sequence
  Description of Artificial Sequence: Synthetic coding sequence
atggaatggtgggcctcttcccccctccgactctggctcctcttatttttgctgccttctgcacaagggagacagaaggaaagtgggagcaaatggaaagtgtttattgaccagattaatcggtcgctggagaattatgaaccatgcagctcccagaattgctcctgttaccatggagtgatcgaggaagacctgactccttttcgaggagggattagcagaaaaatgatggctgaagtcgtgcgccggaagttgggcacgcattaccagattaccaagaaccgactttacagggagaacgattgcatgttcccctcgagatgtagcggcgtagaacacttcattctggaggttatcgggaggttgcccgatatggaaatggtcatcaacgtccgcgactatccccaggtgccgaaatggatggagcccgctatccctgtgtttagttttagtaaaactagcgagtatcacgatattatgtatccggcctggaccttctgggaagggggccctgctgtatggccaatttatccaaccggcctgggcagatgggatttattcagagaggacctggtgcggtcggccgcccaatggccttggaaaaaaaaaaatagcaccgcatacttccgcggttcccgtacttcacccgagcgggaccctttaatcttgctcagccgcaagaatccaaaactggttgacgccgagtacaccaagaatcaggcttggaaatccatgaaggatacactgggtaaacccgccgccaaagacgtacatttagtggatcactgtaaatataagtacctatttaatttcaggggagtggcggcaagcttccggtttaaacacttatttctttgtggatctctcgtgttccacgttggggatgagtggctggagtttttctacccccagctcaaaccctgggttcactacattccagtgaagactgatctctctaacgttcaagaattactgcagttcgttaaggcaaatgatgatgttgcccaggaaatagccgagcgcggcagccagtttatcaggaatcatctccagatggatgatatcacttgctattgggagaacctccttagtgaatactctaaatttttatcctacaatgtgactcgtaggaaggggtacgatcagattatacctaagatgttaaagaccgaattgtag

SEQ ID NO: 29184 - DNA, 3273 bp, Artificial Sequence
  Description of Artificial Sequence: Synthetic coding sequence
atgatgccaatgatcctcacagtgttcctgtccaataacgaacagatcctgaccgaggtgcccattaccccagaaacaacctgtagggacgtcgtggaattttgcaaggagcccggagagggctcttgccacctggccgaggtttggaggggaaatgagcggcctatccccttcgatcacatgatgtacgagcacttacagaagtggggtccccgcagagaagaggtaaagttctttctgcggcatgaagattcacctacggaaaatagcgagcagggtggacgccaaactcaggagcaacggacacaaaggaacgtgattaatgttccaggagaaaagcggacagagaatggggtggggaatcctagagtggaacttaccctgtcagaactgcaggacatggcagctagacagcagcagcagattgagaatcagcagcagatgctggtggcaaaggagcaacgactccatttcttgaaacagcaggaacgcaggcagcagcagagcatctccgagaacgagaaactccagaagctaaaggagcgagtggaggcacaggagaacaagcttaagaagattagggcaatgagaggccaggtggattacagtaaaattatgaacggcaatttaagcgctgaaatcgagaggttcagtgccatgttccaagagaaaaaacaggaagtgcaaaccgccatcctgagagtggatcagttgtcacaacagctcgaggatctgaaaaaaggcaaattaaatggatttcagtcttataacgggaagctgaccgggcccgccgcagtcgagctgaagagactgtaccaggaactacaaatccgcaaccagctgaaccaggagcagaacagcaaattgcagcagcagaaggaactcctgaacaagaggaacatggaagtcgccatgatggataagagaatttccgagctgagggagaggctctacggtaagaagatacaactaaatcgggtgaatggcacctcaagtccccaatctccactgagtaccagcggccgcgttgccgctgtgggcccgtatatccaggtgccaagcgcagggagttttcctgtccttggagaccccatcaagccccagagtctgtctatcgcctccaatgccgctcacggcagaagcaaatctgccaatgatgggaactggccgaccctgaaacagaacagcagtagctcagtgaagcccgtgcaggtggccggtgccgactggaaagatccatccgtggaggggagtgtgaaacaaggcacggttagcagccagcccgtcccattcagtgcccttgggcctaccgaaaagcccggcattgaaatcggaaaggtaccgccgcctattcccggcgtcggaaagcaactgcccccttcttacgggacctatccatcccctactccgctaggcccagggtcaacttcaagcttagaacgccgaaaggaaggatccctgccccgcccgtccgccggcctgccttcaagacaacgtcctaccctacttcccgccacaggttccactccacagcctgggagctctcaacaaatccagcaaaggatatcagtgcctccaagtccaacatatcccccggccggaccccccgcgttccctgccggcgattccaagccagagctgcctctgacggtcgcaatccggccctttctcgccgacaagggttcacggccccagagcccacgcaaaggacctcagactgtaaattccagttcgatttattccatgtatctgcagcaggccacaccacctaagaactatcagcccgccgctcacagcgcgctcaataaatcagtgaaggctgtgtacggcaagcctgtactgccttcagggtctaccagccccagcccccttcctttcctgcacggtagcctttctaccggcacgccccaaccacagcccccttcggagtcaactgagaaggaacccgagcaggacggacccgctgcaccagctgacggcagtactgttgagtccctgccaaggcctttatcgcctactaagttgacccccatagtgcacagtcccctgcggtaccaatcggatgccgacctggaagccctgcggaggaagctggccaacgctcctcggccactgaagaaaaggtcgagcatcacggaacccgaaggacccgggggtccaaatatccagaaacttctgtatcagaggtttaataccctggcaggtggcatggaggggactcctttttaccagccttcgccctcccaagatttcatgggaacattggcagacgtcgataatggaaacacaaatgccaatgggaacctggaagagctgccacctgcccagccaactgctcccctgcctgcagaacctgcaccgagttccgatgctaacgacaacgaactgccttctcccgagccagaggaactgatctgcccccagacgactcaccaaactgccgaaccagccgaggataacaacaacaacgtggctactgtgccaaccacagaacagatcccctcccctgtcgccgaggccccttcaccaggcgaagaacaagttccaccagctcccttgcctcccgcaagccaccctcccgcaacgagtactaacaagcgaactaatctcaagaagccaaattcagaaaggaccgggcacgggctcagggtgcgctttaacccactagccctgctattggacgccagcttggagggcgaatttgatctggtacagagaatcatttacgaagtggaagatcccagcaagcccaatgacgagggtatcacaccacttcacaacgcagtttgcgctgggcaccatcatattgtcaagttcctgctggactttggagtgaacgtcaatgcagccgacagcgacgggtggacaccactgcactgcgccgcgtcctgtaacagcgtgcacctttgtaaacagctcgtggagtctggcgcagccatctttgccagcaccatctcagacattgaaaccgctgcggacaaatgtgaggaaatggaggaaggatacatacagtgctcccagtttttatacggggtccaagagaagctgggagttatgaacaaaggtgtggcatatgcgctatgggattatgaggcacaaaacagcgacgaactgtcttttcacgaaggagacgcactcacaattttacggaggaaggatgaaagcgaaaccgagtggtggtgggctagactgggcgaccgggagggatatgtccccaaaaacttactcggactataccccagaatcaagcccagacagcgcactctagcctag

SEQ ID NO: 29185 - DNA, 1884 bp, Artificial Sequence
  Description of Artificial Sequence: Synthetic coding sequence
atggctgcccgtcagcaacagcagatagagaaccagcaacagatgcttgtcgccaaagagcagcggctgcatttcctcaagcagcaggaacggaggcaacagcagtctattagcgaaaacgagaagcttcagaaacttaaagagcgcgtggaggcccaagagaacaagcttaagaaaatacgggccatgcgggggcaggtagactacagtaaaattatgaatgggaatttgagcgccgagatcgaaaggtttagcgcaatgttccaagagaagaaacaagaggtgcagactgcaatccttagagtggaccagctgagccagcaactggaagacctgaagaaaggcaaactgaacggctttcagtcgtacaacggcaagttgacaggacctgccgcagtagaactgaaacgtctataccaggagctccaaattcgcaatcagctcaatcaggagcagaattcaaagctgcagcagcagaaggagctcttgaataaaaggaatatggaggtcgcaatgatggacaagcggatctccgagctgcgcgaaagattgtacggcaagaagattcagctgaacagggtgaacggcacatcaagcccccagagtccactttcaaccagtggacgggtggccgctgtcgggccttatattcaggtgccctcggctggatcttttcctgtcctcggtgacccaatcaagccccagagtttatccatcgcctcaaacgccgcacacgggcgttccaagtccgcgaatgatggtaactggccaactcttaaacaaaattcatcctcttccgtgaaaccagtccaagtggcaggggccgattggaaagacccctccgtggagggctccgtcaagcaagggacggtgagctctcaacctgtgccattcagcgctcttggccccactgaaaaacctggcatagagattggaaaagtcccgcctccaatccctggcgttggaaagcagctgcctcccagctatgggacttatccgagtcctacaccactcggacctggttcaacatcatcactggaacggcggaaagagggatccctgccaaggccaagcgccggactgcctagtagacagcgcccaaccctgctgcctgcaacagggagcaccccacagcccggatcctcgcagcaaatccagcagagaatctctgtcccaccctcccctacatatccccctgcggggcctcctgcctttcctgccggtgactccaaaccggagctaccgcttacagtggccatcagaccatttttggcggataagggaagcagaccacagagtcctcgcaaggggccccagaccgtgaattcctcttctatctatagcatgtatctacagcaggccactcctccaaagaactatcagcctgcagcccattctgcactgaataagtctgtgaaagcggtctatggcaagcccgttttgccatctgggtccacaagcccatccccgcttcccttcttgcacggctcgctgtcaactgggactccccagccacagcctccctccgagtctaccgagaaggagcctgagcaggacggcccggctgctccagccgatgggagtactgtggaaagcctgccccggccattgtcaccaaccaagctgaccccgatcgttcatagcccattgcggtatcaaagcgacgccgatctcgaagcccttcggcggaagttagccaacgcaccccggccactgaaaaaaaggtcaagtattacagaacctgaagggccaccatttcttcccgcccagccactccccggcctgcatggacacttaggacgctgcggccagtggaagcatcagtgtcagtggaagccagggagagcccccccttgtcccgcccactccccaacaccgagatag

SEQ ID NO: 29186 - DNA, 1197 bp, Artificial Sequence
  Description of Artificial Sequence: Synthetic coding sequence
atgtaccttcagcaggccacacccccaaagaactatcagcccgcagcgcactcggccctgaataagtccgtcaaagcagtgtatggaaagccggtgctcccttccggcagcacatccccatctcccctgccttttttacatggctccctaagtaccggaactccccagccccagcccccaagtgagagcaccgagaaggaacccgaacaggacgggccagccgcaccagctgatggcagcactgtggagagtctccctagacctctcagcccaacaaagctgacgcccattgttcactctccgctgaggtatcagtcagatgcagatctggaagctcttaggcggaaactcgcgaacgcacctagacctctgaagaaaaggagctcaattactgagccggaaggccccggtggcccaaatatccagaaattgctctatcaacgctttaacacactggccggcgggatggagggcacacctttctaccaaccctccccttcccaggacttcatgggcacattggctgacgtcgacaatgggaacaccaacgctaacggtaatcttgaggaattgccaccggctcagcccacagcaccactgccggctgaacctgccccgagttccgatgccaacgataacgagctgccaagtcctgagcccgaggaacttatttgccctcaaacaacgcaccaaactgctgaacccgcagaggataacaataataatgtcgccaccgtcccaacaaccgagcagatcccaagccccgtcgccgaggctcctagccctggtgaggagcaggtcccaccagcaccactgccacctgcctctcatccgccagccaccagtactaacaagcggaccaacctgaaaaaaccaaatagcgagagaactggtcacggattgagggttcggttcaaccccctggctctgctcttggacgccagcttagagggcgagtttgaccttgtgcagaggatcatttacgaggtagaagacccatctaagccaaacgacgagggcatcacacctttgcacaatgcggtttgtgctggacaccaccacatcgtgaaattcctgcttgattttggtgttaacgtgaacgccgccgactcagatggctggggggctgggaaagccggatgtgatgagcagcgatgcggggtttgttctgtcggcttgcgcggccctgagcagtag

SEQ ID NO: 29187 - DNA, 1908 bp, Artificial Sequence
  Description of Artificial Sequence: Synthetic coding sequence
tgagttggtccctacattcaggtacccagcgccgggagctttcccgtcctgggcgaccctattaagcctcaatcacttagcatagcgtctaatgccgcccatggaaggtctaagtcagccaacgatggaaactggccaaccttgaagcagaacagctccagcagtgtgaaaccggttcaggtagcaggggctgattggaaagatccgtcagtcgagggcagcgtgaaacagggcactgtgagtagccagcctgtcccattttccgccttaggccctactgagaagcccggcattgagatcgggaaggtccctcccccaattcctggtgtgggtaagcaattgccaccttcctatggcacctatccctccccaacaccgctgggtccggggagtaccagctctctggagaggagaaaggaaggaagtttgccacgtccatctgccggccttcctagccgacaaagaccgactctgctgccagctaccggctcaaccccgcaaccagggtcatcacagcagattcagcagcggatctctgttcctccttcccccacatacccaccagccggaccaccggctttcccggccggcgattcaaagcctgagctgcctttaacagtggcaattcgtcccttcctggctgataaagggtccaggcctcagagccctagaaaaggaccacagaccgtgaattcttctagtatttactcaatgtacctccagcaggcgactccacctaaaaactaccagccagctgcccacagcgcgcttaacaagagcgtcaaggctgtgtatgggaaacccgtgctgccttctggaagcacgtcacccagtccactgccattcctacatgggtctctatcaaccggcacgccccagccccagcctcctagtgagagtaccgaaaaggaacccgagcaggatggccccgccgcacccgctgatggcagcactgtcgaatctctgcctagacccctgtcaccaactaagttgaccccgattgttcatagtcctctgcggtaccaatcagatgcggaccttgaggctctcagacgcaaactagccaatgccccacgccccctaaaaaaacgctcttctattaccgaacccgaaggccctggcgggcccaatatccagaaactcctttaccaacggtttaacaccctcgccgggggcatggaggggaccccattctatcagccctctccttcccaggactttatgggcaccctggccgacgtcgacaacggcaatacgaatgcgaatggcaaccttgaagagctgcctcccgctcagcctaccgcgccactaccagcagaacctgcgccctcctctgatgccaacgacaatgaactgccctcccccgagcccgaagaactgatctgtccccagacgacacatcaaacagctgaaccagccgaggacaataacaacaatgttgcgacagttcctaccacagagcagattccttcccctgtggccgaggcccccagtccgggtgaggagcaggtgcctcccgcacccctgccccccgctagtcacccaccagcgacttcaaccaataagcgcacaaacttgaaaaaaccaaactctgagagaactggccatgggctgcgcgtgcggttcaacccactagcgctgctgttagatgccagcctggagggcgagttcgaccttgtgcagaggatcatctatgaggttgaggatcccagcaaacccaatgacgagggtatcactcctctgcacaatgccgtatgtgcaggccatcatcatatcgttaagtttctacttgatttcggggtgaacgtgaatgccgctgattcagatggctggggagctggtaaagccggatgtgatgagcagagatgtggtgtgtgtagcgttggtttgaggggaccagagcagtag

SEQ ID NO: 29188 - DNA, 1587 bp, Artificial Sequence
  Description of Artificial Sequence: Synthetic coding sequence
atggccgaacaccttgagctactggcagagatgcctatggtgggacgcatgtccactcaggagaggctgaagcacgcacagaaacgacgggcccagcaggtgaaaatgtgggcacaggccgagaaggaagcccagggtaagaaaggaccaggcgaacgcccacggaaagaggcagctagccagggcttgctgaaacaagtgctgttccctccctcagtcgtcctactggaggctgccgctagaaatgacctcgaagaagttagacaattcttgggctctggtgtctctcccgacctggcgaatgaggatggcctaaccgcattgcaccaatgttgcattgatgactttagggaaatggtacagcagctgctcgaggccggggcaaacataaatgcatgcgatagcgagtgttggactccattgcacgccgctgcaacttgcggccatctacacttggtagagctgttgattgcctctggcgccaacctactcgctgtaaacaccgacgggaacatgccatacgacttatgtgacgacgagcagaccttggactgtctcgagacggccatggccgaccgagggatcacccaggactctatcgaggcagcccgggccgttcctgagctgcggatgctggatgatattcgtagtcgtctgcaggccggcgcagatctgcacgcacccctggaccacggggcgacccttctccacgtggccgcagcaaatggattctccgaagccgccgctttgcttctcgagcaccgcgcaagcttgagtgccaaagaccaagacggctgggagccattacatgccgccgcctactggggacaggtacccctcgttgagctgctggtggctcacggcgcagacctgaatgctaaatccttgatggacgaaacaccattagacgtttgtggggatgaggaagtgagagcaaagctcctagaattaaagcacaagcatgacgccctgcttagggctcagagtcggcagaggagtctactccggagacgtacatccagtgccggaagccgtggtaaggttgtgaggcgggtgagcctaacacagagaaccgatctgtatcgcaagcaacatgcgcaggaggccatcgtatggcagcaacctcctcctaccagcccagagcctccagaagacaacgatgatcgacagaccggtgccgagctgcgccccccaccccccgaagaggacaacccggaggtggtgcgcccccataacggtcgggtcgggggctcacccgtcaggcacctatatagtaaaaggcttgaccggtcagtatcttatcagctgagtccactcgatagcacgacccctcataccctggtacacgacaaggcccatcatacactggcagatctgaaaaggcaaagggctgcagccaagcttcagagacctccgcccgaaggccctgagtctcctgagaccgctgagccaggactgccgggggacaccgtaacccctcagcccgattgtgggttcagggccggaggcgatcctccattgctaaaactgacagctcctgccgttgaggcacctgtcgagcgcaggccatgttgcctgttgatgtag

SEQ ID NO: 29189 - DNA, 1587 bp, Artificial Sequence
  Description of Artificial Sequence: Synthetic coding sequence
atggccgaacatctggagctacttgcagaaatgccaatggtgggcaggatgagtactcaggaaagattgaagcatgctcaaaagaggagagcccaacaagtgaagatgtgggcgcaggccgagaaagaagcacagggcaagaagggaccaggcgaacgtccaagaaaggaggccgcgtcccaggggctgctgaagcaggtcctgtttcctccctctgtggttcttctggaggcagcagcgagaaacgatctcgaggaagttcggcagttccttggaagtggtgtgtcccccgacttggcaaatgaggatggactgaccgccctccaccagtgttgtattgatgacttcagagagatggtgcagcagttgctcgaggccggcgcaaatataaacgcatgcgactctgagtgctggaccccactccatgcagccgctacgtgcggtcatctacacctggtggagcttcttatcgcatctggggccaacctgctggcagtgaatactgatggcaacatgccatatgatctatgcgatgatgaacagacattagattgtctggaaacagccatggcggaccggggaatcacgcaggatagcatcgaagctgcgagggcagtgccagagttgagaatgctggatgatatacgatccagactgcaggcaggcgcagatttgcatgcccccctggaccacggagcgactctgctacacgtcgcagctgccaatgggttttctgaggccgcagctctgttactcgagcatagagcaagcctctccgcaaaagatcaggatggttgggagcccctccatgccgcagcatactggggccaggtgcctctggtggagctgctggttgctcacggggcagacctgaatgccaaatccctcatggacgagaccccgctcgacgtctgtggtgacgaagaggtacgagccaagctgcttgagctaaagcacaagcatgatgctctgttaagagcccagtcaagacaacggagtctcctacggcgacgaaccagcagcgcagggtcgcggggcaaggttgtccgtagggtgtctctgacccagcgcactgacctgtaccgcaagcagcacgctcaggaggcaattgtctggcagcagcccccgcccacgtcaccagaacctccagaggacaacgatgatagacagactggcgccgagctccggcctccccccccagaagaagataaccctgaggttgttagaccacataacggcagggtaggcggtagtccagtccgccacctctacagcaaacgtcttgacagaagtgttagctaccagctgagcccccttgacagcacaactccccacacccttgtgcacgataaggcgcaccatacattagccgacttaaaacgccaaagagctgctgcgaaacttcagcgccctccgccagaaggaccagagtcgccagagactgctgagcctgggctcccaggtgacaccgtgacacctcagccagattgtggattcagagctgggggcgatccacccctgctcaagctgacagccccagctgttgaggccccggtggaaaggcggccctgttgtcttctgatgtag

SEQ ID NO: 29190 - DNA, 840 bp, Artificial Sequence
  Description of Artificial Sequence: Synthetic coding sequence
atgagccgggagagacccccagggaccgacatcccgcgaaacctgtccttcatcgccgctctgaccgagcgggcttattaccgctcccagagaccctctctcgaagaagaaccggaggaagaaccaggggaaggaggaaccaggttcggcgcccggtcccgtgcgcatgcgcccagccgtggtcgccgcgcaaggtcagcccctgctggcggcggcggagccagggcaccaaggagcagatcaccagacacacggaagagggtgcggttcgccgatgctcttggattggagctagccgtcgttcgacggttccgccctggagagctcccacgggttccacgccacgtccagatccagctccagcgagatgccttgaggcattttgccccatgtcagccccgggctcggggcctccaggaggcccgtgcagccctggagcccgcgtcagagccagggtttgcagctagactgctgacccagcggatatgcctggaaagggcagaggcgggtccgttgggagttgcaggcagcgcgagggtggtggatttagcctacgagaagcgtgtgtctgtccgatggagtgcagacggatggcgaagccagcgggaggccccagccgcatatgctgggcctgctcctcctccgcctcgtgcagacaggttcgcatttaggctgccagctccccctattggaggcgcgttgctttttgctctgcggtatcgggttacagggcacgagttctgggataataacggaggaagggactatgcgttgaggggaccggagcaccccggctctggcggggcacctgagccgcagggatggatccattttatttag

SEQ ID NO: 29191 - DNA, 150 bp, Artificial Sequence
  Description of Artificial Sequence: Synthetic coding sequence
tgaggagccctcctgtttgcactccgttatcgggtgaccggccacgaattttgggacaataacggggggagagactacgcactgcgcggtcctgaacacccgggaagcggaggagcgcctgaaccacaggggtggatacactttatctag

SEQ ID NO: 29192 - DNA, 105 bp, Artificial Sequence
  Description of Artificial Sequence: Synthetic coding sequence
taattctgggacaacaacggcggtcgagactacgctctccgcggacctgagcacccaggaagtggcggcgcaccagaaccccaggggtggatccattttatttag

SEQ ID NO: 29193 - DNA, 57 bp, Artificial Sequence
  Description of Artificial Sequence: Synthetic coding sequence
gagcatcccggatctggaggagcaccagagccacaggggtggattcatttcatctag

SEQ ID NO: 29194 - DNA, 90 bp, Artificial Sequence
  Description of Artificial Sequence: Synthetic coding sequence
aacggaggacgagattacgccctacggggtcccgagcatccgggctccggcggagcccccgagccccaaggctggattcattttatttag

SEQ ID NO: 29195 - DNA, 42 bp, Artificial Sequence
  Description of Artificial Sequence: Synthetic coding sequence
tgaggagcccctgaaccacagggatggatccacttcatttag

SEQ ID NO: 29196 - DNA, 2400 bp, Artificial Sequence
  Description of Artificial Sequence: Synthetic coding sequence
atggcccggaccgccccagttgagccccctctcagacactcagctcccccatctccagccgccggagagcctcgaacatccgtggaggctgcagtcgcaccccgcagagtgctatttgccgacgaggctcttggcctacccctcgctcaactcagacgctatcgaccatggggcggacccggcgcagggaaaatggcggcagcagccggccaggatggggggggaggcgggggggcggacgaggacgatgacggggaggacggcgacgagggagaggaagaggaggaagcctgtcctgaacctagcccactctgtccagttcctgctggcggtgggttttatttggtacctaccttcagcctaccacctgcccccgggaggctcgagagattggggcgggtgatggtggaactggaggccctgctgccacctcctggcgcagtgcctgggggggctggtgtctgggtcccaggggggcgccctcctgtcctacggggacttgtgagggtactcaatcgaagcttcgagaaggctgtacacgtgcgagcctcgcacgacggttgggcctctttttgcgatcatccagctcggtacgtcccaaggagtccaccctgggccggggccggagggacgggagccggcgacccgattctggaccctggtctcggactcggtcctgggcaggcttctgcttctagcccggacgacgggggacggacggatagattcgccttccagctgccttttgcggagggggctggcgatggcgctagactggatttcgtcgtgcggtatgagaccccagaaggcactttttgggcgaataatcatgggcgaaactacaccgtcctcttgagaattgctcctgcacctacacctaccgacgcggagggcctgccccaacagcagcagctcccccaactagagccacagcccgagtgccagggccctgtggaagccgaggctcggcagctcaagagctgtatgaagccggttcgacgcaggccggccgaggaagagctcaaaacgaaaaatatggatgacaacacattcgcaatggccgagcaccccgatgtgcaggaatccgtagggcctctagttgcccccacgccactgaggccctggcctcagatgaccctgcaggtatccgacgtgcctatgaccggcaaccccgcagaggaaggagacgtcccccgttcaagtccacccgtggcattcaccgaggtgctccaggccccagccatacggatacctccaagttcacccctgtgcggattgggaggttctccaagagaccaggcttccggaccagacgcatccgagggagccacaggtccgtttctcgaacccagccagcagcaggccgaggccacctggggcgtctcgagcgaaaatggcggcggactggaagccgtctcgggctcggaggaattactcggggaggataccatagatcaggagctggagcagttatatctttcgcacctatccagactcagagccgctgtggctgctggcggcgcagggggcgggggcgagggctcaacagatggcggaatgtccccctctcatcccctaggtatcttgactgatagagacctcatcttaaagtggccaggccccgagcgcgcccttaacagcgcactggctgaagaaattacactgcattatgcccggctgggccggggagtcgagctcatcaaggatactgaggacccagacgatgaaggggagggtgaggaaggcctcagtgtcaccccctcatcacccgaaggagattccccaaaagaatcccccccagaaatcctcagcggcgcaaggtccgtggtggctacaatgggagatgtgtggctgccttgggcagaaggatctgggtgcgacgggcccgtggtattgggaactgaagggcagttcattggcgacccggagaaggggatggggaaggatacaagctcccttcacatgaatcgcgtgatagcgggggttaccgaaagcctcggagaggccggcaccgaggcacaaatcgaagtcacttcggagtgggcaggcagcctggaccccataagcgggaaagaaccagcttcgcctgtactcctgcaaggacagaatcctacacttctgagcccactgggggcggaggtgtgtctctcatcagttgctaggcctcatgtgtccagccaggatgagaaagacgcagggccaagcttggagcctcctaagaagtcacctacactggcagtgccagcggaatgtgtatgcgccctcccaccgcagctgcggggccccctgactcagacactgggcgttctggccggactggtcgtcgtgcccgtggctctgaacagcggggtgtcactgctggtacttgcactctgtctcagcttggcttggttctcatag

SEQ ID NO: 29197 - DNA, 1413 bp, Artificial Sequence
  Description of Artificial Sequence: Synthetic coding sequence
atgaagccggtccgcaggcgcccagccgaagaagagctgaagactaaaaacatggacgacaacacattcgccatggaacatccagacgtgcaggaaagtgtggggcccctcgtcgcgcccactccccttcgaccttggccccaaatgaccctgcaggtgtcagatgtacctatgactggtaatcctgcagaggaaggggatgtcccccgaagtagcccgcccgtggctttcaccgaggtcctacaggctccggccattaggatacctcctagctctccactctgcggccttggtggctctcctagagaccaagcttctggccccgacgcatcagagggtgcaactggcccattcttggaaccctcacagcagcaggctgaagcaacgtggggcgtttcaagcgaaaacggcggcggcttagaggccgtaagcggcagtgaagagttacttggtgaagacacaattgatcaggaactggagcagctgtacttgtctcacctgagtcgcctgcgggccgctgttgctgctggcggagcggggggcggtggtgaaggctcaactgatggaggaatgtctccaagtcacccattggggattttaaccgaccgcgacctcatactcaagtggcctgggccagagagagctttgaattcagcgctggcggaggaaattacgctccattacgcccgactgggcaggggagtggaactgattaaggatactgaggatcctgatgatgaaggcgagggcgaagaaggcctcagcgttacccctagcagcccagagggtgattcgccgaaggagagtcctccagagattttatcaggtgccagaagcgtcgtcgccaccatgggagacgtctggttgccatgggccgagggatctggctgtgacggaccagtggtccttggaacagagggtcagttcatcggggatcctgaaaaaggcatgggcaaggataccagttcgctccacatgaatagagttatcgccggtgtaacagagtcacttggcgaggctggtacggaagcgcagatagaagtgactagcgagtgggccgggtctctcgatccaattagcgggaaagaacccgcctctccagttctattacaaggccagaaccctaccttgctgtcccccttaggagccgaagtctgcttgagctccgtcgcaaggccccacgttagtagccaggacgagaaggacgccggcccctccctagaaccccctaagaaatctccaaccctggctgtgcctgccgaatgtgtgtgtgccctcccacctcagcttcgcgggcccctcacccagacattgggagtgctggccggtctggtggttgtcccagtggccttaaattcaggcgtttccctgttggttctggcactgtgcctctccctcgcatggttctcttag

SEQ ID NO: 29198 - DNA, 1368 bp, Artificial Sequence
  Description of Artificial Sequence: Synthetic coding sequence
atgttctgttccgggcgaaagtgggtggccgaggcaactatttgtactaagctcatgaagagagagaagcggcgaatggggaagagacgggccaaaaaagcaaaacgggaagaaaagaagaagggtggcgagcgtcggcggaacgaaaagaggggtaaccagatgaaacgcatgtgcgaaaggaagaaatacgagactgatcttgaggatcaggatatcatgggggcgtttcttgataagcctaaaatggagaagcacaatgcacaggggcaagggaacggattgaggtacgggttatcttcaatgcagggttggagggtggaaatggaggacgctcacaccgctgtgatcggcctgccctctggcctggaatcctggtctttttttgcagtgtacgacgggcatgcaggttctcaggtcgcaaagtactgttgtgagcacttgttagaccacatcaccaataaccaggacttcaagggaagtgccggtgcccctagcgtggaaaacgtcaagaacgggattcggacaggtttcctcgagatagatgaacatatgagggtgatgtcagaaaaaaagcatggggctgatcgttcgggcagtactgctgttggagtgctgatttcaccacaacacacctacttcatcaactgcggcgactcacggggccttctgtgccggaataggaaagttcacttttttacacaagatcataagccctcaaaccccctggagaaggagcgcattcaaaatgctggaggaagcgtgatgattcagagagtgaacggaagtctcgccgtttctagagcactcggggatttcgactacaaatgtgtacacgggaaaggtccaacggagcagctggtgtctccagagccagaagtgcatgacatagaacgcagtgaagaggacgaccagttcatcattttggcttgcgatggcatatgggatgtgatgggcaatgaggaactctgtgacttcgtaagatctaggctggaagtgacagacgaccttgagaaggtgtgcaacgaagtggttgatacttgcctttacaaaggatcgagagacaacatgagtgtgattctcatatgtttccccaatgctccgaaggtttcgccagaggctgttaagaaagaggcagaactggacaagtacctcgaatgtcgtgtggaggagattatcaaaaagcagggggagggcgtgccagatctggtgcacgtgatgcggacattggcaagcgaaaacatcccctctctgccacccggaggcgaactcgcgtccaagcgtaatgtcatagaggcggtatataatagactgaatccatataagaacgacgacaccgactcgaccagtaccgacgatatgtggtag

SEQ ID NO: 29199 - DNA, 975 bp, Artificial Sequence
  Description of Artificial Sequence: Synthetic coding sequence
atgggcgcattccttgacaagccaaagatggagaaacacaatgcccagggccagggtaacggtctcagatacggcctgtcttccatgcagggatggcgcgtcgaaatggaggacgctcacactgcggtcattggcctgccatccggattggagagttggtccttttttgccgtctatgatggccacgccggttctcaggtagcaaagtactgctgtgaacacctgctcgatcacatcaccaacaaccaggatttcaagggtagtgccggagcaccttccgtggaaaatgtgaagaacggtatcaggactggctttctagaaatagatgagcatatgagagtgatgagcgaaaagaaacacggtgcggaccgctctggctccaccgccgtgggagtgctcatatccccccagcatacttattttattaattgtggagattctcgcggactcttatgcagaaatagaaaagtgcacttttttactcaggaccataagcctagtaatcctttggagaaagagagaatccagaacgctggcggctcagtaatgatccagagggtaaacggcagtttggccgtgtcacgcgccctgggggatttcgattacaagtgcgtacacggtaaaggacccacagaacagctggtgtccccagagccagaggttcacgatattgaacgtagcgaagaagacgatcagttcattatccttgcttgtgatgggatttgggacgtaatgggcaatgaagaactgtgcgattttgtgcgctcacggctcgaagtgaccgacgatctcgaaaaggtctgtaacgaggtagttgacacatgcctctataagggttcaagggataacatgagtgtgatccttatatgttttccaaacgctccaaaagtttcacccgaggctgtgaaaaaggaagcagaactcgataagtatttagaatgccgagtggaaggcgggtcattcaacaaaaaatag

SEQ ID NO: 29200 - DNA, 1149 bp, Artificial Sequence
  Description of Artificial Sequence: Synthetic coding sequence
atgggcgccttcctggacaaaccaaagatggagaagcacaatgcgcagggccaggggaatggactgaggtatggtctcagctctatgcagggatggagggtggaaatggaggacgcccatacggccgttatagggctaccctcaggcttggagagctggtccttctttgccgtgtacgacggccacgccggaagtcaagtggcaaaatactgctgcgagcaccttcttgaccatattacaaacaatcaggacttcaaaggctctgctggcgctccaagcgtcgaaaacgttaagaatggaatacgcacaggtttcctcgagatcgatgagcatatgcgtgttatgtcagagaagaagcatggtgccgacagatccgggagcaccgccgtcggagtccttatatccccacaacacacatacttcattaattgtggcgacagtagaggcttgttatgcaggaaccgaaaagtgcattttttcactcaggaccacaagccttccaaccctctcgagaaggagagaattcagaacgctgggggctccgtgatgattcaacgtgtcaacggttcattggctgtgagccgggcgttgggagatttcgattacaagtgcgtccatgggaaaggccccactgaacagctggtatcacctgagccagaggtgcacgatattgagcgatcagaggaggacgaccagtttataatattagcatgtgatgggatctgggatgtcatgggcaacgaggagctgtgtgattttgtgcgctcacgcctcgaagtcacagatgacctagagaaggtgtgcaacgaagtagtagatacatgtctttataaagggagccgggacaacatgtctgtgattctgatctgttttccgaacgctcctaaggtctcgcccgaggcggtcaaaaaagaagcggagctcgacaaatacctcgaatgcagagtggaggaaatcatcaagaagcagggagagggagtgcctgaccttgtgcatgtaatgagaacactagcgagcgagaacattcccagtctgccgcctggcggcgaactggcatcaaaacggaacgtaatcgaggctgtatataaccgccttaacccatacaaaaatgatgatactgacagtacttctacggatgacatgtggtag

SEQ ID NO: 29201 - DNA, 564 bp, Artificial Sequence
  Description of Artificial Sequence: Synthetic coding sequence
atgggagcctttctggataaaccaaagatggaaaagcataacgcccaaggtcagggcaatggacttcggtacgggctgagcagcatgcagggctggcgagtcgaaatggaggacgcgcacactgcagtgatcgggcttccgtcgggactggaatcatggagcttctttgccgtctatgatggacacgcggggagccaggttgcaaaatattgctgcgagcacctgctcgatcacataacaaataatcaggatttcaaaggcagcgcaggcgccccatccgtggagaacgtcaagaatggaattcgtactggttttctggagattgacgaacacatgcgagttatgtccgaaaagaaacacggggccgatcgcagcggatcaacggccgtgggggtgctgattagtcctcagcatacctactttattaattgtggcgattcacgcggattgttatgcagaaaccgtaaagtccatttcttcactcaggaccataagccctccaatccccttgagaaggaacggattcagaatgctggcgggtccgtgatgatccagcgagtgtag

SEQ ID NO: 29202 - DNA, 390 bp, Artificial Sequence
  Description of Artificial Sequence: Synthetic coding sequence
atgggagcgtttttggacaagcctaaaatggaaaagcataatgcccaggggcagggcaacgggttgagatatggtctctccagcatgcaggggtggcgggtagaaatggaagatgcacacacggccgtcataggtctgccttccggcctagagagttggtccttttttgctgtgtacgacggccacgccggaagtcaggtcgccaaatattgttgtgaacacctcctggaccatattacaaacaatcaggacttcaaaggaagtgcgggagccccgagcgtcgaaaatgtgaaaaacggtatcagaactggtttcttggagattgatgaacatatgcgagtgatgagtgagaaaaaacatggggccgatcgctccggaagtacagcatag

SEQ ID NO: 29203 - DNA, 1149 bp, Artificial Sequence
  Description of Artificial Sequence: Synthetic coding sequence
atgggggcctttctagacaaacccaagatggagaaacataacgctcagggacagggcaacgggctcagatatgggttatcctcaatgcagggctggagagtggaaatggaggacgcacatactgctgtgatcggtctgcctagcggtctggaaagctggagcttctttgcggtgtacgacggtcacgccggatcccaagtggccaagtattgttgtgaacacctgttggatcatattactaacaatcaggacttcaaaggttccgctggagctcccagtgttgagaatgtcaagaacggcatccggactggattcctggagatcgacgagcacatgcgcgtcatgagtgaaaagaagcatggagctgaccgctctggaagcacggcagtcggggtgctcatctcaccacagcacacctactttattaactgcggtgattcaaggggtttgttatgccgcaaccggaaggtgcacttttttacccaggaccacaagcctagtaaccctctcgagaaagagcgcatccagaatgccggtggaagtgttatgattcagcgagtgaatgggagccttgcggtttcacgggcactgggagattttgattacaaatgcgtacatggcaaaggccccactgagcagttggtgagccctgagcccgaggtccacgatattgagaggtctgaggaggacgatcagttcatcattctagcctgtgatggtatatgggatgtgatgggcaacgaagaactttgcgacttcgtccgctctcgacttgaagtgaccgacgatctggaaaaggtgtgcaacgaagtagtggatacctgcctttacaagggctcccgcgacaacatgtccgtgattctgatttgcttccccaacgcacctaaagtttcccctgaagccgtgaaaaaagaagcagaactcgacaagtacttagaatgccgggttgaggagatcatcaaaaagcaaggcgagggcgttccagatctggtgcacgttatgagaactttggcatctgagaacataccatccctcccaccagggggtgagctggcaagcaagcgcaacgtcatcgaagccgtctataataggcttaacccatataagaacgatgacacagatagcaccagcaccgacgatatgtggtag

SEQ ID NO: 29204 - DNA, 447 bp, Artificial Sequence
  Description of Artificial Sequence: Synthetic coding sequence
atgggtgccttcttggataagcccaagatggaaaaacataatgcacagggccagggtaacgggcttaggtacggtctcagctcgatgcagggctggagggttgagatggaggacgcccacaccgccgttatcggtctgccttctggactggagtcctggtcattctttgccgtttacgacggacacgccggttctcaggtcgccaagtactgttgcgagcaccttctcgatcacatcacaaataaccaggatttcaaggggagtgccggcgctccctcggtcgagaacgtaaagaacggcatccggaccggtttcctagaaatcgacgagcatatgcgcgttatgtccgaaaagaaacatggagccgacaggtctgggagcacagctgtaggcgtgttgatcagcccccagcacacttatttcattaactgtggagactccaggtag

SEQ ID NO: 29205 - DNA, 2367 bp, Artificial Sequence
  Description of Artificial Sequence: Synthetic coding sequence
acccactacctgtcccccgggctgtcagacttttacttgaatcattcgcccgcctcgacttgcaccctcaggagatctctgggatctgagaccggtaaatgcctgccggctcactccctgctgcccaaatttttcccttgccgggaggatgttcataaagtggatatcatgaccttttgccaacaaaaggccgctcaatcctgtaaatctgaaaccctgggctcaagagacagcgcactgttatggcagctgctggtcctgttgtgccgccagaatggatccatggtgggtagtgacatcgcggagttgctgatgcaggactgcaagaaactcgagaagtacaagagacagccaccagtggccaacctgattaacctcaccgacgaagattggcctgtcctctcatccggcactccaaacctcctaacgggagaaattcccccttccgtggaaacacctgcccagatcgtcgagaagttcacacgcctgctgtactatggaagaaaaaaggaggccctggaatgggctatgaaaaatcacctctggggacatgctctgttcctgtccagcaagatggatcctcagacctattcctgggttatgtccgggttcaccagcactttggctctcaatgatccattgcaaactttatttcagttgatgtccggccggattccacaagcagccacttgttgcggggaaaagcagtggggagactggcgtcctcatcttgccgtcatactgtcaaaccaggctggcgacccggaactctatcagcgcgcaatcgtggcgattggcgacaccctggccggcaaaggattagtcgaggccgcgcatttttgttaccttatggctcacgtcccattcgggcactatacggttaaaaccgatcatctcgtgttgcttggcagtagtcacagtcaggagtttttgaaattcgcgaccactgaggccatccagcggacggaaatcttcgaatactgtcagatgctgggccgccctaaaagttttattccaagtttccaggtctacaagcttctgtatgcatcgcggttggccgactatggcttagtgtctcaagccctccactactgcgaagctattggggccgccgttctctcccagggggagtcatcacacccagtcctgttggtggaactgattaaactcgcggaaaagctgaagctgagcgatcctctggtgctggaaaggcggagcggagatcgggatcttgagcctgactggctggcacaattaaggagacagttggaacagaaagtggccggagacattggtgacccccacccaacccggagcgacataagcggagccggtggtaccaccaccgagaacactttctaccaggacttctcagggtgccaaggatatagtgaggcccccgggtaccggtctgcactctggttaaccccggaacagacttgcctactgcagccatcaccccagcagccgtttcctctgcagcccgggtcgtaccctgctggtgggggggctgggcaaactggcacgccgcgccccttttacagcgtcccagaaactcatctccctgggaccggcagcagcgtcgccgttacagaggcaacaggcgggacggtgtgggaagagatgttacagacccacttaggcccgggcgaaaataccgtgtctcaagaaaccagccagcctcccgacggccaggaggttatatctaaacctcagacgccactggcggctagaccaaggtccatctcagagtcgtccgcatcctccgctaaagaggacgaaaaggaatctagtgacgaggctgataaaaacagtccccggaacaccgcccagagaggcaagttgggcgatggtaaagaacacaccaaaagttccggctttgggtggtttagctggttccggagcaagccaactaaaaacgcatccccggctggagatgaagacagctctgattcacctgattccgagcaggagaccccgcgcgcctcgagtccacatcaggcaggcctcggtctgtcgctgacccccagcccggagtcgcccccccttcccgatgtctcagccttttcaaggggcaggggcggaggggagggccggggatcagcctcatcaggcggggctgccgcaggcgcaggggttggaggcctgtcaggacccgaatcagtttcctttgaactttgcagtaacccaggggtgcttctacctcctccggccctgaagggtgccgtgccattatacaaccctagccaggtccctcagttgcccacagccacgtctcttaatcgcccgaatcgtctgtcagcgtcactgtcccaccccgccatgctccgcataaatacaagaccccgattgatctcccaagactag

SEQ ID NO: 29206 - DNA, 3183 bp, Artificial Sequence
  Description of Artificial Sequence: Synthetic coding sequence
atggaactgtgggcaccccagcggcttccacaaactaggggaaaagcaactgctcccagtaaagatcccgatcgcggcttcaggcgggacggtcatcacagaccagtcccccattcatggcataatggcgagcgctttcatcagtggcaggataataggggtagtcctcagcctcaacaggagcccagagccgatcaccagcagcagcctcactatgcatcacggcctggcgattggcaccagccagtctcaggagtggattactacgagggtggttaccggaaccagctctacagccgccccggttacgagaattcctatcagagctaccagtctcctaccatgcgggaagagtacgcgtatggaagttattactaccatggacacccacaatggctccaggaggagcgcgtgcctcgacaacgcagcccgtacatctggcatgaggactaccgggaacaaaaatatctggacgaacaccattacgaaaatcaacactccccgttcggcaccaactccgagacacacttccagtcaaatagtcgcaacccttgcaaggatagtcctgcctctaattcgggacaggagtggcccggcgagctgttccccggaagtttgctggcggaggcacaaaagaataaaccttctctggcatcagagtcaaatctgctgcaacagagagaatcgggcttatctagttcatcatacgagctgagtcaatacatcagagatgcaccagaaagagacgacccaccagcctctgcagcatggtcaccggtacaggccgatgtatctagcgccggaccaaaggcgcctatgaaattctatatcccccatgtgccagtgagtttcggaccaggagggcagcttgtgcatgttggtccctcttcacctacggatggccaggctgctttggtggagctgcatagtatggaggtaatcctcaacgatagcgaagaacaggaggagatgaggtctttctccggtccacttattagggaggacgtgcacaaggtcgacatcatgaccttctgccaacagaaagccgcacaatcctgtaagtcagaaaccctagggagtcgtgactccgccctcctgtggcagctactagttctgctctgtcgccagaacggctccatggtgggtagcgacatagctgaactcttgatgcaggactgcaagaaactggagaagtacaagagacaaccaccagtagcgaatctgattaaccttaccgacgaagattggccggtgttgagtagcggcaccccaaacctgctcacaggagagatccctcctagcgtcgagacaccagcccagatagttgagaaattcactaggctgttgtattacggacgaaagaaagaggcactagaatgggcaatgaagaatcacctgtggggtcatgcacttttcctgagtagtaaaatggatccccagacgtattcatgggttatgtccggcttcacaagtacgttggcactcaacgaccccctacagaccttattccagctgatgagtggccgcatcccgcaggccgcaacttgctgcggcgagaagcagtggggagattggaggccccacttagctgtgatcctttccaatcaggccggcgatccagaactttaccagcgggcgatagtagctatcggcgatactctcgcagggaagggattggtggaggcggcccacttttgctacctcatggctcacgtgccctttgggcattatactgttaaaaccgaccacttggtgctgctgggatcatcacactcccaggagtttttgaagttcgccacaacagaagcaatccaacggacggagattttcgagtactgccagatgctcggtaggcccaaatcattcatcccctccttccaggtttataagctgctgtatgccagccggctggctgactacggacttgtcagccaggctctccactattgtgaagccattggagctgccgtcctgagtcaaggcgagtcctcgcaccctgtgctgctcgtggagcttatcaagttggccgagaagttgaaactcagtgatcctctagtcctggagagaaggtccggggatcgggatcttgagccggactggcttgcccaacttcggcgccagttggaacagaaggtggccggcgatatcggcgatccacaccctactcgatctgacatctcaggagccgggggcacaacaacggaaaatacattctatcaggacttttctggttgtcagggttactctgaggctcctggatatagatctgccctctggttaacccctgaacagacgtgccttcttcagccttccccccagcagccgtttcctctgcagcctgggagctaccccgccggcggcggagcagggcagactggcacaccgcggcctttttactcagtcccggagacccatcttccaggcaccgggtcctctgtcgctgtaacagaagccacaggtggcaccgtgtgggaggagatgctacaaacacacctcggccccggggagaatacagtgtctcaggaaacgtcacagccccctgacgggcaggaagtgattagcaaaccgcagaccccactcgcagcgcgacccaggtcgatctcagaaagtagtgccagttcagcaaaggaagatgaaaaggagtcatccgatgaggctgataaaaactcaccacgtaatacggctcagcggggcaaactgggggacgggaaagagcatacaaaatcttccggctttggctggttctcttggtttagatcaaagcctacgaaaaacgcctctcccgccggggacgaggattctagtgacagtcccgacagcgaagaaaccccccgggctagctctcctcatcaggccggcctcggcctgtccctgaccccaagtccagagtcccccccactgccagacgtgtcagcttttagccgggggagaggcggtggagaagggcgaggctccgcatcctccggtggtgccgccgccggggctggcgtcgggggtttgagcgggcccgagtccgtgtcattcgaactatgcagcaaccccggcgtgctgctgccaccccccgcgctcaagggcgctgttcccctgtataacccatcccaggtcccgcagctgcccactgccacaagtctgaacagaccaaacagattagcacagcgaaggtatcctacccagccctgttag

SEQ ID NO: 29207 - DNA, 2238 bp, Artificial Sequence
  Description of Artificial Sequence: Synthetic coding sequence
atggagctgtgggcaccccagcggctgccacagactaggggcaaggccacagcaccttccaaggatccggaccggggcttccgtagggatggccaccaccgcccagtaccccacagttggcacaacggtgaacgatttcaccagtggcaagacaatcgcggatcaccccagccgcaacaggaaccccgggcagaccaccagcaacagccccactatgcgtctagaccaggggactggcaccagcccgtgtccggcgtggactattacgagggaggttaccgcaatcagttgtacagcaggccagtactgagctctgggacccctaacctgctgaccggagagatcccccccagtgtagagacgccagcccaaatcgtggaaaagttcacaaggctcctctactatggtcgcaagaaagaagcgctcgagtgggctatgaagaaccatctatggggccacgctctgttcctatcctctaagatggacccacagacatacagctgggtgatgtcaggattcaccagcacattggccttgaacgaccccctccagactctcttccagttgatgtcgggccggatcccgcaggctgctacatgttgcggagaaaagcagtggggcgactggcgcccccacctcgcagtgatcctgagcaatcaagcaggcgatcctgagctctatcagcgtgctatagttgccatcggcgacaccctagctgggaaagggctcgtggaggcagctcacttttgctatctcatggcccacgtacccttcgggcactacactgtaaagaccgaccatctggtcctattgggatcttcgcatagccaagaattccttaaattcgccacaactgaagccatccagcgcacagagattttcgagtactgccagatgcttggtaggccaaaaagtttcataccttcctttcaggtgtacaaattgctctacgcatccagactcgctgactacggccttgtcagccaggcacttcattattgcgaggccattggggctgcagtgctgagtcagggagaatctagccaccctgtgctcctcgtggaactgatcaagctcgccgaaaagcttaaattgtcggatcctctggtcctggagcgacgcagtggagatagagatctggaacctgactggctcgcccagttaagaagacaacttgagcaaaaggtagccggagacatcggggatccccaccccacgcgttccgatatcagcggcgcaggagggacaaccaccgaaaacactttctaccaggatttttctggttgtcagggctactctgaagccccgggttatagaagcgccctctggcttacaccagagcagacttgcttactacaaccttctcctcagcagccattccccctgcagccaggaagctaccccgctgggggtggagcaggccaaacgggaacccctaggccattttactctgtgcctgagacacacctgcctggcaccggaagttctgtcgcggtgaccgaagctactggaggaactgtttgggaagagatgcttcagactcaccttggaccaggggagaatacagttagtcaggaaacgtcgcaaccgcccgacggacaggaggttatttcaaagccacagaccccattggctgcacgaccacgtagtataagcgagtcttcggcatcatctgcgaaggaggacgagaaggaatcctccgatgaagccgataaaaattcaccaagaaatactgcccaacgcgggaaacttggcgacggcaaggaacatacaaagagcagcggattcggatggttcagctggttcagaagtaagcccacaaagaacgcttctccagcgggggatgaagattcatcagacagcccagatagcgaacaggaaactccacgcgcttcaagtccacaccaggccggcctgggcctttcactgaccccttccccggagtctcccccactgccagatgtctccgccttttctagggggcgggggggcggagaggggagaggctcggctagctcaggcggcgccgccgcaggggccggggtgggtggactgagcggacccgagagtgtgagttttgagttgtgtagtaatccaggtgtgctgcttcccccgcccgctctgaagggggcagtcccattgtacaatccctcacaggtccctcagctgccaacggctacgagcctgaacagacctaatcgtcttgcccaacgccgataccccactcagccgtgctag

SEQ ID NO: 29208 - DNA, 456 bp, Artificial Sequence
  Description of Artificial Sequence: Synthetic coding sequence
atggctgctaccgcattgctcgaagcgggcctggctagagtgctcttctaccccacactcctctatacactattccgtggtaaagtccccggcagggcccaccgtgactggtatcacagaatagaccccaccgtacttcttggcgccctgccactccgctcattgaccaggcaggtaagcagagcaggagagcctgggccgcttcccagaccacgcagaagtgtgccggtgggtccattgggctctcccccttcactgctgtcgcacttgtttgcctcggccgcaggcactggtagggaacgggctagaggtgaccaccatgagagaggagtgagagatgaggtgcctgttcagctgtttaccggagcccagatggagagcagaggcggatgtaagagccaccgacaagaccccgtcatccacccacaccaagcgtggccggcaggttgctcgtag

SEQ ID NO: 29209 - DNA, 3459 bp, Artificial Sequence
  Description of Artificial Sequence: Synthetic coding sequence
atgatattctctgatatgaacactgtgtctgggtcaccaaaggtccatcctcccaacggcacccgattctacaccttccaagagtttgcagccctcaccaaagagttaaatgcttgcagggagcagttactcgagaaagaggaggagatatccgaactgaaggccgaacggaataacacacggctgctgttggaacatctagagtgcctggtgtcccggcatgagcgctcgctcaggatgaccgtggtaaagcgtcaggcccagagccctagcggtgtgagcagcgaggttgaagtgttaaaggctctcaagtctcttttcgaacatcacaaggctttggatgaaaaaattgtggcgctgagggagcaaaacgtacacatccagcgcaaaatggcaagtagtgaaggctctacagagtctgagcatctggagggaatggagcctggtcaaaaagtgcacgagaagcgcttgagtaatggaagtatcgacagtaccgatgagaccagtcagattgtggagctgcaggagctgctggaaaaacagaattatgaaatggcacagatgaaggaacggttggctgcactgagctcccgtgtcggcgaggtcgaacaagaagcagagaccgcaagaaaggacctcattaagactgaggaaatgaatacgaagtatcagagggacattcgggaggctatggctcaaaaggaggacatggaggagcggatcacaactctggaaaaaaggtacctaagtgcacagcgtgaaagcacctccatacacgacatgaatgacaaactggagaatgagttagccaacaaggaggcgatcctgcgccagatggaggaaaagaaccgtcagctgcaggaaaggctggagctcgccgagcaaaagttacagcaaaccatgagaaaggcggaaacactccctgaggttgaagcggaactcgcacagaggatcgcggctctcaccaaagcagaggaacgtcatggcaatatcgaggagcgaatgcggcacctcgagggacaactagaggaaaaaaaccaggaattgcagagggcccgccagcgtgaaaagatgaacgaagagcacaataagcggctgtcagataccgtcgaccggctcctgacagagtctaacgagagattacagctgcacctgaaggaacggatggccgccctggaagaaaagaatgtgcttattcaagagtccgagaccttccgcaagaatctggaggaatcactgcacgacaaggaacgcttggccgaggaaatcgaaaaactgcgatctgagctggaccagctgaaaatgcgcaccgggtctttgatcgaacctactatccccaggacacacctggatacttccgccgagttaaggtactctgtcgggtcactggtggactctcagtccgactaccgcactacgaaggtgattaggcgacctagacggggaaggatgggtgtgcgccgcgatgagcctaaagtcaagtcgctgggggatcacgaatggaaccggacccagcagatcggggtactatccagccacccctttgaaagtgacacggagatgtcagacattgacgacgatgatagggagaccatcttctcaagtatggacctgctgagcccctccggccacagtgatgcacaaacgctcgctatgatgctccaggagcaactggatgctatcaataaagagatcagactcatccaggaggaaaaggagtcaacggagttacgtgcagaggagatcgagaaccgtgtggctagtgtgtccctagagggtctaaatctcgcgagggttcacccgggaacgagcatcacggcatctgtcacagcttcttccttggcctcgagctctcccccttccggacacagtactccaaagctgacaccccgatcacctgcccgcgaaatggacagaatgggcgtgatgacgctgccctctgacctgcgtaagcatcgtaggaagatcgccgtcgtggaagaggacggccgtgaagacaaggcaaccatcaaatgcgagacttctcctcctcctaccccccgggcccttaggatgacccataccttaccatcaagctaccataacgatgccaggagcagcctctccgtcagcctcgaacccgagtctttagggttgggatctgcaaacagttcccaagattccctgcataaggccccaaagaagaaggggatcaagtcttccatcggacggttgttcgggaagaaggagaaggcaagacttggtcaactgcgcggctttatggagaccgaggctgccgcacaggagtcactgggactgggaaaactgggaacccaggcggagaaggacaggcggcttaaaaaaaaacacgagcttctcgaagaggcacgtcggaaaggcttacctttcgcccagtgggatgggcctaccgtcgtagcctggttagagctgtggctgggcatgcctgcttggtatgtggcagcttgcagggccaatgttaaatcaggggcgatcatgagcgctctgtcggatacagagattcaaagggagattggcatctcgaaccccctgcatagattgaagttaagactagccatccaagagatggtgagccttacttccccgtcagccccgcctaccagcagaacaccttcaggaaatgtgtgggtcacccacgaagagatggaaaacctcgcggcccccgcaaagactaaggagagcgaagagggtagctgggcacagacgctggcgtatggagacatgaaccacgaatggattggcaacgaatggcttcctagtttgggcctccctcaataccgatcgtattttatggaatgtctggtggacgcgcgcatgctggaccaccttaccaagaaggatctgcgcgtccatcttaagatggtggactcatttcatcggacatccttacagtatggcattatgtgcctcaagagactgaactatgaccgcaaggagctggaacgccgtagggaagcatcacagcatgagatcaaggatgtgctggtatggagcaacgatcgcgtaataagatggattcaagctattggcctgcgcgagtatgctaataatattcttgagagtggcgtccacggttccctgatcgcattagacgagaacttcgactactcgagtctggctttactgttgcagatccctactcagaacacccaggcccgccagatccttgagagagaatataacaatctgctagcgctagggacggagcgccgcttggatgaaagcgacgataaaaattttcggcggggctcaacctggagacgtcagtttccaccacgggaagtacacggcatctctatgatgcccggctccagtgagacactcccggcgggtttccggctcactaccacctccgggcagagcagaaagatgactacggacgtggccagtagcagattgcagcgcctcgacaattctactgtacgtacatactcttgctag

SEQ ID NO: 29210 - DNA, 2352 bp, Artificial Sequence
  Description of Artificial Sequence: Synthetic coding sequence
atgcgccacttagaggggcagctggaggagaagaatcaagagctgcagagggctaggcagagagaaaagatgaatgaagaacacaacaaacggcttagtgacaccgtagatcgacttctcacagaaagcaatgagagattgcagctccatttgaaagaacggatggcagcgctggaggagaaaaacgtcctgatccaggaatcagagacgttcaggaagaatctggaggaatcactccacgataaggaaaggttggcagaggaaatcgagaagctgagaagcgaactcgatcagttaaagatgcggacagggtcccttatcgagcccactatccccagaacacacctggatacctctgccgagttgagatacagcgtcggcagtctcgtcgattcccagtcggattatcgtaccacaaaggtcattaggcggccccgccgcgggaggatgggggtgcgcagagacgaacccaaggtaaaatcgctgggcgaccacgaatggaaccgaacccagcagatcggcgtccttagctcccacccctttgaaagtgatacggaaatgtcggacatcgatgatgacgacagagaaaccatcttttcttccatggacttgctgtcccctagtggccacagtgatgcccagacccttgccatgatgctccaggagcagttagatgctatcaataaagagatacgcctgattcaagaagagaaagagtcaaccgagttacgcgccgaggagattgagaatcgcgtcgcctcggtttccctggagggactgaatcttgcgcgtgtccaccccgggacgtccatcactgcaagcgtgacggcaagctcgttagccagctcttctccccccagtggtcactcgacaccaaaactgacgccccggtctcctgctcgagaaatggatagaatgggcgtcatgacactgccctcagacctgagaaaacacaggaggaagatagctgtcgtcgaggaggacggtcgggaagacaaagcgacgataaagtgtgaaacttcaccacctcccaccccacgggcactgcggatgacacacactttaccctcgtcataccacaatgatgcgcgttccagcttgagcgtaagccttgaacctgagtcgttaggcttagggagcgccaactcttcgcaagacagcctgcacaaagccccaaaaaaaaaaggcataaaatcatctatcgggagactctttggcaagaaagaaaaggctcgactagggcaacttagaggcttcatggagacagaggccgccgctcaagagtcactcgggcttggtaaactggggactcaggccgagaaggataggaggcttaagaagaaacatgagttgttagaagaggcccgtcgcaaggggctgccatttgctcagtgggatggccctaccgtcgtggcgtggctcgaactgtggctgggaatgccagcctggtacgtggccgcctgtagagcgaacgtgaagagtggcgccattatgagcgcccttagcgacactgagatccagcgtgaaatcggcatctctaatccactgcaccggctgaagctccgtttagctatccaagagatggtgtctctcacttcaccctccgcacccccaacctcgcggacatgcccggtgtttcttcagactctggcgtacggcgacatgaaccacgagtggattggcaatgagtggctcccttctctgggccttccacagtaccgatcatactttatggaatgcctcgtagacgccaggatgctcgaccacctcaccaaaaaggacctgcgagttcacctgaagatggtggactccttccacaggacaagcctgcagtacggaatcatgtgtctcaagcgattgaattacgacagaaaagagctggagcggcgccgcgaagctagccagcacgaaattaaggacgtgttggtgtggtccaatgatagggttattcggtggatccaggcaattggactgcgcgaatatgccaataacattttggagtccggcgtccacgggtctcttattgcccttgacgaaaacttcgactactctagcctggctttgctgctgcagataccaacgcagaacacacaagctagacagatcctcgagcgggaatataataacctgctggcgctaggcacagagagacgtctggatgaatccgacgacaagaacttccgtcgcggatcgacatggcggagacaattcccccctagggaagtccacggaatctcaatgatgccagggtcatctgaaaccctcccagccggtttccgcttaaccaccacctctggtcaaagcagaaaaatgactaccgacgacggggtattctccgtttactctacctag

SEQ ID NO: 29211 - DNA, 3756 bp, Artificial Sequence
  Description of Artificial Sequence: Synthetic coding sequence
atgatgtgtgaagttatgccaacgatcaacgaggacactccaatgagccagagagggtcacagtcctcgggtagcgatagtgatagtcatttcgaacagttgatggtgaacatgctggacgagcgagatcgtctcttagacacgctgagagagacgcaggaaagtctttctctggctcagcagagactccaggacgtgatatacgatagggactctctccagaggcagctgaactctgctctccctcaggacattgagtcattgacaggaggactggccgggtccaaaggcgccgaccctcccgagtttgccgccctaaccaaggaactgaacgcatgtagagagcagctcctcgaaaaggaagaagaaatttctgaattgaaggcggaacgaaacaatacacggctcctcctagagcacctggaatgtcttgtgagccgacatgagagaagtctgagaatgaccgtggtgaaaagacaagcacagagtccctctggggtcagctcagaagtcgaggttctgaaggctctgaagtcccttttcgaacatcataaagcattggacgagaaggtaagagagaggctgagagtgtcgctggaaagggtttctgccttagaggaagagctggccgctgctaatcaagagatcgttgctctccgggagcagaacgtgcatattcagcgtaaaatggcaagtagcgaagggtcaaccgagtcagaacacctggagggaatggagccaggacagaaagtgcacgagaagagattgagcaatggtagtatagactccaccgatgagacgagtcagatcgtcgagctgcaagaacttttagaaaagcaaaactacgagatggcccagatgaaggagcgccttgcagctttgagtagtagagtgggcgaggtggaacaggaagcagaaacagctcgcaaagatctaattaaaactgaggaaatgaataccaaatatcaacgtgatattagagaagccatggctcagaaagaagacatggaagaaagaataaccaccttagaaaagcggtacctaagcgcccagcgggagtcaaccagcattcatgacatgaacgataaactcgagaacgaattggctaacaaagaagccattctgaggcagatggaggaaaaaaatcggcagctgcaggagaggctggagctggccgagcagaaactgcagcagaccatgcgaaaagccgagacattgcctgaggttgaggcagagctggcgcagcgaattgcggcccttacaaaagctgaggagcgccatggcaacattgaggaacgcatgagacacttggaggggcagttggaggagaagaatcaggagctccaaagggccagacagagagagaagatgaatgaggaacataataaacgccttagtgatactgtagacagactcctgacggagagcaacgagcggctgcagctgcacctaaaggaacgaatggctgccttagaggaaaaaaacgtgcttattcaggaaagcgagactttccgaaagaatctagaagagagcctccatgacaaggagcggctggcagaggagattgagaaactgcgttctgagctcgatcagctgaaaatgaggacaggttccctgatagagccaaccattccccggacgcatcttgacacgtctgctgaacttcgctattctgtgggttccctggtcgactctcaatctgactaccggacgaccaaggttattcgaaggccgaggcgtgggagaatgggcgtgaggcgggatgagccaaaggtgaagagcctcggtgatcatgaatggaatcgaacccaacagattggcgtgctttccagtcacccttttgagagcgataccgagatgtcagacattgatgatgacgaccgcgaaactatctttagctctatggatctgctttctccatccggacatagtgatgcccagaccttggctatgatgctgcaggaacagctagacgcaattaataaggagatccgcctcattcaggaagagaaagagagtaccgagttacgcgcagaggagatcgaaaatcgggtggcaagtgtctcactcgagggtttgaacctcgcccgcgtgcaccccgggaccagcattaccgccagtgtgaccgcaagctcactcgcttcttccagccctccgagcgggcattcgacccctaagttaacaccaaggtcacccgcacgcgaaatggaccggatgggagtgatgacgctgccaagtgatctcaggaagcaccggcggaaaattgctgtggtggaagaagatgggcgcgaggacaaagccaccattaagtgtgagacttccccaccccccacacctagagcactacgcatgacccacactttgccctcaagttaccataatgacgcgcgcagctctctgagtgtgagcctggagccagaaagtctgggtctgggttctgcaaactcatcccaggactcactgcacaaagctcccaagaaaaagggcattaagtcatctatcggtagattgttcggaaagaaggagaaggcacgactcgggcagttgaggggctttatggaaactgaagctgccgcccaagaatcactgggtctgggaaaacttggcactcaggctgagaaagatcgcagactgaaaaagaaacatgagctcttggaggaggcccgtcgaaaggggcttccctttgcccaatgggatggaccaacagtggttgcctggctggagttatggttaggcatgccagcctggtatgtcgcggcatgcagggctaacgtgaaaagcggggccattatgtcagcactgagcgacactgaaattcagcgagagatagggattagtaacccactgcatcgcttgaaactgaggctcgcaatacaggagatggtgtctttaaccagcccctcagccccaccaacgagccggacaccctccggaaacgtatgggttactcatgaagaaatggaaaatcttgccgccccagccaaaactaaagagtcagaggaaggctcctgggcacaaactctggcctacggggacatgaatcacgagtggattggaaacgaatggctcccctcattggggttaccacaataccggtcttatttcatggagtgtctcgtggatgctaggatgctcgaccaccttacaaagaaagatctgcgagtacacctgaaaatggtcgattcctttcaccgtaccagcctacaatacggcatcatgtgtctcaagcgactgaattatgaccgtaaagaactggaaagaagaagagaggcgagccagcatgaaatcaaagatgttctggtatggagcaatgatcgcgttatcagatggatacaggccattggtctccgggaatatgccaataacatcctggagagcggggtccatggctcactaatcgctcttgacgagaattttgattattcctccctggcccttcttctgcagatccccacgcagaatactcaagcacgtcagatactagaacgagaatacaataatctcctggctcttgggacagagaggcgactggacgagtctgacgacaagaatttcaggaggggatctacgtggcggagacagtttccgcccagagaggtacacgggatttctatgatgcccggctctagtgaaacgctacctgctggttttcgcctgacgactacgtccgggcagtccaggaaaatgactaccgatgtggccagttctcggctgcaaaggctggacaattctacagttagaacctattcttgttag

SEQ ID NO: 29212 - DNA, 3699 bp, Artificial Sequence
  Description of Artificial Sequence: Synthetic coding sequence
atgatgtgcgaggtgatgcccaccattaatgaagatacacctatgtcacagcgtgggtcccagtcttccggcagcgattcagactcgcattttgaacaactgatggtcaacatgctcgatgagcgtgatcgtctactcgatacgctcagggaaacccaggagtccctaagcctagctcaacagcgcctccaggacgttatctacgaccgcgattctctgcagcggcagctgaactccgcactccctcaagagttcgctgccctgacaaaagagctcaatgcttgtcgagaacaactccttgagaaggaggaggagatttccgagctgaaagctgagagaaacaatactcggctcttgctggagcacttagaatgtcttgtcagtcgccacgaaagatctctgcgtatgacagtagtcaagcgtcaggctcagagccctagtggggtgtcctccgaggtggaggtgctgaaagccttgaaatcactcttcgaacatcataaggctctagatgaaaaggtacgggaaaggctcagggtcagccttgagagagtgtcagcccttgaggaggagctggccgctgccaaccaagagatagtcgctttaagagagcaaaacgtgcacatccagcgtaagatggcctcctcagaagggtcaacggagagtgagcacttggaaggtatggaacctggccagaaggtacacgagaaacggttgagtaatggctccatcgactccaccgatgagacttcacagattgtggaacttcaggagctccttgaaaaacagaactatgagatggcccagatgaaggaacggctggccgccctaagctcaagagtcggggaggtcgagcaagaggcggaaactgccaggaaggacttgatcaagaccgaggaaatgaatacgaagtatcagagagatatacgcgaggccatggcccagaaggaagacatggaagagcgcatcactaccctagagaaaagatatctatccgcacaacgcgagagtacctcaattcacgatatgaatgacaagctggagaacgagctagctaacaaagaggcaattctgcgccagatggaggagaagaatcgacagctgcaggagagactcgagctggcggaacagaagctgcagcaaactatgcggaaggctgagaccctgcctgaggtcgaggctgagttagcacagcgcattgccgcgttgacaaaagccgaggagcggcacggtaacatcgaggagaggatgcgccatcttgaaggccagctggaggaaaagaaccaagagcttcaacgagccaggcagagggagaagatgaatgaagagcataacaagagattgagtgacactgtggaccggcttctaaccgaatccaatgagaggctgcagctccatctgaaagaacgcatggccgcattggaggaaaagaatgttcttatccaggagagcgagacatttagaaaaaatctggaagaaagtctccacgataaggagagactggccgaggagatcgaaaagttacggagtgagttggatcagctcaagatgcggacaggcagtctaatcgagccaacaataccaagaactcatttggatacttccgctgaacttagatattccgtcggctccctggtcgattcccagagtgactaccgtacaactaaggtgattcgacgcccgcgcagaggccgcatgggagtgaggcgtgatgagcccaaggtgaagagtttgggcgaccacgagtggaataggacacagcagataggcgtactatcctctcatccctttgagtctgataccgaaatgtctgacatagatgacgatgatagggaaacaatattttcgtcaatggaccttctttctccctcgggacactctgatgcgcagacactggctatgatgttacaggagcaactggacgccataaataaggagatacggttaattcaggaggagaaggagagcacagagctgagagccgaagagattgaaaatagggtggctagcgtttcattggaagggctcaatttggctcgggtgcatccaggcacaagcatcacagctagcgtcaccgcttcctcgctggcgagcagctcaccaccttctgggcacagtacacccaagttaaccccgcgcagtcctgcccgcgagatggaccgcatgggtgtgatgacactgccatctgacctcaggaagcacaggcggaaaattgcagtggtcgaagaggacggtcgcgaagataaggccaccataaaatgcgagacatctccgccccccaccccccgcgcccttcggatgacccataccctgccttctagttaccacaacgatgctaggagctcgctgtcagtatccctagagccagagagtctagggttggggagtgcaaactcaagtcaggactcactccataaagctccaaagaagaaagggatcaagagttccatagggcgcctctttggcaaaaaagagaaagcccgcctcgggcagctacgaggcttcatggagacggaggccgccgcacaggaatccctcgggctgggcaagttggggacccaggccgagaaagacaggaggctgaaaaaaaacaccagtggccacgaactgctcgaagaggcgcggagaaaagggttacccttcgcacagtgggacggccccactgtggtcgcctggttggagctttggctgggcatgccagcctggtatgtggctgcttgccgggcgaatgtcaaatcaggggccataatgagcgccctgtctgataccgagattcaacgcgagattggaatctcaaatccactccacagactgaaactgcggctggccattcaggagatggtgtcgctgaccagccctagcgccccacccacctccagaactcctagcgggaacgtgtgggtgacccatgaagaaatggagaatctggcggctcccgctaagaccaaagagtccgaggagggatcgtgggctcagtgccccgtgttcctgcaaactctcgcctacggtgatatgaatcacgagtggataggtaatgaatggctgccttcactaggactgccgcagtatcgcagctacttcatggagtgtctcgtcgatgccagaatgctggatcacttgacgaagaaagatcttcgtgttcacctgaagatggtggactctttccatcgtactagtttacagtatgggataatgtgtctgaagaggctcaactacgaccgaaaggagttagagcgcagacgggaagcaagccagcacgagatcaaggatgtgctggtctggtccaacgatcgggtcattcgttggattcaggcaattggactccgggagtatgcaaacaatatcctagagagtggagtccatggttctctgatcgctctcgatgagaatttcgactacagctctctggcccttctcctccagatccctacccagaacacccaggccagacagatcctcgaacgggaatataataatctcctggccttagggacggagcggcggcttgatgagtccgacgataagaacttcaggcgaggatctacttggcgccgacagttcccaccacgcgaggtacatggcataagtatgatgcctggatcctctgaaaccttgccagcaggtttcaggctcacgaccacctccgggcagagccgaaaaatgaccactgatgacggcgtgttctccgtgtacagtacctag

SEQ ID NO: 29213 - DNA, 3633 bp, Artificial Sequence
  Description of Artificial Sequence: Synthetic coding sequence
atgatgtgcgaagtgatgccgacaattaacgaggatacacctatgtctcagaggggttcacaatccagcgggagcgattcagattcgcactttgaacagcttatggttaatatgttagatgagcgcgatagactgctcgatacactgagggagacacaagaatcacttagcttggcccaacagcgcctgcaggacgtgatatatgacagggacagccttcagaggcagctcaatagcgccctccctcaagatatcgagtcgttaactggagggctcgccggttccaagggcgcagatccgccagaattcgcagcgttgaccaaagaactgaacgcttgtcgagagcagttactcgaaaaggaggaagaaatatcggagctgaaagccgaacgcaacaacacacggcttctccttgaacacctggagtgcttggtaagccggcacgagcgcagcttgaggatgacagtggttaagcggcaggcacagtccccgtcaggtgtgtcatctgaagtagaggtgctgaaagccctgaaaagtttgtttgaacatcataaagctctggatgagaaagttcgcgagagacttcgtgtctctcttgaacgggtgagcgcactcgaggaagagttagccgccgccaatcaggaaatcgtggccttgcgtgaacagaatgtgcacattcagaggaagatggcatcgtcagagggctcaacagaaagtgaacacttggaagggatggaaccaggacagaaggtgcacgagaagagactctctaatggctcaattgatagcaccgatgagacttcacagatcgtagaactacaggagctgctggagaagcaaaactacgaaatggcccagatgaaagagagattagcagcgctgtcctctcgcgttggtgaggttgaacaggaggccgaaactgctcgaaaggacctgattaagaccgaggagatgaacactaagtaccagcgggacattagggaggccatggcccaaaaggaggacatggaagaaagaatcacaacactggagaaacgctacctttcagcccagcgtgagagtaccagtatccatgatatgaatgataagttagagaacgagctggccaataaggaggccatcctcagacaaatggaggagaaaaaccgacagctgcaggagagactagagcttgccgaacagaagctgcagcagaccatgagaaaggccgaaacactgcctgaggtcgaggctgagctggctcaaagaatcgcagctttgacaaaggctgaggagaggcacggcaacatcgaggagaggatgagacacctggaaggccagttggaagagaagaatcaggaattgcagagggctcggcagcgggagaagatgaatgaagaacataataaacggctgagcgacaccgtcgatcggctgttgacggagagcaatgaacgcctgcagcttcaccttaaagaacgcatggccgcactggaggaaaagaacgtgcttattcaggagtccgaaacgtttcgaaaaaatcttgaagagagtcttcatgataaggaaagacttgcagaggagatcgagaaactgcgctcagaactggaccagctcaaaatgcgcaccggtagtctaattgaacctacaattcctcggactcacctagatacctccgcggagcttcgctattcggttggatcactggtggatagccagagcgattaccgcaccacaaaagtaattagacgaccaagaagggggaggatgggggtgcggcgcgacgagccaaaggtgaagagcctgggtgatcatgagtggaatcggacccagcaaatcggtgttcttagcagccaccccttcgagtctgatacagaaatgtctgacatcgacgatgatgatagagagaccatcttctctagtatggatctcctctctccgtctgggcattctgatgcacagacactcgctatgatgctccaggagcagttggatgccattaataaggagatccggctcatccaggaagagaaagagagcacagagctgcgcgctgaagagatcgagaaccgggtcgcaagcgtttccctggaagggcttaacttggccagagtacacccaggaacgtcaattaccgccagcgtcacagcttcaagtctcgcctcttcatctccaccaagcggacatagcacccctaaacttactccacggtccccggccagggagatggatcgcatgggcgtgatgactctgcccagtgatctgcgtaaacacaggcggaaaattgccgtcgtggaggaagacgggagggaggacaaagccactatcaaatgcgaaaccagccccccacccacacccagggctctccgaatgactcacactctgccctcatcttatcataacgacgcccggtcctccctgagcgtgtccctcgaacctgaatcgctcgggcttgggagtgccaacagcagtcaggactcattgcacaaggctcccaagaaaaaaggtatcaaatcctctatcggtcggctgttcggaaagaaggagaaggcccggctgggacaactcaggggtttcatggagaccgaggccgccgctcaggaatccctgggattggggaaactcggcacacaggccgaaaaagacagacgcctgaagaagaaacacgagttgctcgaggaagcacggaggaaaggcctcccgttcgcacagtgggatggacccaccgtggttgcctggttagagctttggctggggatgcctgcttggtatgtggccgcttgcagagccaatgtcaaaagcggggctattatgagtgccctgagcgacactgagattcagagagaaattggtatctcgaatcccctccaccgtctgaaacttcgcctggctatccaggaaatggtatcactcacgagcccatcagcaccccctacctcacggacaccttctgggaacgtctgggtgacccacgaggagatggaaaacctcgctgcacccgctaagaccaaagaatcggaggagggttcatgggcccaatgcccagttttcctgcagacacttgcctatggggacatgaatcacgaatggattggaaatgaatggctgccttctttggggctaccgcagtatcgctcatacttcatggaatgcttggttgatgctagaatgcttgatcacctgaccaagaaggatttacgggtccacctgaagatggtcgactctttccaccggaccagcctgcaatacggcataatgtgtcttaaacgcttaaactatgaccgcaaggagctcgagcgtcggagagaagcgagccaacacgagatcaaagacgtcctggtttggagcaacgaccgcgtcattaggtggattcaggccatcggactcagggagtatgccaataacatcctcgaatctggggtccacggctcgctaatcgctctggacgaaaatttcgactacagtagtttggccctattgctccagatacccactcagaacacacaggctagccgctttcttaaagagaataccattactagctggccctgggaactgaaaggcgactggatgaaggtgatgactcgcacctcagacgtggatcagcctggagagggttcattcttgctggtgaagtatatggagagcgcgtag

SEQ ID NO: 29214 - DNA, 3711 bp, Artificial Sequence
  Description of Artificial Sequence: Synthetic coding sequence
atgatgtgtgaagtgatgcccacaataaacgaggacacaccgatgagccagcgagggtcgcaatcttctggctccgattccgattcacacttcgaacagttgatggttaatatgctcgacgaacgcgaccgcctgttagacactttgcgcgaaacacaggagtctctgtccctagcacagcagaggttacaggatgtcatatatgatagggacagcctccagcggcaactcaatagcgccctccctcaggacatagagtcactgaccggtggtctggccggatccaagggtgccgacccgccagagtttgccgccttaaccaaggagctaaatgcctgccgagagcagttactggaaaaagaagaagagatctcggagttgaaggcggagaggaacaatacacgcctcctactggagcatctggagtgcctggtctcaaggcacgaacggagcctgagaatgacggtggtcaagaggcaggcccagtctccttcaggcgtctcaagtgaggtggaagtgcttaaagccctgaaatctcttttcgagcaccataaagccctagacgagaaggttcgcgagaggctgagagtatctctcgaaagagtatctgctcttgaggaagaactggccgcagcaaaccaggaaattgtggctctgagggagcagaacgtccacattcaacggaagatggcctcctctgagggctcaactgaatctgaacatctggagggaatggagcctggtcagaaggtgcacgagaagaggctctctaatgggtctatcgattccaccgatgagacatcccagatagttgaactgcaggaactactggagaagcagaactatgagatggctcagatgaaggaacgactcgccgccctaagctcgagggtgggcgaggtcgagcaggaagctgaaacagcgcggaaagaccttattaagacggaggagatgaataccaagtaccagcgcgatattagagaggctatggctcagaaggaggacatggaggagcggatcaccactctggagaagcggtacctgtctgctcagcgcgagtctacatccatacacgacatgaacgacaaactcgaaaatgagctggcaaacaaagaggctatcctgcggcaaatggaggagaaaaaccgtcagctgcaggagcgcctggaacttgccgagcagaaacttcagcagaccatgcggaaggccgagaccctgcccgaggtcgaggccgagctggcccagcgcatcgcggccctgacaaaggccgaagaacgccacggcaatattgaggaacgcatgcggcacctggaaggacagctggaagagaagaatcaggaactccagcgggccaggcagcgggaaaaaatgaatgaggaacacaataagcggttgtccgataccgtggatagacttttaactgaatccaatgagcgcttacagttacatctaaaagaaagaatggccgcccttgaggagaagaatgttttgattcaagagtccgagacatttagaaagaacttggaggagtcactgcacgacaaggagcgcctcgcagaagagattgagaagttaaggtccgaattggaccagctcaagatgcggaccggatcactgatcgagcccaccatacctcgaacacacctggacacaagcgccgaactcaggtacagtgttgggtcactggtggactcccaatccgattaccgtacaacaaaggtgattcggaggccacgcagggggcgtatgggcgtccgcagagacgaaccaaaggttaagtctctgggggaccacgagtggaatagaactcagcagatcggtgtgctctcgtcacacccctttgagtccgacactgagatgtcagatatcgatgatgacgatcgggagacgatcttctctagtatggacctgttgtctccgagcggacacagtgacgcccagacgctggctatgatgctgcaggagcagctcgacgctatcaacaaagagattaggctgatccaggaggaaaaagaatcgacggagctgcgagcggaggagatagagaatagagtggccagcgttagtcttgaaggactgaatctggcccgggtgcacccaggcaccagcattaccgcctctgtgacggcatcgagcttagcctcctcatcaccacccagtgggcattctacccccaaactgaccccacgctcccctgcgagggaaatggaccgcatgggggtaatgactcttccctcagacctacggaagcaccggaggaagattgccgtagttgaagaggatgggagggaagacaaagctacgatcaagtgtgaaacatcgcccccccccactccacgtgccctccgcatgacccatacgctgccaagctcttatcacaatgatgctcggtccagtctgagcgtgtcactggagccagaatctctgggactgggtagtgccaatagctcccaggactctttgcacaaagctccaaaaaaaaaaggcatcaaatcatcaatcggacgattgtttggtaagaaggagaaagcccgccttgggcagctgcgcggctttatggaaaccgaagcagcagctcaagagagcctggggcttgggaaactaggcacgcaagctgaaaaagatcgtagacttaagaagaagcacgagttgctggaagaggccaggcgtaaggggctgccctttgcgcagtgggacggccccacggtcgtggcctggctcgaactatggctggggatgccagcctggtatgtggctgcgtgccgggctaacgtgaagtctggcgcgattatgtctgccctgagcgacacagagatccagcgggagattggcatctccaatccactgcacaggctcaagttgagattggctatccaggaaatggtgtctcttacctcaccttcagcccctccaacctcgcgcactaaggagtcagaggaaggctcttgggcccagtgccccgttttcttgcagacattagcatacggggacatgaaccacgaatggatcggtaatgaatggctgcccagcctggggctgccgcagtatagatcttacttcatggagtgcctggtcgacgcacgcatgttggaccacctaaccaaaaaagatctcagagtccaccttaagatggtcgattccttccaccgaaccagccttcagtatggaatcatgtgcctgaagaggctgaattatgataggaaggaactagaaaggcgacgcgaagctagccagcacgagattaaagatgtgctggtgtggagcaatgatagagtgatccggtggatccaagccattgggctgcgcgaatatgccaataatattctggaatctggcgtgcatggcagtttgattgcactcgatgagaacttcgattactcctcactcgcacttttgttgcagatccccactcagaacactcaggcccggcagattctggagcgcgagtataataacctgctggcacttggaacggaacgtcggttagacgagagcgatgataagaactttcggagagggagcacatggcgtcgccagtttccacccagggaggtgcacgggatcagcatgatgcccggatcttcagaaacacttccggccggtttccgtttaactaccacgtcaggtcagtcccggaaaatgactacagacgtggctagcagcaggctccaaagactggataatagcacggtgaggacttacagttgctag

SEQ ID NO: 29215 - DNA, 1638 bp, Artificial Sequence
  Description of Artificial Sequence: Synthetic coding sequence
atgcaatctatctctaaacaaactctgcagatggacgtcaataagcttaacatcactcttctacgcatctttcgccagggtgttgctgccgcactggggctgctgcctcagcaagtgcacattaatcgcttgataggcaaaaaaaactcgatagaacttttcgttagcccaatcaatcgcaagaccggtatttccgacgctctgcctagcgaggaggttctgcgaagcctgaatattaatgtcctccatcagtccctgtctcagtttggcattacagaggtgagccccgaaaagaatgtcttgcaaggacagcacgaggcagacaagatatggagtaaggaaggtttctatgcggttgtgatttttttgtccatattcgtaatcattgtgacttgcctgatgatcctctacaggctgaaggaacgatttcaactgtcactccgtcaggataaagagaaaaaccaagaaatccacctgtcaccaattactctccagccagcattaagtgaagccaagactgttcattctatggtgcagccagaacaggcaccaaaggttctgaatgtggtcgtggatccacaggggaggggcgcccccgagataaaggccacaaccgcgacatccgtctgcccttcccctttcaagatgaagcctataggcctacaggaaaggagaggctctaatgtgtctctcaccctggacatgagctctctcggaaacatcgagcccttcgtgagcatccccacacccagggagaaggtggcgatggagtacctgcagagtgccagtcgaatcctgacacggagtcagctgcgagacgtggttgcaagtagccacctcctgcagtctgagtttatggaaattcctatgaatttcgtggatccaaaggaaatcgacattccacgccatggcacaaagaaccgatataaaaccattctccccaatcctctgtccagggtctgcctgagacctaaaaatgtgaccgatagcctgtctacatacattaatgccaattatattagagggtattcgggcaaggagaaggccttcatcgcgacccagggacctatgattaacacagtggatgacttctggcagatggtttggcaagaggacagtcctgtcattgtgatgatcaccaagctcaaagagaagaacgagaaatgtgtgctatactggcccgaaaaaagggggatatacggcaaagtcgaggtgctggtaattagtgtcaatgaatgcgataattatactatacgcaacctggttttgaagcagggcagtcacactcagcacgtcaaacactattggtacacatcctggccggaccacaagacccccgattcggcgcagcccttgctgcagttgatgttagacgtcgaggaagataggttggccagtcagggccgcggacctgtcgtggttcattgtagcgccggaatcggaaggacaggctgctttatagcaacttcaatcggttgccagcaactgaaggaagagggagtggtggacgccctttccatcgtatgtcagttgcgtatggaccgcggcggcatggtccagacatccgaacaatatgaattcgtacatcacgctttgtgtttatacgaatccagactttccgccgagaccgtgcagtag

SEQ ID NO: 29216 - DNA, 606 bp, Artificial Sequence
  Description of Artificial Sequence: Synthetic coding sequence
atggctgccactgctttactggaggccgggttggcacgcgtacttttttacccaaccctgctgtacacactgtttcgaggaaaggtgccaggtagagctcacagagattggtatcatagaattgaccctactgtacttttgggagccctgcctttaagaagcctaactcggcaactggtgcaggatgaaaacgtccgaggtgtgatcacaatgaacgaggaatacgaaactcgttttctgtgtaattcttctcaggagtggaagcggctaggcgttgagcaacttcgcctgagtaccgtagatatgaccggaattcctacactcgataatcttcagaagggtgtgcagttcgcattaaagtatcagtcgctcggacagtgtgtgtacgtgcactgtaaggccgggagaagcagatcagctactatggtggccgcttacctgatacaggtccacaaatggagccctgaagaagcagttcgcgcaatcgcaaagattagaagctatattcacataaggccaggtcagctggatgtccttaaagagtttcataagcagatcacggcccgggctactaaggacgggacctttgttatcagtaagacttag

SEQ ID NO: 29217 - DNA, 2280 bp, Artificial Sequence
  Description of Artificial Sequence: Synthetic coding sequence
atggcaggaagcaaacaatcacaccaggaagccgtaaagagacacttatattttttgcagctgaaaatggacatctgtgaaggtcggcttacctgccccctgaattctgcagtggttttagcttcttatgctgtgcagtctcacttcggtgattacaacagttcaatccaccatcctgggtacctcagcgattcccactttatccccgatcagaacgaggacttcctgaccaaagtggagtccctccacgaacaacacagtggcttgaaacagtccgaagcggaatcctgctacatcaatatcgctcggactctggatttctacggggtcgagctgcatagcggccgggacctccacaacctcgaccttatgatcggtatcgcaagcgcaggcgtagccgtgtataggaaatacatttgcaccagtttttacccctgggtgaacatactgaagatttcatttaaacggaagaaatttttcatccatcagagacagaaacaggccgaaagcagagaacacattgttgcctttaatatgctgaattaccggagctgcaaaaacctgtggaagagctgtgtggaacaccatacatttttccaggcaaaaaaactcctcccccaagagaagaacgtactgagtcagtactggactatggggtccaggaacacaaagaaaagaagcccccggctccgacatgagatcaggaaacctaggcattcttcagccgataacttagccaatgagatgacatacattacagagactgaagacgtgttttatacctacaagggaagcctggcccctcaggattctgactccgaggtgtcccaaaatagatcaccgcaccaggagagtctcagcgagaataaccccgcccaaagttatctgacccaaaaatcgagcagctcagtcagtccatcttccaacgcgccgggcagctgtagcccagatggggtggatcagcagctactggatgattttcatcgcgtgacgaaagggggtagtaccgaagacgcctcgcagtattactgtgacaagaacgataatggggatagttacttggtcctgatacgaattaccccggacgaggatggaaaattcggcttcaatctgaaggggggagtggaccagaagatgcccctggttgtgtcccgcatcaatcccgagtcaccggcagacacttgcatcccaaagctgaatgaaggagaccagatcgtgcttatcaacggccgggatatcagcgaacatacacatgaccaggtggtaatgtttattaaagcgagccgcgagagccatagtagggagttagcactagtgattcggagaagggcggtcagaagtttcgcagattttaagtcagaggatgagcttaatcaactgtttccggaagccatttttcccatgtgccctgaaggtggagacactctggaggggtccatggcccagttgaagaaaggtttagagtccggtactgtgctaatccagtttgaacagctgtaccgcaaaaaaccgggccttgccattacctttgccaagcttccgcagaatctggacaagaatcgctacaaagatgtactgccatatgacactacgcgggtcctgctgcaaggcaacgaagactacatcaatgctagttatgtcaacatggagatccccgccgctaaccttgttaacaagtacatagccacccaaggacctctgccgcatacatgcgctcaattctggcaagttgtctgggaccagaagttgagccttattgtgatgctcactaccctcactgagaggggccgaaccaagtgccatcagtattggccagatccacctgatgtgatgaatcatggaggattccacatacagtgtcagtccgaggattgtacgatcgcatatgtgtctcgagagatgctggttaccaacactcagactggcgaagagcatactgtcacacacctccagtacgttgcctggcccgatcacggggtgcctgacgactcaagcgattttctcgaatttgtaaactacgtacgctccctgcgcgtcgatagtgagccggtgctggtccactgctcagctggcatcggaagaacaggggtgctggtgacgatggagactgctatgtgcctgacagaacgcaacctgcctatctaccctctcgatatcgtgcggaagatgcgggaccagcgtgccatgatggtgcagacatccagtcaatacaagttcgtgtgcgaagcgatactaagagtctacgaggaaggccttgttcagatgctcgatcccagctag

SEQ ID NO: 29218 - DNA, 2742 bp, Artificial Sequence
  Description of Artificial Sequence: Synthetic coding sequence
atgacgtctcgcctgagagcgctaggaggaagaattaataacatcaggacttcagaactgcccaaagagaaaacacgctcagaagtcatctgcagtatacatttcctggacggagtggtgcaaactttcaaagtgacgaaacaggacacggggcaagtcttgctcgacatggttcacaatcacctcggcgtgacagagaaggaatactttggtcttcagcacgatgatgattcagtagacagtcctcggtggctcgaagcctcaaaggccatacgtaagcaactcaagggtggctttccctgtactctgcatttcagggtccgatttttcattcccgatccgaataccttacaacaagagcagacacgacacctgtactttttgcaacttaaaatggatatatgcgaaggcagactgacttgccccctgaactctgctgtcgtgctggcaagttatgccgttcagagccatttcggtgattataactcatccatccaccatccaggttacctgtctgatagccactttatccccgaccagaacgaggacttcctcactaaagtggagtctttacatgagcagcacagtgggcttaagcagtcagaagccgaatcgtgttacatcaacatcgccaggacactcgatttttacggcgtggagctccactcggggagagacctgcacaatttggaccttatgataggcatagcctcagccggcgtcgcggtgtatcgtaaatacatctgcacttcattttatccttgggtcaacattctaaaaatctccttcaagaggaaaaagttttttattcaccagaggcagaaacaagctgaatcgcgcgagcacatcgtggcttttaatatgctcaactatcggagctgcaaaaacttgtggaagtcttgcgtggagcaccataccttctttcaggcgaagaaactccttccccaagagaagaacgtgctgtcgcaatactggactatgggtagtcggaatacgaaaaagtctgtcaacaaccagtactgcaaaaaggtaattggagggatggtatggaaccccgctatgcggagatcactgtccgtggaacacctcgaaactaaatctcttccgtctcggtccccacccattaccccgaattggagatccccacgcctgaggcacgaaataagaaaaccacggcactcctctgccgataatcttgctaacgagatgacctatatcaccgagacagaggatgtgttttacacttacaagggctcacttgcacctcaggacagtgattcagaggtctctcaaaatcggagtccccaccaagaatctttgtctgaaaacaatccagcccagtcctatctaacgcagaaatctagtagctccgtgtctccgagttctaatgctcctggtagttgttcccctgacggcgtggaccagcagttgctagatgactttcaccgcgtgactaaaggggggtctaccgaagacgccagccagtattactgtgataagaacgacaacggggattcctaccttgttctcattcggatcaccccagacgaagacgggaaattcggctttaacttgaaggggggagtggatcagaagatgcctctagtagtaagccgtataaaccctgaaagtcctgctgacacatgcattccaaagctcaatgagggcgaccagatagtgctcattaacgggagagatatttccgagcatacgcacgatcaggtggtgatgttcattaaagccagtcgcgaaagccattcaagggagctggcccttgtaattcgccgcagagctgtccgaagctttgcagatttcaaaagcgaagatgagttaaaccagctttttccggaggcgatcttcccaatgtgcccggaaggaggcgatactctggagggcagcatggcccaattgaagaaaggcctggaatcaggaaccgtgctgatccaattcgagcagctatacagaaaaaaaccagggctcgctataaccttcgccaagttgccgcagaatcttgacaaaaaccggtacaaagatgtcctgccctatgacacgacaagggtcctgctccaaggaaacgaagactacatcaacgctagctacgtgaacatggagatccctgcagccaatctggttaacaaatacattgcgactcagggccccctgccgcatacctgtgcacagttttggcaggtagtctgggaccagaagctttctctcattgttatgcttactaccttgaccgaaagaggtaggactaaatgtcaccagtattggccagaccccccagacgtgatgaaccacgggggattccacatccaatgtcagtccgaagactgtacaattgcttacgtcagcagggagatgctcgtaaccaacacacagaccggggaagagcacaccgtgacccatctgcaatatgtggcctggcccgaccatggagtgcctgatgactcctctgacttcttggaatttgtaaattacgtgagatcgttgagggttgactccgaacccgttctggtgcactgctcagccggcatagggcggaccggggtgctagtcactatggaaacagcaatgtgtctgacagaaagaaacttgcctatctatcctttagatattgtgcgtaaaatgcgcgatcagagggcaatgatggtccagaccagcagtcagtataaattcgtctgcgaggcaatccttcgggtgtacgaggagggtttagtgcagatgttggatccatcttag

SEQ ID NO: 29219 - DNA, 1146 bp, Artificial Sequence
  Description of Artificial Sequence: Synthetic coding sequence
atgcctctggttgtgtccaggattaatccggagtcccctgcggatacttgtatccccaaattgaacgagggcgatcagatcgtgctgatcaacgggagagacataagcgagcatactcacgaccaggtagtaatgtttataaaagctagtcgagagtctcattctcgggaactagcgctagtgatccggcgccgggccgtgcggagctttgcagactttaagtcagaagacgaactcaatcaactgttccctgaggccattttccccatgtgccctgaaggaggggacactcttgaaggctctatggctcaactgaagaagggtcttgaatccgggacggtgctgatccagtttgagcagctgtacagaaagaaacccggcttggctatcacattcgccaagctgccccagaatctggacaaaaataggtataaagacgttcttccatacgacacgacgagggtcctgctgcagggcaacgaagattacataaacgccagttatgtcaacatggagatccccgcggctaatttagtcaataaatacatagcgacacagggcccgctgccgcatacttgcgctcagttttggcaggtggtatgggaccagaagctaagcctgatcgtgatgctgacaacattgactgaacggggtcggacgaaatgccatcagtactggcctgatccgcccgatgtgatgaatcatggaggcttccacattcagtgccagtccgaggactgcacaattgcgtacgtaagtagggagatgcttgttaccaacacacaaacaggtgaggagcacactgtgactcatttacagtacgttgcatggcctgaccatggcgtacctgacgatagctcagactttctggagttcgtgaactacgtgagaagcctgagggtagattccgaacctgtgctggtccactgctctgccggaatcggccggaccggcgtccttgtgacgatggaaacagcaatgtgcctcacagagagaaatttgccaatttaccccctggatattgtacggaagatgcgggatcagagggctatgatggtccaaactagctcgcaatacaagtttgtgtgcgaagccattctgagagtgtacgaagagggcctagtccagatgttagacccgtcctag

SEQ ID NO: 29220 - DNA, 2742 bp, Artificial Sequence
  Description of Artificial Sequence: Synthetic coding sequence
atgacttcccgacttagggcgttaggagggcgaatcaataacatacgtacctccgaacttcctaaggagaagacccggagcgaagtgatatgttctatccacttcttagacggtgtggtacagacctttaaagtcacaaaacaggacaccggccaggttttgctcgacatggtccataaccacctcggtgtaacagaaaaagaatatttcggtttgcaacacgacgacgactcagttgactcgccccgatggctggaggcatcaaaggcaatcagaaagcagctgaaaggaggattcccatgcaccctccactttcgtgtgcggttcttcatcccagatcccaacacattgcagcaggaacaaactcggcacctgtacttcctgcagctcaagatggacatttgcgaggggcgtctcacctgcccccttaatagtgccgtagtgctggcgtcgtacgccgtgcagagccacttcggcgactacaattcgtctatccatcatcctgggtacctgtcggattcccacttcatcccggaccaaaacgaggattttctcacgaaagttgagtcacttcatgagcagcacagcggccttaaacagagcgaggccgaatcatgttatattaacattgcccggacactcgatttttacggagtcgagctccactcaggtagggatctgcataaccttgaccttatgatcggcatcgcatctgcaggggtggccgtgtaccgtaagtatatctgcacgtcgttttacccatgggtcaacatcttaaaaattagctttaagcgaaaaaagtttttcattcatcagcgccagaaacaggcagaaagcagggagcacatagtggctttcaacatgcttaactataggtcatgcaaaaatttgtggaagagttgtgtggagcatcacactttctttcaggctaagaaactgctgccacaagagaagaacgtcttgtcccagtactggacgatgggctctcggaacacaaaaaagagcgtgaataaccaatattgtaagaaagtgataggaggaatggtatggaatcccgccatgcgccgcagtttgtcagtggagcatctcgagaccaagagtctgccatcacgttcgccacctatcactcccaattggcggtctcctcggttaagacacgagattaggaaaccgcgccactctagtgccgataacctggcgaatgagatgacctacattacagagaccgaagatgtgttttacacctataaggggtccctagcaccacaggacagcgactctgaagtttcccagaataggagtcctcaccaagaatccctgagtgaaaacaatccagcccagtcttatttgactcaaaaatctagctcatctgtgagcccaagtagcaacgcgccgggttcatgctcccccgatggggtggaccagcagcttttagatgattttcatcgtgtcaccaagggaggttctaccgaagatgcctcccagtactactgcgataaaaatgataatggcgatagctatttagtgctcatacgaattacccctgacgaggacgggaagtttggcttcaatctaaagggcggagtcgatcaaaagatgcccctcgttgtctctcggattaaccctgaatctcctgctgatacatgtatcccaaagctgaatgagggagatcaaattgtgcttatcaatggccgggacatctctgaacacacacatgaccaggttgtgatgttcatcaaggcatcaagggaatcccacagccgtgagctggcgctggtgattagacgaagggctgtgaggtctttcgcagacttcaagtccgaggatgagcttaaccaactctttcccgaggccattttccccatgtgtcccgagggcggtgatactcttgaagggtcaatggcacaactaaagaaggggcttgaaagcgggaccgtactcattcaattcgagcaactgtataggaagaagccgggcctggctatcacttttgccaaactcccacagaatctggataaaaaccgctacaaggatgtccttccctacgacaccacacgagtcctgttacaaggaaacgaagattatatcaatgcttcttacgttaatatggaaattcccgctgctaatcttgtgaataagtatatcgcaactcaaggaccacttcctcatacctgtgctcagttttggcaggtggtgtgggaccaaaagctgtctctcatcgttatgctgactacactcactgaaagaggccggaccaaatgtcaccagtattggccggacccaccagacgtaatgaatcacggcggctttcacattcagtgccagagcgaggattgtaccattgcttatgttagcagggagatgctcgtcaccaacacccaaacgggggaagagcacactgttactcacttgcaatacgtggcgtggccagaccatggagttcccgacgattcctccgacttcctcgagtttgtgaattacgttcgttctctgcgagtggatagcgagcccgtgctcgtgcattgctctgccggaattggaagaactggcgtccttgtgaccatggaaactgctatgtgtctcaccgagaggaacctgcccatctacccactggatattgtcagaaaaatgagagaccagcgggctatgatggtacaaactagttcccagtataagtttgtatgcgaagccattctgcgggtttatgaggagggtctcgtccagatgctggacccatcatag

SEQ ID NO: 29221 - DNA, 2349 bp, Artificial Sequence
  Description of Artificial Sequence: Synthetic coding sequence
atggatatttgcgaagggcggctaacttgccctttaaatagcgccgtggtacttgcttcctatgctgtccagtcccatttcggcgactacaattccagcatccaccaccccggttatctgagtgacagccactttattcctgaccagaatgaagacttcctgacaaaggtggagtccctgcacgagcagcactccgggctgaagcaaagtgaggctgaatcatgttacatcaatatagcccgcactctggatttttacggtgtagaattgcattctggccgcgatttacataatcttgatctgatgataggaatcgcgagtgctggtgttgcagtatatcgtaagtacatctgcacttctttctacccctgggttaacattctaaagatttctttcaagcgcaagaaattcttcatccatcagaggcagaaacaggcggaatcaagagagcacatcgtggcgttcaacatgctcaattaccgaagctgcaaaaacctgtggaaatcttgtgttgaacatcataccttctttcaggccaaaaagctgctgccgcaagaaaagaacgtgctgtcacagtactggactatggggtctcggaatacgaagaagtctgttaacaatcagtactgtaagaaggtgattggtggcatggtgtggaaccctgccatgcgtcgttcgctaagtgtcgagcacctggagaccaaatcgctgccctctagatcacccccaatcacccccaattggaggtctccacgcttaaggcatgagatcagaaagccaagacactcctccgcggacaaccttgccaatgaaatgacttatatcacagaaaccgaggacgtgttctatacatacaagggctccctcgctccccaggatagcgactccgaggtgtctcagaacaggagtccccatcaggagtcgctgtctgaaaacaatcccgcacagtcctatttgacccagaaatcctcttcctccgtgtcaccttcctctaacgcccctggaagttgcagccctgacggggtggaccaacaactcctggacgactttcatagggttacaaagggcggctctacagaggacgcttcccagtactactgcgacaaaaatgataacggggactcctacctagtcctcatcagaatcactcctgatgaggacgggaagtttggttttaacctcaaaggaggtgtcgaccaaaagatgccgttggttgtaagtagaatcaacccagagagccctgccgatacgtgtattcccaagctcaatgaaggggaccaaattgtcctgattaacggccgcgatataagcgaacacacacacgaccaggtggttatgttcattaaggcctcccgggagtcccactcgcgggaactggcactcgtaatacgcaggagagccgttcgcagctttgccgatttcaagagtgaggacgagctaaatcaactgttccctgaggctatcttccctatgtgccctgaaggaggcgatacccttgaaggctccatggcccagcttaagaaggggctggaatccggcacagtcttgatccaatttgaacagctctacaggaagaaacccgggctggccattactttcgcaaagcttcctcaaaacctggataagaaccgctataaagacgtgctcccttacgataccactagggttcttctgcagggaaacgaggattatattaatgcatcttacgtcaacatggaaatacctgcagccaacttggtgaataaatacattgcgacccaaggtcctctcccccacacctgcgcacagttttggcaggtcgtgtgggatcagaaactcagtctcatcgtaatgctcacaaccctgaccgaacgtggtcggaccaagtgtcaccagtattggcccgaccctccggatgtgatgaaccatggggggtttcatatccagtgtcagtccgaagattgtacaattgcttacgtttccagggaaatgttggttactaatacacagaccggcgaagaacacaccgtgacacatctgcagtatgtagcctggcccgatcatggagtccccgacgacagcagtgattttctcgagttcgttaattacgtcaggtctctgcgggtggattcggaacctgtgttggtccactgcagcgccgggatcgggagaactggtgtcctcgtgaccatggagaccgccatgtgtttgactgagcgaaacttgcccatctatcccctggatatcgtgagaaagatgcgcgatcagcgggcgatgatggtccaaacctccagtcagtataaatttgtctgtgaggccatcctgcgcgtgtacgaagagggattagtccagatgctagacccatcatag

SEQ ID NO: 29222 - DNA, 2214 bp, Artificial Sequence
  Description of Artificial Sequence: Synthetic coding sequence
atggatatttgcgaaggccgcttgacctgtcctttaaactccgcagtggtgctagcatcctacgcagtgcagagtcatttcggagactataatagctccatccatcatccaggttacctatctgacagccattttatcccagatcagaacgaagactttctgaccaaagttgagagcctccacgagcagcacagcggcctcaaacagtccgaagctgaatcctgctacatcaatatagcaaggactttggacttctacggtgtcgaactacactctggccgtgacctccataatttagacctaatgataggtatcgcaagtgccggtgttgccgtgtacagaaagtatatatgtacatcattctacccgtgggttaatatcctgaaaatctcctttaagcggaagaagtttttcatacaccagcgtcagaagcaggccgagtctcgagaacatattgtcgcatttaacatgctaaactacaggagctgtaagaacctgtggaaatcctgtgttgagcaccacacgttttttcaggccaaaaagctgctcccacaagaaaaaaacgttttgtcccagtactggacaatgggaagtcgcaacacaaagaaacgctctccacgcctgagacacgagatcagaaagccaagacattccagtgccgacaatctggccaacgaaatgacttatatcacagagacagaagacgtgttctatacctacaaaggcagtttagctccccaggattctgatagcgaggtgagccagaatagatctccacaccaggagagtctgtctgaaaacaatcctgctcagagctaccttacacagaagtcctcgtcctctgtgtctccttcctccaatgccccaggctcttgctcaccagatggcgttgatcagcagctgctggatgatttccatcgcgtcaccaagggagggagtactgaggacgcatctcaatactattgcgataagaatgacaatggcgattcctacttagtgctgatcagaatcacccccgacgaagacggaaagttcggcttcaatttaaagggaggcgtggaccaaaaaatgccactcgttgttagccgtataaatcctgagtcgcctgctgacacctgcatccccaaactaaacgagggggatcaaattgtgctgattaatgggagggatatttccgaacacactcacgaccaggtggtcatgttcattaaggccagccgggagagtcacagccgcgaactggcactggtgatcaggcgtagagcggttagatccttcgcagatttcaagtctgaggacgaattaaaccaactgtttcccgaggctattttccctatgtgtcccgaaggcggggacacactggaggggtctatggcacagttaaaaaaagggctggaatccggaacggtcctgattcagtttgagcagctataccgcaaaaagcctggcctagcgataacctttgccaaactgccacagaatttagataagaatagatacaaggatgtgctcccctacgatacaactcgggtgctgctgcagggtaatgaagactatatcaacgcttcctatgtgaatatggagattcccgcagctaacctcgtgaataaatatatcgccactcaagggccgctgcctcatacatgtgcccagttttggcaggttgtatgggatcagaagctgagcctcattgtgatgctcactaccctaaccgaaagaggtagaaccaagtgccatcagtactggcctgacccccctgacgtgatgaaccacggaggattccacatacagtgtcaaagcgaggactgcactatcgcatatgtgtcgcgggaaatgctggtgacaaatacacaaactggggaggaacacaccgtgacccacctgcagtatgtcgcatggcccgatcacggagtgccagatgacagctcagacttcctagagttcgttaactacgttcgaagccttcgcgtggacagtgaacctgttcttgtgcattgttccgctggtatcggcagaaccggggtgcttgtgactatggagacagccatgtgtcttacagaaagaaatctaccaatttatcccctggacatcgtgagaaagatgcgggaccagagagccatgatggtgcagacaagcagtcagtacaagttcgtctgcgaggctattctgcgcgtctacgaggagggactggtacaaatgctcgacccatcttag

SEQ ID NO: 29223 - DNA, 2781 bp, Artificial Sequence
  Description of Artificial Sequence: Synthetic coding sequence
atgacaagtaggtttcgcttgccagccggccggacatacaacgtcagagcctccgaattagccagagatcgacagcatacagaggtggtgtgtaatattctgctgctagacaataccgtgcaggccttcaaggtgaataaacacgatcagggccaggtgctcttagatgtggtctttaagcacctcgatctgactgagcaggattatttcggcctccagctggccgacgatagcactgacaatcccagatggcttgatcctaacaagccgatacggaaacagttgaagagggggtcaccctactctctaaatttcagagtcaagttcttcgtgtctgatcccaataaacttcaggaagagtacacacgataccagtactttttgcagataaaacaggacattttaaccgggagacttccctgtcccagcaatacagcagcactgctcgctagcttcgccgtgcagtccgaactgggagattatgatcagagcgaaaatttgtctggctacctgagcgattatagcttcatcccaaaccagcctcaggattttgagaaggagatcgccaaactgcatcaacagcatatcggcttgagtccggccgaagctgagtttaattatctaaacactgcgaggaccctggaactctacggcgtggagtttcactacgcaagagaccagagcaacaatgagatcatgatcggggtgatgtccggcggcattctgatctacaaaaatagggtgcgtatgaacacatttccttggctgaaaatcgttaagataagctttaagtgcaagcagttttttattcagctccggaaagagctgcacgaaagccgggagactctgctgggtttcaatatggtgaattatagagcctgcaaaaacttgtggaaagcgtgcgttgagcatcacactttcttccggctagatagaccgctcccaccgcagaaaaatttctttgcccattacttcacccttggatctaagtttagatactgcgggagaacggaggttcagtcagtgcagtacggcaaagaaaaagcgaacaaagatagggtctttgctagatccccctccaaacccctggcccgcaaactgatggactgggaggtcgtatcccgaaactcaatttcggatgaccgcctcgaaacgcagtctctgccgtcgaggtcaccacccggtacccctaaccataggaactcaaccttcacccaggaggggacgcggctccgccccagctcagtcggccatttggtggatcatatggtacacacatccccttcagaggtgtttgttaatcagagatctccttctagtacgcaagcgaactcaatagtgctcgagagcagtccctctcaagaaacacctggcgatgggaagcctcctgccctcccccccaagcagtcaaagaagaactcttggaaccaaatccactattcgcactcacagcaggatctggagtcgcacatcaatgagacatttgatatcccttcaagccctgagaagccaaccccaaacggtggaattccccacgataatctggttctgatacgcatgaaaccagatgagaacggtagattcggctttaatgtcaagggcggatatgatcagaaaatgcccgtcatcgtgagtcgagtcgcccctggtacccccgccgatctctgtgtgccccggctcaacgagggcgaccaggtggtcctgattaatggaagggacattgctgagcatactcatgatcaagtggtgctttttattaaggcaagctgtgaaaggcattcaggggaactaatgttgctggttagacccaacgctgtttatgatgtcgtcgaagaaaagttagagaatgaaccagacttccagtacatacctgagaaggcacccctggattccgttcaccaggacgatcacagtcttagagaatccatgatacagttagccgaggggctaattacaggaaccgttctcactcagtttgatcaactctatcggaagaagccgggaatgacaatgtcttgtgctaagttacctcaaaatattagcaagaataggtatcgtgacatcagtccttacgatgccactagggtcattctgaagggcaatgaggactatatcaacgcaaactatatcaatatggaaatcccttcgagcagcatcatcaatcagtacattgcatgtcaaggcccattgcctcatacctgcaccgacttttggcaaatgacatgggaacaaggaagctccatggtcgtaatgcttaccactcaggtggagcgcggccgtgtgaagtgccaccaatattggcctgaacctaccggatcgtcatcttatggatgctaccaggttacctgccactcggaggagggcaacacagcctatatcttccggaaaatgacactgtttaatcaagagaagaatgaatcccggcctcttacccagatccagtacatcgcttggccagaccacggagtcccagacgactcatctgactttctcgatttcgtctgccacgtacgtaacaaacgggccggtaaggaggagccggttgtggtacactgctccgctggtattgggcggactggcgtcctaataaccatggagacggcgatgtgtctaatcgaatgcaaccaaccagtctaccctctggatatcgtccgcacaatgcgagaccagcgcgcaatgatgatccaaaccccatcccagtatcgctttgtgtgtgaggctatccttaaagtctatgaagagggatttgtaaaacctctcactacatccacgaacaaatag

SEQ ID NO: 29224 - DNA, 228 bp, Artificial Sequence
  Description of Artificial Sequence: Synthetic coding sequence
atgacttcacgctttaggctgccagcgggacggacctataatgtccgggcctcagagctcgcccgggatagacagcatactgaggtggtgtgcaatatcttactcctggacaacacggtgcaggcgtttaaggttaataaacacgaccagggccaggtgctgctggacgtggtattcaagcacttagacctgacagagcaggattactttggactccagctcgcttag

SEQ ID NO: 29225 - DNA, 486 bp, Artificial Sequence
  Description of Artificial Sequence: Synthetic coding sequence
atgaccagtagattccgccttcctgccggacgcacttacaacgtgagagcctctgagctggcccgcgataggcagcacacagaagtagtctgcaatatcctcttactggataacacagtccaagcttttaaggtcaacaagcacgaccaggggcaagtgctattagatgtagttttcaagcatctcgacctgacggagcaagattattttggcctgcagctagctgacgattctacggataatccccggtggctggatcccaataaaccaattaggaaacagcttaaaaagttgctgcttctgatcttgggagggtctccatactctctcaactttagagtcaagttttttgtaagcgaccctaataaactgcaggaggagtacactcggtaccaatactttctccagatcaaacaagatatattaactggaagactgccctgtcccagtaataccgccgccttgttggcatctttcgcagtctag

SEQ ID NO: 29226 - DNA, 1680 bp, Artificial Sequence
  Description of Artificial Sequence: Synthetic coding sequence
atggactgggaggttgtctccagaaactccatttccgacgataggcttgagacccaatctcttccatcacgcagtccaccgggaaccccaaaccaccgcaacagtacttttacccaagaaggcacgcgactgcgacccagcagcgtgggccaccttgtggatcacatggtgcatacaagccccagcgaagtctttgtcaatcagaggtcgcccagctccacccaagcgaatagcatcgtgttggaaagttcaccgtcacaggaaacacccggcgacggaaagccacctgctctgccccccaagcagtctaaaaaaaacagctggaaccagattcattatagccattcacagcaagatttggaaagccatatcaatgagactttcgacatcccctcctcaccggagaagccaacaccaaacggcggtatccctcacgataacttggttctgatcaggatgaagccagatgaaaacgggcgttttggctttaacgtgaagggagggtacgaccagaagatgcctgtaattgtatcaagagtggccccaggcacccccgccgacctgtgtgtcccaagactaaatgaaggtgaccaggtggtactgatcaatgggagagatattgccgagcatactcacgaccaagtggtgctcttcatcaaagccagctgcgagaggcattccggggagctgatgctcctggtgagacccaatgctgtctatgacgtggtggaggagaagttagaaaatgaacccgatttccagtacattcccgaaaaagcccccctcgacagtgtgcaccaagatgaccattcgctgagagagtctatgattcagctggcagagggattaatcacgggcactgtcttaacacagttcgatcaactgtatcgaaaaaaaccagggatgaccatgtcttgcgctaagcttccgcagaacataagcaaaaataggtatagggatatctctccgtacgatgcaacgagggtcattctaaaaggcaacgaggattatataaacgcaaactacatcaatatggagatcccttcctccagcatcattaatcagtacattgcctgtcagggccctctcccccacacatgtactgacttctggcagatgacttgggaacagggatcatccatggtcgtgatgctcacgacccaggtcgagcgcggtcgcgtgaagtgccaccagtactggcctgaaccgacaggctcttctagctacggatgttaccaagtaacgtgtcactctgaggagggcaacactgcatatatcttcaggaagatgactctttttaaccaggagaagaacgaatccagaccattgactcagatacaatatatcgcgtggcccgatcacggcgtgcccgatgactcatctgattttctggactttgtatgccatgtgcggaacaaaagagctgggaaggaggagcccgtggtggtgcattgcagcgctggtattggccgcacaggcgtgttgatcaccatggagacagcaatgtgtttgatcgagtgtaaccagccagtctatccgttggatattgttagaactatgcgcgatcaaagggcaatgatgatccagaccccctcccagtaccggttcgtttgcgaggcaatcctcaaggtgtacgaagaggggtttgtgaaaccactaactaccagcaccaacaaatag

SEQ ID NO: 29227 - DNA, 3708 bp, Artificial Sequence
  Description of Artificial Sequence: Synthetic coding sequence
atgatgtgcgaagtgatgcccaccattaacgaggacactccaatgtcccagcgcgggagccagtcttctggatccgactctgattcccacttcgaacagttgatggtcaatatgctggacgagagggaccgcctgctcgatactctccgtgaaacccaagaaagtttgtccttggcacagcagcgtttacaagatgtgatttacgacagggactccctgcagaggcaactgaactccgccctgccgcaggagttcgccgccctcactaaagaattgaatgcctgcagagaacagctgctcgagaaggaggaagagatctccgaattgaaggccgagaggaacaacactcggctcctgctagagcacttagagtgcctggttagccggcatgagcgatccctccgcatgacggtggtcaagagacaagcccagtcaccttcaggagtgagctcagaggtggaggttcttaaagctttaaagtctctgtttgaacaccacaaggccttagatgagaaggtgagggagaggctaagagtttcacttgaaagagtctccgctctggaagaagaacttgccgcggccaatcaagagatcgtcgcattgcgagaacagaacgttcatatccaacgcaaaatggcctcttcggagggctcgacggagtcagagcatttggagggtatggagccaggacaaaaagtgcatgagaagcggttgtcgaacggatctatagactctacggatgagacttctcagattgtcgaactgcaagagcttctggaaaaacagaattatgaaatggcccagatgaaagagaggctcgctgcactgagttctcgcgtcggcgaggtggagcaggaggccgaaacagcgcgcaaagatttgattaagaccgaggagatgaatacgaagtatcagagagacatcagggaggcgatggcccaaaaagaagatatggaggaacgcattaccacattggaaaagcggtacctgtctgctcagcgagaatccacaagtatccatgacatgaatgacaagctggagaacgagctggccaacaaggaggctattctgcgacagatggaggaaaaaaatcgtcagcttcaagagcgcttagagctggccgagcagaagctgcagcaaaccatgaggaaggcagagacactcccagaggtagaggctgagctggctcagcgcatcgcagcactcaccaaggctgaagagagacacgggaatatcgaggagagaatgagacatctggagggccaactggaggaaaagaatcaggaattgcaaagggccaggcagcgggaaaagatgaatgaggagcataacaagcgcctgtctgatactgtggacaggctgctgaccgaaagtaacgagaggctgcagttacacctcaaagaaagaatggctgccttagaggaaaagaacgtcctgatccaggaaagcgaaacttttcgcaagaatctggaggaatctttacatgacaaggagcgactcgcagaggaaatcgagaagttgaggtcagaactggatcagcttaagatgcgcacgggaagtctgattgaaccgaccattcccaggacgcaccttgacacgagcgccgaattgcgatattcggtcggaagtctagtcgattcgcagtcagattaccgtacaacaaaagttattcggagaccccggcgtggcaggatgggcgttagacgggatgaaccaaaagtcaagagcctgggcgaccacgagtggaacaggacccagcaaataggggtactgtcgagccatccttttgaaagtgatacagaaatgtccgacatcgacgacgacgatagggaaacaattttctcttctatggatctgctctctcccagcggccattctgacgcacaaacactagccatgatgttgcaggagcagctcgacgcgatcaataaggaaatccgcttgatccaggaagagaaggagagtactgagctaagagctgaggaaattgagaacagagtcgcatcagtgtcccttgaaggcctgaatttagctcgcgtgcacccgggcacgtctatcaccgcatctgttaccgcttcatcattagcgtccagctcacctccttccggtcatagtactccaaagttaacgcctcggtcaccagcaagagagatggatcgcatgggcgtgatgaccttaccgtctgatctacgcaaacatagaagaaagattgcagtggtggaagaggacgggagagaagataaggccaccatcaagtgtgagacctccccccctccaaccccccgcgcactacggatgactcacactctccccagttcttatcataatgacgccaggtcatctctgagtgtgtccctggaacccgagagtttgggcctgggatcagctaattctagccaggattccttgcataaggctccaaaaaagaaaggcataaagagttctatcggccggctgttcggaaaaaaggaaaaagcacggctgggccaactgagggggttcatggaaactgaggccgccgcgcaagagagtctgggtttggggaagctgggcacccaagctgagaaagataggcgactgaagaaaaaagtgattcgccacgagttgctcgaggaagcacgcagaaaggggctaccctttgcccagtgggatggtcctaccgtcgtggcttggcttgagttatggttagggatgcccgcttggtacgtagctgcttgccgcgcgaacgtgaagtctggggccattatgtctgctctctccgataccgaaattcagcgggaaatagggatatccaacccgctgcaccggctgaagctccgtcttgcaatccaggagatggtgtctctcactagcccaagcgcacctccaacaagtcgcactccctctgggaacgtgtgggtgactcatgaggaaatggaaaaccttgccgcaccagctaaaaccaaggagagcgaggagggctcttgggcacagtgccctgtgtttctgcaaaccttggcttacggggatatgaatcacgagtggattgggaatgaatggttacccagcctcggcttaccccagtacagatcttacttcatggagtgtctggtggatgctaggatgcttgaccatctgacaaagaaagatttacgcgtccatcttaaaatggtcgacagcttccatcgcaagaaaaggactagcctccaatacggcataatgtgcttgaaaagactgaactatgaccgcaaagagctggaacgccgcagagaggcctcacaacatgaaatcaaggacgtgttggtgtggtccaacgatcgtgtcatacgctggattcaggctatcggcttgcgcgagtatgccaacaacattttagaatctggagtgcacgggtccttgatcgcccttgacgaaaactttgattattcctctctagctcttctgctgcagatccctacccaaaatacacaggctagacaaattctagagcgggaatacaacaatttgctcgctctcggtactgagaggagactagacgagtcagacgacaagaactttcgacgtggaagcacttggagacggcagttcccaccccgggaggtgcatggtatttcgatgatgcctgggtcatcagagacccttccagcaggatttaggctgacgactacctccgggcagagccgaaagatgacgaccgacgatggcgtcttctcagtatactccacctag

SEQ ID NO: 29228 - DNA, 3471 bp, Artificial Sequence
  Description of Artificial Sequence: Synthetic coding sequence
atgatcttctccgatatgaatacagtgtccggctcacctaaggtgcatcccccaaatggaaccagattctacacctttcaggagttcgccgctcttacgaaagaactcaacgcttgcagggaacagctcctcgagaaggaggaagaaataagcgagctgaaggccgagcggaacaacacacgactgctgctggagcacctcgagtgcctcgtgtctcgacacgagagatccctacgaatgactgtggtaaagcggcaagcccaatctccatctggtgtgagctcagaggtagaagtactgaaagccctcaagagcctctttgaacaccacaaagcgctcgatgagaaggtgcgagagagacttagggtgtccctcgagcgggtgtccgctctggaggaggaactggccgccgccaatcaagagatagtagcgctccgggaacagaacgtgcatatccagcgcaaaatggcgtcctcagaaggatctaccgagtcagagcacctggaagggatggagccaggacagaaggtgcacgaaaaaaggctctccaatgggtccattgattccaccgatgagaccagtcagatcgtcgaactgcaggagctgctggaaaaacagaactatgagatggctcagatgaaggaaaggctggccgcgctttccagcagggtcggggaggtggaacaagaggctgaaaccgcgcggaaggatctgattaagacagaagagatgaacacaaagtaccagcgagacattagagaagctatggcccaaaaggaggacatggaggagcggatcactactctggaaaagaggtacctgtcggcccagagggaatctacctcgatacacgatatgaacgataaactcgaaaacgaactcgccaataaagaggccattctgcggcaaatggaagagaagaataggcagctgcaggaacgcctggagctagccgagcagaagctgcaacaaactatgcggaaggcagagacccttccagaggtcgaggcagaacttgctcagcgtatcgcggccttaactaaggctgaagaacggcacgggaatatcgaagagcgcatgagacatcttgaggggcaactggaggagaagaaccaggaactgcaacgagctcggcagcgcgagaaaatgaacgaagagcacaacaagcgcctctcggacaccgtggacaggctgctaacagagtcaaacgagcgactccagctccacttgaaggaacgcatggctgcacttgaagaaaagaacgttctaattcaggagtccgagactttccggaaaaacctcgaagagagcctccacgacaaagaacggctggccgaagagatcgaaaaactgaggagtgaactcgaccagctcaagatgcgcaccggctcattaatcgaacccactatccctcgtactcacttggacacttctgccgaactgcgctactcggtaggcagcctagtggattcacagagtgattaccggacaaccaaggtgattagaaggcctaggagaggcaggatgggcgtaagacgggacgaaccaaaggtcaagagcctgggcgaccatgagtggaaccggacccagcaaatcggcgtcctgtctagtcacccctttgagagtgatactgaaatgagtgacatagacgacgatgacagggaaacaatctttagctctatggacctgctatccccgagcggacatagtgatgcccagacccttgctatgatgctgcaggaacagttggacgccataaacaaggagatacgattgattcaggaagaaaaagagtcaactgagctgagggcagaggaaatcgagaatagggtagcatctgtgagtctagaggggttgaatcttgcaagagtgcaccctggaacctctatcactgcgagtgtgactgctagctctttggcctcctcttctcctcccagtggtcactccaccccaaagctgaccccacgtagtcctgcgcgtgaaatggaccggatgggcgtgatgacgcttccaagtgatttgcggaaacacaggcggaagatcgctgtggtggaggaggatggccgggaggacaaggcaactattaaatgcgaaacgtcccctccacccacacctagggccttacggatgacccacacgctgccgtctagttatcataacgacgctagaagttcgttaagcgtaagcctcgagccggagtcattaggattgggatccgccaactcaagtcaagattctttgcataaggctccaaagaagaaagggattaaaagctcaatcggtaggctgtttggaaagaaggagaaagccaggttggggcagcttaggggctttatggagaccgaagccgccgcccaggaaagcctgggactcgggaagttgggcacacaggccgaaaaggatcggaggctgaaaaaaaaacacgagctgctggaggaagctcgcagaaagggacttccattcgctcagtgggacggtcccactgtggttgcctggctggagctgtggcttggaatgcctgcctggtacgttgccgcttgtagggccaacgtcaagtctggtgcaatcatgtcagcactcagcgataccgaaattcaacgcgaaattgggatttctaaccccttgcacaggctgaaactgcggctggcgatacaggagatggtcagccttacctctccatctgcgccccccactagtcgcaccaaggaatctgaagaaggttcgtgggctcagacgttagcctatggcgacatgaatcacgaatggatcggaaatgagtggctgcctagcctagggctccctcaatataggagctacttcatggaatgtctggtggatgcacggatgcttgatcatctgacaaaaaaggatctgcgggtgcaccttaagatggtggacagtttccacaggacgagcctacagtacggaattatgtgcttaaaacgactcaactatgaccggaaagaactcgaacgcagacgcgaagcaagccagcacgaaatcaaagatgttctggtgtggtccaacgatcgcgtaatccggtggatacaggccattgggctgagagagtacgctaacaatatacttgaatcaggggtccacgggtccctgatcgctctcgacgagaactttgattactcctccttggctcttctcttacaaatcccgacacagaacacacaggctaggcagatacttgagcgagagtataataacctcctggctttggggacagagcgccggctggatgagtcagacgataagaactttcggagaggttccacctggagaagacagtttcctccgcgtgaggtccatgggatatccatgatgccaggtagtagcgaaaccttaccagctggttttcgcctgacgacgacatcaggtcaatctagaaaaatgactaccgatgtggcatcttcccggctgcagcgcctggacaacagtacagtacgaacgtacagctgctag

SEQ ID NO: 29229 - DNA, 1332 bp, Artificial Sequence
  Description of Artificial Sequence: Synthetic coding sequence
atgacccacactctgccatctagctatcataatgacgctagatctagcctcagtgtgtccctggagcccgaaagtctcgggctgggatcggccaacagttcccaagacagtcttcataaggcgcccaagaaaaaggggatcaagtcctccattggcagactctttggaaagaaagagaaggcccgcttaggccagctgcgagggttcatggagaccgaggcagctgcacaggagagcttgggcctcggcaagttggggacacaagccgaaaaagatagacgcctcaagaagaagcacgagttgctggaggaggccagaagaaaagggcttccattcgcccagtgggatgggcccactgtggttgcctggctggagctctggctaggcatgccagcgtggtacgtggctgcttgtagagcgaacgtgaaatctggcgcgataatgtccgccttaagcgataccgaaatacaacgcgaaatcggcattagcaatccccttcataggctcaagcttcgactggccattcaggaaatggtctcccttacatctcccagcgctccacctacatctcggacctgcccagtcttcctgcagactctcgcctatggtgacatgaaccacgaatggattggcaacgaatggttaccttctctcgggcttccgcagtatcgcagttattttatggaatgcctggtggacgcacgaatgctggatcacttgacgaagaaagatctccgggtgcatctgaagatggtggactctttccaccggacaagtctgcagtacggaattatgtgcctgaaaaggttgaactatgaccgtaaggagctggaaagaaggcgtgaggcgtcgcagcacgaaattaaagacgtgctagtctggagtaacgacagagtaatccgctggattcaggccatcggcctgcgcgaatacgccaacaatatcctggaaagcggggtgcatgggtctttgattgccctcgacgagaatttcgactattcctcacttgccctattacttcagatcccaacccagaatacacaggcaagacagatcctggaacgggagtacaacaatctgctggcactgggaactgaacggagactggatgagtccgatgataaaaacttcagaagaggctcgacatggcgacgccagtttcctccccgagaggttcacggcatttctatgatgcctggctcttccgaaacgctgcctgccggatttcggctgacaaccactagcggccagtcacggaaaatgactacagacgtcgccagctcacgcctacagaggctggataatagtactgtgagaacatatagctgctag

SEQ ID NO: 29230 - DNA, 3783 bp, Artificial Sequence
  Description of Artificial Sequence: Synthetic coding sequence
aggtctaaggatcctaagagtcaaacgctggctatgatgtgtgaggtaatgccaactatcaacgaagacacgcctatgtctcaacggggcagccagtcaagcggatctgattccgactctcactttgaacaactgatggttaatatgctcgatgagcgggaccggttgctggacacacttcgggagacgcaagagagcttatccttggcacagcagcgcttacaggatgtaatatacgaccgagactcattgcagagacagctcaactcagcgctgccccaggacattgagtcactgaccggaggcctggccggttccaaaggtgcagaccccccagaatttgctgcgctgactaaagagcttaatgcatgtagggaacagctgcttgagaaggaggaggaaatctctgagctcaaggcagagagaaacaatacacgtctgctccttgagcacttggagtgcctggtcagcagacacgagcggagcctccggatgaccgtagtgaaacgccaagctcaatctccaagcggagtgtcctcagaggtggaagtccttaaagctcttaaatctctctttgaacaccataaggccctggacgagaaggtgcgggagcggcttcgtgtgtctcttgaacgggtgagcgcgctcgaagaggaactagccgccgccaaccaggaaatcgtagcattacgagagcaaaacgtgcatatccaaagaaaaatggcctcctcagagggcagcaccgagtccgagcatcttgagggcatggagccaggacagaaggttcacgagaagaggctctctaatggatccattgatagcacagacgagacaagtcagatagtcgaactacaggagctactcgaaaaacaaaattatgagatggctcaaatgaaggagaggttggcagcgttgtcctctagggtgggagaggtcgagcaggaagcggaaactgcccggaaagatttaatcaagacagaggaaatgaatactaagtaccagcgcgacattagggaggccatggcccagaaggaggatatggaggaacggattaccaccctagagaaacgatacttgtcggcccagagggagagtacatcgatccacgatatgaatgacaaactggaaaacgagctggcaaataaagaggccatcctgcgccaaatggaagaaaagaaccggcagctccaggagcgcttagagttggcagaacagaaattacagcagaccatgcgtaaggcagagacgctgcccgaggttgaggctgagctagcacaaagaatagctgctcttaccaaggctgaggaacgacacggcaatatcgaagaaaggatgcggcacctggaaggacagttggaggagaaaaaccaagagttgcaaagggcaaggcagagagaaaagatgaacgaggagcataacaaaagactgtctgataccgtggatcgattgctcacagaaagcaacgagcgcctccagcttcatttgaaggagcgtatggcagctctggaagagaagaacgttttaatccaggaaagtgaaaccttcaggaaaaatctggaggagtcacttcacgataaagagcggctcgcggaggagatagagaaacttcggtccgaacttgatcaattgaaaatgcgaaccggctcattgattgaacccactattccaagaacacacctggacacgagtgcggagctaaggtacagcgttgggagtctggtggactctcagagcgattacaggacaacgaaggtaattaggcggcctaggcgtggcagaatgggagtgcgaagggacgagcctaaggtgaaatccctgggggatcatgaatggaatagaacacagcagatcggcgtattaagtagtcatccattcgagtccgacactgagatgagcgacatcgacgacgatgacagagagaccatattctcgtctatggatctgctctctcctagtggtcatagcgacgcacagactctggcgatgatgctccaggagcagctggacgccatcaacaaagaaattcggttgatccaggaagaaaaggagtctacagagctgcgggccgaggagatagaaaatagggttgcttccgtgtcattagaggggttgaacctcgcccgggtccatccagggacatccatcacagccagcgtgacagcaagctcgctggcttcctcctcgccgccatctggtcactcaactccgaagctgactcctaggtctcccgcacgcgaaatggacagaatgggcgtcatgactctgccgtctgatctgcggaaacatcgccgcaaaatcgcggtcgtggaggaagacggcagagaggacaaggccacaatcaagtgtgagacatcaccaccccccacccctcgtgctctaagaatgacacatacattgccttcttcctaccacaacgatgccaggtcgtccttgagcgtgagtctggagcctgagtcactggggctcggaagcgctaactcttcccaagactcacttcacaaagccccaaagaagaaaggaattaaaagctcaattgggcgactgtttggtaagaaggaaaaggccagactggggcagctgcgtggtttcatggagacagaagcggccgcacaggaatccctggggctaggcaagctgggaacacaagcagaaaaggaccgccgactgaaaaagaaacacgagctgctagaggaagcccgcagaaaaggtctgccttttgctcagtgggatggccccacagtggtggcgtggttggagctgtggctcggcatgcccgcctggtatgtcgctgcctgtcgagctaatgtgaaatctggagctataatgtcagcattaagtgatacggagatccagcgggagattggtattagcaaccccctgcacagactgaagcttagattggctatacaagagatggtcagcctgactagtcctagcgcccctcctacctcaagaacacctagcggcaatgtgtgggtgactcacgaagagatggaaaacctggcggcacccgccaagactaaagaatcggaggagggaagctgggcccagtgcccagtgttcctgcagacgctagcctacggagacatgaatcacgagtggataggcaatgagtggctgcctagcttgggcctgccacagtacagatcctattttatggaatgcttggtggacgcccggatgctcgatcatctcacaaagaaggacctgagggtgcatcttaaaatggtggattcctttcatcgcacttccctgcagtatggaattatgtgcctgaaaaggctaaactacgaccgcaaagaattggagcgccgccgagaggccagccagcacgagataaaggacgtgctggtgtggagtaacgaccgtgttattcgctggatccaggccattggtctgcgagagtacgctaataatattcttgagtcaggcgtccacggctcactcatcgccctggatgaaaattttgactattctagtctcgctctgcttctgcagattcccacccagaacacacaggcgaatgcccgacagattctggagagagagtacaacaatctgctggctctaggtactgagcggcggctcgacgagtctgatgataaaaacttcaggcgcggcagcacctggcgccgccaattccctccgcgagaggtgcacggtatcagcatgatgcctgggtctagcgaaacattgcccgcaggctttcgcctgaccactacttctggacagtcacggaaaatgacgactgatgatggggtcttttccgtgtacagcacatag

SEQ ID NO: 29231 - DNA, 366 bp, Artificial Sequence
  Description of Artificial Sequence: Synthetic coding sequence
atgatgtgcgaagtgatgccaaccatcaacgaggatacgcctatgagccagcggggatcccagtcgagcggatctgacagcgactcacattttgagcaactcatggtgaatatgctcgacgagcgcgatcggctgctggatacactgcgagaaacccaggagagtctttcactcgcacagcaaagactccaggatgttatttacgacagggactccctgcagaggcagctcaatagcgcgctgccccaagacattgaaagtctgaccggtgggctcgccggttccaagggcgccgacccaccagaatttgctgcacttaccaaagagttgaacgcttgtcgggagcagctcctggagaaagagtag

SEQ ID NO: 29232 - DNA, 3774 bp, Artificial Sequence
  Description of Artificial Sequence: Synthetic coding sequence
atgatgtgtgaggtgatgcctacaataaacgaggacaccccaatgagtcaaaggggatctcagtccagcggatcagactcagactcccacttcgagcagctcatggtcaacatgctggacgagcgagataggctcctggatacattgagagagactcaggagagcctgagcttggcccagcaaagactgcaagatgtcatctacgaccgggactctctgcaacgccagctgaattcagctctacctcaagatatcgaatcgcttacaggaggcttggcgggttctaagggcgccgatccacctgaatttgctgctctaacaaaggaactcaacgcttgcagggaacagctactcgaaaaggaagaagagatctctgagcttaaagccgaacggaacaatacaagactcctgctggagcatctggaatgcttggtcagtaggcacgagcgatccttgagaatgacggtggtgaagcgacaggcgcagagcccgtctggcgtttcgtccgaagtcgaagtgctgaaggcactgaaatccctgttcgaacaccataaggcattggacgaaaaggtgcgggaacgcctcagagttagcctggagagggtctctgcactcgaggaggagctggccgctgccaaccaggagatagtcgccctgagagaacagaacgtccatattcagaggaaaatggcttcatccgaaggttctaccgaaagcgagcatctggagggcatggagccagggcaaaaagtccacgaaaagcgcttgagcaacggctccatcgactcgacagatgaaaccagtcaaatcgtggagttacaagagctgctggagaaacagaattacgaaatggcccagatgaaggaacggctggctgctttaagctccagagtaggggaggtggagcaggaggcggagactgcccggaaagacctcataaaaacagaggaaatgaatactaagtatcagagagatatccgggaggccatggcccagaaggaagatatggaggagaggattaccacactagaaaaaaggtatttgtctgcgcagcgggaatctacaagtattcacgacatgaatgataaactggagaacgaactagcaaataaagaagccatactgcgccagatggaggaaaagaacagacagttgcaagaaaggctggagctagccgaacaaaagcttcagcagaccatgcggaaggcagagacgcttcccgaggttgaggccgagctcgcccagaggatagccgcgttaactaaagcagaagaacggcacggcaatattgaggaacggatgcggcacctggagggacagctcgaagaaaagaaccaagaattgcagcgagcacggcagcgggaaaagatgaatgaggagcacaataagcgactgtccgataccgtcgaccgtctacttacagaaagcaatgagagactgcagctgcatctgaaggaacgcatggcggccctggaggaaaaaaacgtgctaatccaggaaagcgagacatttcggaagaatctcgaagaaagtttgcacgacaaggaaagattggctgaggagatcgaaaaactgaggtctgaactggatcagctaaagatgcgaaccggctccctcattgaaccaaccataccacgcacacaccttgatacttccgccgaactccggtactccgtcggctctcttgttgacagtcagagtgattatcggacaacaaaagttatccgtaggccccgaaggggaagaatgggagtgcgtagggacgagcctaaggtgaagtctctgggggaccatgaatggaatcgtacacagcagattggcgttttatcctcccatccatttgagtccgacactgagatgtctgacattgacgacgacgaccgcgagactatcttttcctccatggacctgctcagcccatccgggcacagcgatgcacagactttagccatgatgctccaggagcagcttgatgccatcaacaaagagatccggttgattcaggaagagaaagaaagcaccgagctgagagccgaggaaatcgaaaacagagtggcaagtgtaagtctagaagggctgaatctggccagggtgcatccaggcacttccattacagctagcgtcacagcatcatcactggcaagctcctccccgccgagcggacatagcactccgaagctgaccccccggagccccgcacgggagatggacagaatgggcgtcatgacattgccgagcgatcttcgcaagcataggcgtaagattgcagtagtcgaggaagacgggagagaggacaaggccacaattaagtgcgaaacatcccctccccccacaccacgtgccctgaggatgacacacacactcccttcctcttaccacaacgatgcacgctcttccctgtccgtcagtctagaaccagagtccctaggacttgggtcagcaaattcctcccaggacagcctgcacaaggcccccaagaaaaaaggcatcaagtcctctatagggcgactctttggtaaaaaggaaaaggcacgattgggacagctgagaggatttatggagacggaagctgccgctcaggagagtctgggcctcggtaagctggggacccaggctgaaaaagatcgccgcctcaagaaaaaacacgaactccttgaggaggccagaaggaaaggtttaccgttcgcccagtgggacggacctacggttgttgcatggctggaactttggttgggtatgcccgcatggtacgtggcagcctgcagagcaaatgttaagagcggcgcaatcatgagcgctctgtcagacactgaaattcagcgggaaatcgggatctctaaccctcttcatcgacttaagctgcgtcttgcaattcaggaaatggtgagcctgacaagtccctctgcccccccaacaagtcggacccccagcggcaacgtgtgggtgactcatgaggagatggaaaatctcgctgcacctgcaaaaaccaaagagagtgaagagggatcatgggcccagtgcccggtcttcctgcagaccctggcctacggggatatgaaccacgaatggattggcaatgagtggctgccaagcctcgggctgccacagtaccggagttacttcatggagtgcctcgtcgatgcgcgaatgctggaccatttgacaaagaaggatttacgagtccatctaaagatggtggactcttttcacaggacctcccttcagtatgggattatgtgcttgaagcgtctgaactacgaccggaaggagctcgagagaaggcgcgaggcaagtcagcacgagattaaagacgtcctggtgtggagcaatgaccgagtaatccggtggatccaggctattggcctgcgcgaatacgcaaataacattctggagtcgggagtgcatggaagcctcatcgctctcgacgaaaacttcgattactctagtctggccctgctgctgcagataccaacccagaacactcaggcacgacaaattcttgagcgggagtacaacaacctgctggctctcgggacagagagaaggctggacgaaagcgacgataaaaatttccggaggggttcaacgtggcgaaggcaattcccaccgagggaggtgcatggaatctcaatgatgccagggtcatctgagaccctgcctgctgggttcagactgaccacaacctcaggacaatcccgtaagatgacaacagacgtggcgtccagccggttgcagaggctcgacaactccaccgtccggacttacagttgctag

SEQ ID NO: 29233 - DNA, 1974 bp, Artificial Sequence
  Description of Artificial Sequence: Synthetic coding sequence
atgagacgagccgtgtgttttccggctctgtgtcttctcctgaatttacatgctgccggctgcttctctgggaacaacgaccattttcttgcaataaaccaaaaaaaatcgggcaaaccagtcttcatttacaaacactctcaggatattgaaaagagcctcgacatagcccctcagaagatttaccgacattcatatcatagctcatccgaagcacaagtcagtaagcgtcatcagatcgtgaactcagccttcccccgccccgcctacgatccctctctcaacctgctggctatggatggccaagatctggaggtcgagaacctgcctatcccggccgccaacgttatcgttgtcaccctgcagatggacgtcaacaagctcaacatcacattactgaggatttttagacaaggcgttgcagccgccctggggttgctccctcagcaagtgcacataaacaggcttattgggaagaagaacagcattgaactgttcgttagcccaatcaaccggaagaccggaatatcagacgcactgccatccgaagaagtcctcaggtccttgaacattaatgtacttcaccagtcactgtcccagttcggtatcacagaagtttccccagagaagaatgtacttcagggacagcacgaggcagataaaatttggagtaaggagggcttctacgccgtagtgatattcctctcgattttcgtgatcatcgtcacctgcctgatgatcctgtacagattgaaagaacgctttcagctatcccttaggcaggacaaagagaaaaaccaagaaattcacttgtcccctattacattgcagcctgccttgtccgaggccaagaccgtccattcgatggtccaacccgagcaggcacccaaagtccttaacgtggtggtggacccgcagggtcggggggccccggagatcaaggcgaccactgcaacctccgtctgcccttctcccttcaaaatgaagcccattggcctgcaggagaggaggggatcgaatgttagtctgacgctcgatatgagctccctcggcaacatcgaaccttttgtatctatcccgacaccccgcgagaaagtggctatggagtacctgcaaagtgctagccgaattctcactcggtctcagctcagagatgttgtggcaagcagccacctacttcagtcagagttcatggagattccaatgaatttcgtggatcctaaagaaattgacatcccccgccacggtaccaaaaaccggtacaagacgattctcccaaacccactgagcagagtctgtcttcgccccaagaacgtaactgattccctgtctacctacataaacgctaactacattcgcggatacagcgggaaggagaaagctttcattgccacgcagggccctatgataaatacagttgacgacttttggcaaatggtctggcaggaggattcccccgtaatagtcatgatcaccaaattgaaagagaagaatgaaaagtgtgtgctctactggccagaaaagaggggaatttatgggaaagtggaggtgttagtgatttcagtgaatgagtgcgacaactacacaatacgtaacctagtcctgaaacaggggtcgcacacgcagcatgtgaagcactattggtacacatcctggcccgatcacaaaacaccagattccgcccaacccctgctgcagttaatgttagacgttgaagaggatcggttggctagccaggggcgaggtcccgtcgtggtgcactgctctgctgggatcgggcgcactggatgttttattgctacgtccattgggtgccagcagttgaaggaggagggcgtcgttgacgcactgtcaatcgtctgccagctgcggatggatcgcggtggaatggtgcagacgtctgaacagtatgagttcgtccaccacgctctgtgcctatatgagagccggttaagtgccgaaaccgtacagtag

SEQ ID NO: 29234 - DNA, 1356 bp, Artificial Sequence
  Description of Artificial Sequence: Synthetic coding sequence
atgaaccagaagaacgtccttcaaggtcagcatgaagccgataagatatggtccaaagaggggttttacgccgtggtgatttttctgtccattttcgtcattatcgttacgtgtctgatgatcctgtaccgcctgaaagaacgattccagctgtccttacgccaggataaagagaaaaaccaagagatccatctcagtccaatcaccctccaacctgccctgtccgaggccaagacagtccattctatggtgcagcccgagcaggcgcccaaggtgttaaacgtcgtcgtcgatccacaagggcggggtgcgccggagataaaagctaccaccgctaccagcgtatgtccctctccgtttaagatgaagccaatcgggctgcaggagaggaggggtagcaacgtcagcctcacattggacatgtcgtcactcggaaacattgaaccatttgtgtctatcccaacccctcgcgagaaggtcgcaatggaatatctacagtccgcttctcgcatcctcacacgctcacagctcagggacgttgttgcctcttcacacttactgcagtctgagttcatggaaatccccatgaactttgtcgacccgaaggagatcgatattccgcggcacgggacaaagaacagatacaaaaccatcctgccaaatcctttgtcgagggtgtgtcttagaccaaaaaacgttacagactctctttctacctatatcaacgccaactacataagaggttattctggcaaagagaaagcctttattgcaacccaaggtccgatgataaacaccgtggatgatttctggcagatggtttggcaagaggactccccagtgatagtgatgataactaaactgaaagagaagaacgagaagtgtgtcctgtattggcctgaaaagagaggaatctacggaaaggtagaagtgctggtgatttccgttaacgaatgcgacaattacaccattaggaacctggtgcttaagcagggctcacatactcaacacgttaagcactactggtacacttcttggcccgatcacaagacccccgactctgcccagcccctgctgcagctgatgctcgatgtggaagaggaccgcctggcgtctcagggcagaggacccgttgttgtacactgcagcgctggaataggtcgaactggctgctttatagccacctctattggatgccagcaactaaaagaggagggagtggtggacgccctgtcgatcgtttgccaattgcgaatggacaggggcggaatggtgcagacttccgagcaatacgagttcgtgcatcatgcgctgtgcctctacgaatcccgtctctctgcggaaacagtgcagtag

SEQ ID NO: 29235 - DNA, 1239 bp, Artificial Sequence
  Description of Artificial Sequence: Synthetic coding sequence
atgattttatatcgcctgaaagaacgcttccagctcagcctgcgacaggacaaggagaagaatcaggagattcacctctccccgatcaccttgcagcccgctcttagtgaagcaaaaaccgtacatagcatggtacagccggagcaggcccccaaagtgcttaacgtggtggtggacccgcagggccggggcgccccggaaatcaaggccacaactgcaacatccgtctgtccttctcctttcaaaatgaaacctatcggcctgcaggaacgcagggggtccaatgtttcattaactctggatatgagtagcttaggtaacattgagccatttgtctccatcccgacacccagggaaaaagtcgcgatggagtacctgcagtcagcctcgagaatcctcactcggtcgcagctgagggacgttgtggcgtctagccacctgctccagtcagagttcatggaaatccccatgaattttgtcgaccccaaggagatagatataccgcgtcacggcacgaaaaatagatacaagactatcctgccaaacccactgtccagagtgtgtctacgcccgaagaacgtaacagatagtctatccacctacattaatgcgaactatattcggggctacagcggcaaggagaaagcgttcatcgccacacagggacctatgattaatacggtcgatgacttctggcaaatggtttggcaggaggatagccctgtcattgtcatgattaccaagctaaaagaaaagaacgaaaagtgcgtgctgtactggccggaaaagcgaggaatctatgggaaggtcgaagtactggtaatctccgtgaatgaatgtgacaactatacaattcggaacttggtccttaagcagggttcccacacccagcacgttaagcactactggtacacgtcatggcctgatcataaaacgccagactcggcacagcccctgttgcagctgatgcttgacgtggaggaggacagactggccagccagggaaggggaccggtggttgtacattgctctgctggaatagggaggaccgggtgcttcattgctacctcaatcggatgccagcagctgaaggaggagggggtcgtcgacgctctaagcattgtttgtcagttgagaatggaccgcggtggcatggtgcagacttccgagcagtacgagtttgtccaccacgccttatgtttgtatgagtcccgtcttagcgccgagacggtacagtag

SEQ ID NO: 29236 - DNA, 1239 bp, Artificial Sequence
  Description of Artificial Sequence: Synthetic coding sequence
atgatcctttaccgcctgaaggagagatttcagttgtcactgcggcaggataaagagaagaatcaggagatccacctctcaccgattaccttacagcccgcactttcagaggctaagactgtgcactctatggtccagcccgaacaagcccctaaggtactgaacgtcgttgtggaccctcagggcaggggcgcccccgaaataaaggcaaccactgcaacgagcgtctgcccatcccctttcaaaatgaagcctataggactacaggaacgtcgagggtctaatgtcagtctgaccctggacatgtcaagtctggggaatattgaacccttcgtcagtattcctacaccacgagagaaggtggccatggaatatctccagtcggccagccgaatactcactcgtagtcaactacgagatgtggtggctagttcccacctgcttcagtcggagttcatggagattcctatgaattttgttgatccaaaggaaatcgacatacccagacacggaacgaagaacaggtataagaccatactcccaaatccactttcacgagtgtgccttcggcctaagaacgtgacggattctctgagtacttatatcaatgccaactatatccggggatactctggcaaagaaaaagcatttattgctacacaaggccctatgatcaacaccgtggacgacttttggcagatggtgtggcaagaagacagtccagttattgtgatgattacaaagctgaaggaaaaaaatgaaaaatgcgttctgtattggccggagaagagaggcatatatgggaaggtagaagtgcttgtgatcagtgttaatgaatgcgataattacaccatccggaacttggtcctgaaacagggcagtcacacgcagcatgtgaaacattattggtacacctcgtggccggaccataaaacgccagactctgctcagccgctgcttcaacttatgctggatgtcgaagaagaccgactggcatcacaaggtagaggccctgtggtcgtgcactgttccgccgggatcggtcggaccgggtgcttcatcgctacctccatcgggtgtcagcagctcaaggaagagggcgtggtggacgccctgtcaatagtgtgccagctgcgaatggaccggggggggatggttcagacttctgaacaatatgaattcgtgcaccacgcactttgtctttatgagagccgcctgagcgccgaaaccgtgcagtag

SEQ ID NO: 29237 - DNA, 597 bp, Artificial Sequence
  Description of Artificial Sequence: Synthetic coding sequence
atgattttgtatcgcctgaaggagcgctttcagttgtcgctccggcaagataaagagaaaaaccaggaaattcatttgtccccaatcacgctgcagcctgccctgtcagaggccaaaactgttcactctatggtccagcctgaacaggcacccaaagtgctgaacgtggtcgttgatcctcagggacgtggcgcacccgagatcaaagctaccaccgccacttcagtgtgcccttcacccttcaagatgaaacccataggattgcaggagaggagggggtccaacgttagcttgaccctcgatatgtcatctctgggtaatatcgagccattcgtaagcatccccacacccagagagaaggtcgctatggagtatttgcagagcgccagtcggatcttgaccaggtcccagctcagggacgtggtcgcttcatctcatctgctgcagtctgaattcatggagatcccaatgaactttgtggaccctaaggaaattgacataccccgccacggcaccaaaaaccgttataagactatcctacctaacccgttatccagggtttgtctccggcctaaaaacgttactgacagtctgtag

SEQ ID NO: 29238 - DNA, 4353 bp, Artificial Sequence
  Description of Artificial Sequence: Synthetic coding sequence
atggcttctctggccgccctggccctgtcattgctgctaaggctgcaactgccaccactccccggagccagggcccaatcggccgctggggggtgcagtttcgatgagcactatagtaattgcggctactccgttgcgctgggtaccaatgggtttacttgggaacagataaacacctgggaaaagcctatgctcgatcaggctgtccccacaggctcattcatgatggtcaattcttcagggcgggcttccggtcagaaagcccatctgctgctcccaaccctgaaagagaacgacacacactgcatcgacttccattattacttctcctcacgcgaccggtcctccccaggcgcactgaacgtttacgtcaaggtcaatggagggccacagggaaacccggtgtggaatgttagcggggtggttacagagggttgggtgaaggcagagctggccatctccacattttggcctcatttctaccaggtgatctttgaatcggtttcactgaaaggtcaccccggatacatcgccgtggacgaagtgagggtcctggctcacccttgccgcaaggcaccgcacttcctccgactccaaaacgtggaagttaacgttggccagaatgctacgtttcagtgcattgctgggggcaagtggagccagcatgataagctctggttgcagcaatggaacggcagagacacggctcttatggtgacacgagtggtgaatcataggagatttagcgcaacagtcagtgtcgcggacacagcccagagaagcgtgtcaaaatatcggtgtgttattcggtccgatggaggctcaggggttagtaattacgccgagctgatcgtgaaagagccaccaactccaatcgcacccccggagctgttggccgtcggcgctacctacctgtggataaaacctaacgccaacagcatcattggtgatgggccaatcatactgaaagaagtggaatacaggaccaccaccggaacttgggccgagactcacatcgtggattcccctaactacaagctgtggcacctggatcctgacgtagagtacgagattcgagtgctgctcactcggcccggggaaggggggactggacccccaggtccgcctttaacgacacgcacgaaatgtgcggaccccgtgcacggtccccagaatgtcgagatcgtcgacatccgcgcaaggcaactcacccttcagtgggaaccctttggttatgctgttacccgatgccacagctacaacctcacggttcaatatcaatatgtgttcaatcagcaacaatatgaggctgaggaggtcatacagacttcgagccactacacattgcggggactgcgaccctttatgacaattcgactgcgactgttactgagtaaccccgaaggcagaatggagtcagaggagctggtagttcagaccgaggaagacgtgccaggagccgtccctctggagtctatacaagggggacctttcgaagaaaaaatttatattcaatggaagccccctaacgagactaacggagtgattacactctatgagatcaactataaggctgtggggagtctcgacccttccgcagacctgagttcacagaggggcaaggtttttaaacttaggaacgaaacccatcatctgttcgtcggcttgtacccaggcacaacgtattcttttaccataaaggctagcactgctaagggatttggcccccccgtcacgacacggattgctacaaaaatcagcgccccatccatgccggaatatgacacagataccccgctcaatgagacggatacgaccattacggtaatgttgaagccagcccaatctcgcggcgcccccgtcagtgtgtatcaattggtggtgaaggaagaacggctccaaaagtcacgccgggccgccgacattattgagtgcttctcggtgcctgtatcctatagaaacgcatccagcctggactctttacactacttcgccgcggaattaaagccggcaaaccttccagttacacagccatttaccgtgggagacaacaaaacgtacaacggttactggaacccccccctgtctccattaaaaagctactcgatttactttcaggctctctccaaagccaatggtgagacaaaaattaattgtgtgcggctggctaccaaagccccgatgggctcggctcaagtgacgccaggtactccactctgcctccttaccacaggggctagtacccagaactctaacaccgtggagccagaaaaacaggtggataacaccgttaagatggctggtgtcatagccgggttgttaatgttcattataatcctgctcggagtgatgctgactatcaaaaggcgtaagcttgctaagaagcagaaagagacacagagtggcgcacagcgggaaatggggccagtggcctctgccgacaaacctaccacaaagctgagtgcttctcgtaacgacgagggattcagctcaagtagccaggatgtaaatggctttactgatgggagtaggggagagctcagtcagcccaccctgactatccagactcatccttaccggacatgcgaccccgtcgagatgagctatccaagagaccagttccagcccgcaatccgcgtcgctgatctgttgcaacatatcactcaaatgaagagggggcaggggtatgggttcaaggaggaatacgaagcactgcccgaaggccaaacggcctcctgggatactgctaaggaagatgagaaccgcaacaaaaataggtatggaaacatcatctcttacgaccactctcgggttcggttactcgtgctggatggagacccacattcagactacattaatgcaaattacatcgacgggtatcaccggcctaggcattacatcgccacacaggggcctatgcaggagaccgttaaggacttctggcgaatgatttggcaggagaactcagcgtctatcgtgatggtcacaaacctcgtggaggtaggcagggtgaagtgtgttagatactggcccgacgacacagaagtgtacggggacataaaggttacgcttattgagactgagcctctcgctgagtatgtcataaggaccttcaccgtccagaagaaaggctaccatgagattagagagctcaggctcttccactttacttcctggcctgaccatggagtcccatgctacgcaacaggactgctcggcttcgtgaggcaagtgaagtttcttaaccctccagaggcaggacctatcgtggtccactgctccgcaggcgcaggcaggacaggctgcttcatcgccatcgacacaatgctcgacatggctgaaaacgagggcgtggtcgatatctttaattgtgtccgagagttaagggcccagagggtgaatctggtacagaccgaagaacagtatgtgttcgttcatgatgctattctggaagcttgtttgtgtgggaataccgccatcccggtatgtgagttccgatcactttactacaatatcagccgactcgatccgcaaaccaactcatcccaaatcaaggacgagttccaaacactgaacattgtcacacctcgggtgagacccgaggactgcagcatcggattacttccgcggaaccatgataagaacaggagcatggatgtcctaccactggatcgttgtctaccctttcttatctctgtcgatggggaatcctccaactacattaacgccgccttgatggattctcacaagcagccggctgcattcgtggtgacgcagcatccccttccgaacactgtggccgacttctggagactggtctttgattataattgctccagcgtggtaatgctgaatgagatggacaccgcccagttttgtatgcagtattggcccgagaagacaagtgggtgctacggacctatccaggtggagttcgtgtctgccgatatagacgaagacattattcaccgcatcttcaggatctgcaatatggcccggccccaggacggatatcggattgtacagcaccttcagtatatcggctggccagcctaccgcgatacgcctccttcaaagaggtctttactgaaggtggtgcggcgcctggaaaagtggcaagagcagtatgacggtagagaaggtcgcaccgtggtacattgccttaacggcggtgggagaagtggtacattttgtgccatttgtagcgtttgcgagatgatccagcaacagaatatcatcgacgtctttcatatagtcaaaaccctgaggaacaacaaaagcaacatggtcgaaaccttagagcaatacaaatttgtttacgaggtagctttggagtacttgtctagcttctag

SEQ ID NO: 29239 - DNA, 4356 bp, Artificial Sequence
  Description of Artificial Sequence: Synthetic coding sequence
atggcttctcttgcagccctggccctctccctgctgctgagactgcaactacctccccttcccggggcgcgggcacagagtgcagctggaggctgttcctttgacgagcattacagtaactgcggatacagcgtcgccttggggacaaatgggttcacctgggagcagatcaatacatgggaaaagcctatgctagatcaggccgtcccgacaggatctttcatgatggtcaactcatcaggccgagcatccgggcaaaaggcccacctgctgcttcctaccctgaaggaaaatgatacgcactgtattgattttcattattacttttcgtcacgagaccggagcagccctggagccctcaatgtgtacgtgaaagtaaacggcggacctcagggcaaccccgtgtggaatgtgagtggagtggtgactgaaggatgggtgaaggcagaacttgccatcagcacattttggcctcatttctatcaggtcatcttcgaatcagtgagtcttaaaggtcatcctggatacattgctgtagacgaagtaagagttctcgcccacccctgcaggaaggctcctcacttcctgcgacttcagaacgtcgaagtgaatgtgggacagaacgccacgtttcagtgtattgcaggaggcaaatggtcacagcacgacaagctctggttgcaacagtggaacggtcgtgacacagctctgatggtcaccagagtagtgaaccataggagattcagtgccactgtatccgtggcagacactgcacaaaggagcgtgtcaaagtatagatgcgttattagatcggacggcggcagtggcgttagcaattacgccgaactgatcgtgaaggagccccctacccccatcgctcccccggaactgctggcagtcggagcgacctacctttggataaagccaaacgcgaattctatcattggggatggtcccataattcttaaggaggtggagtaccggacaaccacaggcacctgggcggagacgcacatcgttgattctccaaactataagctgtggcacctggatcccgacgtggaatacgagatacgcgtgctcctgacacggccaggcgaaggcggcactggaccacccggcccaccattgacaacgcgaacaaagtgtgccgaccctgtccacggccctcagaacgtcgaaattgtcgatatccgagcccggcagctgacacttcagtgggagccttttggttacgctgtcacaaggtgtcatagctacaacctcaccgtgcagtaccagtacgtgtttaaccagcagcaatacgaagcagaggaagtaatccaaaccagcagtcactacacgttacgaggattgagaccattcatgacaatcagacttaggctccttctgagtaacccggagggacggatggagtctgaagagttggtcgtgcaaacagaagaggacgtgcctggcgctgtcccattggagagcattcagggtgggccgttcgaggagaaaatttacattcaatggaaacctccgaacgagacaaatggagtgatcactctctacgaaatcaattataaggccgtaggctccctggaccctagcgccgatctctcatcccagcgcgggaaggtgttcaagctgagaaatgagactcaccatttgtttgtgggcctataccccggtactacctatagcttcaccattaaggcaagcacggccaaaggctttggacctccagttaccaccaggatcgctactaaaatcagcgccccgtcgatgcccgagtatgacacagacacacccctgaatgaaaccgatacaacgatcaccgtcatgcttaagcctgcgcagagtcgcggggccccagtctccgtgtatcagctcgtcgtcaaggaggagaggctgcagaagtcaaggcgagccgccgatatcatcgaatgcttcagtgttcccgtaagctatcgtaatgcctcatctctagactctctgcattatttcgcggccgagctcaaacccgctaacctgccagtgactcagccgttcactgtgggcgacaacaaaacatacaatggatactggaaccccccattgtctccacttaagtcatactccatttatttccaggcattgtctaaagcaaatggggagactaagattaattgtgtgaggctggccacgaagggagctagcacacaaaactcgaatacagtggagcccgagaagcaggtagacaacaccgtgaaaatggcaggagtcatcgcaggtctgctgatgtttattattattttgcttggtgtgatgctgactattaagaggagaaagttagctaaaaaacagaaggagacccagagtggcgcccaaagagagatggggccggtggccagcgccgacaaacccaccacaaagctgtctgctagcagaaacgatgaaggcttcagcagttccagccaggacgtgaacggatttacagacgggtctaggggcgagctgtcccagcctacactaaccatccagactcacccatacagaacctgcgaccccgtagaaatgtcttaccctagggatcagttccaacctgccatccgggtcgccgatctgctgcagcacatcacccagatgaaacgcggccaaggttacggatttaaggaagaatacgaggcactcccagagggacagacagcctcctgggacaccgccaaagaagacgagaatcggaataagaaccggtacggaaacattatttcctatgatcactcgcgcgtacgtttactcgtcctggacggtgacccgcatagcgattacatcaacgccaattacatagatggctatcacaggccaaggcactatatcgcaacacaggggccgatgcaagaaactgtgaaggacttctggaggatgatttggcaggagaacagcgctagcattgtgatggtcactaatctagttgaagtaggacgacatcctgccgaacacacagtcggaaacgccaccttaggtagagccgccagccccggtatggtgaaatgcgtgcgatactggcctgatgatactgaagtgtatggagatattaaggtaactctgatagagacggagcctctggccgaatatgttatccggacgtttacagtccagaaaaagggataccacgaaatccgcgaactgaggttgttccacttcacaagttggccggatcacggcgtaccttgttacgccaccgggctgcttggctttgttcgacaggtgaagtttcttaacccccccgaggctggacctatagtggtgcattgtagcgccggggccggcaggactgggtgcttcatcgcgatcgatacaatgctggatatggccgagaatgagggtgttgttgacattttcaattgcgtccgcgagctgcgcgctcaacgagtcaatctggttcaaaccgaagaacagtacgtctttgtgcatgacgccatccttgaggcatgcctgtgtgggaacacagccatacccgtctgtgaattcaggagtctgtattacaatatatctaggctggacccgcagactaactcatctcagataaaagacgaattccaaacgctgaacatagtcacacctcgggtgcggcctgaggactgcagcatcggactccttccaagaaaccacgacaaaaatcgttccatggatgtacttcctttggaccgctgtctcccctttctgatctctgtggatggggagagcagtaattatattaatgccgctctcatggacagccacaagcagcctgccgcatttgtggtgacccaacacccccttccaaatactgttgctgatttttggagactcgtgtttgactacaactgtagttctgtagtgatgctaaatgagatggacacagcccaattctgcatgcagtattggccagaaaagacgagcggatgctacggacccatccaggttgagttcgtgtccgcagatatagatgaggatataatccacagaatcttccggatctgtaacatggcccgaccccaggatggttacaggattgttcaacacctgcagtatatcggttggcccgcctaccgtgacactcctccttccaagcggtccctgctcaaggtcgttcggaggctggaaaaatggcaagagcagtatgatggtagagaagggcgcaccgtggtccactgcctgaacggagggggccgatccggcaccttttgcgcgatctgtagcgtatgcgagatgatccagcagcagaatattattgacgttttccacattgttaagacgcttcgcaataataagtcgaacatggttgagactctcgagcagtacaaattcgtctacgaggtggcgttggagtacctcagcagcttttag

SEQ ID NO: 29240 - DNA, 4326 bp, Artificial Sequence
  Description of Artificial Sequence: Synthetic coding sequence
atggcgagcctcgcggcgctcgcactaagcttgcttctgaggctacagctgccacccctccccggcgcacgagctcaatcagccgccggcggttgctccttcgatgaacactattccaattgcggttactccgtggcattaggtaccaatggattcacctgggagcaaattaacacatgggagaagcccatgctagaccaggccgttcctaccggatcctttatgatggtgaacagtagcggcagggcttccggacaaaaggcccatctcctgcttcctaccctcaaggagaacgacacccactgtatcgattttcactattacttcagctcgagggacaggagcagccccggcgccctcaatgtctacgtgaaagtgaatggcggaccccaggggaacccggtctggaatgtcagtggtgtggtgaccgagggatgggtgaaggcggaacttgcgatcagcaccttctggccacacttttaccaagtcatttttgagtccgtgagtctgaaaggccaccccgggtacattgcagtggatgaagtgagagttctagctcacccatgccggaaggctcctcatttcttaagactgcagaatgtggaggtaaacgttggccagaatgccactttccaatgcatagctggggggaagtggtcgcagcacgacaaactgtggctacagcaatggaatggccgggacactgcactgatggtgacaagagtggtgaaccacagaagattttcagcaacagtgagtgtggccgacactgctcagagaagtgtgtccaaatatcgctgtgtgatacgcagcgatggcgggtcaggggtgtccaattacgccgaactcatcgtgaaagaaccaccaaccccaatagcccccccggaactgcttgctgtaggcgccacctatctgtggataaaacccaacgccaatagtatcataggtgacggaccaattattcttaaagaagtggaatatcggaccaccactggaacctgggctgagacacacattgtcgactctcccaactacaaactgtggcacctagatcctgatgtcgagtatgaaatccgcgttttattaacaagacccggggagggtggcacgggcccgcccggcccgccattgacgacgaggaccaagtgcgcggaccctgtccacggcccccagaatgtggagatcgtcgatatccgagccaggcagctgacgttgcagtgggagccattcggatatgctgtcactaggtgtcacagctacaacctcacagtccagtaccagtacgtgtttaaccagcagcagtacgaagccgaggaggtcatccaaacttcaagccactacaccctgcgaggcctgcgccctttcatgaccatacggctgagattgttgttaagtaatcctgaggggcgcatggagagcgaggagctagtagtgcagacggaggaggacgtgccgggagcagttcctcttgagtctatacaagggggaccattcgaagaaaagatttacatccagtggaagcccccgaatgagaccaatggtgttatcaccttgtacgagatcaattataaggctgtgggaagcctcgatccttcagcggatttatccagtcaacgcgggaaagtcttcaaattgaggaatgagactcaccacctgttcgttggcctctatcccggaactacttattctttcacaatcaaagctagcacagcaaagggctttgggcctcccgttaccactcgtattgccactaaaataagtgcaccaagtatgccagagtacgacaccgacactcctcttaatgagaccgatactacaattactgtgatgctcaagcccgcgcaaagcagaggagcacccgtgagcgtgtaccagttagtggtgaaagaggagcgcctccagaaatctagaagggccgccgatattattgagtgtttctctgtgcctgtgagttatcggaacgcctcctccctagactccctgcattacttcgccgctgaattgaagccagctaacctgccagtgacccagccgttcacagtcggggacaataaaacgtataatggttattggaacccacctctttcgcctctcaagtcctactcaatatattttcaggctttatcaaaggctaacggagagaccaagataaactgtgtcaggttagctactaaaggtgctagcacccagaatagcaacacagtcgaacctgagaagcaggtggacaacacggtgaaaatggccggcgttatcgcaggactcctgatgtttattataatacttctcggggttatgctgaccatcaagcgcaggaggaatgcctattcatacagctactatctcaaacttgccaagaaacagaaggagacccaatctggggctcaaagagagatgggacctgtggcctcagccgataaaccgaccacaaagctgtctgctagccgaaatgacgagggcttctcctcttcatctcaggacgtcaatggttttaccgatgggtcaagaggcgagctgtcacagccaacactgaccattcagacccatccctaccgaacctgcgacccagttgagatgtcttaccctagagatcagtttcagccagccatacgagtggccgatctgctccagcacatcactcagatgaagcgcggacagggatacggctttaaggaagagtatgaagcattaccagagggacagaccgcctcctgggacaccgcaaaggaggacgagaaccggaataaaaatagatacggtaacatcattagctatgaccatagcagagtaagactgcttgtgctggatggagacccgcatagcgactatattaatgctaattacattgacggataccacagacctcgacactacatcgcaactcagggcccaatgcaggaaaccgtgaaagatttttggcgaatgatttggcaagagaactcggcttccattgtgatggtgaccaacttggtggaggttggccgtgtgaagtgtgttaggtattggcccgatgataccgaggtctatggcgacatcaaagttactcttatagaaaccgaaccactagccgaatacgtcatcaggacatttacagtgcagaaaaaaggttaccatgaaatacgcgaacttaggctgttccatttcacctcatggcccgatcacggcgtcccttgttatgcaactggcctgctgggattcgttcggcaggtgaaattcctgaatccaccagaggctgggcctatcgtggtgcattgctcagcaggcgccggccgtacagggtgcttcatagcaatcgatactatgctggacatggctgagaacgaaggtgtggttgatattttcaactgcgtgagggagctgagagcacagcgcgtgaatctggtccaaactgaggagcagtatgtgtttgtacacgacgcgatcttagaagcttgtctgtgtggcaacactgccatacccgtctgtgagtttcgatcgctgtactacaacatcagtcgcctggaccctcagaccaattctagccagattaaggatgaattccaaaccctgaatattgtgacacctcgcgtgagaccagaagattgcagcataggtctgttaccccgaaatcacgataagaatcgaagcatggatgtgctgccactagacaggtgcttgccgttcttaatttcagtcgacggagagtcatccaattatattaacgcagcactgatggactcccacaagcagccagccgcattcgtcgtgacacaacaccccttaccaaatactgttgccgacttctggcggctggtatttgactataactgctccagtgtggtcatgctcaacgagatggacaccgcacagttttgcatgcagtattggcctgagaagacaagtggctgctacggaccgatccaggtggagtttgtctctgcggacatcgatgaggatatcatccaccgcatttttcgtatctgcaatatggcccgcccacaggacggttacaggatcgtacagcaccttcagtatataggttggccagcgtatcgagacacacccccgtccaaaaggtcactgctgaaggttgtgcgacgattggaaaagtggcaagagcagtacgatggacgagagggaagaaccgtggtgcactgtctgaacggaggaggcagaagtgggactttttgcgctatttgctccgtctgtgagatgattcagcagcagaatatcatagatgttttccatattgtcaaaaccttgaggaataataagtctaatatggttgagacgctagaacagtacaaattcgtctatgaggtggccctggaatacctaagttcgttttag

SEQ ID NO: 29241 - DNA, 4323 bp, Artificial Sequence
  Description of Artificial Sequence: Synthetic coding sequence
atggctagcctggctgctctagctctaagcctgcttctgaggttgcaactgcctccattacccggagcacgggcacaaagcgcagcagggggttgttcctttgatgagcactattcaaattgcgggtactctgtagcgttaggaactaatggttttacttgggagcagataaatacttgggagaaacctatgctcgaccaggccgtaccgaccggctctttcatgatggtgaactcttccggtcgggcctcaggacagaaggcccatctgctcctaccaaccctgaaggagaacgatacgcactgtatagacttccactattatttttctagtcgcgatagaagctctcccggcgcattaaacgtctatgttaaggtcaatggtggtcctcagggaaaccccgtttggaacgtttccggagtcgtgacagaaggatgggtgaaggccgagctcgcgatctctaccttttggccccacttctaccaggtaatttttgaatccgtgagtttgaaaggacatccaggttatattgctgttgatgaagtccgagttcttgcgcatccttgtagaaaagcacctcatttccttcgcctgcagaatgtagaggtgaatgtgggccaaaatgcgacattccagtgcatagccgggggtaagtggagtcagcacgacaagttatggcttcagcagtggaacggaagagacacagccctgatggtcactcgtgtggttaatcatcggagattttcagcaactgtgagtgtcgccgacacagctcagcggagcgtttccaagtaccgatgtgttattcgttcagacggaggctctggtgtatccaattacgcagaactaattgtgaaagaaccccctacacccatcgccccacctgagctgctggcagtaggggcgacctacctgtggattaaaccaaatgccaacagtatcattggtgatggcccaatcattctgaaggaagttgaatatagaaccaccactggaacctgggccgagacccacatcgtggattcaccgaactacaagttgtggcatttggatcccgacgtggagtacgagattcgggtacttctgacaagaccaggcgaaggcggcaccggtcctcccgggcccccactgacaaccaggaccaagtgcgcggacccggttcacggcccgcagaacgtggaaattgttgacatccgagcccggcagttaacattgcagtgggagccctttgggtatgccgttacgcgctgccactcgtataacctcactgtgcaataccagtacgtgttcaatcagcagcagtacgaagccgaagaggttatccagacgagttcgcactatacactgagaggtctccgacctttcatgaccatccgactcaggttattacttagcaatccagaagggcggatggagtccgaagagctggtcgtacagaccgaggaggacgtaccaggggctgtaccgctggaatcaattcagggcggaccattcgaggagaagatctacattcagtggaaaccccccaacgagaccaatggcgttatcaccttatatgagatcaattacaaagctgttggatccctggacccaagcgccgacctttcttcgcagaggggcaaggtcttcaaacttcgaaatgagacgcaccacctatttgtggggctttatcccggcacaacatactcgttcaccataaaggcttccaccgccaagggtttcgggccaccagtcaccacccggatcgcaaccaaaattagcgctccttcgatgccggagtatgacactgatacacctttaaacgagaccgacaccaccatcacagtaatgctgaaacccgcccaatcacgcggcgctcccgttagcgtgtaccagcttgttgtcaaggaggagaggttgcagaagagccggagggctgccgatatcatcgagtgcttcagcgtgcctgtgagctaccgcaatgcctcctctctggacagtttgcattatttcgcggcagaattgaaacccgcaaatctaccagtcacacagccgttcacggttggggacaataagacgtacaatgggtactggaatccacctctgagcccattgaagtcttactctatttatttccaggcgctttccaaagccaatggagagaccaaaatcaattgcgtgagactggctacaaaaggagcatccactcagaatagcaataccgtcgagccagaaaagcaagtggataacaccgtgaagatggccggtgtcatcgccggcctcctgatgttcattattattctgttgggagttatgctgactattaagcgaaggcgtaacgcctatagctattcatactaccttaaattggcgaagaaacagaaggagacccagtccggcgctcaacgagaaatgggaccagtcgcatccgctgataagccgactaccaaactcagtgcttcccggaatgatgaagggttttcaagctcaagtcaagatgtgaacggctttaacggttcacgaggcgaactgagtcagcccaccttgactatccaaacacacccataccggacctgcgatcccgtggagatgtcatatccccgtgaccagtttcaacccgctatcagagtagcagatcttcttcagcatattacgcagatgaaaaggggccagggctatggattcaaagaggagtacgaagccttgccagagggacaaaccgcatcgtgggacacagctaaggaagatgagaacagaaataagaaccggtacggaaatattatcagttatgaccattccagggtgcgcctcctggtgcttgacggagatccacactcagactacattaatgctaactacatcgacggctaccaccggccccgtcactacatcgccacccagggtcccatgcaagagacagtgaaggacttttggaggatgatttggcaagagaacagtgcaagcattgtcatggtgacaaatctcgtggaggtggggagagttaagtgcgtcagatattggcctgacgacacggaagtctacggagacatcaaagtgactctgatagaaacagagcccctggccgagtacgtcattaggaccttcaccgttcaaaagaaaggctatcatgagatacgcgaacttcggctcttccatttcacctcttggcccgatcatggtgtcccttgctacgctacaggactcctgggctttgtcagacaggtcaagtttctcaatccacccgaagcagggccaattgtcgtgcactgctctgcaggggctggcaggaccggttgcttcatagccatcgacaccatgcttgatatggccgaaaatgaaggggtcgtggacatttttaattgcgtccgcgagctaagagctcagagggtaaacctggtgcagaccgaggaacagtacgtctttgtgcacgacgcaatcctcgaggcttgtttgtgtgggaacactgccattcccgtttgcgagttccggagtttatattacaatatatcaaggctggacccgcagactaatagttcacagatcaaggacgaatttcagacccttaacatcgtgacaccacgcgttcgtccagaagactgctctatcggactcctgccccggaatcacgacaagaataggagcatggacgtgcttcctctggatcgatgcctgccattcctgattagcgtggacggagaatctagcaattacataaacgcggccctgatggactcccacaagcagccagctgcttttgtcgtgacccagcaccccctcccgaacactgtcgccgatttttggagactggtttttgactacaactgttcttctgttgtcatgctaaatgagatggacactgctcagttttgcatgcagtactggcctgaaaagactagcgggtgctacggccctatacaggtggagttcgtcagtgctgatatcgacgaagatataatacaccgcatattccggatctgcaacatggccaggcctcaggatgggtatcgcatagtgcagcacctgcagtacattggctggccggcctatagggacaccccgccctccaagcggtctctgctgaaggtagtgcgaagattagagaagtggcaggaacagtatgacggacgtgagggaagaactgttgtacattgcctgaacggaggcggaagatccggaactttttgcgccatctgttccgtatgtgagatgatccaacagcagaacatcatcgatgtgttccacatcgtgaaaacgctcaggaataacaagtccaatatggtggaaaccctcgaacagtacaaattcgtgtacgaagtggccctcgagtacctttcttctttctag

SEQ ID NO: 29242 - DNA, 4335 bp, Artificial Sequence
  Description of Artificial Sequence: Synthetic coding sequence
atggctagcttagctgcattggcattatccctgctgctgcgactccaactcccccccctgcctggggcaagagctcaaagcgctgccggggggtgctcttttgatgagcactactctaactgcggctattccgtggccctgggcaccaacgggtttacttgggaacagatcaatacctgggagaagcccatgctggatcaggcagtgcctacaggcagcttcatgatggttaatagcagcggccgagccagcgggcagaaagctcacctgctattgcctactctgaaggagaatgacactcactgcatagattttcactattacttttccagccgagacagatcctctcccggcgccctgaacgtttacgtcaaagtaaatgggggcccgcagggaaaccccgtttggaatgtcagtggcgttgtgacggagggctgggttaaggccgaacttgcgatctctactttctggccccatttctatcaagtgattttcgaaagcgtttctcttaaaggccatcctggttacattgccgtggatgaagtgagagttctggcacatccctgccgtaaggcaccgcatttccttaggctgcagaacgtggaggtcaacgtcgggcagaacgccaccttccagtgtatagcagggggcaagtggtcacaacacgacaagctgtggctgcagcaatggaatggacgcgacaccgcacttatggttacaagagtggtaaatcatcgccgcttctccgctaccgtaagtgttgctgataccgcgcagcggagcgtgagtaagtaccgctgcgtcattcggtctgatggcggatccggggtgagcaattatgctgaactcattgttaaagagccccccacaccaattgccccgcccgagctgctggccgtcggtgctacctacctgtggattaagcccaatgcgaacagtattatcggagacggacccataattctcaaagaggtagaataccgcactacaaccggtacatgggccgagacccatattgtcgattctcccaactataaactttggcacttggacccagacgtcgagtacgagatcagggtcctactcacacgccccggggaaggcggcacagggccccccggccctcccctgacaactcgtactaaatgcgccgaccccgtgcatggccctcagaatgtagagatcgttgatatccgggcccgccagttgacccttcaatgggaacccttcgggtatgcggtgacaagatgccacagctacaacttaacagtacagtatcagtacgtgtttaatcagcagcagtacgaagccgaagaagtgattcagacttctagccactatactctgcggggactgaggccgttcatgacaatacgacttcgactgctactgagtaacccggaaggacggatggagtctgaagagctggtggtacagaccgaagaggacgtccctggagcggtgcccttagaatcaattcaggggggtccttttgaggagaaaatctacattcagtggaagcctccaaatgaaaccaacggcgtgattaccctttacgaaatcaattacaaggctgtgggcagcttagaccctagcgccgatctatcctcgcagagaggcaaggtgtttaaactacgtaatgagactcaccacctgtttgtcgggctctacccagggacaacatatagttttactattaaagctagtaccgccaagggcttcggtccaccagtgactacgaggatcgcaacgaagatctccgctccctcgatgcctgagtatgacaccgatacccccctgaacgagacagacaccactatcaccgtcatgctgaagcctgcccaaagcaggggtgcccccgtgagcgtgtaccagctggtggttaaggaggagcggttgcaaaagagcagacgcgccgcagacattattgaatgttttagtgtgcccgtgagctataggaatgcatccagcctggactccttgcattacttcgccgcagaacttaagcctgctaacttgcctgtgacgcaacccttcacagtgggggacaataagacatataatggctactggaaccccccccttagtcccctcaaatcgtacagtatttacttccaggccctgagcaaggctaatggagagaccaagattaactgcgtgcgcctcgctaccaaaggcgcttccacgcaaaattctaacaccgtcgaaccagagaagcaggttgacaacacagttaagatggcaggagttattgctggcttgctgatgttcatcattattctcctcggagtgatgctgactattaaaaggcgaagaaatgcttattcttatagctactatctgagtcaacggaaactggctaagaagcagaaggagacccaaagcggcgcccaacgcgaaatgggcccagtcgccagcgcagacaaaccaacaaccaaactcagtgccagcagaaacgacgagggattttcttctagcagccaggatgtcaacggatttacagacggatcaagaggagagctctctcagccaaccctgaccatacagactcacccctatagaacgtgtgatcccgtggagatgagctatccccgcgatcagttccaaccagccattagggtcgccgacctgctgcagcacataacccagatgaagaggggacagggctatggattcaaagaggagtacgaagccctccctgaggggcagacagcttcttgggatacagcaaaagaagatgagaatcggaataaaaataggtatggtaatatcatctcttacgaccattcacgtgtacgactcctagtgcttgatggtgacccccacagcgactacatcaatgcgaactacattgatgggtaccaccgcccccgccactacatcgccacgcaaggaccgatgcaagagacagtgaaggacttttggaggatgatctggcaggagaactcagctagcatcgtgatggtcaccaacctggtggaggtgggccgcgtgaaatgtgtgagatactggccggacgacactgaggtgtacggtgacatcaaagtaaccctgatcgagactgagcctctggcagagtatgtcatccgcactttcacagtacaaaaaaaaggatatcacgaaattcgggagctgaggctttttcatttcactagctggccagatcacggtgtgccctgttacgccacaggcctgctggggtttgtgcggcaggtgaaatttttgaacccccctgaggccggcccgatcgtggtgcattgtagtgccggtgccgggagaacaggatgctttatagcaattgatacaatgttggacatggccgagaatgagggggtggtcgatattttcaactgtgttagggagctaagagcccagcgggtgaatctggtccaaaccgaggaacagtatgtcttcgttcatgatgccatcctggaggcctgcctgtgcggaaatactgctatacctgtgtgcgaatttagaagcctgtattataatatcagtcggctggatccccagaccaattcttctcagattaaagatgagttccaaacactgaatattgttaccccacgggtcagaccagaagactgttcaatcgggttattgcctagaaaccacgacaaaaacagatccatggatgtgctgccactggacagatgtctgccattcctaatttccgtggatggtgagagctctaactacatcaacgctgccctgatggacagtcataaacaacctgcggcgttcgtggtgacacaacaccccctgccaaatacagttgccgacttttggagactggtgttcgattataattgctcctccgtagtgatgctaaatgaaatggacacagcacaattttgcatgcaatactggcctgaaaagacaagcgggtgttacggcccaattcaagttgagttcgtgtcagccgacatcgacgaagacatcattcataggattttccgaatctgcaatatggcaagaccccaagatggctacagaattgtccaacacctgcagtacatcggctggccggcttaccgcgacactcccccaagtaaacggagcctgctgaaagtggtcaggaggctggaaaaatggcaggaacagtacgacgggcgtgaggggagaaccgttgtgcactgcctgaatggcggggggcgctcaggtactttttgtgccatttgtagcgtgtgtgagatgatccagcagcaaaatatcatcgacgtgtttcatatagtcaagacacttcggaacaataaatccaacatggttgaaacactggagcagtacaagtttgtttacgaagtggctctagaatatctcagctctttttag

SEQ ID NO: 29243 - DNA, 4392 bp, Artificial Sequence
  Description of Artificial Sequence: Synthetic coding sequence
atggcatcactggcagcactggccctgagcctacttctgcgtctgcagttaccccctctgccaggcgcccgggcacagtctgcagctggtgggtgcagcttcgacgagcattacagtaactgcggttactcagtagccctagggactaatgggtttacctgggagcaaattaacacatgggaaaaaccaatgttggaccaggctgtgcccacagggtcttttatgatggtcaactcaagcggccgcgcgtcaggccagaaagctcacttgcttttgccgaccttgaaggaaaatgacacccactgcattgacttccactactactttagttctcgggatcgttcatcaccaggggccctgaacgtatacgtgaaagtaaacgggggcccccagggtaaccccgtgtggaatgtgagcggtgtcgttaccgagggctgggttaaggctgagttggccatctcaactttctggccccatttctaccaagtgatctttgagtccgtgtcactaaagggccaccccggctacatagctgtcgatgaggtgcgggtgttggctcacccctgcaggaaggcaccccactttcttagattgcagaacgtcgaagtgaatgtaggccagaatgccactttccagtgcattgctgggggaaagtggagtcagcatgacaaactctggctgcaacaatggaatgggagagacaccgccctgatggtcacaagagtggtcaaccacaggagattcagtgcaacggtgtcagttgcagacacagcacagaggtcggtctctaagtacaggtgcgttatccgttcagatggcgggagcggtgttagtaactacgccgagctcattgtaaaggagccgcccacaccaatcgcgccaccagagttgctggccgtgggggctacttacctgtggatcaagccaaatgctaatagcattattggagatggcccaattatactcaaggaggtcgagtataggactaccacaggcacttgggcagaaacacatatcgtcgactcacccaattacaagctgtggcatctagatccggacgtcgaatatgagattcgggttctgttgacgcggccgggtgaggggggcaccggccccccagggccaccactaactaccaggaccaaatgcgccgaccccgttcatggtcctcagaatgttgaaatcgtggatataagggccagacagttaaccctccagtgggagccattcggatatgcggtaaccagatgccactcttataacctgacggttcaataccagtacgtatttaaccaacaacagtacgaggctgaagaagtgattcaaacctctagtcactatactcttcgggggctacggccctttatgaccatccgcctgcggctgctacttagcaatcctgaaggtcgtatggagtccgaggagctagtggtgcagacggaggaggatgttccaggagcggtccccttggagtcaatccagggtgggccatttgaagaaaaaatttacattcaatggaagcctcctaatgagactaacggggtgatcacactgtacgaaattaattataaggcagtgggttccttagacccgtcagcagatttgtcgtcccaaagggggaaagtttttaagctgcgcaatgagacgcatcacctgttcgttggtctatatccggggacaacatactcatttactattaaggcctccacagctaaaggattcgggcctcccgtaaccaccaggattgcaaccaagatctccgcgccaagcatgcccgaatatgacacagacactccccttaacgagaccgataccactatcaccgtgatgctcaagccagcacagtcacggggagctcccgtgagcgtttatcaattagtagttaaagaagagagactgcagaaatccagaagagctgccgatataattgagtgtttttccgttccggtctcgtatcgcaacgcatcatcgctggattctctgcactacttcgccgccgagttaaagcccgccaaccttccagtgactcagccattcaccgtgggtgataataagacttacaatggctattggaatccccctctctcaccactgaaatcctactcaatatacttccaggctctctctaaagccaatggagaaactaagatcaattgcgtgaggctcgccaccaaggctcccatgggtagcgcacaggtgacacccgggacccctctgtgcctgcttactacaggcgccagtactcagaatagtaatactgtggagcctgagaagcaagttgacaataccgtgaagatggctggggtgatcgctggcttactgatgttcataataatcctcctaggggtcatgctgacgatcaaacgcagaaggaacgcgtactcatactcttattatctgtcccaaagaaaattggcaaagaagcaaaaggagactcagtccggagcccagagagagatgggccccgtggcttccgccgataagcctactacaaagctgagcgcctctaggaatgatgaaggattctccagtagttcgcaggatgttaatggatttactgatggcagccgaggtgaattaagccaacctaccttgacaatacagacccatccttatcgtacctgcgaccccgtggagatgagctaccctagagaccagttccagcccgccattagggtggccgacttgctccagcacataacacaaatgaaacgcggccaaggatacggcttcaaggaggagtatgaagcactgccagagggccaaaccgcatcctgggataccgcgaaagaagatgaaaaccggaacaagaatcggtacggtaacattatcagctatgaccattcacgggtgcgccttctagtgctcgacggcgaccctcattccgattacatcaacgctaattacatagatgggtatcacaggccaagacactacatcgctacacagggtcctatgcaggaaactgtgaaagatttctggcgaatgatttggcaggagaatagcgccagcatcgttatggtcaccaacctcgtggaagtgggacgcgtgaaatgcgtgcgctactggcctgacgatacagaggtttacggagatattaaggtgacccttattgagacagaacccctcgctgaatacgtgatcaggacgttcaccgtgcagaagaaggggtaccatgagattagagaactccggctgttccattttacctcctggcccgatcacggggtcccctgttacgcaacagggttgctaggctttgtgagacaggtgaagttcctcaacccccccgaagccggaccaatcgtggtgcattgctccgctggagcagggcggacgggatgttttattgctatcgacactatgttagacatggcggagaatgagggcgtggtagatatatttaactgcgtgagggagttaagggcacagcgcgtgaacctggtccaaacggaggagcagtacgtcttcgtgcacgacgccatcctcgaggcctgcctatgcggcaatactgccattcctgtgtgtgaatttcggtctttgtattacaacatcagtcgcttagatcctcagactaactcttcccagatcaaagacgagtttcagacgctgaatatcgtcactccaagagtgcgccctgaagactgtagcattggcctgttgcctagaaatcacgacaaaaatcggtccatggacgtgcttccactggatcgatgcctgccattcctgattagcgttgacggggagagttcaaactatattaacgcagccctaatggacagccacaaacagcctgctgcatttgtagtgactcagcatcccctgccaaataccgtcgctgacttctggagattagttttcgattacaattgctcgtctgtggtcatgttgaatgagatggatacagctcagttttgcatgcagtactggccagagaaaacaagcggctgttacggcccaatccaggtagaattcgtctctgctgacatcgatgaggatatcattcatcgtatcttccggatctgtaacatggctagaccacaggacgggtatagaattgtgcaacacctccagtacattggctggcccgcttacagggatactcccccaagcaaaagatcccttctgaaagtggtgaggcggctggagaagtggcaggaacagtacgacggccgtgagggccggacagttgtccattgcctgaacggcggagggcgcagcgggacattttgcgcaatatgcagcgtgtgcgaaatgattcaacagcagaacataattgatgtgtttcacatcgtcaaaactttacgcaacaataagagcaacatggtcgaaacactggagcagtataagtttgtatatgaagtcgccttggaatatctgtccagtttttag

SEQ ID NO: 29244 - DNA, 4296 bp, Artificial Sequence
  Description of Artificial Sequence: Synthetic coding sequence
atggcctctctcgcagcactagcattgtccctgctgctcagacttcagttaccccctttgcctggcgcacgggcccagtccgcggcgggggggtgttctttcgacgagcattattctaactgtggttactccgtcgctcttggaactaacggattcacatgggaacagatcaatacctgggagaaacctatgctcgatcaggctgtgcctactggcagcttcatgatggttaattctagtgggcgggcgtccggtcagaaggcacacctcttgctgccaacactgaaggagaacgacacgcactgtattgactttcactactacttttcatccagagacagaagttcacccggtgctctgaatgtttacgtgaaagtgaatggaggcccccaaggcaatccggtgtggaatgtttctggcgtggtgactgaaggatgggtgaaagcggaactggctatctctacattctggcctcatttttaccaagttatctttgaatccgtgtccctgaagggtcaccccggatacatcgctgtggatgaggtgcgagtgctggctcacccatgccggaaggcccctcattttcttcggctgcagaacgttgaggtgaatgttgggcaaaacgccacatttcagtgtattgctggggggaaatggagccagcacgacaaactgtggctgcaacagtggaatggccgggacaccgcacttatggtgacaagagtggtcaatcaccgacgtttttccgccacggtttcggtagctgacactgctcagagatccgtttcgaaatataggtgtgttatccgaagtgacggagggagcggcgtatcaaactacgctgaactgatagtgaaggaacctccaactccaattgctcctccagagctactcgctgtcggtgccacatatttgtggattaaaccaaatgccaattctatcattggagatggtcccatcatcctgaaggaagtggaatacagaacaaccacggggacctgggccgagacccacatcgtggattccccaaattacaaattatggcatctggaccctgacgtggagtacgaaattcgggtacttctcaccagaccaggggagggagggacaggccctcccggaccacccctgaccacacggacgaaatgtgccgatcccgtgcatggcccccagaacgtggagatcgtggatattcgggcccgccagctgactctgcagtgggaacctttcgggtatgccgtgacacggtgtcattcttataatctcaccgtacagtaccagtacgtcttcaatcaacagcagtacgaggcggaggaagtgattcagactagttctcattatacactgcgaggactgagacctttcatgactatccggctgcgtctcctgctctcaaacccagaggggcgcatggaaagtgaggaacttgtagtccagacagaagaagacgtgccgggggccgttcccctagaaagcatccaggggggaccctttgaggaaaagatttacatccagtggaagccaccgaacgaaactaatggcgttattactctgtatgaaatcaattacaaggcggtcggctcattggacccaagtgcggatctttcaagccaacggggcaaggtgttcaaactgagaaacgagacccaccatctcttcgtgggcctgtaccccgggacaacctactcgtttactatcaaggcaagcactgcaaaaggttttgggccacctgttactacccgtatcgctaccaaaatctcagcaccgagtatgcctgaatacgacaccgacacgccactgaacgagaccgacacgacaatcactgtgatgttaaaacctgctcagagtagaggggcacccgtgtcggtataccagctggttgtcaaagaggaaagactgcagaagagtcggcgagctgctgatatcatcgaatgcttttctgtgcctgttagctaccgcaacgcctcctctctggattccctgcattacttcgctgcggaactgaagcctgccaacctacccgtgactcagccatttacagtgggggacaacaaaacttacaacggttattggaatccaccactgtctccccttaagagttatagtatctatttccaagccttgtccaaagctaacggagagactaagataaactgcgttcgactcgcgacgaaaggagcaagcacccagaactcaaataccgttgagccggagaagcaggtcgataatacagtgaagatggccggggtcattgccggtctgctgatgtttatcattatcctactaggtgtgatgcttaccattaagcgtcgcaaactggcaaagaagcagaaggagacacagagcggtgcccagagggaaatgggccccgtcgcatctgccgataaaccaacaacaaaattgtcagcgagcaggaacgacgagggcttcagttcctcctcccaggacgtgaatggctttacagacggatctcgcggggagctttcccagcctacattaactatccagacgcacccataccgtacctgcgatcccgtggaaatgtcgtacccgcgggaccagttccaaccagcgatcagagtggccgatcttctccagcacattacccagatgaaacgcggtcaaggatacggttttaaggaggagtacgaggccctgccagaagggcagacggccagttgggacacagccaaagaggacgaaaaccgaaacaaaaataggtacgggaatatcatctcatatgaccacagcagagtccggctgctggtgctggatggggacccccattcagattatattaacgccaattatattgatggataccaccgccctcgacattacatcgcgacgcagggccctatgcaggaaaccgtcaaggatttttggaggatgatatggcaggagaacagtgcgtcaatagtgatggttaccaacttagtggaggtcggccgagtgaaatgcgttcggtactggcctgacgacacggaggtgtatggcgatatcaaagtgacacttatagagactgagcccttggccgagtatgtcatccgcacctttacagtgcagaagaagggataccacgaaatacgggagttgcgcttattccatttcaccagctggcccgaccacggcgtgccatgctacgctactggtctgctggggtttgttcgccaggtgaaattcttaaaccctccagaggctggcccaattgtagtgcactgctcagctggcgctggcagaactgggtgctttatcgctatcgatactatgttggacatggctgaaaacgagggggttgtggacatctttaactgtgtgagggagctgcgagcacaacgggttaacctggtacagaccgaggagcagtatgtttttgtgcatgatgccatcctggaggcatgtctctgtggcaataccgctatcccggtttgtgagttccgaagcttatattacaacattagcaggctggatccacaaacaaatagttcccagataaaagacgagtttcagacccttaacatcgttactccccgcgtgaggcccgaagattgttcgatagggctgctgcccaggaaccacgacaaaaacagatccatggacgtcttacctttggataggtgtttgccttttttaattagcgtggacggggaatcatccaactatatcaacgcagccctgatggatagtcacaagcagcctgctgccttcgtagtcacccagcatccactacccaacacagtagcagatttttggcggttagtcttcgattataattgttcctctgttgttatgcttaatgagatggatacagctcagttctgcatgcaatattggcctgagaagacgagtgggtgctatgggcccatccaagtcgagttcgtatcggccgatatcgacgaggacattattcatagaatcttccggatctgcaacatggctcgtcctcaggacggctaccggatcgtgcagcatctccagtacataggctggccggcctatagggacacaccccctagcaagagatctctcctaaaagtcgtgcgccggctcgagaaatggcaggaacagtacgatggtagagaggggaggactgtagtgcattgcctgaacggaggtggacgctctggcactttctgcgcaatttgtagcgtgtgtgaaatgatacagcagcagaatattattgacgtgttccacatagtgaagacacttagaaataacaaatctaatatggtggagactcttgaacagtataagttcgtctatgaggttgccctcgagtacctctcctccttctag

SEQ ID NO: 29245 - DNA, 765 bp, Artificial Sequence
  Description of Artificial Sequence: Synthetic coding sequence
atggcggccgtggccgctacagccgctgctaaaggcaacggtggggggggagggagggccggtgccggcgatgccagcgggacgcgcaaaaagaagggacccggtccactggcgaccgcctatttggtgatctataacgtcgtcatgactgccgggtggctggtgattgctgtgggtctagttcgggcatatctggctaagggatcataccatagcctgtactatagtatcgaaaaaccactcaaattcttccagactggagccctgctggaaattttacactgtgccatcgggattgtgccaagcagcgtggttctcaccagctttcaggtgatgtcccgcgtgtttttgatctgggctgtcacgcacagtgtgaaagaggtccaatcagaggactcggtcctgttgtttgtcattgcatggaccatcactgagattattcggtacagcttctacaccttcagtctcctgaatcacctcccctacctgatcaagtgggcacggtacacactgtttatcgtgctgtatccaatgggcgtttcgggagagttgctcacaatctacgcggctctacccttcgtgcggcaggcaggattatacagcatttcattgccaaataagtataatttttcgttcgactactacgctttcctgatcttgatcatgataagctatattcctatcttcccccaattatattttcatatgatccatcagcggagaaagattctctcccacacagaggagcataaaaagttcgaatag

SEQ ID NO: 29246 - DNA, 1089 bp, Artificial Sequence
  Description of Artificial Sequence: Synthetic coding sequence
atggagaatcaggttctaacaccccacgtgtactgggcacagcggcatcgtgaactgtacctgcgcgttgagctgtccgacgtgcaaaatcccgccatttctataacagaaaatgttttacacttcaaggcacagggtcatggggcaaaaggtgacaacgtctacgagttccatcttgagttccttgatttggttaaacctgagcccgtttacaaactgacacagaggcaggtgaacatcactgtccagaagaaagtgagtcagtggtgggagcggctgactaaacaggagaagcgaccccttttcctggcccctgactttgacaggtggctggacgaatcagatgccgagatggaattgcgcgccaaagaggaggagagactaaacaaactgagattggaatccgaggggagtccagagaccttgacaaatctacgcaagggctatctttttatgtacaacctagtgcaatttctgggcttctcctggatttttgtcaacctcacggtccgattttgcattctgggaaaggagagtttttacgatacattccacacagttgcggacatgatgtacttctgccagatgctggctgtggtcgagacaattaacgcagcaatcggagtaacgacgagccccgtgctgcccagcctgatccagctactgggcaggaattttatccttttcattatctttggcaccatggaggaaatgcagaataaggccgttgtgtttttcgttttttacctgtggagcgccatcgaaatatttcggtactccttttacatgctgacatgcattgatatggactggaaggtactgacctggttacggtatactctctggattccattataccccttaggctgtctggccgaagctgtttctgtcatccagtctattccaatcttcaacgaaaccggccgcttttcttttactctcccatatccagtcaagataaaggttagattcagtttcttcttacagatttacttgatcatgatcttcttgggactgtatattaacttccgccatttatacaagcagcgccggcggcggtatggtcagaagaaaaagaagatccattag

SEQ ID NO: 29247 - DNA, 699 bp, Artificial Sequence
  Description of Artificial Sequence: Synthetic coding sequence
atgggacctcttgctttacccgcttggctgcaaccacgatatcggaaaaacgcctaccttttcatttactacttaatccagttttgcggccacagctggattttcactaatatgaccgtccggttctttagcttcgggaaggattcaatggtggatactttctatgccatcggcctggtaatgcgtctttgccaatccgtgagcctgttagaactactgcacatctacgtgggtatcgagagcaaccaccttctcccacgctttctgcagttgaccgagagaattatcatactcttcgtcgtaatcacgtcccaggaagaggtacaggagaagtacgtggtttgtgtgctgttcgttttctggaacctcctagatatggtacggtacacgtacagtatgctatccgttattgggatttcctacgccgttctcacttggctctcgcagaccctatggatgccgatctaccccctttgcgtgcttgctgaagcgtttgctatctaccagtcactgccatatttcgagtccttcggtacctacagcacaaagctaccttttgacctatcgatatatttcccatacgtgctgaaaatatacctaatgatgctttttataggaatgtactttacctactcccacctgtatagcgaacgcagggacattttagggatctttcctataaagaagaagaagatgtag

SEQ ID NO: 29248 - DNA, 699 bp, Artificial Sequence
  Description of Artificial Sequence: Synthetic coding sequence
atgggccccctggccctgcctgcctggcttcagcctagataccggaagaacgcctacctgtttatctattaccttatccagttttgcggacattcttggatcttcacaaatatgaccgttcgcttcttctcctttggcaaggactcaatggtcgacacattctacgccatcgggttggttatgagattatgccagtctgtatccttacttgagcttctccatatatacgtcgggatcgagagcaaccacctgctgcctcgcttcctgcagcttactgagagaatcatcatcctttttgtggtgattacctcacaggaggaagtacaggaaaaatatgtcgtttgtgtcctatttgtgttttggaatcttttagatatggtacgttacacttatagtatgctgagtgttatcggcatttcatatgcggtcctgacctggctctcccagacactctggatgccaatctaccccctgtgcgtgttggccgaagcatttgctatctaccagagcctcccttactttgagagttttggcacatacagcactaaattgccattcgacctctctatctactttccttacgtgctcaagatttacctgatgatgcttttcatcggcatgtacttcacttacagtcatctgtacagtgagcgtagggacatcctgggtatttttccaatcaaaaaaaagaaaatgtag

SEQ ID NO: 29249 - DNA, 2397 bp, Artificial Sequence
  Description of Artificial Sequence: Synthetic coding sequence
atggaattttcttggggatcaggtcaggagagcaggcggctgcttctgctgctgcttctcttagccgcatgggaggccggcaacggtcagctgcactattctgtgagcgaggaggctaaacatggtacatttgtgggccgtattgctcaggacctgggactggagctagccgagctggtgccccggctgttcagagtggcgtctaaaggtaggggcgggcttttggaggtgaacctccagaacgggatcctctttgttaactcacggatcgacagagaagagctgtgccggcgtagcgccgaatgtagcatccacctggaggtgatcgtggaccgccctctgcaagtgttccacgtcgatgtggaggtgcgggacatcaatgacaatcctccagtttttccagctacccagaaaaatctttcaattgctgagagtcggccccttgattcccgcttccccttagaaggcgctagtgacgctgacattggcgaaaatgccctgcttacatacagactctctccaaatgaatacttttcgctggagaagcccccggacgacgagttggtcaaggggctcggcttgatactcagaaaaagtctggatcgagaggaagcacccgaaatattccttgtccttacggctaccgatggcggcaaacctgagctgaccggcacggtccagttactgatcaccgtgctggacgccaatgataacgctcctgcattcgaccgtactatctataaggtgcgcctcctcgagaatgtgcccaacggcactctggtgatcaaacttaacgcctcggaccttgatgagggactgaatggtgatattgtatactcctttagcaacgacattagtcccaatgtgaagtcgaagttccatattgatcccatcaccggccagatcatcgtgaaaggctacatcgattttgaggagagtaaaagctacgagattattgtggaggggattgataaagggcagttacctctgtctgggcattgtcgggtcatagtggaggtggaggataacaacgataatgtcccagatttagaatttaagagcctgtctctccccattagggaggacgcccccctcgggaccgtgatcgcattgatatctgttagtgacaaggatatgggtgtcaacgggttggttacttgcagtctgacgtctcacgttccttttaagcttgtctctacgttcaaaaattattactcactggttctagatagtgcattggaccgcgaatccgtatccgcttacgaactggttgttacagccagagacggaggatccccatccctttgggctacggcaagcgtatccgtggaggtcgctgacgtgaacgacaatgcgcctgcttttgcccagcctgaatataccgtgtttgtgaaggaaaataatccccccggatgtcatattttcacagttagcgcttgggacgctgatgcccaggagaacgcactggtgtcttactctctagtcgagcgccgcgtgggggagcgggccctgtcaagctatgtgagtgtccacgccgaatctggcaaagtttacgccctacagcctcttgaccacgaggagctggaattgctgcagttccaggtcactgctcgtgacgcaggcgttccacctttaggaagtaacgtcacgctacaagttttcgtccttgacgagaatgacaatgcccctgccctactcgctccacgggccggcgggaccggaggcgccgtttccgagctggtgccatggagcgtcggcgtcgggcacgtggtggccaaggtacgggcagtggacgccgactccgggtataacgcatggttatcatacgaattgcagcctggaaccggcggtgcaagaatcccgttcagggtgggcctgtacacgggcgaaataagcaccacaagggccctggacgagacagatgcaccgcggcaccgtctccttgtgctggttaaagatcatggcgagcctgccctgaccgctaccgctactgtacttgtctcgcttgtggaaagcggtcaagccccaaaagcttcgtctcgcgccctggtaggagctgtgggacctgacgccgctcttgtagacgtgaatgtctacctgatcatcgcaatctgtgctgtatcttcactgttggtgctgaccctgctgctgtacaccgcgctccgctgctccgcactgcctacggaaggtgcgtgtgcgccaggcaagcctaccttggtgtgctccagtgccgttggaagttggtcctactctcagcagcgtaggcccagagtgtgcagcggcgagggtccccccaaaaccgacctgatggcctttagcccaagtctgccggattcacgggaccgtgaggaccagctgcaaaccaccgaagagtcctttgccaaagtgtctgtgtag

SEQ ID NO: 29250 - DNA, 2706 bp, Artificial Sequence
  Description of Artificial Sequence: Synthetic coding sequence
atggagttctcatggggctctggacaagaaagccgccgcctgctgctgctgctgttgttacttgccgcctgggaagccggcaatggccaactacactacagtgtgtcagaagaggctaaacatggaacatttgtcgggagaattgcacaggacctgggtttagaacttgctgagctagtgccgcgactgtttagggttgcctctaagggcaggggcgggctgctcgaggttaatttgcaaaacggcatcctgttcgtcaatagtaggattgaccgagaggaactttgtcgcaggagcgccgaatgctctatacacctggaggtgatcgtggacagacctctgcaggtgtttcatgtcgacgtcgaggtacgagatatcaatgacaatccaccagtgttccctgcaacccagaaaaacctcagtatcgctgagtcacggccgcttgattccagatttccgctagaaggggccagcgacgccgatatcggggagaatgctctgctcacctatcgcctgagcccgaatgaatacttttctttggagaaaccacccgatgatgaactggtgaaggggcttggcttaatcctgcggaagtctctagatagggaggaagccccagagattttcctggtcctcaccgccactgacggcgggaagcctgagttaactggaactgtgcaactgttaataacagtcctcgacgccaacgataatgcccctgcgttcgaccggaccatctataaggtccgtcttctggagaacgtgcccaatggtactctcgtgattaagctgaatgccagcgacctggatgagggactcaacggcgacatagtgtactcctttagtaacgacatttcccctaacgtgaagagcaagtttcacattgatccaatcacaggacagatcatcgtgaagggatacattgactttgaggagtctaagtcttacgagattattgtcgaaggaatcgataagggtcaactgccactgtctggacattgccgtgttattgtcgaagtggaggataacaacgacaatgtaccggacctggagttcaaaagcttaagtcttcccatacgtgaggatgctcctttgggcaccgtgatagcactgatctccgtgtccgataaggacatgggagtcaatggactggtgacctgtagtctcacctcccatgtcccctttaagttagtctcgaccttcaaaaactattactcacttgtgttagactccgctttggaccgcgagtctgtcagcgcctacgaattggtcgtgaccgcccgtgatggtggctccccatccctctgggccacagcctcagtgagtgttgaggttgccgatgtcaacgacaatgcaccagcctttgctcaacctgagtataccgtgttcgtcaaagagaataatcctcctggatgccatatttttacggtttccgcatgggacgccgacgctcaggaaaatgccctggtgtcatacagcctggtggaacggcgtgtgggggagcgcgcactgtcctcttacgtgtccgtacacgctgagtccgggaaggtctatgcactgcagccactggaccacgaagaactcgagctgctccagtttcaggtgaccgcaagggatgcaggtgttccgccattgggctctaatgttacactacaggtgttcgtgctggacgagaacgataatgctccggccctcctagcaccacgagcagggggtacaggtggagcagtatctgaactagtaccttggtctgttggagtcggccatgtggttgctaaggtgcgcgccgtggacgcagatagcggctacaatgcgtggctcagctatgaacttcagccgggcactggaggggccaggatcccctttagagtgggactatacacgggagagatctcgaccacgagagccctggatgagaccgatgcaccacggcatagattgctcgtcttggtgaaggaccatggcgaacctgctcttaccgccactgccacagtgcttgttagcctcgtggagagcgggcaagctcccaaggcctcaagtcgtgctctggtcggcgctgtcggcccagacgcagccctggtagacgtgaatgtgtatcttatcattgccatctgtgccgtctcgtctttgctcgttctgaccttgttgttgtatactgcacttaggtgttctgctctgccgacagaaggggcctgtgcccctggaaagcctaccctggtctgttcaagtgctgtgggaagttggagttattctcagcagagaaggccgagggtatgctcaggagagggtccacccaaaaccgatcttatggcttttagccccagtctccccgactcgcgcgaccgggaggaccagttacagactacagaagagtcctttgcaaaaccgcgccagcccaatccagactggaggtacagcgcctctctccgcgccggcatgcacagctctgttcacctggaagaggccggcatcttacgagccggccccggcgggcctgatcagcaatggcctacagtttccagcgctacacctgagcccgaggccggggaagtgtctccaccagtaggcgcgggtgtgaatagcaactcatggaccttcaagtatgggcctggtaatccaaaacaatccggtccagagcccaaaaagcagactcaggtttccttcctgctgagacgcaaaggagaggcctcacagcctcgccagtag

SEQ ID NO: 29251 - DNA, 2844 bp, Artificial Sequence
  Description of Artificial Sequence: Synthetic coding sequence
atggaattttcttggggctcagggcaagaaagtaggagacttttgcttcttttgctgctcctggccgcctgggaagccggaaatggacaattgcattatagcgtgtccgaggaagccaaacacggcaccttcgtaggaaggattgcgcaggatctgggcttggaactcgcagagctagtgcctcgactgttccgtgttgcttcaaaggggcgcggtggattgctggaggttaatcttcagaacgggatcctttttgttaactctaggatcgaccgtgaggagttgtgcagaaggagcgccgaatgctctatacatctggaagtgattgtggacaggcctttgcaagtctttcatgttgatgtagaagtgagggacattaatgataatcccccagtcttccccgcgacgcaaaagaatctgagtatcgctgaatcacgaccactcgactccaggttccccctggagggcgcctctgatgccgatatcggggaaaatgctctgcttacctaccgattgagtcccaatgagtacttcagcctcgagaaaccccccgacgatgaactggttaaaggattgggcctcattctcaggaagtctttggatagagaagaagctccagagattttcttggttttgaccgccaccgatggagggaagcccgagttaactggcacagtgcaactcctgatcacggttttagacgcaaatgacaacgcccctgcttttgacagaaccatttataaggtcaggctgcttgagaatgtgcccaacgggactctggttatcaagctgaatgcttcggatctagacgaaggcctgaatggcgacattgtttattctttttctaacgacatatcccccaatgtgaagtccaaattccacattgaccctattaccggccagatcatagtgaaggggtacattgactttgaggaaagcaagtcctatgaaattattgtcgagggaatagataaaggccagctgccattgtcggggcattgtcgtgttatcgtggaggttgaagacaataacgacaatgtcccagatcttgagttcaagtccctttctctacctatccgcgaagacgcccccctgggcaccgtcatcgccctcatctctgtgagcgataaggacatgggagtaaatggactggtcacctgctcactcaccagccacgtccccttcaaactggtgtcaacattcaaaaattactacagtctcgtgctcgatagcgctctagatagagagtcagtctctgcatacgaattggtcgtgacagcacgcgacggaggcagtcctagtctctgggccactgcttcagtttctgtggaggtggctgacgtgaatgacaacgcaccagcctttgctcagccagagtacacagtctttgtgaaggagaacaatcctccggggtgccacatcttcaccgtaagcgcttgggatgcggacgctcaggaaaatgcgcttgtgtcctattctctggttgaacgacgcgtgggcgaacgggcattatcttcctacgttagcgtgcacgccgagagcggtaaggtttacgccctgcagcctttggaccatgaagagctagaattgctccagtttcaggtcacagcgagggatgctggcgtcccacctcttggatccaatgttactctccaggttttcgttctggatgagaatgataatgcgcccgctctgttggcgcctagagcaggtgggaccgggggagctgtctcagagctcgttccatggagtgtgggagtgggccacgtagttgccaaagttagagccgtggacgccgatagtgggtacaacgcctggctctcttacgaattacaaccaggaaccgggggcgctaggatccctttcagggtggggctatacaccggtgagatctcgaccaccagagctttagatgaaacggacgcaccccgacatagactgttagtcctggtgaaagatcatggggagccagccttgacagcgacagctaccgtgttggtctctctagttgaatcaggtcaggcgcccaaagcatcatcccgggctcttgttggagctgtgggacccgatgcagccctcgtggacgtcaatgtttatctgatcatcgctatctgtgccgtttcttcgcttctcgtgcttacactgctgctatacaccgcactccgatgttcagcactgcctacagaaggcgcgtgcgctcccggcaaacccaccctcgtctgtagtagtgccgtcggctcatggagctactcccagcaacgcagacctcgggtctgcagcggagaggggccacccaaaacggatctgatggcattctctccaagcttaccagatagcagagatagggaagatcagctccaaactaccgaggagtcctttgctaaacctaggcagccaaaccccgactggcgctactcagccagcctgagggccgggatgcacagttccgtacatctggaggaggcaggtatcctacgagccggccccggggggcctgaccagcagtggcctaccgttagttcagctactccagaacctgaagctggggaggtgagtccacctgtgggagcaggcgtcaattccaacagttggaccttcaagtatggacctgggaatccaaagcagtccggtcctggcgaactcccagataagtttattatcccggggagccctgcaatcatctctattcgacaggagcccaccaattctcagatcgataagtctgacttcataacgttcggcaaaaaggaagagactaaaaagaaaaaaaaaaaaaagaagggcaacaaaacccaggaaaagaaagagaagggcaactcgaccacagataattcagaccaatag

SEQ ID NO: 29252 - DNA, 2403 bp, Artificial Sequence
  Description of Artificial Sequence: Synthetic coding sequence
atggctgttagggagctgtgttttcctagacagcgtcaagtgttgttcctctttctgttctggggggtgagcttagccggttctgggtttgggcggtattcggttaccgaagagaccgagaagggatcctttgtggtgaaccttgctaaggatctgggacttgcagagggggagctggctgcaaggggcacgcgggtggtatccgacgacaacaaacagtacctattgttagatagccatacggggaatctgctgactaacgagaaactggatcgcgagaaattgtgcggccctaaggagccttgcatgttatacttccagatccttatggacgaccccttccagatctaccgggccgaactgagggtgcgcgatataaatgaccacgctcccgtatttcaggataaggaaactgttcttaagattagcgaaaacactgccgaagggactgcatttaggctggagagagcccaggacccagacggggggttaaacggcattcagaattatacaattagcccgaattcattcttccatatcaatataagtggcggagatgaaggcatgatctatccagaattggttctggacaaggcgctcgaccgtgaagagcaaggcgagctgagcctgactctgaccgcgttggacggcggatctccttcacgctcggggacatccactgttagaatcgtagtgctggacgtgaacgataacgctccccaattcgcccaggctctttatgagacgcaggctccggaaaactctccgattgggttcttaattgtgaaggtttgggctgaggatgttgactcaggcgtcaacgctgaagtttcctatagtttttttgatgcaagtgagaacatcagaaccacttttcaaattaatcctttttcaggcgagatcttcttgagagagctactagattacgagttagttaattcctacaaaattaatatccaggccatggatggcgggggcctgagtgcccggtgcagagtcctcgttgaggtccttgataccaatgacaaccctccggagcttattgtgagtagcttttccaattcagttgccgagaattcacccgagactcccctcgctgtattcaagattaatgaccgggatagtggggagaacggcaaaatggtctgctacatacaagaaaacttgcctttcctgcttaaaccatcggtcgagaatttctatatcttgataacagaaggagctttagatcgagaaattcgagctgaatataacataactatcaccgtgactgatttgggaaccccgcggctgaagactgaacataacatcacagtgttggtgagcgatgtcaacgataacgcccccgcttttactcagacttcttacacactcttcgtcagggaaaacaactcacctgccctccatatcgggtccgtgagcgcgaccgacagagactctgggacaaacgcccaggtaacctattctctgttgcctccccaggacccccacctaccattagcctctctggtcagcatcaacgctgataatggccacctcttcgcactccggtccctggactatgaggccctccaggccttcgaattccgagtgggagctaccgacagaggaagtccagccctgagcagggaagccctggtccgcgtactggtgttagatgctaacgacaacagcccttttgttctttaccctctccagaacggatcagccccttgcactgaactcgttccccgcgcagccgagcccggctatctggtgaccaaagtggtggcagttgacggagactcagggcaaaatgcttggctgtcctaccagttgcttaaggctactgagcctggtctgtttggagtgtgggcccacaatggggaggtgagaactgctcgcctgctgtccgagagagacgccgcaaaacatcgcctcgtggtcttggtcaaagataatggagagccgccacgttccgccacagccacactgcaccttctcctggtagatggattctcccagccctacctgcccctacccgaagctgcacctgcacaagcacaagccgaggctgacttactcaccgtgtatctggtagtggccctggcgagtgtctctagtcttttcctcctgagtgtcctgctgttcgttgccgtgaggttgtgccgacgcagtagagcggcatcagtggggcggtgttccgtcccagaaggtcctttccccggacatctggtagacgtccggggtgccgagaccctttcacagtcatatcagtacgaggtctgcctgacaggcgggccgggcacctccgagtttaagttcctaaaaccggtcataagtgatatacaagcccaggggcccggccgaaaaggcgaagaaaactctacatttagaaacagttttgggttcaacatccaatag

SEQ ID NO: 29253 - DNA, 1764 bp, Artificial Sequence
  Description of Artificial Sequence: Synthetic coding sequence
atgatggaaacccccttgcccaaggctcccgaaaaacggcaggtcaccgctataatttttttgctgctgctgtgggaagctgggtctgcgacgatcaagtattctgtactcgaagagagagactctggctccttcgtagcaaaccttgccaaagatttaggtctcggcgtgggcgagttagccgctcggggagcgcgcatactgagcaaaggtaataaacagtaccttcaattagaacggaagtctgggaatcttcttttaaaagaaaagctcgaccgtgaagaactgtgtggcgacattgacccttgcattctgcactttcagatgctcctaaaaaaccccgttcagttcatccagggcgaactacagcttcaggacgtgaacgatcacgcgcctgaatttcttgagaatgaaattttactcaagatcagcgagggtagtcatccaggcacttcttttccactcaagatcgctcaggacctggacgtcggaagcaacactgtgcagaattactcgatcagtactaactcctacttccatctctttactagaaatcatagtgacggcaagaagtacccagagctggttcttgaccaagcactggatagggaagaacagccccagcttagacttacactgacggccctagacggaggctcccctcccagaaccggcacttcccaggtgctgattgtgattgtggatatcaatgacaacgtgcccgagtttgcccagcgtagatatgaagttcaggtgcccgaaaataccccaataggatcactcgtgatcaccgtatctgcaagagatctggacgctggcacccacggggagttgtcctatagcttttttcaatattcaaaccaaattattcaggccttcgagatcaatagtattactggcgaaattaggttcaagaaggccctcgattttgaagagatccagtcctaccacatggaagtcgaggcatccgacggaggagggttgtccgggaagtgtaccgtggcgattgaagtgatggatatcaacgataatgcccccgagctgaccatgtccctactaatctctgatatcctagagaatagccccgaaacggtggtagcagtgtttggcatcagtgacccggattcaggtaataacggcaagatgatgtgcagtatacaggaccatttgccatttctgttgaaacctactttggagaatttctatactctcttaacagaaggtgctctggaccgggaaagcagggccgaatataacatcacaatcaccgtgacagacttgggcaccccacgcctcaaaacagagtacaacataactctcagagtgagcgacgtgaatgataacgctcctgcgttcacccagacttcctacaccctctttgtacgagaaaacaactctccagcgctgcacattggtagcgtgtctgctacggaccgtgacagcggcacaaacgctcaggtcacctattcactcctgccgcctcagaatcctcacctccccctggccagtctagttagcattaacaccgacaacggacacctcttcgccctgaggtcactcgactacgaagccctccaagaattcgaattccgggtgggagcctctgaccgcggcagtcctgccctgagctcagaagccttggtgcgcgttctggtctgctggacgcccacgactaccagacctagctgttgtacccgctgccgaacagcaccacggcccgccccaagttggtgccctggtcggccctcaagggcaacatggtag

SEQ ID NO: 29254 - DNA, 726 bp, Artificial Sequence
  Description of Artificial Sequence: Synthetic coding sequence
atggaagactacctccagggatgcagggctgctctccaagagcgcaccatcatcttggactgcgtgaatatggatctgaagatcggcaaggccacccccaaggacagcaagtatgtagaaaaactcgaggctctcttcccagacttacccaagaggaacgacatattcgactctcttcaaaaggctaaatttgacgtaagcggtttaacaactgaacagatgctacgaaaggaccaaaaaacaatttaccggcagggagtgaaagtcgctatctctgcgatctacatggatctcgagatctgcgaagttctggaacgcagccacagcccgccgctgaaacttacacctgcatctagtactcatcctaacctacatgcatacctgcagggcaacacacaggtatcaagaaaaaagcttctgcctctactgcaggaagctctgtcagcttactttgattctatgaagatccccagcgggcagcccgagactgctgacgtgtcacgcgaacaggtagataaggaactggaccgcgcgagtaatagccttattagtgggcttagtcaggatgaggaagacccgccactaccccctacccctatgaattccctcgttgacgaatgtcctctggatcaggggctgccgaaactgtctgccgaggccgtgtttgagaagtgcagccagataagtttgtctcagagcactactgctagcctgagcaaaaagtag

SEQ ID NO: 29255 - DNA, 1362 bp, Artificial Sequence
  Description of Artificial Sequence: Synthetic coding sequence
atggaggactacttgcagggttgtagggcggccctccaggaatccagacccttgcatgtagtgctagggaacgaagcctgtgatttggacagtactgtaagcgccctcgctctcgcattttacttggccaaaaccactgaagcggaagaggtgtttgtccccgttcttaatattaaacgatcagaactgccccttcgcggagatatcgtatttttcctgcagaaggtgcacattcctgaatctattttgatcttcagggatgaaatcgaccttcacgcactataccaggctggacagcttactctcatactcgtggatcaccatattctgtccaagagcgataccgccttggaggaagctgtcgcggaggtactggaccatagacctattgagccaaagcattgccccccctgtcacgtttccgtcgagctcgtgggaagctgcgcaactcttgtcacagagaggattctccagggggcaccagaaattcttgataggcaaaccgctgcgcttctgcatggcacaataattctggattgtgtcaatatggaccttaagattgggaaagccacaccaaaggactccaagtacgtggagaaacttgaggctctgtttccagacttgccgaaacgtaacgatatattcgattccctccaaaaagccaaattcgatgtgagcggcttaaccactgagcagatgcttcggaaagaccagaagaccatttaccggcaaggcgtaaaagtggccatctccgctatttatatggacctcgaggcttttttgcagcgcagcaacctgctagccgacctccatgctttctgccaagcccactcttatgatgtgctcgttgctatgacaatcttctttaatacccacaacgaaccggtcaggcagctggccatcttttgcccccatgtcgctttacagaccacaatctgcgaggtgctggagcggtctcacagcccaccactgaagctgacaccagctagctcaacccatcccaatcttcatgcctatctccaggggaatactcaagtttccaggaaaaagctcctccccctgcttcaggaggcgctctctgcatatttcgatagcatgaagattccatccggccagcctgagactgcggatgtctcccgcgagcaagttgacaaagaattggatcgggcgagcaactcgctgatttctggcctgagtcaggacgaggaggatccacccttacctccaaccccaatgaattcgctcgtggatgagtgtcctctggaccagggactccccaagttgagtgctgaggctgtgttcgaaaagtgcagtcagatctcgctgtcacagtctactactgcatccttgtctaagaaatag

SEQ ID NO: 29256 - DNA, 1161 bp, Artificial Sequence
  Description of Artificial Sequence: Synthetic coding sequence
atggaagactaccttcagggatgccgagcagcattgcaggagagccggcctcttcacgtggtgctgggcaatgaggcctgtgacctggatagcaccgtctccgcattggccttggcattctacctcgcaaagagaagcgacaccgcattagaggaggcagtcgccgaagtgttggaccacagaccgatcgagccaaaacactgccccccttgtcacgtcagcgtggagctggtcggatcctgtgcaacactagttaccgagaggatcttacaaggggcccctgaaattctcgaccggcagacggctgcattgctccatggcaccatcatcttggactgtgtcaacatggacctgaagattgggaaagcgactcccaaagattctaaatacgtcgagaaactcgaggcactgttcccagatcttcctaaaagaaatgatatcttcgactccctccagaaggctaagtttgatgtatcaggcctaaccacagagcaaatgcttagaaaagatcagaagaccatctaccgtcagggagtgaaagtggcaatttccgctatttacatggatttggaggctttcctacagaggtctaatttgctggcagacctccacgccttctgccaggctcactcctacgatgtattggtggccatgacaatctttttcaacacgcataatgaaccggtgcggcaattggctattttctgtccacacgtggccctccaaacgactatttgcgaggttctagagcgctcccattctcccccattaaagctgaccccagcctcctccacacaccccaacctgcacgcatatttgcagggtaacacgcaggtgtcccgaaaaaagctgctcccgctcctgcaggaggctctgagcgcctacttcgacagtatgaagattccttccggccagccagaaaccgctgatgtgtccagggagcaagtggacaaagagttagaccgcgcctccaacagcctgatctccggtttaagccaagacgaggaagatccaccactgccgccgacacctatgaacagcctcgtggacgagtgtccccttgatcaaggcctgccgaaattatctgcggaagccgtgttcgaaaaatgtagccagatttccttaagccagagcactactgcctctctcagcaaaaagtag

SEQ ID NO: 29257 - DNA, 657 bp, Artificial Sequence
  Description of Artificial Sequence: Synthetic coding sequence
atggatctgaaaattggcaaagctactcctaaggacagcaagtatgtcgaaaaactcgaggctctgtttccggacctgcccaaacggaacgatatatttgacagcttgcaaaaggcgaaattcgatgtgagcggtctcactactgagcagatgctacgaaaggatcagaagacgatttaccgtcaaggcgtgaaggttgccatatcagcgatttacatggatctggagatctgcgaggtgctggagcggtcacattccccaccactgaaacttactccagcttcttctacccacccaaacttgcacgcttatctccaggggaatactcaggtctcgcggaagaaactgctgcctctcctgcaggaagccctgagtgcctactttgacagtatgaagattccctcaggacagcctgaaaccgccgacgtttctagagagcaggtagataaagaactggatcgcgcctctaattcccttatctctggactgagccaggatgaagaagatccccctctgcctcccactccaatgaatagtcttgtggacgagtgccctctcgaccaggggttgccaaagcttagcgctgaagcagtgtttgagaaatgcagtcaaatttctttgtcgcagtccaccacggcttctctgagcaaaaagtag

SEQ ID NO: 29258 - DNA, 507 bp, Artificial Sequence
  Description of Artificial Sequence: Synthetic coding sequence
atgctgcgcaaggaccagaaaactatttataggcaaggcgttaaggtagccatctcggcgatatatatggacctggagatctgtgaggttcttgagaggagtcacagcccaccattaaaactcactccagcctctagcacccatcccaatctgcacgcctatctgcagggaaatacacaggtttcaagaaagaaacttctgccactcctgcaagaagcgctgtccgcctacttcgattctatgaagattccatccggacaacctgaaactgcagacgtgtccagggagcaggtggacaaggagttggacagggcctccaactcactgattagtggacttagccaggatgaagaggatcccccactgccacccacccctatgaactccctcgtcgacgagtgtcctttggatcaggggctcccgaagctttcagcagaggccgtgttcgaaaaatgctcccagataagtctgagccaatctaccacagcaagcctgtcaaaaaagtag

SEQ ID NO: 29259 - DNA, 816 bp, Artificial Sequence
  Description of Artificial Sequence: Synthetic coding sequence
atggatctgaagattggcaaagccactcccaaggattccaagtacgtggagaagctggaggctctcttcccagatctaccgaaacggaacgatatttttgactccctgcaaaaagcaaaatttgacgtgagcggcctgacgaccgaacaaatgttgagaaaggaccaaaaaaccatctaccggcagggagttaaggtcgccatctctgccatctatatggacctcgaggcattcctccagcgctccaatctgctcgcggacctccacgctttctgtcaggctcatagctacgatgtcctagtcgctatgaccatcttcttcaacacccacaacgagccagtgcggcagttggccattttttgtcctcatgtagccctgcaaaccacaatctgcgaggtgctagagagaagtcattccccaccgttaaaactcaccccagcgagtagcacccatccgaacctgcatgcctacctgcagggcaacactcaagtatctaggaagaaactgcttcccctgttgcaggaggctctttcagcctattttgatagtatgaaaatcccctccggccagccagagacggctgacgtttctagagaacaggttgacaaggagctcgacagggcctcgaactcgcttatctcaggtctgtcacaagatgaagaagaccctcctttacctcctactccaatgaattctctggtggacgaatgccctcttgatcaagggctccctaaactctccgctgaggcagtgttcgaaaaatgtagtcagattagcctcagccaaagcacaaccgccagcctgtccaagaagtag

SEQ ID NO: 29260 - DNA, 657 bp, Artificial Sequence
  Description of Artificial Sequence: Synthetic coding sequence
atggatttgaagatcggcaaggcgactccaaaagattctaaatatgtggagaaactggaagccctgttcccagacctcccaaagcgaaatgacatctttgattcccttcaaaaagccaaatttgatgtttctggcttgacaacagaacagatgctgcggaaagatcagaaaaccatttatcgccagggcgttaaagttgccatttctgccatctacatggacctggagatctgtgaagtgctggaacgcagccattcacctcctctgaaattaactccagcctctagcacacacccaaaccttcacgcctatctccaaggcaacacgcaagtgtccaggaagaagctcttgccgctgctgcaggaagctctgagcgcatattttgacagcatgaaaatcccatcaggccaaccggaaactgcagacgttagcagggagcaagtggataaggaattagaccgggctagcaattcactcatctctggccttagtcaggatgaagaggacccccctttacctccaacgcctatgaatagtctggtggatgaatgtcccctcgatcagggactccctaagctctcagctgaggcagtgtttgaaaaatgtagtcagatatccctctctcaaagcactactgccagcctgagtaagaagtag

SEQ ID NO: 29261 - DNA, 537 bp, Artificial Sequence
  Description of Artificial Sequence: Synthetic coding sequence
atggaccttaaaatcgggaaggcaactcccaaggactctaaatatgtggagaagttagaggcgcttttccccgatctgccaaagcgcaacgacattttcgattctctgcagaaagctaagttcgacgtgtcaggtttaaccactgagcagatgctacgcaaagaccagaaaaccatctaccgtcagggcgtgaaggtcgctatcagcgccatttatatggacctggagatttgtgaagttctcgagagatctcattctccccctcttaaactgaccccggcctcatcgacacatccgaacctgcacgcctacctgcaagggaacacacaggtttcccgaaaaaaactgctgccactgttgcaggaggcgctgtcggcatattttgattccatgaagataccgtctggccaacctgaaacagctgacgtgtctcgggagcaggtcgacaaggagttagacagggcctccaatagtctgatatccgggctgagtcaggacgaggaggatcctccgctaccaccaacgcctatgaattag

SEQ ID NO: 29262 - DNA, 423 bp, Artificial Sequence
  Description of Artificial Sequence: Synthetic coding sequence
atggatctgaagattggcaaggctactccaaaggactcaaagtacgtggagaaattagaagccctgtttcctgacctgcccaaacgcaacgacatcttcgactccctacagaaggccaaatttgacgtttctgggctgacaactgaacagatgctgcggaaggaccagaagacaatttatagacagggggtaaaggtggccatcagtgccatatacatggacctggaggcgtttctccagaggagcaacctgttagctgaccttcatgccttttgccaggcccactcgtatgatgtcctcgtggcgatgaccattttcttcaatacccataatgagcctgtgcggcaactggctatcttttgcccacatgtggctctgcagaccacaatctgtgaagtgcttgaaaggtcccacagtccatag

SEQ ID NO: 29263 - DNA, 5241 bp, Artificial Sequence
  Description of Artificial Sequence: Synthetic coding sequence
atgtccgcatgtaatacctttactgagcatgtgtggaagcccggggaatgcaaaaactgcttcaaaccgaagtctctacatcagttaccacctgatcccgaaaaagcaccgataacccacggcaacgtgaagacaaacgccaatcatagcaacaaccatcgcatacgaaacacagggaacttcagacccccagtcgcaaagaagcccaccatagcagtgaagccaacgatgatcgtagccgatgggcagtccatctgcggggagctaagcattcaagagcactgcgagaataaacctgtaatcattggatggaatcggaacagagccgctctgagccagaaaccattgaataacaacaacgaagacgacgaggggatctcccatgtaccaaaaccctacggcaacaacgattccgccaagaagatgagcgataacaataacggacttactgaagtgctgaaggaaattgcaggcctggatactgccccccagatacgaggaaacgaaaccaacagccgggagaccttcctgggccggatcaacgactgttacaagcgaagcttagaaaggaagctgcccccctcctgcatgatcgggggcataaaggagacacaaggtaaacacgtcatcctgtcagggtcgactgaggtcatatctaacgagggcgggaggttttgctacccggagttctcaagcggcgaggagtcagaagaagacgttttattcagcaatatggaggaagaacacgagtcttgggatgaatcagatgaggagttgctggcgatggagattcgcatgaggggacagcctcgctttgcgaacttcagagcaaatacactaagtccagtgagatttttcgttgacaaaaagtggaatacaattccccttagaaacaagtccctgcagcggatctgcgcagttgattacgacgattcctatgacgagatcttgaatggctacgaagagaatagcgttgtttcgtatgggcagggctccatccagagtatggtgtcttctgattcaacatctccagattccagcctcactgaggagtctcggtccgaaaccgcctctagtctaagccagaagatctgcaatggaggcctgagtcctggcaaccctggagacagcaaggatatgaaggaaatagagcccaactacgagagcccaagttctaacaaccaagataaagacagcagccaggcgtctaagagttcaatcaaggtccccgaaacccataaagctgtgctggcacttcggctcgaagagaaggatgggaagattgctgtgcagacagaaaaagaagagagcaaggcaagcactgatgtggccgggcaggccgtcacaattaatcttgttcccaccgaagagcaggccaaaccttatagagttgtgaatctggagcagcccctgtgtaagccctataccgtagtggatgtaagtgcggctatggccagcgaacacctggagggtcctgtcaacagtccaaagacaaaatctagctcctcaactccgaacagcccagtgacatcctcgagcctcacacccggtcagatctccgcccatttccagaagagctcagcaatacgatatcaggaggtttggacctcatcgacaagtcccaggcagaagattcccaaggtggagttaatcaccagcggtactggcccgaatgtgccccccaggaagaattgtcacaaatccgctccgacttccccaacagctactaacataagttcaaaaacaatcccagtgaagtcccctaacctgagtgaaatcaaattcaattcttacaataatgccggcatgccaccctttcctattatcatccacgatgagccaacctatgcaagatcttctaaaaatgctattaaagtaccaatcgtcattaaccccaatgcatacgacaatctggctatttacaaatccttcctgggcacctcgggggagctgagtgtgaaagagaagacaacctccgtgatttcacacacttacgaagagatcgagactgaaagcaaggttccggataacactacatcaaagaccaccgattgcctgcagaccaagggcttctcaaacagcactgagcacaaaaggggctccgtggctcagaaagttcaggaattcaacaattgcttgaacagagggcagagctcgcctcaaaggtcttattcctcgagccattcttcaccagcaaagatccaacgggcaacgcaagagcccgtcgcgaagatcgagggtactcaagaatcacagatggtcggcagtagctccacccgcgagaaggcctccacagtgctctcgcagattgtggcttccattcagccgcctcagtcccctcccgaaacgcctcagtccggacccaaggcctgttctgtggaggaattgtacgcaattcctccggacgctgatgtagccaaatcaacccccaagagcacccccgttaggccaaaatccctgttcacttcacagccgtccggggaggctgaagctccccagaccactgattcccccaccactaaagtgcagaaagatccttcaattaaacctgtgaccccttcaccctccaaactcgtcacttcccctcaaagcgagcctccggccccctttccaccccctcgatcaactagctcaccgtaccatgcagggaacttgcttcagcgccacttcacgaactggacaaaaccaacgagtcccacccgcagtactgaggcagagtccgtgctgcactcggagggcagtcggcgggcagccgatgcaaagcccaaacggtggattagctttaaatccttttttagaaggaggaaaactgatgaagaagatgataaagagaaggaacgagagaagggcaaactggtgggcctggacgggactgtgatccacatgctgccgcctcctcctgtccagcggcaccattggtttactgaagccaaaggggaatcgagtgaaaagccagcaatcgtttttatgtaccgatgcgatcctgcccagggacaactgtcagtcgaccaatccaaagccaggacagaccaagctgctgtcatggagaaaggacgcgccgagaacgcgctgctccaagactctgagaagaagaggagtcatagctcaccttcccagatcccgaagaagattctcagtcacatgacacacgaggtaacagaagatttctccccccgagatccacgtaccgtggtcggcaagcaggatggtagaggatgcacatccgtgacgactgcattgtcactacccgaacttgaaagggaggacggcaaggaggacatatctgatcctatggatcccaacccctgttccgcaacatacagtaaccttggacaaagccgggcagccatgattccacctaagcagccaaggcaaccgaaaggagccgtggatgatgctatcgcctttgggggaaaaaccgatcaggaggctcctaatgcctcgcagcctacgcctccgccgttacctaagaaaatgatcattcgtgccaacactgagccgatttcaaaagacctgcagaaatcaatggagtcaagcttgtgtgtgatggccaaccctacctacgatatcgatcctaattgggatgcctcctcagctggaagtagcatctcttacgagttgaaagggctggatattgaaagctatgattcactcgagcggcctctcaggaaagagagacctgtgccatccgcagcgaacagtatttcatctctcacaacattgagcataaaggataggttctcgaattccatggaaagcctgagctcgcggcggggcccgtcttgtcgacaggggcgaggaatccagaagccacagcgccaagctctctacaggggtctggaaaacagagaggaggtcgtgggcaaaatccgatcactgcacaccgacgcattgaaaaaactggcagtgaagtgtgaggatttattcatggcaggacagaaagaccagctgcggttcggtgtggactcttggtctgattttcggctcacaagcgacaagccctgctgcgaggctggcgacgcggtttattatactgcatcctacgccaaagatccactcaacaactacgccgtcaagatttgcaagtcgaaggctaaggagtcccaacagtattaccattcattggctgtgagacagagcctagctgtgcatttcaatattcagcaggattgcgggcattttctggcggaagttcctaacagactgctcccttgggaggaccctgacgatccagagaaggacgaagatgatatggaggagacagaggaagatgccaaaggagaaacagacggcaagaaccccaaaccttgctcagaggcggctagctcccaaaaggagaatcagggcgtgatgtcaaaaaagcagagatcccatgtggttgttattacacgtgaggtgccgtgcttgacagtggcggactttgtaagagatagcttggcacagcatggtaagagcccggatctgtatgagaggcaggtgtgtttactcctcctgcagttatgttccggtcttgaacatctgaaaccgtatcatgtgacacattgcgacctgcgattagagaacctgttactagtgcactatcagcctgggggaactgctcagggctttgggcctgccgagcccagcccaacttccagctacccaactagactgattgtgtccaacttcagtcaggcaaaacagaaatctcacctggtagaccctgagatcctgcgagatcagagcagactggcaccagagattatcacggctacacagtataaaaagtgcgatgaatttcagaccggtatactgatctacgagatgctccatctccccaacccctttgacgaaaacccggagcttaaggaaagggagtacacgcgcgcggatttgccgaggataccattcaggagtccatacagccgagggcttcagcagcttgcctcttgccttttaaatccaaacccaagcgagaggatactcatatccgacgccaaaggcatcctccagtgtttactttgggggccccgagaggacctgttccaaacattcaccgcttgtccttcacttgtacagcggaatactcttcttcagaactggctggatataaaaaggactctactgatgataaaattcgctgagaagtcacttgaccgggaaggggggatctcccttgaggactggctctgcgcacagtacttggccttcgccacaacagactccctcagttgcatcgtcaagattctgcagcaccgttag

SEQ ID NO: 29264 - DNA, 5241 bp, Artificial Sequence
  Description of Artificial Sequence: Synthetic coding sequence
atgagcgcttgcaatacatttaccgagcatgtttggaagcctggagaatgcaagaactgtttcaagcctaagtcgctgcaccagctcccgccagaccctgaaaaggctcccattacacacgggaacgtgaaaacaaacgcaaatcattcaaataaccacaggatccgtaacactggcaattttagacccccagtggccaagaagccgaccatcgccgttaagccaacaatgatcgtcgctgacggacaaagcatctgcggggagctctcaattcaggaacattgcgagaacaaaccagtgataatcggatggaaccgtaatagggctgccctgtcccagaaaccgctcaataacaataacgaggacgacgaaggtattagccacgtgccgaaaccctatggcaacaatgactccgcaaagaaaatgagcgacaataataacggcctaacagaggtgttaaaagagattgccgggctggataccgctccacagataaggggtaacgaaactaattctcgggaaactttcctcggacgcatcaacgactgctacaagagatctttggagcgcaaattgcctccgtcatgtatgatcggaggcatcaaggagacgcagggcaagcacgtaattctctctggcagcacagaagtcatcagtaatgaggggggacgcttttgctaccccgaattttcctccggggaggagtccgaggaggatgtcctgttctccaatatggaggaggaacacgagagttgggacgaatctgacgaagaactgctggccatggaaatccgcatgagaggccagccaaggtttgcaaattttagagcaaacactctctccccagttcggttttttgtagataaaaagtggaacaccattccactgcgtaataagagtcttcagaggatttgcgccgttgattacgacgactcctacgatgaaattcttaatggatacgaggagaactcagtggtgtcctatgggcaggggtccatccaatcaatggtctctagcgacagtacttccccggactctagtctcaccgaagagtctcgttccgagaccgcaagttcactgtcacaaaagatttgcaacggaggcctttccccaggaaacccgggggactcaaaggatatgaaagagatcgaacccaattatgagagtccctccagcaacaaccaggacaaagactcctcccaggcgtccaagtcttctataaaggtcccagagacacataaggctgtgctggccttgaggctggaagagaaagatggcaaaattgcagtgcagaccgagaaggaggagagtaaggcatcaacggacgttgcgggccaggcagtgaccataaacctcgttcccaccgaggagcaagctaagccatatagagtggtaaatcttgaacagccactttgcaagccctacacagtagtcgacgtatcggcagccatggcaagtgagcacttggaaggacccgttaacagtccaaaaaccaaatcaagcagttcaacccctaactcacctgttacttcttcatccctaacgcctggtcagatctccgctcattttcagaaaagctctgccatcagataccaagaggtatggacctccagcacttccccacgccagaaaatacctaaggtagagctgatcacgagcgggaccggccctaatgtgccccctaggaagaactgtcacaagtcagcacctactagtccaaccgccacgaacatatcctcgaaaacgatccccgtaaagagtccaaacctgagcgagataaagttcaactcatacaataacgccggaatgccacctttccccattattattcatgacgaacctacctatgcacgctcgagcaagaatgctatcaaagtgccgattgtcattaacccaaatgcatatgataatttggctatatataaatcttttctggggacatctggcgaactctctgtgaaggaaaagactacctctgtgatttcacacacttacgaagaaattgagacggaatctaaagtgcccgacaacacaacaagcaagacaactgactgtctgcaaactaaagggttctcaaatagcaccgagcacaagcgaggatccgtggcccagaaagtccaggaattcaataattgcttgaacaggggtcagtcttctccgcagaggagctattcctcaagccatagcagccctgccaaaatccagcgagccacccaagaacctgtggctaagattgagggcactcaggaaagtcagatggtgggctcaagctccactcgagagaaggcctctacggtgctcagtcagatagtggcttctattcagccaccccagtcacctcccgaaactccacaatctggccccaaggcctgctccgtggaagagctctacgctatacctcccgatgctgacgtagctaaaagcactcccaagagcactcccgttcgtccgaagagcctcttcacttcacagcccagtggcgaagcagaagccccacagacaactgactcccctacaaccaaagttcaaaaagatccatccattaaacctgttacccccagcccatctaagttagtgactagtcctcaatctgagccccctgcccctttcccgccaccccggagcacttcgtctccatatcatgcggggaatctgctacagcgtcacttcactaattggactaagcccacttcccccacacgctccaccgaagcagaatccgtactgcatagcgaggggtccagaagagccgccgacgccaagcctaagcggtggatctcctttaaaagcttctttagacgcaggaaaactgacgaggaagacgacaaagagaaagaacgcgaaaaaggtaagcttgttggattagatggaacagtgatccatatgcttcccccacccccagttcagcggcaccactggttcacagaggccaagggtgagagcagtgaaaaaccagccatcgtctttatgtatcgctgtgaccccgcacaggggcaactctctgtggaccagagcaaggcgcgtacagaccaggctgcggtcatggaaaagggccgggcagagaacgctctgctgcaggacagcgagaagaagaggtcacatagttctccctcacagataccaaagaagatactgtcacatatgacacacgaggttaccgaggacttctctccgagggaccctagaacagttgtaggcaaacaggacggccgtggatgtacatcggtcacaaccgccctgtcacttcctgaactcgaacgcgaagatggaaaggaggatatcagcgacccgatggaccctaatccctgctccgctacatactccaaccttggccagtccagggctgctatgattccccctaaacaacctcggcaacccaagggagccgtcgatgatgcaattgccttcggtggcaaaacagaccaggaagccccaaatgcgagccagccgacgccaccccctttgccgaagaagatgattatcagagctaacactgagccaatttccaaggacctgcagaaatcaatggaaagttctctgtgcgtgatggccaaccccacatacgatatcgatccaaattgggatgcttctagcgcagggagctccatcagttatgagctcaaggggctcgatatagaatcttatgacagtcttgagagacctctgcgcaaggagcggcctgtgccgtcagctgccaatagtatttcgtcactgaccacactctcaattaaagaccggttttccaatagcatggagtccctctcatcacgaaggggccccagctgtcgtcagggaagaggcatccagaagccccaacgccaagcgctctaccggggtcttgagaatcgagaagaggtagtaggaaagataaggagcctgcacacagatgctttgaagaagctagcggtcaaatgtgaagatctcttcatggctgggcagaaggaccagctacggtttggtgtggactcgtggtccgactttcgcctcacttctgataaaccatgttgcgaagctggagacgcagtgtactatacagccagctatgcaaaggacccactgaacaattatgctgtcaagatctgtaaaagcaaggcaaaggagtctcagcagtattaccacagtctggctgttaggcagagcctggcagtgcactttaatattcagcaggactgtggtcacttcctggcggaggtgccaaatagattgttgccctgggaggatcctgacgatcccgagaaggacgaggacgatatggaggaaacagaagaagacgcaaagggagagaccgatggcaagaacccgaaaccatgttccgaagccgctagctctcagaaggaaaatcagggggtcatgtctaaaaaacaaaggtcccacgtggtggttatcacgagagaggtaccctgtcttactgttgctgatttcgtgcgggattctctagcacaacacggtaagtctccggacctgtacgagcgacaggtgtgtctcctgcttctgcagctatgcagtggacttgaacatttaaagccgtaccacgtgacacattgtgatctgagactcgagaacctcctgctggtgcactatcagcccggcggaaccgcccagggtttcggcccggcggaacctagtccaacctctagctatcccaccaggctcatcgtgagcaacttttcacaggcgaaacagaaatctcatttagtggatcctgaaatattgcgtgaccagtccaggcttgcccctgagattatcactgcaactcagtacaagaagtgtgatgagttccagactggcattctgatatatgaaatgctgcatctccctaatccctttgatgaaaaccccgagcttaaggagcgggagtatactagagccgatttaccacgaataccatttcggtcaccgtacagccgggggctgcagcagttagcctcttgcctgctaaacccgaacccttcggagcgtatcctcatcagcgacgccaaggggattctgcaatgcctgctttggggccccagagaagatctttttcagacgtttacagcatgcccatccctggtgcagcggaatacacttctgcagaactggttggacataaagagaacgctcctcatgattaaattcgccgagaagtccttggacagagagggaggtatatcattggaagattggttgtgtgcccagtatttagcatttgccacaacagatagcctttcctgcatcgtcaagattttgcagcatcggtag

SEQ ID NO: 29265 - DNA, 3402 bp, Artificial Sequence
  Description of Artificial Sequence: Synthetic coding sequence
atggatgtcctggcagaagaatttggcaatctgaccccagagcagctcgccgcacccatcccaaccgtagaagaaaagtggcggctgcttcctgcgtttctaaaagtgaaaggcctcgtgaagcaacacattgatagctttaactacttcataaatgtcgaaataaaaaagattatgaaagcgaacgagaaggttacctccgacgccgacccaatgtggtacctcaaatacctgaatatctatgtcggtctcccggacgttgaggagtcctttaacgtgacacgaccggtcagtccccacgaatgcaggcttagggacatgacttactcagccccaatcaccgtggatatcgaatacacacgcggctcccaacggatcatccggaatgccctgcctatcggcagaatgcctattatgctgaggtcttccaattgcgtactgacgggaaagacaccagcagaattcgccaagcttaatgagtgtccactcgatccaggagggtactttatagtgaagggtgtggaaaaggtcatcctgattcaagagcagctctcgaagaacagaatcatcgtcgaggccgataggaaaggcgctgtcggtgcatcagtaacctcctcaactcacgaaaagaaaagtaggaccaatatggccgtcaagcagggtaggttctatttgagacataacaccctgtccgaggacatccctattgtaattattttcaaggcgatgggtgttgagagtgaccaggagattgtccaaatgattggaacagaagagcatgtgatggccgcttttggcccgagcctggaggagtgccaaaaagctcagatctttacccagatgcaggcgctgaagtacattggaaacaaagtgagaaggcagaggatgtgggggggcggacccaaaaagacaaagatcgaggaggcccgagagctgctggcctctacaatcttgacccacgtgcctgttaaagagtttaattttcgcgccaagtgtatttataccgccgtgatggttaggagggtgatcctcgcccagggagataacaaggtcgacgaccgcgactattacggcaacaagcgactggaattggctggccaacttctgagtctgttgtttgaggatttatttaagaagttcaattccgagatgaagaaaatcgccgaccaggtaattcctaagcaacgggccgcccagttcgacgttgtgaagcatatgcgacaagatcagataaccaacgggatggttaacgctatttcaactgggaactggtccctgaagcgtttcaaaatggatcgtcaaggcgtaacgcaggttcttagtcggctctcgtacatctcagctctgggcatgatgacaaggatttcttcacagtttgagaaaacaagaaaagtcagtggacctcgcagcctccaaccgtcacagtgggggatgttgtgcccctctgataccccagagggtgaagcctgtggcctcgtcaaaaacctggctttaatgacccatattacgaccgacatggaggacggcccaattgtgaagctggcgagcaacctcggtgtagaagatgtgaacctcctttgcggagaggaactcagttaccccaacgtctttctcgtgtttctgaatggcaatattctcggtgttattcgcgatcataagaagttagtgaataccttccggcttatgcgccgcgctggctacatcaacgagttcgtctcaatatcaaccaatcttacagacagatgcgtctatattagctccgacggggggcggttgtgtaggccatatattatagtgaaaaaacagaagcctgcagttactaacaaacacatggaagagttggcccaggggtaccggaactttgaggactttctgcacgaatccttagtcgaatatcttgacgtgaacgaggagaacgactgcaacatcgcactttacgagcacacaatcaacaaagatacaactcatctggaaatcgagcccttcaccttgctaggagtgtgcgcaggtctcattccctaccctcatcacaaccagagccctaggaacacctatcagtgtgccatggggaagcaagccatgggtacaatcggttacaatcaaagaaatcgaatcgacactctgatgtacctgctggcatacccccagaaacctatggttaagactaagaccattgaactgatcgaattcgagaaactcccagcagggcaaaacgccactgtggctgtaatgtcatactcaggttatgacatcgaagatgccctggtgttgaacaaggcatcattggatcgtggattcggccgctgtctcgtctacaagaatgcaaagtgtacacttaagaggtatactaatcaaacttttgacaaggtgatgggccccatgctggatgccgcaacccgaaaacccatatggcgccatgagatccttgacgctgacggcatttgctcccccggcgaaaaggttgagaataagcaagttctcgtcaataaatccatgcctactgtgacccagataccacttgagggatccaacgtacctcagcagcctcagtataaggatgttcctattacgtacaagggcgcgactgattcctacattgagaaagtgatgatcagctcaaatgccgaggacgcatttttaataaaaatgctgctgcgtcagacccgccggcctgagatcggagacaaattcagctccaggcacggacagaagggggtgtgtggactgattgtcccacaagaagacatgccgttctgcgactccggaatctgtccagacatcatcatgaacccccatggcttcccatctcggatgacagtgggaaagctgattgaattgcttgcagggaaggccggagttttggatggaaggtttcactacggaacagcctttggcgggagcaaggttaaggatgtgtgtgaggacctcgttaggcacgggtataattaccttgggaaggactatgttacttccggcatcaccggcgagccattggaagcctatatctacttcggccctgtttactaccagaagctgaagcacatggtgcttgacaagatgcacgcccgcgccagaggacccagggcagttctgaccaggcagcctactgagggacgctccagggacggcggcctcaggttaggggagatggagagggattgtctgatcggttacggggcctcaatgttgttgttggaaagacttatgatttcttcagacgctttcgaggttgacgtctgcggccaatgtggcctgctcggctattccggttggtgtcattactgcaaatcctcttgccatgtgtcctccctccggatcccgtacgcatgtaaattgcttttccaggagttgcagagcatgaatatcatcccccgactgaagctctcaaaatacaatgagtag

SEQ ID NO: 29266 - DNA, 3036 bp, Artificial Sequence
  Description of Artificial Sequence: Synthetic coding sequence
atgatgtccgacgcgtctgatatgctggctgcagcactcgaacagatggatggcattatcgccggaagtaaagccctcgagtactctaatggtatcttcgattgccagtcaccaacatcacccttcatgggctccctgcgcgctcttcacttggtcgaagaccttcggggtcttcttgaaatgatggagaccgatgaaaaagagggattaaggtgccagatccctgattcaacagccgagacactcgtcgagtggctgcagagccagatgaccaacggtcacctgccaggcaacggcgacgtgtaccaagagagattagcgcggctagagaacgataaggaaagcctagtgctgcaggtgtctgtgctgaccgatcaggtggaggcgcagggggagaagatcagagatctggagttctgcttggaggagcatcgcgaaaaggtaaatgcgacagaggagatgcttcaacaggaattgctgagcaggacctcactagagacccagaagctggacttgatggccgagatttctaacctcaagctcaaactgacagctgttgaaaaggacagattggattatgaggacaaatttagggatacggagggccttatccaggagatcaacgatctgcgcttgaaggtttccgagatggatagcgaacgcctgcagtacgagaagaaactgaaaagcactaaatctttgatggctaagctgagttccatgaaaatcaaagtcggtcaaatgcagtacgaaaagcagaggatggaacagaagtgggaatctctcaaagatgaactcgcctcgctgaaggagcagctggaggaaaaggagagtgaggtgaagcgcctacaggagaaactggtgtgtaagatgaaaggtgagggggtcgagatcgtcgacagagatatcgaagtacaaaagatgaagaaggcagtagaaagccttatggctgcaaatgaagaaaaggatcgaaagatcgaagatctacggcagtgcttgaatcgctacaagaagatgcaagacacagttgtgctggcccagggcaaggacggcgagtacgaagaactcctcaattcaagcagcatctcttcactcttggatgcgcaggggttcagtgatctcgagaagtccccttcaccaacaccagtcatgggctcgccctcgtgtgacccttttaatacctccgtgccagaggaattccatactactatcctgcaggtgagtatcccatccctgcttcctgctacagtgagcatggagacttcagagaagtccaaacttacgccaaagcccgagacaagcttcgaggagaatgacggaaacataatcttgggcgccactgtggatactcagctttgtgacaaactccttacctcgagcttgcagaagtctagctcgcttggcaacctcaagaaagagacatccgatggggaaaaggagaccatacaaaaaaccagtgaagacagagcgcccgccgagtcacgacctttcggaaccctgccccctaggcccccgggccaggacaccagcatggacgataaccccttcggtacaagaaaggtccgtagctcattcggcaggggtttctttaaaatcaagtcaaataagcggactgcaagcgcccccaatctggcggagaccgagaaagagaccgcagagcatctggatctggcaggtgcctcatctcgtcccaaggactcccaacggaattcaccattccaaatcccacctccttcccctgacagtaagaagaaaagccgtgggattatgaagcttttcggtaaattgcgaaggtcccagtcaaccacctttaacccagacgacatgtccgaacctgaatttaagcgtggggggacacgcgctaccgctgggcccaggctcgggtggtccagggacctgggacaatcgaatagcgacttggacatgccgtttgccaagtggactaaagagcaagtttgcaattggctaatggagcagggcctgggtagttacctcaacagtgggaagcactggatcgctagcggccagacgctgttacaagcaagccagcaggacctcgaaaaggaattggggataaagcatagcctgcacaggaagaaacttcagctggctctacaggcgctgggctccgaagaggagaccaatcacggcaagctcgacttcaattgggtgactcgctggctcgatgacatcgggctcccccagtataaaacccagttcgatgaaggcagggttgacggccgcatgctacattatatgacagtagacgatcttctctcactgaaggtcgtcagcgtccttcaccacctaagcatcaagcgcgccatacaggttctgcgtatcaataatttcgaacctaattgcctgagacggcgcccatcagacgaaaacactatcgccccgagcgaggtccagaagtggacaaaccacagggtcatggagtggctgcgttcagtggacctagccgagtatgcgcctaacctgagagggtcaggggtacacggaggattaatggtgttggaaccacgctttaacgtggagaccatggctcagttactgaatattccaccaaacaagaccttgctgcgacggcacctagccacccattttaacctactgatcggggctgaagcccaacatcaaaaacgggatgcaatggaactgccagattatgtactgctcactgccaccgcaaaggtcaaacctaaaaaactggccttctccaactttggtaatctgcgaaaaaagaaacaggaagacggtgaagaatacgtatgtcccatggaacttggccaggcgtcaggcagcgcatctaagaagggctttaagcctggactcgacatgagactgtacgaggaagatgatctggatagactggagcaaatggaggactctgagggcaccgttaggcaaatcggggcttttagtgaaggcattaataatttaacccacatgttgaaggaggatgatatgttcaaggactttgctgccaggagccctagtgcttctatcaccgacgaggattctaatgtgtag

SEQ ID NO: 29267 - DNA, 513 bp, Artificial Sequence
  Description of Artificial Sequence: Synthetic coding sequence
atgatgtcagatgcttctgatatgctagctgcggctctcgaacaaatggacggtataatcgcaggatccaaggctttggaatacagcaatgggattttcgattgccagtccccaacgtcaccatttatggggagtcttcgagcactccacctggtggaagacctgcggggactgctcgagatgatggagaccgacgaaaaggaaggcctcaggtgtcagatacctgactctactgccgaaacacttgttgagtggcttcagtcgcagatgacgaatggacacctgccaggcaacggtgatgtctaccaggagagactggcgcgacttgagaacgataaagaatctctggtgctacaagtgagcgtgcttaccgaccaagtggaagcccagggagagaagatccgggacttggagttctgtctggaggaacatcgtgagaaagttaatgcaaccgaagaaatgctccagcaagtgtgcgcagaagctcggacgaaaatggggttcccgtgctag

SEQ ID NO: 29268 - DNA, 261 bp, Artificial Sequence
  Description of Artificial Sequence: Synthetic coding sequence
atgatgagcgatgcctcggacatgctcgctgccgcactcgagcagatggatggaatcatcgcagggtctaaggcactggagtactccaacggaatcttcgactgccaatcgcctaccagccctttcatgggatccttgcgagctttacatctagtcgaggatttgcgtggactgctggagatgatggaaaccgatgaaaaagagggcctgcgatgtcagatccccgactccacagccgagactctggttgagtggctgtag

SEQ ID NO: 29269 - DNA, 2577 bp, Artificial Sequence
  Description of Artificial Sequence: Synthetic coding sequence
atgctgcagcaggagctgctatcacggacttccctggagacacagaagttggaccttatggccgaaatttctaatctgaaattaaaactgactgctgtcgagaaggatcggctcgattatgaggacaaattcagagatactgaaggccttatccaagagatcaacgatctgcggttaaaagtctccgagatggactccgagcgactccaatatgagaaaaaactcaaaagtactaaaagcctgatggcaaagctgtctagcatgaagatcaaggtcggacagatgcagtatgagaagcagaggatggagcaaaagtgggaatctcttaaagacgagctggcatctctgaaagagcagctcgaggagaaggagtccgaggttaaaaggttacaggagaaattggtctgtaaaatgaagggggaaggtgtggagattgttgaccgggatatcgaagtacaaaagatgaagaaagcggtggagagtctgatggctgcgaacgaagaaaaggataggaagattgaggacctaagacagtgcctcaatcgctacaagaaaatgcaagatacggtggtgctggcccaaggcaaagatggagagtacgaggaactcctgaactctagctcaatctccagtttgctggacgcccaagggttctcagatctggaaaagagcccctccccaacccctgtgatgggctcgccttcttgcgacccatttaacacctcagttccagaagaattccacactacaatcctgcaagttagcataccaagtcttttaccagctaccgtgtctatggagaccagcgagaagagcaagcttaccccgaagcccgagaccagctttgaggagaatgacggaaatatcatcctcggggctactgtggatactcagctctgcgacaagttgctgactagcagtctgcagaagtccagctcattaggcaacctcaaaaaggagactagcgacggcgagaaggaaacaattcagaaaaccagtgaagatcgggcccccgcggaaagcagaccattcggaacactgcctcctagaccccctgggcaggacacatccatggacgataacccatttgggacacgcaaggtgcgcagctctttcgggcgcgggttttttaagatcaaatcaaataagaggactgcttccgcccctaatctggccgagactgagaaggagactgctgaacatctggacctcgccggggcatcatcacggccaaaagactctcaaagaaattctccttttcagattcctcctccttcccccgatagtaagaagaaaagccgaggtattatgaagcttttcggcaagttgcggaggtctcagagtaccaccttcaatcccgatgatatgtctgagcccgagtttaagagagggggaacccgggccacagctggcccacgtttaggttggtccagagacttaggacagtccaactctgatctggatatgcctttcgccaaatggacaaaggaacaagtgtgcaattggctgatggagcaggggctggggtcttatctgaattctgggaagcactggatcgccagtggccagaccctgctgcaggcctcgcaacaagatctcgagaaagaactgggcattaagcactccctgcaccggaaaaaactgcagctggctctccaggccctgggctcagaggaggagacaaatcatggcaaactggatttcaactgggtcaccaggtggctggatgacattggtctccctcagtacaagacccagttcgatgagggacgcgtcgatggccgcatgttgcactacatgactgtggatgacctgttgagtctcaaggtggttagcgtgctgcaccatctgagtattaaacgtgctatccaggtgctgcggatcaataattttgagcccaactgcctgagaaggcggccaagcgatgaaaatacgattgcccccagtgaggtccagaaatggacaaatcatcgtgtaatggaatggttgcgatccgtcgacctggctgagtacgcacccaatctgaggggtagtggggtgcacggtggccttatggttcttgaacctaggttcaatgtcgaaactatggctcagttgttaaatattccccctaacaagactttgctgaggagacatctcgctacacacttcaatctgctgattggcgctgaggcacagcatcagaagcgggacgcaatggagctgcccgactatgtccttctgacagcgaccgctaaagtgaaacctaagaagctcgcatttagcaatttcgggaatctgcggaaaaaaaagcaggaagacggcgaggagtacgtttgtccaatggagttagggcaggcttcgggcagcgccagcaaaaagggctttaagcccggactcgacatgagactgtatgaggaggacgaccttgacagactcgagcaaatggaggacagcgaagggaccgtgcgtcaaatcggggcattctctgagggcatcaacaacctcacgcatatgttgaaggaagatgacatgtttaaagacttcgctgctaggagcccctctgctagcatcaccgacgaagactctaatgtgtag

SEQ ID NO: 29270 - DNA, 57 bp, Artificial Sequence
  Description of Artificial Sequence: Synthetic coding sequence
atgctgcagcaagagctcctttcacgcacatccctagaaacccagaagctcgattag

SEQ ID NO: 29271 - DNA, 2943 bp, Artificial Sequence
  Description of Artificial Sequence: Synthetic coding sequence
atgatgagcgatgcctctgatatgttggctgcagcactggagcagatggacggcataatcgctggaagcaaggctctggagtatagtaacggcatttttgactgtcagtccccaaccagtccttttatgggctcacttcgtgccctgcatctggtcgaagacctgcggggcctcctggaaatgatggagacggacgagaaagaagggttacggtgtcagatccccgactctactgcagaaacactcgtggaatggcttcagtctcagatgaccaacgggcaccttccaggaaacggagacgtgtatcaagaacggttggcacgtctggagaatgacaaggagtcactcgtgctgcaggtctctgtgttaaccgaccaagttgaggcgcagggcgagaagattagagatctcgagttttgcctcgaggagcatagagaaaaggtgaatgccacagaggagatgctgcagcaagagctgctgtccagaacgagtttagaaacacagaagttagacctgatggccgagatcagcaacctcaagctcaagctgaccgctgtcgagaaggacagactggactatgaggataaattccgggacaccgagggcttgattcaggaaataaatgacctccggctcaaggtatccgagatggactctgagagattacagtacgaaaaaaaacttaagtcaaccaaggacgagctggcaagcctcaaagagcaactggaagagaaggaatccgaagtgaagcgactgcaagagaagcttgtgtgtaagatgaaaggcgagggcgtcgaaattgtggatagagatatagaggttcagaagatgaaaaaggccgtggagtcactgatggctgccaatgaagagaaagaccggaagattgaggacctgcgccaatgcttgaatcgatacaagaagatgcaagacacggtggtgctagctcagggtaaagacggagagtacgaggagctgctgaatagctccagcatcagtagtctactcgatgctcaggggttttctgatttagaaaaatccccatcacctacgccagttatgggcagcccttcgtgcgaccctttcaatacgtccgttccggaggaatttcacacgacgatcttacaggtgtccataccgagtctgttgcctgccacagtttccatggaaaccagtgaaaaatccaaacttacccccaaacccgaaacaagtttcgaggagaacgacgggaacataatcttgggcgctactgttgacacccagctatgcgataagttgctcacctcctccctgcagaagagctcctctctcggcaacttgaagaaggaaacatcagacggcgagaaggagacaattcagaagacaagtgaggacagggcccctgccgagagcaggcctttcggcacacttccgcctagacccccaggtcaggacactagcatggacgacaatccgttcgggacacggaaggtgcgtagcagctttgggaggggcttctttaaaattaaatcaaataaacgcaccgccagtgcgcctaacttggcagagactgaaaaggaaactgctgagcatcttgatctcgccggggcctctagtagacccaaagacagtcagcggaatagcccctttcagatcccccccccttctcccgacagcaaaaagaaaagcaggggcatcatgaaattgttcggaaaacttcgtcgtagccaatcgactacattcaacccagacgatatgagcgagcccgaatttaaacgagggggtaccagagctacagcaggaccccgtctgggttggtcaagagatcttggtcagtccaatagtgaccttgacatgcctttcgctaagtggacgaaggagcaggtgtgcaactggctgatggaacagggcctggggagttatcttaatagcggcaaacattggatagcgagtggccaaactcttctccaggccagccagcaggatctggagaaagaattgggaatcaaacacagtctccacaggaaaaaattgcagctagccttacaggccctcgggagcgaggaagaaacaaatcacggcaagttagatttcaattgggtaactcgctggttagacgatataggtctgccacagtacaagactcagttcgacgaaggccgtgtggatggccggatgttacattatatgacagtcgatgacctactctctctgaaagtggtcagtgtactgcaccacctatcaattaaacgcgctattcaggtgctgcgtatcaataattttgaacctaattgccttcggaggcgtccctcagatgaaaatacaattgccccttccgaagtgcagaagtggacaaaccatagagttatggaatggttaaggagtgtagatcttgcggagtacgcccccaacctgcgtggctcaggagtccacggcggacttatggtcctggaaccaagattcaatgtggaaaccatggcccagctcctcaatatcccacccaataaaactctgctgcgtaggcatcttgcaacgcatttcaacctgttaatcggagcggaggcccaacatcagaaacgcgatgccatggagctgccggattatgtgctgcttactgctacagcaaaagtcaagcctaagaaattggccttcagtaacttcgggaacctgaggaagaagaagcaagaggacggagaggagtacgtatgccccatggagctcggccaggcttctggatcggctagcaaaaagggtttcaagccgggactcgatatgcggctgtatgaggaggatgacctagacagacttgagcagatggaagatagcgagggcaccgtccgccagatcggcgctttctctgagggcataaacaatttgacacacatgcttaaagaggatgatatgttcaaagactttgccgcccgtagtccttccgccagtatcacggatgaggacagcaacgtttag

SEQ ID NO: 29272 - DNA, 852 bp, Artificial Sequence
  Description of Artificial Sequence: Synthetic coding sequence
atgatgagcgacgctagtgacatgctggctgcagccctcgagcagatggacggcattattgcaggaagtaaggccctcgaatatagcaacggcatttttgattgtcagtcgcctacatcaccgtttatgggcagcctgcgcgctctgcacctggtggaggacctaaggggtttgctggagatgatggaaaccgatgagaaagagggcctcaggtgtcagattcctgattcgacggccgaaactttggtggagtggctgcagagccagatgacaaacgggcatctgccagggaacggagatgtgtaccaagagaggctggctaggttagagaatgataaggagtcactggtccttcaggcaatggtctcagtgctaacagatcaggtggaggcgcaaggagagaaaatccgtgaccttgaattttgcctggaagagcatcgggagaaggttaatgccaccgaagagatgctgcagcaggagttgctgtcgcgtacctcacttgaaacccagaaattggacttgatggctgaaatctcaaatctaaagttaaagctcactgccgtcgaaaaagatcgccttgattatgaggataaatttcgcgatactgagggactgatccaagagattaatgatctgcggttgaaggtgtctgaaatggatagcgaaaggcttcaatatgagaaaaagctcaagtcaaccaaggatgaattggcatccctgaaagagcagttggaggaaaaggaatccgaggtgaaacggctgcaggagaaattggtgtgcaaaatgaaaggcgaaggcgttgaaattgtagaccgcgacgagaatttcaagaagaagctcaaggagaagtag

SEQ ID NO: 29273 - DNA, 846 bp, Artificial Sequence
  Description of Artificial Sequence: Synthetic coding sequence
atgatgtccgatgcaagtgatatgttggccgcagcgctggagcagatggatgggatcatagcaggaagtaaagctctggagtatagcaacggtatcttcgactgccagagcccgacctcccctttcatgggctcattgcgggctttgcacctggtggaggatcttcgcggactcctggaaatgatggaaaccgatgagaaagagggcctacggtgccagatccccgacagcacagccgaaacccttgtagaatggcttcagtcacagatgaccaacggtcaccttcccggtaatggagatgtgtaccaggaacggttggctcgactcgaaaatgataaggagtcactggtactgcaagtctctgttctgacagatcaggttgaggcgcagggcgaaaagatccgtgaccttgagttctgtttagaggaacacagggaaaaagtcaacgccacagaggaaatgctgcaacaggaactgctgtctcggacatccctggagacccagaagctggacttaatggcggagatctccaacctgaagctgaaacttacagcggtggaaaaggacagacttgactatgaggataaattccgcgacacagaggggcttatacaggagatcaacgacctgcggctcaaggtgtcggagatggactctgaacggctgcagtatgaaaagaagctgaagtcaacaaaagatgaattagcgagcctgaaggagcagcttgaagagaaggagagcgaggtgaaaagacttcaagagaaactggtctgcaagatgaagggagaaggcgtggagattgtggaccgggatgagaacttcaagaaaaagctgaaggagaaatag

SEQ ID NO: 29274 - DNA, 1197 bp, Artificial Sequence
  Description of Artificial Sequence: Synthetic coding sequence
atgggccaggccgggtgcaaaggactctgtctcagcctgttcgactacaagaccgaaaaatacgtgatcgctaagaacaagaaggtgggacttctttacagattattacaagcttctatattggcatacctcgtcgtgtgggttttcttgataaagaaaggatatcaggatgtcgatacgagccttcagtctgccgtgattactaaggtgaagggcgttgcctttacaaatactagtgatttgggtcaaaggatttgggatgtggcagactacgtgattcccgctcagaacgaagggattcctgacggcgcgtgcagtaaagattcagattgtcacgccggggaagcagtgacagctggcaacggggtcaagacagggcggtgcttgaggcgggaaaacctcgcacgggggacttgcgaaattttcgcatggtgccctctcgaaacatccagcaggcctgaggaacccttcctcaaggaagcagaagatttcacaattttcattaaaaatcatatcagattcccaaagttcaacttttccaaaagcaacgtcatggatgttaaggacagatcctttctgaagtcctgccacttcggaccgaaaaatcattactgcccaatctttcgccttggcagcgttatcaggtgggcgggctccgatttccaggacattgcactcgaaggtggagttattgggataaacattgagtggaactgcgatctggataaggccgcttctgagtgccacccccattattctttttcacgtcttgacaataagctcagtaaaagcgttagctctggatataatttcagattcgcacgctactatagagacgcggctggcgtcgaattccgcacacttatgaaggcctatggcattcgctttgacgtcatggtgaatggaaagggtgcgttcttctgcgacctggtgctgatctatctgatcaagaaaagagagttctatagagacaaaaagtacgaagaagtgcggggcctggaagactcttctcaggaagccgaggatgaagcgtctggcttaggactgtctgagcagctcacatctgggcctgggctgctaggaatgcctgagcaacaggagctgcaggaacctccagaggcgaagcgtggctcatcatcccagaaggggaacggcagcgtttgtcctcagttgcttgaacctcacaggagcacatag

SEQ ID NO: 29275 - DNA, 1248 bp, Artificial Sequence
  Description of Artificial Sequence: Synthetic coding sequence
atgtgtccgcagcttgctggcgcaggatccatgggatcaccaggggcaaccactggctgggggctactggactataaaaccgagaaatgggctttgctagcaaagaaggggtatcaggaacgggacctggagccacagtttagtatcatcacgaaactgaagggcgtgagtgtcactcagatcaaagaactcgggaaccgcctgtgggatgtcgccgatttcgtcaaaccaccccagggtgaaaacgtttttttcctggtcactaactttttagtgaccccagcccaggtgcagggtcggtgtccggagcacccttccgtgccacttgctaattgctgggtggatgaagattgtccggagggcgaggggggtacacactcacacggcgtgaagacagggcagtgtgttgtgtttaacggaacacatcgtacttgtgaaatctggagttggtgccctgttgagagcggcgtcgtgccttcaaggcctctgctggctcaggctcagaactttacactttttattaagaataccgtcactttttcgaaattcaatttctctaaaagcaatgcactggagacttgggatcctacatatttcaagcactgccggtatgaacctcaattctccccatattgcccagtgttcagaattggagacttagtggcaaaggccggggggacatttgaagacctcgctctgttaggtggttccgtgggcattagagtccattgggattgcgatctagatacgggcgattcagggtgctggccacactactcatttcagcttcaggagaaatcatacaacttccgaaccgccacacactggtgggaacaacctggagtcgaagcacgcaccctgctgaaattatacggtataaggtttgacatcctcgtcactggccaagctgggaaattcggcttaattcctaccgccgtgacccttgggaccggagcagcttggctcggagtcgttactttcttctgtgatctcctgctgctgtacgtggaccgagaagctcacttctactggagaactaagtatgaagaagctaaggccccgaaggcaacggcaaatagtgtttggcgggagctcgccctggcttctcaagcccggttggccgagtgtctgcgacgcagctctgcccctgctccgaccgccactgcagccgggtctcagacccagacccctggctggccctgccctagctcagacacccacctgcccactcacagcggatccttatag

SEQ ID NO: 29276 - DNA, 1494 bp, Artificial Sequence
  Description of Artificial Sequence: Synthetic coding sequence
atggccgcagcccagcctaagtaccctgccggggccaccgccagacggttggcccgcggatgctggagtgcattatgggattatgagacccccaaagtaatcgttgtacgcaaccgccgtctgggagtgttgtaccgtgcagttcaactactcatcctgctgtacttcgtttggtatgtgttcattgtgcaaaaatcatatcaggagtctgagaccgggccagagtctagcataattaccaaagtgaaggggattaccacgtctgaacacaaggtttgggacgtcgaagagtacgtcaagccaccagaggggggaagtgtcttcagcatcatcacaagggtggaggccactcactcccagacgcagggtacctgtccagaatcaattcgggtgcacaacgcaacgtgcctgtcagacgcagattgcgtggccggcgaattagacatgctcggcaacggccttcgaaccggtcggtgcgtgccctactaccaagggccctctaagacgtgcgaagtcttcggctggtgtcctgtagaagatggggcatccgtctcgcagtttttgggaactatggcgcccaatttcaccatccttatcaagaactctattcattaccccaagttccacttctcaaagggcaatattgccgaccgcacggacggttacctgaaacggtgcacattccacgaggccagtgatctgtattgccccattttcaaactcggctttatcgtagaaaaggccggggaatcctttactgagttagcccacaaagggggcgttattggagtcatcattaattgggactgtgatcttgatctgccagcatcggaatgcaaccctaaatactctttccggcgcctggaccccaaacacgtacccgcctcttcgggatacaattttaggttcgctaaatactacaaaattaatggcacaacaacccgaacgctgatcaaggcttacggcattagaatagacgtaatcgtgcatggccaggcgggaaaattcagcttgattcctaccatcatcaaccttgccacagccctaacctcagtgggagtagtccgaaacccattgtggggaccctctgggtgtggtggcagtacccgcccactgcacaccggattatgctggccgcagggcagttttctgtgcgactggattctgctgacttttatgaacaagaataaggtgtattctcataaaaaatttgacaaagtctgcactcctagtcacccctccgggagttggcctgtgacacttgctcgggtgttaggacaggccccgccggagccaggccatagatctgaggatcaacacccaagcccaccatcaggacaggagggacaacaaggcgctgagtgcggcccagcttttccacctctccgcccatgcccaatctcagctccaagcgagcagatggtggacacgcctgcttccgaaccggcacaggcttcaacaccaaccgatcccaagggactcgcccagctctag

SEQ ID NO: 29277 - DNA, 1215 bp, Artificial Sequence
  Description of Artificial Sequence: Synthetic coding sequence
atggctgccgcccaacccaaatatccagccggcgctaccgcacgaagactcgcccgtggctgttggagcgcactttgggactacgagaccccaaaagtgattgttgtcaggaatcgacgcctgggagtgttgtatagagctgtgcagctgctgatcctcctgtacttcgtctggtatgtatttatagttcagaagtcctaccaggaatctgaaaccggtcccgaaagtagcattatcacgaaagtgaagggcatcaccaccagtgaacacaaagtatgggatgtcgaggaatatgtcaaacctcctgagggaggatccgtgttctccattatcacccgcgtggaagccacgcatagccagactcaaggaacctgtccagaatcaattcgggtccacaatgccacgtgcctctcggatgccgactgtgtggccggtgagctggacatgttgggaaacgggctgagaaccggcagatgtgtgccatactatcagggcccctccaaaacctgcgaggtgtttggctggtgccccgtggaggacggcgcttcagtctcccaatttctcggcacgatggcgccgaacttcaccatcttaatcaagaattccatccattatcccaaattccattttagcaagggcaacattgcagaccggactgatgggtatctcaagcggtgcacctttcacgaagcctccgatttgtactgtcccatatttaagttgggtttcattgtggagaaggctggtgagtccttcactgaattggcccataagggcggggtgataggagtaatcatcaattgggattgtgaccttgacctgccggcctcggaatgcaacccaaaatactcatttcgaagactggaccctaaacacgttcccgcatcatccggttataatttccgcttcgccaaatactacaaaattaacggaaccactactcgtactctgattaaggcgtacggcattagaattgacgtgatcgtgcatggccaagcaggtaagttttcactgatcccaacgattattaatctggccacggcgctgaccagcgtcggagtggggagcttcctatgcgattggattctgctgactttcatgaacaagaacaaggtctattctcataaaaaatttgataagatggtagatactccagcctccgagccagcccaggcctccaccccaacagaccctaaggggctggcacagctgtag

SEQ ID NO: 29278 - DNA, 1344 bp, Artificial Sequence
  Description of Artificial Sequence: Synthetic coding sequence
atggctgctgctcagccaaaataccctgctggtgcaacagcccgtagactggcccgcggatgctggagtgccctttgggattacgaaactcccaaggttattgtggttcgcaatagaaggcttggagtgctttaccgggccgtgcagctgttaatactcctgtactttgtttggtacgtgttcattgtccagaagtcttatcaggagtcagagactggacccgagagctctataatcacaaaagttaagggaattaccactagcgagcataaggtatgggacgttgaagagtatgtcaagcccccagaaagcatccgtgtgcacaatgcaacatgtctaagtgatgctgactgtgttgctggcgagctcgacatgctggggaatggtctgagaacagggaggtgcgtaccatactaccaaggtccgagtaagacgtgtgaagtgttcggctggtgtcctgttgaagacggcgctagcgtgagccaatttctcggaactatggctcccaattttactattctgattaagaacagcatccactatccgaaattccatttcagcaaagggaatattgccgatcgaaccgacggttatttgaagaggtgtacctttcacgaagcctctgacctatattgtccgatttttaagcttggctttattgttgaaaaggccggcgagtccttcactgagttggctcacaaaggtggtgtcatcggcgtaatcatcaactgggactgcgacttagatctgcccgcctcggaatgcaacccaaagtattcgttccgacgacttgatcctaaacatgttcctgcttcttctggttacaacttccgctttgccaaatactacaagatcaacggcacgactacacggaccctaatcaaggcctatggcataaggattgacgtgatcgtgcacgggcaggctggtaagttcagtttaattccaaccatcatcaacctggcaacggctttgacttccgtcggcgtgggctccttcttgtgtgactggatcctcttgacctttatgaacaagaacaaggtctactctcataagaaatttgacaaggtgtgcacaccttctcacccatctgggtcatggcctgtaaccctggctagggtcctgggacaagccccacctgaaccaggtcacagatctgaggaccagcatccgtcccctccctctggccaagaaggccaacagggagcagaatgtgggcctgcttttcctccgttacgaccttgccccatctccgcgccaagcgagcaaatggtcgatactccggcaagtgagcccgcacaggcctcaaccccgaccgaccccaaaggtctcgcacagctgtag

SEQ ID NO: 29279 - DNA, 1140 bp, Artificial Sequence
  Description of Artificial Sequence: Synthetic coding sequence
atggctgcagcccagcctaagtacccagctggcgccaccgctcgccgcttggctcggggctgttggtccgctctttgggactatgaaactcccaaagtgattgtgtctattcgggttcacaatgccacttgtctcagcgacgcagattgcgtggcgggagagcttgatatgcttggcaatgggctgaggactggccgctgtgtaccttactatcaagggcccagtaaaacatgtgaagtgtttggttggtgccccgtcgaggacggagccagcgtgagtcagtttctgggtaccatggcgcccaattttacgattctaataaaaaattcaatccattaccccaagtttcatttctccaaaggaaacattgcagaccgcaccgacggctatctgaagcggtgcacttttcacgaagctagtgatctttactgtcctattttcaaactcggatttatagtggagaaggcaggcgagagctttaccgaacttgcgcacaaaggcggcgtgatcggagtgatcatcaactgggattgcgatctggatcttcccgctagcgaatgtaaccccaagtatagctttcggagacttgaccccaaacacgttcctgccagctccggatataacttcagatttgcaaagtattataagataaacggaactactactcggacccttattaaagcgtatggaatccgtatcgatgtcattgtccatggccaggctgggaaattctctctcatcccaacaattattaacctcgctactgccctaaccagcgttggtgtggggagttttttgtgcgactggattcttctcacgtttatgaataaaaataaggtttacagccacaagaaattcgataaagtgtgtactcctagccatccatccggctcctggcctgtaactctagccagggttctcggtcaggcccccccagagccaggccaccggtcagaagaccagcatccctcacctccgtctggacaggaggggcagcagggtgccgaatgcgggccagcgttcccaccactgcggccctgccccatcagtgcccccagcgaacaaatggtggacactccggcctccgagcctgcccaagcttcaacaccgactgacccaaagggtttggcgcagctctag

SEQ ID NO: 29280 - DNA, 1200 bp, Artificial Sequence
  Description of Artificial Sequence: Synthetic coding sequence
atggcagctgctcaaccgaagtacccggcaggggccactgctaggaggctcgcccgcggctgctggagtgccttgtgggactatgagactcctaaagtgatcgtcgtgcggattcatagggcagagaaacttcctggcgaaagagacgggccgagggaactgcatcaccatcagggccagggtgaccatcatgtgcgagcacagtccgttggcagggggggagtcagagaggcacctcggggcctgagaaccggccgatgtgtcccatattaccagggaccgtccaaaacctgcgaggtattcggctggtgcccggttgaagacggagcaagcgtgagccagtttctagggacaatggcaccaaacttcactatcctaataaagaattccatccattaccctaagtttcacttttctaagggcaacatcgcagatcgcacggatggctacctaaagcgttgcacatttcacgaagcctctgatctctactgccccatctttaagctcggttttatagtcgagaaggcaggagagagtttcacggagctggcccacaaaggcggcgtgattggagtcatcataaattgggactgcgatctagatttgcccgcctcagagtgtaacccgaaatatagctttagacgtttggatccaaaacacgtacccgcaagctccggatataattttcgattcgctaagtattataagattaatgggacaaccacacggaccctcatcaaggcttatgggatccgaatcgatgtaatcgtgcatggacaggccggtaagttttctcttattccgacgatcatcaatcttgcaaccgcccttacttccgtgggggtcgggagctttctgtgcgactggattctcctaacctttatgaataaaaacaaggtttacagccataaaaagtttgacaaagtttgcacacccagccatccctctggctcctggccagtgactctcgctcgggtccttggccaagccccccccgaacccggtcacagaagcgaagaccaacatcccagccctccttccgggcaggaaggtcaacaaggtgctgagtgtgggcccgcctttcccccactgcggccttgtccaatttctgcaccttcagaacagatggtcgatactcctgccagtgaacctgctcaggcttcaaccccaacagacccaaagggactggcgcagctgtag

SEQ ID NO: 29281 - DNA, 1416 bp, Artificial Sequence
  Description of Artificial Sequence: Synthetic coding sequence
atggccgctgcccaacctaagtacccagctggggctacggcccggcgtctagcgcgtggctgttggagcgctttgtgggattacgaaacacccaaggtaatcgtggtgcgcaaccgccggctgggggtcttatatcgcgctgtgcagctgctgatcttactttatttcgtgtggtacgtgtttatagtacaaaaaagctaccaggagagcgagaccggcccagaaagttcaataattacaaaggtaaaagggatcaccacctcagagcataaggtttgggatgtcgaagagtatgtgaagccacccgaaggaggctcagtctttagcatcattacccgggtcgaggccacacacagccagacccaggggacctgtcctgagagtatcagagtccataacgctacctgtctgtctgatgctgattgcgtcgcaggtgagctcgatatgcttggaaatggattgaggacagggcgttgcgtgccctactatcagggaccctccaaaacctgtgaagtcttcggttggtgcccagtggaggatggggcatcagtgagccagttcctgggcaccatggcacccaattttactatcctaataaaaaacagcatccactatccaaagtttcacttcagcaaaggcaacatcgcagatcgaacagatgggtatctcaagcgttgtacatttcatgaggcttctgatttgtattgccccatcttcaagttaggctttatcgtcgagaaagcaggcgaatcatttacagagttagctcataagggtggcgtaatcggcgtgattataaattgggactgtgatttggatctccctgccagtgagtgcaatccgaagtacagtttccggcgcttggaccccaagcacgtgcctgctagcagcgggtacaactttcggttcgcgaaatactacaagataaacgggaccaccactcgaaccctgatcaaagcgtatgggattagaattgatgtgatagtacatggccaggccggcaagttttcactaattcctaccattatcaacctggcaacagccctgacctccgtgggtgtgggaagctttctttgtgactggattctcctcacctttatgaataaaaacaaggtttactcccataagaagtttgacaaggtctgcacaccctctcatccgagtggatcttggccagtgacactggcgcgagtgctgggtcaggcaccccctgagcctggacacaggagcgaggatcagcacccctctcccccctccggtcaggaagggcagcaaggcgcagagtgtgggcctgcatttcctcccttacggccttgtccaattagtgctccgagtgaacagatggtcgatacccccgcctccgagccagctcaggcaagtacccccaccgaccctaagggactggcccaactgtag

SEQ ID NO: 29282 - DNA, 1113 bp, Artificial Sequence
  Description of Artificial Sequence: Synthetic coding sequence
atggcagctgctcagccaaagtatcctgccggggccacggcccgaaggcttgcgcggggatgttggtcggccctgtgggactacgagactccaaaggtgattgttgtcaggaaccgacgcctgggggttttgtacagggccgtgcagctcttgattcttctgtatttcgtttggtacgtgtttatcgtgcagaaatcctaccaagagtctgaaaccggccctgagtcttcgatcataacaaaggtaaagggtattactacctccgagcacaaagtttgggatgtggaggagtatgtgaaacctcccgagtcaatccgtgtccataatgccacttgcctgagcgatgctgactgcgtcgcaggggaactggacatgcttgggaacggagcactgcaggatctgcgtggggtccggctggtaccgggaggccgttggggcttatgccagcctatttccggctacgacggcccgaagtttcatcatccacatcaggaacagcatccgctgccacagattccactgttgcagggtcagcacagaagaccgcacagacgcgtccccgaggcccttcatgtgcctcgagggctccggcctctgcttccccatctgcaggctgggctttatagaggcgaaggatggggggagctgcatcgggctcgaacccaaggtcgaggaggcgttattggcgtgatcatcaactgggactgtgatctggacctcccagcgagcgaatgcaaccctaagtactctttcagaagactcgacccaaaacacgtgcccgcaagtagcggttacaattttcgttttgctaaatactataaaattaatggcaccactacacggacgctcatcaaggcctacgggattcgtatcgatgtcatagtgcatggccaggccggcaaatttagcctcattccaaccatcatcaacctagctaccgctctgactagcgtgggggtgggcagcttcctgtgcgattggatactgttgacgttcatgaataaaaacaaagtgtattctcacaagaagttcgataagatggttgatactcctgcctcagagccggcccaggcgtcaacacccacagacccgaagggcttagctcagctctag

SEQ ID NO: 29283 - DNA, 1056 bp, Artificial Sequence
  Description of Artificial Sequence: Synthetic coding sequence
atggctgatcaggaccctgccggcatctcaccgcttcagcagatggtagcttcagggaccggggccgttgtgacaagccttttcatgacccctctggatgtcgtgaaggttcgtctgcagtcgcaacgcccaagtatggcctctgagctgatgccgagttccagactctggagcctgtcttacaccaaatggaaatgcctgctgtactgcaatggggtcttggaaccgctgtacctgtgccccaatggcgccaggtgcgcaacatggtttcaagacccaacacgtttcacaggcactatggatgctttcgtgaagatcgtgagacatgaaggaacccggaccctatggagcggcctgcccgccaccttggtcatgaccgtccctgcgactgccatctactttactgcttatgaccaactcaaggccttcctgtgcggtagggcgctgacatccgacctctacgctccaatggttgccggtgctctcgcacgtctcggcacagtcacagtaataagtccactggagctgatgaggaccaagctgcaggctcaacatgtgtcatatagggagctaggcgcttgtgtgcggaccgccgtggcacaggggggttggcggtcattgtggttgggttggggcccaacggcccttagggatgttccattcagcgccttatactggttcaattatgagctggtgaagtcctggctcaacggtttccgtccaaaagaccagacatctgtgggcatgagcttcgtcgctggtggcatctcaggaaccgtagccgccgtgctgacactcccgttcgacgttgtgaagacacagcgccaggttgccttgggcgctatggaggctgttcgtgtgaaccctttacatgtggattcaacatggcttctgctcagacgcattagggctgagtctggtacgaaaggactgttcgcaggcttcctgccaagaatcatcaaagccgctccctcgtgtgcaattatgatttccacctacgagttcgggaagtcgttttttcagaggctgaatcaagaccgactgctgggagggtag

SEQ ID NO: 29284 - DNA, 1299 bp, Artificial Sequence
  Description of Artificial Sequence: Synthetic coding sequence
atgggccaggccggctgtaaaggcctttgcctgtccttattcgactacaaaactgagaagtatgtcatcgctaagaacaagaaagttggattgctgtatagactcttgcaggcatcaattttggcatacctagtggtatgggtttttttaatcaagaagggctatcaggatgtggacaccagcttacagagtgcggtgatcacaaaagtcaagggagttgctttcacaaacaccagcgatcttgggcagagaatctgggatgtggccgattacgtgatcccagctcagggcgaaaacgtgttttttgtggtgaccaatttgattgtgacacctaaccaacggcagaatgtgtgtgctgagaatgaaggaatccctgatggggcatgcagtaaggacagcgactgccacgctggggaagcagtgacagccggcaacggagtaaaaacaggccgctgcctgcgcagagagaacttagctcgtgggacatgcgagattttcgcttggtgtccactcgagacgtcgtcgaggcctgaggagcccttcctcaaggaagcggaggacttcactattttcatcaaaaatcacatcaggtttcctaagttcaacttttcaaaaagcaatgtcatggatgttaaggacaggagttttctgaagtcatgccacttcgggcccaaaaatcattactgtcctatattccggttaggttccgtaatccgctgggccgggtccgatttccaggatattgccctggaaggtggggtgattggtattaacatagagtggaattgcgatctggacaaagctgctagcgaatgtcatccacattattctttctccagacttgataacaaattatccaaatccgtcagctccgggtacaacttcagatttgccagatactacagagacgctgcaggcgtggagttccgtacactgatgaaggcatacggcatcaggtttgacgtgatggtgaacggtaaaggagcattcttctgcgacctggtgctgatttacctaattaagaaaagggagttctaccgtgacaagaaatatgaagaggttcgcggtctggaagactcatcgcaggaggccgaggacgaagcatccggattgggcctgtccgaacaactgacctcaggacccggcctactgggcatgcccgagcagcaggagctgcaggagcccccagaagctaagagaggctcttccagtcagaaaggcaatggttctgtttgcccacaacttctggagccacaccgccttcgaaccccttctgccagcccacttcaccaagaatag

SEQ ID NO: 29285 - DNA, 1266 bp, Artificial Sequence
  Description of Artificial Sequence: Synthetic coding sequence
atggggcaggctgggtgtaaaggtttgtgcctctccctgttcgactacaagacagagaagtacgttattgcaaagaataaaaaagtcggcttgttgtacaggttgttgcaggctagcattctcgcctacttggtagtgtgggtgttcctcataaaaaagggatatcaggatgtagatactagtctacagtccgccgttatcacaaaggttaagggcgtggcattcactaacacgtcagacctggggcagcggatctgggatgtcgcagactacgtaattccggcccagggcgaaaatgtctttttcgtggtgaccaatctaatcgtgactcccaatcagcgacagaatgtgtgtgctgaaaatgagggaattcccgacggcgcctgcagcaaggattcagactgccatgcaggcgaggcagtgaccgcggggaatggggtaaaaacagggcgatgcctacgcagggagaatctcgcccgtggtacttgtgagatctttgcctggtgccctcttgagactagtagccgacccgaggaacctttcctgaaggaggctgaagactttaccatcttcattaagaatcatattagatttcctaaattcaatttttccaacaacgtgatggacgttaaagacaggtcattccttaaatcgtgtcacttcggacccaaaaaccattattgccccatttttagactggggtctgtgattcggtgggcaggaagtgacttccaagatatcgcgctagagggcggagtcatcggaatcaatatcgaatggaactgtgatctggataaagcagcaagtgaatgtcaccctcattatagcttctctagacttgacaataagctatccaaatccgtctcgagcggctataacttccggttcgccagatattatagagacgcagccggagtcgagtttcgcaccctgatgaaggcctatggaatcagattcgatgttatggtgaatggcaagggcgcctttttctgtgacctggtccttatatatcttatcaagaaacgcgagttttatcgggacaaaaagtacgaggaagtgcgcgggctcgaggactcaagtcaggaagcggaggatgaagccagtggcttgggcctctctgaacagctcacatcggggccaggcctactgggaatgcctgaacagcaggaactgcaggaacccccggaggcaaagcggggatctagcagtcagaaaggaaatggcagcgtatgtccacaattgctggagccacaccgatctacttag

SEQ ID NO: 29286 - DNA, 1194 bp, Artificial Sequence
  Description of Artificial Sequence: Synthetic coding sequence
atggggcaggccggatgcaaaggactgtgtctctcactgttcgattacaagacagaaaagtatgtgatcgccaagaacaaaaaggtgggtctgctctatcgcctgttacaggcatcgatactcgcttatctcgtggtctgggtttttctgatcaaaaaaggatatcaggacgtggacaccagtctccagtccgctgtgattactaaggtcaaaggcgtcgcattcacaaacacgagcgaccttggccagaggatctgggacgtagccgattatgttatccctgcccaaaatgagggaattcctgacggagcttgtagcaaagacagtgattgccatgccggcgaggcagtgaccgccgggaatggtgtgaaaactggacggtgcctgaggcgcgagaacctggcaaggggcacatgcgagatcttcgcttggtgtccactggagactagtagtaggcccgaggaaccgttcttaaaggaagccgaggacttcactatctttatcaagaatcacatcaggttcccaaaattcaacttctccaataatgttatggatgtgaaggatagatcctttctgaagtcctgtcatttcggcccaaagaatcactactgtccgatatttcgcttaggctctgttatccggtgggccggatcagacttccaagacatcgcactggagggcggtgtaatcggaattaatatcgaatggaactgcgacttggataaggccgcttcagagtgccacccccactattccttttcacggttggacaacaagctcagcaagtctgtcagctctggttataactttcgctttgctcggtactacagggatgctgccggtgtcgaatttcggacactgatgaaagcgtatggcattcgattcgatgtgatggtgaatggaaagggcgcatttttttgcgatctagttttaatttaccttatcaaaaagagggaattttatagagataagaaatacgaagaggtcagaggtctcgaagatagcagccaggaggccgaggacgaggcatctggactaggcctttccgaacagttaaccagcggcccagggttgctcggcatgcccgaacagcaggaactgcaggagccgcccgaggccaagagaggatcgtcttcacaaaagggcaacggatctgtgtgccctcagctcttagagccccacagatccacttag

SEQ ID NO: 29287 - DNA, 1089 bp, Artificial Sequence
  Description of Artificial Sequence: Synthetic coding sequence
atgccaacctacagacctccatcgcaccgatgggtgttcctgatcaagaagggctatcaggatgtggacacgagtctacagtccgccgtgattaccaaagtaaagggcgttgccttcactaacacatcagacctgggtcagcggatctgggacgtggcagattacgtaattcctgctcagaatgagggcatacccgatggcgcttgctcaaaggattcggactgccacgctggagaagccgtgaccgccgggaatggggtgaagaccgggcggtgcctcagaagggaaaatttagcaagaggaacatgtgagatctttgcatggtgccctcttgagacctcaagcagacctgaagagccctttctgaaggaggcagaagactttacgattttcattaagaaccatatcagattccccaagtttaacttcagtaaaagtaacgtcatggatgtcaaagacagatccttcctcaaatcctgccacttcggccccaagaaccattattgcccaatcttccgcctggggtccgttataagatgggccgggtcagatttccaggatatagcccttgaaggcggcgtgattggtataaacatcgaatggaactgcgacttagacaaagctgcaagcgaatgtcacccgcactactcgttctcacggttagacaacaagttgtctaaaagtgtatctagtggttacaactttcgcttcgcacgttattacagagacgccgcaggggtggaatttagaaccctgatgaaagcgtacggcatccgctttgacgtgatggtgaacggaaagggcgctttcttctgcgatctcgtgctgatatacttaattaaaaaacgggagttctacagggacaagaagtatgaggaggtcagggggctcgaggactcatcacaggaggctgaagacgaagcctctgggctcggcctttcagaacagctcacttctgggcctggcctgcttgggatgcccgagcagcaggaactccaggaaccacctgaggcaaagagaggtagttcatcacaaaagggaaatggaagcgtctgccctcaactgctggaaccacaccggagcacctag

SEQ ID NO: 29288 - DNA, 1296 bp, Artificial Sequence
  Description of Artificial Sequence: Synthetic coding sequence
atgggttcaccaggagccacaaccggatggggtttgctcgattacaaaaccgaaaagtacgttatgacccggaattggagggtgggcgccttgcagagacttcttcagttcggtattgtggtttatgttgtcggctgggccctattagctaagaaagggtaccaagagagggacttggagccccagttctctattattaccaaattgaagggggtgtcagtgacacagataaaggagctgggcaatcgactctgggatgtggccgactttgttaaaccccctcagggagagaacgtctttttcctagtcaccaacttcctcgtcacccccgcacaggtgcaaggtaggtgtcctgagcatccgtccgtgcccctcgctaactgttgggtggacgaagactgtcctgagggggaaggcggtacccattcacatggggtcaagacaggccagtgtgtcgtgttcaatggcacgcatcggacctgtgagatctggagctggtgtcctgtggaatctggcgtggtcccaagcagaccactgctcgcacaggcccagaacttcaccctgtttatcaaaaataccgtcaccttcagcaaattcaatttttcaaaatctaacgccctggagacctgggaccctacctatttcaagcactgcaggtacgagccgcaattctccccatattgccccgtcttcagaatcggggacctcgtggcaaaggctggaggcacgtttgaggatttggcattactgggagggagtgtggggataagagtacattgggactgtgatcttgacaccggcgactctggctgctggccacactactctttccagcttcaggaaaagtcttataacttccggacagcgacacactggtgggagcagccaggggtggaagctcgcacactgctgaaactttatggaatccggtttgacattctggtcactgggcaggccgggaaatttggcttgatcccaacggcagtcaccctggggacgggggcagcctggttaggggttgtgacattcttctgcgacctcctgctgctgtatgtcgaccgcgaggcccacttttactggaggacaaagtacgaagaggctaaggcccctaaagccactgctaacagtgtctggagggagctggccctggcttctcaagctcgcctggctgaatgcttgcggagatcctccgcaccagcccccaccgcaactgcggcaggatctcaaacacagaccccagggtggccttgcccaagctctgacactcacctgcctacacactcagggtcgctttag

SEQ ID NO: 29289 - DNA, 213 bp, Artificial Sequence
  Description of Artificial Sequence: Synthetic coding sequence
atgggctctccaggtgcaacaaccggttgggggctgcttgattataaaacagaaaagtgggctcttctcgccaagaagggctatcaggaaagggaccttgagcctcagttctctattatcacgaagcttaagggcgtgagcgtcacacagattaaggaattggggaataggctatgggacgtggccgatttcgtgaaaccaccccaggtgtag

SEQ ID NO: 29290 - DNA, 1326 bp, Artificial Sequence
  Description of Artificial Sequence: Synthetic coding sequence
atgtgtcctcagctcgccggcgccggatcaatgggctccccaggagcaactacagggtggggtctgttggactataagaccgagaagtatgttatgacccggaactggcgggtcggcgccctgcagaggctgctccagttcggcatcgtcgtttatgtcgttggatgggccttgctggccaagaaagggtaccaagaacgcgacctggagccacagttttccattatcacaaaactgaagggggtgagcgtcacccagattaaggaactgggtaaccggctgtgggatgtggccgatttcgtaaaacctccgcagggcgaaaacgttttttttttagttaccaacttcctggttacaccagcacaagtgcagggccggtgcccggagcatccctcagtgccactggcaaattgctgggtcgacgaagactgccctgaaggagaaggagggactcatagccatggcgtgaaaacggggcagtgcgtcgtgttcaacggtacccatcgtacttgcgaaatctggtcatggtgtccagtcgagagcggggtcgtccccagccggcccctgttggcacaggcccagaattttacactgtttattaagaacactgtgaccttctctaagttcaatttttcaaagagtaatgcgctggagacttgggaccccacttattttaaacactgcaggtacgaaccacagtttagtccatactgccccgtgtttcggattggagaccttgtcgctaaggcaggtgggacgtttgaggatctagctctgctgggcggaagcgtgggaattcgagtacattgggactgcgacttggataccggcgactctggctgttggccccattactcatttcagttacaggagaaaagctacaatttccggacagcaacccattggtgggagcagccaggcgtggaagcacgaactcttctcaagctctacgggattcggtttgacatactggtgaccggtcaggccggaaagtttgggttaattccaaccgccgtcactctggggactggagccgcatggctgggcgtggtcacattcttctgtgaccttttgcttctatacgtagatcgagaagctcatttttattggcgcacaaagtacgaggaagccaaagcaccaaaagcaaccgctaatagcgtgtggagggagctggctttggcttcccaggcccggctggccgagtgtctacgccgttcctccgcacccgcaccaacagccactgccgctggcagccagacacagacacctggatggccttgtccttctagtgacacccacctccctacgcacagcggatcactatag

SEQ ID NO: 29291 - DNA, 243 bp, Artificial Sequence
  Description of Artificial Sequence: Synthetic coding sequence
atgtgcccccaattagccggtgcaggctctatgggctcccctggggccaccaccggatggggtctgcttgattataaaacagagaagtgggccctgcttgctaagaagggctaccaggagcgggacctagaacctcagttcagtataatcactaagctcaagggcgtgagtgtcacacagatcaaggaactcgggaatcgactgtgggacgttgccgatttcgtgaagccaccccaagtgtag

SEQ ID NO: 29292 - DNA, 1167 bp, Artificial Sequence
  Description of Artificial Sequence: Synthetic coding sequence
atgtggtgggctctcctcgctaaaaagggttatcaagaaagggatcttgaacctcagttctcaatcattacaaagctcaaaggtgtttccgttactcagatcaaggaactaggaaatcgcctgtgggatgtagccgactttgtaaagccaccccagggtgagaatgtcttcttcctggtaaccaatttccttgtaactccagctcaggtgcagggccgttgccccgaacatccttctgttccactcgctaattgctgggtggacgaagattgcccagagggtgagggaggaactcactctcacggtgtgaaaacaggccagtgcgtagttttcaacgggacacataggacatgcgaaatatggtcatggtgcccagtcgagtcaggcgtggtaccgtcacgccccttactcgcccaagcgcagaacttcacactgttcatcaagaacaccgtcacattctcaaaatttaatttcagcaagtctaatgcgctcgaaacctgggacccgacatatttcaagcattgcagatatgagccacagttctcgccctactgccccgtgttcaggatcggcgacctggtggctaaggccggcgggacattcgaggacttggcactgctggggggaagcgtgggcatcagagtccactgggactgcgacctggacacaggcgatagcggctgttggccacactacagcttccagctgcaggagaaaagctataactttagaacagccacccactggtgggagcagcccggcgtcgaagctaggactttgctgaagctatacggtatcaggtttgacattctggtgacggggcaggctggcaaattcggactgattcctacagctgtgactctaggaacgggcgctgcctggttgggagtggtcacattcttttgcgaccttttactactgtatgtggatcgggaagcccacttttactggcgaactaaatatgaagaagcaaaagcccccaaggccaccgccaactctgtgtggagggagctggccctggctagccaggcccgccttgcagagtgtcttcgccggtccagcgctccggcaccaactgctaccgctgcaggcagtcagacccagacaccggggtggccatgccctagttctgacactcacctgcctactcactcaggaagcttatag

SEQ ID NO: 29293 - DNA, 1020 bp, Artificial Sequence
  Description of Artificial Sequence: Synthetic coding sequence
atggccaacctggataaatacaccgaaacattcaagatgggaagcaatagcaccagtacagctgagatctactgtaatgtgactaacgtgaagtttcagtacagtctctacgcaacgacctatattttaatttttatacctggcttattggctaactctgccgccttatgggtgctctgtcgtttcatatccaaaaagaataaggcgatcatcttcatgattaatctgagcgtggccgacctggcccatgtcctgtcactgccattacggatctactactatatctcacaccactggccctttcagagagcactctgcctgctttgcttttatctcaagtacctgaatatgtacgcatctatctgtttcctgacatgcatcagtcttcagcggtgtttctttctgctgaagcccttccgggcgcgtgactggaaaagacgatacgatgtggggatctctgcggcgatttggatagttgtgggaacagcatgcctccctttcccgattcttcgttctactgatctgaataacaacaagtcttgcttcgccgacctgggctacaaacagatgaacgccgttgcactagtcgggatgatcactgttgctgagttggccggcttcgttattcccgttattattatcgcctggtgcacatggaagaccaccatttccctgagacagcctccgatggcttttcagggaatctcagaaaggcagaaagcactgcgaatggtgttcatgtgcgccgcggtattttttatttgttttaccccataccatataaatttcatattttataccatggtgaaagagactattataagcagctgtccggtggtcagaatcgctttatactttcatcccttctgtctttgcctcgcctcgctgtgttgcctgctggatccaattctctactacttcatggccagcgaattcagagaccagcttagtcgtcatggatccagcgttacaaggtcacgtctgatgtctaaagagtccggatctagcatgatagggtag

SEQ ID NO: 29294 - DNA, 1020 bp, Artificial Sequence
  Description of Artificial Sequence: Synthetic coding sequence
atggctaatttggacaagtacacggagactttcaaaatgggttctaatagtacaagtaccgcggagatttattgcaacgtgacgaatgtcaagtttcagtattccttatatgccacaacctacatacttatcttcattcccggtctgctggccaacagtgcggccctctgggtactgtgtagatttataagcaagaagaataaagctataatttttatgattaatctgtccgtcgccgacctggctcacgtgctctcccttccgctgaggatttactattacatttcacatcactggccctttcagcgcgctctctgcctgctgtgcttctacttaaaatatctcaacatgtatgctagcatttgctttctcacctgtatctctttgcaaaggtgtttctttctcctgaagccattcagggcaagggattggaaacggaggtatgacgtcgggatctccgccgcgatctggattgttgtggggaccgcgtgtttacctttccctattctccgttctacagacctcaacaacaataagtcctgcttcgccgacctggggtataagcaaatgaatgctgtggctttagtcggaatgatcaccgtcgcagagctcgccggatttgtcattcccgtcatcatcatcgcctggtgtacatggaaaaccacaatctccctgaggcagccaccgatggcctttcaaggcatatctgaacggcagaaggcccttcgcatggtgttcatgtgtgcagccgtcttcttcatctgctttactccgtatcacattaactttatcttttataccatggtgaaggaaaccattatatcctcctgtcctgtggtaagaattgctctgtatttccaccctttttgcctttgcctcgctagcctgtgctgcttgctcgatccaatcctctactattttatggctagtgagtttcgggatcagctcagcagacacgggtcttctgttacccgctctcgactgatgtcaaaagagtctggctcctccatgatcggctag

SEQ ID NO: 29295 - DNA, 1065 bp, Artificial Sequence
  Description of Artificial Sequence: Synthetic coding sequence
atgaccgccgcgataagaagacagagagagctgtctatacttcctaaagttaccctggaagccatgaacacgaccgtcatgcaaggattcaacaggtctgaaaggtgtccaagggacacccgaattgtgcaattggtgttccccgccttatataccgtggtgttcttaaccggaatcttactgaataccctcgcgctatgggtttttgtgcacatacctagcagctctacattcattatttatctgaaaaatacacttgtggctgacctgattatgactcttatgcttccatttaagattcttagcgattcacacttggccccttggcagctgagagcgttcgtatgtagattctcaagtgttatcttttacgagaccatgtacgtcggtatcgttctcctgggtctgatcgctttcgaccggttcctgaagatcattcgcccactgcgaaatatattccttaaaaagccggtctttgctaagactgtctcgattttcatttggtttttcctcttttttattagcctcccaaatactatcctgtccaacaaggaggccacaccatcaagtgtgaaaaagtgtgcatctctcaaaggacccctcggccttaagtggcatcagatggtgaacaacatctgtcagtttatcttctggactgtcttcattctcatgttagtcttctatgtggtaatcgctaaaaaagtgtacgacagttacagaaagtccaagagcaaggacagaaagaacaataagaaacttgaagggaaggtgtttgtcgtggtcgcagtgttctttgtttgcttcgcaccgttccattttgcacgggtgccttatactcactcccagactaataacaaaactgattgccggctccagaaccagctgtttatcgcgaaagagactaccctgttcctcgcagctaccaacatttgcatggaccctcttatatacattttcctatgcaaaaagtttaccgagaaactgccatgcatgcagggcagaaaaacaacagcctctagccaggagaatcactcttcgcagactgacaatatcacactcggctag

SEQ ID NO: 29296 - DNA, 1017 bp, Artificial Sequence
  Description of Artificial Sequence: Synthetic coding sequence
atgattaattccacatccacacagcctccggacgagtcatgtagccagaatctcctgataactcaacagattatccccgtcttgtactgcatggttttcattgccggcattctcttaaatggagtgagtggctggatttttttttatgtcccctcctctaaaagcttcataatatatctgaagaatatcgtaatagccgattttgtcatgagccttaccttcccatttaaaattttgggcgatagtgggcttgggccatggcagttgaatgtattcgtatgtagagttagcgcggttctgttttacgtgaatatgtacgttagcattgtcttctttggtctgatttctttcgatagatactacaagatcgtgaagcccttgtggacttctttcattcagtcagtctcatactctaagttactgagcgtaatagtgtggatgctgatgctgctgctcgctgtgcctaatattatcttgacaaaccagtcagtgagggaggtgacccagatcaaatgtattgagctgaagagcgagctcgggagaaaatggcataaagcatccaattatatcttcgttgccatcttttggattgttttcctgctgttgatagtattctatactgctatcacaaaaaagattttcaaaagccatcttaaaagcagtcgcaactcaacaagtgttaaaaaaaaaagtagcaggaatattttttcaatcgtgttcgtgtttttcgtatgctttgtcccttaccacatcgcacggattccctacaccaagtcccagaccgaagcacattactcctgtcagagcaaagaaatcttgcggtacatgaaagaattcaccctcctgctgtccgctgccaacgtctgtctggatcccataatctacttcttcctgtgtcaacctttcagggaaattctgtgtaagaaacttcatattcccctaaaagctcagaatgatctggacatttcccgcataaaacgagggaacacaacgcttgagagcacagacactctgtag

SEQ ID NO: 29297 - DNA, 1017 bp, Artificial Sequence
  Description of Artificial Sequence: Synthetic coding sequence
atgattaatagtacgtccacacagccccctgatgagagttgtagccaaaatcttctgataactcaacaaataatcccagtcctgtattgcatggtgttcatcgccgggattctgctgaatggcgtttccggctggattttcttttatgtgccatcatccaagagctttatcatatatctaaagaatattgttatcgctgacttcgtcatgtccctcacattcccttttaaaatcctcggcgatagcggcctaggcccctggcagttaaatgtgttcgtgtgtcgcgtttcagccgttctgttttacgtgaatatgtacgtcagtatagtatttttcgggttgatttccttcgatagatattataaaattgtcaagcccctgtggaccagcttcattcagagcgtcagttactcaaagctcctgagtgttattgtctggatgttgatgcttttgctagccgttcctaacattatcctaaccaatcaatcggtgcgagaagtgactcagatcaaatgtattgaactgaaatcagagctcggccgcaaatggcataaggcctccaattacatatttgtagcaattttctggattgtttttttactgttaatcgtgttttacaccgctattactaagaaaatattcaagagccacctgaagtcctctaggaacagtacaagtgtgaagaagaagagctcaaggaacatcttttcaatcgtgtttgtgttctttgtgtgcttcgtcccataccatatcgcaagaattccttacactaagtcccagactgaggcccactactcatgtcaatcaaaggaaattctccgttacatgaaagagtttacactgctcctgtccgccgccaatgtctgcctcgatcccataatttactttttcctctgccaacctttccgggaaattctgtgtaagaagctgcacatcccccttaaagcccagaacgatcttgacattagcagaatcaagcgtggcaacacaaccttggagagcaccgacacactgtag

SEQ ID NO: 29298 - DNA, 291 bp, Artificial Sequence
  Description of Artificial Sequence: Synthetic coding sequence
atgatcaacagtacgagcacacagccgcccgacgaatcctgcagccagaacttgctgatcacacaacagattattcctgtattatactgtatggtcttcatagcaggaatcttattgaatggggtgtcagggtggatatttttctacgtcccttcttccaaaagttttattatctaccttaagaacatagtgattgccgatttcgttatgagtctgacattccccttcaaaattctcggtgacagcggattggggccctggcagctaaacgtgttcgtctgccgcgtatag

SEQ ID NO: 29299 - DNA, 2358 bp, Artificial Sequence
  Description of Artificial Sequence: Synthetic coding sequence
atggcaagcaaggtcacagatgccatagtgtggtatcaaaaaaaggagtttctttctgttgccacgacagcacctggccctcagcaggtgctccccggttactgccaatgtagtcttaaggaccaaggacttttcattcaatgcctgatcggagcttatgatcagcagatttgggagaagagcgtagagcagcgggagatcaagtttataaaactcggcttacgcaacaagcctaagaagaccgcccacgtcaaaccagacctgatcgacgttgacctcgtccgcggctccgcctttgccaaggccaagcctgagtccccgtggacaagcctcactaggaagggcattgtgcgtgtggtcttcttccccttttttttcagatggtggcttcaggtgacttcaaaggtcatatttttttggctgctcgttctgtatcttctgcaggtggccgcaattgttctgttttgttcgaccagtagcccgcactctattccactcacggaagtaatcgggccaatctggctgatgctcttgctgggtacggtgcattgccagattgtcagtactaggacacccaagcccccactgagcactggcggaaaacggcgcaggaagctgcggaaagctgcccatctggaggtgcatcgcgagggggacggttcctctacaaccgataatacccaagagggggcggtgcagaatcacggcactagtacctcccatagcgtgggaactgtgttcagggacctgtggcacgccgccttcttcctgtcaggtagcaaaaaagccaagaatagcatcgacaagagtactgaaacagataatgggtacgtgagtctggacggcaagaagaccgtgaagagtggggaggacggcattcagaaccatgaaccacagtgtgaaactatcagacctgaagaaactgcctggaacactggcaccctgcgaaacgggccgagcaaggatacccagcgcactatcactaacgttagcgatgaagtctcctctgaggaaggcccagaaacaggatactccctgaggagacacgtggatagaacctccgaaggtgtcctgaggaacagaaagagccaccattacaagaagcactatcctaatgaagatgcccctaaaagcggcaccagctgctccagtaggtgctcaagcagccgtcaagattcagaatccgccaggcccgaaagtgagactgaggacgtgctctgggaggacctcctacactgtgcggaatgtcatagttcttgcacaagcgaaactgacgtggaaaaccaccagatcaacccatgtgtgaagaaagagtaccgtgatgaccccttccaccagagtcatcttccatggttgcactcgtctcatccagggctggaaaagataagtgcaatcgtgtgggaaggtaatgattgtaagaaagctgatatgtctgtactggaaatctcagggatgattatgaatagggtaaactctcatattccaggaatcgggtatcagatcttcggaaatgctgttagcctgatcttaggcttaacgcccttcgtcttccgcttgtctcaggcaacggatctcgagcagctcactgcacattcggccagcgagttatatgttatcgctttcggaagcaatgaggacgtgatcgtgctgagcatggtgattatatcattcgttgtgcgagtttctttggtctggatcttttttttcctcttatgtgtggccgagcgcacctacaagcaacggctgctgttcgccaagctgtttggtcatctgacctcagcacgaagggcacgcaaaagcgaggtaccccacttcagactcaaaaaagtccagaacatcaagatgtggctgagccttagaagctatctcaagcgccgaggcccccagcgatccgtggacgtgattgtttccagcgcctttttgttaacaatctcagttgttttcatttgctgcgcacagttgctgcacgttcatgaaatctttctggactgccactacaattgggaactggttatatggtgcattagcctcacactgttcctgttacggtttgtgactctaggctccgaaacaagcaaaaagtacagcaatacctccatcctactcaccgaacagatcaatctgtacctgaagatggagaagaaaccaaacaagaaggaggagctgactcttgtgaacaatgtgttgaagctcgctacaaagctcctgaaggaattggattccccattccggctgtatggtcttactatgaaccccctgctgtacaatattacgcaagtggtgatccttagcgcagtttcgggagtgattagcgacctgctcggtttcaacctcaaactgtggaagatcaagagctag

SEQ ID NO: 29300 - DNA, 2088 bp, Artificial Sequence
  Description of Artificial Sequence: Synthetic coding sequence
atggcttcaaaagtgacagatgcaattgtctggtaccagaagaaaattggggcgtacgaccagcaaatttgggaaaagagtgttgagcaaagagaaattaagggccttcgaaataagcctaagaaaacggcccacgtcaaaccagacctgatagacgtagatttggtccgcggaagcgcttttgccaaggctaaaccagagtccccgtggacatccctgactcgtaaggggattgtgcgtgtcgtcttctttcccttttttttccggtggtggctgcaggtcacaagcaaagtgatcttcttctggcttctcgttttgtacttgctacaagtggccgcgatcgttcttttttgcagtactagctcgccgcactcaatcccactaaccgaggtcattgggccaatctggttaatgctactgctaggtacagtacactgccaaatcgtgtcaacaaggaccccgaaaccacccctaagtacaggaggcaaacggaggagaaagctgcgcaaggccgcccatcttgaagtgcatcgagaaggtgacgggtcatccacaaccgataatactcaagagggcgccgtccagaatcacggaacaagcacgtcacatagcgtaggaaccgtattcagagatctgtggcacgccgctttctttctgagcggttcaaagaaggctaaaaacagcatagacaaatcaacagagaccgacaacgggtacgtaagcctggatggcaaaaagacagttaagtctggtgaagatgggatacaaaatcatgagccacagtgcgaaacaataagacctgaggagacagcctggaacaccggcaccttgagaaatgggcccagcaaagatacgcagcgtaccattactaacgtgagtgatgaggtgagcagtgaagagggaccagagacggggtacagtctgcgcagacacgtcgacaggacgtccgaaggagtgttaagaaacaggaagtctcaccactataagaagcactaccctaatgaagatgcccctaaatcagggactagttgttctagccggtgctcctcctctagacaggactccgaatcagctaggccagagtcagagaccgaagatgtcctgtgggaggatctgctgcactgcgcagagtgtcactccagctgtactagcgagacagacgttgaaaaccatcagataaacccctgcgtaaagaaggaatatcgagacgacccatttcatcagtctcatctcccatggctccactcatcacatcccggcctggaaaaaatcagcgccattgtgtgggagggcaacgactgcaagaaagcggacatgagtgtccttgagatcagtggaatgattatgaatcgggtgaactcccacattcctggaattggttatcagatcttcggcaatgccgtatcactcatcctcggtttgactccatttgtctttcggttatcccaggctaccgacctggaacagctaactgcccactccgcttccgagctctacgtgatagcttttgggagcaatgaggacgtgattgtcctctctatggtcatcatttcgtttgtggtgcgagtcagcctagtgtggatcttcttttttttgttgtgtgtggctgagagaacttataagcagcgcctactgttcgctaaactctttggtcacctcaccagcgccagacgggctagaaaatccgaggtcccacacttccgcctcaaaaaggttcagaatatcaagatgtggctgtccctacgctcatacctgaagagaagaggaccacaaagatccgtggacgtgattgtgagtagtgccttcttgctgacaatttccgttgtgttcatttgctgtgctcaaatcaacctgtatttaaagatggagaaaaagcctaataagaaggaggaactcaccttagtgaacaacgtgctgaagctcgccaccaaactcctaaaggaactcgacagccccttccggctgtatggactgacaatgaaccccctgctctataacatcacacaggtcgtcatccttagcgctgtctctggcgtgatcagtgacctgctgggatttaatctcaagttatggaagattaaaagctag

SEQ ID NO: 29301 - DNA, 2244 bp, Artificial Sequence
  Description of Artificial Sequence: Synthetic coding sequence
atggcctcaaaggtgactgacgccatcgtgtggtatcagaagaagatcggtgcttatgatcagcagatctgggagaagtcagttgagcaacgagaaattaagggactcaggaacaaacccaagaaaaccgctcacgtaaaacctgatttgattgacgtggatctggtccgcggcagcgcgtttgccaaggcaaagcccgagagtccctggaccagcctgacgcgcaaagggatcgtacgagtggttttcttcccgttctttttccgctggtggctacaggttacatctaaggtaattttcttttggctgcttgtgctgtatctcctgcaggttgccgcaatagtgctcttctgttcaacctcatctccccactccatccccctgacagaagtcattggcccgatttggctgatgcttctcctcggaaccgtccactgtcagatagtcagcactagaacaccaaaacctccattgtctaccggcggtaaaagacgccggaaactcagaaaggcggctcatttggaggtgcaccgggaaggcgacgggagctccaccaccgataacacacaggaaggcgcagtgcagaaccacggaacctcaacaagccatagtgttggtactgtgtttagagatctgtggcacgcagctttttttctatccggatctaaaaaggctaaaaattccatagacaagagcacagagactgacaatggatacgtgagcttggacggcaaaaagacggttaaatccggggaagatggtatccaaaatcatgagcctcaatgcgagaccatcaggccagaggaaacagcttggaatacggggacattgcgcaatggcccttcaaaagatacccaacgcaccataactaacgtttctgacgaggtctcaagtgaagaagggcctgaaacaggttacagcctcaggaggcatgtcgacagaacttctgaaggcgtgttacggaatcgcaaatctcaccattataagaaacactaccccaacgaagatgcccctaagtctggaacgagctgttctagccgctgtagctcttctcgccaagactcagaatctgctaggccggagtccgagaccgaagacgtgctgtgggaagatctcctgcattgtgctgaatgccattcaagttgtactagcgaaacagacgtcgagaaccaccagatcaacccttgcgtcaagaaggagtatcgagacgatcccttccatcagtctcacttaccctggttgcactcttcccatcccggcctagagaagataagcgccatcgtgtgggaagggaatgattgtaaaaaagccgacatgtccgtgctggagataagcggaatgattatgaatagagttaactcacacattcccggaattggttatcagatattcggcaatgcagtatctttaatcctgggcttgacaccattcgtcttccggctgtcccaggctaccgatttagaacaactgactgcccattctgcgagcgaactctatgtgattgcgttcggctctaatgaagatgtaatcgtgttgtctatggtaatcatcagctttgtagtcagggtgtctttagtgtggatctttttcttcctgctctgtgtggcagagcggacctacaaacagcgtttgctgtttgcaaaattgttcggccacctgactagcgctcgcagagcacgtaaaagcgaagtgccccactttcgcctcaaaaaggtgcagaacatcaagatgtggctcagcctgcgcagttaccttaaaagaagagggccccagcgcagcgtcgacgttatcgtgagcagtgcttttctcctaacaatctcagttgtgtttatctgttgcgcccaactgcttcatgtgcacgaaatcttccttgactgccattataattgggaactggtaatttggtgcatttcactgactctgttcctgctacggttcgtaactctaggctctgaaacctctaagaaatacagcaataccagtatcctgctaacggagcagataaatctctacctaaaaatggagaagaagcctaacaagaaggaggagttgaccctagtgaataacgtgcttaagttggctaccaagctgttaaaagaactggacagcccatttagattgtatgggcttactatgaatccactgctgtataatattactcaagtagtgattctgtccgctgtatctggcgtgatttcagatctcctaggtttcaacttgaagctttggaagattaagtcatag

SEQ ID NO: 29302 - DNA, 2256 bp, Artificial Sequence
  Description of Artificial Sequence: Synthetic coding sequence
atggcatctaaggtgactgacgctatagtgtggtaccagaagaaaatcggcgcttacgaccagcagatctgggagaagagcgtggaacagagggagatcaaatttattaaactagggcttcgcaacaaacctaaaaaaacagcccatgtgaagccggatttaatcgatgtagatctggtcagggggagcgctttcgctaaggctaagcctgaatccccatggacctcattgactagaaagggcatagtccgcgtggtgttcttccctttcttctttaggtggtggctgcaagttacaagtaaggtgatctttttttggcttctcgtactttacctgctgcaggtggccgctatcgttctcttctgctccacttccagcccacactcaatcccattaaccgaagtgataggcccgatctggctgatgttgctgctcggaactgttcactgccaaattgtgagcacgaggaccccgaagccgcccctctcgactgggggaaagaggcggagaaagcttagaaaagcagctcatctggaggtccatcgagaaggggacggcagctcgactacagataacactcaggagggagcagttcagaatcacgggacgtctacctcacactcagtgggaacagtgtttagagatctgtggcacgcggccttttttctgtccggtagcaaaaaggccaagaactccattgacaagtctactgaaacagacaatggctatgtgagcctcgacggaaagaagacagtgaagtcaggcgaggacggaattcagaaccacgaaccgcagtgtgaaaccataaggcccgaggagaccgcctggaatactggcactctgcgaaacggtcccagtaaagacacgcagcgtactataactaacgtcagtgatgaagttagttccgaagagggcccagagaccgggtacagcctcagaaggcacgtcgatcgaacttcggagggtgtgttgcgcaaccggaagagccaccactacaagaagcactaccctaatgaggacgctccgaagagtggtacatcctgctccagcaggtgctcctcatcacgccaggactccgaaagcgcacggcccgagagtgagacggaagacgtgctgtgggaggacctcctgcactgcgcagagtgccatagctcctgtacaagcgaaacagacgtagagaatcatcagattaatccttgcgtcaagaaggagtatagggacgatcctttccaccagagccatctgccttggttacattcttcccacccaggcttagaaaagatttctgctatcgtgtgggagggcaacgactgtaaaaaggcagacatgagtgtgttagagatttcgggtatgattatgaatagggtgaactctcacatcccgggcatagggtaccagatctttggcaacgctgtgtcactgattcttggactgaccccatttgtgtttagactctcacaggccacagatcttgagcaactcaccgcccatagcgcaagcgagctctacgtaatcgcttttggtagtaacgaggacgtcatcgttctgagcatggtcattatctcctttgtggtacgggtgtccttggtatggatcttcttcttcctactgtgtgtggccgagcgcacttataaacagcgcttgctgttcgccaagctgttcggccatctcacctccgctcggagggcaaggaaaagtgaggtccctcacttcaggcttaaaaaggttcagaacatcaagatgtggttgtccttgcgctcctatctcaaaagaagaggcccgcagcggagcgtcgatgtaatagtgagtagtgccttcctcctcacgataagtgtggtgtttatctgctgtgcccagctgttacacgtccacgagatattcctggactgtcattacaactgggaactcgtaatatggtgcatttctctaacattgttcttgttacggttcgtaacactcggctcagaaacatcgaaaaaatacagcaacaccagcatactgctgactgagcagatcaatctctatttgaaaatggagaaaaagcccaacaaaaaagaagaactgaccctggtgaacaacgtgctgaagctcgccacaaaactgcttaaggagctggacagccccttcaggctgtatggactcaccatgaacccactgctgtacaatattactcaggtggttattctgagtgcagtgtctggcgtgatcagcgacttactaggttttaacctcaagttatggaagattaaatcctag

SEQ ID NO: 29303 - DNA, 2256 bp, Artificial Sequence
  Description of Artificial Sequence: Synthetic coding sequence
atggctagcaaagtgacagacgccatcgtgtggtaccaaaaaaagatcggcgcatatgaccagcagatttgggaaaaatccgtcgagcaacgcgaaataaaattcataaaactggggttgcgtaataagccaaaaaaaaccgcacatgtgaagccggatttgatagacgtggatctggttcgaggctcagcattcgccaaagccaagccggagtctccgtggacatcattgacaagaaaaggcattgtcagagtcgtgttttttccgttttttttcaggtggtggcttcaagtgacttccaaggtgatatttttttggctcttagtcttgtacctgcttcaggtggcagctatcgttctcttctgtagtaccagctctccacattctataccactgaccgaagtcatcggaccaatttggctgatgctgctgctcggcacagttcactgtcagattgtcagtaccaggacgccaaagcctcccctatctaccggggggaagcgccggagaaaactcagaaaagcggcacacctggaggtgcatagagagggagacggtagttccaccaccgataatactcaagagggcgctgtacagaatcacggcacaagtacaagtcacagtgtcggaaccgtatttagagatctgtggcacgccgcctttttcctgtccgggtccaagaaggcgaaaaattcaattgataagtccaccgagacagacaatggttacgtgtccctcgacggtaaaaagactgtcaagtctggggaggatgggatccagaaccatgagccgcaatgtgaaactatccggcctgaggagactgcgtggaacactggcacgctacggaacgggccctctaaagacacacagcgaaccattacaaatgttagtgacgaagtctctagcgaagaggggcccgagacagggtactccctgagacgacatgtggataggacttccgaaggagtactgaggaaccgtaaaagccaccactataaaaagcactatcccaatgaagatgcccctaaatccgggacgagctgcagttccaggtgctcatccagtcggcaggattctgagagcgccagacccgaatcagaaacggaggacgttttgtgggaggatttactccactgtgctgagtgccattcctcctgtacgtcagagactgatgtcgaaaatcaccagattaatccatgtgtcaagaaggaatacagagatgacccattccaccagtcccatcttccttggctgcatagttctcatcctggtctggagaaaatttcagcgatcgtatgggaggggaatgattgtaagaaggccgacatgagcgtgctggagattagcggaatgatcatgaacagagtgaattctcacattcccggaatcgggtaccagatcttcggaaatgccgtgagcctcatcctcggcctcacaccattcgtgtttcgcctgtcccaggccactgatcttgagcaattgaccgcccattctgcttccgaactttacgttattgcattcggctcaaatgaagacgttattgtgctgtccatggttatcatctctttcgtcgttagggttagtctcgtttggatcttctttttcctgctgtgtgtcgccgagcgcacatacaaacagcgattgttgtttgcaaagctgtttggccatttaaccagtgccagacgagcacgcaagagtgaagtgccacatttcaggttgaagaaggtgcaaaacattaaaatgtggctatcactgaggtcttatctcaagagacgcggacctcaacgctccgtggatgtgatagtgagttctgcctttctccttacaatatctgttgtgtttatttgctgcgctcagctgctgcacgttcatgagatcttcctggactgtcattacaactgggaattagtgatctggtgtatttcccttacactctttctgcttagattcgttaccctcgggagtgagacatccaagaagtactctaacacgagcattctactgaccgagcagataaacctgtacctcaaaatggaaaaaaaaccaaacaaaaaagaggagctgactctcgtcaataatgtgctcaaactcgccacaaaactgctcaaggagcttgattcacctttcaggctgtatggtctgactatgaaccctctgctctataatattacacaggtggtgattctgagcgctgtttcaggcgtcatttctgacttgttgggatttaatcttaagctgtggaaaataaagagctag

SEQ ID NO: 29304 - DNA, 2256 bp, Artificial Sequence
  Description of Artificial Sequence: Synthetic coding sequence
atggccagcaaagttacagacgctattgtctggtaccagaagaagattggagcttatgatcaacagatttgggagaaaagcgtggagcaacgggagataaaatttattaagtacggcctgcgcaataagcctaagaaaacagcccatgtgaagcctgatcttatcgacgtggacctggtccgaggatccgccttcgctaaagccaagcctgagtccccgtggaccagcctgactcgtaaggggattgtgcgagtagtcttttttccattcttctttaggtggtggctacaagtgacctcaaaggtgatttttttttggctgctggtcctgtacctgctccaggttgccgcgatcgtgctcttttgcagcactagttccccgcacagcattccactcacagaagtcattggcccaatatggcttatgctactactaggcaccgtgcactgtcagattgtcagcactagaactccaaagccacccttgtcaactggaggaaagcgccgccgcaagttaagaaaagccgcccatctcgaagtccaccgtgagggcgacggctcgtccacaactgataacacccaggagggggcagtacagaaccatgggacgagcacttctcatagcgttggtacagtgtttagggacctttggcacgcggctttttttctgagtggctctaagaaggctaaaaactcaatcgataagtctactgagacggataacgggtatgtatctttagacggtaaaaaaactgtcaaatctggggaagatggaatccaaaatcacgaacctcaatgcgagaccattcgacccgaggaaactgcgtggaacacaggaaccctgcgtaacggccctagtaaggatacgcagcggacaatcaccaatgtgtccgatgaggttagcagtgaggagggccctgagacaggctattcattacgaaggcacgtggaccggacctctgagggggtcttgcggaaccgcaagtcacaccattataagaaacattatccaaacgaggacgctccgaagagcggcacatcttgctcgagcagatgtagctcttctcgtcaggattctgagtcagcacgcccagaatctgagacagaggacgtgctctgggaggacctgctacactgtgcagagtgccattcaagttgcacctccgagacagacgtcgaaaatcaccaaatcaacccatgcgttaagaaagagtatcgggatgacccttttcaccagtcacatctgccctggctgcatagcagccatccagggctggaaaagatctcggccatcgtgtgggagggaaacgactgcaaaaaggcagacatgtccgtgctcgaaataagtggaatgataatgaatcgggtgaactcccatatcccaggaattgggtaccagatttttgggaacgcggtaagcctgatcctgggccttacaccatttgtattccggctaagccaggcgactgacctcgaacaacttaccgctcatagcgcgagtgaactgtacgtgattgcgttcggatccaatgaggatgtgattgtcttatccatggtgattatttcctttgtggtgcgggtcagcctcgtctggatcttcttcttccttttgtgcgtggcagaacgcacttataagcagcggctgctgttcgcgaagctctttggtcacctgacatctgctagacgagccagaaaatctgaagttccgcattttagactgaaaaaagttcagaatattaaaatgtggttgtctctgcgtagctatcttaaacgcagaggcccccagagatccgttgacgtgatagtcagctcagctttcttgctgacaatctctgtagtcttcatctgctgtgctcagctccttcacgttcatgaaattttcctggactgccactacaactgggagcttgtgatatggtgcataagtttgactctattcctccttcggttcgtcaccctaggatcagaaacatcaaaaaagtacagcaatacatctatacttctcacggagcagattaatctttatttgaaaatggagaaaaaaccaaataagaaagaagagcttacactcgtcaacaatgtcctgaaactggccactaagctgctcaaagaattagacagccccttcagattgtacgggctgactatgaatcctctcctgtacaatatcacgcaggtggtgatcctatctgccgttagcggtgtgatatcagacttgctcggcttcaacctgaaactctggaagataaaaagttag

SEQ ID NO: 29305 - DNA, 1059 bp, Artificial Sequence
  Description of Artificial Sequence: Synthetic coding sequence
atggcctcaaaagttacagatgcaattgtgtggtaccagaagaagatcggggcttatgaccagcaaatttgggaaaaaagtgtggagcagagagaaatcaagggtctgcggaataaaccaaagaagacagcccatgtgaagcctgaccttattgacgtcgatctagttagaggctcagcgttcgctaaggcaaagccggaatcaccttggacatcactgactcggaagggcatcgttagagtcgtgttcttcccttttttctttcgatggtggctgcaggtcacctctaaagtcatcttcttttggctgctagtgctatacttgttgcaggtggccgccatcgtgctcttttgcagcacatcctctccccactctatcccattaaccgaagtaatagggccaatttggcttatgcttctgctcggaacggtgcattgtcagatagtgtccacacgaacgcctaaacctcccttgagtacaggaggcaaaaggaggaggaagctgagaaaggccgcacatctcgaggtgcatcgcgaaggagacgggtcgtcaaccactgacaatacccaagagggagctgttcagaaccatggaacctccacctcccactctgttggcacagtttttcgcgatttgtggcacgctgcctttttcctcagcggatccaagaaagctaaaaattctatcgataaatccactgaaaccgataacggatatgtatcgctcgacggcaaaaaaactgtgaagagcggtgaagatggcattcagaatcatgagccacagtgtgagacgataaggccagaagagaccgcttggaacacagggacactgagaaatgggcctagcaaagacacgcagcggactattaccaacgtcagcgatgaggttagctcagaggaggggcccgaaaccgggtacagcttgcggagacacgtggatcgcacttcagagggagtgctaagaaataggaagtcccaccactataaaaagcactatccaaatgaagtctacacactgtccctgtcagtctacataagaatttactttatttgctactag

SEQ ID NO: 29306 - DNA, 1071 bp, Artificial Sequence
  Description of Artificial Sequence: Synthetic coding sequence
atggccagcaaggttaccgatgctatcgtgtggtatcagaagaagattggtgcttacgaccaacaaatttgggagaagtctgtggagcaacgagaaattaaatttatcaagttgggtctgcgtaacaagccaaaaaagaccgcgcatgtgaagcctgatttgatcgacgtggacctggttaggggctccgcattcgcgaaggcaaaacccgagtcaccctggacaagcctgacacgaaaaggcatagttagggtggtatttttccccttcttcttcaggtggtggctccaggtcacgagcaaggtgatatttttttggttgctcgtgctgtatttgctccaggtcgccgctatcgtgttgttttgctccacctcctcaccacacagcataccactgacagaagtaatcggaccaatttggttaatgctgctcctgggcactgtccattgccagattgtgtcaactcgcactcccaaaccacccctgtctaccggcggaaagaggaggcgcaagttgcgcaaggccgcacacctggaggtgcaccgagagggggacggaagttccacgactgacaatacacaggaaggcgcagtacagaatcatggtacctctaccagccatagtgtggggaccgtcttcagagacctgtggcacgccgcattctttctgtctggttctaagaaggctaagaattctatagacaagagtaccgagactgataatggttacgtgtctctagatggtaaaaaaactgtcaagagcggggaggacggaattcaaaaccatgaaccccagtgtgagaccattaggccagaggagacagcctggaataccgggaccctgcgcaacggcccatcaaaggacacccagagaacaattacaaatgtttcagacgaggtaagcagcgaggaagggcctgaaacaggatatagcctgcgaaggcatgtagaccgcacctccgaaggcgtcctcagaaacagaaaaagccaccattataagaagcattaccctaacgaggtctacacattaagtctgtctgtctatatccgaatttacttcatttgctactag

SEQ ID NO: 29307 - DNA, 1449 bp, Artificial Sequence
  Description of Artificial Sequence: Synthetic coding sequence
atggccagaaagctatcagtgctcgaagtgctcttgatcatcttttgtctaatagttgtgaccatcgatattcttctgctgctcttggtcctggaagagacctcagacacaagtttcacacccgagtgtccagaaattccccagtccgaaaggattgattgcacgcccgaccaagaagtgacggaggacatttgcagatggcagtacaagtgttgctggtcccctgtggctgacgccaatgttccccgctgcttttttccttggaattggggctatgaagcgtccaatggccatacgaatacctctacaggtttcacagcacagctgaagcggctgccatccccaagcctgttcgggaacgacgttgcgaccacccttttcacggctgaataccaaacgtctaatcggttccattttaagatcacagatttcaataatattagatatgaggtgtcccacgagaacataaaccttgtggatggcattgcagatgctagcaatttgtcctattacgtggaggtgactgacaagcctttcagcattaaaatcatgagaacaagtaacagacgagtcctcttagacacctctatcggccccttgcagttcgcacaacaatacctgcagctctcatttcggctgccctctgccaacgtatatgggcttggagaacatgtgcatcagcaatacagacacaacatgacttggaagacatggccgatatttactcgagatgcaacgccaactgagggtatgatcaacctatacggagcccataccttttttttgtgtctggaggacgctcggggctccagcttcggcgttttcctgatgaacagcaacgccatggaagtgactctgcagcctgcccccgccattacttatagaaccataggaggcatcctggatttctacgtttttcttgggaatactcccgaacaggttgtgcaggagtatctggagctagtaggtcgccccttcttccccccctactggagcttaggctttcagctgtcacggcgcgattatggaggcattaataagctgaaagaagtggtgagtagaaaccggctggccgagatcccgtacgatgtacaatattccgatatcgactacatggatggtaaaaaggacttcaccgtggacgaagtggcttactccggtctgcctgatttcgtgaaggagctccatgataatggccagaagtacctgattataatgaaccccggaatctcaaaaaattctaattatgaaccgtataataacggcagtctgaagcgggtgtggattcttggttccaatggttttgctgtgggggaggggtatccaggccccacagtattcccagattatacaaacccagtgtgcaccgagtggtggacagaccaggttgcaaagtttcacgaccatctggagtttgacggcgtttggatcgtgagttactattcatag

SEQ ID NO: 29308 - DNA, 1941 bp, Artificial Sequence
  Description of Artificial Sequence: Synthetic coding sequence
atgttcttgtcgatttccacccggctaccatcccaatacatttacggattcggtgagacagaacacacgacattccggagaaatatgaactggaatacgtggggaatgtttgctcacgacgagccacccgcctataagaaaaatagctacggagtgcacccatattatatggctctagaggaagacggttcagcccatggcgtactgctgctcaactctaatgctatggacgtgacactgcagccaacacccgcactgacttataggacgacaggggggattcttgacttctatattgtattggggcctacgcctgagctcgtgactcaacaatatacagagttaatcggccgacccgcaatgattccatattgggcactgggcttccaccttagcaggtacggctatcaaaacgacgccgaaattagttccctctatgacgccatggttgcagcccaaatcccatacgacgtgcagcacgttgatatagattacatgaacagaaaacttgattttacgttaagcgcaaacttccagaacctgtctctgctgatcgagcagatgaaaaagaacggcatgaggtttatactgatcctggaccccgctatctctggaaacgagacgcagtacctccccttcattaggggacaggaaaacaatgtattcatcaaatggccagacactaacgacattgtgtggggcaaggtgtggccagacctgcccaatgtaatcgtggatggttctctggaccacgagacccaagtgaaactgtatagagcctacgtggcgttccccgatttcttcaggaattccaccgccgcttggtggaagaaggaaattgaggaattgtacgccaaccccagagaacctgaaaaaagtttgaagttcgatggcttgtggattgacatgaacgagccttctaatttcgtggacggtagcgtgcgcggatgctccaacgagatgctcaataatcccccgtacatgccttacctggagagcagggacaagggcctttcttccaagactctctgcatggagtcacagcagattctgcccgactcctccccagtggagcattacaacgtgcataacctatatggatggagccagactagaccaacatacgaggcagtccaagaagtgactgggcaaaggggcgttataattacacggtctacctttccttcgagcggacgttggggaggtcaccggttgggaaacaacactgccgcttgggatcagctgggaaagagtatcattggaatgatggagttcagccttttcggcataccgtataccggcgctgatatatgcggatttttcggagatgctgaatacgaaatgtgcgtgcgctggatgcagctgggtgctttctacccattttcacggaaccataataacatcggaacgagacgtcaggatccggtggcttggaactccacttttgaaatgctgagtcggaaggtgctcgagactcggtatactttgcttccatatctttacactctgatgcacaaggcacatgtggaaggcagtaccgtggtaagaccgctcctacatgagtttaccgacgatagaacgacatgggatatagaccgccagtttatgctgggcccagccatactcatctcccctgtcctagagacctctacattcgagatctcggcttacttccctcgggcccgttggtatgactactctaccggcacatcctcaacaagcaccggtcagcggaagattctgaaggcacccctcgaccacatcaatctgcatgttcggggtgggtacattctgccatggcaggaacccgctatgaacacacacagttctaggcagaatttcatgggattgatcgtggcattggacgataacggtaccgcagaaggccaggtgttttgggacgacggccaaagtatcgtgtttaacacaacagccatgtag

SEQ ID NO: 29309 - DNA, 3381 bp, Artificial Sequence
  Description of Artificial Sequence: Synthetic coding sequence
atggtgaagctttccattgtgttgacgccccagttcctgtctcatgatcagggccagctgaccaaggagctccagcagcacgtcaagagcgtgacatgcccttgcgaatacctgaggaaagtcattaacactctagccgaccatcaccaccgtggaactgactttggtggctctccctggctacatgttatcatcgcatttcccacgagctacaaggtggtgatcacattgtggatcgtgtatctctgggtcagcctattgaaaaccatattttggagtcggaatgggcatgatgggtccactgatgtgcagcagagggcttggaggtctaaccggcggcgccaagagggccttcggtccatttgtatgcatacaaaaaaacgagtgtcttcgtttagaggaaacaagatcggtctcaaggacgtgatcacgttacgacgacatgtggaaaccaaagtgagagctaaaatccgcaaacgcaaggtgacgactaagattaaccaccatgataagatcaacggcaagcgcaagaccgccaggaaacaaaaaatgttccaacgtgcccaggagctgagacgaagggccgaggactaccacaaatgcaaaatccctccctcggcaaggaaagccctctgcaactgggtgagaatggctgctgccgaacaccggcactcctcaggcttaccctactggccatatctgacagctgagacccttaaaaaccgtatgggacatcagccaccccctccaacacagcagcactcgatcaccgataactcactcagcctgaaaacaccacctgagtgcctgctgacgccattgccaccgagcgccgatgacaacctgaagacaccacctgagtgtgtgttaacacctctgccacccagcgctgacgacaacctaaagacacccccagagtgcgttctcactccattgcccccttccgcagatgataacctcaaaactccacccgaatgtctgttgacacccctgcctcccagcgccgacgacaatctgaagacaccaccagagtgcttgctcacacctctccccccatccgccctcccgtctgctcctccatctgccgatgataatctcaagactcgcgccgagtgtttgctgcacccactgcctccctccgcagacgacaacttaaaaactcccagtgagaggcagcttactcccctcccgccttcggctcccccgagcgcagacgacaatattaagaccccagctgagagacttcgtggccctctaccccctagtgcggacgacaacttaaagactccatccgagaggcagctgaccccccttcccccttccgcgcccccgagcgcagatgataacattaagacacctgccgagcggctgaggggccctctgcctccctccgcggacgacaacctgaaaacacccagtgagaggcagctgacaccactccctcccagcgctccgccgagcgctgatgataatattaaaacgcctgctgaaagactgcggggtccccttcccccttccgctgacgataatctgaaaactcctagtgagagacagctgaccgcgctccccccatccgctgatgataacatcaagactcctgctgagagattaagaggaccccttccgccctctgcagatgacaatctcaaaactccatctgagcgacagctaacccctctgccaccaagcgcgcctccttccgcagatgataacatcaaaacaccacttcccccatctgcggatgaccttaagactccctctgaacgtcagctcaccccacttcccccatctgccccaccaagcgccgacgataacatcaagataccaggattccaccatcagccgatgataatttcccgccatcttccttccgtgtcttctctcccctttcacccgcagctgcacccgcagcaaatgattatctctagacacctgcccagcgtgtgcggggggagattccacccagaacggatgatcattagtcggcatcttcctagcgtatcctcactgccgttccaccctcagctgcaccctcagcagatgattatcagcaggcatttaccctcagtgtgtggtgggcgattccacccacagcagatgattatcagccgacacttgcccagcgtgtctagcctgccgttccacccgcagttgcacccccaacagatgataatttctcgccatctgccgagcgtgtgtggcggcagatttcacccccagcgcatgattatctcccgacacctgccctcagttagcagtctaccatttcaccctcagcttcacccccagcagatgataattagtcgccatctgccaagtgtctgcggggggagatttcacccccagcagatgataattagccgacatctaccttctgtcagtagcctcccttttcacccccaactgcatccgcagcaaatgatcattagcaggcacctgccaagcgtgtgcggagggagattccatcctcagagaatgataatctctcgccatttgccttctgtgagctccttgccctttcacccccagctccacccgcaacagatgattatttctagacatctgccctctgtatgtggggaaagactgaggggccctctaccaccaagcgcggacgacaatctgaagacaccttcagaaaggcagctgacgcctctgccccccagtgcgcctcccagcgccgacgacaatatcaaaactcccgcagagcgccttaggggacccctgcccccctctgcagacgacaacctgaagactccatccgagcgccagttaacacctctgccaccaagtgcaccaccatccgccgacgataacatcaagacccctgccgaacggctccgtggaccgctgccgccatcagcagatgacaacctgaagaccccgtccgagaggcagctaacgccacttcccccgagcgcacctccctcagcagatgataacatcaagaccccagctgaacgcctccgcggacccctccctccttcagcagacgataatctgaagacacctccactcgctacgcaggaggccgaggcggaaaagccacggaaaccaaagcgccagagagccgccgagatggagccccccccggagccaaaacggcggcgtgtcggggatgtcgaaccctcaaggaaaccaaaacggcgcagggccgccgatgtggagccatcctcccctgagcccaagaggagacgtgtgggcgatgtagagccaagtcgcaaacccaaaagaagacgggcagccgatgtggaaccctctagtcctgaacccaagaggagacgcgtgggagatgtagaaccatctagaaaacctaagcgtcgccgcgctgctgacgtcgagccaagtctgccagaaccaaaacgtcggcgtctctcttag

SEQ ID NO: 29310 - DNA, 2220 bp, Artificial Sequence
  Description of Artificial Sequence: Synthetic coding sequence
atgttctgctgtctcggatatgaatggctgtccggcgggtgcaaaacttggcactccgcctgggtgataaataccctcgcagatcaccaccaccgcggcaccgatttcgggggatctccttggctgcatgtgattatagcctttcctacttcctacaaagtggtcattaccctgtggattgtatacctgtgggtgagcctgctgaagacaatcttctggtcacgcaatggtcacgacggaagcactgatgtgcagcagagagcctggagatctaatcgaaggcggcaggaagggttaaggtctatctgtatgcacaccaaaaagcgggtaagctccttcagaggcaataaaatcggactgaaggatgtgataaccttacgaaggcacgtggaaacaaaagtgagggcaaaaattcgcaagagaaaggtgactacaaagattaaccatcacgacaaaattaatggaaagcgcaagacagctcgcaaacagaagatgttccaacgagcccaggagctgagaagacgcgcggaagactaccataagtgcaaaattccaccaagtgctagaaaagctctgtgcaattgggtccggatggctgctgctgaacacagacactcctccggtcttccctactggccttacctgacggccgagactttaaaaaaccggatggggcatcaacccccgccccccacacaacagcattcaattacagataactccttgtccctcaagacccctcccgagtgcctactgactcctctccctcccagcgccgacgacaacctgaagacccccccggagtgcgtgctgacccctctccccccatcagcagacgacaatttaaagacccctcccgagtgcgtactgacccccctgcctcctagcgccgacgataaccttaaaacgccacctgagtgtttactaactccacttccaccttctgccgatgataacttgaaaaccccaccggagtgcttgctcactcctctgcctccctcagctctgccctccgctccgccaagtgctgatgataacctgaagacacgggctgaatgtctgttacatcctctgcccccatcagcagacgataacttaaaaactccctcagagcgccagctcacccccctcccaccatccgcacctccttcagctgacgataatatcaagactcctgccgaacgacttcgcggcccactgccaccctcagcggatgacaatctgaagacgccgtctgagcgccagctgacccccctgccacccagtgctccaccttctgccgatgacaatattaagacaccggccgaacggttacgggggccgcttcccccttctgctgacgataatcttaaaaccccctctgagcgccagctgactcctctccccccatccgcgcccccttctgcggatgataacatcaaaacaccggcagagcgcctgcgaggtcccctgccaccgagtgcagatgacaacctgaagacaccatccgagcgccagttgacagctctgcccccttctgcagatgataacattaagactcccgcagagcggctcagggggcctctcccaccaagcgccgatgataatttaaagaccccctctgagaggcaactcacaccactccccccctcagccccaccgagtgctgacgacaacataaagacacccgcagagcggctgcgcggcccactgcctccctccgccgacgataacctcaaaacccctagtgagcgacagctgacacctttgccaccttcggctcctccatctgccgacgataacatcaagacccctgctgagcgtctcagaggccctcttccaccgagcgctgacgataatctgaaaacacctccgctggctactcaagaagcggaggccgagaagccccgaaaacccaaacggcagagagcagcagaaatggaacctccccccgagccaaagcggagaagagtgggggacgttgagcccagccggaagcctaaaagacgtcgggcagcagatgtggaacctagttcgccagagcctaaaaggcgacgcgtaggcgacgtggaacccagtcgcaagcccaagcgccgccgtgcagcagacgttgaaccatcctctcccgaaccgaagagacgccgtgtgggggatgtcgagccaagcagaaaacccaagcgtcggcgggcggctgatgtggaaccctccttacctgagcccaagcggcggcgcctgtcttag

SEQ ID NO: 29311 - DNA, 3402 bp, Artificial Sequence
  Description of Artificial Sequence: Synthetic coding sequence
atggtaaagctgtcaatcgtcctgactcctcagttcctctctcatgatcagggacagctcactaaggagctccagcagcacgtaaaatcagtgacctgtccttgcgaatatctccgcaaggtcatcaatacactggctgatcaccaccaccgcggcacagactttggcgggtctccatggcttcacgtgattattgcatttcccactagctacaaggtggtgataacactgtggatagtgtatctctgggtgagtttgctcaagacaattttctggtccaggaacggccatgacggatcaactgacgtgcagcagcgggcctggcgatcgaataggcgcagacaggaggggctgcgatctatctgtatgcacactaaaaagagggtgtcctctttcagaggaaataagatcggccttaaagatgtgatcactctccgtcgacacgtggaaacaaaggtccgggcgaagatccgaaaaaggaaggtgacaaccaaaattaaccaccacgacaaaatcaacggtaaacgcaagacagcacggaagcagaagatgttccagagggctcaggaacttcgaaggcgcgctgaggactaccacaaatgtaaaataccaccgtcagcaagaaaggctctgtgcaactgggtgcgcatggctgcagcagagcatcggcacagtagtgggctcccctattggccctatttaacagccgaaactctgaagaaccgtatggggcaccaacctcctccacctacacagcagcactctattactgacaactccttgtccctgaagacaccacctgagtgcctcctgaccccacttccccctagcgctgacgacaacctcaagaccccaccagagtgcgtgcttacccctctccctcccagcgctgatgacaaccttaagactccccctgaatgcgtattgacccctctaccaccgtcggctgacgataatcttaaaactccccccgaatgtcttctgacgccactgcccccatctgccgacgataatctgaagaccccccctgaatgtcttctcaccccattgcccccctccgctctgccaagtgcacctccttcggccgacgataatctcaagacaagagccgaatgccttttgcatccattgcccccctccgccgacgacaatctgaaaaccccttccgagcgccagctaacccccctacccccaagcgcccctccaagtgctgatgataacattaagacgcccgcggaaagactccggggacctctgccaccctctgctgatgacaatctgaagacacctagcgaacgacagttaacaccgctccctccttctgcacccccatcagctgacgataatattaagaccccagccgagcggctgcggggccctctcccgcccagcgccgacgataacctcaagaccccatctgagaggcagttaacaccacttcccccgtccgctcccccctctgcggatgataacataaaaaccccagctgaacgactccgcggccctcttcctccatccgccgacgacaatctcaagacgcccagcgaacgccagctcaccgctctgccacctagcgccgacgataatatcaagacaccggctgagagactccgtggtccactgcccccctccgcggatgacaacttgaagaccccttccgagcgacagctgaccccactgcctccctcagccccaccatcggctgatgataatattaagaccccagcgtttcaccctcagaggatgatctctcgccacctcccttccgtcagtagcttgccatttcacccccagttacaccctcagcagatgatcattagccggtatctgctcagtgtctgtggttttcggttccaccaccagcccatgattatcagcaggcatctcccatccgtgagttcactgccattccacccacagttacatccccagcagatgatcatttcaaggcatcttcccagcgtgtgcgggggcaggttccacccggagagaatgatcatctcccgccatctccctagcgtctctagtctgccctttcacccgcaactccatccacaacagatgatcatatccaggcacctgcccagcgtctgcggggggaggttccacccccaacagatgatcatatcaaggcatctcccgtctgtgtcaagtctaccattccacccacagctccatcctcagcagatgataatcagtcggcaccttccctcagtgtgcggcggacgctttcacccacagcggatgattatctcccggcatctcccctccgttagctctctcccttttcacccacagttacacccacagcagatgataatctcccggcatctcccgtctgtatgtggcggccgcttccacccacagcagatgataatatcccggcacttgcccagtgtgtctagccttcctttccacccccagctgcatccacaacagatgattatcagtcgtcacttgccatcagtatgtggcggacgcttccacccccaaagaatgatcatcagtcgacacctcccgtctgtatcgtctttgccttttcatcctcagctgcacccgcaacagatgatcatttctcgccacctgccctcagtctgtggcgaacggctccggggcccacttcccccctctgctgacgataacttaaaaacccctagtgagcgccagctgactcctctgccaccctcagcgcccccaagtgctgacgataacattaaaacacctgccgagcgtcttcgtggacctcttcccccctccgccgatgacaacctgaaaacccccagcgaacgccagctaacgccactgccgccttctgccccccctagcgccgatgataacatcaaaacacctgctgagaggttgcgaggacctttacccccctcagcagacgacaacctaaagacaccctccgagaggcagttgactccgctgccaccctccgctccaccatctgctgatgataacataaaaacgccagctgaacgcctcaggggccccctgccgccctcagcggacgacaatctgaaaactcccccactagccacccaggaggccgaggcggaaaagcctaggaagccaaaacgccagagggcagccgaaatggaaccaccccccgaaccaaagaggagacgggtgggcgatgtcgaacccagcaggaagccgaaaaggaggcgcgccgcggacgtggaaccttcctccccggagcccaaacgccgaagagtcggggatgttgaaccatccaggaagcctaaaagacggcgggccgcagatgtggagccgagctctccagagcctaagaggcggcgcgtaggagacgttgagcccagtcggaaacctaagagacggagggccgccgacgtcgagccttcgctgcccgagccgaaacgaaggcggctgagctag

SEQ ID NO: 29312 - DNA, 2037 bp, Artificial Sequence
  Description of Artificial Sequence: Synthetic coding sequence
atggtaaagttgtccattgtgctcactccacagttcctttcacatgaccagggccagttgacaaaggagctgcagcagcatgtgaaatctgtgacctgcccgtgcgaatacctaagaaaggtgattaacacgctcgcagaccaccatcatcggggaaccgactttgggggcagtccctggctacacgtcatcattgcatttcccaccagctacaaggtggtgattactctatggatcgtgtacctgtgggtctctctgctgaagactattttttggtctcgcaatggccatgacggttccaccgacgtacaacagcgggcatggcggtcaaatagaaggcgtcaagaagggcttcgctcaatatgcatgcacaccaagaaacgtgtctctagtttcaggggaaataaaattggactgaaggacgtgattaccttgcgaaggcacgtggagacgaaagtgagggctaaaataaggaagagaaaagtcaccaccaaaataaatcatcatgataaaatcaacggaaagcgcaaaacagcacggaagcaaaaaatgtttcaaagggcccaagaactgcggcgacgggcagaggattaccataaatgtaaaatacctccttccgcacgaaaggcactatgcaactgggtgcgtatggccgctgcagaacacagacatagtagcggcttgccctactggccctacctgacagcagagactctgaagaacaggatgggacatcaacctccccctccaacacagcagcatagcatcactgacaactcactctctctgaagactcctccagagtgtctcctcacgcccctcccccctagtgccgatgacaacctcaagaccccaccggagtgcgtcttgacccctctcccacctagtgctgacgacaacctcaagacacccccagagtgtgtactgacaccactgccacccagcgccgacgataacctcaagacccctccagaatgcctactgactcctctcccaccaagtgctgacgataacctcaagactccccctgagtgcctgctgacccctctacctccctcagcccttccaagtgctccaccgtccgccgacgataacctgaaaacacgtgcagagtgtctgctgcatcccctcccgccttctgcagacgataatctgaaaacgccttcggagaggcagctgactccactacctccatctgctcctccgtcagcagatgacaacattaaaactccagccgagcgactccgcggccctctgcccccaagcgctgatgacaatctaaagaccccgagtgaaagacagctgacccctttgccaccctcagcgcccccgtcggctgacgataatataaagacccccgcagagcgcctgcgcggtcctctgcccccatctgcagacgacaacctgaagacccctagcgagagacagctgacacctctgcctccatctgctcccccctcagctgacgataatatcaagactccagctgaacgactgcgggggcctctgcccccatctgctgatgataatctgaaaacaccttccgaacgtcaactgacgcccctaccacctagtgctcccccttccgcagatgataacattaaaacccctgctgagagactgcgggggccactgccaccatctgctgacgacaatttgaagacccctcccctggcgacacaggaggccgaggctgagaaaccaagaaagccaaaaaggcagagggccgctgagatggagccacctcctgaaccgaagaggaggagagtcggagatgttgaaccatccaggaaaccaaaacggcgccgcgcggccgacgtcgagccgtcaagcccagagcctaagcggcgcagggtgggagacgtcgagccttcgaggaagccaaagagaagaagggcggcagacgtggagccgtcaagccctgagcctaaacggagacgtgtgggagatgttgaaccatcccgtaagcctaaaagacgcagggctgctgatgttgagccttcgctgcccgaaccgaaacgtaggcggctcagctag

SEQ ID NO: 29313 - DNA, 2547 bp, Artificial Sequence
  Description of Artificial Sequence: Synthetic coding sequence
atggtcaagctctcgatagtgctgacaccgcagtttttatcccatgaccagggtcagcttacaaaggagctgcagcagcatgtgaaatctgtgacctgcccttgcgagtacttaagaaaggtgattaatacactagcggaccatcaccacagaggaacggatttcgggggtagcccctggctccatgtgatcattgcatttcccacatcctataaggtcgtcatcacgctgtggattgtatatttgtgggtgtccctgctaaaaacaattttctggtctaggaacggccacgatggctcaacagacgtgcagcagcgcgcttggaggtctaacaggcggaggcaggaggggcttagaagtatctgcatgcatactaagaagagagtgtcctcttttaggggcaataagataggactgaaagatgtcatcacacttagacggcatgtcgagaccaaggtgagggcaaaaatacgcaagcggaaggtaactaccaaaatcaatcatcacgataagatcaacggcaaaagaaaaacagctaggaaacagaaaatgtttcaaagagctcaggaacttcgccggcgcgccgaggattaccacaagtgtaaaattccgccttctgcgcgtaaagccctttgcaactgggtacgtatggctgctgcagagcatagacacagcagtggactcccatactggccatatttgacagctgagaccctcaagaaccggatgggacaccaaccacctcctccaacacagcaacactcgatcacagataacagcttgagcctcaaaactcccccagaatgcctcctgacaccattacccccctcggctgatgataaccttaaaacacctccagaatgcgttttaacacctttgcctccttccgccgatgacaacctgaaaacaccgcccgaatgcctactcactccattaccgccctctgcgctgccttcagcccctccttccgcagatgataatctcaagactcgcgctgaatgcttattgcatcccctccccccaagtgctgatgacaatcttaagacccctagtgaaagacagctgacaccccttccaccatctgcccctccttcagctgatgacaacatcaagactcctgcgttccacccacagagaatgatcatctctcgacacctcccctctgtatcaagtctacccttccaccctcagctacatccccagcaaatgattattagccggcatctcccctccgtatgcggagggcgatttcatccagagcgcatgattatttcaagacatctgccaagcgtgtcatcactgccatttcatcctcagttgcacccacagcagatgatcatttcacggcacctgccttccgtttgtgggggaagattccaccctcaacagatgatcattagccgccatctccctagtgtgtcatcgctgccgttccaccctcagctccacccccagcagatgatcattagccggcatctcccatcagtgtgtgggggtaggttccatcctcagcggatgatcatctcccggcatctcccttccgtctcgtctctcccattccacccacaacttcatcctcagcagatgataattagtcgtcacttaccttctgtgtgcgggggacggttccacccccaacagatgatcatttccaggcatcttccctcagtgagctcgctgcccttccatccacagctgcacccacagcagatgatcatcagcagacacctccctagcgtctgtggaggtcgattccaccctcagcgcatgatcatcagcagacacctgccctccgtgtcttccctgccattccaccctcagcttcacccccagcagatgatcatctccagacatctgcccagtgtgtgtggcgagcggttgagaggccctctgccgccatcagccgacgataatctgaagaccccctctgagagacagttgaccccactccccccgtctgcacctcctagtgctgatgacaatattaagactcctgcggaacggctcaggggacctctgcccccctccgcagacgacaatcttaagaccccttcagagaggcaactgactccattaccccccagcgcccccccctcagccgatgacaacattaaaactcctgccgaaaggttgaggggccctctgccaccctctgcagacgacaacctaaagactccaccccttgccacacaggaggctgaggcggagaaaccccgtaaaccaaagaggcagcgcgctgccgagatggaacctccacccgaaccaaagcgacgtagggtcggggatgtcgaaccaagccgtaagcctaaaaggcgtagggctgctgatgtggagccaagcagcccagagcccaaacgacgaagagtgggcgacgtggaaccatcgcgcaaaccaaaaagacggcgggcagccgacgttgagccatccagtcccgagccaaagaggcgtagagtgggtgacgtggagcctagtaggaaacccaagcggcgccgggccgcagatgtagaaccttccctccccgagcccaagcgcagacggttgtcatag

SEQ ID NO: 29314 - DNA, 3033 bp, Artificial Sequence
  Description of Artificial Sequence: Synthetic coding sequence
atgcatacaaaaaagagagttagcagctttaggggaaacaaaatcgggctgaaagatgtgataacactcaggaggcacgtggaaaccaaagtgcgggcaaagatcagaaaaaggaaagtgacaactaagatcaaccaccacgataagatcaatggaaagcgaaagacggcccgcaagcaaaagatgtttcaaagagcccaggagctcaggcgacgagcggaagactatcacaagtgtaaaatccctcccagcgctcggaaggccttgtgtaactgggttagaatggctgccgccgagcatcgccactccagcggtctgccatactggccatatcttacagcagagacactaaaaaataggatgggtcaccaacctccacccccaacgcaacaacatagcattacagacaacagtttatcgctcaagactccccctgagtgtcttctgacacccttgccgccgagcgctgatgacaatctcaagacccccccggagtgcgtgctaactcctctccccccatccgcggatgacaatctgaaaactcctcctgagtgcgtactgacccccctcccccccagcgcggatgacaatctcaagacaccaccagagtgcctccttactcccctgccaccatccgcagacgataatttaaaaactccccccgagtgtctgctgacacccttgccaccatcagccctaccaagcgctcccccatcggccgacgataatttaaaaactcgcgcagaatgcctcctccaccccctgcctccaagcgccgacgacaatctgaaaactccttctgagcgtcagctgaccccactgcccccatccgccccaccatccgcggacgataatattaaaactcccgccgaacggctgagggggcccctaccaccctcagctgatgacaatctgaaaactcctagcgaacgacagctgacgcctctgcctccctcagctccaccatcagcggatgacaatataaagactccggccgaaaggctgcgtgggccactgccgccctccgcagacgataacctgaagactcctagcgaacggcaacttaccccactgcctccttcagcacccccctctgctgacgacaacattaagacacctgcagaaagattgagaggtcccctcccaccatcagccgacgacaatttaaagactccatctgagaggcagctgacagcactacctccctccgccgacgataatatcaagacaccagccgaaaggttacgaggccctctgcctccatcagctgacgacaatcttaagaccccgtctgagagacagttgactccgcttccaccgtcagctcccccgagcgctgacgataatatcaagacccccgccttccatccacaacggatgatctcccggcacctaccatcagtgtcctccttgcctttccacccacagctccatccccaacagatgattataagccgctatctgctgtccgtttgtggtttccgcttccaccatcagccaatgatcatcagccggcaccttccatccgtgtccagtctcccttttcatccccagcttcatccacagcagatgatcatctcacgccatctcccatcagtctgcggtggaagattccacccagaaaggatgatcatttcgcgccatctcccatccgtctccagcctgcccttccacccccagttgcatcctcagcagatgatcatttctcggcacctcccctccgtgtgtggggggcggttccatccccagcagatgatcatcagcagacatctgccttccgtgtccagtttaccgttccacccgcagctccatcctcagcagatgatcatctctcggcacctgccttccgtatgcgggggacgcttccaccctcaacggatgatcatttcaagacacctgccctccgtatcaagcctgccctttcatccccagctacaccctcagcagatgattattagtcgccacctgccgtcggtctgcggtggcagattccacccacagcagatgattattagccgccatctcccatccgtgtcaagcctgcccttccacccacagctgcacccacaacagatgattataagtaggcaccttcccagcgtatgtggccccctgcccccaagcgccgatgacaacttgaaaacccctagcgaacgacagctaacacctttccctccttctgctccgccaagcgccgatgacaacattaagacacccgcagagcggctacgggagaggctaagggggccgctgccacctagcgccgatgataaccttaagacaccctctgaacgtcagctcacgcccctgcctcccagtgcacctcccagcgcagacgataatatcaagaccccggctgaaaggctgcgcggacctctgccgccctcagccgacgataatcttaaaactccttctgaaaggcagctgactccattgccccccagcgctccgccctcagctgacgacaacattaaaaccccggctgaacggcttcgtggccctctgcctccctcggcagacgacaacctaaaaactcccagtgagcgacagttaaccccactcccacctagcgcaccccctagcgcagacgacaatattaagaccccagctgagcggctaagaggcccactgcccccgtctgcagacgacaatttgaagactccaccactcgcgactcaagaggctgaagctgagaagcctcggaagccaaagcggcaacgcgcggctgagatggagccaccgcccgaaccaaagaggaggcgggttggagatgtggaacctagtcggaagcccaaaaggaggagggccgccgacgttgagcctagtagcccggaaccaaaacgtagaagagttggggacgtggaaccctcccgtaagcccaaaaggcggagggccgcagatgtggagcccagttcacccgaacccaaacggagaagggtgggcgacgtcgagccatctcggaaacctaagcggcggagagcagctgacgtcgagccgtccctcccagagccaaaacggcgaagactcagttag

SEQ ID NO: 29315 - DNA, 3402 bp, Artificial Sequence
  Description of Artificial Sequence: Synthetic coding sequence
atggtcaagctgtccatagttctgaccccacagtttctgtcccatgaccaggggcagctgacaaaagaacttcagcaacacgtaaagtctgtcacttgcccttgcgagtacttaaggaaggtgattaatactcttgctgaccaccaccacagagggactgactttggcggctctccatggcttcatgtgattattgctttccccacctcttacaaagtggtgataaccctgtggatcgtctatctgtgggtctctcttcttaagaccatcttctggagccgaaatgggcatgatggatctaccgacgtgcagcagagggcctggcgcagtaacaggaggaggcaagaaggcctgagatccatctgtatgcatactaagaaaagggtgagttcatttagaggtaacaaaatcggtctgaaagatgtcataacgctcaggcgacatgtagagacaaaggtgagggctaaaatcagaaagagaaaggtgacaaccaaaatcaaccaccacgataagatcaacggcaagcggaaaaccgctcgtaaacagaagatgttccagagagctcaggaacttagacgtcgggccgaagactatcataagtgcaagatacccccctcagcccgaaaggcactgtgtaattgggttcgcatggccgccgcagagcaccgacacagttccggcttgccgtattggccgtatctgaccgctgaaacacttaaaaacaggatggggcaccaacctccaccgccaactcagcaacactctataactgacaacagtttatcccttaaaactcctcccgaatgtctcctgacaccgcttcctccgtctgctgacgacaacctcaagaccccgcccgagtgtgtcctcacgccgctgcctccaagtgcagatgataatctaaaaacccctccagagtgtgttctcaccccactgcccccctccgcagatgataatttaaaaactccccccgaatgccttttgactcccttgcccccgtcagcggacgataacctgaaaacaccgcctgagtgcctgctcactccactgccccccagcgctctgcctagcgcaccaccctccgctgatgataacctgaagacacgcgccgaatgcctgctccacccactgccaccctccgctgacgataatttgaaaaccccctccgaaagacagttgacccccttgccaccaagcgcaccgcctagcgcggacgacaacataaagaccccagccgagaggctgaggggacctttgccaccctcagccgatgacaatctaaagacaccatctgagagacagcttaccccactgcccccctctgccccgccttctgcagatgacaacataaaaacccccgcggagagactgcgtggcccactgccccccagtgcggatgataatctgaaaacaccatccgagaggcagctgacacctcttcccccatccgctccacccagcgccgatgacaatattaagacacccgccgagcgactgcgtggccccctcccgccaagcgcagacgacaaccttaagaccccttcagaacgccagttaacggcattgcccccttccgccgatgataatatcaagacgccagccgagaggctcaggggaccactgccgccttctgctgatgacaacctgaaaactccctctgaacgacagctgacaccattacctccttcagccccaccctccgccgacgataatataaaaaccccagcattccatcctcagcgcatgatatcccggcaccttccatccgtttctagcctgcctttccacccccaacttcacccgcaacaaatgatcatttctagatacctgctgtccgtgtgcggctttcggtttcaccatcagccgatgatcatatcaaggcacttaccatcagtatcaagcctgcccttccaccctcagctgcaccctcagcagatgataataagcagacatctgccttccgtctgcggggggcgatttcatcctgagagaatgataatttccaggcacctcccgtccgtgagttcattaccgtttcatccccagctccatccacagcaaatgattatttctagacatctacctagcgtgtgtggtggcagattccaccctcagcagatgattatctctaggcatttaccatccgtttctagcctgcccttccatcctcaattgcatccccagcagatgatcatctcacggcatttaccgtcagtttgcggcggccggtttcatccccagaggatgatcatcagcaggcatctgccaagcgtgtctagtctgccgttccacccacaactgcatcctcaacaaatgatcatatccaggcacttgcccagcgtttgcgggggtcgctttcaccctcagcaaatgatcatcagccgacacctgcctagcgttagttccctgccttttcatccacagctgcacccccaacaaatgatcatctccagacatctgcccagcgtctgtgggggccgttttcatcctcagagaatgattatatcaaggcacctgccttcggtatcatccttgccgtttcatccccagctgcatcctcagcagatgatcataagcagacatctgccctctgtctgcggcgaacggttacggggcccgctgccgccgagtgccgatgataatctgaagacgccaagtgaacggcagctcaccccacttcctccatccgcacctccatccgccgacgataacatcaaaacacctgcagagcggctgagaggccccttaccacctagtgcagacgacaatcttaagacaccgtctgaaagacagctgacccctttaccacccagtgcaccgcctagtgccgatgacaacatcaagacacctgccgagcgactcaggggtcccttgcccccatcggccgatgacaaccttaagactccatctgaaagacaactgactcccctaccgccttctgccccaccaagcgcagatgacaatatcaagacacctgctgaaagattaaggggacccctgcccccttcggccgatgacaacctaaaaactccgcctctcgctacccaggaggctgaagcggaaaagcctcgaaaaccaaagcgacaacgagctgccgaaatggagccaccacctgaacctaagcgacggagagtgggagatgtggagccctctagaaaacccaaaaggcgcagggccgcagacgtggaacctagtagccccgaacccaagaggcgaagggtgggtgatgtggagccgtcaagaaagcccaagcgacgcagagccgctgatgtcgagcctagctcgcctgagccaaaacgtcggagagtaggcgacgtggagcctagtaggaaaccaaaacggcgccgggccgctgacgtggagccatcacttcccgaaccaaagaggagacgcttatcttag

SEQ ID NO: 29316 - DNA, 708 bp, Artificial Sequence
  Description of Artificial Sequence: Synthetic coding sequence
atgcccaaggggagggcaggtagtctcccaaccacatcgatcgggtggcgattccaattatggtttctggggctgacttgtcccgaacggcatttggcccgaagactgaagaacaacagtttttatccattcgtgcagcaggagccgaacgtcttcgtcttagagtattacctggatacgttatggaaaggcatgctgctgtttatcatctctgtcgtcctggtttcattttcctctttacgagaggtgcaaaagcaggaaacttgggttttccttgtgtacggggtgggggttggcctatggctggtcatttcatcccttcccaggcggaggttggtgctcaatcacactcgaggtgtgtatcacttttctattcagggccgtacggtgtgccagggcccactgcatctggtctatgtaagattggctttgtcttccgatgcccatggtcgttgcttctttcatctcgttctaggcggtcataggctggagccactcgtgcttgtgcagttgtcggagcactacgaacagatggagtatctcggaagatacatcgcaaggaagctgaacattaactacttcgattacttggccaccagttatagacacgtggtcaggcattggccacccccgggcgccggcacagtgatgggtaagtccccaatgggtcataaaccctccagctctcagtcaagcctggaggtgtag

SEQ ID NO: 29317 - DNA, 708 bp, Artificial Sequence
  Description of Artificial Sequence: Synthetic coding sequence
atgccgaaaggaagagcgggaagccttcctacaacttccattggatggcgctttcagctgtggttccttggcttgacttgtcccgagaggcatttggcgaggaggctcaagaataactcattttacccctttgtgcagcaggaacccaacgtgttcgtgttggagtactacctcgacaccttgtggaaaggtatgctgctattcataatcagtgtcgtcctggtgagcttcagttcattgcgggaagttcagaaacaagagacttgggtattcctggtctacggagtgggtgttggcctctggctggttatatctagcctgcctaggcgcaggctggtgctgaaccacaccaggggagtttaccatttttcaattcaggggcggaccgtgtgccagggacccctacacctagtgtacgttcggctcgcactgtcttctgatgcccacggccgatgcttcttccacctcgtgctgggggggcaccgcctcgaacccctggtgctggtgcagctgagcgagcattatgaacagatggaatacctcggaagatacattgctcgcaaactgaatatcaattacttcgactacttagccacaagctaccgccacgtagtccggcactggcctccccctggagcagggaccgtgatgggcaagagtcccatgggtcacaagccctcctcgagccagtcttccctagaagtgtag

SEQ ID NO: 29318 - DNA, 180 bp, Artificial Sequence
  Description of Artificial Sequence: Synthetic coding sequence
atgactagcgtgagcacccaactgagcctagtcctgatgagcctgttgttggtactgccggttgtcgaagctgtggaggccggtgacgcgatcgccctgctgctcggggtcgtactcagtattaccgggatctgcgcatgtctgggtgtgtatgcgagaaaacggaacggccaaatgtag

SEQ ID NO: 29319 - DNA, 180 bp, Artificial Sequence
  Description of Artificial Sequence: Synthetic coding sequence
atgacatctgtttccactcagctcagtctggttcttatgtctcttttgctcgtgttacccgtggtcgaggccgtggaagcgggcgacgctatcgctctactgctgggcgtcgtcttgtctatcaccggtatttgtgcctgtctaggcgtttacgcacgaaagcgcaatggacagatgtag

SEQ ID NO: 29320 - DNA, 180 bp, Artificial Sequence
  Description of Artificial Sequence: Synthetic coding sequence
atgacaagtgtctccacacagctaagcctggtgctgatgtctctcctgctggtattgcctgtagtcgaggctgtggaggctggggatgccattgcattgctgctgggggtcgttttgagcatcacaggaatatgcgcctgtctcggcgtgtacgcgcggaaaaggaacggccagatgtag

SEQ ID NO: 29321 - DNA, 399 bp, Artificial Sequence
  Description of Artificial Sequence: Synthetic coding sequence
atgaccggtgaactggaggttaagaacatggatatgaagcccggctcgacactgaagattacaggatcaatcgctgacggcacggacggttttgtgatcaacctcggacaggggacggacaagctgaacttacattttaatccccgcttctcggagtcgaccattgtgtgcaactctcttgacggatccaattggggacaagaacaaagggaggatcatctgtgcttctccccaggcagtgaggtcaaattcaccgtgacatttgagtcagacaaatttaaagtgaaacttcctgatgggcatgagctgacattcccaaatagactcgggcattctcacctgagctatctatccgtgaggggcggttttaacatgtcttcttttaagctgaaggagtag

SEQ ID NO: 29322 - DNA, 240 bp, Artificial Sequence
  Description of Artificial Sequence: Synthetic coding sequence
atgtttgagtgtattaccgagaatttcagtattgatccagccaggacgttaatggttggagatcggctggagaccgacattttgtttgggcatcgctgtggtatgacgacagtgttgaccctcaccggagtctcccgtctggaggaagcccaggcctatcttgctgcaggccagcacgacttagtgccccattattacgttgagtccatcgccgacctgactgagggcctggaggattag

SEQ ID NO: 29323 - DNA, 1296 bp, Artificial Sequence
  Description of Artificial Sequence: Synthetic coding sequence
atgcaggctctgaacatcacacctgaacagttttcaagactgctgagagatcacaacctaacgcgagagcagttcattgctctgtatcgcctgcgccctctcgtttacacacctgagctaccaggtcgggccaagctggcattggtgctgaccggagtgctgatcttcgccctcgcactgttcggcaatgctctagtcttttatgtggtgacaagatcgaaggctatgagaactgtcactaatatcttcatttgttcactggcactatcagatctgctgatcacttttttctgcatcccggtgaccatgctgcagaacatctctgataactggctggggggagctttcatctgtaagatggttccttttgttcaatccacagctgtggtgaccgagatcctgacaatgacctgtattgctgtcgagagacaccaagggcttgtccatccttttaagatgaagtggcagtatacaaatcggcgagcattcacgatgttaggggtggtttggcttgtggccgttatcgttgggagcccaatgtggcacgtgcagcagcttgaaattaaatacgacttcctctacgaaaaagagcatatttgttgcctggaggagtggacaagcccagtccatcagaaaatttacacaacgttcatccttgttatcttgtttctactgccgctaatggtcatgctcatcctttattccaaaattggttatgagttatggataaaaaagcgggtgggagatggctccgtcttacgaaccatccacggcaaagagatgtccaagatcgcccgcaaaaagaaaagagcggtgatcatgatggtgaccgtcgtggccttattcgccgtgtgctgggctcctttccacgttgtacacatgatgattgagtactcaaatttcgagaaggaatacgacgatgtgacgatcaaaatgatcttcgctatcgtgcagattatcggttttagcaatagcatctgcaatcctatcgtatatgcctttatgaatgaaaacttcaaaaaaaatgttctcagcgctgtctgctactgcatcgttaataagactttctctccagcccaaaggcatggtaatagcggtataacaatgatgcgcaagaaggcaaaattttcactgagagaaaacccagtagaggaaactaagggggaagcttttagtgacggcaacattgaggtgaagctgtgcgaacagaccgaagagaaaaagaagctgaaacgacatttggctctctttcggtctgagcttgccgagaacagtcctctagattctggccactag

SEQ ID NO: 29324 - DNA, 825 bp, Artificial Sequence
  Description of Artificial Sequence: Synthetic coding sequence
atggcagcaagctggaggttggggtgcgatccgaggctgcttcggtacctggtagggtttccaggccgacggagtgtaggcctagttaaaggcgccctaggatggtctgtgtcacgaggcgccaactggaggtggttccattccacccagtggctccggggcgatcctattaagatcctaatgccgtctttgagcccaactatggaagagggcaatattgttaagtggcttaagaaagagggagaggcggtctctgcgggggacgccttgtgtgagattgagacagacaaagccgtggttactttggatgcctcggacgatggcatcctggccaagattgtacagatgccagacgtcaacgttagttgggatggagaggggcctaagcagttgccatttatagacatttctgtggcagtggctacagacaaagggttgctaacgcctatcatcaaggatgctgcagcgaaaggcattcaagagatcgccgattctgtcaaggctctttcaaagaaagcaagagacggtaaactgctgccggaggaatatcagggagggtccttttctatttctaatctcggtatgttcggtatcgacgaatttacagcagtcataaatccccctcaggcgtgtatcctcgctgtcggtagatttaggccggtgttgaaactcacagaagatgaggaaggcaatgctaagctccagcagaggcagctgatcacggtgacaatgagcagtgatagccgggtcgtggacgacgaactggccactcgattcctgaaaagctttaaggccaacctggagaatcctatccgacttgcatag

SEQ ID NO: 29325 - DNA, 1857 bp, Artificial Sequence
  Description of Artificial Sequence: Synthetic coding sequence
atgcacaagactgctagccaacggctgttccccgggccaagctaccagaatattaagagcatcatggaagactcaacaatactctcagattggaccaactccaataaacagaagatgaagtacgatttctcatgtgagctttatcgaatgtcaacttattcaacgtttcctgccggcgtccctgtttctgagaggtctctggctcgggccggcttctactatactggggttaatgataaggtcaagtgcttctgctgcggcctcatgcttgataactggaaacttggtgattcgccaatacagaagcacaaacagctctatcctagctgctccttcatacagaatctcgtcagtgcctccctgggttcaacgagtaaaaacacctcgcctatgcggaattccttcgcccactctctctcccccacactggagcacagctcattattctcggggtcatactcaagcctatcccccaacccgctcaacagcagagctgtcgaggacatttcatctagccgtaccaatccctattcttacgctatgagcactgaggaggcgcggtttcttacctaccacatgtggcctcttacctttctgtccccttcagagctggcccgcgccgggttttactacattggcccaggagaccgcgtggcttgttttgcctgtggcgggaaactgtccaactgggaaccaaaggacgacgccatgtctgaacatcgtcgccactttcctaactgcccatttctggaaaatagcctggagacactcaggttcagcatttctaacctgtcaatgcagacacatgccgctagaatgcggaccttcatgtactggccctcatctgtgcccgtgcaacccgagcaactcgcttccgccgggttttattacgtcggccggaatgacgacgtgaaatgtttctgctgcgatgggggtctaaggtgctgggaaagcggagacgatccatgggtcgagcatgctaaatggttcccgcggtgcgaatttttgattcggatgaagggtcaggagtttgtcgacgaaatacaaggacgataccctcacttactcgagcagctgctgtccacctctgataccacgggtgaggaaaatgccgacccacccatcatccattttggcccaggggaatcgtcctccgaggacgcggtgatgatgaatactcctgtggtcaagagcgctctcgaaatgggatttaatagggacctggttaaacagacagtgcagtctaagattcttactacaggcgaaaactataagacggtgaatgacattgtgtccgcgttactgaatgctgaggacgaaaagcgcgaggaagaaaaggagaaacaagctgaggaaatggcaagtgatgacttgtctctcatcagaaagaatagaatggccttgttccagcagctgacatgtgtgctgccgatcttggacaacctgcttaaagctaacgtgatcaacaagcaagagcacgatatcattaagcagaagacccagatacctctgcaggcgcgtgagcttatcgataccatcttggtgaaaggcaatgccgccgctaatatatttaaaaattgtctcaaggaaatcgacagtacactctataaaaatttgttcgtcgacaagaacatgaaatacatacccaccgaggatgtgtctggtctgtcattggaggagcagttgcgccggctgcaagaggagcgcacctgcaaagtgtgtatggacaaagaggtcagcgtagtcttcattccgtgtggacacctcgtggtatgtcaggaatgcgcaccttccttgcgcaagtgcccaatctgtcgcgggattattaaggggaccgttagaaccttcctgtcttag

SEQ ID NO: 29326 - DNA, 1461 bp, Artificial Sequence
  Description of Artificial Sequence: Synthetic coding sequence
atgcagtcaggaggcgccgaggggtctcccggagctgggaggaccggtcgcggccccggatcaggaaaagctcccccggccgagatctccagcggagcaccagactttcccggaggtgaccccattaaaattctgatgccctctctctcacctaccatggaggaagggaatatcgtaaagtggctgaagaaagaaggcgaagccgtgagtgccggagacgccttgtgtgagatcgagaccgataaggctgtggtgacactggacgcctctgacgacggcatactcgcgaaaatagtggtggaagaggggagcaagaacattagacttggcagcctcatcgggttaatcgtcgaagagggcgaagactggaagcacgttgaaatccccaaggacgtcgggcccccccctccagtatctaagccgtcagagcctcgccctagccctgagccgcagatcagcatccccgttaaaaaggaacacatccccggaacactacgtttcagactgtctcctgccgctaggaacatccttgaaaaacatagcctcgatgcgtcccagggtaccgctactggtccacgaggcatttttacaaaggaggacgctctcaagcttgtgcagctgaaacaaaccgggaagatcacagaaagtcgtccgacccccgctcccacagcgactcctacagctccctccccactgcaagctaccgccggccctagctatccccgccccgtgattcctcctgtgagcacacctggacagcccaacgctgtggggaccttcacagagatcccagcgtctaacattaggcgtgtgattgctaaacgactcaccgagtctaaatccaccgttccacatgcttacgccacagcggactgtgatctgggtgccgttctcaaggtaagacaggaccttgtaaaggatgacataaaggtgtcagtgaatgactttattatcaaggccgcagcagtgaccctaaaacagatgcccgacgttaacgtgagttgggatggagagggacctaaacagctgcccttcattgatatttccgttgcagttgcaacggataaggggctgctcactccaattatcaaagatgccgccgccaagggaatccaggagatcgctgatagcgtaaaggccctgtctaagaaggcacgggacgggaaactgctgccagaggagtaccaaggtggatccttcagcatctccaatctcggaatgtttggcattgacgaattcacagcggtgattaacccaccccaggcctgtatcctggcagtcgggcggttccgccctgttctcaaactgacagaggatgaggaaggcaatgccaaactgcagcagcggcagcttattacagtcacaatgtcctctgactcaagagtcgtcgatgatgaacttgcaacccggttcctgaagtcttttaaggcaaacttggaaaaccccataaggttagcctag

SEQ ID NO: 29327 - DNA, 1221 bp, Artificial Sequence
  Description of Artificial Sequence: Synthetic coding sequence
atgagattgttcaggtggctactaaaacagcccgtgccgaagcagattgaacggtactctaggttctctccctcccctctaagtatcaagcaatttttagatttcgggcgggataatgcttgcgaaaaaacctcatacatgttcctgagaaaggagctccccgttcgattagcaaataccatgcgggaggtgaatctgcttcccgacaacctgctgaaccggccaagtgttgggttggtgcaaagttggtacatgcagtcctttcttgagttgctcgaatatgagaacaagtcgcccgaggacccccaagtcctcgacaacttcctccaggtcctgattaaagtccggaatagacacaacgacgttgtgccaaccatggcccagggcgttattgaatacaaagagaagttcggatttgacccttttatttctacgaacatccagtactttctggaccgcttttacacaaaccgcattagctttagaatgctgatcaatcaacataccctgcttttcggtggtgatacgaatccagtccacccgaaacacattggcagcatagaccccacctgcaatgtggccgacgttgttaaggacgcgtacgaaactgccaagatgctatgtgagcagtattatcttgttgctccggagctggaggtcgaagaattcaatgctaaggctcctgacaaacctatccaagttgtttatgtgccctctcatctgtttcatatgctttttgagctgttcaagaattcaatgagggctacagttgaactgtacgaggatcgcaaggaggggtatcccgccgttaagactctcgttactctagggaaagaggacctaagtatcaaaatttcagatctcggtggcggagttccactcagaaagatcgatcggctgttcaactacatgtactctacggctcccagaccttcgctggaaccaactagggccgcaccgctggctggttttgggtatggcctccccatctcaaggctgtatgctcggtacttccagggagatctgaagctatattctatggagggcgtgggtaccgacgctgtgatttacctgaaggccctatcaagtgagtcctttgaacggctacctgtgttcaataagtccgcgtggagacactataagactacacccgaggccgacgattggtctaatccttcgagcgagcctcgggacgccagtaagtacaaagctaaacagtag

SEQ ID NO: 29328 - DNA, 1248 bp, Artificial Sequence
  Description of Artificial Sequence: Synthetic coding sequence
atgcgattattccgatggctcctcaagcagccagtcccaaaacagatcgagaggtacagccgtttctccccctcgccattgagcatcaagcaattcctggacttcggacgagacaatgcatgtgaaaagacctcttacatgttcctaagaaaagaattacctgtcaggctggcaaatactatgcgagaagttaacttactcccagacaacctgctgaacaggccctccgttggtctggtccagtcatggtacatgcagtccttcctggagcttctggagtacgagaacaaaagcccagaggatccacaggttctggataatttccttcaagtgcttattaaagtgaggaatcggcataacgacgtggtcccgacaatggcccagggcgtcatagagtataaagagaagttcgggtttgacccgttcattagtactaacatccagtattttctggaccgattttatacaaatcggatttcatttcggatgctgatcaatcaacacaccctgctatttgggggcgacactaatcccgttcacccgaaacacatcggctccattgatccaacttgcaatgtcgcggacgtggtaaaggatgcttatgagactgcaaagatgctgtgtgaacagtactacctggttgcccccgaacttgaagtggaggaattcaatgctaaggcccctgataaacctattcaggttgtttacgtgccaagccacctgtttcacatgctgtttgaattgttcaaaaactcaatgcgagccacagtagaattatatgaagatcggaaagaaggatatcccgcagtgaaaacactggtcactctcgggaaggaggatctgtctataaaaatctctgatcttggcgggggagtcccattacgtaaaatcgatagactgtttaattatatgtattctacagcacctcgaccaagccttgagcctactagagcagcaccgctcgctggtttcggctacgggctgcctatctcgaggctttatgccaggtacttccaaggcgatctgaaactgtattccatggaaggggtgggaactgatgctgtgatatacttgaaggcgctgtctagtgagtcgttcgagcgcttacctgtgttcaacaagtccgcatggagacactataaaacaactcctgaagctgacgactggagtaaccccagctccgagcccagggatgcaagcaaatacaaagccaaacaagataagataaagaccaatagaaccttctag

SEQ ID NO: 29329 - DNA, 1590 bp, Artificial Sequence
  Description of Artificial Sequence: Synthetic coding sequence
atgtcctctacagtgtcctattggattctcaactcaactaggaactccatcgccacccttcagggaggaaggcggttatattccaggtacgttagcaatagaaacaagctgaaatggcgcttattttcaagagtgcccccgacactgaattcaagtccgtgcgggggatttacgctgtgcaaggcctaccgtcataccagcaccgaagaagatgactttcacctgcagctgtctcctgagcagatcaatgaggttctgagggccggggagaccacccacaagatcctggatttagagtcacgggtacccaactccgtcctgcggtttgagagtaaccagctggccgccaattctccagtggaggaccgcaggggcgtggcaagctgcctgcagaccaacggcttaatgtttgggatttttgacgggcatggcgggcatgcatgcgcacaggccgtgagtgagcgccttttttactatgtggctgtttcactgatgagtcaccagactctggaacacatggagggggctatggaaagcatgaagccgttgcttcccattctccattggctgaagcacccgggggactccatctacaaagatgtgaccagcgtacaccttgaccacctgcgcgtttactggcaggaactgttggacctccatatggagatggggctgtcaattgaggaagcccttatgtatagctttcaacgactggattcagatatcagtctcgaaatccaggctcctttagaggacgaagtgactcgaaatctgtcactgcaagtcgctttctcaggggcaaccgcctgtatggcccacgttgatggtattcaccttcacgtcgcgaacgctggagactgcagagcaatactcggagttcaggaggataatggcatgtggtcctgtctgcccctaacccgcgatcacaacgcatggaaccaagcagaactgtctagacttaagcgggaacatcctgagtccgaagaccgcacgataattatggaggatcgactgctgggagtcctcatcccatgtcgagcttttggcgatgtgcagctcaagtggtcaaaggaacttcaaaggagcattctcgagagaggatttaatacggaggcacttaatatttaccagtttactcccccacattactataccccgccttacctgaccgcggagccagaagtcacttaccatcgcctgcggccccaggacaagtttctcgttctagcaagcgatgggctgtgggacatgttgtcaaacgaggacgtagttaggctcgtggtgggtcacttggcagaggccgattggcacaagacagatctggcacagagacctgcaaacctcgggctaatgcaatccttgctgctccagcggaaggcctccggtctgcacgaagcagaccagaatgccgcaacacggctgatacgccatgccattggaaacaatgagtatggtgaaatggaagccgagagactggccgccatgttgacactccccgaagatttggctagaatgtaccgtgatgacataacagtgacagttgtgtacttcaattcagagtcaatcggggcctactacaagggtggctag

SEQ ID NO: 29330 - DNA, 978 bp, Artificial Sequence
  Description of Artificial Sequence: Synthetic coding sequence
atggtgggggagatggagacaaaagaaaagccaaagcccaccccagattacctcatgcaactgatgaacgataagaagctgatgagctccttaccaaacttctgcggcatcttcaatcacctcgaacggctgctggacgaggagatctctcgagttcgtaaggatatgtacaacgatacactgaacgggtctaccgaaaaacggtctgcagagttgcccgacgccgtggggcctatagtgcagctgcaggaaaaactgtatgtcccagtgaaagaataccctgatttcaactttgtaggaaggattctgggtcctcgaggactgaccgccaaacagctggaagcggaaaccggttgcaaaatcatggttaggggtaagggcagcatgagagataagaaaaaagaggaacagaaccgaggcaagcctaattgggaacacctcaatgaggatctacatgtgcttatcaccgtagaggatgcacagaatagagcagagatcaagctgaaacgggccgtcgaagaggtgaaaaagctcctcgtcccggctgctgagggggaggattctctaaagaaaatgcagctgatggaacttgcgattctaaacggcacgtaccgcgatgcgaacattaaaagccctgcgctggcgtttagcctggctgccacggcacaggctgcacctaggatcatcacgggccccgcacctgtgctaccccccgccgccctacgcacaccgaccccagccggtcctactatcatgcccctgatccggcagatccaaactgcggttatgcctaatggaacgccccaccctaccgccgcaatcgttccacctggccctgaggccggccttatttacaccccatatgaatatccgtataccctagccccagccacttccattctggagtaccctattgaacctagcggtgtccttgagtggatcgaaatgcccgtcatgcccgacatctctgcccactag

SEQ ID NO: 29331 - DNA, 1002 bp, Artificial Sequence
  Description of Artificial Sequence: Synthetic coding sequence
atggtgggtgaaatggaaaccaaagagaaacccaaacccacccctgactatctcatgcaactcatgaacgacaagaagcttatgtcatctcttccaaatttctgtggtatattcaatcatctcgagagactcttagacgaagagatctccagggtgaggaaggacatgtataacgatactctcaatggatccacagaaaagagatccgctgagttgcctgatgccgtgggacccattgttcaactgcaggaaaaattatacgtaccggtgaaggagtatcccgatttcaacttcgttggaaggattctcgggccaagaggcctcacagcaaagcagctggaggctgagaccgggtgcaagatcatggtgcgtggtaaggggagtatgagggacaaaaaaaaagaggaacagaacaggggcaaacctaactgggaacatttgaatgaggacctgcatgtccttatcactgtggaggacgcgcagaacagagcggagataaaactcaaacgggccgtggaggaagtgaagaaattgctcgtccccgcggccgaaggcgaggacagtcttaagaagatgcaactcatggagctggctatcctgaacggcacgtaccgcgatgccaacattaagtcaccgactgctcaagccgccccacgtattattactggcccagcacctgtcttgcccccagccgcattgcgtactcccacacctgctggccctaccataatgcccctgatccggcagattcagacggctgttatgcccaacggcacaccacatcctacagcagccattgtgccacccggccccgaggcgggactgatctataccccctacgaatacccatacacactggctccagccacctccatactggagtatcccatcgaaccctccggcgtcctgggcgcagtggccactaaagtccgccgccacgatatgagggtgcacccataccagcggattgtgacagctgatagggccgctactgggaattag

SEQ ID NO: 29332 - DNA, 1026 bp, Artificial Sequence
  Description of Artificial Sequence: Synthetic coding sequence
atggtgggagagatggagaccaaggaaaaaccaaaaccaacacccgattacctgatgcagttgatgaatgataaaaagctgatgagttcactacctaatttctgcggcatattcaaccatctggagaggctgctggatgaagagatctcccgggttaggaaagacatgtacaatgacactttgaatggtagcactgaaaagagatcagccgagctacctgacgcagtggggccaattgtacagctgcaggaaaaattatatgtgccggtgaaagaataccctgattttaacttcgttggccgcatccttggtccaaggggtttgaccgcaaaacagttggaagctgagacgggatgcaagatcatggttcgtggtaagggttccatgcgcgataaaaaaaaggaagagcagaaccgcggcaagcccaattgggagcacctgaatgaggacctgcacgtgctgattacagtggaggacgctcaaaaccgcgcagaaatcaaacttaaacgtgccgtcgaagaagttaagaagctccttgtccccgccgcagaaggcgaagatagcttaaaaaagatgcaacttatggagctggcgatccttaacggtacctatagggacgctaacataaagagcccggccctagcattttcccttgcagctacagctcaggcagccccccgcatcatcacgggtccagcacccgtgctgcctcccgccgcactcagaaccccaacccctgccggaccaacaattatgcctcttattcggcaaattcaaactgctgtcatgccgaatggtaccccgcaccctactgcagctatcgtccctcccgggcccgaagccggcttgatttacaccccatatgagtatccctacaccttggcgccggccacgtccatcctggagtaccccatcgagcccagtggggtgctgggtgccgtggctacaaaagtgcgccgccatgatatgcgcgtgcacccctatcagcgcatcgtgaccgccgatcgcgctgccaccggaaattag

SEQ ID NO: 29333 - DNA, 960 bp, Artificial Sequence
  Description of Artificial Sequence: Synthetic coding sequence
atggtaggtgagatggagacaaaggagaagccaaagccaactccagattacctgatgcagttgatgaacgataaaaagttaatgtcatcacttccaaatttctgtggaatttttaatcacctggaacgcttgcttgatgaggaaatctctcgcgtgcgtaaggacatgtacaatgacaccctcaacggctctacagaaaagcgctccgcagaactccctgacgcagtgggccctatagttcagctgcaggaaaaactgtatgtacccgtaaaggaataccccgacttcaatttcgtgggcagaatacttggcccaaggggcctgactgccaagcaattggaggcagaaacgggatgcaaaattatggttagaggcaaagggagcatgcgggacaagaagaaggaagagcaaaaccgaggcaagcccaactgggagcacctaaatgaggacctccacgtgcttattaccgtcgaggatgctcagaatcgcgctgaaatcaagctcaagcgcgcagtggaggaggtgaaaaagttgttggtccctgccgcagaaggtgaggatagccttaagaaaatgcagctgatggagctggcaattctcaacggtacctaccgggacgctaatataaaaagcccggctctggccttctctctggctgctactgcgcaggcggcacccagaatcatcaccggccccgcccccgtcctccctccagccgccctgaggactcctacaccagctggccctactataatgcccctgatcagacaaattcaaacggctgtcatgcccaacgggacgccccatccaaccgcggcgatagttcctcctggtcccgaggcaggcctgatatacacaccctacgagtacccatacaccctggctcccgctacatctattttagaatatcccattgaaccttccggagtcctgggcaaattctttagcccatggggttag

SEQ ID NO: 29334 - DNA, 960 bp, Artificial Sequence
  Description of Artificial Sequence: Synthetic coding sequence
atggtgggtgaaatggaaactaaagaaaagccaaaaccgacacctgactacctgatgcagctcatgaacgacaagaagctaatgtctagtctgcctaacttttgtgggatctttaaccacttagaacgccttctggacgaggagatctctcgggtcaggaaagacatgtataatgacactctgaatggatccacagagaagaggtctgctgagctccctgacgctgtagggcccattgtgcaactgcaggaaaaactctacgtgcccgtgaaagagtatccagacttcaacttcgtcgggcggatccttggacccagagggctaacagccaagcagctggaagctgagactggctgcaagatcatggtacggggcaaaggttctatgagggacaaaaagaaggaggaacagaatagaggcaagccgaattgggagcacctgaacgaggacctccatgtccttatcacagtcgaggatgcccagaacagagccgaaatcaaactgaaaagagccgtcgaggaagtgaagaagctgctggtacctgctgccgaaggtgaagactccctgaaaaaaatgcagctcatggagcttgcaatcctcaatggaacctacagagatgctaatatcaaaagccccgccttggcattctcacttgccgctaccgcgcaggcagccccacgaatcatcacaggtccagcccccgtcctcccaccggccgcactccgcacacctacacctgcgggtcctacaatcatgccgctcattagacagatccaaacagccgtcatgccgaacggcactccccatcccaccgccgctatcgttcctcccggccccgaggccggcctgatatatacgccatacgagtatccctacaccctagccccagccacttccattctggaatatcccatcgagccctcaggagtgctcggcatggccttcccaacaaagggttag

SEQ ID NO: 29335 - DNA, 1137 bp, Artificial Sequence
  Description of Artificial Sequence: Synthetic coding sequence
atggtcgattactctgtctgggaccacattgaagtctctgacgatgaagatgagacacacccgaatattgataccgcctctctgtttcggtggcggcaccaagcacgagtggaacgaatggagcaatttcagaaagaaaaggaagagttggaccgcggctgccgtgaatgtaagcgtaaagtggctgaatgccagcgcaagttaaaggagctcgaagtggccgaaggtggcaaggccgaactcgagcggctccaggctgaagcacagcagctgcggaaggaggaacgaagctgggaacagaagctggaggagatgcggaaaaaggaaaaatcaatgccctggaacgtggatacactgagtaaagacggattttctaagtctatggtcaacaccaagccggagaagacagaggaggacagcgaagaggtcagagagcaaaagcacaagacatttgtcgagaagtacgaaaaacagatcaagcattttggcatgctgcggaggtgggatgacagtcagaaatatctttctgataacgttcatctcgtgtgcgaagagactgccaactaccttgttatctggtgcatcgacctggaagtagaagagaagtgcgccctgatggagcaggtggcccaccagactatcgttatgcaattcatcttagagctcgccaagagcctcaaggttgatccccgggcctgtttccgccagttcttcaccaagattaaaactgccgatcggcagtatatggaaggattcaatgacgagctcgaagcctttaaggaaagagtgcgcggccgggctaaactgcgtatcgaaaaagcgatgaaggaatacgaggaggaggaacggaaaaagaggctggggccaggaggccttgatcccgtcgaggtgtatgagtcactgccggaggagctacagaagtgttttgacgttaaagacgtgcagatgttgcaagatgctatctctaagatggatcccacagatgcaaagtaccacatgcaacgttgcatcgacagcggcctgtgggttccaaacagcaaagcctcggaggcaaaggaaggggaggaggccggacccggagatccgctgcttgaagccgtgccaaagaccggggatgaaaaggatgtctcagtatag

SEQ ID NO: 29336 - DNA, 1962 bp, Artificial Sequence
  Description of Artificial Sequence: Synthetic coding sequence
atggccctcgtgaggggagccgagccagctgccggacccagccggtggctgccaacgcacgtgcaagttacagtgctgcgtgctagggggctcaggggaaaaagttcaggagcaggttccacctctgacgcatatacggtgatccaggttgggcgggagaagtattccacaagtgttgtggagaagacacacggatgcccagaatggcgtgaggagtgctctttcgaactccctcctggcgctctggatgggctgctgagggcgcaggaggccgacgccggacctgccccttgggcggccagcagcgcagcggcgtgtgaactggtgcttacaaccatgcacaggtccctcattggggtcgacaagttcttgggtcaggctaccgttgctctggatgaggtgttcggagccggacgcgcgcagcatacccagtggtataaactgcactctaaaccaggcaagaaagaaaaagaacgtggagaaatcgaagtgactatacagttcacacggaacaacctttcagcctctatgtttgacctctccatgaaggacaagcccagatcacccttttctaagatccgggacaaaatgaaaggcaaaaagaaatatgacctggaatcagccagcgcaatccttccgtccagcgctattgaggacccagacctaggttctctcggcaaaatgggaaaggcaaagggtttttttttacggaacaaactgagaaagagctcattaacccagtccaacacaagcttgggatccgattctaccctttctagtgcgtccggaagtctggcctatcagggtcccggggcagagttattgacgcgatctccaagccgaagttcatggctgagcaccgaaggggggcgagatagcgcccaaagtcccaaactattcactcataagcgaacttactccgatgaggccaaccaaatgagggtggccccacctcgggcccttttggatctgcagggtcacctggacgccgccagtcgcagctccttatgcgtcaatggtagtcacatttacaacgaggagccgcagggcccggtcaggcatcgctcctcgatctcagggtccttgccttcttccggctcactacaagctgtgagcagtcgtttctcagaggaaggccctagatctactgatgacacttggcctaggggatctcggtccaactcctccagtgaagcggttctgggtcaggaagagttatcggcacaggcgaaggttctggctccgggcgcctcccatcccggtgaagaggaaggtgcccggctcccagagggcaagcccgttcaggttgccactccaatagtggcctcctctgaagcagtggcagaaaaggagggcgctcgcaaggaggagagaaaacctcgcatgggcctgtttcatcaccaccatcaagggctcagccgatcggaactaggtcggaggagcagtctgggagaaaaaggtggacccatcttgggggctagtccgcaccactcttccagtggcgaagaaaaggctaagtccagctggtttggtctgagagaagccaaagatcccacacagaagcccagcccacacccggtgaaacccttaagcgccgcgccagtcgagggaagtcccgacagaaagcagagccgatcatcactttctattgccctcagctcaggtctagaaaagttaaaaactgtgacctctggttcaattcagcctgtcactcaagcaccacaggccggtcagatggtcgatacaaaacggctgaaggattcagcagtgctggatcagtctgccaagtattaccatcttacgcacgacgagctgatctctctgttgctgcagagggagcgggagctgtcccaaagagatgaacatgtgcaggagttagagtcatatatcgatcggctgctggttcgcattatggaaacctccccaacactcttacagatcccccccggtcccccgaagtag

SEQ ID NO: 29337 - DNA, 657 bp, Artificial Sequence
  Description of Artificial Sequence: Synthetic coding sequence
atgggcacgcgagatgacgagtatgactacctgtttaaggttgtgctgattggagattcaggcgttggaaagagcaacttactgtcccgtttcacccgcaatgagttcaatctggaaagcaaaagcacgattggggtggagtttgccacccggtctatccaagttgacgggaagactatcaaggctcagatttgggacactgctggtcaggaacgctacagggcaataacaagtgcctattataggggggctgtgggggccctcctcgtgtatgacatagctaagcacctcacctatgaaaatgtcgagaggtggctgaaagagctccgagatcacgccgattccaatatcgtgatcatgctggtgggcaataaatcagatctccggcatctacgcgcagtgcctactgacgaggcacgcgcattcgccgaaaagaacaatctgtctttcatcgagacttccgcactggacagtacaaatgtcgaggaagctttcaaaaatatcttgactgagatttacaggatcgtctctcaaaagcagatcgccgatcgcgccgctcacgacgagtcccccggaaataacgtcgtagacattagtgtgccccctacaactgatggtcagaagcctaataagctccagtgttgccagaacctatag

SEQ ID NO: 29338 - DNA, 627 bp, Artificial Sequence
  Description of Artificial Sequence: Synthetic coding sequence
atggccaagcaatacgacgtcctgtttcgacttcttcttatcggagattctggagttggcaagacttgtcttctgtgtcggtttacagataatgagttccactccagccacatctcgacaatcggtgtggacttcaaaatgaaaactattgaggttgacggcattaaggtgcggatacaaatttgggataccgctggccaggagcgttaccagacaattacgaaacagtattaccgccgcgctcaaggaatctttctggtgtacgacatttcttctgaacgtagctaccagcatattatgaagtgggtctcagatgtagatgaagtcggggatgctacctctcttcccggatgtggggaaggtgcttctcctggtaaagctcggaggggacccgatgggaaggcgaatgcatctaggaagctgtgcttacctcagccttggatgaagacatcaggcacccaccagaaagcgtctcggagaagtctgctggggattaggctcatgcgaagtaggaacggtcgatgggaagagagtaagggctcttcatggcgcagaagcatggcgtggacaagcatgaaacaggttcccgcccctacctccaccctgaagtcccactccagagtttag

SEQ ID NO: 29339 - DNA, 639 bp, Artificial Sequence
  Description of Artificial Sequence: Synthetic coding sequence
atggcaaaacagtatgatgtgctatttaggctgctgctaatcggagacagcggcgttgggaaaacctgccttctgtgccgattcaccgacaatgaattccactcatcccacatttctactatcggagtggatttcaaaatgaagactatagaagtagatggtatcaaggtacgcattcagatttgggatacagccggccaggagcgctaccaaacaattacaaaacagtattatcgccgggcacagggcatctttcttgtgtacgacatcagctctgagagatcttatcagcatataatgaaatgggtctccgatgtagatgagtatgccccagagggagttcagaaaatcctgatcggcaacaaagccgatgaagaacagaaaagacaggttggtcgtgagcaaggccagcaactcgccaaagaatatgggatggacttttatgagaccagcgcctgcaccaacctgaatatcaaggaaagctttacacgcctgactgagctcgtgcttcaagcgcacaggaaagagctggaaggactccgtatgcgtgcttctaacgaacttgcactggccgaactcgaagaggaagaggggaagccagaaggccctgctaattcctctaaaacctgttggtgttag

SEQ ID NO: 29340 - DNA, 795 bp, Artificial Sequence
  Description of Artificial Sequence: Synthetic coding sequence
atgcattttagctcatccgcgcgtgccgccgatgagaactttgattaccttttcaagatcattcttataggggactccaatgttgggaagacgtgcgtcgtgcaacactttaagtccggcgtgtacactgaaacccagcagaacacaatcggcgtggattttacagtgcgcagcctggacatcgacggcaagaaagtgaaaaattctagtgcgtcaatcattaccttcgcatcaattcagatccatggacagacccagaaaatgagccctcagatttggacaaaatctagccactacctgtgggaaccactaatctggaccttgctccctgttctgcttcagatgcaggtttgggatactgcaggtcaggaacgattccgcactattacccagagctattaccgaagcgcacatgcagccattattgcatacgacctcactcgacgatctaccttcgaatctattccccactggatccacgagatagagaagtatggagcagccaatgtcgttatcatgcttattggcaacaagtgcgacctgtgggaaaaaaggcatgtgctgttcgaagacgcttgtacgcttgcggagaagtatggccttctggccgtcttggagacatccgctaaggagagtaagaacatcgaagaggtgttcgtgctcatggcaaaagaacttatcgcccgcaattccttgcatctctatggcgagtccgcacttaacggccttccactggattcatcaccggtactcatggcccagggacctagtgaaaaaactcattgcacctgctag

SEQ ID NO: 29341 - DNA, 654 bp, Artificial Sequence
  Description of Artificial Sequence: Synthetic coding sequence
atgcatttctcaagctccgcccgtgccgctgatgagaacttcgattacctgtttaaaatcatcctgataggggatagtaatgttgggaaaacttgtgtagtccagcatttcaagagcggagtctataccgaaactcagcagaatactatcggtgttgacttcacagtccgcagcctggatatcgacgggaaaaaggtaaagatgcaggtctgggacacggccggccaggagcggttccgaaccattacccagtcctattatcgctcagcccacgccgcaataatcgcatacgaccttacccgtcgaagcactttcgaatctataccccactggattcacgagattgaaaaatatggcgcagccaacgttgtcattatgctgattggaaataagtgcgacctttgggagaagcggcacgttctatttgaagacgcttgcacattagcggaaaaatatgggcttttagcagttctggagacgtcagcgaaagagtcaaaaaatattgaggaagtattcgttttgatggctaaggagctcatcgctcggaatagtcttcacttgtatggggagtcggccttaaacgggctgcctttggattcgagtccagttctgatggcccagggaccgtcggagaagacgcattgcacttgctag

SEQ ID NO: 29342 - DNA, 450 bp, Artificial Sequence
  Description of Artificial Sequence: Synthetic coding sequence
atgcatttttcctcatccgcccgcgccgccgacgagaacttcgactacctgtttaagataatcctgatcggggactccaatgtgggcaagacatgcgtcgtgcaacattttaagagtggagtgtacacagaaactcagcaaaatactatcggtgtggatttcacagtgcgtagcctggacatcgacggaaagaaggtgaagatgcaggtctgggataccgctggtcaggagcggtttaggactatcactcagtcatattaccgttccgcacacgccgcaataattgcatacgacttaactcggcgttcgaccttcgaaagtattccacattggattcatgaaattgaaaaatacggggctgcaaacgtggttattatgcttataggcaacaaatgtgacctgtgggagaaacgccatgtcttgtttgaagatgcctgcaccttggcctag

SEQ ID NO: 29343 - DNA, 654 bp, Artificial Sequence
  Description of Artificial Sequence: Synthetic coding sequence
atgcacttcagtagcagtgccagagccgccgacgagaattttgattacctatttaaaatcattttaatcggcgactctaacgttggtaaaacctgcgtagtccagcactttaagagtggtgtgtatacagaaacgcagcaaaacaccatcggagttgatttcaccgttagatctttggacatcgatggcaaaaaggttaagatgcaggtctgggataccgcggggcaggaacgatttcgaaccattacacagagttattaccgctccgcccacgcagcaattattgcttatgacctgacccgccggtccacattcgaatcaattcctcattggattcacgagatagagaaatacggagcagcaaatgtagtcattatgctgataggcaataaatgtgatctctgggaaaaaaggcacgtccttttcgaggacgcgtgtactctggccgagaagtacggcctgctcgctgtcctggaaactagtgcaaaggaatcgaagaatattgaggaggtgttcgtcctcatggcaaaagagctaatcgcccggaatagcttacacttatacggcgagagtgccctgaatggcttaccactggatagtagcccggtgttgatggctcagggcccatccgagaaaacccactgcacatgctag

SEQ ID NO: 29344 - DNA, 705 bp, Artificial Sequence
  Description of Artificial Sequence: Synthetic coding sequence
atgcggaagccagattccaaaatcgtgttgctcggagacatgaacgtggggaagactagtctgttacaacggtatatggaacgacggttcccagatacggtctcaactgtcggaggtgctttctacctgaaacaatggagatcatataacattagcatctgggatacggccggaagggagcagtttcacgggctgggttccatgtattgcagaggcgccgctgcgatcatcctgacctatgacgttaaccataggcagtctctggtggaacttgaggacagattcttaggccttacggatactgcctctaaggactgcctttttgcaattgtgggtaataaggtagatctaacagaagagggtgccctggctggccaggagaaggaggagtgcagccccaatatggacgccggagaccgagtgtcaccaagagccccgaagcaagttcagctggaggatgcagtcgcactgtataaaaaaatcctgaaatacaaaatgctggatgagcaagatgtgccagcagcagaacagatgtgtttcgagactagcgccaagaccgggtacaatgtcgacctactatttgaaactctcttcgacctggtcgtcccaatgatcctgcaacagagagccgagcgcccatctcacaccgtggatataagcagtcacaagcccccaaaaaggacgaggtcgggctgctgtgcttag

SEQ ID NO: 29345 - DNA, 657 bp, Artificial Sequence
  Description of Artificial Sequence: Synthetic coding sequence
atgactgatggcgactatgattacttgatcaagctcctggccctgggcgattctggggtggggaaaaccacatttttatatcgctatacggataataagtttaatcccaagtttattactaccgtgggcatcgatttcagggaaaaaagagtggtctacaacgcacagggacctaacgggagcagcggaaaagcctttaaagtccacctgcagctgtgggacacggccgggcaggagagatttcggtctcttaccaccgctttctttagagacgcaatgggttttctgctaatgtttgacctcacatcccaacagtctttcttgaacgtgcgaaattggatgtcccaactccaggctaatgcttactgtgagaatcctgacattgttctgattggtaacaaggcagacctgcccgatcagcgggaggttaatgaaaggcaagcacgggaactggctgataagtacggcattccttacttcgagacctcggcagccaccgggcagaatgtggagaaagcagtcgagacacttctggacctaataatgaagaggatggagcagtgcgtggagaagacacagataccagacaccgtgaatggggggaattcaggtaacctggacggtgagaagccacccgagaaaaaatgcatatgttag

SEQ ID NO: 29346 - DNA, 654 bp, Artificial Sequence
  Description of Artificial Sequence: Synthetic coding sequence
atggagactatttggatctaccagtttcgactgatcgtgattggtgattccaccgtaggcaagagctgcttgctgcacagattcacgcagggccggtttccaggattgcgaagcccagcgtgcgatccaaccgtcggggtagactttttcagtcggctcctggaaattgaacccggaaagcgcattaaactgcaactgtgggatacagcagggcaggaacggtttcgcagcataaccagaagctactatagaaactccgtcgggggattcttggtgttcgacatcacaaatcgacgttcgtttgagcacgtaaaggattggttggaggaagctaaaatgtatgtgcagccgtttaggattgtattcctgctcgtggggcacaaatgcgatctcgcctcacagcgccaggtgactcgggaagaagcagagaagctgtctgcggactgcggcatgaagtacattgagacaagcgccaaggatgctaccaatgtcgaggagtcttttacaattctcaccagagatatctacgagttaattaagaagggggagatctgcattcaagacggttgggagggagtgaaatccggtttcgtgcccaacaccgtgcattcctcggaagaggctgtgaagcccaggaaagaatgcttctgctag

SEQ ID NO: 29347 - DNA, 1737 bp, Artificial Sequence
  Description of Artificial Sequence: Synthetic coding sequence
atgaggcagcaggatgcccccaaaccaacccccgcggcctgtcggtgttccggcctggccagacgggtgctcacaatagcctttgctctgctgatcctcggcctaatgacttgggcctacgctgctggcgttcctctggcctccgaccgttatgggttgctggcgttcggcctgtacggagcgttcctaagtgcacatctggttgctcagtcccttttcgcttatttagagcatcgccgagtggcggccgctgcaagaggtcctctggacgctgcgacggctaggtcagtcgcccttaccataagtgcctaccaggaagaccccgcatacctgaggcagtgcttagcttctgcaagggcattgctgtatcctcgcgcaagactgcgggtcctgatggtggttgacggcaatcgagcggaagacctgtatatggtcgacatgttccgtgaggtctttgccgatgaggatccagcaacatacgtgtgggacgggaattatcatcagccttgggaacccgctgccgcaggggcggtcggtgcaggggcttatagagaggtggaggctgaggaccctggcaggctggccgtggaggctctggtgaggacacgtcggtgcgtatgcgtggcgcagcggtggggcgggaaacgagaagtaatgtatactgccttcaaagctttgggtgatagcgttgattatgttcaggtttgcgattccgataccaggctggaccccatggccctgttagaactggtgcgggtgctggacgaagacccgcgcgtaggagctgtcgggggggacgtgagaattcttaatcctctggattcttgggtgtctttccttagctccctccgatactgggttgcattcaacgtggagagggcctgccagtcatatttccactgtgtgagctgcattagcggacctttgggattataccgcaataacctgctgcaacagttcctcgaagcatggtacaaccagaagttcctaggcacccactgcacgttcggagacgacaggcacctgaccaacagaatgctgagcatgggttacgccactaaatatacctccagaagtagatgttatagcgaaactccgagctcatttctccgttggctttctcaacaaactcggtggagtaagtcctattttcgggagtggctctacaacgcactctggtggcaccgccaccatgcctggatgacctatgaggccgttgtaagcgggctgttccccttcttcgtggcagctacagtacttcggctgttctatgcaggtcggccttgggcgctcctgtgggttctcctatgcgtgcagggggttgctttggctaaagctgcattcgccgcgtggttgaggggctgtctgcgtatggtcctgctgtcgttgtatgcacctctgtacatgtgcggcttgcttcctgcaaaatttctggccctcgtgacgatgaaccagtcgggatgggggacaagcggacgcagaaagctggccgccaactatgtgcccttattacccttggctctgtgggctttgcttttgcttggggggttagtgcgatcggtagcccacgaggcccgagccgactggagtgggccatccagggccgctgaagcctatcacttagcggcaggggctggagcctatgttggatactgggtggccatgctcacattatattgggtgggcgtgcgccgcctgtgcaggcgacgcaccggcggctacagggtgcaggtgtag

SEQ ID NO: 29348 - DNA, 834 bp, Artificial Sequence
  Description of Artificial Sequence: Synthetic coding sequence
atgtctgcccccggctcacccgaccaggcttacgattttcttttaaaatttcttctggtgggagatagagacgtggggaagagtgaaatcctcgagtcgctgcaagacggtgcggcggagtccccgtactctcacctcggcgggatcgattacaagacaaccaccatattgcttgatgggcagagagtgaaactaaagctgtgggatactagtggccagggccgtttttgcaccatcttccgctcttactcccgaggtgctcagggagtcatcctggtctacgatatcgccaatcgctggtctttcgagggcatggacaggtggattaaaaagatagaggaacacgcacctggcgtgcccaagattctcgtgggaaatagacttcatctagcatttaaacgacaggtgcccagagagcaagcccaggcttacgctgagcgactcggcgttacgtttttcgaggtctcacctctgtgtaacttcaatataatcgagagttttaccgaactggctagaattgtgttgctacggcacaggatgaattggctgggacgccccagcaaggtgttgtcgttgcaagatctttgttgccgcacaatcgtgtcttgtactccagtccatctggtcgacaaattaccacttccttctaccctgaggtctcatctgaaaagcttttcaatggccaagggcttgaacgccagaatgatgcggggactaagttacagcctcaccacatcctccactcataagtcatctctgtgcaaggtcgagatcgtctgtcccccgcagagcccaccaaagaactgtacacgcaattcgtgcaagatttcatag

SEQ ID NO: 29349 - DNA, 834 bp, Artificial Sequence
  Description of Artificial Sequence: Synthetic coding sequence
atgtctgcccccggtagccccgaccaggcttacgatttcttactgaaattcttactcgtcggggatagagacgttggtaagtcagagatactggaatctcttcaagatggtgctgcggaatcgccctactcccacctcgggggaatcgattacaaaaccacaacaattttgctggacggtcaaagagttaaactcaagctatgggacacttcgggccagggtcgcttctgcacaattttcagatcctactcacgcggcgcccaaggggtgattttagtttacgatattgccaatcgttggtcattcgaaggtatggatcggtggataaaaaagattgaagaacatgcccccggagttcccaagatcctggttgggaataggctgcatctggctttcaagaggcaagtgcctagagaacaggcccaagcatacgccgagcgactcggagtgactttctttgaggtctcccccctgtgcaactttaacatcatcgagtccttcaccgagcttgcccggatcgtactgctgaggcacaggatgaattggctggggaggcctagcaaagtactgtctcttcaggatctatgttgccggactatcgtttcatgcactcccgtgcaccttgtagacaaactgcctctgcccagcactcttcggtcacatctgaagagcttctctatggctaaaggactaaacgcaagaatgatgcgggggctttcttacagcttgaccacgagttccactcacaagtctagcctatgtaaagtcgagatagtctgtccaccccagtctcctcccaagaactgcactagaaactcctgcaaaatctcatag

SEQ ID NO: 29350 - DNA, 837 bp, Artificial Sequence
  Description of Artificial Sequence: Synthetic coding sequence
atgtccgccttaggttctcctgttcgagcctatgatttcctactgaagtttctcttagttggcgacagcgatgtggggaaaggagagatcctcgcatccctgcaagatggagctgcagagtctccatacggtcacccagccggcattgattacaaaactacaacaatactgctcgacggacgaagggtgaagctgcagctatgggatacgtctgggcaaggccggttctgcactatcttccgctcctattcacggggcgcacagggagtgattcttgtgtacgacattgctaatcgctggagctttgatggcattgaccgatggatcaaggaaattgatgagcatgcacccggagttccaaagattcttgtcgggaacagactgcacctggccttcaaacgacaagtgcccacagagcaggcccaggcttacgctgagaggcttggggtcacattcttcgaggtctcaccgctgtgcaatttcaacatcacggaaagctttacagaacttgcccgcatagtcttgctgcgccatggcatggaccggttgtggcgaccatccaaggttctgtctctacaggacctgtgttgccgggccgtggtgtcgtgcaccccagtgcatctagtggacaaactaccactgcccattgctctacgctcccaccttaagtctttctccatggctaatggactcaacgccaggatgatgcacgggggcagctattctctgaccaccagctctacgcacaagaggtcgagcctacgtaaggttaaactcgtccgaccgccacagtcaccccctaagaattgcacaagaaattcttgtaagatctcctag

SEQ ID NO: 29351 - DNA, 837 bp, Artificial Sequence
  Description of Artificial Sequence: Synthetic coding sequence
atgagcgccctggggtccccagtacgggcctacgactttctgcttaagttcctgctggttggggacagcgatgtcggaaaaggcgagattctcgcctcgcttcaggatggtgcagctgagtcaccctatgggcaccctgctgggatcgactataagaccaccacaatccttctggatgggagacgcgtgaagctgcagctgtgggacacatccgggcagggccgcttttgcactatattccggagctactcgcgcggcgctcaaggcgtgattctcgtgtacgatattgcgaacaggtggtcctttgatggaatcgaccgctggattaaggagatagatgagcatgctcctggtgtgcccaaaatcctggttggcaatcgcctgcatcttgcatttaaacggcaggtcccaacggagcaggctcaagcatacgctgaaagacttggagtaacattctttgaagtctctccactttgtaactttaacatcacagaatcattcaccgaactcgcaagaatcgtgcttcttagacacggtatggataggctgtggcggccatcaaaggtcttaagcctccaggacttatgctgcagagcagtggtatcctgtacaccagttcatcttgtagataaactgccgctccccatcgcgttacgctcccatttgaaaagtttctccatggctaatggactgaacgctcggatgatgcacggtgggagctacagcctgaccacttcttcaacacataaacgcagcagcctgcggaaagttaagttggtacgccccccgcagtcccctcccaagaactgtacgagaaattcgtgtaagatttcctag

SEQ ID NO: 29352 - DNA, 1140 bp, Artificial Sequence
  Description of Artificial Sequence: Synthetic coding sequence
gaacagggactgggcgctcgtgcagctccactgggagctgggcccccacccctccgctctgcccctcaggccggccacggatggggtaggcgcgcagttactatgtctgctctcgggagccccgtgagggcctatgatttcttgttgaagttcttgcttgtcggtgatagcgacgtcgggaaaggggaaatcctggctagccttcaggatggagctgcagagtcaccatacggccatccagctgggatcgactacaagacaactacaatactgctagatggtaggcgtgtcaagttacaactctgggataccagtggtcaaggtagattctgcactatttttagatcgtatagcagaggagctcaaggagtgatccttgtgtacgatattgcaaatagatggagtttcgatggaatcgaccgatggataaaggagattgacgagcatgctccaggggtcccgaagatactggtggggaatcgcctgcatctggccttcaagcggcaagttcccaccgagcaagcacaggcctacgccgagagacttggcgtgacattctttgaagtgagccccctgtgcaatttcaatattacagaaagcttcaccgaactggctcggatcgtgctgctcagacacggcatggataggctgtggcgaccttccaaggtcctttctctacaggatctctgttgcagagcggtcgtgtcatgtacgcccgttcatctcgtagataaattacctctccctatcgctttgaggagccacctcaagagcttcagcatggcaaacggcctcaatgctcgcatgatgcacggaggatcttatagtcttaccaccagttccacgcataagcgcagttctttgaggaaagtgaagcttgtcagacccccacagcctccacaaaagttgcaccagaagcaacttcaaaactttcttcgaaaggcgctcaaagagactcgccgcaatctgtcccgcagatcttcggcgctaccccccgccgccggcgggtgcatctctgatcctgggagctcgagaaggatgctactggctaacgtttgcgatgcgttccgggttatggagacccactatcccgtcggcctccggatctctacatggatgtgcatgaagttgctgttttag

SEQ ID NO: 29353 - DNA, 846 bp, Artificial Sequence
  Description of Artificial Sequence: Synthetic coding sequence
atgggctcacaaggctctccagtaaagtcctacgattatttgcttaagtttttgttggtaggagattcggacgttggcaagggtgaaattctggagagcttgcaggatggcgccgctgaatctccctacgcgtacagtaacgggatcgactacaagactaccacgatcttgctggatggccggagagttaaactggaactgtgggatacatcgggccagggacggttttgtaccatcttcagaagctatagcaggggtgctcagggtatactgctggtctatgacatcaccaatcgctggtcttttgatggaatcgaccgctggataaaagagatcgatgaacacgcacccggggtgccacgcatattagtcggcaaccggctccatctagccttcaaacggcaagtgccaacagaacaggcaagggcttatgcggaaaaaaactgcatgaccttcttcgaggtttcccctttgtgcaatttcaacgtcatagagagtttcacagagctttctcgcattgtcctgatgagacacggaatggaaaagatttggagaccaaaccgggtgttctctctccaagacctgtgctgtagggccatagttagctgcacccctgtccacctgattgacaagctacctcttcctgtgactataaaaagccatctgaagagcttcagcatggctaatggaatgaacgccgtgatgatgcatggtcgctcctactctctcgcttcgggtgctggcggcggaggaagcaaagggaatagcctgaagaggtctaaaagcataagacccccccagtcaccgcctcagaattgttccaggagtaattgcaagatatcctag

SEQ ID NO: 29354 - DNA, 846 bp, Artificial Sequence
  Description of Artificial Sequence: Synthetic coding sequence
atggggtcacagggaagtcctgtcaaatcatatgactacctactcaagttcttactcgtgggcgactccgacgtggggaaaggagaaatcctggagagtctgcaggacggcgcggcggagtcaccttatgcatattccaatgggatcgactacaaaactactactatcctgctggatggccgcagggttaagctagagctgtgggacacctcgggccagggtaggttttgtacaatctttagaagttacagccggggcgcccagggtattttactggtctatgacatcacgaacagatggagcttcgacggtatcgacagatggattaaagagatagatgagcatgcaccgggcgtgccacgcatcctggttgggaacagacttcatcttgcatttaaaaggcaggttcccacagaacaggcaagagcatacgcagagaagaactgcatgacttttttcgaggtgtccccactgtgcaacttcaatgtgattgagagcttcaccgaactgtcaaggatagtgctgatgcgccatggaatggagaagatatggagacctaaccgggtgttcagccttcaagacttatgttgtcgtgcaattgtgtcatgcaccccggtgcacctcatagacaagcttccgctgcccgtgacaatcaaatcccacctgaaatcattttcaatggcaaacgggatgaacgccgtgatgatgcatggcagatcctactccctggcctctggtgctggaggtggcggttccaagggaaattcccttaaacgcagcaagagtataagacctccccagtctcccccgcaaaattgctccagatccaattgtaagatcagttag

SEQ ID NO: 29355 - DNA, 846 bp, Artificial Sequence
  Description of Artificial Sequence: Synthetic coding sequence
atgggctcacagggaagcccagtcaagtcatacgattacctccttaaattcctcctggtcggggacagcgacgtgggaaaaggtgagatactggagtctctgcaggacggcgccgcagaaagtccatatgcatatagcaatgggattgattataagacaacgactatattgcttgacggacgcagggtcaaactcgagctgtgggacacctccggacaggggcgtttctgtacgatttttcggtcatactccaggggggctcagggcatattgctcgtgtacgacatcacaaatcgatggtccttcgacgggatcgaccggtggatcaaagagatcgacgaacacgcccctggggtcccgcggattttggttgggaaccgactgcatttagctttcaagaggcaggtgccaaccgaacaggccagagcgtatgctgagaaaaattgcatgacattcttcgaagtttctccactatgcaattttaacgttattgaatcatttactgagctgagccgaattgtcctcatgcggcacgggatggaaaagatctggaggcctaacagagtcttctctctgcaagatctgtgttgccgcgccatagtaagctgtaccccggtccaccttatcgataagctgcccctgcctgtcaccattaagtcccacctaaagtcattctcaatggcaaacggcatgaacgctgtgatgatgcacggccggtcatacagccttgcaagcggggccggtggtggtgggtcaaaagggaactccctcaaacgatcaaagtccataaggcccccccagtctccccctcaaaactgcagcagaagtaattgcaagatcagctag

SEQ ID NO: 29356 - DNA, 846 bp, Artificial Sequence
  Description of Artificial Sequence: Synthetic coding sequence
atgggaagtcagggctctcccgttaaatcctatgattacttgctgaagtttcttttagtcggggacagcgatgttggaaagggagaaatactcgaatcactacaggacggggccgctgaatcgccttacgcctacagcaatggtatagactacaagacaactaccatactgttagatggaagacgggtgaaactggagctgtgggatacatcaggtcaggggagattctgcactatattccggagttactcgagaggcgctcagggtattctcttggtgtatgacattaccaaccggtggtcattcgatggaattgatagatggattaaagaaattgacgaacacgcccccggcgtccctcggatactggtgggcaatcgtctccacctggcgtttaaacggcaggttccaacagaacaggcgcgcgcctacgctgaaaagaattgcatgacattcttcgaagtcagcccattatgcaactttaatgtgatcgagtccttcaccgagttaagccgtatagtgctgatgaggcacggcatggagaagatttggaggccaaatcgggtcttctcgttacaggacctgtgttgccgcgccatcgtctcctgtacacctgtccacctaattgataaactgcctctgcccgttactatcaaatctcatttgaaaagcttttcaatggccaatgggatgaacgccgtgatgatgcacggccggagctactccctggccagtggagccggcggaggagggtcaaaaggcaatagcctgaagcggagcaagagcatacgcccccctcagtcacccccacagaattgctcccgtagtaactgcaagatatcttag

SEQ ID NO: 29357 - DNA, 468 bp, Artificial Sequence
  Description of Artificial Sequence: Synthetic coding sequence
atggctggtcctggccctggcccgggagaccccgatgagcaatacgactttctcttcaagctagtgctggtgggcgacgcctctgtagggaagacgtgtgtggttcagagattcaaaaccggagcattcagcgaacgccagggcagcacaattggcgtcgattttaccatgaaaacactggaaatccagggcaagagggtgaagttgcagatttgggacaccgccggccaggaaaggtttcgaaccattacacaatcttattacaggtctgccaacggcgccattttggcttatgacatcacaaaacgcagtagctttttgagtgttccgcactggattgaggacgtgcgcaaatacgccgggtcaaacattgtgcaactcttgatcgaaatgcagtcctgttacgttgcccaggcagacttggaattattggccagcagcaacccaccggcaagcacatcaaagtag

SEQ ID NO: 29358 - DNA, 639 bp, Artificial Sequence
  Description of Artificial Sequence: Synthetic coding sequence
atggccggaccagggcctggtcccggcgaccctgacgaacagtacgacttcctcttcaagctcgttctcgtgggcgacgcgagcgtaggtaaaacatgtgtagtccagcggtttaagaccggtgcattttcagaacgtcaaggtagcaccatcggagtcgattttacaatgaagactttggagatccagggcaagagagtgaaactgcagatctgggacactgccggccaggaacggtttagaacaattactcagtcttactaccgatctgcaaacggcgccattttggcctatgacattactaaacgttcaagtttccttagtgtgcctcattggatcgaagacgtccggaagtacgctggtagtaatattgtccagctgctgattggaaacaaaagcgatctgtcagagctgagagaggtctcattagctgaagctcagagcctggccgagcattatgacatcctatgcgcgatcgaaacaagcgccaaagactctagtaacgtcgaagaagccttcctacgggtggccaccgagctaatcatgaggcatggcggacctcttttttccgagaaatctccagaccatatacagctgaattccaaggatatcggggaaggctgggggtgcggctgctag

SEQ ID NO: 29359 - DNA, 639 bp, Artificial Sequence
  Description of Artificial Sequence: Synthetic coding sequence
atggctggccccggccccggccctggagatccagatgaacagtatgattttttgtttaagcttgtgctggttggagacgcctctgtcgggaagacatgcgtggttcagagattcaaaaccggcgccttttctgagagacaggggtccactattggggtcgactttacgatgaagactctagaaatccaaggaaagcgggtcaaactgcagatctgggataccgccggccaggagcgtttccggaccatcacccagtcatactacaggtcggcaaacggggctatccttgcctacgacattacgaagcggtcaagtttcttgtcagtgccccattggatcgaagatgtcagaaaatatgctgggtcaaacattgtccagttgttgatcggtaacaaatctgatcttagcgagctacgagaggtgagcctggccgaggcgcagtccttggctgagcattacgacatactttgtgctattgaaacaagtgccaaggattcctctaacgtggaggaggcttttctccgggttgcaacggagctgataatgcgccatggggggccactctttagtgaaaaatctccagaccatatccaactgaattccaaagatataggagaagggtggggctgtggttgttag

SEQ ID NO: 29360 - DNA, 639 bp, Artificial Sequence
  Description of Artificial Sequence: Synthetic coding sequence
atggctggaccaggcccaggcccaggtgacccggacgaacagtatgacttcctgttcaagcttgtcctggtgggcgacgcatctgtcggaaaaacttgtgtggttcagcgtttcaagaccggcgcattttcagaaagacaagggtcaacaatcggcgtggattttaccatgaagaccttggagatccaaggcaaacgggtgaagctgcaaatttgggataccgccggtcaggagagatttaggacaatcacccagtcctattatagaagtgccaacggggctatactggcttatgatatcaccaaacgtagctcattcttgtcagtgccccactggattgaggacgtgaggaaatatgccggctccaatatagtccagctgttaatcgggaataagagtgatctgtcggaactgagggaagtgagcttggccgaggcccagtctctggccgagcactacgacattctgtgcgccatcgagacatcagccaaagacagcagcaatgtggaggaagctttcctcagagttgccaccgagctgattatgcgccatggtggcccactgttttcagaaaaaagccccgaccacattcagcttaattcaaaggacatcggagaagggtggggttgtggctgttag

SEQ ID NO: 29361 - DNA, 639 bp, Artificial Sequence
  Description of Artificial Sequence: Synthetic coding sequence
atggccgggcctggtccaggacctggagatccagatgagcagtatgactttttgttcaaactggtgctcgtaggcgacgcctccgtggggaaaacttgcgtcgttcagagattcaagactggcgcttttagcgagcggcagggcagtacaattggggtagacttcaccatgaagacattggaaattcagggcaagagagtcaagttacagatctgggataccgcaggccaggaaaggtttaggacaattacccaatcttactacagatcggctaatggagccattttggcctacgatatcacaaaacgcagcagcttcctttcagttccacactggatagaggacgtgagaaagtacgctggcagcaacatcgtgcagttactgattggcaacaaatctgatctctccgagctgagggaggtctccctggctgaggcgcagtccctggctgaacactatgacattctctgcgcaattgagactagtgccaaagactccagtaatgtagaggaagcattcctcagagtggcaactgagctgatcatgaggcacggcggtccactcttcagtgagaaaagcccagaccatatccagctaaattccaaagacattggcgaaggatgggggtgtggctgttag

SEQ ID NO: 29362 - DNA, 639 bp, Artificial Sequence
  Description of Artificial Sequence: Synthetic coding sequence
atggctggtccaggtcctgggcccggcgaccctgacgagcaatatgacttcctttttaaacttgtcctggtcggcgacgcttccgtgggcaaaacatgcgtcgttcagcggttcaaaactggtgcgttttccgaacgacaaggttccacaatcggagtcgacttcactatgaagactttggagatacagggtaaacgggtgaagctacagatttgggacacagcaggccaggagagattccgaacaatcacacagtcatattaccgtagcgccaatggagcaattcttgcatatgatattacaaagcggagctccttcctgagtgtcccccattggatagaagatgtgcggaaatatgccgggagtaacattgtgcagctgctcattggtaataaatccgatctgtccgagctacgcgaggtttccctcgctgaggcccagtcgctggctgaacactatgacatcctttgtgccatagaaacttccgccaaggattcatctaatgtggaagaggccttcctcagggtggccactgagttaattatgagacacggcggcccattgttctctgaaaaatcacctgaccacatccagcttaattccaaggacatcggggaaggttggggctgcggctgctag

SEQ ID NO: 29363 - DNA, 261 bp, Artificial Sequence
  Description of Artificial Sequence: Synthetic coding sequence
atggccggtcccggaccagggccaggcgatcctgacgaacaatacgactttctgttcaaactggtactcgtaggtgatgcctccgtcggcaagacgtgcgtggtgcagcgcttcaagacaggtgcttttagtgaacggcaaggttccaccatcggggtcgactttacaatgaagacactggagatccaggggaaaagggttaagctgcaaatatgggataccgcaggacaggagagattccgcacaattacccaatcttag

SEQ ID NO: 29364 - DNA, 624 bp, Artificial Sequence
  Description of Artificial Sequence: Synthetic coding sequence
atggccaagacttacgattacttgttcaaacttctgctcattggtgattcaggcgtcggtaaaacatgcctcctgtttcgttttagcgaagatgcatttaacactaccttcattagcacaattggcatcgacttcaagattcgcacgatcgaactcgacggcaagaaaataaagctgcagatatgggatacggccggccaggagagattcaggacaattactactgcttactaccgaggcgccatgggtataatgctcgtctacgacatcacgaatgaaaagagctttgataacatcaaaaactggataaggaacattgaagagcacgcttcgtcagacgtggagaggatgatcctgggaaacaagtgcgacatgaacgacaaacggcaggtgagtaaagagcgtggggagaaacttgccattgactatggtatcaagtttctggagaccagtgcgaaatcctctgcgaatgttgaagaagcgtttttcactctagccagggatattatgacaaagctgaatcgcaagatgaacgactctaacagtgcaggcgccggagggcccgtgaagattacagaaaatagaagcaagaaaacgagcttcttccgctgctctctcctgtag

SEQ ID NO: 29365 - DNA, 573 bp, Artificial Sequence
  Description of Artificial Sequence: Synthetic coding sequence
atggcgaaaacatacgactatcttttcaagttgttgctgattggcgattctggagtcgggaaaacctgtcttttgttccgcttttctgaagacgcttttaacaccaccttcatcagtacaatcggtattgatttcaaaatccgtaccatagagctggatggtaaaaaaataaaattacagatttgggacaccgcgggccaagaacggttccggaccataactaccgcttactaccgcggggctatggggattatgctggtgtatgacattaccaatgagaagtcctttgacaacataaaaaattggatcagaaatatcgaggaacatgccagcagcgatgtggagcgtatgatccttggaaataagtgcgatatgaatgacaaaagacaggtttctaaagagaggggggaaaaattagctattgactacggaatcaagtttctggaaacaagtgccaaatccagcgccaacgtggaggaaaacgactctaatagtgctggagcaggcggcccagttaagatcaccgaaaatcgctccaaaaaaacatccttttttcgatgcagtctgctgtag

SEQ ID NO: 29366 - DNA, 966 bp, Artificial Sequence
  Description of Artificial Sequence: Synthetic coding sequence
atgaaacaactgcctgtgctggaaccgggcgacaaaccccggaaagctacgtggtacaccttgacagtccccggggacagtccttgcgccagggttggccacagttgtagctatttgccaccagtgggcaatgctaagcggggcaaggtttttatagttggcggtgccaatcctaaccggtcgttttctgacgtgcacaccatggatctggaaactagaacttggactacccctgaagtgacctcgcccccaccttctcccagaacgtttcacacaagttccgccgccatcgggaaccagctatacgtttttgggggcggtgagcgtggagcccaacccgtgcaggatactaagttgcacgtgtttgacgccaatacgctgacctggagccagccagagacccttggcaaccccccgagccccagacatgggcacgtcatggtggctgccggcacaaagctatttatccacgggggattggctggcgatcgcttctacgacgatcttcattgcatcgatatcagcgatatgaagtggcaaaagttgaacccaaccggagctgcaccagctggctgcgcggctcatagcgctgtcgcaatgggaaagcacgtgtatatttttggcgggatgacacctgctggcgccctggacacaatgtaccaatatcacactgaggaacaacattggaccctgctgaaattcgacacattgctccctccaggcagactcgatcatagtatgtgcataattccatggcccgttacatgtgcaagcgagaaagaggactctaattcactgaccttaaaccacgaagcggagaaggaggatagcgcagacaaagtgatgtctcactccggtgattcccacgaggagagtcagacagccacactgctttgcctggttttcggcggaatgaataccgaaggagagatttatgatgactgtatagtcaccgttgtggactag

SEQ ID NO: 29367 - DNA, 1119 bp, Artificial Sequence
  Description of Artificial Sequence: Synthetic coding sequence
atgaaacagttaccggtactagagccaggggacaagccccggaaggcaacctggtacacactcaccgtgcccggtgacagtccttgcgcccgcgttgggcactcctgctcctatctaccacctgtgggtaatgccaaaagggggaaagtgtttatcgttggcggggccaacccaaatcgcagcttttccgacgtgcataccatggacctgggaaaacaccagtgggatctggatacctgcaaggggctgcttccccggtatgagcacgcaagtttcatcccttcctgcacgcccgacaggatttgggtgttcggcggagctaatcagtcagggaatcggaattgcctgcaagttctcaatcctgagaccagaacgtggacaactcctgaggttacctcgccacccccttctccccgaacttttcatacaagttcagccgcaatcggaaaccagttatacgtgttcggcggaggggaacggggcgcccagcccgttcaagatactaagctgcatgttttcgatgcaaataccctgacctggtcacagccggaaacgctgggaaatccaccgtcccccaggcacggacatgtgatggtggccgctggcacaaagctgtttatccacggcggtctggccggagatcgtttttatgacgacctccactgcatcgacatttccgatatgaaatggcagaagctgaatcccacgggggcagctcccgcagggtgcgccgcccactccgctgtcgcaatgggaaaacatgtctatatttttggtgggatgactcctgcgggcgccctggacaccatgtatcagtatcacaccgaggaacagcattggacactcttgaaatttgatacactgcttcctccgggcaggctcgatcactcgatgtgcatcatcccctggcccgtcacctgtgcatccgagaaggaggattctaattcattgaccctgaaccacgaggcagaaaaagaggacagcgctgacaaggtcatgtcccactcaggagactctcatgaagaaagccagacagcgactttactatgtctggtttttggggggatgaacaccgaaggcgagatttacgacgactgcatagtgacagtggtggactag

SEQ ID NO: 29368 - DNA, 465 bp, Artificial Sequence
  Description of Artificial Sequence: Synthetic coding sequence
atgaagcagctgcctgtgctggagcctggcgacaagcctcggaaagcaacatggtacaccttaacagtgcccggggacagcccatgcgcccgcgttggccattcgtgtagttacctgcccccagtggggaacgccaaacggggcaaagtctttattgtgggaggggcgaacccgaacagatcgttcagtgacgtgcacaccatggatctgggaaagcaccagtgggatctcgacacgtgcaaaggcttgctgcctcgttatgaacatgcgtccttcatcccctcctgtacaccagaccggatctgggttttcggcggagctaatcagtccggaaatcgtaactgtctccaagttttgaatcctgcttttaagagttggggcttctggaccgtgttagccaatccgaagtatcacctgcacagctcactcatgtttaagccaggccgagggccacgacaaaagtag

SEQ ID NO: 29369 - DNA, 465 bp, Artificial Sequence
  Description of Artificial Sequence: Synthetic coding sequence
atgaagcaactgcccgtgctggagcccggcgataagcctcgtaaagccacatggtacacgttaaccgtgcccggggatagtccatgtgccagagtgggccattcttgctcttatctgccgcccgtgggtaatgctaaacgcgggaaggtgttcatcgtgggcggcgcaaatcctaatcggtctttctctgacgtgcacactatggatctcgggaaacaccagtgggacctggacacctgcaaggggttgctgccccgatatgaacacgcatccttcattccctcatgtacacctgacaggatctgggtttttggcggggctaaccagtcaggcaaccgcaattgcctgcaagttctgaacccagcgttcaagagttggggcttctggaccgtgttggcaaacccgaagtatcatctgcattcctccctgatgttcaaacccgggcgagggcctcggcaaaagtag

SEQ ID NO: 29370 - DNA, 1119 bp, Artificial Sequence
  Description of Artificial Sequence: Synthetic coding sequence
atgaagcaattgcccgtgctggaaccgggagacaaaccccggaaggcaacatggtacactctaaccgtccctggtgacagtccttgtgcaagagtgggacatagttgcagctatctccctcctgtgggcaacgccaagcgtgggaaagtattcatcgtgggcggtgccaacccaaaccgcagctttagcgatgtccataccatggacctggggaagcaccaatgggacctagacacctgcaaggggctactgccgagatatgagcacgccagctttattcccagctgcacaccggatcgcatatgggtgttcggtggggcaaatcaaagcggaaatagaaattgcctgcaagtactcaatccagaaacaagaacatggactacccccgaggttacatcccctcctccatctcctcggacctttcatacatcgtctgctgcaatcggtaatcagttatacgtgtttggtggcggagagcggggcgcccagcctgtgcaggatacgaagctgcacgttttcgacgcaaacacactgacatggagtcagcctgagaccttaggaaatccccctagtcctcggcacggtcacgtcatggtcgcagccgggacgaagttatttatccatggtggtctggctggcgatagattctatgatgatctgcactgtattgatatcagcgacatgaaatggcagaaactgaacccgactggtgccgctcccgccggatgtgccgcccactcagctgtggctatgggcaagcatgtgtacatttttggagggatgacaccggccggtgcgctggacacgatgtaccagtatcataccgaagagcagcactggactcttctgaaatttgatacactgttgcctcccggcaggttagatcactctatgtgtattatcccctggcctgtgacatgcgcatctgagaaggaagatagcaacagtcttacacttaaccacgaagctgaaaaggaggatagcgccgacaaggtaatgtcacacagtggcgacagccatgaggaatcccagacagcaacattgctctgtctagtatttggagggatgaacaccgaaggtgaaatctacgacgactgtatcgtgactgttgtagactag

SEQ ID NO: 29371 - DNA, 735 bp, Artificial Sequence
  Description of Artificial Sequence: Synthetic coding sequence
gggaggggctcacccgacactggaagcatcactgtctccggccgggagagcgagtcatttagaggggtgggtccatctcgggtccagagaacaggcaaggggttgccatggctcagaccggggcacttcgatcgcattagtctctttttccctgatccagtaagctaccccctagagcttcctcggggcgatgagatatgttgggctggctccgggggatgttgcggtcgcagccggcctcgagaggcctccctgactgagctctggacgctaggcaccgcagtgagcgggctgggcagacgctatacgctaaccgtgcctggagactcaccatgcgccagggtggggcacagctgttcatacctaccccctgtgggtaacgccaagcgtgggaaagtgtttatcgttgggggtgcaaatcctaataggtccttctcagatgtccatactatggaccttggcaagcaccagtgggacctcgatacgtgtaaaggactgctgcctagatatgagcacgcgtcattcattccctcatgcacaccagacagaatctgggtgttcggcggcgcaaatcaaagtgggaaccggaactgcctgcaagtccttaaccccgagactcgtacctggacgacgccagaggtgaccagtcccccacctagcccaagaacctttcatactagttccgcggcaatcggtaatcagctatacgtgtttgggggcggagagcgcgggtag

SEQ ID NO: 29372 - DNA, 606 bp, Artificial Sequence
  Description of Artificial Sequence: Synthetic coding sequence
atggctggaaagtcgtctttgtttaaggtgatactcctaggggatgggggagtgggaaaaagttccctcatgaatcggtatgtgacgaacaagtttgatacccagttgttccacacaatcggagtggaatttttgaacaaggacctggaggtcgacgggcatttcgtcacaatgcaaatctgggataccgcggggcaggagagattcagatctctgaggaccccattctatcggggctccgattgttgcctactgactttttctgtggatgatagtcagtccttccagaacctctcaaattggaaaaaggaattcatttactacgctgacgtgaaagaacctgagtccttccccttcgtgattctgggcaacaaaatcgatattagcgaaagacaagtgagtacagaggaagcccaagcctggtgtagggacaacggggactacccgtattttgaaacctccgccaaggacgccactaacgtcgcagcggccttcgaggaagccgtccgccgagtgcttgccactgaggatcgttccgatcatctgattcagacggacacggtcaacctccaccgtaaaccgaagccctctagctcctgctgctag

SEQ ID NO: 29373 - DNA, 1506 bp, Artificial Sequence
  Description of Artificial Sequence: Synthetic coding sequence
atgggctgtgggttgcgaaaactggaggatcctgacgactcatcaccaggcaagatcttcagcacgttgaagagacctcaggtggaaaccaagaccgagttcgcctatgagtacgtattgctcgatttcacccttcaagcttcatccaatccagaagtgatcaagatcaattccattctcgatatcgtgacaaaagttgaaaactattacctgaaggggtatatcgtgggggcaattcatccagttatacagcctgtggggcagcgaaagcacctgcctgccagctacctgtatcgggtggtgttgctgaggctcaagttgagccccaaaaactccgcagctcccagtggccagcgccgtcctcgactggttattgaggaatgccccttgactagtgaggcccagacaaacgatgcggcgaaggaactcattgagaaaatcaatgtggcggcaaagcgggggatgaagttcgtcggattcatttcccagcactatagcccgtccaaattttgtaacggcacaaatcacgacggcgacatcgagtccatgctgcacgtgagacatggttctgacgagaactgccggagctggaatgaaggaaccctttcaggccaatcaagcgaatcgggcatcgaagaagagctgcatcatgagagtggtcagtatcagatggaacagaatggttcccctacgtcgagcaaatcccgaaagggggaggcatctgacaataagctttatactgtcttcaacgcctttgacgatgactccacttcgtgggcctaccaagaggggattctgagcatgaaggtgactagaaaaggaagcgttatatctacgctcgacgctgactggctcgaactgacaaccttctattacaaacagggcctctccctgatcgactcgtttgtcttctgggagaccagcaagggagagcatctgccaaaatcactagaaggcttcttcatctatgaggaggagggctcaggagtgccaggatcctcacgcaaaggtaacgatgccatcgtggtcgaacagtggacagtgattgagggctgcgaaattaaaaccgactatggccccctcctgcatactctagctgagttcggttggctgctgacctcagttcttcccacacctgtactaagacacgactccgaggggaatctggccaccaaacaaatagtgtttctgcagagacccgtgatgtggaattcagccgctcagacccctgacaaaaaggcctcccgacacatcaaaggcgaggacaagaataaagccaccagtaggtccatcgggctggatacaactagctctcaacctgctgagtctcgccacctgcctgaagagtgccgcctctccccatctagggagtgttggacaaaagaaggcagacttgcccagcataactccttttcaggattcagctctagcgataatgtcttacgagaattggatgacggtcagttcgaccaagaagatggagttacgcaggtgacatgcatgtag

SEQ ID NO: 29374 - DNA, 1737 bp, Artificial Sequence
  Description of Artificial Sequence: Synthetic coding sequence
atgggttgtggccttaataaactggagaagagggacgagaaacgacccggcaacatctactccactctcaagagaccacaggtggagactaagatcgacgttagttacgagtatagatttctcgagttcacaacactcagtgccgccgagctgcccggctcgtctgccgtcagactcgcctcgctccgcgatctgccagcccagttactggagctgtatcagcaggggttttcgcttgccgcactgcaccccttcgtccagcccacacatgagagagaaaaaaccccgttagagcacatttttagggctatcctaatcaagaagactgatagaagccagaagaccgatctgcacaatgaggggtacatcctcgagttggattgctgttccagtctcgaccaccctactgatcaaaagctgatccctgaatttattaagaaaatccaggaggccgcatcccaggggttgaaattcgttggtgtcatcccccagtaccattccagtgtgaatagcgctggcagctctgcgccggtcagcacagcgaattcaactgaggatgctcgcgacgcaaagaatgctcgtggggatcatgcctctttggaaaatgaaaaacctggcaccggagatgtctgctcggcgccagccggacggaatcagtcaccagaaccttccagtggaccgagaggcgaggtacccttggccaagcagcctagctcccccagcggagagggtgacggcggggagctctcaccacaaggtgtatcaaagactctggacgggccagaatcaaacccccttgaagtgcacgaggagcccctaagcgggaaaatggaaattttcacactgtttaacaagcctaagagccaccagaaatgcaggcagtattacccggtgactattcctctccatgtttcaaaaaatggtcagaccgtgagtgggctggatgcgaattggctggaacatatgtcggatcattttcgaaaaggcggcatgctggtcaacgctgtcttttatctggggattgttaacgatagtctgcatgggttgaccgacggtgtctttatttttgaagcagtgtccacggaagattcgaaaaccatccagggctatgatgcaatcgtggtcgagcagtggaccgttctggagggagtggaagtgcagacagactacgtgcctttgctgaattctctggctgcctacggttggcagctcacctgcgtcctgccaacacccgtagtaaagactaccagcgaaggcagcgtgagcactaagcaaattgtcttccttcagcgaccatgcctccctcagaagataaaaaaaaaagaatctaagtttcagtggagattctcccgtgaggaaatgcacaacagacagatgaggaagagcaaagggaagctatcagcccgagacaagcaacaggcagaggaaaatgagaagaacctggaagatcaatccagcaaagcgggagatatgggcaactgcgtgtccggacaacagcaggagggaggggttagcgaagaaatgaaaggccccgtgcaagaggacaagggtgagcagctctcccccggtggcttgctgtgtggcgtgggcgtcgagggtgaagcagtccagaacggtccggcctctcactcaagagctttggtggggatttgcacaggccactccaatcctggcgaggatgcacgggacggtgatgccgaagaagtgcgcgagttgggaaccgtggaagaaaattag

SEQ ID NO: 29375 - DNA, 345 bp, Artificial Sequence
  Description of Artificial Sequence: Synthetic coding sequence
atgggctgtgggcttaataagctggaaaagcgggacgaaaagagacctgggaacatctactccacactcaagaggcctcaggtcgagaccaagattgacgtgtcctatgagtatcggtttctcgagttcactacactttccgcagccgaattgcctggatcctcggctgttagattagcttccctgagggatctacctgcacagctcctggagctgtaccagcaaggattctctcttgcagcacttcatcccttcgtccagccgacccacgaaagggagaagacccctctggaacatatatttagggccatcctcatcaagaaaacagacaggtctcagaaatag

SEQ ID NO: 29376 - DNA, 450 bp, Artificial Sequence
  Description of Artificial Sequence: Synthetic coding sequence
atgggctgtggactcaacaagctggaaaaaagagacgagaaacgtcccggcaacatctacagcacacttaagagaccccaagtggagactaagattgacgtgagctatgagtatcggttcctcgagttcacgaccctatcagccgcagaactgcctggatccagtgcagtgcgcttagcctctctgagagatctgcctgctcaactgctcgagctttatcagcagggattctcactggcggccctgcatccatttgtgcagcccacacatgagcgagaaaaaactcccttagagcatatatttcgggccatccttatcaagaaaaccgataggagccagaagactgacttgcacaatgaagggtacatcttagaactggactgctgtagttctttggaccatccgacagaccaaaaactgatcccagaattcatcaaaaagattcagtag

SEQ ID NO: 29377 - DNA, 450 bp, Artificial Sequence
  Description of Artificial Sequence: Synthetic coding sequence
atgggctgtggtcttaataaactagaaaagcgcgacgaaaaaagacctggcaacatctattctaccctaaagaggcctcaagttgaaacaaagatcgatgtgagttatgaatacagattcctggaatttacaaccctctccgcagctgagctgccaggttcttctgctgtaaggcttgccagtcttagagaccttcctgctcagctgctggaactctaccagcagggcttctccctggcagcactccatcccttcgtacaacctacgcacgagcgtgagaagacaccactagaacatatttttagggccatcctgattaagaagacagatagatcacagaagacagacctgcacaacgagggatacattcttgaattagattgctgctcttccttggatcacccgacagatcagaagctcatcccagaattcattaaaaagatccagtag

SEQ ID NO: 29378 - DNA, 828 bp, Artificial Sequence
  Description of Artificial Sequence: Synthetic coding sequence
atgggctgcggactgaacaagttggagaagcgggatgagaaaagacctggtaacatttattccaccctgaagagaccacaggttgaaactaaaatcgacgtgtcctacgaatacagattcctggagtttaccactttatccgccgcagaactacccggcagctccgcagttcgcttggcctcactgagggacctgccggcgcagctcctagaattatatcaacaaggtttttctttggctgccctgcacccatttgtccaacctacgcatgagagagagaaaacacccctcgaacatatctttcgggccatcttgattaagaagacagaccggtcacagaagacagacctgcacaatgaagggtatatcctggagttagactgctgttcttcactggatcatcccactgatcagaaactcatacctgaattcatcaaaaaaattcaggaggctgctagccagggcctcaagttcgtgggagtgatccctcagtaccatagcagcgtgaacagcgctggcagctccgcccctgtgtcaaccgctaattcaaccgaggatgcgagagacgctaaaaatgctcggggagatcatgcgagcttagaaaatgagaaaccaggcaccggagacgtctgttctgctcccgcagggagaaaccagtctcctgaacctagcagtggaccacggggagaggttcctcttgctaaacaaccgtcttctccttcaggagaaggggacggcggcgaactcagccctcagggggtgagcaagacactggacggaccagagagcaatccactcgaggtacatgaggagcccctttctggatag

SEQ ID NO: 29379 - DNA, 1647 bp, Artificial Sequence
  Description of Artificial Sequence: Synthetic coding sequence
atggacctgatgaatggccaggcatcctcggtaaacattgccgcaacagcctccgaagggcagattacactgatggatgtccccgtgttcaaggcaatccagcccgacgaactgtcatcttgcggctggaataagaaggagaagtactcctctgcgcccaatgccgtggccttcactagacgcttcaaccacgtttccttctgggtggtcagagaaattcttcacgcccagaccttgaagatcagggcagaagtgctgtcccactatatcaagaccgctaagaagctttacgaactcaacaatctccatgccctcatggctgtagtctctgggctgcaatcggctcccatcttccgcctgacaaaaacatgggcactactctcaagaaaagacaaaacaactttcgagaagctggagtatgtgatgtctaaagaggacaactacaaaagattgcgggactacatctcttcactgaagatgactccatgtatcccatatttgggcatatacttgagtgatctaacatacattgacagtgcctatccctctacagggtccattctggaaaacgagcagaggtccaatctgatgaacaacatcctccggatcatcagcgatttacagcaaagttgtgagtacgacatccctatgctcccacatgtgcagaaatatctcaattccgtgcagtacatcgaagagctgcagaaattcgtggaggacgacaactataagctaagcctgaagattgagccaggcacttcgacgccacgcagcgctgcatcccgagaagaccttgtggggccagaggtaggagcgagccctcaatctggccgcaaaagcgtagccgcagagggcgctctgttgccccagactccaccaagcccaagaaatctgattccgcatgggcaccgcaaatgtcattccctgggctataactttatccacaagatgaacaccgctgaattcaagagtgccacctttcccaacgctggccctaggcacctgctcgatgattcggtcatggagccacacgctccgagccgcggccaggctgagagcagcacactatcaagcggaatcagcatcgggtcctcagatggatctgaactgagcgaggaaacgtcctggccagcctttgagagaaaccggctataccattcacttgggcccgtcactagagtggctagaaatgggtaccgatcccacatgaaggcctccagcagcgcagaatccgaagatctcgctgtgcatctgtaccctggagcagttacaatccagggcgtcctcagaagaaagactctcttaaaagaggggaaaaaaccgactgtcgctagttggaccaagtactgggcggccctgtgtgggacacaactgttttattatgccgcaaaatcactgaaagccaccgaacgaaagcacttcaaatccacctccaacaagaacgtgagtgtaatcggttggatggtcatgatggccgatgaccccgaacaccctgacctttttctgctcaccgatagtgagaagggcaatagctacaagtttcaggctgggaatcggatgaacgccatgctttggttcaagcacttatcagctgcgtgtcagagcaacaaacagcaggttcccacaaatctgatgaccttcgagtag

SEQ ID NO: 29380 - DNA, 1674 bp, Artificial Sequence
  Description of Artificial Sequence: Synthetic coding sequence
atggacctgatgaacggacaggctagctctgtgaacattgccgcaacagcctccgagaaatcaagttcaagtgagagcctaagtgataagggttccgaactgaaaaaatcctttgatgctgtggtttttgacgtgctcaaggtaacaccggaggagtacgccggtcagatcaccttgatggacgtaccagtcttcaaggccatccagccagatgagctgtcctcttgcggttggaacaaaaaagagaagtacagcagcgcccctaatgcagtggcatttactaggagattcaatcacgtcagtttttgggtcgtccgagagatactccatgcccagaccctaaagattagagcagaggtgctgtcccactatattaagacggctaagaaattatacgagttaaataacttacacgccctcatggcagtagtctctgggttgcaatccgctccgattttccgattaacaaaaacgtgggcccttctgtctcggaaggataaaaccacattcgaaaaactagaatacgtgatgagtaaagaggataattataagcgcttgagggattacattagcagtctgaagatgaccccctgcattccatatctgggcatctatctgagtgatctgacctacattgactccgcttacccatccaccgggagcattcttgaaaatgaacagcgttcaaacctgatgaataacatattgagaattatctccgaccttcaacagtcgtgcgagtatgacatcccaatgctgccccacgtacagaagtacttgaattcggttcagtatattgaagagttacagaagttcgtggaggacgacaactataagctatcactgaagattgaacctggcacctcaaccccccggtccgcggccagcagggaagacttagtgggaccagaggtgggcgccagcccacagtccggcagaaaatcagtggctgccgagggtgccctactgccacaaacccctccttccccacgtaacctgatcccccatggccaccgaaagtgccattcccttgggtataatttcatacataaaatgaatacagcagaattcaaaagcgctaccttccctaatgcagggcccaggcacctgctcgacgactccgtcatggagccccacgccccctcgcggggacaggctgaatcgagtacactgtcttcaggcatctctatagggagctcagacggctctgaactgagtgaggaaacaagctggccagccttcgaatctagcgcggaatccgaagatctggcagtgcacctgtaccctggagccgtcaccatccaaggagtgcttcggcgcaaaactctgctgaaggaggggaagaaacctactgtcgcctcttggacgaaatactgggctgctctttgtggcacccagctcttctactacgccgctaaatccttgaaagccaccgaaaggaagcatttcaaatcgacttcaaataagaatgtaagcgttatagggtggatggttatgatggccgatgatccagagcatcccgatctattcttgctgacggactctgagaaaggcaactcttacaaatttcaagcaggaaataggatgaacgccatgctgtggtttaagcacctcagcgccgcttgtcaatccaacaagcagcaagttcccacaaaccttatgacatttgagtag

SEQ ID NO: 29381 - DNA, 1752 bp, Artificial Sequence
  Description of Artificial Sequence: Synthetic coding sequence
atggacctgatgaacgggcaggcatccagtgtcaatattgcagcaactgcttctgagaaatcgagcagcagcgagtctctctcagataagggaagtgaactgaaaaaaagcttcgacgctgtggtcttcgacgtgctaaaggtaacaccggaggaatatgccggccagattacacttatggatgtcccagtttttaaagctattcaacccgatgagctctcgagctgcggatggaacaaaaaagagaagtactccagcgcacctaacgctgttgccttcacacgtaggttcaaccatgtgagtttctgggtggtgcgagaaattttacacgcacaaacgctgaagatccgggcagaggtgctcagccactatatcaaaacggcgaaaaaactatacgagttaaataacctgcacgctctgatggctgttgtatctggcctgcagagtgcaccgatcttccggctgaccaagacatgggctctcctgagcaggaaggataaaaccacattcgaaaagcttgagtacgtgatgagtaaagaggacaactataaaaggcttagagattatatttcctccttgaaaatgaccccctgtatcccctacctgggtatatacttgtctgatctcacgtatatcgacagcgcctacccgagtaccggcagtattcttgagaacgagcagaggtccaatctgatgaataacattctgaggatcatctctgacttacagcagagctgcgagtacgatattcccatgcttccacacgtccagaagtacctgaattctgtccagtatattgaggagctgcagaaattcgtggaggacgacaactataagctgtccctgaaaatcgagcccggaaccagtacaccgaggtcagccgcctccagagaggatctggtcggccctgaagttggcgctagcccgcagagcggcaggaaaagcgtggctgcagagggtgccctgctaccccagacaccaccttcacccaggaatttgatcccacacggccatcggaaatgtcattcattaggctataatttcatccacaagatgaatacagccgagttcaagtccgctacattcccaaacgcaggcccccgacatttgcttgacgattctgtgatggagccacacgcccccagtcggggtcaggccgaatcctccaccctttcctcaggcatcagtataggcagcagcgatggaagtgaacttagtgaagagacttcttggcctgcctttgagagaaacaggctctatcatagtctgggtcccgtgacacgggtggcccgaaatggctaccgctcccacatgaaagcaagttcctcggccgagagcgaggatctcgccgtgcatctctaccctggagccgtgacgattcagggggtgctgagacgcaaaaccctgttgaaggagggcaaaaagcccacggtggcttcttggacaaaatactgggctgccctgtgcggcactcagctcttttattacgcagctaagtctctgaaagctaccgagcgtaagcacttcaaatcgacgagcaacaaaaacgtcagcgttatcgggtggatggtgatgatggctgacgatcccgaacatcctgacctattcctgttaacagacagcgagaaaggcaacagctataagttccaggccggaaaccgtatgaacgcaatgttatggttcaaacaccttagtgcagcttgccagagcaacaagcagcaggtcccaacaaacctcatgactttcgagtag

SEQ ID NO: 29382 - DNA, 699 bp, Artificial Sequence
  Description of Artificial Sequence: Synthetic coding sequence
atgaacaccgccgagttcaagagcgccacatttcctaacgccgggcctcgacaccttctcgacgacagtgtgatggagcctcacgcacccagtagaggccaagctgagagctctacactctcctcaggtatctccattggatcttcagacggctccgaattaagcgaagagacctcctggcccgcttttgaaaggaataggctttaccatagcctgggaccagtcacccgagtagcgcggaatggatacagatcccatatgaaggcatcatcaagtgccgagtcagaggatctggctgtccacctctatcctggagctgtgacaatacaaggcgttcttcgccgtaaaaccctgctcaaggaaggaaaaaagcctactgtggccagttggaccaaatactgggcagcactttgcgggacccagctgttttactatgcagccaaatccctaaaggcgaccgagcgaaagcacttcaaatccacatctaacaagaatgtcagtgttattggctggatggtaatgatggcagatgaccccgaacatcctgatctttttttgctaaccgacagcgaaaaagggaactcgtacaagtttcaagcgggaaacaggatgaatgccatgctatggttcaagcacctgtccgcggcctgtcaaagtaacaagcagcaggtgcctaccaatcttatgacatttgagtag

SEQ ID NO: 29383 - DNA, 2388 bp, Artificial Sequence
  Description of Artificial Sequence: Synthetic coding sequence
atggagggattgactcttagtgatgccgaacagaagtactactccgatctattctcttactgcgacatcgagagcacaaaaaaggtggtggttaatgggcgggtgttagaactgttcagggccgcacagctgcctaatgacgttgtgttgcagattatggaactgtgcggagccacccgtctgggctattttggcagatcacaattttatattgcactcaaacttgttgctgtggcccagtccggattccccttgcgggtcgaatcgatcaatactgtgaaggaccttccattacctagattcgttgcttcaaagaacgaacaggagagcaggcacgccgcctcttactcttcagactctgaaaatcaagggagttactcaggcgtgatccccccaccgccaggccggggccaagtgaaaaaaggctcggtgtcacatgacactgtgcagcctcggacttctgcagacgcccaggagcctgcgtcacccgtggtgagccctcaacagagcccccctacttccccccatacatggcggaaacacagccgacacccttccggcggcaacagcgagaggccgcttgctgggcccggtcccttttggagtccttttggcgaggctcagagcggatcgtctgcaggagacgctgtatggtcagggcattccccgcctccgcctcaagagaactgggtgagctttgccgacaccccacctacttccacattactaactatgcaccctgcctccgttcaggatcagacaactgtccgcacagtggcaagtgctactacggccatcgagatacgcagacagtcgtcctcatatgatgacccctggaaaattaccgatgagcaacgacaatattacgttaaccagtttaagacaatccagcctgatctcaatggatttattccagggagtgcggctaaagaattctttacgaaatctaagttgcctattctagaacttagtcatatctgggagttgagcgacttcgacaaggatggagcccttaccctcgacgagttttgtgcagcctttcatctggtcgttgctagaaaaaatggttatgatttacccgagaagctgcctgaaagtcttatgcctaagctgattgacctggaggactcagctgatgtgggagatcagcctggggaagtgggctacagtggctctcctgcagaagcgccaccttccaaatccccttccatgcccagcctaaatcagacctggcccgagctgaaccagtcgtcagagcagtgggagacatttagcgaacgctctagttcttcacaaactttgacgcagttcgacagcaacatcgctccagctgaccccgatacagccatcgtgcatccagtaccgattcggatgaccccctcaaaaattcatatgcaggagatggagttgaaacgcaccgggtcagaccatacaaatccaacctctccccttctggtgaagccatctgacctcttggaggaaaacaaaatcaactcctcagtcaagtttgcgagcggcaatactgtcgatggctactcctcctccgacagctttactagcgacccagagcagatcggcagcaatgtgaccagacagaggagccactccggaacctccccagataataccgcccctccccctccaccccccaggccccaaccttctcactctcggagtagctcacttgacatgaatcgtacatttacagttaccaccggccagcagcaagccggcgttgttgctcatccccctgccgttccccctcggcctcaaccatcccaggctcccggcccagcagtgcataggcccgtggacgccgatggactcataacacacacttcaactagcccccagcaaatccctgagcaacctaattttgccgatttctctcaatttgaagtctttgccgctagtaacgttaacgatgagcaagatgacgaagccgagaaacatcctgaggtgttgcctgccgagaaagcaagtgatcccgccagttctttgagggtggccaaaaccgactccaaaaccgaggagaagaccgcagctagtgcacccgcaaacgtttcgaaaggcaccacacctttggcgccccctcccaagccagtgaggcgaaggcttaagtccgaagacgagcttcgcccagaagttgatgaacacactcagaaaacaggggttctcgccgcagttctcgcttcacagccttccatcccccggagcgtgggaaaggacaagaaggccattcaggcgtcaattcgccgaaataaggaaaccaatactgtcttggcccgtctgaatagcgaactgcagcaacagctcaaggacgtactggaggaacgcatcagcctggaagttcagctcgagcagttgagaccattcagccacctgtag

SEQ ID NO: 29384 - DNA, 2310 bp, Artificial Sequence
  Description of Artificial Sequence: Synthetic coding sequence
atggaaggactcaccttaagcgatgctgagcagaagtattattccgatctgttttcgtactgtgatattgagagcaccaagaaggtggttgtcaatggccgggttctggagctctttcgtgctgctcagctgcccaacgatgtggtgctgcagatcatggagttatgtggcgctacgcggttagggtactttggccggtcacagttctatatcgcactgaagttggtcgccgttgctcagtccggcttcccactacgtgtagagtctatcaacacagttaaagatctgccactgcccagatttgtggcatctaaaaacgaacaggagagtaggcacgcggcgagctattctagtgactccgagaatcaggggtcttacagcggtgtgatccctccacctcctggcaggggtcaagtgaagaaaggctccgtttcccacgatactgtccaaccaaggacaagcgcagacgcgcaagaaccagccagccctgtggtgtcaccgcaacagagcccacccacatcaccccacacctggcggaaacacagtcggcacccaagcggcggcaactcggagcggcctttagcaggtccgggaccgttctggtctccgtttggggaggcccagtctgggtcttcagccggcgacgctgtctggtctggccacagtccccctcccccacaggagaactgggtgtccttcgccgacaccccccctacctccaccctactcactatgcacccagcttctgtgcaggatcagaccaccgtcaggaccgtggcgagcgcaactaccgcaatcgaaatccgaaggcagagttctagctatgacgacccgtggaagattacagatgagcagaggcaatactatgttaatcagtttaaaacgattcagcctgatctgaacgggtttataccgggctcagccgcaaaagagttctttacaaaaagcaagcttcccatacttgagttgtcccatatctgggagctcagtgacttcgacaaggacggcgccctcacactagacgagttttgtgccgctttccatctggtggtggcgagaaaaaatgggtatgacttgccggagaaattaccagagtctcttatgcccaaattgattgatctggaggatagtgcagacgtcggcgaccagcctggtgaagtcggctattcgggcagtcctgcggaggcccccccctctaagtcgccttccatgccatcattgaaccagacatggcccgagttgaatcaatcctctgaggacaccgcaattgtccatcctgttcctatcaggatgacacccagcaagatccatatgcaggaaatggagctgaagcgaacggggtctgatcacactaacccgaccagtccgcttctggtgaagccctcggatttgctggaggagaataagatcaacagtagcgtgaagtttgcctctggaaataccgtggctgacggttattcttcgtctgactcctttacgtcggacccggagcaaatcggatccaacgttacccgacaacgaagccacagcggtacctctcccgacaacacggcccctcctcccccaccgcccaggccacagccatcccactccagatcttcctctttggacatgaataggacattcacagttacaacggggcagcagcaggccggagtagttgcccacccccccgcggtcccccctaggccccagccgtcgcaagcacctggccctgctgttcataggccagtggacgccgacggcctcattacccatacctctacctccccacaacagatccctgagcagcccaacttcgccgacttctctcaatttgaagtgttcgccgctagcaatgttaacgatgagcaagatgacgaagcagaaaagcatccagaagttctgcccgctgagaaagcgagtgaccctgccagcagtctccgggtggcaaaaaccgactcaaagacggaggagaaaaccgctgcgagtgctccggccaacgtgagcaagggcaccacgcccttggcccctccacctaaacccgtgagacgcaggctgaaatccgaagacgagctgaggccagaagtagacgaacacacccagaaaaccggagtgttggcagccgttcttgcctcccagccttctatcccgcggtccgtcggcaaagataaaaaggcaattcaggcctctatccgccgcaataaggagacaaacacagtgctggctaggttgaacagcgaactccaacagcagctcaaggatgtcctggaggagagaatcagccttgaggtgcagctggaacaactcaggcccttttcacatttgtag

SEQ ID NO: 29385 - DNA, 2235 bp, Artificial Sequence
  Description of Artificial Sequence: Synthetic coding sequence
atggaattgtgcggggccacccgactaggctatttcggaagaagccagttctatatcgcacttaaattggtggctgttgcccagtccggattccccctgagagtggaaagcataaatactgttaaggaccttcctctgccccggttcgtcgctagtaagaacgaacaggagtcccgtcacgcagcttcatacagctccgatagtgagaatcagggatcatatagcggcgttatccctcccccccctggtaggggccaagtgaagaagggttctgtgagtcacgacacagtccagccacgcacatcagccgatgcgcaggagccggctagcccagtcgtgtctccccagcagagcccccctacatcccctcacacctggcggaaacacagcagacatccctcaggcgggaatagtgagaggcccctggctgggccgggtcctttttggtctcccttcggcgaggctcagagtggttcgtctgccggggacgcagtctggtccggtcattcaccaccccctccacaggaaaactgggtctcctttgcagacacaccgccaacctctacacttctgacgatgcaccctgcgagcgttcaagaccagaccactgtacgtacagttgcatcagcgacgacagcgatcgagattcgacggcagagtagttcctatgacgacccctggaaaattacagatgagcagcgtcagtattatgtcaaccaatttaaaacaatacagcccgacctgaacggattcatccctggatcagccgcaaaagagttcttcacaaaatctaagctccctatcttggaactgtcccacatctgggagttgagtgattttgataaggatggggcccttacactcgatgagttctgtgctgcgtttcatttggtggttgctcggaaaaatggctacgatttgccagaaaagctgcctgaatctctcatgcccaagttgatcgatctggaggactctgccgatgtgggggatcagcccggggaggtcggctactccggatctccggccgaggcacctccatctaaatcaccttccatgccctctttgaatcagacatggccggagctgaaccagtctagcgaacagtgggagaccttttctgagcggtcctcatcatcacagacccttactcagttcgattcaaacattgccccagccgacccagacaccgccatcgtgcacccagtacccattaggatgaccccatcaaagattcacatgcaggagatggaactgaagcgcactggtagcgaccatacgaatcctaccagcccactcctcgtcaaaccaagcgatctgctcgaggagaataagataaattcatccgtcaaattcgcatctggtaatacggttgccgatggctactcaagttctgattcatttacatccgaccctgagcagattggatctaacgtgactcgccaacggtcacatagcggaacaagcccagacaacactgcgcccccacctccgccaccaagaccccagcctagccatagtaggtcgagctctctcgacatgaaccggaccttcacagtgacaactggacagcagcaggccggagtggttgcgcacccccctgccgtgcctccaagaccccaaccttcgcaggcccccgggcctgcagttcatcgtcctgtggacgcagacggactgatcacacatactagtacctcaccacagcagataccagaacagcccaactttgccgacttctctcagttcgaggtatttgccgcatcaaatgttaatgatgagcaggatgacgaagcagagaagcacccagaggttctgcctgcggagaaggcaagcgacccagcgtcctccctgagggtggccaagaccgattctaaaacagaggagaaaaccgccgcatccgccccagctaacgtaagcaagggcactactcccctggctcctccccccaagcccgttagacgtagacttaaatctgaagacgagctacggcctgaggtggacgaacacacccaaaagacaggagtgctggcagctgtactggcctcccaacccagcatccccagatccgtcggcaaagataagaaggccattcaggcctccattcgcagaaataaagaaactaatactgttctcgctaggctcaattcagagctgcagcaacagttgaaggatgtccttgaggagcggattagcctcgaagttcaactcgagcagctcagaccgtttagccacctgtag

SEQ ID NO: 29386 - DNA, 2118 bp, Artificial Sequence
  Description of Artificial Sequence: Synthetic coding sequence
atggaagggctgactctttctgacgctgagcagaaatattactccgaccttttcagctattgtgacatcgagtccactaagaaagtggtggtgaatgggagggtcctggagctcttccgggccgcccagttgccaaatgatgtcgtgttgcaaatcatggagctgtgtggggccacacgcctcgggtattttggccggagccaattttacatcgctctaaaattggtggctgtcgcgcagagcggctttcctctccgggttgagtccattaacacagtcaaagatttgcctttgccacgctttgtcgcctctaaaaacgagcaagagtcaagacatgccgccagctacagcagtgactctgagaaccaaggctcctattctggggtgattccacccccccctggacgtggacaggtaaaaaagggcagtgtttcacacgacaccgttcagcctcggaccagtgccgacgcccaggagcccgcttctcctgtggtgtcccctcagcaaagccctcctacatctccccacacctggcgaaaacactcaaggcatcctagcggaggcaatagcgaacgacctctcgctggccccggacccttttggagcccttttggcgaagcacaaagcggttctagcgccggtgacgctgtttggagcggccattctccacctcccccgcaggagaattgggtctctttcgctgataccccccccactagtaccctgttaaccatgcatccagccagcgttcaggatcaaacaacagtgcgtaccgtagctagcgcaactacagccattgaaatcagaaggcagtctagcagctacgatgacccatggaagattacagacgaacaaaggcaatattacgttaaccaatttaaaaccatccagccagatctaaacggattcatccctgggtccgcagccaaagaattcttcaccaagtctaaactgccaatcctagaactcagtcacatatgggaactgagtgatttcgataaggacggagccctgacactcgacgagttctgtgcggctttccatctggtggtggccagaaaaaacggatatgatctaccagagaagctccctgagtctctgatgccaaaactgatcgacttggaggattccgctgacgttggtgatcagccgggagaggtgggatacagtgggtcacccgccgaagcccccccctccaagagtccatccatgccgagcctcaatcagacttggcccgagctcaatcagagctctgaggatacggcaattgtgcatcccgtcccaatccgtatgaccccaagtaaaattcacatgcaggagatggaacttaagaggaccggtagcgaccacaccaaccccaccagtcctctgctcgtaaagcccagcgatctgctggaagagaacaagatcaatagctccgtgaagttcgccagcgggaacactgtaggacagcagcaggctggagttgtagctcaccctccagccgtgccaccccggcctcagcccagtcaggcccccggccccgctgtccacaggccggtagacgctgacggattgataactcacacatcaacatcgccacaacagatccctgagcagccgaacttcgcagacttttctcaatttgaggtcttcgcagcctcaaatgtaaacgacgagcaggacgacgaggctgaaaagcaccctgaagtcctgcctgccgaaaaagcaagtgaccccgcaagtagtctgagggtggctaaaactgactccaagaccgaggagaagaccgctgcgtcggcgccagccaacgtcagcaaaggtaccacgccactggccccgcctccgaagccagttcgccgccggttgaagtctgaagatgaactccgcccggaggtggacgaacacacacagaagacaggggtactggcagctgtcctcgcaagtcagccaagtatccctaggtccgtcggcaaggataagaaagcgattcaggcttccattcgccgaaacaaggagaccaacacagtccttgcacgcttaaactcagaacttcaacagcagcttaaagacgtgttggaagagcggatctccttagaggtgcagttagagcagctccgtccattcagccacttgtag

SEQ ID NO: 29387 - DNA, 2391 bp, Artificial Sequence
  Description of Artificial Sequence: Synthetic coding sequence
atggagggtctcacccttagcgacgccgagcaaaagtactacagcgatttgtttagctactgcgacatcgaatctactaaaaaggttgtcgtgaatggacgcgttcttgagctcttccgagctgcacaactcccaaacgatgttgttcttcaaatcatggaactgtgtggggcaacccgtctgggttacttcggcagaagccaattttatattgctctgaagctggttgccgtcgcacagagcgggttcccgttaagggttgagtccatcaacacagtaaaggatctcccgctgccgagatttgtggccagcaagaacgaacaagagtctcggcacgcagcctcctacagcagcgactcagagaaccagggatcctatagcggagtaattcctcctcccccaggacgaggccaggtcaaaaagggaagcgtgtcccatgacaccgtccagccccgcacttccgcagatgctcaggaaccagcttctcctgttgtctccccacagcagtctccgccaacttcaccacatacctggcgcaaacacagtaggcatccttctggcgggaacagcgaaagaccactggctggccccgggcctttttggtctcccttcggcgaggcacaatctggcagcagcgctggcgacgcggtgtggtcagggcatagcccccccccaccccaggagaattgggtctcatttgctgataccccaccaacctccacattgctgaccatgcatcccgcttctgtccaggatcagacaaccgtgcgcacagtggcatccgccactaccgcgatcgagatccgccgtcaaagcagctcctacgacgacccctggaagataacagacgaacagcgccaatactacgtgaaccagttcaagacaatccagccagatctgaatggctttattccaggatccgcagcaaaagagtttttcactaagtcaaaactgcctatactcgagctctctcacatctgggaactaagcgatttcgacaaggacggcgctctaaccctggacgaattttgcgcagccttccatttggtggttgcccgcaaaaacggatacgacctgccagagaaactaccagagagcctgatgcccaaactcatcgatctggaagactccgccgatgtgggggaccaacccggggaggtagggtactcaggctcccccgctgaagcgccaccctccaaatccccatccatgcctagcctcaatcagacctggcccgagctcaatcagtccagcgaacagtgggaaacgttttctgagagaagttcgtcatcccagacgctgacccaattcgatagcaacatcgcacctgctgaccctgacaccgccattgtccatcccgtgccaattagaatgactccgagcaaaattcatatgcaggagatggagctgaagaggactggcagcgaccacacaaacccaacctccccactgctggtgaaaccctccgacctcttggaagagaacaaaataaacagcagtgtaaagtttgcttcaggcaacacagtggctgacgggtacagtagcagtgattcgttcactagcgatcccgagcagatcgggagcaatgtcactaggcaacggtctcatagtggaacttcccccgataatactgcaccacccccccccccgccccgcccgcagccctctcactctagatcctccagcctggatatgaaccgcacattcaccgtgaccacaggacagcagcaagctggcgtcgtggctcatcctcctgccgtgccaccccgcccacagccatctcaagcccccggccccgcagtccacagacctgtggacgctgacgggttgattacgcatacctccacctccccccagcagatcccagaacaacccaatttcgccgatttcagccagttcgaggtgtttgcagcatccaacgtcaatgacgagcaggacgatgaggccgaaaaacaccccgaagtgttgcctgctgaaaaggctagtgatcccgcctcatcgttgcgggtcgcaaagacagacagtaaaacagaggagaagactgccgcatctgcccccgctaatgttagcaagggcaccactccactggcacccccccctaaaccggttcggcgccggctcaaatcagaggacgagctcaggcctgaagtcgacgagcacacccagaaaacaggcgtgcttgccgccgtcctcgcatcgcagccctctatccctcgatcagtagggaaagataagaaagccattcaggcttccatcagacgcaataaagagactaacaccgtactcgcaaggttgaactcagaattgcagcagcagttgaaggatgtgctggaggagcggatctcactagaggtgcagctggagcagctacgccctttcagccacttgtag

SEQ ID NO: 29388 - DNA, 441 bp, Artificial Sequence
  Description of Artificial Sequence: Synthetic coding sequence
gaacttaatcagagctctgagtgggaaactttttctgagagatctagttcatcacagacactcacccagttcgattctaacatcgcaccggctgatcccgacacagctatcgtgcatcccgttcccataaggatgacaccatcgaagatacacatgcaggaaatggagctaaaaagaacagggagtgatcacacgaacccaacttccccactcctcgttaagccgagtgatctactggaggagaataaaattaactcatctgttaagtttgcgagtggcaatactgtggggcaacagcaggccggggtagtggcgcaccctccagcggtcccaccacgtcctcaaccttctcaggcacctgggcccgctgtacaccggcctgtcgacgccgacggattgatcacccatacatcaacctcccctcagcagataccggagtag

SEQ ID NO: 29389 - DNA, 1398 bp, Artificial Sequence
  Description of Artificial Sequence: Synthetic coding sequence
atgacaactattcctcgcaagggatcttcgcaccttccggggagcttgcatacttgtaaattgaaactgcaagaagatagacgccaacaggaaaagagcgtgattgcacagcctatctttgtattcgaaaaaggagagcagacctttaagcgccctgcggaagacacgctctacgaggcagctgagcccgagtgcaatgggttcccaacgaaaagggttcgttcaagctccttcacgtttcatattacagacagtcagtcccagggcgtccgcaagaataatgtgtttatgacgagcgctctcgtccaaagctcagtcgatatcaaatcagccgaacaaggaccggtgaaacactccaaacacgtgattcgccccgccatactacagctgccccaggcacggtcctgcgccaaggttcgaaagacgttcggtcacaaggccttagagtcctgcaaaacaaaggagaaaaccaacaataagataagcgagggaaacagctatctgctatccgagaatttaagcagggccaggatttccgtccagctgtcaacaaatcaagactttcttggagcaacctcggtgggatgccagcctaacgaagacaaatgctcttttaagagttgcagtagcaatttcgtgttcggcgaaaacatggttgagcgagtattaggaacccagaaattgactcagccacagctggaaaacgactcctacgccaaggagaaaccctttaagtctatccctaaatttcctgttaacttccttagctctcgcaccgactccatcaagaacacatcactgatcgagagcgcggcagccttctcttcacagccatctcgtaaatgccttctggaaaagatcgacgttataaccggggaagaaaccgaacacaatgtcctcaagattaactgcaagttattcatcttcaataagaccactcagagctggatcgagcgggggcgcggtaccttaaggctgaacgacaccgcctccacggactgtgggacactgcagtcccggcttatcatgcggaaccaagggtctctgcggctgattctcaatagcaaactttgggctcagatgaagatccagcgcgccaaccacaagaacgtcagaatcactgcaaccgacctggaagattacagcatcaagatttttttaatacaggcatctgcccaagacacagcatatttgtacgccgccattcatcatcgcttggtcgcccttcagagctttaacaaacagcgagacgtgaatcaggcagagtccctaagtgagactgcccagcagctcaattgcgagtcctgtgacgagaacgaagatgacttcatccaggtgacaaagaacggctcagacccttcgtcctggactcatcgccagagtgtggcatgtagttag

SEQ ID NO: 29390 - DNA, 327 bp, Artificial Sequence
  Description of Artificial Sequence: Synthetic coding sequence
atgactacaataccacgtaagggtagtagtcatctgcccggctctctccacacatgtaagctgaaacttcaggaggataggcggcagcaggagaaatccgtgatagctcagccaatatttgtgttcgaaaagggggagcagacctttaaaaggcccgcagaggatactctgtacgaggccgccgaacccgagtgcaatggttttccaactaagagggttcggtcttcctccttcacattccatattaccgatagccaatcccaaggggtcaggaaaaacaatgtgtttatgacctctgcattagttcaaagctccgtggacatctag

SEQ ID NO: 29391 - DNA, 1473 bp, Artificial Sequence
  Description of Artificial Sequence: Synthetic coding sequence
atgaccacgattccgcgcaagggctcgagtcacctgccaggtagcctgcacacatgtaagctgaaactacaggaggatcgaaggcagcaggagaaatccgtgatagcccagcctatttttgttttcgagaagggagaacagacgttcaaaaggcccgctgaagacacgctatatgaggcagctgagccagagtgtaatggctttcccactaaaagggtgcggtccagcagcttcacttttcacatcaccgattcacagagccagggagtatctaccttgtctcaaaagcagatgcgatgctctagtgtgactaatttgcccacctttccacattctggacctgtgcgtaagaacaatgttttcatgaccagcgcccttgtgcaatcgtcagttgatattaaaagcgcagaacaggggcctgtaaaacacagtaaacatgtgatccggccagcgattttacaattaccacaggcacgctcttgcgcaaaggtgaggaagacctttggacacaaagccttggaatcctgcaagacaaaggagaagaccaacaacaagatctcagagggtaatagttatctcctgtcagaaaacctttcgagagccagaatttctgtgcaactgagcactaatcaggactttctaggagctacttctgtcgggtgccaaccaaacgaggataagtgttccttcaaatcctgtagttctaacttcgtattcggtgagaatatggtggagagggttttgggaacacaaaagctgacacagccccagctggagaatgattcatatgccaaggagaaaccctttaaatctattcctaagtttcctgtgaactttctgtcctcgcggaccgatagtattaagaacacttcgctgatcgagtccgctgccgccttctcttcccagcccagtagaaaatgcttgctggagaaaattgatgtgatcacaggcgaggagacggaacacaacgtgctgaagatcaactgtaagcttttcatctttaataagaccactcagtcgtggatcgagcgcggcaggggaacactgcgcctgaacgacacagcttcgacagactgtggaactttacagagtaggcttatcatgaggaaccagggctccctgaggctgattctgaattcaaaactgtgggcacagatgaagatccagcgagccaaccataagaacgttaggatcacagcgaccgatctagaggattacagcatcaaaatcttcctcatccaggcctcagcccaggacacggcctatttgtacgccgcaatacatcacaggctggtggcattgcagtcctttaacaagcagcgggatgttaatcaggcagagagcctttctgagacagcccaacaactgaattgtgagtcctgcgacgagaacgaagatgattttatccaagtgacaaagaacggtagcgaccctagctcttggacccacaggcagtccgtggcatgctcctag

SEQ ID NO: 29392 - DNA, 4500 bp, Artificial Sequence
  Description of Artificial Sequence: Synthetic coding sequence
atgaagccgcttgctattccagccaaccatggagttatggggcaacaagaaaagcactccttgcccgccgattttacgaagctccacctgaccgacagcctgcacccgcaggttacccacgtgagctccagccatagcggctgttctattacatcagatagcggcagttctagtctctccgatatttatcaggcaaccgaatccgaagcaggcgatatggatttatcaggtctgccagagaccgctgtggacagcgaagacgacgacgacgaggaggacatcgaaagggccagcgatccattaatgtcacgggacatcgtgagggactgcctagaaaaggaccctatcgatcggacagacgatgacatcgaacaactgctagagttcatgcaccagttgcctgcatttgctaatatgacaatgtccgtgcggcgagagttgtgtgctgtgatggttttcgcggtggttgaacgggcagggacaattgtgttaaatgatggagaggagttggactcgtggagtgtgatcctcaacggttctgttgaggtcacgtaccccgatggcaaagctgaaattctgtgtatgggaaattcatttggagttagtccaacgatggacaaggagtacatgaaaggcgtcatgcgcaccaaggtggatgactgccaattcgtgtgcattgcgcagcaggattattgtagaatcctaaaccaggtcgagaagaatatgcagaaggtagaagaggagggagagatcgttatggtgaaggaacatagggagttggaccgaactggtacacgaaaggggcacatcgttataaaagggacaagcgagcgcttgacgatgcatctggtagaagaacactcggtcgtcgaccccaccttcatagaggacttcctactgacatatcggaccttcctgtcctcgcccatggaagtaggaaagaagctactggagtggtttaatgatccgtccctgcgcgacaaagtgaccagagtcgtgttactgtgggtgaacaatcacttcaacgatttcgagggggatcctgccatgactagattcctggaagaatttgaaaataacctcgaacgagagaagatgggtggccacctgcgcctgctgaacattgcatgcgctgccaaggcgaagcgtcggctgatgactctcactaagcctagccgcgaggccccactgccttttatcctactgggtgggtccgagaaaggctttgggatttttgtggattcggtagactcagggtctaaagcaacggaggccggcctgaaacgtggggatcaaatcctggaagttaacggtcagaatttcgagaatattcaacttagtaaggctatggagatcctgagaaataacactcacctgtcgataaccgtgaaaactaacctcttcgtcttcaaagagcttctgacaagattgtcggaagagaaacggaatggcgcccctcacctgcctaaaataggggacattaaaaaagcttcccggtacagtattccggaccttgctgtcgacgttgaacaagtcatcggattagagaaggttaataaaaagtcgaaagctaacactgtcgggggccggaacaagctcaaaaagatcttggataagaccagaatcagtatacttccgcagaaaccctacaacgacatcggcataggacagtcacaagacgatagcattgtggggttaaggcaaacaaaacacataccaactgcccttccagttagcggcacattgtcatcctctaatcccgatctcctgcagagccaccacaggattctagacttcagcgcaacacctgatctgcccgatcaagtgttgagagtgttcaaggccgatcagcagtcaagatacatcatgatttccaaagataccaccgcaaaagaggtggtgatacaggctattagagagttcgctgttaccgcaacccctgaccagtatagcctctgcgaggtatcagtcactcccgagggcgtcattaaacagaggaggctgccggatcaactgtctaagcttgcagatagaatacagctgtctggccgttattacctcaagaataacatggagaccgagacattatgctctgacgaggatgctcaggaattgctgagggaatctcagatcagtttgctccagcttagcactgtggaagtggccacccagttaagcatgcgaaatttcgaactgtttagaaacatcgaacccactgaatatatcgatgacctgtttaaactgcgtagtaagacgtcatgtgccaacctgaagaggtttgaagaggtgatcaatcaggagacgttttgggtggcctcagagattctgcgggagactaatcagcttaagagaatgaaaatcatcaaacacttcatcaagatcgcgttgcactgtcgagagtgcaagaactttaattcaatgttcgcaatcatctccggtctcaatctcgctccagtggctaggctgcgaacaacctgggaaaaattgcccaacaagtatgaaaagctctttcaagatcttcaggatctgtttgacccatcccgcaacatggctaaataccggaatgttctcaattctcagaatttgcagccgccaataatccccctgttccccgtgatcaaaaaggatctgactttcttacacgagggtaatgactctaaagtcgatgggttggtaaactttgagaaactcagaatgattgcaaaagagataaggcacgtcggccgcatggcatccgtgaacatggacccggcacttatgttccgaacaaggaaaaagaagtggcgaagcctcggaagtctgtctcaggggagcactaatgccacagtgctggatgttgcccagactggcgggcataaaaagagggtaaggcgcagctctttcctgaatgctaagaagctgtatgaagatgcacagatggcccgaaaggtaaagcaatacctctcaaatctcgaactggagatggacgaagagagtctccaaaccctatccctgcaatgtgagccagccacaaataccctacccaagaacccgggggacaaaaaaccggttaaaagcgaaacaagtcctgtggcaccccgtgctggaagtcagcaaaaggcgcagagcttgccacagccccaacagcaaccccctccagctcataaaatcaatcaggggcttcaagtccccgcggtgtcactgtacccgtccagaaaaaaggttcctgttaaggacctcccaccttttgggatcaatagccctcaggccctaaaaaaaatcttgtccctctcagaggaagggtccctcgagaggcataaaaagcaggccgaggatacaatttcgaacgccagtagtcagctgagcagccccccaacaagtcctcagagttccccacgtaaaggctatactctggctccttccggtacagtggataattttagtgattcaggccacagcgaaatctccagccgcagctccattgtctctaattcctcatttgactcggttcccgtatccctgcacgacgagcgtcggcagagacactctgtgagcatcgtggagacaaatttgggaatgggtagaatggagcgtcgcactatgattgagcctgatcagtatagtttggggagttatgctccaatgtccgaggggcgaggtctatacgctaccgccacagtcatcagtagtccttccaccgaggagctgtcccaagatcaaggcgaccgcgcttctcttgatgccgcggattcagggcgtggtagttggacgtcctgttctagcggttctcacgataacatccaaacaatccagcaccagcgttcgtgggagaccttaccgtttggacacactcatttcgattattccggggacccagctggactttgggccagctcctcccacatggaccaaatcatgttctctgaccactcaacgaaatataacaggcagaatcaatcgcgcgagtcactcgagcaggcccagtcacgagccagctgggccagttcaactggatactggggggaagactcggagggtgatactggcactataaaaaggcgcggcggaaaagacgtgagtatcgaggccgagtccagttctttgacgtccgtcaccactgaggagactaaacctgttcccatgccagcgcatatcgccgtggcttccagtactaccaagggattaatcgcacggaaagaggggagataccgcgagccaccgccaaccccaccagggtacatcggtattccgatcactgatttccctgagggccattctcaccctgcccgtaagcctcccgattataacgtggcactgcagcgttctcgcatggtggctagaagctctgacacggcaggcccttccagcgtacagcagccgcacgggcacccaacgagttcacgtcccgtaaataagccgcagtggcataagcctaacgaatccgatccgagattggccccatatcaaagccagggcttttctactgaggaggacgaagatgaacaggtgtcagccgtctag

SEQ ID NO: 29393 - DNA, 2646 bp, Artificial Sequence
  Description of Artificial Sequence: Synthetic coding sequence
atggtactcaggaggatgcaccgccctcggtcctgctcatatcagctcctgcttgagcaccaacggccgtcatgcatacagggcttgagatggacccctctcactaacagtgaggagtcattagacttctcagagagcctggagcaagcatccaccgagagggttctgagggccggccggcaactacacaggcaccttctggccacctgccctaacctgattagggatagaaagtaccacctcaggctatataggcagtgctgtagtgggcgggaactggtagatggaattctggcactcggtcttggcgtgcattcacgcagtcaagtggtcggaatctgccaggtgttgttggacgaaggggctctgtgccatgtgaaacatgattgggccttccaggaccgagatgcccaattctatcgattccccggacctgagcccgagcccgtgcgcactcatgagatggaggaggagctggctgaagccgtcgccctcctctctcagcggggaccggatgccctcctcaccgttgccctacgtaaacctccaggccagagaaccgatgaggagttggacctgatattcgaagaactcctgcatattaaggcagtggcgcatctctcaaactcagttaagagggagcttgccgctgtcttactttttgagccgcactccaaagctggcacggtactatttagtcagggtgacaaaggaacaagttggtatatcatatggaagggatccgtcaatgtggtgactcacgggaaaggcctggtcacaaccctgcatgaaggggacgacttcggccagctggcactggtaaatgacgctccccgcgctgccactataatcctcagagaggataattgtcactttctgcgcgtcgacaagcaagattttaaccgtattattaaggacgttgaggccaagaccatgaggttagaggaacatggaaaggtggtgctggttcttgagcgggcttctcagggcgccggaccatctcgaccccccaccccaggacggaatcgctacactgtcatgtccggtaccccggaaaagatcctcgaactgcttctggaagcaatgggcccagactcaagcgctcatgatccgaccgaaacatttctgagcgactttctgctgacacatcgcgtgtttatgccaagtgcccaattgtgtgcggctctgctccatcactttcatgtggagcctgccggcgggtcagaacaagagcgatcgacatacgtttgtaacaagagacagcagatcctgcgtctcgtgtcacagtgggttgccctgtatggaagtatgctgcacacggatcccgtggctacgtccttcctgcagaagttgtcggatcttgtgggccgcgacactcgtctgtcaaacctgctgagagaacagtggcccgagcggagacggtgtcatcggcttgagaatggctgcggtaatgcgtcccctcagatgaaggcccgtaatctgcctgtctggctgccgaatcaggacgaaccactcccaggctcatcatgcgccatccaagtgggtgacaaggtcccttacgacatctgtcgtccggatcactccgtccttaccctccagctcccagtgaccgccagcgtgcgggaggtaatggctgcactcgcacaggaggatggctggaccaaggggcaggtcttggttaaagtgaattctgcaggcgatgctataggtcttcaacccgatgcgcgcggagtggctacttctctcggactgaacgaaagacttttcgtggttaacccgcaggaggtccacgagctcatcccccaccccgaccagctgggtcccaccgtcggaagtgccgaaggacttgacctggtgtctgcgaaggacctggcgggccagctgactgaccacgattggtcgttatttaacagtatacatcaagttgagctgatccactatgttctgggtccacagcatttgcgggatgtcactacagccaatctagaacggttcatgcgacgctttaatgagctccagtactgggtcgccacggaactctgcctctgccccgtcccgggtccccgggctcaactgttgcggaagttcatcaagctggccgcgcatctgaaggagcagaagaacctgaactcgttttttgccgtcatgttcggcctgtcgaattcagctatcagtaggctggcccatacctgggagaggctccctcacaaagtgagaaagctctactcggctttagagcggttgctggacccttcttggaatcacagagtctatcgtttggctctggctaaactgagtccccctgtcattcctttcatgcccctcctcctgaaagatatgacttttatccacgagggcaatcataccctggtggaaaatctgataaactttgagaaaatgcgaatgatggctagagcggctaggatgctgcatcactgccggagccacaaccctgttccactaagcccccttcgcagcagagtctcccatcttcatgaagactctcaggttgcgcgaatatcaacctgtagcgagcagtctctgtccactagaagccccgcgtctacttgggcgtacgtccaacagcttaaggtcatagataatcaacgcgaactgtcccggctgtctcgagagctcgagccctag

SEQ ID NO: 29394 - DNA, 2646 bp, Artificial Sequence
  Description of Artificial Sequence: Synthetic coding sequence
atggtacttaggcgcatgcaccgaccaagaagttgcagctatcaactattattagagcaccagcgcccttcgtgtatccagggtctgcgatggacaccgctcacgaattccgaggaaagcctggacttttcagagagcctggaacaggcttctacagagcgagtattgagagctggaagacagctgcaccggcatctgctcgcaacctgcccaaatctcataagagaccgaaagtaccatctccgcctgtacagacagtgctgttccggtcgggagctagtggatgggatcctggcattgggtctcggcgtgcacagcagatcacaggttgttgggatctgccaggtgctgctggacgaaggggcactctgccatgtaaagcatgactgggcctttcaggaccgcgatgcacagttctatcggttcccgggccctgaacctgagcctgtgaggacgcatgagatggaggaagagttggctgaagccgttgcactactttcacagaggggtcctgacgctctgctgactgtcgccttgcgcaagccacctggccaaagaacagatgaagagctggatctcatattcgaggaactgttacacattaaagcggttgcacacctgagcaactcagtgaaacgggagttagccgcagtcttgctgttcgagccccactcgaaggcggggacggttctcttttcacagggcgacaaagggacttcctggtatattatatggaagggcagcgtgaatgttgtgactcatgggaaggggttagtgacaacattgcacgagggagacgattttggtcagttagcacttgtcaacgatgctcctcgggcagcaaccatcatccttcgtgaagacaattgccattttctccgggtggataaacaagattttaaccgcattatcaaggatgtcgaggccaaaaccatgcggctcgaggagcatggcaaggttgtgctcgttctcgagcgcgcctctcagggggccggtccttcgaggcctccaacacctgggaggaatcggtatacggtgatgtccggtaccccagaaaagatacttgagcttctgctggaggccatgggtccggattcttctgcccatgaccctacggaaacattcttatccgatttcttactgacccatcgcgtttttatgcctagtgcccagctgtgtgctgcactcttgcatcacttccacgtcgagccggcgggcggctccgaacaggagagatcaacatatgtttgcaataagcggcagcagatacttcggctggtctcgcagtgggtggctttatatggcagtatgcttcacactgacccagtcgcaacatcttttttgcagaaactgagcgatcttgtgggccgggacacacggctgtccaatctgctaagggaacagtggccagagaggcgacgctgccacaggttggagaatggttgcggaaacgcatcacctcagatgaaggcacggaacttacccgtctggttaccaaatcaagatgaaccattgccagggagcagttgcgctatccaggtgggagacaaggttccctatgatatttgcaggcccgaccactctgtcctcaccctgcaactgcccgtcacggcatcagtgcgggaagtcatggccgccctggcccaggaagatgggtggacaaaaggacaggttcttgtgaaggtgaattctgccggagatgctatcggcttacagccagatgctcgtggggtcgctacaagcctgggactgaatgaaagacttttcgtggtgaacccacaagaggtacacgagctcattccgcacccagaccagctaggccccactgtgggctcagctgaagggttggatctggttagcgctaaggacctcgccgggcagctcacggaccatgattggtccctgtttaattccattcaccaggtggaactcatccattatgtgctcggtccccagcacctgcgggacgtgaccaccgctaacctggagcggttcatgcgaaggtttaacgaattgcagtattgggttgctacagaattatgcctgtgtcctgtccctgggcccagggctcaactgctgcgaaaattcatcaagctggcggcacaccttaaagagcagaagaacctgaacagcttcttcgcggtcatgtttggattatcgaattcagcaatttccagactggcccatacgtgggaacgacttccacataaagtcagaaaactctactcagcactcgagcggctcctggatcccagctggaatcaccgggtgtacagactggcactggccaagctgagtccgcccgtgataccattcatgcccttgttactgaaagacatgactttcatacatgagggtaaccacactctggtcgaaaacctcataaatttcgaaaagatgcgaatgatggccagggcagcaaggatgctgcaccattgtagaagccacaaccctgtgcccctcagcccactgcgctcaagggtaagtcacctgcacgaagacagccaggtcgccaggatttctacatgctcagaacaatctttgagtacaaggtccccagccagcacttgggcctacgtccaacagctcaaagtcattgacaaccagagagagctttctagactttcgagggaactggagccttag

SEQ ID NO: 29395 - DNA, 2772 bp, Artificial Sequence
  Description of Artificial Sequence: Synthetic coding sequence
atgaaagttggctggccaggagagagctgctggcaggtcggtttagctgttgaggacagcccagcactcggagctccccgcgtaggggctttgcctgacgtggtgcctgaaggcactctcttgaacatggtgctgcgccgaatgcataggccacgctcctgtagctaccaactcctgttggaacatcagcgtcccagttgcatccagggactgaggtggacaccactgactaacagcgaagagagtctggacttctctgaaagcctggaacaagccagcactgaaagagttctgcgggccgggagacaactccatagacacttgctcgcaacgtgtcccaatcttatccgtgaccgaaaataccacctgcgtctgtacaggcagtgttgttccggtagggagttagtggatggcatcctcgcattgggactgggtgtgcatagcagatcacaggttgttggcatctgccaggtactgctcgatgaaggggctctgtgccatgtaaaacatgactgggctttccaggatagagacgcccagttttaccggtttcccggcccagagccggagccagttaggacccacgagatggaggaggaattagccgaagctgttgctctgttatctcagagagggcccgacgctctcctcacagtggctctccgcaaaccccctggccagagaacggacgaagaattggacctgatctttgaagagctgttgcacattaaagccgttgcccaccttagcaactccgtaaaaagagagctcgccgccgtgcttctcttcgagccacacagtaaagctggaacagtgctgttcagccaaggagacaaagggacgtcttggtacattatctggaaaggctccgtcaatgtcgttacacacggaaaggggctagtgacaaccctgcatgaaggtgatgacttcgggcaactggcattagttaatgatgcaccgcgcgccgcaactattatcctgagagaagataactgtcactttctccgggttgacaagcaggatttcaatcgcataataaaagacgtggaggctaaaacaatgaggttggaagagcacggcaaggttgtgctggttctggagagggcatcccagggcgctggtccttctcgcccccccactcctggccggaataggtataccgtgatgtctgggactcccgaaaagattctggaactcttgctggaggctatgggacctgactcgagtgcccacgacccaactgagaccttcctttccgattttttgcttacacatcgagtgttcatgcccagcgcccagctttgcgccgcattactccatcatttccatgttgagccagctggcgggtctgaacaggagcggagtacatacgtctgcaataaacgacagcagattttgcgcctggtgtctcaatgggtcgcgctgtatggaagcatgctgcatacggatcctgtcgccacctcctttcttcaaaagctgtccgatttagtgggcagagacacacggctcagcaacctactgagggagcagtggcctgaacgcaggcgctgtcacaggctggagaacggctgtggaaatgcatcccctcaaatgaaggcccgtaaccttcccgtttggttacccaatcaggatgaaccactccccgggtcttcctgcgcaattcaggtcggcgacaaggtgccctacgacatctgccggcctgatcactccgtgctgacgttgcaacttcctgtgactgcaagcgtcagagaagttatggctgcactcgcccaggaggacggctggactaaaggacaggttttggttaaagttaactcagcaggcgatgcgatcgggctccagcctgacgcccgaggcgtagccaccagcctgggccttaacgagcgcctgtttgtcgtgaatcctcaggaggtgcatgagctgatcccacacccggaccagctcggtccaactgttggaagtgcagaggggctggacctggtaagtgccaaagatctcgccggccagctgacagaccacgactggtccctgtttaactctattcaccaggtcgagctgatccactatgtattaggtccacagcatctgcgagacgtcacaaccgctaacttggagaggttcatgcgccgcttcaatgaattacaatattgggtcgctaccgaattatgtttgtgccctgtgcccggtcccagagctcaactgctcagaaagttcatcaagctggctgcccacctaaaggagcaaaagaatttaaactccttctttgccgttatgttcggcctgtctaatagcgccatttctaggctcgctcacacgtgggaacgactacctcacaaagtgcgcaagctctattccgctctcgagcgcctgctggaccccagctggaatcaccgagtgtaccgactcgccttggctaaactgtcaccacccgttattccctttatgcctcttctgcttaaggatatgacttttatccacgagggcaaccatacactggtcgagaatctgatcaacttcgagaaaatgcgcatgatggcaagagccgcgcgaatgctgcatcattgtaggagccataatcccgtccccctgtctccattaaggtctagagtgtcacacctccatgaggactctcaggtggcacgtatctctacttgtagtgaacagtccctgtctacccgttctcctgccagtacttgggcctacgtccagcagctgaaggtgattgataatcagagggagctcagcaggttatctcgggaattagagccctag

SEQ ID NO: 29396 - DNA, 1797 bp, Artificial Sequence
  Description of Artificial Sequence: Synthetic coding sequence
atgaaggtggggtggcctggcgagagttgctggcaggtagggctggctgttgaggatagtccagctctcggtgcccctagggtcggtgctttgcccgacgttgttcccgaaggtactctgctgaacatggtcctgagacgcatgcatcgcccacggtcttgtagctatcagcttctgctagaacaccagcgtcccagctgtatccaggggctccgctggactcctctgacaaactctgaggaatcactcgacttctccgagtccttagaacaggctagcacagaaagagttcttcgggctggacggcagctgcaccgccatctgttggccacatgccccaacctaattcgggatcgcaagtaccatctgaggctataccgacagtgctgctccgggcgagagctggttgatggcatcttggcgcttgggctgggcgtacatagccgcagccaggttgtgggtatttgtcaagtcctccttgacgaaggcgcgctgtgtcatgtgaagcacgattgggcttttcaggatcgcgacgcccaattttacagatttcccgggcctgagcctgagcccgtgcggacccatgaaatggaggaagagcttgctgaagccgttgccttgctgtcccaaagggggcctgatgcgctactaaccgttgcactgaggaagccacccggccaaaggactgacgaggagctcgacttgatctttgaggaacttctccacatcaaggccgtcgcccatctctccaactccgttaaacgcgagctagccgcagtgctgctgttcgagccccattccaaggctggcaccgtcttgttttcccagggagacaaaggcacttcctggtatatcatttggaaaggatctgtgaacgtggtgactcacggcaaagggctcgttactacacttcatgagggtgatgactttggccaactcgctttggtgaatgatgctccaagagcagcgactatcattctgcgcgaagataactgccattttctacgggtagacaagcaggacttcaatcgaatcataaaggacgttgaggccaagaccatgcggctggaggagcatggcaaagttgtcttggtgttggagcgcgcttcccagggcgcaggcccttcacgccccccaactccagggaggaatcggtataccgtgatgtccggtacacccgaaaaaatcctggagctgcttctggaagcgatgggtcctgattcctcggcgcacgatcctaccgagaccttcttgagtgattttctgctaacgcatcgggtgtttatgccgtctgcccagctgtgtgcagccctcctacaccattttcacgttgagcctgccggaggcagcgaacaggagagatccacttacgtttgcaataaaaggcagcaaatcctgagactggtttcacagtgggtggccttatatggatcgatgttacacactgatcccgtggcgacaagcttcctgcagaaactttcagacctggtaggacgggatacaaggctctctaatctgttacgtgaacagtggccggagaggagacgctgtcatcggctggagaatgggtgtggaaatgcctccccccagatgaaagtgtccgcctggccgcagttcctctctagcgcccccccagggctccaagcccctccttccccaccggatcctgaggggctgtgcggacgggggaagctcagtagtcatcgtcacactctcgggagtttgatcggcgtacacggagctttagctgcctgtggggccttaggacaggccgtgcctggaggagccgaggcatag

SEQ ID NO: 29397 - DNA, 2607 bp, Artificial Sequence
  Description of Artificial Sequence: Synthetic coding sequence
atggctcagcgggaggagatcaaacggccgttgtgggagactgtcggatggcccggtgagagttgctggcaggtgggtctcgctgtcgaggacagtccagccctgggggcaccaagggtaggtgctttgccagacgtggtgcctgaagggaccttgctgaatatggttttaagacgaatgcaccggcctcggtcctgttcatatcagcttctcctggaacaccagaggcccagctgtatccagggtcttagatggactcctcttaccaacagcgaggagtctttagatttctccgagagtctggagcaggcgtcgacagagagggttttacgtgccggtcggcagcttcatcgacatctgctggcaacctgccctaacttaattcgcgacagaaaatatcatttgagattgtacaggcagtgctgttccggtcgcgaattggtcgatggaatcctggccctcggcctcggtgtacactcgagatcccaggtagtgggcatttgtcaggttctgctggatgagggtgccctttgtcacgtgaagcatgattgggcctttcaggaccgagacgcccagttctatagatttcccggtcctgaaccagagcctgtacggacccatgagatggaagaggagctggccgaagctgtcgcattactgagccagcgtggtcccgatgccctgttaacagtcgcccttcgcaagccacctggccagcgtactgacgaggaactcgacctcatctttgaggaactgctgcacataaaggccgtggcccatttgtccaattccgtgaagcgcgagcttgccgcagtacttttgttcgaaccacatagcaaggccgggacggtcttgttttctcagggcgacaaagggacatcgtggtatatcatttggaagggatccgtgaacgttgtcacacacggcaaaggtctcgtgacgacactgcacgagggcgatgactttggacaactggcgctagttaacgacgctccccgcgcagccaccataatccttagagaggacaactgtcattttctaagggttgacaagcaggacttcaatcggattataaaagacgtggaggcaaaaacgatgaggctcgaagagcatggaaaagtcgtgctggttctggagagagccagtcaaggcgccggcccctcaagacctcccaccccggggcgtaaccgatacaccgtgatgagcgggactcccgaaaaaattctggagttattgttggaagcaatgggtccggatagttctgcccacgatcccacagaaaccttccttagcgacttcttgctcacgcacagagtgtttatgccatcagcccagctgtgtgccgcgctactccaccactttcatgttgaacccgctggcggatccgagcaggagaggagcacttatgtgtgtaacaagaggcaacagattcttaggttggtgtctcaatgggtggccctttatggctccatgctacacactgaccctgtagcaacgtcattcctccagaaattatcggatctggttggccgagatacccgactgtcaaatctgctgcgcgagcaatggccagaacgtcgacgatgtcacaggctggagaatggatgtgggaatgcctctccccaaatgaaggcacgaaatttacccgtgtggctccccaatcaggatgaaccattgcctggctccagttgcgccatacaggtgggtgataaagatgccattgggctccagcccgacgctcggggggtggcaacgtcactgggtctgaatgagcgtcttttcgtagtgaacccccaggaagtacacgaactcattccccatcctgatcagcttgggccaaccgtggggagcgccgaagggctggatctcgtgtcagcgaaggacctagcgggccagttgaccgatcatgattggtctctcttcaatagcattcaccaagtagagctaatacattatgtgctgggcccacagcacctacgcgatgtcaccacagccaacttagaacggtttatgagaagatttaatgagttacagtattgggtggcaaccgaactctgcctatgtcccgtgccggggcctcgggctcagctgctgaggaagttcatcaaacttgcggcacacaattctgctattagcagattggctcatacgtgggaacgcctacctcataaggtgcgaaagctctattccgccctcgagcgactacttgacccttcctggaatcacagagtgtacagactggccctggcaaagctgtccccccccgtgatccccttcatgcctcttcttctgaaggatatgaccttcatacatgagggaaatcacacattggtggagaacctgatcaacttcgagaagatgagaatgatggctcgcgctgcacggatgttgcatcactgccgctctcataacccagtcccgttatcgcccttgcgaagccgtgtctctcatttgcacgaggactcacaggttgctcggatctccacatgctctgaacagtccttaagtacacgcagcccagcctccacttgggcttacgtgcagcaactcaaggtgatcgataaccagcgggagctgagcagattgtcgcgagaactggagccctag

SEQ ID NO: 29398 - DNA, 2646 bp, Artificial Sequence
  Description of Artificial Sequence: Synthetic coding sequence
atggtactgagacgcatgcaccggccaaggtcctgcagttaccaactgctgctggagcaccagagaccaagttgcattcagggactaagatggacacctctaacaaatagcgaagaatccttggatttttccgaaagtctggaacaagccagcacggagcgagttctcagggctgggcggcagctgcacagacacttactggctacgtgccccaacttgatccgagaccgcaagtatcacctcagattgtacaggcaatgctgcagcgggcgcgaactggtggacggaatcctcgcactcggactaggtgtccattcacgctctcaagtcgtcggaatttgccaagttttgctggacgaaggcgcattatgtcatgtcaaacatgattgggcttttcaagacagggacgcccagttctaccgcttcccgggacctgagccagaacctgtgagaacccatgaaatggaagaagagctagctgaggcagtcgccctgctgtcccagcgcggaccagatgcccttcttacggttgctctgcgcaaaccacctggtcaaaggaccgatgaggaattggatctgatcttcgaagaactgctgcacattaaagcagtggcacatctgagcaattccgtgaaaagagaactggcggctgtgctcctctttgagccccattccaaggcgggcactgttcttttcagccagggagataaaggcacgtcatggtatatcatatggaaaggtagcgtgaatgtggtgactcacggcaaggggctcgtgactactctccacgaaggcgatgattttgggcaattggctctggtgaacgatgcacctcgcgcagccaccataatcctccgtgaggataattgtcacttcttgagggtggataaacaggattttaacagaataatcaaagatgtggaggccaaaacaatgagactagaggagcacggcaaggttgtactcgtgctggaaagggccagtcagggcgcaggaccgagcagacctccaaccccagggcgtaaccgctatactgtgatgagcggaactcctgagaagatactcgaattactgctcgaggctatgggtcccgattcttccgctcatgaccctacggaaactttcctctctgattttctgctcacacatagagtctttatgccaagtgcccagctgtgtgccgccctcctgcaccatttccatgtagaaccagctggcggatctgaacaagagcgaagtacgtacgtatgtaacaagcggcaacaaatcctccggcttgtttctcagtgggtggccctttacgggtctatgttacacaccgaccccgtcgctacctcattcctgcagaagctttcagaccttgtaggccgggatacaagattgagtaacctgctccgcgaacagtggcctgaaaggaggagatgccaccgactcgaaaatggttgtggcaacgcttctcctcagatgaaagctcgcaatttgcccgtgtggctgccgaaccaggatgagcccctaccaggtagttcctgcgccattcaggttggcgacaaggtgccttatgacatttgtaggccagatcacagcgtgctgacactgcagttacccgtgaccgctagtgtgcgggaggttatggccgctctggcccaggaggatggctggacaaaaggtcaggttttggtcaaagtcaactccgctggcgatgcgatcgggctgcaaccagatgcccggggagtggccacgtcccttggtttgaatgagcggttgtttgtagtgaatccccaagaggtgcatgagctgattcctcatcccgaccagctggggccaacagttgggtcagcagaagggttagaccttgtctctgctaaggatctggccgggcaattgacggaccacgactggtccctctttaacagcattcatcaggttgaactgatccattatgtgctaggcccccaacatttaagggatgttacaacagccaatctggagcggttcatgagaaggttcaacgagctgcaatattgggtagcgactgaactctgcttgtgcccagtgcccggacccagggcacagttgcttaggaaatttataaaacttgcagctcacctgaaagaacagaagaacctcaactcattcttcgccgttatgtttggcctctccaactctgccatttctaggttggcccacacctgggaacggttgcctcacaaagtcaggaaattatattccgctctcgagcgcctccttgacccatcctggaatcaccgcgtgtatagactggctctggccaaattgagccctccagtcataccatttatgcccctactgctcaaagatatgactttcattcacgagggcaaccacactctcgtggaaaatctcatcaatttcgagaaaatgcgcatgatggccagagccgcccgcatgctgcaccattgtcgctcccacaatcctgttcctcttagtcccctcaggagtcgggtcagtcaccttcacgaggactctcaggtagcccgcatcagcacttgctccgaacaatccttaagtacacgctcccctgcatctacctgggcttatgtgcagcagttgaaagtgattgataaccagagagagctctcacgcctgagcagagagttggagccctag

SEQ ID NO: 29399 - DNA, 2772 bp, Artificial Sequence
  Description of Artificial Sequence: Synthetic coding sequence
atgaaagtggggtggccaggtgaaagctgttggcaagtcggattagctgtggaggactcgccggctttaggggcaccacgcgttggcgctctcccagacgtagtgcctgagggcacccttctgaatatggttctccgtcgaatgcataggccccgaagctgctcgtatcaactgcttctagagcatcagcggcccagctgtatccagggtctgcggtggactcccctgacgaacagtgaagagagtctggatttcagcgagagcctggaacaggcaagcactgagcgcgttttgcgagccggccggcagctccaccgacaccttctggcaacctgccctaacctcattcgcgaccggaagtaccaccttagattgtaccgtcagtgttgtagtgggcgggagctcgttgatgggatcctggccctgggattaggcgtgcactcccgcagccaggtggtcggaatctgtcaggttcttttggatgaaggcgcattatgccacgtgaagcacgattgggcttttcaggatcgggacgcccagttctatagatttcccggacctgagccagagccagtccgcacccatgagatggaagaagagcttgctgaagccgtggcattactctcccagaggggacccgacgcactgctgactgtggctcttaggaaacccccaggacagcggactgatgaagaactggatctcattttcgaggaacttctgcacataaaggctgttgcccacctctccaacagcgtgaagcgcgaactggccgccgtgctccttttcgaaccacattcaaaggctggcacagtgctattttctcaaggggataagggcacatcttggtacatcatttggaagggaagcgtcaatgtggtgacacacgggaaaggtctggtcacaacattgcacgaaggagatgatttcggccagcttgcattggtcaacgacgcacctcgagcagcaactatcattttacgagaagacaactgtcacttcttacgggtagacaagcaggacttcaataggattatcaaagacgtggaagcaaaaactatgagacttgaagagcacggcaaagtggtgctggtgttagaaagggcctcgcagggtgctggtcccagccgacctcctacgcctggtaggaatcgatacacagtaatgtctgggactcccgagaaaattttggagttacttcttgaggctatggggccagactcttctgcacacgaccctacggagacattccttagtgactttctgctgacccatagggtctttatgccctctgctcaactctgcgccgcactgttgcatcacttccacgtggagcctgccggcggttcagagcaggagcggagcacctacgtctgcaacaaacggcagcaaatcctgcgcctcgttagtcaatgggtcgctctgtacgggagcatgctgcacacggaccccgtggcaacctctttcctgcaaaaactgtccgatctggtgggtcgcgatacacggttgtctaatctgttaagagaacagtggccggagagacggcggtgccaccgcttagagaacggatgcgggaacgcttcgccccagatgaaagcgcggaacctacctgtttggctacctaatcaagacgagccccttccagggagttcttgtgcaatccaggtgggcgataaggtgccttatgacatttgccgccctgatcactcagtcctgacactgcagctgccggtgaccgcatctgtgcgggaggtaatggctgccctggcacaggaagatggatggacaaagggtcaagtgctagtaaaggtgaattcagcaggcgatgctattggactccagccagacgcccgcggggtggccacctccctaggactgaatgaacggctgttcgttgtgaacccacaagaggttcacgaacttattccccaccccgatcagctggggcctacggtaggatccgcagaggggctagatctggtcagtgccaaagatctggccggccagttgacagaccatgactggtctctgtttaatagtatccatcaggtcgagcttattcattatgttttgggcccgcagcacctgagagatgtgacaactgctaatttggagaggtttatgagacgctttaatgaattacaatattgggtagctactgagttgtgcttatgcccagtcccagggccgagggcacaactcctccgaaaattcattaagctcgctgctcacctcaaagagcagaaaaatctcaattctttttttgccgtgatgtttggattgtctaatagtgctatctcccgactagcacatacatgggaaaggctgcctcataaagtgagaaagttgtacagcgctctggagcgcctgctagatcctagttggaaccatcgggtttacaggctggccttagccaaactgtcgcctccagttatccccttcatgcccctactgttgaaggatatgacctttatccacgagggcaaccataccctagtggaaaacctgatcaacttcgagaaaatgcgtatgatggcacgagccgctcggatgctccaccattgcaggtcacataacccagtgccactctccccacttagatcaagagtcagtcaccttcatgaggatagccaggtggctcggatttccacctgttcagagcagtcgctgagcacaagatcccccgccagcacctgggcatacgtgcaacagcttaaagtcatcgacaatcagagagaactatcacgcctgtcgcgggaactggagccctag

SEQ ID NO: 29400 - DNA, 672 bp, Artificial Sequence
  Description of Artificial Sequence: Synthetic coding sequence
atggtgttgcgacgcatgcaccgtccacggagctgttcttaccagctcctactggaacatcaacgaccctcctgtatacagggacttcgatggacacccctgaccaatagtgaagaaagcctcgatttctccgagtccctagaacaagcaagtacagaacgggttctcagggctggccgccagctgcatcgtcacctattggccacttgtcctaatttaatcagagacagaaagtaccatctgcgtctataccggcaatgctgctccggccgagagttagtcgatggtatcttggccctaggactgggagtacattcacgaagccaggtggtcggaatttgtcaggtgctgctggacgagggggcgctttgtcacgttaaacacgactgggcgtttcaggaccgggacgcccagttctaccggtttccagggcctgagcccgagccggtcagaacgcacgagatggaagaggagctggccgaggcagtggcactcctgtcccaacggggccctgatgctctactaacagtagccctgcgcaagccacccggacagaggacagacgaggaactcgacctgatcttcgaggaactactgcacatcaaagccgtagcccacctgagcaattccgtcaaacgggaactcgccgcggtccttctatttgaaccctag

SEQ ID NO: 29401 - DNA, 426 bp, Artificial Sequence
  Description of Artificial Sequence: Synthetic coding sequence
atggtgctccggaggatgcacagacctaggtcatgcagttaccagctcttgttggagcaccagagaccaagttgcatacaggggctgcgatggacccctctaactaacagcgaagagtctcttgattttagtgagagtctggagcaggcttccacagagagagttctgagggctggacggcaactgcaccggcacctgctcgccacatgccccaatctaatccgcgacagaaaatatcatctaagactgtatcgtcagtgttgctctggccgtgagctagtagacggaatcttagcgctggggctcggggttcactcaaggtcccaggtggtcgggatatgtcaagttctcctcgacgaaggcgccctttgccacgtaaaacatgactgggcatttcaggatagagacgctcagttctataggtag

SEQ ID NO: 29402 - DNA, 1713 bp, Artificial Sequence
  Description of Artificial Sequence: Synthetic coding sequence
atgcggctcgaggagcatggcaaggttgtgctggttctggagagggcttctcagggcgcaggcccttcacgtccacccacccctggccgcaaccgttatacagttatgagcggtacacccgagaagatcctagaactcctgctggaggccatgggccctgatagctccgctcacgaccccaccgagacattcttatctgacttcttgctgacacatcgagttttcatgcctagcgctcagctctgcgctgcccttctacaccatttccacgtggaaccagcgggcggctctgagcaggaaagaagcacctacgtttgcaataaacgacagcagatccttcgtctcgttagccagtgggtggcactctacgggtctatgctacatacagacccagttgccacctcgtttcttcagaaactgtctgacctggtcggcagggatacccggttgtccaatctgttgcgagaacagtggccagagcggcgtcggtgccaccgcttggagaacggctgcggaaatgccagcccccaaatgaaagcacgtaacttacccgtgtggttgcccaaccaggatgagcccttaccgggcagttcctgtgccatccaagttggagacaaagtcccatatgatatatgtagacccgaccatagtgtactaactcttcagcttcccgttaccgcaagcgtcagggaggtaatggcagccttggcacaggaggatggatggacaaagggacaagtattggtgaaagtcaattcagcaggggatgctatcgggcttcaacctgatgcgaggggcgtggccaccagcctaggcctgaacgaaagactgtttgtggtaaatcctcaagaggtacacgaactcatcccccaccctgatcagttggggccaacggttgggtccgcagagggattggacctcgtctccgccaaggacctggccggccagttaacagatcatgactggtccctcttcaacagcatccatcaagttgaactgatccactacgtcctgggcccacagcatcttagggatgttacgacagccaatctggaacgctttatgcggcgttttaatgagcttcagtattgggtggccaccgagctttgcctttgccccgtgccaggcccccgagcacagttactccggaaattcatcaaactggcggctcacctgaaggagcagaagaacttgaatagttttttcgccgtgatgtttggcctctctaattcagccatctcacggctggctcacacgtgggaacggctgccccataaagtccggaagctgtactccgcactcgagcggctcttggatccttcctggaaccatcgggtgtaccgactggcactggctaagctctctcctcctgtgatcccctttatgccacttttgctgaaggacatgacattcatccacgagggtaaccataccctagtcgagaacctgatcaacttcgaaaaaatgagaatgatggcacgcgccgcgaggatgctgcatcactgccggtcccacaaccctgtgcctctcagtcctttgcggagtagagtgtcacacctacacgaggattcgcaagttgctaggatcagtacatgctccgaacaatccctatctaccagatccccagcatcaacgtgggcatatgtccaacagctgaaggtaattgataaccaaagggagttgtcccgcctttccagggagcttgagccatag

SEQ ID NO: 29403 - DNA, 2646 bp, Artificial Sequence
  Description of Artificial Sequence: Synthetic coding sequence
atggtgctgcgccgcatgcatcgacccaggtcttgcagctaccagctgctgcttgagcaccagcgcccgagctgtatccagggactgaggtggactcctctcacaaacagcgaggaatctctcgacttcagtgagagtctggagcaggctagcacagagcgggtgctgcgcgcgggccgtcagctgcatcgtcatctccttgcgacatgccctaatttgattcgcgaccgtaaataccaccttcggctctaccgacagtgttgcagtggacgcgagcttgtggacggaatcttggctctagggctcggagtgcattcaaggtctcaggtcgtcggtatctgtcaggtactactggatgagggggccctgtgtcatgtcaaacacgattgggctttccaggatcgggatgcacagttctataggttccccggacctgaaccggaaccagtgaggacccatgaaatggaagaggaactcgctgaggccgttgcgctcctatctcagcgtgggcctgatgccctcctcacagtggccttgcggaaaccccctgggcagcgcaccgacgaggagctcgatctgatctttgaggagttactgcacatcaaggcagtagcacacctgagtaactccgtgaagagggaactggctgcggtattgctctttgagccacattctaaggcaggcacagtgctgttttcacagggagacaagggaacctcatggtacatcatctggaagggaagcgttaacgtggtcacccacggaaaggggctggtaacaaccctccacgagggggatgacttcggccagctcgcactggtgaacgacgctccacgggctgctacaattatcctcagggaggacaactgccacttccttagagtagacaaacaggactttaaccggattatcaaggacgtggaggctaaaaccatgcggctcgaggaacatggtaaagtggtcctggttctcgagcgcgcctcccagggtgctgggccctctaggccccctacaccagggagaaaccgttatacagttatgtcgggaactcccgaaaaaatcctggagctgcttcttgaggcaatgggccctgactcttccgcacatgatccgacagaaaccttcttgagcgatttcctgctgactcaccgggtgttcatgccttctgcccagctttgcgcagcattgctgcatcacttccacgttgaacccgcaggggggtcagaacaggaacggagcacatatgtttgcaacaaaaggcagcaaatcctgaggttggtttctcaatgggttgccctatacgggagcatgctgcacacagatcctgttgctaccagttttctgcagaagttgtcagatttggtggggagagacacccggcttagcaacctcctgcgagagcaatggccagaacgtagacggtgtcaccgccttgagaatggatgcggcaacgcctccccccagatgaaggccaggaacctccccgtatggctgcctaaccaggacgagcctcttccaggttccagctgtgcaatccaggtgggcgacaaagtgccttatgatatctgtcgcccagatcattccgtgcttacactccagctccccgtgacagcgagtgtgagggaggtcatggctgccctggcgcaggaggatggctggacaaaagggcaggttcttgttaaggtcaatagtgccggtgatgctatcggcctgcagcctgatgcgagaggcgtggctaccagcctgggcctaaatgaaagacttttcgtcgtcaatcctcaggaagtacacgagctgattcctcatccagaccaactgggacccactgtgggcagcgcagaaggtctggatttggttagcgcaaaggatctggccggccagctcacagatcacgattggtctcttttcaattctattcaccaggtagagctcatccactatgtgcttggaccccagcaccttcgcgatgtcactaccgctaatcttgagaggtttatgagaaggttcaatgaacttcagtactgggtggccacagagttatgcctctgtccagttcctggcccacgggcgcagctgctacgcaagttcatcaaactggctgcacatctcaaagagcaaaaaaacctgaactcatttttcgccgttatgtttggcctttctaattctgcaatcagtcgattagcacatacatgggagagacttccccacaaagttcgaaagctgtattctgcgttagaaagactcttagacccatcatggaaccatcgcgtgtaccgcttagccctggcaaaactgagccctccagtgatcccctttatgcccttgttgctcaaagacatgactttcatccacgaggggaatcacacattagtggaaaatctgatcaattttgagaagatgcggatgatggcacgagcagctcgcatgctgcaccattgtagaagccacaacccggtacccctttctccacttcgttccagagtgtctcacctccacgaagatagtcaagtggccaggatcagtacatgttcagaacagagcctaagtacccggtccccagcaagcacctgggcgtacgttcaacagctcaaagtcatcgataatcaaagagaactgtctagactgagccgggagctcgagccttag

SEQ ID NO: 29404 - DNA, 3033 bp, Artificial Sequence
  Description of Artificial Sequence: Synthetic coding sequence
atggttgccgcccatgccgcccactcttcttcctcagccgagtggatcgcctgcttagacaagcggcccctagagcggtctagtgaagatgttgatatcatcttcaccaggctgaaagaggtcaaagcttttgagaagttccaccccaaccttctgcatcagatctgtctgtgtggctactacgagaacctcgagaagggcatcactctgttcagacagggggacatcggaacgaactggtatgccgtgctcgctggtagccttgacgttaaggtatctgagacatccagtcatcaggacgccgttaccatatgtacactcggtattggtaccgcatttggagagtcaatactggacaacacaccacgacatgcgactattgtcacccgcgagagttctgaactgttacgaattgaacaaaaggactttaaggcgctatgggaaaaatatcggcaatacatggccggcctgttggccccaccgtatggcgtgatggaaaccggcagcaacaatgacaacatcttcaaagaaatgacccccttaattgagccccatgtgccacttcggccggccaataccattactaaggtcccatcagagaaaatccttcgggcaggcaagatcttaagaaatgcgattctttctcgggctccacacatgattagggaccggaaatatcatctaaagacctacagacaatgctgcgtcgggacagaactggtcgactggatgatgcagcaaaccccatgcgtccattcacggacacaggcagtcgggatgtggcaggtcctgctcgaagacggagtcctgaaccacgtggaccaggagcatcacttccaagataagtatctcttctaccgctttttagatgatgaacatgaggatgcacccctcccaaccgaagaggagaaaaaggaatgtgacgaagagctccaggataccatgctccttctgtctcagatgggaccagacgctcatatgcgcatgattttgcggaagcctcccggacagcggaccgtggatgatttagagattatctatgaggaattgctccacattaaagcccttagtcacctctctacgactgtgaagagggaactcgccggcgttctgatctttgaaagccacgccaaaggcggaacggttttgtttaaccagggggaagagggaaccagttggtacattatcctcaagggcagcgtaaacgtggtgatatatgggaagggagtggtttgtacgctgcatgagggggatgactttgggaagctagctttagtgaacgatgccccccgtgccgcttccatcgtgcttcgtgaggacaactgtcattttctgagggttgacaaggaggattttaatagaattcttagggatgtcgaggccaacacagtcaggctgaaggagcatgatcaggacgttctggtgctggaaaaggtgccagctggcaatcgggccagcaatcaagggaactcacaaccccaacagaagtatactgtgatgtcaggaactcctgaaaaaatactcgagcacttcctggagacaatcagactggaagctacacttaacgaggccacagacagcgtcctcaatgattttataatgatgcactgcgttttcatgccgaatacccagttatgccccgccctggtagcccattatcacgcacagccctctcaagggacggaacaggagaagatggattatgcacttaataacaaaaggcgtgtgatacggctggtgctgcagtgggcggctatgtacggagatctcctgcaagaagatgatgtgtccatggcctttctggaagaattctacgtgtctgtgtcagacgatgcacgcatgatcgctgctttgaaagagcaattgcctgaattagagaagatcgttaagcagatctccgaggatgctaaagctcctcagaagaagcacaaggttctgttgcagcagttcaataccggcgacgagcgggcacaaaagcgtcaacccattcgggggtctgatgaggtcctttttaaggtgtattgtatggaccatacatataccaccataagagtcccagtggctacaagcgttaaagaggtaatatcagctgtagcggataagctcggttcaggagaagggctcattattgtcaaaatgtcatccggcggtgaaaaggtagtgctaaagccgaatgacgtctctgtctttaccactctaacgataaacggtaggctcttcgcttgccccagggagcagtttgattcccttactccgctgccagagcaggaaggccccacagttggaacagtgggaacatttgagcttatgtcttcaaaggacctcgcctaccagatgaccatatatgattgggaattgtttaattgcgttcacgagctggaactcatctaccacacattcggccggcataatttcaaaaagaccacagccaacctcgaccttttcctcagacgctttaacgaaatccagttctgggttgtgactgaaatatgtctatgttctcagctgtccaagagggtccaactccttaagaagttcattaaaattgcagcccattgtaaagaatacaagaacctcaattctttctttgctattgttatgggtctgtctaatgtcgctgtctctcgcttggctctgacctgggaaaagctcccgtcaaagtttaaaaagttttatgccgagtttgagtcattgatggatcccagtcggaaccacagagcttaccgccttaccgttgcgaaacttgaaccccccttaattccctttatgcctttgcttattaaggatatgaccttcacgcacgagggcaataagacttttatcgacaatctggtcaacttcgagaagatgagaatgatagctaatacagccaggaccgtgcgatattacagatcgcagcccttcaatcctgatgccgctcaggctaataaaaaccaccaggatgttcgttcttacgttcggcaactcaacgtgatcgacaaccagaggactctgagccaaatgagccataggttggagcctcggagaccatag

SEQ ID NO: 29405 - DNA, 3036 bp, Artificial Sequence
  Description of Artificial Sequence: Synthetic coding sequence
atggtcgccgcccacgctgcccacagttcctcttccgccgaatggatcgcatgcttggataagaggccactcgagcgtagctctgaagacgttgatatcatctttacccgccttaaggaagtcaaagctttcgagaagttccaccccaacttgcttcaccagatctgcctctgcggctattatgagaatctcgagaaggggattactctgtttagacaaggcgacattggcacaaattggtatgccgttctcgccggctctttggatgtgaaggtgtccgaaacttctagccaccaggatgctgtaacaatttgcactctcggaatcggaacagcctttggggagagtatcttggacaacactccacgacacgccacaatcgtcacccgagagtcgtctgagttgctcaggatcgagcagaaagactttaaggccttgtgggagaagtaccggcagtatatggccggcctccttgcacccccctacggcgtcatggagacaggctcaaacaacgacaggatcccagataaagagaatactcctttgatagagcctcacgtgccattgaggccagcgaatacgataactaaggtgcccagtgagaagattctcagagccggcaagatcctgaggaatgctatcctttcccgcgctccccatatgattcgagaccgcaagtatcatctgaaaacctatcgccaatgctgtgtaggcactgagctggtggattggatgatgcagcagacgccttgcgtgcattcccggacacaagccgtcgggatgtggcaggttctgctcgaggatggagttttaaatcacgttgatcaagagcatcatttccaggacaaatacctgttctacaggtttctggatgatgagcacgaagacgctcccctcccgacagaagaggaaaagaaggaatgtgacgaggagctgcaggatactatgcttctgctgtcacagatgggccccgatgcccatatgaggatgattttgaggaagccacctggtcagagaaccgtcgacgatttggaaataatttatgaggagctactgcatattaaagccctatcacatttaagcaccactgtcaagcgggagctggctggcgtcctcatcttcgagagccatgccaagggcggcacagttctgtttaatcagggtgaagaggggacgtcatggtacatcatcctcaaaggctccgtcaatgtcgtcatctacggtaagggcgtggtttgtacactccatgagggagatgactttggcaagctcgctctagtcaacgacgcacctagagctgcatccattgtcctccgcgaggataactgccatttcctgagagtcgataaggaagattttaaccgtatcctgagggatgttgaagcgaacactgttcggttaaaagagcatgatcaggatgttttggtcctggagaaagttcccgcaggtaacagagcttcgaatcaagggaacagccaaccccagcagaaatatacagtgatgagtggaacccctgaaaagatcctggagcacttcctggagaccatccggctggaggctacactaaacgaagccactgactctgttctcaacgacttcatcatgatgcactgcgtgttcatgcctaacacccagctgtgtccagccctcgtcgctcactaccacgctcaacctagccaaggcaccgagcaggagaaaatggactacgcgttgaacaacaaacgccgtgtgatccgcctcgtccttcagtgggccgccatgtacggagacctgctgcaggaggatgacgtgagtatggctttcctcgaggagttttacgtgagtgtgagcgacgatgcgcgcatgattgccgcactcaaggaacaactacccgaacttgagaagattgtcaaacagatatcagaagatgccaaggctccacaaaaaaagcataaagtccttctccagcagttcaataccggagatgaacgggcccaaaagcgacagcccatacgtggatcagacgaggttctgtttaaggtttattgcatggatcacacctacactaccattcgcgtccccgtggcaacaagcgtcaaagaggtgatttccgccgtggctgataaacttgggagcggcgaagggttgatcattgtcaagatgagttccgggggcgagaaggtggtccttaaaccaaacgacgtctccgttttcaccaccctaaccatcaatggacgcttatttgcgtgtcccagggagcagttcgattctcttacacccttaccagaacaagaggggcctacagtcggaactgtaggtaccttcgagcttatgtccagtaaagacttggcataccaaatgactatttacgactgggaactatttaattgcgtccacgagctggagctaatctaccatacttttggcagacataactttaagaaaaccacagccaatctagatttgttcctgcgccgattcaatgaaattcagttctgggtcgtgactgagatttgcctttgtagccagctgagcaagcgagtgcaattgctgaaaaaattcataaagatagcagcgcattgtaaggagtacaaaaatctcaattcttttttcgcaatcgtgatgggcctgtctaatgtggccgtgtcccgtttagcccttacgtgggagaaactgcccagcaagtttaaaaagttttatgcagagtttgagagcctcatggacccctcccggaatcaccgggcctaccggctgacggtggccaaactggagcctcccctgatacccttcatgcccttactaatcaaggatatgacatttacacatgagggcaataaaacttttatagataacttggtaaatttcgaaaagatgcggatgattgcgaacaccgcaaggacggtccgctactatcgctctcaaccatttaatccagatgctgcacaggccaataaaaaccaccaggatgtcaggagttatgtgcggcagctcaatgttattgacaaccagcgaacactgtcacagatgtcgcataggttggagcctaggcggccatag

SEQ ID NO: 29406 - DNA, 2604 bp, Artificial Sequence
  Description of Artificial Sequence: Synthetic coding sequence
atgttgtacaaaaagtaccgtcaatacatggccgggttattggccccgccttatggcgtgatggagaccggatcgaataatgacagaatacccgataaagagaatacaccgttgatcgaaccacacgtccctttgcgacctgccaacacaataacaaaagtacctagcgagaagatactacgggccggcaaaatcctgagaaacgcgattctgtcacgcgcaccccacatgatccgcgacaggaaatatcaccttaaaacatatcggcagtgctgcgtcggcactgaattagtagactggatgatgcagcagaccccctgcgtgcattcccgaactcaggccgtcgggatgtggcaagttctgctggaggacggtgtactgaatcatgtggaccaagagcatcactttcaggataagtaccttttttaccgatttttggacgatgagcacgaagatgctcctctacccacagaagaagaaaaaaaagagtgcgatgaagagttgcaggacaccatgctgcttctctcgcagatggggccggacgcccatatgaggatgatcttgcggaagccgccagggcagagaactgtcgatgacctggagatcatttacgaagagctcctccacataaaagcgctgtcccatctgagcacgactgtgaagcgggagcttgcaggcgtgcttatcttcgaatcccacgcgaagggtggtaccgttctcttcaaccagggcgaagagggaaccagctggtacatcatacttaagggctctgttaacgtagttatctatggcaagggggtcgtgtgcacattacacgagggtgacgactttggaaaactcgccctggtgaatgacgctcctagagctgcaagcattgtgctgagggaggataattgccattttctgagagtggataaagaggactttaatcggattttgagagacgtggaagctaacactgtacgacttaaagaacacgaccaggacgttcttgtgctggaaaaagttcccgctggcaaccgcgcaagcaaccagggtaatagtcagccgcagcagaagtatactgtcatgagtggaacccccgaaaaaatcctggagcacttcctggagactatacggctcgaagccacactcaacgaggcgactgactctgtgctgaatgacttcatcatgatgcactgcgtttttatgccaaacacccagctatgccctgccttggtagcccactatcacgcccagccttcccagggaacagagcaggagaagatggactacgcattgaacaacaaaagacgcgtcatcaggctggttttacagtgggccgcaatgtacggcgacttactgcaggaagacgacgtgtccatggcctttttagaggagttctacgtcagtgtgtccgatgatgcacgtatgattgcagccctaaaagaacagttgccagagctcgagaaaatcgttaagcagatttccgaagacgccaaagcaccgcagaaaaagcacaaggtgcttctgcagcagttcaacaccggcgacgagcgcgcccagaaacgccagccaatcagaggcagcgatgaagttctattcaaagtttattgtatggatcatacatacacgactattcgggtgccagtcgccacatctgtcaaggaagtgatcagcgccgttgcggataagcttggaagcggggagggacttataatcgtgaagatgtcgagcggcggagagaaggtggttctgaaacccaacgacgtgtcagtgtttaccacccttacaatcaacgggcggctctttgcctgtcctagggaacagttcgattctctaaccccccttcccgagcaggaaggtcccactgtaggtacagtgggcacattcgaactcatgtcttctaaggacctggcgtatcaaatgacaatttacgactgggaactatttaattgcgtacatgagttggaactgatttatcatacatttgggagacacaactttaaaaagacgaccgccaatctcgacctgttcctgagaaggttcaatgaaatacagttctgggtggttaccgaaatttgtctgtgttcccagctgtccaaaagagtgcaactcctgaagaaatttattaaaattgcagcacactgcaaagagtacaaaaacttgaactcatttttcgctatcgtcatggggttaagtaacgtggcagtcagcagactcgcgttaacgtgggagaaactgccaagcaagtttaaaaaattttacgcagagttcgagtccctcatggatcctagcaggaaccacagagcatacagacttaccgtcgctaagttagaaccacccctgatcccctttatgcctctgttgatcaaagacatgacttttactcatgaaggtaacaaaacatttattgacaacctagtaaactttgagaagatgcggatgatagcgaacacggcccgcaccgtgcgatattatcggtcacagccctttaatcctgacgctgctcaggcaaataaaaaccaccaggacgtgcgatcctatgtgcgacaattaaatgtcatcgacaatcagcgcaccctgtcacagatgtctcaccgattggaacctcgacgaccttag

SEQ ID NO: 29407 - DNA, 2832 bp, Artificial Sequence
  Description of Artificial Sequence: Synthetic coding sequence
atggtggcggctcacgctgcccacagtagctcgagtgctgagtggatcgcttgtctggacaagcgtcctttggaaagatcctccgaggatgttgatatcatttttacacggcttaaggaagtgaaagccttcgaaaagtttcatccaaatttgctccatcagatctgcctttgcggctactatgaaaacctggagaaaggtattactttgtttagacagggcgacattggaactaattggtacgccgtgctcgccggttccctggatgttaaagtgtccgaaacctcatcccaccaggatgccgtgaccatttgtaccctgggcatcggaaccgcgttcggggagtctatacttgacaatacacctagacatgctaccatcgtcaccagagaatcatccgaactgctcaggattgagcaaaaggattttaaagccctctgggaaaagtatcgccagtatatggccgggctcttggcccctccttacggcgtcatggaaaccggctctaacaacgatcgcattcccgacaaagagaacacgccactgatcgagccccacgttccgctgaggcccgctaatactatcacaaaagtgcccagtgaaaagattctcagggcgggcaagatcttgcgaaacgccatccttagccgagcgcctcacatgatcagagatcgaaagtatcatctgaaaacctatagacaatgttgcgtgggaactgagctggtcgactggatgatgcagcaaacaccttgcgtccacagtcgcacacaggccgtggggatgtggcaggtcctgctcgaggacggagtgctgaaccatgtagaccaggaacatcactttcaggacaaatatctcttttacagatttctggacgacgagcatgaggatgcccctctcccaacagaggaggaaaagaaggagtgtgacgaagaacttcaagatacaatgctcttgctatcccagatgggaccagacgcccatatgaggatgatactgaggaaacccccggggcaacgcaccgttgacgacctggagatcatatacgaggagctcctgcacattaaagctctgtcacacctctcgactaccgtgaaacgggaactggcgggagtgctgatctttgaatcccacgctaagggtggtactgtcctgttcaaccagggggaagagggcaccagctggtacatcatattgaaaggtagcgttaacgtggtgatttacgggaagggggtggtatgtacccttcacgagggtgatgatttcgggaagctcgcactggtcaatgatgcacctcgggccgctagcattgtcctcagggaagataactgtcatttcctacgcgtggataaagaggacttcaatagaatcttgcgggacgtggaagcaaatacagtgcggctgaaagagcacgatcaggatgttcttgtgcttgaaaaagtacctgccgggaaccgtgcctccaatcagggaaatagccagccccagcagaaatataccgtaatgagcggaacccctgagaaaatcttggagcactttctcgagacaattcgactagaggccacccttaatgaggcaacagacagcgtgctcaacgactttatcatgatgcactgcgttttcatgccaaatacccagttatgtcccgcattagtggcccactatcacgctcagcccagccaggggacggagcaggagaaaatggattacgcactcaataataaaagaagagtgatacgtctggtgctgcagtgggctgccatgtacggggatcttcttcaggaggacgacgtctctatggctttcctggaggagttctacgtgtcagtgtcggatgacgccagaatgattgccgccctgaaagaacagcttcctgaattggagaagattgttaaacagatctctgaggacgcgaaagccccccagaaaaagcataaggtcctcctacaacaattcaacacaggggacgaacgggcgcagaagcgccagcccatcagaggctcggatgaagttctgttcaaggtgtactgcatggaccatacttatacgacaatccgcgtcccggttgccacatcggtgaaagaggtgatctccgctgttgcagataaacttggcagcggagagggcttaatcatagtcaagatgtcctctggcggcgagaaggttgtccttaagcccaatgatgtaagcgtattcacaaccctgacaatcaacgggcgtctctttgcttgcccaagggagcaatttgactccttgactccattgcctgagcaagaaggtcccacagtaggcaccgttggaacctttgaattgatgagtagtaaagacttagcatatcagatgacgatttatgattgggagctgttcaattgcgttcacgagctcgagctgatctatcacacctttggccgccacaactttaaaaaaactacagctaacctcgatctctttttgcggagatttaatgaaatccagttctgggtagtgactgagatatgtctctgttcacagctatccaagcgggtacagttgcttaagaagttcatcaaaattgctgctcactgtaaagagtataagaatctaaacagtttcttcgccatagtgatgggtctgagtaatgtggccgtgagccggctggctctcacatgggagaggatgattgcgaataccgcaagaacggtacgttactacagaagccagccttttaatcctgacgcagcgcaggctaacaagaatcatcaagacgtaagaagctatgttcggcagctaaatgtcatcgacaaccagaggactctgagccagatgtcccatcgactggaaccacgccgaccttag

SEQ ID NO: 29408 - DNA, 2376 bp, Artificial Sequence
  Description of Artificial Sequence: Synthetic coding sequence
atgattagagaccggaaataccacctgaagacgtaccgccaatgctgcgtggggaccgaactggtcgattggatgatgcagcagacgccctgtgtgcacagcagaacccaagcagtcggaatgtggcaagtcttactggaggatggcgtcctgaatcacgtggatcaagaacaccacttccaagacaaatacttattttatcgctttctggacgacgagcatgaagatgcacccttgcctactgaggaggaaaagaaggaatgcgacgaggaattgcaagacactatgctcctcctgtctcagatggggcctgatgcacatatgcggatgattcttcgtaaaccacccgggcagagaaccgtcgacgatcttgaaatcatctacgaagagttactgcacattaaggctctgagtcacttgagtacgaccgttaaaagggagctcgctggggtgctgatattcgagtctcacgccaaaggaggcactgtgctctttaatcagggagaagaaggtacttcttggtacatcattcttaagggcagcgtaaatgtggtcatatatggcaaaggcgtcgtttgtaccttgcacgagggagacgactttggtaagctggcgctggtcaacgacgcaccgcgagctgcttccattgttctccgtgaggataattgccacttcctccgcgtcgacaaggaggattttaaccgtatcctccgtgacgtcgaggcaaatacagtccgattgaaagaacacgaccaagatgtgcttgtcctggaaaaggtaccagctgggaaccgggccagtaaccaggggaatagtcagcctcagcaaaaatatacggtgatgtcggggacccccgaaaaaatcctggagcactttctcgaaaccataaggctggaggcaactttaaatgaagccaccgattcagtgttaaatgactttataatgatgcactgtgtcttcatgcctaacacgcaactatgccccgctttagttgcccactaccacgcacagccctcccaagggaccgaacaggagaagatggactacgccctgaataacaagcggagagtcatcaggctggtccttcagtgggccgcaatgtatggcgatctgctgcaggaagatgatgtcagtatggcatttctggaggagttctacgtgtcggtctcagacgacgctcggatgatcgctgctttaaaggaacagctacccgaattggagaaaatcgttaagcagatttctgaagatgccaaggctccccaaaagaagcataaggtgttactgcagcagtttaataccggcgacgaacgcgcccagaaaagacaaccgattcgcggttccgacgaagtcttgtttaaagtatattgcatggatcacacatatacaacaatccgcgtaccagttgcaacctccgtcaaagaagtgatcagcgccgtggccgataagctagggagtggagaaggattgatcatcgtgaaaatgtcttctggaggagagaaggtcgttcttaaacctaacgacgtttcggtcttcaccactctgactattaatggtcggctattcgcttgtccacgtgaacagtttgattctcttactcccctgccagagcaggagggcccaacagtcggtaccgttggcaccttcgaactgatgtctagtaaggatctggcctaccagatgacaatatatgattgggagctctttaactgcgtgcacgaactcgagttgatttatcacactttcgggcgccataacttcaagaaaacaaccgcgaatctcgacttgttcctgcggcgcttcaatgagatacagttttgggtggttacggagatttgcctctgctcccagctgtcaaagagagtacagctgctgaaaaagttcatcaagatagccgcccactgcaaagagtataagaatttaaatagcttcttcgccattgtgatgggtctatccaatgtggctgtttctaggctcgccttaacgtgggagaaactgccttctaagttcaagaagttttacgccgaatttgaaagtctgatggaccccagtcggaatcatcgagcgtaccgactcacggtcgctaagctcgagccgccattaattccatttatgccactgctgattaaagacatgacatttacacatgagggaaataagacattcattgataatctggttaactttgagaagatgcgcatgatcgctaataccgcaagaactgttagatattaccgtagccagccatttaaccctgatgcagcccaagccaacaagaaccaccaggatgtgaggtcatacgtacgccaattgaacgtcattgacaaccagagaaccctgtcccagatgtcgcatcggcttgaaccgcggaggccctag

SEQ ID NO: 29409 - DNA, 2523 bp, Artificial Sequence
  Description of Artificial Sequence: Synthetic coding sequence
atggcagggttgctggcccccccctacggggttatggagacaggatctaataacgaccgaatacctgataaagaaaatgtgccctctgagaagattttgcgggcgggcaaaattctacggaacgccatcctctccagagcaccacacatgattagagacaggaagtatcaccttaaaacttacaggcagtgctgcgttggtaccgagctggtggattggatgatgcaacagacgccatgcgtccacagcaggacccaggcagtaggtatgtggcaggttctgctcgaggacggagttttgaaccatgtggaccaagaacaccacttccaagataaatatctgttttacagatttctggacgacgagcacgaggatgcccctttaccgacggaagaggagaagaaagagtgcgatgaggagctgcaggatacgatgcttctgttgtctcagatgggtccagacgcgcatatgagaatgattttgcgcaaacctcctggtcagcggaccgttgatgaccttgaaatcatttatgaagagcttctgcacattaaggccctgtcgcatctcagcacgactgtgaagagagagctggcaggagtgctaatcttcgagtctcacgccaaggggggaaccgtgttgtttaaccagggggaggagggaacatcttggtacattatcttgaagggatcggtaaatgtcgtgatttacggcaaaggtgtcgtctgcactctgcatgagggagatgactttggcaagcttgcattggtaaatgatgcacctagggcggcttccatagtgctgcgcgaggataactgccattttctccgggttgataaggaagactttaataggatcctaagagatgtggaagcaaacacagtgcgcctcaaagaacatgaccaggatgtgctcgtgctggaaaaagtgcctgcgggaaacagagcctccaaccagggcaattcacagcctcagcaaaagtataccgtcatgtccggaactccagagaaaattctcgaacactttctggaaactataagacttgaagccactcttaatgaagcgacagacagcgtcttaaacgacttcatcatgatgcactgcgtctttatgcctaatacacagttgtgtcccgctctcgtggcccactaccatgctcagccaagccagggaacagagcaagagaagatggactatgccctgaataataaaagaagagtaatccgactggtcctgcagtgggctgccatgtatggtgacctgctgcaggaagatgacgtgtcaatggccttcctggaagagttctatgtttccgtttccgacgacgccaggatgattgccgcgcttaaagaacagttgcccgagctcgaaaaaatagtcaaacagataagcgaagatgccaaggccccacagaagaagcataaggtactgttgcagcagtttaataccggcgatgagcgcgcccaaaagcggcagcccatcaggggatccgatgaagtgttgttcaaagtatattgcatggaccacacttacaccacgattcgggttccagtggcgactagcgtgaaggaagtgattagcgccgtcgccgacaaactgggaagcggggaaggactgataattgtgaagatgagttctggcggggaaaaggttgtgctgaaacccaatgacgtctcagtgtttaccactctaacgattaacggcaggctcttcgcgtgtccgcgggaacaattcgacagtttaacacccctgcccgaacaggagggccctactgtaggcactgtgggcacatttgagctgatgtcctccaaggacttggcttatcaaatgactatctatgattgggagctgttcaactgcgtccatgagctggagttgatctaccatacctttggacgccacaactttaagaagactacagccaacctggacctgttccttcgccgcttcaacgaaatccagttttgggtggttactgaaatctgcctgtgctcccagctttccaaacgggttcagctcttaaagaagttcatcaaaatcgccgcacattgcaaggaatacaaaaatctgaactcatttttcgccatcgtcatggggctatccaacgttgccgtgtctagactggctctgacctgggagaaactgccctccaagttcaaaaaattttatgcagagttcgagtcactaatggatccctctaggaatcaccgcgcctatcggcttaccgtcgcaaagctggagccacctctgattcccttcatgcccttattaatcaaagatatgacttttacacacgagggtaataaaacgttcattgacaatttggtgaacttcgagaagatgaggatgattgcaaacaccgcacggactgttagatattacaggtctcagccttttaatcccgacgctgctcaagcgaacaaaaatcaccaggatgtcagatcctacgtccgacagctgaacgtgattgacaatcagaggaccctgtcccagatgagtcaccgcctggaacccaggcgcccgtag

SEQ ID NO: 29410 - DNA, 2577 bp, Artificial Sequence
  Description of Artificial Sequence: Synthetic coding sequence
atggccggcctccttgcacctccttatggagttatggagaccggcagtaacaatgacagaatccctgacaaagagaatacaccccttattgagccacacgttccactgcggccagccaacactataacaaaggtgccgtcagagaagatccttagggctggaaagattcttagaaatgctatcttatctcgcgcaccgcatatgatcagagaccggaaataccacctcaagacataccggcagtgctgtgtagggaccgagctcgtagactggatgatgcagcaaacaccctgtgtgcacagccggacacaggccgtcggtatgtggcaagtgctactcgaagatggcgtcctgaatcacgtggaccaggaacatcatttccaggataagtatctgttctataggttcctagatgacgagcacgaagatgcgcctctgccaaccgaagaggagaagaaagagtgtgacgaagagctgcaagataccatgttgttgctcagccaaatgggcccagatgcacacatgagaatgatcctgaggaaaccaccaggacagcgcaccgtggacgacttggagattatctatgaagagctgttgcacattaaagctctctctcatcttagtactacagtcaagagggagctggcaggggtgcttatattcgaaagtcacgccaaaggcgggaccgttctgttcaatcagggcgaggaaggaacgagttggtacatcattctgaagggctcggtgaatgtggtaatttacggcaaaggagtggtctgcactttacatgaaggagatgattttgggaaattagcgctcgtcaatgacgcgccccgggcagcgtctattgtgctaagggaagacaactgccactttctgagagtggataaagaggactttaaccggattttacgggatgtggaggccaacacagtccgcctgaaggaacacgatcaggatgtgctggtgctcgagaaagtccccgctggcaaccgcgcctcaaaccagggaaatagccagcctcagcagaagtataccgtgatgtctggtactcccgagaagattctcgagcacttcctggagactatccggcttgaggctactcttaacgaagcaactgacagcgtgcttaatgacttcattatgatgcactgcgtgtttatgccaaacacgcagttgtgccccgctttggtggctcactaccacgctcaaccttctcagggtaccgaacaagaaaagatggactatgctctcaacaataagagacgggtgatccgcttggttctgcagtgggctgcaatgtatggagacctattgcaggaggatgatgtgtctatggcatttttggaagaattctatgtgagcgtcagcgatgacgcgaggatgattgcggcactgaaagagcagctgcccgaacttgaaaagattgtgaaacagattagtgaggatgctaaggctcctcagaagaaacataaagtactgttgcagcagttcaacactggagatgaaagagcacagaaacggcaacccatacgtggcagcgacgaagtgctgtttaaagtgtactgcatggaccatacatataccacaattagggtccccgtagcgacgtctgtgaaagaggtgatcagcgcggtagctgacaagctgggatcgggagaaggccttattatcgttaaaatgagctccggcggcgaaaaggtcgtcctaaaaccgaacgacgtatctgtgtttacaaccctgactatcaatggaaggctatttgcctgtcccagagagcagtttgatagtttaacgcccctccccgagcaagaagggcccacagtcggaacagtgggaacttttgaacttatgtcgtccaaggacctcgcctatcagatgaccatctacgactgggaactgttcaactgtgtccacgaactcgagctcatttaccacacgtttggaagacataacttcaagaaaaccaccgcaaacctcgacctgtttttgcgccgatttaatgagatccagttctgggtggtcactgagatatgtctttgctctcagttgtccaaaagggtgcagctactcaagaaatttattaaaattgccgctcactgcaaggaatacaaaaatctgaatagtttttttgctattgtcatggggctcagcaacgtggcagtgtccagacttgctttaacgtgggagaagttgccctctaagttcaagaagttttatgctgaatttgagtcactcatggaccccagtcggaaccatagagcgtaccggctgactgtcgccaagctcgaaccacctctgattcctttcatgccacttctgatcaaggatatgacatttactcatgaggggaacaaaacctttattgataatctagtaaattttgaaaagatgaggatgattgcaaacaccgctcggactgtccgatactatagatcccagccctttaaccccgatgctgcccaggctaacaagaaccatcaggacgtccggtcatatgtaaggcagttgaatgtgatcgacaatcaaaggactctatcccagatgtcacaccggttagagcctcgccgaccttag

SEQ ID NO: 29411 - DNA, 1200 bp, Artificial Sequence
  Description of Artificial Sequence: Synthetic coding sequence
atgttcgtgtttgtcctgaccccactgattgaaccccacgtcccactccgccctgccaacactattacgaaggtgccaagtgaaaagatactgagagccggcaaaattttgcgtaacgctatcctgagtcgcgctccccacatgatcagggataggaagtatcatctgaaaacttatcgtcagtgttgcgtaggcactgagcttgtggattggatgatgcaacagactccctgtgtgcactcacggacacaggcagtcgggatgtggcaagtcctgctggaggatggcgtgctcaaccatgtagaccaggaacaccatttccaggataaatatctgttctataggttcctcgatgacgaacacgaggacgcaccgctgcccaccgaagaagagaagaaagagtgcgacgaggaactgcaagatactatgctgttgctttcacagatgggacccgatgctcatatgagaatgatactccgcaaacccccaggccaaagaacagtggatgatctggagatcatatacgaggaattgctccatatcaaagcgctgagccatctctccacaacagttaagagggagctcgcaggtgttctcatattcgagtctcacgccaagggaggtacggtgttatttaatcagggagaggagggcactagctggtacatcattctgaaaggatctgtaaatgtggtgatctacggaaagggcgtcgtctgcacactgcatgagggggatgattttggtaagctggcactggtgaacgacgcccccagggcggcttctatcgtcttgcgggaagataactgccatttcttgcgggtcgacaaggaggactttaacaggattcttagagacgttgaggccaataccgtaagactgaaggagcacgaccaagacgttttggtgctggagaaggttcccgccgggaacagggctagtaaccagggaaacagtcagccgcagcagaagtatactgtcatgagtggaacaccagaaaaaatcctggaacactttcttgaaacgatccgactggaggcaacactaaacgaagccacggatagtgtgctaaatgactttatcatgatgcactgcgtatttatgccaaatacgcagctgtgtcctgctttggtcgcccactaccacgcgcagccaagccgctacagaactggcgagaacggactgtgtccacagcagtag

SEQ ID NO: 29412 - DNA, 2577 bp, Artificial Sequence
  Description of Artificial Sequence: Synthetic coding sequence
atggccggtctcctcgcaccaccctatggggtcatggaaacagggtcaaataatgataggatccctgataaggaaaacactccccttattgaaccacacgtgcctttgcgtccagcaaatacaatcacaaaggtgccaagcgaaaagattcttcgcgcagggaagatactccggaacgctatattgagccgcgcacctcacatgatcagggatagaaaatatcatctgaaaacatatcgtcagtgctgtgtgggcactgagctggtcgattggatgatgcagcaaaccccatgcgtacacagccgaacacaagctgtgggcatgtggcaggtgctgttggaggatggcgtgttgaaccacgttgaccaagagcaccactttcaagataaatacttgttctatcggtttctggatgacgagcatgaggatgctcctctgccaactgaggaggagaagaaggagtgtgatgaagagcttcaggatacaatgttactgctgagccagatgggtcccgacgcgcacatgaggatgatcttaagaaagccccccggccaaagaaccgtggatgatttggagattatctacgaggagctgctacacataaaagctctcagtcatctcagtaccactgtcaagcgtgagttagctggcgtcctgatttttgaatctcacgcaaagggaggcaccgtactgtttaaccaaggcgaagagggtacctcttggtacattatattgaagggtagtgtgaacgtcgtgatttacggaaaaggagtggtgtgcacactgcacgaaggcgacgacttcgggaagctcgccctggtgaacgatgcccctcgggctgccagtattgtgctgcgggaggataactgtcattttctgcgtgtggacaaggaggattttaataggattctcagagacgtggaggccaacacagtccgactaaaggaacatgatcaggatgtgctggtgctggagaaagtgcccgctggcaaccgcgccagcaaccagggaaactcgcaacctcagcagaaatacacagtaatgtccggaacccccgagaaaatcctggaacatttcctggaaactatccgactggaagcaactcttaacgaagccactgactcggtgcttaatgatttcatcatgatgcactgtgtttttatgcccaacacccagttatgccctgccttagtggcccattaccatgcgcagccttcccaaggaactgagcaagagaaaatggattacgccttgaataacaagcgcagagttatccgtctagtgctacaatgggcagccatgtatggtgatctcttacaagaagacgatgtctctatggcttttctggaggaattttatgtttcagtctccgatgacgcccggatgattgctgctttaaaagagcagttacctgaattggagaagatcgttaaacaaatatcggaagacgccaaggccccacagaagaaacataaagtgctgctgcagcagttcaacactggggacgagcgagcacagaagcgccagccaatccggggctccgatgaggtactgttcaaagtctactgcatggaccatacctacaccacgataagggttcccgttgcgacctctgttaaggaggtgatctcagccgtcgccgataagttggggtcaggagaaggcctcattatcgtgaagatgtcgtctgggggagaaaaagtcgtgttgaagcctaacgatgttagcgtctttacaacgctgacaataaatggccgactattcgcctgtcccagagagcagttcgactccctcaccccccttcctgagcaagaaggtcctaccgttggtacggttgggacattcgaactgatgagcagcaaggatctcgcttaccaaatgaccatctatgactgggagttatttaattgtgtgcacgaactcgaattaatataccacacctttgggcgtcacaacttcaaaaagacaaccgccaacttggatctttttttgcgaaggttcaatgaaattcaattttgggtggtaacagagatttgtctgtgttcccagctaagtaagcgggtccagcttttgaaaaagtttatcaagattgcagctcattgcaaggaatacaaaaatctcaattccttctttgctatagtgatggggctgtctaatgtggctgtgtcacgccttgctcttacctgggagaaactgccttctaagtttaagaagttttatgcagaatttgagtctctcatggacccaagccggaaccatcgggcctacagactcaccgtggccaagttggagccccccctaatacctttcatgccgttactgattaaagatatgaccttcacgcacgagggcaataaaacgtttatcgataatctcgtcaatttcgagaagatgcgaatgattgctaacactgcccgaacagtgcgttactaccgcagtcagccctttaaccccgatgcggctcaggccaacaaaaatcaccaggacgtcaggtcctacgtgcggcagctaaatgtgattgataatcagcgtactctttcgcagatgtcccacagattggagccccggcgcccatag

SEQ ID NO: 29413 - DNA, 552 bp, Artificial Sequence
  Description of Artificial Sequence: Synthetic coding sequence
atgcgtgaatataaagtggtcgtgctcggctctggtggggttggcaagtcagctctgaccgtccagtttgtgactggaagttttatcgaaaagtatgaccccaccatcgaggatttttacagaaaagaaatcgaggtggactcatcaccgagcgtcctggagattctagacacagcgggcaccgagcagttcgcttcaatgcgcgatctatacattaagaacgggcaaggttttatcttggtgtactcattagttaaccaacagtcctttcaggacatcaagcccatgcgggaccaaattatacgggtcaaacgatacgaacgcgtaccaatgatccttgtcggtaataaagtcgacctcgaaggcgagagagaagtctcttacggtgagggaaaagccctcgccgaagagtggtcctgtcctttcatggagaccagcgcaaagaataaagcatccgtggacgaactgtttgccgagatcgtgaggcaaatgaattacgcggcacagccaaacggcgacgaaggatgctgctccgcgtgcgtcatattgtag

SEQ ID NO: 29414 - DNA, 552 bp, Artificial Sequence
  Description of Artificial Sequence: Synthetic coding sequence
atgcgggagtataaagtggtggttttgggttcaggtggggtgggaaagtccgctctcacagtgcagtttgtgaccgggacattcatagagaagtatgaccctactatcgaggatttctatcggaaagaaatcgaggtggacagctcaccatcagtgcttgaaatccttgacactgcagggaccgaacagtttgcgtccatgcgcgacttatacatcaaaaatgggcagggatttatactcgtgtactcgcttgtcaaccagcaaagtttccaggacatcaagccgatgcgtgatcaaatcgtcagggtgaagaggtacgaaaaggtgccactgatcttagtgggaaataaggtggacctggaaccagagagggaggtaatgtcgtccgaaggccgggccctggcccaggaatggggatgcccgttcatggaaacctccgcaaaatctaaatcaatggttgacgagctattcgccgagatcgtgcggcagatgaattactcaagtctgccagaaaaacaggatcagtgctgtaccacttgcgtggtacagtag

SEQ ID NO: 29415 - DNA, 552 bp, Artificial Sequence
  Description of Artificial Sequence: Synthetic coding sequence
atgagggaatataaggtggtggtgttggggtccggaggagtcgggaagagcgccctgacggtccaatttgtgactggtacatttattgagaagtacgaccccactatcgaggatttttatcgaaaagagattgaggtggactcatccccttccgtcctggagattttagatacagcgggtaccgagcagtttgctagcatgcgcgatctttacatcaagaacgggcagggattcatccttgtctactcattagtgaaccagcaaagtttccaggacatcaaacctatgcgtgatcagattgtgagggtgaagcggtacgaaaaggtacccctaattctcgtgggcaataaagtcgacctcgagcccgaaagagaagttatgagcagcgagggccgggcattagcccaagagtggggctgccccttcatggagacatctgccaaatctaagagcatggtcgacgaactcttcgccgagattgtgcggcagatgaactactcaagccttccggagaaacaagatcagtgctgcaccacctgtgttgttcagtag

SEQ ID NO: 29416 - DNA, 1023 bp, Artificial Sequence
  Description of Artificial Sequence: Synthetic coding sequence
atgcataccgacctcgacacagatatggacatggataccgaaaccactgccctgtgtccctccggatcccgccgggcttccccgcctgggacaccaacacctgaggctgacgccacgcttctcaaaaaatctgaaaagctcctggccgagctcgaccgatcaggcttaccttcagcaccgggcgcgccccgtcggcgaggatccatgcccgtcccttacaaacaccagctacggcgcgctcaagctgtagacgagctggattggcctccacaggcgtcttctagtggaagttctgactcattaggcagtggagaggctgcacccgctcagaaagatggcatttttaaggtcatgttggttggcgaaagtggagttggcaagtcaaccctagcaggtacctttggaggactgcagggtgactcagcacatgagcccgagaatccagaggacacatacgaacgtcgtatcatggtggacaaagaggaggtgactctcgtcgtctacgacatttgggagcagggagacgctggaggctggctgcgcgatcattgcctgcagacaggggatgcatttttgatagtgtttagtgtcactgaccggcgatcattctctaaggtgccagagactctcctccggctgcgtgcgggaagaccccaccacgacctgcctgtgatcctggtgggcaacaagtccgacctggcccgctctagagaggtgtccttggaggagggcagacatctcgctgggaccctgagctgtaaacacattgagacatccgctgctctacaccacaatactcgggaactgttcgaaggtgccgtgaggcaaatcaggctgaggcggggtcggaaccacgccggcggccagagacccgaccctggctcacccgaagggcctgctcctcccgctcgcagggagagcctgacaaagaaggccaaaagatttctcgcaaacctggtaccaaggaatgcgaaattcttcaaacagcgctcaagatcatgccacgatttgagtgtgctatag

SEQ ID NO: 29417 - DNA, 666 bp, Artificial Sequence
  Description of Artificial Sequence: Synthetic coding sequence
atgcatactgatctagatacggatatggacatggatactgaaaccaccgccttatgccctagcgggagccggcgggcttcccctccaggcactccaacgcctgaggctgacgctactctattgaaaaaaagtgagaagctcctcgctgaacttgacagatcaggactcccttccgcgcccggtgctcctcgcagaagagggtctatgcccgtgccatataaacatcaactgaggagagcacaggcagtagatgagctcgactggccccctcaggccagcagttctggttcgtctgattcgctcgggtctggagaagcagccccagcacaaaaggatggtattttcaaagtgatgcttgtgggggaaagtggtgttgggaaaagcaccctggctggaacatttggaggcttgcagggcgactctgctcacgagcccgaaaaccctggtggctgtcgccgggtggccgctggccccttaccaagcgaccgaggccggctttctcatagactgctgtcgcaccgcccgactgaattcctccagtcctccagggatcccacgtcagccccaggatgggaagccgccccaagaccaacccgttatccacggtggaaacaggaacggctcgggcccctgccgggtggtataacaggcggctgcgtgagctag

SEQ ID NO: 29418 - DNA, 897 bp, Artificial Sequence
  Description of Artificial Sequence: Synthetic coding sequence
atgacactcaatacggaacaggaggccaagacgccactccataggagagcatccacgccgctcccgctgtcgccacgcgggcaccagccaggacggctgagtaccgtgccgagcacccagtctcagcaccccagactgggacaaagcgcttccctaaatccacccacccagaaaccttctcccgcacctgacgactggagttccgagtcctcagactctgaggggtcctgggaagcgctttatcgcgtggtgttgctgggagaccctggagtgggcaagacctccctggctagcctttttgcagggaaacaggagcgcgatctacacgagcagttaggcgaagatgtctatgaaagaacgttgactgttgatggcgaggacaccactttagtcgttgtggacacatgggaggccgagaaactggacaaaagctggagccaagagtcttgtctgcagggcgggtcagcctatgtcattgtttactcaattgccgatagaggctccttcgaaagtgcatccgagctgaggattcagctaagacgtactcatcaggccgatcatgtgccgatcattctcgtgggtaacaaggcggacttggctcgctgtcgggaggtgtcagtggaggagggcagagcctgcgccgtcgtgtttgactgcaaattcatagaaacctcagctacgcttcaacacaatgttgccgaattgttcgagggggtggtgcgccagctgcgtctcagaaggcgcgacagcgcggccaaagagccacctgcccctaggaggccagcctccctagctcagcgcgcgaggagattcctagcccggctgactgcccgaagcgcacggcggcgcgctctcaaggccaggagtaaatcttgccataacctagcagttctatag

SEQ ID NO: 29419 - DNA, 2352 bp, Artificial Sequence
  Description of Artificial Sequence: Synthetic coding sequence
atggagtcacccggcgagtctggagctggcagcccaggtgccccaagcccttcttctttcacaacgggacacctggcccgagaaaagcctgcccaggatcctctgtatgacgttcccaacgcctcaggaggacaagcgggaggacctcaacgaccaggacgtgttgtttctctcagggagaggctgttattaacccgcccggtgtggctacagctgcaggcgaatgccgccgctgcactgcatatgctccgtaccgagcccccaggaacatttctggtccgtaagagtaacactcggcaatgccaggcactctgcatgaggttacctgaggccagcggaccgagctttgtgagtagccattacatcctggaaagtcccgggggggtcagcctcgaaggcagtgaactaatgtttcccgatcttgtgcagttaatctgcgcctattgtcacacacgcgacatcttactgctgcccttgcagctgccgagagctatccaccatgctgccacccacaaggagcttgaagcgatatcacacctggggattgagttctggtcttcatctctcaacattaaggcacagagggggcctgctggagggcctgtccttcctcagctgaaggccaggtctcctcaggagttggatcaggggacaggggctgcattatgcttcttcaaccccctcttcccaggcgacttaggccccactaaacgagagaaattcaaacgtagctttaaagtccgggttagtacagagacgagttcccctctgagcccacctgccgtaccgccaccccccgtgccagttctgccgggagccgtgccttcacagacagaacgtctgcccccctgccagttgttacgcagagaaagctcggtcggataccgggtccccgctggaagcggaccttctctgccaccaatgccgtccctccaagaggtggattgtggatcaccaagcagttcagaggaggagggcgtgccgggcagtagaggttcacctgctacatctcctcacctcggacggcggagacccctcctccgcagcatgtccgccgcattctgttctctgttggctccagagcgccaagttggccgagccgccgcagccctgatgcaggacaggcataccgccgctgggcagttagtgcaggacctccttacccaagtcagagcaggacccgagcctcaagaactccagggcatacggcaggcactgtcaagggccagagcaatgcttagtgctgagctgggccccgaaaaactcctaagccccaaacgattggaacatgtcctggaaaaatccctgcactgcagtgtcttaaagcctctgagaccaatactggctgccaggcttcgcaggaggcttgcagccgatgggtccttgggcaggctcgctgaaggtttgcggcttgcacgggcccaaggaccgggtgcgttcggcagtcatctctcgctgccttcccctgtggagctggaacaggtgcggcagaagctgttacagcttctcagaacctactccccatctgcccaggtcaagcgccttctgcaggcttgcaaactcctgtatatggcccttagaacccaggaaggagaaggcgccggagctgacgagttcctgccactgttgagcctggtcctcgctcattgcgacctgccagaactccttctggaagcggagtacatgtctgagctcttggagcccagccttctgaccggcgagggaggctactatctcacaagcctgtcagctagtctggcgctgttgtctggtctggggcaggcacacactctgcccctgtctccagttcaggagctgaggcgaagtttatcattgtgggagcagcgaagactcccagcgacacattgcttccagcacctgctgcgcgtcgcatatcaggacccttcctctggctgtaccagcaagacccttgctgtcccccctgaggcttcaattgctacattgaatcaactctgcgcgacgaagtttcgtgtgactcagcccaacacatttgggcttttcctttacaaagaacagggataccacagactgcctccaggagcgcttgcccaccgcttacccacaacaggatatctggtgtatcgaagggccgagtggccagagactcagggagctgtaacagaggaagaagggagcggacaatctgaggcccgctcgaggggtgaagagcaaggatgtcagggcgatggggacgcaggggttaaagcaagccccagggacataagggagcagtccgagaccactgctgaggggggccagggccaggcgcaggaaggcccagcacagccgggcgaaccggaagccgaagggtccagagcagcggaggagtag

SEQ ID NO: 29420 - DNA, 1818 bp, Artificial Sequence
  Description of Artificial Sequence: Synthetic coding sequence
atgcgcctgcccgaagcctcagggcccagttttgtgtcttcccactatattctggaatcacctggcggcgttagcttagaaggaagcgaactcatgtttcccgacctggtgcagctgatttgcgcatattgccatacacgggacatcctgttgttacccttgcagctgccacgggccatccatcatgcagcgacgcacaaagagttagaagccatctcccatctggggattgagttctggagcagcagcctgaacatcaaggcccagcgcggacctgctggagggcccgttctgcctcaactgaaggcccggagtccccaggaacttgaccaggggactggagcagctttatgcttcttcaatccgctattccctggagaccttgggcccacaaagcgagagaaattcaagcggtcgtttaaggttcgcgtgtcaacagagacttctagccctctcagcccccctgcagtcccgccccccccagtgcccgtcctgcctggggctgtaccaagtcagactgaacggctgcccccttgccagctccttaggcgagagagtagcgtaggttaccgcgtaccagctggctccgggccttcgctccctcccatgccatcccttcaggaggtggattgcgggagtccaagctcctctgaggaagagggagtgcccggttcccgggggtcccctgctaccagtccccacctggggaggcggagacccctcctgcgatccatgtctgccgcattttgttcgctgttggcgcccgaaagacaggtaggccgggcggcagcggctcttatgcaggataggcatacggccgccggacagcttgtacaagacttgctcactcaggtgcgggccggtcccgaaccccaagagctgcagggaatccggcaggctctgagtcgcgcgagggcgatgttatctgccgagctcggccctgaaaaactgctaagccctaaacgcttggaacacgttctagagaagtcactgcattgctccgtccttaaaccactgaggccaatccttgctgccaggttgcggcgccgcttggccgccgacggctctttgggtcgattagcggaagggttgcggttggctagagcacagggacccggcgccttcggcagtcacctgtctttgccctcccctgttgagcttgagcaagtccggcagaagctactgcagctgctccgcacatactctcccagcgctcaggtaaagcgcctgctccaggcttgtaagctcttgtacatggccctgcggacccaggaaggcgagggagctggcgcagatgagttcctgcctctgctctccctggttctcgcccactgcgacctgcctgaactattattagaggcagaatatatgtcagagctactggagccgtcccttctcactggagagggtgggtactatctcacctcattatccgctagcctggccctgttgtccggactcggccaggctcacaccttgccactgtctcccgtgcaagagctcaggagaagtctgtctctctgggagcagcgccggctgcctgcaacacattgttttcaacacctgctccgggtcgcctatcaggatccctcctccggctgtacaagcaagacactcgctgtaccacccgaggctagtatcgccacactaaatcaactctgcgctaccaagtttcgcgttactcagcccaatacattcgggctgtttctgcaagggaatcagaggcagcgggaagccggccagcagagatctagcctgaagtggcctgagggcagcttcggagcgggggaccctgaacctgccgaaaagtcgttttag

SEQ ID NO: 29421 - DNA, 1935 bp, Artificial Sequence
  Description of Artificial Sequence: Synthetic coding sequence
atggagcagctctcggacgaagaaattgatcacggtgctgaggaggacagtgacaaggaagaccaagacctggataaaatgtttggcgcatggttaggggagttagacaaactcactcagtcgctggactcagacaaaccaatggagcccgtaaagaggagccccctgcgccaggaaacgaatatggccaacttctcgtatcgattttcaatatataatctgaacgaggcattgaaccagggcgaaaccgtcgacctggacgccctcatggcagacctgtgttctatcgagcaggagctctcctctattggatcaggaaacagcaaaagacagattacagagaccaaagccactcagaagctgcccgtgagcagacataccctgaagcacggcaccctcaaaggtctcagttccagtagcaatagaattgcaaaacccagccacgcgtcctatagtctagatgacgtgaccgctcagttggagcaagctagcttgtcgatggatgaagcggcacagcagtcagtgctcgaggatactaaaccattggtgaccaatcagcaccgtcggaccgcctcagctggcacagtgtctgatgccgaggtgcatagcatcagtaatagctcccacagttccatcacatccgcagcctcttccatggacagccttgacattgacaaggtcacccgccctcaggagcttgacttgacccaccagggccagccgattacagaacatgctatctcactgcggtgcagcagtaaacaggcgaaaagacatatcgacttcactgaggaacaggcggagctgacccctcactcttatctggaccgggaaacttctctgttgttaagaaatatagctggcaaaccttcacacctactcacgaaggaagaacaggctgccaaactgaaagcagagaaaattcgtgtagccctggagaagattaaggaagcgcaggtgaaaaaactggtgattcgtgttcacatgagcgacgacagcagtaagacaatgatggttgacgagcgacagaccgtaagacaggtgctggataacctgatggataaaagccactgcggatacagcctcgactggagcttagtggagaccgtgagcgagttacaaatggagaggattttcgaagaccatgaaaatctggtcgagaacctgttaaactggactagagatagtcagaacaagctgattttcatggaaaggatcgagaagtatgccctgttcaagaacccccagaactatctgttgggaaaaaaagaaaccgcggagatggcagaccgcaataaggaggtactgctggaggagtgcttttgtggatccagcgttaccgtgccagaaattgaaggtgtgctgtggctgaaggacgacgggaaaaagagctggaagaagcggtattttctactgcgcgcatctgggatctactatgtccctaagggtaaggcgaaagtctcccgagacttagtctgctttctgcagctcgaccatgttaatgtgtactatgggcaagactacagaaacaagtataaagcgcccaccgactactgcctcgtattaaagcatccgcaaattcagaagaagtcccagtacatcaagtacctgtgctgtgacgacgttagaactcttcatcagtgggttaacggaatcagaatagccaaatacggcaagcagctctacatgaactatcaggaagccctgaagcgcactgagagtgcctatgactggacatcattgtcttcctcatctataaagtccggctccagctcatcatctatcccagaatctcagtcaaaccactccaatcagagtgattctggggtaagcgatacccaaccggctgggcacgtacggtcacaatccattgtgtctagcgtgttttctgaggcttggaaacgaggaacacagttagaggaaagctccaaatag

SEQ ID NO: 29422 - DNA, 3753 bp, Artificial Sequence
  Description of Artificial Sequence: Synthetic coding sequence
atggagcagctgagcgatgaggagattgaccacggggcggaggaggactcagataaggaggaccaggacctggacaaaatgtttggggcttggctcggagagctggataaattgacccagtctctcgatagcgacaagcctatggaaccagtgaagcggtctccccttaggcaggaaaccaacatggctaatttttcatatagattcagtatctacaacctaaatgaggccctcaatcagggggaaaccgtagatttggatgccctgatggctgacctgtgtagtattgaacaggaactcagcagcatcgggagtggaaactccaagcggcaaataaccgagacaaaggctactcagaaactgccggtgtcacgccacacactgaaacatggtacactcaagggacttagttccagttctaaccgcatcgcaaaaccctctcacgccagctattctctcgacgacgtcactgcccagctggaacaagcttccctcagcatggatgaggccgcgcagcagagtgtactcgaagacacaaagcctctcgtcacaaatcaacaccgtagaaccgcctctgctggcactgtgtcagatgctgaagtacactctattagtaacagtagtcacagtagcataactagcgccgcatcctctatggatagcctggacattgataaagtgactaggcctcaagagctggacctcacccatcagggccagcccattacagaggaggaacaggccgcaaagctgaaagccgaaaagattcgggttgcactggaaaagataaaagaggcccaggtgaagaaattagtgatcagggttcatatgtcagatgacagcagcaagactatgatggtcgacgaacggcagaccgttaggcaagtactggacaacctcatggataaaagtcattgcggctattcccttgactggtctctggtcgagacagtctcagaactccagatggagcggatcttcgaggatcacgagaaccttgtagagaatctcctcaattggacccgcgactctcagaacaaattaatctttatggagcggatcgaaaaatacgcacttttcaagaacccgcagaattatctgctcgggaaaaaggaaaccgctgagatggccgatagaaacaaagaagttctgctcgaggagtgcttctgcggtagcagcgtaaccgtgcccgagattgagggggtcttgtggctgaaggacgacgggaaaaaatcatggaaaaaaaggtatttcctgctgagggcgtccgggatctactatgtgcctaagggaaaggcaaaagtgtctagggatctagtttgttttctacagctggatcatgtgaacgtctactatggacaagattacagaaacaagtataaagcccccactgactactgcctggtcctcaaacacccacagattcagaagaaatctcagtacatcaagtatctgtgctgcgatgacgtgcgtactctgcaccagtgggtgaatggcattcgcatcgccaaatacggaaagcagctttatatgaactatcaagaggctctgaagcggaccgaatctgcctacgactggacaagcttgagttccagcagcatcaaatctggctcctcaagttcatctattcctgagtcccagtctaaccactccaatcagagtgactcaggcgtcagtgatacccagcctgccggccacgtccgcagccagagcattgtgagttccgttttcagcgaggcctggaaacgcgggactcagcttgaggagagctctaaagctagaatggagagcatgaacagaccctacaccagccttgtcccccctctttcaccacagccaaaaatcgtaaccccatataccgcatcccagccatcaccgcccctgccgccgccgcccccacctccaccccctcccccgccaccccccccacctccacctcctcccttgccttcacaaagcgcgcccagtgccggaagcgctgctcccatgttcgtcaagtattcaaccatcacccgcctgcaaaacgcatcccaacatagtggggcccttttcaagccgccaactccacctgtgatgcaatcccagagcgtgaaaccgcaaatcctagtgcctcctaatggagttgtcccacccccaccccccccccctccaccccctacccctggcagcgccatggcgcagcttaagccagccccttgcgctccatctttaccacagttcagcgcccctcctccgcctcttaagattcaccaggtgcagcatatcacacaggtggctcccccaactccccctccgccacccccaattccagctccccttccacctcaggctccccctaagccactggtgaccatccccgcccctacatctactaagacagtcgcccctgtggtcacacaagcggctccaccgaccccaacgccacctgttcctccggctaagaagcagccggcatttcctgcgagctacattcccccttccccccctaccccccccgtgcctgtgcctccacccacactgccgaaacaacaaagcttctgcgctaaacctccacctagcccgttgagcccagtgccgagtgtggtgaagcagattgcatctcaattccccccccctccaaccccaccagctatggagagtcagccacttaagcctgtgcctgccaacgtggccccacaatctccccctgccgtcaaagccaagcccaagtggcaaccaagctcgatacccgtgccttctcccgatttccccccaccgccaccagagtcctctctcgtgttccctccaccacccccttcccccgttccagcccctcccccacccccacccccaactgccagtccgactccagataagtctggttcgccaggaaaaaagacatcaaaaacctcctcgccgggcggaaagaaaccccccccaacaccacagaggaactcttccattaagtcaagctcaggtgctgaacatccagaaccaaagcggccctccgtagacagcttagtttccaagttcacacctcccgcagaatccggaagccctagcaaagagaccctgcccccgccagccgcaccgccaaagcctggtaagctgaatttgtccggggtcaatctccctggcgttctgcagcagggttgcgttagcgcgaaggcgcccgtcttgtccggcaggggtaaagactctgtggttgaatttccgtcacctccctccgacagtgatttccccccaccacctccggagacagaactgcctctgccacctattgaaatcccagctgtgttcagcggtaacacctcccctaaggtggccgtggtgaacccacagccacagcagtggtctaaaatgagcgtgaaaaaggctccaccaccaacccggccaaagcgaaatgattccacacggctgacacaggccgagattagtgagcagcccaccatggccaccgtcgtacctcaggtccctaccagtcccaagagttctcttagcgtgcagccgggtttcttagccgacctgaatagaaccctgcagagaaagtctatcacccgacatggctcattatcatccagaatgtctagggcagaaccgacagccacaatggatgatatggccctcccccctcccccccccgagctgctctcagaccagcaaaaagctggctacggagggagccacatctctggctacgccacgctcaggcgaggcccgcctccggctcccccaaaacgagaccagaacaccaagttgtcccgcgattggtag

SEQ ID NO: 29423 - DNA, 1854 bp, Artificial Sequence
  Description of Artificial Sequence: Synthetic coding sequence
atggaacagttaagcgatgaagagattgaccatggcgccgaagaagactctgacaaagaggatcaggaccttgataaaatgttcggggcctggctcggtgaacttgataaattgactcagagcctggatagcgataagccgatggaaccggtgaaacggagccccctgaggcaagaaacgaacatggcaaatttcagttacagattcagtatatataatcttaacgaagcccttaaccagggcgaaaccgtggacttagatgccctgatggcagacctgtgctccattgaacaggagctgtcttccatcgggtcagggaatagcaagcgccagatcactgagaccaaggctacccaaaaactgccagttagtaggcatactctgaagcatggaaccttaaagggtctctctagcagtagtaatcgaattgccaaacccagtcatgctagctactcactggatgacgtgacagctcagctggagcaggcctcgctatctatggatgaggcggcccagcagtcagtacttgaagatacgaagccactagtgacaaatcagcataggcgtacagcctccgccggaacagtatcagatgctgaggtgcattccatttccaatagttcccattcttctattaccagcgccgcttcgtccatggacagcctcgacattgataaagtcacaagacctcaggagctggatttaactcaccagggccagcccataacggaacatagctatctggatcgagagactagcctgctcctgcggaacatcgctgggaaaccaagtcatctattgacgaaagaagagcaggccgcaaaactaaaagccgaaaagatccgggtcgccctcgagaagatcaaagaggcgcaagtgaaaaaacttgttatcagggtccacatgtctgatgacagtagtaaaacaatgatggttgacgaacgccaaaccgtgaggcaagtgctggacaatctgatggacaaaagtcattgcggatatagtctggattggtctttagtagaaacagtttcagagctgcagatggagcggattttcgaggatcatgaaaatctggtggaaaacctgctgaactggacaagggattcccagaacaagctgatctttatggaacgcattgaaaagtatgctctcttcaagaatccacaaaattacctgctgggtaagaaggagacggcagagatggccgaccgcaataaagaagtcttactggaggagtgcttttgcggttctagcgtgacggttccagaaatcgaaggggtgctctggctcaaggacgacgggaagaagtcctggaagaaacggtatttcctgctgcgggcaagcggcatatattatgttcccaagggaaaagcaaaagtgtcacgagatctggtgtgtttccttcagctggatcacgtgaatgtgtattacggccaggattaccgcaacaagtataaagctcctaccgactactgtctggtgctgaaacatccacagattcagaagaagtcgcagtacattaagtacttgtgttgcgacgatgtccgcacactgcatcagtgggttaatgggattaggattgcgaagtatggcaagcagctgtacatgaattatcaggaggccctcaaaaggacagagtccgcctacgactggaccagtttgtcctcctccagtattaagtcagggtcatcctcttcttcaattcccgagtctcagtcaaatcattccaaccaaagcgattccggcgtatcagatactcagccagctggccacgttaggtcccagtccattgtatcaagtgtgttttctgaggcttggaagaggggtacccagctagaggagagctctaaatag

SEQ ID NO: 29424 - DNA, 1860 bp, Artificial Sequence
  Description of Artificial Sequence: Synthetic coding sequence
atggaacaactctcagacgaagagatcgaccatggagctgaagaagacagtgacaaggaggaccaagacttagacaagatgttcggagcctggctaggcgagctggacaagctgacccagtctctggatagtgataagcccatggaaccagttaaacgcagccctctgagacaggagaccaatatggccaacttctcctaccgtttttcaatctataatctgaacgaagctctgaatcagggggagactgtggacctggatgccctcatggctgatctgtgctccattgagcaggagttgagttccattggatctggcaattccaagaggcaaatcaccgaaacaaaggccacacagaaactcccagttagtcgccacactcttaagcacggcacactaaaaggcctttcttcatcctctaaccggatcgccaaaccctcacatgcttcttactccctggatgatgtaaccgcccagctcgaacaagccagcctcagcatggacgaggcagcacagcagagtgttcttgaggacacaaagcctctcgtgactaaccagcatagacgaaccgcgtcagcgggaacggtctcagacgccgaggtccactctataagtaactcatcccatagcagcatcacgtccgccgcatcctccatggatagtctcgacattgataaagtcactcgcccccaggagttggacctgacacatcaaggtcagcctataaccgagcatgcgatatcactccgatgttccagcaaacaggcaaagcgacatatcgactttaccgaagaacaagctgaactgacaccagaggaacaggccgccaaattgaaggccgaaaagattagggtggcactggaaaaaataaaggaggcccaggtgaagaaactcgtcatcagagttcatatgtctgatgactcctccaaaactatgatggtggatgaacgtcagactgttaggcaggtgcttgacaatctgatggataaaagccactgcggctactcccttgactggagcctagtcgagactgtgagcgaattgcagatggaacgcattttcgaggatcacgagaatcttgtcgagaacctgttaaattggacccgagactcccaaaataagctgatctttatggaacggattgagaaatatgcactgtttaaaaatccccagaattacctgctcgggaaaaaggagacggcagaaatggcggaccggaataaggaggtgctcctggaggagtgcttttgtggctcctctgttacagtccctgaaattgagggcgtgttatggcttaaggacgatggcaagaagtcttggaagaagagatactttctgctccgagcctccggcatctactatgtgcccaagggcaaggcaaaggtgtcccgggacttggtatgcttcctccagcttgatcacgtgaatgtgtactatggtcaggactaccggaataaatacaaggccccgacagattactgcctagtgctcaaacatcctcagatacagaagaaaagccagtatatcaaatacctttgctgtgacgatgtgaggacattacatcagtgggttaacgggattagaatcgccaagtatggtaaacagctgtatatgaactaccaggaggccctaaagagaactgaaagcgcctacgattggacgagcttgtcttccagctccatcaagtccgggagctcatcttcatctatccctgagtcccagtctaatcatagcaaccagagcgatagtggcgtgagtgatactcagccggcaggacatgtcaggagtcagtccatcgtctccagtgtcttttcagaggcatggaaacgcggaacacagcttgaagagtcaagtaagtag

SEQ ID NO: 29425 - DNA, 3909 bp, Artificial Sequence
  Description of Artificial Sequence: Synthetic coding sequence
atggaacagctgagtgatgaggaaattgatcatggtgccgaagaagattcagataaagaggaccaggatctggataagatgttcggggcttggctcggtgaactggataagctcacacagtctttagattcagacaagcccatggagcccgtgaagcggtctccactgaggcaggagacaaacatggccaacttctcttatagattttctatctataatctgaacgaagcactcaatcagggtgagacggtggatttagatgccttaatggcggacttgtgctcaattgagcaggaactgagctcaatcggttctggcaactccaagcgacaaatcaccgagacgaaggcaacacagaagctgcccgttagcagacacacactcaaacacggcacactgaagggtctgtcatctagctccaataggatcgccaagccatcccacgcctcctacagcctcgacgacgtgacagcacagctggaacaggcttctctgtccatggacgaggctgctcagcagtctgtcctggaagatactaagccactcgtcacgaaccagcacaggcgtacagcctccgccggcactgttagtgacgccgaggtccacagtattagcaattcaagccactcctccatcacttccgcagcaagctctatggattcccttgatatcgataaggtcacacggccccaggagctcgacctcacacatcagggccagcctatcacagagcatgctatctctctgcgctgcagctccaagcaggccaagagacatatcgatttcaccgaggagcaagcggagcttacaccacattcatacctggatcgcgaaacaagcctgctgctgagaaatatagccggcaaaccatcccacctcctgaccaaggaagaacaagctgctaagttgaaagccgaaaaaatcagggtagcccttgagaagatcaaggaggctcaggttaagaagctggtgattcgcgtacacatgtccgacgactcgtctaaaactatgatggttgacgagcgccagacggtgaggcaagtgttagacaacctgatggacaagtcacactgtggatatagtctggactggagcctggttgaaaccgtctccgaactccagatggagagaatattcgaggaccacgagaatttagtcgagaatctgctgaattggacaagagactcccaaaacaagctaattttcatggagaggatcgaaaagtatgctctgttcaagaacccgcaaaactatttgcttgggaagaaggagactgccgagatggccgatcgaaataaggaggtcctcctggaagaatgcttttgcggcagtagtgttactgtacccgaaattgaaggtgtgctgtggctaaaggacgacgggaaaaaaagctggaagaagcggtactttctgttgcgggcttctggcatctactatgtacctaaaggaaaggcaaaggtatcaagagacctggtgtgctttttgcagctggatcacgtcaatgtgtattatggacaggactaccgcaacaagtacaaagcacctaccgactattgcctggtgctaaaacatccccaaatccaaaagaagtcccagtacattaaatacctttgttgtgacgatgtaaggactcttcaccagtgggtgaatggcattcggatagccaaatacggtaagcagctctatatgaactatcaggaagctctgaaacggacagagtctgcgtacgattggacatccttatccagttcttccattaagagcggctcgtcttcttcaagtataccggaatcacagtctaaccactctaaccagagcgattccggcgtctccgacacccagccagccggccacgtcagaagccagagtatagtgagctcggtcttcagtgaggcatggaagcgcggaacacagctcgaagagtcatctaaggcccgcatggagagtatgaatcgcccctatacatcactggtccctcccctgtctccccagccaaaaatagtgactccctacacggcatctcagcccagcccacctctgcccccaccacccccacccccccctcctccaccaccacctcccccccctccccccccacccctgcccagccagtcagccccatctgctggcagtgccgcgcctatgttcgtcaaatactctaccattacacggctccagaacgcatcgcagcactctggtgccttgttcaagcccccaacaccccccgttatgcagagccagagcgtaaagccccaaatactggtgcctcctaatggggtggtacccccacccccgccaccccctccacctccgacaccaggcagtgccatggcccagctgaaaccagctccatgtgcgccctccctaccccagtttagcgcccctcccccaccccttaagattcatcaggtccagcacattacccaggttgctccccccacccctccacccccacctcccatcccagccccactcccaccgcaggccccccccaaaccgcttgtgacaattcctgcgccaaccagcactaagacagtcgctccagttgtcacccaggccgctccacccacccctacaccccctgtgcctccagccaaaaagcagccagcattcccagcctcttacatccctccttcccctccaactcctcctgtgcctgtgcccccccccactctcccgaagcaacagtctttctgcgcgaaaccccccccatcaccgctgtcccccgtgccgagtgttgttaagcagatcgcatcacagttccctccccccccaactccccccgctatggagtcgcagcccctgaagcccgtgcccgctaacgtggcccctcagagcccccccgccgtgaaagcaaagccaaagtggcaaccctcctcgatcccagtacctagtcccgacttccctcccccaccccctgagtcttcactagtgttcccacctccaccaccgtcccccgttcccgccccccccccaccaccgccccccacagcctcccccacgcccgacaaatctggaagcccaggtaagaagacatcgaagaccagcagccccggcggaaagaaaccccccccgacgccccagcgcaactcctcaattaaatctagctccggtgccgagcatccggagccaaaaagaccatccgtggattcactagtttctaagtttacacctcctgctgaatcggggtctcccagtaaggagacgctacccccgcctgctgcccctcccaaaccaggcaagctcaacttgtctggcgtgaatctccccggtgttctgcaacaggggtgtgtgtccgctaaggcccctgttctgtctggccggggaaaggacagcgttgtagagtttccgagcccaccctcagattccgatttccctccacccccacctgagaccgagttgccactcccgcccatagagatccccgctgtgttctctgggaacacctctcccaaggtggctgttgtcaacccacagccccagcagtggtccaaaatgtctgtcaaaaaagctcctcccccaacgagaccgaaaagaaacgatagtacaaggttgactcaagcagaaatctcggagcaaccgaccatggcgactgtcgttccccaggtgcccacaagtccaaagtctagcctaagtgtgcagccaggcttcctggcagatctgaatcgcaccctccaacggaaatccataacccggcatggctccctatcttctcgcatgagtcgggctgagcccaccgcaactatggatgatatggcgctcccacctcctccccctgagctcctgtccgaccagcagaaggccggatatggcggatcgcacattagcggttacgcaactttgagacgcgggcctccgcctgccccacccaaacgcgatcagaatacaaaactcagtcgtgactggtag

SEQ ID NO: 29426 - DNA, 1875 bp, Artificial Sequence
  Description of Artificial Sequence: Synthetic coding sequence
atggaacagctgtcggatgaggaaatcgaccacggcgccgaggaagacagtgacaaggaggaccaagatctggataaaatgttcggcgcttggctcggcgaactggataaactgacacagagcttagatagtgataagcccatggagccagtcaaacgctctcccctgcgtcaggagactaatatggcaaacttcagttataggttctccatctacaatctcaacgaagcgctcaatcagggggaaaccgttgacctggatgcgctaatggccgacctatgctctatcgagcaggaactcagcagcatcggctccggtaactccaagaggcaaattaccgagaccaaagccactcaaaaactccctgtgagcagacacaccttaaagcatggcacacttaagggactgtcttcttcatctaatagaatcgccaagccttcccacgcttcttatagcctcgatgatgtgaccgcgcaactggagcaggcctctctcagcatggatgaagccgcccaacaaagcgttctcgaagacaccaagcctttggtgacaaatcagcatcgccggacagccagtgcgggcacagtatcagatgccgaggtccattctatcagcaattccagccatagctccatcacatctgccgcttccagcatggattcattggacattgataaggtcaccaggccgcaagagttagacttgacgcaccaagggcagccaatcaccgagcatgctatatcactgcgctgtagctctaagcaggccaagcgacacatagactttaccgaagaacaagcggaactgacgccagaggaacaggcagccaaacttaaggctgaaaagatccgggtcgccctggaaaaaatcaaggaggctcaggtgaagaagctggtgatcagggttcatatgagtgatgatagcagtaagacaatgatggtcgacgaaaggcagacagtgaggcaggtgctcgacaacctcatggacaagagccattgcgggtacagtcttgactggtcgttggtcgagactgtgagcgagctgcagatggagcgaatttttgaggaccacgagaatctggttgaaaatctgctcaactggacccgggactctcaaaataaattaatcttcatggagaggatcgaaaagtatgcgctcttcaaaaacccgcaaaactatctgctaggtaaaaaggaaacggctgagatggccgaccgaaacaaggaggtcttattggaggagtgcttctgtggttcttccgtcaccgtaccggagatcgagggagtcctgtggctgaaagacgacggcaaaaaaagctggaaaaaacggtattttctgctacgggcttccgggatttattatgtcccgaaaggcaaggccaaagtcagccgcgacctcgtctgcttcttacagttggatcatgttaacgtctactacgggcaggattatagaaacaaatacaaggcacctaccgattattgcctagtcttgaagcacccacaaattcagaaaaagtctcagtacatcaagtatttgtgttgtgatgacgttcgcaccctgcatcaatgggtgaatggaatccgcattgccaaatatggcaaacagctgtatatgaactaccaggaggctctgaagcggactgaatctgcctatgactggacgtcactgtctagttctagcataaaaagtggttcctcaagcagtagcattccagaatctcagtccaaccatagcaaccagagcgactctggcgtgagcgacactcaacccgctgggcatgtgcggtctcagtccattgtctcatctgtgtttagcgaggcttggaagaggggcacacagctggaagaatcaagcaaagtcacggcttcgttctag

SEQ ID NO: 29427 - DNA, 1794 bp, Artificial Sequence
  Description of Artificial Sequence: Synthetic coding sequence
atggagcagctttctgacgaagaaatcgatcacggcgctgaggaagattcagacaaagaggatcaggacctggataaaatgttcggcgcatggctcggggagctagacaagctgacacagtcgctggattcagataagccaatggagcccgtcaagaggagccctctccgtcaagagaccaacatggcaaacttcagttacaggtttagtatctataaccttaatgaagctctgaatcagggcgagactgtggacctggacgctttaatggcggatttatgtagtatcgaacaggagctgtctagtatcggctcagggaatagcaaaagacagatcaccgaaaccaaggctacccaaaagctcccggtcagcaggcacactctgaaacacggtacactgaaaggcctgagctcatcaagcaatcgaattgccaaacccagccatgcatcctatagtttggacgacgttacagctcagttggagcaggcatccttatctatggatgaggctgcacagcagtcggtgctcgaggatactaaacccctcgtgaccaatcagcaccggcggaccgccagtgcaggcaccgtatccgacgcagaggtccacagcatcagcaacagtagtcactcttccattacaagcgctgcatctagcatggacagtctggacatagataaagtgacccggccacaggaactggatttaacccatcagggacagccgattaccgaagaggagcaggccgcaaaactcaaggcagagaagatcagggtagcgcttgaaaagattaaggaggctcaggtgaaaaagctggtgatccgggttcacatgtctgacgattcatctaagacaatgatggtggacgagagacagaccgttcgccaagtgctggataaccttatggataaatcgcattgtggctacagcttggattggtctctcgtggagactgtgtctgagctccagatggagcgcatttttgaggatcacgagaacctggtggaaaatcttctgaactggactcgagattcacaaaataagctgatcttcatggaacgtatcgaaaagtacgccctgttcaaaaatcctcagaactacctcttagggaagaaagaaactgcagaaatggccgacaggaacaaggaggtgttgctcgaagagtgtttttgtggatcttccgtcactgtgcccgagattgaaggggtgttgtggttaaaagacgacggaaagaagagttggaagaagagatacttcctgttgagggcctcaggcatatattatgtccccaagggtaaggcgaaggttagcagggatttggtgtgcttcctacaactcgaccatgtaaatgtgtactacgggcaagattatcgaaacaaatataaggcacccactgattactgcctagtcctcaaacaccctcagatccagaagaagagccaatatattaaatacttgtgttgcgatgacgtccgtactctacaccaatgggtcaacggaattcgcatcgccaaatacggaaagcagctgtatatgaactatcaggaagcattaaagcgtacagagagcgcatacgattggacgagcttaagcagtagcagcatcaaatccggtagcagctcaagctccattccagagtcccagtccaaccatagcaatcagagcgactcaggtgtctctgacacacagcctgcggggcacgtaagaagccagtccatcgtctctagcgtgttctccgaagcctggaagaggggaacacagctggaagaatcatctaaggttaccgccagcttttag

SEQ ID NO: 29428 - DNA, 1779 bp, Artificial Sequence
  Description of Artificial Sequence: Synthetic coding sequence
atggaacaactttccgatgaagaaattgaccacggtgctgaggaggatagtgataaggaagaccaggatctggacaaaatgttcggcgcctggctgggagaactcgacaaactgacccagagcctggactcagataagccgatggaaccagtgaagcgatcacctctgagacaggagaccaacatggccaatttcagctatagattctctatctacaaccttaacgaggccctcaaccaaggcgagacggtcgatctcgatgctctgatggcagacttgtgcagtatcgagcaggagctgagcagcataggaagcggcaactcgaagagacagatcacagaaaccaaagctacccagaagctgccagtttctcggcatactctcaaacacggcaccttgaagggcctatctagcagtagcaatagaatagcaaagccgtcccacgcctcatatagcttggatgacgtgaccgcacagttggagcaggcctcattgtctatggacgaggctgcccagcagtctgtattagaggataccaaacccctggtgactaaccaacatcggcgcactgcttcagcgggtactgtttcggatgcagaggtgcatagtataagcaactcgtcacactccagcatcacctccgcagccagttccatggattctttagacatcgacaaagtaacccggccgcaagaactcgacttaacacatcagggtcagccaatcactgaggaagaacaggccgccaagctgaaggccgagaagattcgtgtagccttggagaaaataaaagaagcccaggtaaagaaactggtgatacgcgtccatatgagtgacgattctagcaagactatgatggtcgacgaacgtcagaccgtgaggcaggtgctggataatctaatggacaagtcccactgcgggtacagcttggactggtctcttgtggagacagtctccgagctgcaaatggagagaatctttgaggatcatgaaaaccttgtggaaaacctgctgaattggacccgggacagccagaataaactgatttttatggaaaggatcgaaaagtacgccctgttcaagaatcctcaaaattatttactgggcaaaaaggagacggctgagatggctgaccgaaataaggaggtgttgctggaagaatgcttttgtggttcatcggtgaccgtaccggagatagagggggtgttgtggctaaaggacgatggaaaaaaatcatggaaaaaaagatacttcctcctcagggcgtcgggaatctactatgtgccaaagggcaaggccaaggtgtccagggaccttgtatgcttcttgcagctggatcacgtgaatgtatactacgggcaggattatagaaacaaatataaagctcccactgattattgtcttgtccttaaacacccccaaattcagaagaagtcccagtatatcaagtacctttgttgcgacgatgttcgaacactccaccagtgggttaatgggatcaggatagctaagtatggcaaacagctttatatgaactaccaggaggccctgaaaaggacagaaagcgcttacgactggactagcttatcttctagcagcattaagtcagggtcctcctctagcagcattcctgagtcacagtccaaccattctaatcagtctgactctggtgttagcgatacccaacctgctggacacgtgcgatctcagtctattgtttccagcgtcttcagtgaggcatggaaaaggggtactcagctggaagaatcttcaaagtag

SEQ ID NO: 29429 - DNA, 270 bp, Artificial Sequence
  Description of Artificial Sequence: Synthetic coding sequence
atggagcagctctcagacgaggaaatcgaccacggtgctgaggaagacagcgacaaagaagaccaagacctagacaaaatgttcggggcttggttaggcgaactcgataagctgacacagagtctggacagcgataaaccgatggaacccgttaagcgctcccccctgagacaggaaactaatatggccaattttagttacaggttcagcatatataaccttaatgcactgaaccaaggagagacagtcgacctggacgccctcatgtag

SEQ ID NO: 29430 - DNA, 1860 bp, Artificial Sequence
  Description of Artificial Sequence: Synthetic coding sequence
atggaacagttgagtgacgaggaaatcgatcatggtgcagaagaggactctgacaaggaggaccaggacctggacaagatgtttggcgcatggcttggggagctggataaactcacacagtccttggactctgacaagccgatggagcccgtcaaaaggtcacccctgagacaggagacgaacatggccaactttagctaccgattcagcatatacaaccttaatgaggcgctcaaccagggcgagactgtagacctggatgcgctgatggctgacctgtgttccatagagcaggagctctctagtattgggagcggcaatagcaagagacaaatcaccgaaacgaaagcaacccagaagttaccagttagccgccacaccttgaagcacggtactctcaagggcctatcttcctcttccaatcgtatagccaagccttcccatgcctcctattccctcgacgatgtcactgcccagctggaacaagcctcgctctcaatggatgaagctgcccaacagtccgttttggaggacacaaagccacttgtgacaaatcagcaccgcaggaccgcttcagctggcaccgtcagcgatgctgaggtgcacagtatctccaactcctcacactccagcattacgagcgcagcgtcgtcaatggactcccttgacattgacaaagttactcggcctcaagagctcgacttaacgcatcaaggccagcccataaccgagcatgccatttctcttagatgttcttccaaacaagcaaaacggcatattgattttacggaggagcaagcagagctgacccctgaagaacaggccgctaaacttaaggccgagaagatccgcgtggctctggagaagataaaagaagctcaggtaaaaaagttggtgatccgcgtgcacatgtccgatgactcctcaaagacgatgatggtcgacgaaaggcagactgttcggcaggtgttagataatctcatggacaagtcccattgtgggtattctctggattggtccctggtggagaccgttagcgaactccagatggagaggatctttgaagaccatgaaaacctggttgagaatctgctaaattggacaagggatagccagaataagctcattttcatggaacgtatcgagaaatacgctctctttaagaatcctcagaattacttgctggggaagaaggagacagccgaaatggccgaccgtaacaaggaggttttgctggaggagtgcttctgcggctctagcgtgacagtccccgagatcgaaggagtactgtggctgaaggatgatggcaagaaaagctggaagaaacgatactttctgttgcgagcatccggaatttattacgtgccaaagggcaaagctaaggtctcaagagacctggtctgcttcctgcagctggatcacgtgaacgtgtattacggccaggactaccggaataagtacaaagcccccaccgattactgccttgtcttgaagcatccccagatccaaaagaagagccaatatatcaaatatctgtgttgcgatgacgtgcgaacactgcatcagtgggtgaacggcatcaggatagcaaagtatggaaaacagctgtatatgaactatcaggaggccctcaagagaaccgaatcagcttatgattggacatcactgtccagttcgagcattaagtcaggatcgtctagttctagtatccctgagtcccagtccaatcactccaatcagtcagattctggtgttagtgatacacaacctgcgggacatgtgcggtctcagagcatagtttcctccgttttcagtgaggcctggaaacgggggacacaactcgaggagagtagtaagtag

SEQ ID NO: 29431 - DNA, 519 bp, Artificial Sequence
  Description of Artificial Sequence: Synthetic coding sequence
atggaacaacttagcgatgaagagatcgaccacggcgctgaagaagactcagacaaggaggaccaggatctggacaaaatgttcggtgcctggctgggagagttagacaagctaacacagagcttagattcagacaaacctatggaacccgtcaagcgctctcccctcagacaggagacaaatatggcaaacttttcctatcggttctccatctataatctaaacgaggccctcaaccagggcgagacagtggacctggatgcactaatggcggatctctgttccatcgaacaggaactgtctagcatcggctccggcaattccaagaggcagataacagagacgaaggcgacacagaaactgcctgtttccagacacaccctcaaacacggcaccctgaagggattgtctagttccagcaaccggattgcaaagccatctcatgcctcctatagtttggacgatgtgacagcgcagctggagcaagctagtctgtctatggacgaagctgcacagtag

SEQ ID NO: 29432 - DNA, 1869 bp, Artificial Sequence
  Description of Artificial Sequence: Synthetic coding sequence
atggagcagctctcagacgaagagattgatcatggggcagaggaagactccgacaaggaggaccaagatttggacaaaatgttcggggcctggctgggagagctggataaactgactcagagcctggactccgataaacccatggagcccgttaagaggagccccctccgacaagaaactaatatggctaatttcagctataggtttagcatctataatctcaatgaggccctcaatcagggcgagaccgtggacttggacgctttaatggctgatctttgctccatagagcaagaactgagctctattggctcgggcaattccaagcgccagataactgagaccaaagccactcaaaaattgcccgtttccaggcacaccttaaagcacggtacattgaagggcttgagtagctcttctaaccgaattgcaaaaccttcccacgccagttacagccttgatgacgtaaccgcacagctggagcaagcctcactcagcatggacgaagccgcgcagcaaagtgtacttgaggatacaaagcctctcgttacaaatcagcacagacgtacagcctccgcagggactgtttccgacgcagaggttcacagcatctccaattcatctcattcttcaatcacttctgccgcgtcaagtatggactccctggacatcgataaggtgacgagacctcaggaactggacctgacacaccaggggcagcctataaccgaacatagctatctggatcgagaaacatccctgttgttgaggaacatcgcaggaaagccctcacatctccttacaaaagaagaacaggccgccaaacttaaggccgaaaagattcgggtggctctcgagaaaatcaaggaagcacaggtcaagaagcttgttattcgcgtccacatgtctgatgacagctccaaaacaatgatggtggatgagcgccagaccgtgcgtcaggtcctcgataatttaatggacaagtcgcactgtggatacagcctagattggagcctggtggagacggtatccgaactgcagatggagcggattttcgaggaccatgaaaatctggtggaaaatctgctgaactggacacgagattcacaaaacaagctgattttcatggaaaggattgagaagtatgcactctttaaaaatccacagaattatctcttgggtaaaaaagaaaccgctgagatggctgataggaataaagaagtattgttagaggaatgcttctgcggttcctctgtgacagtgcctgagatcgaaggtgtattatggctgaaggatgatggcaaaaagtcctggaaaaagaggtatttcctcctgcgagcttccggaatctactatgtgcccaaggggaaagctaaagtgagccgggatttggtgtgctttctccaactcgatcacgtcaatgtttattacggtcaagactacaggaataaatataaggcgccgacagattactgtttagtgcttaaacatccacagatccaaaagaaaagtcagtatattaaatacctgtgttgtgacgatgtccgaacactccatcagtgggtaaatggcattcgaattgcaaagtatgggaaacagctttatatgaactaccaggaggccttgaaacgaaccgagtcagcctatgactggacaagccttagtagttcgagcatcaagtcgggctcatcctcttcttctattcctgaaagtcagtcaaatcattctaatcagtcagattccggcgtgtcagacacacagccagcaggccatgtgcgtagtcagtccatcgtcagtagtgtctttagcgaagcttggaagcggggcactcagctggaagagagcagcaaagttacagcgtctttttag

SEQ ID NO: 29433 - DNA, 1854 bp, Artificial Sequence
  Description of Artificial Sequence: Synthetic coding sequence
atggaacaattatctgacgaggagatagaccacggggccgaggaagatagcgacaaagaggatcaggacctagacaaaatgttcggtgcctggctgggcgagctcgacaaattaactcaatccctggatagtgacaaaccgatggaaccagtgaaacgatcacccctcagacaggagaccaacatggccaacttcagttatcgtttttctatttataatttaaacgaagcccttaaccagggggagaccgtggacctggacgcgctgatggccgacctgtgtagcatagagcaagaactcagttcaatcggaagcggcaacagcaaaagacaaattacggagactaaggccactcagaaattgcctgtttcgcgacatactctaaagcatggcaccctgaaagggctgtcttctagttcaaataggatcgccaagccatcccacgccagctattccttagatgatgtcacagctcagctggagcaagcctccttgagcatggacgaggccgcacagcagagtgtgctggaggacacgaagccactcgtaactaaccagcacaggcgcactgcctccgccggcacagtgtcagatgccgaagttcactctatttctaacagctcgcactctagcatcacaagcgcagcctccagtatggacagcttggacatcgacaaggtgacaagaccccaggaattagacctgacccaccagggccagcccatcaccgagcacagttatctggatcgagagactagcctgttactccgcaacatcgctgggaagccttcccatttgctcaccaaagaagagcaggcagccaaactcaaagccgaaaaaattcgcgtcgccctcgagaaaattaaagaggcacaggtgaaaaaactggttattcgcgtgcatatgagcgacgactcctctaaaactatgatggtagatgagaggcagaccgttcggcaagtactggacaatctcatggataagagtcactgtggctacagtctggactggagtttagtagagactgtgtccgagcttcagatggaaagaattttcgaagatcatgagaatctggtagaaaacctgctaaactggacacgagattcccagaataagcttatttttatggagcgcatcgagaaatacgcgctgttcaagaaccctcagaattacctcctggggaaaaaggaaacggccgagatggccgatcgcaataaagaagtcctcctggaggagtgcttctgtggctcttcagtgacagtgcccgaaattgaaggcgtcctctggctgaaggacgacggaaaaaaatcatggaagaagcggtacttcttgctccgagcttcgggcatctattacgttcctaaagggaaagcgaaagtgtcgagggatctggtttgtttcctgcaattggatcatgtgaacgtttactacggacaggactacagaaataagtataaggctccgacagactactgcctggttttgaagcacccccaaattcagaagaagtcacagtatatcaagtacctctgctgtgacgatgtccgtaccctgcatcaatgggtcaatgggatccgcatcgcgaagtatggaaagcagctgtatatgaactatcaggaggcgctgaaaagaactgaatcagcctatgattggacttccctttccagttcctctattaaatctggctccagctcatcatcaattccagagtctcagtccaatcacagtaaccagtcggacagcggtgtgtcggacactcaaccagccggccatgtaagatcccagagtatcgttagctcagtcttttccgaagcttggaaacgtgggacacaactggaagagagctcgaagtag

SEQ ID NO: 29434 - DNA, 1950 bp, Artificial Sequence
  Description of Artificial Sequence: Synthetic coding sequence
atggagcagttgagcgacgaggaaatcgatcatggggctgaggaagactccgacaaagaagatcaggatctggacaaaatgttcggcgcatggctgggagagctggataaactgacacagtccctggattcagacaaacctatggaacctgtgaagcggtcaccactccggcaggagacaaatatggcaaatttctcttaccgcttcagcatttacaacctcaatgaggccctgaaccagggcgagacggtggatctagatgcattgatggccgacctgtgctccattgagcaagagctgtccagcataggatccggaaactccaaaaggcagataacagaaacgaaagctacccagaaacttccagtttcccggcatactctcaagcacggaacactgaagggcctttctagctctagcaataggatcgcaaagcccagtcacgcaagctattccctcgatgatgtaacagctcagttggagcaggcatcattgtccatggacgaggccgctcagcagagcgttctggaagacaccaagcctctggtcacaaatcagcataggaggacagccagtgccggaacggtttcggacgccgaggttcattccatcagcaattcaagtcattccagtattacgtccgctgctagctctatggatagtctcgatatagataaagtgacacgacctcaagagctggacctaacacaccagggacagccaattactgagcatgccatctctctccgctgcagcagcaagcaagcaaaacgccatatcgactttacggaggagcaggcagagctgacaccccacagttacctagaccgagaaacatcacttttgttgcggaatatcgcgggaaagccatcgcatcttttgacaaaggaagagcaagccgccaaactcaaagccgagaagatcagagtggccctcgagaaaattaaagaagctcaggtgaaaaaattggtgatccgagtgcatatgtctgacgacagctctaagaccatgatggtggacgaaagacaaacggtgcgtcaggtgctggacaaccttatggacaaatcccactgcgggtacagtctggactggtccctagtcgaaaccgtgtccgaactacagatggagcggattttcgaggatcacgaaaaccttgttgaaaatctgctgaactggacacgcgactcgcagaataagcttattttcatggaacgaatagaaaagtacgcacttttcaaaaaccctcagaactacctactgggcaaaaaggaaactgccgagatggcggatagaaataaggaggttctcctggaggagtgcttctgtgggagcagcgtgacagtccccgagattgaaggggtcctctggctgaaagacgatggtaaaaaatcatggaaaaaaaggtacttcttgctgcgtgcatcagggatctactatgtgcctaaggggaaagcaaaggtatctcgcgacctggtctgcttcctgcagctggaccacgtgaacgtgtactatggccaggactaccgcaacaaatacaaagcccctaccgactattgtttggtcctgaaacacccacagatccagaaaaagagtcagtacattaaatatctctgttgcgacgatgtgagaaccttgcatcagtgggttaatggcatacgcatcgctaagtatggcaagcagctgtacatgaactatcaagaagcactaaaacgcacagagagtgcttatgattggacttcgctaagctcctcttccatcaaatccggaagttcctcaagctccatccctgagtctcaatcaaatcattccaaccagagcgatagtggcgtgagcgatacacaaccggccggccacgtgcggagccagagtattgtctcaagcgtgttttcggaagcctggaagagaggtacacagctggaagagtcctctaaagtcaccgcgtcgttttag

SEQ ID NO: 29435 - DNA, 2073 bp, Artificial Sequence
  Description of Artificial Sequence: Synthetic coding sequence
atggggtcgtccgggctgggcaaagctgccacccttgatgaactgctgtgcacatgtatcgagatgttcgatgacaatggggagctcgacaattcctatctgccgaggatagtcctcctgatgcatcgctggtatctcagctcgacagaactcgcggaaaagctgctgtgcatgtatcgcaatgccaccggggaatcctgtaacgagtttcgactaaagatctgttactttatgcgttattggatactgaaattccccgccgagttcaacctggatctcgggctaattcggatgaccgaagaattccgcgaggtggccagccaactcggatacgagaagcacgttagcctcatcgacatctcctctattccatcatacgactggatgcggagagtgacccagcggaaaaaggtctctaagaagggcaaggcctgcttgttattcgatcatctggagcctatcgaattagccgaacacctgaccttccttgagcataaaagttttcgtagaatctctttcacggattatcagagctacgtgatccacgggtgtctggagaacaatcctacactggaaaggagtatcgcactgtttaacggaataagcaaatgggttcagctaatggtgctttctaagcctaccccacaacagcgagctgaggtcatcaccaaattcattaacgtcgctaagaaactccttcagctgaaaaattttaatacactgatggcagtcgtaggcggattaagtcattcatcaatcagtagactcaaagaaacccactcacatctgtcctccgaagttaccaaaaactggaacgagatgacggagctggtgagcagcaacggcaattactgcaactatagaaaagctttcgctgattgtgatggcttcaaaatccctattctcggggtgcaccttaaggacctgattgccgttcacgtgattttccctgactggaccgaggaaaataaagttaacatagtcaagatgcatcagttatcagtgaccctgtcagagctggtatccctccaaaacgccagccaccacctcgagcctaatatggatctcattaatctcctcacactgagtctggacctgtatcatacagaggatgacatttacaaactttctctggtgctggagccacgcaatagtaaaagccagccgacgagccccaccacgcctaacaagccagtcgtccctctggagtgggcactgggggtgatgcctaagccagatcccaccgtgatcaacaaacacatcaggaagctggtggaaagcgtcttccggaattacgaccatgaccacgacggctatatttcacaggaggactttgaatctattgctgcaaacttccccttcttggactctttttgtgtgctggataaggatcaagatggtctcatttctaaagacgaaatgatggcctactttctccgagcaaagtcccagctgcattgcaagatgggcccagggtttattcacaacttccaggaaatgacttatctcaagccaacattttgcgaacactgcgctggtttcttatggggcatcattaagcaggggtacaagtgtaaggactgcggtgcaaattgccataagcagtgcaaggacctgctagtcctcgcttgcagacgatttgcgcgcgcccccagtctgagcagtgggcatggctcactgcccggaagtccatcactgcctcctgcccaagacgaggtgttcgagtttccaggcgtcacggccgggcaccgggacctggactccagagctattaccctcgtgaccggctcttctcggaaaataagcgtaagactgcagagggcgacaaccagccaggccacgcaaactgagccggtctggtccgaggctggatggggcgattcaggttctcatacatttccgaagatgaagtcgaaattccatgacaaggcagctaaggacaaaggattcgccaaatgggaaaacgagaaacctagggtgcacgcaggggtggacgtggtggatcgaggcacagagtttgaattggaccaggatgagggtgaggaaacccgacaggatggcgaggatgggtag

SEQ ID NO: 29436 - DNA, 2073 bp, Artificial Sequence
  Description of Artificial Sequence: Synthetic coding sequence
atggggagtagcggactcgggaaggcagcaaccctggacgagttactctgcacatgtatcgagatgttcgacgacaatggggaactggacaatagctatctcccccgaatagtgttgctaatgcatcgctggtatctgtccagcacagagctggctgagaagcttctatgcatgtatcgcaatgctaccggcgaaagttgtaacgaattcaggttgaagatttgctattttatgcgctactggatcctcaaattccctgcggaatttaatcttgaccttggattgattcgcatgaccgaagagtttcgggaggttgcttcccagcttggatacgagaagcatgtgtcacttatcgatatctctagcatcccttcatacgactggatgaggcgggttactcagagaaagaaggtgagcaaaaagggcaaggcctgtctgctgttcgaccacctcgagccaattgaactagcagagcacttgacatttctggagcacaagtcctttcgccgtatcagtttcaccgattaccagagctacgttattcatgggtgcctggagaataaccctacactagagcggtcgattgccttattcaatgggatctccaaatgggtgcagctgatggtgctgagcaaacccacccctcagcagagagccgaggtgatcacaaaatttataaacgtggctaagaaactgcttcagctgaagaattttaacaccctgatggccgtggtaggaggcctgtcgcactcctcaatatctcggttgaaggaaacccacagccacctgagctctgaggtgactaaaaactggaatgagatgactgagctggtttcttccaacgggaactactgcaactatagaaaagcctttgcagactgcgatggcttcaagattcctatcttaggtgtgcacctaaaagatctgatagccgtacacgtaattttccccgactggactgaagagaacaaagtcaacattgttaagatgcaccagctgagcgtgaccctttccgagctggtgagtctgcagaatgcaagccatcatttggagccaaatatggacctcataaatctgctgaccttgtccctcgatctgtaccatacagaggatgacatctacaaattatccttggtactggagccccgcaattctaagagtcagccgacctcgcctacaacgccaaacaaacccgtggtacccctggaatgggcactgggcgtgatgcctaaaccagacccaacggtcatcaacaagcatattaggaagctggttgaaagcgtttttcgtaactacgaccacgatcacgacggctacatctcccaggaagactttgagagcatcgccgctaattttccatttctcgacagtttctgcgtcctcgataaagaccaggacggtttgatctccaaagacgagatgatggcgtactttctccgcgccaaatcccaactgcactgtaaaatgggcccaggatttatccacaacttccaggagatgacctatttaaaaccaactttctgcgagcactgtgcaggattcttgtggggtataattaagcaggggtacaaatgcaaagattgcggggcaaattgtcacaaacaatgtaaggacctgcttgtgctggcctgtcgacggtttgcacgcgcccccagtctgtcttcagggcacggctcactgcctgggtcaccttcattgccccccgcccaagatgaggtgttcgagttcccaggagtgacagcagggcatcgcgacctcgatagccgtgccatcacactcgtcacggggtcaagccgaaaaataagcgtgcggcttcagagggccaccaccagccaagcaactcagactgaaccagtctggtcagaggctggctggggtgatagcggcagccatacctttcctaaaatgaagtctaaatttcacgataaagccgctaaagataaagggtttgcaaagtgggaaaacgagaaacccagggtgcatgccggcgtggacgtcgtggatcgtggtacagaattcgaacttgatcaagatgaaggcgaggagactcggcaggatggggaagacgggtag

SEQ ID NO: 29437 - DNA, 2070 bp, Artificial Sequence
  Description of Artificial Sequence: Synthetic coding sequence
atgggatcttctgggctgggtaaggccgctaccctggacgagctgttgtgcacctgcatcgaaatgtttgacgacaacggcgagctcgacaattcgtatctcccgagaatagtgcttctaatgcacaggtggtacttgtcaagcactgaattggcagagaaattactgtgcatgtaccgcaatgcaaccggtgagtcctgtaacgaatttagactgaaaatatgctatttcatgcgatattggatcctcaaattccctgccgagttcaatctggatctgggactgattcgtatgaccgaggaatttagagaggtcgcttcccagctgggctatgagaaacatgtctcactgatagacatcagtagcattcctagttatgattggatgcgccgagtcactcagaggaaaaaagtgtccaaaaagggcaaggcctgcctgctgttcgaccacctcgagccaattgaactcgcagagcatctaactttcctggaacacaagtcattccgcaggattagtttcactgattaccagtcctacgtcatacacggttgtctcgagaataacccaaccttggagcggtcaatagctttgtttaacggaataagcaaatgggtgcagttaatggtactgtcaaaaccaacccctcagcagcgggctgaggtgattaccaaattcataaatgtggcaaaaaaactgctgcaactcaaaaacttcaatacacttatggcagtggtaggtgggttgtcacatagctctatctcccgtctgaaagagacgcattcccatttgagcagcgaagtgactaagaactggaatgagatgacagaactcgtatccagcaacgggaattattgtaactacaggaaagccttcgcagattgcgatggttttaagatcccgattcttggggtccacttgaaggatcttatcgccgtccatgtaatattccctgactggactgaagaaaacaaagttaacattgtcaagatgcaccaattatctgtaactctttctgaactggtttctctccagaatgcatctcaccatctggaacccaatatggatcttattaatttattgactctaagtttggacctgtaccacaccgaggatgatatctacaaactgagcttagtgttggagccccgaaatagcaaatctccgaccagccctacaacccctaataagccagtggtgcctttggagtgggctcttggggtgatgcccaagcccgatcccacagtcataaataaacacattagaaaactggtcgaaagtgtgttcaggaattacgatcatgatcacgacggttatatttctcaagaagacttcgaatcaattgccgcaaacttccccttcctagactcattctgcgtgctggataaagaccaggatggattaatctctaaagatgaaatgatggcatatttcctgagggcgaagagccaactgcactgtaagatggggccggggttcatccacaactttcaggaaatgacctacctcaaacctaccttctgtgagcactgcgcgggattcctttggggaatcataaaacagggctacaaatgtaaggactgcggtgctaactgtcacaagcagtgcaaggacctgctggtgcttgcctgtaggagatttgctagggccccgagtctgagtagcggccacggaagcctgcccggctccccttctctgccacccgcccaggatgaagtgttcgaattccccggggttacagccggccaccgagacctcgattcacgagccattactctggtaacaggtagctcccggaaaatatcagtccgtctgcaacgagccactacaagccaggcgacccagactgagcccgtttggagtgaggctggctggggcgattccggttcccacacttttccaaaaatgaaaagcaaatttcacgacaaggccgctaaggataaaggcttcgcaaaatgggaaaacgaaaagccccgagtgcatgcgggagtggatgtcgtggaccggggcactgagttcgaactcgatcaggacgagggcgaggagacgcgtcaggacggggaggacggctag

SEQ ID NO: 29438 - DNA, 342 bp, Artificial Sequence
  Description of Artificial Sequence: Synthetic coding sequence
atgggatctagcggcctggggaaggccgcaacactggatgagcttctctgtacatgtattgagatgtttgacgacaacggagaactggataactcctacctccctagaattgtcctgctgatgcatagatggtatctgtcaagcacggaactcgccgagaagctgctctgtatgtataggaatgcaacaggggaaagctgcaatgagttcagactcaagatttgttacttcatgcgatattggattctaaagtttccggcagagttcaacttggacttaggactcattagaatgaccgaggaatttcgcgaggttgcttcacagttaggctacgaaaaatag

SEQ ID NO: 29439 - DNA, 105 bp, Artificial Sequence
  Description of Artificial Sequence: Synthetic coding sequence
atgggctccagtggcttaggaaaggctgccacactggacgagctgctctgcacttgtatcgagatgttcgacgacaatggagaacttgataactcctacctgtag

SEQ ID NO: 29440 - DNA, 519 bp, Artificial Sequence
  Description of Artificial Sequence: Synthetic coding sequence
atgggctcgtccggcctaggaaaagccgctactctggacgagttattatgcacctgtattgagatgttcgacgacaatggagagctggacaatagctacctgccacgaattgtgctcctcatgcaccgttggtacctctcctctactgaactggccgaaaaactgctgtgtatgtataggaacgctaccggcgaaagctgcaatgagttccggctcaagatatgctattttatgcgatactggattttaaaattcccggccgaatttaacctcgacctcggactgatcaggatgactgaggagtttagggaagtagcctcacaactgggatatgagaagcacgtctctcttatcgacatctcgtccattcccagctacgactggatgcgccgtgtgactcagcggaaaaaggtaagcaaaaaagggaaagcttgcctgcttttcgaccatctcgagcctattgagcttgcagagcatctgaccttcctcgaacacaaatcattccgtaggatctcctag

SEQ ID NO: 29441 - DNA, 234 bp, Artificial Sequence
  Description of Artificial Sequence: Synthetic coding sequence
atggggagctctgggctaggcaaggccgcaacattagacgagctgttatgtacttgcattgagatgttcgatgataatggggagttggacaattcttacttgccaaggatcgtcctgctgatgcataggtggtacctctcctccacagagctggcggagaaactgctatgtatgtataggaacgccaccggcgagtcatgcaacgagttccggttgaagatctgctatttctag

SEQ ID NO: 29442 - DNA, 339 bp, Artificial Sequence
  Description of Artificial Sequence: Synthetic coding sequence
atgggatcttcggggttgggcaaagctgccacgctcgacgagctgctgtgtacgtgcatcgagatgtttgatgacaatggtgaattggataactcctacctcccacgtatagtcctcttaatgcatagatggtatctgtcttctaccgagctggcagaaaagttactttgcatgtaccgcaatgccaccggcgagtcatgcaacgagtttcgtctcaagatttgctacttcatgcggtactggatcctgaagttcccggcggagtttaatctagatctaggattaatcaggatgactgaagagtttagggaagtggccagccaactgggatatgaatag

SEQ ID NO: 29443 - DNA, 552 bp, Artificial Sequence
  Description of Artificial Sequence: Synthetic coding sequence
atgcccctcgtgagatatcggaaagtagttatcctgggataccggtgtgtgggcaagacatctctcgcgcaccaattcgtggaaggagagttcagtgaaggatatgatcccactgtggagaacacatactccaaaatcgttactttggggaaagatgagttccatctgcatctcgttgatacggccggccaagatgagtacagtatcctgccctatagctttataatcggtgttcatgggtatgtcttggtctactctgtaacctccctccattctttccaggtcatagagtctctctatcagaagttgcacgaaggacacggaaaaactcgggtgcccgttgttctggtgggcaataaagctgatctttcccccgagagagaagttcaagccgtcgaaggcaagaaattggcagagtcctggggtgctacatttatggagtcctctgctcgagagaatcaactaactcaggggatattcaccaaagtgatccaggaaattgctagagtggaaaattcctatggccaggaacgtcgctgccatctgatgtag

SEQ ID NO: 29444 - DNA, 633 bp, Artificial Sequence
  Description of Artificial Sequence: Synthetic coding sequence
atgaccgcagcccaggctgccggggaggaagctcccccgggcgtcaggtcagtgaaggtggtgctggtcggcgatggaggctgcggcaaaacttcactgctgatggttttcgccgatggtgcattccctgaatcttacacccccaccgtgttcgaaaggtacatggtcaatctgcaagtcaaggggaagccagtccacctgcacatttgggacacagcggggcaggacgactacgatagactaaggcctctgttttaccccgacgccagcgtcctcctgctgtgctttgatgtgacatctccgaacagttttgataacatcttcaatagatggtatcctgaagtgaaccatttctgcaagaaggtgcctataatcgtggtgggatgtaagactgacctttgtaaagacaagtccctggttaacaagctgagacggaacggacttgagcctgtgacctatcatagagggcaggaaatggctaggtctgtgggagcggttgcgtatttagaatgcagcgcaaggctgcacgataatgtccatgctgttttccaggaagcggcggaggtggctctgtcctctcgcggccggaacttttggcggagaattactcagggcttctgtgtggtgacctag

SEQ ID NO: 29445 - DNA, 636 bp, Artificial Sequence
  Description of Artificial Sequence: Synthetic coding sequence
atggatgcccctggagcactggcacagactgcagccccaggcccaggcaggaaggaacttaagatcgtgattgtgggtgatggtgggtgcgggaagacttcattgctgatggtgtacagtcaaggatccttcccagaacattatgccccctcggtattcgaaaagtataccgcatctgttaccgtaggatcgaaagaggtcactctgaacctgtatgatactgccgggcaggaggattacgatagattgcgaccactaagttaccagaacacccatctggtcctcatctgctacgatgttatgaatccaacctcttatgacaatgttctcatcaaatggtttccagaggtaactcatttttgtcggggcattcctatggttctcatcggctgtaagacggacctgcggaaggacaaagagcaactcagaaaacttcgcgctgctcagttggaacccattacgtatatgcaggggctctccgcctgcgaacagattagggcagcactttacctggaatgttctgctaagtttcgggagaacgtggaggacgtgttccgggaggcagccaaggtagctctttctgcgctgaaaaaggcacagcgccaaaaaaagagacggctctgcctcttactgtag

SEQ ID NO: 29446 - DNA, 342 bp, Artificial Sequence
  Description of Artificial Sequence: Synthetic coding sequence
atggatgcccctggtgctctggcccaaacagcagccccaggtcccggacggaaggagctgaaaattgtcatcgtgggggatggcggttgtggcaaaacatcgctgctgatggtgtatagccaagggtccttcccggaacactatgcaccaagtgtgttcgagaagtataccgcgagtgtcactgtgggaagcaaagaggtgacacttaatctctatgatacggcaggtcaagaggattatgatcgtttacgacccctgtcttatcagaacacgcacctggttttgatctgctatgacgtgatgaatcctacgagctatgataatgtgctaatcaaagtctag

SEQ ID NO: 29447 - DNA, 576 bp, Artificial Sequence
  Description of Artificial Sequence: Synthetic coding sequence
atgcagtcaattaagtgcgttgttgtgggagacggagcagttgggaagacctgcctactgatttgttatacaaccaacgccttcccgaaggagtatatacctaccgtgttcgacaactactccgcccagtccgcagttgacggtaggacagtcaatttaaatctctgggatactgcgggccaggaagaatacgaccggctccggacactctcctaccctcagactaatgtgttcgtgatctgtttttccatcgccagccctccaagctacgagaatgttagacacaagtggcaccctgaagtttgtcaccattgccctgatgtgccaattctgcttgtgggtaccaaaaaggatctgcgggctcagccagacaccctgagaaggctgaaagaacagggacaagctcccatcacacctcagcaaggccaagctctggccaagcagattcacgctgttcgatatctggaatgctccgctttgcagcaggacggggtgaaggaggtatttgctgaagcggttcgagccgtgttgaaccctactcctattaaacggggccgatcatgtatcctcctctag

SEQ ID NO: 29448 - DNA, 576 bp, Artificial Sequence
  Description of Artificial Sequence: Synthetic coding sequence
atgcagtccatcaagtgcgtggtggtcggggacggggctgtggggaagacttgcctgttgatttgctatactaccaacgcttttcccaaggagtatatcccaaccgtctttgataactactccgcgcagagcgctgttgacggccgaactgtgaatttgaatctatgggacaccgctggacaagaagaatatgatcggctgcgaaccctcagctatcctcagaccaacgtcttcgtaatatgcttcagtatcgcaagccccccctcctatgaaaacgtgagacataagtggcatcctgaggtttgccatcactgccccgacgtgcccatcctgttggtggggacgaaaaaagacctaagagcccaacctgatactttaagaagactcaaagagcaggggcaggctccaataacaccccaacaagggcaggcccttgctaaacagattcacgccgtgaggtacctcgaatgctccgctctacaacaggacggcgtaaaggaggtattcgccgaagcagtgcgagccgtgctgaatcccactccaatcaagcgggggagaagttgcatcttgctgtag

SEQ ID NO: 29449 - DNA, 576 bp, Artificial Sequence
  Description of Artificial Sequence: Synthetic coding sequence
atgcaatcgatcaaatgtgtagtggtaggcgatggcgcagtcgggaaaacctgtctgctgatatgttatacaacaaatgcgttcccgaaagaatatattccgacggtattcgataattatagcgcccaaagcgccgtagatggacgcacagtcaacctcaacttatgggatacagccggtcaggaggaatacgacaggctgcgaacactctcgtatcctcagaccaatgtgttcgttatttgtttcagcatcgcttccccaccaagctatgagaatgtgaggcacaaatggcatcctgaggtttgccatcactgcccggacgtccccatcctgttagttgggacaaagaaggatctacgagcccagcctgataccctgcgcaggttaaaagaacaggggcaggcccccattacgcctcagcagggccaagccctcgcgaaacaaattcacgcggtgcgttatttggaatgtagtgctcttcaacaagacggcgtcaaagaggttttcgctgaggccgtgcgtgcagtactgaatccaactccaataaaaagagggcggtcgtgcatcttattgtag

SEQ ID NO: 29450 - DNA, 576 bp, Artificial Sequence
  Description of Artificial Sequence: Synthetic coding sequence
atgcaatcaatcaaatgcgtagtggtcggggacggcgccgtcggcaaaacctgtctcctaatttgttacacaaccaacgcatttcccaaagaatatattcccaccgtgttcgataactatagcgcccagtccgcagtggacgggcgtaccgtgaacctgaacctgtgggacacagctggacaggaagagtatgacaggttacggaccctgtcatatccacagactaatgtctttgtgatttgcttctctatagcatctccaccttcatacgagaacgtacggcacaagtggcacccagaagtgtgccatcattgccctgatgtgcccattttattggtggggactaagaaagatctgcgtgcccaaccagatacattgcgaaggctcaaggagcagggccaagcccccataacgcctcagcagggacaggcactagcgaagcagatccatgccgtcaggtaccttgagtgctcggctctacaacaggatggtgtcaaagaggtttttgccgaggctgtccgcgcagtgttaaatcctacaccaattaaaagggggcgctcatgtattctcctgtag

SEQ ID NO: 29451 - DNA, 576 bp, Artificial Sequence
  Description of Artificial Sequence: Synthetic coding sequence
atgctttcaagcatcaagtgcgtgcttgtcggcgactctgcggtcggcaaaaccagtttgctcgttaggtttacttccgagaccttccctgaagcctacaagcccacagtgtatgagaacacgggtgtggatgtgttcatggacggtatccagatcagcctgggtctatgggacactgccggtaatgatgcgttcagaagtattagaccactgtcttatcagcaagccgatgtggtgctaatgtgttattctgtcgccaaccataactccttcttgaacctgaagaacaagtggattggtgaaattcgtagcaacctcccctgcactccagtgctggtggtcgcaacacagacagaccagcgagaaatgggccctcaccgggcctcatgtgtgaatgcaatggagggcaagaaattagctcaagatgtgcgcgctaagggttacctggaatgtagtgcactcagcaatcgcggtgttcaacaagtattcgagtgtgccgtaagaaccgctgtgaatcaggcacgtcggcggaatcggcgtaggctgttctcaataaatgaatgcaaaatattctag

SEQ ID NO: 29452 - DNA, 312 bp, Artificial Sequence
  Description of Artificial Sequence: Synthetic coding sequence
atgttgtcatcaatcaaatgtgtcctggttggagacagcgctgtgggcaagacttctctgctagtgagattcacctccgagacattccctgaagcgtacaagccaactgtgtatgaaaacacaggggtcgatgtttttatggacggcatccagatttccctgggactgtgggataccgctggcaatgacgcttttcggtcaatccgacctctgtcttatcagcaggcagacgtcgttcttatgtgctattcagtcgccaaccacaacagcttcctgaacctcaaaaacaaatggattggcgagattcgatag

SEQ ID NO: 29453 - DNA, 576 bp, Artificial Sequence
  Description of Artificial Sequence: Synthetic coding sequence
atgctcagcagcataaaatgcgtgctcgtgggtgactctgctgttggcaaaacctccctcctcgtccgattcacatccgaaaccttccctgaagcttacaaacctactgtgtatgagaataccggtgtggatgtattcatggatgggattcagatttccctcgggctgtgggacacggcaggaaacgacgccttcagatctatccgccctctttcctaccagcaggcagacgttgtcctgatgtgctattcagtcgccaaccataatagctttcttaatttgaaaaataagtggattggagaaattagatcgaatctgccatgtaccccagttcttgttgtcgcgactcaaaccgatcagcgtgagatgggcccacaccgcgcttcctgtgtaaatgctatggaggggaaaaagctggcccaggacgtgcgggctaagggctacctggaatgttcagcactctccaatcggggcgtccagcaggtcttcgaatgcgccgtgaggaccgctgttaatcaggccaggcggcgaaacagacgccgattgtttagcatcaatgagtgtaagatcttctag

SEQ ID NO: 29454 - DNA, 330 bp, Artificial Sequence
  Description of Artificial Sequence: Synthetic coding sequence
atgctcagctcaatcaaatgcgtattggtgggagatagcgccgtgggcaagaccagccttctggtgaggtttacgtcagagacttttcccgaagcctataagcccactgtctacgaaaacaccggagtagacgtctttatggatggcatccagatctctttgggcctgtgggacactgctggtaacgatgcttttcgctcgatcagacccctgagctaccagcaggctgacgttgtgctgatgtgttacagcgtcgccaaccacaattccttcctcaatctcaagaataagtggattggggagatccgttcaaacttaccttgcacctag

SEQ ID NO: 29455 - DNA, 51 bp, Artificial Sequence
  Description of Artificial Sequence: Synthetic coding sequence
atgctttcttccatcaagtgtgtcctcgtgggcgatagtgcagtgggttag

SEQ ID NO: 29456 - DNA, 21 bp, Artificial Sequence
  Description of Artificial Sequence: Synthetic coding sequence
atgctgtcttctatcaaatag

SEQ ID NO: 29457 - DNA, 645 bp, Artificial Sequence
  Description of Artificial Sequence: Synthetic coding sequence
atgaattgcaaggaagggactgattcatcttgtggatgcagggggaacgatgagaagaaaatgctgaagtgtgtggtcgtgggggatggagctgtgggaaaaacctgcctcctgatgagttacgccaacgatgcattcccagaggagtatgtccctactgtgttcgatcattacgccgtgaccgttactgtgggcggcaagcagcatctgctggggctttacgacaccgcaggtcaggaggattacaatcagctgaggcctttgagttaccccaacactgatgtgttcctcatttgcttctctgttgtgaaccctgccagctatcataacgtccaagaggagtgggtccctgagttaaaggactgtatgccccacgttccttatgtgctgattgggacgcagatcgacctgcgcgatgatcctaagactttagcccgcttactgtatatgaaagagaaaccattgacgtacgaacatggtgtgaaactggccaaggctatcggagcccaatgttatctagagtgtagcgctctgacccagaagggtcttaaggccgtgtttgacgaagcgatcctgaccatctttcatcctaagaaaaaaaagaaacgttgttccgaaggccattcctgctgctcaatcatttag

SEQ ID NO: 29458 - DNA, 618 bp, Artificial Sequence
  Description of Artificial Sequence: Synthetic coding sequence
atggcccatggcccaggggcactgatgctgaaatgtgtcgtggtcggcgatggcgcagtgggaaagacatgtctgttgatgtcctatgctaatgatgcatttcctgaggagtatgtccccacagtcttcgaccactatgcagtgtctgtcacagtgggcggtaagcagtatcttttgggactctacgatacagctgggcaggaagactatgatagattgagacctttgagctatcctatgactgatgtcttcttgatttgcttctccgtcgtcaatccagcgtcttttcagaacgtaaaggaggagtgggtgcccgagctcaaagagtacgctcctaacgtgcccttcctcctgattggaacccagatcgatctccgggatgaccctaagactctcgctagacttaacgatatgaaagagaagcccatatgcgttgagcagggccaaaaactggccaaagagattggcgcttgctgctatgttgaatgctcggcactcacccagaaaggactcaaaaccgttttcgacgaagcaattattgcaatcctcacccccaagaaacacaccgttaagaagagaataggttctaggtgtatcaactgctgtcttataacctag

SEQ ID NO: 29459 - DNA, 915 bp, Artificial Sequence
  Description of Artificial Sequence: Synthetic coding sequence
atggccgtcactaaggaattgctccaaatggacctctacgcactcttgggtattgaggagaaggccgccgacaaagaggtgaaaaaagcctatcgacaaaaggccctaagttgccacccggataagaatcctgataacccacgggccgcagaattgtttcaccagctcagtcaagccctggaagtgttaacagatgccgctgcaagggccgcttacgataaggtgcggaaggcaaagaaacaggccgcagagaggactcagaagctggatgagaagcgcaagaaggtcaaactggatctcgaggctcgggaaaggcaagcacaggcacaggagtccgaggaggaagaggagagcaggtcgacacggaccctcgaacaggagatcgaacgtctgcgcgaggagggatcacgccagctggaagagcagcagcgtttgatcagagagcagatccgacaggagagagatcagaggttacgcggcaaagcagagaacacagaagggcagggaactcctaagttaaagctgaagtggaagtgcaagaaagaggacgaaagcaagggtggctactcgaaagacgttttacttaggctcctccagaaatatggcgaggtgctgaacctggtcctctcaagtaagaaacccggaaccgcagttgtggaatttgccaccgtgaaagccgccgagctggcagttcagaacgaggtggggctagttgacaatccgctgaaaatttcatggttggaggggcagcctcaagacgctgtggggaggagccatagcggcctctcgaagggttcagtgttgtccgagcgcgactatgagagcctggtcatgatgcgcatgcggcaagcggctgaaaggcaacagctgatcgcccggatgcaacaggaagatcaggaaggtccacctacgtag

SEQ ID NO: 29460 - DNA, 258 bp, Artificial Sequence
  Description of Artificial Sequence: Synthetic coding sequence
atggccgtggaggaagaactcaagaaggaccacgctgagatgcaagcagtgatagacgccaaacaaaagattatcgatgcccaagtgatcaatggtgacgaaatcattcaaaccggcaagaccgatagagtacctggcttttcccagcatcagactgacgaacgagcggatccctctgaaggggctgttcaacatgctggccctcagtggcacctgccccatcagccacatcaggcgtttcatcacggcgagtggtag

SEQ ID NO: 29461 - DNA, 3843 bp, Artificial Sequence
  Description of Artificial Sequence: Synthetic coding sequence
atggaactgtctcccagctctggaggcgcagcagaggccttatcttggcccgagatgtttccagcccttgaaagcgattctccactgccaccagaggacctggatgcagtggtacctgtgagtggggccgtagccggcgggatgctcgacaggatccttttagagtccgtctgtcagcagcaatcatgggttcgagtgtacgatgtgaaggggcccccaacccacagactgagttgtgggcaatcaccgtacacagaaactacaacgtgggagcgcaaatactgcatcctgaccgacagccagctggtgctgctaaataaagagaaggagattccagtggaagggggacaggaacagcagaccgatagtaccaaggggagatgtctccgccgcacggtctctgtcccctccgagggccagttccccgagtacccgcccgaaggggccacaaaattggaggttcccgcggagagatcccctaggaggcggtcaataagtggcaccagtaccagcgaaaagccgaatagcatggataccgccaatacatccccttttaaggtaccgggcttctttagtaagagactgaaaggatctattaaacgtaccaagtctcagtctaagctcgataggaacacctcctttaggttaccttcactgcgcagcaccgatgacagatcccggggtctgcccaagttgaaggagagcagatctcatgagtccctcctttctccttgttccacggttgagtgtctggacttgggaagaggggagccggtgtcagtaaagcccctgcactctagcatattagggcaagatttctgtttcgaagtcacatatctgtccggatccaagtgtttctcctgcaatagcgcctcagaacgagataagtggatggaaaaccttcgacgcaccgtgcagcccaataaagataactgccgaagagccgaaaatgtcctgaggctctggataatcgaagccaaggatttagcacctaagaagaagtacttttgtgaactgtgtctggacgatacgctatttgctagaacaacctccaagaccaaggctgataacatattttggggagagcactttgagttcttttcccttccaccgttgcatagtatcaccgtccacatctataaggacgtggagaaaaaaaagaaaaaggataaaaataattacgtggggctagtgaatattcctacagcctccgttacaggccggcagttcgtggagaagtggtatcccgtctctacccccacaccaaataaaggtaagactggaggaccatccattaggattaaaagtcggtttcagactattacaatattgcccatggagcagtacaaagaatttgcagagttcgtcacttcaaattacacaatgttgtgcagtgtgttagaaccagtcataagtgttcgcaacaaggaagagctggcgtgtgctctggtgcacattctccaaagtaccgggcgggcaaaggactttctgacagacctcgtgatgagtgaggtggatagatgtggagagcatgatgtgttgatctttcgcgagaatactattgctaccaaatctatcgaggaatacctgaagctggtgggccagcagtatctccacgacgcgctcggtgagtttataaaggcactgtatgagagcgatgagaactgcgaagtggatccgtcaaaatgcagctcatcagaactgatcgatcatcagtccaatctgaaaatgtgctgcgagctcgctttctgcaaaattatcaactcctattgtgtatttccaagggagttgaaagaggttttcgcaagttggaagcagcagtgcctaaaccggggaaagcaagatatctctgagagactaatatccgccagcctattcctgcgctttctatgccccgccataatgtccccatccctattcaatctgatgcaggagtatcccgatgataggacttctcggaccctgacacttattgccaaagtgattcaaaatctcgccaatttcgccaaattcggcaacaaggaggaatatatggcgttcatgaacgacttcctggagcacgaatggggaggaatgaagaggtttctgttggaaattagcaatcccgacacaatctcaaacacccctgggtttgacggttatatcgatctcggacgtgaattgtcagtcctgcacagcctactgtgggaagtggtcagccaattggataaggccaccgtcgccaaactcggaccgctaccgagagtcctggccgacatcacaaaatcgctcactaacccaacgcccattcagcaacagttgcgtcgattcactgagcacaattcctcgccaaacgtgtccgggagtctgtcatccggattgcagaagatatttgaggatcctacagactctgacctgcacaagctgaaaagtccctcccaggacaacacagacagctatttccgcggtaagaccttgctgttagtgcagcaggcctcctcacagtctatgacatacagcgagaaggatgagagagaaagtagcctgcccaatgggaggagcgtatctctgatggacctccaggacacccatgcagctcaggtggagcacgccagtgtgatgttagatgtccctataagactgactggctctcaactgtctatcacccaggtggccagtataaaacagctccgggagacacaatcaaccccccaaagcgcaccccaggtgagaagaccattgcaccctgccctcaaccaacctggtggacttcagcccctaagttttcaaaatcccgtgtatcatctgaataacccaattcccgcaatgccgaaagccagcatagactctagcctcgagaatctctccaccgcttccagtcgctcccagtccaatagcgaagattttaaactgtctggcccttccaacagcagcatggaggatttcactaaacggtcgacacaaagtgaagatttttctcgccgccacaccgtgccagaccgacacatcccactcgccctgcccaggcaaaattcaaccgggcaagcccagatcagaaaggtagatcagggaggactcggggcccgcgccaaggcgcctccaagtctcccccactccgctagcctccgcagcacaggcagtatgagtgttgtgtcagcagctctggtggccgagccagtgcaaaatggcagcaggtcgagacaacaaagctcctcctcacgtgaaagccccgtacctaaggtaagagcaatccaacgccagcaaacccaacaggtgcagagccccgtcgactccgcgaccatgagtccggtcgagagaactgcagcctgggtgctgaacaacggtcagtacgaggaggacgtcgaagaaacagaacagaatctcgatgaggctaaacacgctgaaaaatacgagcaggagatcacgaagttaaaagagagacttcgcgtctcctcacggcgtctggaggaatatgagcgcaggcttcttgtgcaagagcagcagatgcagaaactgcttctggagtacaaggcccgcttagaagactccgaggaaaggttgagaagacagcaagaagagaaggactcgcaaatgaaatctatcattagccgacttatggcagtggaggaagagctgaaaaaggaccatgccgagatgcaagccgtgatcgacgccaaacaaaaaataattgacgcgcaagagaagcggattgtaagcctagattccgccaacacccgcctgatgtccgctctaactcaggtaaaagagcgctattccatgcaggtccggaatggaattagccctaccaatcccaccaaactgtccattaccgagaacggcgagtttaaaaacagtagctgttag

SEQ ID NO: 29462 - DNA, 2082 bp, Artificial Sequence
  Description of Artificial Sequence: Synthetic coding sequence
taggaagtgttcgcctcttggaaacagcagtgtttaaaccggggcaagcaagacatctccgaacggctgatctctgcttcactgttcctgagattcctgtgtcccgccataatgagtccatcactatttaacttgatgcaggagtaccccgatgacaggaccagccgtacgcttacattgatcgcaaaggttatccagaacctggctaatttcgccaagtttgggaacaaagaggagtatatggcattcatgaatgattttctggagcacgagtggggcggcatgaagaggttcctgctggagatctccaatcctgacacgatttcaaatacccctggatttgatggttacatcgacctcggtagggaactcagtgtgctccacagtttactgtgggaagtggtgtcacaattagacaaaggagagaatagctttctccaggcgactgtcgcaaagcttggccccctgcctagggtgctcgctgatattactaaatctctcacaaatcccactccaattcaacaacagctcaggcgatttactgagcacaactcttctcccaatgtgagtggaagtctatctagcgggctccagaagattttcgaagatcctaccgattcggatctccacaagctgaaatccccttcccaggataatactgactcttatttcagaggcaaaactcttttattggttcagcaggcttcctctcagtctatgacctactcagagaaggatgagagggaatctagtctaccaaatggtaggagcgtctcgctgatggaccttcaggacacccacgctgctcaggtcgaacacgcgtctgttatgcttgacgtccctattcgtctcacgggttctcagctcagcatcacccaggtcgctagcattaaacagctcagggagacacagtctacaccccagagcgcccctcaggtgaggcggcctctgcatccagcccttaaccagcccggtggcctacagcccctgagcttccagaaccccgtatatcatctgaacaaccctattccggcgatgccaaaggcgtcaatagatagcagcctcgagaatctcagcaccgctagctctagaagtcagtcgaacagtgaagatttcaaactgtccggcccctcaaatagctcaatggaagactttacaaagcggagcacacagagcgaggacttcagccgcaggcatactgttcctgatcggcacatccctcttgcactgcctcgccagaatagtaccgggcaggcccagatacgaaaagtggaccagggcggactgggtgcacgtgctaaggcgcctcctagtctccctcacagcgcctctctcaggtctaccggttccatgagcgtggtgtcagccgcgttggtggctgaacccgtacagaacggctcacgtagtaggcagcagagctctagttcgagggagagtcccgtcccaaaagttagagcaattcagcgacagcagacgcaacaggtgcaatcgccggtggatagcgccacaatgagcccagtggagcgcaccgcagcctgggtccttaacaatggccagtacgaagaagatgtcgaagaaactgagcaaaatctcgacgaagctaagcacgctgaaaagtacgaacaagagattaccaagttaaaagaaagactgagggtaagtagtaggaggttggaggaatatgagcggagactgctggtccaggagcagcagatgcaaaaattgctactagaatataaggcacgcttggaagatagtgaagaaagactccgaagacagcaggaggagaaagacagccagatgaagagcattatcagccggctcatggcagtggaggaagaactgaagaaagatcacgcagaaatgcaagccgtaatcgacgccaaacagaagattatagatgcccaggtaatcaacggcgacgagatcattcagaccggcaagaccgatagagttcccggattttctcagcatcagactgacgaaagagcagacccgagtgagggggccgtgcagcacgcaggaccacagtggcacctcccccaccagccccaccaggcctttcaccacggagagtggtag

SEQ ID NO: 29463 - DNA, 3810 bp, Artificial Sequence
  Description of Artificial Sequence: Synthetic coding sequence
atgttcccagcactggaatcagactcacccctcccacccgaggatctggatgccgtcgtgccggtatccggcgcagtggccggtggtatgctggacagaattttgctggagtctgtttgtcagcaacagtcgtgggtgagagtatatgacgtcaagggaccgccaacgcatcggctgagttgtggacaatcgccatacacagaaactactacctgggagagaaaatattgtatcctgaccgactcacagttggtgctgctcaacaaggagaaggagataccagtggagggaggacaggaacagcaaaccgattctaccaagggtagatgtttgagacgcactgtgtccgtcccatcagaaggacagttccccgaataccctcctgagggagccaccaaattagaagtccctgctgagcgctcccccaggcgtagaagtatatcgggcactagtacgtcagagaagcctaactctatggacactgcaaacacgtcacctttcaaagtccccggatttttttccaaaaggttgaaggggtcaatcaagaggactaaatcacagagcaaactggatagaaatacgagcttcagactcccatccctcaggtctacggatgatagatctcggggcctgccgaaactgaaagagagccgcagccacgagtctctgctgtcaccctgctctacggtggagtgcctggatcttggaaggggagagccagtttcggtcaaacccctgcactcaagcatcttggggcaagacttttgttttgaggtgacatacttgagtggctctaaatgcttttcgtgtaattctgcttccgagcgagataagtggatggagaatctcaggcgcacagtccagcccaacaaggacaattgccggagggcggagaacgtgctgcggctgtggatcatagaagccaaggacctggcgccgaagaaaaagtacttctgtgagctgtgtctggatgacaccctcttcgcgcgcacaacctcaaagacgaaggctgacaatatcttttggggagaacatttcgagttcttcagcctccccccgttacattcgattactgttcacatatataaagatgtcgagaagaaaaaaaaaaaggataagaataattatgtgggacttgtgaatatcccaactgcgagtgtcaccggtagacaattcgtggaaaaatggtacccggtttccactccaacgccaaacaaaggcaaaaccggcggtccgagcattcgaattaagtctagattccaaaccataaccattcttccaatggaacaatacaaggagtttgcagagttcgtaactagtaattacaccatgctgtgctccgtgttggaacctgtaatctccgtccggaataaggaggagttagcctgtgccttggtccacattcttcagtccaccggcagagctaaggactttctgaccgacttggtcatgtctgaagtagaccgctgcggcgaacatgacgtgctgatattccgggaaaataccatcgccactaaatctatagaagaatatctcaaactagtcggccaacagtatctccacgacgcacttggcgagttcataaaggccttatacgagtccgacgagaactgtgaagtcgacccatcaaagtgctcctcgagtgagcttatagatcaccaaagcaatttaaaaatgtgttgtgagctcgccttctgcaagattataaactcctattgtgtcttccccagggagctcaaagaggtgttcgcatcatggaagcagcagtgccttaacaggggtaaacaggatatcagcgagcgtctcattagtgcaagcctatttctgagattcttgtgccccgcaatcatgtcgccaagcttgttcaacctcatgcaggagtatcctgacgacagaacatccaggacactgacactaatcgcgaaagtaattcaaaatctggctaacttcgctaaattcggcaacaaagaagagtatatggccttcatgaacgacttcctcgagcatgagtggggcggtatgaagcgcttcctgctggagatctctaatccggacaccatctctaacacacccggttttgacgggtatatcgatctgggtcgggagctgtcagtgttgcattcccttttgtgggaggtggtttctcaactggacaagggggaaaattcctttctgcaagcaacagtggccaagctcggacctctgcctcgcgtgttggccgacatcacaaagtccctcacgaacccaactcccatccagcagcagctgaggagattcaccgaacacaacagctctccaaatgtatccggctctctaagctccggcctgcagaagatttttgaggaccctaccgactccgacttgcacaagctgaaaagtccgtcgcaggacaataccgacagctatttccgagggaagactctgcttctggtgcaacaggcctcaagtcagagtatgacttacagtgagaaagatgagcgggaatctagcttgcccaacggaaggagtgttagcctgatggatctccaggatactcacgctgctcaagtagaacacgctagtgtcatgcttgacgtaccaattaggctgacaggctcccaactctccatcacccaggtggcatccattaaacagctgagagagacacagagcacaccgcagagcgcaccccaggtgcgaaggcccctgcatcctgctctgaaccagcccgggggcttgcaaccgttgagtttccagaacccagtctaccacctgaataatcccatacctgccatgcctaaggctagcatagatagtagtctggagaacttatcaactgcttctagtcggagtcaatctaatagcgaagacttcaagctgtcaggaccctccaactcctccatggaggattttactaaaaggagtacacagtccgaagatttttcccgacgacacactgtgccggatcggcacatccccctggcccttcctcggcaaaactctaccggacaggcccaaatacgaaaggtcgaccagggcggccttggtgctagggcaaaggcccctccttccttaccccactctgcctcgctgagaagcacgggcagcatgtctgttgtgagcgcagctcttgttgcagaaccggttcagaacggctctcgatctaggcagcagagcagttcttcccgggagtcaccggtgccaaaggtgcgcgctatacaaagacagcagacccagcaggtccagagccctgtggattccgccaccatgtcacctgtggaaaggaccgcggcttgggtgctgaacaatggacagtacgaagaggatgtagaggagaccgagcagaacctcgacgaggccaaacatgcggaaaaatatgaacaagagatcaccaagctgaaagaacgcttacgggtgtcatccaggagactggaggagtatgaaagacggctcctggtgcaggagcagcagatgcaaaagctgctacttgagtataaagctagacttgaagatagtgaagagagactgaggaggcagcaggaagaaaaggacagccaaatgaagtccatcatcagtcggctcatggcagtggaggaggagcttaagaaggaccacgctgaaatgcaagccgtgattgacgctaaacagaagatcatcgacgcccaagagaagcgcatcgtcagtctggatagcgctaacacacggctcatgtctgccttaacccaagtcaaggagagatactcaatgcaggttcgaaatgggataagtcccaccaacccaacgaaactgagcattaccgaaaacggggaattcaaaaacagcagttgttag

SEQ ID NO: 29464 - DNA, 3420 bp, Artificial Sequence
  Description of Artificial Sequence: Synthetic coding sequence
atgcagactcccgaggtgccagccgaacggtctccacgtcggcgatctatctccggtacgtcgacgagcgagaaacccaattccatggatactgccaatacgagtcccttcaaggtgccaggtttttttagcaagaggctcaagggcagtatcaagcgcacaaagtcccagtccaagttggaccggaatacctcttttcgacttccatccctgcgttcgaccgacgaccgatcccgcggcctgcctaaactaaaggagtcgcgctctcacgagtctctactctccccctgcagtacagtcgagtgtttagatttaggtagaggagaaccggtgtccgtaaaaccactccattcgtccattctggggcaggatttctgtttcgaagtgacttatttgtccgggagcaaatgctttagctgtaacagtgcatccgaacgggataagtggatggagaacctcaggcgcacagtgcagcccaacaaggacaattgtcgtcgcgccgaaaacgtgcttcgactgtggatcatcgaagcgaaggacttggcgcccaaaaagaaatacttttgtgaattgtgcttagacgacacccttttcgctagaactacctcaaaaaccaaggccgacaatattttctggggcgagcacttcgaattctttagcttgccacctctgcacagcatcaccgtgcatatctacaaggatgtggagaagaaaaaaaagaaggacaaaaataactacgttggactagtgaatattcccacagcctccgtgactggacggcagtttgttgagaaatggtaccctgtctctaccccaactccaaataaaggcaaaacaggaggcccttcaatccggatcaaatcacggttccaaactatcaccattcttcccatggagcaatacaaagaattcgctgagttcgtgacatcaaattacactatgctgtgcagcgtgctcgaacctgtgatcagcgtcaggaataaagaagaactagcatgtgccctggttcacatcctgcagtcaaccgggcgggctaaggactttctgactgatttggtcatgagtgaggtcgacagatgtggcgaacacgacgtgctcatttttcgagaaaatacaatagcaacaaagtccatcgaagagtatctcaagctggtaggacagcagtatcttcacgatgctttgggtgagttcataaaagcattatatgaaagcgacgagaattgtgaagtggaccccagcaagtgctcttcatccgagttaatcgaccatcagtcgaaccttaaaatgtgttgtgaactggcattttgcaaaatcatcaatagctattgcgtctttcccagggaactgaaagaggtcttcgcctcttggaaacagcaatgcctgaatcgcggcaagcaggacatctctgagagacttatatctgcctccctgttcctccgctttttgtgtcccgctatcatgtcaccttcactgttcaatttgatgcaggagtatcctgatgatcgcaccagcagaaccctgacccttatcgcgaaagtgatccagaatctggccaactttgcaaaatttgggaacaaagaagagtacatggcctttatgaacgatttcttagaacatgagtggggggggatgaaacgattcctactggaaatctctaatccggacactatctcaaatacccctgggtttgatggttacattgatctgggcagagagctctcagtactccactctttgctctgggaggtggtctctcagcttgacaagggagagaattcatttctgcaggcgaccgtcgcgaagttgggaccgctcccacgggtgcttgctgacatcaccaaatcattaactaacccaacgccgattcagcagcagctgcggcgcttcacagaacacaactcatccccgaacgttagcggctcactgtcctcaggactacagaaaatttttgaggaccctaccgactccgacctgcacaagttgaagagtcccagtcaggataatacagacagctattttaggggcaagactttgctcttagtgcagcaggcatcctcccagagtatgacatattcagaaaaggatgagcgcgaatccagcttgccgaatggaagaagtgtctcccttatggatctccaggatacacatgcggcacaggtagaacatgcatctgtcatgctggacgtgccaatcaggttaactggatcccagctgtcgattactcaagttgccagcattaaacaactccgggagacacagtccactccgcaatccgcacctcaggtccgccgtcccctgcacccggctctcaaccagccaggcggactccagccactcagcttccaaaatccagtttaccacctgaacaatccaataccggctatgccaaaagcttcaattgattcctcactggagaacctgtccaccgccagttccagatctcagtccaatagcgaggattttaagctctctgggccatccaacagctcaatggaggatttcacgaagaggtctacacagtctgaagacttttcaagaaggcatacagtgcccgacagacatattcctctggccctgccccgacaaaacagtactggccaagcacagatcagaaaggtggatcaaggtggcctcggtgcccgggcaaaggcgccaccatccttaccacacagcgcatcgctgcgctctacaggcagcatgagtgtcgtgtccgcggctctggtggcagaaccagtgcagaacggaagtcggagtagacagcagtccagctcgagtcgcgaaagccccgtcccgaaggtccgcgccatccagcggcagcagacacagcaggttcaatcccctgtggactcagcaacgatgtctccggtggagaggacagccgcctgggtcctcaacaacgggcagtacgaagaagacgtagaagagaccgaacagaacctcgacgaagccaaacatgcggagaaatacgagcaggagattacgaagctgaaagaacgcttaagggtgtcatctcggagattagaagagtatgaaagaaggctcctcgtgcaggaacagcagatgcagaagctgctcttggagtacaaggctcgcttggaggactcagaagaaagactaaggcggcagcaagaggaaaaagactcacagatgaagagcataatctcacggctaatggcagtcgaagaggaactgaaaaaggatcatgctgagatgcaggccgtcatcgacgcaaagcagaaaataattgacgcgcaggagaaacgtattgtgtcactggattctgcaaacacacgtctgatgagcgcactcacccaagtgaaagagaggtatagcatgcaggtacggaacggtatctctccaactaatcccaccaaactgtctatcaccgaaaacggggagttcaagaactctagctgttag

SEQ ID NO: 29465 - DNA, 3036 bp, Artificial Sequence
  Description of Artificial Sequence: Synthetic coding sequence
atggacccgcctagtccctcaagaacaagtcagactcaaccaaccgcaacctcacctttgacttcttaccggtggcacactggaggggggggcgagaaagccgctgggggttttcgatggggacgctttgccggttggggaagagcgctctcgcaccaggaacccatggtgtcaactcagccagcgccgaggagtattttcagaagggttctgagcgcccctccaaaggaaagcaggacttcgcgtctgcggctttccaaggctctatggggtcgtcacaaaaacccacctcctgagcctgatccagagcccgagcaagaagcccccgagttggaacccgaacccgagctggaaccccctactccccagattcctgaggccccaacgcccaatgttccagtatgggatattggtggctttacattgttggacggcaagctggtccttctgggtggggaagaggaagggccccgcaggccaagagtcggaagcgccagctctgagggttctatccatgttgctatggggaattttcgcgacccagataggatgcctggaaagactgaaccggagacagctggcccaaaccaggtgcataatgtgcgcggtttattgaagaggttgaaagaaaagaaaaaagctagactggagccacgggacgggcctccgtctgctttagggtcaagagagtcactagccactctgagtgagctcgatctgggcgccgagagagacgtaaggatttggccactgcacccatctctgctaggcgagccacattgcttccaagtcacatggacaggcggttcccggtgcttctcctgtcgatccgccgctgagagggaccggtggatcgaagacctccgccggcaattccagccaacccaggataatgtcgaacgcgaggaaacatggttatccgtctgggtgcacgaggccaagggcttgccacgggcggcagctggcgcgcctggggttcgcgccgaactgtggctcgatggcgcattgctcgcccgcacggcgccccgggctggacccggacagctcttttgggcagagcgttttcatttcgaggctctgcctccagctaggcgcttgtccttgcgcctgagaggattgggccccggcagcgccgttctcggcagggttgccctagcactggaggaactggatgcacctcgggctcccgccgcaggacttgaacgctggtttccgctccttggtgcaccagctggcgcagccttgcgcgcgcgaattagggctcgaagactccgcgtgctgccaagtgagaggtacaaggagctagcagagttcttgaccttccattatgcacgactatgcggagcactcgagccggctttgccagcccaggctaaagaggagctggctgctgccatggtacgagtgttgcgggctacagggagggcacaagccctcgtcacagatttggggactgcggagttggcccgctgcggcggtcgagaagctctcttatttagagagaataccctagcaacaaaagcaatagatgaatacatgaagctggtcgcccaagactacttgcaagaaacattaggacaggtagtgagacggctttgcgcgtcaacagaggattgcgaggtggatcctagtaaatgcccagcctctgagctacctgaacatcaggcccgcctgagaaattcttgcgaagaagtgtttgagacgataattcattcctacgactggttcccagctgagctcggaatagtctttagttcctggcgggaggcgtgcaaggaacgggggtcagaagtgctaggtccaagattggtatgcgcttccttgtttctacggttgctgtgccccgctattttagccccatctctgtttggcttggctcctgatcatcccgcccccggaccagcaaggactttgactctcattgcgaaggtcatacaaaatttggcaaatagggcccccttcggtgaaaaagaagcgtatatgggattcatgaactcatttctcgaggaacatggtcccgcgatgcagtgcttcctcgatcaagtggccatggtagacgttgacgctgccccgtccggctaccaggggtcaggtgatctggctctgcagcttgcagttttgcatgctcagctgtgcactatatttgccgagctagaccaaaccacacgcgacactctggaacctcttccaacgatcctgcgcgcaatagaggagggtcagccagtgctggtctcagtgcctatgcgattgccacttccccccgcacaggtacactcaagcttgtcagcaggagagaagcccggcttcctagcacctcgcgatctgccgaagcacactcccttaatatccaaaagtcagtccctcaggtccgtgcggcgtagtgagagctgggccagacccagaccagacgaggagcgacctctgcgccggccgcgacccgtgcaacgcactcagtcggtcccagtccggcggcccgccagaaggcggcaaagcgcaggcccatggccgcggcctaaaggctctctgagcatggggcccgcaccccgggcacgcccatggactcgtgactcagcgtcactcccacggaagcctagcgtgccatggcagcggcagatggaccagccacaggaccgcaaccaagccctgggcacccaccgcccggttaacaagctggctgagttgcaatgcgaggttgcagctttacgggaggaacagaaagtcctttcccggttagttgagtcgctgtctactcagatccgagcccttaccgagcagcaggaacagctgagagggcagctacaagacttggattctcggctccgggctgggagtagtgaattcgactctgaacacaacctcacaagcaatgaaggacattcattgaaaaatttggaacacagactgaatgaaatggagcgcactcaggctcagctaagagacgctgtgcagagtctccagttgtctcccagaacacgcggttcatggtcacagccacagccactaaaagctccttgtctgaacggagataccacttag

SEQ ID NO: 29466 - DNA, 711 bp, Artificial Sequence
  Description of Artificial Sequence: Synthetic coding sequence
atggagagatggctgttcctgggggccacggaggaagggcccaaacgcaccatggattccggaactcgccctgttggaagctgctgctcttctccagccggtttgtctagagaatacaagctggtgatgcttggtgccggaggagtgggcaagagcgcaatgaccatgcagtttatttctcaccggtttcctgaagatcatgaccccacgatagaggacgcctataaaatcaggataaggatcgatgatgaacccgcaaacctggacattctggataccgcggggcaagctgaattcaccgccatgcgagaccagtacatgcgcgctggggagggatttataatttgctattctatcacagaccggcgcagtttccacgaggtgagggagttcaaacaactaatctatagagtaagacgaacggacgatacccctgtcgtgctggtaggcaacaaaagcgatctgaagcagttgaggcaggtgaccaaggaagaggggctggccttggcaagggagttctcatgccctttttttgaaaccagcgctgcttatcggtactatattgatgatgtcttccatgccctggtgcgggagatccggcgcaaggaaaaggaggctgtgctggctatggaaaaaaagtccaaacccaaaaattcggtttggaaacgccttaaaagccctttccggaagaagaaggactctgtgacttag

SEQ ID NO: 29467 - DNA, 660 bp, Artificial Sequence
  Description of Artificial Sequence: Synthetic coding sequence
atggactctggcacaagacctgttgggtcatgttgtagtagccccgcaggccttagcagggagtacaaattagtgatgttgggcgctggcggtgttggaaagtctgctatgaccatgcagtttatcagccataggtttcctgaggatcatgatccaacaatcgaggatgcctacaaaatccgtatccgcatcgacgatgaaccggcgaacctggacatcctggacacagccggccaagcagaatttactgccatgcgagatcaatatatgagggccggcgaagggttcataatctgctactctatcactgaccggagatcattccacgaggtcagggagttcaaacagctcatctacagggtgcggcgtacagatgacacacccgtggtcctcgttgggaacaaatctgacttgaagcagctgcggcaagtgaccaaagaggaaggattagcactcgctcgcgaattcagctgcccctttttcgagacttctgctgcctataggtactacatcgacgacgtgttccacgctcttgtacgcgagatccgccgcaaagaaaaggaagccgtgctggccatggaaaagaaaagtaaaccgaaaaattctgtgtggaaacgccttaaaagccctttccgaaaaaagaaggacagtgtgacttag

SEQ ID NO: 29468 - DNA, 552 bp, Artificial Sequence
  Description of Artificial Sequence: Synthetic coding sequence
atgaccatgcagtttatctcacatagatttccagaggaccacgaccccaccatcgaagatgcatacaaaatcaggattcggattgacgatgaaccagcaaatctcgacatcctagacactgcaggacaggccgaattcacagcaatgcgcgatcaatacatgagagccggcgaagggttcattatttgttatagtattaccgataggcgctccttccacgaggtgagagagtttaagcagttaatctacagagttcgccgtaccgacgataccccagttgtcctggtgggaaacaaaagtgatctgaagcagctgagacaagtgaccaaggaggaaggcctggcccttgccagagaattttcatgccctttctttgagacctccgctgcatatagatactacatagatgacgtgttccacgctctggtacgcgaaattcgccgaaaggagaaggaagcggtcctggctatggaaaagaaatccaagcctaagaattcagtgtggaaacgcctgaagagcccgttcagaaaaaagaaagatagcgtgacgtag

SEQ ID NO: 29469 - DNA, 462 bp, Artificial Sequence
  Description of Artificial Sequence: Synthetic coding sequence
atggaagtagagaacgaagcctcctgttcccccggaagcgcctccggtgggagtcgggagtacaaggtcgttatgctgggggctggcggagttggcaagtcagcaatgacaatgcagttcatttcgcaccagtttccggattatcacgatccgaccattgaggacgcttacaagactcaagtgaggattgacaatgaacccgcctacctcgacattctggacacggcggggcaggctgaattcacagctatgagagaacagtatatgcggggaggggaaggtttcatcatttgttactccgttactgaccgccagtccttccaggaagccgccaagtttaaagagttgatctttcaggtgcggcacacatatgaaattcctctggtcctggtggggaataaaattgacctggagcagttccgacaacccaccctgaaggaatttggaagggaggagttttag

SEQ ID NO: 29470 - DNA, 654 bp, Artificial Sequence
  Description of Artificial Sequence: Synthetic coding sequence
atggaggtcgagaatgaggccagctgttcacccggtagcgcgagcgggggtagccgagaatacaaggtggtgatgctgggcgccggcggtgtgggtaagtccgctatgaccatgcagttcatctctcaccagtttcctgactaccacgatccaacgatcgaagatgcgtataagactcaagtccgaattgataacgagcccgcttacctggatatcttagacacagcaggacaggccgagttcactgccatgagggagcagtatatgcgtggcggggaggggttcatcatttgctactccgttacagaccgtcagtcttttcaagaggccgccaagtttaaggagcttattttccaggtgcgccatacctatgagattccgctggttttggtgggcaataaaattgaccttgagcagttccggcaggtgtctactgaggagggattatccctggcacaggaatacaactgcggtttttttgagacttctgcggctctaagattttgcattgacgacgctttccacgggctcgtgcgggagatcaggaaaaaggaaagcatgccttctctgatggagaagaagctgaaacggaaagattcactgtggaagaagcttaagggctcccttaagaagaagagggagaatatgacgtag

SEQ ID NO: 29471 - DNA, 240 bp, Artificial Sequence
  Description of Artificial Sequence: Synthetic coding sequence
atgccagtcgcggtcggcccctacggccagagtcagccctcctgttttgaccgtgttaagatggggttcgttatgggctgcgctgtaggcatggcagctggagctctgtttgggactttctcatgcctgcgcattggaatgaggggccgggaactcatgggcgggatcggcaaaactatgatgcagtccggcggtactttcgggacatttatggcaattggcatgggcatacgatgctag

SEQ ID NO: 29472 - DNA, 240 bp, Artificial Sequence
  Description of Artificial Sequence: Synthetic coding sequence
atgccagtagctgttgggccctacggccagtctcagccctcatgctttgacagggtgaaaatggggtttgtgatgggctgcgccgtgggaatggctgctggtgctctcttcggaacatttagctgcttgcgaatcgggatgcgcggtcgagagctgatggggggtatcggcaaaactatgatgcaatctggcggtaccttcggcacattcatggcgattggcatgggaatccgctgttag

SEQ ID NO: 29473 - DNA, 240 bp, Artificial Sequence
  Description of Artificial Sequence: Synthetic coding sequence
atgccggtggcggtggggccatatggacagtcacagcctagctgtttcgaccgtgtgaagatggggttcgtaatggggtgcgcagtaggaatggctgcaggagcgctgttcgggactttttcatgccttcgcatcggtatgagggggcgggagttgatgggcggtattggaaaaaccatgatgcagtccggcgggacattcggtacctttatggcaatcgggatgggcattcgctgttag

SEQ ID NO: 29474 - DNA, 240 bp, Artificial Sequence
  Description of Artificial Sequence: Synthetic coding sequence
atgcctgtggctgtgggcccctacggccagagccagcctagttgctttgacagagtaaagatgggattcgtgatggggtgtgccgtaggcatggccgccggagccctgttcggcacattttcttgcctcagaatagggatgagagggagagaactgatgggcggaatcggaaagactatgatgcagtccggaggaactttcgggacctttatggccatcggaatgggcataaggtgctag

SEQ ID NO: 29475 - DNA, 792 bp, Artificial Sequence
  Description of Artificial Sequence: Synthetic coding sequence
atgcgcatttttaggccatggaggctcagatgccccgccttacacctgccgtccctttcagtattcagcctgaggtggaagctccccagcctgaccacagacgagactatgtgcaagtcggtcactactgacgaatggaaaaaggtgttttatgagaaaatggaggaggcaaaacccgctgacagctgggacttaattattgacccgaacctgaagcacaacgtcctgagcccagggtggaagcagtacttagaactacatgcttctggccgcttccattgctcttggtgctggcacacctggcagtctccttatgtggtcattttgttccacatgtttctggacagagcacaaagagccggctccgtgaggatgcgggtgttcaagcaattatgttatgaatgcggaaccgccagactggatgaatcttcaatgcttgaggagaacattgaagggctggtcgataacctcatcacttcccttcgagagcagtgctacggagaaagaggcggccagtatcggattcacgtcgcaagcaggcaggacaaccgcagacacaggggagagttttgtgaagcttgccaggagggaatcgtgcattggaaaccctcagaaaagcttctggaagaggaagcgaccacgtacaccttctctcgggctccttctcccacaaaatcccaggatcagaccggctcggggtggaacttctgttcaatcccttggtgtttattttgggccacggtgctgcttttaattatttatctgcagttcagttttaggagctcagtgtag

SEQ ID NO: 29476 - DNA, 678 bp, Artificial Sequence
  Description of Artificial Sequence: Synthetic coding sequence
atgtgtacctccctgaccacatgcgaatggaagaaagttttctacgaaaaaatggaggtggccaagccagccgacagttgggaactgatcatcgatcctaacctgaaaccatctgagcttgcccccggctggaaacaatatctcgagcagcacgcgtccggcagattccactgctcctggtgctggcatacttggcaaagtgcgcacgtggttatcctgttccacatgtttcttgatcgggcccagagggctggcagtgttcggatgagagtctttaagcagctgtgctatgagtgtggcaccgcgcgcctggatgagagctccatgctagaagaaaatatcgaaggtctcgtggataacctgatcacctctctgagggagcagtgctacgaggaggatggcggccaatacaggattcatgtggcttcgagaccggactccggccctcaccgggccgagttttgtgaggcgtgtcaggagggcattgtgcactggaagcccagtgagaaattgctggaggaggaggtgaccacatatacttccgaggcctccaagcccagagcccaggcagggtccggatataacttcctgtccttgcgttggtgtttgttctgggcttccctctgcttactggtagtgtaccttcaattctcctttctgagtcctgcattcttctag

SEQ ID NO: 29477 - DNA, 2016 bp, Artificial Sequence
  Description of Artificial Sequence: Synthetic coding sequence
atgcaacccgatatgtccttaaatgtcattaagatgaagagtagcgatttcctcgaatccgctgagcttgactctggtggctttgggaaggtgagcctgtgctttcaccgaactcaggggctaatgataatgaaaactgtgtataaggggcccaactgtattgaacacaatgaagcattacttgaggaggcaaagatgatgaaccgattgcgtcacagtagggtggtcaaactgctgggggtgataattgaagagggcaagtacagcctcgtgatggagtacatggagaaaggcaatcttatgcacgtgctgaaagccgaaatgtcaacacctctgtctgtgaaaggcagaatcattcttgagataattgaagggatgtgctatctgcatggcaagggggtcattcacaaggatctaaaaccagagaatatacttgtggataacgatttccatattaagatcgctgatttgggactagcgtcattcaaaatgtggtctaaactgaacaacgaggagcataacgaactcagagaagtggacggtaccgccaaaaaaaacggaggcaccctgtactacatggctccagagcacttgaatgacgttaacgcaaagccaacggagaaaagtgacgtgtatagcttcgccgtggtgctatgggcgatatttgccaataaggaaccatacgagaacgccatctgtgagcagcaattaataatgtgcattaagtcaggtaatcgccctgacgtggatgacatcaccgagtactgtccaagagaaattatatcccttatgaagctgtgttgggaagcaaaccctgaagccagaccaacattccctggcattgaagagaaattcaggccattctatctctctcaactggaggaatccgtggaggaggacgtgaagagtttgaaaaaagagtactctaatgaaaacgccgtcgttaaacgcatgcagtctctgcagcttgattgcgtggcggttccatcctcaaggtcaaacagtgcaactgaacagcccggttccttacatagcagccaaggattgggtatggggccagtggaggagtcctggttcgctccaagtctggagcatccgcaagaggagaacgagccctctctgcagtccaaactgcaggacgaggctaactaccatctctatgggtcacgcatggaccgccagacaaagcaacaacctaggcagaacgtggcctataaccgcgaggaggagaggcggcggcgggtgtcacacgacccatttgcccagcagcggccatacgagaatttccagaacacagaaggtaaaggtacagcttattcaagcgctgcaagtcacggaaatgctgtgcaccagccctctggcctcacctcacaaccacaggtactgtaccaaaataacggtctgtactcaagccacggctttggcaccaggcccctcgaccctggaacggccgggccccgagtatggtaccgccctattccgtctcatatgccctctcttcacaatataccggtgcctgaaaccaactaccttggcaacaccccaactatgcctttcagctctctgccacccaccgatgagtccattaaatacactatttataactcaacgggtatccagattggcgcctataactatatggaaataggtggaacctcctcttcgctgctcgacagcaccaataccaatttcaaagaggaacctgctgctaaatatcaggcaatttttgacaacactacttccctgaccgacaaacatctggacccgatccgggaaaatctcggcaagcattggaaaaactgtgcccgcaagttgggcttcacacagtcccagatcgacgagattgaccacgactacgaacgagatggccttaaagaaaaagtgtaccagatgctccagaagtgggttatgcgcgaaggaatcaaaggggccactgtgggcaagctggcgcaggcactccaccagtgcagcaggatcgacctcctatctagtctcatctatgtgtcacagaactag

SEQ ID NO: 29478 - DNA, 2016 bp, Artificial Sequence
  Description of Artificial Sequence: Synthetic coding sequence
atgcagccggatatgtcccttaacgttattaagatgaagtcgtcagactttcttgaatccgcggaactagactcgggcggctttggcaaagtgtcattgtgcttccatcgcacccagggtctaatgatcatgaagacagtatacaaagggcctaattgtattgaacacaacgaggccctgcttgaggaggccaaaatgatgaacagactccggcatagcagagtggtcaaactgctcggcgtcattatcgaggagggcaaatattccctcgtgatggaatatatggagaagggtaatttaatgcacgtgttgaaagccgagatgtcgactccccttagtgtaaaaggtcgaatcatcctggagataattgaggggatgtgctacctgcacggcaagggtgtgattcacaaagatctcaaacccgaaaatatcctggtggataacgatttccacattaaaattgcggacctggggctggcgagctttaagatgtggagcaaacttaacaacgaggagcataatgaactgagggaggtagacggtactgcaaaaaagaacggaggcacactgtattacatggccccagagcatctgaatgacgttaacgctaagcctacagagaagtccgatgtctactcctttgctgtagtgctctgggcgatctttgccaacaaagagccctacgagaacgctatttgtgagcagcagctcattatgtgcattaaatcagggaataggcctgatgtagacgacataacagagtactgtccccgcgaaattatttccctcatgaaactctgctgggaagcaaatccagaagcccgacctacattcccgggaatcgaggagaagttcagacctttttatctgtctcagctggaagaaagcgtggaagaggatgtcaagtcattgaagaaagaatacagcaacgagaacgctgtggtaaaacggatgcaatctctgcagctagattgtgtggccgttcctagctcgcggtctaattccgccactgagcagccaggatctctgcattcttcacagggattaggtatgggaccggtcgaggagtcctggtttgctccttccctcgagcatcctcaagaggaaaatgagcctagcctgcaatctaaactgcaggacgaggctaattatcacctgtatgggtcccggatggatcgtcagaccaagcaacagccaaggcagaacgtggcctataatagggaggaagaaagaaggaggcgcgtgtctcacgacccatttgcccagcagcgcccttatgaaaacttccagaatacggaaggcaaaggcaccgcctactctagtgcggcgtctcacggcaatgcggtccatcaaccctctggtctcacctcccagcctcaggttctgtaccagaacaatggcctttactcaagccacgggttcggtacgaggcctctcgatcccggaactgcgggcccacgagtttggtaccgacccatcccaagtcacatgccttccctacacaacatccctgtccccgaaactaattacctcggtaatacgccaactatgcctttttccagcctgccacccacagatgaaagcataaagtacactatttacaattcaaccggcattcaaatcggggcctacaactacatggagataggcggcaccagttcatctctgctcgattcgacaaacaccaacttcaaagaggaaccggctgcaaaatatcaggcgatattcgacaacactacaagtcttacagacaagcacctggatcccattagggagaatttgggcaagcactggaaaaattgcgcgcgcaagctaggttttactcagagtcagatcgatgagattgaccatgactatgaacgtgatggcttgaaggagaaagtatatcagatgctgcagaagtgggtaatgcgcgagggcatcaagggcgctacagttggcaaactggcccaggctctgcaccaatgctcacggattgatctcctgtctagcctcatctacgtatctcagaattag

SEQ ID NO: 29479 - DNA, 822 bp, Artificial Sequence
  Description of Artificial Sequence: Synthetic coding sequence
atgagcccagcatgtagagtgaattctaagactaagcccactactatcttcatggctgctgcttggacagggaggcggaattctagcccagatagaatgtggttaacaacagaacggcgtaaaggagatgccggaagtcccatgactctcttacaccgcccatcgggccttactagccagccacaggtgctgtatcagaacaatggcctgtactcctctcatgggtttgggacacggccacttgatccaggaaccgccggaccacgcgtctggtataggccaatccccagccatatgccctcattgcacaatatcccagtgcctgagacaaattacctgggcaacacaccaactatgcccttcagtagtctcccgcctacggacgagagcattaaatatacgatatacaattcgacagggattcagatcggcgcgtacaattatatggagattggcggaacaagctcctctctgctggattcaaccaacacaaacttcaaggaagagcctgcggcaaagtatcaggcaatctttgataatacgacaagcctgaccgataaacacctggaccccattagggagaatctcggtaagcactggaagaactgcgctaggaagctgggtttcacacaaagtcaaattgatgagattgatcacgactacgaacgggacgggttgaaagagaaggtctatcagatgctgcagaaatgggtgatgagggaaggtatcaagggtgctacggtgggtaagttggcccaggccctgcaccagtgtagccgtattgatttgctgtcttcgctaatctacgtatctcaaaactag

SEQ ID NO: 29480 - DNA, 1878 bp, Artificial Sequence
  Description of Artificial Sequence: Synthetic coding sequence
atgcagcccgatatgtccctgaacgtgattaaaatgaagagcagcgatttcctcgagtccgccgaattggacagcggcggctttggcaaggtaagcctatgtttccacagaacccagggacttatgataatgaaaacagtctacaaaggacctaattgtatcgaacacaacgaggcactccttgaggaggccaagatgatgaatcggttacggcactctagggttgtgaagctgttgggtgttataatagaggagggtaaatattccttggttatggagtacatggaaaagggcaatctcatgcacgtgttaaaagcggagattgccgatttggggttggcttctttcaagatgtggtctaagctgaataatgaggaacacaatgaactgcgtgaggtagatggaacagccaaaaagaacggtggcacgctttactacatggcccccgagcacctgaacgatgtgaacgctaagccgacggaaaaatctgatgtgtactctttcgctgtggtgctctgggctatctttgccaacaaggagccatatgagaatgccatctgcgagcagcagttgattatgtgcattaagtcagggaacagacccgacgttgacgatatcactgaatactgccctagagagataatttccctgatgaagctgtgttgggaagcaaatccagaggctagaccgacattcccagggatcgaagaaaaatttaggccgttttacctttcacagctggaagagagcgttgaagaagacgtcaagagcctcaaaaaggaatactccaatgagaatgcagtggttaagcgcatgcagagcctccagttggattgcgtagccgtgccaagctcccgttccaactctgcgactgagcagcctgggtcacttcattccagccagggcctaggcatggggccagtggaggaaagctggtttgctccctcactggaacatccccaagaagaaaatgaaccttccctgcaatctaaactgcaggatgaggccaactatcatttgtacgggagtcggatggatcggcagacgaagcagcagcccagacagaacgtggcatataatagagaggaggagcgaagaaggcgtgtgtcacatgacccgttcgcccagcagaggccctatgagaacttccagaatactgagggaaaagggactgcttactccagtgcagctagccacggcaacgctgtgcatcagccatctgggttgacaagccagcctcaggttttataccagaataatggtctctatagtagccacgggtttgggacgagacctctggacccaggcaccgctggcccccgagtatggtataggccgatcccgtcccatatgccaagcctacacaacattcccgtgccagagaccaattacctgggtaacactccaaccatgccctttagttccctgcccccgactgatgagtctatcaagtataccatctacaattcaaccggcattcagattggagcctataattatatggagatcggtggcacctctagcagtttgctggacagtactaacaccaatttcaaagaggaacctgctgcaaaataccaagcaatatttgataacactacctcgctgacagacaaacatttggacccaatcagagagaaccttggcaagcactggaaaaattgtgcccgtaaactcggctttacacagtctcagattgacgaaatagaccatgactacgaacgcgatggattgaaagaaaaagtgtatcagatgctccagaaatgggtgatgcgggagggaattaagggcgcaaccgtgggcaaacttgcccaggcacttcatcagtgctctcgcatcgacctgctgtcaagcctgatctacgtgagccagaactag

SEQ ID NO: 29481 - DNA, 522 bp, Artificial Sequence
  Description of Artificial Sequence: Synthetic coding sequence
atgcagtctgagctctgctttgccgatattcatgatagtgatggctctagttcctcctcccaccaaagccttaagtctaccgctaagtgggccgcttctctagaaaatctgctggaagacccggaaggagtcaaacgcttccgtgaattcctgaagaaggagttttccgaggaaaatgtactgttttggttagcttgtgaagattttaaaaaaatgcaggacaagactcagatgcaggaaaaggcgaaggaaatttacatgacttttctgagctcgaaagccagctcccaagtgaatgtggaaggtcagtccagactgaacgagaagatactggaagagcctcatccactcatgttccagaagctacaggatcagatcttcaatcttatgaagtacgacagctactccaggtttctgaaatcagatttatttttaaaacacaagcgtaccgaagaggaggaggaggacctgcctgacgcccagaccgctgcaaagcgggcaagccgcatctataacacatag

SEQ ID NO: 29482 - DNA, 546 bp, Artificial Sequence
  Description of Artificial Sequence: Synthetic coding sequence
atgttcaacagggctgtgtctagactgagccggaagaggccccctagtgatatccatgactcagatggatcttcctctagctcacaccaaagtctgaagagcacggccaagtgggccgcatccttagagaacctgctcgaggacccggagggggtgaagaggttccgcgagttcctgaagaaggagttctcagaggagaatgtccttttctggcttgcgtgcgaagactttaaaaagatgcaggacaaaacccagatgcaggagaaagccaaggagatttatatgacatttctgagctcaaaggcgtcttcccaggtgaacgtagaaggccagagtcggcttaacgaaaagatactcgaggaaccccacccgctgatgtttcagaagctgcaggatcagattttcaatctcatgaagtatgactcctatagcaggtttctaaaaagtgacctgtttctcaagcacaaacgaaccgaggaggaggaggaagatcttcctgacgcacagacagctgccaagcgagcttctaggatctacaacacttag

SEQ ID NO: 29483 - DNA, 504 bp, Artificial Sequence
  Description of Artificial Sequence: Synthetic coding sequence
atggaacatatccatgacagtgacggtagcagctctagttcccaccagagtctgaagtccacagccaagtgggccgcaagcctggagaacttattagaggaccccgaaggcgtgaagaggttcagagagttccttaagaaggagttctcggaagagaacgtattattttggctggcttgtgaggactttaagaaaatgcaggacaaaacccaaatgcaggagaaagctaaagaaatctatatgacctttctaagttctaaagcaagttctcaggttaatgtcgaaggccagtctcgcctgaacgagaagatactggaggagcctcacccacttatgttccagaagttgcaggatcagatctttaatttaatgaagtacgattcctacagtcgcttcctcaaatccgacctgtttctcaaacacaagagaaccgaagaagaggaggaggatctacctgacgcgcagacagccgccaagagagcctctaggatttacaatacatag

SEQ ID NO: 29484 - DNA, 1341 bp, Artificial Sequence
  Description of Artificial Sequence: Synthetic coding sequence
atggagagagtcgtagtctctatgcaggaccccgaccaaggggtaaagatgcgctctcaaagactgttggttaccgtaatcccccacgcagtcacaggatcagacgtggttcagtggcttgcgcagaagttctgtgtaagcgaggaggaggcgcttcatctgggtgcagtgctcgtccaacatggatacatttaccccctgagagatcctagatcattaatgctgagacctgatgagaccccatatcgcttccagaccccatacttttggacttcaacccttaggcccgcggccgaactcgactacgctatttatctcgccaagaagaacatcaggaagagaggaactctcgtggattatgagaaggactgttacgaccgcttgcacaagaaaataaaccatgcttgggacctggttttgatgcaggctcgcgagcagttgcgagcggcgaaacaacgtagcaagggtgatcggctggtgatagcgtgtcaagaacaaacctattggctcgttaatcgcccaccacctggcgcgccagatgtccttgagcagggcccagggagggggagttgcgccgcatctagagtgcttatgaccaaatccgccgatttccataagcgcgagattgaatacttccggaaggctctgggccgaacccgtgtcaagagttctgtgtgtttggaggcatacctgtctttctgcgggcagagagggccgcatgaccccctggtttctggttgtctcccatcaaacccatggatcagtgacaacgacgcgtattgggtcatgaacgctccgaccgtggcggcacccacaaaactccgcgtggaaagatggggtttttcgttccgcgaactgctcgaagaccctgttgggcgcgcccatttcatggatttcttagggaaagagttctcgggagaaaacctatccttctgggaggcatgcgaagaactgagatacggcgcccaagctcaagtcccaacactggtggatgctgtttatgagcagtttctagcccctggcgctgcgcactgggtgaacatcgactcccgcaccatggagcaaaccctggaaggtctaaggcagccacacagatatgttttggacgatgcccaattgcacatctatatgctgatgaagaaagactcgtatccccgcttcctgaaatcagatatgtacaaggctctactcgcggaagcaggcattcccctggaaatgaaaaggagggtcttcccatttacatggcgaccaagacactcatcccccagccctgccctgttaccaacccctgtggaaccaacggctgcgtgtggccccgggggcggcgatggcgtggcgtag

SEQ ID NO: 29485 - DNA, 786 bp, Artificial Sequence
  Description of Artificial Sequence: Synthetic coding sequence
atggctgccggtcctgcccctcctcctggtcgccctcgcgcacagatgccgcacctgcgcaaaatggaacgggtcgtagttagtatgcaggatccggatcagggtgtgaagatgcgctctcaaaggttgctcgtgacagtcattcctcacgcagtcaccggctctgatgtggttcagtggctggctcagaaattctgcgtcagcgaggaagaggccctgcacttaggcgcagtactcgtgcagcacgggtatatttatccgctgcgcgaccccaggagccttatgctccggcctgacgagactccataccggtttcagaccccttatttctggacatcaactctacgaccagccgcggagttagattacgcaatctatctggcaaagaagaacattcggaaacgagggactcttgttgactacgagaaggattgttatgacagactgcataagaaaataaaccatgcttgggacctggttttaatgcaggcgcgggagcaactgcgggcagccaaacagcggagcaagggcgacagactggtcatcgcatgccaggagcaaacatactggttggtgaatagaccccctcctggagcgcctgacgtgttggaacagggacccggccgcggttcctgcgcggcgtccagggtactcatggttgaggcctctagaactcggggtacccggcctgaaggcgccagcgagcctcgatcgtctaagactctgtgcagcaatcagagccacccagatcccacgagtggcaagatgcacctggaacctcattag

SEQ ID NO: 29486 - DNA, 1404 bp, Artificial Sequence
  Description of Artificial Sequence: Synthetic coding sequence
atggccgcgggacctgctccaccccccggacggcctcgggcacagatgccacatttgaggaagatggagcgggtggtggtgtctatgcaggacccagatcagggtgtgaagatgcgctctcagagactcctcgtgaccgtgatcccacatgcagtaacaggtagcgatgtggtacagtggctggcgcaaaagttttgcgtgagtgaggaggaggccctgcatctcggagcggtgctggtgcagcacggctacatctaccccctccgggatcccaggtccttgatgcttaggccagacgaaacaccatacaggttccagactccatatttctggacgtcgacactgcggcctgcagcagaacttgattatgcaatctacctggccaagaaaaatatacggaaacgcgggactttggtagactacgagaaggactgttacgacaggttgcataagaagatcaatcacgcttgggatcttgtactgatgcaagccagggagcagctgagggcggcaaagcagaggtctaaaggtgatcggttggtgatagcctgccaggaacagacctattggctggtcaaccggccccccccaggagcgcccgatgtgcttgagcagggccccggtcgcggttcttgcgcagccagcagagttctgatgacgaagtccgcagatttccacaaaagagaaatagaatatttccggaaggcactcggtcgcacacgggtgaagtctagcgtgtgcctggaggcatacttaagcttctgcggccaacggggaccacacgaccctctggtttccgggtgtctgccaagtaacccctggatcagtgacaacgatgcatattgggtgatgaacgcgcccaccgtcgctgcccccacaaagctgcgggtcgaacgatggggatttagcttccgcgagctactcgaggaccccgtcggcagggcccacttcatggattttctcggaaaagaattcagcggtgagaatctgtcattttgggaagcctgtgaagaattgcgatatggagctcaagcacaggttcctaccctggtggatgccgtctacgaacagttccttgccccgggcgcagcacactgggtcaatattgacagtaggacaatggagcagactttagagggactgaggcagccacataggtacgtgctggacgacgcccagttacatatctatatgttgatgaaaaaggactcttatccccgatttctgaagtctgatatgtataaggctctgttggccgaggccggcatccctctggaaatgaaacgtcgagtcttcccattcacatggcggccccgccacagcagccctagtcctgcactgctccctactcctgtcgagcccactgccgcctgcgggcctggcggaggggacggggtagcctag

SEQ ID NO: 29487 - DNA, 405 bp, Artificial Sequence
  Description of Artificial Sequence: Synthetic coding sequence
atggccacctctacacgctgtgccactcctgtggcctcgtgcagtgggcagaccagacggcccacaggctcccggtccgggtctggggtgcaggtaggcgcaggtggcacacctacgccaacccatccagcataccaactaggcgagactggaggagctcctagcctgctgggtctcgagtgggactctgcaatgagcccgtgggcaggcgggcctagtccgcccccccagaagagctggaccgccagtactgacgttgtgcgcaggaccaggctccgggacggggctagtgttttcctcgggactaccgctggtcctcacaaagggtcctatgtgcaaagaatcctgccatcctcttggggaagcctggggcctggccctgaagggggagccgttaaagcctag

SEQ ID NO: 29488 - DNA, 480 bp, Artificial Sequence
  Description of Artificial Sequence: Synthetic coding sequence
atgtccaggaggaactgttggatttgtaaaatgtgccgggatgagagtaagaggcccccctctaatctgaccctggaagaggtcctgcaatgggcgcagagttttgaaaacttgatggcaaccaagtacggccctgtggtgtatgccgcctatctaaagatggagcactccgatgagaacatacaattttggatggcttgtgagacatataagaaaatcgccagtaggtggtccaggatatcaagggccaagaagctatataaaatctatattcaaccccagtcgcccagagaaattaatattgacagctccacaagggaaaccattattcggaacattcaggaacctacggaaacatgttttgaggaggcccagaagatcgtatacatgcacatggagagggactcctaccctcgttttctcaaatcagagatgtatcaaaaattgcttaaaactatgcagtccaataattcgttctag

SEQ ID NO: 29489 - DNA, 480 bp, Artificial Sequence
  Description of Artificial Sequence: Synthetic coding sequence
atgtccagaaggaattgttggatatgcaagatgtgcagagacgaatctaagagaccaccctccaatctgacactcgaagaggtgctgcagtgggcacaatcctttgagaacctcatggcaacgaaatatggtcctgtggtgtacgccgcttacctgaagatggagcactccgatgaaaacatccaattttggatggcatgcgagacatacaagaagatcgccagccggtggtctagaatttcacgcgccaaaaaactgtataaaatctacattcaaccgcagtcccctagggagatcaacattgactcatccactcgtgagaccatcatccgaaacatccaggagcctaccgaaacttgctttgaggaagcacagaaaatcgtttacatgcacatggagcgggactcttacccccgctttctcaagagcgagatgtatcagaaactgctgaagaccatgcaaagcaataattcattttag

SEQ ID NO: 29490 - DNA, 1788 bp, Artificial Sequence
  Description of Artificial Sequence: Synthetic coding sequence
atgaccatgaccctgcacacaaaggcttcaggcatggccctgttacatcaaattcagggaaatgaactcgaacccctgaatcgtcctcagttaaaaatccccctggagcgcccgctcggggaggtttatctcgactcctccaaaccggccgtgtacaattacccggaaggcgcagcctacgagttcaatgctgccgccgccgcaaatgctcaagtgtacggccagacagggctcccatacggtccagggagtgaggctgccgctttcggctcaaatggtctaggcggcttcccccccttaaatagcgtttccccctctccactgatgctcctccatccgcctccccaactgtccccattcctgcagccacacggtcaacaggtcccctactacctggagaatgaaccatctggatacactgtccgagaagccggacctcctgccttctaccggccgaacagtgacaaccgacggcagggtggccgggagcgcctggcctctactaacgataaaggatccatggcaatggagagtgccaaggagacgcgttactgcgccgtgtgcaatgattacgcttcaggctaccactatggtgtgtggtcatgtgaaggctgtaaggcgttctttaaacgctccattcagggacacaacgattatatgtgccctgccacaaaccagtgtaccattgataagaatagaaggaaatcctgtcaggcctgcagactcagaaagtgttacgaggtcggaatgatgaaggggggcatcagaaaagaccggcgggggggacgtatgttgaaacacaagcgtcagagggatgacggtgaaggtagaggagaagtcggctccgcaggcgatatgcgggccgccaacctctggccctcaccgctaatgataaaacgaagcaagaagaattcactagctctgtccctcacagccgaccagatggtcagtgctctcctagacgcagagccccccattctttattccgagtacgacccaacccggcctttttccgaggcctcaatgatgggcctactgaccaatcttgcagaccgggagctggtgcacatgataaattgggcgaagagagttccggggttcgtggaccttacccttcatgatcaagttcacctcttagagtgcgcatggcttgagattctgatgattggtcttgtttggcggtccatggaacatcctggcaagcttctgttcgcccccaatctcctcttagaccgaaaccaggggaagtgtgtagaagggatggttgagatctttgacatgctcctcgcaacaagctcaagatttcgtatgatgaatctgcaaggagaggaattcgtctgtctgaagagtatcattctcctgaattctggcgtatatacctttctgagctccacactgaaatccctggaggagaaggaccatattcatagggtgcttgacaagatcactgatacactgatacacctgatggctaaagcaggtctgacattgcagcaacaacaccagagactagcacagctgctgctgatcctctcccacataagacacatgtcaaataaaggcatggaacacctttatagcatgaagtgcaagaatgtggtgccgctgtacgatctgcttcttgagatgctggacgctcatcgtctccatgcccccacctctcgcggaggagccagtgtggaggagacagaccagtcccatttggctacggctggtagcacgagcagtcactccctgcagaagtactacattaccggggaagctgaaggtttccctgcgactgtgtag

SEQ ID NO: 29491 - DNA, 633 bp, Artificial Sequence
  Description of Artificial Sequence: Synthetic coding sequence
atgcgcaaacgccaacagagtcagaatgaagggaccccagcagtaagccaggctccggggaaccagagacctaataacacatgttgtttctgctggtgctgctgttgttcctgctcatgcctcaccgtacgaaacgaggagcggggagagaatgcgggaagacccacgcacacaaccaaaatggagtcgatccaggtgctcgaggaatgccaaaatcccaccgcagaagaggttctgtcttggagccagaatttcgacaagatgatgaaagcccctgcaggacgaaatttgtttcgcgagttcttacgtactgagtattctgaggagaatctcctcttttggctcgcttgcgaagacctgaaaaaggagcagaataaaaaggtgatcgaagagaaggcacggatgatttacgaggactacatcagcattctaagccccaaggaagtttccctggacagtagagtccgggaggtgataaacagaaacctgctggatccaaacccccatatgtatgaagacgcccagcttcaaatatacactcttatgcaccgagactcatttcccagattcttgaattcacagatctataagagcttcgtggaatccaccgcaggctcttcttccgaaagctag

SEQ ID NO: 29492 - DNA, 708 bp, Artificial Sequence
  Description of Artificial Sequence: Synthetic coding sequence
atggagaccacgctgcttttcttctctcagattaatatgtgtgagtctaaagagaagacctttttcaagctgatccacggttctgggaaggaggaaacaagcaaagaggccaaaataagagccaaggaaaagagaaaccgcctcagcctactggtgcaaaagcctgagttccacgaagacaccagatccagccgctccgggcacctggcaaaagagaccagagtgtcgccagaagaagccgtcaagtggggcgaatcctttgacaagctcctgagtcatcgcgatggattggaagccttcactagattcctgaagactgaatttagtgaggagaatatagaattctggatcgcttgcgaggattttaaaaagtcaaaaggaccccagcagatccacctgaaggccaaagccatatacgagaaatttattcagacggacgcccctaaggaagtgaatctggattttcacacaaaggaggttattacaaattctatcacacaaccaaccctgcattcatttgatgccgcccagtcccgtgtttaccagctgatggaacaggacagttacacacggttccttaaaagtgacatatatcttgatttgatggaagggagaccacagcgcccaacaaatcttaggaggaggagcagaagctttacttgtaacgagttccaggacgtccagtccgacgtagcaatttggctgtag

SEQ ID NO: 29493 - DNA, 654 bp, Artificial Sequence
  Description of Artificial Sequence: Synthetic coding sequence
atgccgactccacacgaggccgagaaacagatcaccggacccgaagaagctgaccgacccccctccatgagctcccacgacactgcatctcctgctgccccatcgaggaacccgtgctgtctatgctggtgctgctgttgtagctgttcatggaaccaggagcgaaggagagcctggcaggcctctcgcgagagtaagctgcagcctctgccatcctgtgaagtgtgtgccacgccatcgccagaggaggtgcagagttgggcacagtcatttgataaacttatgcacagccccgccggtcgaagcgtgttccgagctttcctgcgcacagagtactctgaggaaaacatgctgttctggctcgcctgcgaagaattaaaggccgaagccaaccagcacgtagtagatgagaaagctaggcttatttacgaagactacgtgtccatactgtcccccaaggaggtgagcctggactctcgcgtgcgcgaaggcatcaataagaagatgcaggagccgagtgcacacacatttgacgacgctcagcttcagatttatacgctcatgcaccgggactcctacccaagattcttgagctcccctacttatcgagcactattactgcaagggccttctcaaagcagttctgaggcttag

SEQ ID NO: 29494 - DNA, 654 bp, Artificial Sequence
  Description of Artificial Sequence: Synthetic coding sequence
atgcccacaccacatgaggcagagaaacagatcaccggccccgaagaggccgacagaccccccagtatgtcatcacacgataccgcttccccagccgcccctagccggaacccatgctgtttgtgctggtgctgttgttgttcttgctcttggaaccaggaaaggaggcgggcctggcaggccagccgtgaaagcaagcttcaacctttgccctcctgcgaggtttgcgcaaccccgtcgcccgaagaggtccagagctgggcccagagcttcgacaagctcatgcacagtccagccggtcggtccgtctttagagcattcctaagaaccgagtactccgaagagaacatgctgttctggcttgcatgtgaggagctcaaagcagaagccaaccagcatgtggtggacgagaaggctagacttatctacgaggactacgtgtccatcctctcacctaaagaggtgtccctggatagtagagtcagagaagggatcaacaaaaaaatgcaggagccttccgcccacacctttgacgacgcccagctgcagatatacactctgatgcacagagatagctatccccgcttcctgagctcacccacgtatagggctctgctgctacaggggccgtcccagagcagctcagaggcttag

SEQ ID NO: 29495 - DNA, 726 bp, Artificial Sequence
  Description of Artificial Sequence: Synthetic coding sequence
atgaggacagcagacggcggcgagccagccggcgccagttcgccggccggcagggtggatggtggactccagatggggtcagagcgcatggaaatgcggaaacggcagatgcctgccgcccaggacacacccggggccgcccccggtcaaccaggggcaggtagtagaggctcaaatgcgtgttgtttttgttggtgctgctgttgcagttgttcttgcctcaccgtgagaaaccaggaggaccagcgtccaaccatagcgtctcacgagttgagggcagacctcccaacttgggaagagtcacccgcgcctaccctcgaggaggtgaatgcctgggcccaaagcttcgacaagcttatggtgacccccgccggtaggaatgcatttcgtgagttcctgagaaccgaattcagcgaggagaatatgttgttttggatggcctgtgaggagcttaagaaggaggccaacaagaacatcattgaagagaaggccagaattatatatgaggactatatttcaattctgagtcccaaagaagtgtcacttgattcacgcgtcagggaggtcataaatcggaacatggtcgaaccgtcccagcatatctttgacgatgcacagttgcagatttatacattgatgcatagggattcctacccgaggttcatgaactccgcagtgtataaggacctactgcaaagcctgtctgagaaatccatcgaagcttag

SEQ ID NO: 29496 - DNA, 1167 bp, Artificial Sequence
  Description of Artificial Sequence: Synthetic coding sequence
atgccacagttgagtcaagataatcaggagtgtcttcagaagcacttcagccgtcctagcatttggacgcagtttctgccactctttcgggctcagcggtataacactgacatacatcaaattactgaaaatgagggagacctccgtgcagttccagacattaaatctttcccgccggcccagctgcccgattctcccgccgcccccaaattatttggtttactgtccagccccctatcaagcctcgccagattttttagtcacctgctgcgtcggcctccccccgaagcccctcgacgaagacttgacttctcgccactgttgccggccctgcccgccgctcgcctatctaggggtcacgaagaacttcccggccgcctgagcttactgctaggggcggcccttgccctgcctggaaggccgtccggcgggcgaccactgcgaccaccccatcccgtagccaaaccaagagaggaagacgcaactgcgggccaatccagccctatgcctcagatggggtcggagcgcatggaaatgcgtaagagacagatgccagcagcacaggacaccccaggtgccgcccctggacaacctggcgctgggtctagggggtcaaacgcatgttgcttttgctggtgctgctgttgctcttgcagctgcttgactgtgcgcaatcaggaggaccagagaccgactatagccagccacgagctgcgcgccgatctgcctacttgggaagagagtccggctcccacactcgaggaggtgaatgcctgggcacagagtttcgacaagctgatggtgacccccgctggtcggaacgctttcagggaattcctcagaacagaattttccgaagaaaacatgttgttctggatggcttgcgaggagctgaaaaaggaagcaaacaagaatatcatcgaggagaaggctagaatcatatacgaggactatattagcatcttaagtccaaaggaggtgagtttggattcaagagtacgcgaagtgatcaatcggaacatggtggaaccaagccagcatattttcgatgatgcccagctacagatctataccttgatgcaccgggactcgtaccccagatttatgaattctgccgtgtataaagacttactacagtctttgtcagaaaagagcatagaggcatag

SEQ ID NO: 29497 - DNA, 3795 bp, Artificial Sequence
  Description of Artificial Sequence: Synthetic coding sequence
atgcctgagaagcgtctgaccgcagagcctcccactatcaccgaggaagaattcgaggactccttggcaacagatgacttcttggtggattatttcaacgagttcttgtccctacctacattttctgaggctatcaggttcaacgcagactatggggtatttgaagtcgcaaacgacgcaccccagtttctggaaaaacaactcaaaaaaattttacaaaatcagcagcccaggaaccctatttatgacgtggttcggaagggtaagaacgaggtgaaaccagtgcagatgaacgctcctgatgaggatgagaccatcaatgttaattacaatatcatgtgtctatccagggaggagggaatcaaatggataaagaaagagcgcctcccagcatttctcgagtccgactgctactttgagtatcgtctcgcgaagctggtgagtcaagttcgatggtcaaagagcgggatgaattttacggtgggtagcaactttagcccgtggatagtaaaaaagccccctagcctcccaccgcccgctacggaagaggacaatctggttattatgaagaaattttatgtttctttgggggaggctagctacacccagacaaaagattggtttgccttggcaaagcagagtcaacagaccgtgtcaacattcagcctgccgtgttgtgtgccgtacaacaagctgaaatccccagctatcagttctgtctctgagaactttatctttgacgatggggtgcatcctcgcaccaagaaggatccctcaaaaactaacaagttaatctctgaatttgaagaagaagaaggcgaggaagaagaagtgtccgtatcgctgcaggataccccaagtcaagccctgttacgggtctacctagagaaaaaacaggacgttgacgaaagccttaccatgcacttctccacttgtgaggaattcctgtcgtcgtacatttacttcattctgaggggtgctattcagcagattgtaggcaagccagttggagagacgccagattatattaattttaataacattacgaaggtcagtttcgatgactgttttgaaagtattcatgggaagaattttctgagcgaactggtgcagactacaaaggagcgatctgaggaaattgagcaaacgtctctgtcttcaaagaatgagtctgcggggccggaaagccgggccgactggtgtatcagccatcggacttacgacattgggaaccggaaggagtttgagcggttcaagaagtttatcaagggcactcttggagagaggtattggtggctatggatggacatcgaaaggctcaaggtgcttaaggaccctggccgacaccagcggcacttagaaaagatgaagaaatgctatttggttagcaatggggactattatctaagcgccgagattctgagtaagttcaagcttttggatggatcacagtggaacgaggaacatctgcgcaacatccagagcgaagttctcaagcctctcttgctctattgggcccccagattctgtgtgacacacagtgcaagcacaaagtacgcctcagctgaactcaaattctggcacctccgccaggcaaagcccaggaaagacatagatcccttcccccagatggctacattacttcctctgagacccaagtcgtgtatcccacagatccctgagatacagaaggaggaattctctctcagccagccacctaagagcccaaacaagtcacccgaggtaaaaaccgcaactcagaagccttggaaaagggagctcctatatccgggctctagcaaggatgatgttattgagaaaggcagcaagtatatgagtgagtcctccaaagtcatccacttaaccagtttcacggatatttcagaatgcttgaagccacagcttgaccggcgctatgcctacactgaggaaccccgcgtcaaaaccgtgtccgatgtcggagctctagggggcagtgatatggaaaaccttttgcagtctctttacgtggaaaatcgcgccggatttttctttaccaagttttgtgagcactctggcaacaagctctggaagaactcagtttacttctggtttgatctgcaagcttatcaccagctgttttaccaagagacgctgcagcctttcaaggtttgcaaacaggcacagtatctgttcgccacttacgtggccccatcagccactcttgacattggactgcaacaggagaaaaagaaagagatttatatgaagattcagccaccatttgaggacctatttgatacagctgaggaatacatcctgctgcttttgctcgaaccatggaccaagatggttaaatccgatcagattgcttataaaaaggtagagcttgtcgaagagacccgccagctggacagcacatattttcgcaagttgcaggccctgcataaagaaaccttctccaagaaggcggaagataccacttgcgagatagggaccggcatcctaagcctctctaatgtatccaaaagaacggaatactgggataacgttcctgccgagtataaacacttcaaattcagcgaccttcttaataacaaactcgagttcgagcacttccggcagttcctggaaacacattcgtctagtatggatttaatgtgctggactgatatcgaacagttccgcagaataacttatcgcgatagaaaccagcgcaaagcgaagagtatttatatcaagaacaagtatctgaataaaaagtacttctttggccccaatagccctgcctctttgtatcagcagaatcaggttatgcacttgtctggcggatggggaaagattctgcatgagcagcttgatgcacctgtcctcgtggagatccagaagcacgtacaaaatcgccttgaaaatgtctggctgcccctgtttctcgcctcagagcagttcgccgctaggcaaaagattaaggtgcagatgaaggatatcgctgaagaactcctcttacagaaggcggagaagaagatcggggtctggaaacctgtggagagtaagtggatcagcagctcctgtaaaatcatcgcgttccgcaaagcgctgttgaaccccgtgacaagcaggcaatttcagaggttcgttgcccttaagggggacctgctggaaaacgggctgcttttctggcaagaagtccagaagtacaaagacctttgtcacagccactgcgatgaatccgtcattcaaaagaagattacaaccatcattaattgtttcattaatagtagtattcctcctgccctccagatcgatattcctgtggagcaggctcagaagattattgaacataggaaggaactcggcccatacgtgtttcgcgaagcgcagatgaccatttttggagttctgtttaagttttggccacagttttgcgagttccggaagaacctgactgacgagaatatcatgtctgtgctagagcgcaggcaggagtacaacaaacagaaaaaaaagcttgctgtgctggaggatgaaaagagcgggaaggatgggatcaaacagtacgccaacacctctgtgccagctatcaagaccgccttgctgtccgactctttcctgggattacagccctacggacgccagcctacatggtgttactcaaaatatatagaagctctcgaacaggagaggatattgctcaaaattcaggaagagctggaaaagaagctgttcgcaggcctccagcctctgacaaatttcaaagcttcgagcagcaccatgtctctaaaaaagaacatgagtgcacactcatcacagaagtag

SEQ ID NO: 29498 - DNA, 3756 bp, Artificial Sequence
  Description of Artificial Sequence: Synthetic coding sequence
atgcccgagaagaggctgactgcggagccacccaccatcaccgaggaagagttcgaggactctttggcgactgatgacttcttagtcgactatttcaatgagtttttgtcactccctaccttcagcgaggctatcagattcaacgcggactatggagtctttgaagtggccaatgatgctccacaattcctggaaaaacagctgaagaaaattctacagaaccagcagcctcgtaatcccatatacgacgtcgtcagaaaaggaaaaaatgaggtgaaaccagttcagatgaacgctcctgacgaggacgagacaatcaatgtcaattacaacatcatgtgtctgagccgcgaggaaggtatcaagtggattaaaaaagagaggctgccagccttcttggaaagtgactgttattttgagtataggctggccaagctggtctcccaggtgagatggagcaagtccggaatgaacttcaccgtgggttctaatttcagtccctggatcgtcaaaaagccaccttcccttccaccaccagctaccgaagaggacaacttagcatcgtacacccagactaaggattggttcgctcttgccaaacagtcccagcaaacagttagtacattctctctgccttgctgcgtgccgtataacaagttgaagtcccccgctataagctcagtgagcgaaaattttatatttgacgacggagtgcacccacgaactaaaaaggacccgagtaaaacaaataaacttatttcagagtttgaagaggaagaaggagaggaagaggaagtgtctgtgtccctgcaggacaccccttcacaagctctgcttcgagtgtacttggaaaagaagcaagacgtggatgagtccctgactatgcattttagtacatgcgaagaattcctgtctagctacatttacttcatcctccggggtgccatccagcagattgttggtaagcccgttggggaaacaccagattatataaacttcaacaacatcaccaaagtgagctttgatgactgtttcgaaagcattcatggcaagaattttttgtccgagttagtccaaaccacgaaagagaggagcgaagagatcgagcagacatctctgtcctctaaaaacgaatccgccggaccagagtccagggctgattggtgcatctcacatcgaacctatgatatcggcaatcggaaagagttcgagaggtttaagaagtttataaagggcaccctgggtgagcggtactggtggttatggatggacatcgagcgcctgaaagtactgaaagacccgggccgccatcagcgccacctcgaaaagatgaaaaagtgctatcttgtgtcgaatggcgactattatctgagcgcagaaatactaagtaagtttaaactgctggatgggagccaatggaacgaggagcacttgcggaatattcaaagtgaggtgctgaagcccctgctgttatattgggcaccgagattctgtgttacccattcagctagtacgaaatacgcctccgcagaattgaagttttggcacctcagacaggccaagccacgcaaggacattgatccatttccacagatggccaccttgctgcctctgagaccaaaatcgtgtatcccccaaatccctgagatacaaaaggaggaatttagcctgagtcagccaccgaagagcccgaataaatctcctgaggtgaagactgccacgcaaaagccttggaagcgtgagcttttatacccaggttcctccaaggacgatgttattgaaaagggaagtaagtacatgagtgagagttccaaagtcattcacttaaccagttttaccgatattagcgagtgcctgaagccacaactggacaggagatacgcctacactgaggagcctagagtcaaaacggtgtccgatgttggcgcactgggcggatccgacatggaaaatctcctgcagtccttgtacgtggagaacagagccggatttttctttaccaagttttgtgagcattcaggcaacaaactctggaagaacagtgtgtatttctggtttgatctccaggcatatcaccagttgttctaccaggaaacgctccaacccttcaaggtgtgcaagcaggctcaatacctctttgccacctatgtggcaccctccgcaactcttgatattgggttgcagcaagagaaaaagaaagaaatctacatgaagatccagccaccctttgaggatctttttgatacagccgaggaatacatattgttgttgcttctggagccatggaccaagatggtgaagagtgatcagattgcttataaaaaagtcgagttagttgaggagaccaggcagctggacagcacttattttcgtaaattacaggctctccataaggagacgttttccaagaaggccgaggatactacctgcgaaattggtaccgggattctgtccctcagtaatgtgagtaaacgcacagagtactgggacaacgtgccggcagagtataagcattttaaatttagcgacttgctgaataacaaactcgaattcgagcacttcaggcagttcctggaaacccatagctcgagatggatcctgtgtgccgggcaaactctgtcctcttccggcgagacctacagagaccgcaaccagcgtaaggcaaagtccatttatatcaagaataagtatcttaataaaaagtatttcttcggcccaaactctcctgcatccttataccaacaaaatcaggttatgcatctgtcaggcggttggggtaaaatactccatgagcagcttgacgctcccgttctggtagagattcagaaacacgtgcagaaccgattagagaacgtctggctacccctgtttcttgcatctgagcaattcgcagctcggcagaagattaaggtgcagatgaaggacattgccgaggaactgctgcttcaaaaggccgaaaaaaaaatcggagtgtggaaacccgtggaatccaagtggatctcctccagttgtaaaatcattgcctttcgtaaggcgttgctcaatcctgtgactagccggcaattccagagattcgttgcactgaaaggagatctcctggagaacggtttgctgttctggcaggaagttcagaagtacaaggacctgtgccactcccattgcgatgagtcagtgattcaaaaaaagatcacgactattatcaactgtttcatcaatagctctatcccaccagccctccagattgatattccagtggagcaagcccaaaagataatcgagcaccgaaaagaactcggaccctatgtgttcagggaagctcaaatgaccatcttcggcgtcctgtttaaattctggcctcagttctgcgaatttagaaagaatttaactgacgagaatatcatgagtgtgttggaacgtaggcaggaatacaataagcagaagaagaaactggctgttcttgaagatgaaaaatccggaaaggacggcattaagcagtatgccaacacctccgtaccggccatcaaaacggccctgttgagcgactcttttttaggactgcaaccctacggacgccagcccacctggtgctattcgaagtacattgaggctctcgaacaggagagaatccttcttaagattcaagaggaactggaaaagaagttgttcgccggcctgcagccgctgacaaatttcaaggccagttctagtacaatgtctctgaagaaaaatatgagtgctcactcgtctcagaaatag

SEQ ID NO: 29499 - DNA, 597 bp, Artificial Sequence
  Description of Artificial Sequence: Synthetic coding sequence
atgtggaacaccctgactaggtccctctcagaccatcccgtggggaaagacccacaggcgatgcggaccggccaacgtcaaaacaaaggcatgcgcaccaggcttggatgcctcagtcataaatccgatagctgctctgattttaccgctattctgccagataaacccaacagagcgttaaaaagattgagcacagaggaggcaactcgatgggccgatagcttcgacgtgctcctatcccacaaatacggggtggccgcattccgcgccttcctaaaaaccgaattttccgaagaaaatctggagttttggctggcttgcgaggaatttaaaaagactcgctcaacagccaagctcgtgtccaaggcccacaggatatttgaggagtttgtggacgttcaggctcctagggaggtcaacattgatttccaaactcgggaggccacgcggaaaaacttacaggagccctcacttacgtgtttcgaccaagcacaggggaaggtccactccctgatggagaaagattcctacccacgctttcttcggagcaaaatgtaccttgatttgcttagccaaagccagagacgcctatcctag

SEQ ID NO: 29500 - DNA, 543 bp, Artificial Sequence
  Description of Artificial Sequence: Synthetic coding sequence
atggcagcgctgttgatgccccggaggaataagggtatgagaaccagactgggttgcctctcacacaagtccgattcgtgttccgacttcactgcgattctgcccgataaacctaaccgtgcactgaagcgcctctcaactgaagaggctactaggtgggctgactcttttgacgtactgctgagccataagtacggtgtcgccgcttttcgcgcgttcctcaagaccgagtttagcgaagaaaatctggagttctggttggcgtgcgaggagttcaagaaaacacgatccaccgcaaaactcgtgtccaaggcccataggattttcgaggagttcgtagacgtccaggctcctcgcgaggtgaatatagattttcaaacacgggaagccacgcgcaagaatctgcaagagccttccctcacttgtttcgatcaggcccagggcaaggtccactcactgatggaaaaggacagctaccctagattcctccggtcgaagatgtatctggatctcctgagccagagccagagaagattatcatag

SEQ ID NO: 29501 - DNA, 543 bp, Artificial Sequence
  Description of Artificial Sequence: Synthetic coding sequence
atggccgcgctcctcatgcccaggagaaacaaagggatgcgcacccgcctcggatgcctttcacacaagagcgatagttgtagtgactttacagcaatactaccggacaagcccaatcgggccctcaagaggctgtctacagaggaggcaacccggtgggcagattcatttgacgtgttgctctcgcataaatacggagtagctgcttttcgagcgttcctcaaaacagaattcagtgaggagaacctggaattttggttagcatgcgaggagttcaagaagacgcgtagcacggccaagttagtgtccaaagctcatcgtattttcgaagagtttgtcgacgtgcaggcccctcgagaggtgaatatcgatttccagactagagaagccactagaaaaaatttacaggagccgtccctcacttgctttgatcaagcccagggaaaggttcattccttaatggagaaagactcctatccgcggttcttaaggtcgaagatgtatctggatctcctttctcagagtcagagacgcctgtcctag

SEQ ID NO: 29502 - DNA, 543 bp, Artificial Sequence
  Description of Artificial Sequence: Synthetic coding sequence
atggccgctctgctgatgcccagaaggaacaaagggatgcgcacaaggctgggctgccttagtcacaagagcgacagctgttctgatttcacagccatattaccagataaaccgaaccgcgcgcttaaacgacttagcactgaagaagccacgagatgggctgattcattcgacgtacttcttagtcataagtatggcgtggccgccttcagagctttcctcaagaccgagttcagcgaagaaaatctggagttctggctagcctgcgaggaattcaagaaaactaggagtactgccaagctcgtcagcaaagctcacagaatattcgaagaattcgtcgacgtgcaggcccctagagaagtcaatatcgattttcagacccgcgaagccacaagaaaaaacttgcaggagcctagcctcacctgctttgatcaagcccagggcaaagtgcatagcttaatggagaaagacagctatccaagattcctacgctctaagatgtacctcgacctgctctcacagtcgcagcgcaggctgtcgtag

SEQ ID NO: 29503 - DNA, 174 bp, Artificial Sequence
  Description of Artificial Sequence: Synthetic coding sequence
atggcagcattactgatgccacgacggaacaaaggtatgcggactcgtctgggctgtctcagtcacaagtcagattcctgtagcgattttaccgccatcctgcctgacaagccaaaccgggctctgaaacgcctgtcaactgaggaagcaaccaggtgggcggattcattctag

SEQ ID NO: 29504 - DNA, 2274 bp, Artificial Sequence
  Description of Artificial Sequence: Synthetic coding sequence
atgacttcgggtagcgtgttcttttatatcctcatctttgggaagtatttctcgcatggcggagggcaagacgtgaagtgtagccttggatatttcccctgcggcaacatcaccaaatgcctgcctcagctcttgcactgtaacggcgtggacgattgcggcaaccaggccgacgaagacaattgtggtgacaataatggctggagtctccagtttgacaagtactttgccagctactacaaaatgacctcccagtatccttttgaagctgagacccctgaatgcctggtcggctccgtgccggtgcagtgtttgtgtcagggcctggagcttgattgtgacgagacaaatttaagggccgtgccttcagtgagcagcaacgtcaccgctatgtccctgcagtggaatttgattaggaagctgccacccgactgcttcaagaactatcacgacctgcaaaaactgtacctgcaaaataacaaaataacctccatctccatatatgcttttaggggactcaactccctaaccaagctgtatctgtcccacaaccgcataacttttctcaagcccggagtgttcgaggacttgcatcgtctggagtggctcatcattgaggataaccacctgtccagaataagccctcccactttctatggtctgaactccttgattcttctggtgctgatgaacaatgtcctcaccagattacccgataagccattgtgccaacacatgccccggcttcactggctggacttagagggtaatcacatccacaacctaaggaacttgacttttatttcttgcagcaacctcacagtgttagtgatgcggaaaaacaagatcaatcatctcaacgagaataccttcgcacccctacagaaactagacgaacttgatctcggaagtaataagatcgagaatctgcctccattgatatttaaggacctgaaggagctgtcccaattaaacttgagttataacccgattcagaagatacaggcgaatcagttcgactatttagtaaagcttaagagccttagcctcgaaggaatcgaaatatctaatatccagcagaggatgtttcggccactgatgaacctttctcatatttattttaaaaaatttcaatactgtgggtatgccccacacgtgagatcctgtaagcctaatacggacggcatctcttctctggagaatttattagcctcaattattcagagagttttcgtatgggtagtaagcgccgttacctgctttggcaatatctttgtgatttgtatgcggccttatatccgctctgagaacaagctgtacgccatgagcattataagtctctgctgcgccgactgtctgatgggaatttatctgttcgtgattggcgggttcgacctgaagtttcgcggagaatataataagcacgcccaactctggatggaatcaacccactgtcagttagtgggctcactggccatccttagcactgaggtgtccgtgctattgctaacattcctgactctggaaaagtacatctgcatcgtgtatccgtttcggtgcgttcgcccagggaaatgcagaaccataactgtcctcatcctgatctggataacaggtttcatagttgcctttattcccctctccaataaagaattttttaagaattattatggtaccaacggggtctgttttcctctgcactctgaagacacagagagcatcggcgctcagatctattcagtggctatattcctcggtattaacttggcagcattcattatcattgttttctcttacggctcaatgttttacagcgtgcatcagagtgctataacagctactgaaatccggaatcaggttaagaaagaaatgattctcgctaaaagatttttctttatcgtgtttacagatgctctttgttggattccaatcttcgtggtgaaatttctatctctgctgcaggtcgaaattccaggtactattacctcttgggtggttattttcattttgcccattaattcagccctgaacccaatcctgtacacactcaccacccggccattcaaagagatgattcaccggttctggtacaactacaggcagagaaagagtatggatagtaaaggacaaaagacctatgctccgagcttcatatgggtggagatgtggccactacaagaaatgcctccagaactgatgaaaccagacctttttacttatccctgtgaaatgtctctgatctcacagtcgactcggctgaactcctattcatag

SEQ ID NO: 29505 - DNA, 570 bp, Artificial Sequence
  Description of Artificial Sequence: Synthetic coding sequence
atgaccagcggttctgtcttcttttacatcctgattttcggcaagtatttcagtcatggtggaggccaggatgtgaaatgcagcctcgggtacttcccctgtggtaatatcacaaagtgtctgccccaactgctacattgtaatggcgtggatgattgtggaaaccaggcagatgaagataactgcggcgataacaacggatggtctctgcaattcgacaagtacttcgcctcatattacaagatgacgtctcagtaccccttcgaggcggaaactccggaatgtctggtaggatcagtgcccgttcagtgcttgtgccagggactggagctcgattgcgacgagaccaatctaagggctgtgccatccgtgtccagtaacgtcaccgcaatgtcgctgcagtggaacctcatacggaagcttccccctgactgctttaagaattaccacgacctgcagaagctctacctgcaaaataataagattacttcaataagtatttatgcattccgcggattgaattctctgaccaagctctctcgagcagtgaaggacggttctgagaaatag

SEQ ID NO: 29506 - DNA, 1884 bp, Artificial Sequence
  Description of Artificial Sequence: Synthetic coding sequence
aggactatggtgacttgcacccagaacatgaaggccgctctgaaatcgcttctctaccactcccgcaatctgggatacctgcagaacaacaaaatcaccagcatctcaatatacgcatttcggggacttaacagtctcactaaactgtacctgagccacaatcggataaccttcctgaagcctggcgtcttcgaggatttgcatagactggagtggttgataatagaggataatcatctatctcgcatatcaccacccaccttttatggcctgaattctctgatcctactagtgttgatgaacaatgtcctcacaaggttaccagataaacctctgtgccagcatatgcctagattacattggctggacttggagggcaatcacatccacaatctgcggaacttgacgtttatctcctgttctaatctcactgtgcttgtaatgcggaagaacaaaatcaatcacctgaatgagaatacctttgcccccctccagaagcttgatgagttggatctgggcagtaacaagatcgaaaatctccctccactgatattcaaggacttgaaggagctgagtcaactgaacctcagctacaatcctattcagaagatccaggccaaccaatttgattacctggtgaaactcaagagtctttctctggaaggtatcgagattagcaacattcagcagcgcatgttccgccctcttatgaatttgtctcacatctattttaaaaagttccagtactgcggttatgctccgcacgtgaggagctgtaagcctaatacagatgggatctctagcttggaaaacctgctggccagtatcatccaacgtgtattcgtctgggtcgtgtcggctgttacctgtttcggaaacatcttcgttatttgtatgcgaccctacatccgctcagagaataagttgtacgccatgtccatcatcagcctgtgctgtgcagactgccttatgggaatttacctgttcgtcatcggagggttcgacttaaagttccggggtgaatacaataagcacgcgcaactgtggatggaaagcacccactgccagttggtgggatctttggctatactgagtacagaggtgagtgtgctgttgctgactttcttaaccctggagaagtacatctgcatcgtgtacccgttcagatgtgtcaggcccgggaagtgcagaaccatcaccgtgctgattctgatatggatcaccggctttattgtggctttcatccccctgagtaataaagagttttttaagaattactacggaactaatggcgtgtgtttcccccttcactccgaggataccgagtcgatcggcgcgcaaatatattctgtggccatcttcctgggaattaacctggcagccttcataatcattgtgttcagctatgggtccatgttttacagcgttcatcagagtgccattaccgctactgagattcgcaaccaagtgaaaaaagaaatgatattggccaagagatttttctttatcgtgtttacagacgctttatgttggattcccatattcgttgtcaagtttctctccctccttcaagtcgagatacccggtacgattacttcctgggtcgtaatctttattctgccaattaatagcgcactcaaccccattctgtacacactgacgactaggccgttcaaggagatgatccaccggttttggtataactatcggcaacgcaagtctatggacagcaaggggcagaagacctacgcccctagtttcatatgggttgaaatgtggcccctgcaagaaatgcccccagaacttatgaaacctgatctgttcacctatccttgtgaaatgagtttaatcagtcaaagcacgaggctgaattcatactcatag

SEQ ID NO: 29507 - DNA, 1959 bp, Artificial Sequence
  Description of Artificial Sequence: Synthetic coding sequence
atgactagtcagtatccctttgaggccgagactccagaatgcctggtgggcagtgtacctgtccagtgcttatgccaggggctcgagctggattgcgatgaaacgaacctgcgagccgtgccttctgtgtctagcaacgtgacagctatgtctctgcagtggaatttaattagaaaactccccccagactgctttaaaaattaccatgatttgcagaaattgtacctccaaaacaacaagatcaccagcattagcatctatgcattcaggggtttgaattctctaacgaagttgtatctgagtcacaatagaataacatttctgaaaccaggcgtttttgaggaccttcaccgactcgagtggttgatcatcgaggacaaccacctgagtcgcatttccccccccacgttttacgggttgaactctctgattcttctcgtgctgatgaacaatgtcctgaccagattaccagacaaaccgttatgccaacacatgccaagactccactggctggtgatgcggaagaacaaaatcaaccacctgaacgagaacactttcgcacctctccagaagctggatgaactggatttggggagcaataagattgagaatctcccaccacttatctttaaggacctgaaagaactatctcaacttaacctgagctataacccgatccagaagatccaggccaaccaattcgactacttggtcaagctaaaaagcctgtccctggagggcatagagatctcaaatatccagcagcgcatgttccgtcccctgatgaacctttctcatatctacttcaagaagttccagtattgtgggtatgccccacacgtgcgatcttgcaaacccaacacagacggtatttcaagcctagagaatttgctcgcttcaattatccagcgagtctttgtctgggtggtgtcggcggttacgtgcttcgggaacatcttcgttatttgcatgcgcccttacatccgctctgaaaacaaactctatgcaatgagcattatctcactctgttgcgccgattgtctgatgggtatctacctctttgtaatcggaggcttcgatttgaagtttagaggtgagtacaataaacacgcccaattgtggatggagtccacacactgccagctagtggggtctcttgccatcctgagcaccgaagtgagcgtacttttactgacatttttaacgctagagaagtacatttgcattgtgtatcctttccgctgcgtgcggcccgggaagtgccggaccataaccgttcttatcttaatctggataacagggtttatagttgcatttatcccactcagcaataaagagttttttaaaaattactatggtaccaatggagtgtgctttcctcttcactccgaggacacggagtccataggggctcagatttattcagtggccatattcctaggaattaatttagccgcgttcatcatcatcgtgttcagttatgggtccatgttttattcagtgcatcagtccgccatcacagctactgagataaggaaccaggtgaagaaggaaatgattctggccaaacgttttttctttatcgtctttaccgatgctctgtgttggatccccatcttcgtggtgaagttcctcagcctgttacaggtggaaatccccggcaccatcaccagctgggtggtgatctttattttaccaataaacagcgccctcaaccccattttatatactcttacgacgcgacctttcaaagagatgattcatagattctggtacaattaccgtcagaggaagagtatggacagcaaagggcagaaaacctacgccccctcatttatatgggtggagatgtggccattgcaggagatgccccctgagcttatgaaaccagacttattcacttatccatgtgagatgagccttatttcccagtccaccaggctcaactcatactcctag

SEQ ID NO: 29508 - DNA, 474 bp, Artificial Sequence
  Description of Artificial Sequence: Synthetic coding sequence
atgacttcaggctctgtctttttttacatcttgatcttcgggaagtatttttcacatggaggcggccaggacgtgaagtgttctctcggctattttccatgcggtaacattactaagtgcctcccccagctgctccactgtaacggggtcgacgactgcggaaaccaggctgatgaggacaattgtggggataacaatggctggtcccttcagtttgataagtacttcgcatcttactataagatgacatcccagtaccctttcgaggcagagacacccgagtgtctggtaggctcagtgcctgttcaatgtctgtgccaaggacttgagcttgattgcgacgagaccaacctccgcgcagtgccctcagtctccagcaacgtgacagctatgtcactgcagtggaatctcatccgtaagttgccgcctgactgttttaaaaattaccatgatctccagaagttgacactatag

SEQ ID NO: 29509 - DNA, 2265 bp, Artificial Sequence
  Description of Artificial Sequence: Synthetic coding sequence
atgatcgtcttcttggtgtttaagcacctattttcactgaggttaattaccatgttttttctactgcactttattgtgctgatcaacgtcaaggatttcgcactgacgcaagggtctatgattacacccagctgtcaaaagggctatttcccatgcggaaatttgacaaaatgcctgcctagggcctttcactgcgatggcaaggacgattgtggcaacggcgccgatgaggagaactgcggagacaccagcggatgggctacgatctttgggaccgtccatggaaatgccaattcagttgctttaactcaagagtgttttttgaagcagtatccacagtgttgcgattgcaaggaaacagaactggagtgtgtcaacggcgacctcaagtccgtcccaatgatcagtaataatgtgactctcctctccttgaagaagaataagatccacagcctgcctgacaaagtgtttatcaaatataccaagcttaagaagatttttcttcagcacaactgcatccgtcacattagtcgcaaggctttcttcggtctgtgcaatctgcagatactctacctgaaccacaactgcattaccacacttcggcccggcatcttcaaagatctgcaccaacttacctggttgattctcgacgataaccctataaccagaattagtcaacggctgttcacgggactcaatagtctgtttttcctgtcgatggtaaacaactaccttgaggcccttccaaagcaaatgtgcgcccagatgccccagctgaattgggttgatctcgagggaaacagaattaagtatcttacgaattctacctttctgagctgcgactctctgacggtgctgttccttccccgcaaccagattgggttcgtaccagaaaagactttcagctcactcaagaatctgggagagctggacctgtcttcgaacaccatcaccgagctgagtcctcacctgttcaaagaccttaagctcctgcaaaaactgaaccttagctcaaatcctcttatgtatctgcataagaaccagttcgagtctctcaagcaactgcagagcctggaccttgaacgtattgaaatccccaatataaacacgcgaatgtttcagccgatgaagaatctttcccacatttacttcaagaacttccgctactgctcgtacgcaccacacgtgcgtatctgcatgcccctgacagatggcatctcatcctttgaagacctgttggccaacaacatcctaagaattttcgtttgggttatcgcctttattacctgtttcggaaacttgttcgtaattggcatgaggtcatttattaaggccgagaacaccacacatgccatgtcaattaagatcctgtgctgtgcagactgtctgatgggcgtctaccttttcttcgtgggcatcttcgatattaagtatcgcggacagtatcaaaagtatgctctgctgtggatggaaagtgtacagtgccggttgatgggcttcctggcaatgctatccactgaggtgagtgtcctgctactcacttatctcactctggagaagtttctggtaatcgtctttccatttagtaacatcagaccaggtaaacgtcagacatccgttatccttatatgtatttggatggcaggtttcctgatcgctgttattcccttctggaacaaagattattttgggaacttctatggaaaaaatggcgtgtgcttccccctgtattatgaccaaaccgaggacattgggtccaaaggctatagccttggcattttcctgggggtgaatctgttggcattccttataattgtgttctcttacataaccatgttctgctctattcagaagactgcactccagactaccgaggtaagaaattgctttggtcgagaggtagcggtagcgaaccggtttttctttatcgtcttctctgacgccatatgttggatacctgtgttcgttgtcaagatcctgtctctttttagggtcgaaattccagacaccatgaccagttggatcgtcatctttttcctgcctgttaattcagcccttaaccctattctgtacaccctgacaacaaacttttttaaggataaacttaaacagctgttgcacaagcaccagcgcaagagcattttcaaaatcaaaaaaaagtccctctcaactagcatagtgtggattgaggattcctcttccctcaagctaggcgtcttaaacaagatcaccctgggtgacagcatcatgaaacctgtcagctag

SEQ ID NO: 29510 - DNA, 2193 bp, Artificial Sequence
  Description of Artificial Sequence: Synthetic coding sequence
atgatagttttcctcgtcttcaagcacctattctctcttcgcttgatcacgatgtttttccttttgcactttatcgtactcataaatgtcaaagactttgctctgacccagggctccatgatcacgccgagctgccaaaaaggctacttcccctgcggcaatctcactaagtgcctgcccagggcatttcactgcgacggaaaggacgattgcggcaacggtgctgacgaagagaactgcggagatacttccggctgggcaacaatatttgggactgtccacggtaacgcaaactctgtggcccttacccaggagtgctttctaaaacaatacccacagtgttgcgattgtaaagaaaccgagctggagtgcgttaatggcgatctcaagagcgtgccgatgattagcaataacgttacccttcttagcctcaagaagaataaaatccatagtctgccagacaaggtattcataaaatatactaaactgaaaaagatttttcttcaacacaactgcattaggcacatctcacgaaaggctttctttggcctatgtaacctgcagatcctttatctcaatcacaactgcatcactacgctgaggccgggtatcttcaaggatctccaccagctgacctggttgattctggatgacaaccctataacgagaatctctcagaggctgtttacaggactcaattccctgttctttctgtccatggttaataactacctcgaggccctgccaaaacagatgtgtgcccagatgccccagctgaattgggtagatctcgaggggaatcggatcaagtatctgacaaattccaccttcctgtcatgtgattcattgaccgtgctagacttgtcatccaacacaatcaccgaattgtccccccacctttttaaagatctgaagctattgcagaagctaaatctgtcctctaatcccttgatgtatcttcataagaaccagttcgagagcctgaaacagctccagagcctggatttagagaggatcgagatccccaacatcaacacccgcatgtttcagcccatgaaaaatctgtcccacatatactttaaaaattttcgttactgctcctatgccccacacgtgagaatctgtatgccactcacagacggtatcagctccttcgaggacctgctcgccaataatattctgcggattttcgtgtgggtaatagcatttatcacatgctttggaaacctcttcgtcatagggatgagatcatttataaaggccgaaaatacaacacatgcaatgtctattaagatcctatgctgtgcagattgcctgatgggcgtttacctcttctttgtcgggattttcgacatcaagtaccgcggtcagtatcagaagtatgccttgctctggatggagtcggttcaatgtaggctcatgggctttctggcgatgctgagtaccgaggtttcagtgttgctgctgacctacttgacactagaaaagttcctggttattgtgtttcctttctctaacataaggccaggtaagcgccagacctctgtcatactgatatgcatctggatggcgggtttcctgatcgctgtgattcccttttggaataaagattatttcgggaatttctacggcaagaacggcgtgtgtttccccctctattatgatcagactgaggatatcggatctaagggatactccctgggtatatttctgggagtcaatttgctcgcgttcctaataatcgttttcagctacatcactatgttctgctctatccagaaaacagcgctccagacaactgaagttaggaattgctttggacgggaagtggcagtcgccaatagatttttttttattgtgttttccgatgctatctgctggattccagtattcgtagtgaaaatcctttccctgtttcgagtcgagatccctgacaccatgactagctggatcgtgatcttcttcttacccgtgaacagcgctctgaaccctatcttgtatacactcactacaaacttcttcaaagacaagttgaaacagctcttgcacaagcatcagcgtaaaagcatcttcaagattaaaaagaagagtcttagtacctctattgtgtggattgaagattctagctccctgaagttaggcgtgctgaacaagatcactctcggtgacagcatcatgaagccagtctcctag

SEQ ID NO: 29511 - DNA, 1410 bp, Artificial Sequence
  Description of Artificial Sequence: Synthetic coding sequence
atgcagatggccgatgcagccaccattgcaacgatgaataaggccgcaggcggagacaaactagcggagcttttttctctggttcctgacttactggaagcagccaatacctcaggaaacgccagcctgcaattgcccgacctgtggtgggaactgggactggagttgccggacggtgcccctcctggacaccctcctggaagcggtggagcagagagtgcggatacagaggctcgggttcggattttgattagtgtggtgtattgggtcgtttgtgccttaggactcgctggaaatctgctcgtcctctatttgatgaaatcaatgcaagggtggagaaaatcctcaataaatctgttcgtgactaacttagcacttaccgattttcaatttgtcctcaccctccccttctgggcagtggagaatgcgcttgactttaagtggccattcgggaaggcaatgtgtaaaattgtatccatggttacctctatgaacatgtatgcatcagtgttcttcctgactgctatgtcggtgaccagataccattccgttgcttccgcactgaaaagtcatagaacacggggtcacggtagaggcgactgctgtggtagaagtctgggtgacagctgctgttttagcgccaaggcattatgtgtatggatctgggctctggcagctttggcctcactgcccagcgccatcttcagtaccaccgttaaggtgatgggcgaagagctttgtctcgttcggttccccgacaaactccttgggcgcgaccggcaattctggctggggctctatcattcacagaaagttttgctcggctttgtcctccccttaggtataataatactgtgttatctgctgcttgttcgattcatcgccgacagacgcgcagcgggaacaaaaggcggcgcagcagtggctggtggtcggcccactggggcctccgcaaggagattgtcaaaagtgacaaaaagcgtgaccatcgtggtgttgtcttttttcttgtgctggctgcccaaccaggcgctgacaacttggagtatcctaattaagtttaacgccgtaccattcagccaggaatactttctatgccaagtgtacgcattccccgtctccgtgtgtctggctcacagcaatagttgcttaaaccctgtcctgtactgtcttgtcagacgggaattccgcaaagcgctgaagtctttgttgtggcgtatcgctagcccctcgattacgagtatgagacccttcactgccaccactaaacccgaacacgaggaccagggtctacaggcacccgcacccccccacgcagctgccgaaccagacttactctactatcccccaggcgtggttgtctactccggaggcaggtatgacttgttgccatcctcctccgcatattag

SEQ ID NO: 29512 - DNA, 1125 bp, Artificial Sequence
  Description of Artificial Sequence: Synthetic coding sequence
atgccaaccctcaatacctcagcctctcctccgaccttcttctgggccaacgctagcggcggaagcgtactcagtgctgatgatgcgcctatgcctgtcaaattcctggccctgcgtttaatggtggcattggcctacgggctggtgggggcaatcggcttacttggaaacttagctgtcctgtgggtgctgtctaattgcgcacgccgtgcaccaggaccgccatctgatacctttgtcttcaacttggcactcgccgacctgggacttgccctgacccttccgttttgggccgccgaatccgctttagattttcattggccttttggcggtgccttgtgcaaaatggtgctcacggccacagtgctgaatgtgtacgcctctatttttcttattacagcgctgtcagttgcccgttattgggttgtcgcaatggctgccggccccggaacccacctctctcttttctgggcacgtatcgccactttggctgtgtgggccgccgctgctctggtcacagtgccgactgctgtattcggagtggaaggagaggtgtgtggcgtcaggctctgcctgttgagatttccctccaggtattggctgggtgcgtatcagttgcagagagtggtgctcgcatttatggttcctctcggcgtgatcactacatcttatttgttgctgctggccttcctccagcgaagacagcggagaagacaggatagccgcgtggtggctcggagtgtgaggatcctggttgcctcctttttcctttgttggttccctaatcacgtagtcaccttatggggggtgctggtgaagttcgatctggtaccctggaattcgactttctataccatacagacttatgtctttccagtgactacctgcttggcccacagtaactcctgtctgaatcctgtgttatattgcctactgcgtcgggagccacgccaagctctggccggcacctttagggatctccgcttgcggttatggccgcaagggggcgggtgggtccagcaagtcgctctcaagcaggtgggacgaaggtgggttgcctccaatccgcgagagtctcggccctcaacgctgctcaccaacctagatcgcggaacccctggttag

SEQ ID NO: 29513 - DNA, 816 bp, Artificial Sequence
  Description of Artificial Sequence: Synthetic coding sequence
atggctccaagagccctgccaggctctgccgtcctggctgctgctgtatttgttggtggggcagtctcctcccccttggtggccccagacaacggaagttcccgcacactccattctcgcacagagacaaccccttcaccttcaaacgataccggcaatggacatccagaatatattgcgtatgcgctagtcccagtgttcttcatcatgggtttgtttggggtattgatttgccacctcctaaagaaaaagggatacaggtgcaccaccgaggccgagcaagatatcgaggaggagaaggtagagaagattgagttgaatgacagtgtgaacgagaatagcgacactgttgggcagattgtccattacattatgaagaacgaggccaacgccgacgttttgaaagccatggtggctgataattctctctatgaccccgagtcacccgtaactcccagcacacccggcagccctcctgtctcgccaggccccttgagcccagggggcaccccggggaaacatgtctgcggacaccacctgcacacagtgggcggcgtagtggagcgggatgtatgtcatagatgtaggcacaagcgctggcacttcataaagcccacaaacaagagtcgcgaatctcgtcccagacgtcagggcgaagtcaccgtcctgtctgttgggcgctttcgcgtcacaaaggtggagcataagtccaaccagaaggagcgaagatctctgatgagtgtctcgggggctgagaccgtaaatggggaggtgcccgccacacctgtcaaaagggagcgttcaggcaccgaatag

SEQ ID NO: 29514 - DNA, 816 bp, Artificial Sequence
  Description of Artificial Sequence: Synthetic coding sequence
atggctcccagggccctccctgggagcgccgtgctcgccgcagctgtgttcgtgggaggcgctgtcagttcacccctagtcgcacccgataacgggtcatcccgaacgctgcatagtaggaccgaaaccacacccagtcccagtaatgacacaggcaatgggcatcctgagtatatagcgtacgctctcgtgcctgttttttttatcatgggtctgtttggggtgctgatttgccacctgctcaaaaagaaagggtataggtgcactacagaagctgaacaggatatcgaggaggagaaagtggagaaaattgaactcaatgacagtgtgaatgagaattcagacaccgtgggacagatcgttcattacatcatgaagaacgaggcgaatgccgatgtcctaaaggcaatggtggctgacaattctttgtacgatccagaatctcccgtcaccccatcaacacccggaagccctccagtctctcccggccccctaagcccaggggggacccctggcaaacatgtgtgcggacaccatctgcacacagtaggaggggtcgtcgaacgggacgtctgccatcggtgccgccataaacgctggcatttcataaagccaacaaacaagagtcgcgagtcccgaccgaggagacagggggaggtgactgtgctgtccgtgggccggtttcgggtcacaaaggtggagcataagtcaaatcagaaagagcgacgttcccttatgtctgtcagtggtgccgagactgtgaatggggaagtgcctgctactcccgtcaagagagagcggtcagggactgaatag

SEQ ID NO: 29515 - DNA, 363 bp, Artificial Sequence
  Description of Artificial Sequence: Synthetic coding sequence
atgaacgccaccttcttaaaccactctgggctagaggaggtggatggtgttggggggggggcgggggccgctctcggcaacagaacacacggacttggcacctggctgggctgttgtccaggcggcgccccgctcgctgcaagcgacggtgtgcccgcggggctggctccagacgaacgaagcctttgggtgagccgcgtggctcagatagcggtcctgtgtgtattgtcacttacggtggtgtttggagtgttttttctgggatgtaacttactaattaagtcagagtcaatgatcaattttctcgtgcaagagcgtagaccatccaaagatgtcggagccgccatcctaggtctgtactag

SEQ ID NO: 29516 - DNA, 717 bp, Artificial Sequence
  Description of Artificial Sequence: Synthetic coding sequence
atgggcgttgagaacagcgccaaagaaggcgatcctggcacaattttcttctttagagagggagccgcagtgttttggaatgtcaaagacaaaacaatgaagcacgttatgaaagtcctggagaaacatgaaatacagccatatgagatcgctctggtccactgggagaacgaggagctaaattatataaaaatcgaggggcagagtaagctccaccggggagagatcaagctcaatagcgagcttgacctggatgatgccatcctggaaaaattcgcttttagcaatgctttatgcctttctgtcaaactcgcgatttgggaggctagtctcgacaaattcattgagtccatccagagcatccccgaggccttaaaagccggtaagaaggtcaagctgtctcacgaggaggtaatgcagaaaattggagagctctttgctctgcgtcacagaatcaacctgagcagcgattttctcataactcctgatttttactgggacagggaaaatctggaaggcctatatgacaaaacatgtcagtttctgagtatcgggcgccgggtgaaagtgatgaacgagaaactccagcactgtatggagctgacagatctgatgagaaaccatctcaacgaaaagcgtgctctgaggctggagtggatgatagtaatcctcataacaattgaagtaatgttcgagctagggcgagtatttttttag

SEQ ID NO: 29517 - DNA, 423 bp, Artificial Sequence
  Description of Artificial Sequence: Synthetic coding sequence
atgcctttctgcaagaccggcaacctgggatctatcctagacaaattcatcgagtctatccagtcaatcccggaggccctgaaggccggaaagaaggtcaagctctcccacgaagaagtgatgcaaaaaattggcgaattgttcgccctgaggcaccgcatcaacctgtcatctgactttctcatcacaccagatttttattgggatagggaaaatttagagggactctacgataagacatgccagttcctctccattgggcggcgtgttaaagtaatgaacgaaaagttacagcactgtatggaactgaccgatttgatgagaaaccatctcaacgagaaacgtgccttaagactggagtggatgattgtcattctgattaccatcgaggtcatgttcgagctggggcgagtctttttttag

SEQ ID NO: 29518 - DNA, 1350 bp, Artificial Sequence
  Description of Artificial Sequence: Synthetic coding sequence
atgcccgcaactcttctgcgagccgtagctcggtctcatcacatcctgtcaaaggcccaccagtgtaggcgaatcggccacctcatgctgaagccactgaaggaatttgagaatactacctgttcaacacttaccattcgtcaatcgcttgacttgttcctgcccgataaaaccgcttcggggttgaataaatcccagatcctggagatgaaccagaagaaaagtgataccagcatgttgagccccttgaacgcggccagatgccaggacgagaaagcgcatttaccgaccatgaaatcttttggtacccatagaagggttacccataagcctaacctcctgggctcaaagtggtttataaaaatccttaagaggcactttagctctgtgtccacagagactttcgtccccaagcaggattttccgcaggtgaagcgaccgttaaaggccagcaggactagacagccatcccgaaccaatcttcctgtcctctccgtgaatgaggatctgatgcactgcacggcctttgctactgctgacgaatatcatctcggaaatttatcccaggacctggcaagtcacggctacgtagaggtgacaagtcttccacgggatgcggctaatatcctggttatgggggtggagaattccgcgaaagagggggaccccgggacaatctttttctttcgcgagggagccgctgtattctggaacgtgaaagataaaactatgaagcatgttatgaaggtcctcgaaaagcacgagatccagccttacgaaattgccctggttcactgggagaatgaggaactaaattacatcaaaatcgagggccagtcaaagctccatcgtggggagatcaagttgaatagtgagctggatctagatgacgccattcttgagaagttcgcctttagcaatgcactgtgcctgtctgtcaagctggcaatttgggaggcttcccttgacaagttcatagagtcgatccagtctattcctgaggccctaaaagcaggcaagaaggtgaaactgagtcacgaggaggtgatgcaaaagatcggggaactgttcgccctgcggcaccgcataaatttatcaagcgatttcctcatcactccagatttctactgggatagggagaacctggaagggctttacgacaaaacctgccaattcttatccatagggcgcagggtgaaggtcatgaatgagaaattgcagcattgcatggagctcacagacctgatgagaaaccatcttaatgagaagcgggcgctgagactcgagtggatgatagtgattctcataactattgaggtcatgttcgagctaggccgcgtattcttctag

SEQ ID NO: 29519 - DNA, 636 bp, Artificial Sequence
  Description of Artificial Sequence: Synthetic coding sequence
atgcactgcaccgccttcgccactgccgatgagtaccacctcggcaacctttcccaggacctagcttctcatggatatgtcgaggtcaccagtctgcctcgggatgcggctaacatactcgtgatgggtgtggaaaattccgccaaagagggagatccaggaaccatctttttttttagagaaggcgccgctgttttttggaacgttaaggataagaccatgaaacatgtcatgaaggtgctcgaaaagcacgaaattcagccctacgaaattgccttggtccactgggaaaatgaggagctgaattatatcaaaattgagggccagagcaagctccaccgcggcgaaattaagctcaattcagagctcgatttagacgacgctatactggagaagttcgcattcagtaatgcattatgcctgagtgtaaagcttgcaatctgggaggcttctctggacaagttcatcgagtccatccagagtattcccgaggctctgaaagccgggaaaaaggtgaagttgagccacgaggaagtcatgcaaaagatcggagaattgtttgcactaaggcaccggattaacctgagttccgacttcctgatcacccccgacttttattgggatagagaaaattag

SEQ ID NO: 29520 - DNA, 591 bp, Artificial Sequence
  Description of Artificial Sequence: Synthetic coding sequence
atgagcgagggcgactcagtcggcgaaagcgtgcatggtaagccgagcgtagtgtatcggttttttacccgtttgggtcaaatttaccagagctggctcgacaaaagtactccatacaccgctgtgcgttgggtggttactctcggactgtcctttgtttatatgataagagtgtatctcttgcaaggatggtacattgttacctatgccctcggcatttaccatttaaatctgttcattgccttcctgagccctaaggttgatccatccctcatggaggactctgacgacggcccatcattaccgaccaagcagaatgaggagtttaggccctttattcgtcgactccctgagttcaaattttggcatgccgcgaccaaaggtatcctggtcgccatggtgtgcacgttttttgacgcctttaatgttccggtgttttggcccatcctggtaatgtatttcatcatgctcttctgcataactatgaagcgacaaatcaagcacatgatcaaataccgttatattccattcactcacggtaagagaagatacaggggcaaggaggatgcaggcaaagcgtttgcaagctag

SEQ ID NO: 29521 - DNA, 564 bp, Artificial Sequence
  Description of Artificial Sequence: Synthetic coding sequence
atgtctgagggcgattccgtcggggagagcgtgcatggcaagccatccgtcgtctataggttctttacacgcctcggccagatctaccagagttggctcgataagagcaccccttacaccgccgttcgatgggtagtcacactcggtctctcgtttgtttacatgatacgcgtctatctgttgcagggctggtacattgtgacctacgcactcggaatttatcacctcaacctttttatcgcattccttagccctaaagtggacccaagccttatggaggacagtgacgatggcccatccctcccaacgaaacagaatgaggagttcaggccttttataagacggttgcccgagttcaagttttgggatgcgagcgtctgcggagacgggaggtgttcatgtaaagctgggggaggcaggcaagttcccggcgcaggatgcaggtgtggcgccaacctgttgtccccactggagggcatgcggctgcctcgggcatcactttggctgtggtctgtcctatcttcaacactctcaacttctcgatgtagcggccgcttctggtag

SEQ ID NO: 29522 - DNA, 354 bp, Artificial Sequence
  Description of Artificial Sequence: Synthetic coding sequence
atgtctgagggcgacagtgtgggcgagtccgtacacggcaaaccttcagttgtgtataggttctttactcggctgggacagatttatcaatcatggttggacaaatctacaccatataccgctgtgcggtgggtcgtgaccctggggctcagcttcgtgtacatgataagggtgtacctgctgcagatgaccgtgctccgatatccacccaaccgtacccgtaatagcgcgccttcgtttgaaggaagccagagcctgaattttgggatgcggctgccccgcgcctcactgtggctttggagcgtgctaagctcaacactcagtaccagcagatgttccggtcgcttttggtag

SEQ ID NO: 29523 - DNA, 354 bp, Artificial Sequence
  Description of Artificial Sequence: Synthetic coding sequence
atgagtgaaggcgattctgtcggggaaagtgttcatggaaaacctagcgtggtgtacaggttctttacacgcttaggccaaatctaccagagttggcttgataagtccactccctacacggcagtgcgatgggttgtgaccctagggctgagttttgtgtatatgattcgggtgtatttgctgcagatgacagtactgcgataccctcccaaccggacaaggaactccgcgcctagctttgaaggttcccagagtctcaacttcgggatgagactccctagagctagtctgtggttgtggtctgtcctatcttccacactgtctactagtagatgttccggtcgcttttggtag

SEQ ID NO: 29524 - DNA, 645 bp, Artificial Sequence
  Description of Artificial Sequence: Synthetic coding sequence
atgtcagaaggcgattcggttggggagagcgtacacggcaagccttccgtggtctaccgattctttacaaggctgggtcaaatttatcagtcttggttagataagagtacaccgtacaccgccgtgaggtgggtggtgactctgggcctgtcattcgtctatatgattagagtatatttacttcaagggtggtatatcgttacctatgctcttggcatataccatttgaacctattcatcgctttcctttcgccaaaagtcgacccttccctgatggaagattctgatgatggcccctcactcccgactaaacaaaacgaggagtttagaccatttattcggaggttgcccgaattcaaattctggcacgccgcgacgaaaggcatactcgtggccatggtgtgcacgttttttgatgctttcaacgttcctgtattttggcccattttggtcatgtactttataatgcttttttgcattaccatgaagagacagatcaaacacatgatcaagtaccggtatatccctttcacccacggaaaacgtaggtacagggggaaggaagacgccggcaagcctagccctgcaagatccggaacagaggcagcgtctcgagtcgcccgcacagtgctctcacactgctag

SEQ ID NO: 29525 - DNA, 477 bp, Artificial Sequence
  Description of Artificial Sequence: Synthetic coding sequence
atgtctgagggcgatagtgtgggggagagcgtccacgggaagccttccgtcgtgtaccgcttttttactaggctagggcaaatctatcagagctggctggacaagagtacgccttacacggctgttagatgggtcgtgacgttgggactctcatttgtttacatgattcgggtgtaccttttacagggctggtacattgttacatatgccctgggaatctaccatcttaacctgtttattgccttcctctcccctaaagtggacccctcgctcatggaggactcagacgacgggccttctctgccaactaagcagaatgaggagttccggccattcatcagacgactcccagaattcaaattttggcatgccgccactaaggggattctcgtggccatggtgtgcacttttttcgatgcctttaatgtacccgtgttttggcccatcctggtgatgtatttcattatgttattttag

SEQ ID NO: 29526 - DNA, 1110 bp, Artificial Sequence
  Description of Artificial Sequence: Synthetic coding sequence
atggcctacagcaccgtgcagcgtgtggcgctcgcctcaggcctggttctcgcgttgagcctgctgctcccaaaggcatttctcagtaggggaaagcgtcaggagcccccccccacgcctgaaggaaaactgggacgattcccaccaatgatgcatcaccatcaggcccccagtgatggtcagactccgggagcacgattccagcgctctcacctcgctgaggcattcgccaaggccaagggttccggcggaggagcaggtggcggaggttctggacggggcttgatggggcagatcataccaatttacgggttcggcattttcctgtatatcttgtacattctttttaagctgtcaaaaggaaagactaccgccgaagacgggaagtgctatacagctatgcccggaaacacgcaccgcaaaatcactagcttcgagctcgcgcaactgcaggaaaaattgaaggagaccgaagccgccatggagaaactgattaacagagttggtcccaatggggaatcacgtgctcagactgtaacatccgaccaggaaaagcgcttacttcaccagttgcgagagataacccgggttatgaaggagggcaaattcattgacagattctcacccgagaaggaggctgaggaggccccatatatggaagattgggaaggctatccagaggagacttatcctatctacgatctgagcgactgtattaaacgtagacaagagaccatacttgtcgattaccccgacccgaaagaactgagcgctgaagaaatcgccgaaagaatgggcatgatagaggaggaggagagcgaccacttgggctgggaaagtttgcccaccgatcctagagctcaggaagacaactctgtgactagctgtgaccctaaacctgagacttgtagttgttgtttccatgaagacgaggatcccgcagtgctggcagagaatgccggcttttcagctgacagctaccctgagcaagaggagactactaaagaggagtggagccaggactttaaggatgaagggttaggaatctcaacggataaagcgtataccggctccatgctaaggaagcgaaatccacagggcttagagtag

SEQ ID NO: 29527 - DNA, 564 bp, Artificial Sequence
  Description of Artificial Sequence: Synthetic coding sequence
atggcttatagcactgtccagcgcgtggcgcttgcctcagggcttgttctagccctgagcttgctgcttccaaaggctttcttatctagaggcaagcggcaagaaccaccacctacccccgaaggctatccagaggaaacttaccctatttatgatttatccgactgtatcaagcgtcgacaggagactatcctcgtggattaccctgatcccaaagaactgagtgcagaggaaatcgctgagaggatgggcatgatcgaggaggaagagtctgatcacctcgggtgggagagtctgcccaccgaccctcgagcccaagaggataactccgtgaccagctgcgaccccaagccagaaacttgctcatgctgttttcatgaggatgaggaccccgctgttctggccgaaaacgcaggatttagtgctgacagctaccctgaacaggaggagacgaccaaggaggaatggagtcaggatttcaaagacgaggggctgggtatatctaccgacaaggcgtacacaggctccatgctcagaaagcgaaatccccagggcctggaatag

SEQ ID NO: 29528 - DNA, 1107 bp, Artificial Sequence
  Description of Artificial Sequence: Synthetic coding sequence
atggcttactcgactgtacagcgcgttgcactggcttcggggctggttttagcccttagccttctgcttccaaaggcattccttagcagggggaagcggcaggagcctcctcccaccccagaagggaaactcgggaggttcccgcccatgatgcatcaccaccaggcccctagtgacggccagacacctggcgctcgattccagcggagtcatctcgctgaagcatttgcaaaggcaaagggcagtgggggtggagccggaggaggaggcagtggaaggggattgatggggcagattataccgatctatgggttcggtattttcctgtacattctgtatattctgtttaagctttctaaaggaaaaactactgcagaggatggtaaatgctacacggcgatgcccggcaacacacatcggaaaattacatcattcgagctggcacagctgcaggaaaagctgaaggagacagaggctgccatggagaagttaataaaccgagttgggcctaatggggagagagcccagactgttacatccgatcaagaaaaacggctgctgcaccagctacgcgagattacccgcgtcatgaaagagggcaagtttattgaccggttctccccagaaaaggaagctgaggaagccccttacatggaagattgggaagggtatcctgaagagacttatcccatttatgacctgtcagactgcataaagaggcgacaggaaactattctggtggactaccccgaccccaaggagctcagtgccgaagaaatcgctgagcggatgggcatgatagaggaagaggagtccgaccatctggggtgggaatcactgcccaccgacccaagggcccaggaggacaacagcgtgaccagctgcgaccccaagcccgaaacttgctcttgttgcttccatgaagacgaggaccctgccgtgctcgccgaaaacgccggcttttctgctgatagctatcccgagcaagaggaaacaaccaaggaggaatggagccaggacttcaaagatgagggacttggcatttccacggacaaggcctataccggtagcatgctcagaaaacgcaatccccaaggtctggagtag

SEQ ID NO: 29529 - DNA, 624 bp, Artificial Sequence
  Description of Artificial Sequence: Synthetic coding sequence
atgtgtcgattgaaacgccaagaatttgttatctctagggctcagacagtcactagcgatcaggaaaaacgactgctgcatcagctgagggagattactagggtgatgaaagagggtaagtttattgaccggttcagccctgagaaagaggccgaagaggccccatatatggaggactgggagggatacccagaagaaacataccctatctatgatctatcagattgcatcaaacgaagacaggagactatacttgtagactacccagaccctaaggagctttctgccgaagagatcgctgagcgcatggggatgatcgaggaagaggaaagcgatcatctaggttgggagtctctgccaaccgatcctagggcacaggaggacaatagtgttacatcgtgcgatcccaagccagaaacctgttcatgttgctttcacgaggacgaggacccagcagtgctggccgagaacgcaggctttagcgctgactcctatccagaacaggaggaaacgactaaagaggagtggtcccaggattttaaagacgaagggctaggaatctccaccgataaagcttacaccggctcaatgctccggaaacgtaaccctcagggactggagtag

SEQ ID NO: 29530 - DNA, 387 bp, Artificial Sequence
  Description of Artificial Sequence: Synthetic coding sequence
atggcctacagcaccgtccaaagggttgcgctcgcatccgggctcgtgttagccttatctctgctgctaccgaaagctttcctgtcccgcggtaaaaggcaggagcctcctccgactccagaggggaagctggggcgcttcccacctatgatgcatcatcaccaggcaccatctgatgggcaaacccccggtgcccgattccaaagatctcatctggccgaagcctttgctaaagctaagggatccggaggcggcgccgggggcggcggcagcggtcgcggcttgatggggcaaatcatccctatttatggattcgggatttttctctatatcctttacatcctcttcaaggtgtctaggatcatactgatcatccttcatcagtag

SEQ ID NO: 29531 - DNA, 963 bp, Artificial Sequence
  Description of Artificial Sequence: Synthetic coding sequence
atgatgcaccatcaccaggcaccatcagacggccaaacccccggcgccaggtttcagagaagtcatttggctgaggcgtttgcgaaggccaagggtagtggagggggtgctggcgggggaggctccgggcggggcctgatgggccagattattcccatttacggctttgggatctttttatacattctttatattttgtttaaattgagcaagggcaagactaccgctgaagatgggaaatgttacaccgctatgccgggtaatacccaccgaaagatcacttcatttgagctcgctcagcttcaggagaagttgaaggaaactgaagcagcgatggaaaaactcattaaccgggtgggacctaatggcgaatcccgcgcccaaactgtaaccagcgatcaggagaagcgccttttgcaccagctccgagagattacccgagtcatgaaggagggcaagtttatcgacagattctccccggagaaggaagccgaggaagctccgtatatggaggattgggaaggctatcctgaggagacataccccatctatgacttgtctgattgcatcaaacggagacaagaaaccatcctggtggattatccagatcctaaggaactttctgccgaagaaatagccgaaagaatgggcatgatcgaggaagaggaatctgatcacctgggctgggagtctctccctactgatcctagggcccaggaagacaactccgtcacatcatgcgacccaaaacccgaaacttgcagctgctgttttcatgaagacgaagatcctgccgttctggccgagaacgcggggttttccgctgattcatatcctgagcaagaagagactaccaaggaagaatggtcgcaagactttaaagacgagggactggggatcagcacggataaggcctacactggtagcatgttacggaagcgaaacccgcagggcctcgaatag

SEQ ID NO: 29532 - DNA, 990 bp, Artificial Sequence
  Description of Artificial Sequence: Synthetic coding sequence
atggcctatagcaccgtgcaacgagtcgccttggctagtggcctggtgctggccctttcacttttgctgcccaaggctttcctgagtcgaggcaagcgacaggaacctcctccaactccagaggggaaactgggacggtttcctcccatgatgcaccaccaccaagctccatctgacggccagacaccgggtgcgcgttttcagaggtctcatttggccgaagccttcgccaaggccaagggaagtggagggggtgctggaggcggcggatcggggagaggattgatgggtcaaattatcccaatatatggcttcggcatcttcctttatatcttatacatcctcttcaaactgtccaaaggcaaaaccaccgcggaagacgggaagtgttatacagctatgcctgggaatacacacagaaaaatcacctctttcgaacttgcgcagctacaggaaaaactgaaggaaacggaggctgcaatggaaaagctcatcaatcgcgtcgggccaaacggcgagtctacccagacagaccacagtgatgtctacgtgcattgcctaggagttttcaccacgaagtggctcgactgcctgatctttcttagcagggcccagacagttacgtcagaccaggagaagcggctcctgcaccagctacgcgagataactcgcgttatgaaagagggaaaatttatagataggtttagtcccgagaaggaggcagaagaagccccctatatggaagactgggaaggctaccccgaggaaacctatccaatttacgacctctcagattgcattaagagacggcaggaaaccattttggtcgattatccagatcctaaggaactgtccgccgaggaaatagctgagcgaatgggcatgattgaggaggaagaatccgaccacctgggatgggaatcccttcccaccgatccccgggcgcaggaggataatagtgttacgagttgcgatcccaaacccgtatag

SEQ ID NO: 29533 - DNA, 867 bp, Artificial Sequence
  Description of Artificial Sequence: Synthetic coding sequence
atggcttattctacagtccaaagggtcgcactggcgagcggtttggtgcttgcgctcagtcttctgttaccgaaggctttcttaagcagaggtaaaaggcaagagcctccacctacaccagagggcaagcttggccgctttccacctatgatgcatcaccatcaggcaccctcagatgggcagacacccggtgctcggttccaacggtcacacctggccgaggccttcgccaaagctaaaggctccggtggcggagcagggggcggtgggagcggacgagggctcatgggccagataatacctatctatggttttggtatcttcttatacatcttgtatatcctgttcaagctatcaaaagggaaaactactgcagaggatggtaaatgttatacagcgatgcccgggaatacccacaggaaaatttcgtaccctgaagaaacttatcctatctacgatttatcagactgtattaaacgacggcaggaaacaatcctggtggactaccctgatccgaaagaactgtctgccgaagagattgcagagcgtatgggcatgatcgaagaagaggagagcgatcacctcgggtgggaatcactgcccactgaccccagggcacaagaagataactcagtcacctcctgcgaccccaaacccgaaacctgctcctgttgtttccacgaagatgaggatccagctgtactggccgagaacgccgggttttccgccgacagctacccagaacaggaggagacaactaaagaggagtggagtcaagacttcaaggacgaaggtctgggaatcagcaccgacaaagcatacaccggcagcatgttgcgaaagcggaacccccagggcctggaatag

SEQ ID NO: 29534 - DNA, 1614 bp, Artificial Sequence
  Description of Artificial Sequence: Synthetic coding sequence
atggaaccacgcgcagttgccgaagctgtggagactggagaggaagatgtgattatggaggcgctgcggtcttacaaccaggagcactcccagtctttcaccttcgacgacgctcagcaggaggataggaagaggttggcggaattactcgtgtcagtgttagagcaggggctacccccttcgcatcgtgtgatctggctccagtctgtgagaatactctcccgggataggaattgcctggatccatttactagccgacagtcactgcaagcactcgcctgctacgccgacatcagcgtgtccgagggatctgttcccgagtccgccgacatggatgtggtactggagtcactgaagtgcttgtgtaatcttgtgttaagttccccagttgctcagatgctagcggccgaagcgcgtctcgtggtgaagctaacagaaagagttggactgtaccgcgagaggagtttcccccacgatgttcagttcttcgatttgcggttactctttttgcttacagctctgagaacggacgtcagacaacagctatttcaagagctgaaaggagtcaggcttctgactgataccctcgagctgacactgggcgtcactccggagggaaacccaccacccacactgctgccttctcaagagaccgagcgcgcaatggaaatcctcaaagtgctctttaacattaccctcgattcgataaagggtgaggtggacgaggaggacgctgcgctgtatcgacacttagggacactgttgagacattgtgtaatgatcgccactgccggcgatagaacggaggagttccacggacacgctgtgaacctccttgggaatctcccactgaagtgccttgacgttctgctcacgctagagcctcacggcgatagcaccgagttcatgggggtaaacatggatgtaatccgcgccctgcttatttttctcgaaaaacgactgcataaaacacaccggctcaaagaatccgtcgcaccagtgctcagcgtcctgaccgagtgtgcaagaatgcatcggcccgctaggaagtttctgaaggcccagggttggcccccccctcaggtccttcctcccctcagagatgtgaggactaggcctgaggttggcgaaatgctgagaaacaagctggttagactgatgactcacttagacacagatgtgaagcgagtggccgccgagtttctctttgtcctgtgctccgagtcggtacctaggttcataaagtataccggctacggaaatgcagccggcctgctggccgctagaggcctgatggctggggggcgcccagagggccagtatagcgaagatgaagataccgacaccgatgagtataaggaagctaaagcaagcatcaatccagttactggtagggtcgaggagaaaccacctaatcctatggagggaatgaccgaggagcagaaggagcatgaagcaatgaagctcgtaaccatgttcgacaaactctcccgcaaccgggtgatccagcctatgggaatgtctccccgcgggcacctgactagtctgcaggacgccatgtgtgagactatggaacagcagctgtcttccgatccggactccgatcccgactag

SEQ ID NO: 29535 - DNA, 1596 bp, Artificial Sequence
  Description of Artificial Sequence: Synthetic coding sequence
atggagccaagagcagttgctgaagctgtggagacaggcgaagaggacgtaatcatggaggccctcaggtcttataatcaggagcactcgcaatctttcaccttcgatgatgctcagcaggaagatagaaaaaggctagccgagcttttggtgtcagtgctggagcagggtctgcctcctagccatcgtgtgatctggttgcaaagcgtgcgaatcctgtccagagatagaaactgcctggatccctttacatctcgccagtctctccaagctctggcatgctacgcggacatcagtgtctccgagggatctgtgccagagagtgctgacatggacgtggtcctggaaagcctaaagtgcctctgtaaccttgttctttcctcccctgtcgcccagatgctggcggctgaggcacgactggttgtgaaactgaccgagagagttggtctctaccgtgagcgctctttcccacatgatgttcagttctttgacttgagactgctgttccttcttactgcccttaggaccgacgtgcgccagcagctgtttcaggagctgaaaggggttcgattactgacagataccctggagctgaccctcggggtgacgccagaaggcaaccctccgccaacactccttccgtcccaggagacggaaagagcaatggagatacttaaggtgttattcaatatcaccctggatagtattaagggggaggtggatgaagaggatgcagcactgtaccggcacctggggaccttgctgaggcattgtgtcatgatagccactgccggggacagaactgaagaatttcatggacacgccgtcaatttgctgggaaatttgccgctcaaatgcttagacgtcctccttaccctggagcctcacggagattctacggagttcatgggagtcaacatggacgtgatacgcgcgctgctgatttttctcgagaaaaggttgcataagacccatcggctgaaggaaagtgtggcgccagttttgtccgttcttacggagtgtgcgcggatgcaccgaccagcgcgtaaattcctgaaggcacaggtcctccccccgctgcgcgatgtgcggacccgaccggaagttggtgagatgttacgcaataaattggtgcggttgatgactcatctggatactgacgtgaaaagagtagcagctgaatttctcttcgtgctgtgcagcgaaagcgtccctcgttttatcaaatacacaggatacggcaatgcagccgggttactggccgcccgagggttaatggctggcggcaggcccgagggccagtactcagaggacgaggacacagatacagacgaatacaaagaggccaaggcgtctatcaaccccgtaacagggcgtgtcgaggagaaaccccccaaccccatggagggaatgaccgaagagcagaaggagcacgaggcaatgaaactggttacgatgttcgataagctgtcccggaaccgagttatacagcccatggggatgagccctagagggcacctgacttccctgcaggatgccatgtgtgagaccatggaacagcagctgtccagtgaccctgacagcgatcctgattag

SEQ ID NO: 29536 - DNA, 1491 bp, Artificial Sequence
  Description of Artificial Sequence: Synthetic coding sequence
atgctagctagtaaactgtgtgagggtattttcaaagttcttattaaggatatccccacgacatgccaagtgtcctgcctagaagtgttgcggatcctctccagagataagaaggtgttagtgccagtgaccaccaaagaaaatatgcagattctcctccgcctggctaaactcaatgaactcgatgactcgctggagaaggtctccgagtttccagtgatcgtggagagcctaaagtgcctatgcaatatcgtcttcaacagtcagatggctcagcagctgtccctcgagctcaatctcgcagccaagctgtgcaacctgctacgcaaatgtaaagaccgcaaatttataaacgacataaagtgttttgatctgagactgcttttccttctctccctgctacacactgatataagatctcagctgagatatgaacttcagggattgccactgttgacgcagatattagagtccgccttctccataaagtggaccgacgagtacgagagcgcaattgatcacaacggcccacctttatcgcctcaggaaactgattgtgccatagaggctctgaaagcccttttcaacgtgaccgtggacagctggaaagtgcacaaggagtctgacagtcaccagtttcgcgtgatggctgctgtcctcagacactgcctcctgatagttggcccaactgaggacaagacagaggaactgcatagcaacgctgtcaatctactgtctaacgttcctgtttcttgtctcgacgtactgatttgcccgctcacccatgaggaaacggcccaagaggctaccaccctggacgagctgccttccaacaagaccgcagaaaaagaaacagtcctgaagaataacacaatggtttacaacgggatgaacatggaagccattcatgtcttattgaactttatggagaagcgcatcgacaagggcagttcctatcgagagggtctaacacctgtgttgtctctcctgacagagtgcagtcgcgcacatcgaaacatccggaaatttctcaaagatcaagtcctgccccctctgcgcgatgttaccaataggcccgaggttggcagtacggtgcgcaataaactggtgcgcttgatgacacatgtggatttgggagtgaagcaaatcgccgccgagttcttgttcgtcttgtgcaaggaacgcgttgatagtctactcaaatacacaggttatggcaacgcagcggggctactcgccgcaagaggcttgctcgccggcggccggggcgacaactggtactccgaggatgaggacacagatacagaggagtataagaatgctaagcctaacatcaatctcatcacaggacacctggaggagccaatgcctaatcctattgatgagatgacggaagagcagaaagaatatgaagcaatgaaattagtaaacatgcttgacaagctgagtagaagggcagatgtgaaagacctccaccaggatggtggttag

SEQ ID NO: 29537 - DNA, 1683 bp, Artificial Sequence
  Description of Artificial Sequence: Synthetic coding sequence
atggatgaagagcgcgcactgtacatcgtgcgtgcaggcgaagccggggcaatagaaagagtgcttcgggattactctgataagcaccgggctacctttaaatttgaaagcaccgatgaggacaagcggaagaaactttgcgagggaatattcaaagtgcttatcaaagatattcccacgacctgccaggtatcttgtctggaggtactgcggattctgtcaagagataagaaagtgctggtgcccgtcacaactaaggaaaatatgcagatactacttagattggcgaagcttaacgagttggacgactcgcttgaaaaagtgagcgaatttcccgttattgttgagtcacttaagtgcctgtgcaatatagttttcaactcgcagatggcacaacagttatcactggaacttaatttggctgcgaaattgtgcaatctccttcgtaaatgcaaagacaggaaattcatcaatgacattaaatgtttcgacttgcgcttgttattcctgctttctctgctgcatactgacatccggtctcaactgcggtacgagcttcaaggtctcccgctcttaactcagatcctggaaagcgctttttcgattaaatggacggatgaatacgagagtgccatcgatcacaacgggccgccactctctcctcaggagacagactgtgccatcgaagctcttaaagccttgtttaatgtgaccgtggactcttggaaagtgcataaggagtccgattcacatcagttcagagtgatggccgccgtcttgagacattgcctcttgatcgtagggcctactgaggacaaaactgaggaactgcattccaatgcagtgaacctgctgagtaatgtacccgtgagctgtctcgacgtgttgatctgtcctcttacccacgaggaaactgcccaggaggcgaccacgctcgacgaactgccttctaacaaaaccgccgagaaagagacagtccttaagaacaacactatggtctacaacgggatgaacatggaggctatccacgtcctattgaacttcatggagaagcgcatcgataaaggcagctcctaccgggaaggtctgactcccgtcctttcactattgaccgaatgctcacgagctcacaggaacatccgtaaattccttaaggaccaggtgctgccccctctgcgagacgtcaccaaccggcccgaagtgggctcaacagtgcgtaacaagctggtcaggctcatgacccatgttgacttgggtgtcaagcaaattgcggctgagtttctgttcgtactgtgtaaagagcgcgttgatagtctgctgaagtacacaggctacggtaacgccgccggtctcctcgctgcaagaggcctgttagccgggggtcgtggcgataactggtattccgaggacgaagacactgatacagaggaatacaaaaatgccaaacctaacatcaacttaattactgggcatctcgaggaacctatgcccaaccctatcgatgagatgaccgaggaacagaaagaatacgaagcgatgaagcttgtcaacatgttagacaagctcagccgtgaggaactccttaaaccgatgggcctaaaacctgacggcactattacaccattggaagaggctctaaatcagtactcagttattgaagaaacctcctccgacaccgactag

SEQ ID NO: 29538 - DNA, 1563 bp, Artificial Sequence
  Description of Artificial Sequence: Synthetic coding sequence
atggatgaggaaagggcactgtacattgtaagggccggggaagccggcgcaatcgaacgtgtgttgcgggattactccgacaaacaccgggccactttcaaatttgagtccacagacgaggataaaagaaagaagctgtgcgaaggaatcttcaaagtgctcatcaaggatatccctacaacctgtcaggtgagttgcctagaggtcctgaggatcctgagcagagataaaaaggtcctggtgcccgtgacaactaaggagaacatgcagattttgctgcggctggccaagctgaatgagttggacgatagcctggagaaagtctctgagtttccagttatagtggagagcctgaaatgcctctgtaacatagtttttaatagtcagatggcacagcagctcagcctcgaattgaatttagctgccaagctttgtaatctgttgaggaagtgcaaagacaggaagttcattaatgatattaagtgcttcgatctgcgcttactatttctcctgtccctgcttcacacggatataaggagtcagctgagatacgaactccagggcctcccattactgacgcagatattggaaagcgcttttagcatcaagtggactgatgagtatgaatctgctatcgaccacaacggtccccctctctctccccaggaaacggactgcgccattgaggcactgaaagctctgttcaacgtcacagtcgacagctggaaagtccacaaagaatcagattcccatcagttcagagtgatggccgcggtgctgagacattgcctgctgatcgtggggccaactgaagataagactgaagagctccacagcaacgctgtgaatcttctcagtaatgtcccggtctcctgtctggacgtactgatatgtcccctaactcacgaagagacagcacaggaagcgaccaccttagacgagctgccatccaacaaaacagctgaaaaggagacagtcctgaagaacaatactatggtttataacggcatgaatatggaagctatccatgtcctactgaactttatggaaaaaagaatcgacaagggctcaagttatcgcgaagggctcacaccagtcctctctctgttgacagagtgttctcgtgcacatcgaaacatcagaaagtttctcaaggatcaagtactgccgcctctcagagacgtgacgaacaggccagaggtaggctccaccgtccgcaataagctagtccgactgatgacccacgtggatcttggagtgaaacaaatcgccgcagagtttctgttcgtgctgtgtaaggagagggtggactctctgctcaagtatactggatatggaaacgccgctggcttactcgctgccagaggattactggcgggcggacgaggggacaactggtattctgaggatgaggatacagataccgaggagtataagaacgctaagcctaaggaggagttgttgaaaccaatggggttaaaacccgacggtaccattactcccctcgaggaggcactcaatcagtactctgtgattgaggagactagctctgacactgattag

SEQ ID NO: 29539 - DNA, 987 bp, Artificial Sequence
  Description of Artificial Sequence: Synthetic coding sequence
atgatgtggcgtccctctgtgctgctcctgctcctcctgttaagacatggcgctcagggtaaacccagcccagacgcaggacctcacggccagggcagagtccaccaggccgctcctctgtccgacgctcctcacgacgatgctcatggtaatttccagtacgatcacgaggccttcctcggcagagaggtagcaaaggaatttgaccagttgaccccagaagaaagtcaggccaggctcggacgaattgttgacagaatggatcgcgctggagatggcgatggctgggtgtccctggccgaactgagggcgtggatcgcccacacgcagcagcgccacatcagggatagcgtatccgctgcctgggacacgtatgacactgatcgggacggccgcgtggggtgggaagaactgcgcaacgccacgtacggacactatgcccctggggaagagttccacgatgtggaggacgctgaaacatataaaaagatgctcgcgagggacgaaagaaggtttagggtggccgatcaggacggagactctatggcaacaagggaagaactcaccgcgttcctgcaccccgaggagtttcctcacatgcgtgatatcgtcatcgctgagactctggaggacctggacagaaataaagacgggtatgtgcaggtggaggagtacatcgccgatctatattctgcagaacccggagaggaagagccagcctgggtgcaaacagaacgccaacagttccgcgactttcgagatctgaacaaggacgggcatttggatggcagtgaggtcggacactgggtcctgccacctgcacaggaccagccacttgtggaagccaatcaccttctgcacgagtctgatacggataaggacggccggcttagcaaagccgaaatacttggaaactggaacatgtttgtgggatcccaagctactaactacggcgaagacctgacgcgacaccacgatgagctctag

SEQ ID NO: 29540 - DNA, 1326 bp, Artificial Sequence
  Description of Artificial Sequence: Synthetic coding sequence
atgctgcggaagggatgttgtgtggagctcctactgctgctcgtagctgccgagctgccactcgggggtggctgcccaagagattgtgtgtgctatccagccccaatgactgtctcgtgtcaagcgcataactttgcagccatcccggaaggaatccctgttgactccgaaagggtatttttgcagaacaacaggattggcctgttacaaccgggccacttctctcctgcaatggtgaccttatggatttattccaacaacattacctacatccatccatcaacattcgaaggattcgtacacctagaagaattggatcttggggataatagacagttacgcactttggctcccgaaacattccaaggactggtcaagttgcacgcactgtacctctacaaatgtggactatcagccctccctgccggcgtcttcgggggacttcacagcctacagtatctgtatctgcaggataatcatattgagtacctccaggacgatatcttcgtcgatttggtgaacctctctcaccttttccttcacggcaacaaattatggtctctgggacctggcactttcaggggcctggtaaatctggatcggttgctgctgcatgagaatcagctgcagtgggttcatcataaggcattccacgatctccggcgactcaccaccctgttcctattcaataatagcctgtccgagctgcagggggaatgtctagcccccttgggggcattggagtttctccggcttaacggaaacccttgggactgcggttgcagagcgagatctttatgggaatggctccagcgcttcagaggaagcagtagcgccgtgccgtgtgttagccccggcctgcggcatggacaggacctgaagctgttgagggcggaggacttccgcaattgtacgggacccgcgagcccacaccagatcaagtctcataccctgaccacgacagatcgggctgcccggaaagagcatcactcaccacacgggcctacacggagcaaggggcatcctcatgggccacgcccaggacaccgaaagcccggtaaaaactgcaccaatccccgcaatcgaaaccaaatcagtaaggctggggctggaaagcaagctcccgaactcccagactacgcaccggattatcagcataagttctctttcgatatcatgcccactgcccggcctaaacgcaaggggaaatgtgctcggcgcactcctatccgggctccctcaggggtacagcaagcgtcctctgcttctagcttgggtgcgtcactcctggcatggactctaggacttgccgtgacactacgttag

SEQ ID NO: 29541 - DNA, 1263 bp, Artificial Sequence
  Description of Artificial Sequence: Synthetic coding sequence
atgctgccaggtctccggcgactacttcaagcccccgctagcgcatgtctcctgcttatgctgctggcactgcccctggcggccccttcttgccctatgctgtgcacctgttacagctctccccccactgttagttgccaggctaataatttttcgagcgtgccgctgtctctgccacccagcacccagcggctgttcctgcagaacaaccttataagaactcttcgccctggcaccttcggatccaacctcttgaccctgtggctgttttccaacaatttgtcgaccatttatccaggcacattcagacatctgcaggctctggaggaattggatctgggtgataatcgccatctgcggtccctggaacccgacaccttccagggccttgagaggttgcagagcctccacctgtaccggtgtcagctgtcaagtcttccagggaatatcttccggggacttgtgagcttgcagtatctgtacctacaggagaatagcctgctccatctacaggatgatttattcgcggatcttgctaacctttctcacttgttcctccatgggaaccggctgaggctcctgacagaacatgtgtttcgcggcttgggctccctggatcggttgcttcttcacggcaaccggttgcagggggtgcaccgggcagcgtttcgcggccttagccggttaactattctgtacctcttcaataattctttggcgtccctacccggggaagccctagctgacctgccctcactggagttcctaagattgaatgctaatccatgggcttgcgactgccgcgcccgaccattgtgggcatggttccaaagggcccgggtttcaagctctgatgtaacatgcgcgaccccacctgagcgccagggccgcgacctgcgcgcccttagagaagcagattttcaagcatgtccacccgcagctcccactcggccaggttcaagggcccgcggtaactcctcttctaaccatctgtatggagtggccgaggccggcgccccacccgccgatccttctacactttaccgtgacctgccggcggaggattccagaggaagacagggcggagacgccccgacagaagatgactattggggtggatatgggggagaggaccagcgaggggagcagatgtgcccgggcgccgcttgtcaggctccacctgactcccgcgggccagctctttcggctggacttccaagccctcttctgtgtttattactgctggtgcctcatcacctgtag

SEQ ID NO: 29542 - DNA, 1014 bp, Artificial Sequence
  Description of Artificial Sequence: Synthetic coding sequence
atgctcagaaacaatttggggaattcctcggactctaagaatgaggacggttccgttttcagccagaccgagcacaacatcgttgcaacctacttgattatggctggcatgatttctataatcagcaatattattgtccttggcatatttatcaagtacaaggaactccgtactcctaccaatgcaattattatcaatctggctgtgaccgacattggcgttagcagcattgggtaccccatgtcagccgcttctgacctgtatggctcttggaaattcggatacgccgggtgccaagtctacgctggtctgaatatctttttcggcatggcgtctatcggcctgcttaccgtggtggctgtggaccgatatctcaccatctgtctgcccgatgtgggcagacgtatgaccacaaatacttacatcgggctcattctgggagcatggatcaacgggctgttttgggcccttatgcccatcatcggctgggcttcctacgcgcctgaccctacaggggcaacatgtaccattaactggcgtaagaacgatagatctttcgtatcatataccatgaccgtcatcgcgatcaatttcatcgtaccactcaccgtgatgttttactgctactaccacgtgacattgtcgataaagcaccacacaactagcgattgtaccgagtccctgaatagagattggtcagaccagatagacgtcactaagatgtcagtgataatgatctgcatgtttctggtagcctggagcccatattcaatcgtatgcctttgggcctcctttggagatccaaagaaaatccccccgccaatggctatcattgcccccctgttcgccaagagcagtactttctataacccatgtatctacgtggtggccaacaagaagtttcggagggcaatgctagcaatgtttaagtgccagacccaccaaaccatgcccgttacatcaattctgccaatggatgtgtcccagaacccactagccagcggtaggatctag

SEQ ID NO: 29543 - DNA, 792 bp, Artificial Sequence
  Description of Artificial Sequence: Synthetic coding sequence
atgcgcagaatttcattgaccagttctcccgtccgcctgctgctgtttcttttgttgctgctgatagcactggagatcatggttggaggacactccctgtgctttaactttacaataaagtcactttctcgccccggacagccctggtgtgaggcccaagtttttctgaataaaaatctctttcttcagtacaacagcgacaataacatggtcaaacctctgggcctcctgggcaagaaagtgtatgccacatctacttggggcgagctcacacagacactcggggaagtggggagggatctccgtatgttgctgtgtgacattaaacctcagatcaaaaccagcgatccttcgacattgcaggtcgagatgttttgccaaagggaagccgagcgctgcacaggcgcaagttggcagtttgccacaaatggcgaaaagtccctccttttcgacgctatgaatatgacatggacagtgatcaaccatgaggcgagcaagatcaaggagacctggaaaaaagaccggggccttgaaaagtatttcaggaaactgagcaagggcgactgcgaccactggctccgggaattcctcggtcattgggaggccatgccggaacccactgtgagcccagtgaatgctagtgatattcattggagtagtagctcgctgccagacagatggattatcctgggagcatttatccttcttgtgctgatgggaattgtgctgatctgcgtctggtggcagaacggtgagtggcaggctgggttatggcccctgagaacaagctag

SEQ ID NO: 29544 - DNA, 684 bp, Artificial Sequence
  Description of Artificial Sequence: Synthetic coding sequence
atgagacgcatctctctgacctcatcccccgttcggctgctgctgttcctgctgttgctgctcatcgccctcgaaataatgtataatagcgacaataacatggtgaagccgctggggctcctgggcaaaaaggtctacgccacgtcgacatggggagaacttacacaaacattaggggaggtgggtcgcgacctacggatgctcctgtgcgatatcaagccacagataaaaactagcgatccgtccacgctccaagtggaaatgttctgccaacgggaggcagaaagatgcaccggagccagctggcaatttgcgacaaatggtgaaaaatcactgctgtttgatgctatgaatatgacctggacagtcattaaccatgaagccagcaagattaaagaaacatggaagaaagatcgcgggctcgaaaagtacttccgcaagctgagcaaaggggattgcgatcattggcttcgcgagttcctcggccactgggaggccatgccagaaccaacagtgagcccagtaaacgcatctgatatccactggagtagttcctcactgccagacaggtggattattctgggcgctttcatactgttggtacttatgggtattgtgcttatatgcgtttggtggcaaaacggggagtggcaggcgggcctatggcccctgcgaacatcatag

SEQ ID NO: 29545 - DNA, 354 bp, Artificial Sequence
  Description of Artificial Sequence: Synthetic coding sequence
atgagaagaataagcttaacgtctagccctgtgcggctgttgcttttcctgctcctcctcctgatcgctctagagattatggtggggggccattccttatgttttaacttcacaatcaaatccctgagccgcccaggccagccatggtgtgaggcccaggtgttcttaaacaaaaaccttttcctgcagtataatagtgacaataacatggtgaagcccctgggccttctcggcaagaaaatcctgccattgtgtaagtctagatgttttgtcaatgtgaagcagaatggtgccttagtgcatcctgggtctagccctccaatggagcgaaatccctccagtctcacacagtag

SEQ ID NO: 29546 - DNA, 630 bp, Artificial Sequence
  Description of Artificial Sequence: Synthetic coding sequence
atgcgccgtatctcccttacaagcagccccgttcggctgttactcttcctgctgctattgcttatcgccttagagatcatggtgggcggccacagtctctgcttcaactttacaattaaatcactcagccggccggggcagccttggtgcgaagcgcaagtatttctgaacaaaaacctgttccttcagtacaacagcgacaacaacatggtgaagccgctggggctgttggggaaaaaggtctatgctacttctacgtggggagaactcacgcagaccctaggagaggtgggacgcgacctgcgcatgctcctttgcgacatcaaaccacagattaaaaccagcgacccctctaccctacaggtagagatgttttgccaacgggaagctgaacggtgtaccggcgccagctggcaatttgccactaacggggaaaagagcctcctgtttgatgcaatgaatatgacctggacagtaattaatcatgaggcgagcaagatcaaagaaacatggaaaaaggatcgggggctggaaaagtacttcaggaaattgtccaagggagactgcgaccactggttacgagagtttctgggccactgggaggcaatgccagaacccacaggcaattag

SEQ ID NO: 29547 - DNA, 243 bp, Artificial Sequence
  Description of Artificial Sequence: Synthetic coding sequence
atgcggaggatcagtctcacatcctcccccgtgcgtctcctgcttttcctgctgctgctgctcattgcattagaaattatggtgggtggtcactcactatgcttcaactttacaatcaaaagcctgtcaaggccaggtcagccttggtgtgaggcacaagtatttctcaacaaaaacctgtttctgcagtacaatagcgacaacaatatggtcaagccgctgggcctcttagggaagaagtag

SEQ ID NO: 29548 - DNA, 639 bp, Artificial Sequence
  Description of Artificial Sequence: Synthetic coding sequence
atgcggaggataagcctcacttccagcccggtgcggctcttgcttttcctgctcctccttttgattgccctggaaattatggtcggcggtcatagcctttgtttcaatttcacgatcaaaagccttagcagaccaggccagccatggtgcgaggctcaggtgttcctgaataaaaatctgtttttacaatacaacagtgataacaatatggtgaagccactaggactgctcggtaagaaggtctatgcaacgtccacttggggggagttaactcaaacactgggcgaagttggaagagatttaaggatgcttctgtgtgacatcaaacctcagatcaaaacaagcgaccctagcactttacaagtggagatgttttgtcaaagggaagctgagcggtgcacaggagcatcatggcagttcgccacaaacggagagaagtcactgttattcgacgcaatgaatatgacctggacagtcatcaaccacgaggcatccaaaatcaaggagacatggaagaaggataggggcttggagaaatacttccggaaacttagtaagggagattgcgatcattggctcagggaattcctgggtcactgggaggcaatgccagagcccacgggtcggcgcagcacctag

SEQ ID NO: 29549 - DNA, 1005 bp, Artificial Sequence
  Description of Artificial Sequence: Synthetic coding sequence
atggcagccgctgcctcccccgcatttctccttaggctccccctgttgctgctcctttccagctggtgtcggacaggcctcgcggaccctcactccctttgttatgacatcactgtcatccccaaattcaggcctggaccccgttggtgcgccgttcagggccaggtcgacgaaaaaacctttctgcactatgactgcggctcaaaaaccgtgacgccagtgtcgccccttggcaagaaactgaatgttacaacggcatggaaagcccagaaccctgtcttgcgtgaagtcgtggacatcctgaccgagcaactgctggacattcagctggaaaattatatcccgaaagaaccccttacactccaggccagaatgtcatgtgaacagaaagccgaaggtcacggatcagggtcctggcagctgtcgttcgatggccagatctttctgctgtttgactccgaaaacaggatgtggaccactgttcaccccggagctaggaagatgaaggaaaagtgggagaatgataaagacatgaccatgtcttttcattatatctccatgggcgattgcactgggtggctagaggactttcttatgggcatggacagtactttggaaccctctgccggggcccccccaacgatgagttctggcaccgcccagccgcgggccactgcaaccactctgattctgtgctgcttacttatcatgtgcctgcttatttgttcccggcacagtctgacacagtcccatggacatcacccacagtccctgcaaccccccccgcacccaccactgcttcaccctacctggctgctccggagggtgttgtggtctgattcgtaccaaattgcgaagcggccactatctggtggccacgtgacgagagtcacattgcctataatcggggatgactcccattccttgccttgccccctagccttatatactattaataacggtgctgccagatactctgagcctctacaagtgagcatttcatag

SEQ ID NO: 29550 - DNA, 663 bp, Artificial Sequence
  Description of Artificial Sequence: Synthetic coding sequence
atgtcaaggtacttacttcctctgtccgccctcggcacggtggctggagctgctgtgctactcaaagactatgttacaggaggtgcttgtcctagcaaggctacaattcctggtaaaaccgtcattgtgacgggggctaacacgggcatcggcaagcagacagcacttgaactagctcgcaggggcggaaacatcatcctggcatgtagagacatggaaaagtgtgaggccgcagctaaggatatccgcggagagactttgaaccaccatgtcaacgctaggcatctggatctggctagtttgaagtctataagagaatttgccgctaagattatcgaagaagaggaaagagttgacatcctgatcaacaacgcaggagttatgcgttgtccccattggactaccgaagacggatttgagatgcagtttggcgtgaatcatttaggccacttccttctgacaaacctgctactagacaagttaaaggcttctgcaccatctcggataataaacctgtctagtctagcccacgtggccgggcatatcgattttgacgatttaaactggcagacccgtaaatataatactaaggccgcctactgccagtcaaagcttgctatcgtgctcttcaccaaggagctgtctaggcggctacaagggtag

SEQ ID NO: 29551 - DNA, 783 bp, Artificial Sequence
  Description of Artificial Sequence: Synthetic coding sequence
atggagaaatgtgaggcagctgcgaaagacatccgcggcgaaacactgaaccaccacgtgaacgctagacacctcgatctggcatccctgaaatcaatccgagagtttgcagccaagatcatcgaagaagaggaaagagttgatatcctgattaacaatgcaggggttatgagatgcccccattggacaacagaagacggttttgagatgcaatttggggttaaccatcttgggcactttttgctgacaaacctcctgcttgataagttgaaagcaagcgcccctagtcgtatcatcaaccttagttctctcgcccacgtggccggccacattgacttcgacgatttaaattggcagactaggaaatacaacactaaggccgcctattgccagagcaagctcgccatcgtgctgttcacgaaggaactgtcccggcgcttgcaggggtccggggttactgtgaatgctctccaccctggtgtagctaggaccgaactggggcgtcataccggtatccacggttccacattttccagcactacactgggcccaattttctggctcctcgtgaaatcccccgagctcgccgctcagccttcgacgtatctggctgttgccgaggaactcgccgacgtaagtggaaaatacttcgacgggttgaagcagaaggctccagctcccgaagctgaagacgaagaagtggcgcgtcgcttgtgggctgagagtgcacgccttgtgggactggaggccccttctgttcgagagcagcctttgcctaggtag

SEQ ID NO: 29552 - DNA, 996 bp, Artificial Sequence
  Description of Artificial Sequence: Synthetic coding sequence
atgagtcggtacctgttacctctgtccgccctgggcaccgtggcgggggcggctgtgctcttaaaggattatgtgaccgggggcgcttgcccctctaaggccacaatcccagggaaaacagttattgtgactggagcaaacacaggaatcggaaaacaaactgctctggaactggccaggcggggtgggaacataattctcgcctgccgcgacatggaaaaatgtgaggccgcggccaaggatattcgtggggaaacactcaatcatcacgtgaatgcacgtcacctagatctggcaagcctcaaatcaataagggagtttgctgccaagataatagaggaggaagaacgggttgatattctcataaacaatgctggcgtgatgcgatgcccccactggaccactgaagacggctttgaaatgcagttcggtgtgaatcacctgggccacttcctactgactaaccttctcctcgacaagctgaaggcttcggcccccagccgcatcataaacctgagcagtctcgcccatgttgctggccatatcgatttcgatgatctcaactggcagacacgtaaatacaacacaaaggcagcttactgtcagtccaaactagccatcgtgctgttcacaaaagagctgtcccgacgtctgcagggctcgggggtcacagtgaacgcactgcatccaggcgttgcccgaacagagctagggagacatacgggcattcacgggagtacctttagcagtacgacactgggcccgattttttggcttcttgtcaagagtccagagctggccgctcagcccagtacttatttagctgtggctgaagaactcgcagacgttagcgggaaatacttcgacggtctaaaacagaaagcccccgcacctgaggcggaagatgaagaagtggccagaaggctgtgggccgaatcagcccgcttggtaggcctcgaagctcctagtgtacgcgagcagcccctgccgcggtag

SEQ ID NO: 29553 - DNA, 1011 bp, Artificial Sequence
  Description of Artificial Sequence: Synthetic coding sequence
atggcagttgccaccgccgcagctgtgttagctgcgctcggcggggccctgtggctggcagctcgaaggttcgtgggaccccgggtccaaaggctgagacgcggtggcgaccccgggctgatgcatggaaagacagtactgatcactggagccaactcgggcctcgggcgcgccacagcagcggaacttcttcggcttggggcccgggttatcatggggtgccgggaccgggccagagccgaggaagcggccggacagctcaggagggagctccgacaggcggccgagtgcggaccggagcccggggtcagtggcgtaggagagttaattgttagggagctggacctagcatcacttcgcagcgtgcgggcattttgtcaagaaatgctgcaggaggagcctaggttggacgtgctgattaacaacgccggcatcttccagtgcccttatatgaaaacagaggatggctttgaaatgcagttcggggttaaccatcttggacattttctgttgacaaacttactcctcggactgctgaaaagtagcgcaccgagccgaatagttgtagtctcatcgaaactttacaagtatggcgatataaacttcgacgacctgaattcagagcagtcttataacaagagcttctgctatagccgatcgaagcttgctaacatcctcttcactcgcgaactggcaaggaggctggaaggaacaaatgtaactgtgaacgtgcttcacccaggcatcgtgcgtaccaacctcggcagacatattcatatcccactgctggtgaaaccactgtttaatctggtcagttgggctttctttaagactcccgtcgaaggagcacagactagcatttatcttgccagctcgccagaggtcgaaggggtgtctggacgatattttggcgactgtaaagaggaggaattacttcccaaagccatggatgagtcagtcgctaggaagttgtgggatatcagcgaggtgatggtgggccttttgaagtag

SEQ ID NO: 29554 - DNA, 954 bp, Artificial Sequence
  Description of Artificial Sequence: Synthetic coding sequence
atgtggttgtacctggccgtattcgtcggtttatattatctgcttcactggtaccgcgaaagacaagttctgtcccacctgcgcgacaagtacgtatttatcactggttgcgacagcggattcggcaaactcctggcccgccagttggacgcccgcggcctgcgcgtgctggccgcctgcctcacagaaaaaggcgctgaacagctgcgcggccagaccagcgacagactggagaccgtgactctggacgtgactaaaacagagagcgtggccgccgccgcccaatgggtgaaggaatgcgtgcgagataagggtctgtggggcctggtgaataacgccgggatctctctgcctaccgctccaaatgagctgctgaccaagcaggacttcgtcacaatcctggatgttaatctgctgggggtgatcgacgtcacactgtctctcttacctctggtgcgtcgtgctaggggacgcgtagtcaatgtaagcagcgttatgggcagagtctccctgttcggcggagggtactgcatctcaaagtacggggtagaggcattctccgattcgctccggagagaattgagctactttggagtgaaagtcgccatgatcgaacccggttatttcaagaccgcagtgacatccaaagaacgcttcctcaagagcttcctcgagatatgggatcgctcctctccggaggtgaaagaggcctacggcgaaaagtttgtggcggactacaagaaaagtgccgaacagatggaacagaaatgcacacaggatctgagcctcgttacgaattgcatggagcacgcgctcatcgcatgccatccgagaacgagatattctgccgggtgggatgccaagttgttgtacctgccaatgagctatatgcccactttcctggtagatgctataatgtattgggtctctcctagcccggcaaaagcgctttag

SEQ ID NO: 29555 - DNA, 1446 bp, Artificial Sequence
  Description of Artificial Sequence: Synthetic coding sequence
atgtggttacctctggtattgctgttagctgtactcttgttggcagtgctgtgcaaggtttacctgggcctcttctcggggagttcaccaaatccgttctcggaagacgtaaagcgtcctcctgccccgctggtgaccgataaggaggctagaaagaaagtgttgaaacaggccttttcggccaaccaggtccccgagaaactggacgtagtggtcatcggctctggattcggaggtctggccgcagccgcaattcttgcgaaggctggcaagcgtgtgctggtcctggaacagcacaccaaggctggaggctgctgccatactttcggcaagaacgggttggaatttgacaccggcatacattacatcggcaggatggaggaaggctctatcgggcgtttcattctcgatcagatcaccgaagggcagcttgactgggctccattaagtagccctttcgacatcatggttttggaaggacccaacggccgtaaggagtaccccatgtacagcggggagaaggcgtacatccaggggttgaaagagaaattcccacaggaggaggccattatagataagtacatcaaactcgtcaaagtggtgtcatcaggtgccccacatgcaattcttctgaagtttctccctcttcccgtggtgcagctcttggaccgatgcggtcttttgaccaggtttagtccctttttgcaggcctcaacacagtcgctcgcggaggttctgcagcagctcggggcctcctccgagctgcaagctgttttgtcctatatcttccctacatacggagttactcctaaccacagtgctttcagtatgcatgccctcctcgtcaaccattacatgaaaggcggcttctaccctcgcggaggttccagcgaaatagctttccacacaatcccggtgatacaaagggctggaggcgctgtcctgacaaaggccactgtacagagcgtgctcctggatagtgccggtaaagcttgtggggtgtctgtgaagaaaggccatgaattggtcaacatctactgtccgatcgtcgtttctaacgccggactgtttaacacgtacgagcacctcctgccagggaatgcccggtgcctcccaggcgtgaaacagcagctgggcacagtgcgcccggggctcggaatgactagcgtatttatctgtcttagaggtaccaaagaggaccttcatctgccctcaactaactattatgtttactatgataccgatatggaccaggctatggagcgctatgtttccatgccccgagaggaagccgccgagcatatccctttactgttcttcgcctttccatcagcaaaagaccctacctgggaagatcgatttcccggcggggaatgtgactgccgcataccgacacaccaacctgtgctgtcagggtgcagtccccggtgtctcctgaggggctag

SEQ ID NO: 29556 - DNA, 1833 bp, Artificial Sequence
  Description of Artificial Sequence: Synthetic coding sequence
atgtggctgcctctggttttgctgcttgctgtgctgctactcgctgtgctttgtaaagtgtacctgggccttttcagtggctcatcgccaaatcccttcagcgaggatgttaagaggccacccgcacctttagtaactgacaaggaagccagaaagaaggtcctgaagcaggcattttctgctaaccaggttcccgaaaagctcgatgtcgttgttatcggctctgggttcggcggcttggccgctgcggcaatcttagctaaagctggcaaacgcgtgttggtcttggagcagcataccaaggcaggaggctgttgccacacgttcggcaagaacggcctcgagttcgacacaggcatccactatattggcagaatggaagaaggcagcatcgggaggtttattctggatcagatcaccgagggtcagctcgattgggctcctttgagttcaccgtttgatatcatggtcctggaaggtcctaatgggagaaaggagtacccaatgtactcaggcgagaaggcttacatacaagggcttaaagaaaaattcccccaggaagaggctattatagacaaatatattaagctcgtgaaagttgtgtcttcaggcgcgcctcacgccattctgctgaaatttctgcctctgcccgtcgtccaattgctggaccggtgtgggctactgactcgcttttcgccgtttctccaggcgtccacgcagtcattagctgaggtgctgcagcagctgggggcctcctctgagctgcaggcagtgctgagctacatcttcccaacttatggcgtcacacctaatcactctgccttcagtatgcacgctctcctggtgaatcactatatgaaaggcggcttctatccaagaggtggctcaagcgagattgcgtttcatactatcccagttattcagcgcgccggaggtgctgtgctgacaaaagcgaccgtgcagtccgtcctgctggattccgccgggaaagcttgtggtgtaagcgttaaaaagggccatgaactcgttaacatctactgccccatcgtcgtctcaaacgcgggcctctttaacacctacgaacatctgctaccaggtaatgcccggtgtctgcctggagttaagcagcagctaggaactgtcagaccggggttaggcatgacatctgtgtttatttgccttcggggtacaaaggaggatcttcacttaccatcgacaaattactacgtgtattacgacactgatatggaccaggccatggagagatatgtgtcgatgccacgggaggaagctgccgaacatattccattactcttttttgctttcccctcggcaaaggatcccacctgggaggaccgctttccagggcgcagtaccatgatcatgcttattccaacggcatacgaatggtttgaggagtggcaagcagagttgaaaggcaagcgcggcagcgactacgagacttttaagaattcttttgtggaagcatctatgtcggtggttctgaaactgttccctcagctggagggtaaagtggagtccgtgactgcgggtagccccctcacgaatcagttctatttagcggccccaaggggcgcgtgctatggagctgatcacgacctagggagactgcatccctgtgttatggctagcctgcgcgcacagtcccctatacctaacctatacctcaccggacaagatatctttacctgcgggctggtgggagcgctgcaaggggcactcctctgttcttctgcaatcctcaaaagaaatctgtacagcgacctcaaaaacctggattctagaatccgagcgcaaaagaagaaaaactag

SEQ ID NO: 29557 - DNA, 1650 bp, Artificial Sequence
  Description of Artificial Sequence: Synthetic coding sequence
atgtggttacccctggtgctgctcctggccgtcctgctcctggccgtcttgtgcaaggtgtatttaggactgttctccggttcaagtcctaatccttttagtgaagatgtgaaacggccccccgcaccacttgtgacggacaaagaagccagaaagaaagttcttaagcagggcatccactacataggacgcatggaggaggggtcaatcgggcgatttatactcgatcagataactgagggacagttggactgggccccactgagctccccctttgacatcatggtgctggaggggcctaatggacgaaaggaatatcccatgtattctggtgagaaggcatatattcaagggctgaaggaaaagttccctcaggaggaagctattatcgacaaatacataaagctcgtgaaggttgtctcgtcaggagcgccacatgccatcttgctgaagtttctgccgctgcctgtcgttcagctcctggaccggtgcgggttgttaacacggttcagccctttcctgcaggcctctacacagtccctggccgaagttctccagcagctcggggcctcgtccgaactccaggccgtattgagctacatctttcctacatacggagttacacccaaccactctgcattcagcatgcacgcgctcctggtgaatcattatatgaagggcggtttctatccccgtggtggctcgtccgagattgcattccacaccatccctgtcattcagagagctggcggcgccgttctgaccaaggccactgtccagtctgtgctgctggatagtgccggaaaagcctgcggagtgtccgtcaaaaagggtcatgaacttgttaatatctattgtcctatagtggtttctaatgcgggcttatttaatacttatgagcatctgctccccggtaacgccagatgtttaccgggcgtcaagcaacagctgggtacagtccgtccaggccttggaatgactagcgtgtttatctgccttaggggaacaaaggaagatctgcacctccctagcaccaattactacgtgtactacgacacagatatggaccaggccatggagcgctacgttagcatgcccagagaagaagctgccgaacatattccgctccttttttttgcctttccaagtgccaaagacccaacgtgggaggatcgctttcctgggaggagtaccatgattatgctgattccgaccgcctacgagtggtttgaagagtggcaggccgaactgaaagggaaacggggtagcgattacgagacctttaaaaactctttcgtcgaggcttccatgtcggtggttttgaaattattcccccagttggagggaaaggtagaaagcgtgaccgcgggatctcccctgacaaaccagttctacctggcggcacctaggggagcctgttacggtgcagaccacgacttgggtcgattacatccctgtgtgatggcttcactgcgcgcccagagtccaattcccaacttgtatctgaccggccaggacatatttacatgcggtcttgtgggggcactgcaaggggccttactgtgctcttctgccatcctgaagaggaatttgtacagcgacctgaagaatctcgatagccgcatcagagctcagaaaaaaaagaattag

SEQ ID NO: 29558 - DNA, 699 bp, Artificial Sequence
  Description of Artificial Sequence: Synthetic coding sequence
atgaaagaaagacgcgctccccagcccgtggtcgcgcgatgtaagctggtcctcgtgggcgacgtgcagtgcggcaaaaccgcaatgcttcaggtactggctaaggattgttacccagaaacttatgtgccaactgttttcgagaactataccgcttgccttgagacagaggaacagagggtagaactgtctctgtgggacacttcaggcagtccgtattatgataacgtgagaccgctgtgttactccgactccgacgccgttctgctctgcttcgacatatctaggccagagacggttgactcagctctgaaaaagtggcgtactgagatcctcgattattgcccatctacgcgggtactgctcatcggttgcaaaactgatctaagaactgatctcagcaccttgatggaactctcccaccagaaacaggcacctatctcctacgagcaggggtgcgccatcgccaagcagctcggagcagaaatctatctggaagggtctgctttcacgtctgagaaatcaatacacagtatcttccgcacagctagtatgctgtgccttaacaaaccatcgcctctgccacagaagtctcctgtgaggtccttgagtaaacgtctccttcatctgcctagcagaagtgagttgatctcaagtacatttaagaaggaaaaggctaagtcgtgctctattatgtag

SEQ ID NO: 29559 - DNA, 381 bp, Artificial Sequence
  Description of Artificial Sequence: Synthetic coding sequence
tggagaaccgagattcttgactattgcccctcaaccagagtgctgctgataggatgcaagaccgacctgagaaccgatctgagtacgctaatggagctcagtcatcagaaacaggctcccatttcttacgagcagggctgcgctatcgcaaagcagttaggagctgaaatctacctcgagggctctgcttttacctcagaaaagtccattcacagtatattccggaccgcttctatgctctgccttaacaagcccagtccactaccccagaagagtccagtgagatccctgagtaagcgcctattgcatctgccaagccgctcagaactgatctcaagcaccttcaagaaagaaaaggccaagtcctgctctatcatgtag

SEQ ID NO: 29560 - DNA, 924 bp, Artificial Sequence
  Description of Artificial Sequence: Synthetic coding sequence
atgaccaaggccggctccaaaggaggcaacctgagggacaaattagatgggaacgagttggatctcagtctgtcagatctgaacgaggtgcccgtgaaagagctggcagccctgcctaaagcaacgatacttgacctcagctgcaacaagctcaccacacttccgagtgacttctgcgggctgacccaccttgtgaagcttgatctgagcaaaaataagctgcagcagttgcctgcggattttggtaggctcgtcaacttgcagcacctagatctcctcaacaacaagttggtaactctgcctgtgagctttgcccagcttaaaaatctgaagtggttagatctgaaggataacccgttggatcccgtcctggccaaggtggcaggggactgcctcgatgagaagcagtgtaaacagtgcgcgaataaagtcctgcagcacatgaaggccgtgcaggctgaccaggaaagagaaagacagaggcgtttagaggtggagcgggaagccgagaaaaaacgtgaagccaaacagcgggccaaggaggcccaggaacgggaacttcgcaaacgggaaaaggcagaagagaaggagcgcaggaggaaagaatatgatgcactgaaagctgctaaacgcgaacaggagaagaagccgaagaaggaggctaaccaggcaccaaagagtaagagcggtagtaggccacgtaagccaccacctcggaagcatacacgtagctgggcagttcttaagctgctactgttattgttgctgttcggcgtggccggtggtttggttgcctgtagggtcacggagctacagcaacaacccttgtgtacctctgtcaacacaatctatgataatgcagtgcaggggctcagacgacatgagatcttgcagtgggtcctgcaaacggacagtcagcagtag

SEQ ID NO: 29561 - DNA, 687 bp, Artificial Sequence
  Description of Artificial Sequence: Synthetic coding sequence
atggagggccagtcgggtagatgcaagatcgtagtagtgggggacgccgagtgcggaaagacagccttgctgcaggtctttgcgaaagacgcctacccaggctcttacgttccaaccgtgtttgaaaattatacagcttccttcgagattgacaagcgccggatagagctcaatatgtgggacacttctgggtcgagctactatgacaacgtcaggccactcgcataccccgactccgatgcagtgttaatttgtttcgacatcagtcgacccgaaaccctggacagcgttttaaagaaatggcagggcgaaacccaggaattttgtcctaatgcgaaggttgtgttggtgggatgtaagttggacatgagaacagatctcgccacattgagagagctgagcaagcagcggctgatccctgtgacacacgagcaagttggtaccgtgctagctaagcaggtgggagcagtgagctatgtggagtgctcgtctcggagttccgaacgcagtgtgcgggatgtcttccacgtggccactgtggctagccttggaagagggcatcgacagctgcgccggaccgatagtaggcgggggatgcagagatctgcgcagctaagcggtagacccgacagaggcaacgagggagaaattcacaaggaccgtgccaaatcctgcaatctgatgtag

SEQ ID NO: 29562 - DNA, 684 bp, Artificial Sequence
  Description of Artificial Sequence: Synthetic coding sequence
atggaaggccagtctggacggtgcaagattgtggtggttggcgatgctgagtgcgggaagactgctcttctacaggtattcgcaaaagacgcttaccccggtagctacgtgccaaccgtctttgagaattatacggcgagcttcgagattgacaagagacggatcgagctcaacatgtgggacacctccgggtcaagttattacgacaatgtgagacctttggcttatccggatagtgacgctgttctaatttgcttcgatatttcaaggcccgagactctggactccgtccttaagaagtggcagggggagacacaggaattttgtcctaatgcgaaggtggttctggtgggctgtaaactcgatatgcgtacagacttagctacattgagagaactatctaaacaaagactcatacctgtcacgcacgaacagggcactgtccttgcaaagcaggtcggtgctgtctcctacgtggaatgtagctcacgatcctccgaacggagcgtgagggacgtgtttcacgtggctacagtggcaagcctgggtaggggacataggcaactcaggcgcacagactcacgtcgaggtatgcagcgctctgcccagctttctggtcgtccggaccggggcaacgaaggcgaaattcacaaagatcgcgctaagagttgtaacttaatgtag

SEQ ID NO: 29563 - DNA, 6264 bp, Artificial Sequence
  Description of Artificial Sequence: Synthetic coding sequence
atggagacagaaagtgaaagcagcaccctgggtgacgactccgtcttctggctggaaagcgaagtaatcattcaggtgaccgactgtgaggaggaggagagggaggagaagttccgcaagatgaaaagttccgtgcacagcgaagaagacgatttcgtgcccgagttacaccgaaatgtgcacccaagagagcggccggactgggaagagactctttctgccatggcaagaggcgccgacgtaccggaaatccccggcgacctcaccctgaagacttgcggcagcactgctagcatgaaagtgaagcacgtgaaaaaactacccttcacaaaggggcacttccccaagatggccgaatgcgcccacttccactacgaaaacgtagagtttgggagcatccagttgagcctcagtgaggagcagaatgaggtgatgaagaatggatgcgaatccaaggaactggtctaccttgtgcagatcgcctgtcaggggaaatcgtggattgtcaagagaagctacgaagatttccgcgtgctcgataaacacctgcacctttgtatatacgaccggcgattctcgcagctctctgaattgccccgctcggacacactcaaggattcccccgaatcagtcactcagatgcttatggcttacttaagcagactgtcggccatcgccggtaacaagatcaattgtggaccagctctcacatggatggagattgacaacaaaggaaaccacttgctcgtccacgaagaatctagcatcaacacaccagcagttggggccgcccatgtgatcaaaaggtacacagcacgtgccccagacgagctaacattagaggtcggagatattgttagcgtgatagatatgccaccgaaagtgttatctacttggtggagggggaaacatggatttcaggtcggtctgttcccggggcattgcgtggaattgattaaccaaaaggtgcctcagtctgtaaccaacagcgtgcccaagccggtctctaagaaacacgggaagctgattacctttcttcgaactttcatgaaaagccgaccaaccaagcaaaagctcaagcaacgggggattctgaaggaacgggtttttgggtgtgatcttggagaacatctgctgaattcaggtttcgaagtgccccaggtcctgcagtcctgtacggcattcatagaaagatatggtattgttgatgggatctatcggctgagtggggtggcaagtaatatccaaaggttacggcacgaattcgacagtgaacacgtccccgaccttacgaaagagccatacgttcaggacatacacagcgtgggttccttgtgcaagctatattttagagaactacctaatcccctcctgacataccagctatacgagaagttcagcgatgccgtgtcggccgcgactgacgaagaacgtctcattaagatccacgatgtgatacaacagcttccgcctccgcactacagaactttagaatttctgatgaggcatcttagtctgcttgcagactactgtagcattaccaatatgcacgccaagaatttggcgatcgtatgggcaccaaacttactgcggagcaagcagatcgagagtgcctgtttcagtggcactgcggcatttatggaggtgaggatccagtcagtcgtggtggaattcatcctcaaccatgtagacgtgctgttctctggaaggatttcaatggcgatgcaggagggcgccgcgagcctgtccagacctaaaagccttctcgtgtcatccccttcaacgaagctgctgaccttagaagaggcccaggctaggacacaagcacaggtcaattccccaatcgtgacggaaaacaagtacatcgaggtgggggagggacccgccgctctccaggggaaattccacaccatcattgaattccctctggagcggaaacgcccacaaaacaagatgaaaaaatctccagtggggtcttggaggtcgttctttaaccttggcaaatcttctagcgtgtccaaaaggaaattgcaacggaacgaatccgagccctccgaaatgaaggcgatggcactcaaaggaggccgggctgaggggacactgagatctgcgaagtccgaagagtccttgacgtccctgcacgcagtcgacggcgatagtaagctcttcaggccaagacgcccgaggtcgagctctgatgccttgagcgcctctttcaacggtgaaatgctcgggaatcggtgtaacagctatgataatttaccacatgataatgagtccgaggaggagggcggcctgctgcacattcctgcgctgatgtcaccgcactccgccgaagacgtagacttgtcaccacccgatattggggtggccagcctggacttcgaccccatgtccttccagtgttcacctcccaaagcagagtctgaatgcctggaatccggtgcaagttttcttgatagccccggatatagcaaagataaacctagcgctaataaaaaagacgcagagaccggttcttcacaatgtcaaacacccgggtctactgcaagctccgagccggtgtctcccctgcaggaaaaactttcccctttctttactttggacctgtctcccacagaagataaaagctcaaaaccctctagttttaccgaaaaagtggtgtatgctttcagcccaaagataggccgcaagctctccaagtcacctagcatgtcaatctccgaaccaatatccgtgactctcccacccagagtgtcagaggttatcgggaccgtcagcaataccacagcccagaacgcatctagcagcacttgggataagtgcgtcgaggagagggacgctacaaaccgcagccctacccaaattgtcaaaatgaaaactaacgagacagtcgcccaggaagcctacgaatctgaggtccagccccttgaccaagttgctgctgaggaggtggaactccccggcaaggaggatcagtctgtctctagtagccagagtaaggcagtggcttcaggccaaacccagactggcgctgtcacgcacgatccacctcaggacagcgtgcctgtgagctcagtctccctgatcccaccccctccgccacctaaaaacgtcgcccggatgttggccctggccctggccgaatccgctcaacaggcctctacccagtcgcttaagagacctggaacatcacaagctggatacactaactacggtgacattgctgtggccactacagaagataatctgtccagcagttacagcgcagttgcccttgataaggcctacttccagaccgacaggcctgccgagcagtttcacctgcaaaataatgccccaggtaattgcgatcaccctctccctgaaacaaccgcaacaggggatccaactcacagcaatacaaccgagagtggagagcaacatcaccaagtagatctcacagggaaccagcctcatcaggcctacctgagcggcgatccagaaaaggcacggattactagcgtccctctggattctgagaagtctgacgatcacgtttcttttcccgaggaccagagtggcaaaaactccatgcccactgtttcattcctagaccaggaccaaagccctccccgattctactccggggatcagcccccctcctacctgggggcatctgtggataagctgcatcacccactggaatttgctgacaagtctcccacaccaccaaatctcccctcggataagatttatcccccaagtggttctccagaggaaaacacttccacggctaccatgacatacatgaccactacaccagctacggcgcagatgagcactaaagaggccagttgggacgtagctgagcaacctaccacagccgatttcgccgctgccacgcttcaacgcacacaccgaacgaatcggcccctgcctccgcccccatcacaaaggagcgctgagcagccacctgtggttgggcaggttcaagcggcaacgaatatcggtctgaacaactcacacaaggtgcagggcgtggtcccagtgcccgaaagacccccagagccccgcgccatggacgatccagccagcgctttcattagcgacagtggagccgccgccgcacaatgtccaatggccaccgcagtacagcccggtttgcctgagaaagtgagagacggcgcgcgcgtacctctgcttcaccttagggccgagtctgtgcctgcacacccctgcggattccccgctccactgccccccacccgaatgatggaatccaagatgatcgccgctatccattctagctccgcggatgcaactagcagctcaaactaccactccttcgttaccgccagctccaccagcgtcgatgatgcgctccccctgcccctgcctgtgccccagccaaaacacgcttcccaaaaaactgtgtatagcagctttgcccggccggatgttaccactgaaccatttgggcccgacaactgtttgcacttcaacatgacaccgaactgccaataccggccacagagcgttcctcctcaccacaataaactcgagcagcaccaagtctatggggcccgtagtgagccaccggcttctatggggttgcgatacaacacctatgtagcccccggacggaacgctagcgggcaccactctaagccttgtagtagggtcgagtacgtgagcagcctctcttcttcagtgaggaacacctgctatcctgaagatataccaccctaccctacgatccgacgcgtacagtctctgcatgcacctccctcctctatgatcagatcagtgcctatctctcgaaccgaggtgccccccgacgatgaacccgcatactgcccacgtcccctatatcagtacaagccctaccagtccagtcaggcacgttcggactaccacgtcacacagctacaaccctactttgagaatggccgcgtacattatcggtattctccctacagcagctcttctagttcctactattcacccgacggagcactgtgcgatgttgacgcatacgggaccgtgcagttaaggcccctgcatcgattaccgaatcgggacttcgccttctataacccccggttacaagggaaaagcctgtactcctacgcaggactagcgcctcggccacgtgctaatgtgaccgggtacttctcaccaaacgaccacaatgtggtgagtatgcccccagccgccgacgtgaaacatacatacacttcttgggacctggaagatatggaaaaatatcggatgcagagcattaggagggagagtagggcccgccaaaaggtcaaaggccctgtcatgagtcagtacgacaacatgactcccgcggtgcaagacgacctggggggtatctacgtgatccacctgcgtagcaaaagtgaccccggcaaaacaggcttgttgtccgttgccgagggaaaggagtcccgccatgccgcaaaggcaatttcgcccgagggcgaggatcgcttttataggcgacacccagaggccgaaatggaccgggcacatcaccatggggggcacggctccacacagcctgagaaacccagcctgccacaaaagcagtcaagcttacgatccagaaaactacccgacatggggtgctccctccctgagcatcgagcccatcaagaagccagccatagacaattctgcgaaagtaaaaatgggcctccttatccacagggggccgggcaacttgattatgggagtaagggtatcccggacacctctgagccggtgtcatatcacaactccggagtcaaatatgcggcctccggacaggagagcctaagattgaatcacaaggaagtccgactgtctaaggaaatggaacgcccctgggtgagacaacccagcgcacctgagaaacacagcagggattgttataaagaggaagaacatctaactcagtctattgtgccccccccaaaacctgagcgaagtcacagtctgaagctccaccacacccagaacgttgaaagagatccgtcggtgctgtatcagtatcaaccacacggtaagaggcagtctagcgttaccgtggtgtcacaatacgacaatctggaggactatcacagcttgccccagcaccagcgaggagttttcggtggcggcgggatggggacctacgttcctccaggtttccctcaccctcagtccaggacatatgctacagcactgggtcagggcgcctttctgccagccgaactctcgcttcagcaccctgaaacacagatccacgccgaatag

SEQ ID NO: 29564 - DNA, 969 bp, Artificial Sequence
  Description of Artificial Sequence: Synthetic coding sequence
atgccacccaaggttctgtctacctggtggagagggaaacatggatttcaggtagggctgtttccggggcactgtgtcgaactgatcaaccagaaagtgcctcaatctgttactaactccgtgcctaaacctgtgagtaaaaaacatggcaagctgataacttttctgaggacctttatgaagagtcgccccaccaagcagaagctcaaacaaagggggatcctcaaagaacgcgttttcggatgcgatttaggcgagcatctactaaattccgggtttgaagttccacaggtgcttcagagctgtaccgccttcatcgagaggtacggaattgttgacgggatttaccgacttagcggggtggcctctaatatccagaggctccgtcacgaatttgatagtgaacatgtaccagatctcactaaggagccttacgtccaggacatccacagcgtggggtcgttgtgcaagctgtactttcgcgagctgcccaatccgctcctgacgtaccagctgtatgaaaaatttagcgacgctgtctctgcggcgacagatgaggagcgcctgatcaagatccatgatgtcatccaacagctgccacctccacattaccggacccttgagttcttgatgagacacctgagccttttagctgactattgctcaatcactaacatgcacgcaaagaaccttgctatcgtctgggcacccaatctgctcaggagcaagcagatcgagtccgcctgtttttcaggaacagccgccttcatggaagtgaggattcagtccgtggtggtggagttcattctaaatcacgtagatgttctgttgcctcacttctctgccaggaccgagcttatcgtgcccttccccctgcgattgccgcgaaagcagtttacgccacctctcctcggccccatgagtccactgaaccctctggtccagattactgtctgcatctctatctag

SEQ ID NO: 29565 - DNA, 2865 bp, Artificial Sequence
  Description of Artificial Sequence: Synthetic coding sequence
gactacgaggagaccagcaaaaaggaagcacgcggtgcagacgtgccggagatcccaggtgaccttaccctcaagacctgtggcagtacagcctccatgaaagtgaagcacgtaaaaaaactcccatttactaagggccactttcctaaaatggcagagtgtgcccatttccattacgagaatgtggagttcggctctatccaattgagcctctccgaggaacagaacgaggtcatgaagaatggatgcgagagtaaagagctggtgtatctggtccaaatcgcatgtcagggtaagagctggattgtcaaaagaagctatgaggactttagagtgctggacaagcatctccacctgtgtatctatgaccggcgattttcccagctctccgagttgccaaggtccgacacactgaaggatagcccagagagcgtgactcagatgctaatggcctacctgtctaggctcagtgcgatcgcaggtaacaaaatcaactgcggcccggcactgacctggatggagattgataataagggtaaccacctgctggttcacgaagaaagttcaatcaacactccggccgtgggggccgcacatgtgattaaacggtacactgcacgtgctccggacgaattgacccttgaagtaggagatattgtatctgtgatagacatgcccccgaaggttctgtcaacatggtggcgaggcaaacacgggttccaggtgggactgtttcctggtcactgtgtagagctgatcaatcagaaggtccctcaatccgtcaccaacagtgtgccaaaaccggtgtccaagaaacatggaaagttgataacatttttgagaactttcatgaagtctcgtccaaccaagcaaaaactcaagcagcgaggtattctgaaagaacgagttttcggttgcgatcttggggaacatctgctcaatagtggatttgaggtgccacaggtactccagagctgtaccgcttttatcgagcgatatggaattgtcgatgggatatacagactgtcaggggtggcctccaacatccagcgactacgccacgagttcgacagcgagcatgttcccgacctgaccaaagagccatacgtgcaagatattcatagcgtaggatccctttgcaagctctatttcagggaactccccaatcccctgctgacatatcaactgtacgagaagttcagtgatgcggtgtccgctgccaccgacgaggagcgcttaattaagatccatgatgtgatccagcagctgccccccccccattacaggactctagagttccttatgagacacctcagtctcctcgcagactactgttcaatcacaaatatgcatgcgaaaaacttggctatcgtgtgggcaccaaacctgcttaggtccaagcagatcgagtccgcctgctttagcggaacagcagcttttatggaggttcggatacaatccgtggtagtggaattcatactgaaccacgtggatgtgcttttttccggccgcatatctatggccatgcaggagggcgccgcttcattgtcaaggccaaaatccctcttagtgagcagcccctccaccaagctccttacactcgaagaagcacaggcccgaacacaggctcaggtgaatagtcccatagtcaccgagaacaaatacatcgaggtcggtgaggggccggctgcactccagggaaaattccataccatcattgaatttccgctggagaggaaacgtcctcagaataagatgaaaaagtcccccgtcggcagctggagatctttcttcaacctaggaaaaagcagctcggtctccaaacgcaagcttcagcgcaatgagagcgaaccctctgaaatgaaagccatggcactcaaaggcggcagagccgaggggacgttaagaagcgctaagtccgaagaatccctaaccagcctacatgccgtggatggagacagcaaattattccgccctagacgtccccggtctagctcagacgctttatctgcatcatttaacggcgaaatgctcggaaatagatgcaattcctatgataatctcccacacgataacgagagcgaggaggaaggggggttgttacacatccctgcactgatgtcgcctcactctgctgaagacgttgacttaagtcccccggacattggagtcgccagtctagatttcgatccgatgtccttccagtgtagccctccgaaggcagagagtgagtgcctggagagtggggcgagctttttggatagtcctgggtactctaaagataagcccagcgccaataagaaggacgccgaaaccggctcctctcagtgtcagacccctggctccacagccagttcagaaccagtgagccctttacaagagaaattgtccccgttttttaccctggacctgtcacccaccgaggataagtcttcaaagccatcatctttcaccgaaaaggtagtgtacgccttctctcccaagatcggcagaaaactctccaagagccccagcatgtcaatatctgagcctatcagtgttacactgcccccccgggtgagcgaggtgatcggaacagttagcaatactactgctcagaacgcctcatctagcacatgggataaatgcgtagaagagcgcgatgccacaaataggtcaccaactcagatcgttaagatgaagaccaacgaaactgtggcccaggaggcctatgagtcagaagtgcagccgttggatcaggtggcggcagaggaagttgagctgcccgggaaggaggaccaaagcgtgagttcatctcagtccaaagccgtcgccagtggccagacccaaacaggaaccgtgtgcttccccccgttcttcttgtag

SEQ ID NO: 29566 - DNA, 5217 bp, Artificial Sequence
  Description of Artificial Sequence: Synthetic coding sequence
atgaaatcaagacctaccaagcagaagctgaagcagaggggcatcctgaaggagagagtgtttgggtgtgatcttggcgagcatctcctgaatagcggatttgaagttccacaggtgttacagagttgtaccgcatttatcgagcgctacggaattgtggacgggatctatcgcttaagcggcgtcgccagcaatatccagaggttgcgacacgaattcgattctgaacacgtccctgacctgacaaaggaaccatatgtgcaggacattcattctgtggggtctctgtgtaaactatactttcgggagctgcccaaccccctacttacctaccaactgtatgagaagttcagtgacgccgtaagcgccgccactgatgaagagagacttatcaagattcacgatgtcatccagcaattgccacccccccactataggacattagagtttctgatgcggcatctttctcttctggcagattactgttctattacgaatatgcacgccaagaacctcgcgatagtgtgggcacccaacctgttacgctcaaagcaaattgagtctgcctgttttagtggcaccgctgcctttatggaggttaggatccagagcgtggttgtagagttcattctgaatcatgtagatgtgttgttctccgggcgcatcagcatggcaatgcaggagggcgccgcctctctgtctcggcccaaatcactcctggtctccagccccagcacaaaactgctgacattggaagaagctcaggccaggacccaggcccaggtaaattcccccatcgttaccgagaataaatacattgaggtcggtgaggggcccgctgccttgcagggaaaattccacacaattatcgaattcccactcgaaaggaaaaggccccagaataagatgaaaaaatcgcctgtgggttcatggcgttcgtttttcaatctgggcaagtctagctctgtctcgaagagaaaactgcagcgcaacgagtctgaaccctctgagatgaaggccatggccctaaagggagggcgagccgagggcacacttcgtagcgcaaaatcggaggaaagtctgacgtccctccacgcggtggatggggactccaagctttttaggcccaggcggcctcgttcttcttctgatgctctgtctgcgtcctttaatggggaaatgctgggcaaccggtgtaattcctacgacaatctgcctcacgacaacgagtccgaagaggaaggtggtctgctgcacattcccgcactcatgagtcctcatagcgccgaggacgtagatctgtctccccccgatattggcgtcgctagtttggatttcgacccaatgtctttccaatgcagtccacctaaagccgagagcgaatgcttggagtcaggggcctcgtttctggacagccccggctactccaaagacaaaccatctgccaataaaaaagatgccgagactggcagctcccagtgccagacccccgggagcaccgcttctagtgagccagtgagtccgttacaggagaagctttcccctttcttcacgcttgatctcagccccactgaggataaatcgagtaagccgtcatcatttaccgaaaaagtggtgtacgcgttcagccccaagatcggacgaaaactcagtaaatcgccatccatgagcatatcagagcctatttcagtgacactgccgccccgcgttagcgaggtgatcggcactgtgtcaaacacaaccgcacaaaatgctagtagcagtacatgggacaagtgcgttgaagagcgagacgcgacaaataggtctccaacacagatcgtaaagatgaagacaaatgagactgttgctcaggaagcctacgaatctgaagtgcagcctctggaccaggttgctgctgaagaggtagagctccctgggaaggaagatcaatccgtgagtagctcgcagagcaaagctgtggcctccggccagacccaaacaggtgcggttactcacgatcccccgcaggatagtgtccctgtgtcatcagtgtctctaatcccgcctcccccccctccaaagaacgtggcccgcatgctggcccttgccctggcggagtctgcacagcaggcctccacccagagtctcaagagacctggaacgagccaagctggctataccaattacggggatatcgctgtggctactacagaagacaatcttagctcctcttacagtgcggttgccctggataaagcctacttccagacagaccgccccgctgaacagtttcatcttcaaaataatgctcccggcaattgcgatcaccccctcccagaaaccactgcgactggggacccgacccacagtaacaccactgagtctggcgagcagcaccaccaggtagatctgacaggcaaccagccccaccaagcttacctctcgggagatcccgaaaaagccagaataaccagcgtccccctagacagcgagaagagcgacgaccacgtgtcgtttccagaggatcaaagcggcaagaactctatgccaactgtctccttcctagaccaggatcagagcccaccgcgattttattccggcgatcaacctccatcatatctgggcgcaagcgtcgataaactacatcaccccctggaatttgcagacaagagtcctacccctcctaatctgccaagcgataagatctacccaccgtcaggttctcctgaagagaacacaagcacggctaccatgacctatatgaccactacaccggctacagcccagatgagcacaaaggaagcaagctgggacgtggccgaacagcctacgacagccgatttcgcagctgccaccctgcagcggacgcaccgcaccaatcgaccattaccgccgcctccgtcccagagatccgccgaacaaccaccggtagtcggtcaagtgcaggcggccacgaatataggactcaataattcacacaaggtgcagggcgtggtcccagtgcctgaacggccacctgaaccccgggcaatggacgatccagcttccgctttcatttccgacagcggagctgcagcagcccaatgccccatggctactgcagtgcagcctgggttgcctgaaaaagtgcgggacggcgcccgcgtacccctactgcacctcagagccgagagtgtgccagcccacccttgcggatttccagcacctcttccgccgacgcgtatgatggaaagcaagatgattgccgcgattcattcgagttctgccgacgctacttcctcaagcaactaccactcattcgtcaccgcttctagtaccagcgttgacgacgctctgccactccctttgccagtcccccagcctaagcacgcatcacagaaaacagtatacagtagctttgcccgcccagatgtcactacagaaccattcggccccgacaactgcctgcattttaacatgactccgaactgtcagtataggcctcagtctgttcctccacatcacaataaacttgagcaacatcaggtgtacggtgcccgctccgaacctccggcatccatgggattgcgttacaacacttatgtagcgcctgggaggaatgcgtccggtcaccacagcaagccatgctctagagttgaatacgtgtcctctctcagctctagtgtacgaaatacttgctacccagaagatatccctccttatccaactatccggagagtgcagagtctgcatgcgcccccttcaagtatgatcaggtccgtgcccattagccggacagaggtacctcccgatgatgagccagcatactgtccaaggccgctgtatcagtacaagccatatcaatccagccaggcacggagtgactatcacgttacgcagctccaaccctacttcgaaaacggtcgggtgcactatcgatatagcccttactctagctcctctagctcctattacagtcctgacggcgcactgtgtgatgtagacgcctacggtaccgtgcagctacggcctctgcataggctgcccaatagagattttgcgttctacaatccaaggctgcaggggaagtccctctacagctacgctggattggctcctcggccccgcgctaatgtgacaggatatttctcacctaatgaccataacgtcgtctccatgccacccgctgcagatgtgaagcatacttacacttcctgggatttagaggatatggagaagtacagaatgcagtcgatacgtcgggaatccagggctagacagaaggtgaagggtcccgtcatgagccagtacgataacatgactccagccgtgcaggacgaccttgggggaatctatgtgatacatttaaggtctaagagtgatcctggaaaaactggattactgagcgtggcagaagggaaggagtcacgccacgctgccaaggctatcagtcccgagggagaggatcgattctaccgcaggcacccagaagctgagatggatagggctcatcaccacggcgggcatggcagcacacagcccgagaagccgagcctgcctcagaaacagtcgtccctcaggagtcggaagctgcccgacatgggatgtagtctgccagagcacagggcccaccaggaagcgagccaccggcagttctgtgagtctaaaaatggtcccccatatccacaaggtgctggccagctcgattatgggagcaaaggtataccagatacatctgaaccagtgagctaccacaatagcggggttaagtacgccgcttccggacaggaatcacttagactgaatcacaaggaggtcagattaagtaaggaaatggagcggccttgggtgagacagccaagcgcaccggagaagcatagcagggattgctataaagaggaagagcatctcacccaaagcattgttcccccacctaaacccgaaaggagccactccttgaagctccatcacactcagaacgtcgagagggacccttccgttctataccagtatcagcctcatgggaagaggcagagttccgtaacagtcgtgagccagtatgacaacctagaggactatcattctctcccccagcatcagcgcggcgtcttcggggggggaggaatgggtacatacgtcccccccggattcccgcacccccagtctcggacctatgcgacggcgcttgggcagggtgcctttttgcctgcagaactaagcctgcagcatcccgaaacccagattcacgctgagtag

SEQ ID NO: 29567 - DNA, 2841 bp, Artificial Sequence
  Description of Artificial Sequence: Synthetic coding sequence
atggccgcacacggcaaacttcggagggagagagggcttcaggccgaatacgaaacgcaagtcaaagagatgagatggcaattgtctgaacagctgagatgcttggagctgcagggggaactgcgacgggaactactccaggagcttgccgagttcatgagaaggcgggccgaggtggagctcgaatactcaaggggcctggaaaaactcgctgagcggttttcaagcagaggaggccgtctagggtccagccgggaacaccaatcattccggaaggagccatccctgctttcgccactccattgctgggccgtcttactacagcacacaaggcagcagtctagggagtctgccgctttgtcggaggtgcttgccggaccactcgcacaaagactcagccatattgccgaggacgttggcaggctggtgaagaaatccagagacctggagcagcaactacaggatgagctcctagaagtagtctcggagctgcaaaccgctaaaaagacttaccaggcgtatcatatggagtctgttaacgctgaagctaagctgagagaggctgagcgccaagaggagaagagagcaggacgttctgtacctacaaccacagcaggcgcaaccgaagccggccccttaagaaaaagcagtctcaagaaaggcggtagactcgtggagaaacggcaagctaagttcatggagcataaactcaaatgtacgaaggcacgcaatgaatacctcctgtctcttgccagtgtgaatgctgctgttagcaattactatctgcacgatgtactcgacctgatggactgttgcgatactgggtttcacttagctttaggtcaagttctaagaagctacaccgctgctgagtcgcggactcaggcatcccaggtgcaggggctgggctccctggaagaggccgtggaagctctggacccaccgggagacaaggccaaggttttggaagttcacgccactgtcttttgcccacccctgagatttgattatcatccacatgacggcgacgaagtggctgaaatctgcgtcgaaatggaactgcgagacgagatccttcctagggctcagaatatccagtctcgcctggaccggcaaactatagagacagaggaagtcaacaaaacactgaaggcaactctgcaggcactcctcgaggtagtagccagtgacgatggagatgtcctcgattcttttcagaccagcccatcaacggagtcccttaaatctaccagctcagatcctggctctcgtcaagccgggaggcggcgaggacagcagcaggaaactgagacattttatctcactaaattgcaggagtatctcagcggaaggtctatcctcgccaaacttcaggccaaacatgagaaactccaagaagcactccagcggggcgataaggaggagcaagaagtatcctggacccagtacacgcagcggaaatttcagaaatctagacaacccaggcctagtagccagtacaatcagaggctgttcggaggcgacatggagaagtttatacagagtagcggacagccagtccccctggtggtagaatcttgtatcaggttcatcaatttaaacggcctccaacacgaggggatttttcgggtctcgggagcacagcttcgagtgagcgaaatccgagatgcctttgaaagaggtgaggatcccctggtggagggctgtactgcacatgatctcgattctgtggccggcgtcctaaaattgtatttccgttccctggaaccacctctgttccctccggacctgtttggcgaactgcttgccagcagcgagctagaggccaccgctgaacgggtggagcacgtatcacggctgctgtggcgcctcccagcccccgtgttagtggttttgcggtacctgtttacgttcctgaaccatctggcccagtatagcgacgaaaacatgatggatccatacaatttggccgtctgcttcggccctactctgctgcccgtcccggccggtcaggaccccgtggctttgcagggcagagtcaaccagttggttcagacacttatcgtgcaaccggatcgggtctttccccctttgacctcactcccaggtcccgtctacgagaagtgtatggccccaccatcagcctcatgccttggggatgcccagctggagtctctgggggctgacaatgaacccgaattagaagcagaaatgccagcacaggaggacgaccttgaaggtgtggtcgaggcggtggcttgcttcgcgtacacagggcgcacggctcaggagctctcatttcgtcggggggacgttctgagactgcacgagcgggcttcatctgactggtggcgaggagagcacaacggaatgaggggtctgattccacacaaatatattactcttcctgctggcaccgagaaacaggtcgttggggccggcctgcagaccgcgggagagtctggttccagccccgagggacttctcgcttctgagctggtgcatcgacccgagccctgcacgtcgcctgaagccatggggccaagtgggcacaggcgtaggtgtctcgtaccagcgtcccctgagcaacatgtggaagtcgacaaggccgtagcccagaatatggattccgtgtttaaagaactattgggcaaaacatccgtgcgacaaggactgggacctgcctctactacatctccaagcccaggcccaaggagtcctaaggcgccaccctcttcgcgactgggcagaaataagggcttttccagaggtccaggcgcaccagccagtccgagcgcgagtcatcctcagggcctcgacacaactcccaaaccccattag

SEQ ID NO: 29568 - DNA, 2778 bp, Artificial Sequence
  Description of Artificial Sequence: Synthetic coding sequence
atggcggcacacggaaagctgaggcgggagagaggcctgcaggctgagtatgaaacgcaggttaaggagatgcgatggcagcttagcgagcagttacgttgtctggagcttcaaggagaactcaggagggagctcctacaggagttagctgaattcatgaggcggcgggctgaggtagaactggagtatagcaggggtctggaaaaactggccgagcgcttctcctctcgtggtgggaggctggggagctcacgagaacaccaaagcttcagaaaggaacccagcttgctttccccccttcattgctgggccgtactcctacagcatacaagacagcagtctagagagagtgccgcactaagtgaagtccttgccggccctctcgctcaacgcctctcacacatcgccgaagacgtcggacggcttgtcaagaaagcgaagaaaacttatcaggcgtaccatatggagagcgtgaacgctgaagctaagctccgcgaagccgagagacaggaagagaagcgggctggacgctctgttcccaccactactgcgggagcaaccgaagccggaccacttaggaaatcctctcttaagaaaggcggcagactcgtggaaaagcgccaggccaaatttatggaacataaactgaaatgtacaaaggccagaaatgagtacctgctatctctggcctctgttaatgcagccgtttcaaattattacctccatgacgttcttgacctgatggattgctgtgacaccggcttccaccttgccttaggccaagttctgaggagttacaccgcagccgaaagcagaacccaagcgtcgcaggtccagggcctgggttctctcgaggaagctgttgaggccctggacccccccggagataaggccaaagtcctggaggtgcatgcaactgtgttttgtccccctttgcgctttgactaccaccctcacgacggcgacgaagtggcggagatatgtgtggaaatggagctgagagacgagatcctaccccgagcccagaacatccagtctcgtttagatagacagactatagagacagaagaggtgaataagaccctgaaagcaacactccaggcgctcctggaggttgttgccagtgatgatggtgacgtgttggactcttttcaaacttcaccatctacagagtccctgaagtctacatccagtgaccctgggtcgaggcaggcaggccggcgaagaggacaacagcaagagaccgagacattctatttgaccaaactgcaagaatatttaagtggcagatccatccttgcaaaattacaagccaaacatgagaagctgcaagaggccttgcagaggggggacaaggaggaacaggaagtgtcttggacacagtatacgcagcgtaagttccagaagtccagacagccacgcccctcgtctcagtataatcagagacttttcgggggcgacatggagaagttcatacagtctagcgggcagcccgtacccctggtggttgagtcctgtattaggttcataaacctgaatggcctgcagcacgagggaatcttccgggtctcgggtgcgcagctgagagtgagtgagattcgcgacgcctttgagcgaggagaggaccctctggtagaaggatgcactgcacatgacctcgacagcgtagcgggcgtgctgaaactctatttccgttctttggaaccacctctgtttccaccagacctgtttggcgaactgctcgcttccagcgagttagaggcaaccgccgagcgcgtcgagcacgtcagtcgccttttatggagacttcctgctccagtactcgtcgtgcttagatatctgttcacatttctaaaccacctcgcacaatatagcgacgaaaacatgatggacccatataaccttgccgtttgcttcggcccaacccttctccctgtacctgccggtcaggaccccgttgccctgcagggaagggtcaaccaactcgtgcaaaccctgatcgtccagccggaccgggtttttccgcctctgacgtctttaccaggccccgtgtacgagaaatgcatggcccctcctagtgctagctgcctcggcgacgcgcagttagagtcactcggcgccgataatgaaccagagcttgaagccgagatgccagctcaggaggatgacttagagggcgtggtggaagccgtagcttgcttcgcttatacaggccgtaccgcccaggaactttctttcaggcggggcgacgtgctgcgactccacgaacgggccagcagcgactggtggcggggcgagcacaatggaatgcgaggcttaattccacataagtacatcactctcccagccgggactgaaaaacaggtcgttggagccggcttgcagaccgccggcgaatctggctcctccccagagggtctgctggcctccgagctcgttcacagaccagagccctgtacatctccagaagccatgggcccttctggccatcgcagacggtgtctggtgccagccagcccagagcagcatgtcgaagtggacaaagccgttgctcagaacatggactctgtctttaaagaactacttggcaagacttctgttaggcagggattgggaccagcatcaaccacctcacccagtccagggccccgctcccccaaagcaccccccagttccaggctgggcaggaacaaaggtttctcaagaggacccggcgcccctgcttcaccaagtgcctctcatccccagggccttgataccacgccaaaaccccattag

SEQ ID NO: 29569 - DNA, 2961 bp, Artificial Sequence
  Description of Artificial Sequence: Synthetic coding sequence
atggctgcacacggcaagctgcgccgggagaggggcctgcaagccgaatatgagactcaggtaaaagagatgagatggcagctaagcgaacaacttcgctgccttgagctgcagggtgagctcagacgcgagcttctgcaagaactcgctgaattcatgcggagacgagccgaagttgagcttgagtatagtcgcggattggaaaagctagccgagcgattttcctcacgcggcggtcgactgggctcaagcagggaacatcagtccttcagaaaggagccttctctgttgagtcccctacactgttgggccgtgctactccagcatacacgtcagcagagccgtgagagcgcagcactgagtgaagtgctggccgggccactggctcagagattgtctcacatcgccgaggacgtcgggaggctcgtgaagaaatctagggatttggaacagcagctgcaagatgagctgctggaggtcgtgtctgagttgcagactgcgaaaaagacctatcaggcttaccacatggaatctgtcaatgctgaggctaagctgagagaagctgagaggcaagaggaaaaaagggccggacgttcagtgcctaccactaccgccggagctacggaagccggaccactgaggaagagttctctgaagaagggaggcaggttggtcgagaaattgtggcctccgcagcggcctgtcgctgcctcaagctgcgcacccgtttgttggcttcaggcaggatttctggtgcatccaccctggtggggcgcaatgtgtgcgccgagtacccaccagcgccaggctaaatttatggagcacaaactgaagtgcacaaaggcccgaaacgagtacctccttagcctggccagtgtaaatgccgcagtgtctaattattatttacatgatgtcctcgatctgatggattgttgtgataccggtttccatctggcactgggccaagtactgaggtcatataccgccgccgaatcccgtacacaggcgagccaagttcaaggcctcggatcgcttgaggaggcggtggaggctttagacccccctggagataaagcaaaagttctggaggtgcacgccaccgttttctgtccacccctgaggtttgattatcacccgcacgacggcgacgaagttgcggaaatctgtgtcgaaatggagctccgcgacgaaatattacccagggcccagaatatccaatcgagactcgataggcagacaattgaaaccgaagaagtcaataaaactctcaaagcaaccctgcaggccctgttggaagttgtcgcatcagatgatggcgatgtgctcgattccttccagacaagccctagcaccgagagcctcaaatctacgtcctccgatccaggcagtcggcaggccggcagaagacgcgggcagcagcaggagaccgaaaccttctacctgactaaactccaggagtatttgagcggacgatcgattttggcgaagctgcaggcaaaacatgagaaactccaagaagccctccagcgcggcgataaggaagagcaagaggttagttggacccagtacacacagcgcaagttccagaaaagccgccagcctcgaccttcgagccaatacaatcagcggctatttggaggggatatggagaagttcattcagtcttcaggtcagcccgttcccctggttgtggaatcctgcatccggtttataaaccttaacggcctgcagcatgaggggattttcagggtaagcggcgcccagctgagagtctctgagatccgggacgcctttgaaaggggggaagaccctttggtagaggggtgtaccgcgcacgaccttgattccgtggccggtgtgctcaagctgtattttcgttccttggagccaccactgttcccccccgatttatttggagagctgctcgcctcttccgagctcgaagcgaccgccgagcgggtagagcatgtttcccggctcttgtggcgcctgccggcacctgtgctggtcgtgttgcgttacttgtttacttttctcaatcacctcgcccagtactcagatgagaacatgatggacccttataacttggcggtgtgcttcggtcctacgctgttgccagtgcccgccggccaagatcctgttgccttacagggccgcgtaaatcagttagtccaaacactcatcgtgcagccggatagagtgtttcctcctcttacctctttgcctggacctgtgtatgaaaagtgtatggcccctccttctgcctcttgccttggcgacgctcagcttgagagcttaggcgccgacaatgagcccgaactagaagctgagatgcctgcacaggaagacgaccttgaaggcgtcgtggaggcagtggcatgctttgcctatactggccggactgcccaagagctatccttccggcgcggagacgttttgaggctccacgaaagggcttcatcggactggtggagaggtgaacacaatggtatgcgcggattgatacctcacaagtacattacgctccccgcaggcaccgagaaacaggtggtgggcgctggcctgcaaacagccggtgaaagcggcagcagcccagaggggcttctcgctagcgagctcgtgcaccggcctgaaccatgcactagcccagaagcaatgggtccctcaggccataggaggcgctgcctggtgcctgcctcgccagagcagcacgtggaggttgataaagctgtggcccaaaacatggactctgtttttaaggaactgcttggcaagaccagcgtccgccagggccttgggccagctagcacaacatcaccaagccccgggcccagatctccgaaagctccgccgagctcccgtttaggacggaataagggatttagtagggggcccggggctccagcatccccctcagcgtcccacccacagggcttggatactacccccaagccacactag

SEQ ID NO: 29570 - DNA, 2307 bp, Artificial Sequence
  Description of Artificial Sequence: Synthetic coding sequence
atggccgcacacggtaaactccggcgcgaacgtggcctccaggccgagtacgagacccaggtcaaggagatgagatggcagctcagcgagcagctaagatgtttagaactgcaaggcgagctccgccgggagctgctgcaggaacttgctgagtttatgagacggagggccgaggtggagttggagtactccagagggctggagaagttggctgaacgctttagttctagaggaggcagattaggatccagtcgcgagcaccaatctttccgcaaggaaccttccttactgagtccactccactgttgggccgtgctgctgcaacacacccgacagcagagccgcgaatccgcagctttgagcgaggtcttggccggccctttggctcagcgtttaagccatattgcagaagacgtgggtcgcttggtcaagaagagtagggacctggagcagcaactccaagatgaattgttggaggtcgtcagcgagctccagactgtcgctgagatatgcgtggagatggaacttagagatgaaattctgcctagggctcagaatatacagtcacgcctggacagacagacaatcgagactgaggaggtcaacaagacccttaaagccaccctgcaagctcttttggaggtggtggcatcagatgacggcgacgtgctggattctttccagacttcccctagcacggaatcactgaagtccacctcttcagatcccggctctagacaggctggcagacgacggggccaacaacaggagacagagaccttttacttaaccaaactgcaggagtacctatccggtcgcagcatcttggccaagcttcaggccaaacatgagaaactacaagaagctctgcagcggggagataaggaggagcaggaggtctcatggacacaatatacccaacgaaagttccagaaaagtcgtcaacctcgacccagcagccagtacaaccagagactgttcggcggggatatggaaaaattcattcagtcgagcgggcagcccgtacctctcgttgtcgagtcctgtattagatttataaacctgaacgggcttcagcatgagggaatcttccgggtcagtggtgcacagctccgtgttagtgaaatccgagatgccttcgagcggggggaggaccctttggtggaaggctgcactgctcacgacctcgacagcgtggccggcgtgctgaaactgtattttcgctcattggaaccaccactgtttccacctgacctgttcggggaacttctggcgtcctcagagctggaggccacagctgaacgagttgagcatgtgtcccgcctgctctggcgtcttcctgcccccgtcctcgtggtgttgaggtacctgtttacatttctgaatcatctggcacagtactcagatgagaatatgatggacccgtataacctggcagtgtgctttggtccaaccctgctgccagtcccagcaggccaggaccccgtggcactccaaggcagggttaaccagttggtgcagactcttatcgtgcagccggatagggttttccccccattgacatccctgccgggccccgtgtacgaaaaatgcatggctccaccctctgcttcttgcttgggcgacgcccagcttgagagtctaggggcagacaacgagccagagttggaggccgaaatgcctgcacaggaggacgacttggagggcgttgttgaggcagtggcatgtttcgcatatacggggcgtaccgctcaggaactgagttttagaagaggggatgtcttacgcctccacgaacgagcttcctcggactggtggcgcggcgagcacaatgggatgagaggtttgatcccacacaagtacatcactctccccgccggaaccgagaagcaggtcgtgggggccgggttgcagacggcaggagaaagtggaagctcacctgagggcctactagctagtgagcttgtccatcggcctgagccatgcaccagccccgaggcaatgggcccctccgggcatcgtcgaaggtgtctcgtgcccgcttcaccagaacagcatgtggaagtggacaaggctgtcgcccaaaatatggatagcgtgtttaaggagctgctgggaaaaacaagtgtgaggcaggggctggggcctgcctccactacgtcaccatctccaggaccgagatcacccaaggcaccgcccagctcccgcctcggccgcaataaaggcttcagccgcggcccaggcgcacctgcaagtccctcagctagccatccgcaaggcctggacacaaccccgaagccacactag

SEQ ID NO: 29571 - DNA, 2772 bp, Artificial Sequence
  Description of Artificial Sequence: Synthetic coding sequence
atgcgctggcaactctctgagcaattgcgatgtctagaattgcagggggagctgcgcagggaactcttgcaggagttggctgaatttatgcggagacgggcagaggtggaactcgagtattctcgagggcttgagaaactagccgaacgcttttcctctaggggcggcagattgggctcatcccgggagcatcagagctttagaaaggagccctctttgctaagtcctctccactgctgggctgtactgcttcagcacactcgacaacaatctagggagagcgccgccctctccgaggtgctggcaggtccactcgctcagagattgtctcatatcgctgaagatgtgggtcgcctagtgaagaagtcccgggatcttgagcaacagctgcaagacgagctattggaagtggtgagtgagctgcagacagccaagaaaacttatcaggcataccacatggagtcggtgaacgctgaagccaaactgcgcgaagccgagcgacaggaagagaagcgggctggacgctccgtacctacaactacagccggcgctacggaagcaggtcccctcaggaaatcgtccctgaagaaaggcgggagactggtggaaaaacgacaggctaaattcatggaacataagctgaagtgcacgaaggccagaaatgagtatctcttgtccttggcctcagtgaacgctgctgtctccaattactacttgcatgacgtgcttgacctgatggattgctgcgacacagggttccacctagccctggggcaggtcctgaggtcgtatacagccgcagaatctaggacccaggcaagtcaagtgcaaggactggggagtctcgaggaggccgtcgaggctctggacccccctggggacaaagccaaagtgctggaggtacatgctacagtcttctgcccccccctacgttttgattaccatccccatgacggcgatgaggttgcagaaatttgtgtggagatggagctgcgggacgaaatcttgcccagggcgcagaacatccaatctcgactggatagacagactattgagactgaagaggtgaataagactttaaaggccactctgcaagctctgctggaggttgtagcatcagacgacggcgatgtccttgattctttccagacttccccaagtacggagtcactgaagtcaacctcgtcagacccaggcagccggcaggctggccgccgcagaggccagcagcaggagaccgagacgttctatttaaccaagctccaggagtacctgtccggaagatcaatacttgccaaactgcaagctaaacacgaaaaactccaagaggctcttcaaagaggcgacaaggaggagcaggaggtgtcatggacccaatacacgcaacgtaagtttcagaaatcccggcagccacggccgtcatctcagtacaaccaacgtttattcgggggagatatggaaaagttcatccagtcctcaggccagccagtaccactggtggtcgagtcctgtatcagatttataaacctcaatggcctgcagcacgaaggcatctttagagtgagtggggcacaactccgagtgtcagagatccgggacgcattcgaacggggggaagacccccttgtggaggggtgcacagcacacgaccttgacagcgtcgccggcgtgctgaagctgtactttagatctcttgaacccccactatttccccccgacctgtttggagagctcctggcctcctccgaactggaggcaactgctgagcgcgtcgaacacgtgtctcggctcctgtggcggctccctgctccggtgctcgtggtactccgctacctattcaccttcctgaatcatttagcccagtattccgacgagaacatgatggatccctacaatctagctgtgtgttttggccccactttgctccctgtaccagccggccaggacccagtcgctctgcaaggcagagtgaatcaactggtgcagacacttatagtccagcccgaccgagtcttccctcctctgacaagcctacctgggccggtgtacgaaaaatgcatggccccgccctccgcctcttgcctgggagatgcccagctggagagtctcggcgcagataacgagcccgagctcgaagccgagatgccagcacaggaggacgatctggagggcgtggtcgaggccgtggcttgtttcgcctacaccggacgcactgcccaggagctctcgttccgcaggggcgatgtgctgcgacttcacgaaagagccagttcagactggtggcgcggcgagcacaatggtatgaggggactgatcccgcacaagtatatcacactgcctgcaggcaccgagaaacaggttgtcggggctggattacaaactgccggggagtccggttcatcgcctgagggcctactggcttcggagctggttcacagacctgagccatgtactagccccgaggccatgggcccctctggacatagaaggagatgtctcgttcctgcctccccagagcagcacgtggaagtggataaagctgttgcacaaaatatggactctgtctttaaggagctgctgggtaaaactagtgtgcgacaaggattgggccccgcgagcaccacctctccaagccccgggcctcgaagccctaaagctcccccctcatcccggctcggtaggaacaaaggttttagcagggggcccggggcgcctgcgagtcctagtgcctcccatccgcaaggactggacacgacgccgaaaccccattag

SEQ ID NO: 29572 - DNA, 2817 bp, Artificial Sequence
  Description of Artificial Sequence: Synthetic coding sequence
atgttccggcgacgtacctgcgggacagaagcatctctgaggtggagtcatagcagtcgcagcgaaattcggctgggcagatccgagtctctgaaggggcgggaggaaatgaagcggagcaggaaggctgagaacgtgcccaggtcccgatctgacgtagacatggatgcggcggcagaggctactcgtctgcaccaatcagctagttcaagcacctcctccctgtcaaccagatcactcgaaaaccccacacccccatttacccctaagatgggcaggaggtcaatcgaaagtccctcgctgggcttttgcacagacaccctgcttccacaccttttggaggacgatttgggacagctctccgacctggaaccagagcctgacgcacagaattggcagcataccgtcggcaaggacgtggtggctggcctgactcagagggagattgacagacaggaggttatcaatgaacttttcgtaactgaagcgagtcatctgcgcacactccgggtactggatctgatcttctatcagaggatgaaaaaagagaatcttatgcctcgtgaggaacttgcccggctgttccctaatctgcctgagttgattgaaatccacaatagctggtgcgaagccatgaagaaactacgggaggaaggacccattatcaaagagatcagcgatttaatgcttgcccgattcgatgggcctgccagggaagagctccagcaggtcgccgctcaattttgcagttaccaaagtatagcgctcgaactgatcaagaccaagcaacgcaaggagtctcgcttccagctgtttatgcaggaagccgagagccatccccagtgtaggcgtttgcaactgcgggatctgattatatcagaaatgcaacgtttgaccaagtaccctctcttgctggagagcatcatcaaacataccgagggtggcacgtctgagcatgaaaaactgtgcagggcacgggaccaatgccgggaaatcttgaagtacgtaaatgaggccgtaaagcagactgagaacagacaccgcctggagggttaccagaagaggctcgacgctaccgcgctcgagagggcatcaaatccacttgctgcagagttcaagtccttggacctgactacacggaaaatgattcatgagggtcccctgacctggcgtatatccaaggataaaacattggatctccacgtgcttctgttggaggatttattagtccttctccagaaacaggatgaaaaactgctgctgaaatgccattctaagaccgctgtcggcagctctgatagcaaacagaccttttcccctgtgcttaagctcaatgcagtactgatccgatcagtagccacggataaacgtgccttctttattatatgtacaagcaaactgggtccacctcagatatacgaattggtcgcactcaccagcagtgataaaaacacttggatggaacttctagaggaggcggtgcgtaacgccactagacaccccggtgcagcccctatgccagttcaccctccgccccccgggccgagggaacctgcccagcaggggcccaccccttctagagttgagcttgatgatagcgacgtgtttcacggtgaaccagaaccggaggagctgccagggggcaccggctcacagcagcgggtgcaggggaagcatcaggtcctgctcgaggatcccgaacaggaaggatcggctgaagaggaagagctgggagtactgccttgtcccagcacctcccttgatggagaaaatcgcggtatacggaccagaaacccaattcatttagcttttcctggtcccctttttatggagggcctggccgactcagctctggaagatgtggaaaatctcagacatctcatcctctggtctctgttgcccggccacacaatggagacccaagccgcacaggaacctgaggatgacctgactcctactccaagcgtgatctctgttaccagccacccttgggatcctggcagccccggtcaggcgccgcctgggggtgagggcgacaatacccagctggcaggactggagggcgagagacccgagcaggaggacatgggactgtgttctctggagcacctcccaccaagaactcgtaactctggaatctgggaatctcctgagcttgataggaacctagccgaggatgctagcagtacggaagcagctggaggctacaaggttgtgcgcaaagccgaggtggcagggtcgaaggttgtccctgccctgccggaaagtggacagtcagagcctgggccgccagaggtcgaaggtggtactaaagcaaccggtaattgcttttacgtttctatgccaagcggtccaccggattcctcaacagatcattccgaggcccccatgtcaccccctcagcctgatagcctccccgctggtcagacagagccacagccacagctgcagggcggcaacgatgacccaaggcggccctcacgatctccacctagcctcgccctgcgcgacgtgggaatgattttccataccattgaacagctcactttaaaactgaatcgactcaaggacatggagctggcccacagggaactcctaaagagtctgggcggggagtcctctggcggaaccacaccagtgggatcattccacacggaggcagcacgttggaccgatggctctctctccccacccgccaaagaaccgctggcttccgattcgcgtaacagtcatgagctgggcccctgccccgaagacgggagcgacgctcccttggaagacagcacagccgatgccgcagcatcccccggcccctag

SEQ ID NO: 29573 - DNA, 4569 bp, Artificial Sequence
  Description of Artificial Sequence: Synthetic coding sequence
atgagcgttcgactgccacagagcatcgaccgcctcagcagcctgagcagtctaggggattccgcacctgagagaaagagcccctctcaccataggcagccgagcgatgccagcgaaactaccggcctggtgcaacggtgtgtgattatccaaaaggatcagcatggattcggttttaccgtgagcggcgatcgtatcgtgctagtgcagtccgtcagacctgggggggctgctatgaaagccggcgtgaaagagggcgaccgcatcattaaggttaacggaacaatggtaaccaattcttcccatctggaagtagttaaactgatcaagtcaggcgcgtacgtggctcttactctgctgggctccagtccgagttccatggggatctctggcctacagcaggacccctctcccgccggcgcacccaggatcacatctgtgattccttcaccacctccaccaccaccactaccgcctccccagaggatcaccgggccaaagcccctgcaggatccggaggtccagaagcatgcgacccagatcctgcggaacatgttacgtcaggaggaaaaggaactacaggatatcttgcccctgtatggcgacacatcgcagagaccatccgagggccgcttgagtctggatagtcaagagggagactctgggctggattccggtacagagaggtttccatcactgtccgagtcacttatgaaccggaactctgttctgagcgacccaggactagactccccccgcaccagccccgtcataatggcccgggttgcccagcaccacaggcggcaaggaagtgacgctgcggttccttccaccggcgatcagggcgtcgatcagagccccaaaccccttattatcggtccagaggaggattatgaccctgggtatttcaataacgaatccgacattattttccaggatcttgagaaacttaagtccaggcctgcccatttaggggtgttcctgcgttacattttctctcaggcggatccctcaccccttctcttttatctgtgcgcagaagtgtatcagcaggcctctcccaaggattcacgaagcctcggaaaggacatctggaatatatttctggagaaaaatgccccactcagggtaaagatccctgaaatgttacaggctgagatcgacagccggctgcgtaactcggaggatgccagaggggtgctatgtgaggcccaggaggcagctatgcccgaaattcaggaacagattcacgattataggaccaaacgtacgctcggactgggctccctgtacggagaaaatgacttactcgacctcgacggcgatccccttcgtgagcgccaagtcgcagagaagcagctggctgccttgggagacatcctgtcaaagtatgaagaagatcggagcgcccctatggatttcgctctcaacacatacatgtcacacgcgggaatcagattgagagaagcccgccccagtaatactgctgaaaaagctcaatctgcacctgataaggacaaatggctgcctttcttcccgaaaactaaaaagtctagcaatagtaaaaaggaaaaagacgcactggaggataaaaagcgaaatccgatcttgaaatacattggaaagccgaagtcgtcgtctcagagcactttccacatacccctctcacctgtcgaagtcaagcccggcaacgtgagaaacatcattcagcatttcgagaataatcagcagtatgatgcacccgagcccggcactcagcggttgtcaacaggtagctttcctgaagacttattggaatccgattcaagtcgatcagagattcggctggggcgctcggaatcgctgaaaggacgggaggagatgaagcgctctcgtaaagctgagaacgtgcctcgctcacgatctgatgtggacatggatgccgccgccgaggcaacgcggctgcatcaatcagcaagcagtagtactagttccttatctaccagatccctcgagaatccaactccgccttttaccccaaaaatgggaaggagatcaatcgagagtccatccctgggattctgtacagacaccctgctgcctcatctgttagaggatgacctgggacagttgagcgatttggaaccggagccagatgctcaaaattggcaacacacggtgggcaaagatgtagtagcggggcttacccaaagagaaatcgaccgccaagaggtgatcaacgaactattcgtgactgaagcctctcatttaaggaccttgagggtccttgatttaatcttctaccaacgtatgaaaaaagaaaatctcatgccccgagaagagcttgcgaggctatttccgaacctgccagagctaattgaaatacataacagttggtgcgaagccatgaaaaaattacgggaagaggggcccattattaaggaaatctcagatctgatgctcgcccgcttcgacggtcctgcaagagaggaacttcagcaggtggcggcccaattttgcagctatcagagcattgccctcgaactcataaaaaccaagcagagaaaggagagcagattccagctgtttatgcaggaagcagagtctcacccacaatgtcggcgactgcaactccgggatctgatcatcagcgagatgcagagactaaccaaatacccccttctgctcgagtcaattattaagcataccgaagggggcacgtccgaacacgagaagctgtgccgcgcacgcgaccaatgcagagaaatactgaagtacgtcaatgaagctgttaaacaaactgagaacagacatagacttgaaggctaccagaaacgccttgatgccactgctttagagcgcgcctccaatccattggccgccgagttcaagtctctggatctcaccactaggaaaatgatacatgagggtccattgacttggcgcattagcaaagacaagacacttgacctccatgtgctgttgttggaggacctgttagtgctattacaaaagcaggatgaaaagctgctcctgaaatgccactccaaaaccgccgtgggctcttctgacagtaagcaaaccttttctcccgttctgaagctgaacgcagtgctgatcagatctgtggccaccgacaagcgtgcattttttattatctgtaccagtaaactgggtccaccacagatctatgaattggtggcactgaccagttctgataaaaatacatggatggaattgctagaagaagccgtacggaacgcaaccaggcatccaggcgcagcgcccatgcccgtccacccacccccaccagggccaagagagccagcgcagcagggacccaccccctctagggtggagttggatgactccgatgtcttccacggcgagcccgagcccgaagaactacccgggggcaccggctcccagcagcgtgtgcaagggaagcatcaggtgttgcttgaggatcctgagcaagagggatccgccgaagaggaagaactgggcgttctgccctgtccgtctacgtctctagacggggagaacagagggattagaacaaggaaccccattcacctggccttccctgggcccctcttcatggaaggactcgcggattccgctctggaggatgtcgagaacttacgtcacctcattctctggagtcttttaccagggcacaccatggaaacccaggcagcccaggaacctgaggacgacctgacgcctactcccagtgtaatctccgttacatctcatccatgggatcccggcagccctgggcaggcaccccccggaggagagggtgataacactcaactggctggattggaaggggaacgcccagagcaggaagacatgggattatgcagtctggagcatctgccgccccgaacacgcaactccggtatctgggagtcacccgagctggaccggaatctggctgaggacgcctccagtacggaggccgccggtggttacaaggtcgtccgcaaggccgaagtcgctggcagcaaggtagttcctgctcttccggagtccggacagtccgagcctggtcccccagaagtggaggggggtactaaagcaaccgggaactgcttctatgtttcgatgccttccggccccccggatagcagtacagatcactctgaggctcctatgtctcccccccaacctgattcactgccagcgggacagactgagccccagccccagcttcagggtgggaacgacgacccacgaagacctagtcgctcccctccctcgctcgccctgcgtgatgtgggtatgatcttccataccatagaacagttgactttaaaactcaacagacttaaagatatggagctggcccaccgtgaactgcttaagagcttaggcggtgagtcttccggcgggaccacgcccgtaggttcctttcataccgaagccgcccgttggacggacggcagcctatcccccccggctaaagaaccactggcctccgattctaggaattctcatgagctcggcccctgtcccgaagatggctcagacgccccattagaggattccaccgccgatgcggcagcaagtccgggaccatag

SEQ ID NO: 29574 - DNA, 4689 bp, Artificial Sequence
  Description of Artificial Sequence: Synthetic coding sequence
atgtcagtgcggctccctcaaagcatagatagactgtcttctctctctagtctcggggatagcgctcctgagcgtaagtctccctcccatcacaggcagccttcagatgcatcagagacaaccgggctggtccagagatgcgtgattatccagaaagaccagcacggatttggcttcactgtgtctggtgatcggatcgtgttggtccaatccgtcaggcccggtggcgccgccatgaaagccggagtaaaggaaggagaccggatcataaaggtgaacggcacgatggtgaccaactccagtcatctcgaggtggtgaaactgatcaagtcaggggcttacgttgcactgactctgctgggtagttccccgagtagtatgggcatctccgggctccagcaggaccccagcccagccggtgcgccgaggataacaagtgtaattccttcacccccacctcctccaccactcccccctccccagcgaattaccggtccaaaacccttgcaggatccagaagtgcagaagcacgcgacacaaatcctgcgcaatatgctgagacaggaggagaaagaactgcaaagaatttgtgaggtctattcccgcaaccccgcttccctcctggaggagcaaattgagggagcccgaagacgggtcacacaactacaactgaaaatacaacaggagacaggcgggtccgtcgatattcttccactttacggcgatacgtctcagcggcctagtgaaggcagactgagccttgattctcaggaaggcgattcagggctggactctggcacggagagatttccatccctttccgagtccctgatgaacaggaattccgtgctctctgatcccgggctcgattcccctcgcacttcccctgtgattatggctcgggtggcacagcatcatcggaggcaaggctctgacgccgctgtcccttccaccggggaccagggagtggatcagtcccccaagcccctgatcatcgggccggaagaggactatgatcccggatactttaacaatgagagcgatataatctttcaggacctcgagaaactgaaatctcgcccggcgcacttaggagtttttcttcggtatattttttcccaagccgacccttctcccttgctattctacctgtgcgcggaagtgtatcagcaggcctctcccaaagattctaggtcgttgggcaaagatatctggaatatatttctcgagaaaaacgcaccgttgagagtaaagatccctgaaatgttgcaggcagaaatcgattccaggttgcggaatagtgaggacgcccggggcgtgctgtgcgaggcccaagaggctgccatgccggagattcaggagcagatccacgattaccgcacgaagaggaccctaggcctgggctctctctatggcgagaacgacctgcttgatctcgatggcgatcccctgagagagagacaagtggccgaaaaacagctggctgctctaggtgatattctcagtaaatacgaagaagaccggagcgcaccgatggacttcgccttgaacacctatatgtcccatgctggtatccggctgagggaagctagaccatcgaatactgcagagaaagcccagtcagcccccgataaagacaagtggttacccttttttcccaaaactaaaaaatccagcaacagcaagaaagagaaggacgcattggaggataaaaagaggaatccaatcctcaagtatataggcaagccaaaatcttccagccagagcacattccatattccgctgtccccagtggaggtgaagccaggaaatgtacgcaacataatccagcatttcgagaataatcaacagtacgacgctccagagcctggcacacagaggctgtccacaggatcatttccagaggatctgcttgagagcgactcttccagatcagaaatcaggcttgggcgcagcgagagtttgaagggaagagaggagatgaagcgatctcggaaggcagagaacgtccctagaagcaggagtgacgtggatatggatgctgctgcagaggccaccagactgcaccagtcagcatcttcttctacgtcgtctttgagtacccgaagcctcgagaatcccacacctccatttacgccaaagatgggaaggcgctcaattgagtctccatcactgggcttctgcactgatacccttctgccccacctgctggaggatgacctggggcagttgagcgacctcgaacctgagcccgacgcccagaattggcaacacacggttggcaaagatgtcgtcgccggattaacacaacgggagatagatagacaggaggttatcaacgaactgtttgtcacagaagccagccacctccgcaccctccgggtactagatctgatcttttatcagaggatgaagaaggaaaacttgatgccacgggaggaattagctagattatttcccaacttgcccgagcttatcgaaatccataactcgtggtgtgaagccatgaagaagctccgggaagaaggcccaattattaaggagatcagcgacctcatgctcgctagattcgacggtcccgctcgtgaggaactccagcaggtggctgcccagttctgttcgtatcagtcaatcgccttggagcttatcaaaaccaagcagcgtaaagagtctaggtttcagctgttcatgcaagaagcagagtcacacccgcaatgtcggaggctgcagctgcgggatctgattattagcgagatgcagagactgacaaagtatcccctgctgctggaaagcattatcaagcatacagaaggcgggacctcagagcacgagaagctgtgccgcgcgagggaccagtgtagagagattctgaagtacgtgaacgaggcagtgaagcaaactgagaatcgacaccggctcgaggggtatcagaagcggcttgacgctactgcactggagcgggcctcgaacccgctagccgcggagtttaaatcactggacctgacaacccgcaagatgatccacgaaggcccattgacttggagaatctcaaaagataagacccttgatctgcacgtgttgctcctcgaggacctgttggtcttattacagaaacaagatgagaaactactgttgaagtgtcattcaaaaaccgccgtaggatcaagcgacagtaagcagacgtttagcccggttcttaagcttaatgcagtactaatcaggagcgtggccactgataagagagcgttcttcataatttgcacgagcaagctcggcccgcctcagatctacgagctcgtggccttaacctcgtctgacaaaaacacatggatggagcttttagaagaggccgtgcggaatgcgacacgacacccgggtgccgctccgatgcctgtccaccccccaccacctggtcctagagagcctgcccaacagggacccaccccgtcaagggtcgagctcgacgactccgatgtgtttcacggggagcccgagcctgaggaattgccagggggaactgggtctcagcagagagtccagggaaagcaccaagttctgctggaggatcctgagcaggaagggtctgccgaggaagaagaactcggcgtgctcccatgcccttctacgagcttagacggagagaatcgcggaattcgcaccaggaatcccatccacctggcgtttcccggccctctttttatggaagggttggcggacagcgcactggaggacgtggagaatttaaggcacctgatactctggtcccttcttcccggccataccatggagacccaagcagcgcaagagcctgaggatgacttgacacctacgccctctgtgatcagtgtgactagccatccgtgggacccgggcagcccaggacaggccccaccaggcggagaaggggacaacacccagctcgctggtctggagggggagaggcccgaacaagaggacatgggactgtgctcgctggagcatttgcccccccggactcggaatagtggcatttgggagtcccctgagctggatcgcaatttggctgaggatgcctcttctactgaagcggcaggaggctacaaggtagttagaaaagcagaagtcgccggatccaaggtcgtcccggccctgccagaatcaggccagtccgagccaggtcctcctgaggttgaggggggcactaaggcgaccggcaattgcttttacgtgagtatgccttctggcccccctgacagttctactgatcattccgaggcccctatgagcccaccccagcccgacagcctgcccgctgggcagacagaacctcagccccagctccagggtgggaacgacgacccaagacgcccatccaggagccctccctctcttgcactgagggacgtgggaatgatctttcacactattgaacaactgacgctaaagttgaatagactgaaggatatggaattagcccacagggagctgttgaaaagcctgggaggagagtctagcggcgggacaacacccgtaggatcattccacacagaggctgccaggtggactgatggctcactaagcccacctgccaaggagcccttagccagcgatagtaggaattctcatgaattaggcccctgccctgaggatgggtccgacgccccactggaggactccaccgccgacgctgcagctagccctggcccttag

SEQ ID NO: 29575 - DNA, 1743 bp, Artificial Sequence
  Description of Artificial Sequence: Synthetic coding sequence
atgagaggaggacacaagggaggcaggtgcgcgtgccctcgggtgattcgcaaggtccttgctaagtgcggatgctgctttgcaagaggaggccgtgaatcgtatagcattgccggatccgaaggaagcatcagtgccagtgccgcgagtggtctagctgcacccagcgggccatcttccggtttaagtagtggtccatgctctccggggccaccgggacccgtgagcggcctccgccggtggcttgaccacagcaaacattgtctgtcagtagagaccgaagcagatagtggacaggcgggtccttacgagaattggatgctagaaccagcccttgccaccggggaggagttacctgagctgaccctgctgactaccctcctggagggaccaggagacaagactcagcctccagaagaggaaactttgtctcaagcccccgagtcggaggaagagcagaaaaaaaaggccttagaaagatctatgtatgttctttccgaacttgtagagactgagaagatgtatgtcgacgatcttggtcagattgtggaaggctacatggcaacaatggccgctcaaggcgtgccagagagtctccgcggcagggatcgaattgtatttggaaacatccagcagatttacgagtggcaccgagattactttctgcaggagctgcagcgctgtcttaaagacccagattggctcgcccagctgttcatcaagcatgagcgaagattgcatatgtacgtggtgtactgccagaataagcccaagagcgaacatgtggtatcggaattcggagattcatacttcgaggaactccgtcaacagcttggtcatcggttgcagctgaatgaccttcttataaaacccgtgcagagaataatgaagtaccagctcctgttgaaggatttcctgaaatactacaaccgtgccggtatggatactgcagacttagagcaggccgtcgaggtcatgtgtttcgtgcctaagcggtgcaatgacatgatgactcttggcaggctgcgaggctttgagggaaagcttactgctcagggcaaactcctagggcaagataccttttgggtgaccgagcccgaggcaggcggccttttgtcttcacggggacgcgagcgacgggtgtttctcttcgagcaaattataattttctcagaggcactgggcggcggggtcagagggggcacccagcctggctacgtttacaagaactccatcaaggtatcatgtctagggctcgaaggcaatttgcagggcgacccctgccggttcgctctgacatcccgggggcctgagggggggattcagcggtacgtgctgcaggctgccgatcccgctatatctcaggcctggataaaacacgtagcacagatactagagagtcagagagacttcctgaacgctctgcaatcccctatagaataccagagaagggaatcccagacaaactctttgggtcggccaagaggacctggtgtcggaagccctggccgcatccaattgggggatcaggcccagggttcaactcataccccaatcaacggctctctcccctctcttctgctctcccccaagggagaggtggccagagcgctccttcctctggataagcaagctctgggagacatccctcaggcacctcacgactccccccctgtttccccaacgcccaaaacccccccgtgtcaagctagacttgcgaaactggatgaagacgagctgtag

SEQ ID NO: 29576 - DNA, 921 bp, Artificial Sequence
  Description of Artificial Sequence: Synthetic coding sequence
atgcggagttccccagggctatgtagcccccctcctgaagaagaaacactctcgcaagccccagagtccgaggaggagcagaaaaagaaggccctagagcgcagcatgtatgtattgtctgagctcgtagagactgagaagatgtatgtcgatgacctgggacagatcgttgaggggtatatggccacgatggccgcccagggagttcccgagtcgctacggggccgtgatagaatagtttttggcaatattcagcagatatatgagtggcacagggactactttctccaggaactccaaaggtgtcttaaggacccagactggctcgctcagctgttcattaagcacgagagacggctgcacatgtacgtggtgtactgccaaaataagccaaagtctgaacacgtggtgagtgagttcggcgattcttattttgaagagttgaggcaacagctgggccaccggctgcagctgaacgatctgctgataaaaccagtccagcgtattatgaagtaccaactcctgctgaaggattttctgaaatactacaacagggccggcatggacactgccgatttagaaggtaaactgacagcgcagggcaaactacttgggcaggatacgttttgggttactgaacctgaggccgggggcttgttaagtagcaggggcagagagcgaagagtgttcctgtttgagcagatcattatctttagcgaggcactgggcggcggtgtgcgcggcggcacccagcctgggtacgtctataaaaattctatgcggcaggtcttctgtcaaatgcaagagctcccacagctgtggcatattagcagggtcgatttcgtacggaacgccattacgccccggctgcccccattgatcctactggcctccccggcatctgctttgaaccaaacatag

SEQ ID NO: 29577 - DNA, 1860 bp, Artificial Sequence
  Description of Artificial Sequence: Synthetic coding sequence
atgaaacctccagatcgtcccgcacctggccggactgatcggattttgggagtgatgggaggaatgctgagagcctgcgctctgcccggccaagagggacccccaaggcgcagccccctcggactcgtgggaactgaaccggagtctgagagaactgaaggagatcataggcgagatagagaacatgaagtgctcgccggcgcattgcagcccgagtcctattctatcgctggctctgagggatccatctctgcatccgctgccagcggactggccgcgccgtcaggtccaagcagcgggctctcgtctgggccctgcagtccggggcctcccggaccagtgtccgggctccgaagatggctggaccactcaaagcactgtctcagtgtggagacagaagcggattccgggcaggcgggcccttatgagaactggatgctagaaccggcactggccacgggggaggaactgcccgagttaaccctgttaacaaccctcctggaagggcctggtgacaaaacccaacccccagaggaggagactctatctcaggcacccgagagcgaagaagaacaaaaaaagaaggctttggagcggagtatgtacgtactgagcgaactggtggagactgagaaaatgtatgttgacgaccttgggcagatcgtcgaggggtacatggcgacgatggctgcacagggggtgcccgaaagtttgcgcggtcgcgacaggatcgtgttcggcaatattcagcaaatttacgagtggcaccgggactatttcctccaagaactgcagcgctgtcttaaggacccagactggttggcccagctgttcatcaagcatgagcgacgtctccatatgtacgtggtgtattgtcagaataaacccaaaagcgaacacgtggttagtgaattcggcgattcctatttcgaggaattaaggcagcagttaggacataggcttcagctcaacgatctgttgattaagcccgtgcagagaataatgaaataccagcttctgttgaaagacttcttgaaatactataatcgggctgggatggacacagcagatctggaacaagccgtggaggttatgtgtttcgtacccaagcggtgtaatgacatgatgacgctggggcggctgcgcggttttgaaggcaagctgactgctcaaggcaaattactggggcaggacacgttttgggtcaccgagccagaagcaggcggactgctgtcaagtaggggcagagaacggagagtgttcctttttgaacagattattatattctccgaggccctcgggggtggtgtgaggggcggcactcagccaggctatgtttacaagaactctatcaaagtttcctgtctcggactcgagggcaacttacagggtgatccatgtagatttgctttaacctcccgcgggccagagggagggattcagagatacgtgcttcaggccgccgaccccgccatatcccaggcctggatcaagcatgtggcacaaatcctggaatcccaacgagacttcttgaacgcgctccagagccccatcgagtaccagcgccgcgagagccagaccaactcccttggtcggcctcgggggcccggggtcggtagccctggcaggatccaactaggtgaccaggcccagggttccacacacacccctattaacggctctctcccttctctgcttcttagcccgaagggagaagtagcccgcgctctcttaccgttagacaaacaggcattgggtgacataccacaggcgccacacgacagcccacctgttagccctacccctaagactcccccttgtcaagctaggctagcaaagctggacgaggacgagctgtag

SEQ ID NO: 29578 - DNA, 5064 bp, Artificial Sequence
  Description of Artificial Sequence: Synthetic coding sequence
atggagctttcttgttctgaagcaccactgtacggccaaatgatgatctacgccaagttcgataagaatgtgtacctcccagaagacgctgagttctactttacctacgatgggtctcaccagaggcacgtgatgattgcggagagaatcgaagacaacgtccttcagtcctcggtgcctgggcacggactgcaagagacagtgacagtgtctgtctgtctttgctccgagggatattcgcctgtcaccatgggtagtggctcagtcacttacgtggacaatatggcgtgcagattagctaggctgctagtgacccaagctaaccggctgaccgcatgcagtcaccagactttactgacaccgttcgctctcacagctggggccctcccagctctcgatgaagagctcgtgctggctctgacccacctcgaactccctcttgagtggacagtacttggctcctctagtcttgaagtgagctcacatagggagagcttattgcaccttgcaatgcggtggggactggcaaaactgtctcagttcttcctgtgcctccctgggggagttcaagcattggccttgcccaacgaggaaggagccactccgcttgaccttgcattgcgcgaggggcatagtaaactggtagaggacgtgaccaactttcagggacgatggtcaccaagcttctccagagtgcaactctcagaggaggcatctttacactacattcactcgtccgaaacactgactctaacccttaatcatacagcagaacacctgctggaggctgacataaagctattccggaagtatttctgggatagagcattcttggtaaaggcctttgaaccggaggcccgccctgaggagaggacggccatgccatcttctggtgctgagacagaagaggagatcaaaaactctgtatccagccggtcggcagcagagaaggaagatataaaacgagtaaaatccctagtagtgcagcataatgagcatgaggaccagcactccctggatctagaccgatcattcgacattctgaaaaagtccaaacccccttctaccctgctcgcagctggccgactgtcggacatgctaaacggaggcgatgaggtctatgctaattgcatggtaatcgaccaagtcggagatctggacatctcctatattaatattgaaggtatcacagctacaacttcccctgagagtcgcgggtgcactctatggccccaatcaagcaaacatacattacccacagaaacctcaccctcagtttatcccctgtctgagaatgttgaaggcaccgcccacactgaagcacagcaatcgttcatgagtccttcatcctcgtgcgcgtctaacctgaacttgagttttggctggcatgggtttgagaaagaacaatctcacttaaaaaaacgctcttcatctcttgatgcgctcgatgcagactccgagggagaaggacattccgagcctagccacatctgttatacgcccggaagccagtcaagttccagaactggcattccatccggagatgaactggactcctttgaaacaaatacagagcccgattttaacatcagtagggcagaaagtctcccactttctagcaacctccaatctaaggaaagtctgctgagtggagtgcggtcccgctcctactcatgctctagtcccaagattagcttgggcaagacccggcttgtccgggagctgacagtctgtagctcttccgaagagcagagggcctactctctgtccgaaccaccgcgagaaaacagaatacaggaagaggagtgggataaatacattattcccgccaaatcggagtccgaaaaatacaaagtatcacggaccttctccttcctgatgaaccggatgactagtcctcggaacaaatctaagacgaagtctaaggacgccaaggacaaagagaaattgaataggcaccaatttgctcccgggacatttagcggagtgctccaatgcctggtttgcgacaagactctactcggcaaagagtcgttacagtgtagcaactgcaatgccaacgtccacaagggatgtaaagatgccgctccagcttgcactaagaagttccaagagaaatataacaaaaataagccccagactatcctcgggaattcctcattccgggacattccacagcctggcctatcgctccacccatcatcctctgttcctgtgggccttccaaccggccgccgagagactgtgggacaggtccaccctctgagcagaagcgtgcctgggactactttggagagcttccgtcgctctgcgacctctctcgagtccgagagtgaccacaacagctgccggagtaggtcgcactcagatgagctgcttcagtccatgggtagcagtcccagcacagagtcattcatcatggaggacgtggtcgactctagcttgtggtccgacctctcatccgacgcacaggaatttgaagccgaaagctggtccttggtggttgacccaagcttctgcaaccggcaggagaaggatgttattaaacgccaggacgtcattttcgaactgatgcagacagaaatgcatcatatccagactctgttcataatgagtgagattttccgtaagggcatgaaggaggaacttcaactggaccatagtaccgtagataagatctttccatgtcttgatgagctgctggagattcacagacactttttctattctatgaaagagagaaggcaagaatcgtgtgctggtagtgaccgaaatttcgtaatagaccggatcggggatattttagtgcagcagttttctgaggaaaacgcatccaaaatgaagaagatttacggcgaattttgctgccaccacaaggaggcagtcaacctattcaaggagctgcaacaaaataaaaagttccagaatttcatcaagttgcgtaattccaatttgctggcaagacgacgcggcattcctgaatgtattcttcttgtgacacagcggattacaaaatacccagtgcttgtggagaggattctgcagtataccaaagagcgtacggaggaacataaggacctgcggaaggcgctttgtttgatcaaggacatgattgccaccgtcgacctgaaggtcaatgagtacgaaaaaaatcagaagtggctggagattctgaataaaattgagaataagacatacacgaagctcaagaatggccacgtgttccgcaagcaggcgctgatgagtgaggaacggacactgctgtacgatggtctggtctactggaaaacggcaactgggagattcaaggacatacttgccctactgctcacggacgtgttgcttttcctgcaagaaaaggaccagaagtacatttttgctgcggtcgatcagaaaccgagcgtgattagcctgcaaaagctgattgcacgggaggtagccaatgaagagcgcgggatgttcctaatctcggcaagttctgcagggccagagatgtacgagattcacaccaacagcaaggaggaacgcaacaattggatgcggagaatccagcaggcagtggaatcttgtcctgaagaaaagggtggtaggacatccgagtcagacgaggataaaagaaaggccgaggcacgggtggccaagatccaacagtgtcaggagattctgacaaatcaagatcagcagatctgcgcctacctggaggaaaaactgcacatctatgccgaactaggggagcttagcgggtttgaagatgtacatctggagccccaccttctgatcaaacctgatcctggcgaaccaccccaagccgccagcctgttagctgccgctctcaaggaggctttagtcactggcggcagagaggggcgcggatgttcagacgttgaccccgggatccaaggagttgtgacagacctagccgtttccgatgcaggggaaaaagtcgagtgtagaaactttcccgggtcatcacagagcgagatcatccaggccatccaaaacctcacacgcttgttatactcgctgcaggcagccctgacaatccaggacagccacatagaaatccaccgcctggtgctccagcagcaggaagggctgagtttgggacactctattctacggggaggcccacttcaagaccagaaatcacgagatgccgatcgacagcatgaggaactggccaacgtccaccagcttcaacaccaactgcagcaagagcaacgaagatggcttcggaggtgcgaacaacagcagagagctcaggccacccgtgagtcttggttacaggaacgcgagcgcgaatgccagagccaggaagagttgttgttgaggtccagaggcgaactggatctccaactgcaagagtaccagcactcactggaacgcttgcgagagggccagaggctcgtagagagggaacaggccaggatgagggcgcaacaaagtcttcttggccattggaagcacggcaggcagaggtcactcccggctgtgctgctgcccggcggacccgaggtcatggagttgaatcgctcagaaagcctgtgtcacgaaaactcttttttcattaacgaggccctcgtgcagatgtctttcaataccttcaacaagctaaaccctagcgtgatacaccaagacgctacctaccccactactcagagtcatagtgatctggtcaggacctccgaacaccaggtggatctcaaagttgaccccagccagccttctaacgtctctcataagctctggacagccgccgggtcagggcaccagatcctcccgtttcacgaaagtagcaaagacagctgtaaaaatgggagctccatgaccaagtgctcctgtactctcacttctcccccaggcctttggacagggaccacatcaactttgaaggacttggacacttcgcacactgagagccctaccccgcatgacagtaactcccacagaccacaacttcaggccttcataactgaggctaaactgaacctgcccacacggactatgacacgacaggatggcgaaactggtgacggcgctaaggaaaacattgtgtatctctag

SEQ ID NO: 29579 - DNA, 4956 bp, Artificial Sequence
  Description of Artificial Sequence: Synthetic coding sequence
atggaactgtcatgttccgaagctccactttacgggcaaatgatgatatacgcaaagtttgacaaaaacgtgtacctgccggaagacgctgaattttatttcacgtatgacggttcccaccagcgccacgtgatgatagcagagcgtattgaagataatgtactgcagagctcagtccccgggcatggcttacaggagactgtgaccgtctctgtttgtttgtgttctgagggctatagtcccgtgacaatgggctcgggcagcgtaacctacgtcgacaatatggcctgtaggctggcgcggttgctggtgacacaagcgaaccggttgacggcgtgtagtcaccagacacttctcaccccattcgcactaactgccggagctttacctgcactggacgaagagctcgtcctggccctgactcatctcgaactgcctctggagtggacagtactgggctcttcatctctggaggtttcttcacacagagagtctctgctgcacctggctatgcggtggggcctggccaagctttctcaattctttctgtgtcttccagggggcgtccaggccctggctctgccaaatgaagagggagccacacctctggatttagcactaagggaaggacattccaagttggttgaggacgttaccaactttcaggggcgttggtcacctagcttttcacgcgtacagctctccgaggaagcgtccctgcactacatacatagttcagaaactctgacactgactcttaatcatactgcagaacacctcctcgaggccgacattaagctgttccggaaatacttttgggaccgtgcgtttctggtaaaggccttcgagcctgaagcccgcccggaggagagaactgcaatgccttcgtcaggggccgaaacagaggaggaaataaagaactcagtcagcagtaggagcgccgctgaaaaggaggacattaaacgagtgaaaagtctagtggttcagcataacgaacatgaggatcagcattctctggatctggatagaagctttgacatccttaaaaagagtaaacctcccagtaccctgctcgcggcagggcggctgagcgacatgctgaatggcggcgatgaggtttacgccaactgcatggtgatcgaccaggtaggggatttggatatcagttatatcaatatcgaagggatcaccgccacaacctcaccggaaagcaggggatgtactttgtggccccagtctagtaaacacacgctgcccaccgaaaccagcccctcagtgtacccactcagcgagaacgtggaagggacagcgcatactgaagcccaacagtcgtttatgagccccagttcaagttgcgccagcaacctgaacctcagttttgggtggcacgggtttgagaaggagcagagtcacctgaaaaagagaagcagctccttggacgccctggatgcagatagtgaaggggagggacactctgagcctagtcatatatgctatacccctggatctcagtcgtcctctcggaccggaataccttcaggcgatgaactcgattctttcgaaaccaataccgagcctgacttcaatatcagtcgcgccgagagtctgcccctctcatccaacttacaaagtaaagaaagtctgctttctggagtaagaagtcggtcctactcgtgtagctctcccaagatttccttgggcaagacaagattggtccgggagctcacagtgtgctcttccagtgaggagcagagggcttacagtctgtcagaacccccaagagagaaccggattcaggaggaagagtgggacaaatatattatcccagccaagagcgaatccgaaaagtataaggtgtctaggacgttttccttcctaatgaataggatgacatcacctcgaaacaagagtaagaccaagagcaaggatgctaaagacaaggagaagctcaaccgccaccagtttgcccctggaacattcagcggcgttctgcagtgtctcgtgtgcgacaaaactctgctcggcaaggaatcccttcagtgttcaaattgcaacgccaatgtgcataaaggctgcaaagatgctgcacctgcctgcacaaagaaattccaagagaaatacaataaaaataaaccccagaccattttaggcaactcatccttccgcgacatcccacagccagggctgagcctgcatccctcttcctctgttcctgtcggcctgcctacaggccggagggagacagtggggcaggtccatccactctcaagaagtgtgccgggaaccaccctagagagcttcaggaggagcgccacatccttggaaagtgaatccgaccacaattcatgtcgctcgcgctctcatagcgatgaactccttcagtccatggggtcaagtccctccaccgagtcctttatcatggaagatgttgtagatagttccctctggtctgacttgtcctcagacgcccaggagttcgaggctgagtcttggtctcttgtggtggacccttccttttgcaatcggcaggagaaagacgtgattaagcgccaggacgtgatctttgaactgatgcagaccgaaatgcatcacatccagactctgtttatcatgtccgagattttcagaaagggcatgaaggaagagctgcaactggaccactccaccgtcgataagatttttccttgcctcgacgaattgcttgagattcatcgccatttcttctatagtatgaaggaacgaaggcaggagtcctgtgctggaagcgataggaactttgtgatagatcgcataggggacatcttagttcagcagttttccgaagagaatgcttccaagatgaaaaaaatttatggggagttctgctgtcaccataaagaggctgtgaatctgtttaaggagctccagcaaaataagaagttccagaactttattaaattaaggaattctaatcttctcgcaaggcgacgcggaattcccgagtgtattctgttggtaacacagcggattacgaaataccccgtgctcgtggagcgcatactacagtacactaaggagaggactgaggaacacaaagatctaagaaaggcactctgtctgattaaggacatgattgccacggtggacttgaaggtgaatgagtacgagaagaatcagaaatggctggaaattctgaataagattgagaacaaaacctatactaagctgaagaatggtcacgttttccgcaagcaagcgctgatgtccgaggagagaaccttactttacgacggccttgtttactggaagaccgcaacaggaagatttaaagacattctcgcactgcttctaacagatgtcctgctgtttctgcaggagaaagatcagaagtacattttcgccgccgtcgatcaaaagcctagcgtgatttcactgcagaaactaattgcccgggaggtcgctaacgaagagaggggtatgtttctcatttcagcgagctcagccggccccgaaatgtacgaaatccacaccaattcaaaagaagagcgaaacaattggatgcgccgcatccagcaggccgtggagagttgccccgaagaaaaagggggtcgcacgagcgaatccgacgaagacaagaggaaggcagaggcacgtgtggcaaaaatccagcagtgtcaggagatcctcaccaatcaagaccagcagatctgtgcctacttggaggaaaaactgcacatatacgccgagttgggagaactttctggattcgaagatgtacacctggaaccacatttgctgattaagccagatccaggagagcccccacaggccgcctctctgttggcggcagcactcaaggaagcagagagcctccaagtcgcagtcaaagctagccagatgggagctgtttctcaaagttgcgaggactcatgcggcgactctgtcctcgcggacacactgtcttcgcatgacgtgccagggagtcccacggcttcgttggtgacagggggtcgcgaaggtcgtgggtgttccgatgtggatcccggtatccagggagtggttactgacctggctgtgagtgatgccggggaaaaggttgagtgccgtaatttccccggaagctcacagtccgaaattatccaggccatccagaatcttactaggttgttgtactcgcttcaagcagctctcactatccaagatagtcacatagagattcataggctcgtactgcaacaacaggagggattgtcactggggcactcgatcctgcgtggtggaccactgcaggaccagaagagtcgggacgccgatcggcagcatgaggagctagccaacgtccaccaacttcagcaccagctgcaacaggaacagcgcagatggctcaggcggtgtgaacagcagcagcgagcccaagccacccgggagtcatggctgcaagagagagagagagaatgccagtctcaggaggaactgttgctccggtctcggggtgagctcgaccttcaacttcaggagtatcagcatagcctggagcgcctacgcgagggtcagagactggtggaacgtgagcaggcgagaatgcgggctcagcagtctctcctcggccactggaagcacggaaggcaacgctccctcccggccgttttactgcccgggggaccagaggtcatggaactgaatcgctccgaaagcctttgccacgagaactccttcttcatcaacgaagccttggtccagatgtctttcaacacctttaataaactcaatccctcggttatccaccaggatgctacctacccaaccacccaatcccattccgatcttgtgagaacttcagaacaccaggtggatctgaaagtcgatccctcccagccttcaaacgtgtctcataaattatggacagctgctgggtcagggcaccaaatcctccccttccatgaaagttccaaggatagctgcaagaatggtaactag

SEQ ID NO: 29580 - DNA, 5118 bp, Artificial Sequence
  Description of Artificial Sequence: Synthetic coding sequence
atggagctgtcttgttcagaagctccgttgtacggccagatgatgatctatgccaaatttgataaaaatgtctatttgcctgaggatgcagagttttattttacttatgatggcagtcaccaacgccacgtcatgattgcagaaagaattgaagataacgttctgcagagtagtgtaccaggtcacggcctgcaggagacagtgactgtaagcgtgtgtttatgtagtgagggttactctcccgttactatgggctcgggctctgtgacatacgtggataatatggcctgccggctggcgagattgctggtgactcaggcgaacaggctcacagcctgttctcaccaaaccttattgactccatttgcactgacagccggtgccctccccgcgctcgacgaagaactcgtactggccctgacccatctcgaactgcccctggaatggactgtccttgggtccagttccttggaggtgtcctcacatcgggaatcattgttgcaccttgctatgcgctggggtctggccaaactgtcccagttctttctttgtctgcccggcggggttcaggcactggctcttcccaacgaagaaggagcaacaccgctggaccttgccctacgcgagggccacagtaagttagtcgaagatgtcacgaacttccagggcagatggtccccgagcttctctcgagtccagctgtcggaggaggcttccttgcactatatccactcctccgagactctcacccttactctgaatcatacagccgagcacttgctggaagctgacattaaattattccgcaagtacttttgggaccgagctttcctggtgaaagcatttgaacctgaagccaggcccgaggaacgaaccgctatgccaagctctggagccgagacggaggaagagattaagaattcagtcagctcccggagcgctgctgagaaagaggacataaagcgtgtgaaaagtctcgtagtccagcacaatgagcacgaagaccagcattcgctggacttggaccgtagctttgatatcttaaaaaagagcaaaccaccatctactttgctggctgccggcagactcagtgatatgttgaatggcggcgatgaggtctatgccaattgcatggttatcgatcaggtaggtgatttagacatctcgtacataaatatagaaggcatcaccgcaaccacatctcctgaatcccgggggtgtaccctgtggcctcagagcagcaagcacaccctccctactgagactagtccttcagtatacccactttcagagaatgtggaggggaccgcacacactgaagctcagcagtcctttatgtccccatcgagctcttgtgccagtaacttgaatttgtcatttggctggcatgggttcgaaaaagagcaatcacatctgaaaaaaaggtcctcatcattggacgcgctggatgcagattctgagggcgaggggcattccgaacccagccacatttgttacaccccaggcagtcagagctccagccggactggcataccctcaggcgatgagctggattcatttgagacaaacaccgagcccgattttaacatcagtcgcgccgagtctctcccactgagcagcaatctccagagtaaggaatcactgctgtccggggtgagaagccgaagttacagttgcagtagcccgaaaatctcacttggcaaaacaagactggtgagggagctgacagtgtgctcgagttctgaggaacaacgcgcttattcattaagtgaacctcctcgggaaaatcggattcaggaggaggagtgggacaaatatattattcctgcaaagtcggaatcggagaaatataaggtgagccgaactttttcttttctgatgaatcgaatgacctctccccggaataagagcaagacaaagagcaaggacgccaaagataaggagaaactgaataggcaccagttcgcccccggcacttttagcggcgtgcttcagtgtttagtgtgcgacaagactttgctcggaaaggaaagcctacagtgctcaaactgtaacgcgaatgtgcacaaagggtgtaaagacgccgctcctgcttgtaccaaaaaatttcaggaaaagtataataagaacaagccacagaccatattaggcaattccagttttagggatatcccccagcccggattgtctcttcatcccagttcttccgtgccagttggcttgccaaccggcaggagggagaccgtaggccaggttcacccactctctagaagcgttcccgggactactctggagtcattccgacgcagtgccacaagtctagagtctgaatccgatcacaactcatgcagatcaagatctcactctgacgagcttctccagtcaatgggctcctcaccatcaacagagtctttcatcatggaagatgtggtcgactcatccctgtggagcgatctttcaagcgatgctcaggaatttgaagctgaatcctggtcccttgttgtcgaccctagcttttgcaaccggcaggaaaaagacgttatcaagagacaggacgtgatctttgaactgatgcagactgaaatgcaccacattcaaaccctcttcatcatgagcgagatttttaggaagggcatgaaagaagagcttcaattggaccattccacagttgacaaaatcttcccgtgcctcgatgagctgttagaaatccatagacattttttctattccatgaaagagaggaggcaggaaagttgcgccgggtccgatcggaacttcgtgatcgatcgcatcggcgatattctggtgcagcaattctccgaagagaatgcatcaaaaatgaaaaagatttacggggagttttgctgtcatcacaaagaggctgtgaacctcttcaaagagttgcaacagaacaagaagttccagaattttataaagcttcggaactctaacctcctcgccaggagacgtggcattcccgaatgcattctgctcgtgacgcagaggatcacaaagtaccctgtcctggttgagcgcatcctgcagtacacaaaggaaaggactgaggagcataaggacctgaggaaggctctctgtctgatcaaagacatgattgcgacagttgatctgaaagtcaatgagtacgagaaaaaccagaaatggctcgagatacttaacaaaatcgagaataagacatatactaagttgaaaaacggccacgtgtttcgtaagcaggcactcatgtctgaggagcgaaccctattgtatgacggacttgtttactggaagactgcaactggcaggttcaaggatattctcgccttgctgctgacagacgtgctgctcttccttcaggaaaaagaccagaagtatattttcgccgctgtcgatcagaagcctagcgtgatctcgttgcagaagctcattgcgcgggaggtggccaatgaagaaaggggtatgttcctgatctccgccagctccgctggtccagagatgtacgaaattcacacaaattcaaaagaggaacgcaacaactggatgagaagaattcagcaggcggttgaatcctgcccagaagagaaaggcgggcggacatcggagtcagatgaggacaagcgtaaggccgaggcgcgggttgccaagattcagcagtgtcaagaaatcttgacaaatcaagatcagcagatttgtgcatacctggaagaaaaactgcacatctatgcagaacttggcgaactgagcggatttgaggatgtgcacctggaacctcacctgctgataaagcctgatccaggggagcccccacaggcagcatcccttctagccgctgctttgaaggaagcggaatccttacaggtggcagtgaaagcctcacagatgggggccgttagccagtcatgcgaggattcctgcggcgactcagtgctcgcggacacactcagttcccatgacgttccggggagtccaacagcatctctggtcactggaggacgggagggaagaggctgctccgacgttgaccccgggattcaaggagtagtcacggaccttgcagtctctgatgcaggcgaaaaggttgaatgtagaaactttccaggttcatcacaatccgaaattattcaggccatccaaaacctgacacggttactttattccctccaagccgcactcactattcaggattctcatattgagattcacaggttggtgctgcaacagcaggagggactgtccctcggacacagtatcctacggggaggcccattgcaggatcagaaatcccgggacgcagaccgtcagcatgaagaattagctaacgtgcatcagctgcaacatcagctgcagcaggaacagaggagatggctgaggcggtgcgaacagcagcaaagagctcaggccactcgggaatcatggctccaggagagagagcgcgagtgtcagagccaggaagaactgctcctgaggtcccgcggtgagttggatttgcaactgcaggagtaccagcattctttggagcgcttgcgagagggacagagactcgtcgagcgggagcaggccagaatgcgagcacagcaaagtctgctcggacactggaagcatgggaggcagaggagcctgccagctgtgctgctgcctgggggtcctgaggtgatggagcttaatcgatccgaatctctctgccatgaaaacagcttctttattaacgaggccctcgtgcagatgagtttcaacacgttcaataagttaaatcccagcgtcattcaccaggacgccacttaccccacaactcagagtcattccgatctggtgaggactagtgagcaccaagtcgaccttaaggtagacccttcccaacctagcaacgtgtcccacaagctgtggacagcagccggtagcggacaccagattctgccctttcacgagagtagcaaggattcctgcaaaaacgacttggacaccagtcacacagagagtccaaccccgcacgatagtaattcgcatcgcccccaattgcaagcattcattaccgaagccaaattaaatctgcccacacggaccatgacccgccaagatggggaaacaggcgacggggccaaggagaatatagtctatctctag

SEQ ID NO: 29581 - DNA, 252 bp, Artificial Sequence
  Description of Artificial Sequence: Synthetic coding sequence
atggagctcagttgttccgaggctccactatatggacagatgatgatttatgctaaattcgataagaacgtgtacctcccagaagacgcggaattttacttcacttatgacggatcccaccaacgacacgttatgatagccgaacgcatagaagataacgtgcttcagtctagcgtaccaggccacggattacaggaaaccgtaacagtgtcagtctgtctgtgttcagaaggttacagcccggtaacctag

SEQ ID NO: 29582 - DNA, 5118 bp, Artificial Sequence
  Description of Artificial Sequence: Synthetic coding sequence
atggaactgtcttgctccgaagcccccctgtatggacagatgatgatatacgctaagttcgataagaatgtgtacctgcccgaagatgctgaattttattttacttacgatggctcccatcaaagacacgtcatgatagctgaaagaatagaggacaacgtgttacagtcaagcgtgccagggcacgggctgcaggaaactgttacagtttcggtgtgcttgtgttctgagggctacagtcccgtaacaatgggctccggtagtgtcacatacgtggacaacatggcctgccggctagctaggctgttggtgacccaagcaaatcggctgactgcctgtagccaccaaacccttctcactccatttgccctcacggcaggcgctctgcctgcactggatgaggaacttgttctggcccttactcacctggaacttcccctggagtggactgtgctcggatccagttctttggaagtgtcctcacacagagagtccctcttgcacctggctatgaggtgggggctcgctaagctgagccagttctttctgtgcctgcccggaggtgttcaggcactcgctcttcctaatgaggagggagccaccccactcgatctagccctgcgggaagggcactcaaaattggtcgaggacgtcacaaatttccagggcagatggtctcctagtttttcacgggttcagttgtccgaggaggcttctctccattacatacactcatccgagaccctgaccctgacattaaatcataccgctgagcacctcttagaggccgacataaagctgtttcggaagtacttctgggatcgggcgtttttggtgaaggccttcgaaccagaggccagacctgaggaaaggaccgcaatgccttcctctggtgccgagacagaggaagagattaaaaattccgtgtcttcaagaagcgctgctgagaaggaagacataaagcgggtaaagtctctggtagtgcagcacaatgagcatgaagatcagcacagtctcgaccttgatagaagcttcgacatactgaaaaagtctaagcctccttctacactactggccgcgggtcgcctgtccgatatgttaaacgggggagacgaggtatatgccaactgtatggttatagaccaggtgggcgacctggacatctcctatatcaatatcgaagggattaccgccacgacgagccccgaaagccggggatgcactctatggccccagtcatctaagcacaccctgcccaccgaaaccagcccaagcgtgtatcccttgagtgagaatgtggagggaactgcacatacagaagcccaacagagttttatgagcccatctagtagttgcgcttctaatctcaacctgtcatttgggtggcacgggttcgagaaggagcagtcgcaccttaagaaacgcagcagtagcctggatgctttagatgctgactctgagggagaaggacactcagagccgtcccacatttgctatacccccgggagccaaagttcttcccgaaccggtatcccaagtggggacgagcttgactcttttgagactaatacggagcccgattttaatattagcagagcggagtcactgcctctgtcatcgaatttacagtcgaaagagtccctgcttagcggggtcagatcgagaagctactcctgctcatcacctaagatcagtctcggaaagacgagactggtacgcgagttgactgtctgctcgagttcggaagaacagcgtgcctacagtcttagcgaaccgcctagagagaatcgaatacaggaggaggaatgggacaagtacattatccctgcaaagtctgagagtgagaagtataaggtgtccagaactttctccttcctgatgaatcgaatgacatctccaaggaataagagtaaaaccaaatcaaaagacgcaaaagacaaggagaagttaaaccggcatcagttcgcccccgggaccttctccggtgtcctgcagtgcctcgtttgcgacaagaccctgctgggcaaagaaagcctgcaatgtagtaattgcaatgctaacgtccataagggatgtaaagacgccgcccctgcatgcactaaaaagttccaggaaaagtataataagaataagccccaaacaatactggggaacagcagctttcgggacataccccagccgggcttgagcctccatccatcttcttccgtgccagtcggcctgcccactggtcggagagaaacagtggggcaagtccatccactttctagaagtgttccaggcacaaccttagaaagctttcgtcgttccgccacctcattggaaagcgagtcagaccacaactcatgcaggagtcgttcgcattcagacgagttactgcagtctatgggatcttcaccttccactgagtcgttcatcatggaggacgtggtggattcttctttgtggtccgatctgtccagtgacgcacaggaattcgaggccgaatcgtggagtctcgtggtcgatccttcattttgcaacaggcaggaaaaagacgtcatcaaacgtcaggacgtgatatttgaactgatgcagacagagatgcaccacatccagaccctgttcattatgtcagaaatttttcgtaaaggaatgaaagaagagctgcaattggaccacagtactgtggacaaaattttcccttgcctcgatgagttgctagaaatacaccgccactttttctactcaatgaaggaacggcgtcaagagtcctgtgccggtagtgatcggaatttcgtcattgacagaatcggagacatcctggttcagcagttctctgaagagaacgcctccaaaatgaagaagatatatggcgaattttgttgccaccataaagaggcggtgaacctattcaaagaacttcagcagaacaagaagttccagaattttatcaagcttagaaactccaacctgctggctagaagaagaggcattcctgaatgcattttgttggttacccagagaatcaccaaatatccagtgctggttgagcggatcttgcagtataccaaggaacgtaccgaggagcacaaagatctgcgcaaggctttgtgccttattaaagacatgatcgcaacagttgacctcaaagtaaacgagtatgagaaaaatcagaaatggctggaaatcctcaacaaaattgagaataaaacctatactaaactgaagaatggacacgtctttcgcaaacaagccctgatgagcgaagaacgcactctactctacgacgggcttgtctactggaaaactgcgacaggccgatttaaggatatactagccctgcttttaacagacgttctgctgttcctccaggagaaggatcagaagtacatcttcgcagccgttgatcaaaaacccagtgtgatctctctgcaaaagttaatcgccagggaagtggcaaacgaagagaggggcatgttcctcatctccgcgtcctccgcaggtcccgaaatgtatgaaatccataccaatagtaaggaggagagaaataactggatgcgcagaatccagcaggcagtcgagagttgcccagaagagaagggtgggcgcaccagcgaatctgacgaggacaagcggaaagctgaggcgagggtggccaagatccagcagtgtcaggaaatcctaactaatcaagaccaacagatttgtgcatatttagaggagaaactccatatctacgcggagctcggggaactgagcgggtttgaggatgttcacctggagcctcaccttctcatcaagcctgaccccggggaacccccacaggccgcatctctcctcgcggctgcactgaaggaggccgaaagcctgcaggtggctgtgaaggccagccagatgggtgcggtttcacagagctgtgaggactcgtgcggagattctgtgctcgccgataccctctctagtcacgatgtgcccgggtcacctacagcctcacttgtcaccggcggaagggaggggcgagggtgttccgatgtggacccaggcattcagggtgttgtgacggatctagctgtcagtgacgccggcgaaaaggtcgaatgtagaaactttcccggaagtagccagtcagagatcatccaggcgatacagaatctcactcggttgctgtattcattgcaggccgcgctgacaatccaggacagtcacatagagattcatcgcttagttctgcaacagcaggaaggcctctctctgggccattctattctgcggggagggcccctgcaggatcagaaaagcagagatgctgatcgtcaacacgaagaactcgcaaacgtacatcaattgcagcaccagctccagcaggagcagcgaaggtggctccggcgctgtgagcagcagcagcgcgctcaagccacacgcgagtcgtggttgcaggaaagggaacgcgagtgccagagtcaggaagagctgctgctgcgttccagaggggagttggatctgcagttacaggaataccaacatagcctcgagagacttagagaaggacaacgattggtcgaaagagaacaggcacggatgcgcgcccagcaaagcctcctggggcactggaaacatgggcgccagcgcagcctcccagccgttcttctgcctggaggtcctgaagtgatggaactgaataggtccgagtctctttgccacgagaactccttttttatcaacgaggctcttgtgcagatgtccttcaacacatttaacaagctgaacccttctgtgatacaccaggacgcgacgtatcccacgacccagtctcactctgacctcgtaagaacctctgagcatcaggtcgatctaaaggtggatccaagccaacctagcaacgtttctcacaaattatggactgccgcgggttctggccaccagatcctgcccttccatgagagcagcaaagacagctgcaaaaacgacctcgacacaagccacaccgagagtcccacaccccacgacagtaatagtcatagaccccaactgcaagcctttatcaccgaggcaaagcttaatcttcccacccgcactatgactcgacaggacggcgaaaccggcgatggggcaaaagagaatattgtgtatctctag

SEQ ID NO: 29583 - DNA, 5196 bp, Artificial Sequence
  Description of Artificial Sequence: Synthetic coding sequence
atggagctgagttgtagtgaagcccctctgtatggccagatgatgatctatgccaagtttgacaaaaacgtgtatctgccggaggacgccgaattctattttacatacgatggcagccaccagcgccatgtcatgattgcggaacgaatagaagacaatgtcctgcagtcttcagtaccaggtcatggtctacaggaaacggtgaccgtcagtgtctgtctgtgttctgaagggtattctccagtcactatgggctcggggagcgtcacgtacgtggataacatggcgtgtcgactcgcccgactcctcgtcacccaggcaaataggctcactgcgtgcagccatcagaccctgctgaccccattcgcactcactgccggcgctttgcctgctctggatgaggagcttgtgctagccctgactcatcttgagctgccattggaatggactgttctcggctctagctcactggaagttagtagccatcgagaaagcttgcttcaccttgccatgaggtggggccttgccaagctcagtcagttcttcttgtgccttccaggcggcgtccaggctctagcattgcccaacgaggagggggcgacccccctggacctggctctgcgcgaggggcattccaagcttgtggaagacgttactaatttccaggggcgatggagtccttcattctcacgtgtgcagttatcagaggaagcgagcctgcattacatccattcctctgaaactttaacactcactctgaaccacactgccgaacatcttctggaagctgatatcaaactttttcggaaatatttctgggatagggcatttttggtgaaggcttttgagcctgaagctcgtccagaggagcggaccgctatgccatcctctggcgctgagacagaggaggagattaaaaatagcgtttcttctcgctccgccgctgagaaagaggacataaagcgcgtgaaaagtctggtagtccagcacaacgaacatgaagaccagcactcactggatttggacaggagctttgacatcttgaagaaatctaaacccccgtcaactcttctggccgctggccgcctgtccgatatgttgaatgggggcgacgaggtgtatgctaactgtatggttatagatcaggtcggagaccttgacatcagctacattaacatcgaaggcattacagcgactaccagcccggagtccagaggctgtacactttggccacaaagctctaagcacactttacccaccgagacctcacccagcgtttacccactttctgagaacgtggaaggtaccgctcatactgaggcgcagcagagtttcatgtcgccaagctcaagttgcgcctccaacctgaacctgtcttttggctggcacggctttgagaaggagcagtcccatctcaagaaaaggtcaagcagcctcgatgccctagacgcagattcagagggagaaggacactccgagcccagccacatctgttacacacccggttcgcagtcatcgtcacggaccggcattccctccggcgatgagctggattcgtttgagacgaacacagagcccgacttcaacatttcccgtgccgaatctcttccactctctagtaacctgcagtctaaagagtcacttttatctggggtccggagtcggagttacagttgctcatccccgaaaatctctctgggtaagacgcggctcgtccgcgagctgactgtttgcagctcctctgaggagcagcgtgcctattctttgtccgaaccgccacgcgagaaccgaatccaagaggaggagtgggacaagtacatcattcctgccaaaagcgagagtgagaaatacaaagtcagtagaacattttcgttcttaatgaacaggatgaccagccccagaaataagagtaaaacaaagtccaaggacgccaaagacaaggaaaagttgaacaggcatcagttcgcacctgggactttcagcggggtcctgcagtgtctggtgtgtgataaaacactgctgggtaaagagtcactgcaatgtagcaattgcaacgcaaatgtacacaaggggtgcaaggatgcggctcccgcttgtaccaagaagtttcaggagaaatacaacaagaataaaccacagacaattctgggaaattcctcctttagagacattccacaacctggacttagtctgcatccgtcttccagcgttccagtgggtttgcccaccggaaggcgagaaacagtggggcaagtgcatcctctgtcacggtccgtgccaggtactacgctggaatcattccgcaggtcagccacatctctggaatctgaatctgaccataacagctgtcggtcgcgcagccacagcgacgaactcttacaatctatgggttcctccccgtcaacagagtcatttattatggaggacgtcgttgactcttctctctggtccgacttgtcaagtgacgcccaggaattcgaagctgaatcttggagcctggttgttgacccttccttttgtaatcggcaggagaaagacgtgatcaagcggcaggatgtgattttcgaacttatgcagaccgagatgcaccacatccagaccctcttcattatgtcggaaatcttccgcaaaggcatgaaggaggaattgcagttagatcacagcaccgtggataagatcttcccctgtctggacgaacttctcgagatacaccgccatttcttttattccatgaaagagaggcggcaggagtcttgtgcgggttcagacaggaattttgtcatcgacagaattggggacatattggttcaacagtttagcgaagagaacgcgagcaagatgaagaaaatatatggtgaattctgttgccaccataaagaagcagtgaatctgttcaaagaactgcagcaaaacaaaaagttccagaattttataaaattacgtaattccaatctcctggcccgcaggaggggaatccctgagtgcatcttgttagtgacccaacgcattacaaagtatcctgtgctcgtagagcgaatattgcagtacactaaagagcgtaccgaggaacacaaagatctgaggaaagccctttgcctgattaaagatatgatcgcgactgtggatctcaaggtcaacgaatatgaaaagaaccagaagtggctagagattctgaataaaatcgagaataagacgtacactaaacttaagaatggacatgttttccggaaacaggcgttgatgagcgaagaacggactctgttgtacgacggactcgtgtattggaagactgctacaggtcgctttaaggatattcttgcattattgctgacagacgttctcctattcttacaggagaaagatcaaaaatacatctttgccgcagtcgaccagaaaccgtctgtgatttcactgcagaaactgattgctagagaagtggccaatgaggagcgcgggatgttcctcatctcggcttcctccgctgggccagaaatgtacgagatccacactaattcaaaagaggaacggaataattggatgcggaggatacaacaggccgtcgagtcttgccccgaggagaaggggggacgtacttctgaaagtgatgaagacaagcggaaggctgaggctagggtcgcgaagatccagcagtgccaagaaatcttgactaaccaggaccagcagatatgcgcttacctcgaagagaagctgcatatctacgctgaactaggcgagctctcggggtttgaagatgtacaccttgagcctcatctgttaatcaagccagaccccggtgagcctcctcaagctgcatccctgcttgcagccgcactaaaggaagcggagagccttcaggtggccgtgaaggcgtcacagatgggcgccgtgtcacagtcctgtgaggatagctgtggcgacagtgtgctagccgacactctcagctcgcacgatgtgccggggagtcctactgcaagcctggtcacaggcggacgcgagggaagggggtgctccgatgtagacccagggatccagggtgtcgtcacagatttagccgtttctgacgcaggggagaaggtggagtgtaggaacttccccggcagttcccagtcagaaattatccaggccattcaaaacctgactagactcctctacagtcttcaggccgctcttacaatccaggactcccatatagaaatccaccgcttggtgctgcagcagcaggaaggactgtctctgggccacagtattctgcggggtggacccctgcaggatcagaagagcagggacgctgatcgccagcacgaagaactcgctaacgtgcatcagctacagcaccagcttcaacaggaacagcgccgctggcttcgccgttgcgagcaacaacagcgtgcccaagccacccgcgaatcatggctgcaggagagggagcgagaatgtcagagtcaggaagagcttctgctccgcagcaggggcgagttggacctgcaactccaagagtatcagcattccctggagcgacttagggaggggcaacggctggtagaacgggagcaggctcggatgcgggcgcagcaatctctcctggggcactggaagcatggccggcagcgctccctgccggccgtcctcctgcctggagggcctgaggtcatggagctaaatcgatccgaatcattatgccacgaaaattcattcttcatcaatgaggcgcttgtgcagatgtcttttaacacctttaataagctgaaccccagcgtcatccaccaggacgcaacctaccccaccactcaatcacacagcgacctggtccgtacaagtgaacaccaggtggatctgaaagtggacccttcacagccatctaacgttagccataaactatggacagccgcagggagcgggcatcagatactcccatttcacgagagtagcaaggactcctgtaagaacggaagctcgatgaccaaatgttcctgtacattgacgagtcctccaggcctatggacgggaactactagcactctgaaagacctcgatacttctcacacagagagccccaccccacacgattcgaatagccacaggcctcagctgcaagcatttatcacggaagccaaactcaatctaccgaccaggaccatgactcgacaagacggagagactggagatggtgcaaaggagaacattgtttatctgtag

SEQ ID NO: 29584 - DNA, 948 bp, Artificial Sequence
  Description of Artificial Sequence: Synthetic coding sequence
atgcaaaggcgcagtcgtggcataaacactggcctgatcctgctattgtcccaaatcttccatgtcggcatcaataatatacccccagttactctggccactctcgctttaaacatctggttcttcctcaatcctcagaagcctctgtactcctcgtgtctgagtgtggaaaaatgttaccaacagaaggactggcaaaggttattgttgtcacccttacatcatgctgatgactggcacctttatttcaacatggctagcatgctgtggaaaggcatcaatttggaaagaagattagggtcaagatggttcgcctacgtaattacagcctttagcgtactgacaggagtcgtgtacctgctgttgcagttcgctgtggcagaatttatggatgaaccggactttaaacggagttgcgcagtggggttttcaggcgtgctgtttgcgctcaaagtgctcaataaccattactgtcctggaggattcgttaatattttgggctttcctgtgccaaatcgcttcgcttgctgggtcgagcttgtcgctatacatctgttttcccctggcacttcattcgcaggacatcttgcgggcatcctggttggcttgatgtacacacagggaccacttaagaagattatggaagcatgcgcaggaggtttttcaagcagcgtgggctaccccggacgacagtactacttcaattcctctggatcaagcggctaccaagactactacccacacggccgcccagatcattacgaagaggcccccagaaactatgacacttataccgccggactctcagaggaagaacagcttgaacgcgcactgcaggcatccctttgggataggggtaatactcgtaactcccccccaccttacgggttccatttgtctccagaagaaatgcgccgacagcggttacatcgtttcgattctcagtag

SEQ ID NO: 29585 - DNA, 948 bp, Artificial Sequence
  Description of Artificial Sequence: Synthetic coding sequence
atgcagcgccggtctcgggggattaacaccggactgatcctcctgctgtcacagattttccatgtgggaatcaacaacattcctcctgtcaccctggcgactctggctcttaatatctggtttttcctgaatccacagaagccactatattcgagttgtttgtccgtcgagaagtgctaccagcagaaagactggcaaagacttctgctgtcgccattacaccatgccgacgactggcacctgtactttaatatggcctccatgttatggaagggaatcaacttagaacgccggctgggctcccgctggttcgcatatgtaattaccgctttctcggtgctgactggtgttgtctacctactgctgcagttcgctgtggcggagtttatggatgagcctgactttaagaggtcctgtgctgtgggattctctggcgttctgtttgccctcaaggttctgaacaatcactattgtcccgggggttttgtgaatattctgggattccccgtgccgaataggtttgcctgttgggtcgaactggtggctatccacctgttcagtcctggtacgagtttcgcgggccatctggctggaatactggtgggcttaatgtatacacagggcccgctgaagaagatcatggaagcctgtgccggcgggttctccagcagcgtcggatatcccggtcgacaatactattttaattcaagcggaagcagcggctatcaggattactaccctcacggtcgcccagaccactatgaggaagctccaaggaattacgacacttatacagcgggcctgtcagaggaagaacagctggaacgagcgctccaggcctctttgtgggatagggggaacacacgtaactccccaccaccctatggcttccacctgtcacccgaggagatgaggcgccagcgacttcatcgatttgacagtcagtag

SEQ ID NO: 29586 - DNA, 456 bp, Artificial Sequence
  Description of Artificial Sequence: Synthetic coding sequence
atgcagagaaggagtcggggaatcaatacagggcttatcctgctgttatcgcaaatatttcatgttggcattaataacataccccccgtcaccctcgcaaccctcgctctcaacatttggtttttcttgaatcctcagaagcccctctatagcagttgtttgtccgtggagaaatgttaccaacagaaagactggcagcgtttgctattgtctccacttcaccacgccgacgattggcacctgtacttcaacatggcttccatgctctggaagggcatcaacctcgagcgtcgactgggaagtcggtggtttgcctacgttatcaccgcattctcagtcctcacaggcgtagtatacctgttactccaattcgccgtggctgagtttatggacgaaccagactttaagcggagttgcgccgtcgggttttcaggagttctgtttgcactaaagtag

SEQ ID NO: 29587 - DNA, 405 bp, Artificial Sequence
  Description of Artificial Sequence: Synthetic coding sequence
atgcagcgtcgatctagaggaatcaacactgggctcattctactgctctcgcagattttccatgtgggtatcaacaacatcccccctgtcactctcgccacactcgctctcaacatctggttcttcctgaatcctcagaagcccttatacagctcatgcctgtctgtggaaaagtgctaccagcagaaagattggcagcggctgttgctcagcccgttgcaccatgcggacgactggcacctgtattttaatatggcctcaatgttgtggaaaggcatcaacctagagcggaggctaggcagcagatggtttgcctatgtcattacagcttttagcgttctgacaggcgtggtttatctgctgctgcaatttgccgtggcggagttcatggacgagcctgattag

SEQ ID NO: 29588 - DNA, 165 bp, Artificial Sequence
  Description of Artificial Sequence: Synthetic coding sequence
atgcagcggagatccaggggaattaataccggtctgatcctgctcctttcacagatctttcatgtggggatcaataatattcccccagtgaccctagccacactggccttgaacatttggttctttctgaaccctcagaaaccactgtattctagctgcctgtag

SEQ ID NO: 29589 - DNA, 153 bp, Artificial Sequence
  Description of Artificial Sequence: Synthetic coding sequence
atgcagcggcgttctagaggtatcaacactggtttgattctgctgctgtcccagattttccatgtggggattaataatatcccccccgtgaccctggcaacactggccctgaatatatggtttttcctgaatcctcagaagcccctgtattag

SEQ ID NO: 29590 - DNA, 21 bp, Artificial Sequence
  Description of Artificial Sequence: Synthetic coding sequence
atgcagaggcgcagtcgatag

SEQ ID NO: 29591 - DNA, 375 bp, Artificial Sequence
  Description of Artificial Sequence: Synthetic coding sequence
atgcaacggcggtctagagggatcaacacgggtctaatcctcttactgtctcaaatattccacgtgggtatcaacaacatacccccggtaacgctagcaaccttggccctaaacatctggttctttctgaatccccaaaaaccactgtacagcagctgtctgtccgtggaaaaatgctaccagcagaaggattggcagcgcctgctgctgtcacctctgcatcatgcggatgattggcacctgtatttcaatatggcatctatgttatggaaagggattaacttagaacgacgactggggtccaggtggtttgcttacgtgatcaccgccttctcagttctcacgggcgtcgtgtacctgctcctccagttctag

SEQ ID NO: 29592 - DNA, 1095 bp, Artificial Sequence
  Description of Artificial Sequence: Synthetic coding sequence
atggccgccagcggaccaggttgcaggtcctggtgtctctgtcctgaggtacctagtgctacattctttaccgccctgctcagccttctggttagcggaccaaggctgtttctgctacaacagcctctggcaccctccggacttactttgaaatcagaggccctgcgaaactggcaggtctataggcttgtgacttacatctttgtgtacgaaaacccaatcagtctgttgtgcggtgcaattatcatctggcggttcgctggaaactttgaacggactgtgggaacagtgaggcattgcttttttactgtcatctttgctatattctcagccatcattttcctctccttcgaggctgtgtctagcttatctaagcttggcgaagtcgaggacgccaggggttttacgcctgttgctttcgcaatgctgggggtgaccaccgtgcggagccggatgcgcagggccctggtctttggtatggtagtgcccagcgttcttgtgccctggctgcttctgggggcgtcgtggctgatccctcaaacaagcttccttagtaacgtgtgtggcctctctatcggcctggcctacggcctcacctattgttattctattgacctgtccgaaagggtcgccctgaagctggaccagacattcccatttagcctgatgcggagaatttccgtgttcaaatatgtatctggtagcagtgcagaacggcgcgctgcccagtccaggaaacttaatccggtcccaggatcctatccaacgcagtcctgccatcctcacctctccccctcccaccctgtgtcacaaacgcaacatgccagtggtcaaaaattggcttcctggccctcctgcacccccgggcacatgcccaccttgccaccgtaccaacctgcatcaggactctgctatgtgcagaaccactttggacccaaccctacatcatcttctgtgtatcccgcatctgcaggcacttcactcggcatccaacctcctactcccgttaattctcccggaaccgtttattccggtgccttgggaacacctggcgcggccggaagcaaggaaagctctcgagtccccatgccttag

SEQ ID NO: 29593 - DNA, 672 bp, Artificial Sequence
  Description of Artificial Sequence: Synthetic coding sequence
atgctcggggtgactacggtaagatcacgcatgagaagagctctggtgttcggaatggtcgtgcctagcgttctggtaccctggctcctcttaggggcaagttggctgatccctcagacgagcttccttagtaatgtgtgcggtcttagtatcgggttggcctatggccttacatattgctacagcatcgacctctcagagcgggtggcgttgaagcttgaccagacatttccattctccctcatgaggcgtatttccgtcttcaaatacgtgtccggatcctccgcagagagacgtgctgctcagtctaggaagctgaaccctgttccgggctcatatccaacacagtcctgccaccctcacctctctccatctcacccggtgagccagacccagcacgccagcggtcaaaagttggcgagttggccatcctgcacccctggtcacatgccaacactacccccttatcaaccggcctcagggctttgttatgtgcagaatcactttggcccaaaccccacttcttcctctgtctaccctgcttccgccggcacctccttaggaattcagccaccaactcccgttaatagccctggcacagtgtacagcggcgcactaggcactcccggcgctgccggttccaaagagagctcgagggttcctatgccctag

SEQ ID NO: 29594 - DNA, 1305 bp, Artificial Sequence
  Description of Artificial Sequence: Synthetic coding sequence
atgggacggggtctctgggaagcttggcctccagcagggtcctccgcagtggccaaaggaaattgcagagaggaggctgaaggcgccgaggataggcagccagcctctcgccgtggagcagggacaaccgcggccatggccgcttcgggtcctggctgtcggtcatggtgtctatgccctgaagtgccaagcgcgacctttttcaccgccctcctatcgctgctcgtgagtggccccaggctttttctcctgcagcagccactggcgccatcggggcttactcttaagagcgaagcccttagaaactggcaggtttaccgtttggtgacatatatctttgtttacgagaatcctatctcactgctgtgcggggctatcattatctggcgattcgccggcaactttgagcgcacagtaggcaccgtacggcattgcttcttcacagtgatatttgcaatcttctccgctattatcttccttagttttgaggctgtgtcttctctgtccaagttgggagaggttgaagatgcaagggggtttactcccgttgcttttgcgatgctaggggtaacgacggtcaggagccgaatgagaagggcacttgttttcgggatggttgtgcctagcgtactcgtcccctggctgctgcttggggcctcctggctgattcctcagacctcctttctctccaacgtgtgcgggctttccataggcctagcctaccctcatctgctcctgtttcaccgccctctgcgggcttccgggacggaagcccgaagtgatttgcctctccaaccagacgaggaggacatcagagtgcaggtacggctgagagtattttctagagaagaaggcagtccggagcctgaaacagagccgggcgcctggctcctgccccatacagaattgccaccctccccagtgccaaagcctccttgcgttccggacgctgctcgacagtggtcagaggctgggctgctggcaagctgcaccccaggccacatgcctaccctccccccttaccagcctgcctcaggcctgtgctacgtgcagaaccattttggtccaaaccccacctcgagctcggtctacccagcctctgccggtactagccttggtatccagcccccaaccccagtgaatagtccaggtactgtctattccggcgccctgggacatcagggcttacaggctccccggtcgccaccgggatccccgtgcccggaaaggatcagtagagaagttatttccttaggattgctgaaagtgctgccaaagagtctcctgacaaaggtaacgtattag

SEQ ID NO: 29595 - DNA, 672 bp, Artificial Sequence
  Description of Artificial Sequence: Synthetic coding sequence
atgcttggcgtgactacagtacgctcccggatgaggagggccttagtttttggaatggtggtgccatcagttttagtcccgtggttactcctgggggcttcatggctgatcccacagactagcttcttgtcaaacgtgtgtggactgtccatcggcctggcatatggactcacatattgttatagtatagacttatcagagagggtggctctgaaacttgaccagaccttcccattttctctcatgcggagaattagtgtattcaaatacgtctctggttccagtgccgagcgacgcgctgcacagtccaggaagctgaatccagtgccaggctcataccctacacagtcttgccacccccacctctcacccagtcatccggtatcccagactcagcacgcaagcggacagaaactggcttcctggcccagctgcactcctgggcacatgccaacattacccccctaccagccggcgagcggtctgtgctacgtccagaaccacttcggcccgaatccaacttcgagctccgtgtacccagcaagcgcaggcacatcgctcgggattcaaccgccaacacccgtcaactcacctggcacggtgtatagcggggcccttggcacccccggtgcagcgggaagtaaagagtctagtagggtgcctatgccctag

SEQ ID NO: 29596 - DNA, 1185 bp, Artificial Sequence
  Description of Artificial Sequence: Synthetic coding sequence
atggaactgagcgcagtgggagagagggttttcgccgccgaatctattataaaaaggcgtattagaaaaggaaggatagagtacctggttaagtggaagggatgggcgattaagtactccacctgggagcctgaggagaatatcttagatagtaggcttatcgctgcatttgagcagaaggaacgtgagagagaattgtacgggccaaagaaaagagggccaaaacctaagacatttctgctcaaaccctccgcgagtgccagtagtcctaagctgcacagcagtgccgcggtgcataggctcaagaaagacattcggaggtgtcatcgcatgtcaaggcgtccactgccaaggcccgaccctcaggggggtagcccagggttgcgaccacccatctctccattttcagagaccgtccgcattattaataggaaggtgaagcctagagagccaaaaaggaaccgcatcatacttaacctgaaagtgatcgacaagggtgctggtggcggcggcgccggacaaggtgccggagctctcgcaaggcccaaggtgccgtctagaaacagagtaattggcaagtccaagaagtttagcgagtcagtcctccgaacccaaatccgtcacatgaagtttggcgctttcgcgctctataagcctccccctgcaccgttagtggccccctccccagggaaggcagaggccagcgcacccgggcccggcctgctactggctgcccccgccgccccttacgacgctcggtcttccggttccagtgggtgcccgtcaccaactccacagtcgtcagaccccgatgacactcctccaaagcttctacccgaaactgtatcacctagcgcgccttcatggagggagcctgaagtgctcgatctttctctccctcccgagtcggccgcaacttctaaaagggcaccccccgaagttactgccgcggccggtcctgctcccccaaccgctccagagcccgcaggagccagtagcgaacctgaagctggggattggcgaccagaaatgagcccatgtagcaacgtagtcgttactgatgtcacatctaacttacttaccgtgacgatcaaagagttctgtaaccccgaggatttcgagaaggtggctgccggtgttgctggcgcagcagggggcggaggtagcattggtgcttctaaatag

SEQ ID NO: 29597 - DNA, 411 bp, Artificial Sequence
  Description of Artificial Sequence: Synthetic coding sequence
atgcacgccagagggccgcacgggcagttgagtccagcacttcccctggcctcctccgttctcatgctgctcatgtcgaccctgtggctggttggcgcagggccaggactggtcctggcgcccgaactgttactggatccctggcaggtgcacaggctcctgacacatgctctaggacataccgccctgccaggtctgctcctgtccctgctgctcctccccactgtgggctggcagcaagagtgtcacctgggcaccttgaggttccttcacgcttccgccctgctggccctggcatcgggtttattggctgtgctgctcgctgggctgggcttgagcagcgctgccggtagttgtggctatatgccggtgcatttagccatgctagctggcgaggggcataggccttag

SEQ ID NO: 29598 - DNA, 588 bp, Artificial Sequence
  Description of Artificial Sequence: Synthetic coding sequence
atgcacgcccgggggcctcacggtcagctgagtcctgccctccctctggcaagttccgtgctcatgctgctgatgtctacactctggttggtaggcgcgggtccagggcttgtactcgccccggaacttctgcttgacccctggcaagtacaccgactgttgactcacgccctggggcataccgccctgcccgggcttctgctgtcgctacttctcctgcccactgttggatggcaacaggaatgtcatctaggaactctgcggtttctgcatgcttctgccctgctggcgctggccagtggtctcctcgccgtcctgctggcgggtctggggctgtcctctgcagccggatcttgcgggtacatgcctgtgcacctggctatgcttgccggcgaagggcatcgaccaagaagacctcggggagcactgccaccttggcttagcccctggttacttctcgccctgacaccactgctttccagcgagcctccattcttgcagctgttgtgcggtctgctggcaggccttgcgtatgccgctggagctttccgttggttggagccctctgagaggagattgcaggtgtag

SEQ ID NO: 29599 - DNA, 912 bp, Artificial Sequence
  Description of Artificial Sequence: Synthetic coding sequence
atgaaaggtaaggaggaaaaagagggcggcgcacgactgggcgccggagggggatctccagagaagtctccgtcggctcaggagctgaaagagcaagggaacagactgttcgtgggccgcaaatatccggaggccgctgcctgctacggtagggccatcaccaggaacccccttgtggccgtttactacacaaaccgtgctctctgttacctgaaaatgcagcagcacgagcaggccttggccgattgtcgtagagccctggaactggacggacagtccgtaaaggctcattttttccttgggcaatgtcagcttgaaatggagagctacgacgaggcaatagcaaatttgcagagagcatactctctggcaaaggagcagcgcctcaatttcggtgacgacatccctagcgcactgaggatcgctaagaagaagcggtggaatagcatcgaagaaaggcggatccaccaggaatctgagttgcactcatacttgtcacggttgatagcagccgaacgagaaagagagctggaggagtgtcagcggaatcatgaaggtgacgaggacgacagccacgtgagggcccaacaggcatgtattgaggccaagcacgacaaatacatggccgatatggacgagttattctcccaggtggacgaaaaaaggaaaaagagagatataccagattacctgtgcgggaaaatctccttcgaactcatgcgggaaccctgtatcaccccctcggggatcacatatgatagaaaagacattgaggaacacttgcaacgggtgggtcattttgatcccgtgacaaggtcccctctgacccaggaacagctgattccaaatctggccatgaaggaagtgatagatgccttcatcagcgaaaacggatgggtcgaggactactag

SEQ ID NO: 29600 - DNA, 1122 bp, Artificial Sequence
  Description of Artificial Sequence: Synthetic coding sequence
atggatcgttcctcactcctgcagctgatccaggagcaacagctggatcccgagaacactggtttcattggcgcagacaccttcaccggcctcgtccattctcatgagcttccgctggatccggccaagttagacatgctggttgccttagcgcagtcgaacgaacaaggacaagtgtgctaccaggagctggtcgatctgatttccagcaagcgttcctcatcctttaagcgcgccattgccaacggtcagcgggctctgccaagagatggacccctggacgagcccggcctcggtgtgtataagaggttcgttcgctacgtggcgtatgaaatattgccctgtgaggtggacagacgttggtacttctacaggcatcggtcgtgtccgccccctgtcttcatggcctccgtaacacttgcccagattatcgtttttctctgctatggagcccgcctgaataagtgggtgcttcaaacctatcatcccgaatacatgaagtctcctctcgtttaccacccaggacacagggcaagggcatggaggttcctcacctacatgttcatgcacgttgggctggagcaactgggttttaatgctctgcttcagttaatgatcggagtgcctttggaaatggtgcacggtctccttagaattagcctgctgtatctcgctggggtcttggccggctctcttacagtttctatcacggacatgagggcacctgtggtcgggggaagcggaggggtctatgctctatgctcagcgcacctggctaacgtggtcatgaactgggccggcatgcgctgcccatataaactactccgtatggttttggcgctggtatgtatgtcaagtgaagtaggtagagctgtgtggctccgattctcaccaccgctcccagcctccggaccccagccaagttttatggcacacctggccggcgccgttgtgggtgtttctatggggctcaccatactcagaagttacgaggagaggctgcgagaccaatgcggatggtgggttgtgttgctagcttacggaacctttctgctgttcgcagttttctggaacgtgtttgcttacgacctattaggcgcccacatcccccctcccccttag

SEQ ID NO: 29601 - DNA, 933 bp, Artificial Sequence
  Description of Artificial Sequence: Synthetic coding sequence
atggacaggtcctcactcttgcaactgatccaggaacagcaacttgaccccgaaaacacaggctttattggggcagacactttcactggtcttgtgcacagccatgaactgcccctcgacccagcaaaactggatatgttggtggctctcgcccagtcaaatgagcaagggcaggtgtgttaccaggagctcgttgatctcattagctctaagaggtcctctagttttaaaagggccatcgcaaatggtcaacgggctctgccccgtgacgggcccttggatgagccgggtctgggtgtgtacaagcgtttcgtgaggtacgttgcatatgagatccttccttgtgaggttgatcgacgttggtacttttatcggcacagaagctgtcccccccctgtgtttatggccagcgtgacattggctcagatcatcgtcttcctgtgctatggagcccgcctgaataagtgggtcctgcagacgtatcacccagaatatatgaaatctccactcgtgtaccaccctgggcaccgcgcccgagcttggaggtttctgacttacatgtttatgcacgtgggcctggagcagcttggctttaatgccctacttcagctcatgataggggtgcctctggaaatggtccacggcctgctacggatatccctgttgtacctcgccggtgtcctcgcaggctccctgaccgtgagtatcacagatatgcgcgcaccggtcgtcggcggtagcggtggcgtatatgctctgtgctctgctcacctggccaatgttgttatggtcactggcctgccaggaggagggaggggggaaggcccacaagtttctcttaccaccagtcgcctgcacacccccatcgagttaggctgggacgagatgtccctgcaagtagccgaagacggagctggactgggcgtacagtag

SEQ ID NO: 29602 - DNA, 912 bp, Artificial Sequence
  Description of Artificial Sequence: Synthetic coding sequence
atggcggccgtgcacgatctcgagatggagtccatgaatctgaacatggggcgggaaatgaaggaagagcttgaagaagaagaaaaaatgagggaagatggcggggggaaagacagagcaaagtccaagaaagtacatagaatagtgtcaaagtggatgctgccagaaaaatcgcgtggtacctatctggagcgagcaaactgttttccccctcctgtgttcattattagtatcagtttggcagaactggcagtgtttatttattatgctgtgtggaagcctcaaaaacagtggatcacgctcgacaccggcatccttgaaagtcccttcatatattctccggagaaaagggaggaggcttggcgcttcattagctacatgctggtacacgccggagtgcagcacattctgggaaacctgtgcatgcaacttgtgctcggtattccattggagatggtccataaggggcttagagttggcctcgtgtatctggctggagtcattgcgggcagcttagcaagttccatttttgatcccctccgttatctggtgggcgcctcaggaggcgtgtacgccctgatgggcggctatttcatgaatgttttggtcaatttccaagagatgatccccgcattcggtatatttagactgctgatcatcattctgatcatcgtgctggatatgggattcgccttgtataggcggtttttcgtgcctgaagacgggagccctgtatcctttgctgcccacatcgccggcggatttgcaggcatgtccattgggtatacagtcttctcttgctttgataaagccttactgaaggatccacggttctggattgctattgccgcatacctcgcctgtgtgttatttgctgttttttttaatatctttctgagcccagccaattag

SEQ ID NO: 29603 - DNA, 1152 bp, Artificial Sequence
  Description of Artificial Sequence: Synthetic coding sequence
atgcaattagggaagcggcacaagctgaccacaaaatctgtgtgccatggtaaaggagtagttatcagggtattggccctgcctggcccttcttgggttagacggagacgagagggtaaagcactggagtcttccagatgtgcaaggcaacctcgggaggaacgacaaccagaggatttgggacctcctgcagtgccatgggactcctgcccttccggggaggaggggggacctcgcactatggcagctgtgcatgacctggagatggagtccatgaatcttaacatgggtcgagaaatgaaggaggaacttgaggaagaggaaaagatgagggaggacggggggggtaaggaccgggccaaatcgaaaaaggttcaccgcatcgtatctaaatggatgctcccagaaaaaagtaggggtacgtatctggagcgtgccaactgctttcctccaccggtgttcattatctcgatcagcctcgctgaacttgctgtttttatatattacgcggtgtggaaaccccagaaacaatggattacactcgacaccggcattctggagtccccctttatatactcccctgaaaagcgcgaagaggcatggaggttcatcagttatatgctggtacacgctggcgtccagcatattctgggaaacctttgcatgcagttggtacttggaatccccttggagatggtgcacaagggactcagagtggggttggtgtatctggctggtgtgattgccgggtctctcgcttccagtatctttgatccccttcgttacctggtgggagccagcggcggtgtgtatgctttgatgggcggatacttcatgaatgtgcttgttaattttcaggagatgatccccgcctttgggatcttccggctcctgatcatcatcctgatcattgtgttagacatggggttcgctctttacaggcgtttcttcgtccctgaagatggaagccctgtctccttcgccgctcacatcgccggaggattcgcaggaatgagcattggctacacggtcttttcatgcttcgataaggccctgctcaaggacccacgattttggattgccatcgctgcttacctggcctgcgtgctgtttgctgtattcttcaatatcttcctgagtcccgcaaactag

SEQ ID NO: 29604 - DNA, 912 bp, Artificial Sequence
  Description of Artificial Sequence: Synthetic coding sequence
atggccgcagtgcacgatttggagatggaaagcatgaatctcaatatggggcgcgagatgaaggaggagctggaagaagaggagaaaatgcgcgaagatgggggcggcaaggatcgcgctaagtccaaaaaggtacatcggatagtgtccaagtggatgctgcccgagaagtcaagaggcacctacctggagcgagccaattgcttccctcccccggtgttcatcattagtatttccttggccgagctggcggtattcatctactacgccgtgtggaaaccgcaaaagcagtggataacactcgacacaggaatacttgagtccccattcatctattctccagagaagagggaagaggcctggagatttatatcctacatgttggtgcacgctggtgtacagcacatccttggcaatctatgcatgcagctagtactgggcatcccccttgaaatggtgcataaagggctgagggtcggcttggtgtatctcgccggtgtaattgctggtagcctggctagcagcatctttgaccccctgaggtatctcgttggggcctcaggaggggtgtatgccctgatgggggggtacttcatgaatgtgctggtgaactttcaagagatgattcctgccttcggtatctttcgtctactgattattatcttgatcatcgtactcgatatgggattcgctctttatcgacggttttttgtgccagaggatggaagccctgtgtctttcgccgcacacatcgctggcgggtttgcaggaatgtccatcggatataccgtgttcagttgctttgacaaggccctcctgaaagaccctcgcttttggatcgccatcgccgcctacttggcatgtgtgctcttcgcagtgttctttaatatttttttgtcccccgcaaattag

SEQ ID NO: 29605 - DNA, 1113 bp, Artificial Sequence
  Description of Artificial Sequence: Synthetic coding sequence
atgaccaccacatatatgctgagcaagaaccccctggaggtgtttgacatttgtcggtttaatacctgtaattttggtaaggcccttgagtccagtcggtgcgctcggcagcccagagaggagaggcagcctgaagatttagggccacctgccgttccttgggactcctgcccatccggtgaggaagggggcccgcggacaatggccgcagtgcatgacctggaaatggagtctatgaatctgaacatggggcgggaaatgaaggaagaacttgaggaggaagaaaagatgcgggaggatgggggaggaaaagacagggctaagtccaagaaggtccacaggatagtgtccaagtggatgctgccagagaaaagccgcgggacctaccttgaacgagccaattgctttccaccaccagtcttcattatctctatttcactggccgaactcgccgtgtttatttattacgccgtctggaagccccaaaagcagtggatcaccctggatacggggatcctcgaatccccatttatctacagccctgagaagcgcgaagaagcatggaggttcatcagctatatgctggtgcacgccggtgtgcaacacattctgggcaatctctgtatgcaactcgtcctgggaattccactggaaatggtgcataagggacttcgggtggggctggtgtacctggccggcgtcattgccggcagcctggcctcaagcatctttgacccactaaggtatctggtaggggcatccgggggcgtgtatgcccttatgggcggatatttcatgaacgtgctggtaaatttccaggagatgatacccgcattcgggatcttcaggttactcatcatcatcctgatcatagtgctggacatggggtttgccttgtatcgacggtttttcgtccccgaggacggcagtccggtgagcttcgccgcccacatagccggtggcttcgcaggtatgtctataggctatactgtgttttcatgttttgataaggcactccttaaggacccgcggttctggatcgctatcgcagcttatttggcctgtgtgttattcgccgtcttcttcaatatatttctatcaccagctaattag

SEQ ID NO: 29606 - DNA, 1215 bp, Artificial Sequence
  Description of Artificial Sequence: Synthetic coding sequence
atgggcgagcaccccagcccggggcccgcagtggcagcctgcgccgaagctgaaagaatcgaagagctagaacctgaagccgaggagaggttgcccgccgcccctgaagaccattggaaagtgctgtttgatcagtttgaccctggtaacacgggctacatctctacagggaaattcaggagcctgctcgaatctcactcatccaaactggaccctcataagcgcgaagtcctcctcgccctggcagactctcatgccgatggccagatcggataccaggacttcgtgtctctgatgtcaaataagaggagtaactctttccgccaggcaattctgcagggaaaccgccgattatcttcaaaagcccttctagaggagaaggggctgtccttatcccaacgcctcatccgacatgtggcctacgagactcttccccgggaaatcgacaggaagtggtattacgactcctacacctgctgcccacctccatggttcatgatcactgtgaccttgctggaagtggccttcttcctctacaacggcgtgtccttagggcaattcgtgctccaggttacacacccacggtatcttaaaaattcccttgtctatcacccccagttacgagctcaggtctggagatatctcacctacatattcatgcatgctgggatcgaacatctgggactgaatgtagtgctgcagctcctcgtgggggtgcctttagaaatggtgcatggggctaccagaattgggctcgtctacgttgcgggagtagttgctggatcattggcggtgtccgtagctgacatgacagccccagtggtgggcagttcaggcggtgtctacgccctggtttctgcacatctggccaatattgtaatgaactggagcgggatgaagtgtcagtttaaactgttaaggatggccgtggccttgatatgcatgagcatggagtttggccgggccgtctggcttagattccacccaagcgcttaccctccatgtccccacccttcattcgtcgctcatctcggcggtgtggctgttggcattacgcttggggttgtggtcctgcgcaattacgaacaaaggctgcaggaccagtccctttggtggatctttgtggcgatgtacacggtgtttgttctcttcgccgttttctggaatatctttgcctacacgctgctggacctgaaactgcccccacctccgtag

SEQ ID NO: 29607 - DNA, 1287 bp, Artificial Sequence
  Description of Artificial Sequence: Synthetic coding sequence
atgggagagcacccgagcccggggcctgctgttgccgcctgtgccgaggctgagaggattgaggagctcgagccggaggctgaagaaagactgccagctgctcccgaagaccactggaaggtgctctttgaccagttcgatccgggcaatacgggctacatcagcaccggaaaatttcggtccctcctagagagccattccagcaagctcgatcctcacaagcgtgaggtgctcctggcactggccgacagtcatgccgacgggcaaattggctatcaggacttcgtctctctcatgagcaataagcggagcaactctttccgtcaagctatcctgcaggggaatcgtaggctcagcagcaaagcactgctggaggaaaaaggacttagtctgtctcagaggctgattcgacatgtggcatacgaaactctgccccgagagattgacagaaagtggtattacgatagctacacgtgctgcccaccaccatggtttatgatcaccgtaaccctcctcgaggtcgccttttttctatacaatggcgttagtctaggacaatttgtgttgcaagtaactcatcccagatacctgaaaaattcgctggtctaccaccctcagctgcgcgcacaggtatggagatacctgacctacatttttatgcatgccgggatagaacacctgggactgaacgtggtactgcagctattagtgggtgtgccactcgagatggttcacggggccacaaggatcgggctggtttacgttgcgggtgtggtagctgaattggtgagacacgaggttcccgtccaggcggcagccgacggctgcgggccgtacttgtacgagcacggagtgtgggccggacgggtcgctcccctcccccctgtgggattgtccccagtcccatccccaaagctttgcggagccctaggatggagagggagaggtcaccaccctgggcgcgggggcccggaagagctaagagcagaggcgcctggccccgtgacggtcgtggatttctgcgggcacgtgcatcgactccgcgcggtccggtgcctgctggagcatttgtgtctccaccccgctgggttaaaagccgctgctagcccgttgcgggctggcggtcctcgtagcggtcggggcggcaagtcctcaacgcatcgggaaaggttgcgcggattcttctccagcccagcgcagctcggaagggccgataaggacaggcgcctttgggctactgtgatgtttgtgtttaggttcggtcacaccgtcgagacactattctag

SEQ ID NO: 29608 - DNA, 921 bp, Artificial Sequence
  Description of Artificial Sequence: Synthetic coding sequence
atgagtaataagaggagcaattcattccgccaagcaattttgcaaggcaacagaagactgagtagcaaagcgcttttggaggaaaagggtctaagtctgtcacaacggctcattagacacgtcgcctacgagacactacccagagaaatcgatcgcaagtggtactacgacagctacacttgctgcccccctccctggttcatgatcacagttactctgctggaagtggcatttttcttgtataatggtgtcagcctcggccagtttgtcctgcaggttacacaccctcgctaccttaagaactcactcgtatatcacccgcagttgcgcgcgcaggtttggcgttacctgacctatattttcatgcacgccgggattgagcatctcgggctgaatgtcgtgctccagttgctggtcggcgtcccactcgagatggtgcacggcgctacacgcattgggctggtttacgtggccggagttgtggcagggagcctagctgtttcggtggccgacatgaccgctcccgtggtgggcagcagtgggggggtttatgccctggtctccgcacatcttgcgaatatagtgatgaattggtctggtatgaagtgccagttcaaactactgagaatggctgttgcactgatttgcatgagtatggaattcgggagagcagtgtggctccgtttccatcccagtgcctacccgccatgtcctcacccttcctttgtcgcccatctgggcggcgtggctgtaggaatcactctcggcgtagtggtgctccgcaattatgagcagcggctccaagatcaatctctctggtggatttttgtggccatgtacaccgtgttcgtgctgtttgctgttttctggaacatcttcgcctatacactgttggacctcaagcttccacctcctccctag

SEQ ID NO: 29609 - DNA, 1191 bp, Artificial Sequence
  Description of Artificial Sequence: Synthetic coding sequence
atgggtgagcacccgtcccctggaccagcggttgctgcatgcgccgaggctgaacgtatcgaagaactggagcctgaggccgaggaacgccttcccgccgcgccagaggactttgaccctggcaataccggctatattagtacaggcaagttccgctctctactggagagtcactcttcaaaactggaccctcataagcgcgaggtgctgttggccctcgcagactcacatgcggacggtcagattgggtaccaggatttcgtgagcctaatgagcaataagcgctctaattccttccgacaggcaatcctgcagggaaaccggagactgtcaagcaaggccttgctggaagaaaaggggctgtcactgtcacagaggcttattcgtcatgtcgcttatgaaaccttgcctcgcgaaatagaccggaaatggtactacgacagttacacatgttgcccacccccctggttcatgattacagtgactctccttgaagtcgcatttttcctgtacaacggggtgagtctcggtcagtttgtgctgcaggtcacacaccctaggtacctcaagaactctctggtttaccacccgcagcttcgcgcgcaagtttggagatacctgacatacatattcatgcacgctggaattgagcacctgggattgaatgtggtgttgcagctcttggtgggggtccccttagagatggtgcacggagctacacgtattgggctggtgtacgtggccggcgtcgtggccggctccctcgctgttagcgtggccgacatgaccgcccccgtcgtcggctcatccgggggagtgtatgcgctcgtgagcgcccacttggccaacatcgttatgaactggagcggcatgaagtgccagttcaaattgttgcggatggccgtggccttgatttgcatgagcatggagtttggccgggccgtgtggttgcgattccatcctagtgcctatcctccgtgtccccatccaagtttcgtggctcaccttgggggtgtagctgtcggcattaccttaggtgtggttgtgttgaggaactacgaacagcggttacaagaccagtctctttggtggatttttgtggctatgtataccgtgttcgttctgtttgcagtgttttggaatatatttgcctacactctacttgatctgaaattgccacctccgccatag

SEQ ID NO: 29610 - DNA, 927 bp, Artificial Sequence
  Description of Artificial Sequence: Synthetic coding sequence
atgtgcctgctcttgagttccgctgtgtttggcgtcaagtataatttactggctcatacaaccctgactctggaaagcgccgaagactcattcaagacacacaatctgtctattaatgggaatgaggaatcatctttttggcttccattatacggcaatatgtgttgtagactggtggcccagcccgcctgcatggctgaggacgcatttgctggtttcttgaaccagcagcagatggtagaaggactgattagttggaggagattgtactgcgtgctgcgcggggggaagctatactgtttttactccccagaggagatcgaagccaaggttgagcccgctctggtggttcctatcaacaaaagcctcgtccttttcgaagattcactggagggaatccagttagccatatcccagagcttcaaagaaactcgcatccgcgctatggacaaggacgctaagaagcggatccacaatttctcagttattaaccctgtaccaggccaagcaattacacaaatcttcgccgtcgacaatcgtgaagatcttcagaagtggatggaggctttctggcagcactttttcgacctgtctcagtggaaacactgctgcgaggagttgatgaagatcgagataatgtctcctagaaaaccaccgctgttccttacaaaggaagctacgtcggtgtaccatgatatgtccatagattctcctatgaaactggagtctcttacagatataattcagaaaaaaatagaagaaactaatggacaattcctgatcggccagcacgaggaaagccttccacctccttgggccaccctctttgacggaaaccaccagatggtgatacagaagaagaataattccaatcagctgcacaacctccaaaaactcccagctacttctaaatttctattcacttag

SEQ ID NO: 29611 - DNA, 1830 bp, Artificial Sequence
  Description of Artificial Sequence: Synthetic coding sequence
atggaagggcccagtctcaggggccctgctttgagactggcgggattgcctacccagcaggattgcaatattcaagaaaagatcgacttagagatacgaatgagagaagggatctggaaactgctgagtctctcaacccagaaagaccaggtgctccatgcggtaaaaaacctgatggtgtgtaacgccaggctcatggcttacacaagcgagctgcaaaaactggaagagcagattgccaaccagactggcagatgcgacgtgaagttcgaatccaaggagcgaactgcgtgcaaaggaaaaatagcgattagcgacatccggatcccattgatgtggaaggatagcgatcacttttccaataaagagagatcaaggagatatgctatcttctgcctgtttaaaatgggtgcgaacgtgtttgatacagatgtggtgaatgtcgataaaacgatcacagatatatgttttgagaacgtaacgatcttcaacgaagcgggacccgatttccagatcaaggtcgaggtatattcctgctgtaccgaggagtcttccataaccaatactccaaaaaaactggcaaagaagctaaagactagcattagtaaagccactggcaagaaaatctcttctgtgctgcaagaagaagatgatgaaatgtgcctgctgctgagttccgccgtgtttggagtcaagtataacttgttggcccacacaacattgactctggagagcgctgaggacagcttcaagacacacaaccttagtatcaatggcaacgaagagtcctctttttggctgcccctgtacggcaacatgtgttgtcgactcgttgcccaacccgcctgcatggccgaggatgcctttgcaggctttcttaatcaacagcagatggttgagggtcttatctcttggaggcgcctctattgtgtgctgcggggggggaaattatattgtttttatagtcctgaggagatcgaagcaaaagtggaacccgccctggtggtgcccattaacaaggaaactaggatcagggccatggacaaggatgccaagaaacggatccataacttctcagtcataaatcctgtcccagggcaggccatcacgcagatcttcgccgtggataatagggaggatctgcaaaaatggatggaggctttctggcagcacttttttgatcttagtcagtggaaacactgttgcgaagaacttatgaagatcgagatcatgtccccaaggaagcctccgctgttcctgactaaggaggcaacgagtgtgtaccacgatatgagcatcgattcccccatgaaactggaaagtctcacagatataatccagaagaaaatagaggagacaaatggacagttcctgataggccaacatgaggaatctctccccccgccgtgggccactttgtttgatggcaaccatcaaatggtcatccagaagaaggtgttataccccgcctccgaaccactccacgacgaaaaaggtaagaaaaggcaagcccccctcccacccagcgacaagcttccgttttccttgaaaagccagagcaataccgatcagctggtcaaagacaattggggcaagacttcagtgtcacagacatcttcccttgatactaagttgtccacactgatgcatcacctgcagaaaccaatggcagccccccgcaagcttttacccgcccggcgtaatcggctgtccgacggagagcacaccgatactaagaccaactttgaggccaaacccgtacctgcacctagacagaagagtattaaagatattctggacccaaggtcatggctgcaggcccaggtttag

SEQ ID NO: 29612 - DNA, 492 bp, Artificial Sequence
  Description of Artificial Sequence: Synthetic coding sequence
atggagggccctagcctccgcggcccggctctccgactcgcgggactgcctacccagcaggactgcaacatccaggagaagatcgatctggaaatacgaatgagggaaggaatttggaagctgcttagcctgtccacacaaaaggaccaagtgttgcatgcagtaaaaaatttgatggtctgtaatgcacgcctcatggcatacacctcggaattgcaaaagctagaagagcagattgcaaaccagactgggagatgcgacgtaaaatttgagtccaaggaacgcaccgcatgcaagggtaaaatagccatctcagatatcagaatcccacttatgtggaaggacagcgaccatttttctaataaggagaggtctagacggtatgcgattttttgtctcttcaagatgggggccaacgtgtttgacaccgatgtcgtgaatgtcgacaaaacaattacagacatttgctttgagaacgtgacaatcctgtag

SEQ ID NO: 29613 - DNA, 1584 bp, Artificial Sequence
  Description of Artificial Sequence: Synthetic coding sequence
atggaaggcccgtccctgagggggcccgcattaaggctagctgggctgcctacccagcaagattgcaatatccaggaaaaaatcgacctggagatacggatgcgcgaaggaatttggaaactgttgagtttgagcacacagaaagaccaggtcttacacgctgtgaagaacctgatggtatgtaacgcaagactgatggcatacactagcgaactgcagaagttggaggagcaaattgccaatcagacgggaaggtgtgacgtaaagttcgagtccaaggaaagaacagcctgtaaaggaaagattgcgattagtgacatcaggataccactcatgtggaaagattctgatcacttctctaacaaggagcgctcacgacgttacgctatcttttgtttgttcaagatgggtgccaacgtgttcgatacggatgtggtcaacgtagataaaactataacggatatatgcttcgaaaacgttacgatattcaacgaagctggccccgactttcaaattaaggtggaggtgtattcctgctgcacagaggaatcatctataactaatacacctaagaagcttgctaaaaagctgaagacctctatttcaaaagcaaccgggaaaaagatcagcagcgtgctgcaggaggaagacgacgagatgtgtttgctcctgtcatcagccgtgttcggagttaagtataacctcctggcccacactactctgacacttgaaagtgccgaagatagcttcaaaactcataacttatctattaatggcaacgaggaaagttcgttttggctgccgctttacgggaacatgtgctgcagactggtcgcccaacctgcctgcatggccgaagatgctttcgctggcttcctgaaccagcagcagatggttgagggcttaatatcgtggagacgcctgtactgtgtgctgcgagggggaaaactgtactgcttctactcgcccgaagagatcgaggcaaaggtcgagccagccctggtggttccaattaacaaaagtctggtacttttcgaagactccctggaaggcattcagctggcgattagccagagctttaaggaaaccaggatccgggcaatggacaaggacgccaagaaacggatccacaatttctccgtcattaaccctgtgccaggtcaggccatcacacagatttttgccgtggataatagagaagatctacagaagtggatggaggcattctggcagcactttttcgacctgtcccagtggaaacactgttgtgaggagctgatgaaaatagaaattatgagcccgaggaaacctccgctatttttgactaaggaggcaacctcagtataccatgacatgtccatagacagcccaatgaaactggagtctctgacggatattatccagaaaaagatagaagaaaccaacggacaattcttgatcggccagcacgaggaaagtttgccccctccttgggccacactgtttgacggtaaccaccagatggttatacaaaaaaaaaacaatagtaatcaactacacaatctgcagaagctgcctgccacgagcaagtttctgtttacatag

SEQ ID NO: 29614 - DNA, 297 bp, Artificial Sequence
  Description of Artificial Sequence: Synthetic coding sequence
atggctagcctgttgtgctgcggccccaagctggccgcttgcgggatcgtgttgtccgcttggggagtgattatgctaattatgcttggaattttcttcaatgtacatagcgcagtcctgatagaggacgtgcccttcacagaaaaggactttgagaatggaccgcagaacatttacaatttgtacgagcaggtaagttacaactgtttcattgctgcggggctctatttactgctaggtggtttctccttttgccaggtacgtctcaacaagagaaaagaatatatggtaagatag

SEQ ID NO: 29615 - DNA, 414 bp, Artificial Sequence
  Description of Artificial Sequence: Synthetic coding sequence
atggggtggctgagaccgggtccccggccgctctgccctcctgcgagagcgtcctgggcattctctcaccgctttccatcccctctggccccccggcgcagccccacacctttctttatggctagtctgttgtgctgcggccctaagcttgccgcttgcggcatcgtgctctctgcttggggcgtcattatgttgatcatgctgggcatcttcttcaacgtacatagcgccgtgcttattgaagatgtgcccttcaccgagaaggactttgaaaatggcccacagaatatatacaatctgtacgagcaagtgtcctacaattgtttcatcgccgcagggttgtatttactgttgggcgggttttctttctgtcaggtacgactgaacaaacgcaaggagtacatggtcaggtag

SEQ ID NO: 29616 - DNA, 471 bp, Artificial Sequence
  Description of Artificial Sequence: Synthetic coding sequence
atgcagattttcgttaagacccttaccggaaagacgataacattagaagtcgaaccctcagatactatcgagaacgttaaagcaaaaattcaggacaaggaggggataccccctgatcagcagcgattgattttcgccggtaagcagcttgaagatggacggactttgtcagactacaacatccagaaggagtctactctgcatttagtgctacgccttagggggggcgcgaagaagagaaagaagaagagctacactaccccgaaaaagaacaagcataagagaaagaaggttaagctcgctgtgctgaaatactacaaggtcgacgagaacggtaaaatttccaggctccggcgggagtgcccatccgatgagtgcggcgccggcgtgttcatggcttctcacttcgatcgccattactgcggcaagtgctgtctgacgtattgctttaataagccagaagacaagtag

SEQ ID NO: 29617 - DNA, 471 bp, Artificial Sequence
  Description of Artificial Sequence: Synthetic coding sequence
atgcagatattcgtaaagaccctcacggggaaaaccatcacactggaggttgagccgagcgacaccatagaaaacgttaaggccaaaatccaagacaaggaaggcatcccaccagatcagcagcggttgatctttgcaggaaagcagctcgaggatgggcggaccctgagcgattataatatacagaaggaaagcacgctgcacctcgttctgcgtctaaggggaggcgctaaaaagagaaagaagaagagttataccactcccaagaagaacaaacacaaaaggaaaaaagttaagctcgcagtgctcaagtactacaaggtcgatgagaacggcaagatatcacgtctgcggagggagtgtccttcagacgaatgtggtgcaggggtcttcatggctagccacttcgatcggcattattgtggtaagtgctgcctaacttactgcttcaacaaaccagaggataaatag

SEQ ID NO: 29618 - DNA, 471 bp, Artificial Sequence
  Description of Artificial Sequence: Synthetic coding sequence
atgcagatttttgtgaaaacactcactggaaagacaataaccttggaggtggaaccctctgataccatcgagaacgtgaaagctaagatacaagataaagagggaatcccccctgatcagcagagactgatatttgccggaaaacagctcgaggatggtaggactttgagcgactacaatatacaaaaagagagcaccctgcacttggttctaaggctacgagggggcgccaagaaacggaaaaaaaagtcttatactaccccaaaaaagaacaagcataaacgtaagaaagtgaaacttgcagtcttgaagtattacaaagtcgacgaaaacggcaagataagccggctgaggcgagaatgtcctagcgacgagtgtggcgcaggtgtattcatggccagccatttcgaccgccattactgcggaaaatgttgcttaacctactgttttaataaaccggaggataaatag

SEQ ID NO: 29619 - DNA, 321 bp, Artificial Sequence
  Description of Artificial Sequence: Synthetic coding sequence
atgcaaatcttcgtgaagaccctgacgggtaagacgataaccttggaggtggagcctagcgatacaattgagaacgtgaaggccaagatccaggacaaggagggaataccgccggatcagcagcgattgatcttcgccggtaaacagttggaggatggccggactctcagcgattacaacatccagaaggaaagcaccctgcaccttgtgctccggcttcgtgggggggccaagaaacgcaaaaaaaagtcttacaccacaccaaaaaaaaataaacataagcggaaaaaggtgaaactggccgtattaaaatactattag

SEQ ID NO: 29620 - DNA, 1428 bp, Artificial Sequence
  Description of Artificial Sequence: Synthetic coding sequence
atgcccgggatcagcgccaggggcctttcgcacgaagggcgtaagcagctggctgttaatttgacaagggtactggccctgtacaggtctatcctcgacgcttacattatcgaattcttcactgataatctgtgggatacgctgccatgttcctggcaggaggcccttgatggactgaaacctcctcaactggcgacaatgttgctgggaatgccaggtgaaggcgaagtggtgaggtacaggtctgtgtggcctctcaccctgctcgcattgaaatctaccgcttgcgctctagcatttaccaggatgcccggattccagacccctagtgaattccttgaaaatccctcccaatcctctagactcactgctcccttcaggaaacatgtgagaccaaagaagcagcacgaaattaggcgcctgggcgaactggtaaaaaaactgagcgattttactggctgcacccaggtcgtggacgtcggaagcggccagggccatctgtcccggtttatggccctgggtctaggactgatggttaagtccattgaaggggatcagcggctagttgagagggcacagagactggaccaggagcttctgcaagcgctggaaaaagaggagaagcgcaatccccaggtggttcagacatccccacgacattcaccccatcacgtggtgagatgggtggatcctaccgctctatgcgaggaactgctgttaccccttgaaaatccctgtcaaggtcgcgcccggctgctgctcaccggactgcacgcatgcggcgacctctctgtggcgctgctgagacatttcagttgctgcccagaagtggtagccctggctagtgtcgggtgctgttacatgaaactgagtgaccctggaggatatccactgtcgcaatgggtggcaggtctgcccgggtatgagctgccttacagactgagggaaggcgcttgccatgcgctggaggaatatgcagagagactgcagaaggcaggccctggcctgagaacccattgctaccgcgcagccctggaaaccgttatcaggcgtgctcggcccgagctgagacgacccggtgttcaaggtatcccccgtgtgcacgaacttaagatcgaagaatatgtccagaggggattgcagcgggtcggactcgaccctcagttgccactcaatctcgcagctcttcaagcccacgtggctcaggagaatagggtcgttgccttcttcagcctcgcccttttgttagcccccctggtggagacactgattcttctggataggctgctctatctccaggaacaaggctttcacgccgaattactccccattttctctcctgagctttcaccacgcaatcttgtcctcgtggcgacgaaaatgcccctcggacaggccttaagcgtactcgaaacagaagattcatag

SEQ ID NO: 29621 - DNA, 834 bp, Artificial Sequence
  Description of Artificial Sequence: Synthetic coding sequence
atgcccggtatctctgctagagggcttagtcacgagggacgaaaacagctggcagttaacctgacccgcgttctggctttgtatcggagcattctggatgcctatattatcgagttctttactgacaacctgtgggatacactcccttgctcatggcaagaggcactggatggactgaagcctccccagctcgctaccatgctgttggggatgcccggcgagggtgaggtcgtcagataccgctctgtgtggccgttaactctgctggcactgaaatccaccgcttgcgcgctcgccttcacaagaatgccggggtttcaaactccaagcgagtttctggaaaacccatcgcaaagcagccgtctcaccgccccctttcgaaaacatgtgagacccaagaaacagcacgagatccgtagactcggggagttagtgaagaaactcagcgatttcaccgggtgtacccaggtcgttgacgtgggatccggtcagggccacctgagccgatttatggccctcggcctgggcttgatggtcaagagtattgaaggcgatcagcgactggttgagcgtgcccagcgtcttgaccaggagttactccaagcactggaaaaggaggagaagaggaatccgcagatctgcgccgcgggggccaccgcctccggtgctagatcccctgctgccacagagtccggttgtccctctggaccccgaggaccaggggagccctgcggcggcttgttacaaccagggtcaacggcttgccctacgggaggggatgcttatagtactggacctgctgctgtcccatcaggcaccgggtttccctgctag

SEQ ID NO: 29622 - DNA, 3594 bp, Artificial Sequence
  Description of Artificial Sequence: Synthetic coding sequence
atggggagatcaggtaaactgccgtcgggggtgtcagccaagctgaagcgatggaaaaaagggcacagctcggacagtaaccctgccatttgccgccatcgacaggctgctcgcagccgattcttctctaggcctagcggaaggtctgacctgacggtagacgcagtgaaactgcataatgaactgcagtctggctcgctacgcctgggcaagtccgaggccccagagaccccgatggaagaggaggctgagttggtcctgaccgaaaagtcttcgggaaccttccttagcggccttagcgattgtactaatgtgactttcagcaaagtccagagattttgggagtcaaattccgcagctcataaagagatatgcgccgtgctagccgcagtcacagaggtgatccggtcccagggcggtaaggagactgaaactgagtattttgccgccttaatccgaaaagcagcccagcatggagtgtgttcagtgctgaagggttctgagtttatgttcgaaaaggcccctgctcatcacccagccgctatatcgaccgcgaagttttgtattcaggagatcgaaaaatctggaggcagcaaagaagctactactacccttcatatgctcaccctgttaaaggacctgcttccatgtttccccgaggggctggttaaatcctgttctgaaaccctcttgcgcgttatgacactgagccacgttttagtgacagcatgtgccatgcaagcgttccactctctctttcatgcacgccccgggctctcaaccttatctgccgaattgaatgcccagatcatcactgcgctgtacgactatgtgccgagcgagaatgatttgcagccgctcttggcttggctcaaagtgatggagaaagcccatataaatcttgtgaggcttcaatgggacctgggattaggccacctgccaagatttttcgggacagccgtgacctgtctgctgtccccacactctcaggtccttactgccgcaacccagtcccttaaggagatccttaaagagtgtgtggctccgcacatggccgacatcggctcagtgacctctagcgcatctgggccagctcagtccgtggccaagatgtttagggctgttgaagagggtttaacctataagttccacgccgcatggtcaagcgtgctgcagctgttgtgcgtattcttcgaggcttgcgggcgccaagctcatccggttatgcggaaatgcctgcaatctttgtgcgatctccgcctgagccctcactttccccacacagctgctctcgaccaggctgtaggcgcggctgtcacaagcatgggaccagaggtcgtgctgcaggctgtgcctctggaaatcgacggatcagaagagaccctggattttcccaggtcgtggcttctgccggtgattcgcgaccacgttcaggagacacgactaggattctttaccacatatttccttcctctagccaacacgctgaagagcaaggcgatggatctggcacaggccggctctacagtggagagcaaaatttatgatactcttcaatggcagatgtggacactgctgcctggcttctgcacaagacctaccgatgttgctattagttttaaggggctggctcgaacactgggtatggcaatttcagagcggcctgatctgcgtgtgaccgtgtgtcaggcactgagaaccctgatcaccaagggatgccaagcagaggccgatcgggcagaggtgagcagatttgccaagaacttccttcctatcttatttaatctctatggtcagcccgtggccgccggagatacaccagcccccaggagggccgtcctggaaactatccggacttacctgacaattaccgatacccaacttgtgaactctttgctggagaaggcatcagaaaaggtgctagatcccgcatcttctgacttcacgaggctgagcgttctggatttggtcgtcgcattggccccttgtgccgacgaggctgccatttcaaagctgtacagcactatcaggccttacctggagtctaaggctcacggggttcagaagaaagcttaccgggtgcttgaagaggtttgcgctagcccccagggtccaggagccctcttcgtgcaaagccaccttgaagacctgaagaaaactctgctcgacagcctgcgttctacctcttctccagccaagagacctcggcttaagtgtcttctacacattgtcaggaaactcagcgccgagcacaaagaatttattaccgcattgatcccggaagtgatcctttgcaccaaagaggtttcagtcggggcccgcaagaacgcattcgccctcctggtggagatggggcacgcttttctgcgctttggcagcaatcaggaggaagcactccaatgttacttagttctcatatacccaggtttagtaggcgctgtaaccatggtgtcatgcagcatactggcacttacccacctgttgtttgaatttaagggcttgatgggcacttccaccgtggaacagctgctggagaatgtgtgccttctccttgcatcaagaactagggatgtggttaaatccgcgcttggttttatcaaggtagccgttacagttatggacgtagctcacctggctaagcacgtacaattagtgatggaagctataggaaaactgtcagatgacatgcgcagacacttccgcatgaagttgagaaacctgttcaccaagtttattcgcaaattcgggttcgaattggtgaagcgcttgctccccgaagaataccatcgggtgcttgtcaacatccgcaaggccgaggcgcgagccaagcggcatagagctctgtcccaagctgctgtggaggaagaggaagaagaagaggaagaggaagagcccgcacaaggtaagggggattccatcgaggagattttagcggattctgaagacgaagaggataacgaagaggaagagcgctccaggggaaaggagcagcgtaagctggcccgccagcgcagtagagcctggctcaaagagggtggcggcgatgaaccacttaacttcctcgatcctaaggtagcgcagcgcgtgttggcgacacagcctggccccggcagaggaagaaaaaaggaccatggattcaaggtgtcagcagacggcagactgattatcagagaggaagccgatggcaacaagatggaggaagaagaaggagctaagggcgaagatgaagagatggccgatcccatggaggatgtaattattcggaataagaagcatcagaaactgaaacaccagaaagaggcagaggaggaagagcttgaaattccaccccagtaccaggccggggggagcggcatccacaggccagtcgccaagaaggccatgccaggggctgaatacaaagccaagaaagctaagggcgacgtgaaaaaaaaaggaagacccgacccgtacgcttacatccccctgaatcggtctaaacttaaccgcagaaagaagatgaagctacaaggacagttcaagggcctggtaaaggccgcgcggagaggctcccaggtggggcataagaatcgaaggaaagaccggcggccctag

SEQ ID NO: 29623 - DNA, 3894 bp, Artificial Sequence
  Description of Artificial Sequence: Synthetic coding sequence
atggggaggagcggcaaactcccttctggcgtgagtgcaaaattaaagcggtggaaaaaaggacacagctctgactccaacccagccatatgcagacaccgtcaggcagcacgatccagattctttagcaggccttccgggagatctgacctcaccgtggacgcggtgaaactccataacgaactgcaaagtggtagtctgaggctggggaagagcgaggctcccgagacccctatggaggaagaggcagaactcgtcctcaccgaaaagagctccgggaccttcttaagtggcctaagtgactgcactaacgtaaccttctctaaagttcagaggttctgggagtccaattccgccgcacataaggaaatttgcgctgtgctggccgccgtgaccgaggtaatcaggagccaaggcggaaaagagacagaaaccgaatattttgcagccctgatgactaccatggaagccgtagaatccccagagtcgctggcagccgtggcctacttgctgaacctggtgcttaaacgcgtgccttcccctgtcctgataaagaaattttctgatacaagcaaggcctttatggacatcatgtccgctcaggccagctcaggttctacctccgtccttcggtgggtcctttcttgcttagcaacactgctgagaaagcaggacttagaggcctgggggtatcccgtcactctccaggtgtaccacgggctcctctcatttaccgtgcaccctaaaccaaagatcaggaaagccgctcagcatggagtatgttccgtgctcaaaggctcagaattcatgtttgaaaaggcacctgcacatcaccccgccgcgatcagcactgctaagttctgcatacaggagattgaaaaatcaggtgggtcgaaggaagctaccacgacgttacatatgctgaccctgctgaaagacctcctgccatgttttcccgagggcctcgtgaagtcatgcagtgaaaccctgcttagagtgatgactctcagccatgtgctggtcaccgcctgtgctatgcaggcttttcatagcctcttccacgcgagacccggcctctccacgcttagcgctgagttgaacgcccagataatcaccgctttgtacgactacgtgcctagcgagaacgacctccaaccgcttttggcctggctgaaagtgatggagaaggcccacataaacctggtaaggctccagtgggacctcggattggggcacctgccccgcttcttcgggacagccgtgacctgcctgctatctcctcacagccaggtacttacggctgctacacaatctctgaaagaaatcctcaaagaatgtgttgcacctcatatggctgacataggctccgtgacaagcagcgcgagcggaccagctcagtcagttgctaaaatgttcagagccgtagaagaaggcctcacatacaaattccatgcagcttggtctagtgtcctgcagctgctctgtgtttttttcgaggcttgtggccgccaggcacatccagtaatgagaaagtgtctgcaatctctgtgcgacttgaggctgagcccccattttcctcataccgcagcattggaccaggctgtcggcgcggcagtgacaagtatgggccccgaagtcgtgttgcaggctgtacccctcgagatcgatggcagtgaggaaactctggatttcccacggtcctggctgctgcccgttatcagggatcacgtccaagagactaggctcgggttcttcacaacctatttcttgcccctcgccaataccctgaaatctaaggcgatggatctggctcaggcaggctcaactgtcgagagcaagatctatgatactttacagtggcagatgtggactctccttccaggattctgtacgagacctactgatgtggccatttcctttaagggactcgcgcgaacactcggcatggctatatctgaacgtcctgatctgagggtgacggtttgtcaggccttaaggacccttatcactaaaggttgccaggccgaggcggatcgcgccgaggtgtcacgctttgctaagaatttccttcccatcctgtttaacctgtacggacaaccagtggctgccggtgacacccctgctccacggagagccgtgcttgaaaccatacgcacatacttgactatcactgatacccaacttgtcaacagtctcctggaaaaggcgtcagagaaagtgcttgacccggctagttccgacttcacccgcctttccgtgcttgacttggtcgtggccttggcgccctgcgcagacgaggccgctatctccaagctatatagtaccatccggccctatctcgaaagcaaagcacatggcgtccaaaaaaaggcttatagagttctggaagaggtttgtgcaagccctcagggcccaggggcccttttcgtgcagtctcacctcgaggacctgaaaaagacactgctggactctcttcgatcaacaagctcaccggccaaacggcccagactaaagtgtctccttcacatcgtacggaagctcagcgcggagcacaaagaatttattaccgcacttatcccggaagtgatcctctgtactaaggaagtgtccgtgggggccaggaaaaacgcctttgcccttctagtggaaatgggccacgcctttctccggttcggctctaatcaggaggaggcattacaatgttacctcgtactgatttatccagggctggtgggcgctgtgaccatggtctcctgctccattcttgccctgactcacctgctgttcgagttcaagggcctgatgggcactagcaccgtggagcagctgctggaaaacgtgtgtctcttgctggcaagcaggactcgcgacgtcgtgaaatctgctttggggtttataaaggtggccgtcaccgttatggacgtcgcacacctcgctaaacatgtccagctggttatggaggcaattggcaagctttctgacgacatgcggcgtcacttccgaatgaagttgcgcaatctgttcactaaatttattcgtaaattcggtttcgagttagtcaagcgcctcctaccagaagaataccacagagtactggtgaacatccggaaagctgaagcccgggcaaagaggcatcgcgccctttctcaagccgctgttgaggaggaggaggaggaagaggaggaggaggagccagcccaaggcaagggtgacagtattgaggagatattggcggacagcgaggatgaagaggacaacgaggaggaggaacggagccggggcaaggaacaacggaagctggcgcgacaaagatccagagcctggttaaaggaaggagggggtgatgaacccctcaacttccttgacccgaaggtggcccagcgcgtgctggcaacacaacctggtcccgggagaggccgcaagaaggaccatggtttcaaggtgtccgccgatggaaggctgatcatacgagaggaagccgatggcaataaaatggaggaggaggagggcgccaagggtgaggacgaggagatggctgaccccatggaggacgttattattcgcaacaagaaacaccagaaactgaagcaccagaaggaggccgaggaggaggaactggaaatcccaccacagtaccaagctgggggaagcgggatccataggcccgtggctaaaaaggccatgccaggggcggagtacaaggccaagaaggccaaaggagatgtaaaaaaaaaggggcgccccgacccatacgcctatataccgcttaataggtctaaactaaacaggcgtaagaaaatgaagttgcagggtcagttcaaaggtcttgtcaaggcggcgagacggggttctcaggtgggtcacaaaaaccggaggaaggatcgccgaccttag

SEQ ID NO: 29624 - DNA, 3711 bp, Artificial Sequence
  Description of Artificial Sequence: Synthetic coding sequence
atggggagatccggaaagttacctagcggggtcagcgcaaagctgaagcgctggaaaaagggccacagttccgattccaatccggccatatgccgtcacaggcaggcagcccgctccaggtttttcagcagaccaagcggtagatcagacctgaccgtggatgcagttaagctacataatgaattgcagtctggctccctgaggcttggaaagagtgaagccccggagaccccgatggaagaagaagcagaattggttttgaccgagaagagttccggtactttcttatccgggctgtcagattgtaccaacgtgacctttagcaaggtccagcggttttgggagagcaatagcgcggcacataaggagatttgtgccgtcctagccgccgttacagaagtgatcaggtcgcagggcggcaaggagacagaaacggagtattttgccgcccttgttctgagctgcttagctacacttctcaggaagcaggacctggaagcatggggataccccgtgactcttcaggtgtaccatggattgctgtcattcacagtgcaccctaagcctaaaatacgcaaggccgctcaacatggcgtgtgcagcgtcctcaagggaagcgagttcatgttcgagaaagcgcccgctcaccacccagccgccattagcaccgccaagttttgcattcaggagatagaaaagagcggagggagcaaggaggctactactactttacacatgctaacattgcttaaggacctgctgccgtgctttcccgaaggcctggtgaaaagctgtagcgagactctactccgagtaatgaccctgtcccacgtgctggtcaccgcctgtgctatgcaagctttccactctttgttccacgcacgaccagggctgagtaccctcagcgcagagttgaatgctcagatcatcactgccctctatgactatgtgccatccgaaaatgaccttcagccactgcttgcatggctgaaggtcatggaaaaagcacatatcaacctggttcgtctgcaatgggatctgggcctgggtcacctgcctcgcttttttggcacagctgtgacatgcctgctgagtccccactcgcaggtccttacagctgccactcaaagccttaaagaaatccttaaggagtgcgtggcacctcatatggcggatatcggttctgtgaccagctcagcctcagggccagctcaatctgttgccaagatgttccgcgcggtggaggaggggttgacctataagttccacgcggcctggagcagcgtgctacaacttctgtgcgtgttcttcgaggcatgcggaaggcaggcacatcctgtgatgcgtaagtgcttgcagtcactgtgcgacctcaggctgtcacctcacttccctcacaccgccgcgcttgaccaagcggtgggagccgccgtcactagtatggggcctgaagtggtgctccaggctgtacctctggagatcgatggctctgaggaaaccctggacttcccaagaagctggcttctccccgtaattagagatcacgtccaagagactcgactcggcttttttaccacgtattttctccctctggctaacacccttaagagcaaggcaatggacctcgctcaagccggctccacggtggagtccaagatctacgacactttgcagtggcagatgtggactctattacccggcttctgtaccagacccactgatgtggccatctctttcaagggccttgccagaaccttgggtatggctatcagcgagcgccctgatttgcgggtcactgtgtgccaagccctgagaaccctgattacgaagggatgccaggctgaagcagacagggcagaggtctctcggttcgcgaaaaattttctccctattctcttcaacttatacggacaacctgtagcagcaggcgatacccctgccccaaggagggctgtcctggagacaatccggacatatctgaccataacagatacccagttagtcaattccctcctggagaaggcctccgagaaagtgttagaccccgcctccagtgacttcaccaggctgtccgtgctagacctcgtggtcgctctcgccccttgtgcagacgaggccgccataagtaagctgtactcaaccattcgaccttatctggagtcgaaggctcacggcgtccaaaagaaggcttaccgggtgctagaggaagtatgtgcctctccccagggcccaggggcactatttgtccaatcgcacctggaggatctaaagaagacgttgctagattccttgaggtctacctcaagcccggctaagcgcccccgcctcaagtgcctattacacattgtcaggaaactgtcggccgaacataaagaattcataacggctctgatcccagaagtgatcttatgtaccaaagaggtgagcgtgggagctagaaagaatgcgttcgcgcttttggtggaaatgggccacgccttcctcaggttcggctccaaccaagaggaagccttgcagtgttatctggttctgatctatccggggctggtcggtgcagtgaccatggtgtcatgcagcatccttgccctgacacatctgctgttcgaatttaagggactgatggggacgtcgaccgtggaacagctgttggaaaatgtgtgcctccttctggcctcacggacacgcgatgtcgtcaagtctgcactcggatttattaaggtcgccgttaccgtgatggatgttgcccatctggccaagcacgtccagctcgtcatggaagccataggtaagctctctgacgacatgcgaagacactttcggatgaaactgcggaatttattcactaagtttattagaaagttcggatttgagctagttaaacggctcttaccagaggagtatcaccgtgtcctcgtcaacatcaggaaggctgaggcccgggctaagcgccatcgggccttaagccaggcggccgtggaggaggaagaggaggaggaggaggaagaggaacccgcgcagggcaaaggggactccattgaggagattctggcagacagcgaagacgaggaggacaatgaggaggaagaacgcagtagaggcaaggagcaacggaagctggctcgccagcgttctagggcctggctgaaagaggggggtggggacgagccactgaatttcctagatcccaaggtggcccagagagtcctggccactcagcccgggcccggtcgcggtagaaagaaggatcacgggttcaaggtgagtgctgacggtcgattgattatccgggaagaagctgatgggaataagatggaagaggaagagggagccaaaggagaggatgaagagatggcagatcccatggaggatgtaatcatcaggaacaaaaaacatcagaaactgaaacaccagaaggaggctgaagaggaagagttagagattccgccacaatatcaggccggagggtccgggattcaccgccctgtggccaaaaaggctatgcctggtgccgagtataaggccaagaaggcaaaaggcgacgtcaagaaaaaaggccgacctgacccatatgcctatattccactgaatcgaagcaaactcaacagaaggaagaagatgaaattacagggccagttcaaggggctggtaaaagccgcacgacgtggctctcaggtgggacataaaaatcggcgaaaggataggaggccatag

SEQ ID NO: 29625 - DNA, 3048 bp, Artificial Sequence
  Description of Artificial Sequence: Synthetic coding sequence
atggacattatgtccgcccaagcgagcagtggcagcactagcgtactgcgctgggtattgagctgtctcgccacactgttgaggaagcaagacctggaagcttggggatatcctgtcaccttgcaggtctatcacggtcttctatctttcaccgtgcatccaaaacctaaactggtgacagcatgcgcgatgcaggcattccactcactcttccacgccagaccaggtttgagcacattatccgcagagctaaacgcccaaatcattacagctctgtacgattacgtccctagcgagaatgacctccagcctctcctcgcttggttgaaggttatggaaaaggcccacatcaacctcgtccgactgcagtgggatcttggacttggccacctgccgcggttctttggcaccgccgtcacatgtctcctctctcctcacagccaggttttaaccgctgctacgcagagcttgaaagaaatcctcaaggagtgcgtggctccccacatggccgacatcggttccgtgacgtcttccgcctcgggtcccgcccaaagcgtcgctaagatgttcagagcggtagaggagggattaacttataagttccacgccgcttggtcctctgttcttcagctgctatgcgtgttttttgaagcgtgtgggaggcaggcccatcccgttatgagaaaatgcttgcagtctttgtgtgatctgcgtctaagccctcactttccacacacggccgcgctggatcaggcagtgggagccgccgtcaccagcatggggccagaagtggtcttgcaggcagtccccctggagattgacggaagcgaagagaccctggacttcccaaggtcctggctcctccctgtgatccgcgatcatgtgcaggagacccgacttgggttcttcactacttatttcctacccctagcgaacactttaaagagcaaggctatggacttggcccaggccgggtctaccgtcgagtccaagatttatgacaccctgcagtggcagatgtggacactgcttcctggcttctgtacaaggcccactgacgtcgccattagtttcaaaggtctggccaggacgttagggatggccataagcgagaggccagatttgagagtgacagtctgtcaggcccttcgtacactgattaccaaaggttgccaggcagaagccgatagagccgaggtcagccgcttcgctaagaattttctcccgatattgttcaatctgtatgggcaacctgtggcagccggggacacacccgccccccgacgagccgtgctagagactatcagaacatacctcacaatcacagacacacaattggtaaactccctgttggaaaaagcctcggaaaaggtccttgatcccgcttcctccgatttcacacgtctgtcagttctggatctggtggtggccttggctccctgtgcggatgaggccgccatttccaaactgtactctacaatccggccgtatttggaatctaaggctcatggcgtgcagaagaaagcttatagagtacttgaagaagtctgcgcctcacctcaggggcccggtgccttattcgtgcagagccacctcgaggatttgaagaagactttacttgactctctccggagtacatcatctcctgctaaacgccctcggctgaagtgcttactgcacatcgtccgcaagctgtctgcggaacataaggaattcatcacagccttgattcccgaagtcattttatgcactaaagaagtgtcagtgggggctagaaagaatgctttcgccctgcttgtggagatggggcatgcctttctgcggttcggaagtaaccaggaagaggccctccagtgttatctggtgctgatatacccagggctggttggagctgtgaccatggtctcctgctccatcctggcacttacacacctgctattcgaattcaaggggttgatgggaacaagtaccgtggaacagctcttggagaatgtttgcttgcttcttgcatccaggacgagggacgtcgttaagtctgcattgggttttattaaggtggcagtcactgtgatggacgtggcccacctcgcaaagcatgtgcagctggtgatggaggcaattgggaagctcagcgacgatatgaggagacacttccgaatgaaattaagaaatctgttcacaaaatttatacggaagttcggtttcgagctggtgaagcggctgttgccggaagagtaccaccgcgtgctggttaatatccggaaagccgaagcgcgtgccaagcgccacagagccctctcacaggccgccgtggaagaagaagaggaagaagaagaggaggaggagccggctcaaggcaagggcgacagcatcgaggaaattctcgctgacagcgaggatgaggaggataacgaagaggaagaacgcagcaggggcaaggagcagaggaagctggctagacagagaagcagggcatggctgaaggaagggggtggtgatgaacccttgaatttcctcgacccaaaggtagcgcagagggtcttggccacccagcccggtccaggcagggggcgtaaaaaggatcatggtttcaaggttagtgcagacggccgacttatcatacgagaggaggccgacgggaataaaatggaagaggaggagggcgcaaaaggagaagacgaagaaatggcagatcctatggaggacgtgataatccgtaataagaagcatcagaaacttaaacatcagaaggaagccgaggaggaagaactagagataccaccccagtatcaggctgggggaagtggaatacacagacctgttgccaaaaaagcaatgccaggagctgaatataaggcaaagaaagcaaagggggatgttaagaagaaaggaagacctgatccatacgcctacattccactcaataggagtaagcttaatcgcagaaagaagatgaagctacaaggtcagtttaagggtctggtgaaagctgctaggcgcggctctcaggtgggccataaaaatcgcagaaaagaccgaagaccatag

SEQ ID NO: 29626 - DNA, 849 bp, Artificial Sequence
  Description of Artificial Sequence: Synthetic coding sequence
atggcggcagcagcccccgactcccgagtgtctgaagaagagaatctgaaaaaaacaccaaagaaaaagatgaagatggttactggggctgtcgcttcggtcctggaagacgaagctaccgacacgagcgactctgaaggcagttgtgggtctgagaaggaccacttttatagcgatgacgacgccattgaagctgacagcgaaggggatgccgaaccttgcgacaaagagaatgagaacgatggcgagagcagcgtgggcactaatatgggctgggctgatgccatggcaaaggtcctgaataagaagactcccgagagcaagcccactatcttagtaaagaacaagaaactcgaaaaggagaaggaaaagctgaagcaggagaggctcgagaagattaagcagcgtgacaaacggctggaatgggaaatgatgtgccgcgttaaaccagacgtagtgcaggataaggaaaccgaacgcaacttgcaacggattgccacacgcggtgttgtacagctgtttaatgctgtccaaaagcaccagaaaaatgtggacgagaaggttaaagaagcaggatcctccatgcgaaagcgggctaagctgatttccacagtgagcaagaaggactttatatctgtgctgagaggaatggacggaagcaccaatgaaacagcgtcttcaagaaaaaagcctaaagcaaagcagaccgaagtgaagtctgaggaaggacctgggtggaccattctgagggatgatttcatgatgggcgcctctatgaaagattgggacaaagaatccgacgggcccgacgacagccggccagagtctgcctccgattcggacacttag

SEQ ID NO: 29627 - DNA, 729 bp, Artificial Sequence
  Description of Artificial Sequence: Synthetic coding sequence
atgtgggccgcggcggggggactttggaggtcaagggcaggtctccgcgcgctcttcaggtctagggacgccgcccttttccccggatgcgaacggggccttcattgcagcgctgtgtcatgtaaaaattggcttaaaaagttcgcatccaagacaaaaaagaaagtgtggtatgagtctccatcactgggcagccactccacatacaagcctagtaaattagaattccttatgcgcagcacatccaaaaagacaaggaaagaggaccatgccagattacgtgccctgaacgggctgttgtataaagcgctgactgatctgctctgtaccccagaggtgagtcaggaactctacgacttgaacgtggaactatcaaaggtcagcctcacaccggactttagcgcgtgccgtgcatactggaaaacaaccctgtccgcagagcagaacgctcacatggaggccgtcctccagcggtccgccgcccatatgtcgctgatttcatactggcagtctcagacccttgatcctggtatgaaggagaccacactgtataaaatgatctcagggacactgatgcctcacaatcctgccgcccctcagtctcggccacaagcaccagtctgtgttgggagtattatgaggaggagcaccagcaggttatggtcgactaagggagggaaaattaagggttccggggcctggtgtgggcgtgggcgatggctgagctag

SEQ ID NO: 29628 - DNA, 1032 bp, Artificial Sequence
  Description of Artificial Sequence: Synthetic coding sequence
atgtgggctgctgccggagggctttggagaagcagagctggtctcagggcgctgtttagatccagggacgccgcactattccccgggtgtgagcggggcttgcactgttccgccgtgtcctgtaaaaactggctgaaaaagttcgcctctaaaaccaagaagaaagtgtggtacgagtctccgtccctggggtcccattctacctacaaaccgtctaaactggagtttctgatgcgatctacatcgaaaaagacccgcaaggaggaccacgcccgcctccgagccctgaacggcctcctctacaaagctcttacagacctgctgtgtactcccgaagttagtcaggaactttatgacctcaatgtggagctgtccaaagtatctctgactcctgatttttccgcttgtagggcttattggaaaacaacactctccgccgagcaaaatgcccacatggaggccgttctgcagcggagcgctgcccatatgcggcatcttctgatgtcccagcagactctaaggaatgtcccccctatcgtgttcgtgcaggacaagggtaacgcagccctggctgagcttgatcagcttctggccgtcgccgacttcggacctagagatgaacgcgacaactttgtgcagaatgattttagagatcctgatgcgccgcagccatgtgggaccactgagcctacgacaagttcatctctgtgtgggatcgaccacgaagccttgaataaacagattatggaatacaaacggcgcaaggacaaggggctggggggccttgtttggcaggggcaagtggccgagctgactacgcagatgaagaagggccgcaaaagggcaaagccgcgacttgaacaagatagcagccttaagtcatacctaagcggcgaagaagttgaggacgacctggacctagtaggtgctcccgaatatgaatgctacgcccccgatacagaggagctcgaggctgaacgcggaggaggacggaccgaggacggacattcatgtggcgcatctcgcgagtag

SEQ ID NO: 29629 - DNA, 2058 bp, Artificial Sequence
  Description of Artificial Sequence: Synthetic coding sequence
atgtggttgaagctattctttctgttactctacttccttgtgttgtttgtccttgcccggttcttcgaagcaattgtttggtacgaaacagggattttcgcaacccagctggtggatcctgtggcgttgtcgttcaagaaactgaagacaatcctggagtgtcgcggcctcggctactcaggtttgccagagaaaaaagacgttcgtgaattagtggagaaatccggcgacctgatggagggagaactgtacagcgccctgaaagaagaagaagctagtgaaagcgtgagtagtaccaacttttccggggagatgcatttctatgagcttgttgaggatacgaaagatggcatctggctggtccaggttatcgctaacgacaggtcaccacttgtgggaaaaatccactgggagaaaatggtcaagaaagtaagtagattcggaatcagaacaggtacctttaactgcagctctgacccaagatattgcaggcggaggggttgggtcagatcaacgctgatcatgagcgtaccccaaacatcgacatcaaagggaaaagtgatgctcaaggagtatagcggaaggaaaatcgaggtagagcacatatttaaatggataacagctcacgcagcttcaagaatcaagaccatctacaacgccgaacatctaaaagaagaatggaacaaatcggatcagtattggcttaagatttatttattcgccaacctggatcagccccccgcgttcttctccgcgcttagtatcaagttcaccggccgagtcgaatttattttcgtcaacgttgaaaactgggataacaagagctacatgacagatatcggcatatacaacatgccttcatacattcttagaactccggaaggcatttaccggtatgggaatcatacaggggaattcatttcactgcaggctatggactcattcctgcgcagcctgcagcctgaggtcaacgacctattcgtactaagtcttgttttggtcaatctcatggcctggatggacctgtttattacccagggagctacaataaagagattcgttgtgctaatctctactctcgggacgtataattccttattgattatcagctggttaccagtcctaggctttcttcaactcccttacttggactccttctatgaatatagtttgaaattattgcgctactctaacactaccacattggcatcatgggtgagggctgattggatgttctactcttcacatccagccctattcctgagtacatacttggggcacggtctgctgattgactattttgagaaaaagaggcgtcggaacaacaacaatgacgaggtgaacgccaataatctggaatggcttagctccctgtgggattggtacacctcatacctgtttcaccccatagcgtctttccagaacttccctgtcgaatctgactgggatgaggaccccgatctgtttttggagagactggctttccctgatctgtggttgcaccctctgataccaaccgattacattaaaaacctccctatgtggcggttcaagtgtctgggggtccagtcggaggaagagatgtccgaaggttcccaggacactgaaaacgattccgaaagtgagaacacagacaccctgagtagcgaaaaagaagtctttgaggacaagcagtcagtcctgcacaattcaccagggacagccagccattgcgatgctgaggcctgcagctgcgccaacaagtactgccagaccagtccctgtgaaagaaaggggaggagttacgggagctataatactaacgaagatatggagccagattggctgacttggcccgcagatatgttacactgcaccgagtgtgtggtctgtctggagaattttgaaaatgggtgtcttctcatgggactgccttgtggtcatgtgttccatcagaactgcatagtgatgtggcttgctggaggtaggcactgttgccccgtgtgccgatggccctcctacaagaagaaacagccttatgcacagcaccagccgttgtcgaacgacgttcccagctag

SEQ ID NO: 29630 - DNA, 984 bp, Artificial Sequence
  Description of Artificial Sequence: Synthetic coding sequence
atggctgctgtcgtagaggtcgaagttggggggggcgctgcaggcgaaagagagttggacgaggtggacatgagcgatttgagtcctgaggaacagtggcgggtggaacacgctcggatgcatgctaagcatcgtggccatgaggccatgcatgccgaaatggtgttgattctgatcgccaccttggtggtggcccaattacttctggtgcagtggaagcagcgccatccccggagctacaatatggtgaccttatttcagatgtgggtggtgccactgtatttcaccgtaaagctgcactggtggcgctttcttgttatctggatcttattctctgctgttactgcctttgtcacattcagagcgaccagaaagcccctcgtgcagacaactcccagactcgtgtacaagtggttcctcctcatttacaaaattagttatgcaaccgggatcgtgggttacatggctgtcatgttcaccctttttggcctcaacttactcttcaagattaaacccgaagatgctatggatttcggcatctctttgctgttctacggtctctactatggtgtgttggagcgtgacttcgcagaaatgtgcgcagattacatggcgagcactattgggttttactcagaatctgggatgccaacgaagcacctcagcgacagcgtctgcgcagtgtgcggccagcagatatttgttgacgtgtctgaggagggaatcattgaaaacacctacaggctgagctgcaaccacgtcttccatgagttttgcattagaggctggtgcatcgttggaaaaaagcagacatgtccatattgtaaagagaaggtcgacctgaagcgaatgttcagcaacccctgggagagaccacacgttatgtacggtcagctgctcgattggctgcgctacctggtggcctggcagcctgttattatcggcgtagtgcagggcattaattacatcctgggcctcgagtag

SEQ ID NO: 29631 - DNA, 741 bp, Artificial Sequence
  Description of Artificial Sequence: Synthetic coding sequence
atggtaaccctcttccagatgtgggtcgtgcccctgtatttcaccgtgaaactccactggtggaggttcctcgtgatttggatcctcttttctgcggttacggcatttgtgaccttccgcgcaacaagaaagcctcttgtgcagacaacgcctcgtttggtgtataagtggtttctccttatatacaaaataagctacgccaccggaattgtgggatatatggcggttatgtttacattattcggcctcaacctgctgttcaaaattaaacctgaggacgcaatggacttcggcatcagtctgctattctatggtctctattacggcgtgctggagagggactttgccgagatgtgcgccgactacatggccagtactatcggcttttatagcgagtcaggaatgcccaccaaacacctgagcgacagtgtatgcgcggtctgtggtcaacagattttcgttgacgtgtccgaggaggggattattgaaaatacctatcgcttatcctgtaaccacgtatttcacgagttctgtatcagaggatggtgtattgtcgggaaaaaacagacatgcccatactgtaaagagaaggtggacttaaaacggatgttttcgaacccatgggagcggcctcacgtcatgtacggtcaactcctggattggctccggtacttagtcgcctggcagcccgtcattatcggcgtggtgcaaggaataaactatatactggggctggagtag

SEQ ID NO: 29632 - DNA, 468 bp, Artificial Sequence
  Description of Artificial Sequence: Synthetic coding sequence
atgcatccatttcagtggtgtaacgggtgtttctgcggcctggggcttgttagtaccaacaagagttgttccatgcctcctatttcctttcaggacctccctttgaacatctatatggttatcttcggtaccggcattttcgtgttcatgctaagtctcatcttctgttgttatttcatatctaagctgcgtaatcaggctcaatccgaacggtacggttataaggaggttgtgcttaagggagatgccaagaaactacagctatatgggcaaacatgcgccgtctgcctggaggactttaaaggcaaggatgaactgggcgtcctcccatgtcagcacgcatttcacagaaagtgcttggttaaatggctggaagtacggtgcgtttgccccatgtgcaataagccaatcgctagccccagtgaggcaacccagaacataggcatccttttggacgaactggtttag

SEQ ID NO: 29633 - DNA, 1146 bp, Artificial Sequence
  Description of Artificial Sequence: Synthetic coding sequence
atgctgttgagtataggcatgctgatgctcagcgccacccaggtatacaccattttgacagttcagttatttgcttttcttaatttactgcccgtcgaagctgacatactagcttataacttcgaaaacgccagtcagacgttcgacgacctgcctgctaggtttggttaccgcttgcccgccgagggcctgaaagggttcctcatcaattccaaaccagagaacgcttgcgagccgatagtccccccaccagtgaaggacaactcctcgggaaccttcattgtcctcatccgacggctggattgtaatttcgatattaaagtactgaacgctcagagagcaggctacaaggcagccatcgtgcacaacgtagactcagatgacttgatatcaatgggatctaatgacattgaagtgttaaagaaaatagatatcccctctgtgttcattggcgagtcttccgcgaatagcctcaaggatgaatttacctatgagaagggtgggcatttgatcctggtccctgagttctcccttccgctggagtactacctaataccttttctaatcatcgttggcatatgcttgatcttaattgtgattttcatgatcaccaagttcgtgcaagaccggcaccgcgcacggcggaataggctgcgcaaagatcagctcaaaaagctccccgtccataaatttaaaaaaggggatgaatacgacgtttgtgccatatgcctcgatgagtatgaggatggagacaaactgcgtatcctgccttgctctcacgcttatcattgcaagtgtgtcgacccttggctgacaaagacgaaaaagacctgcccagtgtgcaaacagaaagttgtgccgtcccagggagacagtgacagcgacactgacagtagtcaagaggagaatgaggtgactgagcacactccgctcttgcggcctctggcaagcgtgtccgcgcagtcctttggcgccctcagcgaatcaagaagtcatcagaatatgactgagagtagcgactatgaagaggatgacaatgaagatactgactcatccgatgccgagaacgagatcaacgagcacgacgtagtcgtgcagctacagccaaatggcgaaagggattacaacatcgccaacaccgtgtag

SEQ ID NO: 29634 - DNA, 1146 bp, Artificial Sequence
  Description of Artificial Sequence: Synthetic coding sequence
atgctgctctctattggcatgctgatgctgagtgctacccaagtgtatacaattctcactgtgcaactgttcgcatttctcaacttgttacctgtggaggccgacatcctcgcctacaacttcgagaatgccagtcagacctttgacgatctgcccgcacgctttggctatcgccttccagctgaggggctgaagggcttcctgattaactctaagcccgagaacgcctgtgagcctatcgttcctcctcccgtgaaagacaatagcagcggaacattcattgtcctgatccggcggctggattgcaacttcgatataaaggtgttgaacgctcagagagctggctacaaagctgctatcgtgcataacgtggactcagacgatcttatctctatgggctccaacgatattgaagtgttaaaaaagatagatatcccatctgtctttatcggagagtcgtccgcgaactctctcaaggacgagttcacgtacgagaagggagggcacctgattctggtgccggaattttctttaccacttgaatattacctcattcctttcttgataattgttggtatttgtcttatcctgattgtgatattcatgatcacaaaatttgtgcaggaccgtcaccgcgctagaaggaaccggctgcggaaggaccagttgaagaagctgccagtgcataaatttaagaaaggtgatgagtatgatgtttgcgctatttgtttagacgagtatgaggacggcgacaaacttcggatcctgccctgtagccatgcttatcactgtaagtgtgtcgacccttggcttaccaagaccaaaaagacctgccctgtgtgtaagcagaaagttgtcccctcacagggcgattccgactccgatacagatagttcacaagaggagaacgaagtgaccgagcacactcccctactccgacccctggcttcagtttcagcccagtcgtttggcgcactgagcgagagccgctcccatcaaaacatgacagaatcaagcgattacgaagaggacgataacgaggacaccgattccagtgacgcagagaacgaaatcaatgaacacgatgtcgttgtccaacttcagcccaacggagagcgcgattataatatcgcaaatacggtgtag

SEQ ID NO: 29635 - DNA, 498 bp, Artificial Sequence
  Description of Artificial Sequence: Synthetic coding sequence
atgctgctgagcatcggcatgcttatgctgtccgcgacacaagtttacacaattttgactgtccagctgtttgccttccttaatttactgcccgtggaggcggacatccttgcctacaacttcgagaatgcctcccagactttcgacgacttacccgctcgcttcggataccgcttgcccgcggagggcctgaaagggtttcttattaatagcaaacctgaaaacgcctgtgagccgatagtccctcctccagtcaaggataatagctccggcacttttatcgtactgattcgccgactggattgcaacttcgatataaaagttttgaatgcccagagagcaggttacaaagcagccattgtgcataatgtggatagtgatgacctcatcagcatggggtccaatgatattgaagtgttgaaaaaaattgacattcccagtgtattcatcggcgagtcctctgccaattctctgaaggacgaattcacatacgaatag

SEQ ID NO: 29636 - DNA, 219 bp, Artificial Sequence
  Description of Artificial Sequence: Synthetic coding sequence
atgctgctgagcatcgggatgctgatgctgagcgccacgcaggtgtatacaatcttgacagtgcagctgtttgcctttcttaacctcctgccggtggaggcagatattctcgcctacaactttgaaaacgctagccagacattcgatgatcttcctgctcgcttcggctacagactgcctgctgagggactaaagggcttcctgattaattctaagtag

SEQ ID NO: 29637 - DNA, 492 bp, Artificial Sequence
  Description of Artificial Sequence: Synthetic coding sequence
atgttgctgtccatcggaatgttgatgttatcggccacacaggtttatactatccttactgtgcagctgttcgcctttcttaatcttttgcctgttgaagctgatatactcgcctataacttcgagaacgcgagccagacattcgacgatttaccagcccgatttggttacaggctccctgccgaggggctgaagggcttcctcatcaattccaagcccgagaacgcatgcgagccaattgtgccgccaccagtcaaggacaacagctccggcacgttcattgttcttattagacgcctggattgcaacttcgatatcaaggttttaaatgctcagagagccggctacaaagcggcgatagttcacaatgtggactcagacgatctgatctccatggggtcgaacgatatcgaggtcctcaaaaagatcgatattcccagtgtttttattggcgagtctagtgctaatagcctgaaggacgagtttacatag

SEQ ID NO: 29638 - DNA, 348 bp, Artificial Sequence
  Description of Artificial Sequence: Synthetic coding sequence
atgctgctgtccatcggcatgcttatgttatccgccactcaggtttacaccatcctcaccgtccagctgttcgcctttttgaacctgctcccagtggaagcggacattctggcatacaacttcgagaacgcatcgcaaacattcgacgacctccccgccagattcgggtataggttgcctgccgagggattgaaaggctttcttatcaactcaaagccggaaaacgcatgcgagcccattgtcccacctccggtgaaagacaactcctccggaaccttcatagtacttatccgtagattggactgcaacttcgacattaaagtcctcaacgctcagagagccggatag

SEQ ID NO: 29639 - DNA, 243 bp, Artificial Sequence
  Description of Artificial Sequence: Synthetic coding sequence
atgctgttgagtatagggatgctgatgctgtctgccactcaggtttataccattcttacagtgcaactgttcgctttcctgaacctgctgcctgtggaggctgatatcctagcatacaactttgagaatgcttcacagacgttcgacgatctgcctgcgaggtttgggtacaggttgcctgccgagggtttaaaggggtttctcattaatagtaaaccagaaaacgcctgcgagccaatctag

SEQ ID NO: 29640 - DNA, 273 bp, Artificial Sequence
  Description of Artificial Sequence: Synthetic coding sequence
atgctgctttccatcggcatgttgatgctgtcagcgactcaggtgtatacgattctgactgtccagctctttgcctttctgaatttgctgccagtggaagctgacatcctggcctataatttcgagaatgccagccaaaccttcgatgatctgcctgccagattcggttacagactcccagccgagggcttgaagggatttcttattaatagcaagcccgagaatgcatgcgaacctatagtgccgccacctgtcaaagataatagtagctag

SEQ ID NO: 29641 - DNA, 876 bp, Artificial Sequence
  Description of Artificial Sequence: Synthetic coding sequence
atgttgctgagtattggcatgttgatgctgtctgccacacaggtgtacactatactgaccgtacagctgtttgcgtttcttaacctattgccagtcgaggctgatattctcgcgtacaactttgagaacgcctcacaaacatttgacgatctgcccgctaggtttggttatcgacttcctgcagaagggctgaagggctttctgattaactcgaagccggaaaacgcttgtgagcctattgtgcccccccctgtcaaggacaacagctctggcacctttattgtcttaatccgcagactggactgtaacttcgatatcaaagtgctaaacgcccagagggccgggtacaaggcggctattgtgcacaacgtggattctgatgatctgattagtatgggatcaaatgacatagaggtcctgaagaaaatagacatcccttcagtgttcattggggagagctcagccaattctttgaaggatgaatttacctatgaaaaaggaggccatctcatcttggtcccggagttctccctccccttggagtattatctcattcccttcctgatcatcgtcgggatctgcctaattctgattgtaatcttcatgattaccaagttcgtgcaggacaggcatagggcccgccgaaataggttgaggaaagaccagctcaagaaactgcccgttcataaattcaaaaagggagatgaatatgacgtgtgcgctatctgcttggatgagtacgaggacggtgataaactgcgcattctcccctgcagccatgcctaccactgtaagtgcgtagacccctggctgaccaagaccaaaaaaacctgccctgtgtgcaaacagaaaccaaagcataagaagaagaaatag

SEQ ID NO: 29642 - DNA, 1260 bp, Artificial Sequence
  Description of Artificial Sequence: Synthetic coding sequence
atgtcctgtgccgggagggccggcccagctaggttggccgcgcttgcccttctgacttgtagcctgtggcccgcccgagcagataacgccagtcaagagtactatactgctctgattaacgtcaccgtccaagagcccggaagaggtgcgccgctgactttccgcatagatcgcggcagatacggcttagattcccctaaggccgaagtgagaggccaggtgttggccccactgcccctccacggagtggccgaccatctgggctgcgatccgcaaactcgattcttcgtgcctcctaacataaagcaatggatcgcactgcttcaaagaggtaattgcacatttaaggagaagattagtcgtgctgcattccataacgcggtcgcagtggtgatctacaataacaaaagcaaagaagaaccagtgaccatgactcaccctgggactggagatatcatcgcagtgatgatcactgagttgcgcggaaaggacatactctcttacctcgaaaaaaacattagcgtgcagatgacaattgccgtggggaccaggatgcctcccaaaaatttcagccgggggtcccttgtctttgtgtcaatttcctttattgttctgatgataatcagttctgcctggctcattttctattttatccagaaaatcagatacacaaacgcgcgcgaccggaaccaacggcgattgggagatgctgcaaaaaaagccatttctaaattgacgaccaggaccgtaaagaaaggggataaagagactgacccggatttcgatcattgcgctgtgtgcattgagagttataagcagaacgacgtggtcaggatcctcccttgcaaacatgtcttccacaagtcctgtgtcgatccatggctcagtgagcactgcacgtgccccatgtgcaagcttaatattctgaaagccctcggcattgtcccaaatctgccctgtacggataacgtggctttcgacatggaaaggctgactcgcacccaggccgtgaaccgtaggagcgcactcggtgatctggccggagacaactcgcttggattggaaccgctgaggacgtccggtattagtccgctgccgcaggacggtgagctgacaccaagaactggcgagatcaatattgctgtgaccaaagaatggtttatcattgcaagcttcggactgctaagtgcgttaaccctctgttacatgatcatcagggcgacggcctccctcaacgcaaacgaggtagaatggttctag

SEQ ID NO: 29643 - DNA, 1131 bp, Artificial Sequence
  Description of Artificial Sequence: Synthetic coding sequence
atgcacctattgaaggtggggacttggaggaacaacactgcctcaagttggctaatgaagttctccgtgttgtggctcgtctctcagaattgttgcagagcctcagtggtctggatggcttacatgaacatctccttccatgttggcaatcatgtgttatcagagctgggtgagacgggggtttttggcagatcctcgacattaaagagggtggcaggggtgattgtgcctcctgaaggcaagatacaaaacgcatgcaacccgaataccattttttcccgcagcaaatacagcgagacctggttggcactgatcgagcgtgggggctgtacctttactcagaaaatcaaggtggccaccgaaaaaggcgcttccggggtcatcatctacaatgtgcccgggaccggtaaccaggtgtttccgatgttccaccaggccttcgaagacgtggtagtggtgatgattggcaatctcaaagggaccgagatattccatttgatcaagaagggggtgctgatcaccgccgtcgttgaggtgggccgaaagcatatcatttggatgaatcattacctggtgagtttcgtcatcgtgaccactgcgactctcgcatacttcatcttttaccatattcatcgcttgtgtttggcccgaatacagaataggagatggcaacgcctgaccaccgatctccagaacacatttggtcagctccagctgcgcgtggtcaaagagggggatgaggaaatcaatccaaatggagattcctgtgtgatatgctttgagcgatacaaacctaatgacatagtcaggatcttgacctgcaagcatttctttcataagaactgtatagatccctggattctgccccacggaacgtgtcccatctgcaaatgtgacatcttgaaagtactgggcatccaagtcgtggtggaaaacggaaccgagcccttgcaagtcctgatgtctaacgagctgcccgagacactttcccctagcgaggaggaaaccaataacgaggttagcccagccggcaccagcgacaaagtaatccatgtggaagaaaatcccacatcacagaacaatgacatccagccccacagtgtagtcgaggacgtccacccatcaccctag

SEQ ID NO: 29644 - DNA, 879 bp, Artificial Sequence
  Description of Artificial Sequence: Synthetic coding sequence
atgaccaccacacgctaccggcccacttgggacttggcgcttgaccctcttgtttcttgcaagctatgtttaggggagtacccagttgagcaaatgaccaccatagctcagtgtcagtgtattttttgcacattgtgcctaaagcagtacgtggaattgctgattaaggaaggcctggaaacagccattagctgtcccgacgctgcatgccccaagcaggggcacttacaggagaacgagatcgagtgtatggtggccgcggaaattatgcaaagatataaaaagcttcagtttgagcgcgaagtgctgttcgacccatgccgtacctggtgtccagcatctacctgccaggccgtttgtcagctccaggatgtgggcctgcagaccccacagccagtccagtgtaaggcatgcagaatggagttctgctctacttgcaaagcctcatggcaccctggccaaggctgtcccgagaccatgccaattacgttcctccccggcgagacatctgccgcctttaagatggaagaggatgacgcacccatcaaacgctgcccaaaatgtaaagtctatatcgaacgggacgaagggtgcgcgcaaatgatgtgcaagaactgcaaacacgccttctgctggtactgtctcgaatcgttagacgacgattttctcttgatccactatgacaagggcccctgtcggaacaagcttggccactcacgcgctagtgtcatatggcacagaacccaagtggttgggatttttgcgggattcggcctgctgctgctggtagctagtccttttctgcttctggctacaccctttgtactatgttgtaaatgcaaatgttctaaaggggacgacgatcccctgccaacctag

SEQ ID NO: 29645 - DNA, 168 bp, Artificial Sequence
  Description of Artificial Sequence: Synthetic coding sequence
atgactaccactcgctaccgaccgacttgggaccttgccctggaccctctggtgtcgtgcaagctatgcctcggagagtaccctgttgaacagatgacaaccatcgctcaatgtcaatgtatcttctgcaccttgtgtcttaagcagtatgtagagttgctgatctag

SEQ ID NO: 29646 - DNA, 597 bp, Artificial Sequence
  Description of Artificial Sequence: Synthetic coding sequence
atgacaaccacaaggtaccggcccacctgggatctggccctggacccactggtgtcctgcaagctgtgcctaggagagtatcccgttgagcaaatgaccacaattgcacagtgtcagtgcattttttgcacactctgtttaaaacagtatgtcgagttgctgattaaagaaggcctggaaaccgctatctcatgtccagatgcagcgtgccctaagcaagggcacttacaggagaatgaaatagagtgcatggtggcggctgagatcatgcagagatacaagaagctgcaatttgagcgagaagtgctgtttgatccttgcagaacctggtgccccgcttccacctgccaggccgtttgccagctgcaggatgtggggctccagactccacagccggtccagtgcaaggcttgcaggatggaattctgctctacttgcaaagcctcttggcaccctggccagggctgcccggagactatgccaatcactttcctgcctggggagacatcagcagccttcaagatggaagaggacgatgcaccgatcaagcggtgtcctaaatgctctaagggggatgacgatcctctgcctacttag

SEQ ID NO: 29647 - DNA, 168 bp, Artificial Sequence
  Description of Artificial Sequence: Synthetic coding sequence
atgaccacgacccgataccggccaacgtgggacctggcattggaccccctagtaagctgcaagctctgcctcggcgagtatcctgtcgaacaaatgaccactattgcccagtgtcaatgcattttctgcacactctgcttgaaacagtacgtggagcttctgatctag

SEQ ID NO: 29648 - DNA, 912 bp, Artificial Sequence
  Description of Artificial Sequence: Synthetic coding sequence
atgggttccgctggacgtctacactacctggccatgaccgctgaaaacccaaccccgggcgaccttgccccagctcctttaattacttgtaagttgtgcctctgcgagcaaagcctggacaaaatgacaacattgcaggagtgccaatgtatcttttgcaccgcttgccttaagcagtatatgcagctcgctattagagaaggctgcgggtctcccatcacgtgccctgatatggtctgtctcaatcatggcaccctgcaggaggcagagatcgcatgtctggtgccagtggatcagttccaactgtatcaaagactgaagttcgagcgggaagtccatctggacccctacaggacatggtgtccagttgccgactgccagacagtctgccccgtcgccagttccgaccctgggcagccagtattggtcgagtgcccttcctgccatctcaaattctgcagctgttgcaaggatgcatggcatgcagaggtaagctgccgcgactcacagccaatagtcctccctacagagcatcgggcattgttcggaactgatgccgaggctcctattaagcagtgtccggtgtgccgagtttacatcgagcgaaacgaaggctgtgcacaaatgatgtgcaagaattgcaagcacaccttctgctggtactgtctgcagaacttggacaacgatatttttctgcggcattacgataaggggccttgccggaataaattgggtcattctcgcgcctctgtcatgtggaacagaactcaggtagttgggatcctcgtcggcctgggaatcatagcacttgtgacatctccactgttattgctggcaagtccctgtattatttgctgcgtatgcaagtcttgccgtgggaaaaagaaaaagcatgatccctccacaacatag

SEQ ID NO: 29649 - DNA, 645 bp, Artificial Sequence
  Description of Artificial Sequence: Synthetic coding sequence
atgctgtggattaccatgcctcaccctgcacacttaggactattcatcgcagtgactttaagtgaggttcacctggacccctatcggacgtggtgccctgtcgctgattgtcagaccgtgtgccctgtcgcatctagcgacccaggacaacctgtgcttgtggaatgcccatcttgtcatctcaagttctgctcttgttgcaaggacgcttggcatgctgaagtttcttgccgcgatagtcagcccattgtcctgccaaccgagcacagagcactgttcggcaccgacgctgaggcacccatcaagcagtgtccagtttgccgcgtctacatcgagcgtaatgaagggtgtgcgcagatgatgtgtaaaaattgtaaacacaccttttgctggtattgtctccagaatctggataacgatatttttctgaggcattatgacaaaggcccttgtaggaacaaactgggccactccagggcctcggtcatgtggaaccgtactcaggtagtgggtatcttagtgggtctgggtattatcgcccttgtcacctcacctctccttctgctggcaagcccttgcataatttgctgcgtgtgtaaatcttgtagagggaagaagaagaagcacgatccgagcaccacctag

SEQ ID NO: 29650 - DNA, 2076 bp, Artificial Sequence
  Description of Artificial Sequence: Synthetic coding sequence
atgatgagaaaccaccgcatcgcctcgtcattgtgtggcgaccaggtgttcagtaagaagaaaaaaaagaaaaagaagaataacatggccgctaaagagaagttagaagcggttctcaacgtcgccctccgcgtcccctcaatcatgcttctggacgtgctgtacagatgggacgttagtagtttttttcaacaaatccagcggtctagcctcagcaataacccgctgttccagtataagtatcttgctttaaatatgcattatgtcggctacatcctcagcgttgttttgctcacattgccgaggcagcatctcgtccagctctatctgtacttcctgacagccttgttactgtacgctggccaccaaataagcagggattatgtgcgatccgagttagagttcgcttatgagggacctatgtacctcgagccactcagtatgaatagatttacgaccgctcttattgggcaactggttgtttgcacgttgtgctcgtgtgtgatgaaaaccaagcagatctggttgttttccgcccatatgctgccactgctggctcggctgtgcctcgttcccctcgagaccatcgtgataattaataagtttgccatgatttttactggtcttgaggtgctttacttcctcggtagtaacctgctggtgccttacaatcttgcgaaatccgcgtacagggaactggtgcaagttgtggaagtgtatggacttctggcccttggtatgtctctgtggaatcaactagtcgtaccagtcctcttcatggtgttctggttagtgctgtttgccctccagatatactcatacttttcaacacgggaccagccagctagtcgggaacgattgctgttccttttcctcacgtcaatcgccgagtgttgcagcacgccttactcacttctgggcttggttttcaccgtgagctttgtcgctctgggagtgctgaccctgtgcaagttctatctgcaaggatacagagctttcatgaatgatccagctatgaacaggggcatgacagagggcgtcactctcctgattctggccgtgcagaccggactcattgagctgcaggtggtacacagagccttcttactgagcatcatactgttcatcgtggtagccagcatcctgcagagcatgctggagatcgctgaccccattgtgctagcccttggagcatcacgtgacaagtcactgtggaagcattttcgagccgtgagcctgtgcctctttctcttggtgtttcccgcctacatggcctacatgatctgccagtttttccacatggacttctggttgctaattataattagctcctcaatcctgacaagcctgcaagtgttgggcaccttgttcatttacgtgctgttcatggtggaggagttccggaaagaacccgtcgaaaatatggatgacgtcatttattacgtcaacggcacctacaggctgttggaattcctggtggctctctgtgtggtggcttacggtgtttcggaaactattttcggggagtggaccgtcatgggcagcatgataatatttattcattcctactacaatgtttggcttcgtgcacagctcggatggaagagtttcttgctaaggagagacgctgttaataagataaaatcgctccctattgctaccaaggagcagttggaaaagcacaatgacatttgtgctatctgctatcaagacatgaaatctgccgtcatcaccccatgttctcacttttttcatgccgggtgcttaaaaaagtggctttacgttcaggaaacgtgccccctctgtcactgccacttgaaaaattcctcccagctgcccggcctcgggacagaacccgtattacagccccatgcaggtgccgagcagaacgtcatgtttcaggagggtactgaaccgccgggacaggagcatacgcctggcactcgtatccaggagggatctcgtgacaataacgaatatatcgcacgccgaccagataatcaggagggggcgtttgaccctaaggagtatccccattctgctaaagatgaagcacaccccgtggagtctgcttag

SEQ ID NO: 29651 - DNA, 2043 bp, Artificial Sequence
  Description of Artificial Sequence: Synthetic coding sequence
atggctgaagtcgtcttctccaaaaagaagaagaaaaagaagaagaacaatatggccgcgaaggaaaaactggaagctgtcctgaatgttgcacttagagtgcctagcataatgttgttagatgtgctctaccgttgggacgtctcatcattcttccagcagattcagcggagcagtttgagcaacaaccccttgtttcaatacaagtatctggctctgaacatgcactacgttggctatattctgagcgtcgtactcctcacgctgcctcgacagcacctggtgcaactctatctctatttcttaactgcattgcttctttatgccggccatcagatcagtcgcgattacgtccgatcggaactggagtttgcttatgaggggcccatgtaccttgagccgctatctatgaaccggtttacaaccgccctgatcggtcagctggtggtgtgcacgctgtgcagttgtgtaatgaagacaaagcagatctggctcttctctgcccacatgctgccattattggctcggctttgccttgtgccacttgagaccatcgtaatcattaacaaatttgccatgatcttcacaggactggaggttctgtattttctggggagcaatttgttggtgccctataacctggctaagagtgcctacagagagctggtgcaagtggtggaggtgtacgggctgttggctttgggaatgagcctgtggaaccagctagtggttcccgtcctatttatggtgttttggctcgtcttgttcgccctgcagatctacagctatttcagcacccgggaccagcctgccagcagagagaggctgttattcctttttctgacatcgatagctgaatgttgtagcaccccctacagtctgctgggtctggtgttcacggtgtcatttgtagctctgggcgtcttaacattgtgcaaattctacctgcagggatatcgggcctttatgaatgatccggccatgaacaggggcatgactgagggcgttactctcctcatccttgctgtgcaaactggactgatcgaactgcaagtggtgcaccgggcgttcttgttgagcattatcctgttcattgtggtcgctagcattctacaaagcatgctggagatcgccgatcctatcgtgctggcccttggtgccagccgcgataagtcactctggaagcacttccgtgcagtgtctttgtgtctctttttgctcgtcttccccgcttacatggcctacatgatttgccagttcttccacatggatttttggttgctcatcattatctcatccagtatcctcacatctctccaggtgcttggcactttgtttatatacgtattatttatggttgaggaatttaggaaagaacccgtggagaacatggatgacgttatttactatgtgaatggcacttataggttgttggaattcctcgtagccttgtgcgtggtcgcctatggtgtatcagagacgattttcggcgaatggaccgtcatggggtccatgattatcttcattcatagttattataatgtctggcttagggctcagctgggttggaaaagcttcctgttgaggagagatgcagtgaataaaattaaaagcctgccgattgctacaaaggagcagctggagaagcacaatgatatctgtgcaatttgttatcaggacatgaaatccgctgtcatcaccccctgttcacacttttttcacgcaggctgcctaaaaaagtggctgtatgtgcaggagacatgcccgctgtgccactgtcacctgaagaactcctctcaactacctggcttgggaaccgagcccgtcctccagccgcatgccggtgccgaacagaatgtgatgtttcaagaaggcacagaacctcccggtcaggaacacacgcccggcacacgtatccaggaaggctcccgggacaacaacgagtacatagcacggagaccagacaatcaggagggtgccttcgaccctaaagaatacccccattctgcgaaagacgaagcacatcccgtggaaagcgcttag

SEQ ID NO: 29652 - DNA, 1992 bp, Artificial Sequence
  Description of Artificial Sequence: Synthetic coding sequence
atggccgccaaggaaaagcttgaagcggtgctgaatgtggcactccgagtgccctcgattatgcttctggatgtgttgtaccggtgggacgtgtcgagtttctttcagcagatccagaggtcatcattgagtaataacccgctcttccagtataaatatctggctctgaatatgcattacgtgggttacatcctgagtgtggtccttctgacactgccccgtcagcatttagttcagttgtacctgtactttctcacagcgttactgctctacgccggccaccaaatatctcgggattacgtgagatccgagctggagtttgcctacgaaggccctatgtatttggaacctctgtctatgaataggttcaccactgcgctgataggtcaattagtggtctgcacactgtgtagctgcgtgatgaaaactaaacaaatttggctgttttcggcccacatgttaccactactggctagactgtgtctcgtcccactggaaacgattgtgataatcaacaaattcgccatgatctttactggcttagaagtcctttattttctggggagcaacctgctcgttccatacaatctcgctaagtccgcataccgggaactggtacaggtggtggaagtatacggcctgctcgccctcgggatgagtctttggaaccagctcgtcgtcccagtgctgtttatggttttttggctcgtgctgtttgcattgcagatttactcctacttttccacccgggatcagcccgccagccgtgagcgcttgctgtttctcttcttaacatctattgccgaatgctgttctaccccttacagtctgctgggcctggtgttcaccgtgtcctttgtggccctaggagtgctgacgctctgcaagttctatctgcaaggctaccgggcttttatgaacgacccagcgatgaatcgcggcatgactgaaggcgtgacgctgcttatattagctgtccagacaggtctgatcgagttgcaggtggtgcatagagcgttcttgctttcaataattctttttattgtcgtggcatctatactgcagagcatgctggagatcgcagatccaattgttttggccctcggagcatccagagacaaatcactctggaaacacttcagagcagtgtcactgtgtcttttcctcttagtgttccccgcttatatggcatacatgatttgtcagttctttcacatggatttttggctactgattattatttcgtccagcatcctaacttcgctccaggtgctgggcaccctcttcatatatgtgctgttcatggtcgaggaattccgtaaggagcccgttgagaacatggacgatgtgatctactatgtgaacggaacatataggcttctggagttcctggttgccttgtgtgtggtcgcgtacggggttagcgaaacaatatttggggagtggacagtgatggggtctatgatcattttcatccactcctactataacgtgtggcttcgcgctcaattagggtggaagagcttcctgctgcgcagggatgcagtgaacaaaattaagtccctgccgattgccaccaaggaacagctggagaagcacaatgacatttgtgccatttgctatcaagatatgaagagtgccgtgatcaccccctgctctcactttttccacgccgggtgtctcaaaaaatggctgtatgtccaagaaacctgccccctctgtcactgtcaccttaaaaatagctcacagttacccgggcttggaaccgagccagttctgcagcctcacgcgggggctgagcaaaacgtcatgtttcaggagggcactgaacccccaggccaggaacacactcccggcacccgaatccaggagggaagtagggataacaacgaatacatcgccagacggcccgataatcaggaaggggctttcgatccaaaggagtatcctcatagtgcaaaagacgaagcccatccagtggaatctgcatag

SEQ ID NO: 29653 - DNA, 2082 bp, Artificial Sequence
  Description of Artificial Sequence: Synthetic coding sequence
atgcacagggataggattagtccttcaaacagtcctacatggtctctgcaagtttttagcaagaaaaaaaaaaagaagaagaagaataacatggctgctaaggagaaactggaagctgttttgaatgtggcccttagggtcccttccattatgctcttagatgttctgtatcgctgggacgtgagcagcttttttcaacagattcagaggtctagtcttagcaataatcccctgttccagtacaaatacctggccctaaatatgcactacgtcggttatatactgagcgtcgtgctgcttactctgccgaggcagcacctggttcaattatatttgtacttcctcacagcactattactctatgcgggccatcagattagccgcgactatgtccgctccgaattagaatttgcttatgagggccccatgtatttagagcccctgtcgatgaaccggtttaccacagcacttatcggacaactagtggtctgcaccttatgtagttgcgtgatgaagaccaaacaaatctggttgttcagtgctcacatgttgcctcttctagcaagactctgcctggtcccactagagactattgtgatcatcaacaaattcgccatgatcttcaccggactggaagttctctattttctcgggtccaatctactggtcccctacaatctcgccaagagcgcttaccgggaactggttcaagtggttgaagtgtatggcttgttagctcttggtatgagtttgtggaatcagcttgtggtgcccgtgctatttatggtgttttggcttgttctctttgcccttcaaatttattcttatttctccaccagagatcaacctgcatccagggaacgacttctgttcctctttctcacaagcatcgcagaatgctgtagcacaccatacagcttacttggcctggtgttcactgtgtctttcgtggcactgggagtactgaccctctgtaagttttacctacaggggtaccgcgcttttatgaacgaccccgcaatgaatcgcggaatgaccgagggcgtgactctgcttatcctggcagtccagacaggccttattgaattacaggttgtgcatcgcgcttttttattgagcatcatcttgttcatagtcgtcgcttcaattctgcagagcatgctcgaaatcgcagaccccattgtcttagctctgggggcttcaagggacaaaagcctctggaaacacttcagagctgtgtctttgtgtttgttccttctcgtttttcccgcctatatggcctacatgatttgtcagttctttcatatggatttctggctgctgatcatcatctcctcctccattctgacaagtcttcaggtgcttgggacattgttcatctatgtgctgttcatggtagaggagttcagaaaggagcccgtcgaaaacatggatgacgtgatttattacgtaaacggaacctatcgcttactagaattcctggtggccctgtgtgttgtcgcctacggagttagcgagaccatttttggtgagtggaccgtcatgggcagtatgattatttttattcattcttactataatgtgtggttaagagcacagctgggctggaaaagtttcctgcttaggagggatgcggtgaataagatcaagtcgctgccaatagccacgaaggaacagcttgaaaaacataatgacatatgtgccatctgctatcaagacatgaaatcggccgtgatcactccatgctcgcactttttccatgctgggtgcttgaagaaatggttgtacgtccaggagacctgtccattgtgtcattgccatctcaagaattcctcacaactgcctggcctgggtactgagcctgttctgcagccccatgctggagccgagcagaatgtaatgttccaggagggtactgaaccgccagggcaagaacatacgcccggaacccgtatccaagaaggctcccgcgataataatgagtatatcgctcgcaggcctgataatcaggagggagcttttgatcctaaagagtatccacactccgcaaaagatgaggcccacccagtcgaaagcgcatag

SEQ ID NO: 29654 - DNA, 1992 bp, Artificial Sequence
  Description of Artificial Sequence: Synthetic coding sequence
atggccgccaaggagaaactggaggcggtgctgaatgtagccctcagagtgccgagcatcatgctgcttgacgttctctaccgatgggatgtaagctcattcttccaacagatccaacgctcgtcattaagtaacaaccccctctttcagtataagtatcttgcgttaaatatgcattatgttggctatattctgagtgtggttctgctcaccctgcccagacagcacctagttcaactgtatctatattttttaaccgcattgctactttacgctgggcatcagatcagcagagattatgtgaggtcagagctcgaatttgcttatgaggggccaatgtacctggagccattgtctatgaaccggtttactacagccctcataggccagctggtggtatgcactctgtgtagttgtgtcatgaagaccaaacaaatttggctgttctcagctcacatgctgccactgctcgcgcggctctgcttggttcctttggagaccatcgtgatcataaataagttcgcgatgatttttaccggcctcgaggtgttgtatttcctcgggtctaacttgttggtcccttacaatctcgccaagtctgcctacagagagctcgtccaagtggtggaggtctacggattgctggctctcggaatgtcactttggaatcagctcgtcgtgcccgtcctcttcatggtcttctggctcgtgcttttcgctctccagatctactcctatttttcaaccagagaccagcccgcatcacgtgaacgattattattcttgtttctgacctcaatcgccgaatgctgctctaccccttattcactgctcggtctcgttttcacagtctcgtttgtggcacttggcgtcctgactttatgcaagttctacctacagggttacagggcatttatgaatgatcctgctatgaatcggggcatgactgaaggggttactttgctcatcttagccgtgcagacagggctgattgaactccaagtcgtgcacagggcgttcctcctgtccatcattctgtttattgttgtggcctcaatcctgcagagcatgttagagatcgctgaccctatagtgttggcactgggggccagccgtgacaagagtctgtggaaacactttcgggccgtcagtctgtgccttttcctactggttttccccgcatacatggcgtacatgatctgtcagttcttccacatggacttctggctgctgatcatcatcagcagtagcatcttgacaagtttgcaagttcttggaaccctgtttatttatgtgctattcatggtggaagagtttagaaaggaaccggtggagaatatggatgacgtgatctattacgtgaatggaacttatcgcctcctcgagtttcttgtggcactgtgtgtcgttgcttacggagtgtcggagacaatcttcggggaatggacggttatgggaagcatgattatctttatccatagttattataacgtatggctacgagcacagcttggctggaaaagttttttgctgcgccgcgacgctgttaataaaataaagtctctgccaatagctacaaaagagcagcttgagaaacacaacgatatctgtgccatttgctatcaggatatgaagagcgcggtgattacaccatgctcccacttcttccacgctggctgtctgaaaaaatggctgtacgtgcaagaaacatgcccactatgccattgtcacctgaagaattcttctcagcttcccggactgggcactgagcccgtgttgcagccacacgccggagccgagcaaaatgtaatgttccaggaaggaacagagccccctggacaggagcatacacccggaactaggattcaggaaggctcccgcgacaacaatgagtacattgctaggcgccctgacaaccaggagggagcatttgaccccaaagaatacccccactctgcaaaagacgaagctcaccccgtcgagagtgcctag

SEQ ID NO: 29655 - DNA, 2034 bp, Artificial Sequence
  Description of Artificial Sequence: Synthetic coding sequence
atggtgttttctaaaaagaagaagaagaaaaaaaagaacaatatggctgccaaagagaaactcgaagccgttcttaacgtcgccctcagggtgccctccataatgttactggatgtgctctaccggtgggatgttagctcattttttcagcaaattcaaaggtcctcgctgagtaacaatccgttgttccagtacaagtatctcgccctcaacatgcattatgtgggttatatcctgagtgtggtgctgctgacactgccgaggcagcacttggttcaactgtatctctattttttaaccgccctgctgctgtacgctggccaccagatttcccgagactatgtccggagcgagctggagttcgcctacgaaggacccatgtacctcgaacctttgtccatgaatagattcaccacagccttgatcggccagctagtcgtatgtactctttgctcgtgtgtcatgaagacaaagcagatctggctgttctccgcccatatgctaccgctccttgcacgcttatgcctggtacctctggaaacaattgtgatcataaacaaattcgctatgattttcactgggttggaggtgctgtactttctgggcagcaacctgctggttccttacaatttagccaaatcagcataccgagaactggtgcaggtggtagaggtatacggactgctggcactcgggatgagcctgtggaaccaactggtcgtcccagtgttattcatggtgttctggttggtgttgttcgctctccagatatattcctatttctcaacccgagaccagcctgcgagccgggagagattactgtttcttttcctgacctctattgccgaatgttgcagtacgccctactccctcctggggctggtcttcacagtctctttcgttgcccttggcgtcctcacactatgtaaattttaccttcagggctaccgcgcctttatgaatgaccccgccatgaatagaggcatgaccgaaggcgtgactcttttaattctcgctgtgcaaactgggctgatcgaattacaagtagtccaccgagctttcctgctgagcatcatcctctttatcgtggtcgcctcgattctgcagtcaatgctcgaaattgccgacccaattgttctcgctctgggtgcctctcgcgataagtcattatggaagcactttagggctgtgtctctctgcctgttcctgcttgtgttccccgcatatatggcctacatgatttgccagttttttcacatggacttctggcttttgatcatcatctcatcttctatcctgacgtctctccaggtgctgggcactttatttatttatgtcctgttcatggtagaggaatttaggaaggaacctgtggaaaatatggacgacgtcatatattacgttaatgggacttatcgtcttctcgaatttttagtggccctttgcgttgtggcctacggggtctcggaaaccatcttcggagagtggacagtcatgggctcaatgatcatcttcattcactcctactataacgtgtggctgagggcacagctggggtggaaaagctttcttctgcgcagggacgctgtgaacaagataaagagtctgcctattgctactaaagaacagctcgaaaaacacaatgacatttgcgcaatttgttaccaagacatgaaatcagctgtgattacgccctgcagccacttttttcatgcagggtgcctgaagaaatggctctatgttcaggagacctgccctttgtgtcattgccacttaaagaacagtagtcagctgcccggcttaggtactgaacctgtcctccagcctcacgccggcgcagaacaaaatgttatgttccaggaggggacagagccaccagggcaggagcatacccctgggacaaggatccaggaaggatcgcgggataataatgagtatatcgccaggcgccccgataaccaagaaggagcttttgaccccaaggaatatccacacagtgccaaggacgaagcccaccctgtggagtcagcttag

SEQ ID NO: 29656 - DNA, 2040 bp, Artificial Sequence
  Description of Artificial Sequence: Synthetic coding sequence
atggccgaagtcttctccaagaagaagaagaagaagaaaaagaataatatggcggccaaggagaagcttgaggctgtcctcaatgtggcgctgagagttccatctattatgttattggacgtcttatatcgatgggatgtcagctcctttttccagcagatacagaggtcctctctatccaataaccctttattccagtataaatacctcgctctgaacatgcattatgtcggctacattctctccgtggtgctgttgaccctgcctcgccagcatctggtccagttgtatctatactttcttaccgccctcctgttatacgcaggacaccagatctcacgggactatgtgagatcggaattggaattcgcctatgaggggcccatgtacctcgaacccctgtccatgaatagattcacgaccgcactcatcggccaacttgtggtgtgcacactgtgcagttgcgtgatgaagaccaaacaaatctggcttttctcagcccacatgctgcccttgctggccaggctttgtctggtacccctcgagaccatcgtgataattaacaagttcgcaatgatttttacagggctcgaagtcctgtactttttggggagcaacctcctggtaccctacaatctagccaaaagtgcgtatcgcgagctcgtgcaggtggtggaggtctatggattattagctttagggatgagtctgtggaaccagctcgtggtgcctgtcttgttcatggtcttctggttggttctgtttgctctgcaaatttactcttatttttccactcgggaccaaccagcgtctcgcgagcgattattgtttctattcctgacttcgattgctgagtgctgttccaccccatattcactgctgggcctggtcttcactgtcagcttcgtcgccctgggcgtcttgaccctgtgcaaattttacctccagggctaccgggcatttatgaacgatcctgcaatgaaccgcggcatgacggagggggtgactttactgatcttagctgtgcagactgggcttattgagcttcaggtggtgcatagagctttcctactgtctattatcctctttattgtggttgccagcatcctgcaatccatgctggagatagccgatccaatcgtgctggccctgggcgcctctcgtgataaatctctctggaaacacttccgggcagtgtccctgtgtctattcttactggttttcccggcatacatggcttacatgatatgccagttcttccacatggacttttggctcctcattatcatctcttcgtcgatcttgacttcactgcaggtcctcggtaccctgtttatctatgtgcttttcatggttgaagaatttcgcaaagaacccgtcgaaaatatggacgacgttatctactacgtaaatggcacatatcggctgctggaatttctggtggcgctctgcgttgtggcgtatggcgtgtccgagaccatcttcggggaatggactgtgatgggctctatgattatctttatccactcctactataacgtgtggcttcgggcacagttaggctggaagtccttcctcctgaggcgcgatgccgttaataaaattaagagcctgcccatcgccacaaaggaacagctcgagaagcacaatgacatctgtgctatctgttaccaagatatgaagagtgccgtaattactccctgtagccatttctttcacgccggctgcctgaagaagtggctatacgtccaggaaacctgtccactgtgtcactgccacctgaaaaatagctcacagctgcccgggctcggaacagaacctgtcctccagccccatgccggggccgaacagaatgtgatgtttcaagagggtaccgaacctcccggccaggagcatacaccagggacacgaatccaagagggttccagggacaacaacgagtacatagccaggaggcccgacaaccaggagggggcatttgatcccaaggaataccctcactcagccaaagatgaggcacaccctgtagaaagtgcatag

SEQ ID NO: 29657 - DNA, 1992 bp, Artificial Sequence
  Description of Artificial Sequence: Synthetic coding sequence
atggcagctaaagagaagctagaggccgtgctaaatgtggccttacgtgtcccttccataatgcttctggatgtactgtaccggtgggacgtctcatccttcttccagcagattcagaggtcgtccctatcaaacaaccctctcttccagtataaatatcttgcattgaacatgcactacgtcgggtacattctgagcgtcgttctccttacactgccgagacaacacttggtccagctctacttatacttccttacagcactcctactctacgccggccatcagatttcgagagattacgtgcggagtgaattagaattcgcatacgaaggacccatgtacctggagccactgtccatgaaccggtttacgactgctttaatcggacagctagtcgtgtgcacactctgcagctgcgtcatgaagactaaacagatatggctgttcagtgcgcacatgctgccacttctggccagactttgtttggtgcctttggagacaattgtaataattaacaagttcgcaatgatattcacgggcctagaggtgttgtactttctgggcagcaacctgcttgtcccctacaatctggcaaaatccgcctaccgtgagttagttcaggttgtcgaggtctacggcttactagccctgggaatgtccttatggaaccaactggtggtgccagttctgttcatggtattctggctcgtgctgttcgcgctgcagatctacagctatttctccacgcgagaccaacccgcaagtcgcgagcgcctgctgttcctgttcttgacctcgattgcagaatgttgtagtacaccatacagcttattagggctggtcttcaccgtgagtttcgtcgccttgggcgtgcttacgttatgcaagttctatctgcagggatatagagcctttatgaacgatcctgctatgaatcggggcatgactgagggagtgacacttctgatcctagcagtgcaaactggcctgattgagcttcaagttgtacacagggcgtttctcctcagtataatcctgttcatcgtcgtggcgtcaattttgcaaagtatgcttgagattgccgacccaattgtgctagccctcggggccagccgcgataagagcctgtggaagcatttccgggctgtgagtctttgcctttttcttctcgtttttccagcttacatggcatatatgatttgccaatttttccacatggatttctggctgctgataatcatcagctcctctatcctgacatccctgcaggtgctgggtactctgttcatctacgtcttattcatggtcgaggagttccgcaaggagcctgtggaaaacatggacgacgtcatctactatgtcaacggcacgtataggctgctagaattcctggtggcattatgcgtagtggcctatggggtctcggaaacaatttttggtgagtggacggtgatggggtccatgattatattcatccactcttattataatgtgtggctgcgggcgcagctggggtggaaatctttcctgctccgccgagacgccgttaataagataaagtcgctccccatcgccaccaaagagcagctggaaaagcacaatgatatctgtgcaatttgctatcaggatatgaagagcgccgttatcacaccttgttcccacttttttcacgctgggtgcctaaaaaagtggctgtatgtgcaggagacctgtcccctgtgtcattgccacctcaagaactcttcccagttgcctgggcttggcaccgagcccgtgctgcagccgcacgcaggagccgagcagaacgtcatgttccaggaaggtacagagcccccggggcaggagcatacccctgggaccagaatccaggaaggatcgagagacaacaatgaatatatagcccggcggccagacaatcaagagggagcattcgatcctaaagaatatccccatagcgcaaaggacgaggctcaccccgtggagtcggcctag

SEQ ID NO: 29658 - DNA, 918 bp, Artificial Sequence
  Description of Artificial Sequence: Synthetic coding sequence
atgtcctttctgaggattaccccgagtacccatagctctgtgtcatccggccttctgcgtttatccatatttctgctgctgagcttcccagatagtaatgggaaagccatctggaccgcgcatctcaacatcacatttcaggtgggtaacgaaataacatcagagctgggtgaatccggggtgtttggaaaccactcccctctagagagagtgtctggagtggtggccctgccagaaggctggaaccaaaacgcctgtcaccctttaaccaattttagtcgtcctaaacaggccgactcctggctggccttaatcgagagaggggggtgtacgtttacccataagatcaatgtggctgcagaaaagggagctaatggagtgattatctacaactatcagggcacaggctccaaggtgttccctatgagtcaccagggcacggagaatatagtggccgtgatgatcagtaacttgaaggggatggagatcctgcactctattcagaaaggcgtctacgtcacggtgataatcgaagtaggcagaatgcacatgcagtgggttagccactatattatgtatcttttcacttttctggcagcgactatcgcctacttttatctagattgtgtgtggcggcttaccccaagagtccccaatagtttcaccaggagacgatcacagatcaaaacagatgtgaagaaggctattgaccagctgcagctgcgcgttttaaaagagggcgacgaagaactcgatctcaatgaagataactgcgttgtctgctttgatacctacaaaccccaggacgtcgtgcggatcttgacctgtaagcacttctttcacaaagcctgtattgacccttggcttttagcacaccgtacctgcccgatgtgcaagtgcgacatcttgaagacatag

SEQ ID NO: 29659 - DNA, 1203 bp, Artificial Sequence
  Description of Artificial Sequence: Synthetic coding sequence
atggcttggcgaagaagggaagcaagtgtgggggcccgcggcgttctcgcactagccctgctggccctggctctttgcgttcccggagccagaggtagggctcttgagtggttctctgccgtggtgaatatcgagtacgtagacccccagactaatctaactgtgtggtccgtatcagaaagtggaagatttggcgattcttctcccaaggagggggctcatggactcgtgggcgtgccctgggccccagggggagatttggagggctgcgcccctgatacaagattcttcgtacccgaacccggcggccgcggtgcagccccctgggtcgccctcgtggcacggggcggctgcacgtttaaggacaaagtccttgtagctgcccgccggaacgcctccgctgtcgtgctttacaacgaagagcggtatggcaatatcacactccccatgtctcatgccggcaccgggaacattgtggtgattatgatcagctaccctaaagggagggagattctggagctggtacagaagggaatcccagtgacaatgactataggggtcggtaccaggcatgttcaagaatttatctcagggcaatctgtggttttcgtcgccatagctttcattactatgatgattataagccttgcctggctgattttctattatatccaacgattcctgtacacagggtctcagataggctctcagagccaccggaaggaaactaaaaaggtcatcggacagctcctgttgcacacagtgaagcatggcgagaaaggaatcgacgtagatgctgagaattgtgcagtgtgtatcgaaaattttaaggtgaaagatataatccggattttaccctgcaagcatattttccacaggatatgcattgacccctggctgttggatcacagaacgtgccctatgtgcaagctggatgttattaaggccctaggctattggggggagcctggggacgtgcaggagatgcctgcgccagagagtcctccaggcagagacccagctgcaaacctgagtcttgcattgccggacgatgatggctcagacgattcaagcccgccttccgcctcacccgccgagtctgaaccccagtgtgatccctcctttaaaggagacgcgggggagaataccgccctactggaggcaggacgctcagattcccggcacggaggcccaatcagttag

SEQ ID NO: 29660 - DNA, 1191 bp, Artificial Sequence
  Description of Artificial Sequence: Synthetic coding sequence
atggccatgtctctcatccaggcgtgttgctccctggctctgagtacctggttgttaagcttctgctttgtccatcttttgtgcctcgattttacagtggccgaaaaagaagagtggtatacagcatttgtcaatatcacttacgcggagcctgcccctgacccaggcgccggggctgcggggggcggcggcgcagagctccataccgaaaagacagaatgtggacggtacggtgaacactcacctaaacaggacgctagaggcgaagtggtcatggcttctagcgcccacgatagactagcttgcgatccaaatacaaaattcgcagcccccactcgcggaaagaactggatagcccttatccctaagggcaattgcacctacagggataagatcagaaatgctttcttgcagaatgcttcagccgtggtgatttttaatgtgggctctaacaccaacgaaacaatcacgatgccccatgccggggtggaagacattgtcgccatcatgatcccagaaccaaaaggaaaagagatcgtgtccctcctcgagcgcaacattaccgtgacgatgtacatcaccattggtactcgcaatctgcagaagtaccggaggctgggcgacgcagcaaaaaaggccatcagcaagctccaaattaggacaatcaagaagggtgacaaggagactgaatcggatttcgacaactgtgctgtctgcattgaggggtacaagcccaatgacgtggttcgcattctgccctgcagacacctcttccacaagagttgtgtcgacccttggttgctggaccacaggacttgccccatgtgtaaaatgaatatactcaaagcccttggaatcccaccaaacgccgactgcatggacgatctgccgaccgacttcgaagggtccctcggagggccccccactaaccagattacgggagcctccgacacgacggttaacgaaagcagcgttaccctcgaccccgccgtccggactgtcggcgcactgcaggtcgtgcaagataccgatcctattccacaagaaggcgacgtgatatttactaccaattccgagcaggaaccagcagtctcttcggactctgacattagtctgatcatggccatggaagttggtctcagtgatgtggagctcagcaccgaccaggactgtgaggaggtgaaaagttag

SEQ ID NO: 29661 - DNA, 894 bp, Artificial Sequence
  Description of Artificial Sequence: Synthetic coding sequence
atgagcagccatgcccagcctttaaagctcatttccccatgtccctattccctttctagcggagttgaggatattgtggcgatcatgatccctgaaccaaaaggcaaggagatagttagccttctagagagaaacattaccgtgactatgtatatcaccatcgggaccagaaatctccagaaatacgtgagtaggacttcagtagtgtttgtcagcatctctttcattgtgctcatgattataagcttagcttggctcgtcttttactatattcagcgcttccgatatgccaacgcgcgcgatcgcaatcagaggaggctgggcgatgcagccaagaaggcaatctccaagctgcaaatacggacaattaagaagggtgacaaagagactgaatccgactttgacaactgcgccgtgtgtatagaaggctacaaacccaatgatgtagtgaggatcctaccatgccgccacctgttccacaagtcctgcgtagatccttggttgctggatcacagaacctgccccatgtgtaagatgaatatcctgaaagccctagggattccgccaaatgccgactgtatggatgacctcccaacagactttgagggatcactgggcggacccccaacaaaccaaattacaggcgcctcagacacaacggtgaatgaatccagcgtgacactggaccccgcagtcagaacggtgggcgcccttcaggtggtgcaggataccgaccctatcccacaggaaggcgacgttattttcacaaccaacagcgagcaggaacccgcggtgtcatctgacagcgatattagcttaatcatggctatggaagtcgggctgtcagatgtcgagctctccactgatcaggattgtgaagaagtgaaatcatag

SEQ ID NO: 29662 - DNA, 894 bp, Artificial Sequence
  Description of Artificial Sequence: Synthetic coding sequence
atgagctcacatgcacagccactgaagctgataagtccgtgtccctatagcttgtcatccggggtagaggacatcgtagccatcatgattccagaacccaaaggaaaggaaatcgtaagcctgttagagcgtaacattactgtcactatgtacatcactataggaacacggaatctgcagaaatacgtgtccaggacaagcgtcgtgttcgtaagcattagcttcattgtgctgatgattatctctttggcctggctcgtattttactatattcagagattccggtatgccaacgcacgggaccgaaatcaacgcagactgggagacgcagctaagaaggccatttcaaagctgcagattaggactatcaagaaaggagataaggagaccgaatcagactttgataattgcgctgtttgtatcgaggggtataaacctaatgatgtggtgcggatcttaccgtgtcggcacctgttccacaagtcctgcgtggatccatggcttctcgatcacaggacctgccctatgtgtaaaatgaatatcctgaaggctctggggatcccaccaaacgccgactgcatggatgacctacccaccgactttgagggaagtttgggcggcccgccaaccaaccagataacaggagctagcgatacgaccgtaaatgagtcttcggtgaccttagatccagcggttcgcaccgtaggagctctgcaggtggtgcaggacacagatcctatccctcaagaaggagacgttatattcacgacaaacagcgaacaggaacctgccgtgagttcagactccgacatatcattaattatggcgatggaagtgggcctttcagacgtcgagttgtccaccgaccaagactgcgaagaggtaaagagctag

SEQ ID NO: 29663 - DNA, 1218 bp, Artificial Sequence
  Description of Artificial Sequence: Synthetic coding sequence
atggcgatgtcattaatccaagcttgttgttctttagcattatccacctggctattgtctttttgttttgttcatctgttgtgcttggacttcaccgttgccgaaaaggaggaatggtatacagcctttgtgaatattacttacgcagaacctgcgccagatcccggcgccggcgcggctggtggcggcggcgcagagctccatactgagaaaacagagtgcggccggtacggagagcactcaccaaaacaggacgcccggggcgaggtggtgatggcctcgagtgcccatgaccgtcttgcatgtgatccaaacactaaattcgccgctccgaccaggggaaagaactggatcgcacttattccaaaagggaattgcacgtaccgtgacaagatccgaaacgcctttttgcagaacgcatcggctgtcgtaattttcaatgtaggatccaataccaacgagactattactatgccccacgcaggcgtggaggatattgtggccatcatgatcccagagcccaaggggaaggagattgtgtccctgctggaaaggaatattaccgtaacgatgtacatcactatcggtactcggaacctccagaagtacgtgtctcgaactagcgtagtgttcgtgtctataagtttcattgtgctgatgatcatttctctggcctggcttgtgttttattatatccagcgctttcggtacgcaaatgcccgcgacaggaatcagcgtaggctgggagacgcggctaagaaggctatatcaaagctccagattcgcactatcaagaagggtgacaaggaaactgagagtgacttcgataactgcgcagtgtgtattgaaggttacaaacctaacgatgtggtgcgcatcttaccatgtcgccacctgttccacaagtcctgcgttgacccatggctcctggatcatagaacgtgtcctatgtgcaaaatgaatatcctgaaagcactgggcattcctccaaatgccgactgcatggacgatctgccgaccgacttcgagggatctttgggcgggcccccgacaaatcaaatcaccggagccagcgacaccaccgtgaacgagtcttcagttacccttgatccagccgtgcgaactgtcggtgcattgcaagtggtgcaggacacagatcctattcctcaggagggcgatgtgatcttcactaccaacagcgagttttgccacacctag

SEQ ID NO: 29664 - DNA, 1317 bp, Artificial Sequence
  Description of Artificial Sequence: Synthetic coding sequence
atggctatgagcttgattcaagcttgctgctcccttgctctctccacttggttgctgtccttttgtttcgtacacctgttgtgcctggatttcactgtggccgaaaaggaagaatggtatacggcatttgtgaatattacatacgccgagccagcccctgaccctggcgctggcgctgcaggaggcggcggcgctgagcttcacacagaaaagactgaatgcggccggtatggggagcactcacctaaacaggatgcacgcggggaagttgtgatggcttctagcgcgcatgaccgcctggcatgtgaccctaatacaaaattcgcagcccctaccaggggtaagaattggatcgctctcattcccaagggtaattgtacctacagggataagatccgtaacgccttcctccagaatgcatccgccgtcgttattttcaatgtcggctcaaacaccaatgagacaataaccatgcctcatgctggagtagaagatattgtggccataatgatcccggaaccaaaggggaaggaaatcgtgagcctcctggaacgcaatatcaccgtcacaatgtacattactattggaacacgcaacctccaaaagtacgtttccagaacatccgtagtttttgtttctatttcttttattgtattgatgatcatctcgctcgcatggctcgtgttctattatatccagaggttccgttatgccaacgccagggaccgaaaccaacggcggttaggcgacgcagctaagaaagccattagcaagctacagatccggaccatcaaaaagggcgacaaagagaccgagagcgacttcgataattgtgcggtgtgtatcgagggatataagcccaacgacgtggtgaggatcctcccctgtagacatttgttccacaaatcttgtgtagacccctggttactcgatcaccgcacatgccctatgtgtaagatgaacatcctgaaagccttgggaataccaccaaacgctgattgtatggacgacctgcccaccgacttcgagggctctctcggggggccgcctactaaccagatcactggggctagcgatacgacagttaacgaaagtagcgttacactggaccccgcagttcgcacagttggtgcgctccaggtagtccaagacacagaccccatacctcaggaaggagacgtaatttttaccacaaactcagagcaggagcccgccgtctccagcgattcagacattagtcttatcatggcaatggaagttggtttatcggacgtggaactctctaccgatcaagattgcgaagaggtcaaaagctag

SEQ ID NO: 29665 - DNA, 612 bp, Artificial Sequence
  Description of Artificial Sequence: Synthetic coding sequence
atggaaaccttgtctcaggactccctgttggagtgccagatttgtttcaattactatagtccgaggcgccgccccaaactgctggactgtaaacacacttgttgttccgtgtgcctgcagcagatgcggacttcccagaaggacgtgcgatgtccgtggtgtcgtggtgttacaaaactaccgcccggtttctccgtttcgcaactgcccgatgaccctgaagttctggccgtgatcgccattccgcacacatctgaacataccccagtgtttataaaactgccttccaacggctgttacatgctgccactcccaattagcaaggagagggccctgctgcctggggacatgggatgccgcttgctaccggggtcacaacagaagtcagtgactgtagtgaccatacctgctgaacagcagcccctacagggcggcgcaccacaggaagcggtcgaggaggagcaggatcgcagaggggtggtgaaatcctccacgtggtctggagtctgcaccgttattctggtcgcttgtgtgttggtgttcctcctcggcattgtgctgcacaacatgagctgcatctctaagaggtttaccgtaatctcctgcggctag

SEQ ID NO: 29666 - DNA, 1053 bp, Artificial Sequence
  Description of Artificial Sequence: Synthetic coding sequence
atgcacccagccgcttttcctttgccagtggttgtggcagcagttttgtggggagccgcccccacaaggggacttatccgagcgacgtcggaccacaatgcctcaatggacttcgctgatctcccagctctgtttggcgccactcttagccaggaggggctgcagggattcctggtggaagcccacccagacaacgcctgttctccaatcgccccaccgcctcccgcccccgtcaatggctccgtatttatagcccttctgcgaagattcgactgtaatttcgatctaaaggttttgaacgcgcagaaggctgggtacggtgctgccgtcgtgcataatgtgaactccaatgaactgcttaacatggtctggaacagcgaggaaattcagcagcagatatggatcccctccgttttcataggcgaaagatcctctgagtaccttagagccttgtttgtctatgaaaagggagctcgcgtgctacttgtccccgacaatactttccccctgggctactatttaattcctttcacggggatcgtggggctcctcgtgctggccatgggcgccgtcatgatcgctcggtgcatacaacacagaaagcgtctgcaacgcaatcgcttgaccaaagaacagctgaagcagattcctactcatgactaccagaaaggggatcaatacgatgtttgcgccatctgccttgacgagtacgaagacggggataagctaagggtgctgccatgtgcgcacgcatatcactcccggtgcgtcgatccatggctgacacagactcgcaaaacctgccctatttgtaagcaacccgtgcaccgcgggcctggggacgaggaccaggaagaggagactcagggccaggaggaaggcgatgaaggagagccgcgggaccatccagccagtgaacgcacacccctgctgggttcatcgcctaccctcccaacaagttttgggtcactggcccccgcacccctggtcttccccggcccatccaccgatccacccttaagtcctccaagctccccagtaattttggtctag

SEQ ID NO: 29667 - DNA, 489 bp, Artificial Sequence
  Description of Artificial Sequence: Synthetic coding sequence
atgcacctgctgcccctggatagctctagtacccttacttgcactgtcccaagcgcttgcacaaaacccccttctcgctggagaccaactgtggatattttcttcgtggtgacgctgcttctaacagtgttcggtgaggacgaccagtcacaggacgtcttacggcttcatcaggacatcaacgactacaatcgacgcttcagtggccaaccgcgctcaatcatggaacgaatcatggacctaccgactttgctccgccatgcctttagggagatgttcagtgtgggcgggcttttctggatgtttagaatccgcattattctttgtctcatgggcgcttttttttatctcatcagtccactcgacttcgtgcccgaggctctgttcggcatcctgggattcctggacgacttttttgtcattttcctgctgctgatctacattagcataatgtatcgggaggtgatcactcaaaggttaacgagatag

SEQ ID NO: 29668 - DNA, 603 bp, Artificial Sequence
  Description of Artificial Sequence: Synthetic coding sequence
atggccaagtaccagggggaggttcaaagtctcaagctggacgacgatagcgtgattgagggcgtgtcagaccaggtcttggtggcagtcgttgtgtcctttgccctgatagctactctcgtctacgctcttttccgaaacgttcaccaaaatattcaccccgaaaatcaggagcttgtgcgggtcctccgggagcagctgcagactgagcaggacgcccctgcagccacacgtcagcagttttacactgacatgtattgtccaatatgcctccaccaggcctctttccccgtcgagacgaactgtgggcacctgttttgtggcgcgtgcattatcgcctactggaggtacggttcatggcttggggcaatatcctgtcctatttgcaggcaaaccggaagttccgaaaagtcaagtagagctagtgaacagacccaccaggaggccgtggcatgcttggacacccaaaatagcccagcttgtacagtgggctgccgctccgggccacagcatattccacacgataggatgctgccctcggcttcgccacgattgtgttttactctgctggactgtgtcagcattctgtggttctccgggtag

SEQ ID NO: 29669 - DNA, 138 bp, Artificial Sequence
  Description of Artificial Sequence: Synthetic coding sequence
atggcaaagtatcagggcgaggtgcaatctctgaaactggatgatgactctgtgatcgagggcgttagcgatcaggttctggtggccgtcgtagtttcatttgcccttatagcaacgctggtctatgccctgttctag

SEQ ID NO: 29670 - DNA, 777 bp, Artificial Sequence
  Description of Artificial Sequence: Synthetic coding sequence
atggccaagtaccagggagaagtacagagcctcaaactggacgacgactcagtaatcgagggagtgtccgatcaggtccttgtggctgtcgtagtgtcctttgctttgatagctaccttagtctacgctctgtttcgaaacgtccatcaaaatatccatccagaaaatcaggagctggtccgagtactcagagaacaactgcagacagaacaggatgcaccagctgcaactagacaacagttctacactgacatgtactgcccaatttgcttgcaccaggccagttttcccgttgagacaaactgcggccacctgttttgcggcgcctgcatcattgcctattggcgctatggcagttggttgggagccatcagctgcccaatttgtcgacaaaccgtaaccttactactcactgtgttcggtgaggacgaccagagccaggatgtgctacgccttcaccaggacatcaacgactataaccgtagattctctggacagccccgatctattatggagcggatcatggacctgcctactctcctgcgtcacgcgttcagagagatgttctccgtgggaggcctgttctggatgttcagaattagaatcatcctctgcttaatgggcgcatttttttatctgatcagcccgctcgacttcgtccccgaagctctgttcggcatcttaggcttcctggacgactttttcgtgatttttcttctattgatttacatttctatcatgtatagagaagttataacacagcggctgactaggtag

SEQ ID NO: 29671 - DNA, 348 bp, Artificial Sequence
  Description of Artificial Sequence: Synthetic coding sequence
atggcaaaatatcagggggaagtacagagtctgaagctggatgacgattctgtgatcgagggcgtttccgaccaagtgctagtagcagtagtcgtgagcttcgctttgatagctaccctcgtgtacgccctcttcagaaacgtgcatcagaacattcaccccgagaatcaggagttagttagagtgctgcgtgagcagctgcagaccgagcaggatgcccccgcagccactagacagcagttctatactgatatgtattgtccaatatgtttacaccaagcctcctttcctgtggagaccaattgtgggcaccttttctgtggcgcttgcattattgcttactggtag

SEQ ID NO: 29672 - DNA, 777 bp, Artificial Sequence
  Description of Artificial Sequence: Synthetic coding sequence
atggctaaatatcaaggagaagtccagagtctcaaattggatgacgactcagtaatcgaaggcgttagcgatcaagttctcgtcgctgtggtagtgtctttcgcgcttattgcaacccttgtgtatgccctctttcgaaatgtgcatcagaacatccatcccgagaatcaggagttggtgagggtcctccgtgaacaactgcagaccgaacaggatgccccggccgccacaagacagcagttttacaccgatatgtattgtcctatttgtctgcaccaggcgtcattccctgtggaaactaattgtggacacctgttctgcggcgcctgtattatagcctactggagatatggatcttggctgggggccatcagctgcccaatctgtcgccagaccgtgactttactgcttactgtcttcggggaggatgaccaatctcaagacgtcctacggctccaccaggacattaatgattacaatagacggttttcaggccagcctcgcagcataatggaacgcattatggatcttcccacgctgctgcgtcacgctttccgagagatgttctcggtcggcggattgttctggatgtttcggatcagaataatcctctgcctgatgggtgcattcttttatctgattagcccccttgactttgttccagaggcactttttgggattctaggatttctggatgacttcttcgtgatctttttgttgctgatctacatatccattatgtacagagaagtgataactcaacggctcacccggtag

SEQ ID NO: 29673 - DNA, 525 bp, Artificial Sequence
  Description of Artificial Sequence: Synthetic coding sequence
atgtactgcccaatctgtctccatcaggcttcgtttccagtcgagactaactgcggtcaccttttttgtggcgcttgcatcattgcctattggaggtatgggtcgtggctgggcgccatatcttgtccgatctgtaggcagactgtgactctcttgctcacggttttcggtgaggacgatcagtctcaggatgttctccggcttcaccaagacatcaacgattataaccggagattcagcggccagccgcggagcatcatggaacgaatcatggacctcccgaccctacttcggcacgcctttcgggaaatgttttcagtcggtggcttattctggatgttccgcattaggatcatcctgtgtctgatgggagcattcttctatctcatcagtcccctggacttcgtgccagaggcattgtttggaatcttaggttttcttgacgattttttcgttatatttctgctgctgatctacatctctatcatgtatcgcgaagttatcacacagcggctgactagatag

SEQ ID NO: 29674 - DNA, 546 bp, Artificial Sequence
  Description of Artificial Sequence: Synthetic coding sequence
atggcggatcctaccattctcgtctataagtggttcctactgatttacaaacttagttacgcattcggggttgtgggctacctggccattatgtttactatgtgtgggttcaatcttttctttaaaatcaaggcgagggacagcatggattttggaattgtgagcttgttttacgggctatattacggcgtgatggggcgcgacttcgcagaaatttgctctgactatatggcttccaccatcggcttctatagcgtgtctagactccctaccagatccctgtccgataacatatgcgctgtctgcgggcaaaagatcattgttgagcttgatgaggagggattgattgagaatacctaccagctctcatgcaatcatgtgtacccttttcaacgcaaactctttggtcttcaccaggcctctttctttccgccaagtcctcctcccccacccgtcccgattagcagtatcctgcttacatttcacgctcaaacgcccgtcctgtatcccccagcacagagctccctaccggtgtgcccctgttag

SEQ ID NO: 29675 - DNA, 987 bp, Artificial Sequence
  Description of Artificial Sequence: Synthetic coding sequence
atggctgctggaaccgccgcacgtaaggcagccccagttctggaggctcctccgcagcaagagcaactcagtcatactaagctgagcgccgaggatacttggaacctccagcaagaacgcatgtacaagatgcatagggggcatgactccatgcacgtcgagatgatcctgatttttttatgtgtccttgtcatcgcgcaaattgttctggtgcagtggcgccagaggcatggacgttcttataacctggtgacactgctgcagatgtgggttgtgccgctctacttcacaattaagctgtattggtggagattcctgtccatgtggggaatgtttagcgtgataacaagttatattttgttcagggctacacgtaaaccactaagcggtcgaacgccacgacttgtgtacaaatggtttctactgatctacaagctgagctacgcattcggagttgtgggttatttagcaattatgttcaccatgtgtggcttcaatctcttctttaagatcaaagctcgagattctatggatttcgggatcgtgtcccttttctacggactgtactacggcgtgatggggagggattttgctgagatctgctccgactacatggcctcgacgattgggttttacagcgtgtccaggctccctaccaggtcactcagcgacaacatttgcgccgtgtgcgggcagaagattattgtcgagctcgacgaggaagggctgatcgagaatacttatcagttgtcatgcaatcatgtgttccacgagttttgcatccgcggctggtgcatcgtgggtaagaagcagacctgtccatattgcaaagagaaggttgaccttaaacgaatgatctccaatccctgggaacgcacacatttcttatacggccaaatccttgactggcttaggtacctcgtcgcctggcagcctgttgtcatcggaatcgtgcaaggcattatctactcactgggtctggagtag

SEQ ID NO: 29676 - DNA, 1251 bp, Artificial Sequence
  Description of Artificial Sequence: Synthetic coding sequence
atgaaacgaagcaaagaactcattacgaagaaccacagccaagaggagaccagtatcttgcggtgctggaagtgtaggaagtgcatcgccagtagcgggtgttttatggagtatctggagaatcaggttattaaggacaaagatgactcggtggacgcgcagaacatctgccacgtctggcatatgaacgtcgaagctctaccggagtggatctcctgtttgattcagaaagctcagtggacagtcggcaaattaaattgtccgttctgcggcgcccgcctgggggggttcaacttcgtatcaaccccaaagtgctcttgtgggcaactcgccgccgtgcacctaagtaaatctaggactgactatcagcctacccaggctggtcgccttatgagacccagcgttaagtacctcagtcacccacgcgtccagagtgggtgcgacaaggaggccctgctcaccggtgggggaagtgaaaaccgtaaccacaggctcctgaatatggccagaaacaacaatgatccggggcggctgacggaggccctctgtttagaggtacgacccacttatttcgagatgaagaacgagaaattacttagcaaggcaagcgaaccaaagtaccagctttttgtccctcagctggtgacaggtaggtgcgcaaccagggcctttcataggaagtcccattctctcgacctaaacatctccgaaaaattaacactgcttcctacgctgtacgagattcatagcaaaaccaccgcatacagtaggctcaatgagacacagcccattgacctgtccggcctaccacttcagagtagcaagaacagctatagttttcagaacccttccagcttcgacccctccatgttgctgcaacggttttcagtggctccgcacgaaacccagacacaacgtggcggggagttccaatgtggccttgaagccgcaagcgtttactcagatcataccaacactaacaacttgacctttcttatggacctaccttctgctgggcggtcgatgcccgaagctagcgaccaggaggagcatttgagtcctctggacttcctgcactccgcgaacttttcattgggtagcatcaaccaacgcctgaataaacgggagcggagcaagctgaagaatttacgccgaaaacaacggcggagggagagatggctccagaagcagggcaaatattctggcgtcggcctactggaccacatggtgagcatttacctattgatctag

SEQ ID NO: 29677 - DNA, 291 bp, Artificial Sequence
  Description of Artificial Sequence: Synthetic coding sequence
atgaaacgcagtaaggagctcataaccaagaaccactcccaggaggagactagcatcttgaggtgctggaagtgtcgaaaatgcattgcatcatccggatgctttatggagtacctggaaaaccaggtcatcaaagataaggacgattctgttgatgcacagaatatttgccacgtgtggcacatgaatgtggaggctttgcccgagtggatctcctgcctgattcagaaaggtaagtacagtggagtgggccttctagaccacatggtctcgatatatctgctgatctag

SEQ ID NO: 29678 - DNA, 1779 bp, Artificial Sequence
  Description of Artificial Sequence: Synthetic coding sequence
atgaagagaagcaaagagctgattacaaagaatcatagccaagaggagacctcaattttgagatgttggaagtgtaggaagtgtatcgcttcaagtgggtgttttatggaatatctcgagaatcaggtcattaaagacaaagacgattctgtcgacgcccagaatatctgccacgtgtggcacatgaacgtcgaggcccttcccgagtggataagctgcttaatccagaaggctcagtggacggtgggtaaactcaattgccccttctgcggtgctagactggggggattcaacttcgtgagcactcccaaatgttcctgtggccaacttgctgcggtgcatctcagtaagagcagaacggattaccagcccacacaggctggccgactaatgaggccatcagtcaaatacctgtctcacccccgagtgcagagtggctgtgataaagaagccctgctaactggcggcggctccgaaaacagaaatcacaggctgttgaacatggccaggaataataacgacccagggagactgaccgaggccttgtgcttggaagtccgacccacctattttgaaatgaagaatgagaagttactttccaaggcgagcgaaccaaagtaccagctgttcgtcccacagctagtcactgggcggtgtgccacgcgggctttccacagaaagtcccatagcttagatctgaacatcagcgagaagctgacactactgcccacattatacgaaatccattccaaaaccaccgcctattctaggctgaatgaaacacagcccatcgatctaagcgggttaccgctgcagagctctaagaattcatattcatttcaaaatccttctagtttcgatcccagcatgttgctccaacggttcagtgtggctccgcacgagacacagacccagcgcggtggcgaatttcagtgtggactggaggcagctagtgtatacagcgaccacactaatactaataacttaaccttccttatggatctgcctagcgctgggcgctctatgccagaggcttctgatcaggaagaacacctttctcccctggattttctgcactcagctaatttttccctgggtagcatcaatcaacgcctgaataaaagagagcggtcaaaactcaaaaacctgcgccgtaagcaacgcagacgggaacgctggctgcagaaacaaggaaagtatagcggggttggcttgctggaccacatgactctcaataacgagatgtcaacagatgaggacaacgagtatgcagaggaaaaggattcctatatttgtgcagtttgtctggacgtgtacttcaacccctacatgtgttatccctgccaccacattttctgtgaaccttgcctccgtaccctagctaaggataatccctccagcaccccctgccctctctgtcgtaccattatctcgagagtgttttttcagactgagctgaataacgccaccaagaccttcttcaccaaagagtacctgaaaattaagcagtcctttcagaaatcaaacagtgctaagtggccactccccagctgccggaaggcatttcatctcttcgggggtttcagaaggcacgcggctccagtcacaagaagacagtttccacatggcgcacatcgcatggattatctgcattttgaagatgacagtagaggttggtggtttgatatggatatggtaataatctatatttacagtgtgaattgggtcatcggatttattgtcttttgtttcctttgctattttttttttccattctag

SEQ ID NO: 29679 - DNA, 324 bp, Artificial Sequence
  Description of Artificial Sequence: Synthetic coding sequence
atgaagcggtccaaagagctgataaccaaaaatcattcccaagaggaaacatccattctgagatgctggaagtgcagaaagtgcatcgcaagctccggctgtttcatggagtatttggagaaccaggtaatcaaggataaagatgacagtgtggacgctcagaatatctgtcatgtgtggcatatgaatgtggaagcgctgcccgagtggatcagctgtctgattcagaaagcacagtggacggtgggtaagctgaactgtccattttgcggagctcggctgggcggattcaacttcgtctccacacctaaatgctcgtgttag

SEQ ID NO: 29680 - DNA, 489 bp, Artificial Sequence
  Description of Artificial Sequence: Synthetic coding sequence
atggccagtcaaccccctgaagacaccgcggaatcccaggcctccgacgagctggaatgtaagatctgttataatcggtacaatttgaaacagcgcaagccaaaagtgctcgagtgctgccacagagtgtgcgcaaagtgtttatataagattattgattttggcgattcacctcagggggtcatcgtgtgccccttttgtaggttcgaaacttgcttgcctgatgatgaggtcagctcactgcctgatgataataacattctggtgaacttgacttgtggtggaaaggggaaaaaatgtctgccagagaatcctacagagcttctgctgaccccaaagagactcgccagcctggtgtcaccctcccacacgagctcaaattgtctcgtcattaccattatggaagtgcagcgcgagtcaagtcccagtctgagttcaactccagtagtcgagttctaccgtccagctagcttcgattcagtgacttag

SEQ ID NO: 29681 - DNA, 249 bp, Artificial Sequence
  Description of Artificial Sequence: Synthetic coding sequence
atggcatcccagccccctgaagacacggccgagtctcaagcctcagacgaactggaatgcaagatttgctacaaccgctacaatctgaagcagagaaagcccaaagttctggaatgttgtcaccgcgtgtgtgccaaatgtctgtacaaaatcatcgacttcggcgatagcccccaaggtgtgatagtgtgtccattttgtcgcttcgagacatgccttcctgacgatgaagtctcctcgctgccgtag

SEQ ID NO: 29682 - DNA, 42 bp, Artificial Sequence
  Description of Artificial Sequence: Synthetic coding sequence
atggcatctcagccgcccgaggataccgccgagtctcaatag

SEQ ID NO: 29683 - DNA, 744 bp, Artificial Sequence
  Description of Artificial Sequence: Synthetic coding sequence
atggcgagccagccaccagaagatactgccgagagccaagcctcggatgaactggagtgcaaaatctgttacaacaggtacaacttaaaacagagaaaaccgaaggtgctggagtgttgccatcgagtatgtgccaaatgtttgtataagattattgactttggtgattctccacagggagtgatcgtgtgcccgttttgccgttttgagacctgcttgccagatgacgaggtgtcctcgctgccggacgacaacaacatcttggtgaacctcacttgtgggggtaaaggaaaaaagtgcctaccagagaaccctacagaattattactgactcctaaaaggctggcctctttggttagcccctcacacacctcttccaattgtctggtcattactatcatggaggtgcagcgcgagagttctcctagtctgtcatccaccccagtcgtcgagttctaccgcccagcgtcttttgatagcgtaactacagtgagtcataattggactgtgtggaattgtacatcacttctcttccagacctctattcgggtactggtatggctgcttggtctcctctacttttctagcctgcccctgggtatatacctcctggtgtccaaaaaggtgaccctcggcgtggtgttcgtgtctctcgtgccgagcagtcttgtcatattgatggtgtacgggttctgccaatgtgtatgccatgagtttttggattgtatggcccccccctcatag

SEQ ID NO: 29684 - DNA, 156 bp, Artificial Sequence
  Description of Artificial Sequence: Synthetic coding sequence
atggcttcgcagccacccgaggacacggctgaaagccaggcgagcgacgagttagaatgcaagatctgttacaaccgttacaatctcaagcagcgcaagccaaaggtcctggaatgctgtcatcgcgtttgcgccaaatgtttgtacaaaatctag

SEQ ID NO: 29685 - DNA, 744 bp, Artificial Sequence
  Description of Artificial Sequence: Synthetic coding sequence
atggcttctcagccacccgaagataccgccgaatctcaagcctcagatgagctggaatgcaagatctgttataatagatacaatctaaagcagcgaaagccaaaagtcctggagtgctgccaccgggtttgcgctaagtgcctttataagatcatcgactttggcgactccccacaaggtgtcatcgtatgtccgttttgccggttcgagacctgcttgcccgatgacgaagtgtcgtcccttcccgatgataacaatatcctcgtgaaccttacctgtgggggcaaagggaaaaaatgtctgccggaaaatccgactgaactgctccttaccccaaagcgactcgcgagccttgtgagcccctctcatacgtcatccaactgtctagtgattacgattatggaggtgcagagggagtcatctccatccctgtcttctacccctgttgtcgaattctacaggccagccagtttcgatagcgtcactacagtgtcccataactggacagtgtggaactgtacatcgctgctctttcaaacaagcatccgcgtgctggtgtggctgctgggattgctgtatttttcttcactgcccttggggatttacttgcttgtctcgaagaaggtgaccctgggggttgtcttcgtgtctctggtacccagttctctcgtcatattgatggtttatggtttttgccaatgcgtgtgccatgagttcttggactgtatggccccccccagttag

SEQ ID NO: 29686 - DNA, 744 bp, Artificial Sequence
  Description of Artificial Sequence: Synthetic coding sequence
atggccagccagccacctgaggatacggcggaatcacaagcgagtgacgagctcgagtgtaagatctgttataaccggtacaaccttaaacaacgcaagcctaaggtgctcgagtgctgccacagagtgtgtgccaaatgtctctacaagattattgattttggggacagcccccagggagtgatcgtgtgtcccttttgcaggtttgaaacttgtctgccagatgatgaggtctcaagcttaccggacgataacaacattctggtgaatcttacatgtggaggaaaaggcaaaaaatgtctgcctgaaaacccaaccgaactgctcctgaccccaaaaagactggcgtcactcgtcagcccctctcatacaagtagtaactgcttggtcattacgattatggaagtgcaaagggagtcttcaccttcgctgagttccactccagtcgttgagttttatcggcctgcaagtttcgactctgtgaccaccgtgagtcacaactggactgtctggaattgcactagcctcctgtttcagacctccattcgtgtgctggtctggctgttgggactgctctatttttctagcttgccgctgggtatatacctgttggtctctaagaaagttacccttggggtcgtctttgtttccctcgtcccctcgagtcttgtgatattaatggtatatgggttttgtcagtgcgtgtgccacgagtttcttgattgcatggcccctccgtcatag

SEQ ID NO: 29687 - DNA, 744 bp, Artificial Sequence
  Description of Artificial Sequence: Synthetic coding sequence
atggcttcccagccaccagaggacacagcagagtcccaagcatctgatgagcttgagtgcaaaatctgctataaccggtacaacctcaaacaacggaagccgaaagtgctggagtgctgtcacagggtctgtgcgaagtgtctgtacaaaattattgatttcggcgatagcccccaaggggtgattgtgtgtccattttgtaggttcgagacctgcctgcccgatgacgaagtgtccagtcttccagatgataataacatactcgtgaacttaacctgcggtggaaagggcaagaaatgcttaccagagaatccaaccgaactgcttttgacaccgaagagactggctagtttggtgagcccatctcacacttctagtaattgtctcgtgataaccatcatggaagtccagcgagaaagttccccttcgctgtcatcgactccagtcgtggaattctaccgacctgcctccttcgatagcgttacaacggtcagccataattggacagtgtggaattgtacaagccttctgttccagacatccatacgtgttctggtttggctcctcgggctcctgtatttctcgagtttgccactagggatctacctgctggtgtctaagaaggtgacactcggagttgtatttgtgtcccttgtgccaagcagtctggtcatactcatggtttatgggttttgccagtgcgtgtgtcacgagttcttggattgcatggcaccaccctcctag

SEQ ID NO: 29688 - DNA, 579 bp, Artificial Sequence
  Description of Artificial Sequence: Synthetic coding sequence
atggcttctaaaggcccttccgcttcagcctccccagagaatagttctgctgggggcccgagtggcagcagcaacggagccggggagtctggagggcaggattccaccttcgaatgcaacatttgtctggataccgcaaaggatgccgtcatctccttatgcggccacctgttttgctggccatgtctgcatcagtggctcgagacacgaccaaatcgacaggtgtgccccgtgtgtaaagcaggtatttctagagacaaggtgatccccttgtatggccgcgggtccacgggtcaacaagacccacgagaaaagactcccccccgccctcaggggcaaaggccggagcccgaaaatagaggtgggttccagggtttcggcttcggcgacggcggttttcagatgtctttcgggattggtgcattcccattcggcatttttgctactgcctttaatatcaatgacggaaggcctccaccagctgttcccgggacacctcagtacgtcgacgagcagttcctgagccgtctgtttctcttcgttgctctagtgatcatgttctggctgctgatcgcctag

SEQ ID NO: 29689 - DNA, 393 bp, Artificial Sequence
  Description of Artificial Sequence: Synthetic coding sequence
atggctctagcccgggccgaaggtcgcacggcgctcagcagcgccacaagcgcgtggacccaaccgagaatgccgagcagcgcttgtgtagctacgagctcagtcggaagggtgtatatcagagagaagactcccccacgcccgcaaggccagaggcccgagccagagaaccgaggaggttttcagggttttggtttcggggatggtggtttccagatgagcttcggaatcggtgcattcccatttggcatctttgcaacagcttttaacatcaacgacggcagaccaccacctgcggtgcctggaacacctcagtacgttgatgagcagttcctctcacgcctgttcctgtttgtggctctggtcattatgttctggctgctgatcgcgtag

SEQ ID NO: 29690 - DNA, 474 bp, Artificial Sequence
  Description of Artificial Sequence: Synthetic coding sequence
atggctagcaaaggacccagtgcctccgcctctcctgagaactcctccgccggggggcctagcggtagcagtaacggagcgggggaatccggaggacaggatagcacttttgaatgtaacatatgtctcgacactgccaaggatgcggtgatttccctttgcggacacctgttttgttggccgtgtttgcaccagtggttggagactcgccctaacaggcaggtttgtccagtgtgcaaagcaggcatatcccgcgacaaggtgatcccactctacgggagaggcagtaccggccagcaggacccccgtgaaaagactcctcctcggccccagggccaaagaccagaaccagagaataggggtgtccggaatattctgggcgaggccagtaccaacgagcttatggctctcgaagtaagttttcttgcattacagttcttttcacttatcataaaagttaaggaaaatctttag

SEQ ID NO: 29691 - DNA, 579 bp, Artificial Sequence
  Description of Artificial Sequence: Synthetic coding sequence
atggctagtaaggggccctctgcgtccgcgtccccagagaacagttctgccgggggtccctctgggtcatccaacggcgccggcgagagcggcggtcaagattccacctttgagtgtaatatctgccttgatacggctaaggatgccgtgatctccctatgcggtcacctgttttgctggccttgtttgcatcagtggttggagacccgtccaaaccggcaggtgtgccccgtttgcaaagcaggaatcagtagggataaggtaattccactgtacggccgaggctccaccgggcagcaagaccccagagagaagacacctccaaggccacaggggcaaagaccagaaccagagaatcgtggcggcttccagggtttcgggtttggggacgggggcttccagatgtcatttgggattggggctttcccttttggcatcttcgccactgccttcaacataaacgatgggaggcctccccctgcagtgcccggaactccacagtatgttgacgagcagttcctgagcaggctgttcctgtttgtggctctcgtcatcatgttttggctcctaattgcgtag

SEQ ID NO: 29692 - DNA, 411 bp, Artificial Sequence
  Description of Artificial Sequence: Synthetic coding sequence
atggcatcaaagggcccttccgctagtgctagccctgagaactcaagcgccggggggccttcaggtagctcaaatggggccggggagtccggaggacaggactccactttcgagtgtaatatctgcttggataccgccaaggatgccgtgattagcctgtgtgggcacctgttttgctggccctgcttgcatcagggcttccaagggtttgggtttggggacggggggttccaaatgtcctttggcatcggagcctttcccttcgggatcttcgcaacagcattcaacatcaatgatggtcgcccacctcccgcagtgccagggactccacaatatgtggacgagcagtttctcagtaggctgttcctgttcgttgctctcgttatcatgttctggctgctgatcgcatag

SEQ ID NO: 29693 - DNA, 2517 bp, Artificial Sequence
  Description of Artificial Sequence: Synthetic coding sequence
atgcaagagcaggagataggcttcattagcaagtacaacgagggcctatgcgtaaacacagatccagtcagcattctcactagtattctggatatgagccttcatcgacagatgggctctgatcgcgatttacagtcctccgccagttcagtgtccctaccttctgtcaagaaggccccaaagaaaagacgtattagcattggcagcctttttcggagaaagaaagataacaagcgaaaatcccgcgaattaaacggaggggttgatggaatcgcttccattgagagcattcattccgaaatgtgtacggacaagaatagcatcttttcaactaatacgtcttctgacaatgggctaacatcaatttccaagcagattggtgactttatagaatgtcccttgtgtttactacgccactcgaaagatagattcccagacataatgacatgccaccatcggagttgtgtggactgcctgcggcagtacctcagaatagaaatatcagaaagtagagtcaatatctcttgtcccgaatgtaccgaaaggttcaacccgcatgacatcagactgattttgtctgacgacgtacttatggagaaatacgaagaattcatgctgcgccgatggctcgtggctgatccagattgccgctggtgtccagcccccgactgtggctacgctgtgatcgcttttggctgcgcctcatgtcccaagcttacttgcggtcgggagggttgtgggacggaattctgctaccattgtaagcagatctggcatcctaatcagacttgcgacgccgcccggcaggagagagcccagagcctccgtttgcggaccatcaggagctcttctatctcctattcccaagaatctggtgccgctgctgatgacattaagccctgccccagatgtgcagcttatatcatcaagatgaacgatggttcgtgtaatcatatgacttgtgctgtctgcggatgcgaattttgctggctttgcatgaaggaaattagtgacctgcactatctctccccgtctggttgcaccttttggggcaagaaaccttggtcccgcaagaaaaaaattctgtggcagctcggcacgcttgttggtgcccccgtgggaatcgccctgatagcaggaatagcgatacctgcaatgattattgggatcccggtctacgtgggcaggaagatccataatcgctatgagggaaaagacgtgtcaaagcataaacggaacctagccatcgccggaggagttaccctcagcgtgattgtcagcccggttgtggctgccgtcaccgtcggaataggagtgcccattatgttggcttacgtctacggagtggtgccgatctctctttgtagaagtgggggatgcggcgtgtcggctggtaatgggaagggtgttcgaatcgaattcgatgacgaaaacgatattaacgttggagggacgaacactgctgttgataccacatctgtggcagaggctaggcataacccttccattggggaaggcagcgtgggcggcctaactggctccctttctgctagcggcagccatatggataggatcggcgccatccgtgataatctgagcgaaacagctagcaccatggctctagctggggccagtatcactgggagcttaagtgggagcgcaatggtgaactgtttcaacagactggaagtccaggccgacgtacagaaagagaggtatagcctgagtggtgagagcggtaccgtgagccttggcacagtcagcgacaatgcgagtacgaaggccatggccgggtctatcctgaactcttatataccccttgataaagaaggtaattctatggaagtgcaagtggacattgagtcgaagccgagcaagtttagacataactcaggttcatcctccgtcgacgatggcagcgcaacccgaagccacgccggcggctcgagctcaggactgcccgagggaaagtcctctgccaccaaatggagcaaagaagctactgcggggaaaaagagtaagagcgggaaactcagaaagaagggcaatatgaaaattaacgagactagggaggatatggacgcccagcttttggaacaacaatcaacaaatagctccgagtttgaggctccttctctgtccgactctatgccttctgtcgccgattcccacagttctcattttagcgaattttcctgtagcgatttggaaagcatgaagacaagctgtagccatggcagcagtgactaccacacccggttcgctaccgttaacatactgccagaggtagaaaatgatcggctagagaattcaccccaccagtgcagcatcagcgtggttacgcagacagcatcatgttcagaagtctctcagttgaaccatatcgctgaagaacacggcaacaacggaatcaagccaaacgtcgacctctattttggagacgcgcttaaagaaaccaataataaccatagccatcagaccatggagttaaaagtggcaattcaaaccgaaatttag

SEQ ID NO: 29694 - DNA, 270 bp, Artificial Sequence
  Description of Artificial Sequence: Synthetic coding sequence
atgcaggagcaggagatcggattcatcagtaaatataacgagggactgtgtgtgaatacagatccagtatcaatcctgacaagcattctggatatgtctttacataggcagatgggaagcgatagggacctgcagtcatcggctagcagcgtttccttgcccagtgtgaagaaggctccaaaaaaaaggagaattagcatcgggtcactgtttagacgcaagaaggataacaagaggaaatccagggagttgaacggtggagttgactag

SEQ ID NO: 29695 - DNA, 2517 bp, Artificial Sequence
  Description of Artificial Sequence: Synthetic coding sequence
atgcaggaacaggaaatcggcttcatcagtaagtacaacgaggggctgtgtgtgaataccgaccctgttagtattctgaccagtattctcgacatgtctcttcatagacagatgggctcggatagagatttgcaaagctccgccagcagcgtgagcctgcccagtgtgaagaaagcccctaaaaaacggcgaatctcaatagggagtttattccggcgcaaaaaagacaacaaacggaagtctcgtgagctgaacggtggtgtcgatggcattgcctctattgagagcatacactctgaaatgtgcactgacaaaaattctattttttcaaccaacacatcttccgacaacggtctgaccagcatttccaagcagatcggggacttcatcgaatgtccactgtgcctgctccgacactctaaagaccggttcccggacattatgacgtgtcatcataggtcctgtgtcgactgtcttaggcagtatctgcgaattgagatttctgagagccgggtcaatattagctgtccggagtgtaccgagagattcaacccccatgatatcagattgatcctgtccgacgatgtactgatggagaagtatgaagagttcatgctacgccgttggttggtggccgatcccgattgtcgatggtgtcctgctcccgactgcggctatgccgtcattgctttcggatgcgcctcctgccccaaactcacatgtggcagggaaggctgtgggaccgaattctgctaccactgtaagcaaatctggcatcccaaccagacatgtgatgcagcccgacaggagagagcccagagccttaggctccggactattcgctccagcagtatcagttacagccaggagtcaggagccgccgctgatgacattaagccctgtccccggtgtgctgcctatatcataaaaatgaatgacggctcatgcaatcatatgacctgtgccgtttgcggatgcgagttttgctggttgtgtatgaaggagatttccgacttgcattacctcagtcccagcggttgtactttctggggaaagaagccttggagccgcaagaagaagatactatggcagcttgggactcttgtaggggcccccgtgggaattgcactgatagcaggaattgcaattcccgccatgatcattgggattcccgtttatgtcggccggaagattcacaatcgatacgaggggaaggacgtttccaagcacaagaggaacctggccatcgcaggcggcgttactctgtcagtcattgtgagccctgtggtcgccgctgtgaccgtgggaattggcgtgcctatcatgctagcctatgtgtacggcgtcgtgcctatttccctgtgtcggtcgggtgggtgtggtgtttcagccggcaatgggaagggagtccggatcgagtttgatgacgagaatgacatcaatgtggggggaactaacacagccgtggacacgacaagcgtagccgaagcccggcataacccgtccatcggagagggctctgtaggcggccttaccggcagcctgagcgcatcgggctctcatatggataggattggggctatccgagacaacttaagcgagaccgcaagcaccatggccctggccggcgcttcgattacgggctctcttagtggaagcgccatggtgaattgcttcaatcggctagaagtccaggccgacgtacagaaggaaaggtactctctaagcggcgaaagtggcaccgtgtctctcggcactgtgtcagacaatgcctcaacaaaggcgatggccgggagcatccttaattcatacattcccctcgacaaagaggggaattcaatggaagtgcaggttgatattgagtccaaaccaagcaagttcagacacaactctggctcatccagtgtggacgacgggtcagctaccagaagtcacgctggcggcagctcatccggactgcctgaaggcaaaagctctgctaccaagtggtctaaagaggctacagccggaaaaaaaagcaagtcagggaaactgcgcaaaaagggaaatatgaagattaatgaaacacgtgaggatatggacgcacaactgctcgagcagcaaagcaccaattccagcgaatttgaggccccctcactgtctgactcaatgccctctgtggccgactctcacagcagccacttcagcgaattttcctgctctgacctggagtccatgaagacatcttgtagccacggatcaagtgattaccatactcggttcgcgaccgtcaacattcttcccgaggtggagaatgatagacttgagaatagcccgcaccaatgttccatctccgtggtgacgcagaccgcttcatgctccgaggtgagccagttgaatcacattgccgaagagcacggaaataatgggataaagcccaacgtagacctttatttcggagacgctcttaaggaaactaataacaaccattctcaccagaccatggaactgaaagtggcgatacagacggaaatttag

SEQ ID NO: 29696 - DNA, 498 bp, Artificial Sequence
  Description of Artificial Sequence: Synthetic coding sequence
atgcaggaacaggagatagggttcatttctaagtacaacgaaggactctgcgtaaacacagatccagtgtcgatcctcacatccatactcgatatgagtctgcaccggcagatgggatctgacagggatctgcaatccagcgcatcctcggtgagtttgccttccgtcaagaaagccccgaagaaacgcagaatcagcattggcagtttatttcgtaggaagaaggacaataagcggaaatctagggaactgaatggcggtgttgatggcatcgcctcaattgagagtatccattcagaaatgtgcacggacaaaaattcaatttttagtacgaacacttcctctgacaacggcctcacaagcattagcaagcagataggagattttatcgagtgcccactttgtctcctgaggcattctaaggatcgcttcccagatatcatgacatgccatcaccgctcttgtgtcgattgcctcagacagtatctccgcatctag

SEQ ID NO: 29697 - DNA, 342 bp, Artificial Sequence
  Description of Artificial Sequence: Synthetic coding sequence
atgcaggaacaagagatcggcttcattagtaaatataatgagggcctctgtgtcaacacagaccccgtgagtatattgacgtcaatccttgatatgtcactccaccgccagatgggctcagacagggacctccagagctcagctagttctgtgtctttgcccagtgttaagaaggcccccaaaaaacgacgaatctctattggaagcctgttccgccggaagaaggataataagcggaagagccgggaactaaacgggggggtggatggaatcgcatccatcgagagcatacacagtgagatgtgtaccgataaaaattctatcttcagcactaatacctag

SEQ ID NO: 29698 - DNA, 471 bp, Artificial Sequence
  Description of Artificial Sequence: Synthetic coding sequence
atgcaggaacaggagattggcttcatttccaagtacaatgaaggtctgtgcgtaaatactgacccagttagcattctgacctccattcttgatatgtctctgcaccgacagatgggtagcgatagagatttgcagtcttctgcatcatctgttagtttgccatctgtgaagaaagccccgaaaaagcgaagaatctccattggatctctcttcagacgtaagaaggacaacaagcggaaaagcagagagctgaatgggggcgttgatgggattgcctccatcgaatccatacattcagaaatgtgcaccgataagaattccattttttccactaacactagttccgataatggccttacaagcatttccaaacaaataggggatttcattgaatgccccttgtgtctcttacggcacagtaaggaccgtttcccggacattatgacctgccaccacaggagttgcgtatag

SEQ ID NO: 29699 - DNA, 48 bp, Artificial Sequence
  Description of Artificial Sequence: Synthetic coding sequence
atgcaggaacaggaaatcggattcatctctaagtacaatgagggctag

SEQ ID NO: 29700 - DNA, 1029 bp, Artificial Sequence
  Description of Artificial Sequence: Synthetic coding sequence
atgagaaaagagacgccaccccccctggtaccacctgctgctagagaatggaaccttccacccaatgcccctgcttgtatggagcggcagctggaggcagcccgatatagatctgacggtgctctgctgctgggagcgtcatccctgagtggccgttgctgggccgggtccctttggctgtttaaggatccctgtgcagccccaaacgaggggttctgttctgcgggagtccagacagaagctggcgtggctgatttgacctgggtgggcgagcgtggcatattagtcgcttcagattccggagccgtggaattatgggaacttgacgagaatgagaccctcatcgtcagcaagttctgtaagtacgagcatgatgacatcgtgagcaccgtgagcgtactcagctccgggacccaggctgtgagcggctctaaagacatctgtataaaggtatgggatttagcacagcaggtcgtcctgagctcgtatagagctcacgctgcacaagtgacatgcgttgctgccagtccccacaaggattccgtattcctaagctgcagtgaggacaatcggatcctgctctgggacacacggtgtcccaaacctgccagccaaatcgggtgtagtgcccccggatatctacctaccagccttgcttggcaccctcaacagtccgaagtttttgtgttcggcgacgaaaacggtaccgtctctctggttgatacaaagtcgacctcttgtgttctatcaagcgcagttcactctcagtgcgtgactgggctcgtcttctcccctcactccgtgccttttctcgccagcctaagcgaagactgcagcctggcagtccttgacagctctctgtctgagctgttccgcagtcaagcacacagagatttcgtcagggacgctacctggtccccacttaatcattccctgttaaccactgtaggttgggatcaccaggtagtacaccatgtcgttcccactgaaccactgcccgcccctggtcccgcttccgtaacagaatag

SEQ ID NO: 29701 - DNA, 1764 bp, Artificial Sequence
  Description of Artificial Sequence: Synthetic coding sequence
atgggctctgaaaaggacagcgagtccccgcgttcaacatcactgcatgcagcggcgcccgaccctaagtgccgcagcgggggacgccgacgacgattaacgttgcactctgtcttcagcgcttcagcacgggggcgacgcgcacgcgccaaaccacaagcggaacctccgcctccagccgcccagcctccccccgcaccagcaccagctgcagcccagggaccgccaccggaggctttgccggccgaacctgctgcagaagccgaagcggaggctgccgccgccgcagccgagccaggctttgacgatgaagaagccgccgagggcggcgggcctggggctgaagaggttgagtgtcctctatgccttgttcgattgccccctgaaagagccccccgtctgctgagctgtccacaccgctcatgtcgggactgtctgagacattacctccgccttgaaatttcagaaagccgtgtaccgatcagttgcccagagtgtagtgagcggttaaatccccatgatatacggctgctgttagccgaccctccattaatgcataagtacgaggaattcatgcttcgccgatacctggcttcagatcccgactgtagatggtgccctgccccagattgtggctatgcagtgatcgcgtatgggtgcgcctcatgtccgaagctaacatgcgagcgcgaaggatgccagacagagttctgttaccactgtaaacagatttggcaccccaaccagacttgcgacatggcccgccagcaacgcgcccagactctgcgcgtgcggaccaaacataccagcgggctgagctacgggcaggagtcaggtcccgatgacattaagccttgtcctaggtgtagtgcgtacatcattaagatgaacgatggctcatgcaaccacatgacctgtgcagtctgcggctgcgaattctgctggctgtgcatgaaggagatttccgacctgcattacctgtcaccctccggatgtaccttttggggaaagaaaccctggtctaggaaaaagaaaatcctttggcaacttggcacactcataggcgctcctgtcggaatctcactgattgctggtatcgccatcccggctatggtcatcggaataccggtctatgtgggacggaaaatccatagtcggtacgaggggcggaagactagtaagcacaagcggaacctcgccatcacaggcggcgtcacgcttagcgtcatcgccagcccagtgatagctgcagtttctgtagggatcggagtccctatcatgctggcctatgtatacggtgtagttccaatatccttgtgccggggaggtgggtgcggcgtcagtacagcgaatggcaagggagtaaagatcgaattcgacgaggacgatgggcccattacagtcgccgacgcatggagggcactgaagaacccatcaatcggtgaaagctcgatagaaggtctgactagcgtcctgtcaaccagcggcagccccacagatggactgagcgttatgcagggaccttactcagaaaccgcctccttcgccgcccttagcggcggtacgctgagcggagggatcttatcttctggcaaaggcaaatacagtcggctggaggtccaagcagacgtacagaaggagatctttcccaaggacaccgcctctctgggcgccatttctgacaacgccagcactcgagccatggctggatcgataattagcagttacaacccacaggaccggttctcaatgatacacgcttag

SEQ ID NO: 29702 - DNA, 2199 bp, Artificial Sequence
  Description of Artificial Sequence: Synthetic coding sequence
atgggttctgaaaaggatagcgagagtccaaggagtaccagtttgcacgctgccgcgccagacccaaaatgtcgatccggcgggcgccgccgccggttaacccttcacagcgtgttctctgcctctgctcgcgggcggcgtgcccgcgctaagccacaggcggaaccccctccaccggccgcgcagccacctcccgctccagcccctgctgcggcccaaggacctcccccagaggcactccccgccgaaccagccgccgaggccgaggcggaagcagccgccgctgcagcagagccagggttcgatgacgaggaggctgccgaggggggagggcccggcgcggaggaggttgaatgccctctttgcctggtgcgtctgccccctgaacgtgcccccagactgttgtcgtgcccgcacaggtcttgtcgtgactgcctccggcactatttaagacttgagatcagtgagtcccgcgtccccattagctgccccgagtgctcagagaggctgaacccccatgatattaggctcctgctcgccgatccgcctcttatgcataagtatgaagagttcatgttacgccggtatttagcttcggatccagactgccgctggtgccccgcccctgattgtggctacgcagtgatagcttatggttgtgcatcatgccccaaactgacctgtgaacgcgagggttgtcagaccgagttttgctatcactgtaaacagatttggcatccaaaccagacatgcgatatggctagacagcagagagcccagacactaagagtgcgaacgaagcatacctcgggcttgtcttacggacaagagtctgggcccgccgatgatattaagccatgtccgcggtgttccgcctacattattaaaatgaacgacgggtcgtgcaatcatatgacttgcgccgtctgcgggtgcgagttctgctggctgtgtatgaaggaaatcagtgaccttcactacctctctccctcaggatgcacattctggggcaagaagccctggtcacgaaagaaaaaaatcctatggcagctgggaaccctcattggcgcgcctgtggggatatccttaatcgctggcatcgcaatccccgccatggttataggcattcctgtgtatgtaggccgaaagatccacagtcgctatgaggggaggaagacaagcaaacataaacggaacttggcgatcacaggaggagtgaccttaagcgtgatcgcttctcccgtgatagctgcagtatccgtgggcatcggcgtgcccatcatgttggcctacgtctacggagtggtgcccattagcctgtgtcggggcggcggttgcggggtgagtacagccaacgggaagggcgtcaagatcgaattcgatgaagacgacggtcctataaccgtggctgatgcctggcgcgcactgaagaatccctccatcggggaatcatctatagagggtcttacatctgttctctctacaagcgggtctccaactgacggcttgtccgtgatgcagggcccatactccgaaaccgctagttttgctgcactgagtggcgggacactgagcggcgggatcttgtccagcgggaaagggaagtatagcagactggaggtccaagcggacgttcagaaggagattttccccaaggataccgccagcctaggggcaattagcgacaatgcctcgactagggcaatggcgggtagtatcatttctagctacaacccacaggaccgcgagtgcaacaatatggagattcaggtggatattgaggccaagcctagccattatcagctggtgtcaggtagcagcaccgaggacagtctgcacgtgcacgcacaaatggcagaaaatgaagaagaaggaagtggcggaggcggatccgaggaagacccgccatgtagacaccagtcctgtgagcaaaaggattgcctggccagtaaaccatgggatattagcctcgctcaacccgagtctattcgtagcgatctagaaagcagcgatgcacagagcgacgacgtgcctgacattacgtcagacgagtgcggatcacctcgatctcacactgctgcctgtccttctactccccgcgcccagggagcacctagtccatccgcccacatgaacctttctgcactggccgaaggccaaaccgtccttaagccagaaggcggcgaggcgagggtatag

SEQ ID NO: 29703 - DNA, 1461 bp, Artificial Sequence
  Description of Artificial Sequence: Synthetic coding sequence
atgggctcagagaaggacagcgaatctccacgctcgaccagcctgcacgccgcggcgcctgatcctaaatgtcgatcgggaggtcgccgccggcgcttattgagctgtccgcaccggtcctgtagagattgtcttagacactacctcaggttggaaatttccgagagtagagtcccaatttcctgccctgagtgttctgagcggcttaacccacacgatataaggctacttctggctgatccgccactgatgcataagtacgaagagtttatgctccgccgttatttggcctccgatccagactgccggtggtgtccagcaccggactgtggatacgccgtgatcgcgtatggctgcgcttcgtgtcccaagctgacatgtgaaagagagggatgccagacagagttttgctaccactgcaaacagatttggcaccctaaccagacctgtgatatggctcggcagcaacgcgcacaaacactgagagtgaggacgaaacatacctcaggcctgtcatacggacaggaaagcggaccagacgacataaagccttgtccccggtgctccgcctacataatcaaaatgaacgatggaagttgtaaccatatgacctgtgctgtgtgtggctgcgagttctgctggttatgtatgaaggagatttctgatttacactatttatcaccttcaggctgcactttttggggcaagaaaccatggtcacggaaaaaaaaaatcctctggcagctgggcactttgatcggcgccccagtgggcatctctctgattgccggcattgccatccccgcaatggtcataggtatccctgtgtacgttggaaggaagattcattctaggtatgagggccgtaaaacctctaagcacaagaggaacctggctattacgggcggcgttaccctctccgtgattgcttctcctgttattgccgctgtctcagtgggcattggagtgcccatcatgttagcgtacgtgtacggggtggtccctatctccttgtgcaggggcggcggatgcggcgtttcaaccgccaacgggaaaggcgtcaagatcgagtttgacgaggatgacggaccgattacagtggccgacgcctggagggctttaaagaacccatccattggcgagtcctcaatcgagggtctcacgtccgtgctgtcaacctccggatcgccaaccgatggtttgtctgtgatgcaggggccttactccgaaactgcctctttcgccgctctaagtgggggaacactgtctgggggtattctgtccagcggaaaaggtaagtattcccggctggaggttcaggccgacgttcagaaggagatcttccctaaggataccgcatcccttggggccatcagtgataatgcatctacaagagctatggccgggagtataatatccagctacaatccacaggaccgatctagtatgccccacgtgtag

SEQ ID NO: 29704 - DNA, 1134 bp, Artificial Sequence
  Description of Artificial Sequence: Synthetic coding sequence
atgggtccggctgcgcggcccgccctccgaagtcccccacctccaccccctccaccaccgagcccactgttgctcctcctcccactgctcccactgtggctcggcctggcggggcccggagccgccgccgacgggtccgaacccgccgccggagccggcagggggggcgcccgtgcggtcagggtggacgtgcgcctgcctcgacaggacgccttagttttggagggagtcagaattgggagtgaggcagaccctgcccctctcctggggggccggctgctgcttatggatatcgtggatgccgagcaggaggctcccgtggagggctggatagccgtagcgtacgttgggaaggaacaggcggcacagttccaccaagagaataagggctccggccctcaggcttacccgaaggcactggttcaacagatgcggcgagccctgttcctgggtgctagtgctttgttgctccttatcctcaaccataatgttgttagagagttagatataagccaattactgctgcggccagttatcgtactgcactacagcagcaatgtaactaaactgctcgacgcactgttacagcgtacgcaagcaacagctgaaatcacaagcggcgagtctttgtcagccaacatagagtggaagctcacgttatggaccacttgtggcctctcaaaagacgggtatggagggtggcaggaccttgtgtgcctgggtgggtctcgggcccaagagcagaaaccgctgcagcagttgtggaatgctattctccttgtcgccatgctcttatgtaccggactggtggtgcaggcccaacgtcaggcctccaggcagagccaaagggagttgggggggcaggtggaccttttcaaacgccgggttgtacgacggctggcgagccttaagacccgtaggtgccgcctctctcgtgctgcccagggcctaccagaccccggggctgagacgtgcgctgtttgccttgactatttctgcaacaagcagtggctgcgtgtgctaccgtgcaaacatgagttccacagagactgtgttgacccatggctgatgctccaacagacatgtcccctatgcaaatttaacgtactcggtaatcgctattctgacgactag

SEQ ID NO: 29705 - DNA, 561 bp, Artificial Sequence
  Description of Artificial Sequence: Synthetic coding sequence
atggcaccttgcacagagaccaagatctttgtgctgtgcgacgaacagatccagtgtccgacctgccagttcgtttggtgcttcaagtgccattcgccttggcatgagggcgttaactgcaaagagtataagaagggggacaaactcctgaggcattgggcaagcgaaatcgagcatggtcagcggaacgctcaaaagtgcccaaagtgtaagattcatattcagcggacagaaggctgtgatcacatgacttgctcccagtgcaataccaatttttgttatcgttgcggagagagatatagacagctgagattttttggagatcacacaagtaatctcagtatattcgggtgcaagtataggtacctgccggaacgccctcatcttcgacggctagtccgcgggagcgtctgcgccggaaaattatttatagccccactcattatggttttgggcctggcactcggagccatcgccgtggtgatcggactctttgtgtttcccatttattgcttgtgcaaaaagcagcggaaacgaagcagaactggaatgcattggtag

SEQ ID NO: 29706 - DNA, 828 bp, Artificial Sequence
  Description of Artificial Sequence: Synthetic coding sequence
atgaaggttcagttaggccaggtagagattaagtgccccattaccgagtgctttgaatttctggaggagaccaccgtcgtttacaatttgacccatgaggatagcattaagtacaagtacttcttggagctgggcaggattgactcaagtaccaagccatgccctcaatgcaaacacttcactacattcaagaagaaggggcacataccgacaccctcaaggagtgagtctaagtataagatccagtgcccaacttgtcagttcgtgtggtgcttcaagtgtcattccccctggcacgagggcgtgaactgcaaagaatacaaaaaaggtgacaagttgctgcgccactgggcaagtgagattgaacatggccagcgcaatgctcaaaagtgccctaaatgcaaaatccacattcagaggacggaagggtgcgatcacatgacctgttcgcagtgtaacaccaatttttgctacaggtgtggtgaacgttaccgccagctacgattctttggagaccacacctcgaacctctcgattttcgggtgcaagtaccggtatctgcccgaacgcccccacctgcggagactggtacggggcagcgtgtgtgctggcaaattgttcattgccccactcattatggtgctgggactggcccttggagcaatcgccgtggtcattgtagaggagataaaaacctactggaacctaattagcggtcgaacacgaaaccagacccaacacctggcgccacaacccgtgctgctgagcgacatgctgtactgtctgaaacaagtatttatatgcatcagctacctgctacccctgtag

SEQ ID NO: 29707 - DNA, 9 bp, Artificial Sequence
  Description of Artificial Sequence: Synthetic coding sequence
atgaaatag

SEQ ID NO: 29708 - DNA, 924 bp, Artificial Sequence
  Description of Artificial Sequence: Synthetic coding sequence
atgccatccctcctgggagcacctccctatagcggactgggcggcgtgggggacccatatgtgccgctgatggtgttgatgtgtagggtctgtctggaagataaacctatcaagcctctgccatgttgcaaaaaggcagtttgtgaagagtgcttgaaagtctatctgagtgcacaggtgcagttgggccaggtggaaattaagtgtccaataaccgaatgcttcgagtttctcgaggagaccacagtagtgtacaacctgacccatgaggatagcatcaaatacaagtacttccttgaattaggaagaattgactcctcaacgaagccctgccctcagtgcaagcatttcacaacctttaaaaaaaaaggccatatcccaactcccagtagatccgagagtaagtataaaatccagtgccccacttgccagttcgtttggtgtttcaaatgccactccccttggcatgaaggggtaaactgtaaggaatataaaaagggagacaagctgctgcgccactgggcctctgaaattgaacacggtcagcggaacgcacagaagtgcccaaaatgcaagatccacattcagaggacagaagggtgcgatcatatgacatgttctcagtgtaacacaaacttttgctaccggtgcggcgagaggtaccgccaactgcgattttttggtgaccacacctcaaatctatccattttcggctgtaaatacagataccttcccgaaaggcctcaccttaggaggctcgtgcggggctcggtgtgtgctggcaaattgttcatcgcacctctgattatggtgctgggtcttgccctaggcgccatagcggtagtgatcggtctgttcgtgtttcccatctactgcctgtgtaaaaaacagagaaaaagatcaagaaccgggatgcactggtag

SEQ ID NO: 29709 - DNA, 750 bp, Artificial Sequence
  Description of Artificial Sequence: Synthetic coding sequence
atgtcatccggccagcaggtgtggcataccgctgtgccaccgccaaggcgatcatcgtctatcgcgtcgatgcccagaagcccctcctcagcaggtagcccccgctctcctgggacacccgggagtgaacgagttgcttctccgcttgagtgttctatttgcttttccggatatgacaacatcttcaagacccccaaggagttgagctgtacccatgtcttctgcttggagtgtttagctcggctagccgctgcccagcccgtgggcaggccaggaggggaagcagtcccgtgccctttttgtcgtcagcctactgcagttcctcctgccggggcacctgcactgtgtacaagccgtcagctgcaagcacgtatgcctgctcacctgaggcgggaagaaccagtatggttggagggtacaaaattatgctgtcagcctttgcccaccacacctggccgcgagccgggattcgtgtgcgttgatgtgggcctttcaaaacctgccgagccacctgcccctgcaagagatccggcaccgcggagagggcgcttggcaagatgttgggccagatgtcgggattggcgcaggatggcactggtgagcgcactgctgctaatgctcttctgtgtggcactgtggccagttcagtgtgctttgaaaacaggcaatctgcgctgtcttccactgcctcctagaccccccgctacatccaccgcagccagccctctcgggccacttactgacaattag

SEQ ID NO: 29710 - DNA, 3006 bp, Artificial Sequence
  Description of Artificial Sequence: Synthetic coding sequence
atgagcggtccgggcaacaagagagccgccggtgacggggggtccgggcccccagaaaagaagctttcccgagaggaaaagacaaccaccactttgatcgagcccataagactgggcgggatttcttcaaccgaagagatggatctcaaagttctgcagtttaagaataaaaagttagccgaaaggctcgagcaaaggcaggcgtgcgaagatgagcttcgggaacgcatcgagaaactggagaagcggcaggccactgatgacgccaccctgcttatagtgaaccgttactgggcccagcttgacgaaacagttgaggccttgctcagatgtcatgaatcccagggtgagctcagtagcgctcctgaagcacccggcacgcaggaggggccaacttgtgacggtacccctctcccagagcccggcacttccgaactgcgcgacccattgctcatgcaactccggcctcctctcagcgagccagcactggctttcgtggttgcccttggcgcctccagtagcgaggaggtcgaattggagttgcagggacgcatggaatttagcaaggccgctgtaagtcgcgttgtggaggcttctgacaggttgcagcgaagagttgaggaattgtgtcagagggtctactcacgtggggactccgagcctttgtccgaggccgctcaggctcacacccgcgagttgggccgcgaaaaccgaagactgcaggacctggctacccagctgcaggagaagcaccacaggatctctctggagtatagcgagctccaagacaaggtgacatcagctgagacaaaagtgttggagatggagaccaccgtggaagatctgcagtgggatattgagaagctgcggaagagggaacagaagttaaataaacatcttgctgaagcactggagcagctcaatagcggatattatgttagcgggagttcttctggcttccaggggggccagatcaccctttctatgcaaaagtttgaaatgctgaacgccgagctggaggaaaaccaggagctcgcaaattcgcgaatggcagagctcgagaagctgcaggcagagttgcagggggccgttcgcactaatgaaagactgaaagtagctctcagatcactgccagaggaggtggtgcgagagaccggcgaatataggatgctgcaagcacagttttccttactctataacgaatctctgcaggtaaaaacccaactggacgaggcccgcggcctattactcgcgacaaaaaactcgcaccttcggcacatcgaacacatggagtccgacgagctgggcctccagaagaagctccggaccgaagtcatccagctcgaagatacactagcccaggtgagaaaagagtatgagatgctgcgcatcgagtttgagcagaacctggccgccaatgaacaggcagggccaataaatagggaaatgcgtcacttgatctcctccttgcagaatcacaaccatcagttgaaaggagacgcccaaaggtataaaaggaaactccgggaggtgcaggccgaaattggcaaactcagggcacaggcctccggctcagctcattctacccccaacctcgggcaccccgaagatagcggagtatcagccccagccccaggcaaggaagaaggggggcctggtcccgtgtccactcctgataaccgcaaggagatggccccagtgccaggcactaccaccactaccacctccgttaaaaaagaggaactcgtcccttctgaggaggacttccaggggattacaccgggcgcccaaggtcccagtagtcggggccgcgaaccagaggcccggcctaagcgtgagctgcaggagcgtgaaggaccctctctgggcccaccccccgtggcctcagccctgagtagagcagatcgtgagaaagcgaaggtagaagaaactaaacggaaggagagtgagctcctcaaaggactgcgcgccgaattaaaaaaggcccaggagtctcaaaaagaaatgaaacttctcctcgacatgtacaaatctgcaccaaaagaacagagggacaaggttcaactgatggctgccgagcgcaaagcgaaggcagaagtcgatgaactgcgttccaggatcagagaactcgaggaaagggatcggcgcgagtcgaagaaaatcgcagacgaggatgctctcagacggattcggcaggccgaagaacaaatcgaacatctgcagaggaagctcggagcaacaaagcaggaagaggaggccttgctcagtgagatggacgtgaccggccaggcttttgaggatatgcaggaacaaaacggcagactgctgcaacaattgagggagaaagatgatgccaattttaagctcatgtcggaaaggatcaaggccaatcagattcacaaactgctgcgcgaagagaaagacgaactgggggagcaagtgttggggttgaaaagccaggtcgacgctcagctgctgacagtgcagaagctcgaggagaaagagagagcactgcagggttctctcggtggggtagaaaaagagctgactttgcgatctcaggcccttgaactcaacaaacgaaaagcggtggaggcggcccagcttgccgaggatctgaaggtccagctggaacacgtgcaaacccgacttcgcgaaattcagccttgcctcgccgaaagtcgagctgcgcgagagaaggagtctttcaacttaaaaagggcacaggaagacatatcgcggctgcgacgcaagctggaaaagcaaaggaaggtggaggtctacgcagacgctgatgaaatcctgcaggaagagattaaggaatacaaagcacggttgacatgtccatgttgcaatacccgaaagaaggacgctgtattgactaagtgttttcatgtgttttgcttcgagtgtgtgcgaggccgctacgaggcacgccaacgtaagtgcccaaaatgtaacgccgctttcggcgcacacgatttccaccgtatctacatatcatag

SEQ ID NO: 29711 - DNA, 2706 bp, Artificial Sequence
  Description of Artificial Sequence: Synthetic coding sequence
atgtccggaccagggaacaaacgcgctgctggggacgggggaagcggccctcccgagaagaaactctcaagagaggagaagacaacaactaccctcattgagcctattaggctcggcggtatatctagcaccgaggagatggatctcaaggtgttgcagttcaagaataagaagctggcagaacggctggaacagaggcaagcgtgtgaggatgagcttagagaacggattgagaagctggaaaaacggcaggctacagacgatgctacgctgttaatagttaatcgctactgggcgcagttagacgaaacagtggaggctctgctgagatgccatgagtctcagggtgaattgagctctgctcctgaagccccaggaactcaagagggccctacctgcgatggaacacctctgcctgaacctggcacgtcagaactgagggatccactgctgatgcagctccgtcctccactgtcggagcccgctcttgcattcgtggtcgccctcggcgcctcctcctccgaagaagttgaactggagcttcaagggcgaatggagttctccaaggcagcggtctctcgcgtagtggaagcatccgaccgactgcaacgtcgcgtggaagaactgtgccagcgcgtgtactctcgcggagactccgaacccctatcagaggccgctcaagcccatacccgcgaacttggcagggagaaccggcgcctgcaagatctcgctactcagcttcaggagaaacaccacaggatctccctagagtactccgagctccaggacaaagtaacttcggccgagaccaaggtgctcgagatggagacaaccgttgaagacctgcagtgggacatagagaagctcaggaaacgcgagcagaagcttaataagcacctggcagaagccctcgaacagctaaacagcggctactacgtaagtgggtcatcgtctgggtttcaagggggtcagattactctttctatgcagaagtcagacgagctgggactgcagaagaaattgaggacagaggtcattcagcttgaagatacattggcacaggtgaggaaggaatatgagatgctgagaatcgagtttgagcaaaacctcgccgccaacgagcaggctggccctatcaaccgcgagatgcgccaccttatttcctcactgcaaaatcacaaccatcagctgaagggggacgcccagaggtacaaaagaaagctgagggaggtacaggccgaaattggcaaattacgggcccaggcatccggcagtgcgcacagtacacccaacctgggacaccctgaggactcaggcgtgagtgcacctgcgcctggtaaggaggaaggcgggcctgggccagtgtctacccctgataatcgcaaagaaatggccccggtgccggggacaacgaccacgactacatcggtgaaaaaggaggagcttgtgcctagtgaggaggacttccaaggaattacaccaggggctcagggcccttcttcacgtggccgggagcctgaggcccggccaaagagggaattacaggagagggagggaccttctctgggtcctcccccggttgcctcggccctgtcaagggctgatagagagaaggccaaagttgaggaaactaagagaaaagagagtgagctgttgaaagggctgagggccgagctcaagaaagcacaggaaagtcaaaaagagatgaaactgctgctcgacatgtacaagtcagcccctaaggagcagcgggacaaggttcaactgatggccgctgagcggaaggctaaagcagaggtcgacgagctgcggtctagaatcagggaactggaggagcgagaccgacgcgaaagcaaaaagatagccgacgaggacgcactaagacgaattaggcaggccgaggaacagatagagcacctgcagcgtaagctgggtgcaaccaagcaggaggaagaggcactcctctcagaaatggatgttaccggacaagcttttgaagatatgcaggagcagaacggccgcttactccagcagctgcgggaaaaggacgacgcaaacttcaaactaatgagtgagcggatcaaagctaatcagatacataaactgcttcgcgaggaaaaggatgagctgggagagcaggtgcttggcctgaaatctcaggtggatgcccagctccttaccgtccaaaaactagaggaaaaagaaagagcactgcaaggttcattgggaggtgtggaaaaggagctcacacttcgctcccaggctttagaattgaacaaacgcaaggctgtagaggccgctcaactggccgaggatttgaaagtgcaattggagcacgtgcagacacggttgcgcgaaatacagccctgtctggccgagagtagggccgccagagagaaagagtcattcaaccttaaacgagcccaggaggatatttcccgcctaagaagaaagctggagaagcagagaaaagtcgaggtgtatgctgacgccgacgaaattctccaggaggagataaaagagtacaaagcccgcctcacctgcccctgctgcaatactcgaaagaaagacgccgtcctgacaaagtgtttccacgtcttctgttttgagtgtgtaaggggacgctacgaggcacggcagcgaaagtgtcctaaatgcaatgcagcttttggcgcccatgatttccaccgtatttatatatcctag

SEQ ID NO: 29712 - DNA, 2082 bp, Artificial Sequence
  Description of Artificial Sequence: Synthetic coding sequence
atgtcaggccctggaaacaagagagctgcaggtgacgggggttccggtccaccagaaaagaaactaagccgcgaggagaaaacaacaactaccttaatagagcctatcagattgggaggcatttccagtaccgaggagatggacctgaaagtgctacagttcaagaacaagaaactggcggagcgcttggagcaacgccaggcttgtgaggatgaactacgggagagaattgagaagctggaaaaaagacaggcccagttttcgctcctatacaatgagtctttgcaggtgaaaacgcaattagacgaggctcgaggtctgttactggccactaagaatagtcatttacgccatattgagcacatggaaagtgatgagctggggctgcagaagaaactccgcaccgaagttatccagcttgaagacacccttgctcaggtgagaaaggagtacgagatgcttaggattgaatttgaacagaacctggccgctaacgaacaggcaggccctattaatcgagaaatgcgtcacctgatctcctcccttcagaaccacaatcaccaattgaagggagatgcccagcggtacaagcgtaagctcagggaggttcaagctgaaattggcaaactaagagcacaggcctcaggatctgctcattccaccccaaacctcggtcaccccgaagatagcggcgtgtccgcccctgctcccgggaaggaagagggtgggcctggtccagttagcacccccgacaatcggaaggagatggcccctgttcctggcactaccacaactacaacctccgtaaaaaaggaagaactggtgccaagtgaggaagactttcagggcattacacccggcgcccaaggtccatcgtcaagaggccgagaaccggaggccagaccaaaacgggagttgcaagaaagagagggcccatcactgggcccacccccagtcgctagcgcattgtctcgagctgatagagagaaagccaaagtggaagagacgaaaaggaaagaaagcgagttgcttaagggccttcgggccgaattgaagaaggcgcaggagtctcagaaggagatgaaactcttgctggacatgtataaatccgcccctaaggagcagcgggataaggttcagctgatggccgctgaaaggaaggccaaagcagaagtggatgaactgaggagcaggattcgcgaactcgaggaacgcgaccggagagagagtaagaaaatcgctgatgaagacgctctacgccgcatccgacaagcagaggaacaaatcgagcatctgcagcgtaagctgggtgccaccaaacaggaggaagaggctctgctgtctgaaatggacgttactggccaggcttttgaagatatgcaagagcagaatggtcgccttctccaacagctgcgtgagaaggatgacgccaactttaaactgatgtctgaacgcatcaaagcgaaccaaatccataagctcctccgggaagagaaggatgaattgggcgagcaggtgctgggtctaaagagtcaagtggatgcgcaactacttaccgtacaaaagttagaggagaaggaacgtgctttgcagggttccctagggggagtcgagaaggagctgacactgcgctcccaggcacttgaactgaacaagcggaaggccgtggaagctgcacagctggccgaagacctcaaggttcagctggaacatgtgcagacgaggttgagggagatacagccatgcctcgctgagagtcgcgcagcgcgggaaaaggagagctttaacctgaagagggctcaagaggatatatcacggctgcggcggaagctagaaaagcagagaaaggtcgaagtgtatgcggacgccgatgaaattctgcaggaggagattaaagagtacaaagctagactgacctgcccctgctgtaatactcgaaaaaaggacgctgtactcactaagtgcttccacgtgttctgcttcgaatgcgttcgcgggaggtacgaggcccgacagcggaaatgcccgaaatgcaacgccgcgttcggggcccacgattttcacagaatttatattagttag

SEQ ID NO: 29713 - DNA, 693 bp, Artificial Sequence
  Description of Artificial Sequence: Synthetic coding sequence
atgcagctccggccaccgctgtctgagcccgccctggctttcgtggtggcactaggggcgtcctcaagtgaagaagtcgaactagagctccaggggaggatggagtttagcaaggcagccgttagccgcgttgtggaagcgtcagacagactgcaacggagagtagaggagctgtgccagcgggtgtactccagaggtgattcggaacccctttctgaagcggcacaggcacacacacgcgagctgggcagagaaaacagacgactacaggacctggctactcagttacaagagaagcaccaccgtatcagcctcgagtacagtgagctgcaggataaggtgactagtgctgagacgaaggtgctggagatggagaccaccgtcgaggatctacagtgggacatcgagaagctgcgtaagcgcgaacagaaactgaataaacatctggctgaggccctggaacagctcaactctgggtattatgtcagcggatccagcagtggttttcagggcgggcagattaccctgtctatgcaaaaatttgagatgcttaatgccgagctagaagagaaccaagagctggccaatagtcgcatggccgaattggagaagttgcaggccgaactgcagggcgcagtgaggacaaacttccagtctttccagttggaggaattaccgccagataccctgtag

SEQ ID NO: 29714 - DNA, 924 bp, Artificial Sequence
  Description of Artificial Sequence: Synthetic coding sequence
atgaagttgctgttggatatgtacaaaagtgccccaaaggagcagcgcgacaaagtccagctcatggccgctgaaaggaaggcgaaagctgaggtagatgagttacgttccagaattagggagcttgaagaacgcgatcggcgagaatccaaaaaaatagccgatgaggatgctcttcgtcggatccgccaggcagaggagcaaattgaacatttgcagcgcaaactcggggccaccaaacaagaggaggaggcgcttctgtccgagatggatgttactgggcaggcgttcgaagacatgcaggagcagaacggtcggctgctccagcagctccgtgaaaaggatgatgcaaacttcaagctgatgtctgagcgaattaaggccaatcaaatacacaagctgcttcgtgaggagaaagatgagctaggcgagcaggtcctcgggctaaagtcgcaggtggatgcgcagctattgaccgtacagaagttagaggagaaggagcgggcactgcagggcagccttgggggcgttgaaaaggagctgacacttcgttcgcaagcgcttgagctgaataagagaaaagccgtcgaagcagctcaactcgccgaagacctgaaggtgcagctcgagcacgtccagactagacttcgtgagattcagccatgcctggccgagtctagggcagcccgggaaaaagaaagctttaatctcaaacgagcccaggaagatatttcaagactacgcagaaagctcgagaaacaaaggaaggtggaggtgtatgccgacgcagatgagatcttacaagaagagatcaaggaatacaaagtcggcctgtgggccaaactctgtcctattcatttgcgaattgtggatgcgggcctgctcaggctggtcgagtctttaggcaccttggaagtgatgtag

SEQ ID NO: 29715 - DNA, 1308 bp, Artificial Sequence
  Description of Artificial Sequence: Synthetic coding sequence
atgcccctgttccttctcagccttcctactcctccaagcgcgtctggccacgaaagacggcagcggcctgaggcgaaaacctcaggcagcgaaaaaaaatacctgagagcgatgcaagcaaaccgctcccagctccacagtcctccggggactgggtcctcggaagacgctagcactccccagtgcgtgcatacaaggctcaccggggagggtagttgtccccactcaggagatgtgcacattcagatcaattctattccaaaagaatgtgccgagaatgcatcaagtagaaacatcaggagcggtgtgcattcatgcgcgcacggctgtgtgcacagcagactgagaggtcattcacacagtgaggcccgacttactgacgatacggctgcagagtctggggatcatggtagctcaagcttcagtgagtttaggtacctctttaagtggctgcagaagtcactgccctatattctgatcctatctgtgaaacttgtaatgcagcacatcacgggcatcagcttaggaattggcctactgactacctttatgtacgccaacaagagtattgtcaaccaggtgttcctcagagagcggagcagcaagattcaatgcgcttggctgcttgttttcctcgctgggagtagtgtgctcttgtactacactttccacagccagagtttgtactatagtctcatcttcttaaaccctacactggaccacctgtccttctgggaggtgttttggatcgtgggcatcactgacttcatcctgaaattcttcttcatggggctgaagtgtctcattctcctcgtgcctagcttcattatgccctttaaatcgaagggatattggtacatgctactggaagaactttgtcagtattaccgcacatttgtgcccatacccgtgtggttcaggtatctgatctcatatggcgagttcggcaatgttacccgttggtctctcgggatcctgctcgccctcctgtacctcattctcaaactgctggaattctttggtcacctcagaaccttcagacaggtgctgcggatcttttttacacagccatcgtatggagtcgctgcctccaaacgccagtgctccgatgttgatgatatttgctccatctgccaggccgagtttcaaaaacccatactgctcatttgccagcatatcttttgtgaggagtgcatgactttatggtttaatagagagaagacatgtcctttgtgccggacagtaattagcgatcacattaacaagtggaaggacggtgctacaagttctcacctccaaatctactag

SEQ ID NO: 29716 - DNA, 408 bp, Artificial Sequence
  Description of Artificial Sequence: Synthetic coding sequence
atgcaggcaaacaggtcccaactgcacagcccgcccggtacaggctcatctgaggatgcctctacgcctcagtgtgtgcacaccaggctgactggagagggcagctgtcctcacagtggtgacgtgcatatccagattaattccatcccaaaagaatgcgctgaaaatgcctcttcacgtaacatcaggtctggcgtgcacagctgcgcgcacggttgtgtccattcccgcctgaggggacatagtcattcagaggcacgacttaccgacgatacagctgcggaatcgggagaccacggaagctcaagtttcagcgaatttagatatctgtttaaatggctgcagaaatcactcccctacattctgatcctcagtgttaaactggttatgcagcatattacagcatag

SEQ ID NO: 29717 - DNA, 1335 bp, Artificial Sequence
  Description of Artificial Sequence: Synthetic coding sequence
atgtggctattcactgtgaatcaggtcttgcgcaaaatgcagagaagacactctagcaacactgataacatcccacccgaaaggaatagaagccaggccctgtcttcagaggccagcgtggatgaaggcggcgtgtttgagtctctcaaggccgaggcagcttccccacctgcgttgttcagcggtttgagcgggtcacttcctactagttccttcccgtcctcactggtgcttgggagttctgccggcggcggcgatgttttcatccagatgcctgctagccgcgaagaaggagggggacgtggcgaggggggcgcatatcaccatcgccagccacatcaccatttccaccacggaggccacagggggggctcattgctgcaacatgtcggtggagatcacaggggccactcggaggaggggggagacgagcaaccagggactccagcaccggcactgagcgagttgaaagccgtcatatgctggctacagaaggggttacctttcatcctaattcttctggccaaattgtgctttcagcacaaattagggatcgctgtctgcatcggaatggcatcaacatttgcctacgcgaactctaccctcagggagcaggtgtcccttaaggagaaaaggtcggtgttggtcatcttatggatccttgcttttctggccggcaataccctgtatgtgctgtacacattcagcagccagcagctgtataactcattgatcttcctgaaacccaatttggaaatgctcgacttcttcgatcttctgtggattgtcggaatagccgattttgtgctgaagtatatcaccatagccttgaaatgcctgatagtagccttgcccaagattattttagcagtgaaatctaagggcaagttttaccttgttattgaagagctgagtcagctctttcgctccttggtcccgatccagctgtggtataaatacattatgggtgacgatagcagcaattcatattttcttgggggggtgctgattgtgctatatagcctgtgtaagtctttcgatatatgtggaagagtcggaggggtccggaaggcacttaagctgctgtgcacatctcaaaactacggcgtgagagcaacgggacagcaatgtactgaggctggagatatctgtgccatttgtcaagctgagtttagggagccattgattctcttgtgccagcatgtgttttgtgaggagtgcctgtgcctgtggttggacagggaaagaacctgtccactctgtcgttcagtggccgttgacacactgcggtgctggaaggacggggctacaagtgcgcatttccaggtgtattag

SEQ ID NO: 29718 - DNA, 1335 bp, Artificial Sequence
  Description of Artificial Sequence: Synthetic coding sequence
atgtggctgtttaccgttaaccaggtgctgcgcaagatgcaacgacgacactcctctaacaccgataacataccccctgagcgtaaccgaagccaggccttgtcttccgaagcatccgttgacgaaggaggtgtcttcgagtctttgaaggccgaggctgcatcccctccggccctgttttcgggattaagtggctctctgccaacctcctcctttcccagtagtctagttctaggctcttctgcggggggcggagatgttttcattcaaatgcctgcttctcgtgaagaaggaggaggacgaggcgaaggaggggcttaccatcacaggcaaccacatcatcattttcatcacggtggacacaggggcggtagcttactgcagcatgtgggtggcgaccaccgcggccacagtgaagagggcggggatgaacaaccaggcacaccagccccagcactttctgagttgaaggctgtgatttgctggctgcagaagggattaccattcatcctaattctgctggcgaagctgtgttttcaacacaagctggggatcgctgtgtgtataggaatggcctctaccttcgcttacgctaactcaaccctgagagaacaagtgtcactgaaggagaaacgatccgtgctcgtgattctctggatactggcatttttggccggaaacactctctacgtactttataccttttcctctcaacagctgtataattcccttattttcctaaagcctaatctagaaatgctggattttttcgatctgctgtggatagtcgggattgccgactttgtcttaaagtatattaccattgctctaaaatgtctcatcgttgccctccctaagattattcttgcggtcaaatcgaaaggcaagttttacctggtcattgaagaactgtctcagcttttcaggtcactggtgccaatccagttgtggtataagtatattatgggcgatgactctagtaacagctacttcctcggcggggtcttaatcgttttatactcactttgcaaaagtttcgacatctgcggaagggtaggaggtgtgaggaaggcccttaaactcctctgcacttcccaaaactatggcgtgagggcaaccgggcagcagtgcactgaagcaggtgacatttgcgcgatatgtcaagctgagttccgagagccactgattctactctgccagcatgtcttctgtgaagagtgcctgtgtctttggcttgatcgtgaacggacatgtcctctttgccgatccgtcgctgttgatacattgaggtgttggaaggatggagccacgtcagctcactttcaggtttactag

SEQ ID NO: 29719 - DNA, 1263 bp, Artificial Sequence
  Description of Artificial Sequence: Synthetic coding sequence
atgtggttgttcactgtaaatcaggttttgaggaagatgcagcggaggcacagctccaacactgacaatatcccaccagaacggaataggagtcaggccctgtcgagcgaagctagtgtcgacgaggggggggtcttcgagtcgttgaaggcagaggccgcttctcccccagcactgtttagtggattgtctggttcattacccacgtcatcattcccatcctccctggtgctgggttcatctgctggagggggtgatgtctttatccaaatgcctgcgagccgggaagaagggggcggacgtggtgagggcggagcctatcatcatcggcaaccccaccaccattttcatcatggtggccacaggggcgggagtctactgcagcatgttgggggagatcatcggggccatagcgaggagggcggtgatgagcaacctggcacccccgctcctgcactgagcgagctcaaggcagtgatatgttggctgcagaaggggctgccttttatcctgattctgctagctaagctgtgttttcagcataaattagggattgctgtgtgcattggcatggcctccactttcgcttacgcaaatagcaccctgagagaacaggtgtcccttaaggagaaaaggtcagtgctggtcattttgtggatactcgcatttctggctggtaacacattatatgtgctctacacctttagctcccaacagctgtacaattccttaattttcctcaagcccaatcttgagatgctcgatttcttcgaccttctctggattgtgggcattgctgacttcgtgctcaagtatattacaattgccctcaaatgccttatcgtagcattgcctaaaataatcctcgccgttaaatctaaggggaagttttacctggtgattgaggaactgtcccagctatttcggtcacttgtccccatacagctatggtacaagtatatcatgggagatgattctagcaatagctattttttaggcggtgtgcttatcgtgctgtactccctgtgtaaatctttcgacatttgcggaagagtggggggcgtgaggaaggccctgaaactgctgtgcactagccaaaactacggtgtgcgggcaaccggtcagcagtgtacagaagcaggcgatatctgtgctatctgccaggctgagtttagagagcccctaatcctgttgtgccagatgctgttaaagggacacaagaagctggagctggaaaaaatcgacgaaagtgccggcgtatag

SEQ ID NO: 29720 - DNA, 1212 bp, Artificial Sequence
  Description of Artificial Sequence: Synthetic coding sequence
atggctgcctttctcaagatgtccgttagtgttaacttctttcggccttttacaagattcttggtgcccttcacattacatagaaagaggaataacctgacaatattgcaacgctatatgagctcgaaaattcctgctgtgacataccctaaaaatgaatcaaccccgccgtcagaggagcttgagctcgacaagtggaaaactactatgaaatcatcagtgcaagaggagtgtgtctcgaccattagctcaagtaaggacgaggaccctttagctgcaactagagagtttatcgagatgtggcgcttgctcggtagggaggtgcccgagcacatcacagaggaggaactcaagactctgatggaatgtgtaagtaacactgcaaaaaaaaaatacttaaaatatctttacacaaaggaaaaagtgaagaaggccagacaaattaagaaagagatgaaagccgctgccagggaagaagcaaagaatattaaactgcttgagaccactgaggaagataagcagaagaactttctgttcctcaggctctgggacagaaacatggatattgccatgggatggaagggagcacaggctatgcaattcggacagccgttggtgttcgacatggcctacgaaaactatatgaagagaaaggagttgcaaaatacagtcagccagctgctggagtctgaaggatggaataggaggaacgtagatccctttcacatatatttttgtaatctcaagatagacggggccctacaccgtgaacttgtaaaacggtaccaggaaaagtgggacaagctgctgctgacttccacagagaaaagccacgtcgacctctttccaaaggactcaatcatctatttgacggctgacagccccaacgtcatgacaactttccggcatgacaaggtgtatgtaatcggcagtttcgtagataaatcaatgcagcctggcacaagccttgcgaaagccaagcgcctgaatctagccaccgagtgtctgccccttgacaagtacctgcaatgggagataggcaacaagaatcttactttggaccagatgattaggatcctgttgtgcctgaagaacaacggaaattggcaggaagcgctgcagtttgtccccaagcgaaaacacaccggatttctggagatctctcagcattcacaagagttcatcaatagacttaagaaagccaaaacgtag

SEQ ID NO: 29721 - DNA, 939 bp, Artificial Sequence
  Description of Artificial Sequence: Synthetic coding sequence
atggctgcttttctcaagatgtccgtttccgtgaatttcttcaggccctttacacgtttcctcgtgcccttcacactccacaggaagaggaataatcttacaattttacagagatatatgtcaagcaaaattcccgctgtgacctaccccaaaaacgaatctactcccccatctgaggagctggagttggataagtggaaaaccaccatgaagagttccgtccaggaggaatgtgtaagtaccatttctagctcgaaagatgaggatcctttggccgctacaagagagtttattgagatgtggaggctccttggacgcgaggtgccagaacatatcacggaggaagaactcaaaacactgatggagtgcgtaagtaacacagctaaaaaaaaatacctcaagtacctatacacaaaggagaaggtgaaaaaagccaggcagattaagaaagaaatgaaggccgctgctcgcgaggaggcgaagaatatcaaacttctggaaactaccgaagaagataaacagaagaatttcctttttttgagactgtgggatagaaatatggatatagccatgggatggaaaggggcccaggccatgcagttcggacaacctcttgtcttcgacatggcgtacgagaactacatgaaacggaaggaacttcaaaacaccgtctcacagcttcttgagtccgagggatggaataggagaaacgtggatccatttcacatctatttttgtaacctcaagatcgacggcgccttacaccgggagctcgttaaacgttatcaggagaaatgggacaagctgctgctgacctctaccgagaaatcacatgttgacctgttcccaaaggacagtatcatctatttgaccgctgacagcccaaacgtgatgaccacctttcgacacgataaagtttacgtgattgggtccttttag

SEQ ID NO: 29722 - DNA, 1134 bp, Artificial Sequence
  Description of Artificial Sequence: Synthetic coding sequence
atggccgctcctcgatggtctgcatccggaccatggattaggggcaacgggcagggatgcgggtctctttttactctggtctccaaacccttttgcgctgccgctgcagcttccacggctatcaatgctcagagactcgccgagaagctgcgtgcacagaagcgagaacaggacacaaaaaaagagcctgtttcaacgaatgcagttcaacggagagtgcaggaaattgtgaggtttacacggcagctacaacgtgttcaccccaacgtccttgccaaggcactgactagaggaatcctccatcaggacaagaatcttgtggtcattaataagccatatggactccccgtacacgggggtccaggcgtgcaactgtgcatcacagacgttctacctattttggccaaaatgctgcacggacacaaagcagagccattacatttgtgtcatcgattagacaaggaaactacgggtgtcatggtcctcgcgtgggataaagatatggcccaccaggttcaggagctcttccgaactcgccaggtcgttaagaaatattgggcaatcactgtgcacgtgcctatgccatccgcaggcgtggtggatatcccaattgtcgagaaggaggcccagggccagcagcagcaccataagatgaccctttccccgtcctaccgaatggacgatggtaagatggtcaaggtacgcaggagtcgcaacgcacaggtggccgttacccaataccaagtgctaagctcaaccttaagctccgccttagtggaactgcaacccatcacgggcatcaaacaccaattgagagtgcacctctcttttgggttggactgtccgattctgggggatcacaagtactccgactggaacagactcgccccacagaaattgtccgtaggtaccctgaagaagttaggcttagagcagtccaaggctagatacatacccttacacctgcatgctaggcagttgatcctcccggccctcggttcaggcaaagaagagctcaacttggtatgtaagctccctcggtttttcgtgcactccctgcacaggcttcgcttagagatgccaaacgaggatcagaacgaaaataatgaagcaaaatgtctgggagcccaatag

SEQ ID NO: 29723 - DNA, 1041 bp, Artificial Sequence
  Description of Artificial Sequence: Synthetic coding sequence
atggctgccccacgttggagcgcctctgggccctggatccgtggcaatggtcaaggatgtggcagtctcttcaccctggttagtaagcccttttgtgcagcagctgccgccagtacagccatcaatgcacagagactcgcagaaaagctgcgcgcacagaaaagagagcaggacacaaagaaagaaccagtgtccacaaacgctgtccagaggagagttcaggagatagtccgtttcaccaggcagctgcagagagttcaccctaatgtccttgccaaggctctgacgagaggtatcctccatcaggataagaacttggttgttatcaacaaaccctacggactccctgtgcacggtggaccaggagtgcagctctgtataactgatgttttacctatcctggctaaaatgctgcacggccataaagctgagccactacatttatgtcatagactagataaggaaaccacaggagtgatggtgcttgcctgggacaaggatatggctcatcaggtacaggaactgttccgtacgcggcaagtggtcaaaaaatactgggcgataactgttcacgtacccatgcctagtgccggcgtcgtagatatcccaatagtcgagaaggaggctcaagtggccgtgactcaataccaagtcctgtcttctacactgagcagcgcactggtggagctgcagcctattactggcatcaaacatcagctccgggtgcacctctcctttggactggattgtccaattctcggagatcataagtactccgactggaatcggctggccccacagaagttgtctgttggaaccttaaagaaactgggattggagcagtccaaggcgaggtatatcccattgcaccttcacgcacgacaattaattctgcctgccctcgggtcagggaaagaggagcttaatctggtttgcaagttgccccgtttctttgtccactctctgcaccgcctcaggctcgagatgcctaatgaggatcagaatgagaataatgaagctaagtgtctcggcgctcagtag

SEQ ID NO: 29724 - DNA, 1098 bp, Artificial Sequence
  Description of Artificial Sequence: Synthetic coding sequence
atggagggacagtcagttgaggagctgctggccaaagcggagcaagacgaagccgagaaactgcaaaggataactgtgcacaaggagctggagcttcagttcgaccttggaaacctactggcttcagacagaaatccgccaacaggattaagatgcgctggacccacaccagaagcagagttgcaggccctggcccgggataatacacagctgctgataaatcagctgtggcagctgcctacagagcgagtggaagaggccatagtagctcgactgcccgagcctacaacacgccttcctcgcgaaaagcccttgcctcgaccccgacccctaacaagatggcaacagttcgctcggctgaaaggaatccgacctaaaaagaagacgaatctggtgtgggacgaggtgtcgggacagtggcgtaggagatggggatatcagcgcgcgcgggatgataccaaggaatggctcatcgaggtgcccggtaatgctgaccccttggaagatcagtttgctaagaggattcaggccaaaaaggagcgtgtcgcaaagaatgagttgaataggctacgaaatctggctcgcgcccataagatgcaactgccgtcagctgcaggactccatccgaccggccaccagagtaaggaggaactgggtcgcgcaatgcaagtcgccaaagtgtcgactgctagcgtaggcagattccaagagcgcttaccaaaggaaaaggttccccgtggctccggaaagaaacgtaaattccagcccttattcggtgatttcgctgcggagaaaaagaaccagctggagctacttcgggttatgaactcgaagaagccccagttggatgtgacgagggccacgaataaacagatgagggaggaagatcaggaagaagccgctaagcggcgaaagatgtcacagaagggtaaaaggaagggagggcgacaggggcctggtggcaaaagaaaaggaggtccaccttcccagggaggcaagaggaagggaggtctggggggtaaaatgaatagtgggcccccaggtcttggagggaaacgaaaaggcggccaacggcccgggggcaaacggagaaaatag

SEQ ID NO: 29725 - DNA, 2127 bp, Artificial Sequence
  Description of Artificial Sequence: Synthetic coding sequence
atggctgacagagaagggggctgtgcagccggccggggacgcgagcttgaacctgagcttgagccagggccgggcccaggaagtgccctcgaacctggcgaagagtttgaaatcgtggaccgcagccagctgcctgggccgggcgatctcagaagtgccacgcgcccacgggctgcagagggatggtcagctcccattctgaccctggccagacgagccactggcaaccttagtgcctcgtgcggttccgcgctgcgggctgcagctggcctcggcggcggggattctggcgatggaacggcccgcgcggctagcaaatgccaaatgatggaggagagggccaacctgatgcatatgatgaagttatctatcaaggtcctgctccagtctgccctgagtctgggacgctccctcgatgctgatcatgccccactgcagcaattctttgtcgtaatggaacactgtctgaaacatggtctcaaagtgaaaaaatcatttattggtcagaataagagttttttcgggcctttagagttggtggagaagctttgtcctgaggcctccgacattgcaacctcggtgcggaacttaccggagctcaaaacggccgtgggaagggggcgcgcttggctctatctagcactgatgcaaaagaagctggctgattacctcaaagtcttaattgacaataagcacctcctgagtgagttctacgagcctgaagcactgatgatggaagaggaggggatggtgattgttggtttgctggttggcctgaacgtgttggacgccaatctgtgcctcaaaggcgaggacctggactcccaggtgggagtgatcgacttctcactctatctgaaagatgtacaagatctggacggcggaaaagaacatgagcgcattacagacgttctggatcagaagaattatgtcgaggaacttaacaggcatctgtcatgtacagtgggagatcttcaaaccaaaattgatgggctcgagaaaacaaatagtaaactgcaggaagaactctctgctgccaccgaccgcatctgctcgctgcaggaagagcagcaacagttaagagagcagaacgagctgatccgtgaaaggagtgagaagagcgtagagatcaccaagcaggataccaaggtcgaactggagacttacaaacaaacaaggcaagggctggatgaaatgtatagcgacgtttggaaacagctgaaggaggagaaaaaagttcgcttggagcttgagaaggagcttgagctgcaaattggcatgaagacagagatggaaattgccatgaagctccttgaaaaagacacccacgagaagcaagacacattggtcgctctgaggcaacagctggaagaggtgaaagcaatcaacctacaaatgttccataaggcacagaacgctgagagcagcctgcagcagaagaatgaggccatcacttcatttgaagggaaaacaaaccaagtgatgtccagcatgaagcagatggaggagcgacttcagcactctgaaagggcacgtcagggtgccgaggagagaagccataagctccaacaggagctggggggacggattggcgccctgcagctgcagctgagccagctccacgagcagtgtagttctcttgagaaggagctcaagagcgagaaggagcaacggcaggccctgcagcgcgagttacaacatgagaaggacaccagttccttgttgcgaatggagctccagcaggtggagggtctgaaaaaggagctgcgggagttgcaggatgagaaggccgagctacagaaaatatgcgaagagcaggagcaggcattacaggaaatgggcctccatttatcccagtcaaagctgaaaatggaggatatcaaggaagtgaatcaggcgctaaaggggcacgcctggctcaaggacgatgaggcaacccactgcagacagtgtgaaaaagaattcagcatcagccggcgcaagcatcactgtcgcaattgcggacatattttctgtaacacctgttcatctaacgagctggcactcccaagctatccgaagcccgtgcgcgtgtgcgacagttgccacacactgttgctccaaaggtgtagtagcaccgcttcctag

SEQ ID NO: 29726 - DNA, 933 bp, Artificial Sequence
  Description of Artificial Sequence: Synthetic coding sequence
atgtactccgacgtatggaagcagttaaaagaagagaagaaagtgcgtctggagttggaaaaggaacttgaacttcaaattgggatgaagacagaaatggagatcgcaatgaagttactggagaaggacacccatgaaaagcaggatacgttggtcgccctgagacaacagctagaggaggtcaaggcgatcaatctccaaatgttccataaggcccagaacgcagaatcttccttgcagcaaaagaacgaggcaatcacgtctttcgagggcaaaaccaaccaggtcatgtcaagtatgaagcagatggaggaacgactgcaacattcagagcgagcaagacagggagccgaggaaaggtcacataagttgcaacaggagctcggcggcaggattggcgctttacagcttcagctatctcagttgcacgaacagtgctcaagtctcgaaaaggagttaaagagtgaaaaggaacaaaggcaggccctgcaaagggagttgcagcacgaaaaagacacgtcttcactgctcaggatggaacttcaacaggtcgaaggcctaaaaaaagagctgagagaactgcaggacgagaaggcggagttgcaaaagatatgcgaggagcaagagcaggctcttcaagagatgggactgcatctgtcccaatctaagttgaagatggaggatattaaagaggttaaccaggccctcaaagggcacgcgtggctcaaggatgatgaggccacacactgccgccaatgtgaaaaagaattttccatctctcggaggaaacatcactgccgcaactgcggccacatcttttgcaacacttgttcatcaaatgagttggctctccccagctaccctaagccagttcgcgtgtgtgactcatgccacaccctcctgctgcaaaggtgctcctctactgccagttag

SEQ ID NO: 29727 - DNA, 1239 bp, Artificial Sequence
  Description of Artificial Sequence: Synthetic coding sequence
atggccgatagggagggaggatgcgcagcgggccgcggccgagaactggaacccgaactggagcccggaccgggacctggaagcgcactggagcccggtgaggagttcgagatcgtagatcgctcccaactccccggaccaggggatctccgcagcgccaccaggccacgcgccgcggaaggctggtcagccccaatcctcactctggctagacgggctacgggcaatttatcggcgtcttgcggcagtgcccttagagctgccgccggactcggcggtggtgactccggcgacggaacagcacgtgcagcttccaagtgccagatgatggaagagcgtgcaaacctgatgcacatgatgaaattgagcatcaaggtattactgcagagtgcacttagcctcggacgttctttggatgcagaccatgctccactacaacagttctttgtggtcatggagcactgcctgaagcacgggctgaaagtcaaaaagtcttttattggtcaaaataagtcctttttcgggcctctggaactcgtggaaaagttatgccctgaagcttccgatatagccacatcagttagaaatttgcctgaactgaaaaccgcagtcggccgtgggagagcatggctctatcttgctctgatgcagaaaaagctggccgactacctgaaggtgctgatagataataagcatttgctgtccgaattctatgagccggaagcattaatgatggaggaggaggggatggtgatagtcggactcctggtaggactgaatgtgcttgatgccaacctctgcttaaagggggaggatctggattcgcaggtaggcgtaatcgatttctccctgtacctgaaggacgtccaagacctcgatggcggaaaggaacacgaaaggatcactgacgtgctagatcaaaagaactacgtggaggagctcaatcggcaccttagttgcacggtcggagacctgcagacaaagattgacggcttagagaagacgaattctaaactgcaggaagaggaggagcgtatgaaaggccaggacaaaggtggactgtcaagaggccgtgaacttgctgccagttgtcccgcagtctctctgctggacacctcatgtctgttgctcgctggcgggggatgctccgctctgctcaggctgtccaccgcattctcttgtaaccggcctaatctcttgacatctcggcgaacagccgccgtgaaacgtaccaagtag

SEQ ID NO: 29728 - DNA, 1803 bp, Artificial Sequence
  Description of Artificial Sequence: Synthetic coding sequence
atgatggaagagagagctaatttgatgcatatgatgaaactgagcattaaagttcttctgcaatccgctctgtctttaggccgcagtctcgatgcagaccacgcccccttacagcagtttttcgtagttatggagcactgtttaaagcacggattgaaagtgaaaaagtccttcattgggcagaataaaagcttctttggccccctggagttggtggaaaaactgtgccccgaggcatcagacatagcaacaagcgtccgcaatctgcctgaactaaagacagccgtcgggcgaggacgggcgtggctgtacctcgccctgatgcagaaaaaactggctgactacctaaaagtgttgatcgataataagcacctgctgtccgagttctatgaacccgaggcactcatgatggaagaggaaggaatggtgatagtgggcctgctagtggggctgaatgtgcttgatgctaacctgtgcctgaagggcgaggacctggattcccaggtgggcgtgattgatttcagtctctatcttaaagacgtgcaggatcttgatggaggtaaagagcacgagagaattaccgatgtgttagaccagaagaactacgtagaggagcttaatcggcacctgtcctgtactgtgggagatctgcaaacaaagattgatgggttagagaagactaactcgaaacttcaagaagaactgagtgccgccaccgatcgaatatgcagtctacaggaggaacagcagcaactgcgcgagcagaacgagcttatcagagagcgatctgagaaatccgtagagatcacaaaacaggacacaaaagtggaactagaaacctacaaacagactagacaggggctggacgaaatgtacagcgacgtttggaaacagctgaaagaggagaaaaaggtgcgccttgagctggagaaagagctggaattacagatcggtatgaaaacagagatggagatcgcaatgaagcttctcgagaaagatacccacgaaaaacaggatacattggtggcgctgagacaacagctcgaggaagttaaagccattaatcttcagatgtttcacaaggcccagaacgccgaatcatcattgcagcaaaagaatgaggctataacatcgtttgagggtaagacgaaccaggtgatgtcctctatgaaacagatggaagaaagactgcaacactctgaacgcgcccgacagggcgcagaggaaagaagccataagctgcagcaagaactggggggccgtatcggagctttacagttgcagctgagccagctgcacgagcagtgctcttctctggaaaaggaactcaaatccgaaaaggaacagagacaagccctgcagagagagctgcaacatgagaaggacacctcctcccttcttcgtatggagctgcaacaggtggagggcctgaagaaggagctccgggagctccaagatgagaaagccgagctccagaaaatatgcgaggagcaggagcaggccctgcaggagatgggactacacttgtctcagagcaaattaaagatggaagacatcaaggaggtgaatcaggctctgaagggccatgcctggctgaaagatgatgaggctactcactgccgtcagtgtgagaaagagttcagtatctctaggcgcaaacatcattgtaggaactgcggccatatcttttgtaacacatgttccagtaacgagcttgccttaccttcctatccaaagcccgtgcgagtttgtgactcttgccacaccttgctgctgcagcgttgtagtagcactgcatcttag

SEQ ID NO: 29729 - DNA, 1803 bp, Artificial Sequence
  Description of Artificial Sequence: Synthetic coding sequence
atgatggaggagagggctaacctgatgcatatgatgaaattgagtattaaggtactgctgcagtctgccttgtccctggggagatcactggacgccgatcacgcccccctgcaacagtttttcgtggttatggagcactgcctgaagcatggcttgaaggtaaagaagtcttttattggccagaataaatccttctttgggcctctggaattggttgagaagctttgcccagaagcttcagatatcgccacgagtgtgcgcaacctgccggaactcaaaacggctgtaggacgcggtcgagcctggctgtacctggctctcatgcagaaaaaactggctgattaccttaaggtgctgatcgacaacaaacacctgctctcagaattctacgaacctgaggcccttatgatggaagaagaagggatggttatcgtgggtctcttggtggggctaaatgtcctcgacgctaacctgtgcctgaagggcgaggacttggacagtcaagttggcgtcatcgatttctcactttacctgaaagacgtccaggatttggatggcggcaaggagcatgagcgaataactgatgtgctggaccagaaaaattacgtggaagagctgaacaggcaccttagctgtacagtgggagacttacagaccaagatcgacggcctagagaaaacaaatagtaaactccaggaagagctctccgccgctacagatagaatttgctccctacaagaagaacaacagcagctgagagagcagaatgaacttatccgcgagcgatctgagaagagcgtggagatcactaaacaggacacgaaagtcgagctagagacttacaaacagacaaggcagggtctcgatgagatgtacagcgacgtttggaaacaacttaaggaagagaaaaaagttcggctggaattggagaaggagctggagctccagataggaatgaaaacagaaatggagatcgccatgaaactcctggaaaaggacacacacgagaagcaagacacactcgtagctctccggcaacagctggaagaggtcaaagcgattaatcttcaaatgtttcacaaagcacagaacgctgagtcatccctccagcagaaaaatgaagcaataaccagcttcgaaggaaagactaaccaagtaatgtcttctatgaaacagatggaggagaggctgcagcactccgaacgggctcgccaaggagcagaagaaaggagccacaaactccagcaggaattgggtggaagaattggagctctacaactgcagttgtctcaactgcacgaacagtgttcatcactggagaaagagctgaaatcagagaaggaacagcgccaggcactgcaaagggaactgcagcacgagaaggatacgagttcactccttcgtatggagctgcagcaggttgaggggctcaagaaagagctgagggaactccaagacgaaaaggcagagttacagaagatctgtgaagagcaggagcaggcactccaggagatggggctccatctgtcacagtctaagttaaagatggaggacatcaaagaggtcaaccaggctctcaagggccacgcatggctgaaagacgacgaggccacccattgccgccagtgcgaaaaagagttcagcatctctagaagaaagcatcactgtcgaaactgcggtcatatattttgcaatacctgttcaagcaacgaactggccctgcctagttatccaaaaccggtacgcgtgtgtgacagctgccatactttactgttgcagcggtgctcgagtacagcatcctag

SEQ ID NO: 29730 - DNA, 1827 bp, Artificial Sequence
  Description of Artificial Sequence: Synthetic coding sequence
gcttgggccgcgagattagggcggccaggacgtagttgcctgcctggagcccgcgggagagctccaccccctcctcctcttctactcctcctggcattgctgccccttttgcccgcacccggggctgccgccgcccctgctccacggccacctgaactgcaatccgcaagtgccggacctagtgtctccttatacctgagtgaagatgaggtgaggcggttgatcggtctggacgccgagctgtattacgttcgcaacgacctgatttctcattatgctctttcctttagcctccttgtaccatcagaaacaaattttctgcatttcacttggcatgcgaaaagcaaggtggagtacaagctgggatttcaagtggataatgtgctcgcaatggatatgccccaggtgaacatctctgtccagggggaggtaccaagaactttgtcagtgttccgagtggagctgagctgtactgggaaagtggactctgaggtgatgatcctgatgcagctgaatttgacggtcaacagcagcaagaactttacagtgctgaatttcaaacgccggaagatgtgttacaagaagttagaggaggtgaagacatccgccctggacaagaataccagcagaactatttatgacccagtccatgccgcaccaactacatcgacgagagtgttttacatttccgtgggcgtgtgctgtgctgtaatttttctagtcgccataatcctggctgtgttacacctccacagcatgaaacggatcgagctcgatgatagcatctccgcgtccagctccagccaaggcctgagccagccctctacccaaaccactcagtatctgcgggcagatacccccaataatgcgacacccatcacttcttccctgggctaccctacgcttcggatcgagaagaacgaccttcgctcggtcaccttgctcgaggccaagggcaaggtaaaagacatagctatttcgcgggagcgcatcaccctgaaggatgttctgcaggagggaacatttggtcgtatcttccacggcattcttatcgacgagaaggaccctaacaaggaaaagcaggcatttgttaagacagtgaaagatcaggcaagtgagattcaggtgactatgatgctcacagaaagctgtaaactccggggtctgcatcatcgtaatctgctccctattacccacgtttgtatcgaggaaggagaaaagcccatggtgattttgccctacatgaattggggtaatctgaaattgtttctgagacaatgcaagttggttgaagccaacaatccccaagccatctcacagcaggatctggtccatatggccattcagattgcctgtggcatgagttatctggcgagaagagaagtgattcataaggacctggcagctcgcaactgtgtcatcgacgacaccctccaagttaagattaccgacaacgctctgagcagagatctgtttcccatggactatcattgtcttggggataatgagaatcggcccgttagatggatggctctggagtcactagtgaataatgagttttcctcagccagtgatgtgtgggcttttggggttacactctgggagctcatgaccctggggcagaccccttatgtggacatagatccctttgagatggcggcctacttgaaagacggatacaggattgctcagccgattaactgcccggatgagctgtttgccgttatggcttgttgttgggcccttgaccccgaggaaaggcctaagttccagcagctagtgcaatgtttgaccgagttccatgcggctttgggtgcctatgtttag

SEQ ID NO: 29731 - DNA, 1257 bp, Artificial Sequence
  Description of Artificial Sequence: Synthetic coding sequence
atgtgctacaagaagttagaggaggtaaagactagcgccctggacaagaacacttcacgtactatttacgacccagtgcacgctgcgccgactacatctacccgggttttttacatcagcgtgggtgtgtgttgtgccgtgatatttctggttgccattatcctcgcagttctccacctgcactctatgaagcgcattgagctggacgactcgataagcgccagctctagcagccagggactttcccagccatccacccagaccacccagtacctgcgggcagacacacctaataacgccacacccatcactagcagcctcggttatccgaccctccgaatagaaaaaaacgacttaaggagcgtcactcttctggaagccaaagggaaggtgaaagacatagcaatcagccgggaacggattacccttaaagacgtcttgcaggaagggacctttggcaggatcttccacgggattctgattgatgagaaggatcctaacaaagaaaaacaggctttcgtgaagactgtaaaggaccaggcctcagagatccaggtgacaatgatgctgaccgagtcttgtaagcttaggggactgcatcaccggaacttgcttcctatcacccacgtctgtatcgaggaaggcgaaaagcctatggttatcctaccttatatgaactggggcaacctgaagctattcctgaggcagtgtaaattagtggaagccaataacccccaggcaatatcacagcaagacttagtacatatggcaatccagattgcgtgcggcatgagttatctcgcccgccgcgaggtgatccacaaggatctggccgcaaggaattgcgtcattgacgatacactgcaggtgaagatcaccgacaatgcactctccagggacctattccccatggattatcattgcctgggggataatgagaatcggcccgtcagatggatggcacttgagagtctggttaacaatgagttcagttccgccagcgatgtgtgggctttcggcgtgactttgtgggagctcatgacgctcggacagactccgtatgtggatattgacccgttcgagatggctgcctacttaaaggacggatacaggattgcacagccaatcaactgccctgatgaactgttcgcagtgatggcctgttgttgggcacttgacccagaggagcggccaaagtttcagcaactagtccaatgcctgaccgagtttcacgccgcgttaggcgcttacgtatag

SEQ ID NO: 29732 - DNA, 1764 bp, Artificial Sequence
  Description of Artificial Sequence: Synthetic coding sequence
taaagagccccgcccccacccccgctgctactgttgctggctctactgccactgctgcccgcacccggtgccgcagccgcccccgcgccccggccaccggagctacagtccgccagcgcgggcccgtcagtatcactgtacttgtcagaggatgaggtcaggcgactcatcggcctggacgccgaactctactatgtcagaaatgatctgatttcccactatgcactctctttctccctgctcgttccgtctgaaaccaacttccttcacttcacttggcacgctaaatctaaggtggagtacaagttggggtttcaggtggataatgtactcgctatggacatgccacaggtcaatatctccgtgcaaggcgaggtcccccggactttgtccgtgttcagagtggagttgtcctgcacaggcaaggtggattccgaggtgatgattcttatgcagctgaacctgactgtcaacagcagtaagaacttcaccgtgttaaacttcaaacgacgtaaaatgtgctacaaaaaactggaagaggtaaagaccagtgctttggataagaacacatcacgcaccatctacgacccagtgcatgccgccccaacaactagtacccgagtattctacatttccgtgggtgtgtgttgtgctgtgatcttcctcgtagccatcattttggccgtccttcatctccactctatgaagcgaattgaactggacgatagcatttctgcctcttcatcttcccaggggctgagccagccttccacccagacaacccagtatttacgcgcagatacccctaataacgccaccccaattacaagctaccccacactgcgcatagagaaaaatgacctgagaagcgttaccttgttggaagccaaaggaaaggtgaaagacatagcgatatctcgggagaggatcactctgaaagacgtgctgcaggaagggaccttcggcaggatatttcacggtatactgatcgatgagaaggacccaaacaaggaaaagcaggcttttgtcaagaccgtgaaggaccaagccagtgaaatccaggtcaccatgatgcttacagagagttgtaagctgaggggacttcatcatcgaaacctgcttccaattactcacgtttgtatagaagaaggagagaagcctatggtgattctgccctacatgaactggggcaacctgaagcttttcctccgccagtgtaagctcgtggaagctaataaccctcaagcgatcagtcaacaagatctggtgcacatggccattcagattgcctgcgggatgagctacttggctcgacgcgaggtgatccacaaggatctggccgcccggaattgtgtcatcgatgatacactccaggtgaagatcaccgacaacgctctgtctagggatcttttcccgatggactaccattgcttgggcgacaatgagaaccgtcccgtgaggtggatggccctagaaagtttggtgaataacgaatttagtagcgcttcggacgtctgggctttcggcgtcacgctttgggagctgatgacactaggacagacaccttacgttgatatcgatcccttcgagatggcagcctacctcaaggacgggtatcgcatcgctcagccaattaattgtcctgacgaactcttcgcggtgatggcatgctgctgggccctcgatccagaggagcggcccaagttccaacagttggtgcagtgcctcaccgaattccacgcagccttaggagcatacgtgtag

SEQ ID NO: 29733 - DNA, 240 bp, Artificial Sequence
  Description of Artificial Sequence: Synthetic coding sequence
atgtccactaagaagtccccggaggaattaaaacgcattttcgagaaatatgctgctaaagagggcgacccagatcaactctcaaaagacgagcttaagctccttatccaggctgagtttccttctctactgaaggggccgaataccctggatgacctgtttcaggagctggacaagaatggggacggcgaggtcagctttgaggagttccaggtacttgtgaagaaaatctcccagtag

SEQ ID NO: 29734 - DNA, 726 bp, Artificial Sequence
  Description of Artificial Sequence: Synthetic coding sequence
atgaatggcactttaacagcagtggagagctttctcaccattcactctggtccagagggactatcgatccacgatgggacctggaaatcggcaatctatggcttcggtgaccagtctaacctgcggaaactgcggaacgttagcaatctaaaaccagtcccgctcataggccctaagctgaaaagaagatggcctatcagctattgcagagagttgaagggctactccatcccctttatgggctctgatgtctccgtagtgcggcgcactcagaggtacttgtatgaaaacctggaggagtcccccgttcagtatgcagcttatgtcactgtggggggtattacatcggtgattaaactcatgttcgccgggctgtttttcctattctttgtccggttcggcattgggcggcagctattgattaagatcgatgccgcctcctttacactgactttttttggtcagggatactcccaggggactggcacggacaagaacaaacccaatattaagatttgtacccaagtgaaagggcctgaagccggctacgtcgccactcctattgcgatggttcaggccgccatgacgctgctgagcgatgcaagccatctccctaaagccgggggcgtattcaccccaggcgccgccttttccaagacaaaactgattgatagactaaataaacacggtatcgagttttccgtgattagcagtagtgaagtctag

SEQ ID NO: 29735 - DNA, 1290 bp, Artificial Sequence
  Description of Artificial Sequence: Synthetic coding sequence
atggcaaccgagcaacggcctttccatctcgtggtgtttggcgcctcgggcttcacgggccagttcgtcactgaggaggtggcccgcgagcaggtggatcctgaacgttctagccgcttgccttgggctgtggccggacgatcccgggagaagcttcaaagagtgctggagaaggccgcactgaaacttggtcggccaaccctttccagcgaggtgggcattatcatttgtgatatcgccaatccagcgtcattggacgaaatggcaaaacaggctaccgtggtgcttaactgtgtgggtccttatagattctacggcgaacctgtcatcaaggcatgcatcgagaacggggcatcgtgcatcgacatctcaggggaaccgcagttccttgaacttatgcaacttaaataccacgaaaaggccgctgataaaggagtgtacattatcggtagcagtggatttgactctattccagctgacctaggggtgatatataccagaaacaagatgaatggaaccttaacagcggtcgagtcttttcttaccatacactccggcccagaagggttaagcattcacgacggcacctggaagtcagccatatacgggttcggggaccagagcaacttgagaaaactgagaaacgtgagcaatctcaagccagtgccactgattggacctaagctaaagaggagatggccgatttcctattgtcgggagctcaaaggatatagcattccttttatggggagtgacgtcagtgtggtccgacggacacagaggtacttgtacgaaaatctggaggagagtccagttcagtatgccgcctacgtgaccgtgggtggcataacaagcgttatcaagcttatgttcgcagggttatttttcctattctttgtgagattcggtattggcagacagctcctcattaagtttccctggtttttctcctttgggtacttttctaaacaagggcctacacagaagcagattgacgctgccagtttcacattgacctttttcgggcagggctactcgcaaggaaccggcacagataaaaataaaccaaacatcaagatttgcacccaggtcaagggccctgaagcaggctatgtcgctacccccatcgcgatggttcaagccgccatgacactgctatcagacgcttcacacctgcctaaggcaggcggtgtgttcactccaggcgccgcgtttagtaaaaccaagctcattgatagacttaacaaacacgggattgagttttcggtcatctcatcgtccgaggtttag

SEQ ID NO: 29736 - DNA, 1074 bp, Artificial Sequence
  Description of Artificial Sequence: Synthetic coding sequence
atgagcggtaagactaaagcccgacgtgcagcaatgttctttaggcgctgctccgaagatgcctcaggctccgctagtgggaatgccctgctatcagaggacgagaatcccgacgcgaatggagtaacacgaagctggaaaattattctaagtaccatgctcacattaactttcctactggttggactgttgaaccatcagtggctcaaagagaccgacgtgcctcagaagagtcggcagttgtacgcaataatcgccgagtatgggtctagactatacaaatatcaggcccgtctgagaatgccaaaggaacaacttgagttgctgaaaaaggagtcccaaaatctggagaataatttcagacagatcctgtttctaatcgagcaaattgatgtgctaaaggcccttctccgtgatatgaaagacggcatggataacaaccataactggaatacccacggagatccagtagaggatcccgatcatacagaagaggtgagcaacctggtgaattacgtgctgaagaaactgagagaagaccaggtcgaaatggccgattacgcactgaagtctgcaggcgctagcatcattgaagcagggaccagtgagtcttacaagaataataaggccaagctgtactggcacgggattggcttccttaaccacgagatgcccccagacatcattctacagcccgatgtataccctggcaaatgttgggcctttcccggaagccaggggcacactctcattaagctggcgaccaagatcattcctacagctgtgacaatggaacatatttcggaaaaagtgtctccaagtggtaacatctcatctgccccaaaggaattctcggtttatggaatcaccaagaaatgtgaaggtgaggagatctttttagggcaattcatctataataaaacagggactaccgtccagaccttcgagctgcaacatgccgtcagtgaatatcttctgtgtgtgaagctgaatatcttcagcaactggggacatccgaaatatacatgtctgtaccgctttagggttcatgggaccccaggcaaacatatttag

SEQ ID NO: 29737 - DNA, 1074 bp, Artificial Sequence
  Description of Artificial Sequence: Synthetic coding sequence
atgtccggaaagaccaaggcacgccgtgcagccatgttttttagaagatgcagcgaggacgcgagcggtagtgcctctggtaatgcccttttaagcgaggacgagaatcccgatgccaacggcgtcacacgttcctggaagattatattgtctactatgcttactctgacctttctactcgtcgggctgctgaatcatcagtggctgaaggagacagacgtgccccagaagagcagacagttatatgcaatcatcgccgagtacggctcccgcctctacaagtaccaggcaaggctgagaatgcccaaggaacaactagagttgctgaagaaagagtcccagaacctcgagaataatttcagacagatcttgttcctaatcgagcagatagacgtgcttaaggcactgttacgggatatgaaggacggtatggataacaaccataattggaatacccacggcgatccggtcgaagatcccgaccatactgaagaggtgtctaatttggtaaattacgttcttaaaaagctcagagaggatcaggtggaaatggctgactacgctctgaaatctgccggggcatccatcatcgaagcggggacaagtgagtcctacaaaaataataaagctaaattgtactggcatggcattggctttctgaatcatgaaatgccaccagacatcatccttcagccggatgtgtacccaggtaagtgctgggcctttcctggaagtcaggggcacacgctgattaagctggccacaaagattatcccaaccgccgtgacgatggagcacatatccgaaaaggtttcacccagcgggaatatctccagcgccccaaaggaattcagcgtgtatggaataaccaagaagtgtgagggcgaggagatcttcctaggccagttcatttataacaagactggcacaacagtgcagacattcgaactgcagcacgcagtttctgagtacctgctctgcgtcaagctaaacatttttagcaattgggggcaccccaagtatacctgtctttaccggttccgggtgcacgggacaccaggaaaacatatttag

SEQ ID NO: 29738 - DNA, 810 bp, Artificial Sequence
  Description of Artificial Sequence: Synthetic coding sequence
atgcccaaggaacagctggaactccttaaaaaggaatcccagaatttggagaataactttaggcaaatcttatttctgattgaacaaatcgacgttctgaaggctttgttgcgcgatatgaaggacggaatggataataatcataattggaatacgcacggagaccccgtggaggatccagatcacactgaggaagtgtctaacttggtgaactacgtgctgaaaaagctcagggaagaccaggtcgaaatggctgactacgcattgaagtccgctggagctagtattatagaggctgggacatctgagtcctataaaaacaacaaagctaagttatactggcacggcataggcttcctaaatcacgaaatgcctcctgacatcatcctacagccagacgtatacccaggcaaatgttgggccttccctggcagccagggccatacgctgattaagctggccaccaagataatacctacagccgttactatggagcacatttccgagaaggtgagtccttcgggcaatatctctagcgcccccaaagaattttcagtatatgtgcagcgttatatgtgccggtttgtcatacaagcgggaattacaaaaaaatgcgagggtgaggagatcttcctgggccagtttatatacaataagacaggaacgaccgtacagacctttgagcttcaacatgctgtaagtgaatacttgctgtgtgtcaaactgaacattttttctaattggggccatcccaaatacacctgcctgtatagatttagggtgcacgggactcctggcaaacacatttag

SEQ ID NO: 29739 - DNA, 810 bp, Artificial Sequence
  Description of Artificial Sequence: Synthetic coding sequence
atgccgaaagaacagctggagcttcttaagaaagaatcgcagaacctggagaataatttcagacagattttgttcctgatcgagcagattgacgtgctgaaggctcttcttagagatatgaaagatggtatggataataatcataactggaatacacacggcgaccccgtggaagatcctgaccatactgaggaggtcagcaatcttgttaattacgtcttaaagaagcttagagaggaccaagtcgagatggctgactacgcgctgaagtccgctggcgcatccataatcgaagcaggaacatccgaatcctacaaaaacaataaggccaaactttattggcatggcatcggcttcctgaatcatgagatgcccccggatattatcctccagcctgacgtatacccgggcaagtgctgggcatttcccgggagccagggacacacactcattaagctggctaccaagatcattccaaccgcagtcaccatggaacacatatctgaaaaggtctcgccttcaggaaacatttcttcagctccaaaggaattttctgtatacgtccaaagatatatgtgcagattcgtgattcaggccgggataacgaagaagtgcgaaggggaagagatctttctgggacagttcatctacaacaaaactggaacgaccgttcaaacattcgagctacagcatgccgtctcagaatatctgctttgtgtgaaattgaatatcttttccaattggggccatcctaaatatacctgcctctaccggtttcgagtccacgggaccccaggaaaacatatctag

SEQ ID NO: 29740 - DNA, 846 bp, Artificial Sequence
  Description of Artificial Sequence: Synthetic coding sequence
tgatacgctataatcgcggaatatgggtcccggttatacaaataccaagcgcggttgcggatgccaaaggagcaactggagctgctgaagaaagaatcgcaaaacctcgaaaacaatttcagacagatcctttttctcatcgagcagatcgatgtgctcaaggcactgctgagggacatgaaagacggcatggataataaccacaattggaatacgcatggggaccccgtggaagatccagatcacactgaagttctggacgaggaggtgagcaaccttgtcaattatgtcctgaagaaactgcgcgaggaccaggttgagatggctgattatgcgctgaagtctgcaggagcctctatcatcgaagctggaacaagtgagagctataaaaacaataaagccaagctgtattggcacggaataggctttctgaatcatgaaatgccgcccgacatcattctccaaccagatgtatatcctggaaaatgctgggccttccctggaagtcaaggccacacactgattaagctggcaactaagatcatccctaccgcagtgaccatggagcatatttccgagaaagtgtccccttctggcaacatttcaagcgctcctaaggagttctccgtttacggcatcacgaagaagtgtgaaggagaggaaatatttctggggcagtttatttataacaaaaccggtactacagttcaaactttcgaactgcagcatgctgtgtctgagtaccttctgtgcgtgaagttaaatatcttctcaaattgggggcaccccaagtatacctgcctttatcggtttcgcgtccacggaactccaggaaaacacatctag

SEQ ID NO: 29741 - DNA, 1038 bp, Artificial Sequence
  Description of Artificial Sequence: Synthetic coding sequence
atggaagactattctaagtataacgcctacacagatttcagttcctgcaggctggaatgctcgggagcaatacttgcccactgtaatctgcacctgctcggctcctcaatttccccagcttcggcttccagagtggccggcaccacaggactcttgaatcaccaatggttgaaagaaaccgatgtaccccagaagagccgacaattgtacgcaattatcgctgaatatgggagtcgcttatacaagtatcaggcccggctgagaatgcctaaggagcagctcgagcttctcaagaaggaaagccagaaccttgaaaacaactttcggcagatcctgtttctcatcgagcaaatcgacgttctaaaggccttacttagggacatgaaggatggaatggataataaccacaactggaatactcacggggatcccgtcgaagatcctgatcacacggaggaagtctccaacttggtgaactacgttcttaaaaagctacgagaagaccaggtcgaaatggctgactacgcccttaagagtgccggggcctccattatcgaagctgggactagcgaatcttataagaacaacaaagccaagctgtactggcacgggatcggatttttaaaccatgaaatgcctccggacatcattctgcagccagacgtgtaccctggaaaatgttgggccttccccggaagtcaggggcatacccttatcaagctggccaccaaaatcatcccaacagccgtgactatggaacatataagtgaaaaagtgtctccttccgggaatatttcttccgcgccgaaagaattttctgtttatggaataacaaagaagtgtgagggagaagagatcttcctcggccagttcatttataataagacaggaacaacagtgcagacatttgagctccagcacgcagtgtccgagtaccttttatgcgtcaaactaaatatcttctcgaactggggacatcctaagtatacctgtttgtatcggttccgtgtgcacggcacgcctggcaagcatatctag

SEQ ID NO: 29742 - DNA, 939 bp, Artificial Sequence
  Description of Artificial Sequence: Synthetic coding sequence
atggatcgctctacaaatctcgatattgaggagttgaaaatgacgcgggaacaatatatccttgctacccagcagaataacttgccccgcaccgaaaacgcacagctttaccctgtgggcatatacggttggagaaaacgatgcttatactttttcgttctcctgttgttagtaactatgatcgtcaatctggccatgacaatttggatcctcaaggtcatgaatttcactgtggatgggatggggaatctccgtgtaaccaagaaggggatcaggttagagggtatcagtgaatttctgctgccactgtatgtgaaggaaattcactctagaaaagattcacctctggtgctgcagtctgacaggaatgtgaccgttaatgctcgtaatcacatgggccagcttactggacagcttacaatcggcgccgatgccgtcgaagctcaatgtaaaaggtttgaagtccgtgcatctgaggatggtagggtgctcttttctgcggacgaagacgagattaccatcggggctgagaaactgaaagttactggcaccgagggcgcagtgtttgggcacagcgtggagaccccccacataagagctgaaccaagtcaggacctcaggctggaatcacccactaggtccctcattatggaagcacctagaggagttcaggtgtccgctgctgcaggggatttcaaggcaacttgtcggaaagagctgcatctccagtctacagaaggggagatttttctgaatgcggaaactattaagctcgggaacctgcctactggctctttctcttcgtccagccccagcagttcttcctcacgacagaccgtatacgaactgtgcgtctgtccaaacggcaagctgtacctgtcccctgccggagtcgggagcacatgtcaatcaagctccaacatctgcctgtggtcctag

SEQ ID NO: 29743 - DNA, 798 bp, Artificial Sequence
  Description of Artificial Sequence: Synthetic coding sequence
atgacccgcgagcagtacatattggctactcaacagaacaatctgccaaggacagagaacgctcaactttatcccgtgggaatctacggttggcgtaagcgatgtctgtacttctttgtgttattgttgctggtaaccatgatcgtcaatctagccatgaccatttggatcctgaaggttatgaattttaccgtagactcaccgctcgtgcttcagtccgaccgtaatgtcaccgttaatgctagaaatcacatggggcagctcacgggccaattgactattggcgctgatgccgtggaagctcagtgcaagcgttttgaagttcgcgcctcggaagatggacgcgtactgttcagcgccgacgaagatgaaattaccattggggcggaaaaactgaaagtgaccgggacagaaggagctgtttttgggcacagcgtggagacaccacatattcgcgcggagccttcccaagacctcaggctagagtctcccacacgatctctgattatggaagctccacgtggggtccaagtgtccgctgccgctggcgactttaaggcaacctgtcgaaaagagctacacctacagtccaccgagggcgaaatattcttaaatgctgagacaatcaaactgggtaacttaccaacaggcagttttagtagctcctccccgtcctcaagctcatcccggcagactgtgtatgagctgtgtgtttgtccaaatgggaagctctacctttcccctgccggagtgggatctacctgtcagtcctccagcaatatatgtctatggagttag

SEQ ID NO: 29744 - DNA, 2436 bp, Artificial Sequence
  Description of Artificial Sequence: Synthetic coding sequence
atgccatccgcactggccatattcacatgtcgtcccaacagtcacccctttcaggagaggcacgtttacttggacgagcccatcaagattggtcggagcgtcgcccgctgccgccctgcacagaataatgctactttcgattgtaaagttctctcgcggaatcacgctctggtgtggttcgaccataaaaccggcaaattttacttacaggatacaaaatcaagcaacgggaccttcattaacagtcagaggctcagccgcggctccgaggagtcccccccatgcgaaatattgtctggggacattatccagttcggggtggatgtaaccgaaaacactagaaaggttacccacggttgcattgtgtccactatcaagctgttcctgcccgatggaatggaggcccgactgcgtagtgatgtaatccatgcgcccctaccatccccagttgacaaagttgccgccaatactccttccatgtactctcaggaactgttccagctgtctcaatatctgcaggaagccttgcatagggagcagatgctggagcagaagctagcgacccttcagaggctgcttgccataacacaggaagctagtgatacctcctggcaagccctgatcgatgaggacaggcttctctcccggttggaggtgatgggcaaccagttgcaagcatgctccaaaaaccagaccgaggattcactgcgcaaagagctgatcgcgttgcaggaggataagcacaattatgagacgaccgcaaaagagtcacttcggcgtgtccttcaagaaaagattgaagtcgtcagaaaactcagcgaggtggagcgctctctctcaaacacagaggatgagtgcacccatctcaaggaaatgaatgaaaggacacaggaggagctgagagagttagcaaataaatacaatggagccgtgaatgagatcaaggacttatcagataaacttaaggttgctgagggaaagcaagaagagatccagcagaagggccaagccgaaaagaaagaactgcagcacaagattgatgagatggaagagaaggagcaggagttgcaggccaaaatcgaagccttgcaggccgataacgacttcacaaacgagagactgaccgctctgcaagagcacttactgtctaaaagtgggggcgattgcacctttatccatcaatttattgagtgccagaagaaactaatcgttgaaggacacctaacaaaggctgtcgaggaaacaaaactgagtaaagagaaccagacaagagccaaggagtccgatttcagtgacaccctgtctccttctaaagagaagtcttcggacgataccacagatgcccaaatggacgaacaggacctgaacgaacctttggctaaggtgagtctgctcaaggacgacttacaaggcgcccagtcagaaatagaagccaagcaggagatacagcacctgagaaaagaactaattgaggcgcaggagctcgccagaacttccaaacaaaaatgtttcgaattacaagcactcctcgaagaggaacgtaaggcctacagaaaccaggtggaggaatcgacaaagcaaattcaagtcctccaggctcaactccagcgcttgcatatagacaccgaaaacctacgggaggagaaggattccgagatcacaagtacaagagatgaactcctgtcagctagggatgaaatcttgttgttgcatcaggcagccgccaaggtcgcgagcgagcgagacacggatattgcatccctccaggaggagctcaagaaagtccgagctgagctcgagcggtggagaaaggccgcgtccgaatacgagaaggagatcaccagcctccaaaactcattccaattacggtgtcagcagtgcgaagatcaacagagagaagaggcgactagactgcagggagaactcgaaaaactccgaaaagagtggaatgcactggagactgagtgccactcgctcaagcgcgaaaacgtactacttagctctgaacttcagcggcaggaaaaggagctgcacaattcccagaagcagagcctggagcttacgtctgacttaagcattctgcagatgtctaggaaagaacttgaaaaccaagtcgggagccttaaggagcaacacctgcgagactctgcggatcttaagacgctgctgtctaaggctgagaatcaagcaaaggacgtacagaaagaatacgagaagactcaaaccgtcctgagcgaactgaaactaaaatttgagatgacagaacaggagaagcagagtatcacggacgagctgaaacagtgcaagaacaacttgaaattgctgcgggagaaaggaaacaacaagccttggccatggatgccgatgctagctgcactagtggccgtgaccgctatcgtcctatacgtgccaggactcgccagagcttccccctag

SEQ ID NO: 29745 - DNA, 2436 bp, Artificial Sequence
  Description of Artificial Sequence: Synthetic coding sequence
atgccttctgcattagctattttcacctgccgccctaactcccacccatttcaggagcgccacgtgtacctggatgaaccgatcaagattggaagaagcgtagctaggtgtcggccagcgcaaaacaatgctaccttcgattgtaaggtgttgtctcgcaaccacgccttggtgtggtttgatcacaagaccggtaaattctatctgcaggacacgaagtctagcaacggaaccttcattaacagccagagactgagccgggggtccgaggaaagccctccctgcgaaattctgagtggcgatatcatccaattcggggtcgatgtgaccgagaacacacgcaaagttacccacggttgtatcgtgtctaccattaagctgtttctgcctgacggcatggaagccaggctgcgttcggatgtgatacatgcacccctcccatccccagtagataaagtggctgccaacacaccctccatgtacagccaagagctattccagctgagccagtacctgcaggaggctttgcacagggagcagatgttggaacagaagttggcaacgcttcagagactactggcaataacgcaggaggcctctgacacctcttggcaagcactgattgacgaggaccggctgctgtctagattagaggtcatgggcaaccagctccaggcgtgctcaaagaaccaaactgaagacagtctgcgaaaggaactaatcgccctgcaggaggacaaacacaattacgaaaccactgccaaagagtccctcagacgcgttctgcaagagaagatcgaagttgtgcggaagctcagcgaggttgaaagatccctgtccaatacagaggacgagtgcacccatttaaaagagatgaacgagaggactcaagaagagctgcgggagcttgctaataagtataacggcgcagttaatgaaatcaaagatctgtccgataaactgaaggtggctgagggaaaacaggaagaaatccaacagaagggccaggccgagaagaaggaactgcaacacaagatagatgagatggaggaaaaagagcaagagctgcaggccaagattgaagccctgcaggctgacaacgacttcacaaatgagcggttgaccgctcttcaggagcacctcctcagcaagagtgggggcgactgtacgtttatacatcagtttattgagtgccagaagaaattaattgtagaggggcacctaacaaaggctgtagaggaaaccaagctttccaaagagaaccagactcgcgctaaggaatcagatttttccgacactctgtcgccttccaaggagaagtcttcagatgacacgactgatgcacaaatggacgagcaggacctgaacgagcccctggcaaaagtttccttattaaaagatgatctgcagggagcgcagtccgagatcgaggccaaacaggagatccagcacctgagaaaagaactcatcgaggcgcaggagttggctcggacttctaagcagaagtgctttgaactgcaggcattgctcgaggaggagcgcaaggcttatcgcaaccaggtggaggagtcaacaaagcagatacaagtgctgcaggcacagctgcagcggttgcacattgacactgagaacctgagggaagaaaaggactccgaaatcacttctacacgagatgaattgttgtctgcccgggatgaaatactgctgttacaccaggcggctgccaaggttgccagtgagagagacacagatatcgcctctctacaagaagaactcaaaaaggttagagctgagctcgagagatggcgcaaggcggccagtgagtatgaaaaagaaataacaagtttacagaactcatttcaattgcgttgccagcagtgcgaagaccagcagcgggaagaagcaacaaggcttcagggtgagcttgagaaactccgcaaggagtggaatgctttggagaccgagtgtcactcacttaagcgcgaaaacgtactgctgagcagtgagctccagcgccaggaaaaggaattgcacaacagtcagaagcagtccctcgaactcactagcgatctttctatactgcagatgtctcggaaagaactagagaatcaggtcggcagcctaaaggagcagcacctccgcgatagcgccgatctcaagaccttgctgtctaaggcagagaatcaggccaaagatgtgcagaaggaatacgagaagacacaaacagtgctaagcgagctcaagctgaagtttgaaatgaccgagcaagagaagcagtccatcaccgacgagctgaagcagtgcaagaataatttaaagctgctccgagagaagggaaacaacaaaccgtggccctggatgcctatgcttgccgccttggtcgccgtgacagcgatagttttgtacgtgcctggcctggcaagagcaagcccctag

SEQ ID NO: 29746 - DNA, 1521 bp, Artificial Sequence
  Description of Artificial Sequence: Synthetic coding sequence
atgccatctgcgctcgccatatttacctgtcgacctaactctcaccctttccaagagaggcatgtctacctggatgaacctattaagattggaaggagtgtcgcacgctgccggccagcccagaacaatgccacctttgactgcaaggttctcagcagaaaccatgcactggtgtggtttgatcacaagaccggaaagttttatcttcaggacactaaaagttcaaacggcacctttataaacagccagaggctcagccggggtagcgaggagtcccccccttgcgagattctgtccggagatataattcagttcggagtcgacgtcaccgaaaatacaaggaaggtgacccacggttgtattgtgagcaccatcaaattatttttgccagacgggatggaggccaggcttcgctctgatgtgatacacgcccccctgccttcacccgtcgataaggtcgccgcgaatacgccatctatgtattcccaagaactattccagctgtcacagtacctccaggaagccttacaccgagaacagatgcttgaacagaagctggctacactgcagaggttactggcgatcactcaggaggcgagtgatacatcttggcaggcgctgatcgacgaggataggttactgtctcggctggaggtcatgggtaaccagctgcaggcttgttcaaaaaatcagacagaagactcattgaggaaggaattaattgcccttcaggaggataaacataactatgagactactgcaaaagaaagccttaggcgggtgctccaggagaagatcgaggtggtgcgaaaactgtcagaagtggagaggagtctctcaaatactgaagacgagtgcacacatttgaaggaaatgaatgagaggacacaggaggaactccgcgagttggctaataaatataatggagcagttaatgaaattaaagatctcagtgacaagctcaaggtggccgagggcaagcaggaagagattcagcagaaaggacaggcggaaaagaaggaactacagcacaagattgatgagatggaagaaaaggaacaggagctgcaggcgaagatcgaggccctccaagccgataatgactttacaaatgaacgactcactgcccttcaggtgaggctggaacacctgcaggagaagaccctgaaggaatgcagctctttagggatacaagtggacgacttcctgccgaagattaacggatccacagagaaggagaagctgattgtggagggacaccttactaaagcagtcgaggagacaaaattatccaaagagaaccaaacgcgcgcaaaggaatccgatttctcagataccctgagccctagcaaggagaaatctagcgacgatacaaccgatgctcagatggatgaacaagatctgaacgagccattggccaaggtgagcctcttgaaaggcacccttacgtgtttttacgacatcgtcaaccagggtataaagtctccattcgcaatcaagtccgtacttgatattatgtag

SEQ ID NO: 29747 - DNA, 816 bp, Artificial Sequence
  Description of Artificial Sequence: Synthetic coding sequence
atggatgagcaggaccttaatgagcctctcgcgaaggtgagcctgctcaaagcccttctggaggaggagagaaaagcgtatcgcaatcaggttgaggagtcaaccaagcagattcaagttctgcaagcccagctccagcgattacacatcgacaccgagaacctaagagaagaaaaggattctgagataacgagcacacgcgatgaattattaagcgcccgcgacgagattcttctgctacaccaggcggctgcaaaggttgcaagcgagagagacaccgatattgccagcttacaggaagagttaaagaaagtccgagcggaactggagcgttggagaaaggccgcctctgagtatgagaaggagattacttctcttcagaattccttccagcttaggtgtcagcagtgcgaagatcagcaacgcgaggaagcaactcgcttacaaggagaacttgaaaaactccggaaagaatggaatgctctcgaaactgagtgtcatagcctcaaaagagagaatgttcttctctcatccgagctgcagcggcaggagaaggaactgcacaattctcagaagcaaagcctggagctgacctctgatctgtcaatactgcagatgagccgcaaagagctggagaatcaggtgggatccctcaaggagcagcatctgagggacagtgctgatctaaagaccctgctgtccaaggctgagaaccaagcaaaagatgtgcagaaggaagttaagcgaaaagacattatgagccccatcatggtgggattaaaagccaaaagcaagtctgacatccatgccagttag

SEQ ID NO: 29748 - DNA, 1230 bp, Artificial Sequence
  Description of Artificial Sequence: Synthetic coding sequence
tagaaactgatcgtggagggacacctcacaaaggcggtggaagagactaagttgtccaaggagaatcagactcgagccaaagagtccgacttctcggacactctgagtcctagcaaagaaaagtcgtctgacgacacaacagacgcccaaatggacgagcaggatctgaatgagcctctggctaaagtatccctgctcaaggacgacctccagggtgctcagtcggagatcgaagctaagcaggaaatccaacatcttcggaaggagcttatagaagcccaggaattggccagaacaagtaaacagaagtgctttgaacttcaggcgcttttagaggaagaacgaaaggcctaccgcaatcaggttgaagaatctacaaaacagatacaggtgttgcaggctcagctgcagagactccacatcgacacggagaatctccgagaggaaaaagattcagagatcactagtactcgggacgaactgttgagtgctcgtgacgagattctgctcctgcaccaggccgccgcgaaagtcgcgtcagagcgagatactgatatcgcctcccttcaagaagagcttaaaaaggtcagagccgagctcgagcggtggcgcaaggcagcgagcgaatacgagaaagaaatcacgtccttacagaacagttttcaattgcggtgtcagcagtgtgaggaccagcaaagggaggaggcgaccaggctgcaaggcgagctggagaaattgcgaaaagagtggaacgccttggagactgagtgccacagtctgaagcgcgaaaatgtcctcttgagcagcgagctgcaacgtcaggagaaagagcttcacaattcccagaagcaaagcctcgaactgaccagcgacctttccatcctccagatgtctagaaaggagctggaaaatcaagtcggtagcctgaaggagcagcacctgagagatagtgccgaccttaagactttgctgtctaaggccgaaaatcaggcaaaggatgtccagaaagagtacgaaaagacacagaccgtgctttcggagctgaaactgaaatttgaaatgactgaacaggaaaagcagtccattacagatgagctgaagcagtgcaagaacaatcttaagctgcttcgagagaaagggaacaacccgtctatccttcagcctgtgcctgccgtctttattggcttgttcctggcctttcttttttggtgctttggccccctctggtag

SEQ ID NO: 29749 - DNA, 2487 bp, Artificial Sequence
  Description of Artificial Sequence: Synthetic coding sequence
atgcccagcgcactggcaattttcacctgcaggcccaactcccatccttttcaagaacggcatgtttatctggatgagccaatcaaaattggtaggagtgtggctcggtgtagaccagcccaaaacaatgctacctttgactgtaaggttttaagtagaaatcacgccctagtgtggtttgatcacaaaacaggtaagttctatttgcaagatacgaagtcatcaaacggcactttcattaatagtcagagattatctcggggaagtgaagaatctcccccatgtgagattttgagtggtgatataatccagtttggagtcgacgtgacagagaatacccgaaaggtcactcacgggtgcatcgtgtctactatcaagcttttcctgcccgacggaatggaggccaggttgagatctgatgttatccacgccccactgccttcaccagtggacaaagtcgctgccaacacaccatcaatgtatagccaggaactctttcagttgagtcaatatctgcaggaagcgctgcatagggagcagatgctggaacagaagttagctaccttgcaaaggctactcgcaatcacccaggaagcttcggacaccagctggcaagcactgatcgatgaagaccgactcctttctagactggaggtgatgggaaaccagctgcaggcctgctcaaaaaaccagaccgaggacagcttgagaaaggagttgatcgccctgcaggaagataaacacaattacgagaccacagcaaaagaatccctacgacgcgtactacaagagaaaatcgaggtcgtacgaaagttatccgaggtggaaaggagcctgtccaatacagaagacgagtgtacacatctgaaagaaatgaatgaacgcactcaggaggaattgcgcgagctggcgaacaagtacaatggagcagtgaacgaaattaaagatctctcggacaaattgaaggtcgcggaaggcaagcaagaagagatccagcagaagggccaggcggagaagaaagagctccagcacaaaattgacgagatggaggaaaaggagcaagagttacaagccaagatcgaagctctgcaggcagacaatgatttcactaatgagaggctcaccgctctacaagtcaggctcgagcaccttcaagagaagactctaaaagagtgttcttcactggagcacctgttgtcaaagtccggtggggactgcacctttattcaccagtttatcgagtgccagaaaaagctaatcgtggaaggacacctgaccaaggccgttgaagaaacaaagctgtctaaggagaaccaaactcgggctaaggaatccgatttcagcgatacgctgagcccgagcaaagagaagagcagtgacgacactaccgatgcccaaatggatgagcaagacctgaacgaacctctcgcaaaggttagcctgctcaaggacgacctgcagggagcccagtccgaaatagaggctaagcaggaaatacagcatctccggaaggagctcatcgaggctcaggagctggctagaacttcaaagcagaagtgcttcgagcttcaggctttactggaagaggagcgcaaagcgtacaggaaccaggttgaagaaagtaccaaacagattcaggtgcttcaagcccaactccagcggctgcatatcgatacggagaacctgcgggaggagaaggacagcgagatcacctccacacgcgacgagctgctgagcgccagggacgaaatcctgctgctgcaccaggccgcagcgaaagtcgcctctgaacgggacactgacattgcttcgctgcaggaggagctcaagaaggttagagctgagctggagaggtggcgcaaggctgccagtgagtatgagaaggagatcacaagtctgcagaactcgttccagcttcggtgtcagcagtgtgaggaccagcagagagaggaagccacgagactgcaaggcgagttggagaaactgcgcaaagagtggaatgccctggaaacagagtgtcatagcctgaaacgcgaaaatgttctgctcagttctgaattacaacgacaggagaaagagcttcataatagccaaaaacagtccctggagttaacctcagacttgagtatcctgcagatgtcaagaaaggaactggagaaccaggttggtagcctgaaggagcagcacttgcgggacagcgctgacttaaagactctccttagcaaagccgaaaatcaggctaaggatgtgcagaaggagtacgaaaaaacacagaccgtcctttccgaacttaaattgaaattcgagatgaccgaacaggaaaaacaatctattacagacgaattaaaacagtgcaaaaataacctgaagctgctgcgggagaagggcaacaataagccttggccatggatgccaatgctggccgcccttgtcgccgtgacagcaatcgtgctgtacgtcccaggactggcccgggcaagtccatag

SEQ ID NO: 29750 - DNA, 951 bp, Artificial Sequence
  Description of Artificial Sequence: Synthetic coding sequence
tgaggacacttgactaaagccgtggaggagaccaagctgtccaaagaaaaccagacaagagctaaagaatcggatttctcagatacattgtctccctccaaagagaaatcaagcgatgatactacggacgctcagatggacgagcaagacctgaacgaacccctggccaaggtttccctccttaaagctcttttggaggaagagcgcaaagcttatcggaatcaggtcgaggagagcactaaacaaatccaggtgctgcaggcccagctgcagagactgcatattgatacagaaaatctccgagaggagaaggacagcgagattacctcaactagagatgaacttctgtcagcccgtgacgagattttgctgttgcaccaggcagctgcaaaggtcgcctcagagcgggacactgatattgcttccctccaggaagaacttaaaaaggtacgcgccgagttggaacggtggcgaaaggccgcctcagagtatgagaaggaaatcaccagtctccagaatagcttccagctgagatgtcagcaatgcgaggaccaacaacgcgaagaggccacccgattacaaggcgagctggaaaaacttcggaaagagtggaacgcgcttgaaaccgaatgtcactcactcaaacgggagaacgtgttgctctccagtgaactccaaagacaggaaaaagagctccacaacagccagaagcagtctctagagttgacttcagatctcagcatcttacaaatgtcgcgtaaggaactcgagaaccaagtgggcagcctcaaggagcaacacttgcgcgactccgcggatttgaagactctcttatccaaagccgaaaaccaagctaaggatgtgcagaaagaagtgaaacggaaggatatcatgtcaccaatcatggtaggactgaaggcgaaaagtaagtcggacatccatgcctcttag

SEQ ID NO: 29751 - DNA, 891 bp, Artificial Sequence
  Description of Artificial Sequence: Synthetic coding sequence
atggacgagcaggacctgaatgaacctcttgctaaagtgagtctactgaaggcccagctgcaacgcctgcacatcgacaccgagaatctgcgagaggagaaggatagtgagatcacatcaacgcgcgatgagctcttgtccgctcgagacgaaattctcctattgcaccaggctgccgccaaagtggctagcgagagggacacggatatcgcaagcctacaagaagaactgaaaaaggtgagggccgagcttgagcgctggcgcaaagctgccagcgaatacgaaaaagagatcacaagcctacagaattcattccaactgagatgtcagcagtgcgaagaccagcaacgggaagaggccaccagactgcaaggagagctggaaaagctgcgcaaggagtggaacgccctggagactgaatgccacagcttgaagagagaaaatgtgcttctcagcagtgaactgcagcgccaggagaaggagctacataattctcaaaagcagtcccttgaattgaccagcgatctgtccattcttcagatgtcgcggaaggagcttgagaatcaggtgggatccctcaaagagcagcatctgcgagattctgccgacctcaaaactttattgagcaaggcggaaaaccaagctaaggacgtgcagaaagagtacgagaaaacacagaccgtgctcagtgagctgaaactcaagttcgaaatgaccgagcaagagaaacagagtattaccgacgagctgaagcagtgtaagaataatttaaagctgctgagagagaagggtaacaataagccttggccctggatgcctatgctggccgctttagtggccgtcaccgccattgtgctgtacgtgccggggctggcccgtgcatccccttag

SEQ ID NO: 29752 - DNA, 2373 bp, Artificial Sequence
  Description of Artificial Sequence: Synthetic coding sequence
atgccaagtgcactcgccatatttacgtgtaggcccaatagccacccatttcaggaacgccatgtgtacctagacgagcccataaagattgggaggtctgtggctcgttgtcgtccagctcagaataacgcaacgtttgattgtaaggttctttcccggaaccacgctctggtctggttcgatcataagacggggaaattttatctacaggatacaaagtcgtccaacgggactttcattaattcacagcggttgtcgaggggttcagaggaatccccaccgtgtgagattctcagcggcgatattatacagtttggcgtggatgtgactgagaatacccggaaggtgacacacgggtgcatcgtctcaacgatcaagctctttctgcccgacggcatggaagcccggttgaggagtgacgtgatccatgcaccgctccccagcccagtcgataaggtggcagctaacaccccttcaatgtattcgcaagaactgtttcagctctctcaatacctacaggaggccctccacagggaacagatgctggagcagaaactcgctaccctgcagcggctgctggccataacacaggaggcctctgacacttcttggcaagccctgatcgatgaggaccggctcctgagcaggctggaagttatgggaaaccagttgcaggcatgttctaaaaatcagactgaggactcactgcgcaaggagctgattgcactccaagaggacaagcataactatgagacaactgcaaaggaaagcctccgtagggtactgcaggagaagattgaggttgtgcgcaagctcagtgaagtcgaacggtccctatcaaacaccgaggacgagtgcacgcacttgaaggaaatgaacgagagaacccaagaggagctgagggaactagctaacaaatataatggagcagtgaatgagatcaaggacttgagcgataagcttaaggtcgccgaaggtaagcaagaagagattcaacagaagggacaggcagagaagaaagagttacagcataagatcgatgaaatggaggaaaaggaacaagagctccaggctaagatcgaggcgcttcaggcagacaacgatttcactaatgagcggctgactgctctgcaagagaagctgatcgtggagggacacctgaccaaagcagtcgaggagaccaaactgtccaaggaaaaccaaacacgcgcaaaggaatcggacttttcagatacattaagcccatctaaggaaaagtcttccgacgacacaaccgatgctcagatggatgagcaggacttgaatgaacccctagccaaggttagcctgctcaaagacgatcttcagggcgctcagtcagaaatcgaagcaaagcaggagatacaacacctgcggaaggagctaatagaggcccaggagctggcgcgaacctctaaacagaaatgttttgagctccaagccttgttggaagaggaaagaaaggcctatcggaatcaggtcgaagagagtacaaagcagatccaggtgctccaagcccaactgcaaagactccacattgacactgaaaacctccgtgaagagaaggatagcgagattactagcacaagggacgaacttctgagtgcccgcgacgagatcctgttactgcatcaggccgcagccaaggtcgcgtctgagagagacacggacattgcttcactccaggaggaactcaagaaagttagagccgagctagaacggtggcgtaaggccgcaagcgagtacgagaaagaaattaccagcttgcaaaatagctttcagcttcggtgccaacaatgcgaagatcagcagagagaggaggcgactagactgcagggtgagctggaaaagcttagaaaagagtggaatgcgttggaaacagagtgccatagtttaaaacgggagaacgtattgctttcgtccgagctgcagcgtcaggagaaggagctgcacaatagccagaagcagagtcttgaacttacttccgaccttagcatattgcaaatgagcaggaaagagcttgaaaatcaggtcggctcactgaaggagcagcacctgagggactctgcagatctaaaaacactcctgtcaaaagccgagaatcaagcgaaggatgttcagaaggagtatgaaaagacgcaaaccgttctgagtgaactgaagctaaagtttgagatgacagagcaggaaaagcagtctattaccgacgagctgaaacaatgtaagaataacctaaaactcctccgtgaaaaaggtaacaataagccgtggccttggatgcctatgcttgcagccctggtcgctgtcacagccatcgttctttacgtgccaggactcgcccgagcctcgccatag

SEQ ID NO: 29753 - DNA, 957 bp, Artificial Sequence
  Description of Artificial Sequence: Synthetic coding sequence
atggacgaacaggacctcaacgagcctctggccaaggttagcctgctgaaggccctcctcgaggaggaaaggaaggcttatcgtaaccaggtggaggagtctacgaagcagatccaagtgctgcaggcccagctccagcggctgcatatcgatacagagaatctgcgtgaggagaaagactctgagattacatcgacccgagacgagctgctcagcgcccgggatgagattttgcttctacaccaagcagccgctaaagtcgccagtgaacgtgacaccgacatcgccagcctgcaggaggaattaaaaaaggtcagggccgagctcgagcgctggagaaaagctgcgtccgaatacgaaaaggagataacaagcctccagaatagttttcagctgcgctgccaacagtgcgaggatcagcagagagaggaagccactcgtctccaaggcgaactggagaaattgagaaaagagtggaacgctcttgaaactgaatgccactcactcaagcgggaaaatgtgttgctcagtagtgagctccagcgacaggaaaaggagctgcacaactctcagaaacagtcccttgagctaaccagcgatctgtccattctgcaaatgtccaggaaagagctcgagaaccaggttgggtcactgaaggagcaacacctgcgggatagcgccgacttgaaaacccttctgtctaaggccgagaatcaggcaaaggacgtccaaaaagaatacgaaaagacccagacagtgctgagtgagttgaaacttaagttcgagatgacagaacaggaaaagcagtccattaccgacgaattaaagcagtgcaagaataatttgaagctgctgagggagaagggcaataacccgagcatcctgcaacctgtgcctgccgtgttcatagggctctttctggctttcctgttctggtgttttgggccgctgtggtag

SEQ ID NO: 29754 - DNA, 1089 bp, Artificial Sequence
  Description of Artificial Sequence: Synthetic coding sequence
atggacgagcaggatctgaatgaaccgctggccaaggtgagcttgcttaaggacgatcttcaaggtgctcagtcagagattgaggccaaacaggagattcaacacctacgcaaagaactcatagaagcacaggaattggccagaacttccaagcaaaaatgcttcgagctgcaggctctgttggaggaggaacgtaaagcctatagaaatcaggtagaagagtcaaccaaacaaatccaggtgttgcaggcacagctccagaggcttcacattgacacagagaatctcagggaagaaaaagattcggagatcacgagcactagagacgagttgctctccgcgcgagatgaaatcctcctgttgcaccaggcagcagccaaagtggcgagtgaaagagacactgatatcgcctcactccaggaagaactcaaaaaagtgcgtgcagaacttgaacgatggcgcaaggcagcttccgagtacgaaaaagagatcacctctttacagaattctttccagctgcgctgtcagcaatgcgaggaccagcagagagaagaagcaacacggcttcagggggagctcgagaaactgaggaaggagtggaacgccctggagaccgagtgtcactcactcaagcgggagaatgtgctgctctcaagcgagctccagcggcaggagaaggaactgcacaactcacagaagcagtcattagagctcacttccgatctaagcatcctgcagatgagccggaaggagttggagaaccaggttgggtccctcaaggagcagcacctacgcgatagtgctgatctgaagactctgctctcaaaggctgaaaaccaggctaaagacgtgcagaaggaatatgagaagacacagacagtgttgtctgaactgaagctcaagttcgagatgacagagcaagaaaaacagtccattacagatgaattaaagcagtgcaaaaacaatctgaagctgctgagagaaaagggaaataataagccctggccctggatgcctatgctcgccgctctggtggcggttactgccatagtgctttatgtgcccggccttgccagggctagcccctag

SEQ ID NO: 29755 - DNA, 1356 bp, Artificial Sequence
  Description of Artificial Sequence: Synthetic coding sequence
atggaagagaaggagcaagaactgcaggccaagatagaggcgcttcaagcagataatgactttaccaacgaacgactcactgctcttcaagagaaccagacacgcgctaaagagtctgattttagcgatacactcagcccttcaaaagagaaatcttcagacgacacaaccgacgcacagatggatgaacaggacctcaatgaaccgctggcaaaggtttccttgctgaaggacgacctccagggcgcccagtccgagattgaagctaagcaagagatccaacacttgcgtaaagagctgattgaggcgcaggagcttgcaagaacaagcaaacagaagtgtttcgaactccaggcactgcttgaggaagaaagaaaagcttaccggaaccaggtcgaggagtctaccaagcagatccaggttctgcaggcccagctgcagaggctgcatatcgatacagaaaatttgcgagaggagaaggactccgagatcacctccacaagagacgaactgttgtccgcccgcgacgagatcctgttattacaccaagcggccgcgaaggtggctagcgagagagatacagacatagcctctctgcaggaagagctgaaaaaagtgcgcgcggaacttgaacgttggaggaaagcagccagtgagtatgaaaaggagattaccagtctgcagaacagttttcagctccggtgccagcaatgcgaggatcaacaacgcgaagaggctactcgtttgcagggagagctcgaaaaactccggaaggagtggaatgcgcttgaaacagaatgtcattccctaaagcgagagaatgttctgctgagcagtgagttgcaaaggcaggagaaggaattacacaattcccaaaaacagtccctcgagctgacatccgacctgtcgatactccagatgtcccggaaagaactggagaaccaggtggggagtttgaaagaacagcatttgagggactcggctgatctcaagactcttttgtccaaggccgagaaccaggccaaggacgtgcagaaggagtatgagaagactcagactgtgctgtcagagctcaagctcaagttcgaaatgaccgagcaggagaaacagtctatcacagatgaactcaagcagtgtaagaataatctgaaactgctaagggagaaagggaataatccttccattctgcagcccgtcccacgaatccaccgacctatccccggcttccccgtactcgtgttcagaagcattgtggttgaacagaagccgtggccctggatgcccatgctggctgctttggtcgccgtcactgctatagttctttacgtgccaggactagcacgagcatccccttag

SEQ ID NO: 29756 - DNA, 2427 bp, Artificial Sequence
  Description of Artificial Sequence: Synthetic coding sequence
atggcggggacggtcgttctggatgatgttgagctacgtgaagctcagagggattaccttgattttctggatgacgaggaagaccagggcatttaccagtccaaggtgcgagaactcattagtgacaaccagtatcggctgatcgtcaatgtgaatgatctgcgccggaagaatgaaaagcgagccaaccggctgttgaacaatgcgtttgaggagctggtcgcttttcagcgtgccctgaaggactttgttgcctcaattgacgcaacttacgccaaacagtatgaagagttctatgtaggactggaaggaagctttgggtccaagcatgtcagccctcgcactctgacttcttgcttcctcagttgcgttgtatgtgtggagggtatcgtcactaagtgtagcctggttaggcctaaagtggtgagatcagtccactattgccctgctaccaaaaagaccattgaaaggaggtatagcgacctgaccaccctcgtagcgttcccatcatcctctgtatatcccaccaaggatgaagagaataatccactcgagactgagtatgggctttctgtttataaggatcaccagaccattactatacaggaaatgcccgagaaggctcccgcaggccagctgccacgttccgttgacgtgatcttagacgacgacttagttgacaaagcaaaaccgggtgatagggttcaggtggtgggcacataccgatgccttcctgggaaaaagggcggatacaccagtggaacatttcgcacagtgttaatcgcctgcaatgtgaaacagatgtcgaaagatgcacaaccctcgttctccgcagaggacatcgccaagatcaaaaaattttccaagactagatccaaggatatctttgatcaattggcgaagagtctagctccctcaattcacggacacgactacgtgaagaaggctattttatgtctgttactggggggagtggagcgggacctggagaatggctcccacattcgaggtgacatcaatatccttcttataggtgatccttccgtggctaaatcccagcttttgcgttatgtcctctgcacagccccccgtgccataccgaccacagggcgtgggtcatcaggtgttggactcacggctgctgtcactacggatcaagagaccggggagaggcgcctggaggctggcgctatggtgctggctgacagaggggtcgtctgcatcgacgagtttgataaaatgagtgatatggataggaccgccatccatgaagtgatggaacagggacgagtgacaatcgcgaaggcaggcatccacgcacgcctaaatgctagatgctccgtgcttgctgccgcaaacccggtttatggacgatatgatcaatacaaaactcctatggagaacatcgggctgcaagattcgctgctgtcccggtttgacctgcttttcattatgctcgatcagatggatcccgagcaggatcgggaaatctccgatcatgtgcttcgcatgcatcgctaccgggcacccggagaacaagacggggacgctatgcccttagggagtgccgtcgacattcttgcaaccgacgaccccaacttcagtcaggaagaccagcaggacactcaaatctatgaaaagcacgataatctgctacatggtaccaagaaaaaaaaggaaaaaatggtctctgcagcctttatgaaaaaatatatccacgtggctaagataataaagcccgtgttgacccaggaatcggcgacatatattgctgaagagtacagtaggctgcgttcccaggacagcatgagctcggacactgcccggacttcccccgtcacggcacgcaccttggaaactcttatcagactcgccacagcgcacgcgaaagctcggatgtccaagactgtcgaccttcaggatgccgaagaagccgtcgagttggtacagtacgcctatttcaagaaagtactcgagaaagagaagaaaagaaaaaagcggagtgaggacgaatccgagaccgaggatgaggaggagaagagtcaagaagaccaggagcagaaacgtaaaaggcgaaaaaccagacagccagatgctaaggacggggattcatacgacccttatgacttcagcgatacagaagaggaaatgccccaggtgcacactcctaaaaccgcggactctcaggagaccaaagaatcccagaaagtcgagcttagcgagtctcgcctgaaggccttcaaggttgccctgctggacgtgtttagagaagcgcatgcacagtctatcggcatgaacagactcacagagagcataaatagagactcggaggagcccttctcgtccgtcgaaatccaagctgccttgtccaaaatgcaggacgataaccaggtaatggtatctgaaggcatcatctttctaatatag

SEQ ID NO: 29757 - DNA, 351 bp, Artificial Sequence
  Description of Artificial Sequence: Synthetic coding sequence
atgctcgaggccgctcaaccccagggttcgactagtgagacaccttggaatacagcaataccgctaccctcatgctgggaccaaagtttccttaccaatataacgtttttgaaagtactgctgtggcttgtgctgctggggctgttcgtggaattagagttcgggctggcttacttcgttctttctctgttctattggatgtacgtaggcacaaggggccccgaggagaagaaagaaggcgagaagtcagcctactcagtcttcaatccagggtgcgaagctattcagggaacacttacagcagaacaactcgagcgagaactccagcttcggcctctggccggccggtag

SEQ ID NO: 29758 - DNA, 1074 bp, Artificial Sequence
  Description of Artificial Sequence: Synthetic coding sequence
atggagaataaagccatgtacctgcacactgtgagtgactgcgacaccagctctatctgcgaagactccttcgacggacgcagcttatcaaagctgaatttgtgcgaagacgtaagcaggccaagatcctcacctgacgacttaaaggccctaacccgcaatgttaaccgcttgaacgagtctttccgcgacctgcagctgagacttttgcaggcaccgctccaggctgacctcacagagcaggtctggaaggtgcaggacgcactgcaaaatcagtccgattctctgcttgcacttgcgggcgccgtgcagcgattggaaggagctctatgggggcttcaggcccaggccgtgcagactgagcaggcagtcgccctgctgcgtgacaggaccggacagcagtccgacacagcccaactggaactgtaccagttgcaggttgaaagcaattcttcccagttactgttgagaagacacgccggacttctggatgggctcgcacggcgcgtggggatcctcggcgaggaactggccgacgtgggcggtgttttaaggggtttgaatcactctctgtcatatgacgtggcgctgcatcggaccaggctgcaggatctgcgggtgctcgtgtctaatgcatcagaagatactcgtcgcttgcgtcttgcacatgtaggtatggagttacagctgaagcaggagctcgcgatgttaaacgccgttacagaggacctgcgcctcaaggactgggagcatagcatcgccctgcgcaacatctccttagctaagggacccccaggaccaaagggcgaccagggcgacgaagggaaggaaggaagacccgggatcccagggcttcctgggttaagggggctcccgggagaaaggggaactcccggtctgccagggcctaagggcgatgacggcaagctgggagcgactggccctatgggcatgcgaggatttaagggagacaggggccctaaaggcgaaaaaggcgagaagggggatcgggcaggcgatgcctctaaggacattctgctcgggccttgggacatggttctggcacagggatag

SEQ ID NO: 29759 - DNA, 1488 bp, Artificial Sequence
  Description of Artificial Sequence: Synthetic coding sequence
atggagaacaaggcaatgtacttacatacagtcagtgattgtgatacttccagcatttgcgaagatagcttcgatggcaggtccctgtctaagctgaatttgtgcgaggacgggccatgccacaagcgaagagctagcatatgctgtactcagctgggcagtctgtcagccctgaaacatgcggttctcggcctatacctcttagtctttttgattctagtaggcatatttattttagctgtcagtcgccccagaagtagtccagacgatctaaaggccctgactcgtaacgtgaatcgcctgaacgagtctttcagggatctgcaacttcggctgttgcaagccccgttacaggccgatctgacagagcaggtgtggaaagttcaggacgccctccagaaccagtccgattctctgctggcgctggccggagcagtccagcgcctggagggagctttatggggtctgcaggctcaagctgtgcagaccgagcaggcggtcgccttactccgagaccggacaggacagcagtctgacacagcacagcttgaattgtaccagctccaggtggagtccaactcctcccagttattgcttcggcggcacgcaggtctcctggatggcctggcccgacgagtcggaatactcggtgaagaacttgccgacgtgggcggggttctgcgggggttgaaccactccctctcatacgacgtggccctccacaggacccggctgcaggacctccgggttctcgtctctaatgcgagcgaggacaccaggagactgcggctagcacatgtggggatggagctgcagctgaagcaggagctggccatgttgaacgctgtcacggaggaccttcgcctgaaggattgggaacacagcatagctctccggaacatctccctggctaaaggtccccccggcccaaagggcgaccagggagatgagggcaaggagggaagacccgggattcccggtctgcctggactgcgagggctaccaggggaaaggggaacgcctggcctgccaggaccaaaaggtgatgacggaaaactgggggccacaggaccgatgggcatgagagggtttaaaggtgacagagggcctaaaggcgaaaagggggagaaaggagacagggccggtgatgctagcggcgtcgaggccccaatgatgatccggctggttaacggctcaggcccccacgagggacgggtggaagtgtaccacgatcggaggtgggggaccgtctgcgatgacggatgggacaagaaagatggagatgtggtatgtcgcatgctgggttttcggggtgtggaggaagtctatagaaccgcccgttttggacaagggaccgggcgtatttggatggacgacgtggcctgtaagggaaccgaggaaactattttcagatgcagcttctctaagtggggagtcaccaattgcggtcacgcggaggacgcgagcgtgacctgtaaccgccattag

SEQ ID NO: 29760 - DNA, 813 bp, Artificial Sequence
  Description of Artificial Sequence: Synthetic coding sequence
atggagaataaggcgatgtaccttcatacagttagtgattgcgacacttcaagtatctgtgaggatagttttgacgggagatcactctcaaaactgaatctatgcgaagacggcccgtgccataagcgtcgagcctcgatttgttgtactcagttgggtagtctctctgctctcaagcatgctgtccttgggctttaccttctggtgtttctgatactggttggtatcttcatcttggccggacccccggggcccaaaggggaccagggcgacgaggggaaagagggcaggcccggcattccaggactgcccggcctcaggggcctacctggcgagcgagggacccctggattgcctggtcctaaaggtgacgatgggaagcttggggccaccggacccatggggatgcgcggctttaagggagataggggacccaagggcgagaagggcgaaaagggcgatagggccggggacgcctcaggggtagaggctccgatgatgattagactcgtaaacggctctggccctcacgaggggcgggtggaagtgtatcatgatcggcggtggggtacagtgtgcgacgatggctgggataagaaggatggagacgtggtctgtcgaatgctggggtttcggggcgtagaagaagtctatcgtaccgccagattcggtcaaggcacaggaaggatttggatggatgacgtcgcctgtaaaggcacagaagaaactatctttaggtgcagtttctccaagtggggggttactaactgcggccatgcagaggatgccagtgtcacttgcaaccgacattag

SEQ ID NO: 29761 - DNA, 1074 bp, Artificial Sequence
  Description of Artificial Sequence: Synthetic coding sequence
atggagaacaaggccatgtacctgcacacagtcagtgactgcgacaccagctctatctgtgaagacagtttcgacgggaggtccctatctaaactcaacctgtgcgaagatgttagcaggcctcggtcctctcccgacgacttgaaggctctcacacgaaacgtcaatcgtctgaatgaatccttcagggacctgcagctgaggctcctgcaggcccctttacaggccgatctaacagagcaagtctggaaggtacaagatgcactccagaaccagtctgactcactgctcgcactggccggcgcggtccagagactcgaaggcgcgctctggggacttcaggcccaagcggtccagactgagcaagccgtagccctcctgcgggatcgaacgggccagcagtctgatacggcacagctggagttgtatcaattgcaggtcgaatccaactccagccaactcctgctccggcggcatgccggattgctcgatggtttggctcggcgggtcggcattctaggcgaagagcttgccgacgttggcggggttctgagaggcctcaatcactcattatcctatgatgtagctttgcatcgaacaagactgcaggatctgagggtgcttgtctccaatgcgtctgaagacacccgccggctgcgcctggcccatgtgggtatggagctacaactcaagcaggaacttgcgatgctgaacgccgtcactgaggacctgcggctcaaggactgggagcacagcatcgcactcaggaacatctcattggctaaaggcccccccgggcccaagggggatcaaggggatgaaggcaaagagggtaggccaggtattcccggactcccagggctcaggggactgcccggagaacgcggcaccccaggtctccctggcccaaaaggagatgatgggaagttgggcgccactggcccaatgggtatgagagggttcaagggggaccgtggaccaaaaggagaaaagggcgagaaaggcgaccgggccggcgacgcctccaaagacatcctcttgggcccatgggacatggtactcgcccagggttag

SEQ ID NO: 29762 - DNA, 1203 bp, Artificial Sequence
  Description of Artificial Sequence: Synthetic coding sequence
atggagaataaggctatgtatctgcacactgtgagtgactgcgacacttccagcatctgtgaagatagctttgacggccggtcacttagcaagcttaatctgtgtgaagacggcccttgtcacaaacgtagggcgtcaatttgctgtactcagttgggctctttaagtgcccttaagcatgccgtcctcggactgtatctattggtctttctcattctggtgggaatattcattctggcggtctcgcgcccccggagctcacccgacgaccttaaggctcttactcggaatgtcaatcgtctcaacgaaagttttagagacctgcaattacgcctgttgcaggcacctttacaggcagatctgacagagcaggtttggaaagttcaggacgccttacagaaccagagcgattctctcctcgcgcttgctggtgcagttcagcgattagaaggcgctctctggggtttacaggcacaggcagtgcagaccgagcaagccgtggcactgctcagagacagaacagggcaacagagtgatactgcccaactcgaactataccaactccaagtggagagcaactcaagccagctgctcctgcggcgacacgctggactcctcgacggtttagctaggcgcgtggggatccttggggaagagttggctgatgtcggaggagtcttacgggggctcaaccattctttgagttacgatgtggcactccaccgaacgcgccttcaggatctgcgcgtactcgtgtcaaacgcatctgaagataccagaagacttagactggcgcacgtgggaatggaattgcagttaaaacaggaactggccatgctaaatgccgttaccgaagacttaagactgaaggactgggagcactcaatcgctctcagaaatatctctttggccaaaggccccccgggccctaaaggcgaccagggcgatgaggggaaagagggccgtcccgggatacccggccttccagggctgcgaggcctccccggagagcgcgggactcctggcttaccagggcctaagggggacgatggaaagttaggggcaacgggacctatgggcatgagggggttcaagggcgatcggggcccaaaaggagagaagggtgagaagggcgatcgcgctggagacgcttcaaaggacattttgctgggaccctgggatatggtgttggcacagggctag

SEQ ID NO: 29763 - DNA, 1002 bp, Artificial Sequence
  Description of Artificial Sequence: Synthetic coding sequence
atggtccacgggaacattactccagaaaatattattctcaacaaatctggggcatggaaaattatgggctttgacttttgtgtgtcatctactaatccttctgagcaggagcctaaattcccctgcaaggaatgggatccaaatctgccttctctgtgccttcccaacccagaatatcttgcaccagagtatattctgtctgtttcctgcgaaaccgctagtgatatgtacagcctaggaacggtaatgtatgccgtcttcaacaaaggaaagcctattttcgaggtgaataaacaagatatctacaaatccttcagccgccagcttgaccaactctctcgcctgggcagcagttctctcacaaacattcccgaggaggtacgggaacacgtcaagctgctactcaacgttacaccaacagtgcggcccgacgccgatcagatgactaagattccattttttgatgacgtaggtgcagtgaccctgcagtacttcgatacactatttcagagagacaatctgcagaagagccaattcttcaaggggctgcctaaggttcttcccaagcttcctaagcgcgttatcgtgcaaagaatcctaccttgcctaacttctgagtttgtgaatcccgacatggtcccctttgttctccctaacgtgcttttgattgccgaggaatgtaccaaggaggaatacgtcaagcttattttgcctgagctcggtccagtcttcaaacaacaggagcctattcagatcctcttgatttttcttcaaaaaatggatttgcttcttactaagacaccccccgatgagattaaaaacagcgtcctaccaatggtttaccgggcactcgaagctccatctatccaaattcaagagctgtgcctaaatataattcctacattcgcaaacctcattgattatccaagcatgaaaaacgctcttataccaagaatcaaaaatgcgtgctacaaacacctacccctgaggttccaacagtag

SEQ ID NO: 29764 - DNA, 2790 bp, Artificial Sequence
  Description of Artificial Sequence: Synthetic coding sequence
atggaaagcatgctcaataagttgaaaagcaccgtgacaaaagtgactgctgacgtgaccagtgcagttatgggcaacccagttaccagagagtttgacgtcggccgacacatagccagcggaggtaatggattagcctggaagatttttaatggcacaaagaagtctaccaagcaggaagtggccgtctttgtcttcgataagaagttaatcgataaataccagaaatttgagaaggaccagatcatcgactccctgaagcggggagttcagcagttgacaaggttacgtcacccgcgtctgctgacagttcagcacccattggaggaatccagggactgtttagcgttctgcacggaaccggtgttcgcctcacttgctaatgtgctaggaaactgggagaatttaccctccccaatctcacccgatattaaagattacaaactctacgatgttgaaacaaagtatggcctgcttcaagtgtctgaggggctgtcattcctgcactcatctgtaaagatggtgcacgggaatatcacacccgagaatatcattctgaataaatccggagcgtggaaaattatgggattcgacttctgcgtctcaagcaccaacccttctgaacaggaacctaagtttccttgcaaggaatgggatcctaacctgccatcattgtgtctgccaaatcccgagtatttggcccctgaatatatcctgtctgtgtcctgcgagacagccagcgatatgtacagcctcggtaccgtgatgtatgctgtgtttaataagggaaagcccatcttcgaggtgaataaacaggatatttataaatctttcagccgtcaactcgaccagttgtcccgtttgggttcgtcctcactgactaacatacccgaggaggtgagggagcatgtgaaattactgctgaacgttacccctaccgtgcgccctgatgcagatcagatgactaaaatcccgtttttcgacgatgtgggggccgttacattacagtactttgatactctgtttcagcgtgataacctgcagaagagccagtttttcaaaggtttgccaaaggtactgccaaagcttcccaagagagtcattgtccaacggattttgccgtgtcttactagcgagtttgtgaatcctgatatggtccccttcgtgttgccgaacgtcctcctgattgctgaggagtgtaccaaagaagagtacgtgaagctcatcctgcccgagttgggaccggtatttaagcaacaggagcctattcagatcttgcttattttcctacagaagatggatctgctgctcactaagactccacctgacgagattaaaaactctgtgttacccatggtctatcgggccctggaggcgccttccatacagatccaggaactttgcctaaacatcatcccaacattcgccaacttgatagattatccttcaatgaagaacgccctgattcccagaattaagaatgcatgtcttcagacgtcgtctctcgcggttagagtgaattctctggtatgcttgggcaaaattctggagtacctggacaagtggtttgtgctggacgatatacttcctttcttgcagcagatcccttcaaaggagcctgctgtccttatggggatacttggtatttataaatgtaccttcactcataaaaagctgggcataaccaaagagcagctagcaggcaaagtgctgccgcatctcatcccactgtccatcgaaaacaacctgaatctaaatcagtttaatagcttcattagcgtgatcaaggaaatgcttaataggttggagagtgagcacaagaccaagcttgaacagctacatattatgcaggagcaacagaagtctcttgacatagggaaccagatgaacgtgtctgaagagatgaaggtcacaaacatcggcaaccagcagatagataaagtgtttaacaatattggagcggatttgctgaccgggtctgaaagcgagaacaaggaagacggcctccagaacaagcataaacgagcctctttgaccctggaggagaagcagaagctggccaaagagcaggagcaggctcagaagctgaagagccagcagcccttgaagcctcaggtgcacacgccagtggctacggttaagcaaactaaagacctcaccgataccctgatggacaacatgagctcactcacttccttgagtgtgagcacacccaaatccagcgcttcatcaaccttcaccagcgtcccaagcatggggatcggaatgatgttttccactcccaccgataacacgaagcgtaacctaaccaacgggcttaacgccaatatgggcttccagacctccggattcaacatgcccgtgaacacaaaccagaacttctatagtagccccagtactgtcggagtaacgaaaatgactctgggaactccccctaccctccccaatttcaatgcactctctgtaccccccgctggcgcaaagcagacgcagcaacgccccaccgacatgtccgccttaaacaatttgttcggacctcagaagccaaaggtcagcatgaatcaactgagtcaacagaaacctaaccagtggctcaatcagtttgttcctccccagggaagcccaactatgggatcatctgttatgggaacccagatgaatgtgatcggacagagtgcattcgggatgcagggaaaccccttttttaatcctcagaactttgcccagcctccgacaactatgactaactcctcttccgccagcaacgatctgaaggacctgtttggctag

SEQ ID NO: 29765 - DNA, 2046 bp, Artificial Sequence
  Description of Artificial Sequence: Synthetic coding sequence
atggagagcatgctgaacaagttaaaatcaaccgtgactaaagttaccgccgatgtgacatctgctgtgatgggcaaccctgttaccagagagttcgatgtcgggcgacatattgcctccggggggaacgggcttgcctggaaaatctttaatggcactaagaaatcaaccaagcaggaagtggccgtttttgtattcgacaagaagcttatagataaatatcagaagtttgagaaagatcagatcatcgattctctgaagcggggcgtgcagcaactgaccaggttacgccaccctaggttgctaacggtccagcatccactggaggagagcagagattgccttgccttctgcacagagcccgtcttcgcatcgctagcaaatgtgctgggaaattgggagaatctgccctcccccatatctccagatatcaaagactataaactgtatgacgtggaaaccaagtacgggctcctccaagtgtcggaaggcctgtcttttcttcactcttccgttaaaatggtgcatgggaacattacgcccgaaaacataatccttaataaatcaggagcctggaagatcatgggtttcgacttttgcgtgtccagtacaaatccatcggaacaggagcccaaatttccttgtaaggaatgggatccgaacttgccatccttgtgtctacctaacccagaatacctggcgccagagtatatcctctcagtttcttgtgagactgccagcgatatgtacagtttggggacagtcatgtatgcggtgttcaacaagggaaagcccatcttcgaagtcaataaacaggacatttataagtctttcagtaggcagctggatcagctgagtaggctgggttctagctccctcacaaacatacccgaagaagtgagggagcacgtgaagctgcttctgaatgtgacacctactgtcagacccgatgccgaccagatgacaaagatcccatttttcgacgacgtgggcgcagtgacacttcagtattttgatacactgttccagagggacaatttgcagaagagtcagtttttcaaaggcctaccaaaggttctccctaaattgccaaagcgcgtgatagtgcagcgcatactcccttgtctcacctccgagtttgtgaaccccgatatggtgccatttgtgctgcctaatgtgctgcttatcgcagaagagtgtactaaagaagaatacgtaaagctgatcctgccggaactcgggcccgtgtttaaacagcaagagccaattcaaattttgctcattttcctgcagaagatggacttgcttctgaccaaaacaccacccgatgagatcaaaaattccgtgctacctatggtgtaccgcgcactggaggctccttcgattcagatccaggagttgtgccttaatattatccccacctttgcaaatctgatcgattatccatctatgaagaacgcactaattcctcgtatcaaaaacgcttgcctccagacgagcagtcttgcagttcgggtcaactcgttggtgtgtttgggcaaaatcctggaatatctcgataagtggttcgtccttgacgatatcctcccttttttgcaacaaattccttccaaagaacccgcagtgctcatgggcatcctcgggatttacaaatgcactttcactcacaagaaacttgggatcacaaaagaacagctggctggcaaggtgttgccacatctcatccccctgtctatagagaacaatctgaatcttaatcagttcaattcctttatttctgtgatcaaagagatgttgaaccgtctggaatctgagcacaagacaaagttagaacaactgcatatcatgcaggaacagcagaagtctctggatattggtaaccagatgaatgtatccgaagagatgaaagtgacaaatatcggcaaccagcagattgacaaggtgtttaacaacatcggagccgacctcctcaccggcagcgagagcgaaaataaggaagacgggttgcagaataaacacaaaagagccagcctgaccttggagtag

SEQ ID NO: 29766 - DNA, 1653 bp, Artificial Sequence
  Description of Artificial Sequence: Synthetic coding sequence
atgcccacagaggagaatatcgatcgaatgtgtcaggacctccggaaccaactgtatgaaagttattacttaaacttcatttccgccatcagccggagcaaactagaggatatcgccaacgccgccctagcagcatctgctgtaacccaggtggctaaggtgttcgatcagtacttaaatttcataactcttgaagacgatatgtttgtattgtgtaatcaaaataaggagctggtgagttatcgcgccatcaatagacccgatattactgacacagaaatggagaccgtcatggacacgatagttgactcactcttttgcttttttgtgactctgggagccgtgcctattatcaggtgctctcgtggaacagccgccgaaatggtcgctgtgaaactcgataaaaaattacgggagaatcttcgtgatgcgaggaactccctctttaccggcgacactcttggggccggacagtttagcttccagcgcccactactggtcctggtcgacagaaacattgacctcgctaccccccttcaccatacatggacttaccaagcgctggtacacgatgtgctagactttcacctgaatcgggtcaatctggaagagagctctggtgtggagaactctccagcaggcgcacgccccaaacgaaagaataagaaatcttacgatctgacccccgtggacaagttctggcagaaacataaggggtccccattccccgaagtggcggagtccgtccaacaagagttggaaagctaccgggcgcaggaggatgaagtaaagcgacttaagagcattatgggactggagggggaggacgagggcgcaatttcaatgctgtcagacaataccgccaagctgacttcggccgtgtcatccttgcctgaacttctggaaaaaaagcgcctgattgaccttcacaccaacgtcgctactgcagtcctggagcacattaaggcacgcaagctcgacgtttacttcgaatacgaggaaaagatcatgtccaagacaacactggacaaatctttactggacattatttcggaccccgacgccggtacccctgaagacaaaatgagattgtttctgatctactatatctcaactcaacaggctccatctgaggctgacctggagcagtataaaaaggctcttacagatgccggctgtaacctcaaccccctgcagtacattaaacagtggaaggcatttacgaaaatggccagcgcgccagcctcttatggttctactactacaaagcccatggggctactgtccagagtgatgaataccggttcccaatttgtgatggagggcgtaaagaatctggtgttgaaacagcagaatttgcctgtcacaagaatcctagacaatctgatggaaatgaaatctaatcccgagacagacgactaccgatacttcgatcccaaaatgcttcgaggcaacgactcttcagtacccaggaataagaaccccttccaggaggctatcgtcttcgtggtgggtggaggtaattatatagagtaccaaaacctcgtggactacattaagggtaagcaggggaagcacattctctacggctgtagtgaattgttcaatgcgacgcagtttattaagcagcttagtcagcttggccagaagtag

SEQ ID NO: 29767 - DNA, 1752 bp, Artificial Sequence
  Description of Artificial Sequence: Synthetic coding sequence
atgtgtctaatactgaagaccgcccaggaaaaccaatatggtagattactgcacagcgacagagatcccattccagatgttcctgcagtctactttgtcatgccaaccgaggagaacatagatcgtatgtgccaggacctgcggaatcaattgtatgagtcatattacctgaatttcatcagcgcaatttccagatcaaagctggaggatatcgccaacgcggcccttgcagcgagcgcagttacccaggttgccaaagtatttgatcagtacctcaatttcattacactggaagacgacatgttcgtgctttgtaatcagaacaaagagctcgtgagttaccgagctatcaacagaccagacatcactgataccgagatggagacagtgatggacactatcgttgacagcctgttttgtttctttgtgacccttggggctgtgccaatcatccgttgttcacggggcaccgctgccgagatggttgctgttaagctggacaaaaagctgcgggaaaacctgcgcgatgcgcgcaacagcctgttcacgggcgacaccctgggcgctggacagttcagctttcaacggcctcttcttgtcctcgtagacaggaacatcgaccttgccacaccgctacatcatacctggacatatcaggccctcgtccatgatgtcctcgattttcatctcaatcgggtgaatctggaggagtcctcaggcgtcgagaacagcccagctggagccaggcctaaacgcaaaaataagaagtcctatgatttgacccccgtggacaagttttggcagaaacacaaagggtccccattccccgaagtagcagaaagcgttcaacaggaactggaatcctacagggcccaggaagatgaagtgaagcggctgaaaagcatcatgggtttagaaggcgaagatgagggtgcaattagtatgctctccgataatacggctaagctcacgagtgccgtgagtagcttacctgaactccttgaaaagaaacggctgatcgatctccacactaacgtggctacagccgtgctggagcatatcaaagcaagaaaactcgacgtctattttgaatacgaggaaaagattatgtctaaaaccactctggacaaaagcctgctggacattatctccgatcctgatgcgggaaccccagaggacaagatgaggctcttcctgatttactatatctccactcaacaagctccttctgaggcagatcttgaacagtacaaaaaagccctgaccgatgcaggttgcaacctcaatcccctgcagtatattaaacaatggaaggcctttacaaaaatggcaagcgcacccgcatcttatggcagtacaacaactaagccaatgggcttactgagcagggtaatgaacactggatcccagttcgtgatggagggggtgaaaaacctagtcttaaagcaacagaatttaccagtaacccgcatcctcgacaacctgatggagatgaagtctaatccagagactgacgattataggtattttgacccgaaaatgctccgcggcaacgacagcagcgtaccaaggaacaagaaccctttccaggaagccatcgtgtttgtcgtcggagggggcaactacatagagtaccaaaatttagtggattatattaaaggtaaacaggggaagcacatattatatgggtgctctgagttgtttaatgccactcagttcatcaagcagctcagccaactggggcagaagtag

SEQ ID NO: 29768 - DNA, 1929 bp, Artificial Sequence
  Description of Artificial Sequence: Synthetic coding sequence
atggcagcggcagccgcagcaaccgctgctgccgcagcctctattcgtgagcggcaaacagtggctctgaagcgaatgctgaacttcaacgtaccacacatcaagaactcgaccggagaacccgtctggaaggttttgatctacgatcggtttgggcaagacatcattagtcccctgctgtccgtcaaggagctcagagacatgggcattacgctgcacttgctgctgcactccgacagggacccaataccagacgttcccgctgtttacttcgttatgcccactgaggagaacattgatcggatgtgccaggacctccgaaaccagctgtatgagagttactacctaaatttcatcagcgctattagtagaagtaagctggaggacatcgctaatgcagccttggccgcaagcgctgttacccaggtggccaaagtctttgatcagtacctgaacttcatcactttggaagacgacatgtttgtgttgtgtaatcagaacaaggagctcgtgtcgtaccgcgcaattaataggcctgacataacagacactgagatggagacagtgatggacactatagtggatagtctattttgttttttcgtgacactgggcgcagttcccattatacgctgttccagaggaactgctgccgagatggtagcagtgaagttagacaagaagctgagagagaatctccgcgacgccaggaacagcctctttactggagacacactcggcgcgggacagttctcattccaaaggccccttttggtgctggtcgaccgaaatatcgacctggctacccccctacaccatacctggacttatcaagccctagtgcacgacgtactagactttcacctgaatcgtgtcaatttagaggaatcctccggtgttgagaattctcctgctggcgctcgaccaaaaagaaaaaataagaaatcatatgacctgaccccagtggataagttctggcaaaaacacaaaggctccccttttccggaggtggccgagagtgtgcagcaggaactagagagctacagggcgcaggaagacgaggtgaaaaggctgaaaagcattatgggactggagggtgaggacgagggcgcaatttcaatgctatctgataataccgctaaacttacttccgccgttagctcgctgcccgagttgctggagaaaaagcgcttaattgatttgcacaccaatgtggcaaccgctgtcctggagcacataaaggcccgcaaactggatgtgtatttcgagtatgaggaaaagatcatgagtaaaacaaccctggataagtcccttctggacatcatctcagaccctgacgctggcaccccggaggacaaaatgcgactcttcctgatctattatatctccacccagcaggcaccaagtgaagccgaccttgaacaatacaaaaaagccctgacagacgcaggttgcaacctgaatccactccagtatatcaaacagtggaaggcgtttacaaaaatggcaagtgcacccgcctcatatggctcaaccactactaaacccatgggcctcctgtctcgcgtgatgaacactggtagccaatttgtgatggagggcgtgaagaacctggttctaaaacagcagaacctgcctgtcacacgcattttggataacctgatggagatgaaatcaaatcccgagacggacgactaccgttactttgaccccaagatgctgaggggcaacgacagcagcgtgccccgcaacaagaatccctttcaggaagctatcgtatttgtggtgggaggagggaattacatagaataccagaatctagtcgattacatcaagggcaaacagggtaaacacatcctgtacggatgcagcgagctgtttaacgcgacccagtttatcaaacagctatcccagctgggccaaaagtag

SEQ ID NO: 29769 - DNA, 1374 bp, Artificial Sequence
  Description of Artificial Sequence: Synthetic coding sequence
atggagacagttatggacacaattgtggatagcctcttttgcttctttgtcacgctgggcgctgtgccaatcatccgttgttccagagggacggcagccgaaatggtcgccgtaaagttggataagaagctgcgagaaaacctgcgcgacgcccggaactcgctgtttaccggcgacaccttgggcgctggccaattctccttccaaaggcccctcctcgttcttgtggatcggaatattgacctagctacccctctacaccatacatggacgtaccaggcactcgtgcatgacgtgttagattttcatcttaacagagtgaatctggaggagagctcaggcgttgagaacagcccagccggcgcaaggcccaaaagaaagaacaaaaaaagttatgacctaaccccagtcgacaaattctggcagaagcacaaaggaagcccgttcccggaggtagccgagagtgttcagcaggagctggagagttatcgtgcacaggaggatgaggtgaagaggcttaagtctattatgggattggaaggtgaggatgagggcgcgatctccatgctatctgacaacaccgccaaactaacttcagctgtttcctctctcccggagttgctcgaaaagaagcgcctgatagacctccataccaatgtcgccaccgccgtgttagaacatattaaagctagaaaactggacgtttatttcgaatatgaggaaaagatcatgtccaaaacgacactggataaaagtttacttgacataatatcagacccggacgccggcacccccgaggataagatgcgcttgtttttaatctactacatcagtacccagcaagctcccagcgaggctgatttggaacaatacaagaaggcccttacagacgctggctgtaatctgaatccgctgcaatacattaaacaatggaaggcatttaccaaaatggcctcagctcccgcttcctacggatctacgaccactaaacccatgggtcttctcagccgcgttatgaacactggctcacagttcgtgatggaaggggtgaagaacttggtgttgaaacagcaaaatttaccagtgacccgtattttggacaatctgatggaaatgaaatccaaccccgaaacagacgactaccgttacttcgaccctaagatgctgagggggaacgatagctcagtgccacggaataagaacccgttccaagaagcaattgtgtttgtggtcggcgggggtaattatatagagtatcagaatctagttgattatatcaaaggcaagcaagggaaacacatcctgtacggttgctcagaactatttaatgccacacagttcatcaaacagctctcccagctgggacaaaagtag

SEQ ID NO: 29770 - DNA, 1728 bp, Artificial Sequence
  Description of Artificial Sequence: Synthetic coding sequence
atgggaattaccttacatttgctactccattctgaccgagacccaattccagacgtaccagccgtgtatttcgttatgccaaccgaggagaacattgatcgaatgtgtcaagatctgcgaaaccagctgtatgagtcatactacttaaattttatttctgctatcagccgaagcaaattggaagatatcgcaaatgcagcactcgctgcttccgcggtaacacaagtcgccaaagttttcgaccagtatcttaatttcataaccttggaggatgatatgtttgtgctatgtaatcaaaataaagaactagtctcgtatcgcgcaattaacagaccagatattactgacacagagatggagacggttatggacacgattgtggattcgctgttttgtttttttgtgaccctgggtgcagtccctattatacggtgcagcaggggcaccgcagcagagatggtggccgtcaagcttgataaaaaactgcgggagaacttacgagatgcccgaaactcactcttcactggcgatacactcggagccgggcaattttcttttcagcggccactgctcgtgctggtagacagaaacatcgacctggcaacccccttacaccatacttggacctaccaggcactggtccatgatgtgctcgattttcacctgaatagggttaacctggaagaatcctcaggtgtcgagaattctcccgctggagcccgtcctaagagaaagaataaaaaaagttatgacctgactcctgtggataagttttggcagaaacacaagggctccccattccctgaggtggccgaaagcgtgcagcaagaactagagtcttaccgagcacaggaggacgaagtgaagcgacttaagtcgataatgggcctggaaggcgaggatgagggcgccatctctatgctctcagataataccgctaaactgaccagtgcggtaagttctctgcctgagcttttggaaaaaaagaggctgatcgacctccatacgaatgtcgccaccgccgtcttggaacacatcaaggcccggaagctggacgtgtactttgaatacgaggagaagatcatgagcaaaacaacccttgataaatcactcttagacataatttcagatcccgatgccgggacgcccgaagataagatgaggctgttcctgatctactacatttctacgcagcaggcgccgtctgaggcagacctggaacaatataaaaaggcacttaccgacgccggatgcaaccttaacccactccaatatataaagcagtggaaagctttcaccaaaatggcaagtgcccctgcatcctacgggagcacgactacaaaacctatgggacttctctcccgtgttatgaataccggctcccagtttgtcatggagggggtgaaaaatctggtcctcaaacaacagaatcttccggtgacacgcattcttgataaccttatggagatgaagtctaacccggaaaccgatgattatcggtatttcgatcccaaaatgctgaggggtaatgactcctctgtccctcgcaataaaaacccttttcaggaagcaatagtgtttgtcgtcggaggtggcaactacatcgagtaccaaaacctagtggactacattaagggtaaacaggggaagcacattctatatggctgttcagaactttttaacgccacacagttcatcaagcagctcagccagctcggtcagaagtag

SEQ ID NO: 29771 - DNA, 540 bp, Artificial Sequence
  Description of Artificial Sequence: Synthetic coding sequence
atgctcagtcttgacttcctagatgacgttcggcgtatgaataaacggcagttatactatcaggtgttgaacttcggcatgattgtgagcagcgcactcatgatctggaaggggctgatggttatcaccgggtccgagtccccaatcgtggtcgtactctctggaagtatggaaccggcattccaccgtggggacctgctgttcctgaccaaccgggtggaggatcccatccgggtcggggaaatcgtcgtttttaggatcgagggccgcgagatcccaatcgtgcaccgggtgctcaagatacatgagaaacagaacggccacatcaagtttctcacgaaaggggataacaacgccgttgacgatagaggtctgtacaagcagggtcaacattggctggagaaaaaagatgtggtgggcagagccagaggatttgtgccatacattggcatcgtgacgatacttatgaacgattatcctaaattcaaatacgcagtgctgtttttgcttggtctttttgtcctggttcacagggagtag

SEQ ID NO: 29772 - DNA, 462 bp, Artificial Sequence
  Description of Artificial Sequence: Synthetic coding sequence
atgatcgtttcttccgccctcatgatttggaaaggcctcatggtgataaccggcagcgagagccccatagtcgtagtgttatcagggtcaatggagcccgcctttcatagaggtgacctgctgttcctcacaaaccgcgtggaggacccgattcgcgtgggggagatcgttgtcttccggattgagggacgagaaattcctatcgtccatcgagttttgaaaatacacgaaaagcagaacggccacattaaattccttactaaaggtgacaataacgccgtggatgatagaggattgtacaaacagggacagcattggctggagaaaaaggatgtggtgggtagagctcgtggctttgttccgtacataggcattgttaccattttgatgaatgattatcccaagttcaagtacgccgttctgttcctgctgggcctgtttgtgctcgtgcaccgcgagtag

SEQ ID NO: 29773 - DNA, 579 bp, Artificial Sequence
  Description of Artificial Sequence: Synthetic coding sequence
atggtccgtgcgggggccgttggcgcgcacttgcccgccagcggactggacatctttggggatctgaagaaaatgaataagcggcagctgtattatcaggtgctcaatttcgcgatgatcgttagttcagctctcatgatctggaaaggccttattgtcttgaccggctccgagtctcccatcgtagtcgtcctttccggctcaatggagcctgcgtttcaccggggtgatctcctgtttcttacaaacttcagagaagacccgattagagccggagaaatcgtagtgttcaaggtggaaggtagggatatcccaatagtgcatagagtcattaaggtgcatgagaaggacaacggagatatcaaatttctcaccaaaggggataacaatgaggtcgatgatcgcggactctacaaggaaggtcagaattggttggagaagaaagacgtggtcggacgggcccggggctttctgccctatgttgggatggttaccatcatcatgaacgactaccctaagttcaagtatgccttactggccgtcatgggcgcctacgtcctactgaaaagagaaagctag

SEQ ID NO: 29774 - DNA, 471 bp, Artificial Sequence
  Description of Artificial Sequence: Synthetic coding sequence
atggtgagggcgggcgcagtgggcgctcatctgcctgccagcggcctggacatatttggtgacctaaaaaagatgaacaagcggcagctgtactaccaggtgttgaacttcgccatgattgtttcatccgcccttatgatctggaaggggctgattgttttgacaggaagcgagagcccgatagtcgttgttctgtctggatccatggagcccgccttccatagaggagacttgctgttcctaacgaactttcgggaagaccccattagagcaggtgagatcgtggttttcaaagtagagggccgcgatatcccaatcgtgcacagggtgattaaggttcatgagaaggacaacggcgacattaaatttctgaccaaaggtgataataatgaagtggatgacaggggcctctataaagagggtcagaattggctggaaaagaaagacgtcgtcggtagagctcgggggtag

SEQ ID NO: 29775 - DNA, 579 bp, Artificial Sequence
  Description of Artificial Sequence: Synthetic coding sequence
atggtgcgcgcaggtgctgtcggggctcacttaccagcgtcaggcctagacatattcggggatttgaagaagatgaacaaaaggcagctctactatcaagtgctgaatttcgctatgatcgtgagcagcgcactgatgatatggaaaggattaatagtcttaactggatcagagagccccattgtggtcgtcctttctgggagcatggagcccgccttccaccgtggggacctcctgtttttaacgaattttcgcgaagaccctatccgagcaggagagatcgtggttttcaaggtcgaaggccgggatataccaatcgtgcacagagtgatcaaggtgcatgagaaggacaacggcgatattaaattcctaaccaagggcgacaataacgaggtcgacgaccgaggcttgtataaagagggccagaattggcttgagaagaaagatgtcgttggcagagctcgcggatttttaccctacgtcggcatggtgacaatcatcatgaatgactatcctaagtttaagtacgctttgcttgcagtgatgggcgcctatgtgttattgaaacgcgagagctag

SEQ ID NO: 29776 - DNA, 2091 bp, Artificial Sequence
  Description of Artificial Sequence: Synthetic coding sequence
atggaagccagcgtcattctgcccatcctcaaaaaaaaactcgctttcctgtcaggcgggaaggatcgcaggagcggtctgatactgaccatccctctttgtctcgaacagactaacatggatgaactttccgttactctcgactatctcttgtctatcccctccgagaaatgcaaggctcgcggctttactgttattgtcgatggaagaaaaagccaatggaacgtagtcaagactgtagtcgtaatgctgcagaatgtagtgccagcagaggtgagcctggtgtgcgtcgtgaagcccgatgaattctgggacaaaaaagtcacgcatttttgcttctggaaagagaaggaccgactcggatttgaagtgatccttgtctcagctaacaaactcactcgatatatagaaccttgccagcttacagaagatttcggtgggtctctgacctatgatcacatggattggttgaacaaacgcctggttttcgagaaattcaccaaagagagtaccagcctgctggacgagctggccttgatcaacaacggcagcgacaagggcaaccagcaggaaaaggagcggtctgtggatctgaactttctcccatccgttgacccagagaccgttttgcagacaggacacgagctgctcagtgagctgcagcagaggcgattcaacggcagtgatgggggtgtgtcctggtcccccatggacgacgaactcctggcccagccacaggtgatgaagctgctggactccctgcgagagcaatacacaagataccaagaggtttgccggcaacgaagcaagaggacacagctcgaggagatccaacagaaggtaatgcaagtggttaactggttggaaggcccaggctccgaacagctcagagcccagtggggaatcggagacagcatcagggcatcgcaggcactccagcaaaagcatgaggagatcgaatcccagcattcagaatggtttgccgtgtacgttgagttaaaccagcagattgcggcattgctgaacgccggagatgaagaggatctggtagagctgaagagtctccaacagcagttgtctgatgtgtgctatagacaggctagccagctggagtttagacagaacttgttgcaggcagccctcgaattccatggagtggctcaggatctgtcccagcagttagacggactattaggaatgttgtgtgtggatgttgcccctgcagacggagcctcgattcagcagaccttgaaacttcttgaggagaagctcaagagcgttgatgtgggactccagggtctccgtgaaaaaggccagggattactggaccagatttccaaccaggcctcctgggcgtatggcaaggatgtgaccattgagaataaggagaacgtagaccacatccagggagtgatggaagatatgcagttgcgaaaacagcggtgcgaggacatggtagatgtgagacgtctgaagatgctccagatggtgcagctttttaagtgcgaagaggatgccgcacaggcagtggagtggctgtctgaattgctggatgctctcctgaaaactcatatacggttgggcgatgacgcacaggaaaccaaagttttgctggaaaaacaccgaaaattcgtcgatgtcgcacagagcacatacgactatggccgacagctgctgcaggcgacagtggtcctttgtcagtccctacgttgtacaagcaggagcagcggggacactctgccacggctcaaccgagtgtggaagcagttcacaatcgctagcgaagagcgagtacatagactcgagatggctattgccttccacagcaacgccgagaagatccttcaagactgtcctgaggaaccagaggccattaacgatgaagagcagttcgatgaaattgaggccgttggcaagtccctcctggacaggctgactgtgccagtggtataccccgatggtactgaacagtacttcggatctccttctgacatggccagcaccgctgagaacatcagagacaggatgaagctggtcaacctgaaacgccaacagttgcggcatcctgagatggtcaccacagagtcatag

SEQ ID NO: 29777 - DNA, 432 bp, Artificial Sequence
  Description of Artificial Sequence: Synthetic coding sequence
atggaggcaagcgtgattctgcctattctgaagaagaagttggcttttctttccggtgggaaagaccgaagaagcggactcatcttaacgatccccctctgtctagagcagacgaacatggacgagctgtccgtcaccctggactatttactgagcatacctagtgaaaagtgcaaggcccgcgggtttacagttatcgtcgacggaagaaaatctcagtggaacgtagtcaagactgtcgtggtcatgcttcaaaatgtggttcctgccgaagtgtccctggtctgcgtggtgaaacccgatgaattttgggataagaaagtcactcatttttgtttctggaaggagaaggatagactgggctttgaagttatactcgtttcagctaataagctaactaggtacatcgagccgtgtcaactgacagaatag

SEQ ID NO: 29778 - DNA, 441 bp, Artificial Sequence
  Description of Artificial Sequence: Synthetic coding sequence
atggaggcaagcgtgatactcccaattctcaagaaaaagctagccttcctgtccggcggcaaggacaggcgctctggccttattctgaccatacctctttgtttggagcagactaacatggacgaactgagcgtgactctcgattatttgctgtccatcccaagtgagaaatgcaaggcgaggggattcacagtgatcgtggatgggaggaagtcacaatggaacgtggttaaaaccgtggttgtcatgcttcaaaatgtcgtcccggccgaagtctctttggtgtgcgtcgtaaaaccagatgagttctgggacaagaaggtgacccacttctgtttttggaaggagaaggatagattgggattcgaggtgattctggtatctgctaacaagcttacaaggtacatcgagccgtgtcagctgaccgaggattttggctag

SEQ ID NO: 29779 - DNA, 2160 bp, Artificial Sequence
  Description of Artificial Sequence: Synthetic coding sequence
atggttcaaaagtatcagtcacctgtgcgagtctataaatatccgtttgaactgatcatggctgcatacgagcggaggttcccaacctgccccctaatacccatgtttgttggctctgatacagttaacgaattcaagagcgaagatggcgccatccatgtgattgaaaggcgctgcaagctggacgtggatgcccctagacttctcaagaagatcgcaggtgtcgactatgtgtacttcgtccaaaagaactcattgaacagccgtgaaagaaccctccacatcgaggcctacaacgagactttcagtaaccgagtgattatcaacgagcactgctgttatacagtgcaccccgagaatgaggactggacttgctttgaacagagcgcctctcttgacattaagtccttcttcggctttgagagcaccgtggagaaaatcgccatgaaacagtacaccagcaatatcaagaagggtaaggaaattattgagtactatctgagacagctcgaagaagaaggcattacatttgtgcctagatggtcacctccctccattacaactagctcagagacctcttcatcctcatcgaaaaagcaggccgcctctatggccgtcgtgatccccgaagcagctctcaaggagggacttagtggggatgctttgtctagtccttcagcccccgagccagtggtgggtacccccgacgacaagttggacgctgattatataaagcggtacttgggggacctcactcccctgcaagaatcctgtctcatccgcctccgtcagtggttgcaggaaacacataaaggtaagatccctaaagatgagcacattcttagatttctgcgcgccagggatttcaacatcgacaaagcaagggagattatgtgccagtccctcacatggcgcaaacagcaccaggtagactacatactggagacctggaccccgccccaggtgcttcaggactactacgcaggaggatggcatcaccatgacaaggacggccgccccctttacgtcctgcggttgggccagatggacacgaagggtcttgttagggctctcggagaggaggcccttctacggtacgtgctttcgatcaatgaagaaggattgaggaggtgtgaggagaacacaaaagtatttggacgccccatctcgagctggacttgcttagtggatcttgaaggtctcaatatgaggcacctctggaggcccggcgtaaaagcccttttgcgtattatcgaggtggtcgaggccaactacccagagactctagggcggctcctcattcttcgcgcccctcgggtgtttccagtgctatggaccctggtttccccttttatcgacgataacacccgacggaagttcctgatatatgcagggaacgactatcagggaccaggcgggctattagactacattgataaggagatcatcccagactttctgtcaggcgagtgtatgtgtgaagtacctgagggggggttggtgcctaagtcactgtataggactgccgaggaattggagaatgaagatttaaaactttggacagaaactatctatcaatctgcttctgttttcaaaggggcccctcacgagatactgatccagattgtggacgctagcagcgtcattacatgggattttgacgtgtgcaaaggggatatcgttttcaatatttaccacagcaagcgctctcctcagcctcctaaaaaggatagcttgggtgctcactctatcacatcacctggcggtaacaatgtgcagctcatcgataaggtgtggcagctgggacgcgactattccatggtggaaagccctctcatatgcaaggagggggaatcagttcaggggagtcatgtgacacgctggcctggattctatatcctccaatggaagtttcattcaatgccggcttgtgccgcctcctcattaccaagggtcgatgacgtgctcgctagcctgcaggtttcttctcacaagtgcaaggtcatgtactatacggaggtgatcggatctgaagactttcggggatctatgacctctctcgagagttctcattccgggtttagccaattgtctgctgccacgacttcttcctcacaaagccatagcagttctatgatttcaaggtggcgcttctgctag

SEQ ID NO: 29780 - DNA, 2148 bp, Artificial Sequence
  Description of Artificial Sequence: Synthetic coding sequence
atggtccagaagtaccagagccccgtgcgggtgtataaatatcccttcgaactgataatggcagcctacgaaagacggttccccacctgcccgctcatccctatgtttgtggggagcgacacggtaaatgaatttaagtctgaggatggcgccatacatgtgatcgaacggcggtgcaaactcgacgtggacgcccccagacttctgaagaaaatagctggagtcgactatgtatattttgtgcagaagaatagtctgaacagccgggaacgcaccctgcatatcgaagcttacaacgagactttctcgaatcgtgtcataattaacgaacactgctgctatactgtgcaccccgaaaatgaagactggacctgcttcgagcagagcgctagcttggatatcaaatctttcttcgggttcgaatctactgtagaaaagattgccatgaaacagtatacatccaacatcaaaaaagggaaggagattatcgagtattatctcagacagctggaagaggaagggatcactttcgtgccgcgttggtccccaccatctatcaccacttctagcgagacatcttcatcatctagtaaaaaacaggctgcctcaatggcagtcgtcattccagaagctgccttgaaagaagggctcagtggagatgctctgtccagcccatcagctcctgaacccgttgtgggaacccctgatgacaagctggacgccgactatattaagcggtacctgggagatctcacccccctgcaggagagctgcctgatcaggctccggcagtggctgcaggagacgcataaggggaaaatccccaaagacgagcatatcctgcgtttcttgcgagccagagatttcaacatagacaaggcccgagagattatgtgccagtcactgacgtggcgtaagcaacaccaagttgactatatcctggagacctggactcccccccaggtcctacaggactactacgctggggggtggcatcaccatgataaggacggcaggcctctgtacgtgctgcggctcggccagatggatacgaagggcctggtccgagcattaggagaggaggctctgctgaggtacgtgctgagtatcaatgaagagggacttagaagatgcgaggaaaacactaaggtttttgggaggcctattagtagctggacctgtctcgttgacctcgaagggcttaacatgaggcacctgtggcgtcccggagtgaaggctcttcttcggatcatagaggtggtcgaggctaattaccccgaaacgttgggtcgactgctgattctgcgcgccccccgcgttttccccgtgctgtggacactagtctcacccttcatagacgacaatactcgtcgaaaatttctcatttacgctgggaatgattaccagggcccaggggggctcttggattatattgacaaggagatcattccggattttcttagcggggagtgtatgtgtgaagtgcccgagggtgggctggtacccaagtcactgtatagaactgccgaggagttagagaatgaggacctgaagttgtggactgagaccatctaccagagcgccagtgtatttaaaggggcaccgcacgaaatactgattcagatagttgacgcctcttccgtgatcacatgggactttgatgtgtgcaagggggatattgtcttcaacatttatcatagcaaacgttctccccagcctcctaaaaaggattcactcggcgcgcatagcattacttcacccggggggaacaacgtccagcttattgataaagtgtggcagctgggccgagactactccatggtggagtctcccctcatctgcaaggagggtgagagtgttcaggggtcccacgtcactcgatggcctggcttctatattctgcaatggaagttccatagcatgcccgcctgcgccgcatcatctctgcctcgggtggatgacgtgctagccagtctacaagtctctagccataagtgcaaagtcatgtactacaccgaggtgataggaagcgaggacttccggggttcaatgacttctctggaaagtagtcactccggcttctcccaactctccgctgccacgacctcttccagtcagtctcacagttcatctatgatcagtagatag

SEQ ID NO: 29781 - DNA, 2148 bp, Artificial Sequence
  Description of Artificial Sequence: Synthetic coding sequence
atggtccagaaataccagagccctgtcagagtgtacaaatatcccttcgagctgatcatggcggcctacgaaaggagattccccacttgtcccctgatccccatgttcgttggctccgatacagtgaacgagtttaaatcggaggatggcgccatccacgttattgagcgacgctgtaaattagatgtggacgcccccagactgcttaagaagatcgccggggtggattacgtctatttcgtgcaaaaaaatagcctgaacagtagggagagaacactccatattgaggcatataatgagacgttttctaatcgagtgatcatcaacgagcattgctgctataccgttcaccccgagaatgaggactggacctgttttgaacagtctgcatcgttggacataaagtctttcttcggcttcgagagcacagtggagaaaattgcgatgaaacagtacacgagtaacatcaaaaagggcaaggagattattgaatattatctgaggcagcttgaggaggaaggcatcactttcgtaccaaggtggtctcctccaagtatcaccacgtcctcggaaacctcatccagtagctctaagaaacaggcagctagcatggctgtggtgatccccgaggctgccctcaaggaagggctgtccggtgatgcgctgtcatcccctagtgcaccagagcccgtagtagggacccccgatgataagttggacgctgactatatcaagcgctacctcggagacctcacccctttgcaagagagctgcctgatccggttgcggcagtggctccaggagacacataaggggaaaattcccaaagacgagcacattcttcgattcctaagggcaagagactttaacatcgataaggcgcgagaaatcatgtgtcagtcgctgacatggcgcaagcagcaccaggtagactatattcttgagacttggacccctccacaagtcttgcaagactactacgccgggggctggcatcaccatgacaaggatggacggcctctctatgtgcttagactggggcagatggacacgaaaggattggtgagggctcttggagaagaggccttgctgagatacgtcctctccattaatgaggagggactgcggcgatgcgaagaaaatacaaaggtgttcggacgccctatcagtagctggacctgcttggtagatctcgaggggctgaacatgaggcacctttggcgtcccggcgtgaaagctcttttgcgcatcatcgaagtcgttgaagccaactatcctgaaaccctggggagactgttgatacttcgggctcccagagtttttccggtcctgtggactcttgtgtcacccttcattgacgataatactagacgaaaatttttaatctacgccgggaatgactaccaggggcctggcgggcttctagactacatcgacaaggagattatccctgatttcctcagcggagaatgcatgtgcgaagtgccagagggaggtctggtcccgaagagcctctacaggactgccgaagaattagagaacgaagatcttaagctatggacagaaacaatctaccagtccgcctcagtgtttaagggggcgcctcatgaaatcctcattcagatcgtggatgcctcctcagtcattacttgggacttcgatgtgtgcaaaggcgacattgtgtttaacatctaccattccaaacgatccccccagcccccaaagaaagactcgctaggagcacactctattacctcacccgggggaaataacgtgcagcttatcgataaggtgtggcaacttggacgagactactcaatggtcgaatctcccctaatctgcaaagagggcgaatctgtccagggatcccatgttacacgatggcccggtttttatatcttgcaatggaagttccactctatgcccgcctgcgccgcctctagtcttcctcgggtagacgatgtgctcgccagcctacaggtgtccagccacaagtgcaaagtcatgtattataccgaagttattggatccgaagacttccggggttctatgacatccctggagagctctcactccggattttcccagctgtccgccgccacaacctcttcttcccagtcccactcttcatccatgatatctagatag

SEQ ID NO: 29782 - DNA, 2046 bp, Artificial Sequence
  Description of Artificial Sequence: Synthetic coding sequence
atgttcgtggggtcggacaccgttaatgaattcaagtccgaggacggagcaatacatgtgatcgagcggcgatgtaagctcgatgtggacgccccaagacttctgaagaaaatcgcgggtgttgactatgtgtactttgtacagaaaaacagtctgaacagcagggagaggacacttcacatagaggcctataatgaaaccttcagtaatcgggtgatcatcaacgagcactgttgttacaccgtgcatccggagaatgaagattggacatgcttcgaacagtccgcgtccctggacatcaagagtttcttcggatttgagtcgacagtagagaagattgccatgaagcagtacaccagtaatataaaaaaaggtaaggaaatcatcgaatactacctccgccaactagaagaagagggaattacttttgttcctaggtggtccccaccttcgatcactacttcgagtgagacctccagttcttcctccaagaaacaggccgcaagcatggctgtggtcatacctgaagcagccctcaaagagggcttgtcaggggacgcgctgtcatccccctcagccccagagcccgtggtgggtacacccgacgacaagctggacgccgactacatcaagcgctacttaggcgatctgacgcccctccaggagagctgcctaatcagacttcgacaatggctgcaggagacccataaggggaagattcctaaggacgaacacatccttcgttttttaagggccagagattttaatattgacaaagcacgtgagatcatgtgccagtcactgacatggcggaagcagcaccaggttgattacatcctcgagacctggacaccacctcaggtgctgcaggattactatgcaggcggatggcatcaccatgacaaggatggacgccctctgtatgtcctgaggttgggccagatggatacaaaagggttggtgagggccctcggggaagaggccctgttgagatatgtgctgtccatcaacgaagaagggcttcggcgctgtgaggagaacacgaaggtgttcggacggccgatttcctcatggacatgcctggtcgacctggagggtctcaacatgcgccatttatggagaccaggggttaaagccctgcttcgcataatcgaagtggttgaggcaaactaccctgagactttagggagactgctgatcctacgcgcgccacgtgttttccccgttctttggacgctggttagcccgtttattgacgacaatacgcgaagaaagttcctgatctacgccgggaacgattatcagggcccagggggactcctggactatatagataaggaaattattcctgattttttgtccggcgagtgtatgtgcgaagttcctgaagggggcctggtgcccaaaagcctgtaccggaccgcggaagagctggagaacgaagacctgaagctctggacagagacgatttaccagtccgctagtgtttttaagggcgccccacatgagatacttatccaaatcgtggatgcgagctccgtgatcacttgggatttcgacgtctgtaagggggatattgtcttcaacatataccattccaagaggtctcctcagccacccaaaaaagacagtctcggcgctcatagtattaccagcccgggggggaacaacgtgcagctcatagataaggtttggcagctcggccgagattactctatggttgagagccctctcatctgtaaggaaggggaaagtgtgcaagggtcccacgtgactcgctggcctggcttttatattttacagtggaagttccattcgatgccggcttgtgccgcttcgagccttcctcgcgtggacgacgtgctggcatccctgcaggtctctagccataaatgcaaggtgatgtactacactgaagtgatcggttctgaggacttccgcggcagcatgacttctctagaaagctcacacagcggcttcagccagctcagcgctgccacaacaagctccagtcagagccatagcagttcaatgatttcgagatag

SEQ ID NO: 29783 - DNA, 2148 bp, Artificial Sequence
  Description of Artificial Sequence: Synthetic coding sequence
atggtgcaaaagtatcaatctccagttcgagtatataagtatcctttcgaactcattatggccgcctacgagcggcgcttccctacgtgtcctctcatcccaatgtttgtcgggagcgacaccgtcaatgaattcaagagtgaagacggtgcaatccatgttatcgagcgtagatgcaaacttgacgtcgacgcgccaaggctcttaaagaaaatcgcgggcgttgactacgtctactttgtacaaaaaaatagcttaaattcaagggagcggacactccatattgaggcttacaacgagacgttctctaacagggtcattattaatgagcattgctgttatacggtccacccagagaatgaagattggacctgctttgaacagtcagcttctcttgacatcaaaagcttcttcggatttgaatctacggtggaaaaaattgccatgaaacagtatacaagcaatattaagaagggcaaagaaattatcgaatattatctacgtcaactggaggaggagggtatcacctttgtgccaagatggtcaccgccttcaattaccacttcgtccgagacatcttctagtagttccaaaaaacaggctgcttctatggccgtcgtgatacccgaggccgccctgaaggaaggtttaagcggcgatgccctcagttccccgagtgcaccagagcctgtggttgggactccagacgacaagctggacgccgattatatcaagcggtacttaggggatctgacccccctacaggaaagctgcctgatcagactgcggcaatggctacaggagacccacaagggaaagattcccaaggacgaacacatactacgtttcttgagagcgcgggattttaatatcgacaaggctcgcgaaatcatgtgtcagagtctgacatggcggaaacaacaccaggtcgactatatcctggaaacatggacacctccacaggtgctgcaagattattatgccgggggatggcatcatcacgataaggatgggagacccttgtacgtgctcaggctgggacaaatggatactaaaggtctggtgagggcattgggagaggaggccctgctgcgatacgtgttgtcaattaacgaagaaggactacggcggtgcgaggaaaacaccaaggtcttcggccgacccattagctcttggacgtgtctggtagatttggaggggctaaatatgagacacctctggcgccctggcgtcaaagccttgctcagaatcatcgaggtggtggaggcgaactatccagagactttgggcaggctgttgatactcagagcgcctcgtgtcttcccggtattatggacactcgtgtcccccttcatcgacgacaatactcgcaggaagtttttgatatacgccggcaatgactatcaggggcctgggggtctgctggactacatcgataaagaaatcattcctgattttctgagcggagagtgtatgtgcgaagtccctgaaggcggcctagtgcctaaaagcctctacagaacggctgaggaactggagaatgaggatttgaaactgtggaccgagacaatctaccaatctgcctctgtgttcaagggcgctcctcatgaaatattaatacaaattgtcgatgcctcatcagtgattacctgggatttcgatgtgtgtaaaggggacattgtgttcaatatttaccatagcaagagaagcccccagccaccgaaaaaagattctctgggagctcatagcatcaccagccccggaggcaataacgtgcagttgattgacaaagtgtggcaactcggtcgcgattacagcatggtggagagtccactcatctgcaaggaaggggagtctgtgcaggggagtcatgtgaccaggtggcctggattttatattctgcagtggaagttccattccatgccggcctgcgccgcgagcagccttccccgggtggacgatgtcctcgcctcactgcaggtttctagccacaagtgcaaggttatgtactacactgaggttatcggttcggaggattttaggggaagtatgacttctctggaatcctcccactccgggttctctcagctgtccgccgcaactacatcaagttctcagtcgcatagctcatcaatgatctctcgctag

SEQ ID NO: 29784 - DNA, 2160 bp, Artificial Sequence
  Description of Artificial Sequence: Synthetic coding sequence
atggtgcaaaaataccagtctccagtccgcgtctacaagtaccccttcgaactgattatggcagcctacgagagacggtttcctacttgtcctctcatccccatgttcgtgggatcagataccgtgaatgagtttaaatccgaagacggagcaatacacgtaattgagaggagatgtaagctggatgttgacgcccctcgactcttgaagaaaatcgcaggggtggactacgtctattttgtgcagaagaattccctgaattctcgcgagaggaccttgcacattgaggcatataatgagacattctcgaacagagttattatcaacgaacactgttgttacactgtccaccccgaaaacgaggattggacctgttttgaacaatctgcgtccctggacattaaatcgttctttggtttcgaatctacagtggagaagattgccatgaagcagtatacaagcaatataaagaaaggaaaggaaattatcgagtactatcttcggcagctggaagaggagggaataactttcgtccctcgctggagccctcccagcatcacaacttccagcgagacatcctctagctccagcaagaaacaggctgcttccatggcagtcgtcattcccgaagccgctctgaaagaaggcctcagcggagatgccctctcaagcccgtccgcgccagagcctgtagtaggcaccccggacgacaagcttgatgccgattacatcaagcgataccttggggatctgacacctttacaggaatcttgcctaattaggctcagacaatggttgcaggagacccataaaggcaagataccaaaagatgagcatatcctaagatttctgagggccagggattttaacatcgacaaggctagagagatcatgtgccaatcactgacctggagaaagcagcatcaggttgactacatcctggaaacctggactcctccacaggtgcttcaagattattacgccgggggctggcaccatcatgataaagacgggagacctctgtatgttctcaggctaggccagatggatacaaaggggctggtgcgcgcgcttggagaagaggctctccttcgttatgtcctgagcattaacgaagaagggctgaggcgctgtgaggagaacacgaaggtttttggccggcccatatctagctggacgtgtctcgtcgatttagagggtttaaacatgaggcacctgtggcgcccaggagtgaaggctctgctgcgcatcattgaagtggtcgaggcaaactatcccgagaccctgggccgactgttaatcctcagagccccaagagtatttcctgtgctgtggaccctggtgtcaccgtttatagacgacaataccagaagaaaattcctgatttatgccgggaatgactaccagggccccggagggttgttagattacatcgataaagaaattattccggattttctaagtggggagtgcatgtgcgaggttcctgaagggggcctcgtgccaaagtcactttaccgtaccgcggaagaactcgaaaacgaagacctgaagttatggactgaaaccatctatcagtctgcctctgtttttaagggcgctccacacgagatcctcatacagatcgttgatgcctcgtctgtgataacttgggacttcgatgtgtgcaaaggagacattgtatttaatatttatcactccaagcgatcaccacaacctcccaagaaagatagcctcggcgctcattccataacctcacctggtggcaacaacgttcagctgatcgacaaagtttggcagcttggcagggactactctatggtagagtcccccctgatttgcaaggagggggagtccgttcaggggtctcatgtcacccgttggcccgggttctatatcctgcagtggaagtttcattctatgcctgcatgtgccgctagcagcctcccccgggtagacgatgtcctggcttccctgcaggtgagctctcacaaatgcaaggtaatgtattatacagaagtgatcggatctgaagatttcaggggctccatgacttcactggaatccagccattcaggctttagtcagctgagcgctgctacaactagctcttctcagtcgcacagctcctccatgattagccgatggcggttttgctag

SEQ ID NO: 29785 - DNA, 2091 bp, Artificial Sequence
  Description of Artificial Sequence: Synthetic coding sequence
atggttcagcggtaccagagcccggttagggtgtacaagtacccatttgaacttgttatggctgcgtacgaaaagcgttttcccacctgcccccagatccctgtattcttgggttccgaggtcctgcgcgagtcccgatcaccagacggagcagtgcatgttgtggaaagatcatgtcggctgagagtcgatgcaccccgcctgctgagaaagatcgcaggcgtggagcacgtggtattcgtgcagaccaacattctcaactggaaagaaagaacactcctaattgaagcccacaatgagacttttgctaacagagttgtggtaaatgaacactgcagttacacagtgcacccggaaaatgaggattggacatgtttcgagcagtctgcatctctagatattcgctctttcttcgggtttgaaaacgctctggagaaaatagcaatgaaacagtacacggccaacgtaaagcgaggtaaagaggttatagagcactatctgaatgaattaatatcgcagggcacttcacacattccccggtggacccctgcccctgttagggaggaggatgcacggaaccaggcagggccaagggacccctccagcttagaagcccacggccccagatcaacactgggtcctgcattggaggcagtcagtatggatggcgataagctggacgctgactacattgaaaggtgcttgggacatttgacaccaatgcaggagagctgtctgattcagctccggcactggctccaggagactcacaaaggtaaaatcccgaaggacgagcatattctcaggtttctgagagctcacgactttcatctagacaaggccagggagatgttgaggcagtcattgtcgtggcgcaaacagcaccaggtcgatttactcctgcagacatggcagcctcctgcactgttggaggagttctacgcgggtggctggcactaccaggacattgacgggcggcctctttacatactgaggctgggacagatggacactaaggggctcatgaaggcagtcggcgaagaagctctgcttagacacgtcctgtccgtaaacgaggaaggtcagaagcgatgtgagggttccacccgccagctgggccgcccgatctcaagctggacctgcctgctcgacctggagggacttaatatgagacacctttggcgtccaggggttaaggcgctcctgaggatgattgaggtcgtggaagataactaccctgagacactaggccgcttgttgattgtgagggccccaagagtgttcccggtcctgtggaccctgatttcacctttcatcaacgaaaacactcgcaggaaattcctgatctacagcgggagcaattaccagggtcctggaggactggtcgactatctggaccgtgaggttattccagatttcttgggaggcgagtccgtttgtaatgtaccagaaggcgggttagtccccaagtccctttatatgacggaagaggagcaagagcatacagaccagctgtggcagtggagtgagacataccactccgcttccgtgctgagaggtgccccacacgaggtggcggtagagattctggagggggaatcggtcatcacttgggacttcgacatcctgcggggagacgtcgtgttcagtctctaccacacaaaacaggcccctcggcttggcgcgcgggaacccggcactagagcatctggccagttaatagataaaggatgggtcctaggccgggattatagtcgagtcgaggcgccactcgtgtgcagagaaggggaatccatacaaggctcgcatgtgactagatggcccggcgtctatttgctgcagtggcagatgcactcccccccctcatcagttgcatgcagtctgccaggagttgatgacgtgctcaccgccctgcacagcccgggccccaagtgtaaacttctgtattattgtgaggtgcttgcttccgaggattttcggggaagtatgagcagcctggagtcctgcacaagtggtttcagccagttgtcagccgcaacatcatctagctctagtggccagagccattcatcatcactcgtgagtcgatag

SEQ ID NO: 29786 - DNA, 912 bp, Artificial Sequence
  Description of Artificial Sequence: Synthetic coding sequence
atgtccgtgatattctttgcctgcgtcgtgagggtccgggacggtctgcccctctcggcctccacagacttctaccatacccaggattttttagagtggaggcggagattgaaaagtctggccttaagactggcacaatatccggggaggggatccgcagaagggtgtgacttttctatccatttttcaagtttcggggacgttgcttgcatggctatatgtagctgtcagtgccccgcagcaatggcgttctgtttcttagagactctctggtgggagtttactgcctcttacgatactacatgcatcggcttagcctcacggccctacgcatttttggaatttgattccatcatccagaaagttaagtggcacttcaactacgtgtcatcttcacagatggagtgttccctagagaagattcaggaggaattaaaactacagccccccgccgtgctgacacttgaagataccgacgtcgccaacggcgtcatgaatggccacacaccgatgcacctcgaaccagcccccaactttagaatggagcccgtaaccgcgctgggaatcctaagccttattctgaacattatgtgcgctgctcttaatcttattcgcggagtgcatctggccgaacatagcctccaggtggcacacgaggagattgggaacattttggcattcctggtgccctttgtagcatgtatcttccagtgttatctctatctgttctacagcccggcccgtaccatgaaggtcgtgcttatgttgctctttatttgtctgggcaacatgtacctccacgggttgaggaacctgtggcaaatactcttccatattggggtagcatttctgagcagctatcagattctgacacgacagttgcaggaaaagcagagcgactgtggggtctag

SEQ ID NO: 29787 - DNA, 753 bp, Artificial Sequence
  Description of Artificial Sequence: Synthetic coding sequence
atgtcggtgatttttttcgcctgtgttgtcagggttcgtgatggcctaccattaagcgcttcgactgatttctaccatacacaggacttccttgaatggaggcgccgtttgaaatcactggcgctgagacttgcccagtatccggggaggggcagtgcagaaggttgcgactttagcattcacttctcctccttcggcgatgttgcttgtatggccatatgcagctgccagtgccctgcagccatggctttttgtttcctcgagacactatggtgggagtttaccgcctcgtatgataccacctgtatcggcttggcctctcgcccctatgcctttctggagttcgactctataatccagaaagtcaaatggcacttcaactacgtgagcagttcgcagatggaatgtagcctggagaagattcaagaggagttaaagctgcagcctccggcagtcctgactttggaagacactgacgttgcaaacggcgtgatgaacggccatacgcctatgcacctggaacccgccccaaatttccgtatggaacccgtcactgctttaggcatactctctctgattctcaacatcatgtgcgccgcactcaacctgatacgcggagtacatctggcagaacatagtctccaggtggcacacgaagagattgggaacattttggctttcctcgtgccctttgttgcgtgcatctttcaggatcctaggtcttggttttgctggctagaccagacctcctag

SEQ ID NO: 29788 - DNA, 753 bp, Artificial Sequence
  Description of Artificial Sequence: Synthetic coding sequence
atgtcagttatattttttgcatgcgtcgtaagggtgcgggatggcctgcccctgtcagcctcaacagacttctatcacactcaggatttcctagagtggcggagaaggcttaaatcactggcattaaggttggcacaatatcctggtcgggggagcgccgaaggttgcgattttagcatccacttttccagttttggtgacgtcgcctgcatggcaatatgcagctgtcagtgccccgccgccatggcattttgtttcctcgagacactctggtgggaatttacagcaagctatgatacaacctgtatcggcttagcctctcggccttacgctttcctggaatttgattccataatccagaaagtcaaatggcatttcaactatgtcagttcctctcagatggagtgcagcctcgaaaagatccaggaagagctgaaactccagccgcccgctgtccttaccctggaggatactgatgtcgctaacggtgtcatgaatggtcacacacccatgcaccttgagccggctccgaactttcgcatggaaccagtcaccgctcttggtatcctgagcctaattctgaacattatgtgcgcagcactgaacctcatcaggggcgtgcacctggcagagcactctttacaggtggctcatgaggaaattggaaacatcctggctttcctggttcctttcgtcgcatgcatctttcaggatccaaggagttggttctgttggttggaccagacgtcctag

SEQ ID NO: 29789 - DNA, 687 bp, Artificial Sequence
  Description of Artificial Sequence: Synthetic coding sequence
atgagcgtgatcttcttcgcttgcgttgtaagagttcgggatgggctgcccctgtctgcaagcaccgacttttaccacactcaggacttcctcgaatggcgcaggcgcctgaagagcttggcactaaggctggcccagtacccaggacgaggatccgcggaaggctgcgatttctccatacacttttcgtcctttggggatgtggcctgtatggcgatctgtagttgccagtgtccagcagccatggccttttgtttcctcgagactctctggtgggagttcacagcctcttacgacaccacctgcattggtcttgcttctcggccgtatgcattcctggaattcgacagtatcatccagaaagttaaatggcactttaactacgtgtcgtcctcccaaatggagtgttcactcgaaaagattcaagaagagctgaagctgcaacctccagctgtgctcacactggaagacactgacgtggcaaacggtgtaatgaacggccatacgccaatgcacctggagccagcccctaattttcgaatggagccggtgaccgcgttaggcatcctgtcactgatcctgaacataatgtgcgcagccttgaatctgattcgcggagtccatctagctgaacacagtttgcaggacccgagatcatggttctgctggctcgaccagaccagttag

SEQ ID NO: 29790 - DNA, 543 bp, Artificial Sequence
  Description of Artificial Sequence: Synthetic coding sequence
atggccatctgctcttgtcaatgtcctgcagcaatggctttttgctttcttgagactttatggtgggaatttactgcgagttacgacaccacatgcatcgggctggcttcacgtccatacgcgtttctggagtttgattcaattattcagaaagtgaaatggcacttcaactacgtgtcatcctcccaaatggagtgctctctggaaaagattcaggaggagctgaaactgcagcccccagcggtccttaccttggaagataccgacgtggctaatggtgtaatgaacggtcacactcctatgcatctggaacccgcccccaatttcagaatggagcccgttactgctctgggaatcctcagcctgattctcaatatcatgtgtgctgccctcaacctgattcggggcgtccatcttgccgaacactcgctgcaggtggcacatgaagaaatcggaaacattttggccttcctggtgccgttcgtggcttgtatcttccaggatccccgcagttggttctgctggctagaccagacatcatag

SEQ ID NO: 29791 - DNA, 1842 bp, Artificial Sequence
  Description of Artificial Sequence: Synthetic coding sequence
atgagccagcccggcattcctgcgtcggggggtgcaccggcctcgctgcaggcccaaaacggagcggcgctggcatctgggtccccatatactaacggtcccgtacaaaatgcccttctgtcctctcaggagtctgtgtcccaaggatacaattttcagttgccagggtcatacccccaccctataccagcaaaaaccctcaaccctgttagtggccagtccaattatggcggatcccagggctccggacaaacgctgaatcggccacctgttgcgtctaatccagttacccccagcctgcactcaggtcccgccccccgaatgccgctccccgcctctcagaatcccgccaccacccctatgcctagcagctcctttctccctgaggcaaatctaccgcccccattaaattggcaatacaattatccaagcaccgctagtcaaacaaaccattgcccacgggcctcttcccaacccacagtatccggtaacacttctctgacaacgaaccaccagtacgtgtcttcaggctatccaagcttacagaatagctttattaagagcgggccctcagtccccccattagttaacccacctctaccaactaccttccagccaggcgcccctcacgggcccccaccagctggcggcccaccacccgtaagagcactgactcctctgacatccagctatcgggacgtaccccaaccgctgtttaatagtgcggtcaatcaagaaggaatcacatctaacaccaacaatgggagcatggtggttcatagctcgtacgatgaaattgagggcggagggctgttggccaccccacagctcacaaataaaaaccctaagatgtcaaggtccgtcgggtatagctatccatccttgcctcccggctatcagaatacgaccccacccggcgcaactggggtgcctccgtcctccctgaactatccatctggccctcaggcctttactcagacgcctctaggggccaatcatttaactacatcaatgtccgggttgtccctgcagccggaagggctgcgagtagtaaatctcctccaggaacgcaatatgctcccaagcacgcctctcaagcctcccgtccccaatctccacgaggatattcagaagttaaactgcaatccagagttgtttcggtgcacccttacctccattccgcagactcaggctctgttgaacaaagcgaaattgccattagggctgctgctgcatcctttcaaggatctggtgcaactgccggtggtcacttccagcacaatcgtgcgctgccggtcgtgtcggacttacattaacccgttcgtgtccttcttagatcagcggaggtggaagtgcaacctgtgttaccgtgtgaacgacgtccctgaagagttcttatataaccccctcacacgcgtgtatggtgagccacatcgacggccagaggtccagaacgccaccatcgaatttatggctccctcagagtatatgctgagacctcctcagccaccagtgtacctgtttgtgttcgacgtgtcccacaacgccgtagagaccggttacctcaatagtgtgtgccagtctctcctcgacaatttggaccttctgcctggcaatacacgcactaaaattggcttcattaccttcgatagcaccatccacttttacggcctgcaggaaagtttatcacagccccagatgttaatagtgtccgacattgaggacgtgttcatcccaatgccggaaaacctgttggtcaatcttaatgagagcaaggaaagcgttattggcgtgtcaagtgaggagacactcataacatgtctcgaaattgctatgaggtag

SEQ ID NO: 29792 - DNA, 3282 bp, Artificial Sequence
  Description of Artificial Sequence: Synthetic coding sequence
atgtcacaacctgggatccccgctagtgggggagctcctgcaagcctgcaggcccaaaatggcgctgccctggcttctggttctccgtacactaacgggcccgtgcagaatgcgctgcttagttcccaggagtccgtgtctcagggctataattttcaactgccagggagttacccccacccaattcccgcgaaaaccctaaatccggttagcgggcaatctaactacggggggagccagggaagcggacaaacgctgaacagaccacccgtggctagcaacccagtgacgccttcccttcatagcggaccagccccaaggatgcctctacctgcaagccagaaccccgccaccacccccatgcctagctccagctttcttcctgaagccaatcttccccccccactgaattggcagtacaactatccctccaccgcatcacagaccaaccattgccccagagcaagtagtcagcccaccgtgtcaggtaatactagtttgaccacaaatcaccagtatgtttcctcagggtatccctcacttcagaatagttttataaagagcggtcccagtgtccccccccttgtcaaccccccacttcccacaactttccaacctggagctccccatggaccaccaccagccggagggcctcctcccgtgagggccctcacgcctctgaccagttcttaccgcgatgttcctcaaccattgttcaattccgctgttaatcaggaaggcattacctctaataccaataacggctccatggttgttcactcaagttatgacgaaatcgaagggggtggccttttggccaccccgcaactcaccaacaagaatcctaaaatgtcccgaagtgtaggctattcatacccgtctctgcctcctggctaccaaaataccaccccaccaggagcgactggcgttccaccttcctccctcaattacccgtcagggccccaagccttcacgcagactcccctgggagcaaaccacctgaccacatccatgagtgggctgtcactccagcccgaagggctcagagtggtaaatcttctgcaggagcgtaacatgttgccatcaacacccctcaagcctcccgtgcctaatctgcacgaagacattcagaaactgaactgtaatccggagctctttagatgcactctgaccagcattccgcaaacccaggccttattgaataaggcaaagctgcccctcggcctacttctgcacccttttaaagatctcgtccagctgcctgttgttacttctagcactattgttcgctgtcggtcctgtagaacctatatcaacccatttgtaagtttcctggatcagagacgctggaaatgtaacctgtgctatagggttaacgatgttccagaggagttcctatataaccctctgacaagggtttatggtgagccccatcggcggcccgaagtgcaaaacgccaccatcgaatttatggctcctagcgagtacatgctcaggcccccccagccccctgtctacctgtttgtcttcgacgtgtcccataacgccgttgaaaccggctacttgaatagcgtctgccaaagtctgcttgataacctggatctactccctggcaatactagaacaaagataggcttcatcacattcgactcaaccattcacttttacggcctgcaggaatcactctcacagccccagatgctgatcgtatccgacatcgaggacgtcttcattcccatgccagagaacctgctcgtgaatctaaacgaaagtaaggaattggttcaagacttgctgaaaacactgcctcagatgttcactaagactctggagacccaatccgctctgggccctgccctccaggcagcctttaagctgatgtccccaacaggcggaagaatgagtgtgtttcagacacaattgcctaccttgggcgtgggcgccctaaagccaagagaggaacctaaccaccgctcttctgcaaaggacattcatatgaccccttccacagacttttataagaagttggcactcgattgcagcggccagcaagtggccgtcgacctcttcctgctgtccggtcaatactccgatctggcttccctgggttgcatctccagatactcggcaggaagtgtgtactactacccttcttatcaccatcaacataacccggtgcaggtccagaaactccagaaggaactccaacgttatcttacaagaaagatcgggttcgaggcagttatgagaatcagatgtactaaagggctgtctatccataccttccacgggaatttctttgtgagatccacagacttactgtcactccccaatgtcaatcccgatgccggatatgcggtgcagatgtcagtcgaagagtcgcttaccgacactcagttagtgagctttcaatccgctctactctacacatcatcgaaaggggaacggagaatccgagtccacacactgtgtttgcctgtggttagtactttgaatgacgttttcctcggcgctgacgtgcaagctatcagcggcctgttagcaaacatggccgtggatcggagcatgacagcctcgctgtctgacgctcgggatgccctggtgaacgccgtcatcgatagtctttcagcctaccgatccagtgtgctgtcaaaccaacaacctggactgatggtcccattctccctgaggctttttccgctctttgtcctggcgctgctgaagcaaaagagctttcagaccggcacaaatgctcggctggacgagcgcatctttgctatgtgccaggtgaagaaccagccgttagtttacttgatgctcaccacacacccctccctctaccgggtggataacctgtctgacgagggggctttaaatatctcagatcgaaccatccctcaacctcctatcctgcagctctccgttgagaagctctcacgggatggcgctttcctgatggatgccgggagcgtgctgatgctctgggtcggaaagaattgtacccaaaacttcctgtcccaagtgctcggagtacagaattacgcaagcattcctcagccaatgacagatctgcctgaattggatactcctgagagtgctcgcattatcgcttttataagctggcttcgcgagcagcgtcccttttttcccatcttatacgtgatcagggacgagagtcctatgaaagccaactttcttcagaatatgatcgaggacaggacagaaagcgccttgtcatactacgaatttctattgcacatccaacagcaagtgaacaagtag

SEQ ID NO: 29793 - DNA, 3807 bp, Artificial Sequence
  Description of Artificial Sequence: Synthetic coding sequence
atgagtgcccctgccggcagtagccacccagcagccagcgcccgcatcccgccgaagttcggaggcgcagcagttagcggagccgcagcacctgccggacccggtgccggaccagcacctcatcagcagaacgggcctgcacaaaaccaaatgcaagtgcccagtggatatggtctgcatcaccagaactacatagcacccagtggccattacagccagggacctgggaagatgacgagcctgcctctggacacacagtgcggggattactactccgctctgtatacggtacctacacagaacgtgacccccaatacagtcaatcaacaaccaggcgcgcagcagctctacagccgcgggcccccggctccccatattgtgggctcaacactggggtctttccagggagcagccagctccgcaagccacctgcatacaagcgcttcacagccatacagctcttttgtaaaccattacaattctcctgctatgtactccgcatcctcctcagtggccagccaggggttcccaagcacctgcggtcattacgcaatgtccaccgtgtctaatgctgcttacccgtcagtgtcatatccgtctttgccagcgggcgatacctacgggcagatgttcacctcccagaacgcccccacagtgagaccagtcaaggacaacagcttttcagggcagaacactgccatatcccacccatcccccctgccccccctcccttcacaacagcaccatcagcagcaatccctgtctggctattccaccctgacgtggagtagcccaggtctcccatcaacacaggacaatctcattcgaaatcacacaggctcgctcgctgtagctaacaacaaccccactattactgttgcagatagcctatcctgtcctgtcatgcagaacgtgcaacccccaaaatcctctcccgttgtctcaacagtcctctcgggctcgagtggcagtagcagtacacggacccctccaacagctaaccaccccgttgagcctgtaacttctgtgacgcagccctctgagctgctgcagcagaagggggttcaatacggtgagtatgtcaacaatcaagcttcgagtgcccccacgcccctttcctccacgtccgatgacgaagaggaagaagaggaggacgaggaagctggagtggattcttcatccactactagctcagcatccccaatgccaaacagctacgacgcactggaagggggtagttacccagatatgctgagtagctccgctagctcacctgcgcccgaccccgcccctgagcctgatcccgccagtgcccccgcaccagcatcagctcccgctcccgtggttccacagccatccaaaatggctaaaccatttggttatgggtatccaacattgcagccaggctaccagaacgcaaccgcccccctgatttccggtgtgcagccttcaaatcccgtctacagcggtttccagcagtatcctcaacagtaccctggagtaaaccagctgagctcctcaattggcggcttgagcctgcagagttctccccagcccgagtctctacgtcccgtcaatcttacgcaagagcgaaatatccttccaatgacccctgtgtgggcaccagtgcccaatcttaatgcggacctgaaaaagctgaactgttcgccagattctttcaggtgtacattaacgaatataccacagacacaggcgctcctgaacaaagcgaagctgcctctgggcctattgctgcaccctttccgcgacttgactcagctgccagtcattacatccaacacgattgtgagatgcagatcgtgtagaacctacatcaacccgttcgttagcttcatcgatcaacgaaggtggaagtgcaacctgtgctaccgggtaaatgatgtgcctgaagagttcatgtacaaccccctaactagatcatatggagagccacataagcggcctgaagtgcagaattcgaccgtggaattcatcgcctccagtgattacatgctgaggcccccacagccagctgtctatttgttcgtgctcgacgtaagccacaacgccgtggaagctggctacctgactatcctgtgccagagtctactggaaaatctcgataagcttcctggcgatagcagaacccgaatcggctttatgactttcgacagcaccatccatttctataacctccaagagggactgtctcaaccgcagatgttaatcgtatctgatatcgatgatgtgtttctgcctactcccgattctttactggttaatctctacgagagtaaggagctcatcaaggacctgctaaacgctttgcctaatatgttcaccaataccagggaaacacactccgccttgggccctgccctccaggcggccttcaaactgatgagccctacgggaggaagggtatctgtgttccaaacgcagctgccttctctaggggcgggcctcttgcagagccgggaggaccccaaccaacgctcttccacgaaggtcgttcaacacctcgggcctgccactgacttttacaagaaactggcacttgactgctctgggcaacagaccgctgtggatctttttctgctcagctcccagtacagtgacctggcgtcgctggcttgtatgagcaagtatagcgccgggtgtatctactactaccctagtttccactatacccacaatccttctcaggctgagaagctacagaaggatctcaaaagatatttgacccgcaagatcggcttcgaggcagtgatgcggattagatgcactaaggggctctcgatgcatactttccacggtaacttcttcgtcaggtccacggatttgttgagtctagccaacatcaatcccgacgctgggttcgctgtgcagttgagcatagaggagagtctcacagacacaagcttggtgtgctttcagactgccctgctgtacaccagctcaaagggtgagcgaaggattcgagttcacacactatgcctccccgtcgtgtctagcttggctgatgtttatgcaggcgtggatgtgcaggccgccatatgccttttggccaatatggccgtcgatagaagtgtctccagtagcctgagcgatgcccgcgacgctctggttaacgctgtggtggatagcctcagtgcatacggcagtaccgtgagtaacctacagcactccgccctcatggcaccttcatctttgaaattgtttcctctttatgtcctggctttactaaagcaaaaagcatttcgaacaggcacatctacacgactggatgaccgcgtttacgcaatgtgtcagataaagtcccaaccgcttgtgcacctcatgaagatgattcatcctaatctttaccgtatcgaccgtctcacggatgaaggggcagttcatgtgaacgaccgtatcgtccctcagcctcccctgcagaagctgtcggccgagaagctaaccagggagggcgccttcttgatggactgtggttcagttttttatatttgggtggggaaagggtgcgacaacaacttcattgaagacgtgctggggtacaccaactttgctagtataccacaaaagatgactcatctcccggagttggatacgctgtccagtgagagggcaagaagctttatcacttggctgcgggatagcagacctttgtctcctatactgcacattgttaaagatgaaagccctgcaaaagcggagtttttccaacacctgattgaagaccgaacggaggctgcgttcagctattacgagtttctcctgcatgtccagcagcaaatatgcaagtag

SEQ ID NO: 29794 - DNA, 3702 bp, Artificial Sequence
  Description of Artificial Sequence: Synthetic coding sequence
atgagtgcgcccgccggaagcagccatccagcagcctccgcccgaatccctcccaagtttgggggcgctgcagtcagcggagctgccgcaccagctgggcccggtgccggaccagcacctcaccagcagaatggccccgcccagaaccagatgcaggtgccttcaggttacggtctacatcatcaaaattatattgcaccaagtggacattacagtcagggccctggtaaaatgacctcattgccgctggatacccagtgtggcgactactatagcgcgctgtacactgtgccaactcaaaatgtcacgccaaacactgtgaaccagcagccaggggcccaacagttatacagccgggggccccccgcccctcacattgtgggatctaccctgggctcttttcagggggccgcgtcctcagcgtcccatctgcacacatccgctagccaaccatactctagcttcgtgaaccactataacagcccggccatgtattcagccagtagctccgtggcgtctcagggttttccctcaacgtgcggacattacgctatgagcacagtgagtaatgcggcctatccttcagtgagctatccctctctccccgcaggtgacacttacggacagatgttcacatcgcaaaatgcacccactgttcggccagttaaagataacagcttttccgggcagaacactgccatctcccatcccagccctttaccacctttgccctcccagcaacaccaccagcaacagagcctgtcagggtactccaccctgacctggagttcccccgggctacccagcacgcaggacaatctgatacggaatcatactgggtcattggcggtggctaacaacaaccctacgattaccgtcgctgactcgttgtcttgtccggtgatgcagaacgtacagccaccgaagagctccccagttgttagtaccgtgctcagtggttcttccggtagctcatctacccgtaccccccccactgcgaaccaccctgttgagccagtcacctctgtcacgcaacccagcgagctgttacagcagaagggcgtagacagctcaagtacgactagctccgccagccctatgccaaattcttacgatgccttagagggcggctcttatcccgatatgctttcttcttctgctagcagccctgcgcctgaccccgcccccgaaccagaccccgcctctgctcccgctccagcctccgccccagcccccgtggtgccacagccatccaagatggccaagcccttcgggtacggatatcccactttacagccggggtaccagaatgctacagccccacttatctcaggcgtccaaccctccaaccccgtgtacagcggatttcaacaatatccgcagcagtatcctggcgtgaatcaactctcctcatcaatcggcggtctgagcctgcagagtagcccacagcccgagtctttacggccagttaacctcactcaagagagaaatatcctgcccatgacccctgtatgggcaccagtgcctaacctaaatgccgatcttaaaaaactgaactgcagcccagacagtttccggtgtaccctcacaaacattccccagacgcaagcacttttgaacaaagccaagcttccactggggctcctcttgcatcccttccgtgatctaactcaactgccagtgatcacatcaaacaccatagtgagatgccgctcgtgtcggacctacatcaacccttttgtctccttcatcgaccaaagaagatggaagtgcaacctgtgttacagagtaaacgacgttccagaggagttcatgtataacccattgaccagatcctacggagaaccacacaagcgcccagaagtgcaaaactcaacagtggagttcattgcttcatccgattacatgctccgacctccacaacccgcagtttatttgttcgtgctggatgtgtcacacaacgcggtagaggcagggtatctgactattttgtgtcagagcctgctcgagaacctggataaacttcccggcgattcacggactcgaattgggtttatgacattcgattccaccatccacttttataacctgcaggaaggattatcccaaccgcagatgcttattgtctcagacattgacgatgtctttctcccaacccctgacagtctgctggtgaacctgtatgaatcaaaagagcttattaaggacctactcaacgccctgcccaacatgtttaccaatacgagagagacccatagtgcgctgggaccagccctgcaagctgcattcaaacttatgtcgcccacaggaggtcgggtctccgtcttccagacacagctgccctctctgggcgccggcttactccagtctcgggaggatcccaaccagcggtcgtcaaccaaggtcgtacagcatcttggccctgccacggacttctataagaaactggctctggattgcagcggacaacagactgcggtggacctgttcctgctatccagtcagtattccgacttggcttcgctagcgtgcatgagtaaatacagcgctggctgtatctattattatccatccttccactacacccacaacccttcacaagccgagaaactgcaaaaggaccttaaaaggtatctgactcgtaagataggcttcgaagcagtcatgcgtattcgctgcacgaaaggtctgagcatgcacaccttccacggcaacttcttcgtgcggagtacagatctcctgtcactggccaatattaatcctgatgcaggttttgcggtgcagctgagtattgaggagtctctgaccgacactagcttggtgtgtttccagactgcactgctgtacacatcatcaaagggcgaaaggaggattcgagtgcacactctgtgtttgcccgttgtctcgtctctggccgacgtgtacgcaggcgtcgacgttcaggcagcaatatgtctattggccaatatggcagtcgaccgctcagtgagttcttccctcagcgatgcacgtgatgcattagtcaacgcggtcgtcgactcactgtccgcatacgggagcaccgtcagcaacctgcaacatagcgcccttatggcaccctccagtttgaagctgttccccctgtacgtcctagcactgctgaagcagaaagcatttcggaccggcacttctacgcgcctggacgatcgcgtgtacgcaatgtgccagattaaaagccagcccctagttcacctcatgaagatgatccatcccaatctgtacaggatagacaggttgacggatgaaggcgcagtgcatgtcaatgatcggatcgtccctcagcctcccctgcaaaagctgtcagccgagaaactgacgcgcgaaggggccttcctcatggactgtggctctgttttctacatctgggtcggtaaggggtgcgacaataactttattgaagatgtgttagggtacacgaactttgccagtatcccgcagaagatgacacacctgcccgagctggatactttgagctccgaaagagctcgatcgttcatcacatggctcagggacagtagacccctgtcgcccattttacacatagtgaaggatgagtcgcctgctaaggcggaatttttccaacacctgatcgaagacagaacagaagcagctttcagttactacgagtttctgctccacgtgcagcagcaaatctgcaaatag

SEQ ID NO: 29795 - DNA, 3897 bp, Artificial Sequence
  Description of Artificial Sequence: Synthetic coding sequence
atgtcagctcctgccggctcctcacacccagctgccagcgctcgcatccctccaaagttcggaggagctgccgtaagcggggctgccgcaccagcaggacctggagcgggcccggctccccaccagcagaacgaaacagggttccaccacgtcgcgcaggcatcccttgaacttctagacccttccaatctcccagcgtctgcaagtcagattgccggatccacaggtccagctcaaaaccagatgcaggtgccgtctgggtatggcctgcaccatcagaattacatcgccccttccggccactactctcaagggccaggcaagatgacctcattgcctttagacacacagtgcggcgactattactctgctctttatactgtgcccacccaaaatgtaacccccaacaccgtgaaccaacagcctggagctcagcagctatattcaagaggacctccggccccacacatagtgggttctaccctcgggtcattccagggtgcggccagttctgccagtcacttgcacacatccgctagtcagccttattcttccttcgtgaatcactataattctcctgccatgtactctgcctccagtagcgtggcatcacaaggctttccctccacgtgtgggcactatgctatgtccaccgtgtcaaatgctgcatatccaagcgtgtcctatccgtcactccccgctggtgacacttacggtcagatgtttacatcgcaaaacgctcccaccgtaagacccgtgaaggacaacagtttttccgggcagaataccgccatcagtcaccctagccccctcccgcccctgccgtcccagcaacaccatcagcagcaatctttgtcaggttactctactttgacctggagcagtcctgggctaccatctacacaggataatctgattcggaatcacactgggtcactcgcggtagccaacaacaacccgacaataactgtcgcggatagtctctcctgtcccgtgatgcaaaatgtccagccacccaagagcagccctgtcgtaagcactgtgctcagcggatcatctgggtccagcagcacacgcacaccccctaccgcgaatcaccccgtcgaacctgtcacttccgtcacacagccctcagaactgctgcagcagaaaggggtgcaatacggcgagtacgtgaacaaccaggcctcatcagcccctacacctctctcatcgactagtgatgacgaggaggaagaggaagaggatgaagaagccggggtcgatagctcgtcaactacttcaagcgcgagcccaatgcccaactcttacgatgccttagagggaggaagctacccagacatgctctcttctagtgcaagctctccggcccctgaccctgctcccgaacctgatccagcctctgccccagctcctgccagcgcccccgcgcctgttgtcccgcagccttccaagatggctaagccttttgggtacggctaccctactctgcaacccgggtatcagaatgctactgccccgcttatatctggtgtgcagccctccaatcctgtgtactccggctttcagcaatacccccagtatccaggggttaaccagttgtctagcagcattgggggtttatccctgcaaagctctccacagcctgaaagccttcgcccggtgaacctcactcaggagagaaacatcctccctatgacccccgtatgggctcccgtgcccaacctgaatgcggacttgaaaaagctcaattgttctcctgacagctttcgctgcaccttgaccaacattccccagacacaggctctcctgaataaggcaaagttgccgctgggtcttctcctacatccatttagggacctcacccaactgccagtgatcaccagtaatacaatcgtaaggtgccggtcctgcaggacttacattaatcctttcgtgagttttatcgaccagcgtagatggaagtgcaatctttgctatcgagtaaacgatgtgccggaagagttcatgtataaccccctgacccgttcttacggagaaccacacaagaggcctgaggtgcagaattcaacggtcgagttcatagcctcctcagactatatgctgcgcccacctcagccagccgtttacctattcgtgttggacgtgagtcataatgctgtcgaagctggatatttgactattctgtgtcagtctttgttggaaaatttggataagctgccaggagactctcgcacccgcatcggtttcatgacatttgattctacaatacacttttacaacctgcaggagggattgtctcaacctcagatgttgatcgtcagcgatattgatgacgttttcctgcccacccctgattcgctattggtcaacttgtatgagtctaaagaactcattaaagacctgctaaacgctttaccaaacatgtttaccaatacgcgagaaactcactccgcactcggccccgccctgcaggccgccttcaaactgatgagccctactgggggccgagtttccgtgttccagacgcagctgccctctctcggagccggactgctgcagtctagagaagaccccaatcagaggagctccacgaaagtggttcagcatttgggaccggctaccgatttttacaagaagctcgcactggactgttcaggccagcagaccgcagtagacttgtttctgctctcatctcaatactccgacctggccagcctggcgtgtatgagcaagtactctgcaggctgcatctattattacccgagctttcattacacccacaacccatctcaggcggagaagctgcagaaggacctcaagaggtatctcacccggaaaattggcttcgaggccgtaatgaggattcggtgtacaaaaggcctttccatgcacacctttcacggtaatttcttcgtacgatcgaccgacttgctgtccctagccaacatcaaccctgatgcaggcttcgcggtgcaattgtcaattgaagagtctctgactgataccagtctggtgtgctttcaaaccgctttgctgtacacatcgtcgaagggcgagagaaggattcgagttcataccctctgcctgccagtggtgtccagcctcgctgacgtgtatgccggcgttgacgttcaggcagctatctgcctcctggcaaacatggcagtggatcggagcgtgagcagtagcttgtcagatgctagagatgcattggtgaatgcagtggtggactctctgagcgcctatggcagcaccgtgagtaaccttcaacacagtgccctcatggctccctctagtttgaagctgttccccctgtacgtgctcgcgctcttaaagcagaaggcctttagaaccgggactagcacacgtttggacgatagagtgtatgcaatgtgccagatcaaatctcagcccctcgttcacctaatgaagatgatacatcccaacttgtacaggatcgatcggctaaccgacgagggggccgtacacgtgaatgatcgcatcgtcccacagcctcctctccaaaaactcagcgctgagaagctgacacgcgaaggtgccttcttgatggactgtggaagcgtcttttatatatgggtcggcaagggatgtgataacaactttattgaggacgtgctaggctacaccaattttgcaagtataccccagaaaatgacgcacttacccgaactggataccctgagctcagaacgggccagatcttttatcacatggcttagggactccaggccattgagccctatcctccatatagtcaaggacgagagtccggccaaagccgagttcttccagcatctcatagaggacagaaccgaggcggcattcagctactacgaatttctgctccacgtgcagcagcaaatttgcaagtag

SEQ ID NO: 29796 - DNA, 3285 bp, Artificial Sequence
  Description of Artificial Sequence: Synthetic coding sequence
atgaatgtgaaccagagtgtacccccagtgcctcccttcggccagccccagcctatctaccccggctaccaccagtcatcttatggtgggcagtcaggctctaccgcccccgcgattccctatggggcatacaatggtcccgtgcccggctaccagcaaacccccccgcagggcatgtcaagggcacctccaagttctggcgccccacccgcgtccaccgcccaagccccatgcggccaggccgcctatggccagttcgggcaaggggatgtgcagaatggtccctcctctacagtccagatgcagcgcctgcccgggtcccaaccgtttggctctccccttgctcctgtcggaaaccagcctcctgttctacagccatacggccctccaccaacatccgcccaggtggccacacagctttctggaatgcagatctcaggcgctgtggccccggcccctccgagtagcggtctaggctttggacctcccacatcactggcaagtgcctccggtagcttcccaaacagcggcctttacgggagttatcctcaggggcaagccccaccactctcccaagcgcaaggacaccccgggattcagacgccccaaagaagcgctccctctcaggccagttcttttacacctccagcgtcaggtgggccgcgtctgcccagcatgacaggtccactcctccctggccagagctttggcggaccttccgtgtcccaacctaatcatgtatcgagcccaccacaagcattgcctccaggtacacagatgacggggcctctgggtccgcttccccccatgcactcaccgcaacagccaggctatcagccccagcagaacggatcctttggccccgctcgggggccccaatctaattacggaggaccatatcccgccgccccaacattcggaagccagccaggtccgccccagccgctcccgcccaaacgcttagacccagacgcaatcccctcccccattcaggtcatcgaggacgaccggaataatcgcggcacggagccctttgtaactggagtgaggggccaggtgcccccactcgtgactaccaacttcctagttaaggaccaagggaacgcatcccccaggtacatcaggtgtacctcttacaatattccgtgcacctcagatatggccaaacaggcacaggtacctttagctgctgtcataaaaccactggcgcgattgcctcccgaggaagcctccccgtacgtggtggaccacggcgagagcgggccactacgttgcaatcggtgtaaagcatacatgtgtccatttatgcagtttattgagggagggagaaggtttcaatgttgcttttgctcatgtattaacgacgtacctccccagtactttcagcatctggatcacacaggcaagcgcgtggacgcctacgataggcccgagttgtcgctgggctcctacgagttcctagctacagtggattattgtaagaataacaagtttccatcccccccggcgttcatctttatgattgatgtgtcctataacgcaattaggacagggctggtgaggcttctttgcgaggagttgaaatcgctgttagactttcttccacgggaagggggtgcagaagagagcgcaattcgtgtaggcttcgtgacatacaacaaggtactacatttttacaatgtaaagagtagccttgcacagccgcagatgatggtggtctcggacgtggccgacatgtttgtccctttattagacggtttcctggtcaatgtcaacgagagccgggcagttattacgtccctcctggaccagatcccggagatgtttgcagacacccgcgaaaccgaaactgtgttcgtaccagtcatccaggctggcatggaggccctcaaggcagctgagtgtgcaggcaaactgttcctgtttcatacttccctgccgattgccgaagcccctggtaagcttaagaatcgcgacgaccggaagctgattaataccgacaaggaaaagacactttttcagccacagacaggggcttaccagaccctggccaaggaatgcgtggcccagggctgctgcgtggacctgttcctgttccccaatcagtatgtggacgtcgccaccttgagtgtagtaccacaactcaccggtggatcagtgtataaatacgcaagcttccaggtagagaacgatcaggaaagattcctgagcgacctgagaagagatgtgcagaaagttgtggggttcgatgcggtgatgagagtgagaacttctacgggcattcgagccgtggacttctttggcgccttttacatgagcaacacgactgacgtggagctggccggactagacggagacaaaaccgtcacagtggagtttaaacacgatgaccgactcaatgaagaaagcggggccctgctccagtgcgccttactgtatacaagttgtgccggacagagaaggctgcgcatccataaccttgccttaaactgttgtacgcagctcgcagatctgtatcggaactgtgagactgataccctgattaactatatggcaaaattcgcttatcggggcgtgctgaattcccctgtgaaagcagtgagggacaccttaattacgcagtgcgcgcaaattctggcatgctaccggaagaattgcgcttccccatcctccgccgggcaacttattttgccagagtgcatgaagcttcttcccgtttatcttaactgcgtgttgaaaagcgatgtgttgcaaccgggcgccgaggttacgacagacgatagagcttatgtgagacagttagtcactagcatggatgtgaccgagacaaatgtcttcttttacccccgactgctacctctcacaaaatctcccgtggaatctacaacagaacccccagccgtgagggcaagcgaggaacggcttagcaatggggacatctatctgctggagaatggcctgaatctcttcctatgggttggagccagcgtacagcagggtgttgtacagtctttgttctctgtatctagcttcagccagataacatcgggcttaagcgtgctcccagttctggacaatcctctctccaaaaaggtgcgaggactgattgattctttgagggcacagcgctctagatacatgaagttaacagtggtgaaacaggaggacaaaatggaaatgctgtttaagcacttcctcgtggaggataagagcttgagcgggggcgccagctacgtggatttcctctgccacatgcataaagaaattaggcagctgctgagttag

SEQ ID NO: 29797 - DNA, 3285 bp, Artificial Sequence
  Description of Artificial Sequence: Synthetic coding sequence
atgaatgtcaaccagtctgttccccccgttccgccgttcggccagcctcagcctatctatcccggctaccaccagagcagctacggtggacagtccggatctaccgcccccgctatcccttatggcgcctacaatggtcccgtgcctggctatcagcaaacaccgccccaaggcatgagcagagctccaccctccagcggagccccccctgcttctacggctcaggctccgtgcggccaagcggcctacgggcaatttggccaaggtgatgtgcagaatggaccctcctccaccgtccagatgcagcggcttcccggttcgcagccattcggctctcccctggctccagtgggcaaccagccacctgtgctccaaccctatggcccgccaccaactagcgcccaagtggctactcagctgagcgggatgcagattagcggggctgtggctcctgccccaccctcttccggccttgggttcggcccgcccacatctcttgcctccgcctctggcagcttccctaattcaggactgtacgggagctacccgcaaggccaggcacccccattgagccaagctcagggtcacccagggatacagaccccacagagatcagcacccagccaggccagtagctttacaccccccgcttccggcggacctcgacttccctcaatgacaggaccgttgctaccggggcagtcatttggaggcccatcagtttcacaacctaatcatgtcagctcacctcctcaggccctccccccaggaacccaaatgacggggccattaggcccactccctccgatgcactctccccagcagccagggtaccagccgcagcagaatggttccttcggaccggctcgcgggccacagagcaattacggaggaccctaccctgcagcgccgacattcggctcacagcctggaccaccccaaccacttcccccaaagagattagaccccgacgcaataccttctccgattcaggtcatcgaggacgatcggaataataggggaaccgaacctttcgtaacaggggtgcgcgggcaagtgcctcccctcgtgaccacgaattttttagtaaaggaccagggtaacgcctctccaaggtacatcagatgtacatcgtacaacattccctgcacctccgatatggctaaacaggctcaggtacctcttgcggccgtgattaagcccttagcgcggcttccccccgaggaagcaagcccctacgtcgtcgaccatggcgagagcggacccctgcggtgtaacaggtgcaaggcttacatgtgtcctttcatgcagtttatagaaggcgggagaagattccagtgctgtttctgctcatgtattaacgacgtaccgccccagtacttccagcacttggaccacactggcaagcgggtcgatgcatatgacagacctgaattatcccttggcagctacgagttcctggcaaccgtggactactgtaagaacaataaatttccctccccgccagccttcatatttatgatcgatgtgagctataacgcaattcggacgggtctggttcggctgttgtgcgaggagctcaagagcctccttgatttcctgccaagggaaggcggcgcagaggagtcggcaattcgagtcggcttcgtgacctacaataaagtgctccacttctataacgtcaagtcatcccttgctcagccgcagatgatggtcgtctcggacgtggccgacatgttcgtgccactcctggacggattcttggtcaacgtgaacgagagcagagccgtgattacctcactgcttgaccagataccggaaatgtttgcagataccagagagaccgagactgtgttcgtacctgtgatacaggccggcatggaagcactgaaagccgcagaatgtgctggcaaactgttcctgtttcatacgtccctgcccatcgcggaggccccaggaaagcttaaaaatcgagatgaccgtaaactaataaacaccgataaagaaaagacactgtttcaaccgcagacaggcgcataccagacactcgctaaggagtgcgtggcccagggatgttgcgtcgatttgtttctcttcccgaatcagtatgtggatgtcgctacccttagcgtggtgcctcagctgacgggtggctcggtgtataaatacgcctcttttcaagtggaaaacgatcaagaacggtttttgtcagacttgcgacgagacgtccagaaggtggttggctttgacgccgtgatgagagtgaggacatccactgggatacgggccgttgacttttttggagctttttacatgtccaataccacagatgttgaacttgccggactggacggcgacaagacggtcaccgtggaattcaaacatgatgaccgtcttaatgaggagagcggcgctctgctccagtgcgctctgctgtacacatcttgcgccggacagaggagactgaggatccacaaccttgcactcaactgctgcacccagctggcggatttgtatagaaattgcgaaactgatacactgatcaattatatggccaagttcgcatatcgcggagtgctgaactccccggtcaaagctgtgcgggacactttgatcacccagtgtgcccagattctggcctgctatcgaaagaattgtgcgtcaccctcaagcgcgggccagcttatcctcccagagtgcatgaagctgctgcccgtgtacctgaattgtgtgttgaagagcgatgtgctgcagccgggcgctgaagtaacaacagatgatcgagcatatgtgcgacaactcgttacgagcatggacgtcaccgagacgaatgtttttttttatcccaggctactgcctttgaccaagtcaccagtggagtctaccaccgaacctcctgctgtgagagcttccgaggaacgtctgtcaaacggcgatatctacttgttggaaaacggcctgaaccttttcctgtgggttggggccagcgtccaacagggcgttgtgcaatccctgttttccgtaagtagcttctcacagataacttcggggcttagtgttctgcccgtactggacaaccctctcagtaaaaaggtgagaggattaatcgattccttgagagcccaaaggagcaggtacatgaaactgactgtggtcaaacaagaggataaaatggaaatgcttttcaagcattttcttgtagaagacaaaagcttgtcaggcggtgctagctacgttgattttctgtgccacatgcataaggagattcggcagctgctgtcctag

SEQ ID NO: 29798 - DNA, 2928 bp, Artificial Sequence
  Description of Artificial Sequence: Synthetic coding sequence
atgcagatctctggggcagtcgcccctgcgcccccaagctctgggctgggtttcggaccaccaacgtcactggcctcggcctcggggagcttccccaattcaggactctatggtagctacccccaaggccaagccccaccactctcgcaggcgcaagggcatcccggcatacagacccctcagcgcagcgcaccatcacaggccagtagtttcacccccccggcgagtgggggaccacggctgcccagtatgaccggtccattgctgcccgggcaatcctttggcgggccctcggtcagtcagcctaatcacgtctcatcccccccgcaggctctccctcccggcacccagatgacagggcccctgggtccactcccaccgatgcactcaccccagcagccaggttatcaaccacagcaaaatgggtctttcgggcctgcccgcggaccccaaagtaattatgggggtccttatccagctgcccccacgttcggatcccagcctggacctccacagccactgcctcctaagagacttgaccccgacgcaattccatcaccccagctgtctgagctgccgccccagcagaagacacgtcatagaatcgaccctgacgcgatcccatcaccaatccaggtgatcgaggatgaccgtaacaataggggtacagagcctttcgtaacaggcgtgcgaggtcaggtgcctccattggttactacaaattttctcgtcaaggatcagggaaacgcatctcctagatacattagatgtaccagttataacatcccttgcactagcgatatggcaaagcaggctcaagtccctctggcggcggtgattaagccacttgctcgcctgcctccagaagaggcctccccctacgttgtcgatcacggcgagtcaggccccttacgatgcaaccggtgcaaggcctatatgtgtccattcatgcagttcatcgaaggaggtcggagatttcaatgctgcttttgttcatgcattaatgacgttcccccccaatacttccagcatctggaccacacaggcaagagagtggatgcgtacgatcgacccgagttaagcttgggctcctatgagtttctcgctaccgtggactactgtaagaataataagtttccatctccacctgcctttatattcatgatagacgtgtcgtacaatgcaatacggactggcctggtgcgccttttgtgcgaggagttgaaatcactgctggatttccttccacgtgagggcggcgctgaggagagcgcaattagggtggggttcgtgacttataataaagtactgcatttctacaatgtcaaatctagcctcgctcagcctcaaatgatggtggtcagcgatgtggccgatatgttcgtccccctcctagacggcttcctcgtgaacgtgaacgagtcaagagccgttattactagcctgctggatcagatccctgaaatgtttgccgataccagggagactgagacagtgtttgttccagttattcaggccggtatggaggctctgaaagcagccgagtgcgccggtaaactcttcctctttcacacctcgcttcccatagcagaggccccaggaaagttgaagaatcgcgacgaccggaaattgatcaatactgataaggaaaagaccttgtttcagccccagaccggagcatatcagactctggccaaagagtgcgtcgcccaaggttgctgcgtcgatctcttcttatttccaaaccagtacgtcgatgtggcaacactctccgtggtgcctcagctgaccggcggatccgtgtataagtacgcgagttttcaagtggagaatgatcaggagcgctttctatccgatctcaggcgagacgtgcagaaagtggtggggttcgacgctgtgatgcgcgtccgcacttccactgggattagggcggtggactttttcggcgctttttacatgtccaacacaacagacgtcgagctcgccggcttggatggcgacaaaaccgtcacagtcgaatttaagcatgatgatcgcctaaacgaggagagcggggcgctcctgcagtgtgcactcctgtacacatcctgcgccggtcaaagacgccttaggattcataacctcgccttgaactgttgcacccaactcgctgatttgtacagaaactgtgaaactgacacacttataaattacatggctaaattcgcgtaccgcggcgtactcaattcaccagtgaaggcagtacgggataccctgataacccaatgcgcccagatactagcctgctaccgtaaaaactgcgcctcaccctctagtgctggtcagttaatcctccctgaatgcatgaagttgttaccagtctacctgaattgcgtgctgaagtccgacgttctccagccaggcgcggaggtgactacggacgatcgggcgtatgtaaggcagcttgtgacaagtatggacgtgacagaaaccaatgtgttcttctaccctcggctgctgcccctcacgaaatcgccagtagaatccacaaccgaaccccctgcagtcagggcaagcgaggaacgactcagcaacggggatatttacctccttgaaaatgggctgaatctgttcctgtgggttggcgcctcagttcagcaaggggtggtgcaaagtttgttttcggtttcctcattcagccaaatcacatccggtctgtctgtgctgcctgtactagataaccccctgagcaaaaaagttcgcggtctgatagactctctgcgggcacagcgcagcagatacatgaagcttaccgtggtcaagcaggaagacaagatggagatgctgttcaaacatttcctggttgaggacaagtcattaagcgggggtgctagttatgtcgactttctctgccacatgcacaaagaaatccggcagcttcttagttag

SEQ ID NO: 29799 - DNA, 1029 bp, Artificial Sequence
  Description of Artificial Sequence: Synthetic coding sequence
atgagggtgcgaaccagtaccggcatcagagccgtggacttctttggggccttttatatgagcaacaccacagatgtggaactagcagggcttgacggggataagacagttacggtggaatttaaacacgatgatcggctgaacgaagaatccggcgcactactgcagtgcgctctgctgtatacaagctgcgctggacagcgacgattgcggatacacaacctggcattaaactgctgcacacagttagcggacctgtaccgcaattgtgagactgacaccctgatcaattatatggcaaagtttgcttatcgaggtgttttaaactcccctgtgaaggctgtgagggatacattaatcacacaatgtgcccagattctagcttgctaccggaaaaattgtgcaagccccagctccgctggacagttgatcctgcctgaatgcatgaaattgctcccagtctatctcaattgtgttctcaaaagcgatgtgttgcaacctggagcggaggtaaccaccgacgatagggcgtacgtgagacagctagtgactagtatggatgtgactgaaaccaatgtgtttttctaccctaggttacttcctctaactaagagccctgtagagagcacaacggaaccccctgcagtgcgagcttcagaggaacgtctgtccaatggcgatatatacctgctggaaaacggcctgaatttgttcctgtgggtcggtgcatcagttcagcaaggcgtcgttcaaagccttttcagtgtctcaagtttcagtcagatcacctctggactatctgtcctgccagttctggacaacccactgtcaaaaaaggtgcggggccttatcgattctcttcgggcccaaagatcacgctacatgaagctcacagtggtcaagcaggaagataagatggagatgttgttcaagcactttctcgtggaggataaatcgctgagcgggggcgctagttatgtggactttctttgccacatgcataaagaaattaggcagctgctgtcttag

SEQ ID NO: 29800 - DNA, 1029 bp, Artificial Sequence
  Description of Artificial Sequence: Synthetic coding sequence
atgcgggtcaggactagcacgggcatacgcgccgtcgatttttttggagcattttatatgagtaacaccactgacgtcgagctcgcaggactagatggagacaagactgtgacagttgaattcaaacatgatgaccggttaaatgaagaatctggcgccttgctccagtgtgcactgttatatacctcatgtgctggtcagaggagactgaggatccataatctggcattgaattgttgcacccaactggcggatctgtataggaattgtgagacagacacgcttattaattacatggccaagttcgcctatcgcggagtcctcaattctccagtaaaggctgtgcgggacacattgatcacccagtgtgcccagattctggcctgctatcggaagaactgtgcctcaccatctagcgcaggtcagcttattctgccagagtgtatgaagctcctgcccgtttacctgaactgtgttttgaagtccgatgtgctgcagcctggtgcagaggttaccaccgacgaccgggcctatgtcaggcagctggttacctcgatggacgttaccgaaacaaacgtattcttctaccccaggctgctgccactgacaaagagccctgtcgagagtacaaccgaacctccggccgtacgagcatcggaggaacgcctcagtaacggcgacatctacctgttggaaaacggtctgaacctctttctgtgggtcggagcctctgtgcagcagggcgttgttcagagtctctttagcgtatcatcttttagccagattacaagcgggctgtccgtgcttcccgtgttagataaccccctgtccaagaaagtgcggggtttgatcgactcattacgcgcgcaaagaagccggtacatgaagctcactgtggtgaaacaagaggacaagatggagatgctgtttaaacacttcttggtcgaagataagtccctgagcgggggagcttcttacgttgacttcctttgccacatgcacaaagagatccgacagctgctctcttag

SEQ ID NO: 29801 - DNA, 3099 bp, Artificial Sequence
  Description of Artificial Sequence: Synthetic coding sequence
atgtctcaacagggttacgttgcgaccccaccctacagccagcctcagcccgggattggcctctcccccccgcactacggccattacggggaccctagtcatacagccagccccacagggatgatgaagcccgctggacccctcggagctacggcaacacgagggatgcttccccctggcccacccccacccggaccacatcaatttggacagaacggggcacatgcaactggacatccccctcaacgattccccggccctccccctgtgaataacgtggcatcgtcacatgcaccatatcagccctcagcccaatccagctatccggggcccatcagcacatccagcgtcacccagctggggtcgcagttaagcgcgatgcaaataaactcttatggctccggtatggcccccccttcccagggccctccgggtcccctgtctgctacatcgctgcagacaccaccccgtcccccgcagccgtctatcctgcagcctggctctcaagtcctgcccccgcccccgaccaccttgaatggccctggggcctcgcctcttcccctgcctatgtacaggcctgatggcctgtcgggccccccgcctcctaatgcacagtatcaacctccacctttacctggccagacgctaggtgccggataccccccccaacaggccaactctggccctcaaatggctggtgcgcagctcagctatccaggaggatttccgggagggcccgcccagatggcaggacctccacagccgcaaaagaagctggatccggactccatcccgagcccaattcaggtgatcgagaatgatagagcaagccggggtggccaagtgtatgccactaatacccgaggccagattccacctctcgtgacaaccgattgtatgattcaagatcaagggaacgcatctccacgctttatccggtgtactacctattgctttccatgcacttcggatatggctaaacaggcccagatcccacttgccgccgtgatcaagccttttgccaccatcccctctaacgagtcccccctttatttggtcaatcatggagagagcggaccggtgaggtgtaatcgatgtaaagcgtacatgtgcccatttatgcaattcatcgagggtggcagacggtaccaatgtggcttttgcaattgtgtgaatgatgtgcctccattctatttccagcacctggatcacataggacggcgcttggaccactacgaaaagcctgagctgtcactcggctcttatgaatacgtggccaccctagattattgtagaaaatccaagcccccgaatccacctgccttcatcttcatgattgatgtgtcctatagtaacatcaagaatgggctggtgaagttaatctgtgaggagctgaagactatgctcgagaaaattccaaaagaagagcaggaggaaaccagcgccataagggttggatttattacctacaacaaagttctccacttttttaacgttaaatctaacttagcccagccccagatgatggtcgtaaccgatgtgggtgaggtctttgtgcccctccttgatggcttcctggtgaactatcaggaatcccagagtgtgattcataacctgctcgatcaaatccctgacatgtttgcagatagcaacgagaacgagacagtgtttgccccagtcatccaggcgggcatggaagcgttgaaggccgcagactgtccgggaaagctcttcatcttccactcttcattgcccacagctgaggcccctggcaagctaaaaaatcgcgacgataagaagctagtgaacactgataaagaaaagattttgtttcagccacagacaaacgtttatgactcactggctaaggactgcgtggcacatgggtgtagcgtaactctgtttctgtttccctcacagtatgtcgacgtggcctccctgggcctcgttccacagctgacaggtggcacgttgtacaagtataacaacttccagatgcacctggataggcagcagtttctaaacgacctgcgcaacgacatcgaaaaaaagattggctttgatgcgataatgagggtgcgaacgagcacaggatttcgcgccacagacttttttggaggaattcttatgaataataccaccgatgtggagatggctgccattgattgtgacaaggctgtgactgtggagtttaagcacgacgacaagctgagtgaggattcaggagccctcatccagtgtgctgtgctttatacaactatcagcggccaacggcgcctacgcatccataatcttggcctcaattgttcgtcccagctggctgatctgtacaagtcatgtgagacagacgctttgattaatttctttgccaaatccgccttcaaagcggtactgcaccagcccttgaaggtgattagagaaattctggtcaaccagacagcccacatgttagcttgttataggaaaaactgcgcctctccatctgctgcctcacaactaatcctgccagatagcatgaaagtgctaccagtttacatgaattgtttactgaagaactgcgtgctgctctcaaggcccgagatcagtacggacgagagggcataccagagacaactcgtcatgacgatgggggtcgctgattctcagctctttttctacccacaactgctgccaatccataccctcgatgtgaaatctaccatgctcccagccgccgtcaggtgctcagaatctaggttgagcgaagagggcatctttctgctagccaatggcttacacatgtttctgtggctgggcgtttcatcaccccccgagctgatccaggggatctttaacgtgccaagcttcgcacatataaatacagatatgacccttttgcctgaagtagggaacccatattctcagcagctgagaatgataatgggtattattcagcagaagcgaccttattccatgaagttgacaatcgtgaaacagcgggagcagcctgaaatggtgtttcgccagtttctcgttgaggataaaggactctatggcggaagctcttacgtagacttcctttgctgtgtgcacaaggaaatatgccagctgctgaattag

SEQ ID NO: 29802 - DNA, 3102 bp, Artificial Sequence
  Description of Artificial Sequence: Synthetic coding sequence
atgtcccaacaggggtacgtagccaccccaccctattctcagccacaacccggaatcgggttatctccgccacactacggccattacggtgacccatcccacactgcctctcccacaggtatgatgaaacccgctgggcccctcggagcgactgccacccgaggaatgctgcccccgggcccaccaccacctggacctcatcagttcggccagaacggggctcacgctaccggccacccgcctcagagattcccgggtccgccccctgtgaacaatgtcgctagcagccatgcaccttaccagccctctgcccagtcatcctacccaggacctatttcgacctccagcgttacccagctggggtcccagttatctgcaatgcaaattaattcctatggctccggaatggcacctccatcccagggcccccctggaccgctctccgcaacctccctccagacccccccacggccaccacagcccagcatcctgcagcccggatcccaggtccttccaccgccgcccaccaccctcaacggaccaggagcaagccccctgcctctccctatgtatcgccccgatggcctgtccggaccgcctcctcctaacgctcagtatcagccccccccactgccaggtcaaactttgggagctgggtatcctccacaacaggccgcgaattccggaccgcagatggctggtgcacagctgagttatccgggcggatttcctggcggaccagcacagatggccgggccacctcagcctcaaaagaaattggaccccgattctatcccaagcccaatacaggtgatcgaaaacgatcgggcgagcagagggggccaggtttatgcaactaataccagagggcagattccgcctctggtgaccactgattgcatgattcaggaccaggggaacgcttcgccgcgctttatcaggtgcacaacatactgtttcccttgcacatccgacatggctaaacaggctcaaataccgctcgccgcagtcattaaaccattcgctaccatcccgtccaatgaaagccccttgtatctcgttaatcacggggaatctggtcccgtacgctgcaaccgctgtaaggcctacatgtgcccctttatgcagtttattgaaggcggtcgcaggtatcagtgtgggttttgtaattgtgtaaacgatgtcccacctttctacttccagcatctggatcatatcggcagacgacttgaccactatgaaaaacccgagctcagtctgggatcatacgaatacgtggctactctcgattattgccggaaatcgaagcctcccaacccgccagcatttatctttatgatcgatgtgtcgtactctaatattaagaatgggcttgttaagcttatttgtgaggaattgaaaaccatgctcgagaagatacctaaggaggagcaggaggaaactagcgctattagagtggggttcattacctacaataaagtccttcacttctttaatgtgaagtcaaatctggcccagccccagatgatggttgtgaccgacgttggcgaagtgtttgtcccactgttggatggttttctagtgaactatcaggaatcacagtctgtcatccacaatctactggatcagatacccgatatgttcgcagacagcaacgagaatgaaaccgtttttgcccccgtgatacaggccggaatggaagcgttgaaggctgctgactgtcccggtaagttgtttatctttcactcctctttgcccacagccgaggcaccagggaaattgaaaaatagagatgacaaaaagctggtgaacaccgataaggagaagattctcttccagccccagactaacgtgtacgattctcttgcgaaggactgcgtcgcgcatgggtgcagcgttaccctgtttttattcccgtctcagtatgtagatgtggcctcactgggactcgtcccccagctgaccgggggcacactctacaaatataataatttccagatgcatctcgaccggcagcaattcttaaacgatttgcggaacgacatcgagaaaaaaatcggatttgacgctataatgagagtgagaaccagcacgggtttccgagccactgactttttcgggggaatattaatgaacaacaccacagatgtcgaaatggccgccatcgattgcgacaaggccgtaacggtggaattcaagcacgatgacaaactgtctgaagactcgggcgccctcatccagtgcgccgtgttatacactaccattagcgggcagcggcgcctgagaattcataacttggggttgaactgctcgtcgcagctagccgatctgtacaagagctgcgaaactgacgccctcatcaacttttttgcaaaaagcgcctttaaggccgtgctgcaccagcccctcaaagtgatacgtgagattctggtgaatcaaacagcccatatgctggcatgttacagaaaaaactgtgcctcacccagcgccgcctctcagttaatcctgcccgatagcatgaaggttctgcctgtgtatatgaattgtctgctgaaaaactgtgtgcttctgagccgccccgagatcagtaccgatgagcgtgcctatcaaagacagctggtgatgacaatgggtgtggcggactctcaactgtttttctaccctcaactgctgcctattcacactctcgatgtgaagtctactatgctccctgccgcagtccggtgcagtgagtcacgcttgtcagaggagggtattttccttttggcaaacggcctgcatatgttcctgtggctcggagtgtcctcaccccctgaattgattcaaggcatcttcaacgtgccgtctttcgcacacatcaacacagatatgacgctgttgcctgaggtggggaatccttactcccagcagctccggatgatcatgggcataatccaacagaaacgaccttacagtatgaaattgacaatcgtgaagcaacgcgaacaaccagagatggtcttcaggcagttcctagtcgaagataaaggtctatacgggggatcctcatacgtcgatttcttatgttgcgtgcacaaggaaatttgccagttactgaattag

SEQ ID NO: 29803 - DNA, 1182 bp, Artificial Sequence
  Description of Artificial Sequence: Synthetic coding sequence
atgatcgacgtcagttattcaaatatcaaaaatggcctggttaaactgatctgtgaggagctgaagacgatgttggaaaaaatacccaaggaggaacaggaggaaacatctgccataagagtcggattcattacttacaataaagtcctacatttctttaatgtgaagagcaatctggcccagccccagatgatggtggtgaccgacgtgggtgaggtgtttgtgccgcttcttgatgggttcctggtgaattatcaggaaagccagagcgttatccataatcttcttgatcagattccggatatgttcgccgattctaatgaaaacgaaaccgtctttgcaccagtgattcaagctggcatggaagcccttaaggcggcagattgccccggcaaactgtttatcttccattcatcactgccaacagcagaagctcccggcaaattgaaaaacagggacgataagaagctcgtgaacacagacaaggaaaagatcttgtttcagccgcaaaccaacgtgtacgactccctggcaaaggactgtgtagcccacgggtgttcagtgactctcttcctctttccaagtcagtatgttgatgttgcatcactagggctggtgccccaattgacaggcgggaccctgtacaagtacaataacttccagatgcatctggatcgccagcaattcctgaacgacttgcggaacgacatcgagaagaagatcggctttgatgctatcatgcgcgtccgcacttccactggctttagagcaacagactttttcggaggaatcctgatgaataataccacagacgtggaaatggccgcaatcgattgtgacaaggcggtaacagtagaatttaagcatgacgataaattgagcgaggactctggcgcgttgatccaatgcgcagttctgtacacgaccatttccggacagagacggcttagaatacataatctgggcctcaattgtagctctcagctggccgacctttacaagtcctgcgagaccgatgcattgatcaacttcttcgccaagagcgcctttaaagctgtgttgcaccagcccttgaaagttatcagagagattctcgtcaatcagaccgcccacatgttggcctgctatcgtaaaaattgcgcttctccatcagcagccagccagttcacttgtgagaagtag

SEQ ID NO: 29804 - DNA, 1182 bp, Artificial Sequence
  Description of Artificial Sequence: Synthetic coding sequence
atgattgatgtgagttattcgaacattaagaacggcctggtgaaactgatttgcgaagagttgaaaaccatgttggagaaaataccaaaggaggagcaggaagaaacgtccgccataagagttgggttcattacatacaataaggtgctgcatttcttcaatgtgaaaagtaacctagcacagccccaaatgatggtggtcaccgatgtgggagaggtattcgtcccactcctggacggtttcctggtgaactaccaggaatcccagtcagtcatccataacctactggaccagatccccgacatgtttgctgacagcaatgaaaacgaaaccgtgttcgccccagtcattcaagccggcatggaggctctgaaagcggcggactgccctggaaaacttttcatctttcactcctccctgcccaccgccgaggctcccggcaaattaaagaatcgcgacgacaaaaaattagtaaacacagataaagagaaaatactgtttcagcctcagactaatgtgtatgactccctggccaaagattgcgtggctcacggctgctcagtgacactcttcctgtttccatcccagtacgttgatgtggcaagtcttgggctagtgcctcaactgacaggggggaccctctataagtacaacaacttccagatgcacctcgatagacagcagttcttgaacgatctgcgaaatgatatcgaaaagaaaatcgggtttgatgccatcatgagagtgcgtactagtacaggctttagggcaaccgacttctttggaggcatactaatgaataataccacagacgttgagatggcagcaatcgattgcgataaggccgtaacagtggaattcaaacatgatgacaaattgagtgaggacagcggagcattaatccaatgcgccgtgctgtatacgacaatatcaggtcagcgccgcttgaggattcacaatctaggactaaactgcagcagccagttggcggatctgtacaagagctgcgagactgatgccttaataaacttctttgctaaaagcgccttcaaagctgtgctgcatcagcctcttaaggtcattcgtgagattttggtgaaccaaacggcacatatgttagcatgttaccgcaaaaattgcgcttccccttcggccgcctcacagttcacctgcgaaaagtag

SEQ ID NO: 29805 - DNA, 2910 bp, Artificial Sequence
  Description of Artificial Sequence: Synthetic coding sequence
atggtcaaactggtgcttttgtcaatcgtgttgctcaaggtcactgtcccgaaattgtccaacgaccttttacagctggactttatgcctattcaccgcgggattctggctattgcttggtccatggcggaccccgaactcctcctaagttgcggaaaagacgctaaaatcctctgctctaaccctaatacaggagaggtgctttatgagctgccgacaaacacgcaatggtgtttcgatatacagtggtgcccccggaacccagctgtcctgagtgcggcttcctttgatggcaggatttccgtctactccatcatgggcggctctactgatggactgaggcagaaacaggtggataaactaagctcgagtttcgggaatttagatcctttcggaaccgggcaaccactgcctcctctgcagatccctcagcagactgctcagcacagcatcgtgttgccgctcaagaagccacccaaatggatcagacggcccgtgggcgcttctttttccttcgggggcaaactggtcacgtttgagaatgttcggatgccctctcatcaaggtgcggaacaacagcagcaacagcaccacgtattcattagccaggttgtgaccgagaaggaattcctgagtcggagcgaccaactgcagcaggccgttcagtctcagggattcatcaactattgccagaaaaaaatagacgctagccagacggaattcgagaagaacgtctggtccttcctgaaggtcaactttgaggacgattccagggggaagtacctcgaattgttaggctatcgcaaggaggacctcgggaaaaagcatatcaaagaggaaaaagaggagtcagagttcctgccaagttctggcggaacatttaatatttctgtcagcggggacatcgatgggctgatcacacaggctcttctcaccgggaattttgaaagcgccgtcgacttatgcctacacgataatcggatggccgatgctatcatcctcgcaatcgcggggggccaggaactactggccaggacacagaagaagtactttgccaaatctcagtccaagataacaaggcttatcaccgctgttgtgatgaagaactggaaagaaattgtggaatcatgtgaccttaagaactggagggaggctctcgctgcagtgctgacctatgctaagcctgacgagttcagcgccctatgcgacctcttgggcacccgcctggagaatgagggagattccctgctgcaaacccaggcctgtctttgctatatctgcgcgggtaatgtggaaaaactggtggcctgctggacgaaggcccaggatggatctcacccgcttagcctccaggacctgattgagaaagtcgtgatcctgcgaaaggctgtgcaattgacccaggcgatggatacttctacagtaggagtactgctggccgccaagatgagtcaatatgccaatctgctggccgcccagggctctatcgctgccgccctcgccttcctgcccgataatactaatcagcccaacatcatgcagttacgggaccggctgtgtagagcacagggcgagccagttgctggacacgagagccccaagatcccttatgagaagcaacagctgcccaaaggcagaccgggcccagtggctggtcaccaccagatgccaagagtccagacacagcagtattatcctcatgttaggatcgcccccacagtgaccacttggtctaataaaacccctaccgcgctgcccagccaccctcctgctgcaagcccttccgatacacagggggaaaatcctcctccacccggatttataatgcacggaaatgtgaatccaaacgctgctggacagctccccaccagtccggggcatatgcacacacaagtgccaccctaccctcaaccacaaccttatcagccggctcagccctatcccttcggtaccggaggatcagcaatgtatagacctcagcagccggtcgctccgccaacctcaaatgcctatcctaacaccccttacatttctagcgcttccagctatacaggtcagtcgcagctttatgcagcccaacaccaggcctccagtcctacaagtagccccgctacaagtttcccccctcctccatccagtggagcctccttccaacacggcggccccggggccccgccatcttcctccgcatatgcccttccccccggcacaaccgggccacaaaatggttggaacgatcctccagcgctgaatagagtgccaaagaaaaagaaaatgcccgagaatttcatgcctccagtgcccatcactagtccaattatgaaccctctgggcgacccccagtcacagatgttgcaacaacagccatccgcaccagtcccattatctagccagagctctttccctcagccacacttaccgggagggcagccattccacggcgtccagcaaccactgggccagaccgggatgccacctagtttctcaaaacccaacattgagggagcccccggagcacctatcgggaatacattccagcatgtgcagtctcttcccaccaagaagattacgaagaagcctatacccgatgaacacctgattctcaagactacttttgaagacctaatccaacgctgcttatcgtcagcaacagaccctcagaccaagcgcaaactggacgatgcttccaagcggctggaatttctctacgacaaattgagggaacagaccctaagcccaacaattaccagcggtctccacaacatcgctagatcaatagagactaggaattactcagaggggctaacgatgcacacacacatcgtctccacttctaatttcagcgagacgtctgcatttatgcccgtgttgaaagtagtgcttacacaggctaacaagctgggagtttag

SEQ ID NO: 29806 - DNA, 3321 bp, Artificial Sequence
  Description of Artificial Sequence: Synthetic coding sequence
atgaaactcaaagaggttgaccggactgcaatgcaggcttggtccccagcgcagaatcacccgatctatctcgccaccgggacttcagcgcagcagctcgatgccacgttttctactaatgcaagcctggagatcttcgaactggacctgtcggacccctcactggacatgaagagttgtgctaccttcagctcttcacacagataccataagctgatctggggaccttataaaatggattctaagggagacgtaagcggggtccttattgcaggcggcgagaatgggaatatcatcttatatgatccttctaagatcattgcaggagataaggaggtggtgattgcgcaaaatgacaagcacacaggccccgtaagagctctggatgtgaacatcttccagaccaacttagtggcttctggcgcgaacgagagcgagatttacatctgggatctaaataatttcgcaacacccatgactccgggcgcaaaaactcagccccccgaagacatttcctgtatcgcttggaacagacaggtgcagcatattctggcttctgcctctccttctgggcgggctacagtatgggatctcaggaaaaacgaacccattattaaggtctctgaccactctaacaggatgcattgcagcggcttagcatggcatcctgatgttgctacccagatggtcctggctagcgaggacgatcggctcccagtgatacagatgtgggatcttagattcgcaagctcaccgctgagagtactcgagaaccacgctcgcgggattctggcaatcgcttggagcatggcagacccggaattgcttctatcctgcgggaaagatgcaaagattctttgttcaaaccctaacaccggtgaagtcctttacgagttgcccacaaacactcagtggtgtttcgacatccagtggtgcccgcgcaatccggccgtcctgagcgccgctagcttcgacggaagaatctctgtgtactcaataatgggaggaagtaccgacgggttgcgccagaaacaggtagataaattgtccagtagcttcggaaaccttgatcctttcgggacgggccagcctcttcctccattacagattccgcagcagactgctcaacacagcattgtactgcccctgaagaagccacccaagtggattcgcaggccggtgggtgcatcattttccttcggtggcaagctggttacattcgaaaacgtgcgtatgccgtctcatcagggggccgagcagcagcagcagcaacatcacgtgttcatcagtcaggtggtgaccgaaaaggagttcctatctagaagtgatcagcttcagcaggccgtccagtcccagggctttatcaattattgccagaagaaaatcgatgcatctcagaccgaatttgagaagaatgtctggtcttttttaaaggtcaactttgaggacgattccagggggaaatacctagaactgctcggttaccgaaaggaggatctgggcaaaaagatcgcgctggcactcaacaaggtggacggggcaaatgtcgcactgaaagattctgaccaggtggcccagagcgatggtgaggagagtcccgcggccgaggagcaacttctgggcgagcacattaaggaagagaaggaggaatccgaatttctgccctcctctggtggtaccttcaacataagcgtttccggcgacatcgatggactaattactcaggcgctccttaccggcaatttcgagagtgctgtggatttatgccttcacgataataggatggctgacgctatcattctggctatcgccggaggacaggagttgcttgcccgaacccaaaagaagtatttcgcgaaaagccagtccaagatcacccgtctgattactgcagtagtgatgaagaattggaaagaaatcgtggagtcctgtgacctgaaaaactggagagaggccctcgccgctgtgctaacttatgcgaagccggacgagttttccgccttgtgtgacttgttgggcactcgcttggagaacgagggcgattcattactgcaaacccaagcctgcctgtgctacatctgcgccgggaatgtagagaaactggtggcctgttggaccaaggcgcaggacggatcccaccccctatccctgcaggacctgattgagaaggtcgtgatcctgcgtaaggccgtccagctgactcaggcgatggacacatcgacagttggtgtgcttcttgctgctaaaatgagccagtacgcaaatcttttggctgcccaaggttctatagctgcagctttagcctttctgcctgacaataccaatcagccaaatatcatgcagctgagggataggctttgcagggcgcagggggaacctgttgcggggcatgagagtcctaaaatcccctacgagaaacaacagcttccaaagggcagacctggcccagtggctggacatcatcaaatgccgagggttcagacccagcaatactatccccatggagaaaatcctcctccacccggcttcatcatgcatgggaatgttaatcctaacgcagctgggcagctgccaacgagccctggtcatatgcatacccaggtgccgccttatcctcagccacagagaccacaaaacggatggaacgatcctccggcactcaaccgagttcctaagaaaaaaaagatgcccgagaacttcatgccaccggtgcccataacctctcccatcatgaatcccctgggagatccccaatctcagatgctgcagcagcagcccagcgccccagtgcccttgagcagccagtcctcattcccacagccccacctgcccgggggccagcccttccatggcgtgcaacagccattgggacaaaccgggatgcccccgagcttctccaagccgaatatagagggagcccctggagccccaattggaaacacctttcagcatgtgcagtctcttccaactaaaaagattactaaaaaaccaattcccgacgagcatctgatcctgaaaaccactttcgaggacctgatccaacgatgcttgagctcagctacagatccacaaactaaaagaaagctggacgatgcttccaagcgattggagttcttatacgataagctccgggagcagactcttagcccaacaatcacctccggcttgcataatatcgctagatcaattgagacgcgaaattacagtgaggggctgactatgcatacgcatatcgtgagtacaagcaatttctccgagacgagcgccttcatgcctgtgctgaaagtggtcctgactcaggctaacaagttgggagtttag

SEQ ID NO: 29807 - DNA, 3546 bp, Artificial Sequence
  Description of Artificial Sequence: Synthetic coding sequence
atgaagctaaaagaggtagaccgcaccgcaatgcaggcttggtcccccgcccagaaccatccgatctatctggcaactggcacgagcgcacagcaactggatgccacgttttcaaccaatgcctccctggagatcttcgagctggacttaagtgacccttccctggacatgaaatcctgcgccaccttctcctcctcccataggtatcacaaactcatttggggcccttacaagatggattccaagggcgacgttagcggcgtgctcatcgccggcggcgagaacggcaatatcattctgtacgacccttcaaaaataattgcaggagataaagaagtggtcatcgcgcagaatgacaaacatactggtccagtgagagctctcgatgttaatatattccagaccaacctggtcgcaagcggcgccaatgaatcggaaatatacatctgggaccttaacaactttgccacccccatgacccctggcgctaaaactcagccgcccgaagacatctcttgcatcgcctggaacaggcaggtacagcacatcttagcatccgcctctccctccggcagagcgaccgtctgggatttgagaaagaacgaacccatcataaaagtcagcgaccatagtaacagaatgcattgcagcggacttgcctggcaccctgatgtggccacccaaatggtactggcgtcagaagatgatcggctgcctgtcatacagatgtgggatctaagattcgcctcctctccactgcgggtgcttgagaaccacgcccgcggcattctggccattgcttggagtatggcagaccccgagcttctcctgagttgcggaaaggatgctaagatcctttgctcaaaccccaatacgggagaagtgttgtatgaactgcccacaaatacccaatggtgttttgatatacaatggtgcccccgcaacccagctgtgctctctgcagcctcattcgacggcagaatctccgtgtactcaattatgggagggtccaccgacggattacgccagaaacaggtggataaacttagctctagctttggcaacctggacccctttggcacggggcagcccctgcccccgctccagattccacagcaaacagcacaacactccattgtgctgccgctgaaaaagcctcctaagtggattcggcggccagtgggtgcgtctttcagtttcgggggaaagctggttacattcgagaacgtcagaatgcctagccaccagggagctgaacagcagcagcagcagcaccacgtgtttatttcacaggtggtgaccgagaaagaatttttgagcaggtcagaccagctccaacaagcagtgcaatcacagggtttcatcaactactgtcaaaagaagatcgatgcttcccaaacagaattcgaaaagaatgtgtggagcttccttaaagtgaactttgaggacgattcccgggggaagtacttggagctgctcggctaccggaaagaagacctcgggaagaaacacatcaaggaggagaaggaagaatctgagttcctgccctcaagcggaggcactttcaacattagcgttagcggcgacatcgacggattgatcacacaggcactcctcaccggtaacttcgagtccgctgtagacctgtgtctccacgataaccgaatggccgacgctataattctagccattgcgggaggacaagagcttctagccaggacccagaagaagtactttgccaagagtcaatccaagatcaccagattgattaccgcagtcgtgatgaagaactggaaagaaatcgtagagtcttgcgaccttaaaaactggagagaggcgctcgccgcggtcctgacatacgccaagcccgatgaatttagtgccttgtgtgatctcctggggacccggttggaaaacgaaggcgactcgttgctccagactcaggcttgcttgtgctacatctgcgctggcaacgtcgagaagctggtggcttgctggactaaggcgcaagatggatcacacccactgtccctgcaggatcttatcgaaaaggtggtgatcctgaggaaggccgtgcaattgacccaagctatggatacatccactgtcggggtcctgttggcagcgaagatgagccagtacgcgaatctgctggctgcacagggaagcatcgccgcagccctggcctttcttcccgataataccaaccagccaaacatcatgcagctccgggataggctttgtagagctcaaggggaacctgtcgcaggccatgaaagtcccaaaataccttatgaaaaacagcagctgcccaaggggaggccaggtcccgtggcaggccaccatcagatgcctagagtgcagacacagcagtactaccctcatggagagaatccgcccccacctggattcatcatgcacggtaatgtcaatcccaacgcagccggccagctgccaacaagcccgggacacatgcacacccaagtgccaccctacccacagccacagccctaccaaccagcccagccttacccttttggtaccggggggtctgctatgtaccggccccagcagcccgtagcgcccccgacttcaaacgcctacccgaacaccccttatatctcgtctgcgtcttcctacaccggacagagccaactctatgccgcacagcaccaagccagttctcctaccagctcccccgccacaagctttcctccccccccaagttctggcgcttcatttcagcacggcggaccaggcgcccccccgtcctcaagtgcatacgctcttccgcctgggacgaccggcactttaccagctgcttccgagttaccggcgagccaaagaaccgggcctcagaacggctggaatgacccccctgccttaaatagagtgcctaagaaaaagaagatgccggagaactttatgcctcctgtcccgattacaagccccattatgaatccactgggagatccgcaatctcagatgctacagcagcaaccctcagcaccggttcctctgtcgtcacagtcatctttccctcagccgcacctgcccggaggtcagcccttccacggtgtgcagcagcccctgggtcaaacagggatgccacccagttttagcaagcccaacattgaaggcgccccaggcgcccctatcggaaataccttccagcatgttcagtctctgccgacaaaaaagatcacaaaaaaacccatcccagacgagcacctgattctgaaaaccaccttcgaagacttaatacaacgctgtctgtctagcgctacagatccacaaactaagagaaaactggatgatgcttcaaagcggctggaatttttgtacgataaactgagggagcagacccttagtccaaccatcactagcgggcttcataatattgctaggtccatcgagactcgaaattacagcgaaggcctcacaatgcatacacatatcgtatccacctccaattttagcgaaactagcgcttttatgccagtcttgaaggtggtgttgacccaggctaacaaattgggcgtgtag

SEQ ID NO: 29808 - DNA, 3546 bp, Artificial Sequence
  Description of Artificial Sequence: Synthetic coding sequence
atgaaactaaaggaggtggaccggactgccatgcaagcctggagccctgctcagaaccacccaatctatcttgctaccggaacctcagctcaacagttggatgccaccttcagtaccaatgcctccctcgaaatttttgagctcgacctgagcgacccgtctctggacatgaaaagctgtgccaccttcagtagctctcatagataccacaaattgatatggggaccgtataagatggacagtaaaggcgatgtgtcaggtgtgctgattgctggaggagaaaatgggaacattatcctctatgacccttcaaagatcattgcaggtgacaaggaagtcgtcatcgcccagaatgataagcacaccgggccagttcgcgccttggacgtgaacattttccagacgaacttggtggccagtggggctaacgagtcagagatttatatctgggatctgaacaatttcgctactccgatgacccctggcgccaaaacccagccacctgaggacatttcatgtattgcatggaatcgccaggtccaacacattctggccagtgctagtccttcaggaagagcaacagtgtgggacctccggaagaatgagcctatcattaaagtgtccgaccattctaatcggatgcactgttctgggcttgcctggcatccagacgttgccacacagatggttctggcttcagaggatgatcggctcccggttattcagatgtgggacctccgatttgcgtcatcgccccttagggtccttgagaaccatgcacggggtattctggcaatcgcctggtctatggcggaccccgagttattactgagctgcggtaaagatgcgaaaatactctgttctaaccctaacacgggcgaagtgctgtatgagctgccaactaatactcagtggtgtttcgatatacaatggtgccccagaaatcccgccgtgctgtctgccgcttcctttgacggacgaatttcagtgtatagcattatgggtggatctaccgatggcttgcggcagaagcaggtcgacaaattgtccagtagtttcggaaatcttgaccccttcggcactggccagccattgccaccgcttcagatcccccagcaaacagcacaacatagcatcgtgctgccactgaaaaagccgcccaaatggatccgaagaccggttggagcgtcttttagctttggaggcaaattggtgacttttgagaacgtgagaatgccatcccaccagggtgccgagcagcaacaacagcagcatcatgtatttatctcacaggtagtcaccgagaaggagtttttgtctcgatccgatcagctacagcaggccgtgcagtctcaggggtttatcaactattgtcagaagaaaatcgacgccagccagacagagttcgagaagaacgtatggtccttcctcaaagttaatttcgaagacgacagccgcggcaagtacctagaactactcggctatcgtaaagaggatttagggaagaagcacatcaaagaagaaaaggaggagtccgaattcctgccttccagcggcggcacctttaatatcagcgtcagcggtgacattgacggcctgattactcaggctttactgactgggaactttgagtccgcggttgacctgtgcctccacgacaaccggatggccgatgcaatcatactggccatcgctggtgggcaagaactgttggctagaacacagaagaagtacttcgctaaatcacagagtaagatcacccgactcatcaccgcggtggtgatgaagaactggaaagagattgtggaatcatgcgatctgaagaactggagagaagctctggctgcggtgctgacctacgcaaagcccgatgagttcagtgcactttgtgacctcctcggaacaaggttagagaacgaaggtgacagcctgctgcagacccaggcctgcctgtgctatatctgtgcagggaatgtagaaaaactggtcgcttgctggacaaaagcacaggatgggtcccatcctttgagtctgcaggacctgattgagaaggtggtcatcctccggaaggcagtacagctgacccaggccatggacacttctacggtgggcgtgctcctcgccgctaaaatgtcccagtacgcaaacttgctggctgcccagggcagtatagcggcggccttagcattcttgccagacaacaccaaccagccgaatatcatgcagctccgggacagactgtgtcgggcacaaggcgagcctgtcgccgggcatgagagcccaaagattccctatgaaaagcagcagctaccgaagggtcggccaggtcctgtggctgggcatcatcagatgccacgggtccagacccagcaatactatccccatggcgagaacccacccccacctggcttcattatgcatggcaatgtgaacccgaacgctgcaggccagcttccaactagtccgggccacatgcacacacaggttcctccttaccctcaaccccaaccctaccagccagcccagccctatccttttggaaccggggggtcagctatgtatcggcctcagcagcccgtagcacctcccacatctaacgcctatcccaacaccccttacattagcagtgcttcctcatacactgggcagagccagctgtacgctgcgcagcatcaggccagtagtcctacttcctcccctgcgacttcatttcccccgccaccgtcctccggtgcttctttccagcatgggggaccaggcgcgccgccaagctctagtgcctacgccctcccgccagggacaaccggcactttgccagctgctagcgagctgccggcatcccaacggacgggcccccagaatgggtggaacgaccccccagctctcaatcgcgtgccgaaaaagaaaaagatgcccgagaattttatgcccccagtacccattacaagtcccattatgaacccactcggtgacccccaaagccagatgctccagcagcaaccctctgctcccgtgcccttgagctctcagagctccttcccacagcctcacctgcccggaggtcaaccattccacggagtccagcaaccactggggcagaccggaatgccgccatcttttagcaagcccaatattgagggcgcaccaggcgcacccatcgggaatacttttcagcatgttcagtccctgccaactaaaaaaatcactaagaaacctatcccggacgagcatttgatcctgaagacaacatttgaggatctgatccagcggtgtcttagctccgccacagatccacaaacaaaaagaaagttagacgacgctagtaaacgcttagaattcttgtacgacaagctgcgggagcaaaccctatctccaaccatcacctcagggctccacaatatcgcaaggtcgatagagactcgtaactacagtgaagggttaacaatgcatacacacattgtatccacgtccaacttcagcgaaacttcagcttttatgcccgtgctcaaggtcgtccttacacaggccaataaactgggggtgtag

SEQ ID NO: 29809 - DNA, 3663 bp, Artificial Sequence
  Description of Artificial Sequence: Synthetic coding sequence
atgaagctcaaggaggtggatcggacagcaatgcaggcatggtctcctgctcagaaccatcctatttatttggctacaggaacttccgctcagcaacttgatgccaccttttccacgaatgccagcttagaaatctttgaattagaccttagtgacccgtcattggacatgaagagctgcgctaccttcagtagctcacatcggtatcacaagcttatttggggaccctataagatggactctaaaggggatgtgtccggggtgctgattgcaggcggcgaaaatggcaatatcatcttgtatgacccttcaaaaataatcgctggcgataaagaggtcgtcattgcccagaatgataagcacactggacctgtccgggcacttgacgtgaacatttttcagacaaatctggtggctagcggagctaatgagtccgaaatatatatttgggatctaaataatttcgccacacctatgaccccaggcgcaaagacacaaccccctgaagacatctcctgtattgcatggaaccgacaggtccaacacattctcgcttccgcctctccctccggacgcgcaaccgtatgggacttaagaaagaatgagccaatcatcaaggtatcagaccacagtaaccggatgcactgcagcgggcttgcctggcaccccgatgtggcgactcagatggtgttagcaagtgaggacgaccggctgcctgtcattcaaatgtgggatctccgcttcgccagctctcccctgcgtgtgctggagaaccatgcccggggcattttggccattgcttggtcgatggcagacccggaacttctcctgtcctgtggaaaagatgccaagatcctctgcagtaatccaaacacaggggaagtgctatacgaattaccgaccaacacccagtggtgtttcgatatccagtggtgtccccggaatcccgccgtcttatcagctgcatctttcgacggcagaattagcgtgtattcaatcatgggcggatctacggacgggctgagacaaaaacaggtagacaaattatcctcatcctttgggaacctcgatcctttcggaacaggccagcctttaccaccactccagatccctcagcagactgcccagcactcaattgtacttcccctgaaaaagcctccaaagtggatcaggcgacctgtcggcgcaagcttcagctttggcggcaaattggttacatttgagaatgtacgtatgcccagccatcagggggcagagcagcagcagcaacagcaccacgttttcatttcacaggtagtaacagaaaaagagttcctgtcccggtctgaccaactgcagcaggcggtgcagagccaaggtttcatcaattactgccaaaagaaaattgacgcatcgcagacggaattcgagaaaaatgtttggtcattccttaaggtcaatttcgaagacgattctagaggcaaatacttggagctgctcggatatcggaaggaagatctagggaagaagattgctttggctttgaacaaagtagatggggctaacgtggccttaaaagactccgaccaagtagcacagtccgatggagaggaatctcctgctgccgaagaacagttgctcggcgagcatattaaagaggagaaggaagaaagtgagtttttgcctagttcgggggggaccttcaacatttctgtatcaggggatattgacggcctgatcactcaggccttgcttacaggcaattttgagagcgcagttgacctctgcctgcatgataatcgtatggctgatgccattatccttgctatagctggcggccaggagctcctggcacgcactcagaagaaatacttcgcgaagtctcagagtaagataactagactcatcacggctgtcgtgatgaagaattggaaagaaatcgttgaaagctgcgatctgaaaaattggagggaggctttggccgccgtacttacttatgccaagccagatgagttctctgccttgtgcgacctgctggggactaggctggagaatgaaggcgattccttgctacagactcaggcatgtctgtgttatatctgcgccggcaatgtcgaaaagctcgtggcatgttggaccaaagctcaggatggctcccaccctctgtcactgcaggacctcatcgaaaaggtggttattctgcgaaaagctgttcaactgacacaggccatggatacaagcactgtgggagtcctactggccgccaagatgtcccagtatgccaatttactggcggcccaagggtccattgccgccgccctggcgtttctgcccgacaacacaaaccagccaaacatcatgcagctgcgcgacaggctgtgccgagcccagggcgagcctgtggctggccacgaatcccccaaaattccgtacgagaagcagcaactgcccaagggcagacccgggcccgttgctggccatcaccagatgccaagggtgcagactcaacagtattaccctcatggggaaaacccaccaccacccggattcattatgcatggcaacgtcaatcccaatgctgctgggcagctgcctacgtctcccggacatatgcacactcaggtgccgccatatccgcagcctcaaccctatcaacccgcccaaccatacccattcggtacaggtggatcagccatgtacaggccccagcagccagtcgctccaccgacatccaatgcctatccaaataccccctacatctccagcgcgtccagctataccggtcagtcacagctgtatgctgctcagcatcaggcctccagcccaaccagctctccagcgacatctttccctcctccaccgagttctggggcaagcttccagcacggggggcctggagcccctcctagcagcagcgcttacgcactgccccctgggaccactggcacacttcccgcggcctcagagctgcctgcctcgcagcgcaccggcccccagaatggctggaatgacccacccgcccttaatagggttccaaagaaaaaaaagatgcccgagaactttatgcccccagtgccgatcacaagccctatcatgaatccactgggagaccctcaatcacagatgctgcaacaacaaccatctgcccccgtccctctgtctagtcaatctagctttccccaacctcatctgcccggcggacagcccttccatggcgtgcagcagccattgggtcaaaccggtatgccaccatcattctcaaagcccaatatcgagggcgcccctggagccccaattgggaatacgttccagcacgtgcagtcgcttcccactaagaaaatcacaaaaaagcccatccctgacgagcatctgatcctaaagaccacattcgaggacctgattcagcgatgtctatcaagtgctacagatcctcagactaaaagaaagctagacgatgcaagcaagaggctggagttcttatatgacaagctgagggagcagacacttagccccacaataacgtccgggctgcacaacattgccaggtcaattgaaactaggaactatagtgagggtttaacgatgcacactcacatcgtgtctacatccaatttttcagagacatccgcctttatgcctgtactgaaagtcgtgcttactcaggccaataaattaggggtctag

SEQ ID NO: 29810 - DNA, 3663 bp, Artificial Sequence
  Description of Artificial Sequence: Synthetic coding sequence
atgaagctcaaggaggttgaccggacagccatgcaggcttggtcccccgcacagaaccacccgatctacctggcaaccggaacatctgcccagcaactggacgctacgttttcaacaaacgcctcacttgagatcttcgagctggacctatccgatccctcactggacatgaagtcatgtgctaccttttcaagttcccaccgataccataagctcatttggggcccatacaaaatggattcgaaaggagacgtctctggcgtgctaattgctggaggagaaaacggcaatataattctgtatgatccttctaaaataatagctggtgataaggaggtagtaatcgcccagaatgacaaacatacaggtcctgtacgggccctggacgtcaatattttccagaccaacctggtggcctctggagcgaatgagtcagaaatctacatctgggacctcaacaatttcgctactcctatgacccccggggccaagactcagccccccgaggatatatcgtgcatcgcctggaatagacaggtgcagcacatactcgcctcggccagccctagtggacgtgccacagtttgggacttgagaaagaatgagcctatcatcaaggtgtcggaccattctaacaggatgcattgctctgggctagcttggcacccagacgtcgccacccaaatggtcctcgccagcgaagatgacaggttacccgttatacaaatgtgggatcttagattcgcgagcagtcccctcagggtgctggagaatcacgcgagaggtattctggctatcgcttggagtatggccgatcctgagttgctgctgtcgtgcggcaaggatgctaagatcttgtgttccaaccctaataccggggaagtgctgtacgagctaccaacaaacactcagtggtgctttgacatccagtggtgtcccagaaatcccgccgtcctgtccgcagcatccttcgacggtcgcatctccgtgtacagtatcatgggaggtagcactgatggcctgcgccagaaacaagttgacaaactgagcagctcattcggaaatctggatccgtttggaaccgggcagcctctgccgccgcttcagatccctcagcagactgcgcagcattctatcgtcctgcctctcaaaaaaccacccaagtggatccggcggcctgtgggcgcgagctttagctttggtgggaagttggtgaccttcgagaacgtgcgtatgccctctcaccagggcgcagagcagcagcaacagcagcatcatgtgttcatttcccaggtcgtgactgagaaagaattcttgagtcgcagtgaccagcttcagcaggctgtccagtcacagggtttcatcaactactgtcaaaaaaagatcgacgcgagtcagacagagttcgagaagaacgtctggtcttttttgaaggtcaacttcgaagatgactcacggggtaaatacctggagctgctcggctacagaaaggaagatctggggaagaagatcgccctcgcactgaacaaggttgacggagctaacgtggccctgaaagactctgatcaagtggcgcagtccgatggcgaggaatcacccgccgctgaagagcagctgcttggggagcatattaaggaggaaaaggaagaaagcgaatttctgcccagctctgggggcacattcaatatatctgtgtcgggtgatattgacggtctgatcacccaggcactgctgactggcaacttcgagtctgcggtcgacctgtgcctgcacgacaacagaatggcagacgcaattatattagcaattgctggcggtcaagaactgctcgctaggacacaaaaaaaatacttcgccaagtcccagagcaagatcactagattgattacggctgtcgttatgaagaactggaaggagatagtggaatcttgtgatctgaaaaattggcgtgaagcccttgcagccgttctgacgtacgctaaaccagacgagtttagtgcactctgtgatttgttagggacaaggcttgagaacgagggcgactccctcctgcagacacaggcttgcctctgctatatatgcgccggaaatgtggagaagcttgtggcttgttggaccaaagctcaggatgggtcacatccgctttcccttcaagacttaatcgagaaggtagtgatcctgagaaaagccgttcagttaacccaggcgatggatacgagtacagtgggcgttcttctggctgcaaagatgagtcaatatgcaaacctcctggccgcgcagggctcaattgccgccgctctggccttcctcccagataacacaaaccaacctaacatcatgcagcttcgggatagactttgccgggcccaaggcgagccagtcgccgggcacgaaagcccgaagattccatatgaaaagcagcaactgcctaagggcaggcctgggccggtggcgggccatcaccaaatgccaagagtgcagacccagcagtactaccctcatggtgagaatcctcctccgcccggtttcattatgcatggtaacgtcaatccaaatgctgctggacaactgccgacgtctcccggtcacatgcacactcaggttcccccttacccacaaccccagccatatcaacccgcacaaccctacccatttggcactggcggtagcgctatgtaccggcctcagcagcccgtggcacctccgactagcaacgcctacccgaataccccatacatttcttcggcgagctcttacacaggacagagccagttatacgccgctcagcatcaggcatcatctccgacttccagcccggccacatccttcccaccacctcctagcagtggagcaagtttccagcacggagggcccggggccccgccgagttctagtgcgtatgccctgccgcccggaaccacagggaccctgccagcagccagcgagctgccagcgtcacagagaactggcccccaaaatggctggaatgaccctcctgccctgaaccgcgtcccaaagaaaaaaaagatgcctgaaaatttcatgcccccagttccaattacctcccctataatgaacccacttggagatccccagagccagatgctgcaacaacaaccttctgcccccgtgcctctttcgtctcaatccagctttccgcagccgcatctccccggcggacaacctttccatggagttcagcagcctctgggacaaacaggaatgccaccatccttctctaagcccaacatcgagggggcccctggagcgcctattggaaatacttttcagcatgtgcagtccctgcccaccaagaagataactaagaagcccatcccagacgaacatctcattctcaaaacaacattcgaagacttaatacaacggtgtctctccagcgccaccgacccacagacaaagcgaaaactggacgacgcctccaaacgcttggagtttctttacgataaattacgggagcagacgctgtcaccaacgattacttcaggcctgcataacattgccaggtcaatcgaaaccagaaactattctgagggactgaccatgcatacccacatagtctctacgagcaatttttccgagacgagcgcctttatgccggtgctcaaggtggtcctcacccaggccaataagctcggcgtctag

SEQ ID NO: 29811 - DNA, 3702 bp, Artificial Sequence
  Description of Artificial Sequence: Synthetic coding sequence
atgaagttgaaggaggtcgatagaacagctatgcaggcttggagccccgctcagaatcatcccatttacctggcaacgggaacgtcggcccagcagctcgacgccacattctcaacgaacgccagcctggaaatctttgagctggatttaagcgatccgtccttagacatgaagtcatgtgccacattcagtagttcacaccgatatcacaagctgatttgggggccatacaaaatggattcgaagggagacgtgtccggcgtcctgatagctggcggagagaacggtaacataatcctgtatgacccaagcaaaataatcgctggagacaaagaagtggtgatagcacaaaatgacaaacatactgggccagtgagagccctggatgtaaatattttccaaactaatctcgtggctagcggggcaaatgagagcgaaatttacatttgggatttgaataactttgcaactcccatgacgccgggcgccaagacacagccaccagaggatattagttgtatagcttggaacaggcaggtgcaacatatcctggccagcgcttctccctccggacgtgccaccgtttgggatctaagaaaaaatgagcctatcatcaaagttagtgaccactctaatcgcatgcattgtagtggtctcgcctggcaccctgatgtggctacccagatggtgttggcatcggaggacgaccgtctgccagtgatacagatgtgggatttgcgctttgctagtagcccactgcgggtcctggagaaccacgctaggggcattcttgccatcgcctggtctatggccgatccagagttgctgctgagctgtggcaaagacgccaagattctctgcagtaaccccaacactggtgaagtcctctatgaactacctacaaacactcaatggtgtttcgatattcagtggtgccccagaaacccggccgtgctctccgccgccagctttgatggcaggatcagcgtctactctatcatgggaggttcaaccgacggcctccggcaaaaacaggtcgacaaattgagcagtagctttggcaacttggaccctttcggtacaggtcaacccctgccaccactgcagatccctcaacagactgcgcaacattcaattgtgctccccttgaagaaacctcccaagtggattcgcaggcctgtgggcgcctctttctcctttggtgggaaattggtcacttttgaaaatgtgcgcatgccttcgcaccagggggcagagcaacaacagcagcagcatcatgtattcataagccaggtagtcaccgaaaaagaatttctttctagatcagaccaactccagcaggccgtacaatcacagggctttataaattattgtcaaaagaagatcgatgcttcccagacggagttcgagaagaatgtttggtcctttttgaaagtcaattttgaggatgacagccgcggaaagtatctagagttattgggttacagaaaggaggatcttggaaagaaaatcgcactggcactgaacaaggtggatggggctaatgttgccttaaaggattccgatcaggtggcgcagtcagacggggaggaatccccggcggcagaagagcagctgctgggcgaacacatcaaggaggaaaaggaagagtccgagttccttccgagctcgggcggaacttttaatataagcgtaagcggcgacattgacggactgattacccaagccctcctgaccgggaactttgagagtgctgtagatttgtgcctgcatgataacagaatggcagatgcaatcatcctggccattgctgggggccaggaactgctggcgaggactcagaaaaaatacttcgcgaagtctcagagcaagataacccgcctgataactgccgtcgtcatgaagaactggaaggaaattgtcgagagctgtgatttgaagaattggagggaggcactcgccgctgtactgacatatgccaagcctgatgagttcagtgccctgtgcgacctgctgggaactcggttggagaacgagggagatagcttgttacagactcaggcatgtctttgctacatctgcgcaggcaacgtggaaaaactcgtcgcctgttggactaaggcccaggacggaagtcacccactaagtcttcaggacctcattgaaaaggttgtgatcctacggaaggcagtgcagctgactcaggcgatggatacgtcaaccgtgggggtgcttcttgctgccaagatgagccagtacgccaatctgttggcggcccagggctccatagccgcagctctagcatttctccctgacaatacaaaccaacccaatattatgcaactccgcgaccgcttatgtagagcccagggagagccggttgccgggcacgagtcccctaagattccctatgagaagcagcagctgccaaaaggtcgccccggacctgtggctgggcaccaccagatgcctcgcgtccagactcaacagtattacccccatggcgaaaaccccccaccccccggattcataatgcacggcaacgtgaatccgaacgctgccggccagctgcctacatctcccggacatatgcacacacaggtccctccctatccccagccacagccatatcaacctgctcagccttaccccttcgggaccggaggcagtgcaatgtatcgacctcagcagcccgtggccccgcccacttcaaacgcttaccctaacacaccatacatcagttccgcatcatcctatacaggccagtcacagctgtacgccgcacagcatcaagcgtcctctcctacatcatcacccgcgacctccttccctcctcccccatcctccggcgcgagtttccagcatggcggaccaggcgcgccgccaagcagctcagcatatgcgctgccaccaggaaccacagggacgctgccagccgctagtgagctgcccgcgtctcagcgcacggagaaccagagtattcaggaccaggcgcctatgttggagggtccccagaatggatggaatgatccacctgccctcaaccgggtcccaaaaaaaaaaaaaatgcctgaaaactttatgccgcccgtgccaataacaagtccaatcatgaatccactaggcgacccccagagtcagatgcttcagcagcagccctccgcgcccgttcctctttctagccaatcatcctttccgcaacctcacttgccgggtggtcaaccttttcacggtgttcagcagcccttaggccagaccggcatgcctccctcattctcaaaacccaacatcgagggagcccccggtgctccgataggcaacacttttcagcatgtgcaaagtttacctacaaagaaaattacaaagaagcctatccccgacgagcacctgattctgaaaactactttcgaagatctcatccagagatgcttgagcagtgccacagatccccaaacgaagcgaaaactcgatgatgccagcaagcgcctggagttcctgtatgacaagttacgcgaacagactttgagccccacgatcacttcagggctgcacaacatcgcacgcagcatcgagacaagaaactacagcgagggcctgacaatgcatacgcatatcgtgtccacgtccaattttagcgagacctctgcatttatgcctgtcctgaaggtcgttctgacacaagccaataagctgggagtatag

SEQ ID NO: 29812 - DNA, 3663 bp, Artificial Sequence
  Description of Artificial Sequence: Synthetic coding sequence
atgaaactaaaggaggtggacagaaccgcaatgcaagcgtggtccccagctcagaaccaccccatctatcttgctacgggcaccagcgcacaacagctagacgccacattcagcactaacgccagccttgagatcttcgagctggacctgtcggatccctctctagatatgaaatcctgcgccaccttcagtagctcacacaggtatcataagttgatctggggcccttacaaaatggattcaaaaggtgacgtctccggcgttctgatagccggcggcgaaaatgggaacataatcctatatgacccttcaaagatcatcgcgggtgataaggaggtggttatcgcacaaaatgataagcatactgggccggtgagggcccttgacgtcaatattttccagacaaacctggtggcctcgggtgctaacgaatccgaaatctatatctgggatctgaataatttcgctaccccaatgacacctggggcgaaaacccaaccccccgaagacataagctgcattgcttggaaccggcaagtgcaacacatcttggctagcgcctcccctagtggccgtgcgacagtctgggacctgcggaaaaacgaacctatcatcaaggttagcgatcacagcaacagaatgcattgctccgggctggcctggcacccagacgtggctacccaaatggttctcgcctctgaagacgacaggcttcccgtgatccagatgtgggatttgcggtttgcttcctctcctttaagagtcctggagaaccacgcccgcgggattttggccatcgcctggtctatggcggatccagagctgctgctcagctgcggcaaagacgccaagattctgtgttccaacccaaacactggggaggtcctctacgagctcccaacaaacactcaatggtgttttgatatccagtggtgtccacgaaatccagccgtgttatcagccgcaagctttgacggaagaatctccgtgtacagcattatgggcggaagcactgacggcttgcggcagaaacaggttgacaaattgtctagtagctttggtaaccttgatccctttggcacaggtcaaccactgccccccctgcagatcccacagcagaccgcacagcatagcatagtcctacccctcaaaaaaccccctaagtggattcgtaggccagtgggagcaagtttctcatttgggggaaagttggtcacttttgagaatgttcggatgccatcacatcagggtgccgagcagcagcagcagcaacaccacgtctttatttcccaggttgtgacagagaaggaatttctaagcagaagtgaccagctgcaacaagctgtgcagagtcaggggtttattaactattgccagaagaagattgacgctagccagacagagttcgagaagaatgtctggagttttctgaaggtgaactttgaagatgacagcaggggaaagtacctcgaacttctcggataccgcaaagaggacctaggaaagaagatcgccctcgcactcaacaaagtcgacggggccaatgtggctctgaaggacagcgaccaggttgcacagtcggacggagaagagtctccagctgccgaggaacaactgcttggcgagcacatcaaagaggagaaagaggaaagtgagttcctgccttcctccgggggaacatttaatatctccgtttcaggcgatattgacgggctaattacacaggcacttctgacagggaactttgaaagcgcggtggacctgtgccttcatgataatagaatggctgacgctattatactcgctatcgctggaggccaggagttactggcccggacacagaagaagtatttcgcaaagtcccagagtaagatcaccaggttaatcacagcagtagtgatgaagaattggaaagagattgtagagtcttgtgatcttaaaaactggagggaggcactggcagcggtgctgacctacgccaaacccgatgaattttccgctctgtgtgatttgctgggaacccgtctcgagaatgaaggcgatagtcttctgcagactcaggcctgcctgtgttacatctgtgccggtaacgtggagaagttggttgcatgctggacaaaagcccaggatggatctcatccgcttagccttcaggacttaattgaaaaagttgtgattttgagaaaggccgttcagttaacacaggccatggatacgagcaccgtgggcgtgctattggcagccaagatgagccagtatgccaatctccttgccgctcagggtagcatcgccgccgcgttagcatttcttcctgacaatacaaatcaaccaaatattatgcaactccgggatcggctatgccgggctcagggtgagccagtggcaggacacgagtcacccaagattccctacgagaagcaacagctgcccaaggggcgccctggccctgtcgccggacatcaccagatgccaagggtgcagactcagcagtattacccccatggggaaaaccctccaccaccaggtttcataatgcacggaaacgtcaaccctaatgccgcgggtcagctgcccacctccccaggtcatatgcatacccaggtcccaccttacccccagcctcagccctaccaaccagcccaaccatacccattcggcactggtgggagcgcaatgtacagacctcagcaacccgtggcaccccccacgtccaacgcttaccccaatacaccttacatatccagtgcaagtagctacaccgggcagagccagttgtatgcggcgcagcatcaggccagctctccgacaagctcccctgccacgagctttcccccacctccatccagtggcgctagtttccagcatggggggcctggagctccacctagcagctctgcttatgctctacccccaggcacaaccggcacgctcccagccgcttccgagctgcctgcctcacagcgcaccggaccccagaacggttggaatgaccctcctgcactgaatcgggttcccaagaaaaaaaagatgcctgagaactttatgcctcccgtgcccattacgagcccaatcatgaacccactgggcgatccccagtcccagatgcttcaacaacaaccttccgcacctgtgcccctgagttcccaatcctccttcccacaaccacacctgccaggagggcagcccttccatggagtgcagcagcctctaggtcaaactggtatgcccccctccttcagtaaaccgaatatcgagggggcgcccggagccccgataggtaataccttccagcacgtgcagtcgttgccaaccaaaaaaattacaaaaaagcccatccctgatgaacacctgatcctgaaaactacattcgaggatttgattcagcggtgtctgagcagcgccacagatccccagactaaacggaagcttgacgatgcctctaaaagattagaatttctttacgataagctcagagaacagaccctgagtccaacaattacgtccggactgcataacattgctcgaagcattgagactcggaattactcagagggtctcacaatgcacactcatatcgtatcaaccagtaatttttccgagacctcagcgtttatgccagtactcaaagtggtgctgacacaggccaataagctcggagtttag

SEQ ID NO: 29813 - DNA, 3204 bp, Artificial Sequence
  Description of Artificial Sequence: Synthetic coding sequence
atgaagttgaaggaggtggacagaaccgcaatgcaagcctggagtccagcacagaatcatccaatttacttagcgacaggtacatccgcacaacagctagatgcgactttcagcaccaacgccagcctggagatcttcgagcttgacttaagcgacccgtctttggatatgaagtcctgcgcaacattttcatcatcccacaggtaccacaagttgatctggggtccctacaaaatggactctaaaggcgatgtgagcggtgtgctaatcgctggcggcgaaaatggcaatattattctgtacgacccctccaagattattgcaggggacaaggaagttgtgatcgctcagaacgacaagcataccggccctgtgagggcgctagacgtcaacatttttcagacaaatctggtggcatcaggagccaatgagagtgagatctatatctgggatctgaacaactttgcaaccccaatgaccccgggagctaaaacacagcccccagaggacatcagctgtatcgcgtggaatcgacaggttcagcacatcctagccagtgcttctcccagcggcagagctacggtctgggatctgcgtaagaatgaaccaatcattaaagtgtcagatcattctaacaggatgcattgttctggtctggcttggcacccagacgtagcaacgcaaatggttctggctagtgaggacgaccgcctgcctgtgatacagatgtgggatctcaggtttgcgagcagccctctgagagttctcgagaatcacgcgcgaggtattctcgccattgcttggagcatggctgatcccgagctgctactgtcgtgcgggaaggacgctaaaattttatgctctaaccctaataccggtgaggtactgtatgagcttcctacaaacactcaatggtgctttgacattcagtggtgcccccggaatccagcagtcctctccgcggccagctttgatgggaggatcagcgtgtactccattatgggcggctccacggatgggctccggcagaagcaagtggataaattgtcctctagctttggcaatctggacccgttcggaactggacagccactgccccccttgcagatacctcagcagaccgcacagcactccatcgtgcttcctcttaaaaagccccctaaatggatccgcaggcccgtgggcgcgtccttctccttcgggggaaaactggtgaccttcgagaatgttaggatgcccagccaccaaggggccgagcaacagcagcaacaacaccatgtgtttataagccaggttgtgaccgaaaaggaatttcttagccgcagcgaccagttgcaacaggccgtgcagagccaaggctttatcaattattgccagaaaaagatcgacgcctcacagaccgaatttgagaaaaacgtgtggagcttcctcaaggtcaactttgaagacgactcgcgaggaaaatacctcgagctgctcggctacagaaaggaagacctgggcaagaaacacataaaagaggagaaggaggagtcggagtttctgccaagctcaggagggacatttaacatctcagtctccggagacatcgacgggctgataacccaagctcttcttacaggaaacttcgagagcgcagtggatctatgtctgcacgataataggatggccgacgcaatcatactcgccatagcaggtggccaagagctgcttgctaggacacagaaaaaatactttgctaaaagccagtcaaagatcactcgcctaataacggccgtggtaatgaaaaactggaaagagatcgtcgagtcttgtgacttgaagaattggcgcgaagccttagccgcagtgctcacatatgcgaaaccagatgagttctccgccttgtgtgatttactcggcacccgactggagaacgagggcgactccctgctgcagacccaggcttgcctgtgctacatttgtgcgggcaatgtggagaaactggtggcctgttggaccaaagcccaagacggcagtcatccgctgagcctacaggatcttatcgagaaagtagtaatattgcgaaaagctgtccagctcactcaggccatggataccagcacagttggagttctgctggccgcaaagatgtcccaatatgcaaacctgctggctgctcaggggagtattgccgccgcccttgcctttctgccagacaacacgaatcaacctaacataatgcagctgagagacaggctctgtagggctcaaggtgaacccgtggcgggacatgaatctccaaagataccttacgaaaaacagcaattacccaagggacggcccggacccgtggcaggacaccaccagatgcccagggtacagactcagcagtactacccacacggtgaaaacccacccccccctggtttcataatgcacggcaatgttaatccgaacgcagccgggcagcttcctaccagtcccggccatatgcacacgcaagtcccaccgtacccccaaccgcagcgcccacaaaacggttggaacgatcctcccgctctgaacagggtgcccaaaaagaagaagatgcccgagaactttatgccgccagtgccaatcacaagtcccatcatgaatcccttgggagatccccagtcccagatgctgcagcagcagccgtcagccccagtccctctgtcaagtcagtctagctttccacagcctcacctcccgggtggacagccctttcacggtgtgcagcagccattgggacagaccggcatgcctcccagcttttccaaacctaacatcgagggcgctccaggggcccctatcggcaacactttccagcatgtccagagtctgcctactaaaaagattacaaagaaaccgatccccgacgagcatctgatactcaaaactactttcgaggatctgatccagcggtgtttgtcatcggcaactgacccccagacaaagaggaagctcgatgatgcatccaagcggttggaattcctttacgataagctgagggagcaaaccctctcccctacaataacaagcgggctgcacaacattgcgcgaagtatagaaacccgaaactattctgagggattgacaatgcacacacacatagttagtacgtcaaatttcagcgaaacctcagcctttatgccggttctaaaggtggttctaactcaggcaaacaaacttggcgtgtag

SEQ ID NO: 29814 - DNA, 246 bp, Artificial Sequence
  Description of Artificial Sequence: Synthetic coding sequence
atgaagctgaaggaggtggacaggacggcgatgcaggcgtggagccctgcccagaaccaccccatatacctagctacagggacctctgcccaacagctggatgccacattttctacaaacgcaagcctagaaatttttgaactggatctgtctgatccaagcttagacatgaagtcttgcgccacgttctcctcctcgcacagatatcacaagctcatctgggggccatataagatggactcatag

SEQ ID NO: 29815 - DNA, 201 bp, Artificial Sequence
  Description of Artificial Sequence: Synthetic coding sequence
atgaaactcaaggaggttgatagaaccgcaatgcaagcatggtcccccgcacagaatcatccaatctacctcgccacaggtactagtgctcagcagcttgacgccacattcagcacaaatgcaagcttggaaatttttgaattagacctgagcgatccaagcctggatatgaagtcatgtgcaaccttctcgtcaagctag

SEQ ID NO: 29816 - DNA, 3501 bp, Artificial Sequence
  Description of Artificial Sequence: Synthetic coding sequence
atgaaactcaaagaggtcgatcggaccgcgatgcaggcttggagccctgcacaaaaccatcctatctatctagccacaggtacgagcgcacagcagctggatgcaaccttctcgaccaatgcatccttagagatttttgaactggatctgagtgaccctagcctcgacatgaagagttgcgccactttttccagtagtcataggtatcacaagctcatatggggcccctacaagatggatagtaaaggtgacgtgagcggggtgctgattgccgggggtgaaaatgggaacattattctttacgaccccagcaaaatcattgccggggacaaggaggtggtgattgcccagaatgataaacataccggaccagtacgggccttggacgtcaatatcttccagacaaatttagtggcaagcggggcaaatgagtcagagatttacatctgggatctcaacaactttgccactccaatgacccccggtgctaagacccagccaccagaggatatcagctgcatcgcctggaacaggcaggtgcagcacatccttgcttccgcctctccatctggccgcgcaaccgtgtgggatctgcgaaagaacgaaccaatcattaaagtaagcgaccatagtaaccgcatgcattgttctggattagcctggcacccggacgtggctactcagatggtcctcgcttccgaagacgacagactgccagtgattcaaatgtgggacttgaggttcgcctcttctcccctcagggttctagagaatcacgctagggggatcttggcaatagcctggtctatggctgacccagagctacttctgagttgcgggaaagacgccaagattctctgttctaaccctaacactggggaggttctgtacgagctgcctacgaatacccaatggtgctttgatatccaatggtgccccagaaaccctgctgtgctgtctgctgcctctttcgacggaaggatttctgtatactccattatgggagggtcaactgacggcctcagacaaaagcaggttgataaactatcaagtagctttggaaacctggaccccttcggcacagggcagcccctgccccctctgcagattccacaacagacagcccaacactccatcgtactgccactcaagaagccccccaaatggattaggcgcccggtgggggccagcttttcctttggcggaaagctcgtgacattcgagaatgtgagaatgccatcacaccagggcgccgagcagcaacagcaacagcaccatgtttttattagtcaggttgtgaccgagaaggagttcctctcccgcagtgaccagcttcagcaggctgtgcaatcgcaggggttcattaattactgtcagaaaaagatcgacgcctcgcagacagaatttgaaaagaacgtgtggtcgtttcttaaagtgaacttcgaggatgatagccgcgggaagtacttggaactcctgggttaccgtaaggaggatttaggaaaaaagcatatcaaggaggagaaggaggagagcgagttcctcccctcttccggtggaacatttaacatctcagtgtccggcgacatagatgggctcatcacccaagcacttctgacaggaaacttcgaatccgccgtggatttgtgcttgcatgataatcgaatggcagacgccatcattcttgcaatcgccggggggcaggaactcttggcaaggactcagaaaaagtatttcgcaaagagccaatcgaagatcacgagactgattacagctgttgtcatgaagaactggaaggagattgtcgagagctgcgatttgaagaattggcgtgaggcactggcggccgtgctgacctatgcaaaaccagatgagttctcagctctctgtgatcttctgggcacccgcctggaaaacgagggcgatagtttgctgcagactcaggcttgtctgtgttacatctgcgccggaaatgtggaaaaactcgtagcctgttggaccaaagcccaggacggatctcacccactatcattacaagatctgattgagaaggtggtcattctgcggaaggcagtgcagctgacacaggcaatggatacatccactgtgggtgtcctgcttgccgcaaaaatgtctcagtatgctaatttactggccgcccagggtagcatcgctgccgctctggctttcctgcctgacaacactaatcagccaaatattatgcagctcagagatagactgtgccgggcccagggcgagcctgtggcgggtcatgaatcacctaagattccatacgaaaaacagcagttacccaaaggtagaccaggccccgtggcagggcaccatcagatgccccgagtgcagacccaacagtattatccgcatggcgagaaccctcctcctcctggcttcattatgcatggtaacgttaaccccaatgcagctggacagctgcctacgtcgcctggccacatgcacacacaggtgccaccgtaccctcagccccagccttatcagcccgctcagccttaccccttcggtacggggggctcagccatgtatcgcccacagcagccagtggcacctcctacctcaaacgcctacccaaacaccccttatatttccagcgcctcatcctataccggccagtctcagctctacgccgctcagcatcaggcttcaagccctacatcaagcccggcaaccagctttcctccgcccccttcctctggtgcctcttttcaacatgggggccccggcgcccccccttcatctagtgcgtacgctctcccaccagggaccaccgggcctcagaacggctggaacgatcccccagccctaaaccgggtgccaaaaaagaagaaaatgcctgagaactttatgccaccagttcccatcacatcaccaatcatgaacccactcggtgatccgcagagtcaaatgttacagcagcagccaagtgctcccgtgcccttgtctagtcaatcctcttttccgcagccccacctaccaggcggccagccgttccacggcgtccagcaacctttggggcagaccggtatgcctccttcatttagcaagcctaacatcgaaggagctcctggcgcccctataggtaacaccttccaacacgtgcagagcctacccacaaaaaaaatcacaaagaagcctatcccggacgaacaccttattttgaaaactacattcgaagacttgattcagaggtgcctgtcgtctgcgacagacccccagactaagcggaagctggacgacgcaagtaagagactggagttcctgtatgataaactgagagagcagaccctgtctcccactataacaagcgggcttcacaatatcgccaggtcaatcgagacacgcaattattctgagggactcaccatgcacactcacatagtgagcacaagcaatttctcagaaacatctgctttcatgccagtccttaaagttgtcctaacacaagccaacaagctgggtgtgtag

SEQ ID NO: 29817 - DNA, 84 bp, Artificial Sequence
  Description of Artificial Sequence: Synthetic coding sequence
atgaagctcaaggaagtggatagaaccgctatgcaggcctggagtccagcccagaatcaccccatctacctggctaccgggtag

SEQ ID NO: 29818 - DNA, 3618 bp, Artificial Sequence
  Description of Artificial Sequence: Synthetic coding sequence
atgaaacttaaggaggtcgacagaacggccatgcaagcctggagtccggctcagaatcaccctatctatctcgccacaggcacgtccgcccaacagctggatgcaacattttctactaacgcatctttggagatctttgagcttgacttatctgatccatccttagatatgaagagctgcgctacattttcatcttcgcaccgatatcataagctgatatggggaccctataaaatggatagcaagggggacgtctctggagtgctgatcgccggaggggagaatgggaatattattctgtatgatccttctaagatcattgccggggacaaggaagttgtgatagcccaaaatgataagcacactggtccggtccgcgcacttgacgtcaatatctttcagacgaatctggtggccagcggagcaaatgaaagcgaaatctacatatgggacctgaataactttgccacccctatgacacctggagctaagacgcagcctccagaggacattagctgtatagcgtggaaccgacaggtgcagcacattctggcctctgcaagcccctcaggacgcgcaaccgtgtgggacctcagaaaaaacgagccaatcattaaagtcagcgaccattccaacaggatgcactgctcaggtctggcctggcaccctgatgtagccacgcagatggttctggcaagcgaggatgaccgactgcctgtaatacagatgtgggacttgagattcgcgtcgagccccctgagggtcctggaaaaccacgctcgcgggatcctcgcaattgcttggagtatggctgaccctgagcttctgctgtcatgcggtaaggacgctaagatcttgtgttccaatccgaacacaggtgaggtcctgtacgaactcccaactaatacccaatggtgtttcgatatccagtggtgcccacggaatccagctgttctgtccgctgcctcctttgacggaagaatcagcgtttatagtattatgggcgggagtaccgacggtctccgccagaaacaggtggacaaactctctagctcgtttggaaatctagatccctttggaacagggcaacccttaccaccacttcaaattccccagcagacagcccagcacagcattgtgctcccactcaagaagccacccaagtggatccggagacccgtgggggcttccttcagtttcggaggcaagctggtgacgtttgaaaatgtgcggatgccgagtcaccagggcgcagagcagcagcagcagcagcaccacgtctttatttcccaggttgtgacagagaaggaattcctgagtcgctccgaccagctccagcaagcagtgcagagccaaggttttatcaattactgccagaagaaaattgatgcctcacagaccgagttcgagaagaacgtctggtcattcctgaaagtgaatttcgaagatgactctagaggaaaataccttgagctcctgggctacagaaaggaggacctgggcaaaaagattgccttggctctaaataaagtagacggcgcgaacgtagcactcaaggactcggaccaagtggcccagtccgatggcgaagagtcccctgctgctgaggaacagttgttgggcgagcacatcaaggaagagaaggaggagtctgagttcctgcctagttcaggtggaacctttaatatttccgtcagcggggacattgatggattgattactcaggcacttctgactggaaacttcgagagtgccgtggacttatgcctgcatgataatagaatggcggacgctattatcctggccatcgccgggggtcaggagttgcttgcccgtactcagaagaagtattttgccaagtctcagagcaagatcactagactgatcacagcagtggtgatgaagaactggaaagagatcgtggagtcttgcgatcttaaaaattggcgcgaggccctcgcagccgtgctgacatacgccaaacctgatgaatttagtgctctctgtgatctccttgggactcggctggaaaacgaaggcgattcattgcttcaaactcaggcatgtctgtgctacatttgtgccggcaacgtcgaaaagctagtggcgtgctggaccaaggcacaggacgggtctcaccctctttcactccaggatctgattgaaaaggtcgtcatcctgcggaaagccgtacagctgacacaggccatggacacttccactgtaggggttcttctggcagccaagatgtctcagtatgcaaatttactggcggctcagggcagcatagcggcagcactggctttccttcctgataacacaaaccaaccaaacatcatgcagctcagggatcggctgtgccgtgcccagggtgagcctgtagccggccacgagagtcccaaaattccctatgagaaacagcaactgccaaaagggcggcccggccctgtagctggccaccaccaaatgccccgagtccagactcagcagtactatcctcatggagaaaatcctccccccccaggatttataatgcatggcaacgtgaatcccaatgccgccggacagctgccaacgtcacccggtcatatgcacactcaagtcccaccttaccctcagccgcagccttatcagcctgcacagccttatccttttggcaccggggggagtgccatgtaccgcccacaacagcctgtcgctccccccacttcgaacgcttatcccaatacgccttacatttccagcgcaagcagctatacaggtcagtctcaactctatgccgctcagcaccaggccagttcccccacctcctctcccgccacctcatttcctccccctccatctagcggggctagtttccagcacggtggtccgggcgcccctccatcttctagtgcctacgctttgccgcctggcacaacaggtccacagaacggatggaacgacccccctgccctcaatcgcgtccctaagaagaaaaaaatgcctgaaaatttcatgccccccgtgcctattacgagccccataatgaatcctctgggagacccacagtcgcagatgctccaacaacagccctccgcccccgtgccattgtcaagtcagtctagtttcccccagccacatctgccggggggtcagcctttccacggagtacagcagcccctgggacagaccggtatgcctccaagcttctcaaaaccgaatattgaaggtgcaccgggcgcccccataggaaatacatttcagcacgttcagagccttccgaccaaaaaaattaccaaaaagcccatccccgacgagcacctgatccttaagacaacgttcgaggatctgatccaacgctgtctttccagtgccaccgaccctcagaccaagaggaaactggacgatgcaagtaaaaggctcgagtttctgtacgacaagctgagggaacagacgctgtctcccacaattaccagcgggttgcataacattgctcgctccattgaaacccggaattatagtgagggcctgaccatgcacactcatatcgtttctacaagcaatttcagcgagacaagcgcgttcatgcccgtcctgaaagtggtactgacccaggccaataagctaggcgtatag

SEQ ID NO: 29819 - DNA, 3321 bp, Artificial Sequence
  Description of Artificial Sequence: Synthetic coding sequence
atgaagctgaaggaagttgatcggaccgcaatgcaagcctggagcccagcccagaatcacccaatctatctggctaccgggacctctgcgcagcagttggatgccacttttagcaccaacgccagtttagagatattcgagctagatctgagcgacccctcattggatatgaagtcttgtgccacctttagctcatcccaccggtatcacaagctgatttgggggccctacaagatggacagtaagggcgatgtgtctggtgtacttattgctggcggagagaatggaaacatcattctctatgatccatctaaaattatcgcaggcgataaggaggtggttatagcacaaaatgataaacacactggccctgtgagggcactggacgttaacattttccagactaacctggtcgctagcggtgcaaacgagtccgaaatctacatatgggatctcaataatttcgctaccccaatgacccctggcgcaaagacacagccccccgaggacatctcatgtattgcatggaatagacaggtgcagcatattctcgcgtccgctagtccttctggcagggcgacggtctgggatctccgcaagaacgagccaattatcaaggtttctgatcattcaaatcggatgcactgctcggggctagcctggcaccccgacgtggccacccaaatggtgctagccagcgaggacgatcgcctgccagttatccaaatgtgggatctgcgcttcgcttcatcccctctgcgggtgctcgaaaaccacgcacggggcattttggcaattgcctggtcaatggctgaccccgagctgctgctgtcttgcggcaaagacgctaaaattctctgctctaaccccaatacgggtgaggtgctgtatgagctaccaacgaacacacaatggtgtttcgacatacaatggtgcccacgcaacccggctgtgctgtctgccgcatcctttgatgggaggatctcagtttatagtatcatgggcggctctacagatggcctgagacagaaacaggtcgacaaactgagctccagttttgggaacctggacccatttggaactggacagccgcttccaccacttcaaatcccccagcaaacagcacaacacagcatcgttctgcccctgaaaaaaccacctaagtggattcgcagaccagttggagcatccttctcgtttggcggaaagctggtgacctttgaaaatgttagaatgccatcacatcagggggccgagcaacagcaacagcagcaccacgtgtttatcagtcaggttgtgaccgaaaaggagttcttgtccaggtctgatcaattgcaacaggcagtgcagtcccaaggattcatcaactattgccaaaaaaagattgacgctagtcagacagagttcgagaagaatgtatggtcatttctgaaggtgaattttgaggacgacagcaggggcaagtatctggagctgctgggctacaggaaggaagatctcggaaaaaaaattgccctggcactcaacaaggtggacggggccaatgttgcccttaaggattccgatcaagtggcccagtccgatggtgaagagagccctgccgcagaagagcagctgctcggcgagcatattaaagaggagaaggaagagtcagagttcctgccaagctcaggagggacctttaatatctccgtcagcggcgacattgacggcctcattacacaggccttactgaccgggaacttcgagagtgctgtcgatctttgcctccatgacaaccgtatggcagatgcaatcattctcgctattgctggagggcaggagctgctcgcgcggacgcagaagaagtactttgccaagtctcagtccaaaattacacgcttaataacagctgttgtaatgaagaattggaaagaaatcgtggaaagctgtgacctgaaaaattggcgggaagccctcgcagctgtgttgacttacgcgaaacccgatgaattcagtgcactctgcgatctgctgggtacccgattagaaaatgagggggatagtcttcttcagacccaggcttgcctgtgctacatctgtgctggaaacgtggaaaagctggtggcctgttggacgaaagcacaggatggatcgcacccactttctcttcaagatctgatcgagaaggtggtgattctcagaaaggcagttcagctgacacaagctatggatacatccacagtcggggtcctgctcgccgctaaaatgtctcagtacgctaatttgctggccgctcagggaagcatcgccgccgcactcgcctttttgccagataacactaaccagcctaatattatgcaactccgggatcgcctgtgcagggctcagggtgagcctgtagcgggtcatgaaagtcccaagatcccatatgaaaagcagcaactgcctaaaggccgcccagggcccgttgccgggcatcatcagatgccaagagtgcagacacagcaatactaccctcacggtgaaaacccacctccccccggcttcataatgcacgggaatgttaatccaaatgccgcggggcaattgcccacaagtcctggccatatgcacacacaggtcccgccctatccacaacctcagcgaccccagaatggctggaatgaccccccagcactgaatcgggtcccgaagaaaaaaaaaatgccagagaatttcatgcctccggtcccaataaccagccctataatgaacccattgggcgatcctcagagtcagatgcttcagcagcagcctagcgctccagtgcctctgagcagccaaagcagtttcccccaaccccatctgcctggcggacagccgtttcatggtgtacagcaaccattagggcaaaccgggatgcccccgtctttctctaaacccaacatagaaggggctcctggggcccctattggcaatacattccagcatgtccagtcactgccaacaaaaaagattacaaagaagccaatcccagatgagcacctgatcctaaagactacctttgaggatttaatacagagatgcctgagcagcgccaccgatcctcaaaccaagcgcaagttggacgatgcctctaagagactggagttcctctatgacaagctccgagaacagaccctttccccaacaatcacaagcggcctgcataacatcgcacggtctatcgaaacccgtaactacagtgaaggcttaaccatgcatactcatatcgtgagcaccagcaacttttccgagacgtcagcatttatgcctgtattgaaagtggtcctcactcaggctaacaagctgggggtgtag

SEQ ID NO: 29820 - DNA, 498 bp, Artificial Sequence
  Description of Artificial Sequence: Synthetic coding sequence
atgaagcttaaggaggtggacaggactgcaatgcaagcctggagtcctgcacagaatcaccctatctacctagccaccggcacatcagctcagcaacttgacgctactttcagtaccaacgcatccttggagatttttgaactggatttatcagatcccagccttgacatgaagagctgcgccacctttagcagtagccacagatatcacaaattaatttgggggccctacaaaatggactccaagggggacgtcagcggtgtgctgatcgccggaggggaaaatggtaatattatcctgtacgacccgagtaaaattattgcaggcgataaggaagtggtcattgcccagaacgacaagcacaccggacctgtcagggcactagatgtgaacatatttcagaccaacctggtggccagtggggccaacgaatccgagatatacatatgggacctcaacaatttcgcgacaccaatgacccccggcgccaaaacgtag

SEQ ID NO: 29821 - DNA, 501 bp, Artificial Sequence
  Description of Artificial Sequence: Synthetic coding sequence
atgaagctcaaggaggtggatcgcacagccatgcaggcctggtccccggcccaaaatcacccgatctatctagcaacggggacgagtgcgcagcagcttgatgccaccttctcaactaatgcttcgctggagatcttcgaactggatctgagtgatcctagtttggatatgaagagctgcgctactttctccagcagccacagatatcacaaattgatctggggtccatacaagatggattccaaaggtgatgtctctggcgtgttgattgccggaggagagaatggtaacataatcttgtatgacccctccaagatcatcgctggggacaaggaagttgtcattgctcaaaacgataagcacaccgggcccgtaagagccctggacgtgaacattttccaaactaatctggtggcctcaggtgcgaacgagtctgagatctatatctgggacttgaacaactttgccacacccatgaccccaggagcgaaaacccagtag

SEQ ID NO: 29822 - DNA, 3603 bp, Artificial Sequence
  Description of Artificial Sequence: Synthetic coding sequence
atgctcggtgagtctgatgagcggtgcactaacgccggatcgggatgccgccgaagtagtccaggcaccagcgcccagcagctagacgctacgttctccacaaacgccagtttggaaatctttgaacttgatctgagcgacccttccctcgatatgaagagctgcgctaccttcagcagttcccataggtaccacaaacttatttgggggccttacaaaatggactccaaaggtgacgtgagcggcgttttaatcgctgggggtgagaacggaaacattatcttgtatgacccatctaagattatcgcaggagataaggaggttgtaattgcccagaatgataaacatactggaccggtgcgtgcactcgacgtgaatattttccagacaaacctggtggcgagtggcgccaacgagagcgaaatttacatctgggatctcaataacttcgcaacacccatgacaccaggcgcaaaaactcagcctcctgaggatatatcgtgcatcgcctggaatcgccaggtccaacacatacttgcaagcgcatcacccagcggtcgagcaactgtctgggatcttcgcaagaatgagcccattattaaggtgtcagaccacagcaacaggatgcactgctccgggctggcatggcaccctgacgtggcgacccagatggtgctggccagtgaggacgatcggttgcctgttattcagatgtgggatcttagatttgcgtcctccccattaagggttctggagaatcacgctcggggcatcttagcaatagcctggtctatggcagaccctgaactgctgctgagttgcgggaaggacgctaaaatcctgtgtagcaatccaaacaccggagaagtgctatatgaactaccaacaaatacccagtggtgtttcgacatccagtggtgcccccgtaaccctgccgtgcttagtgccgcatcattcgatggaagaatttcggtatactctataatgggcggctccaccgacggcttgagacagaaacaggtggataagctgagcagtagcttcggcaacttagatccattcggcactggtcaacccctaccccccttgcaaattccccagcaaaccgcccaacactccattgtcttgcctctgaagaagcctccaaaatggatccgcagacccgtgggtgccagttttagcttcggcgggaagttggtcactttcgaaaacgtgaggatgccgagtcatcagggagctgaacaacaacagcagcagcatcacgtgttcatctcccaagtggtgaccgagaaggaattcttatcaagatctgaccaactgcagcaagccgtccagtcacaagggttcatcaattattgtcagaaaaagatcgacgcatcccagactgaatttgagaagaacgtgtggtccttcctgaaagttaacttcgaggatgattctcgggggaagtacttggagttgctgggttaccggaaagaggaccttggaaagaagatcgccctggcattaaataaggtcgatggcgccaacgtcgcccttaaagactccgatcaggtcgcccagtcggacggggaggagagtcccgccgcagaggagcagttgcttggggagcatataaaagaagagaaggaagagagcgagttcctgccctccagtggtggaacattcaacatttcagttagtggcgacatcgatggattaattacccaagccttactgacaggcaatttcgaatcggccgtagatctgtgtttacatgacaaccgcatggctgatgccatcatccttgccatcgcgggaggacaggagttattagctagaactcagaagaagtattttgctaagtcccagagtaaaatcactaggctcattacagcagttgtgatgaagaattggaaggaaattgttgaaagctgtgatcttaagaactggcgggaagccctggcagccgtgctgacatacgccaagcctgacgagttcagcgccttgtgcgaccttctggggacccggttagaaaacgaaggggatagtctgctgcagacccaggcctgcctgtgttacatttgcgccggtaacgtcgaaaagctggtggcctgttggacgaaggctcaggatggttcccacccattaagcttacaggatcttattgaaaaagtggtgattctccgcaaagccgtgcagcttacacaggcgatggacactagcacagtcggcgtcctcctggcggcaaagatgtcacaatatgccaatctgctggctgctcagggatcaatcgctgctgcattggccttccttcccgacaacactaatcagccaaatatcatgcagctgcgagatagactttgccgggctcaaggcgagcctgtggctggccatgaatcccctaaaatcccttacgagaagcagcagctgcctaaagggagacccggcccagtcgctggccaccaccagatgccaagagtacagacccagcagtactatcctcacggggaaaacccacccccaccaggtttcattatgcacggcaatgtaaatccaaatgctgctggacagcttcctacaagcccgggccatatgcatacgcaggtgcccccgtacccccagcctcagccctaccagcccgcccaaccatatccattcggcactggaggatcagcaatgtatcgaccccagcagccagtggcaccacctacctctaacgcatacccaaacacaccctacatttcttctgcatcctcttacaccggccagtctcagctgtacgccgcccaacaccaggcgagcagccctacaagcagcccggcaacttcttttccccctcccccgtcttccggtgcatcatttcagcacggcggtcccggggcacccccatcctcatctgcttacgcattgccccccggcaccacgggcccacagaatgggtggaacgatcctcctgctcttaatcgagtacctaaaaaaaagaagatgccagaaaactttatgcccccggtgcccattacaagccccataatgaacccgctgggagaccctcagagccagatgctacagcagcagccatccgctccagtccctctctcatcccagtccagtttcccccaacctcatctacctgggggtcagccctttcatggcgtgcaacagcctctgggtcagacaggcatgccccccagtttcagtaaacctaatatcgagggggcaccaggtgcacccatcggcaacacattccagcatgtgcagtctctgcccacgaagaaaattactaagaagcccatacctgacgagcacctgatcctgaagaccactttcgaggacctgattcaacgatgtctgtctagcgcgaccgatccacagacgaagaggaagctcgatgacgcaagcaagaggttggaatttttgtacgacaagctccgggaacaaacactttccccaaccatcacttccgggctgcataatatagccaggagcattgaaacaaggaactattcggagggattgacgatgcacacccatattgtctccacatccaacttctctgagacttcagctttcatgccagtccttaaagttgttcttacacaggccaacaaactgggcgtgtag

SEQ ID NO: 29823 - DNA, 1431 bp, Artificial Sequence
  Description of Artificial Sequence: Synthetic coding sequence
atggccatcaaatttctggaagtgatcaagcccttctgcgtgattctgccagagattcagaaaccggaacgcaaaattcagttcaaagaaaaggttctttggactgctattacattattcatttttttagtctgttgccaaatacctctctttgggataatgtctagtgactccgccgatcccttttactggatgcgcgtaattctcgccagcaacagaggcaccctcatggaactgggaatcagtccaatagttacttccgggcttatcatgcaactgctggccggtgctaaaatcatcgaggtaggcgataccccgaaggaccgcgccctgtttaatggagctcagaagctcttcggaatgatcatcaccatcggccaaagcatcgtttacgtgatgactgggatgtatggagatccctccgagatgggagctggcatatgtctgcttatcacgattcaattgtttgtggctgggctgatagtccttctgctagacgagcttctgcagaaaggctatggactgggcagcggcatatccctgtttattgcaaccaatatctgcgagactatagtgtggaaggcattctcacccaccactgtcaacactggtcgcggaatggagtttgaaggggcgattatcgctctctttcatctcctggctacccgcactgacaaagtgcgcgctcttagagaggcattctaccgtcaaaatctacctaatctgatgaacctcatcgccactatattcgtttttgccgtagtcatatacttccaaggctttcgggtcgatcttcccatcaaatcagctcgctaccggggccagtacaatacataccccatcaagctcttttacacatccaacatacccatcatcttgcagtccgccttagtaagtaacctgtatgtaatttctcaaatgctgagcgctcggttctcaggcaatctgcttgtctcattactgggaacgtggagtgataccagtagtggtggccctgcccgagcctacccggtcggaggactgtgctactatctgtctccccccgagagtttcggctccgttctcgaggacccagtccacgccgtcgtttacattgtctttatgttgggcagctgcgcctttttctccaaaacctggatcgaagttagcggtagctctgccaaagacgtcgccaagcaactgaaggagcaacagatggtaatgcgtggacacagggaaacatccatggtccatgaactaaaccgctacatccctaccgccgcggcttttggaggactatgtataggcgccctgagtgtgctcgccgatttcttgggcgcaataggaagcggcactggaatcctgctggccgtgacaataatttaccagtatttcgaaattttcgtgaaggaacaaagcgaggttggcagcatgggtgccctcttgttttag

SEQ ID NO: 29824 - DNA, 1071 bp, Artificial Sequence
  Description of Artificial Sequence: Synthetic coding sequence
atgatcatcactattggacagagtatagtatacgtcatgacaggcatgtatggggacccatccgaaatgggcgccggcatctgtctgctcatcacaatccagctgtttgttgctggactgatcgtcctgcttctggacgagctgctgcagaagggttatggtctggggtcagggatctcgctgtttatagccaccaacatctgcgagacaattgtttggaaggcgttttctccaaccacagtcaacacaggccgaggcatggaattcgaaggcgccattattgcgctctttcatctgttagcaacaaggaccgacaaggtgcgggcactccgggaagcattttaccgccaaaaccttccaaacctaatgaatctaatcgcaaccatatttgttttcgccgtggtgatttatttccagggattcagggtagatctgcccatcaaaagcgccaggtaccgcgggcagtataacacctatcctattaagttattttatacctcaaacatcccgatcatcctccaatcagcgctggttagcaacctttacgtgatttcccagatgctctcggcacgcttctccgggaacttactagttagtttactcggcacatggagcgacaccagttctggcggcccagctcgggcttatcccgtgggagggctgtgctactacctatctcctccagaaagtttcgggtctgttctggaagaccccgtacatgccgtagtgtacatcgttttcatgttgggttcatgtgctttcttctctaaaacctggattgaagtttcaggatcatccgccaaggacgtggccaagcaacttaaagaacaacagatggtcatgagaggacaccgcgagacctctatggttcatgaattgaaccgctatattcccactgccgcggcttttggggggctttgtattggggcactgagtgtgctggccgacttccttggcgccatcggttcgggtacggggatcttactagcagtgactataatctaccaatattttgagatcttcgtaaaggagcagtccgaggttgggagcatgggagcactgctgttttag

SEQ ID NO: 29825 - DNA, 1449 bp, Artificial Sequence
  Description of Artificial Sequence: Synthetic coding sequence
atgacccagacagctagagtgttagtgaagtttctggaagtaataaagcccttttgcgtgattctgccggagatacagaaaccggagcgtaagattcagttcaaagaaaaagtactttggacggcaatcaccctgttcatattcctggtgtgctgccagatacctttgttcgggatcatgagcagtgactccgccgacccattctactggatgcgggtcatccttgctagcaacaggggtaccctcatggagctaggcatttcgcccatcgtcaccagtgggctgatcatgcaacttctggccggcgccaaaatcatagaggtgggcgacacacctaaagatcgtgctcttttcaatggtgctcagaaactttttgggatgatcattacaattggacagagtatcgtgtacgtgatgacgggcatgtacggcgatccctccgagatgggcgcagggatctgtctgctcatcactatccagcttttcgtggctggcttgatcgtcctcctgctcgacgaactcctgcaaaaaggatacggattggggtctggtatttccctttttatcgctaccaatatctgcgagaccatcgtatggaaggccttctcccccacaaccgtgaatacaggcaggggaatggagttcgaaggcgctattatcgcccttttccacttgctggctacccgcacggataaagttcgagccctgcgagaagcattttaccgtcagaatctgcctaatctaatgaatctaattgctactattttcgtgtttgcagttgtgatttactttcaaggttttagggtggacctgccgatcaagagcgccagatacagaggccaatataacacttacccaatcaagttattttacacctcaaacatccccataatcctgcagagcgcactcgtgtccaacctgtacgtgatctcacagatgctcagtgcccgattcagcggaaacttactggtcagcctcctgggaacatggagcgacactagcagtggtggccctgctcgagcctatcccgtgggaggcttgtgctactatcttagccctccagagtcatttggatctgtattagaagacccagtgcacgcagtcgtgtacattgtttttatgctgggctcatgcgcatttttcagcaagacctggattgaggtcagtggatcttccgccaaagacgttgccaaacagctgaaagaacagcagatggtgatgaggggacacagagagacctctatggtccacgagcttaaccgctacattccaaccgctgcggcttttggtggcctatgcataggggccctctcggttctggccgattttttgggcgctattgggagcgggactggcattctgctggcagtcacaatcatctaccagtatttcgagatttttgtgaaggagcaatcagaagtaggaagcatgggggcactgctgttttag

SEQ ID NO: 29826 - DNA, 1431 bp, Artificial Sequence
  Description of Artificial Sequence: Synthetic coding sequence
atggggatcaaattcctggaggttattaagcctttctgcgcagtgctgcccgagattcagaagcccgagcggaagattcaatttagagaaaaggtgctctggaccgcaattaccctgttcatcttcctggtctgctgccaaattcctttatttgggatcatgtcaagcgacagcgctgaccctttttattggatgcgtgtgatcctggcctctaaccgtgggacattgatggagctgggaatcagcccgatcgtgacttccgggctaattatgcaactgctggccggggccaagataattgaagttggagatacccctaaagacagagccctgtttaatggagctcaaaaattattcggcatgatcatcacaattggccaggcaatagtatatgtgatgactgggatgtacggggatccagcggagatgggcgcaggaatctgcctgctgattatcatccagctctttgtagccggtcttatcgtgttacttctcgatgaactgctgcaaaaaggttacggactcgggtcaggtatctcactgttcatcgccacaaatatctgcgagacaattgtatggaaggcgtttagtcccaccacgattaacactggcaggggaacagaatttgagggtgctgtcattgctctcttccatctgctggccaccaggaccgataaggtgagggccctcagagaggcgttttacaggcagaacctccccaacctcatgaacctcatcgccaccgtgtttgtctttgccgttgttatttatttccaggggtttcgcgtggacctgccaatcaagagtgcccgatatcggggacagtactcttcatatcctatcaagctgttttataccagtaatattcccatcatacttcagtcagccctggtgagtaatctgtacgtgatttcccagatgctctcagtgcgcttctccggcaattttctggtcaacttacttggtcagtgggcagacgtgagcggcggggggcctgcccgctcttaccctgttggaggactgtgctattacctgtcgccacctgagtctatgggcgccatctttgaggatcctgtgcacgtcgttgtatatatcatatttatgttgggttcctgtgcatttttcagcaaaacctggatcgaggtttccggctcatccgctaaggatgtagccaagcagttgaaagaacagcagatggtcatgcgtggccatagagacacttctatggtccacgaactcaaccgttacattcctacggccgcggcctttggggggttgtgtattggtgcccttagcgtgctggcagactttttgggggctatagggtcaggcactggcattctgctagctgtgactatcatttaccagtattttgagattttcgttaaagaacaagctgaagtgggcggcatgggagccctgtttttctag

SEQ ID NO: 29827 - DNA, 1314 bp, Artificial Sequence
  Description of Artificial Sequence: Synthetic coding sequence
atgggaataaagttccttgaggttataaagccattttgcgccgtgttaccagagatacagaagccggagagaaagatccagtttcgggagaaggtcctgtggactgccattactctattcatcttcttggtgtgctgtcagattcctttgtttggaatcatgtcttccgacagcgctgatccattttattggatgagggtgattttggctagcaaccgcggcaccttgatggagctcggcatttcgcccattgtgacgtcaggcctcatcatgcaattattggcaggtgccaagataattgaggtcggggacacgccaaaggaccgtgctttgttcaacggtgcacaaaagctatttgggatgattattactatcggtcaggctatcgtgtacgttatgacaggtatgtatggagatcccgcagaaatgggtgctggtatctgccttttaattattatccagttattcgtcgccgggctaatcgttttactgctggacgagctgctgcagaaaggatacggactggggagcggcatctccctatttattgctaccaacatttgcgagaccattgtttggaaggccttcagcccaaccacgatcaatacggggcgtggaacagagtttgagggcgcagtgattgctttgtttcatctgttagcaactcgaactgataaggttagggccctcagggaagccttttacagacagaaccttcccaacctgatgaacttgatcgctacggtgtttgtgttcgcagtagtcatttacttccagggctttagggttgacctgccaattaagtcagccagatatcggggccaatacagttcgtatccaatcaaactgttttatacttctaacatccccatcatcctgcagtccgcattggtttccaatctctatgttattagccagatgctttcggtgaggtttagtgggaacttccttgttaatttactaggccagtgggctgacgtgtcagggggcggtcccgccagaagctaccccgtaggtggcttatgctactacttgagcccccctgagtcgatgggcgcaattttcgaagacccggttcatgtggttgtgtatatcatatttatgctagggagttgcgcgttcttctccaaaacttggatcgaggtgagcggaagttctgccaaggatgtggcaaaacagctgaaggaacagcagatggtcatgcgaggccatagggacacatccatggtgcacgaactcaatcgacccaaagtcaagctgcggcgctggaagggtgagggaaggcactttaccaaacgtatattgttttattag

SEQ ID NO: 29828 - DNA, 507 bp, Artificial Sequence
  Description of Artificial Sequence: Synthetic coding sequence
atgggtattaagttcctggaggttattaagcctttctgtgcagtgctgccagagattcagaagcccgagcggaagatacaatttcgcgagaaggttttgtggactgccatcactctattcatatttcttgtctgttgtcagatccccttgtttgggattatgtcctcggacagcgccgatcccttttactggatgagagtgattttggcatctaaccgggggactctgatggaactgggcatcagcccaatcgtgacatctgggttgatcatgcagctgcttgctggtgctaagattatcgaagtgggggacactccaaaggatcgagcgctctttaacggcgcacagaaactgttcgggatgattataaccattgggcaagccattgtttacgttatgacagggatgtatggcgaccctgccgaaatgggagcaggcatctgccttttgattataatccaagccctcctgactttgaaaatttgcggctataccgaggagctttag

SEQ ID NO: 29829 - DNA, 1233 bp, Artificial Sequence
  Description of Artificial Sequence: Synthetic coding sequence
atggggattaagtttttagaggtgataaagccattttgtgctgtgctgcccgaaattcaaaaacctgagcggaagatccaattccgagaaaaggtactgtggaccgccataactttgttcattttcctcgtgtgttgtcagatcccattgtttgggataatgagtagcgacagtgccgacccattttattggatgcgggtgattctggctagtaaccgtggtaccctgatggagctggggatatcgccaatcgtgaccagcggcctgattatgcagctgctggccggggctaaaatcatcgaagtgggcgacaccccaaaagatcgcgccctttttaatggcgcccaaaagctcttcggaatgatcatcacaatcggacaggccatcgtttatgtgatgacaggaatgtatggggatcccgccgagatgggcgcaggcatatgcctgttaatcataatccagctgtttgttgccgggctcatcgtgctgctgctggatgagctgctccaaaagggttacgggctcggtagcggcatcagcctatttattgccaccaacatctgtgagaccatcgtatggaaggccttctcacctaccaccattaacacagggaggggcactgaattcgaaggagcagtcattgcactcttccacctgctggctaccagaaccgacaaagttcgcgctctgagagaggcgttctaccgccagaatctgcccaatcttatgaacttgatcgccactgtgttcgtgttcgctgtggtcatctactttcaggacgtttcaggtggaggccctgccaggagttatccagttggtggcctgtgttattatctaagcccaccagaaagcatgggcgcgatattcgaagatcccgtccatgtcgtcgtgtatattatcttcatgctggggtcatgtgccttcttctcaaagacatggatagaggtgtctggctcttctgcgaaagatgtcgcgaagcagctgaaggagcagcagatggtgatgagaggtcaccgggacacaagcatggttcacgaacttaatcgatatattcccacagccgctgcctttggcggattatgcatcggcgccctgagcgtgttggcagactttctgggggcaatcgggtctggaaccggcattctgctcgcagtgacgattatctatcaatactttgaaatttttgtcaaggaacaggctgaggtcggcgggatgggagctttgtttttttag

SEQ ID NO: 29830 - DNA, 1365 bp, Artificial Sequence
  Description of Artificial Sequence: Synthetic coding sequence
atgggcatcaaatttctggaggtgattaaaccattttgcgcagtgctgccggaaatccagaaaccagaaaggaagatccccttattcgggattatgagctctgacagtgcggaccctttttattggatgcgcgtcatcctggcctcaaacaggggcaccctgatggaactcggtatatctcccatcgtcacaagtgggctgatcatgcagctactggccggagccaaaattattgaggtgggtgacactcctaaggacagagccctcttcaacggggcccaaaagctgttcggaatgatcattactatcggacaagcaatcgtgtacgtgatgacaggcatgtacggtgatcccgccgagatgggggccggcatttgcctgctgatcataattcaactgtttgtcgcaggcctgattgtgctgcttctggatgaactgctgcagaagggatacggcctcggtagcggaatttccctattcattgccaccaacatctgcgagactatcgtatggaaggcattttctcctactaccattaacaccggtcgcggcaccgagtttgaaggtgcagtgattgctctttttcatctcctggctactaggacagacaaagtgagagctctgagggaagcattttatcgacagaacttgcctaatctgatgaatctgatcgctacagttttcgtgtttgcggtcgttatttacttccaaggctttagagtggacctcccaatcaagtctgcacggtacaggggccagtattctagctacccaataaaactcttttatacatccaacatcccaataatactgcaatcagcactggtgagcaatttgtatgtgatttcccagatgttgagtgtgcgcttcagtggcaatttcctcgtgaatctattgggccagtgggcggacgtgagtggtgggggacccgcgcgatcataccccgtcgggggcctgtgttattacttatctccccctgaatccatgggcgctatcttcgaggatcctgtgcatgtcgtggtgtatataatatttatgctcggttcttgcgccttcttcagtaagacttggattgaagtcagcggtagttctgcaaaagatgttgcaaaacaattgaaggaacagcagatggtgatgagaggacaccgggacaccagcatggttcacgaactgaatagatacattcccacggccgccgcgttcggcgggttgtgtatcggggctctatccgtccttgcggactttcttggcgcaattggaagtggcactggaatactgctggccgtcaccattatctaccagtacttcgagatttttgtcaaggagcaggctgaggtaggagggatgggcgcgctgtttttctag

SEQ ID NO: 29831 - DNA, 480 bp, Artificial Sequence
  Description of Artificial Sequence: Synthetic coding sequence
atggggattaaatttctggaggttatcaaaccattctgtgctgtgttacccgaaatacaaaaaccagagcgcaagatacagtttcgggaaaaagttctgtggactgctatcaccttgtttatttttctagtgtgctgtcagatcccactcttcggcattatgtcatcggactcggcggaccccttttattggatgcgggttatacttgcatctaatcgaggaactctgatggaattgggaatctctcccatcgtgacatcaggactgattatgcagctgcttgcaggtgccaaaatcattgaagttggggatacccccaaagacagagctctgttcaatggggcacaaaagctgttcggcatgattattaccatcggccaggcaattgtgtatgtaatgacaggaatgtacggagaccctgcggaaatgggggccggtatatgcctccttatcatcattcaggaccagcattccccatag

SEQ ID NO: 29832 - DNA, 438 bp, Artificial Sequence
  Description of Artificial Sequence: Synthetic coding sequence
tgatcggatagcgccgaccctttttactggatgagagtgatccttgcatcaaatagggggaccctgatggagctcggcatctctccaatcgtgacatccgggctgataatgcagctccttgcaggcgccaagatcattgaggtgggggacactcccaaggatcgtgccctgttcaatggggcgcagaaactctttggaatgattattacaattggccaggctatagtttacgtcatgacggggatgtacggagatccagccgaaatgggagccgggatttgtttgctgatcatcatccagggattccgagtagatctgccaatcaaatcagctcgttatcgaggccagtactcgagctaccctatcaaactcttttatacgtcaaatatcccaatcatcctgcaatccgcgctcgttagcaacctttacgtgatctag

SEQ ID NO: 29833 - DNA, 687 bp, Artificial Sequence
  Description of Artificial Sequence: Synthetic coding sequence
tgaggcatgatcataactataggccaggccattgtgtacgtgatgactggtatgtatggggatcccgctgaaatgggagccggcatctgcctgctaatcatcatacagctgtttgtcgccggtctgattgtactgctgcttgacgagcttcttcagaagggttacgggctcgggtcgggcatttcactattcatcgccaccaacatctgtgagacgatcgtgtggaaggccttcagccccaccacaatcaatacagggcgtggcacagagttcgagggggcagtgatcgcactgttccacctattggctacgagaacagataaggtgagggccttacgggaggccttctaccgccagaatttgccaaacctgatgaacttgatcgctaccgtattcgtattcgctgtagtgatttattttcaggttgccaaacagctgaaagaacagcagatggttatgagagggcaccgagatacatcaatggtccacgaactgaataggtacattccaaccgctgctgcatttggaggcttatgcataggcgcactgagcgtactagcagacttccttggggccatagggtctggcacggggatcctcctagcggttacgatcatttaccagtattttgagattttcgttaaagagcaggccgaagttggcggtatgggagcactgttcttttag

SEQ ID NO: 29834 - DNA, 633 bp, Artificial Sequence
  Description of Artificial Sequence: Synthetic coding sequence
aagtacaatctcttcacaaagggatttcgggtggatctcccaattaagagtgcacgctatcgcgggcagtatagctcctaccccataaagctattctacaccagcaatatccctatcatcctccagagcgctcttgtgtccaatctctatgtaatcagccagatgttgagcgttaggttcagtggcaactttcttgtgaatctccttgggcaatgggccgacgtcagcggtggtggaccagcgcggtcttatccggttggaggattgtgctactatctgtcacctccagagagcatgggcgctattttcgaagatcccgtgcacgtcgttgtgtacatcatctttatgctgggttcctgtgctttcttctcaaaaacatggatcgaagtgtctgggtcttctgcgaaggatgtcgctaagcagttgaaagaacagcagatggtgatgaggggccaccgcgatacaagtatggtgcatgaactcaataggtacattcccacagccgcggccttcggggggctctgtatcggcgcgctaagtgtgttggctgatttcctgggggctattggctctggcactggaatcctgctcgctgtgacgatcatctatcagtactttgaaatttttgtatag

SEQ ID NO: 29835 - DNA, 570 bp, Artificial Sequence
  Description of Artificial Sequence: Synthetic coding sequence
atgggcattaaattcctggaggtgattaagcccttctgcgctgtgctccccgagatacaaaagcccgagcgaaaaattcagttcagggagaaggtcctgtggacagcaattaccctttttatctttctcgtgtgttgccaaatcccgctatttggaattatgtccagtgattctgccgatccattctattggatgagagtcatcctcgctagcaacagagggacgctgatggagttgggaatcagtcccatcgtaacatctggcttgattatgcagttactggctggcgcaaaaattatcgaggtaggtgatactcccaaagacagagctctgtttaacggcgcgcagaagagaaccgaatttgaaggcgctgtgattgcccttttccatctcctcgcaacccgcacagacaaagttcgcgcgctgcgggaagctttttaccgacaaaacctacccaacctgatgaaccttattgccaccgttttcgtgttcgctgtagtaatctacttccaaggtttcagggtcgacctgccaatcaaaagcgccaggtatagaggacagtattcctag

SEQ ID NO: 29836 - DNA, 285 bp, Artificial Sequence
  Description of Artificial Sequence: Synthetic coding sequence
tgatttcgagaaaaagtcctgtggacggccatcacattattcatatttctcgtatgctgccagatacccctgttcggaattatgtcttcggattccgccgacccattctactggatgcgggtgatactggccagtaaccgtggaactttgatggaattaggaatcagccccattgtgacctctggactcattatgcagttgctcgctggtgcaaagatcattgaggtgggagacaccccgaaagacagggctctgttcaacggagcacagaagcgtgagcactag

SEQ ID NO: 29837 - DNA, 1257 bp, Artificial Sequence
  Description of Artificial Sequence: Synthetic coding sequence
atgggcatcaagtttctggaggtcatcaagcctttttgcgccgttctgccggagatccagaagcctgaaagaaagatccagttccgcgaaaaagtcctatggaccgcaattactctgttcatctttctcgtgtgttgccaaatccctcttttcggaattatgagtagcgactctgcggatcccttctactggatgcgtgtcatactggcttctaatcgggggacgctcatggaattgggaatttctcctattgtgacgagcgggctgatcatgcaactgctagcgggagccaaaatcatcgaagtaggcgacactcctaaagatcgcgctttatttaatggagcccagaaactgtttggcatgatcatcacaatcggacaagccatcgtctacgtgatgacagggatgtacggagatcctgctgagatgggagctggcatctgtttattaatcatcattcagctgttcgtggccgggctgatcgtcctcctcctggacgagctgctgcagaaggggtatgggcttgggtccggcattagcttgttcatcgcaacaaacatttgcgagacaatcgtgtggaaagcttttagtccgaccactattaataccggcagaggaactgaattcgagggcgcagtcatcgccctctttcatttactagcaacaaggaccgataaggtcagggccttgagagaagcattttatcggcagaacctgccgaatcttatgaacttgatcgcgaccgtttttgtttttgctgtggtgatctacttccagggattccgcgtcgatttgccgattaaaagcgcacgctatcggggacaatacagcagttatcccataaagttgttctatacatcaaacatcccaataatactgcagtctgccttagtttcaaatctctatgtgatctcacagatgctctccgtgagattctcaggcaacttcctggttaacctcctgggccagtgggcggatgtgtctggcggagggcctgccagaagctatccagtcggcggattgtgctattacctgagtccacctgaaagcatgggcgccatcttcgaggatccagtccatgtggtggtgtatatcatcttcatgctggggagttgtgctttcttctccaaaacttggatcgaggtgagcgggagcagtgctaaggacgtcgctaaacagctcaaggaacagcagatggtgatgaggggccacagggacacctcgatggttcacgagcttaacagcgccagagcttag

SEQ ID NO: 29838 - DNA, 975 bp, Artificial Sequence
  Description of Artificial Sequence: Synthetic coding sequence
atgctaaagtcctgctcacgcgcgtcgttttctccttccgtccggaaaccacctctgatcctgaggcggctgctctcagaagacgttggaatggatataccattcgaggagggagttcttagtccctccgcggcagacatgcgtccagagcccccaaactcgctggatctgaacgacacccatcctcggaggatcaagctcacggctcctaacatcaatctttccttagatcagtcggaaggttctattttgtccgacgacaatctcgattctcctgatgagatcgatattaacgtggatgaactggacacccccgacgaggcggattctttcgagtatactggtcacgaagacccaaccgccaacaaggactcagggcaagaatccgagtcaattcctgaatataccgctgaagaagagagggaagataacagattatggagaactgtggtgataggggagcaggagcaacgcatagacatgaaagtgattgagccctatagaagggtgatatcccacggaggttactatggggatggacttaacgcgattatcgtgtttgctgcctgttttctacccgattcttctcgggcagattaccactacgtgatggaaaatctttttctgtacgttatatctacactggaattaatggtggcggaggactatatgattgtctacctcaatggagccacccctcgtcgcagaatgcccggccttggctggatgaaaaaatgctatcagatgatcgaccgaaggctaagaaagaaccttaagtcttttattattgtacacccctcctggtttattcgaacaatcctggcagtgaccagaccctttatctcaagtaaattctcgtcgaaaattaaatacgttaatagcctttctgagctctcaggattgattcctatggactgcatacatatccctgagagcattataaacatcgatctcaaactcaaggagaagccatag

SEQ ID NO: 29839 - DNA, 207 bp, Artificial Sequence
  Description of Artificial Sequence: Synthetic coding sequence
atggatcaggtgatgcaatttgttgaacccagtcgccagtttgtaaaggattccatcaggcttgtgaaaagatgtaccaagccggatcggaaggagtttcaaaaaatcgccatggccacagccatcggctttgcaatcatgggattcatcggcttcttcgtcaaactgattcatataccgataaacaatatcatagtgggcgggtag

SEQ ID NO: 29840 - DNA, 207 bp, Artificial Sequence
  Description of Artificial Sequence: Synthetic coding sequence
atggaccaggtgatgcaatttgtggagccaagtcggcagtttgtcaaggactccatcagattggtaaaacgctgtacgaaaccagacaggaaggagtttcagaagattgccatggccaccgccattggctttgctattatggggtttataggattcttcgtgaagctgatccatataccaattaacaatattatcgtgggcgggtag

SEQ ID NO: 29841 - DNA, 207 bp, Artificial Sequence
  Description of Artificial Sequence: Synthetic coding sequence
atggaccaggtcatgcaatttgtggaaccgagtcggcagtttgtaaaggactccatccgcttggtaaaacggtgtactaaaccagatagaaaggagttccaaaaaattgctatggctactgctatcgggtttgccattatggggtttattgggttcttcgttaaactgatccatattcctatcaataatattatcgtcggcggatag
